United States Patent 7,655,785 (BIOINFORMATICALLY DETECTABLE GROUP OF NOVEL REGULATORY OLIGONUCLEOTIDES AND USES THEREOF) - sequence listing, part 27

SEQ ID NO: 1097787 - RNA, 20 nt, Homo sapiens
uguuaaauauuuacauauga

SEQ ID NO: 1097788 - RNA, 21 nt, Homo sapiens
uguuaaauauuuacauaugaa

SEQ ID NO: 1097789 - RNA, 21 nt, Homo sapiens
uguuacuaaagucacauauaa

SEQ ID NO: 1097790 - RNA, 16 nt, Homo sapiens
uuuauuaauucauuaa

SEQ ID NO: 1097791 - RNA, 13 nt, Homo sapiens
uuuauugugaucu

SEQ ID NO: 1097792 - RNA, 12 nt, Homo sapiens
uuuauuuccaca

SEQ ID NO: 1097793 - RNA, 19 nt, Homo sapiens
uuuauuuuuguagagccag

SEQ ID NO: 1097794 - RNA, 13 nt, Homo sapiens
uuucaacauauca

SEQ ID NO: 1097795 - RNA, 12 nt, Homo sapiens
uuucaaccagca

SEQ ID NO: 1097796 - RNA, 19 nt, Homo sapiens
uuucaaguguaacuuauua

SEQ ID NO: 1097797 - RNA, 14 nt, Homo sapiens
uuucacaauuccau

SEQ ID NO: 1097798 - RNA, 20 nt, Homo sapiens
uuucacauaaacacauacau

SEQ ID NO: 1097799 - RNA, 14 nt, Homo sapiens
uuucaccauuuccg

SEQ ID NO: 1097800 - RNA, 21 nt, Homo sapiens
uuucaccuguuuuuaagcugu

SEQ ID NO: 1097801 - RNA, 21 nt, Homo sapiens
uuucagaauugaaggagaaaa

SEQ ID NO: 1097802 - RNA, 14 nt, Homo sapiens
uuucagagugacac

SEQ ID NO: 1097803 - RNA, 16 nt, Homo sapiens
uuucagcacucagaaa

SEQ ID NO: 1097804 - RNA, 12 nt, Homo sapiens
uuucagcuaaag

SEQ ID NO: 1097805 - RNA, 21 nt, Homo sapiens
uuucaugauaaugaacagaac

SEQ ID NO: 1097806 - RNA, 22 nt, Homo sapiens
uuuccaagggucuuccuccuaa

SEQ ID NO: 1097807 - RNA, 21 nt, Homo sapiens
uuuccacugccaaaacaaugc

SEQ ID NO: 1097808 - RNA, 21 nt, Homo sapiens
uuuccauaaacacccaugaau

SEQ ID NO: 1097809 - RNA, 12 nt, Homo sapiens
uuuccccagugu

SEQ ID NO: 1097810 - RNA, 18 nt, Homo sapiens
uuuccguaaaaaugauuu

SEQ ID NO: 1097811 - RNA, 21 nt, Homo sapiens
uuuccucuuccccuugcccuu

SEQ ID NO: 1097812 - RNA, 13 nt, Homo sapiens
uuuccuugcaaau

SEQ ID NO: 1097813 - RNA, 15 nt, Homo sapiens
uuuccuuuuaugaga

SEQ ID NO: 1097814 - RNA, 23 nt, Homo sapiens
uuucuaaagcucugaacaaaagc

SEQ ID NO: 1097815 - RNA, 21 nt, Homo sapiens
uuucuaguuucuugugggcua

SEQ ID NO: 1097816 - RNA, 14 nt, Homo sapiens
uuucucaaaugcac

SEQ ID NO: 1097817 - RNA, 15 nt, Homo sapiens
uuucucuguauagua

SEQ ID NO: 1097818 - RNA, 18 nt, Homo sapiens
uuucucuugaagaacuga

SEQ ID NO: 1097819 - RNA, 22 nt, Homo sapiens
uuucugauaacagaauugccaa

SEQ ID NO: 1097820 - RNA, 19 nt, Homo sapiens
uuucugcuaaaaaguccuu

SEQ ID NO: 1097821 - RNA, 22 nt, Homo sapiens
uuucugcuaaaaaguccuugau

SEQ ID NO: 1097822 - RNA, 18 nt, Homo sapiens
uuucuggaaaacugccuu

SEQ ID NO: 1097823 - RNA, 22 nt, Homo sapiens
uuucugucacaucagcuccacu

SEQ ID NO: 1097824 - RNA, 20 nt, Homo sapiens
uuucuguggagagugagaau

SEQ ID NO: 1097825 - RNA, 22 nt, Homo sapiens
uuucuuauagucaauguuucuu

SEQ ID NO: 1097826 - RNA, 14 nt, Homo sapiens
uuucuucaccaaau

SEQ ID NO: 1097827 - RNA, 21 nt, Homo sapiens
uuucuuccaaagcacauugaa

SEQ ID NO: 1097828 - RNA, 17 nt, Homo sapiens
uuucuugcagaucaaau

SEQ ID NO: 1097829 - RNA, 18 nt, Homo sapiens
uuucuuucuaacuccagu

SEQ ID NO: 1097830 - RNA, 15 nt, Homo sapiens
uuucuuuuccauuua

SEQ ID NO: 1097831 - RNA, 23 nt, Homo sapiens
uuugaauuucaguaaacaaugaa

SEQ ID NO: 1097832 - RNA, 14 nt, Homo sapiens
uuugacaaccauga

SEQ ID NO: 1097833 - RNA, 22 nt, Homo sapiens
uuugagaacaauggagauauca

SEQ ID NO: 1097834 - RNA, 13 nt, Homo sapiens
uuugagugauccu

SEQ ID NO: 1097835 - RNA, 20 nt, Homo sapiens
uuugaugauuaauucaccuu

SEQ ID NO: 1097836 - RNA, 17 nt, Homo sapiens
uuugaugguaagacugu

SEQ ID NO: 1097837 - RNA, 14 nt, Homo sapiens
uuugauguuuacag

SEQ ID NO: 1097838 - RNA, 16 nt, Homo sapiens
uuugcacccaugccau

SEQ ID NO: 1097839 - RNA, 12 nt, Homo sapiens
uuugcacugagg

SEQ ID NO: 1097840 - RNA, 16 nt, Homo sapiens
uuugcagcagaagcca

SEQ ID NO: 1097841 - RNA, 13 nt, Homo sapiens
uuugccucaaaua

SEQ ID NO: 1097842 - RNA, 21 nt, Homo sapiens
uuuggauuuacgacugaagaa

SEQ ID NO: 1097843 - RNA, 14 nt, Homo sapiens
uuuggccauuccaa

SEQ ID NO: 1097844 - RNA, 22 nt, Homo sapiens
uuugggggacuuacaugauuca

SEQ ID NO: 1097845 - RNA, 20 nt, Homo sapiens
uuuguaauaaacucucuagg

SEQ ID NO: 1097846 - RNA, 22 nt, Homo sapiens
uuuguaaugggaacugccucuu

SEQ ID NO: 1097847 - RNA, 16 nt, Homo sapiens
uuugugacuuuccuaa

SEQ ID NO: 1097848 - RNA, 15 nt, Homo sapiens
uuugugcagcacagu

SEQ ID NO: 1097849 - RNA, 20 nt, Homo sapiens
uuuguuguuuuuaacaacua

SEQ ID NO: 1097850 - RNA, 18 nt, Homo sapiens
uuuuaaagagcauggaaa

SEQ ID NO: 1097851 - RNA, 14 nt, Homo sapiens
uuuuagcuuuacaa

SEQ ID NO: 1097852 - RNA, 18 nt, Homo sapiens
uuuuaguagacaguagga

SEQ ID NO: 1097853 - RNA, 22 nt, Homo sapiens
uuuuaguauaaguacauuauug

SEQ ID NO: 1097854 - RNA, 22 nt, Homo sapiens
uuuuauauauuaugucauucau

SEQ ID NO: 1097855 - RNA, 18 nt, Homo sapiens
uuuuauuuccacauaaag

SEQ ID NO: 1097856 - RNA, 18 nt, Homo sapiens
uuuucaaagauguguugc

SEQ ID NO: 1097857 - RNA, 22 nt, Homo sapiens
uuuucaaguugagaacaaaaau

SEQ ID NO: 1097858 - RNA, 12 nt, Homo sapiens
uuuucaccucau

SEQ ID NO: 1097859 - RNA, 17 nt, Homo sapiens
uuuucagaguugcuuua

SEQ ID NO: 1097860 - RNA, 13 nt, Homo sapiens
uuuucuaaucuug

SEQ ID NO: 1097861 - RNA, 14 nt, Homo sapiens
uuuucuaugcuuau

SEQ ID NO: 1097862 - RNA, 14 nt, Homo sapiens
uuuucuauuauuaa

SEQ ID NO: 1097863 - RNA, 20 nt, Homo sapiens
uuuucuccacuuuguuggaa

SEQ ID NO: 1097864 - RNA, 22 nt, Homo sapiens
uuuucugcuaaaaaguccuuga

SEQ ID NO: 1097865 - RNA, 20 nt, Homo sapiens
uuuugagaauacacuaucaa

SEQ ID NO: 1097866 - RNA, 14 nt, Homo sapiens
uuuugagaguauau

SEQ ID NO: 1097867 - RNA, 14 nt, Homo sapiens
uuuugauagauauc

SEQ ID NO: 1097868 - RNA, 16 nt, Homo sapiens
uuuuuaaaaaaguaag

SEQ ID NO: 1097869 - RNA, 13 nt, Homo sapiens
uuuuuuaacauuc

SEQ ID NO: 1097870 - RNA, 23 nt, Homo sapiens
aauggggguggggaggcaagaac

SEQ ID NO: 1097871 - RNA, 15 nt, Homo sapiens
aauggggugcaugaa

SEQ ID NO: 1097872 - RNA, 17 nt, Homo sapiens
aauggggugcaugaagg

SEQ ID NO: 1097873 - RNA, 20 nt, Homo sapiens
aauggguacaauguacauua

SEQ ID NO: 1097874 - RNA, 23 nt, Homo sapiens
aauggguuugcuagaaugugaua

SEQ ID NO: 1097875 - RNA, 16 nt, Homo sapiens
aaugguuuacugcugu

SEQ ID NO: 1097876 - RNA, 13 nt, Homo sapiens
aauguaugugaaa

SEQ ID NO: 1097877 - RNA, 17 nt, Homo sapiens
aauguauuuguuugcaa

SEQ ID NO: 1097878 - RNA, 21 nt, Homo sapiens
aauguauuuguuugcaauuuu

SEQ ID NO: 1097879 - RNA, 16 nt, Homo sapiens
aaugucagaaaccagu

SEQ ID NO: 1097880 - RNA, 20 nt, Homo sapiens
aaugucaucaaauauuacca

SEQ ID NO: 1097881 - RNA, 18 nt, Homo sapiens
aaugucuggucuguccac

SEQ ID NO: 1097882 - RNA, 19 nt, Homo sapiens
aaugucuuaaucaugagau

SEQ ID NO: 1097883 - RNA, 21 nt, Homo sapiens
aaugucuuaaucaugagauaa

SEQ ID NO: 1097884 - RNA, 16 nt, Homo sapiens
aaugugaccaggggug

SEQ ID NO: 1097885 - RNA, 12 nt, Homo sapiens
aaugugucacua

SEQ ID NO: 1097886 - RNA, 19 nt, Homo sapiens
aaugugugaaggucuugcc

SEQ ID NO: 1097887 - RNA, 21 nt, Homo sapiens
aauguguggugcuaacuguau

SEQ ID NO: 1097888 - RNA, 19 nt, Homo sapiens
aauguuuaagauaaacaga

SEQ ID NO: 1097889 - RNA, 18 nt, Homo sapiens
aauguuugaguaccugau

SEQ ID NO: 1097890 - RNA, 19 nt, Homo sapiens
aauuaaaugcauguccuca

SEQ ID NO: 1097891 - RNA, 17 nt, Homo sapiens
aauuaagagauacauuc

SEQ ID NO: 1097892 - RNA, 13 nt, Homo sapiens
aauuagaugaacu

SEQ ID NO: 1097893 - RNA, 18 nt, Homo sapiens
aauuagguuuuguacaau

SEQ ID NO: 1097894 - RNA, 18 nt, Homo sapiens
aauuaucggaagcagugc

SEQ ID NO: 1097895 - RNA, 14 nt, Homo sapiens
aauucaagccuuag

SEQ ID NO: 1097896 - RNA, 21 nt, Homo sapiens
aauucauacauaguacauaca

SEQ ID NO: 1097897 - RNA, 17 nt, Homo sapiens
aauucaucucucuuuaa

SEQ ID NO: 1097898 - RNA, 18 nt, Homo sapiens
aauucccauuuugcaaaa

SEQ ID NO: 1097899 - RNA, 18 nt, Homo sapiens
aauuccuguagcaucuuc

SEQ ID NO: 1097900 - RNA, 22 nt, Homo sapiens
aauuccuuagcuuagaccucag

SEQ ID NO: 1097901 - RNA, 17 nt, Homo sapiens
aauucuaggcaucccag

SEQ ID NO: 1097902 - RNA, 19 nt, Homo sapiens
aauucuauuacgugcaaua

SEQ ID NO: 1097903 - RNA, 13 nt, Homo sapiens
aauugaacuacuu

SEQ ID NO: 1097904 - RNA, 14 nt, Homo sapiens
aauugaacuacuug

SEQ ID NO: 1097905 - RNA, 23 nt, Homo sapiens
aauugaagagagauauaucugaa

SEQ ID NO: 1097906 - RNA, 19 nt, Homo sapiens
aauugaagauguaaggaau

SEQ ID NO: 1097907 - RNA, 11 nt, Homo sapiens
aauugcacaau

SEQ ID NO: 1097908 - RNA, 17 nt, Homo sapiens
aauugugcgacuucaca

SEQ ID NO: 1097909 - RNA, 12 nt, Homo sapiens
aauugugcuuau

SEQ ID NO: 1097910 - RNA, 15 nt, Homo sapiens
aauuguuuggggaug

SEQ ID NO: 1097911 - RNA, 17 nt, Homo sapiens
aauuuaaaacacagaga

SEQ ID NO: 1097912 - RNA, 17 nt, Homo sapiens
aauuuaaucacuuucau

SEQ ID NO: 1097913 - RNA, 17 nt, Homo sapiens
aauuuagaaaacauuca

SEQ ID NO: 1097914 - RNA, 15 nt, Homo sapiens
aauuuauuucaaaaa

SEQ ID NO: 1097915 - RNA, 15 nt, Homo sapiens
aauuuccaguaccuu

SEQ ID NO: 1097916 - RNA, 17 nt, Homo sapiens
aauuucuaaaaaacaga

SEQ ID NO: 1097917 - RNA, 17 nt, Homo sapiens
aauuugaauggugcaga

SEQ ID NO: 1097918 - RNA, 18 nt, Homo sapiens
aauuugacucaugaacua

SEQ ID NO: 1097919 - RNA, 17 nt, Homo sapiens
aauuugauacugaccuu

SEQ ID NO: 1097920 - RNA, 21 nt, Homo sapiens
aauuugauguuuacaggugga

SEQ ID NO: 1097921 - RNA, 18 nt, Homo sapiens
aauuuggagacucugugg

SEQ ID NO: 1097922 - RNA, 22 nt, Homo sapiens
aauuuggauuuacgacugaaga

SEQ ID NO: 1097923 - RNA, 18 nt, Homo sapiens
aauuugggggacuuacau

SEQ ID NO: 1097924 - RNA, 12 nt, Homo sapiens
aauuuguacaua

SEQ ID NO: 1097925 - RNA, 18 nt, Homo sapiens
aauuuguuuuauauucuc

SEQ ID NO: 1097926 - RNA, 13 nt, Homo sapiens
aauuuuaauugaa

SEQ ID NO: 1097927 - RNA, 14 nt, Homo sapiens
aauuuuauaaucau

SEQ ID NO: 1097928 - RNA, 20 nt, Homo sapiens
aauuuuccagggcucaaaaa

SEQ ID NO: 1097929 - RNA, 21 nt, Homo sapiens
aauuuugcagcagaagccaaa

SEQ ID NO: 1097930 - RNA, 22 nt, Homo sapiens
acaaaaaugaaagcaugucuca

SEQ ID NO: 1097931 - RNA, 12 nt, Homo sapiens
acaaacaugugg

SEQ ID NO: 1097932 - RNA, 11 nt, Homo sapiens
acaaacccagg

SEQ ID NO: 1097933 - RNA, 15 nt, Homo sapiens
acaaagaacaagcau

SEQ ID NO: 1097934 - RNA, 15 nt, Homo sapiens
acaaagcccuuccau

SEQ ID NO: 1097935 - RNA, 18 nt, Homo sapiens
acaaagcccuuccauguc

SEQ ID NO: 1097936 - RNA, 23 nt, Homo sapiens
acaaauagucuaucaaccccaga

SEQ ID NO: 1097937 - RNA, 16 nt, Homo sapiens
acaaauuaucauacua

SEQ ID NO: 1097938 - RNA, 15 nt, Homo sapiens
aaguuggguuaggag

SEQ ID NO: 1097939 - RNA, 20 nt, Homo sapiens
aaguuuauuuuuucuacaca

SEQ ID NO: 1097940 - RNA, 23 nt, Homo sapiens
aaguuucuucuuuaggcauuaaa

SEQ ID NO: 1097941 - RNA, 13 nt, Homo sapiens
aaguuuucaggac

SEQ ID NO: 1097942 - RNA, 14 nt, Homo sapiens
aauaaaaacacuua

SEQ ID NO: 1097943 - RNA, 14 nt, Homo sapiens
aauaaaaacugacu

SEQ ID NO: 1097944 - RNA, 13 nt, Homo sapiens
aauaaaaugaugu

SEQ ID NO: 1097945 - RNA, 15 nt, Homo sapiens
aauaaagaccugaga

SEQ ID NO: 1097946 - RNA, 20 nt, Homo sapiens
aauaaagcccuugaaccagc

SEQ ID NO: 1097947 - RNA, 21 nt, Homo sapiens
aauaaagcugcugagaaucua

SEQ ID NO: 1097948 - RNA, 16 nt, Homo sapiens
aauaaaguuagugugu

SEQ ID NO: 1097949 - RNA, 16 nt, Homo sapiens
aauaaauaaaugcaau

SEQ ID NO: 1097950 - RNA, 18 nt, Homo sapiens
aauaaaugccaacauacc

SEQ ID NO: 1097951 - RNA, 13 nt, Homo sapiens
aauaacagugugu

SEQ ID NO: 1097952 - RNA, 17 nt, Homo sapiens
aauaacuuauaucauca

SEQ ID NO: 1097953 - RNA, 20 nt, Homo sapiens
aauaaggcuccuucaugugg

SEQ ID NO: 1097954 - RNA, 15 nt, Homo sapiens
aauaaguacugugua

SEQ ID NO: 1097955 - RNA, 14 nt, Homo sapiens
aauaauaauuuucc

SEQ ID NO: 1097956 - RNA, 15 nt, Homo sapiens
aauaauauaugcuca

SEQ ID NO: 1097957 - RNA, 13 nt, Homo sapiens
aauaauguauaca

SEQ ID NO: 1097958 - RNA, 15 nt, Homo sapiens
aauaauucuaugaga

SEQ ID NO: 1097959 - RNA, 15 nt, Homo sapiens
aauaauugauuucaa

SEQ ID NO: 1097960 - RNA, 15 nt, Homo sapiens
aauaauuguuccaaa

SEQ ID NO: 1097961 - RNA, 22 nt, Homo sapiens
aauaauuuagacuucaagcaug

SEQ ID NO: 1097962 - RNA, 21 nt, Homo sapiens
aauacaugaaaugucuggucu

SEQ ID NO: 1097963 - RNA, 20 nt, Homo sapiens
aauaccuuaguuuuuuccac

SEQ ID NO: 1097964 - RNA, 22 nt, Homo sapiens
aauacgugaaagaugcaagcac

SEQ ID NO: 1097965 - RNA, 16 nt, Homo sapiens
aauacuuaacauugau

SEQ ID NO: 1097966 - RNA, 15 nt, Homo sapiens
aauagccucccugua

SEQ ID NO: 1097967 - RNA, 18 nt, Homo sapiens
aauagccugcgcuguuuu

SEQ ID NO: 1097968 - RNA, 21 nt, Homo sapiens
aauagcugggacuacaggugu

SEQ ID NO: 1097969 - RNA, 23 nt, Homo sapiens
aauaguaaaagauaacaagaucu

SEQ ID NO: 1097970 - RNA, 14 nt, Homo sapiens
aauaguauuuauga

SEQ ID NO: 1097971 - RNA, 16 nt, Homo sapiens
aauauaaaguguaaua

SEQ ID NO: 1097972 - RNA, 22 nt, Homo sapiens
aauauaaauuuguguucucaaa

SEQ ID NO: 1097973 - RNA, 16 nt, Homo sapiens
aauauaagaacuugau

SEQ ID NO: 1097974 - RNA, 14 nt, Homo sapiens
aauaucacaucacu

SEQ ID NO: 1097975 - RNA, 19 nt, Homo sapiens
aauaucauuaaauuggaau

SEQ ID NO: 1097976 - RNA, 17 nt, Homo sapiens
aauauccuaaacaucau

SEQ ID NO: 1097977 - RNA, 16 nt, Homo sapiens
aauaucugcuuuaaua

SEQ ID NO: 1097978 - RNA, 19 nt, Homo sapiens
aauaucuugaaacauagag

SEQ ID NO: 1097979 - RNA, 19 nt, Homo sapiens
aauauggacaaagaaggca

SEQ ID NO: 1097980 - RNA, 21 nt, Homo sapiens
aauaugguaaugcacaauucc

SEQ ID NO: 1097981 - RNA, 22 nt, Homo sapiens
aauauugaauaaguauucuuca

SEQ ID NO: 1097982 - RNA, 17 nt, Homo sapiens
aauauuuaaacuucuug

SEQ ID NO: 1097983 - RNA, 20 nt, Homo sapiens
aauauuuauuaccucugaua

SEQ ID NO: 1097984 - RNA, 20 nt, Homo sapiens
aaucaaaacccaacaugacu

SEQ ID NO: 1097985 - RNA, 14 nt, Homo sapiens
aaucaaacaauaau

SEQ ID NO: 1097986 - RNA, 12 nt, Homo sapiens
aaucaaagacau

SEQ ID NO: 1097987 - RNA, 12 nt, Homo sapiens
aaucaaccagca

SEQ ID NO: 1097988 - RNA, 20 nt, Homo sapiens
aaucaagcuagaaggccaca

SEQ ID NO: 1097989 - RNA, 21 nt, Homo sapiens
aaucacuaucuuucugauaac

SEQ ID NO: 1097990 - RNA, 18 nt, Homo sapiens
aaucagguccucagagaa

SEQ ID NO: 1097991 - RNA, 22 nt, Homo sapiens
aaucagucuuggaauacuugaa

SEQ ID NO: 1097992 - RNA, 23 nt, Homo sapiens
aaucauaaauauaaucuaauaca

SEQ ID NO: 1097993 - RNA, 12 nt, Homo sapiens
aaucauucaaua

SEQ ID NO: 1097994 - RNA, 14 nt, Homo sapiens
aaucccauugucac

SEQ ID NO: 1097995 - RNA, 15 nt, Homo sapiens
aauccuuuacuguua

SEQ ID NO: 1097996 - RNA, 14 nt, Homo sapiens
aaucuccaguuuuc

SEQ ID NO: 1097997 - RNA, 12 nt, Homo sapiens
aaucucuugucu

SEQ ID NO: 1097998 - RNA, 13 nt, Homo sapiens
aaucuuacuccuu

SEQ ID NO: 1097999 - RNA, 16 nt, Homo sapiens
aaucuucuuaugcaau

SEQ ID NO: 1098000 - RNA, 20 nt, Homo sapiens
aaucuuguuaaauugcuuau

SEQ ID NO: 1098001 - RNA, 20 nt, Homo sapiens
aaucuuuggguaacuucaaa

SEQ ID NO: 1098002 - RNA, 19 nt, Homo sapiens
aaugaagacccaguguaaa

SEQ ID NO: 1098003 - RNA, 15 nt, Homo sapiens
aaugaagaugucuaa

SEQ ID NO: 1098004 - RNA, 17 nt, Homo sapiens
aaugaaucuuacuccuu

SEQ ID NO: 1098005 - RNA, 23 nt, Homo sapiens
aaugaaugaccuuguugcaugau

SEQ ID NO: 1098006 - RNA, 11 nt, Homo sapiens
aaugaauuuau

SEQ ID NO: 1098007 - RNA, 16 nt, Homo sapiens
aaugaauuuaucugaa

SEQ ID NO: 1098008 - RNA, 21 nt, Homo sapiens
acaauggcuaauucccagagu

SEQ ID NO: 1098009 - RNA, 23 nt, Homo sapiens
acaauguaugugaaaguguaaaa

SEQ ID NO: 1098010 - RNA, 16 nt, Homo sapiens
acaauuuuuaagcauu

SEQ ID NO: 1098011 - RNA, 20 nt, Homo sapiens
acacaagugcgccuugcaaa

SEQ ID NO: 1098012 - RNA, 22 nt, Homo sapiens
acacacacucuacccuauacaa

SEQ ID NO: 1098013 - RNA, 23 nt, Homo sapiens
acacaccccucaaaaaaagccuu

SEQ ID NO: 1098014 - RNA, 23 nt, Homo sapiens
acacagacacacaaaaugucaca

SEQ ID NO: 1098015 - RNA, 12 nt, Homo sapiens
acacagagccug

SEQ ID NO: 1098016 - RNA, 22 nt, Homo sapiens
acacagcaguaugaaugauguu

SEQ ID NO: 1098017 - RNA, 20 nt, Homo sapiens
acacagcucuucuccaggcu

SEQ ID NO: 1098018 - RNA, 21 nt, Homo sapiens
acacagcucuucuccaggcug

SEQ ID NO: 1098019 - RNA, 14 nt, Homo sapiens
acacaggcaaaauc

SEQ ID NO: 1098020 - RNA, 16 nt, Homo sapiens
acacaguucaauucuc

SEQ ID NO: 1098021 - RNA, 20 nt, Homo sapiens
acacauacugcaugcucagg

SEQ ID NO: 1098022 - RNA, 18 nt, Homo sapiens
acacauggacacaccaga

SEQ ID NO: 1098023 - RNA, 19 nt, Homo sapiens
acacaugguuuccaagggu

SEQ ID NO: 1098024 - RNA, 20 nt, Homo sapiens
acacauguaucuaugcauuu

SEQ ID NO: 1098025 - RNA, 17 nt, Homo sapiens
acacauuacuugcacaa

SEQ ID NO: 1098026 - RNA, 17 nt, Homo sapiens
acacauucuuaacacau

SEQ ID NO: 1098027 - RNA, 20 nt, Homo sapiens
acacauucuuaacacauguc

SEQ ID NO: 1098028 - RNA, 19 nt, Homo sapiens
acacccagucuguucccca

SEQ ID NO: 1098029 - RNA, 14 nt, Homo sapiens
acaccccucccaca

SEQ ID NO: 1098030 - RNA, 19 nt, Homo sapiens
acacccuuuuaacauuuau

SEQ ID NO: 1098031 - RNA, 17 nt, Homo sapiens
acaccuaugucauuuca

SEQ ID NO: 1098032 - RNA, 18 nt, Homo sapiens
acaccuaugucauuucau

SEQ ID NO: 1098033 - RNA, 13 nt, Homo sapiens
acaccucaaauac

SEQ ID NO: 1098034 - RNA, 14 nt, Homo sapiens
acacgcgugcacac

SEQ ID NO: 1098035 - RNA, 17 nt, Homo sapiens
acacuaauacaccaggu

SEQ ID NO: 1098036 - RNA, 15 nt, Homo sapiens
acacuacaaguuuau

SEQ ID NO: 1098037 - RNA, 21 nt, Homo sapiens
acacuaguuuugugccagccg

SEQ ID NO: 1098038 - RNA, 17 nt, Homo sapiens
acacugaaguuaacaga

SEQ ID NO: 1098039 - RNA, 20 nt, Homo sapiens
acacuuaugggccaagccca

SEQ ID NO: 1098040 - RNA, 21 nt, Homo sapiens
acagaacacugucuugaagac

SEQ ID NO: 1098041 - RNA, 18 nt, Homo sapiens
acagaacuauguacuuua

SEQ ID NO: 1098042 - RNA, 12 nt, Homo sapiens
acagaagccagg

SEQ ID NO: 1098043 - RNA, 23 nt, Homo sapiens
acagacaccaucuuuugugagau

SEQ ID NO: 1098044 - RNA, 15 nt, Homo sapiens
acagaccaccugcuu

SEQ ID NO: 1098045 - RNA, 22 nt, Homo sapiens
acagacuauuaaaacuaauaau

SEQ ID NO: 1098046 - RNA, 16 nt, Homo sapiens
acagacuggaagcaca

SEQ ID NO: 1098047 - RNA, 17 nt, Homo sapiens
acagacuucuccagacc

SEQ ID NO: 1098048 - RNA, 15 nt, Homo sapiens
acagagaugugauaa

SEQ ID NO: 1098049 - RNA, 17 nt, Homo sapiens
acagagccaacucacuc

SEQ ID NO: 1098050 - RNA, 20 nt, Homo sapiens
acagagcgagagucugucuc

SEQ ID NO: 1098051 - RNA, 15 nt, Homo sapiens
acagauuguuugcaa

SEQ ID NO: 1098052 - RNA, 19 nt, Homo sapiens
acagauuuuagacaaggac

SEQ ID NO: 1098053 - RNA, 19 nt, Homo sapiens
acagcaaaacuccaucuca

SEQ ID NO: 1098054 - RNA, 15 nt, Homo sapiens
acagcacuaauucaa

SEQ ID NO: 1098055 - RNA, 18 nt, Homo sapiens
acagcagcucaggcacac

SEQ ID NO: 1098056 - RNA, 12 nt, Homo sapiens
acagcagguggg

SEQ ID NO: 1098057 - RNA, 13 nt, Homo sapiens
acagcaguaugaa

SEQ ID NO: 1098058 - RNA, 15 nt, Homo sapiens
acagccaucaaggga

SEQ ID NO: 1098059 - RNA, 21 nt, Homo sapiens
acagcucaagucuucccugau

SEQ ID NO: 1098060 - RNA, 20 nt, Homo sapiens
acagcucuagacacugccac

SEQ ID NO: 1098061 - RNA, 13 nt, Homo sapiens
acaggacucugcc

SEQ ID NO: 1098062 - RNA, 14 nt, Homo sapiens
acaggcccaagaga

SEQ ID NO: 1098063 - RNA, 17 nt, Homo sapiens
acaggccucgcuacaag

SEQ ID NO: 1098064 - RNA, 15 nt, Homo sapiens
acagguacagcaaca

SEQ ID NO: 1098065 - RNA, 12 nt, Homo sapiens
acaguaaaucac

SEQ ID NO: 1098066 - RNA, 15 nt, Homo sapiens
acaguauuacuucug

SEQ ID NO: 1098067 - RNA, 20 nt, Homo sapiens
acagucaccgacaacaugcu

SEQ ID NO: 1098068 - RNA, 18 nt, Homo sapiens
acagucucugggagacuu

SEQ ID NO: 1098069 - RNA, 22 nt, Homo sapiens
acagucucugggagacuuuccc

SEQ ID NO: 1098070 - RNA, 21 nt, Homo sapiens
acagugagucgaggacaggga

SEQ ID NO: 1098071 - RNA, 22 nt, Homo sapiens
acagugaucuccauauguuaca

SEQ ID NO: 1098072 - RNA, 22 nt, Homo sapiens
acaguguauguacuaagcagua

SEQ ID NO: 1098073 - RNA, 17 nt, Homo sapiens
acaguuagguagcuuua

SEQ ID NO: 1098074 - RNA, 18 nt, Homo sapiens
acaguuagguagcuuuag

SEQ ID NO: 1098075 - RNA, 14 nt, Homo sapiens
acauggaauuaccu

SEQ ID NO: 1098076 - RNA, 24 nt, Homo sapiens
acauggcaaaaccccaucucuacu

SEQ ID NO: 1098077 - RNA, 20 nt, Homo sapiens
acauggccagugugauccca

SEQ ID NO: 1098078 - RNA, 15 nt, Homo sapiens
acaugugacacauau

SEQ ID NO: 1098079 - RNA, 17 nt, Homo sapiens
acaugugacacauaugc

SEQ ID NO: 1098080 - RNA, 23 nt, Homo sapiens
acauguggugggacagggaccca

SEQ ID NO: 1098081 - RNA, 20 nt, Homo sapiens
acauguguagccugugcaug

SEQ ID NO: 1098082 - RNA, 14 nt, Homo sapiens
acauuaucuuggau

SEQ ID NO: 1098083 - RNA, 16 nt, Homo sapiens
acauucccuaucaaaa

SEQ ID NO: 1098084 - RNA, 21 nt, Homo sapiens
acauucuuguuuuaagugccu

SEQ ID NO: 1098085 - RNA, 23 nt, Homo sapiens
acauucuuguuuuaagugccuuu

SEQ ID NO: 1098086 - RNA, 18 nt, Homo sapiens
acauucuuuaucuugaca

SEQ ID NO: 1098087 - RNA, 11 nt, Homo sapiens
acauugaacaa

SEQ ID NO: 1098088 - RNA, 18 nt, Homo sapiens
acauuuauucugcucaca

SEQ ID NO: 1098089 - RNA, 19 nt, Homo sapiens
acauuucccuccugggaga

SEQ ID NO: 1098090 - RNA, 19 nt, Homo sapiens
acauuugauguacaugugu

SEQ ID NO: 1098091 - RNA, 19 nt, Homo sapiens
acauuuguacauuccugau

SEQ ID NO: 1098092 - RNA, 23 nt, Homo sapiens
acauuuuguacaaagauaugcua

SEQ ID NO: 1098093 - RNA, 15 nt, Homo sapiens
acauuuuuguacaca

SEQ ID NO: 1098094 - RNA, 16 nt, Homo sapiens
accaaaaguuacaugu

SEQ ID NO: 1098095 - RNA, 19 nt, Homo sapiens
accaaagagaagcaaaauc

SEQ ID NO: 1098096 - RNA, 14 nt, Homo sapiens
accaaagagacugg

SEQ ID NO: 1098097 - RNA, 14 nt, Homo sapiens
accaaaucaucucu

SEQ ID NO: 1098098 - RNA, 17 nt, Homo sapiens
accaaaucaucucucau

SEQ ID NO: 1098099 - RNA, 15 nt, Homo sapiens
accaaaugagcauua

SEQ ID NO: 1098100 - RNA, 16 nt, Homo sapiens
accaaauuauugucca

SEQ ID NO: 1098101 - RNA, 13 nt, Homo sapiens
accaacaugguga

SEQ ID NO: 1098102 - RNA, 19 nt, Homo sapiens
accaacccuguuuccugag

SEQ ID NO: 1098103 - RNA, 17 nt, Homo sapiens
accaaguguguugggaa

SEQ ID NO: 1098104 - RNA, 12 nt, Homo sapiens
accaauauuugu

SEQ ID NO: 1098105 - RNA, 14 nt, Homo sapiens
accaaucucuguga

SEQ ID NO: 1098106 - RNA, 17 nt, Homo sapiens
accaaugauucauaaca

SEQ ID NO: 1098107 - RNA, 19 nt, Homo sapiens
accaauguacccaccgggc

SEQ ID NO: 1098108 - RNA, 15 nt, Homo sapiens
accacaugugcacau

SEQ ID NO: 1098109 - RNA, 20 nt, Homo sapiens
accaccuucccagcucuccc

SEQ ID NO: 1098110 - RNA, 19 nt, Homo sapiens
accacuaugcaauauauca

SEQ ID NO: 1098111 - RNA, 21 nt, Homo sapiens
accacuauucuuaacuauuca

SEQ ID NO: 1098112 - RNA, 16 nt, Homo sapiens
accacuguguauuuaa

SEQ ID NO: 1098113 - RNA, 15 nt, Homo sapiens
accagaagccaaaga

SEQ ID NO: 1098114 - RNA, 12 nt, Homo sapiens
accagauuugcu

SEQ ID NO: 1098115 - RNA, 13 nt, Homo sapiens
accagauuugcua

SEQ ID NO: 1098116 - RNA, 21 nt, Homo sapiens
accagauuuuuacacauguau

SEQ ID NO: 1098117 - RNA, 14 nt, Homo sapiens
accagcacauuucu

SEQ ID NO: 1098118 - RNA, 16 nt, Homo sapiens
accagccacacagagc

SEQ ID NO: 1098119 - RNA, 22 nt, Homo sapiens
accagccuggccaacaugguga

SEQ ID NO: 1098120 - RNA, 22 nt, Homo sapiens
accagccuggucaacaugguga

SEQ ID NO: 1098121 - RNA, 16 nt, Homo sapiens
accaggacuauagccc

SEQ ID NO: 1098122 - RNA, 17 nt, Homo sapiens
accaggaucgcuuugua

SEQ ID NO: 1098123 - RNA, 19 nt, Homo sapiens
accaggaucgcuuuguacu

SEQ ID NO: 1098124 - RNA, 21 nt, Homo sapiens
accaggggugauuucagagag

SEQ ID NO: 1098125 - RNA, 16 nt, Homo sapiens
accaggucaucuccuu

SEQ ID NO: 1098126 - RNA, 13 nt, Homo sapiens
accagucacuguc

SEQ ID NO: 1098127 - RNA, 14 nt, Homo sapiens
accagucacugucc

SEQ ID NO: 1098128 - RNA, 15 nt, Homo sapiens
accaguuaugugaau

SEQ ID NO: 1098129 - RNA, 13 nt, Homo sapiens
accauaauguuac

SEQ ID NO: 1098130 - RNA, 18 nt, Homo sapiens
accaucaaaaauauucca

SEQ ID NO: 1098131 - RNA, 14 nt, Homo sapiens
accaucaguuacug

SEQ ID NO: 1098132 - RNA, 16 nt, Homo sapiens
accaugaaauauccag

SEQ ID NO: 1098133 - RNA, 22 nt, Homo sapiens
accaugaagcuggaagcacugc

SEQ ID NO: 1098134 - RNA, 15 nt, Homo sapiens
accaugccaggcuaa

SEQ ID NO: 1098135 - RNA, 15 nt, Homo sapiens
accaugccucuccaa

SEQ ID NO: 1098136 - RNA, 20 nt, Homo sapiens
acccaaauaaauguguaaau

SEQ ID NO: 1098137 - RNA, 22 nt, Homo sapiens
acccaauucaaaacauugugcc

SEQ ID NO: 1098138 - RNA, 16 nt, Homo sapiens
acccaccaucaugucu

SEQ ID NO: 1098139 - RNA, 12 nt, Homo sapiens
acccaccucagc

SEQ ID NO: 1098140 - RNA, 21 nt, Homo sapiens
acccacugcuuuuggucugug

SEQ ID NO: 1098141 - RNA, 20 nt, Homo sapiens
aggccuggccagaugcacca

SEQ ID NO: 1098142 - RNA, 17 nt, Homo sapiens
aggccuguguagcugug

SEQ ID NO: 1098143 - RNA, 17 nt, Homo sapiens
aggcggggugcuguggu

SEQ ID NO: 1098144 - RNA, 14 nt, Homo sapiens
aggcguucuucgag

SEQ ID NO: 1098145 - RNA, 16 nt, Homo sapiens
aggcucacagcuggaa

SEQ ID NO: 1098146 - RNA, 16 nt, Homo sapiens
aggcugaccaagagag

SEQ ID NO: 1098147 - RNA, 15 nt, Homo sapiens
aggcugccucagacc

SEQ ID NO: 1098148 - RNA, 16 nt, Homo sapiens
aggcugcuguguagcu

SEQ ID NO: 1098149 - RNA, 23 nt, Homo sapiens
aggcuggcacuccccugaccuca

SEQ ID NO: 1098150 - RNA, 14 nt, Homo sapiens
aggcuggcagauuu

SEQ ID NO: 1098151 - RNA, 15 nt, Homo sapiens
aggcuggcugaaaau

SEQ ID NO: 1098152 - RNA, 16 nt, Homo sapiens
aggcuguacacugcac

SEQ ID NO: 1098153 - RNA, 13 nt, Homo sapiens
aggcuuaucaaaa

SEQ ID NO: 1098154 - RNA, 15 nt, Homo sapiens
aggcuucacccugaa

SEQ ID NO: 1098155 - RNA, 21 nt, Homo sapiens
aggcuuccagagaguccucug

SEQ ID NO: 1098156 - RNA, 17 nt, Homo sapiens
agggaaauucacacugu

SEQ ID NO: 1098157 - RNA, 14 nt, Homo sapiens
agggacccacuuca

SEQ ID NO: 1098158 - RNA, 16 nt, Homo sapiens
agggacuccaguucac

SEQ ID NO: 1098159 - RNA, 17 nt, Homo sapiens
agggagacugcaucuca

SEQ ID NO: 1098160 - RNA, 16 nt, Homo sapiens
agggaggccgaagcua

SEQ ID NO: 1098161 - RNA, 16 nt, Homo sapiens
agggagggcucugagg

SEQ ID NO: 1098162 - RNA, 23 nt, Homo sapiens
agggauggggcagucucugccca

SEQ ID NO: 1098163 - RNA, 16 nt, Homo sapiens
agggauuccccuaacc

SEQ ID NO: 1098164 - RNA, 16 nt, Homo sapiens
agggcaauaaaugccc

SEQ ID NO: 1098165 - RNA, 15 nt, Homo sapiens
agggcacaggagcua

SEQ ID NO: 1098166 - RNA, 17 nt, Homo sapiens
agggcacucacaugccg

SEQ ID NO: 1098167 - RNA, 23 nt, Homo sapiens
agggccuagcuuucauuugacac

SEQ ID NO: 1098168 - RNA, 22 nt, Homo sapiens
agggcugccccuguagguugcu

SEQ ID NO: 1098169 - RNA, 13 nt, Homo sapiens
aggggacauuucc

SEQ ID NO: 1098170 - RNA, 20 nt, Homo sapiens
aggggagcaacagaggacau

SEQ ID NO: 1098171 - RNA, 21 nt, Homo sapiens
aggggauagagagagaccacu

SEQ ID NO: 1098172 - RNA, 20 nt, Homo sapiens
aggggccugcccagugcacu

SEQ ID NO: 1098173 - RNA, 12 nt, Homo sapiens
aggggcugucca

SEQ ID NO: 1098174 - RNA, 18 nt, Homo sapiens
agggggugugucugcuca

SEQ ID NO: 1098175 - RNA, 17 nt, Homo sapiens
aggggugauuucagaga

SEQ ID NO: 1098176 - RNA, 22 nt, Homo sapiens
aggggugggagagccagcucuc

SEQ ID NO: 1098177 - RNA, 20 nt, Homo sapiens
aggguagauaaccuguacuu

SEQ ID NO: 1098178 - RNA, 20 nt, Homo sapiens
aggguaucaggugcugccau

SEQ ID NO: 1098179 - RNA, 14 nt, Homo sapiens
agggucucuucagg

SEQ ID NO: 1098180 - RNA, 16 nt, Homo sapiens
agggugcuaacguauc

SEQ ID NO: 1098181 - RNA, 15 nt, Homo sapiens
aggguguaucuagcu

SEQ ID NO: 1098182 - RNA, 13 nt, Homo sapiens
aggguuacuaugc

SEQ ID NO: 1098183 - RNA, 19 nt, Homo sapiens
agguagcccagcacuguga

SEQ ID NO: 1098184 - RNA, 14 nt, Homo sapiens
aggucaacaucuaa

SEQ ID NO: 1098185 - RNA, 17 nt, Homo sapiens
aggucauagcagugcuu

SEQ ID NO: 1098186 - RNA, 20 nt, Homo sapiens
agguccucuacuuaaugaga

SEQ ID NO: 1098187 - RNA, 15 nt, Homo sapiens
agguccugcauuucu

SEQ ID NO: 1098188 - RNA, 13 nt, Homo sapiens
aggucuccaaaau

SEQ ID NO: 1098189 - RNA, 11 nt, Homo sapiens
aggucuugccu

SEQ ID NO: 1098190 - RNA, 15 nt, Homo sapiens
aggugagaccaccuc

SEQ ID NO: 1098191 - RNA, 19 nt, Homo sapiens
aggugaugguaacugcaca

SEQ ID NO: 1098192 - RNA, 15 nt, Homo sapiens
aggugcugacaaaga

SEQ ID NO: 1098193 - RNA, 22 nt, Homo sapiens
aggugcugacaaagaugaccug

SEQ ID NO: 1098194 - RNA, 15 nt, Homo sapiens
aggugucugcaccca

SEQ ID NO: 1098195 - RNA, 22 nt, Homo sapiens
agguguucaagaccagccugac

SEQ ID NO: 1098196 - RNA, 15 nt, Homo sapiens
agguguuuaguugca

SEQ ID NO: 1098197 - RNA, 13 nt, Homo sapiens
agguuaacagaua

SEQ ID NO: 1098198 - RNA, 18 nt, Homo sapiens
agguuaucaaccauauga

SEQ ID NO: 1098199 - RNA, 23 nt, Homo sapiens
aguccucuggauggcaccagagg

SEQ ID NO: 1098200 - RNA, 22 nt, Homo sapiens
aguccuuuacuaauccaaccca

SEQ ID NO: 1098201 - RNA, 23 nt, Homo sapiens
agucgaggacagggaggugaccc

SEQ ID NO: 1098202 - RNA, 12 nt, Homo sapiens
agucuaccucuu

SEQ ID NO: 1098203 - RNA, 12 nt, Homo sapiens
agucucuaugau

SEQ ID NO: 1098204 - RNA, 18 nt, Homo sapiens
agucucugugcuuugacu

SEQ ID NO: 1098205 - RNA, 18 nt, Homo sapiens
agucugagguccugagca

SEQ ID NO: 1098206 - RNA, 23 nt, Homo sapiens
agucuuaaaauaacuuauaucau

SEQ ID NO: 1098207 - RNA, 17 nt, Homo sapiens
agucuuauuuccucaac

SEQ ID NO: 1098208 - RNA, 13 nt, Homo sapiens
agucuucccugau

SEQ ID NO: 1098209 - RNA, 19 nt, Homo sapiens
agucuugucauugccagcu

SEQ ID NO: 1098210 - RNA, 13 nt, Homo sapiens
agugaaccaaaga

SEQ ID NO: 1098211 - RNA, 16 nt, Homo sapiens
agugaagaugccagug

SEQ ID NO: 1098212 - RNA, 20 nt, Homo sapiens
agugaagaugccagugaaac

SEQ ID NO: 1098213 - RNA, 21 nt, Homo sapiens
agugaaguucuuuuacuguaa

SEQ ID NO: 1098214 - RNA, 18 nt, Homo sapiens
agugacagagacccagau

SEQ ID NO: 1098215 - RNA, 20 nt, Homo sapiens
agugacaucucuuugauguc

SEQ ID NO: 1098216 - RNA, 21 nt, Homo sapiens
agugacaucucuuugauguca

SEQ ID NO: 1098217 - RNA, 22 nt, Homo sapiens
agugagacccccaucucuacaa

SEQ ID NO: 1098218 - RNA, 18 nt, Homo sapiens
agugagacuccgucucaa

SEQ ID NO: 1098219 - RNA, 22 nt, Homo sapiens
agugagaucuucaaugcuuccu

SEQ ID NO: 1098220 - RNA, 19 nt, Homo sapiens
agugagucgaggacaggga

SEQ ID NO: 1098221 - RNA, 13 nt, Homo sapiens
agugagucucuuc

SEQ ID NO: 1098222 - RNA, 17 nt, Homo sapiens
agugauugauagagugu

SEQ ID NO: 1098223 - RNA, 19 nt, Homo sapiens
agugcacuugcuggaagac

SEQ ID NO: 1098224 - RNA, 21 nt, Homo sapiens
agugccguaacaacugugguc

SEQ ID NO: 1098225 - RNA, 14 nt, Homo sapiens
agugccuuaccucc

SEQ ID NO: 1098226 - RNA, 18 nt, Homo sapiens
agugcgccuugcaaaaaa

SEQ ID NO: 1098227 - RNA, 19 nt, Homo sapiens
agugcugagaaggacaccu

SEQ ID NO: 1098228 - RNA, 20 nt, Homo sapiens
agugcugcuggaaguagaau

SEQ ID NO: 1098229 - RNA, 21 nt, Homo sapiens
agugcugggauuacaggugug

SEQ ID NO: 1098230 - RNA, 21 nt, Homo sapiens
agugcuugauugcguggaauu

SEQ ID NO: 1098231 - RNA, 22 nt, Homo sapiens
agugcuugccaccaccagauga

SEQ ID NO: 1098232 - RNA, 18 nt, Homo sapiens
aguggcauucacaucuca

SEQ ID NO: 1098233 - RNA, 19 nt, Homo sapiens
aguggcauucacaucucau

SEQ ID NO: 1098234 - RNA, 20 nt, Homo sapiens
aguggccaugccacccuguu

SEQ ID NO: 1098235 - RNA, 21 nt, Homo sapiens
aguggcucacgccuaugaucc

SEQ ID NO: 1098236 - RNA, 14 nt, Homo sapiens
agugggacccauag

SEQ ID NO: 1098237 - RNA, 21 nt, Homo sapiens
agugggaggguaccagcagaa

SEQ ID NO: 1098238 - RNA, 20 nt, Homo sapiens
agugggugccccccuugcca

SEQ ID NO: 1098239 - RNA, 19 nt, Homo sapiens
agugggugguggaucuguc

SEQ ID NO: 1098240 - RNA, 15 nt, Homo sapiens
agugguaccagcuca

SEQ ID NO: 1098241 - RNA, 19 nt, Homo sapiens
agugguauagaguacugca

SEQ ID NO: 1098242 - RNA, 21 nt, Homo sapiens
aguggugcgaucuggguucac

SEQ ID NO: 1098243 - RNA, 20 nt, Homo sapiens
aguggugcgaucuuggcuca

SEQ ID NO: 1098244 - RNA, 18 nt, Homo sapiens
aguguaauugagaaggaa

SEQ ID NO: 1098245 - RNA, 16 nt, Homo sapiens
aguguagccuugcccg

SEQ ID NO: 1098246 - RNA, 15 nt, Homo sapiens
agugugcuugucauc

SEQ ID NO: 1098247 - RNA, 22 nt, Homo sapiens
aguguggcccagggaagccaaa

SEQ ID NO: 1098248 - RNA, 20 nt, Homo sapiens
aguguguugggaauugcaug

SEQ ID NO: 1098249 - RNA, 17 nt, Homo sapiens
aguguuaucagucauaa

SEQ ID NO: 1098250 - RNA, 20 nt, Homo sapiens
aguuaaagugaauaaccacu

SEQ ID NO: 1098251 - RNA, 23 nt, Homo sapiens
aguuaaagugaauaaccacuuaa

SEQ ID NO: 1098252 - RNA, 13 nt, Homo sapiens
aguuaagaaccug

SEQ ID NO: 1098253 - RNA, 14 nt, Homo sapiens
aguuaagaaccuga

SEQ ID NO: 1098254 - RNA, 13 nt, Homo sapiens
aguuaauacuuaa

SEQ ID NO: 1098255 - RNA, 12 nt, Homo sapiens
aguuacuugaaa

SEQ ID NO: 1098256 - RNA, 18 nt, Homo sapiens
aguuauuccccaucuucc

SEQ ID NO: 1098257 - RNA, 20 nt, Homo sapiens
aguucaaauuuugcauugug

SEQ ID NO: 1098258 - RNA, 14 nt, Homo sapiens
aguucagcaaagag

SEQ ID NO: 1098259 - RNA, 18 nt, Homo sapiens
aguucauauguaccaugu

SEQ ID NO: 1098260 - RNA, 20 nt, Homo sapiens
aguuccagauuguucugucc

SEQ ID NO: 1098261 - RNA, 14 nt, Homo sapiens
aguuccauguuaaa

SEQ ID NO: 1098262 - RNA, 20 nt, Homo sapiens
aguuccuacuuuagccacug

SEQ ID NO: 1098263 - RNA, 21 nt, Homo sapiens
aguuccugugggugugucucu

SEQ ID NO: 1098264 - RNA, 18 nt, Homo sapiens
aguucgaggcugcaguca

SEQ ID NO: 1098265 - RNA, 16 nt, Homo sapiens
aguucugaaaacuguu

SEQ ID NO: 1098266 - RNA, 19 nt, Homo sapiens
aguucuggcugaacacugg

SEQ ID NO: 1098267 - RNA, 15 nt, Homo sapiens
aguucuugugccaua

SEQ ID NO: 1098268 - RNA, 13 nt, Homo sapiens
aguugaacaucuc

SEQ ID NO: 1098269 - RNA, 18 nt, Homo sapiens
aguugaagcuaagauuua

SEQ ID NO: 1098270 - RNA, 15 nt, Homo sapiens
aguugacuuacuguu

SEQ ID NO: 1098271 - RNA, 13 nt, Homo sapiens
aguugagaacaaa

SEQ ID NO: 1098272 - RNA, 19 nt, Homo sapiens
aguugcguggacucugcac

SEQ ID NO: 1098273 - RNA, 21 nt, Homo sapiens
aguugcguggacucugcacau

SEQ ID NO: 1098274 - RNA, 17 nt, Homo sapiens
aguugcugaugaacucu

SEQ ID NO: 1098275 - RNA, 22 nt, Homo sapiens
aguugcuuuaaaguaccuguag

SEQ ID NO: 1098276 - RNA, 20 nt, Homo sapiens
aguuggaaccguguccagca

SEQ ID NO: 1098277 - RNA, 11 nt, Homo sapiens
aguuggcagaa

SEQ ID NO: 1098278 - RNA, 16 nt, Homo sapiens
aguugggagcacugga

SEQ ID NO: 1098279 - RNA, 12 nt, Homo sapiens
aguuuacuucau

SEQ ID NO: 1098280 - RNA, 15 nt, Homo sapiens
aguuuauugacaaua

SEQ ID NO: 1098281 - RNA, 17 nt, Homo sapiens
aguuuauugacaauaau

SEQ ID NO: 1098282 - RNA, 17 nt, Homo sapiens
aguuuauuuuguuacac

SEQ ID NO: 1098283 - RNA, 21 nt, Homo sapiens
aguuucucagcucccaaggcu

SEQ ID NO: 1098284 - RNA, 10 nt, Homo sapiens
aguuugauau

SEQ ID NO: 1098285 - RNA, 18 nt, Homo sapiens
aguuugcaguuaugcaga

SEQ ID NO: 1098286 - RNA, 19 nt, Homo sapiens
aguuuuucagaaagcauua

SEQ ID NO: 1098287 - RNA, 17 nt, Homo sapiens
aguuuuugauagcuuua

SEQ ID NO: 1098288 - RNA, 17 nt, Homo sapiens
cagagaguccucuggau

SEQ ID NO: 1098289 - RNA, 19 nt, Homo sapiens
cagagaugccuccaccgcu

SEQ ID NO: 1098290 - RNA, 20 nt, Homo sapiens
cagagcaagacucugucuca

SEQ ID NO: 1098291 - RNA, 20 nt, Homo sapiens
cagagccuggggcaucccag

SEQ ID NO: 1098292 - RNA, 20 nt, Homo sapiens
cagagcgagagucugucuca

SEQ ID NO: 1098293 - RNA, 17 nt, Homo sapiens
cagaggaggccggugaa

SEQ ID NO: 1098294 - RNA, 23 nt, Homo sapiens
cagaggaggccggugaagugcau

SEQ ID NO: 1098295 - RNA, 22 nt, Homo sapiens
cagaggcagcgaguuguggaaa

SEQ ID NO: 1098296 - RNA, 14 nt, Homo sapiens
cagaggcugcagga

SEQ ID NO: 1098297 - RNA, 17 nt, Homo sapiens
cagaggcugcaggacuu

SEQ ID NO: 1098298 - RNA, 22 nt, Homo sapiens
cagagggguaggcagagccuuu

SEQ ID NO: 1098299 - RNA, 14 nt, Homo sapiens
cagaggguugugau

SEQ ID NO: 1098300 - RNA, 23 nt, Homo sapiens
cagagguaaaagugugagcagug

SEQ ID NO: 1098301 - RNA, 18 nt, Homo sapiens
cagagucucacuguugcc

SEQ ID NO: 1098302 - RNA, 15 nt, Homo sapiens
cagaguugcuuuaaa

SEQ ID NO: 1098303 - RNA, 18 nt, Homo sapiens
cagaucccauccaucagc

SEQ ID NO: 1098304 - RNA, 12 nt, Homo sapiens
cagaugcaauac

SEQ ID NO: 1098305 - RNA, 20 nt, Homo sapiens
cagaugcaaucucuugucuc

SEQ ID NO: 1098306 - RNA, 15 nt, Homo sapiens
cagaugcccccguga

SEQ ID NO: 1098307 - RNA, 13 nt, Homo sapiens
cagauggagacau

SEQ ID NO: 1098308 - RNA, 17 nt, Homo sapiens
cagauggccgggacaug

SEQ ID NO: 1098309 - RNA, 15 nt, Homo sapiens
cagauucccagagca

SEQ ID NO: 1098310 - RNA, 19 nt, Homo sapiens
cagauugcaacaggcuggg

SEQ ID NO: 1098311 - RNA, 19 nt, Homo sapiens
cagauuuccuaacucuggu

SEQ ID NO: 1098312 - RNA, 18 nt, Homo sapiens
cagcaaaacuccaucuca

SEQ ID NO: 1098313 - RNA, 23 nt, Homo sapiens
cagcaaaagaagacaacauuucu

SEQ ID NO: 1098314 - RNA, 19 nt, Homo sapiens
cagcaaagugucaguguug

SEQ ID NO: 1098315 - RNA, 18 nt, Homo sapiens
cagcaacaggaaucucag

SEQ ID NO: 1098316 - RNA, 21 nt, Homo sapiens
cagcaagacuucucuuugccu

SEQ ID NO: 1098317 - RNA, 17 nt, Homo sapiens
cagcacucugaaacuga

SEQ ID NO: 1098318 - RNA, 22 nt, Homo sapiens
cagcagaaaggagaacuaucca

SEQ ID NO: 1098319 - RNA, 14 nt, Homo sapiens
cagcagaagccaaa

SEQ ID NO: 1098320 - RNA, 20 nt, Homo sapiens
cagcagccagcucucagcca

SEQ ID NO: 1098321 - RNA, 12 nt, Homo sapiens
cagcagcugaac

SEQ ID NO: 1098322 - RNA, 22 nt, Homo sapiens
cagcauaccuuuauugugaucu

SEQ ID NO: 1098323 - RNA, 15 nt, Homo sapiens
cagcaucugcuaaua

SEQ ID NO: 1098324 - RNA, 14 nt, Homo sapiens
cagccaacauggca

SEQ ID NO: 1098325 - RNA, 19 nt, Homo sapiens
cagccagcgccucccucca

SEQ ID NO: 1098326 - RNA, 18 nt, Homo sapiens
cagccaggcggcuggaau

SEQ ID NO: 1098327 - RNA, 15 nt, Homo sapiens
cagccaucaugugcc

SEQ ID NO: 1098328 - RNA, 19 nt, Homo sapiens
cagccaucaugugccugga

SEQ ID NO: 1098329 - RNA, 15 nt, Homo sapiens
cagcccauggcuuua

SEQ ID NO: 1098330 - RNA, 16 nt, Homo sapiens
cagcccugacuggugc

SEQ ID NO: 1098331 - RNA, 20 nt, Homo sapiens
cagccuccccaccuucuuca

SEQ ID NO: 1098332 - RNA, 15 nt, Homo sapiens
caguuaauacuuaac

SEQ ID NO: 1098333 - RNA, 17 nt, Homo sapiens
caguuaucuaaguuaau

SEQ ID NO: 1098334 - RNA, 14 nt, Homo sapiens
caguugcuuugcag

SEQ ID NO: 1098335 - RNA, 17 nt, Homo sapiens
caguuggcagaaaggau

SEQ ID NO: 1098336 - RNA, 16 nt, Homo sapiens
caguuugcuuugcccu

SEQ ID NO: 1098337 - RNA, 15 nt, Homo sapiens
cauaaaacaaugaag

SEQ ID NO: 1098338 - RNA, 22 nt, Homo sapiens
cauaaacacccaugaaucaaag

SEQ ID NO: 1098339 - RNA, 23 nt, Homo sapiens
cauaaacacccaugaaucaaaga

SEQ ID NO: 1098340 - RNA, 17 nt, Homo sapiens
cauaaacuucaugguca

SEQ ID NO: 1098341 - RNA, 16 nt, Homo sapiens
cauaaagguauuuaga

SEQ ID NO: 1098342 - RNA, 19 nt, Homo sapiens
cauaaaguaugccuuccug

SEQ ID NO: 1098343 - RNA, 19 nt, Homo sapiens
cauaaauuuaucaucucga

SEQ ID NO: 1098344 - RNA, 20 nt, Homo sapiens
cauaacucauaauccagaga

SEQ ID NO: 1098345 - RNA, 20 nt, Homo sapiens
cauaagccuccauuuaguuc

SEQ ID NO: 1098346 - RNA, 18 nt, Homo sapiens
cauaauuugaauggugca

SEQ ID NO: 1098347 - RNA, 22 nt, Homo sapiens
cauacacacacacgcgugcaca

SEQ ID NO: 1098348 - RNA, 19 nt, Homo sapiens
cauacacucaaacaaucau

SEQ ID NO: 1098349 - RNA, 15 nt, Homo sapiens
cauacagauuugcaa

SEQ ID NO: 1098350 - RNA, 17 nt, Homo sapiens
cauacauaguacauaca

SEQ ID NO: 1098351 - RNA, 18 nt, Homo sapiens
cauacaugacucagcaua

SEQ ID NO: 1098352 - RNA, 21 nt, Homo sapiens
cauacaugacucagcauaccu

SEQ ID NO: 1098353 - RNA, 19 nt, Homo sapiens
cauaggaaguauggcauga

SEQ ID NO: 1098354 - RNA, 22 nt, Homo sapiens
cauagucacauggccuaugcac

SEQ ID NO: 1098355 - RNA, 14 nt, Homo sapiens
cauagugcacacuu

SEQ ID NO: 1098356 - RNA, 18 nt, Homo sapiens
cauagugcacacuuguau

SEQ ID NO: 1098357 - RNA, 20 nt, Homo sapiens
cauaguucuuacuacuugcc

SEQ ID NO: 1098358 - RNA, 19 nt, Homo sapiens
cauauaauguuguuauuua

SEQ ID NO: 1098359 - RNA, 21 nt, Homo sapiens
cauauacuuuggggacuugua

SEQ ID NO: 1098360 - RNA, 14 nt, Homo sapiens
cauaucagaccucu

SEQ ID NO: 1098361 - RNA, 22 nt, Homo sapiens
cauaucauuuuuuuaacacaua

SEQ ID NO: 1098362 - RNA, 20 nt, Homo sapiens
cauaugaauuuacuacuuua

SEQ ID NO: 1098363 - RNA, 19 nt, Homo sapiens
cauauggacucugcacaug

SEQ ID NO: 1098364 - RNA, 20 nt, Homo sapiens
cauaugugaauauggacuca

SEQ ID NO: 1098365 - RNA, 16 nt, Homo sapiens
cauauuaaacuucuga

SEQ ID NO: 1098366 - RNA, 19 nt, Homo sapiens
cauauucuuuaaauuucau

SEQ ID NO: 1098367 - RNA, 14 nt, Homo sapiens
cauauuuguuaaau

SEQ ID NO: 1098368 - RNA, 13 nt, Homo sapiens
cauauuuucacau

SEQ ID NO: 1098369 - RNA, 19 nt, Homo sapiens
caucaaauauuaccaaaaa

SEQ ID NO: 1098370 - RNA, 21 nt, Homo sapiens
caucaagaugagagaacugga

SEQ ID NO: 1098371 - RNA, 22 nt, Homo sapiens
caucaccuugauaaugggauga

SEQ ID NO: 1098372 - RNA, 18 nt, Homo sapiens
caucacuuaacugauguu

SEQ ID NO: 1098373 - RNA, 18 nt, Homo sapiens
caucagacuccugugcaa

SEQ ID NO: 1098374 - RNA, 22 nt, Homo sapiens
caucagcauuuaauaaauguau

SEQ ID NO: 1098375 - RNA, 16 nt, Homo sapiens
caucauauuguaugua

SEQ ID NO: 1098376 - RNA, 14 nt, Homo sapiens
caucaugucuggcu

SEQ ID NO: 1098377 - RNA, 16 nt, Homo sapiens
caucaugugccuggaa

SEQ ID NO: 1098378 - RNA, 13 nt, Homo sapiens
caucauuccuuga

SEQ ID NO: 1098379 - RNA, 18 nt, Homo sapiens
guuugaccucauuuguaa

SEQ ID NO: 1098380 - RNA, 15 nt, Homo sapiens
guuugagaccagccu

SEQ ID NO: 1098381 - RNA, 23 nt, Homo sapiens
guuugcaccuuucuaguugaaaa

SEQ ID NO: 1098382 - RNA, 21 nt, Homo sapiens
guuugcuauugacaagucauu

SEQ ID NO: 1098383 - RNA, 13 nt, Homo sapiens
guuugucaaaaag

SEQ ID NO: 1098384 - RNA, 14 nt, Homo sapiens
guuugugaaacaaa

SEQ ID NO: 1098385 - RNA, 17 nt, Homo sapiens
guuuuaacaguucacuu

SEQ ID NO: 1098386 - RNA, 12 nt, Homo sapiens
guuuuaagacug

SEQ ID NO: 1098387 - RNA, 17 nt, Homo sapiens
guuuuccuaaaugcagu

SEQ ID NO: 1098388 - RNA, 19 nt, Homo sapiens
guuuuccuaaaugcaguga

SEQ ID NO: 1098389 - RNA, 17 nt, Homo sapiens
guuuuggaagcucugaa

SEQ ID NO: 1098390 - RNA, 23 nt, Homo sapiens
guuuuggaagcucugaagucaca

SEQ ID NO: 1098391 - RNA, 13 nt, Homo sapiens
uaaaaaaugucua

SEQ ID NO: 1098392 - RNA, 20 nt, Homo sapiens
uaaaaacaugagaaauguga

SEQ ID NO: 1098393 - RNA, 13 nt, Homo sapiens
uaaaaacauuccc

SEQ ID NO: 1098394 - RNA, 23 nt, Homo sapiens
uaaaaacccuguauggcacuuau

SEQ ID NO: 1098395 - RNA, 13 nt, Homo sapiens
uaaaaacugagug

SEQ ID NO: 1098396 - RNA, 17 nt, Homo sapiens
uaaaaacugagugacuc

SEQ ID NO: 1098397 - RNA, 12 nt, Homo sapiens
uaaaaacuugua

SEQ ID NO: 1098398 - RNA, 15 nt, Homo sapiens
uaaaaacuuguacua

SEQ ID NO: 1098399 - RNA, 19 nt, Homo sapiens
uaaaaaucaugagauccuu

SEQ ID NO: 1098400 - RNA, 18 nt, Homo sapiens
uaaaaauggccauuugcu

SEQ ID NO: 1098401 - RNA, 17 nt, Homo sapiens
uaaaaauugacuucuug

SEQ ID NO: 1098402 - RNA, 23 nt, Homo sapiens
uaaaaauugugaucagaccauaa

SEQ ID NO: 1098403 - RNA, 20 nt, Homo sapiens
uaaaacaacacucacauuua

SEQ ID NO: 1098404 - RNA, 16 nt, Homo sapiens
uaaaagaaaucuucau

SEQ ID NO: 1098405 - RNA, 19 nt, Homo sapiens
uaaaagaaccgagcaauuu

SEQ ID NO: 1098406 - RNA, 17 nt, Homo sapiens
uaaaagaauuugugaca

SEQ ID NO: 1098407 - RNA, 15 nt, Homo sapiens
uaaaagauucacuaa

SEQ ID NO: 1098408 - RNA, 14 nt, Homo sapiens
uaaaagguauugag

SEQ ID NO: 1098409 - RNA, 21 nt, Homo sapiens
uaaaaguguauuuuuguuuaa

SEQ ID NO: 1098410 - RNA, 13 nt, Homo sapiens
uaaaaguuacuua

SEQ ID NO: 1098411 - RNA, 20 nt, Homo sapiens
uaaaauagacaacucuucca

SEQ ID NO: 1098412 - RNA, 22 nt, Homo sapiens
uaaaauauuuuuaugugcaaua

SEQ ID NO: 1098413 - RNA, 16 nt, Homo sapiens
uaaaaucaggauuuua

SEQ ID NO: 1098414 - RNA, 22 nt, Homo sapiens
uaaaaucaggauuuuagugcuu

SEQ ID NO: 1098415 - RNA, 20 nt, Homo sapiens
uaaaaugaaauuacuacaaa

SEQ ID NO: 1098416 - RNA, 20 nt, Homo sapiens
uaaaauuaaaugcauguccu

SEQ ID NO: 1098417 - RNA, 23 nt, Homo sapiens
uaaaauuaaaugcauguccucaa

SEQ ID NO: 1098418 - RNA, 13 nt, Homo sapiens
uaaaauuagugag

SEQ ID NO: 1098419 - RNA, 14 nt, Homo sapiens
uaaaauucuuggga

SEQ ID NO: 1098420 - RNA, 18 nt, Homo sapiens
uaaaauuuaccacagacu

SEQ ID NO: 1098421 - RNA, 16 nt, Homo sapiens
uaaacaacuaccuccu

SEQ ID NO: 1098422 - RNA, 17 nt, Homo sapiens
uaaacaagugcacuuga

SEQ ID NO: 1098423 - RNA, 21 nt, Homo sapiens
uaaacaagugcacuugaacau

SEQ ID NO: 1098424 - RNA, 11 nt, Homo sapiens
uaaacagugcc

SEQ ID NO: 1098425 - RNA, 14 nt, Homo sapiens
uaaacauccuucaa

SEQ ID NO: 1098426 - RNA, 20 nt, Homo sapiens
uaaacauugguauauuucca

SEQ ID NO: 1098427 - RNA, 13 nt, Homo sapiens
uaaaccaaaaagg

SEQ ID NO: 1098428 - RNA, 15 nt, Homo sapiens
uaaacuaaaagcaua

SEQ ID NO: 1098429 - RNA, 21 nt, Homo sapiens
uaaacuuaccugggcauucuu

SEQ ID NO: 1098430 - RNA, 14 nt, Homo sapiens
uaaagaaguuugau

SEQ ID NO: 1098431 - RNA, 22 nt, Homo sapiens
uaaagauuuuuuaauaauuuag

SEQ ID NO: 1098432 - RNA, 22 nt, Homo sapiens
uaaagcaguguuuucaccucau

SEQ ID NO: 1098433 - RNA, 13 nt, Homo sapiens
uaaagcccuugaa

SEQ ID NO: 1098434 - RNA, 18 nt, Homo sapiens
uaaagcucaucagcuauc

SEQ ID NO: 1098435 - RNA, 19 nt, Homo sapiens
uaaagcucugaacaaaagc

SEQ ID NO: 1098436 - RNA, 16 nt, Homo sapiens
uaaaggcccacuggca

SEQ ID NO: 1098437 - RNA, 17 nt, Homo sapiens
uaaaggugcugcacugg

SEQ ID NO: 1098438 - RNA, 18 nt, Homo sapiens
uaaaguuguucacauaua

SEQ ID NO: 1098439 - RNA, 15 nt, Homo sapiens
uaaauaaaucauuaa

SEQ ID NO: 1098440 - RNA, 16 nt, Homo sapiens
uaaauaaauguaaaua

SEQ ID NO: 1098441 - RNA, 15 nt, Homo sapiens
uaaauaacagugugu

SEQ ID NO: 1098442 - RNA, 12 nt, Homo sapiens
uaaauacagaca

SEQ ID NO: 1098443 - RNA, 22 nt, Homo sapiens
uaaauaguuuuaaauaugaaca

SEQ ID NO: 1098444 - RNA, 14 nt, Homo sapiens
uaaauaugaaauga

SEQ ID NO: 1098445 - RNA, 16 nt, Homo sapiens
uaaaugcauguccuca

SEQ ID NO: 1098446 - RNA, 20 nt, Homo sapiens
uaaaugcauguccucaaaac

SEQ ID NO: 1098447 - RNA, 19 nt, Homo sapiens
uaaaugccaggccuggcaa

SEQ ID NO: 1098448 - RNA, 21 nt, Homo sapiens
uaaaugcugucaacuaugaua

SEQ ID NO: 1098449 - RNA, 12 nt, Homo sapiens
uaaauggagcuu

SEQ ID NO: 1098450 - RNA, 16 nt, Homo sapiens
uaaauguauaggcaga

SEQ ID NO: 1098451 - RNA, 14 nt, Homo sapiens
uaaauguaucuuau

SEQ ID NO: 1098452 - RNA, 20 nt, Homo sapiens
uaaauguaucuuauucacau

SEQ ID NO: 1098453 - RNA, 22 nt, Homo sapiens
uaaaugucucuuuaaugucaca

SEQ ID NO: 1098454 - RNA, 17 nt, Homo sapiens
uaaaugugguacaagca

SEQ ID NO: 1098455 - RNA, 22 nt, Homo sapiens
uaaauuauuuuaaaaacuaaaa

SEQ ID NO: 1098456 - RNA, 13 nt, Homo sapiens
uaaauugcagaug

SEQ ID NO: 1098457 - RNA, 16 nt, Homo sapiens
ucuugcauucccagug

SEQ ID NO: 1098458 - RNA, 18 nt, Homo sapiens
ucuuggccgacucaggga

SEQ ID NO: 1098459 - RNA, 20 nt, Homo sapiens
ucuugggaauuuucuuccaa

SEQ ID NO: 1098460 - RNA, 12 nt, Homo sapiens
ucuuggugccuc

SEQ ID NO: 1098461 - RNA, 15 nt, Homo sapiens
ugagaaacugauuua

SEQ ID NO: 1098462 - RNA, 17 nt, Homo sapiens
ugagaaacuuccuuuga

SEQ ID NO: 1098463 - RNA, 17 nt, Homo sapiens
ugagaccacuguuauca

SEQ ID NO: 1098464 - RNA, 15 nt, Homo sapiens
ugagacuccgucuca

SEQ ID NO: 1098465 - RNA, 22 nt, Homo sapiens
ugagagcauugggauaucuccu

SEQ ID NO: 1098466 - RNA, 20 nt, Homo sapiens
ugagagcccuucaugcauuu

SEQ ID NO: 1098467 - RNA, 17 nt, Homo sapiens
ugagcaauucauuucac

SEQ ID NO: 1098468 - RNA, 22 nt, Homo sapiens
ugagcacugccaggagggacaa

SEQ ID NO: 1098469 - RNA, 14 nt, Homo sapiens
ugagccacagacca

SEQ ID NO: 1098470 - RNA, 18 nt, Homo sapiens
ugagcuagugauuugccu

SEQ ID NO: 1098471 - RNA, 15 nt, Homo sapiens
ugagcuccccaaaaa

SEQ ID NO: 1098472 - RNA, 17 nt, Homo sapiens
ugagcugggcaccacag

SEQ ID NO: 1098473 - RNA, 14 nt, Homo sapiens
ugagcuucaguaua

SEQ ID NO: 1098474 - RNA, 16 nt, Homo sapiens
ugaggaaggugcuugc

SEQ ID NO: 1098475 - RNA, 17 nt, Homo sapiens
ugaggaauauuugcaag

SEQ ID NO: 1098476 - RNA, 22 nt, Homo sapiens
ugaggaggcuugccccacccaa

SEQ ID NO: 1098477 - RNA, 20 nt, Homo sapiens
ugaggauuuugauccaagcu

SEQ ID NO: 1098478 - RNA, 22 nt, Homo sapiens
ugaggcagacagcagcucaggc

SEQ ID NO: 1098479 - RNA, 15 nt, Homo sapiens
ugagggaaaaugagu

SEQ ID NO: 1098480 - RNA, 22 nt, Homo sapiens
ugaggggcuccuggaaaggcuc

SEQ ID NO: 1098481 - RNA, 19 nt, Homo sapiens
ugagguuuucugugcuuug

SEQ ID NO: 1098482 - RNA, 17 nt, Homo sapiens
ugagucagacauuuggu

SEQ ID NO: 1098483 - RNA, 18 nt, Homo sapiens
ugagucugcagaugagga

SEQ ID NO: 1098484 - RNA, 14 nt, Homo sapiens
ugagugaacaacua

SEQ ID NO: 1098485 - RNA, 21 nt, Homo sapiens
ugaguuauaguuugcuuugcu

SEQ ID NO: 1098486 - RNA, 22 nt, Homo sapiens
ugaguucuggaagggacuuuag

SEQ ID NO: 1098487 - RNA, 19 nt, Homo sapiens
ugaguugcacagcuaugaa

SEQ ID NO: 1098488 - RNA, 21 nt, Homo sapiens
ugaguugguguugacaugugc

SEQ ID NO: 1098489 - RNA, 13 nt, Homo sapiens
ugauaaacauuaa

SEQ ID NO: 1098490 - RNA, 14 nt, Homo sapiens
ugauaaacauuaaa

SEQ ID NO: 1098491 - RNA, 19 nt, Homo sapiens
ugauacaagaaagcaaugc

SEQ ID NO: 1098492 - RNA, 14 nt, Homo sapiens
ugauacauauguga

SEQ ID NO: 1098493 - RNA, 15 nt, Homo sapiens
ugaucacacucuggg

SEQ ID NO: 1098494 - RNA, 19 nt, Homo sapiens
ugaucacggcucacugcag

SEQ ID NO: 1098495 - RNA, 20 nt, Homo sapiens
ugaucagaauuuuaccaaaa

SEQ ID NO: 1098496 - RNA, 22 nt, Homo sapiens
ugauccacaaaaacaacuuauu

SEQ ID NO: 1098497 - RNA, 17 nt, Homo sapiens
ugauccuuuuauguuau

SEQ ID NO: 1098498 - RNA, 21 nt, Homo sapiens
ugaucgcgccacuacacucca

SEQ ID NO: 1098499 - RNA, 16 nt, Homo sapiens
ugaucuuggcacaaau

SEQ ID NO: 1098500 - RNA, 14 nt, Homo sapiens
ugaugaauuacuuc

SEQ ID NO: 1098501 - RNA, 23 nt, Homo sapiens
ugaugaggccucuuggaccucug

SEQ ID NO: 1098502 - RNA, 17 nt, Homo sapiens
ugaugauuaauucaccu

SEQ ID NO: 1098503 - RNA, 17 nt, Homo sapiens
ugaugauuugcuaucaa

SEQ ID NO: 1098504 - RNA, 16 nt, Homo sapiens
ugaugcuaccaugccu

SEQ ID NO: 1098505 - RNA, 21 nt, Homo sapiens
ugauggagauauuuacaugaa

SEQ ID NO: 1098506 - RNA, 16 nt, Homo sapiens
ugaugggucccaaaag

SEQ ID NO: 1098507 - RNA, 19 nt, Homo sapiens
ugaugugucaucuaauuaa

SEQ ID NO: 1098508 - RNA, 11 nt, Homo sapiens
ugauguugcug

SEQ ID NO: 1098509 - RNA, 14 nt, Homo sapiens
ugauucagacagcu

SEQ ID NO: 1098510 - RNA, 19 nt, Homo sapiens
ugauugaaaauaguaaaug

SEQ ID NO: 1098511 - RNA, 21 nt, Homo sapiens
ugauuggacauuuucuucaga

SEQ ID NO: 1098512 - RNA, 14 nt, Homo sapiens
ugauuucauuucaa

SEQ ID NO: 1098513 - RNA, 13 nt, Homo sapiens
ugcaaaauuucca

SEQ ID NO: 1098514 - RNA, 20 nt, Homo sapiens
ugcaaaguucccuacuuccu

SEQ ID NO: 1098515 - RNA, 16 nt, Homo sapiens
ugcaacuucuaccucc

SEQ ID NO: 1098516 - RNA, 21 nt, Homo sapiens
ugcaacuucuuacuucccuaa

SEQ ID NO: 1098517 - RNA, 12 nt, Homo sapiens
ugcaagacauag

SEQ ID NO: 1098518 - RNA, 21 nt, Homo sapiens
ugcaagacauagaauaguguu

SEQ ID NO: 1098519 - RNA, 23 nt, Homo sapiens
ugcaagcuucuuuuaguuguauc

SEQ ID NO: 1098520 - RNA, 16 nt, Homo sapiens
ugcacaaagcccuucc

SEQ ID NO: 1098521 - RNA, 12 nt, Homo sapiens
ugcacaauuuga

SEQ ID NO: 1098522 - RNA, 12 nt, Homo sapiens
ugcacacuugua

SEQ ID NO: 1098523 - RNA, 17 nt, Homo sapiens
ugcacaugcacgugugu

SEQ ID NO: 1098524 - RNA, 23 nt, Homo sapiens
ugcacaugucuuguacaugugua

SEQ ID NO: 1098525 - RNA, 19 nt, Homo sapiens
ugcacauuuuguacaaaga

SEQ ID NO: 1098526 - RNA, 20 nt, Homo sapiens
ugcaccaaaucaucucucau

SEQ ID NO: 1098527 - RNA, 17 nt, Homo sapiens
ugcaccacuucaaguga

SEQ ID NO: 1098528 - RNA, 18 nt, Homo sapiens
ugcaccccaacauugaga

SEQ ID NO: 1098529 - RNA, 17 nt, Homo sapiens
ugcaccccuccccauuc

SEQ ID NO: 1098530 - RNA, 14 nt, Homo sapiens
ugcacuccagccug

SEQ ID NO: 1098531 - RNA, 16 nt, Homo sapiens
ugcagacucacugugg

SEQ ID NO: 1098532 - RNA, 17 nt, Homo sapiens
ugcagacucacuguggg

SEQ ID NO: 1098533 - RNA, 19 nt, Homo sapiens
ugcagagguaaaaguguga

SEQ ID NO: 1098534 - RNA, 15 nt, Homo sapiens
ugcagaugaggacua

SEQ ID NO: 1098535 - RNA, 16 nt, Homo sapiens
ugcagccucaaccucc

SEQ ID NO: 1098536 - RNA, 14 nt, Homo sapiens
ugcaggaaaacuga

SEQ ID NO: 1098537 - RNA, 23 nt, Homo sapiens
ugcaggaagugucuagaggaaua

SEQ ID NO: 1098538 - RNA, 21 nt, Homo sapiens
ugcagggggugugucugcuca

SEQ ID NO: 1098539 - RNA, 23 nt, Homo sapiens
ugcaggugucuauccaccugggg

SEQ ID NO: 1098540 - RNA, 20 nt, Homo sapiens
ugcaguauggccaugggcug

SEQ ID NO: 1098541 - RNA, 22 nt, Homo sapiens
ugcagucccagcuacucaggag

SEQ ID NO: 1098542 - RNA, 23 nt, Homo sapiens
ugcagugguaugaucacggcuca

SEQ ID NO: 1098543 - RNA, 20 nt, Homo sapiens
ugcaguggugcgaucuuggc

SEQ ID NO: 1098544 - RNA, 16 nt, Homo sapiens
ugcaguugacagcagg

SEQ ID NO: 1098545 - RNA, 22 nt, Homo sapiens
ugcaguuuccaaucccauagau

SEQ ID NO: 1098546 - RNA, 14 nt, Homo sapiens
ugcauaagauuaaa

SEQ ID NO: 1098547 - RNA, 18 nt, Homo sapiens
ugcauacagagacagaua

SEQ ID NO: 1098548 - RNA, 14 nt, Homo sapiens
ugcauaggaaguau

SEQ ID NO: 1098549 - RNA, 12 nt, Homo sapiens
ugcaucuacuca

SEQ ID NO: 1098550 - RNA, 22 nt, Homo sapiens
uggaaagcaucaccucaggcca

SEQ ID NO: 1098551 - RNA, 14 nt, Homo sapiens
uggaaagcugcuuc

SEQ ID NO: 1098552 - RNA, 16 nt, Homo sapiens
uggaacacucucugag

SEQ ID NO: 1098553 - RNA, 18 nt, Homo sapiens
uggaacacucucugagau

SEQ ID NO: 1098554 - RNA, 13 nt, Homo sapiens
cauggaauuaccu

SEQ ID NO: 1098555 - RNA, 16 nt, Homo sapiens
cauggcccaaauccag

SEQ ID NO: 1098556 - RNA, 14 nt, Homo sapiens
cauggccuaugcac

SEQ ID NO: 1098557 - RNA, 16 nt, Homo sapiens
caugguuuugaaaugc

SEQ ID NO: 1098558 - RNA, 19 nt, Homo sapiens
cauguaaaccuaagcacgu

SEQ ID NO: 1098559 - RNA, 19 nt, Homo sapiens
cauguaaaugauuaucucc

SEQ ID NO: 1098560 - RNA, 12 nt, Homo sapiens
cauguacaugaa

SEQ ID NO: 1098561 - RNA, 15 nt, Homo sapiens
cauguaucuaugcau

SEQ ID NO: 1098562 - RNA, 13 nt, Homo sapiens
cauguaugucuug

SEQ ID NO: 1098563 - RNA, 17 nt, Homo sapiens
cauguaugucuuggaca

SEQ ID NO: 1098564 - RNA, 15 nt, Homo sapiens
caugucagacuguac

SEQ ID NO: 1098565 - RNA, 13 nt, Homo sapiens
cauguccucaaaa

SEQ ID NO: 1098566 - RNA, 15 nt, Homo sapiens
caugucucaauagua

SEQ ID NO: 1098567 - RNA, 22 nt, Homo sapiens
cauguggcuaaaugccuaauaa

SEQ ID NO: 1098568 - RNA, 22 nt, Homo sapiens
cauguguugccuggaagcacau

SEQ ID NO: 1098569 - RNA, 16 nt, Homo sapiens
cauguuacucaugacu

SEQ ID NO: 1098570 - RNA, 14 nt, Homo sapiens
cauuaaaaaugcau

SEQ ID NO: 1098571 - RNA, 13 nt, Homo sapiens
cauuacugcaugc

SEQ ID NO: 1098572 - RNA, 17 nt, Homo sapiens
cauuacugcaugcacuu

SEQ ID NO: 1098573 - RNA, 15 nt, Homo sapiens
cauuacuugcacaag

SEQ ID NO: 1098574 - RNA, 22 nt, Homo sapiens
cauuagaaacugaaaacuguaa

SEQ ID NO: 1098575 - RNA, 16 nt, Homo sapiens
cauuagcuacuuuuca

SEQ ID NO: 1098576 - RNA, 18 nt, Homo sapiens
cauuauaacugaaggaga

SEQ ID NO: 1098577 - RNA, 14 nt, Homo sapiens
cauucacagagccu

SEQ ID NO: 1098578 - RNA, 19 nt, Homo sapiens
cauucacauuugauguaca

SEQ ID NO: 1098579 - RNA, 14 nt, Homo sapiens
cauuccaccuuccc

SEQ ID NO: 1098580 - RNA, 11 nt, Homo sapiens
cauucccugag

SEQ ID NO: 1098581 - RNA, 18 nt, Homo sapiens
cauucucuuauauaguau

SEQ ID NO: 1098582 - RNA, 17 nt, Homo sapiens
cauucuggaaaagcaaa

SEQ ID NO: 1098583 - RNA, 23 nt, Homo sapiens
cauucuuguccuggcuggaccag

SEQ ID NO: 1098584 - RNA, 10 nt, Homo sapiens
cauugaacaa

SEQ ID NO: 1098585 - RNA, 23 nt, Homo sapiens
cauuucagagaggccuuuuggaa

SEQ ID NO: 1098586 - RNA, 15 nt, Homo sapiens
cauuucgccccucau

SEQ ID NO: 1098587 - RNA, 14 nt, Homo sapiens
cauuucuacuguga

SEQ ID NO: 1098588 - RNA, 21 nt, Homo sapiens
cauuucugucucucucugucc

SEQ ID NO: 1098589 - RNA, 14 nt, Homo sapiens
cauuugagugucuu

SEQ ID NO: 1098590 - RNA, 15 nt, Homo sapiens
cauuuguacugaccc

SEQ ID NO: 1098591 - RNA, 15 nt, Homo sapiens
cauuuuacugucugu

SEQ ID NO: 1098592 - RNA, 22 nt, Homo sapiens
cauuuuccaaaucuuaauucaa

SEQ ID NO: 1098593 - RNA, 21 nt, Homo sapiens
cauuuuuaguagagacagggu

SEQ ID NO: 1098594 - RNA, 13 nt, Homo sapiens
ccaaaaaccucac

SEQ ID NO: 1098595 - RNA, 20 nt, Homo sapiens
ccaaaaagggauccguacau

SEQ ID NO: 1098596 - RNA, 18 nt, Homo sapiens
ccaaaaucggaucugggg

SEQ ID NO: 1098597 - RNA, 18 nt, Homo sapiens
ccaaaauuacuucucucu

SEQ ID NO: 1098598 - RNA, 14 nt, Homo sapiens
ccaaaguaaauguc

SEQ ID NO: 1098599 - RNA, 15 nt, Homo sapiens
ccaaauaaauauauu

SEQ ID NO: 1098600 - RNA, 16 nt, Homo sapiens
ccaaauaaauguguaa

SEQ ID NO: 1098601 - RNA, 16 nt, Homo sapiens
ccaaauaagcaucugu

SEQ ID NO: 1098602 - RNA, 19 nt, Homo sapiens
ccaaauauaaacuugugua

SEQ ID NO: 1098603 - RNA, 21 nt, Homo sapiens
uggaaccaaucccgugaaaga

SEQ ID NO: 1098604 - RNA, 15 nt, Homo sapiens
uggaacccaggaccu

SEQ ID NO: 1098605 - RNA, 22 nt, Homo sapiens
uggaacccuggugucuccucca

SEQ ID NO: 1098606 - RNA, 18 nt, Homo sapiens
uggaacugucucucauga

SEQ ID NO: 1098607 - RNA, 17 nt, Homo sapiens
uggaagaggcaccuguc

SEQ ID NO: 1098608 - RNA, 14 nt, Homo sapiens
uggaagcacauguu

SEQ ID NO: 1098609 - RNA, 16 nt, Homo sapiens
uggaagcccuccuucc

SEQ ID NO: 1098610 - RNA, 21 nt, Homo sapiens
uggaagccggccggcugggau

SEQ ID NO: 1098611 - RNA, 17 nt, Homo sapiens
uggaauaaagcccuuga

SEQ ID NO: 1098612 - RNA, 19 nt, Homo sapiens
uggaauaaagcccuugaac

SEQ ID NO: 1098613 - RNA, 19 nt, Homo sapiens
uggaaucagcuuuuaauaa

SEQ ID NO: 1098614 - RNA, 21 nt, Homo sapiens
uggaauccuuucagcaagacu

SEQ ID NO: 1098615 - RNA, 19 nt, Homo sapiens
uggaauugcugcucucuga

SEQ ID NO: 1098616 - RNA, 16 nt, Homo sapiens
uggaauuuuucauuga

SEQ ID NO: 1098617 - RNA, 15 nt, Homo sapiens
uggaccaacccuguu

SEQ ID NO: 1098618 - RNA, 19 nt, Homo sapiens
uggaccuauguccuaagga

SEQ ID NO: 1098619 - RNA, 15 nt, Homo sapiens
uggacgaacaggggc

SEQ ID NO: 1098620 - RNA, 17 nt, Homo sapiens
uggacucugcacauguc

SEQ ID NO: 1098621 - RNA, 19 nt, Homo sapiens
uggagaaauaaaaauaccu

SEQ ID NO: 1098622 - RNA, 15 nt, Homo sapiens
uggagagaacugaau

SEQ ID NO: 1098623 - RNA, 17 nt, Homo sapiens
uggagauuggcucccaa

SEQ ID NO: 1098624 - RNA, 20 nt, Homo sapiens
uggagccaggaguuugagac

SEQ ID NO: 1098625 - RNA, 18 nt, Homo sapiens
uggaggaaagugauaucc

SEQ ID NO: 1098626 - RNA, 14 nt, Homo sapiens
uggagguugcagug

SEQ ID NO: 1098627 - RNA, 16 nt, Homo sapiens
uggagucugugucugc

SEQ ID NO: 1098628 - RNA, 23 nt, Homo sapiens
uggagugucaccagcugccaaaa

SEQ ID NO: 1098629 - RNA, 13 nt, Homo sapiens
uggaguucagaga

SEQ ID NO: 1098630 - RNA, 19 nt, Homo sapiens
uggaguugugaucauccca

SEQ ID NO: 1098631 - RNA, 15 nt, Homo sapiens
uggauagucugucca

SEQ ID NO: 1098632 - RNA, 22 nt, Homo sapiens
uggaugugcccacagggaccaa

SEQ ID NO: 1098633 - RNA, 13 nt, Homo sapiens
uggauguuuguca

SEQ ID NO: 1098634 - RNA, 13 nt, Homo sapiens
uggauucucuggg

SEQ ID NO: 1098635 - RNA, 19 nt, Homo sapiens
uggauuuacgacugaagaa

SEQ ID NO: 1098636 - RNA, 17 nt, Homo sapiens
uggcaaagguggcucuc

SEQ ID NO: 1098637 - RNA, 18 nt, Homo sapiens
uggcaacaacaaagccaa

SEQ ID NO: 1098638 - RNA, 15 nt, Homo sapiens
uggcaccacugcacu

SEQ ID NO: 1098639 - RNA, 11 nt, Homo sapiens
uggcagccacc

SEQ ID NO: 1098640 - RNA, 15 nt, Homo sapiens
uggcaucacagggca

SEQ ID NO: 1098641 - RNA, 18 nt, Homo sapiens
uggcauccccuuuauuaa

SEQ ID NO: 1098642 - RNA, 18 nt, Homo sapiens
uggcaucucuuucugcaa

SEQ ID NO: 1098643 - RNA, 19 nt, Homo sapiens
uggcauuaaagugcuguau

SEQ ID NO: 1098644 - RNA, 16 nt, Homo sapiens
uggcauucacacagcc

SEQ ID NO: 1098645 - RNA, 12 nt, Homo sapiens
uggccaagcuga

SEQ ID NO: 1098646 - RNA, 17 nt, Homo sapiens
uggccaggggacacugu

SEQ ID NO: 1098647 - RNA, 18 nt, Homo sapiens
uggccagugugaucccaa

SEQ ID NO: 1098648 - RNA, 19 nt, Homo sapiens
uggccaugcuucuugcccc

SEQ ID NO: 1098649 - RNA, 15 nt, Homo sapiens
uggcccaaauccagu

SEQ ID NO: 1098650 - RNA, 15 nt, Homo sapiens
uggccccugggccug

SEQ ID NO: 1098651 - RNA, 14 nt, Homo sapiens
uggcccuucuugcc

SEQ ID NO: 1098652 - RNA, 14 nt, Homo sapiens
uggccuaugcacau

SEQ ID NO: 1098653 - RNA, 15 nt, Homo sapiens
uggccuccugugcau

SEQ ID NO: 1098654 - RNA, 23 nt, Homo sapiens
uggccugcugggcucuccaccuc

SEQ ID NO: 1098655 - RNA, 12 nt, Homo sapiens
uggccuggcaca

SEQ ID NO: 1098656 - RNA, 18 nt, Homo sapiens
uggccuggcacacaucag

SEQ ID NO: 1098657 - RNA, 22 nt, Homo sapiens
uggcuacugggaaauuacuuau

SEQ ID NO: 1098658 - RNA, 17 nt, Homo sapiens
uggcuccaggacagacc

SEQ ID NO: 1098659 - RNA, 23 nt, Homo sapiens
uggcucccaucugaaccacuuug

SEQ ID NO: 1098660 - RNA, 15 nt, Homo sapiens
uggcucucagaaggu

SEQ ID NO: 1098661 - RNA, 14 nt, Homo sapiens
uggcugaaaaucac

SEQ ID NO: 1098662 - RNA, 12 nt, Homo sapiens
uggcugcaguga

SEQ ID NO: 1098663 - RNA, 15 nt, Homo sapiens
uggcuucuuacugaa

SEQ ID NO: 1098664 - RNA, 22 nt, Homo sapiens
ugggaagucguccuuacuccug

SEQ ID NO: 1098665 - RNA, 21 nt, Homo sapiens
ugggaaugacucugacuuuga

SEQ ID NO: 1098666 - RNA, 22 nt, Homo sapiens
ugggacuacaggugugagucac

SEQ ID NO: 1098667 - RNA, 12 nt, Homo sapiens
ugggacugagau

SEQ ID NO: 1098668 - RNA, 23 nt, Homo sapiens
ugggagagaaggagaucagggca

SEQ ID NO: 1098669 - RNA, 17 nt, Homo sapiens
ugggauuacagguguga

SEQ ID NO: 1098670 - RNA, 12 nt, Homo sapiens
ugggauucccac

SEQ ID NO: 1098671 - RNA, 22 nt, Homo sapiens
ugggcaaagcugugcacuugca

SEQ ID NO: 1098672 - RNA, 19 nt, Homo sapiens
ugggcaacaacagcaaaac

SEQ ID NO: 1098673 - RNA, 17 nt, Homo sapiens
ugggcaggaacugcagu

SEQ ID NO: 1098674 - RNA, 17 nt, Homo sapiens
ugggcccugcacagaua

SEQ ID NO: 1098675 - RNA, 21 nt, Homo sapiens
ugggccgggcaauccagacag

SEQ ID NO: 1098676 - RNA, 19 nt, Homo sapiens
ugggccugcugcugagaac

SEQ ID NO: 1098677 - RNA, 15 nt, Homo sapiens
uggggaagcugugaa

SEQ ID NO: 1098678 - RNA, 20 nt, Homo sapiens
uggggaguuauaaaaauaca

SEQ ID NO: 1098679 - RNA, 19 nt, Homo sapiens
uggggcagucucugcccaa

SEQ ID NO: 1098680 - RNA, 11 nt, Homo sapiens
uggggccugua

SEQ ID NO: 1098681 - RNA, 18 nt, Homo sapiens
uggggcuccuuucuccag

SEQ ID NO: 1098682 - RNA, 21 nt, Homo sapiens
uggggcuggaugucuccaucu

SEQ ID NO: 1098683 - RNA, 15 nt, Homo sapiens
ugggggaugugcacg

SEQ ID NO: 1098684 - RNA, 16 nt, Homo sapiens
ugguaaauuaguauuu

SEQ ID NO: 1098685 - RNA, 17 nt, Homo sapiens
ugguaaauuaguauuua

SEQ ID NO: 1098686 - RNA, 13 nt, Homo sapiens
ugguacaauccuu

SEQ ID NO: 1098687 - RNA, 14 nt, Homo sapiens
ugguaccagcucac

SEQ ID NO: 1098688 - RNA, 23 nt, Homo sapiens
acauauucuuggagaacuuucca

SEQ ID NO: 1098689 - RNA, 18 nt, Homo sapiens
acauauucuuuaaauuuc

SEQ ID NO: 1098690 - RNA, 17 nt, Homo sapiens
acaucacugaaaugcua

SEQ ID NO: 1098691 - RNA, 14 nt, Homo sapiens
acaucagcagagaa

SEQ ID NO: 1098692 - RNA, 15 nt, Homo sapiens
acaucaggaguucaa

SEQ ID NO: 1098693 - RNA, 21 nt, Homo sapiens
acauccaaggagaaacagaga

SEQ ID NO: 1098694 - RNA, 16 nt, Homo sapiens
acauccccagccagaa

SEQ ID NO: 1098695 - RNA, 20 nt, Homo sapiens
acaucuauuauaaaaccaug

SEQ ID NO: 1098696 - RNA, 14 nt, Homo sapiens
acaucucacuuugc

SEQ ID NO: 1098697 - RNA, 17 nt, Homo sapiens
acaucucuuugauguca

SEQ ID NO: 1098698 - RNA, 22 nt, Homo sapiens
acaucugugucucuggaaccca

SEQ ID NO: 1098699 - RNA, 18 nt, Homo sapiens
acaucuugcucugcugac

SEQ ID NO: 1098700 - RNA, 14 nt, Homo sapiens
acaugaagaagcua

SEQ ID NO: 1098701 - RNA, 18 nt, Homo sapiens
acaugaaucccacccaca

SEQ ID NO: 1098702 - RNA, 23 nt, Homo sapiens
acaugaaucccacccacauguga

SEQ ID NO: 1098703 - RNA, 23 nt, Homo sapiens
acaugaccuccguguagugucug

SEQ ID NO: 1098704 - RNA, 21 nt, Homo sapiens
acaugauggagcgcaccugcc

SEQ ID NO: 1098705 - RNA, 16 nt, Homo sapiens
acaugcaauuuugcau

SEQ ID NO: 1098706 - RNA, 15 nt, Homo sapiens
acaugcacgugugug

SEQ ID NO: 1098707 - RNA, 21 nt, Homo sapiens
acaugcacuuggcugcauaaa

SEQ ID NO: 1098708 - RNA, 22 nt, Homo sapiens
acaugcauuacugcaugcacuu

SEQ ID NO: 1098709 - RNA, 20 nt, Homo sapiens
acauggaauuaccuuagauu

SEQ ID NO: 1098710 - RNA, 19 nt, Homo sapiens
acauggacacaccagagug

SEQ ID NO: 1098711 - RNA, 23 nt, Homo sapiens
acauggugaaaccucaucucuac

SEQ ID NO: 1098712 - RNA, 19 nt, Homo sapiens
acaugucuuguacaugugu

SEQ ID NO: 1098713 - RNA, 12 nt, Homo sapiens
acaugugcacau

SEQ ID NO: 1098714 - RNA, 16 nt, Homo sapiens
acaugugcacaugcac

SEQ ID NO: 1098715 - RNA, 22 nt, Homo sapiens
acauguguagccugugcaugua

SEQ ID NO: 1098716 - RNA, 15 nt, Homo sapiens
acauucccccaacau

SEQ ID NO: 1098717 - RNA, 23 nt, Homo sapiens
acauucccuaucaaaacauauca

SEQ ID NO: 1098718 - RNA, 23 nt, Homo sapiens
acauucccuuggauguagucuga

SEQ ID NO: 1098719 - RNA, 20 nt, Homo sapiens
acauuccucugcagcacuuc

SEQ ID NO: 1098720 - RNA, 19 nt, Homo sapiens
acauuccugauacugggua

SEQ ID NO: 1098721 - RNA, 19 nt, Homo sapiens
acauucuggaaaagcaaaa

SEQ ID NO: 1098722 - RNA, 22 nt, Homo sapiens
acauucuuguuuuaagugccuu

SEQ ID NO: 1098723 - RNA, 20 nt, Homo sapiens
acauuggcagugugucacac

SEQ ID NO: 1098724 - RNA, 13 nt, Homo sapiens
acauuuacaauaa

SEQ ID NO: 1098725 - RNA, 18 nt, Homo sapiens
acauuucuauagccaaaa

SEQ ID NO: 1098726 - RNA, 15 nt, Homo sapiens
acauuuucucuuuaa

SEQ ID NO: 1098727 - RNA, 13 nt, Homo sapiens
accaaagagacug

SEQ ID NO: 1098728 - RNA, 21 nt, Homo sapiens
accaaagagacuggagcaucu

SEQ ID NO: 1098729 - RNA, 11 nt, Homo sapiens
accaaaucauc

SEQ ID NO: 1098730 - RNA, 23 nt, Homo sapiens
accaaaucuugguugaugccaaa

SEQ ID NO: 1098731 - RNA, 14 nt, Homo sapiens
accaacauggagaa

SEQ ID NO: 1098732 - RNA, 17 nt, Homo sapiens
accaacuggagcacuga

SEQ ID NO: 1098733 - RNA, 20 nt, Homo sapiens
accaagaugaucacauggaa

SEQ ID NO: 1098734 - RNA, 14 nt, Homo sapiens
accaauaacuucag

SEQ ID NO: 1098735 - RNA, 16 nt, Homo sapiens
accaauaccuccucca

SEQ ID NO: 1098736 - RNA, 22 nt, Homo sapiens
accaauguugugauuaacauca

SEQ ID NO: 1098737 - RNA, 13 nt, Homo sapiens
accacagcugcag

SEQ ID NO: 1098738 - RNA, 13 nt, Homo sapiens
accacagugucug

SEQ ID NO: 1098739 - RNA, 19 nt, Homo sapiens
acgaggagcuuccagugca

SEQ ID NO: 1098740 - RNA, 20 nt, Homo sapiens
acgcagccugcagacucacu

SEQ ID NO: 1098741 - RNA, 20 nt, Homo sapiens
acgccacucauuucaucuca

SEQ ID NO: 1098742 - RNA, 15 nt, Homo sapiens
acgccuaugauccca

SEQ ID NO: 1098743 - RNA, 13 nt, Homo sapiens
acgccuguagucc

SEQ ID NO: 1098744 - RNA, 19 nt, Homo sapiens
acgccuguaguccuagcca

SEQ ID NO: 1098745 - RNA, 12 nt, Homo sapiens
acgcgugcacac

SEQ ID NO: 1098746 - RNA, 20 nt, Homo sapiens
acgcgugcacacaccagagc

SEQ ID NO: 1098747 - RNA, 16 nt, Homo sapiens
acgcucauuguagaaa

SEQ ID NO: 1098748 - RNA, 13 nt, Homo sapiens
acgcucucugucu

SEQ ID NO: 1098749 - RNA, 12 nt, Homo sapiens
acggccagcugc

SEQ ID NO: 1098750 - RNA, 16 nt, Homo sapiens
acgucccaugugcaug

SEQ ID NO: 1098751 - RNA, 14 nt, Homo sapiens
acgugagccaggua

SEQ ID NO: 1098752 - RNA, 10 nt, Homo sapiens
acgugcaaua

SEQ ID NO: 1098753 - RNA, 18 nt, Homo sapiens
acgugcucuucuguucuc

SEQ ID NO: 1098754 - RNA, 15 nt, Homo sapiens
acguguccuacagcc

SEQ ID NO: 1098755 - RNA, 20 nt, Homo sapiens
acgugugugcacguacacac

SEQ ID NO: 1098756 - RNA, 18 nt, Homo sapiens
acguguucucacacuggu

SEQ ID NO: 1098757 - RNA, 22 nt, Homo sapiens
acguugccuaauaaacauccuu

SEQ ID NO: 1098758 - RNA, 16 nt, Homo sapiens
acguuuauagccgaaa

SEQ ID NO: 1098759 - RNA, 23 nt, Homo sapiens
acguuuggcauuucucuuugaga

SEQ ID NO: 1098760 - RNA, 14 nt, Homo sapiens
acuaaaaauauuau

SEQ ID NO: 1098761 - RNA, 20 nt, Homo sapiens
acuaagcaguaagcuaucuu

SEQ ID NO: 1098762 - RNA, 17 nt, Homo sapiens
acuaaggugugcucuga

SEQ ID NO: 1098763 - RNA, 13 nt, Homo sapiens
acuacagccagaa

SEQ ID NO: 1098764 - RNA, 18 nt, Homo sapiens
acuaccaaaugagcauua

SEQ ID NO: 1098765 - RNA, 21 nt, Homo sapiens
acuaccggcuacaucaaauca

SEQ ID NO: 1098766 - RNA, 21 nt, Homo sapiens
acuacgugccaggcacuguug

SEQ ID NO: 1098767 - RNA, 20 nt, Homo sapiens
acuacugcugcaaagugcaa

SEQ ID NO: 1098768 - RNA, 20 nt, Homo sapiens
acuacuugccacacacuguu

SEQ ID NO: 1098769 - RNA, 15 nt, Homo sapiens
acuagaacucuccau

SEQ ID NO: 1098770 - RNA, 19 nt, Homo sapiens
acuagucacauucuuguuu

SEQ ID NO: 1098771 - RNA, 17 nt, Homo sapiens
acuaguugaacaucuca

SEQ ID NO: 1098772 - RNA, 23 nt, Homo sapiens
acuaguugaacaucucacuuugc

SEQ ID NO: 1098773 - RNA, 15 nt, Homo sapiens
acuauaaacauuaaa

SEQ ID NO: 1098774 - RNA, 22 nt, Homo sapiens
acuauaaauaauauucuauuca

SEQ ID NO: 1098775 - RNA, 22 nt, Homo sapiens
acuauagccuaggugacagagu

SEQ ID NO: 1098776 - RNA, 16 nt, Homo sapiens
acuaugacacugagca

SEQ ID NO: 1098777 - RNA, 22 nt, Homo sapiens
acuauuaaaacuaauaaucacc

SEQ ID NO: 1098778 - RNA, 23 nt, Homo sapiens
acuauuaacaacuugucuauuac

SEQ ID NO: 1098779 - RNA, 19 nt, Homo sapiens
auuacuccauuacuaaaga

SEQ ID NO: 1098780 - RNA, 14 nt, Homo sapiens
auuacugauuuugu

SEQ ID NO: 1098781 - RNA, 13 nt, Homo sapiens
auuacugcaugca

SEQ ID NO: 1098782 - RNA, 16 nt, Homo sapiens
auuacugcaugcacuu

SEQ ID NO: 1098783 - RNA, 20 nt, Homo sapiens
auuagacaugaaaucugagg

SEQ ID NO: 1098784 - RNA, 13 nt, Homo sapiens
auuagaggaagaa

SEQ ID NO: 1098785 - RNA, 21 nt, Homo sapiens
auuagaggaagaaaaccagcg

SEQ ID NO: 1098786 - RNA, 16 nt, Homo sapiens
auuagauguuuuacaa

SEQ ID NO: 1098787 - RNA, 19 nt, Homo sapiens
auuagcaauugacugucac

SEQ ID NO: 1098788 - RNA, 18 nt, Homo sapiens
auuagccgggcauggugg

SEQ ID NO: 1098789 - RNA, 16 nt, Homo sapiens
auuagcucuggaccag

SEQ ID NO: 1098790 - RNA, 14 nt, Homo sapiens
auuaguauccuguu

SEQ ID NO: 1098791 - RNA, 16 nt, Homo sapiens
auuaguugagaaagaa

SEQ ID NO: 1098792 - RNA, 15 nt, Homo sapiens
auuauaaaggccagc

SEQ ID NO: 1098793 - RNA, 18 nt, Homo sapiens
auuaucgggaacaguguu

SEQ ID NO: 1098794 - RNA, 18 nt, Homo sapiens
auuaugccauagcaagau

SEQ ID NO: 1098795 - RNA, 18 nt, Homo sapiens
auuaugguguaaugcaca

SEQ ID NO: 1098796 - RNA, 12 nt, Homo sapiens
auuauguacaaa

SEQ ID NO: 1098797 - RNA, 17 nt, Homo sapiens
auuauuguugcauuaaa

SEQ ID NO: 1098798 - RNA, 20 nt, Homo sapiens
auucaaaagguuauauacca

SEQ ID NO: 1098799 - RNA, 15 nt, Homo sapiens
auucaagccugugaa

SEQ ID NO: 1098800 - RNA, 21 nt, Homo sapiens
auucacaauagaaacucacca

SEQ ID NO: 1098801 - RNA, 12 nt, Homo sapiens
auucacaaugaa

SEQ ID NO: 1098802 - RNA, 15 nt, Homo sapiens
auucacuuuaccuuc

SEQ ID NO: 1098803 - RNA, 15 nt, Homo sapiens
auucauguggaauau

SEQ ID NO: 1098804 - RNA, 21 nt, Homo sapiens
auucauuuuaacaucugagaa

SEQ ID NO: 1098805 - RNA, 22 nt, Homo sapiens
auuccaacagcucaagucuucc

SEQ ID NO: 1098806 - RNA, 17 nt, Homo sapiens
auuccagaccugaagaa

SEQ ID NO: 1098807 - RNA, 19 nt, Homo sapiens
auucccuuggauguagucu

SEQ ID NO: 1098808 - RNA, 13 nt, Homo sapiens
auuccgucuuaaa

SEQ ID NO: 1098809 - RNA, 14 nt, Homo sapiens
auuccuacaaagau

SEQ ID NO: 1098810 - RNA, 15 nt, Homo sapiens
auuccuagaaguuga

SEQ ID NO: 1098811 - RNA, 14 nt, Homo sapiens
auuccuugauucac

SEQ ID NO: 1098812 - RNA, 20 nt, Homo sapiens
auucuaaaugaauguuuaca

SEQ ID NO: 1098813 - RNA, 17 nt, Homo sapiens
auucuacccagagccuu

SEQ ID NO: 1098814 - RNA, 20 nt, Homo sapiens
auucuagccaaacuauucua

SEQ ID NO: 1098815 - RNA, 17 nt, Homo sapiens
auucuaguguaacacug

SEQ ID NO: 1098816 - RNA, 18 nt, Homo sapiens
auucuauuacgugcaaua

SEQ ID NO: 1098817 - RNA, 15 nt, Homo sapiens
auucucaaccuacca

SEQ ID NO: 1098818 - RNA, 19 nt, Homo sapiens
auucucaguguagggcaga

SEQ ID NO: 1098819 - RNA, 22 nt, Homo sapiens
auucucaguguagggcagagag

SEQ ID NO: 1098820 - RNA, 19 nt, Homo sapiens
auucucauuugucacacac

SEQ ID NO: 1098821 - RNA, 18 nt, Homo sapiens
auucucuccucagacugc

SEQ ID NO: 1098822 - RNA, 15 nt, Homo sapiens
auucucuuacugcuu

SEQ ID NO: 1098823 - RNA, 11 nt, Homo sapiens
auucugaccau

SEQ ID NO: 1098824 - RNA, 18 nt, Homo sapiens
auucugauucgaaugaca

SEQ ID NO: 1098825 - RNA, 18 nt, Homo sapiens
auucugcucuuugauuca

SEQ ID NO: 1098826 - RNA, 22 nt, Homo sapiens
auucuuaaaauauauuucagau

SEQ ID NO: 1098827 - RNA, 15 nt, Homo sapiens
auucuugaguucugg

SEQ ID NO: 1098828 - RNA, 13 nt, Homo sapiens
auucuuggaauac

SEQ ID NO: 1098829 - RNA, 15 nt, Homo sapiens
auucuuguccuggcu

SEQ ID NO: 1098830 - RNA, 19 nt, Homo sapiens
auucuuguuuuaagugccu

SEQ ID NO: 1098831 - RNA, 24 nt, Homo sapiens
auugaacuuucacauagcacagaa

SEQ ID NO: 1098832 - RNA, 17 nt, Homo sapiens
auugaagaaaagcacuu

SEQ ID NO: 1098833 - RNA, 21 nt, Homo sapiens
auugaaucccuuaaacucagg

SEQ ID NO: 1098834 - RNA, 15 nt, Homo sapiens
auugacaacauuuua

SEQ ID NO: 1098835 - RNA, 17 nt, Homo sapiens
auugacuaucaaacuga

SEQ ID NO: 1098836 - RNA, 16 nt, Homo sapiens
caaauaucuugaaagg

SEQ ID NO: 1098837 - RNA, 16 nt, Homo sapiens
caaauauuaccaaaaa

SEQ ID NO: 1098838 - RNA, 20 nt, Homo sapiens
caaaucaucucucaucacuu

SEQ ID NO: 1098839 - RNA, 14 nt, Homo sapiens
caaaucccacaggg

SEQ ID NO: 1098840 - RNA, 21 nt, Homo sapiens
caaaucuugguugaugccaaa

SEQ ID NO: 1098841 - RNA, 15 nt, Homo sapiens
caaaugacccaaaga

SEQ ID NO: 1098842 - RNA, 11 nt, Homo sapiens
caaaugagauc

SEQ ID NO: 1098843 - RNA, 23 nt, Homo sapiens
caaauguaaaauaaguauuucca

SEQ ID NO: 1098844 - RNA, 13 nt, Homo sapiens
caaaugucuaagg

SEQ ID NO: 1098845 - RNA, 15 nt, Homo sapiens
caaauuaaggcauaa

SEQ ID NO: 1098846 - RNA, 16 nt, Homo sapiens
caaauucuuuuucaca

SEQ ID NO: 1098847 - RNA, 16 nt, Homo sapiens
caaauuggauacugcu

SEQ ID NO: 1098848 - RNA, 19 nt, Homo sapiens
caacaaagccaacagucaa

SEQ ID NO: 1098849 - RNA, 23 nt, Homo sapiens
caacaaauuagguuuuguacaau

SEQ ID NO: 1098850 - RNA, 12 nt, Homo sapiens
caacaacaugua

SEQ ID NO: 1098851 - RNA, 15 nt, Homo sapiens
caacaagucuugaaa

SEQ ID NO: 1098852 - RNA, 16 nt, Homo sapiens
caacaggaaucucaga

SEQ ID NO: 1098853 - RNA, 15 nt, Homo sapiens
caacauaacugaagg

SEQ ID NO: 1098854 - RNA, 14 nt, Homo sapiens
caacauaccagacc

SEQ ID NO: 1098855 - RNA, 14 nt, Homo sapiens
caacaucccauugc

SEQ ID NO: 1098856 - RNA, 12 nt, Homo sapiens
caacaugacugu

SEQ ID NO: 1098857 - RNA, 16 nt, Homo sapiens
caacaugcgaccguga

SEQ ID NO: 1098858 - RNA, 21 nt, Homo sapiens
caacaugguaaaaccccaucu

SEQ ID NO: 1098859 - RNA, 21 nt, Homo sapiens
caacauggugaaaccucaucu

SEQ ID NO: 1098860 - RNA, 23 nt, Homo sapiens
caacauuacuccauuacuaaaga

SEQ ID NO: 1098861 - RNA, 18 nt, Homo sapiens
caaccaaagacacugucc

SEQ ID NO: 1098862 - RNA, 21 nt, Homo sapiens
caaccacuguaaaaugaaauu

SEQ ID NO: 1098863 - RNA, 20 nt, Homo sapiens
caaccccuucgcuccugugu

SEQ ID NO: 1098864 - RNA, 21 nt, Homo sapiens
caacccgugccaaguccaggu

SEQ ID NO: 1098865 - RNA, 15 nt, Homo sapiens
caacccuguuuccug

SEQ ID NO: 1098866 - RNA, 12 nt, Homo sapiens
acugacuccuua

SEQ ID NO: 1098867 - RNA, 14 nt, Homo sapiens
acugagccuagcua

SEQ ID NO: 1098868 - RNA, 19 nt, Homo sapiens
acugagcugggcaccacag

SEQ ID NO: 1098869 - RNA, 14 nt, Homo sapiens
acugaggcagacag

SEQ ID NO: 1098870 - RNA, 19 nt, Homo sapiens
acugaugacaaacccagga

SEQ ID NO: 1098871 - RNA, 21 nt, Homo sapiens
acugauguuacaucacagugu

SEQ ID NO: 1098872 - RNA, 20 nt, Homo sapiens
acugcacacaugguuuccaa

SEQ ID NO: 1098873 - RNA, 20 nt, Homo sapiens
acugcacuauagccuaggug

SEQ ID NO: 1098874 - RNA, 13 nt, Homo sapiens
acugcaucucaaa

SEQ ID NO: 1098875 - RNA, 18 nt, Homo sapiens
acugcaugcacuucuuac

SEQ ID NO: 1098876 - RNA, 18 nt, Homo sapiens
acugcgaucuucagagca

SEQ ID NO: 1098877 - RNA, 17 nt, Homo sapiens
acugcucaucauuccuu

SEQ ID NO: 1098878 - RNA, 15 nt, Homo sapiens
acugcucgucuauca

SEQ ID NO: 1098879 - RNA, 22 nt, Homo sapiens
acugcugcccagccuccaagcu

SEQ ID NO: 1098880 - RNA, 20 nt, Homo sapiens
acugcuguucauguuacuca

SEQ ID NO: 1098881 - RNA, 20 nt, Homo sapiens
acuggacuugagcuuggcag

SEQ ID NO: 1098882 - RNA, 19 nt, Homo sapiens
acugggcaaugauggcaau

SEQ ID NO: 1098883 - RNA, 23 nt, Homo sapiens
acugguuucucagaauccaaaga

SEQ ID NO: 1098884 - RNA, 20 nt, Homo sapiens
acuguaauuaaguaaaccaa

SEQ ID NO: 1098885 - RNA, 21 nt, Homo sapiens
acuguaauuaaguaaaccaaa

SEQ ID NO: 1098886 - RNA, 22 nt, Homo sapiens
acuguaauuggugacaauguca

SEQ ID NO: 1098887 - RNA, 21 nt, Homo sapiens
acugucccucaaaugacccaa

SEQ ID NO: 1098888 - RNA, 16 nt, Homo sapiens
acuguccuacccaccc

SEQ ID NO: 1098889 - RNA, 16 nt, Homo sapiens
acugucuugaagacaa

SEQ ID NO: 1098890 - RNA, 13 nt, Homo sapiens
acuguuccaaaaa

SEQ ID NO: 1098891 - RNA, 14 nt, Homo sapiens
acuguuucucucac

SEQ ID NO: 1098892 - RNA, 22 nt, Homo sapiens
acuguuuuuauaugcacaugua

SEQ ID NO: 1098893 - RNA, 21 nt, Homo sapiens
acuuaauguuugguaacuuuu

SEQ ID NO: 1098894 - RNA, 11 nt, Homo sapiens
acuuacaugau

SEQ ID NO: 1098895 - RNA, 14 nt, Homo sapiens
acuuacaugcauua

SEQ ID NO: 1098896 - RNA, 15 nt, Homo sapiens
acuuauuucauaaac

SEQ ID NO: 1098897 - RNA, 19 nt, Homo sapiens
acuuauuucauaaacaacu

SEQ ID NO: 1098898 - RNA, 13 nt, Homo sapiens
acuucaagugacc

SEQ ID NO: 1098899 - RNA, 13 nt, Homo sapiens
acuucaagugcau

SEQ ID NO: 1098900 - RNA, 17 nt, Homo sapiens
acuucacaaaaugcaag

SEQ ID NO: 1098901 - RNA, 18 nt, Homo sapiens
acuucaguugcuuugcag

SEQ ID NO: 1098902 - RNA, 16 nt, Homo sapiens
acuucauaaauguuca

SEQ ID NO: 1098903 - RNA, 18 nt, Homo sapiens
acuucaugaggaggucag

SEQ ID NO: 1098904 - RNA, 19 nt, Homo sapiens
acuucauuugaugcuaaau

SEQ ID NO: 1098905 - RNA, 11 nt, Homo sapiens
acuucccugaa

SEQ ID NO: 1098906 - RNA, 14 nt, Homo sapiens
acuuccugcacuga

SEQ ID NO: 1098907 - RNA, 15 nt, Homo sapiens
acuucuaaaugaagu

SEQ ID NO: 1098908 - RNA, 12 nt, Homo sapiens
augagaaucacu

SEQ ID NO: 1098909 - RNA, 16 nt, Homo sapiens
augagaccacuguuau

SEQ ID NO: 1098910 - RNA, 17 nt, Homo sapiens
augagaccacuguuauc

SEQ ID NO: 1098911 - RNA, 23 nt, Homo sapiens
augagaguuucuguuaaucaugu

SEQ ID NO: 1098912 - RNA, 16 nt, Homo sapiens
augagggaaaaugagu

SEQ ID NO: 1098913 - RNA, 20 nt, Homo sapiens
augaguuuuugauagcuuua

SEQ ID NO: 1098914 - RNA, 16 nt, Homo sapiens
augauaauuuacuuaa

SEQ ID NO: 1098915 - RNA, 14 nt, Homo sapiens
augaucacggcuca

SEQ ID NO: 1098916 - RNA, 17 nt, Homo sapiens
augaucagcuguuuguc

SEQ ID NO: 1098917 - RNA, 20 nt, Homo sapiens
augaucuuugcagacaggca

SEQ ID NO: 1098918 - RNA, 18 nt, Homo sapiens
augaugaccaagaauuac

SEQ ID NO: 1098919 - RNA, 22 nt, Homo sapiens
augaugaguaacuuaaccagca

SEQ ID NO: 1098920 - RNA, 19 nt, Homo sapiens
augauggcaccacugcacu

SEQ ID NO: 1098921 - RNA, 19 nt, Homo sapiens
augauuucaugcuaucucu

SEQ ID NO: 1098922 - RNA, 15 nt, Homo sapiens
augcaacaacaugua

SEQ ID NO: 1098923 - RNA, 22 nt, Homo sapiens
augcaaggaaggaaagaaagaa

SEQ ID NO: 1098924 - RNA, 20 nt, Homo sapiens
augcacauauggacucugca

SEQ ID NO: 1098925 - RNA, 14 nt, Homo sapiens
augcaccagugccg

SEQ ID NO: 1098926 - RNA, 17 nt, Homo sapiens
augcaccccaacauuga

SEQ ID NO: 1098927 - RNA, 19 nt, Homo sapiens
augcacuuggcugcauaaa

SEQ ID NO: 1098928 - RNA, 20 nt, Homo sapiens
augcacuuggcugcauaaau

SEQ ID NO: 1098929 - RNA, 16 nt, Homo sapiens
augcauuugcacuauu

SEQ ID NO: 1098930 - RNA, 17 nt, Homo sapiens
augccacccuguuuuca

SEQ ID NO: 1098931 - RNA, 19 nt, Homo sapiens
augccagggacugacaaaa

SEQ ID NO: 1098932 - RNA, 17 nt, Homo sapiens
augccagugaaacuuca

SEQ ID NO: 1098933 - RNA, 22 nt, Homo sapiens
augccagugaaacuucaagcaa

SEQ ID NO: 1098934 - RNA, 17 nt, Homo sapiens
augcccucaaucccagc

SEQ ID NO: 1098935 - RNA, 17 nt, Homo sapiens
augccgcccccagcagc

SEQ ID NO: 1098936 - RNA, 17 nt, Homo sapiens
augccugguggcagcug

SEQ ID NO: 1098937 - RNA, 19 nt, Homo sapiens
augccuucacuuuacaaau

SEQ ID NO: 1098938 - RNA, 16 nt, Homo sapiens
augcgcacaaggcuga

SEQ ID NO: 1098939 - RNA, 19 nt, Homo sapiens
augcguacguuuccugaga

SEQ ID NO: 1098940 - RNA, 17 nt, Homo sapiens
augcucaaccacugugg

SEQ ID NO: 1098941 - RNA, 20 nt, Homo sapiens
augcuggacggcauuccugc

SEQ ID NO: 1098942 - RNA, 20 nt, Homo sapiens
augcuucaguuguacuucca

SEQ ID NO: 1098943 - RNA, 13 nt, Homo sapiens
augcuucuugccc

SEQ ID NO: 1098944 - RNA, 14 nt, Homo sapiens
gcuggggagggaga

SEQ ID NO: 1098945 - RNA, 16 nt, Homo sapiens
gcuggugccccacuga

SEQ ID NO: 1098946 - RNA, 21 nt, Homo sapiens
gcuggugucugagcuucagua

SEQ ID NO: 1098947 - RNA, 20 nt, Homo sapiens
gcugguuuuccuaaaugcag

SEQ ID NO: 1098948 - RNA, 14 nt, Homo sapiens
gcuguacacugcac

SEQ ID NO: 1098949 - RNA, 18 nt, Homo sapiens
gcugugaaagaaccaaaa

SEQ ID NO: 1098950 - RNA, 15 nt, Homo sapiens
gcuguggccagggug

SEQ ID NO: 1098951 - RNA, 16 nt, Homo sapiens
gcuguuauucuuccac

SEQ ID NO: 1098952 - RNA, 15 nt, Homo sapiens
gcuguuccacuucuc

SEQ ID NO: 1098953 - RNA, 13 nt, Homo sapiens
gcuguugccucau

SEQ ID NO: 1098954 - RNA, 18 nt, Homo sapiens
gcuuaaaacaacacucac

SEQ ID NO: 1098955 - RNA, 13 nt, Homo sapiens
gcuuagaccucag

SEQ ID NO: 1098956 - RNA, 12 nt, Homo sapiens
gcuuauggccag

SEQ ID NO: 1098957 - RNA, 19 nt, Homo sapiens
gcuuauuguacuuguuauc

SEQ ID NO: 1098958 - RNA, 13 nt, Homo sapiens
gcuuccagugcau

SEQ ID NO: 1098959 - RNA, 12 nt, Homo sapiens
gcuuccuaacug

SEQ ID NO: 1098960 - RNA, 22 nt, Homo sapiens
gcuuccuuagguugaugcugga

SEQ ID NO: 1098961 - RNA, 17 nt, Homo sapiens
gcuuccuucauuuccuc

SEQ ID NO: 1098962 - RNA, 16 nt, Homo sapiens
gcuucuggagcccuug

SEQ ID NO: 1098963 - RNA, 11 nt, Homo sapiens
gcuugccauau

SEQ ID NO: 1098964 - RNA, 21 nt, Homo sapiens
gcuugccccacccaacaagcc

SEQ ID NO: 1098965 - RNA, 23 nt, Homo sapiens
gcuuggaaacuggaugaggucau

SEQ ID NO: 1098966 - RNA, 20 nt, Homo sapiens
gcuuguaaauagcucaggug

SEQ ID NO: 1098967 - RNA, 14 nt, Homo sapiens
gcuuuaacaaaaca

SEQ ID NO: 1098968 - RNA, 20 nt, Homo sapiens
gcuuuauuuuuuaaguauuu

SEQ ID NO: 1098969 - RNA, 18 nt, Homo sapiens
gcuuucaugaacacagcc

SEQ ID NO: 1098970 - RNA, 19 nt, Homo sapiens
gcuuugacucaccuguuac

SEQ ID NO: 1098971 - RNA, 19 nt, Homo sapiens
ggaaaaaccaauagcuuua

SEQ ID NO: 1098972 - RNA, 12 nt, Homo sapiens
ggaaaaugugac

SEQ ID NO: 1098973 - RNA, 20 nt, Homo sapiens
ggaaacagcuaaugggacac

SEQ ID NO: 1098974 - RNA, 17 nt, Homo sapiens
ggaaacuggaugagguc

SEQ ID NO: 1098975 - RNA, 16 nt, Homo sapiens
ggaaagaaaugcccau

SEQ ID NO: 1098976 - RNA, 16 nt, Homo sapiens
ggaaagcaucaccuca

SEQ ID NO: 1098977 - RNA, 14 nt, Homo sapiens
ggaaaggauucaug

SEQ ID NO: 1098978 - RNA, 17 nt, Homo sapiens
ggaaaguaaauauuuca

SEQ ID NO: 1098979 - RNA, 18 nt, Homo sapiens
ggaaaguaaauauuucag

SEQ ID NO: 1098980 - RNA, 18 nt, Homo sapiens
ggaacagaaggaugaaug

SEQ ID NO: 1098981 - RNA, 12 nt, Homo sapiens
ggaacagugcag

SEQ ID NO: 1098982 - RNA, 13 nt, Homo sapiens
ggaaccaugaagc

SEQ ID NO: 1098983 - RNA, 22 nt, Homo sapiens
ggaacccccagaauaaauaugc

SEQ ID NO: 1098984 - RNA, 23 nt, Homo sapiens
ggaacugggccaacucaccugag

SEQ ID NO: 1098985 - RNA, 10 nt, Homo sapiens
ggaacuuccu

SEQ ID NO: 1098986 - RNA, 12 nt, Homo sapiens
ggaagaccaaga

SEQ ID NO: 1098987 - RNA, 19 nt, Homo sapiens
ggaagagagagacccucac

SEQ ID NO: 1098988 - RNA, 16 nt, Homo sapiens
ggaagcccuugccuga

SEQ ID NO: 1098989 - RNA, 21 nt, Homo sapiens
ggaagcuccgcuuucuaccca

SEQ ID NO: 1098990 - RNA, 22 nt, Homo sapiens
ggaagguagcccagcacuguga

SEQ ID NO: 1098991 - RNA, 19 nt, Homo sapiens
ggaaggucccuuguuucca

SEQ ID NO: 1098992 - RNA, 23 nt, Homo sapiens
ggaagugaagagggagaagggau

SEQ ID NO: 1098993 - RNA, 18 nt, Homo sapiens
ggaauaaagcccuugaac

SEQ ID NO: 1098994 - RNA, 16 nt, Homo sapiens
ggaauaagaagcaaau

SEQ ID NO: 1098995 - RNA, 21 nt, Homo sapiens
ggaaugugccucggccuccaa

SEQ ID NO: 1098996 - RNA, 20 nt, Homo sapiens
ggacaaaggagccugugaac

SEQ ID NO: 1098997 - RNA, 13 nt, Homo sapiens
ggacacuuguaug

SEQ ID NO: 1098998 - RNA, 21 nt, Homo sapiens
ggacagcgccaccucuuguca

SEQ ID NO: 1098999 - RNA, 17 nt, Homo sapiens
ggacaggacuaacacuc

SEQ ID NO: 1099000 - RNA, 22 nt, Homo sapiens
ggaccaggacuauagcccaggu

SEQ ID NO: 1099001 - RNA, 13 nt, Homo sapiens
ggaccucugcucu

SEQ ID NO: 1099002 - RNA, 17 nt, Homo sapiens
ggacuacaggcacccac

SEQ ID NO: 1099003 - RNA, 16 nt, Homo sapiens
ggacuaugaaaagcua

SEQ ID NO: 1099004 - RNA, 20 nt, Homo sapiens
ggacuauggguacauuccac

SEQ ID NO: 1099005 - RNA, 22 nt, Homo sapiens
ggacucaaugcacugacauugu

SEQ ID NO: 1099006 - RNA, 23 nt, Homo sapiens
ggacucaaugcacugacauuguu

SEQ ID NO: 1099007 - RNA, 17 nt, Homo sapiens
ggacuggaaccagggag

SEQ ID NO: 1099008 - RNA, 16 nt, Homo sapiens
ggacuuacuauuuauu

SEQ ID NO: 1099009 - RNA, 15 nt, Homo sapiens
ggacuuggaagcucc

SEQ ID NO: 1099010 - RNA, 18 nt, Homo sapiens
ggagaagaaagaggugac

SEQ ID NO: 1099011 - RNA, 17 nt, Homo sapiens
ggagacaaaacuagaga

SEQ ID NO: 1099012 - RNA, 18 nt, Homo sapiens
ggagacggccaagugaag

SEQ ID NO: 1099013 - RNA, 13 nt, Homo sapiens
ggagagaaguuuc

SEQ ID NO: 1099014 - RNA, 11 nt, Homo sapiens
ggagagccaga

SEQ ID NO: 1099015 - RNA, 15 nt, Homo sapiens
ggagagcccagccau

SEQ ID NO: 1099016 - RNA, 15 nt, Homo sapiens
ggagaggcauggcug

SEQ ID NO: 1099017 - RNA, 18 nt, Homo sapiens
ggagaggggaagggccag

SEQ ID NO: 1099018 - RNA, 21 nt, Homo sapiens
ggagaguacagugagccaaga

SEQ ID NO: 1099019 - RNA, 14 nt, Homo sapiens
ggagcaaauguuuc

SEQ ID NO: 1099020 - RNA, 13 nt, Homo sapiens
ggagcaacagagg

SEQ ID NO: 1099021 - RNA, 12 nt, Homo sapiens
ggagcacugggu

SEQ ID NO: 1099022 - RNA, 15 nt, Homo sapiens
ggagcaucugacuca

SEQ ID NO: 1099023 - RNA, 21 nt, Homo sapiens
ggagccucgguggccaugcuu

SEQ ID NO: 1099024 - RNA, 15 nt, Homo sapiens
ggagccugaggcaug

SEQ ID NO: 1099025 - RNA, 19 nt, Homo sapiens
ggaggacgguuaacuugua

SEQ ID NO: 1099026 - RNA, 22 nt, Homo sapiens
ggaggccgaagcuaacagggaa

SEQ ID NO: 1099027 - RNA, 20 nt, Homo sapiens
ggaggcggagguuccaguga

SEQ ID NO: 1099028 - RNA, 15 nt, Homo sapiens
ggaggcugaggcaag

SEQ ID NO: 1099029 - RNA, 22 nt, Homo sapiens
ggaggucccugccaguguuuag

SEQ ID NO: 1099030 - RNA, 14 nt, Homo sapiens
ggaggucgacccca

SEQ ID NO: 1099031 - RNA, 18 nt, Homo sapiens
uauuaaugaacugugaca

SEQ ID NO: 1099032 - RNA, 21 nt, Homo sapiens
uauuacaauuuuugaacaacu

SEQ ID NO: 1099033 - RNA, 12 nt, Homo sapiens
uauuaccaaaaa

SEQ ID NO: 1099034 - RNA, 15 nt, Homo sapiens
uauuacgugcaauac

SEQ ID NO: 1099035 - RNA, 15 nt, Homo sapiens
uauuagaacaggcaa

SEQ ID NO: 1099036 - RNA, 13 nt, Homo sapiens
uauuagacaugaa

SEQ ID NO: 1099037 - RNA, 18 nt, Homo sapiens
uauuagcaacugugcuac

SEQ ID NO: 1099038 - RNA, 15 nt, Homo sapiens
uauuaguuaggugug

SEQ ID NO: 1099039 - RNA, 19 nt, Homo sapiens
uauuaugggaaugacucug

SEQ ID NO: 1099040 - RNA, 17 nt, Homo sapiens
uauuauucuucauaaca

SEQ ID NO: 1099041 - RNA, 18 nt, Homo sapiens
uauuauucuucauaacaa

SEQ ID NO: 1099042 - RNA, 13 nt, Homo sapiens
uauuauuguggaa

SEQ ID NO: 1099043 - RNA, 20 nt, Homo sapiens
uauuauuuggcaugcuuaaa

SEQ ID NO: 1099044 - RNA, 20 nt, Homo sapiens
uauucaauggaaagcugcuu

SEQ ID NO: 1099045 - RNA, 22 nt, Homo sapiens
uauuccauggcuaacuggcgag

SEQ ID NO: 1099046 - RNA, 17 nt, Homo sapiens
uauucucuaagauauau

SEQ ID NO: 1099047 - RNA, 13 nt, Homo sapiens
uauucucuccuca

SEQ ID NO: 1099048 - RNA, 15 nt, Homo sapiens
uauucugcauggaaa

SEQ ID NO: 1099049 - RNA, 17 nt, Homo sapiens
uauucugguuacugugg

SEQ ID NO: 1099050 - RNA, 16 nt, Homo sapiens
uauucuuaacuauuca

SEQ ID NO: 1099051 - RNA, 23 nt, Homo sapiens
uauucuuuuuggaaauaaaauac

SEQ ID NO: 1099052 - RNA, 18 nt, Homo sapiens
uauugacaauaauuucag

SEQ ID NO: 1099053 - RNA, 17 nt, Homo sapiens
uauugcugaaugacuac

SEQ ID NO: 1099054 - RNA, 20 nt, Homo sapiens
uauuggaaaggucauugugg

SEQ ID NO: 1099055 - RNA, 15 nt, Homo sapiens
uauuguauuacauuu

SEQ ID NO: 1099056 - RNA, 14 nt, Homo sapiens
uauugugaucuauc

SEQ ID NO: 1099057 - RNA, 13 nt, Homo sapiens
uauugugcauaga

SEQ ID NO: 1099058 - RNA, 23 nt, Homo sapiens
uauuuaaaauuuauugcuugaua

SEQ ID NO: 1099059 - RNA, 14 nt, Homo sapiens
uauuuaauuagcca

SEQ ID NO: 1099060 - RNA, 15 nt, Homo sapiens
uauuuauagucacaa

SEQ ID NO: 1099061 - RNA, 21 nt, Homo sapiens
uauuuaugaccuuauaguguu

SEQ ID NO: 1099062 - RNA, 13 nt, Homo sapiens
uauuuauuuacug

SEQ ID NO: 1099063 - RNA, 21 nt, Homo sapiens
uauuucaaccgcuugccauau

SEQ ID NO: 1099064 - RNA, 23 nt, Homo sapiens
uauuuccuuuccagucauuucaa

SEQ ID NO: 1099065 - RNA, 16 nt, Homo sapiens
uauuugaaucuacaaa

SEQ ID NO: 1099066 - RNA, 17 nt, Homo sapiens
uauuuguuugcaauuuu

SEQ ID NO: 1099067 - RNA, 20 nt, Homo sapiens
uauuuguuuggucacugcua

SEQ ID NO: 1099068 - RNA, 19 nt, Homo sapiens
uauuuuauucccuuucaca

SEQ ID NO: 1099069 - RNA, 13 nt, Homo sapiens
uauuuucacauga

SEQ ID NO: 1099070 - RNA, 14 nt, Homo sapiens
uauuuuccaugaaa

SEQ ID NO: 1099071 - RNA, 19 nt, Homo sapiens
uauuuuccccuagcuuucc

SEQ ID NO: 1099072 - RNA, 19 nt, Homo sapiens
uauuuucccucucuugccu

SEQ ID NO: 1099073 - RNA, 18 nt, Homo sapiens
uauuuugcauaguaccaa

SEQ ID NO: 1099074 - RNA, 22 nt, Homo sapiens
uauuuugcauaguaccaaucau

SEQ ID NO: 1099075 - RNA, 16 nt, Homo sapiens
uauuuugccagacuua

SEQ ID NO: 1099076 - RNA, 16 nt, Homo sapiens
uauuuuuagacagagu

SEQ ID NO: 1099077 - RNA, 14 nt, Homo sapiens
uauuuuuaugugca

SEQ ID NO: 1099078 - RNA, 22 nt, Homo sapiens
uauuuuuguuucuuccaaagca

SEQ ID NO: 1099079 - RNA, 13 nt, Homo sapiens
ucaaaacauauca

SEQ ID NO: 1099080 - RNA, 14 nt, Homo sapiens
ucaaaaccuuucaa

SEQ ID NO: 1099081 - RNA, 12 nt, Homo sapiens
ucaaaaggugcc

SEQ ID NO: 1099082 - RNA, 23 nt, Homo sapiens
ucaaacaugaaguguguuuccuu

SEQ ID NO: 1099083 - RNA, 14 nt, Homo sapiens
ucaaaccaggauuu

SEQ ID NO: 1099084 - RNA, 18 nt, Homo sapiens
ucaaaccauaaacuucau

SEQ ID NO: 1099085 - RNA, 17 nt, Homo sapiens
ucaaacugcaugauuca

SEQ ID NO: 1099086 - RNA, 15 nt, Homo sapiens
ucaaacuuuacucua

SEQ ID NO: 1099087 - RNA, 22 nt, Homo sapiens
ucaaagagggagugcauuuaug

SEQ ID NO: 1099088 - RNA, 21 nt, Homo sapiens
ucaaagcacuguuucucucac

SEQ ID NO: 1099089 - RNA, 18 nt, Homo sapiens
ucaaagcccccacuucuc

SEQ ID NO: 1099090 - RNA, 22 nt, Homo sapiens
ucaaagcccccacuucucucca

SEQ ID NO: 1099091 - RNA, 23 nt, Homo sapiens
ucaaagcccccacuucucuccag

SEQ ID NO: 1099092 - RNA, 15 nt, Homo sapiens
ucaaaguaaaacuug

SEQ ID NO: 1099093 - RNA, 18 nt, Homo sapiens
ucaaaguaaaacuugcug

SEQ ID NO: 1099094 - RNA, 23 nt, Homo sapiens
ucaaauacauaccuacugacuga

SEQ ID NO: 1099095 - RNA, 21 nt, Homo sapiens
ucaaaucacauggcuuuccac

SEQ ID NO: 1099096 - RNA, 17 nt, Homo sapiens
ucaaaucuauucagaca

SEQ ID NO: 1099097 - RNA, 12 nt, Homo sapiens
ucaaaugcacau

SEQ ID NO: 1099098 - RNA, 17 nt, Homo sapiens
ucaaccccagacacugg

SEQ ID NO: 1099099 - RNA, 15 nt, Homo sapiens
ucaaccgcuugccau

SEQ ID NO: 1099100 - RNA, 18 nt, Homo sapiens
ucaaccuaagcaacagaa

SEQ ID NO: 1099101 - RNA, 13 nt, Homo sapiens
ucaacuaugauau

SEQ ID NO: 1099102 - RNA, 17 nt, Homo sapiens
ucaacugaaaagacuca

SEQ ID NO: 1099103 - RNA, 20 nt, Homo sapiens
ucaacuguugauugcaggaa

SEQ ID NO: 1099104 - RNA, 12 nt, Homo sapiens
ucaacuuugaca

SEQ ID NO: 1099105 - RNA, 18 nt, Homo sapiens
ucaacuuuuccuuugaau

SEQ ID NO: 1099106 - RNA, 16 nt, Homo sapiens
ucaagaaaacuggaaa

SEQ ID NO: 1099107 - RNA, 15 nt, Homo sapiens
ucaagaaacugagga

SEQ ID NO: 1099108 - RNA, 19 nt, Homo sapiens
ucaagagaagcacaugaaa

SEQ ID NO: 1099109 - RNA, 17 nt, Homo sapiens
ucaagagugagugaaca

SEQ ID NO: 1099110 - RNA, 18 nt, Homo sapiens
ucaagaugagagaacugg

SEQ ID NO: 1099111 - RNA, 19 nt, Homo sapiens
ucaagccaguacgugcuaa

SEQ ID NO: 1099112 - RNA, 19 nt, Homo sapiens
ucaaguugagaacaaaaau

SEQ ID NO: 1099113 - RNA, 20 nt, Homo sapiens
ucaaguuuuucagaaagcau

SEQ ID NO: 1099114 - RNA, 12 nt, Homo sapiens
ucaaugaccugu

SEQ ID NO: 1099115 - RNA, 14 nt, Homo sapiens
ucaaugaccuguau

SEQ ID NO: 1099116 - RNA, 13 nt, Homo sapiens
gcauaaaugcauu

SEQ ID NO: 1099117 - RNA, 20 nt, Homo sapiens
gcauaaaugugguacaagca

SEQ ID NO: 1099118 - RNA, 15 nt, Homo sapiens
gcauacagagacaga

SEQ ID NO: 1099119 - RNA, 20 nt, Homo sapiens
gcauaccuuuauugugaucu

SEQ ID NO: 1099120 - RNA, 15 nt, Homo sapiens
gcauaguaauagggc

SEQ ID NO: 1099121 - RNA, 19 nt, Homo sapiens
gcauauaaaaugcuuuauu

SEQ ID NO: 1099122 - RNA, 22 nt, Homo sapiens
gcaucaugccucugaggccagc

SEQ ID NO: 1099123 - RNA, 14 nt, Homo sapiens
gcauccuggccaac

SEQ ID NO: 1099124 - RNA, 20 nt, Homo sapiens
gcaucuacacagccuggacu

SEQ ID NO: 1099125 - RNA, 14 nt, Homo sapiens
gcaucugacucaca

SEQ ID NO: 1099126 - RNA, 12 nt, Homo sapiens
gcaucuguguaa

SEQ ID NO: 1099127 - RNA, 17 nt, Homo sapiens
gcaugaagguuucugaa

SEQ ID NO: 1099128 - RNA, 18 nt, Homo sapiens
gcaugauugugaccucca

SEQ ID NO: 1099129 - RNA, 22 nt, Homo sapiens
gcaugcacuucuuacaauaauu

SEQ ID NO: 1099130 - RNA, 21 nt, Homo sapiens
gcaugcauuuugcagcaguga

SEQ ID NO: 1099131 - RNA, 21 nt, Homo sapiens
gcaugccggugaucccuagcu

SEQ ID NO: 1099132 - RNA, 15 nt, Homo sapiens
gcauguccucaaaac

SEQ ID NO: 1099133 - RNA, 14 nt, Homo sapiens
gcauguugccauga

SEQ ID NO: 1099134 - RNA, 12 nt, Homo sapiens
gcauuccaugau

SEQ ID NO: 1099135 - RNA, 22 nt, Homo sapiens
gcauugaauauauuauaaucuu

SEQ ID NO: 1099136 - RNA, 14 nt, Homo sapiens
gcauugcauggaca

SEQ ID NO: 1099137 - RNA, 18 nt, Homo sapiens
gcauuuaaauuagauaac

SEQ ID NO: 1099138 - RNA, 19 nt, Homo sapiens
gcauuuacuuuguguucac

SEQ ID NO: 1099139 - RNA, 17 nt, Homo sapiens
gccaaacacccaugccc

SEQ ID NO: 1099140 - RNA, 20 nt, Homo sapiens
gccaaacccaugaggcaaug

SEQ ID NO: 1099141 - RNA, 15 nt, Homo sapiens
gccaaacucugccag

SEQ ID NO: 1099142 - RNA, 13 nt, Homo sapiens
gccaaauguaauu

SEQ ID NO: 1099143 - RNA, 16 nt, Homo sapiens
gccaacucacucuuau

SEQ ID NO: 1099144 - RNA, 15 nt, Homo sapiens
gccaacuuguaaaua

SEQ ID NO: 1099145 - RNA, 19 nt, Homo sapiens
gccaagaaucaagcuagaa

SEQ ID NO: 1099146 - RNA, 20 nt, Homo sapiens
gccaagaucgcgccacugca

SEQ ID NO: 1099147 - RNA, 14 nt, Homo sapiens
gccaaggaugacac

SEQ ID NO: 1099148 - RNA, 14 nt, Homo sapiens
gccacaacccuguu

SEQ ID NO: 1099149 - RNA, 16 nt, Homo sapiens
gccacagaagccagga

SEQ ID NO: 1099150 - RNA, 12 nt, Homo sapiens
gccacauuugau

SEQ ID NO: 1099151 - RNA, 15 nt, Homo sapiens
gccacauuugauuau

SEQ ID NO: 1099152 - RNA, 22 nt, Homo sapiens
gccacccugugggccgggcaau

SEQ ID NO: 1099153 - RNA, 14 nt, Homo sapiens
gccaccucuugggc

SEQ ID NO: 1099154 - RNA, 21 nt, Homo sapiens
gccaccucuugggcaugcuca

SEQ ID NO: 1099155 - RNA, 14 nt, Homo sapiens
gccacgaggagcuu

SEQ ID NO: 1099156 - RNA, 13 nt, Homo sapiens
gccacugcacucc

SEQ ID NO: 1099157 - RNA, 22 nt, Homo sapiens
gccagaaagcauaaaauucuua

SEQ ID NO: 1099158 - RNA, 22 nt, Homo sapiens
gccagagccuggggcaucccag

SEQ ID NO: 1099159 - RNA, 22 nt, Homo sapiens
gccagccggguaccucaguuuc

SEQ ID NO: 1099160 - RNA, 17 nt, Homo sapiens
gccagccgugaugcuca

SEQ ID NO: 1099161 - RNA, 16 nt, Homo sapiens
gccagcucagucccau

SEQ ID NO: 1099162 - RNA, 15 nt, Homo sapiens
gccagcucucucuac

SEQ ID NO: 1099163 - RNA, 13 nt, Homo sapiens
gccaggugcagug

SEQ ID NO: 1099164 - RNA, 11 nt, Homo sapiens
gccaguauuuu

SEQ ID NO: 1099165 - RNA, 18 nt, Homo sapiens
gccaucaugugccuggaa

SEQ ID NO: 1099166 - RNA, 19 nt, Homo sapiens
gccaucaugugccuggaaa

SEQ ID NO: 1099167 - RNA, 22 nt, Homo sapiens
gccaugaggccuuuccccagug

SEQ ID NO: 1099168 - RNA, 16 nt, Homo sapiens
gccaugcuucuugccc

SEQ ID NO: 1099169 - RNA, 18 nt, Homo sapiens
gccauguaccaguguacu

SEQ ID NO: 1099170 - RNA, 23 nt, Homo sapiens
gccauuauuucaaccgcuugcca

SEQ ID NO: 1099171 - RNA, 16 nt, Homo sapiens
gcccaagagaugaaga

SEQ ID NO: 1099172 - RNA, 15 nt, Homo sapiens
gcccaauguaaugca

SEQ ID NO: 1099173 - RNA, 14 nt, Homo sapiens
gcccacagggacca

SEQ ID NO: 1099174 - RNA, 20 nt, Homo sapiens
gcccacgcuggagugcagug

SEQ ID NO: 1099175 - RNA, 21 nt, Homo sapiens
gcccagaaaaccuccaguagu

SEQ ID NO: 1099176 - RNA, 20 nt, Homo sapiens
gcccagccauuaccauggag

SEQ ID NO: 1099177 - RNA, 14 nt, Homo sapiens
gcccagcucuuugu

SEQ ID NO: 1099178 - RNA, 20 nt, Homo sapiens
gcccaggcuggagugcagug

SEQ ID NO: 1099179 - RNA, 15 nt, Homo sapiens
gcccagggcauccca

SEQ ID NO: 1099180 - RNA, 16 nt, Homo sapiens
gcccagggcaucccau

SEQ ID NO: 1099181 - RNA, 17 nt, Homo sapiens
gcccaggucaacaucua

SEQ ID NO: 1099182 - RNA, 20 nt, Homo sapiens
gccccaacuccuuccagcua

SEQ ID NO: 1099183 - RNA, 21 nt, Homo sapiens
gccccagagaggggacauuuc

SEQ ID NO: 1099184 - RNA, 22 nt, Homo sapiens
gccccagagaggggacauuucc

SEQ ID NO: 1099185 - RNA, 13 nt, Homo sapiens
gccccagugacag

SEQ ID NO: 1099186 - RNA, 21 nt, Homo sapiens
gccccaugaccuccagcuuuc

SEQ ID NO: 1099187 - RNA, 21 nt, Homo sapiens
gcccccagcagauggaaagaa

SEQ ID NO: 1099188 - RNA, 20 nt, Homo sapiens
gccccccuugccagacaugu

SEQ ID NO: 1099189 - RNA, 18 nt, Homo sapiens
gcccugccuggaggaccu

SEQ ID NO: 1099190 - RNA, 22 nt, Homo sapiens
gcccugggaccgcuacaccacu

SEQ ID NO: 1099191 - RNA, 16 nt, Homo sapiens
gcccuggggccuguac

SEQ ID NO: 1099192 - RNA, 18 nt, Homo sapiens
gcccuguuuauauuggua

SEQ ID NO: 1099193 - RNA, 17 nt, Homo sapiens
gccuaaaaaugcaacuu

SEQ ID NO: 1099194 - RNA, 20 nt, Homo sapiens
gccuacaucccaucauggcu

SEQ ID NO: 1099195 - RNA, 16 nt, Homo sapiens
gccuacguuaacccau

SEQ ID NO: 1099196 - RNA, 20 nt, Homo sapiens
gccuauaaucccagcacuuu

SEQ ID NO: 1099197 - RNA, 16 nt, Homo sapiens
gccuaugcacauaugg

SEQ ID NO: 1099198 - RNA, 14 nt, Homo sapiens
gccucaaugugacc

SEQ ID NO: 1099199 - RNA, 12 nt, Homo sapiens
gccucacuuuua

SEQ ID NO: 1099200 - RNA, 13 nt, Homo sapiens
gccucagaccuga

SEQ ID NO: 1099201 - RNA, 18 nt, Homo sapiens
cuccugggcuaagugauc

SEQ ID NO: 1099202 - RNA, 16 nt, Homo sapiens
cuccuggucuugagau

SEQ ID NO: 1099203 - RNA, 16 nt, Homo sapiens
cuccuguugcaaugac

SEQ ID NO: 1099204 - RNA, 14 nt, Homo sapiens
cuccuugguauuuc

SEQ ID NO: 1099205 - RNA, 20 nt, Homo sapiens
cuccuuggucuaagugugcu

SEQ ID NO: 1099206 - RNA, 17 nt, Homo sapiens
cuccuuuggccauucca

SEQ ID NO: 1099207 - RNA, 19 nt, Homo sapiens
cuccuuuugcuugaaacca

SEQ ID NO: 1099208 - RNA, 20 nt, Homo sapiens
cucgauuauucccuguacaa

SEQ ID NO: 1099209 - RNA, 18 nt, Homo sapiens
cucggcaccuccccggcc

SEQ ID NO: 1099210 - RNA, 15 nt, Homo sapiens
cucggggugcacagg

SEQ ID NO: 1099211 - RNA, 15 nt, Homo sapiens
cucguccccaaguga

SEQ ID NO: 1099212 - RNA, 18 nt, Homo sapiens
cucuaacgccugagccca

SEQ ID NO: 1099213 - RNA, 14 nt, Homo sapiens
cucuagauugagag

SEQ ID NO: 1099214 - RNA, 17 nt, Homo sapiens
gaucucacaagcacuuu

SEQ ID NO: 1099215 - RNA, 17 nt, Homo sapiens
gaucuccauauguuaca

SEQ ID NO: 1099216 - RNA, 21 nt, Homo sapiens
gaucuguuuuuaaaaaucaua

SEQ ID NO: 1099217 - RNA, 20 nt, Homo sapiens
gaugaugcaagcgacaggaa

SEQ ID NO: 1099218 - RNA, 18 nt, Homo sapiens
gauggaauaaagcccuug

SEQ ID NO: 1099219 - RNA, 22 nt, Homo sapiens
gauggacaagauuaccccaccu

SEQ ID NO: 1099220 - RNA, 18 nt, Homo sapiens
gauggauagucuguccaa

SEQ ID NO: 1099221 - RNA, 16 nt, Homo sapiens
gauguaccauguuaaa

SEQ ID NO: 1099222 - RNA, 20 nt, Homo sapiens
gauguccagaagaauauuca

SEQ ID NO: 1099223 - RNA, 18 nt, Homo sapiens
gauguugcuggacuguca

SEQ ID NO: 1099224 - RNA, 19 nt, Homo sapiens
gauuauucccuguacaaua

SEQ ID NO: 1099225 - RNA, 20 nt, Homo sapiens
gauucacaaugaaaugcucu

SEQ ID NO: 1099226 - RNA, 21 nt, Homo sapiens
gauucacaaugaaaugcucuc

SEQ ID NO: 1099227 - RNA, 18 nt, Homo sapiens
gauucggauuugacaaaa

SEQ ID NO: 1099228 - RNA, 20 nt, Homo sapiens
gauucgugacaacaugcgac

SEQ ID NO: 1099229 - RNA, 15 nt, Homo sapiens
gauucuucucuuaau

SEQ ID NO: 1099230 - RNA, 20 nt, Homo sapiens
gauucuucucuuaauuucau

SEQ ID NO: 1099231 - RNA, 23 nt, Homo sapiens
gauucuucucuuaauuucauaga

SEQ ID NO: 1099232 - RNA, 18 nt, Homo sapiens
gauucuugacauucacuu

SEQ ID NO: 1099233 - RNA, 22 nt, Homo sapiens
gauuggccccacugacguuggc

SEQ ID NO: 1099234 - RNA, 14 nt, Homo sapiens
gauuggcucaccca

SEQ ID NO: 1099235 - RNA, 22 nt, Homo sapiens
gauuguucuguccaguuuccaa

SEQ ID NO: 1099236 - RNA, 15 nt, Homo sapiens
gauuuaacacuaaaa

SEQ ID NO: 1099237 - RNA, 14 nt, Homo sapiens
gauuuaagcauuuu

SEQ ID NO: 1099238 - RNA, 15 nt, Homo sapiens
gauuucaugauuuca

SEQ ID NO: 1099239 - RNA, 20 nt, Homo sapiens
gauuugcacccaugccauag

SEQ ID NO: 1099240 - RNA, 12 nt, Homo sapiens
gauuuguuuaaa

SEQ ID NO: 1099241 - RNA, 12 nt, Homo sapiens
gauuuuauacau

SEQ ID NO: 1099242 - RNA, 17 nt, Homo sapiens
gcaaaaucuaccagguc

SEQ ID NO: 1099243 - RNA, 15 nt, Homo sapiens
gcaaacacuguguau

SEQ ID NO: 1099244 - RNA, 21 nt, Homo sapiens
gcaaagcaccagcuucuccag

SEQ ID NO: 1099245 - RNA, 16 nt, Homo sapiens
gcaaagcugugcacuu

SEQ ID NO: 1099246 - RNA, 16 nt, Homo sapiens
gcaaaggccagcagca

SEQ ID NO: 1099247 - RNA, 16 nt, Homo sapiens
gcaaaggcgucugaau

SEQ ID NO: 1099248 - RNA, 23 nt, Homo sapiens
gcaaagugcugcuggaaguagaa

SEQ ID NO: 1099249 - RNA, 19 nt, Homo sapiens
gcaaaguucccuacuuccu

SEQ ID NO: 1099250 - RNA, 11 nt, Homo sapiens
gcaaccuguag

SEQ ID NO: 1099251 - RNA, 23 nt, Homo sapiens
gcaaccuuuuugauuucuuccag

SEQ ID NO: 1099252 - RNA, 15 nt, Homo sapiens
gcaacugaggcagac

SEQ ID NO: 1099253 - RNA, 18 nt, Homo sapiens
gcaagaagucaaaguaaa

SEQ ID NO: 1099254 - RNA, 22 nt, Homo sapiens
gcaagacuucucuuugccucaa

SEQ ID NO: 1099255 - RNA, 21 nt, Homo sapiens
gcaaggacggccuucaacuga

SEQ ID NO: 1099256 - RNA, 23 nt, Homo sapiens
gcaaucaaguccuacaagcuaaa

SEQ ID NO: 1099257 - RNA, 22 nt, Homo sapiens
gcaauucuaacuuuuuugcuau

SEQ ID NO: 1099258 - RNA, 19 nt, Homo sapiens
gcaauucuacccagagccu

SEQ ID NO: 1099259 - RNA, 12 nt, Homo sapiens
gcacaaaccuua

SEQ ID NO: 1099260 - RNA, 20 nt, Homo sapiens
gcacacaugguuuccaaggg

SEQ ID NO: 1099261 - RNA, 21 nt, Homo sapiens
gcacacuagccucuccaggaa

SEQ ID NO: 1099262 - RNA, 20 nt, Homo sapiens
gcacacuuaugggccaagcc

SEQ ID NO: 1099263 - RNA, 12 nt, Homo sapiens
gcacacuuguau

SEQ ID NO: 1099264 - RNA, 16 nt, Homo sapiens
gcacagcuaugaaggc

SEQ ID NO: 1099265 - RNA, 21 nt, Homo sapiens
gcacauauggacucugcacau

SEQ ID NO: 1099266 - RNA, 17 nt, Homo sapiens
gcaccaaauucauguac

SEQ ID NO: 1099267 - RNA, 21 nt, Homo sapiens
gcaccaggcacgaacccaccu

SEQ ID NO: 1099268 - RNA, 13 nt, Homo sapiens
gcaccaucucuga

SEQ ID NO: 1099269 - RNA, 12 nt, Homo sapiens
gcacccuggauu

SEQ ID NO: 1099270 - RNA, 21 nt, Homo sapiens
gcacccuggauugaucggagc

SEQ ID NO: 1099271 - RNA, 16 nt, Homo sapiens
gcacccuguucccucu

SEQ ID NO: 1099272 - RNA, 17 nt, Homo sapiens
gcaccuacuuacaugca

SEQ ID NO: 1099273 - RNA, 22 nt, Homo sapiens
gcaccuggcuaguuucuaacau

SEQ ID NO: 1099274 - RNA, 17 nt, Homo sapiens
gcaccuguacucaggag

SEQ ID NO: 1099275 - RNA, 24 nt, Homo sapiens
gcaccuugugucuguacacguguc

SEQ ID NO: 1099276 - RNA, 12 nt, Homo sapiens
gcacggcagcuu

SEQ ID NO: 1099277 - RNA, 19 nt, Homo sapiens
gcacucagaagacacugau

SEQ ID NO: 1099278 - RNA, 20 nt, Homo sapiens
gcacuugcagauacauucau

SEQ ID NO: 1099279 - RNA, 14 nt, Homo sapiens
gcagaaaagugcuu

SEQ ID NO: 1099280 - RNA, 19 nt, Homo sapiens
gcagaaagguuaguaucau

SEQ ID NO: 1099281 - RNA, 13 nt, Homo sapiens
gcagaauaaucuu

SEQ ID NO: 1099282 - RNA, 13 nt, Homo sapiens
gcagacugucccu

SEQ ID NO: 1099283 - RNA, 21 nt, Homo sapiens
gcagagaacuggaaagacaua

SEQ ID NO: 1099284 - RNA, 21 nt, Homo sapiens
gcagagaccuugcgaccaugu

SEQ ID NO: 1099285 - RNA, 20 nt, Homo sapiens
gcagagguaaaagugugagc

SEQ ID NO: 1099286 - RNA, 18 nt, Homo sapiens
gcagauacauucaugagg

SEQ ID NO: 1099287 - RNA, 18 nt, Homo sapiens
gcagccaaacccaugagg

SEQ ID NO: 1099288 - RNA, 15 nt, Homo sapiens
gcagccauccaugag

SEQ ID NO: 1099289 - RNA, 15 nt, Homo sapiens
gcagcccagccucug

SEQ ID NO: 1099290 - RNA, 16 nt, Homo sapiens
gcagccccacacccgc

SEQ ID NO: 1099291 - RNA, 22 nt, Homo sapiens
gcaggaacucccagcaacacaa

SEQ ID NO: 1099292 - RNA, 21 nt, Homo sapiens
gcaggagaaucacuugcacuc

SEQ ID NO: 1099293 - RNA, 20 nt, Homo sapiens
gcagggccuugcccagagau

SEQ ID NO: 1099294 - RNA, 16 nt, Homo sapiens
gcagguggcaucucua

SEQ ID NO: 1099295 - RNA, 13 nt, Homo sapiens
gcaggugucuauc

SEQ ID NO: 1099296 - RNA, 17 nt, Homo sapiens
gcagucaacaguucaaa

SEQ ID NO: 1099297 - RNA, 19 nt, Homo sapiens
cgcuuuguacuuugugcaa

SEQ ID NO: 1099298 - RNA, 17 nt, Homo sapiens
cggaaccugaaggugcu

SEQ ID NO: 1099299 - RNA, 23 nt, Homo sapiens
cggagacggagucccaccuuggc

SEQ ID NO: 1099300 - RNA, 17 nt, Homo sapiens
cggaggagaccagcuca

SEQ ID NO: 1099301 - RNA, 15 nt, Homo sapiens
cggagguuccaguga

SEQ ID NO: 1099302 - RNA, 14 nt, Homo sapiens
cggcacacaaggca

SEQ ID NO: 1099303 - RNA, 17 nt, Homo sapiens
cggcaugugaauucugu

SEQ ID NO: 1099304 - RNA, 14 nt, Homo sapiens
cggccccaucagag

SEQ ID NO: 1099305 - RNA, 21 nt, Homo sapiens
cggccccugcugguucagggu

SEQ ID NO: 1099306 - RNA, 14 nt, Homo sapiens
cggcgccaccaucc

SEQ ID NO: 1099307 - RNA, 21 nt, Homo sapiens
cggcugagucaugaucucccu

SEQ ID NO: 1099308 - RNA, 15 nt, Homo sapiens
cgggagcagugucuu

SEQ ID NO: 1099309 - RNA, 19 nt, Homo sapiens
cgggcacucagaagacacu

SEQ ID NO: 1099310 - RNA, 21 nt, Homo sapiens
cggggcgaccccucagugcuc

SEQ ID NO: 1099311 - RNA, 22 nt, Homo sapiens
cggguaccgugcaugugcaguc

SEQ ID NO: 1099312 - RNA, 11 nt, Homo sapiens
uugaaaagccu

SEQ ID NO: 1099313 - RNA, 18 nt, Homo sapiens
uugaaacauagagaucua

SEQ ID NO: 1099314 - RNA, 15 nt, Homo sapiens
uugaaauauaaugca

SEQ ID NO: 1099315 - RNA, 19 nt, Homo sapiens
uugaaauuauaucuguggu

SEQ ID NO: 1099316 - RNA, 16 nt, Homo sapiens
uugaaauuugacucau

SEQ ID NO: 1099317 - RNA, 16 nt, Homo sapiens
uugaacugauucacau

SEQ ID NO: 1099318 - RNA, 21 nt, Homo sapiens
uugaacugccaagaaaaggca

SEQ ID NO: 1099319 - RNA, 21 nt, Homo sapiens
uugaacuuaaauaaaugucau

SEQ ID NO: 1099320 - RNA, 23 nt, Homo sapiens
uugaacuuaaauaaaugucauua

SEQ ID NO: 1099321 - RNA, 18 nt, Homo sapiens
uugaagagcauugcaugg

SEQ ID NO: 1099322 - RNA, 23 nt, Homo sapiens
uugaaggcccaggucaacaucua

SEQ ID NO: 1099323 - RNA, 18 nt, Homo sapiens
uugaauaaagccugcuuu

SEQ ID NO: 1099324 - RNA, 15 nt, Homo sapiens
uugaauggguuugcu

SEQ ID NO: 1099325 - RNA, 17 nt, Homo sapiens
uugaauguaagaacaug

SEQ ID NO: 1099326 - RNA, 17 nt, Homo sapiens
uugacaaaauauauaau

SEQ ID NO: 1099327 - RNA, 13 nt, Homo sapiens
uugagacagaguu

SEQ ID NO: 1099328 - RNA, 18 nt, Homo sapiens
uugagaguugcuggugua

SEQ ID NO: 1099329 - RNA, 20 nt, Homo sapiens
uugagauaaugucaaaauca

SEQ ID NO: 1099330 - RNA, 23 nt, Homo sapiens
uugagccaagcuucaacccucag

SEQ ID NO: 1099331 - RNA, 21 nt, Homo sapiens
uugaggacaaccauuccagac

SEQ ID NO: 1099332 - RNA, 17 nt, Homo sapiens
uugaguucaaauuuugc

SEQ ID NO: 1099333 - RNA, 16 nt, Homo sapiens
ucaauggaaagcugcu

SEQ ID NO: 1099334 - RNA, 14 nt, Homo sapiens
ucaaugguaugcaa

SEQ ID NO: 1099335 - RNA, 15 nt, Homo sapiens
ucaaugucacuuaaa

SEQ ID NO: 1099336 - RNA, 14 nt, Homo sapiens
ucaauuaguacagu

SEQ ID NO: 1099337 - RNA, 16 nt, Homo sapiens
ucaauucagugcugua

SEQ ID NO: 1099338 - RNA, 16 nt, Homo sapiens
ucacaagcaauaauua

SEQ ID NO: 1099339 - RNA, 22 nt, Homo sapiens
gccuccucccugggcagaaagu

SEQ ID NO: 1099340 - RNA, 21 nt, Homo sapiens
gccuccucucucaaacugggg

SEQ ID NO: 1099341 - RNA, 15 nt, Homo sapiens
gccucgcuacaagaa

SEQ ID NO: 1099342 - RNA, 20 nt, Homo sapiens
gccucuucgcugaccucgac

SEQ ID NO: 1099343 - RNA, 20 nt, Homo sapiens
gccucuuucugugcuucucu

SEQ ID NO: 1099344 - RNA, 12 nt, Homo sapiens
gccugaaccugg

SEQ ID NO: 1099345 - RNA, 13 nt, Homo sapiens
gccugaaccuggg

SEQ ID NO: 1099346 - RNA, 21 nt, Homo sapiens
gccugaagucccagcauugau

SEQ ID NO: 1099347 - RNA, 18 nt, Homo sapiens
gccugacuguguucagug

SEQ ID NO: 1099348 - RNA, 16 nt, Homo sapiens
gccugagcccagggag

SEQ ID NO: 1099349 - RNA, 19 nt, Homo sapiens
gccugagucacccaugaag

SEQ ID NO: 1099350 - RNA, 16 nt, Homo sapiens
gccuggccuccugccu

SEQ ID NO: 1099351 - RNA, 16 nt, Homo sapiens
gccugggcaacaaagu

SEQ ID NO: 1099352 - RNA, 18 nt, Homo sapiens
gccugguagaauugggaa

SEQ ID NO: 1099353 - RNA, 13 nt, Homo sapiens
gccuguaauccca

SEQ ID NO: 1099354 - RNA, 20 nt, Homo sapiens
gccuguaaucccagcacuuu

SEQ ID NO: 1099355 - RNA, 20 nt, Homo sapiens
gccugugcauguaugucuug

SEQ ID NO: 1099356 - RNA, 19 nt, Homo sapiens
gccugugcccacgugugca

SEQ ID NO: 1099357 - RNA, 15 nt, Homo sapiens
gccuguuaacuggua

SEQ ID NO: 1099358 - RNA, 22 nt, Homo sapiens
gccuuaccuccugcccaggaga

SEQ ID NO: 1099359 - RNA, 15 nt, Homo sapiens
gccuucaguguaccg

SEQ ID NO: 1099360 - RNA, 21 nt, Homo sapiens
gccuuccaggagcaauuugca

SEQ ID NO: 1099361 - RNA, 18 nt, Homo sapiens
gccuucucuguucauuuc

SEQ ID NO: 1099362 - RNA, 14 nt, Homo sapiens
gccuugccaugucu

SEQ ID NO: 1099363 - RNA, 19 nt, Homo sapiens
gccuuuccaccugcuuucu

SEQ ID NO: 1099364 - RNA, 21 nt, Homo sapiens
gccuuucuaguccuauucuau

SEQ ID NO: 1099365 - RNA, 19 nt, Homo sapiens
gccuuuuguggauugacag

SEQ ID NO: 1099366 - RNA, 17 nt, Homo sapiens
gcgaccccucagugcuc

SEQ ID NO: 1099367 - RNA, 20 nt, Homo sapiens
gcgagcccugguggcagugg

SEQ ID NO: 1099368 - RNA, 17 nt, Homo sapiens
gcgaguucagcaaagag

SEQ ID NO: 1099369 - RNA, 14 nt, Homo sapiens
gcgcgguggcucac

SEQ ID NO: 1099370 - RNA, 13 nt, Homo sapiens
gcggaaccauagc

SEQ ID NO: 1099371 - RNA, 23 nt, Homo sapiens
gcgggagugggggcugugccgug

SEQ ID NO: 1099372 - RNA, 15 nt, Homo sapiens
gcggucaauuugccu

SEQ ID NO: 1099373 - RNA, 18 nt, Homo sapiens
gcgugucccucucggaag

SEQ ID NO: 1099374 - RNA, 15 nt, Homo sapiens
gcuaaggcugccuca

SEQ ID NO: 1099375 - RNA, 23 nt, Homo sapiens
gcuaaggcugccucagaccugac

SEQ ID NO: 1099376 - RNA, 19 nt, Homo sapiens
gcuaaucuucuuaugcaau

SEQ ID NO: 1099377 - RNA, 22 nt, Homo sapiens
gcuacaccugaggcugaggcag

SEQ ID NO: 1099378 - RNA, 22 nt, Homo sapiens
gcuacucugugccagagccugg

SEQ ID NO: 1099379 - RNA, 22 nt, Homo sapiens
gcuacugacuauggcuaccaaa

SEQ ID NO: 1099380 - RNA, 15 nt, Homo sapiens
gcuagaaauaagccc

SEQ ID NO: 1099381 - RNA, 20 nt, Homo sapiens
gcuagaaauaagcccaacag

SEQ ID NO: 1099382 - RNA, 18 nt, Homo sapiens
gcuagacaagcuugucca

SEQ ID NO: 1099383 - RNA, 23 nt, Homo sapiens
gcuagacuaggagguuccggugu

SEQ ID NO: 1099384 - RNA, 18 nt, Homo sapiens
gcuaggagcaaagccugu

SEQ ID NO: 1099385 - RNA, 17 nt, Homo sapiens
gcuaucgcaccacugug

SEQ ID NO: 1099386 - RNA, 15 nt, Homo sapiens
gcuaucugcauuuau

SEQ ID NO: 1099387 - RNA, 20 nt, Homo sapiens
gcucacagcuggaacccugg

SEQ ID NO: 1099388 - RNA, 18 nt, Homo sapiens
gcucacauaucugucauu

SEQ ID NO: 1099389 - RNA, 22 nt, Homo sapiens
gcucacugaaaagacuauugug

SEQ ID NO: 1099390 - RNA, 14 nt, Homo sapiens
gcuccaagagaauu

SEQ ID NO: 1099391 - RNA, 14 nt, Homo sapiens
gcuccccacucugc

SEQ ID NO: 1099392 - RNA, 23 nt, Homo sapiens
gcuccccugggggcuagcagaag

SEQ ID NO: 1099393 - RNA, 15 nt, Homo sapiens
gcuccccuuccugcc

SEQ ID NO: 1099394 - RNA, 17 nt, Homo sapiens
gcucccuaggagaccaa

SEQ ID NO: 1099395 - RNA, 22 nt, Homo sapiens
gcuccgaaaaacuuuguuauau

SEQ ID NO: 1099396 - RNA, 16 nt, Homo sapiens
gcuccugggcagcuug

SEQ ID NO: 1099397 - RNA, 21 nt, Homo sapiens
gcuccuuucuccagccagcaa

SEQ ID NO: 1099398 - RNA, 22 nt, Homo sapiens
gcucuagagaaaagucuacccc

SEQ ID NO: 1099399 - RNA, 14 nt, Homo sapiens
gcucuggacaggca

SEQ ID NO: 1099400 - RNA, 20 nt, Homo sapiens
gcucuggaccaacccuguuu

SEQ ID NO: 1099401 - RNA, 23 nt, Homo sapiens
gcucuguguuucuggggacacca

SEQ ID NO: 1099402 - RNA, 21 nt, Homo sapiens
gcucuucuacguauaaauaug

SEQ ID NO: 1099403 - RNA, 10 nt, Homo sapiens
gcucuugccu

SEQ ID NO: 1099404 - RNA, 12 nt, Homo sapiens
gcugaacacugg

SEQ ID NO: 1099405 - RNA, 13 nt, Homo sapiens
gcugagcucugag

SEQ ID NO: 1099406 - RNA, 16 nt, Homo sapiens
gcugagcugaacccau

SEQ ID NO: 1099407 - RNA, 21 nt, Homo sapiens
gcugaggggaggaucacugga

SEQ ID NO: 1099408 - RNA, 16 nt, Homo sapiens
gcugagucugcagaug

SEQ ID NO: 1099409 - RNA, 14 nt, Homo sapiens
gcugaucaguuuuu

SEQ ID NO: 1099410 - RNA, 21 nt, Homo sapiens
gcugcaacggaauuaggaaga

SEQ ID NO: 1099411 - RNA, 20 nt, Homo sapiens
gcugcagugacgugcaccug

SEQ ID NO: 1099412 - RNA, 16 nt, Homo sapiens
gcugcauuugugucau

SEQ ID NO: 1099413 - RNA, 18 nt, Homo sapiens
gcugccaaacacccaugc

SEQ ID NO: 1099414 - RNA, 13 nt, Homo sapiens
gcugccucaugac

SEQ ID NO: 1099415 - RNA, 14 nt, Homo sapiens
gcugccugccuugg

SEQ ID NO: 1099416 - RNA, 15 nt, Homo sapiens
gcugcgagcauuucc

SEQ ID NO: 1099417 - RNA, 18 nt, Homo sapiens
gcugcggugucacugggc

SEQ ID NO: 1099418 - RNA, 18 nt, Homo sapiens
gcugcugagaaucuagcc

SEQ ID NO: 1099419 - RNA, 20 nt, Homo sapiens
gcugcugagaaucuagccuc

SEQ ID NO: 1099420 - RNA, 14 nt, Homo sapiens
gcuggagugcagug

SEQ ID NO: 1099421 - RNA, 20 nt, Homo sapiens
gcuggagugcaguggugcga

SEQ ID NO: 1099422 - RNA, 17 nt, Homo sapiens
gcuggauaaaaugaggu

SEQ ID NO: 1099423 - RNA, 20 nt, Homo sapiens
gcuggaugucuccaucucug

SEQ ID NO: 1099424 - RNA, 18 nt, Homo sapiens
agccugcaaacucacugc

SEQ ID NO: 1099425 - RNA, 17 nt, Homo sapiens
agccugggcaacaaagu

SEQ ID NO: 1099426 - RNA, 18 nt, Homo sapiens
agccugggcagcauagca

SEQ ID NO: 1099427 - RNA, 16 nt, Homo sapiens
agccugggccuaugga

SEQ ID NO: 1099428 - RNA, 16 nt, Homo sapiens
agccugucacgugguc

SEQ ID NO: 1099429 - RNA, 13 nt, Homo sapiens
agccugucuuuca

SEQ ID NO: 1099430 - RNA, 20 nt, Homo sapiens
agccugugaauaaaaacccu

SEQ ID NO: 1099431 - RNA, 22 nt, Homo sapiens
agccugugcauguaugucuugg

SEQ ID NO: 1099432 - RNA, 23 nt, Homo sapiens
agccuguucauggcagauguagg

SEQ ID NO: 1099433 - RNA, 22 nt, Homo sapiens
agccuguuggacccgcucugga

SEQ ID NO: 1099434 - RNA, 22 nt, Homo sapiens
agccuucucuguucauuuccuc

SEQ ID NO: 1099435 - RNA, 13 nt, Homo sapiens
agccuuuccauaa

SEQ ID NO: 1099436 - RNA, 16 nt, Homo sapiens
agcgagcuaugaucgc

SEQ ID NO: 1099437 - RNA, 15 nt, Homo sapiens
agcguagcuaaguga

SEQ ID NO: 1099438 - RNA, 16 nt, Homo sapiens
agcuaaacaugcugcc

SEQ ID NO: 1099439 - RNA, 12 nt, Homo sapiens
agcuaagugaaa

SEQ ID NO: 1099440 - RNA, 19 nt, Homo sapiens
agcuaagugaaaaggucau

SEQ ID NO: 1099441 - RNA, 14 nt, Homo sapiens
agcuacaauaucuu

SEQ ID NO: 1099442 - RNA, 19 nt, Homo sapiens
agcuaccuguggugauguu

SEQ ID NO: 1099443 - RNA, 14 nt, Homo sapiens
agcuacugacuaug

SEQ ID NO: 1099444 - RNA, 22 nt, Homo sapiens
agcuaggccuggccagaugcac

SEQ ID NO: 1099445 - RNA, 12 nt, Homo sapiens
agcuaugaaggc

SEQ ID NO: 1099446 - RNA, 20 nt, Homo sapiens
agcuaugaucgcgccacuac

SEQ ID NO: 1099447 - RNA, 16 nt, Homo sapiens
agcuauugcauguaaa

SEQ ID NO: 1099448 - RNA, 20 nt, Homo sapiens
agcucaagaugacagcucuu

SEQ ID NO: 1099449 - RNA, 12 nt, Homo sapiens
agcucaccagcc

SEQ ID NO: 1099450 - RNA, 22 nt, Homo sapiens
agcucaggugucccugcacuug

SEQ ID NO: 1099451 - RNA, 12 nt, Homo sapiens
agcucaguuuau

SEQ ID NO: 1099452 - RNA, 21 nt, Homo sapiens
agcuccccugggggcuagcag

SEQ ID NO: 1099453 - RNA, 14 nt, Homo sapiens
agcucuaguucaaa

SEQ ID NO: 1099454 - RNA, 16 nt, Homo sapiens
agcucugaacaaaagc

SEQ ID NO: 1099455 - RNA, 24 nt, Homo sapiens
agcucuggaugaagcucuggccaa

SEQ ID NO: 1099456 - RNA, 15 nt, Homo sapiens
agcucuguuuuacaa

SEQ ID NO: 1099457 - RNA, 14 nt, Homo sapiens
agcucuucuaagga

SEQ ID NO: 1099458 - RNA, 19 nt, Homo sapiens
agcucuuuguucaguugac

SEQ ID NO: 1099459 - RNA, 22 nt, Homo sapiens
agcugaagcccaugcuuuccca

SEQ ID NO: 1099460 - RNA, 21 nt, Homo sapiens
agcugagauugcgccacugca

SEQ ID NO: 1099461 - RNA, 14 nt, Homo sapiens
agcugaguguagug

SEQ ID NO: 1099462 - RNA, 20 nt, Homo sapiens
agcugcagucaacaguucaa

SEQ ID NO: 1099463 - RNA, 20 nt, Homo sapiens
agcugcaugggugccugcug

SEQ ID NO: 1099464 - RNA, 13 nt, Homo sapiens
agcugcucgcaca

SEQ ID NO: 1099465 - RNA, 13 nt, Homo sapiens
agcugcucuggaa

SEQ ID NO: 1099466 - RNA, 21 nt, Homo sapiens
agcuggaacacucucugagau

SEQ ID NO: 1099467 - RNA, 19 nt, Homo sapiens
agcuggcaaagguggcucu

SEQ ID NO: 1099468 - RNA, 22 nt, Homo sapiens
agcugggauaaucacauuauca

SEQ ID NO: 1099469 - RNA, 20 nt, Homo sapiens
agcuggugguaucugaguug

SEQ ID NO: 1099470 - RNA, 18 nt, Homo sapiens
agcugucaggcugauuau

SEQ ID NO: 1099471 - RNA, 11 nt, Homo sapiens
agcugucauca

SEQ ID NO: 1099472 - RNA, 22 nt, Homo sapiens
agcugucaucaauuaaaggcaa

SEQ ID NO: 1099473 - RNA, 11 nt, Homo sapiens
agcugugauuu

SEQ ID NO: 1099474 - RNA, 16 nt, Homo sapiens
agcugugcacuugcag

SEQ ID NO: 1099475 - RNA, 23 nt, Homo sapiens
agcuuaaauaaauucaaaccauu

SEQ ID NO: 1099476 - RNA, 13 nt, Homo sapiens
agcuuagaccuca

SEQ ID NO: 1099477 - RNA, 14 nt, Homo sapiens
agcuucaacccuca

SEQ ID NO: 1099478 - RNA, 23 nt, Homo sapiens
agcuucaacccucagccuugaaa

SEQ ID NO: 1099479 - RNA, 14 nt, Homo sapiens
agcuucagacuuuu

SEQ ID NO: 1099480 - RNA, 22 nt, Homo sapiens
agcuugauccagaccucuacaa

SEQ ID NO: 1099481 - RNA, 22 nt, Homo sapiens
agcuuggaaacuggaugagguc

SEQ ID NO: 1099482 - RNA, 15 nt, Homo sapiens
aggaaaaaaaugacu

SEQ ID NO: 1099483 - RNA, 21 nt, Homo sapiens
aggaaagccucacugauauau

SEQ ID NO: 1099484 - RNA, 18 nt, Homo sapiens
aggaaagggauaguccaa

SEQ ID NO: 1099485 - RNA, 19 nt, Homo sapiens
aggaaauggagaagcucug

SEQ ID NO: 1099486 - RNA, 20 nt, Homo sapiens
aggaaauggagaagcucugu

SEQ ID NO: 1099487 - RNA, 22 nt, Homo sapiens
aggaacacccggaaagacugaa

SEQ ID NO: 1099488 - RNA, 23 nt, Homo sapiens
aggaacacccggaaagacugaaa

SEQ ID NO: 1099489 - RNA, 20 nt, Homo sapiens
aggaagaaaaccagcgcaag

SEQ ID NO: 1099490 - RNA, 19 nt, Homo sapiens
aggaagccaggcugaguga

SEQ ID NO: 1099491 - RNA, 13 nt, Homo sapiens
aggaagguacaaa

SEQ ID NO: 1099492 - RNA, 18 nt, Homo sapiens
caccucugccucaaugug

SEQ ID NO: 1099493 - RNA, 20 nt, Homo sapiens
caccucugccucaaugugaa

SEQ ID NO: 1099494 - RNA, 22 nt, Homo sapiens
caccucuucucuuccuguaaca

SEQ ID NO: 1099495 - RNA, 16 nt, Homo sapiens
caccugccauuugcac

SEQ ID NO: 1099496 - RNA, 14 nt, Homo sapiens
caccuguaauccca

SEQ ID NO: 1099497 - RNA, 14 nt, Homo sapiens
caccuuauguauua

SEQ ID NO: 1099498 - RNA, 16 nt, Homo sapiens
caccuucaauacuuca

SEQ ID NO: 1099499 - RNA, 15 nt, Homo sapiens
caccuugccaagcuu

SEQ ID NO: 1099500 - RNA, 16 nt, Homo sapiens
caccuugcccuuuacg

SEQ ID NO: 1099501 - RNA, 20 nt, Homo sapiens
cacgagagagggcuuucuca

SEQ ID NO: 1099502 - RNA, 22 nt, Homo sapiens
cacgaggagcuuccagugcaug

SEQ ID NO: 1099503 - RNA, 22 nt, Homo sapiens
cacgccuguaaucccagcacuu

SEQ ID NO: 1099504 - RNA, 18 nt, Homo sapiens
cacgucccggaccugugg

SEQ ID NO: 1099505 - RNA, 13 nt, Homo sapiens
cacguguccugua

SEQ ID NO: 1099506 - RNA, 18 nt, Homo sapiens
cacgugugcagacugugg

SEQ ID NO: 1099507 - RNA, 16 nt, Homo sapiens
cacuaaccacgcugga

SEQ ID NO: 1099508 - RNA, 18 nt, Homo sapiens
cacuacgugccaggcacu

SEQ ID NO: 1099509 - RNA, 12 nt, Homo sapiens
cacuacuuaaaa

SEQ ID NO: 1099510 - RNA, 23 nt, Homo sapiens
cacuauagccuaggugacagagu

SEQ ID NO: 1099511 - RNA, 12 nt, Homo sapiens
cacuaugcugcu

SEQ ID NO: 1099512 - RNA, 16 nt, Homo sapiens
cacuauuauggaugaa

SEQ ID NO: 1099513 - RNA, 19 nt, Homo sapiens
cacuauucuuaacuauuca

SEQ ID NO: 1099514 - RNA, 21 nt, Homo sapiens
cacucacuccacaacccaaga

SEQ ID NO: 1099515 - RNA, 20 nt, Homo sapiens
cacucagaaaagaaaaccau

SEQ ID NO: 1099516 - RNA, 21 nt, Homo sapiens
cacucaggccaacaagccaac

SEQ ID NO: 1099517 - RNA, 16 nt, Homo sapiens
cacucauuucaucuca

SEQ ID NO: 1099518 - RNA, 19 nt, Homo sapiens
cacuccagaacaaaccucu

SEQ ID NO: 1099519 - RNA, 17 nt, Homo sapiens
cacucucaaauccugau

SEQ ID NO: 1099520 - RNA, 18 nt, Homo sapiens
cacucuccccucccucuu

SEQ ID NO: 1099521 - RNA, 20 nt, Homo sapiens
cacucugaauaccaagugug

SEQ ID NO: 1099522 - RNA, 14 nt, Homo sapiens
cacucugcucugau

SEQ ID NO: 1099523 - RNA, 13 nt, Homo sapiens
cacucuuaugaaa

SEQ ID NO: 1099524 - RNA, 19 nt, Homo sapiens
uguaccaucugucuugcca

SEQ ID NO: 1099525 - RNA, 15 nt, Homo sapiens
uguacccacuccuca

SEQ ID NO: 1099526 - RNA, 18 nt, Homo sapiens
uguacgucugacaggcaa

SEQ ID NO: 1099527 - RNA, 20 nt, Homo sapiens
uguagaguggcccagaauug

SEQ ID NO: 1099528 - RNA, 15 nt, Homo sapiens
uguagcauuucuuga

SEQ ID NO: 1099529 - RNA, 17 nt, Homo sapiens
uguagccccagugacag

SEQ ID NO: 1099530 - RNA, 13 nt, Homo sapiens
uguagcucuaugg

SEQ ID NO: 1099531 - RNA, 15 nt, Homo sapiens
uguagcuuugcucuu

SEQ ID NO: 1099532 - RNA, 21 nt, Homo sapiens
uguaggccccuggucugcccu

SEQ ID NO: 1099533 - RNA, 22 nt, Homo sapiens
uguaguccguuaacacuacuua

SEQ ID NO: 1099534 - RNA, 20 nt, Homo sapiens
uguauauuccaccauucaca

SEQ ID NO: 1099535 - RNA, 22 nt, Homo sapiens
uguaucagaguugcuuuucuaa

SEQ ID NO: 1099536 - RNA, 17 nt, Homo sapiens
uguaucauuugaacaac

SEQ ID NO: 1099537 - RNA, 15 nt, Homo sapiens
uguaucuaugcauuu

SEQ ID NO: 1099538 - RNA, 18 nt, Homo sapiens
uguaucucuauguggauc

SEQ ID NO: 1099539 - RNA, 20 nt, Homo sapiens
uguaucugaagaccuaccag

SEQ ID NO: 1099540 - RNA, 15 nt, Homo sapiens
uguaugugaaagugu

SEQ ID NO: 1099541 - RNA, 18 nt, Homo sapiens
uguauguuccucuaugaa

SEQ ID NO: 1099542 - RNA, 15 nt, Homo sapiens
uguauuuaacugccu

SEQ ID NO: 1099543 - RNA, 14 nt, Homo sapiens
ugucaaauaucuca

SEQ ID NO: 1099544 - RNA, 18 nt, Homo sapiens
ugucacuguuccuuguca

SEQ ID NO: 1099545 - RNA, 22 nt, Homo sapiens
ugucaucaaauauuaccaaaaa

SEQ ID NO: 1099546 - RNA, 21 nt, Homo sapiens
ugucaucuuccuggaagcaga

SEQ ID NO: 1099547 - RNA, 22 nt, Homo sapiens
ugucaucuuccuggaagcagag

SEQ ID NO: 1099548 - RNA, 15 nt, Homo sapiens
ugucauucauuuaau

SEQ ID NO: 1099549 - RNA, 21 nt, Homo sapiens
ugucccucuuugccuguguga

SEQ ID NO: 1099550 - RNA, 16 nt, Homo sapiens
ugucccugcacuugca

SEQ ID NO: 1099551 - RNA, 18 nt, Homo sapiens
ugucccuugcuguuuuca

SEQ ID NO: 1099552 - RNA, 17 nt, Homo sapiens
uguccuacucuguguca

SEQ ID NO: 1099553 - RNA, 17 nt, Homo sapiens
ugucgaguuuacuucau

SEQ ID NO: 1099554 - RNA, 16 nt, Homo sapiens
ugucgccucugcauuc

SEQ ID NO: 1099555 - RNA, 15 nt, Homo sapiens
uaaucuucauggcca

SEQ ID NO: 1099556 - RNA, 19 nt, Homo sapiens
uaaucuuccauacuucuuc

SEQ ID NO: 1099557 - RNA, 19 nt, Homo sapiens
uaaucuucuuaugcaauuu

SEQ ID NO: 1099558 - RNA, 18 nt, Homo sapiens
uaaugaagacccagugua

SEQ ID NO: 1099559 - RNA, 19 nt, Homo sapiens
uaaugaagacccaguguaa

SEQ ID NO: 1099560 - RNA, 10 nt, Homo sapiens
uaaugccuuc

SEQ ID NO: 1099561 - RNA, 19 nt, Homo sapiens
uaauggcucaugaccugga

SEQ ID NO: 1099562 - RNA, 19 nt, Homo sapiens
uaauguauuuguuugcaau

SEQ ID NO: 1099563 - RNA, 13 nt, Homo sapiens
uaauguuacauua

SEQ ID NO: 1099564 - RNA, 20 nt, Homo sapiens
uaauguuguaauucaugcca

SEQ ID NO: 1099565 - RNA, 22 nt, Homo sapiens
uaauuaaacaagugcacuugaa

SEQ ID NO: 1099566 - RNA, 19 nt, Homo sapiens
uaauuaaguaaaccaaaaa

SEQ ID NO: 1099567 - RNA, 23 nt, Homo sapiens
uaauuagaacaauagcuauugca

SEQ ID NO: 1099568 - RNA, 15 nt, Homo sapiens
uaauucuaugagaua

SEQ ID NO: 1099569 - RNA, 18 nt, Homo sapiens
uaauucucaugugauccu

SEQ ID NO: 1099570 - RNA, 22 nt, Homo sapiens
uaauugcauuucugcucuucca

SEQ ID NO: 1099571 - RNA, 18 nt, Homo sapiens
uaauuggaagaaauuccu

SEQ ID NO: 1099572 - RNA, 15 nt, Homo sapiens
uaauuggcaugaagg

SEQ ID NO: 1099573 - RNA, 16 nt, Homo sapiens
uaauuggcaugaaggu

SEQ ID NO: 1099574 - RNA, 17 nt, Homo sapiens
uaauuuccucugacaug

SEQ ID NO: 1099575 - RNA, 22 nt, Homo sapiens
uaauuugaaauuugacucauga

SEQ ID NO: 1099576 - RNA, 13 nt, Homo sapiens
uaauuuuguagua

SEQ ID NO: 1099577 - RNA, 19 nt, Homo sapiens
uaauuuugugaaagaagga

SEQ ID NO: 1099578 - RNA, 14 nt, Homo sapiens
uaauuuuugcaauu

SEQ ID NO: 1099579 - RNA, 15 nt, Homo sapiens
uacaaaaaacaacaa

SEQ ID NO: 1099580 - RNA, 14 nt, Homo sapiens
uacaaacauaucaa

SEQ ID NO: 1099581 - RNA, 16 nt, Homo sapiens
uacaaagauaugcuaa

SEQ ID NO: 1099582 - RNA, 21 nt, Homo sapiens
uacaaauuguuucuggaauug

SEQ ID NO: 1099583 - RNA, 16 nt, Homo sapiens
uacaacuuccacucca

SEQ ID NO: 1099584 - RNA, 14 nt, Homo sapiens
uacaagaaagcaau

SEQ ID NO: 1099585 - RNA, 15 nt, Homo sapiens
uacaagaaccugcua

SEQ ID NO: 1099586 - RNA, 18 nt, Homo sapiens
uacaauaaagucuuaccu

SEQ ID NO: 1099587 - RNA, 20 nt, Homo sapiens
uacaauaauucuaugagaua

SEQ ID NO: 1099588 - RNA, 13 nt, Homo sapiens
uacaauugucauu

SEQ ID NO: 1099589 - RNA, 21 nt, Homo sapiens
uacacacacacgcgugcacac

SEQ ID NO: 1099590 - RNA, 20 nt, Homo sapiens
uacacauacugcaugcucag

SEQ ID NO: 1099591 - RNA, 19 nt, Homo sapiens
uacacauguaucuaugcau

SEQ ID NO: 1099592 - RNA, 20 nt, Homo sapiens
uacacauguaucuaugcauu

SEQ ID NO: 1099593 - RNA, 13 nt, Homo sapiens
uacaccacucugg

SEQ ID NO: 1099594 - RNA, 15 nt, Homo sapiens
uacaccuaugucauu

SEQ ID NO: 1099595 - RNA, 16 nt, Homo sapiens
uacaccuaugucauuu

SEQ ID NO: 1099596 - RNA, 23 nt, Homo sapiens
uacacucuuauagaaaguucaaa

SEQ ID NO: 1099597 - RNA, 15 nt, Homo sapiens
uacagacguaugcuu

SEQ ID NO: 1099598 - RNA, 15 nt, Homo sapiens
uggaucucaagagcc

SEQ ID NO: 1099599 - RNA, 18 nt, Homo sapiens
uggaucucacaagcacuu

SEQ ID NO: 1099600 - RNA, 19 nt, Homo sapiens
uggaucucacaagcacuuu

SEQ ID NO: 1099601 - RNA, 19 nt, Homo sapiens
uggaugaagcucuggccaa

SEQ ID NO: 1099602 - RNA, 23 nt, Homo sapiens
uggaugucuccaucucugucuca

SEQ ID NO: 1099603 - RNA, 18 nt, Homo sapiens
uggaugugcccacaggga

SEQ ID NO: 1099604 - RNA, 15 nt, Homo sapiens
uggaugugggguccc

SEQ ID NO: 1099605 - RNA, 22 nt, Homo sapiens
uggcaaaucucuauuaggaaau

SEQ ID NO: 1099606 - RNA, 20 nt, Homo sapiens
uggcagugugucacacugag

SEQ ID NO: 1099607 - RNA, 17 nt, Homo sapiens
uggcauucacaucucau

SEQ ID NO: 1099608 - RNA, 15 nt, Homo sapiens
uggccagcacucuga

SEQ ID NO: 1099609 - RNA, 18 nt, Homo sapiens
uggccauuccaacagcuc

SEQ ID NO: 1099610 - RNA, 14 nt, Homo sapiens
uggccccaugucuc

SEQ ID NO: 1099611 - RNA, 19 nt, Homo sapiens
uggcccugggagagccaga

SEQ ID NO: 1099612 - RNA, 15 nt, Homo sapiens
uggccgacucaggga

SEQ ID NO: 1099613 - RNA, 21 nt, Homo sapiens
uggccuagcaggcacaggaca

SEQ ID NO: 1099614 - RNA, 13 nt, Homo sapiens
uggccuaugcaca

SEQ ID NO: 1099615 - RNA, 16 nt, Homo sapiens
uggccuaugcacauau

SEQ ID NO: 1099616 - RNA, 18 nt, Homo sapiens
uggccuaugcacauaugg

SEQ ID NO: 1099617 - RNA, 19 nt, Homo sapiens
uggccugcugggcucucca

SEQ ID NO: 1099618 - RNA, 19 nt, Homo sapiens
uggcgcaagagaacauuuc

SEQ ID NO: 1099619 - RNA, 14 nt, Homo sapiens
uggcuaacuggcga

SEQ ID NO: 1099620 - RNA, 22 nt, Homo sapiens
uggcuaauucccagagugugaa

SEQ ID NO: 1099621 - RNA, 13 nt, Homo sapiens
uggcuaugcaaca

SEQ ID NO: 1099622 - RNA, 21 nt, Homo sapiens
uggcuccaggacagaccuuca

SEQ ID NO: 1099623 - RNA, 18 nt, Homo sapiens
uggcuccuccaggcacgu

SEQ ID NO: 1099624 - RNA, 12 nt, Homo sapiens
uggcucugugaa

SEQ ID NO: 1099625 - RNA, 15 nt, Homo sapiens
uggcugaaaaucacu

SEQ ID NO: 1099626 - RNA, 16 nt, Homo sapiens
uggcugccugcaucua

SEQ ID NO: 1099627 - RNA, 15 nt, Homo sapiens
uggcuuuuucuccuu

SEQ ID NO: 1099628 - RNA, 22 nt, Homo sapiens
ugggaaaaauucagagaguuag

SEQ ID NO: 1099629 - RNA, 18 nt, Homo sapiens
ugggaacccgacugugaa

SEQ ID NO: 1099630 - RNA, 22 nt, Homo sapiens
gaagucuugucucaagaagaaa

SEQ ID NO: 1099631 - RNA, 18 nt, Homo sapiens
gaagugguaggaaagccu

SEQ ID NO: 1099632 - RNA, 14 nt, Homo sapiens
gaauaaagcccuug

SEQ ID NO: 1099633 - RNA, 18 nt, Homo sapiens
gaauaaagccugcuuuuu

SEQ ID NO: 1099634 - RNA, 22 nt, Homo sapiens
gaauaaauaugcucagccaccc

SEQ ID NO: 1099635 - RNA, 12 nt, Homo sapiens
gaauaaccacuu

SEQ ID NO: 1099636 - RNA, 22 nt, Homo sapiens
gaauacaguaagcugcucuauu

SEQ ID NO: 1099637 - RNA, 23 nt, Homo sapiens
gaauaccaguguuauuaaugaca

SEQ ID NO: 1099638 - RNA, 20 nt, Homo sapiens
gaauacccuuuucugaccaa

SEQ ID NO: 1099639 - RNA, 15 nt, Homo sapiens
gaauaccuucuucgc

SEQ ID NO: 1099640 - RNA, 19 nt, Homo sapiens
gaauagcuuugaauguggc

SEQ ID NO: 1099641 - RNA, 20 nt, Homo sapiens
gaauauauuauaaucuucca

SEQ ID NO: 1099642 - RNA, 21 nt, Homo sapiens
gaauauauuauaaucuuccau

SEQ ID NO: 1099643 - RNA, 23 nt, Homo sapiens
gaauauggugggcacagaaguag

SEQ ID NO: 1099644 - RNA, 18 nt, Homo sapiens
gaauauuuauuaccucug

SEQ ID NO: 1099645 - RNA, 16 nt, Homo sapiens
gaaucaaaaauugaag

SEQ ID NO: 1099646 - RNA, 13 nt, Homo sapiens
gaaucaagcuaga

SEQ ID NO: 1099647 - RNA, 20 nt, Homo sapiens
gaaucagugaagaugccagu

SEQ ID NO: 1099648 - RNA, 23 nt, Homo sapiens
gaaucagugaagaugccagugaa

SEQ ID NO: 1099649 - RNA, 17 nt, Homo sapiens
gaaucccggcugucaag

SEQ ID NO: 1099650 - RNA, 20 nt, Homo sapiens
gaaucggagcgaagcagaga

SEQ ID NO: 1099651 - RNA, 18 nt, Homo sapiens
gaaucuccccuccucaca

SEQ ID NO: 1099652 - RNA, 21 nt, Homo sapiens
gaaugaaguggaggaaguaac

SEQ ID NO: 1099653 - RNA, 15 nt, Homo sapiens
gaaugacacuguuca

SEQ ID NO: 1099654 - RNA, 19 nt, Homo sapiens
gaaugcaaaguagcaauuu

SEQ ID NO: 1099655 - RNA, 16 nt, Homo sapiens
gaaugcggaaccauag

SEQ ID NO: 1099656 - RNA, 16 nt, Homo sapiens
gaauggcagcuggaau

SEQ ID NO: 1099657 - RNA, 16 nt, Homo sapiens
gaauggguuugcuaga

SEQ ID NO: 1099658 - RNA, 21 nt, Homo sapiens
gaaugugucugcguuccuguu

SEQ ID NO: 1099659 - RNA, 16 nt, Homo sapiens
gaauguuaagacuuga

SEQ ID NO: 1099660 - RNA, 14 nt, Homo sapiens
gaauguuugccucu

SEQ ID NO: 1099661 - RNA, 23 nt, Homo sapiens
gaauuaaguuagggaauggcaca

SEQ ID NO: 1099662 - RNA, 17 nt, Homo sapiens
gaauuaggaagaccaag

SEQ ID NO: 1099663 - RNA, 14 nt, Homo sapiens
ugucugcacccagg

SEQ ID NO: 1099664 - RNA, 15 nt, Homo sapiens
ugucuggugguggca

SEQ ID NO: 1099665 - RNA, 22 nt, Homo sapiens
ugucuguaucggagacagugau

SEQ ID NO: 1099666 - RNA, 21 nt, Homo sapiens
ugucuguuucaaugaccugua

SEQ ID NO: 1099667 - RNA, 22 nt, Homo sapiens
ugucuguuuuuguaacuuaaaa

SEQ ID NO: 1099668 - RNA, 23 nt, Homo sapiens
ugucuuacagagaaaagacauaa

SEQ ID NO: 1099669 - RNA, 22 nt, Homo sapiens
ugucuuauagguuuccacugcc

SEQ ID NO: 1099670 - RNA, 18 nt, Homo sapiens
ugugaaaguaugugauau

SEQ ID NO: 1099671 - RNA, 14 nt, Homo sapiens
ugugaaugaucucu

SEQ ID NO: 1099672 - RNA, 14 nt, Homo sapiens
ugugacacauaugc

SEQ ID NO: 1099673 - RNA, 15 nt, Homo sapiens
ugugaccagggguga

SEQ ID NO: 1099674 - RNA, 17 nt, Homo sapiens
ugugacccuacuuccug

SEQ ID NO: 1099675 - RNA, 13 nt, Homo sapiens
ugugacuuuccua

SEQ ID NO: 1099676 - RNA, 20 nt, Homo sapiens
ugugagcacucuacugcaag

SEQ ID NO: 1099677 - RNA, 21 nt, Homo sapiens
ugugaguugcacagcuaugaa

SEQ ID NO: 1099678 - RNA, 9 nt, Homo sapiens
ugugcaaua

SEQ ID NO: 1099679 - RNA, 14 nt, Homo sapiens
ugugcagacugugg

SEQ ID NO: 1099680 - RNA, 15 nt, Homo sapiens
ugugcagacuguggc

SEQ ID NO: 1099681 - RNA, 17 nt, Homo sapiens
ugugcauguaugucuug

SEQ ID NO: 1099682 - RNA, 19 nt, Homo sapiens
ugugccuuaggaaaagcau

SEQ ID NO: 1099683 - RNA, 22 nt, Homo sapiens
ugugcugaguugguguugacau

SEQ ID NO: 1099684 - RNA, 14 nt, Homo sapiens
uguggaaaaaucca

SEQ ID NO: 1099685 - RNA, 19 nt, Homo sapiens
uguggcccagggaagccaa

SEQ ID NO: 1099686 - RNA, 15 nt, Homo sapiens
uguggccccaacaca

SEQ ID NO: 1099687 - RNA, 17 nt, Homo sapiens
uguggcugcuagcacuu

SEQ ID NO: 1099688 - RNA, 21 nt, Homo sapiens
uguggcugcuagcacuuggag

SEQ ID NO: 1099689 - RNA, 15 nt, Homo sapiens
uguggcuuaguaaua

SEQ ID NO: 1099690 - RNA, 14 nt, Homo sapiens
uguggcuuccucag

SEQ ID NO: 1099691 - RNA, 17 nt, Homo sapiens
ugugggacugagaugca

SEQ ID NO: 1099692 - RNA, 20 nt, Homo sapiens
ugugggguccccaucauccc

SEQ ID NO: 1099693 - RNA, 20 nt, Homo sapiens
uguggguuuuuucacauaaa

SEQ ID NO: 1099694 - RNA, 13 nt, Homo sapiens
ugugguagccuca

SEQ ID NO: 1099695 - RNA, 19 nt, Homo sapiens
ugugguuaaugccauggac

SEQ ID NO: 1099696 - RNA, 16 nt, Homo sapiens
uguguaccugugacua

SEQ ID NO: 1099697 - RNA, 16 nt, Homo sapiens
uguguacugcaguugg

SEQ ID NO: 1099698 - RNA, 15 nt, Homo sapiens
uguguagccugugca

SEQ ID NO: 1099699 - RNA, 22 nt, Homo sapiens
uguguagcucuguccacucuga

SEQ ID NO: 1099700 - RNA, 13 nt, Homo sapiens
uguguagcuguga

SEQ ID NO: 1099701 - RNA, 17 nt, Homo sapiens
uguguauuuaacugccu

SEQ ID NO: 1099702 - RNA, 14 nt, Homo sapiens
ugugucacacugag

SEQ ID NO: 1099703 - RNA, 16 nt, Homo sapiens
ugugucaguggaugcu

SEQ ID NO: 1099704 - RNA, 13 nt, Homo sapiens
ugugucuguacac

SEQ ID NO: 1099705 - RNA, 14 nt, Homo sapiens
ugugugaccccaaa

SEQ ID NO: 1099706 - RNA, 16 nt, Homo sapiens
ugugugcacguacaca

SEQ ID NO: 1099707 - RNA, 23 nt, Homo sapiens
uguguugggaauugcaugccauc

SEQ ID NO: 1099708 - RNA, 21 nt, Homo sapiens
uguguuuccuucagugcaucu

SEQ ID NO: 1099709 - RNA, 17 nt, Homo sapiens
uguguuucuggggacac

SEQ ID NO: 1099710 - RNA, 21 nt, Homo sapiens
uguguuucuggggacaccagc

SEQ ID NO: 1099711 - RNA, 13 nt, Homo sapiens
uguuaaaauaacu

SEQ ID NO: 1099712 - RNA, 15 nt, Homo sapiens
uguuaaaaucaggau

SEQ ID NO: 1099713 - RNA, 19 nt, Homo sapiens
uguuaaaauguacacugga

SEQ ID NO: 1099714 - RNA, 15 nt, Homo sapiens
uguuaagacuugaca

SEQ ID NO: 1099715 - RNA, 13 nt, Homo sapiens
uguuaaugcauca

SEQ ID NO: 1099716 - RNA, 21 nt, Homo sapiens
uguuacuugaaauaccaguga

SEQ ID NO: 1099717 - RNA, 20 nt, Homo sapiens
uguuaucagucauaacuaaa

SEQ ID NO: 1099718 - RNA, 18 nt, Homo sapiens
uguuauuuuuuauuucca

SEQ ID NO: 1099719 - RNA, 17 nt, Homo sapiens
uguucagcuccagcuca

SEQ ID NO: 1099720 - RNA, 15 nt, Homo sapiens
uguucauguuacuca

SEQ ID NO: 1099721 - RNA, 22 nt, Homo sapiens
uguucauuaaauuuucuaugcu

SEQ ID NO: 1099722 - RNA, 18 nt, Homo sapiens
uaaaguaauuuugugaaa

SEQ ID NO: 1099723 - RNA, 16 nt, Homo sapiens
uaaaguacccugugcu

SEQ ID NO: 1099724 - RNA, 16 nt, Homo sapiens
uaaaguauauauuuau

SEQ ID NO: 1099725 - RNA, 20 nt, Homo sapiens
uaaagugaauaaccacuuaa

SEQ ID NO: 1099726 - RNA, 21 nt, Homo sapiens
uaaagugaauaaccacuuaaa

SEQ ID NO: 1099727 - RNA, 15 nt, Homo sapiens
uaaaguugauaaaga

SEQ ID NO: 1099728 - RNA, 19 nt, Homo sapiens
uaaaguuguuugugccuuu

SEQ ID NO: 1099729 - RNA, 19 nt, Homo sapiens
uaaauaauguuaucugugu

SEQ ID NO: 1099730 - RNA, 12 nt, Homo sapiens
uaaauagcucag

SEQ ID NO: 1099731 - RNA, 17 nt, Homo sapiens
uaaauauguacacaagu

SEQ ID NO: 1099732 - RNA, 13 nt, Homo sapiens
uaaauccuuccau

SEQ ID NO: 1099733 - RNA, 20 nt, Homo sapiens
uaaaucuguuauuuugcuau

SEQ ID NO: 1099734 - RNA, 15 nt, Homo sapiens
uaaaugaagugcaaa

SEQ ID NO: 1099735 - RNA, 16 nt, Homo sapiens
uaaaugaagugcaaau

SEQ ID NO: 1099736 - RNA, 17 nt, Homo sapiens
uaaaugaaucuuacucc

SEQ ID NO: 1099737 - RNA, 17 nt, Homo sapiens
uaaaugcaaacacugug

SEQ ID NO: 1099738 - RNA, 14 nt, Homo sapiens
uaaaugcauguccu

SEQ ID NO: 1099739 - RNA, 15 nt, Homo sapiens
uaaaugcauguccuc

SEQ ID NO: 1099740 - RNA, 17 nt, Homo sapiens
uaaaugcauguccucaa

SEQ ID NO: 1099741 - RNA, 13 nt, Homo sapiens
uaaaugccuaaua

SEQ ID NO: 1099742 - RNA, 17 nt, Homo sapiens
uaaauguaucauagaaa

SEQ ID NO: 1099743 - RNA, 19 nt, Homo sapiens
uaaauguaucuuauucaca

SEQ ID NO: 1099744 - RNA, 18 nt, Homo sapiens
uaaaugucuuaaucauga

SEQ ID NO: 1099745 - RNA, 16 nt, Homo sapiens
uaaauguguaaaugug

SEQ ID NO: 1099746 - RNA, 14 nt, Homo sapiens
uaaauuaguauuua

SEQ ID NO: 1099747 - RNA, 21 nt, Homo sapiens
uaaauuggaauuuucuuaccc

SEQ ID NO: 1099748 - RNA, 20 nt, Homo sapiens
uaaauuggugauaaguggaa

SEQ ID NO: 1099749 - RNA, 13 nt, Homo sapiens
uaaauuuauuuca

SEQ ID NO: 1099750 - RNA, 23 nt, Homo sapiens
uaaauuugggggacuuacaugau

SEQ ID NO: 1099751 - RNA, 17 nt, Homo sapiens
uaaauuuguguucucaa

SEQ ID NO: 1099752 - RNA, 20 nt, Homo sapiens
uaaauuuguguucucaaaua

SEQ ID NO: 1099753 - RNA, 15 nt, Homo sapiens
uaaauuuucuaugcu

SEQ ID NO: 1099754 - RNA, 15 nt, Homo sapiens
uaacaaaacaagaaa

SEQ ID NO: 1099755 - RNA, 17 nt, Homo sapiens
uaacaaagaacaagcau

SEQ ID NO: 1099756 - RNA, 13 nt, Homo sapiens
uaacaacuguggu

SEQ ID NO: 1099757 - RNA, 14 nt, Homo sapiens
uaacacaagccaca

SEQ ID NO: 1099758 - RNA, 17 nt, Homo sapiens
uaacacaagccacagaa

SEQ ID NO: 1099759 - RNA, 18 nt, Homo sapiens
uaacacaagccacagaag

SEQ ID NO: 1099760 - RNA, 14 nt, Homo sapiens
uaacacuacuuaaa

SEQ ID NO: 1099761 - RNA, 23 nt, Homo sapiens
uaacagaccacuguauguuuacu

SEQ ID NO: 1099762 - RNA, 22 nt, Homo sapiens
uaacaggcucaauauuccugaa

SEQ ID NO: 1099763 - RNA, 14 nt, Homo sapiens
uaacaguucacuuu

SEQ ID NO: 1099764 - RNA, 19 nt, Homo sapiens
gaaagaguccuauuugcac

SEQ ID NO: 1099765 - RNA, 17 nt, Homo sapiens
gaaagcaaucugagaga

SEQ ID NO: 1099766 - RNA, 15 nt, Homo sapiens
gaaagccucuggaaa

SEQ ID NO: 1099767 - RNA, 21 nt, Homo sapiens
gaaaggagaacuauccaaaac

SEQ ID NO: 1099768 - RNA, 13 nt, Homo sapiens
gaaaggcucaguc

SEQ ID NO: 1099769 - RNA, 21 nt, Homo sapiens
gaaagggucaacggcccuguu

SEQ ID NO: 1099770 - RNA, 19 nt, Homo sapiens
gaaaggucauuguggcuau

SEQ ID NO: 1099771 - RNA, 19 nt, Homo sapiens
gaaauaaaagccucuggug

SEQ ID NO: 1099772 - RNA, 21 nt, Homo sapiens
gaaauaaaagccucuggugga

SEQ ID NO: 1099773 - RNA, 19 nt, Homo sapiens
gaaauaaguuuuuguuuca

SEQ ID NO: 1099774 - RNA, 21 nt, Homo sapiens
gaaauagccaccgucuacaga

SEQ ID NO: 1099775 - RNA, 13 nt, Homo sapiens
gaaauauaaugca

SEQ ID NO: 1099776 - RNA, 17 nt, Homo sapiens
gaaauauuuaaguauau

SEQ ID NO: 1099777 - RNA, 15 nt, Homo sapiens
gaaaucgaugagaaa

SEQ ID NO: 1099778 - RNA, 21 nt, Homo sapiens
gaaaugacuuugaaaaccugg

SEQ ID NO: 1099779 - RNA, 21 nt, Homo sapiens
gaaaugcccaucuaugucccu

SEQ ID NO: 1099780 - RNA, 16 nt, Homo sapiens
gaacaagcauuaguuu

SEQ ID NO: 1099781 - RNA, 19 nt, Homo sapiens
gaacaaguuguuucauuga

SEQ ID NO: 1099782 - RNA, 14 nt, Homo sapiens
gaacaaugaaugcu

SEQ ID NO: 1099783 - RNA, 17 nt, Homo sapiens
gaacagaaggaugaaug

SEQ ID NO: 1099784 - RNA, 16 nt, Homo sapiens
gaacagacaacagaag

SEQ ID NO: 1099785 - RNA, 21 nt, Homo sapiens
gaacagacaacagaagucaug

SEQ ID NO: 1099786 - RNA, 15 nt, Homo sapiens
gaacaguaacugcca

SEQ ID NO: 1099787 - RNA, 13 nt, Homo sapiens
gaacaguguuucc

SEQ ID NO: 1099788 - RNA, 18 nt, Homo sapiens
gaaccaaaagagaucaca

SEQ ID NO: 1099789 - RNA, 12 nt, Homo sapiens
gaaccacuuugc

SEQ ID NO: 1099790 - RNA, 10 nt, Homo sapiens
gaaccaugaa

SEQ ID NO: 1099791 - RNA, 12 nt, Homo sapiens
gaacccaggaca

SEQ ID NO: 1099792 - RNA, 21 nt, Homo sapiens
gaacccugcuugcacuuugua

SEQ ID NO: 1099793 - RNA, 21 nt, Homo sapiens
gaaccgagcaauuuucugcua

SEQ ID NO: 1099794 - RNA, 19 nt, Homo sapiens
gaaccugaaggugcugaca

SEQ ID NO: 1099795 - RNA, 15 nt, Homo sapiens
gaacgaguuguuggc

SEQ ID NO: 1099796 - RNA, 17 nt, Homo sapiens
gaacuauuagacaugaa

SEQ ID NO: 1099797 - RNA, 16 nt, Homo sapiens
aaauaugaaagacuua

SEQ ID NO: 1099798 - RNA, 22 nt, Homo sapiens
aaauaugcucagccacccugug

SEQ ID NO: 1099799 - RNA, 16 nt, Homo sapiens
aaauauuauugguguu

SEQ ID NO: 1099800 - RNA, 19 nt, Homo sapiens
aaauauuuacauaugaaau

SEQ ID NO: 1099801 - RNA, 15 nt, Homo sapiens
aaauauuuaugagaa

SEQ ID NO: 1099802 - RNA, 12 nt, Homo sapiens
aaauauuucagg

SEQ ID NO: 1099803 - RNA, 12 nt, Homo sapiens
aaaucacuauaa

SEQ ID NO: 1099804 - RNA, 17 nt, Homo sapiens
aaaucaugaauauuuca

SEQ ID NO: 1099805 - RNA, 19 nt, Homo sapiens
aaaucauuaauacucuucu

SEQ ID NO: 1099806 - RNA, 10 nt, Homo sapiens
aaauccaaag

SEQ ID NO: 1099807 - RNA, 20 nt, Homo sapiens
aaaucccuauuuaauuuucc

SEQ ID NO: 1099808 - RNA, 16 nt, Homo sapiens
aaauccuguuacuuaa

SEQ ID NO: 1099809 - RNA, 15 nt, Homo sapiens
aaauccuuccaugaa

SEQ ID NO: 1099810 - RNA, 23 nt, Homo sapiens
aaaucggaucuggggcucuggga

SEQ ID NO: 1099811 - RNA, 17 nt, Homo sapiens
aagaauugaacccagga

SEQ ID NO: 1099812 - RNA, 14 nt, Homo sapiens
aagacaacauuucu

SEQ ID NO: 1099813 - RNA, 13 nt, Homo sapiens
aagacaauggcuu

SEQ ID NO: 1099814 - RNA, 14 nt, Homo sapiens
aagacacagacugc

SEQ ID NO: 1099815 - RNA, 14 nt, Homo sapiens
aagacagauuacca

SEQ ID NO: 1099816 - RNA, 21 nt, Homo sapiens
aagacaggucuagacuuucuc

SEQ ID NO: 1099817 - RNA, 22 nt, Homo sapiens
aagaccauaacagccaacaggu

SEQ ID NO: 1099818 - RNA, 16 nt, Homo sapiens
aagacccaguguaaag

SEQ ID NO: 1099819 - RNA, 20 nt, Homo sapiens
aagaccuucugaagaucuca

SEQ ID NO: 1099820 - RNA, 15 nt, Homo sapiens
aagacuacacuguug

SEQ ID NO: 1099821 - RNA, 14 nt, Homo sapiens
aagacuccugggcu

SEQ ID NO: 1099822 - RNA, 22 nt, Homo sapiens
aagacucuacccauauuacaga

SEQ ID NO: 1099823 - RNA, 16 nt, Homo sapiens
aagagccugacugugu

SEQ ID NO: 1099824 - RNA, 22 nt, Homo sapiens
aagagcuggcaaagguggcucu

SEQ ID NO: 1099825 - RNA, 21 nt, Homo sapiens
aagagcuuacaagacccuaug

SEQ ID NO: 1099826 - RNA, 22 nt, Homo sapiens
aagagucuuaauauauauaucc

SEQ ID NO: 1099827 - RNA, 21 nt, Homo sapiens
aagagugagugaacaacuauu

SEQ ID NO: 1099828 - RNA, 19 nt, Homo sapiens
aagagugccguaacaacug

SEQ ID NO: 1099829 - RNA, 18 nt, Homo sapiens
cucacgccuaugauccca

SEQ ID NO: 1099830 - RNA, 13 nt, Homo sapiens
cucacugauauau

SEQ ID NO: 1099831 - RNA, 15 nt, Homo sapiens
cucagaauccaaaga

SEQ ID NO: 1099832 - RNA, 20 nt, Homo sapiens
cucagaauccaaagaucaca

SEQ ID NO: 1099833 - RNA, 21 nt, Homo sapiens
cucagucugggugggacuuau

SEQ ID NO: 1099834 - RNA, 11 nt, Homo sapiens
cucagugccac

SEQ ID NO: 1099835 - RNA, 13 nt, Homo sapiens
cucauaguauggu

SEQ ID NO: 1099836 - RNA, 22 nt, Homo sapiens
cucaucaacaaagaaauauuau

SEQ ID NO: 1099837 - RNA, 22 nt, Homo sapiens
cucaucaguguccucuugcuca

SEQ ID NO: 1099838 - RNA, 23 nt, Homo sapiens
cucaucaguguccucuugcucaa

SEQ ID NO: 1099839 - RNA, 19 nt, Homo sapiens
cucaucuguuauccugcua

SEQ ID NO: 1099840 - RNA, 16 nt, Homo sapiens
cucaugagcacagggu

SEQ ID NO: 1099841 - RNA, 20 nt, Homo sapiens
cucauggcagcuaagccaca

SEQ ID NO: 1099842 - RNA, 21 nt, Homo sapiens
cucauggcagcuaagccacau

SEQ ID NO: 1099843 - RNA, 12 nt, Homo sapiens
cucauuagacug

SEQ ID NO: 1099844 - RNA, 10 nt, Homo sapiens
cucauuccac

SEQ ID NO: 1099845 - RNA, 13 nt, Homo sapiens
cucauuguagaaa

SEQ ID NO: 1099846 - RNA, 22 nt, Homo sapiens
cucauuguagaaaagcuauaaa

SEQ ID NO: 1099847 - RNA, 15 nt, Homo sapiens
cucauuuaagggaaa

SEQ ID NO: 1099848 - RNA, 13 nt, Homo sapiens
cuccaaaugagau

SEQ ID NO: 1099849 - RNA, 18 nt, Homo sapiens
cuccaaauuuuuuuuacu

SEQ ID NO: 1099850 - RNA, 17 nt, Homo sapiens
cuccagaacaaaccucu

SEQ ID NO: 1099851 - RNA, 20 nt, Homo sapiens
cuccagaacaaaccucuaua

SEQ ID NO: 1099852 - RNA, 21 nt, Homo sapiens
cuccagccugacuuggggaga

SEQ ID NO: 1099853 - RNA, 14 nt, Homo sapiens
cuccaggaaugccu

SEQ ID NO: 1099854 - RNA, 21 nt, Homo sapiens
cuccaggaugaguuacuugaa

SEQ ID NO: 1099855 - RNA, 19 nt, Homo sapiens
cuccaggauugaagagcau

SEQ ID NO: 1099856 - RNA, 19 nt, Homo sapiens
cuccagucuggucggcaag

SEQ ID NO: 1099857 - RNA, 14 nt, Homo sapiens
cuccauucugacca

SEQ ID NO: 1099858 - RNA, 19 nt, Homo sapiens
cuccauucugaccauuuca

SEQ ID NO: 1099859 - RNA, 21 nt, Homo sapiens
cuccauuugcaauugaccucu

SEQ ID NO: 1099860 - RNA, 19 nt, Homo sapiens
cucccaaagugcugggauu

SEQ ID NO: 1099861 - RNA, 19 nt, Homo sapiens
cucccaaggcucugagcaa

SEQ ID NO: 1099862 - RNA, 18 nt, Homo sapiens
cucccaccccacccccuu

SEQ ID NO: 1099863 - RNA, 15 nt, Homo sapiens
cucccagcccuaugg

SEQ ID NO: 1099864 - RNA, 15 nt, Homo sapiens
cuccccacucuaggg

SEQ ID NO: 1099865 - RNA, 14 nt, Homo sapiens
cucccccacucuau

SEQ ID NO: 1099866 - RNA, 14 nt, Homo sapiens
cuccccccacugca

SEQ ID NO: 1099867 - RNA, 17 nt, Homo sapiens
cucccccugccagugcc

SEQ ID NO: 1099868 - RNA, 13 nt, Homo sapiens
cuccccuuugccu

SEQ ID NO: 1099869 - RNA, 20 nt, Homo sapiens
cucccgggagaggagaucag

SEQ ID NO: 1099870 - RNA, 16 nt, Homo sapiens
cucccuaggagaccaa

SEQ ID NO: 1099871 - RNA, 22 nt, Homo sapiens
cucccuauccuaaaggcccacu

SEQ ID NO: 1099872 - RNA, 13 nt, Homo sapiens
cucccucaugagc

SEQ ID NO: 1099873 - RNA, 21 nt, Homo sapiens
cucccuuccugaggagcuguu

SEQ ID NO: 1099874 - RNA, 19 nt, Homo sapiens
cucccuuguggcuuccuca

SEQ ID NO: 1099875 - RNA, 19 nt, Homo sapiens
cuccgcuuucuacccagcg

SEQ ID NO: 1099876 - RNA, 14 nt, Homo sapiens
cuccgucaccucag

SEQ ID NO: 1099877 - RNA, 18 nt, Homo sapiens
cuccuaaauuuccagggg

SEQ ID NO: 1099878 - RNA, 12 nt, Homo sapiens
cuccucaaaagc

SEQ ID NO: 1099879 - RNA, 16 nt, Homo sapiens
cuccucuccccagcaa

SEQ ID NO: 1099880 - RNA, 15 nt, Homo sapiens
cuccucucugagacu

SEQ ID NO: 1099881 - RNA, 22 nt, Homo sapiens
cuccucuguccaggcacugcug

SEQ ID NO: 1099882 - RNA, 12 nt, Homo sapiens
cuccugcaaaau

SEQ ID NO: 1099883 - RNA, 15 nt, Homo sapiens
cuccugcaggugucu

SEQ ID NO: 1099884 - RNA, 14 nt, Homo sapiens
cugcaggaaucaaa

SEQ ID NO: 1099885 - RNA, 23 nt, Homo sapiens
cugcaggcaaagugagacugaca

SEQ ID NO: 1099886 - RNA, 22 nt, Homo sapiens
cugcagggggugugucugcuca

SEQ ID NO: 1099887 - RNA, 21 nt, Homo sapiens
cugcaguauggccaugggcug

SEQ ID NO: 1099888 - RNA, 21 nt, Homo sapiens
cugcagugacgugcaccugua

SEQ ID NO: 1099889 - RNA, 23 nt, Homo sapiens
cugcagugggccauccagagcau

SEQ ID NO: 1099890 - RNA, 14 nt, Homo sapiens
cugcauaaucauau

SEQ ID NO: 1099891 - RNA, 19 nt, Homo sapiens
cugcauggagugagcagua

SEQ ID NO: 1099892 - RNA, 13 nt, Homo sapiens
cugcauugcugag

SEQ ID NO: 1099893 - RNA, 19 nt, Homo sapiens
cugcauuuauaaaugugug

SEQ ID NO: 1099894 - RNA, 22 nt, Homo sapiens
cugccaaccagcuuguccaaca

SEQ ID NO: 1099895 - RNA, 16 nt, Homo sapiens
cugccaaggaugacac

SEQ ID NO: 1099896 - RNA, 16 nt, Homo sapiens
cugccacccuggggag

SEQ ID NO: 1099897 - RNA, 20 nt, Homo sapiens
cugccagugccuuaccuccu

SEQ ID NO: 1099898 - RNA, 19 nt, Homo sapiens
cugccauauucuguuggcc

SEQ ID NO: 1099899 - RNA, 18 nt, Homo sapiens
cugccuaaguggcugcug

SEQ ID NO: 1099900 - RNA, 12 nt, Homo sapiens
cugccuacaucc

SEQ ID NO: 1099901 - RNA, 16 nt, Homo sapiens
cugccugaagucacac

SEQ ID NO: 1099902 - RNA, 17 nt, Homo sapiens
cugccugaagucacaca

SEQ ID NO: 1099903 - RNA, 14 nt, Homo sapiens
cugccuguagcccc

SEQ ID NO: 1099904 - RNA, 20 nt, Homo sapiens
cugccugugugggacugaga

SEQ ID NO: 1099905 - RNA, 20 nt, Homo sapiens
cugccuuccacaauucacua

SEQ ID NO: 1099906 - RNA, 18 nt, Homo sapiens
cugccuugaagccacuga

SEQ ID NO: 1099907 - RNA, 17 nt, Homo sapiens
cugccuuuucaucuaau

SEQ ID NO: 1099908 - RNA, 16 nt, Homo sapiens
cugcgagcauuucccu

SEQ ID NO: 1099909 - RNA, 17 nt, Homo sapiens
cugcuaccucacugggg

SEQ ID NO: 1099910 - RNA, 13 nt, Homo sapiens
cugcucaaguuga

SEQ ID NO: 1099911 - RNA, 21 nt, Homo sapiens
cugcucccaaauaaacuccag

SEQ ID NO: 1099912 - RNA, 22 nt, Homo sapiens
cugcucuggaaaaugugaccca

SEQ ID NO: 1099913 - RNA, 11 nt, Homo sapiens
cugcucuugcc

SEQ ID NO: 1099914 - RNA, 23 nt, Homo sapiens
cugcucuuugauucaaagcacug

SEQ ID NO: 1099915 - RNA, 19 nt, Homo sapiens
cugcugagugcaccacuuc

SEQ ID NO: 1099916 - RNA, 19 nt, Homo sapiens
cugcuguucauguuacuca

SEQ ID NO: 1099917 - RNA, 14 nt, Homo sapiens
cugcuuaguaucuc

SEQ ID NO: 1099918 - RNA, 15 nt, Homo sapiens
cugcuucugaacuca

SEQ ID NO: 1099919 - RNA, 22 nt, Homo sapiens
cugcuucuuuucacuucagagc

SEQ ID NO: 1099920 - RNA, 20 nt, Homo sapiens
cugcuuuucuucccagcaaa

SEQ ID NO: 1099921 - RNA, 15 nt, Homo sapiens
cuggaaaaugugacc

SEQ ID NO: 1099922 - RNA, 12 nt, Homo sapiens
cuggaacccagg

SEQ ID NO: 1099923 - RNA, 15 nt, Homo sapiens
cuggaagcauuuguu

SEQ ID NO: 1099924 - RNA, 14 nt, Homo sapiens
cuggaccucagguu

SEQ ID NO: 1099925 - RNA, 18 nt, Homo sapiens
cuggagcaucugacucac

SEQ ID NO: 1099926 - RNA, 20 nt, Homo sapiens
cuggaucucacaagcacuuu

SEQ ID NO: 1099927 - RNA, 17 nt, Homo sapiens
cuggaucucagccucug

SEQ ID NO: 1099928 - RNA, 13 nt, Homo sapiens
cuggauggcacca

SEQ ID NO: 1099929 - RNA, 13 nt, Homo sapiens
cuggaugucucca

SEQ ID NO: 1099930 - RNA, 15 nt, Homo sapiens
cuggcacuccccuga

SEQ ID NO: 1099931 - RNA, 19 nt, Homo sapiens
cuggccagaugcaccagcc

SEQ ID NO: 1099932 - RNA, 20 nt, Homo sapiens
cuggcgugcaguggugcgau

SEQ ID NO: 1099933 - RNA, 14 nt, Homo sapiens
cuggcucucagaag

SEQ ID NO: 1099934 - RNA, 13 nt, Homo sapiens
cugggacuuucac

SEQ ID NO: 1099935 - RNA, 17 nt, Homo sapiens
cugggagaaccucaggc

SEQ ID NO: 1099936 - RNA, 12 nt, Homo sapiens
cugggagagcca

SEQ ID NO: 1099937 - RNA, 22 nt, Homo sapiens
cugggagugauaugauguguag

SEQ ID NO: 1099938 - RNA, 21 nt, Homo sapiens
cugggaucaagaaggggacag

SEQ ID NO: 1099939 - RNA, 18 nt, Homo sapiens
cugggauuacaagcguga

SEQ ID NO: 1099940 - RNA, 15 nt, Homo sapiens
cugggauuacaggug

SEQ ID NO: 1099941 - RNA, 19 nt, Homo sapiens
cugggauucccaccaaggu

SEQ ID NO: 1099942 - RNA, 20 nt, Homo sapiens
gagauggggucuugcuauau

SEQ ID NO: 1099943 - RNA, 18 nt, Homo sapiens
gagauucuugugccucag

SEQ ID NO: 1099944 - RNA, 20 nt, Homo sapiens
gagauugcaccauugcgcuc

SEQ ID NO: 1099945 - RNA, 21 nt, Homo sapiens
gagauugcaccauugcgcucu

SEQ ID NO: 1099946 - RNA, 21 nt, Homo sapiens
gagauugcgccacugcacucc

SEQ ID NO: 1099947 - RNA, 19 nt, Homo sapiens
gagcaaauaaagaccugag

SEQ ID NO: 1099948 - RNA, 18 nt, Homo sapiens
gagcaaauguggcuccug

SEQ ID NO: 1099949 - RNA, 19 nt, Homo sapiens
gagcaauuugcacauguaa

SEQ ID NO: 1099950 - RNA, 15 nt, Homo sapiens
gagcacaucugggag

SEQ ID NO: 1099951 - RNA, 23 nt, Homo sapiens
gagcacugccaggagggacaaag

SEQ ID NO: 1099952 - RNA, 17 nt, Homo sapiens
gagcaggggcaggguga

SEQ ID NO: 1099953 - RNA, 17 nt, Homo sapiens
gagcaggguuagcucac

SEQ ID NO: 1099954 - RNA, 17 nt, Homo sapiens
gagcaguagaagccugc

SEQ ID NO: 1099955 - RNA, 14 nt, Homo sapiens
gagcaucucugugu

SEQ ID NO: 1099956 - RNA, 14 nt, Homo sapiens
gagccaagcuucaa

SEQ ID NO: 1099957 - RNA, 13 nt, Homo sapiens
gagccaaggguuc

SEQ ID NO: 1099958 - RNA, 17 nt, Homo sapiens
gagccagccuugcagua

SEQ ID NO: 1099959 - RNA, 23 nt, Homo sapiens
gagccagcucucucuacccggcc

SEQ ID NO: 1099960 - RNA, 20 nt, Homo sapiens
gagcccagaaaaccuccagu

SEQ ID NO: 1099961 - RNA, 16 nt, Homo sapiens
gagccucgguggccau

SEQ ID NO: 1099962 - RNA, 15 nt, Homo sapiens
gagccucuccuugcc

SEQ ID NO: 1099963 - RNA, 18 nt, Homo sapiens
gagccuggggcaucccag

SEQ ID NO: 1099964 - RNA, 22 nt, Homo sapiens
gagccugucuuucagcauucag

SEQ ID NO: 1099965 - RNA, 16 nt, Homo sapiens
gagcucacaaggcagc

SEQ ID NO: 1099966 - RNA, 15 nt, Homo sapiens
gauguguaaauggag

SEQ ID NO: 1099967 - RNA, 15 nt, Homo sapiens
gauguucugggacac

SEQ ID NO: 1099968 - RNA, 15 nt, Homo sapiens
gauguuucugucaca

SEQ ID NO: 1099969 - RNA, 20 nt, Homo sapiens
gauguuuugucccauuuccu

SEQ ID NO: 1099970 - RNA, 23 nt, Homo sapiens
gauuaaaaucuggcaaaguuaua

SEQ ID NO: 1099971 - RNA, 13 nt, Homo sapiens
gauuagcacuuaa

SEQ ID NO: 1099972 - RNA, 18 nt, Homo sapiens
gauuagcucuggaccagc

SEQ ID NO: 1099973 - RNA, 11 nt, Homo sapiens
gauuccauuug

SEQ ID NO: 1099974 - RNA, 17 nt, Homo sapiens
gauugacacacagcacu

SEQ ID NO: 1099975 - RNA, 18 nt, Homo sapiens
gauugacacacagcacuc

SEQ ID NO: 1099976 - RNA, 19 nt, Homo sapiens
gauugauagaguguuauca

SEQ ID NO: 1099977 - RNA, 15 nt, Homo sapiens
gauuggccccacuga

SEQ ID NO: 1099978 - RNA, 17 nt, Homo sapiens
gauuggcucacccaagc

SEQ ID NO: 1099979 - RNA, 19 nt, Homo sapiens
gauuuaugaucacuuggaa

SEQ ID NO: 1099980 - RNA, 22 nt, Homo sapiens
gauuucaggauacucugucaga

SEQ ID NO: 1099981 - RNA, 21 nt, Homo sapiens
gauuugaacccccgccauccu

SEQ ID NO: 1099982 - RNA, 20 nt, Homo sapiens
gauuuuacagagaaucugaa

SEQ ID NO: 1099983 - RNA, 12 nt, Homo sapiens
gauuuuuacaca

SEQ ID NO: 1099984 - RNA, 21 nt, Homo sapiens
gauuuuuacacauguaucuau

SEQ ID NO: 1099985 - RNA, 20 nt, Homo sapiens
gcaaaaaaauuaaauuauuu

SEQ ID NO: 1099986 - RNA, 16 nt, Homo sapiens
gcaaaacuccaucuca

SEQ ID NO: 1099987 - RNA, 17 nt, Homo sapiens
gcaaaacuccaucucaa

SEQ ID NO: 1099988 - RNA, 23 nt, Homo sapiens
gcaaacccaaaaccucaugacag

SEQ ID NO: 1099989 - RNA, 23 nt, Homo sapiens
gcaaagcuaaaauugaacuacuu

SEQ ID NO: 1099990 - RNA, 15 nt, Homo sapiens
gcaaaggccagcagc

SEQ ID NO: 1099991 - RNA, 17 nt, Homo sapiens
gcaaagggagcacuggg

SEQ ID NO: 1099992 - RNA, 18 nt, Homo sapiens
gcaaagggagcacugggu

SEQ ID NO: 1099993 - RNA, 18 nt, Homo sapiens
gcaaauaaagaccugaga

SEQ ID NO: 1099994 - RNA, 14 nt, Homo sapiens
gcaaauaaauauca

SEQ ID NO: 1099995 - RNA, 21 nt, Homo sapiens
gcaaauguaguauggccugug

SEQ ID NO: 1099996 - RNA, 14 nt, Homo sapiens
gcaaauuugauaca

SEQ ID NO: 1099997 - RNA, 13 nt, Homo sapiens
gcaacaaagugag

SEQ ID NO: 1099998 - RNA, 20 nt, Homo sapiens
gcaaccagaggaaacuugca

SEQ ID NO: 1099999 - RNA, 18 nt, Homo sapiens
gcaacucuauagacuuuu

SEQ ID NO: 1100000 - RNA, 16 nt, Homo sapiens
gcaagacguccuggaa

SEQ ID NO: 1100001 - RNA, 17 nt, Homo sapiens
gcaagaucuugucucca

SEQ ID NO: 1100002 - RNA, 14 nt, Homo sapiens
gcaagcaccaggcu

SEQ ID NO: 1100003 - RNA, 17 nt, Homo sapiens
gcaaggacggccuucaa

SEQ ID NO: 1100004 - RNA, 22 nt, Homo sapiens
gcaaggacugcagggacugcca

SEQ ID NO: 1100005 - RNA, 16 nt, Homo sapiens
gcaaucucuugucuca

SEQ ID NO: 1100006 - RNA, 18 nt, Homo sapiens
gcaaugucccuugcacag

SEQ ID NO: 1100007 - RNA, 13 nt, Homo sapiens
gcaauuugcacau

SEQ ID NO: 1100008 - RNA, 17 nt, Homo sapiens
gcaauuuugcauuugaa

SEQ ID NO: 1100009 - RNA, 19 nt, Homo sapiens
gcacaaaccuuacuaugga

SEQ ID NO: 1100010 - RNA, 14 nt, Homo sapiens
gcacaaaugcaccu

SEQ ID NO: 1100011 - RNA, 15 nt, Homo sapiens
gcacaaauuguacau

SEQ ID NO: 1100012 - RNA, 22 nt, Homo sapiens
gcacaagcuuguauauacauau

SEQ ID NO: 1100013 - RNA, 17 nt, Homo sapiens
gcacacaugguuuccaa

SEQ ID NO: 1100014 - RNA, 18 nt, Homo sapiens
gcacagaaggaaucugug

SEQ ID NO: 1100015 - RNA, 16 nt, Homo sapiens
gcacaggagcuaccug

SEQ ID NO: 1100016 - RNA, 20 nt, Homo sapiens
gcacaugucuuguacaugug

SEQ ID NO: 1100017 - RNA, 16 nt, Homo sapiens
gcacccccugcagcuu

SEQ ID NO: 1100018 - RNA, 15 nt, Homo sapiens
gcacccccuggagag

SEQ ID NO: 1100019 - RNA, 22 nt, Homo sapiens
gcaccgagagagauggaauaaa

SEQ ID NO: 1100020 - RNA, 12 nt, Homo sapiens
gcaccuucaaua

SEQ ID NO: 1100021 - RNA, 18 nt, Homo sapiens
gcacguguguguguuuca

SEQ ID NO: 1100022 - RNA, 20 nt, Homo sapiens
gcacucacccaugugccaag

SEQ ID NO: 1100023 - RNA, 16 nt, Homo sapiens
gcacugaggaccagcc

SEQ ID NO: 1100024 - RNA, 22 nt, Homo sapiens
gcacuggguugacuuucaggua

SEQ ID NO: 1100025 - RNA, 18 nt, Homo sapiens
gcacugugaagacccagc

SEQ ID NO: 1100026 - RNA, 16 nt, Homo sapiens
gcacuguuucucucac

SEQ ID NO: 1100027 - RNA, 12 nt, Homo sapiens
gcagaaccaaag

SEQ ID NO: 1100028 - RNA, 16 nt, Homo sapiens
gcagaagcacauauga

SEQ ID NO: 1100029 - RNA, 12 nt, Homo sapiens
gcagaaguauaa

SEQ ID NO: 1100030 - RNA, 18 nt, Homo sapiens
gcagaaguauaaagugau

SEQ ID NO: 1100031 - RNA, 22 nt, Homo sapiens
gcagaaucccggcugucaaggg

SEQ ID NO: 1100032 - RNA, 17 nt, Homo sapiens
gcagacucacuguggga

SEQ ID NO: 1100033 - RNA, 21 nt, Homo sapiens
gcagacugcaaaucugccuga

SEQ ID NO: 1100034 - RNA, 14 nt, Homo sapiens
gcagagagaagccu

SEQ ID NO: 1100035 - RNA, 18 nt, Homo sapiens
gcugaguugguguugaca

SEQ ID NO: 1100036 - RNA, 24 nt, Homo sapiens
gcugaugagugauugacacacagc

SEQ ID NO: 1100037 - RNA, 21 nt, Homo sapiens
gcugcacaucacaacauuuac

SEQ ID NO: 1100038 - RNA, 19 nt, Homo sapiens
gcugccccugcaguuggca

SEQ ID NO: 1100039 - RNA, 15 nt, Homo sapiens
gcugccucaugaccc

SEQ ID NO: 1100040 - RNA, 14 nt, Homo sapiens
gcugcucuauugua

SEQ ID NO: 1100041 - RNA, 15 nt, Homo sapiens
gcugcugagaaccug

SEQ ID NO: 1100042 - RNA, 22 nt, Homo sapiens
gcugcuugacuaucacauacaa

SEQ ID NO: 1100043 - RNA, 19 nt, Homo sapiens
gcuggcccgucauguuccu

SEQ ID NO: 1100044 - RNA, 14 nt, Homo sapiens
gcuggcugcaguga

SEQ ID NO: 1100045 - RNA, 15 nt, Homo sapiens
gcugggacuggccag

SEQ ID NO: 1100046 - RNA, 16 nt, Homo sapiens
gcugggauuacaggug

SEQ ID NO: 1100047 - RNA, 15 nt, Homo sapiens
gcugggcuucagugg

SEQ ID NO: 1100048 - RNA, 14 nt, Homo sapiens
gcuggggagcgaaa

SEQ ID NO: 1100049 - RNA, 16 nt, Homo sapiens
gcuguacuugaugaca

SEQ ID NO: 1100050 - RNA, 18 nt, Homo sapiens
gcuguccauguauucaca

SEQ ID NO: 1100051 - RNA, 12 nt, Homo sapiens
gcugucugcuca

SEQ ID NO: 1100052 - RNA, 19 nt, Homo sapiens
gcuguuauuuaauuagcca

SEQ ID NO: 1100053 - RNA, 21 nt, Homo sapiens
gcuguuuauuuauucacugua

SEQ ID NO: 1100054 - RNA, 21 nt, Homo sapiens
ggauugcuacuguccuaccca

SEQ ID NO: 1100055 - RNA, 17 nt, Homo sapiens
ggauugcuaugaaugau

SEQ ID NO: 1100056 - RNA, 18 nt, Homo sapiens
ggcaaaaacuuccaucac

SEQ ID NO: 1100057 - RNA, 16 nt, Homo sapiens
ggcaauaaaugcccuc

SEQ ID NO: 1100058 - RNA, 18 nt, Homo sapiens
ggcaauccagacagcagg

SEQ ID NO: 1100059 - RNA, 20 nt, Homo sapiens
ggcacauuggcaguguguca

SEQ ID NO: 1100060 - RNA, 20 nt, Homo sapiens
ggcaccacaggcugccucau

SEQ ID NO: 1100061 - RNA, 19 nt, Homo sapiens
ggcacccggccccugcugg

SEQ ID NO: 1100062 - RNA, 16 nt, Homo sapiens
ggcacucacaugccgc

SEQ ID NO: 1100063 - RNA, 19 nt, Homo sapiens
ggcacucagaagacacuga

SEQ ID NO: 1100064 - RNA, 11 nt, Homo sapiens
ggcacuggguc

SEQ ID NO: 1100065 - RNA, 22 nt, Homo sapiens
ggcagagacaauaaaacauucc

SEQ ID NO: 1100066 - RNA, 20 nt, Homo sapiens
ggcagccacccccuccccca

SEQ ID NO: 1100067 - RNA, 21 nt, Homo sapiens
ggcagccacccccucccccau

SEQ ID NO: 1100068 - RNA, 19 nt, Homo sapiens
ggcaggagaaucaauaaaa

SEQ ID NO: 1100069 - RNA, 23 nt, Homo sapiens
ggcaggggugggagagccagcuc

SEQ ID NO: 1100070 - RNA, 14 nt, Homo sapiens
ggcagggucucacu

SEQ ID NO: 1100071 - RNA, 21 nt, Homo sapiens
ggcaguagacuauaagcagaa

SEQ ID NO: 1100072 - RNA, 20 nt, Homo sapiens
ggcauccugcagugggccau

SEQ ID NO: 1100073 - RNA, 15 nt, Homo sapiens
ggcaugcaccagugc

SEQ ID NO: 1100074 - RNA, 23 nt, Homo sapiens
ggcauguuuugcccaccagauca

SEQ ID NO: 1100075 - RNA, 15 nt, Homo sapiens
ggcauuuccugggug

SEQ ID NO: 1100076 - RNA, 20 nt, Homo sapiens
ggccaaccaaagacacuguc

SEQ ID NO: 1100077 - RNA, 18 nt, Homo sapiens
ggccagagggagugacag

SEQ ID NO: 1100078 - RNA, 20 nt, Homo sapiens
ggccaggcaggggugggaga

SEQ ID NO: 1100079 - RNA, 17 nt, Homo sapiens
ggccaggcuggucucaa

SEQ ID NO: 1100080 - RNA, 11 nt, Homo sapiens
ggcccagaccu

SEQ ID NO: 1100081 - RNA, 15 nt, Homo sapiens
ggcccccacaggccc

SEQ ID NO: 1100082 - RNA, 15 nt, Homo sapiens
ggcccugagcucggu

SEQ ID NO: 1100083 - RNA, 12 nt, Homo sapiens
ggccucccucaa

SEQ ID NO: 1100084 - RNA, 22 nt, Homo sapiens
ggccuccugccucuacugggaa

SEQ ID NO: 1100085 - RNA, 16 nt, Homo sapiens
ggccugcccucaggga

SEQ ID NO: 1100086 - RNA, 17 nt, Homo sapiens
ggccugcugcugagaac

SEQ ID NO: 1100087 - RNA, 17 nt, Homo sapiens
ggccuggcaagugggug

SEQ ID NO: 1100088 - RNA, 15 nt, Homo sapiens
ggcgaccccucagug

SEQ ID NO: 1100089 - RNA, 13 nt, Homo sapiens
ggcgaguggcacg

SEQ ID NO: 1100090 - RNA, 23 nt, Homo sapiens
ggcggcacauuggcaguguguca

SEQ ID NO: 1100091 - RNA, 16 nt, Homo sapiens
ggcgggcagggguucc

SEQ ID NO: 1100092 - RNA, 13 nt, Homo sapiens
ggcuacucugugc

SEQ ID NO: 1100093 - RNA, 12 nt, Homo sapiens
ggcuagucauaa

SEQ ID NO: 1100094 - RNA, 16 nt, Homo sapiens
ggcuaucugcauuuau

SEQ ID NO: 1100095 - RNA, 12 nt, Homo sapiens
ggcuaugccuug

SEQ ID NO: 1100096 - RNA, 12 nt, Homo sapiens
ggcucacagcug

SEQ ID NO: 1100097 - RNA, 19 nt, Homo sapiens
ggcucagcggggacagcuc

SEQ ID NO: 1100098 - RNA, 15 nt, Homo sapiens
ggcucuaacgccuga

SEQ ID NO: 1100099 - RNA, 15 nt, Homo sapiens
ggcugagcaccucag

SEQ ID NO: 1100100 - RNA, 18 nt, Homo sapiens
ggcugagugagccacaga

SEQ ID NO: 1100101 - RNA, 21 nt, Homo sapiens
ggcugauuauuaaaguccuuu

SEQ ID NO: 1100102 - RNA, 14 nt, Homo sapiens
ggcugcagauuucc

SEQ ID NO: 1100103 - RNA, 19 nt, Homo sapiens
ggcugccugcaucuauucu

SEQ ID NO: 1100104 - RNA, 21 nt, Homo sapiens
ggcugcugcggugucacuggg

SEQ ID NO: 1100105 - RNA, 20 nt, Homo sapiens
ggcuggaaaagucacacaga

SEQ ID NO: 1100106 - RNA, 19 nt, Homo sapiens
ggcuggaugugguggcaua

SEQ ID NO: 1100107 - RNA, 17 nt, Homo sapiens
ggcuguccauguauuca

SEQ ID NO: 1100108 - RNA, 21 nt, Homo sapiens
ggcuuagacuucgacucagga

SEQ ID NO: 1100109 - RNA, 16 nt, Homo sapiens
ggcuuaggacuuucca

SEQ ID NO: 1100110 - RNA, 19 nt, Homo sapiens
ggcuuccagguaucuccag

SEQ ID NO: 1100111 - RNA, 14 nt, Homo sapiens
ggcuucccaugucu

SEQ ID NO: 1100112 - RNA, 11 nt, Homo sapiens
gggaaccauga

SEQ ID NO: 1100113 - RNA, 14 nt, Homo sapiens
gggaagacuguggc

SEQ ID NO: 1100114 - RNA, 15 nt, Homo sapiens
gggaauggauccugg

SEQ ID NO: 1100115 - RNA, 22 nt, Homo sapiens
gggaaugugccucggccuccaa

SEQ ID NO: 1100116 - RNA, 17 nt, Homo sapiens
gggacaauaaauuuugc

SEQ ID NO: 1100117 - RNA, 14 nt, Homo sapiens
gggacacuuaccca

SEQ ID NO: 1100118 - RNA, 22 nt, Homo sapiens
gggacauuucccuccugggaga

SEQ ID NO: 1100119 - RNA, 19 nt, Homo sapiens
gggaccuaagccacguuaa

SEQ ID NO: 1100120 - RNA, 16 nt, Homo sapiens
gggacuccaguucaca

SEQ ID NO: 1100121 - RNA, 22 nt, Homo sapiens
gggcaaagcugugcacuugcag

SEQ ID NO: 1100122 - RNA, 14 nt, Homo sapiens
gggcaacaacagca

SEQ ID NO: 1100123 - RNA, 13 nt, Homo sapiens
gggcaagaaggaa

SEQ ID NO: 1100124 - RNA, 17 nt, Homo sapiens
uaauuucuuacuaaaca

SEQ ID NO: 1100125 - RNA, 18 nt, Homo sapiens
uaauuugauacugaccuu

SEQ ID NO: 1100126 - RNA, 21 nt, Homo sapiens
uaauuugauaguauugugcau

SEQ ID NO: 1100127 - RNA, 22 nt, Homo sapiens
uaauuuugcagcagaagccaaa

SEQ ID NO: 1100128 - RNA, 15 nt, Homo sapiens
uaauuuugccauccu

SEQ ID NO: 1100129 - RNA, 20 nt, Homo sapiens
uaauuuuuuugagacagagu

SEQ ID NO: 1100130 - RNA, 12 nt, Homo sapiens
uacaaacaugug

SEQ ID NO: 1100131 - RNA, 14 nt, Homo sapiens
uacaaaguauuugc

SEQ ID NO: 1100132 - RNA, 17 nt, Homo sapiens
uacaacuucaagugcau

SEQ ID NO: 1100133 - RNA, 22 nt, Homo sapiens
ucaagcaauccuccugccucag

SEQ ID NO: 1100134 - RNA, 15 nt, Homo sapiens
ucaagcuaccuucau

SEQ ID NO: 1100135 - RNA, 20 nt, Homo sapiens
ucaagcuaccuucaugucac

SEQ ID NO: 1100136 - RNA, 15 nt, Homo sapiens
ucaagcuagaaggcc

SEQ ID NO: 1100137 - RNA, 17 nt, Homo sapiens
ucauuuuaacaucugag

SEQ ID NO: 1100138 - RNA, 23 nt, Homo sapiens
ucauuuuugguaggcuuaucaaa

SEQ ID NO: 1100139 - RNA, 18 nt, Homo sapiens
uccaaaucuuaauucaac

SEQ ID NO: 1100140 - RNA, 16 nt, Homo sapiens
uccaaaugaaugaccu

SEQ ID NO: 1100141 - RNA, 15 nt, Homo sapiens
uccaaauggacauaa

SEQ ID NO: 1100142 - RNA, 15 nt, Homo sapiens
uccaacagacagggc

SEQ ID NO: 1100143 - RNA, 19 nt, Homo sapiens
uccaacagcucaagucuuc

SEQ ID NO: 1100144 - RNA, 19 nt, Homo sapiens
uccaaccccccaccugcca

SEQ ID NO: 1100145 - RNA, 21 nt, Homo sapiens
uccaaccccccaccugccauu

SEQ ID NO: 1100146 - RNA, 23 nt, Homo sapiens
uccaacuaacguacauucaacag

SEQ ID NO: 1100147 - RNA, 23 nt, Homo sapiens
uccaagccugaccacgcuuucua

SEQ ID NO: 1100148 - RNA, 19 nt, Homo sapiens
uccaagguguaacucuaau

SEQ ID NO: 1100149 - RNA, 16 nt, Homo sapiens
uccaaugcauugcuaa

SEQ ID NO: 1100150 - RNA, 22 nt, Homo sapiens
uccaaugucuuuuuaagcuuau

SEQ ID NO: 1100151 - RNA, 22 nt, Homo sapiens
uccaauugaacuuucacauagc

SEQ ID NO: 1100152 - RNA, 20 nt, Homo sapiens
uccacaagauucccagagac

SEQ ID NO: 1100153 - RNA, 20 nt, Homo sapiens
uccacaccuagcaucucaug

SEQ ID NO: 1100154 - RNA, 19 nt, Homo sapiens
uccaccauucacauuugau

SEQ ID NO: 1100155 - RNA, 21 nt, Homo sapiens
uccacuccagauuuuuuacag

SEQ ID NO: 1100156 - RNA, 14 nt, Homo sapiens
uccacuucucuaga

SEQ ID NO: 1100157 - RNA, 16 nt, Homo sapiens
uccagaauaaaacgca

SEQ ID NO: 1100158 - RNA, 15 nt, Homo sapiens
uccagaccucuacaa

SEQ ID NO: 1100159 - RNA, 14 nt, Homo sapiens
uccagaucagauuc

SEQ ID NO: 1100160 - RNA, 16 nt, Homo sapiens
uccagauggcaugugu

SEQ ID NO: 1100161 - RNA, 13 nt, Homo sapiens
uccagggcccaaa

SEQ ID NO: 1100162 - RNA, 20 nt, Homo sapiens
uccagugagcucuggaugaa

SEQ ID NO: 1100163 - RNA, 15 nt, Homo sapiens
uccaguucugacaca

SEQ ID NO: 1100164 - RNA, 18 nt, Homo sapiens
uccaguuucccaccaccu

SEQ ID NO: 1100165 - RNA, 19 nt, Homo sapiens
uccaguuucccaccaccuu

SEQ ID NO: 1100166 - RNA, 23 nt, Homo sapiens
uccauaaaguaauuuugugaaag

SEQ ID NO: 1100167 - RNA, 18 nt, Homo sapiens
uccauauauuagcauuua

SEQ ID NO: 1100168 - RNA, 22 nt, Homo sapiens
uccaucagguuccaucccgaaa

SEQ ID NO: 1100169 - RNA, 17 nt, Homo sapiens
uccaucucugucucaaa

SEQ ID NO: 1100170 - RNA, 21 nt, Homo sapiens
uccaucugcuuguauuuucca

SEQ ID NO: 1100171 - RNA, 16 nt, Homo sapiens
uccauguauucacaca

SEQ ID NO: 1100172 - RNA, 20 nt, Homo sapiens
uccauucaugccaaagcaaa

SEQ ID NO: 1100173 - RNA, 19 nt, Homo sapiens
uccauuuggugaccaucug

SEQ ID NO: 1100174 - RNA, 18 nt, Homo sapiens
ucccaaauaaacuccaga

SEQ ID NO: 1100175 - RNA, 22 nt, Homo sapiens
ucccaagagcaucaugccucug

SEQ ID NO: 1100176 - RNA, 17 nt, Homo sapiens
ucccacaaucugggacu

SEQ ID NO: 1100177 - RNA, 18 nt, Homo sapiens
ucccacacccuguuuuac

SEQ ID NO: 1100178 - RNA, 20 nt, Homo sapiens
ucccaccaugcgcugcucaa

SEQ ID NO: 1100179 - RNA, 15 nt, Homo sapiens
ucccacuugucaugu

SEQ ID NO: 1100180 - RNA, 23 nt, Homo sapiens
ucccagcagcccuaaggaucucu

SEQ ID NO: 1100181 - RNA, 17 nt, Homo sapiens
ucccagcuacucaggag

SEQ ID NO: 1100182 - RNA, 16 nt, Homo sapiens
ucccauagccaggaaa

SEQ ID NO: 1100183 - RNA, 13 nt, Homo sapiens
ucccauguuaaau

SEQ ID NO: 1100184 - RNA, 21 nt, Homo sapiens
uccccaagcuggcagcuguca

SEQ ID NO: 1100185 - RNA, 22 nt, Homo sapiens
uccccaagugaccuauaccugu

SEQ ID NO: 1100186 - RNA, 20 nt, Homo sapiens
uccccaccuuccccagacuc

SEQ ID NO: 1100187 - RNA, 20 nt, Homo sapiens
ucccccaucccccacugcca

SEQ ID NO: 1100188 - RNA, 21 nt, Homo sapiens
ucccccuaugcuccaguaugg

SEQ ID NO: 1100189 - RNA, 22 nt, Homo sapiens
ucccccuggggcuucuccugac

SEQ ID NO: 1100190 - RNA, 20 nt, Homo sapiens
uccccuccguaggagcucac

SEQ ID NO: 1100191 - RNA, 22 nt, Homo sapiens
uccccuggggucucugcugcau

SEQ ID NO: 1100192 - RNA, 22 nt, Homo sapiens
uccccuugcccagggcucagcc

SEQ ID NO: 1100193 - RNA, 11 nt, Homo sapiens
ucccuaauccu

SEQ ID NO: 1100194 - RNA, 19 nt, Homo sapiens
ucccucaaaugacccaaag

SEQ ID NO: 1100195 - RNA, 20 nt, Homo sapiens
ucccucaaaugacccaaaga

SEQ ID NO: 1100196 - RNA, 13 nt, Homo sapiens
ucccucaacccca

SEQ ID NO: 1100197 - RNA, 14 nt, Homo sapiens
ucccucucuugccu

SEQ ID NO: 1100198 - RNA, 18 nt, Homo sapiens
ucccucuuugccugugug

SEQ ID NO: 1100199 - RNA, 19 nt, Homo sapiens
ucccugaaaacccagagag

SEQ ID NO: 1100200 - RNA, 13 nt, Homo sapiens
ucccugccagugu

SEQ ID NO: 1100201 - RNA, 19 nt, Homo sapiens
ucccugcuuugaggacaaa

SEQ ID NO: 1100202 - RNA, 21 nt, Homo sapiens
ucccuguccuccucggaucac

SEQ ID NO: 1100203 - RNA, 17 nt, Homo sapiens
ucccuuuaucaguuuga

SEQ ID NO: 1100204 - RNA, 15 nt, Homo sapiens
uccgaagucuuccau

SEQ ID NO: 1100205 - RNA, 13 nt, Homo sapiens
uccggugugagau

SEQ ID NO: 1100206 - RNA, 23 nt, Homo sapiens
uccgucaccucagagacauacac

SEQ ID NO: 1100207 - RNA, 18 nt, Homo sapiens
uccguccaggagccugug

SEQ ID NO: 1100208 - RNA, 21 nt, Homo sapiens
uccgucucaaaaaaagggcaa

SEQ ID NO: 1100209 - RNA, 16 nt, Homo sapiens
uccuaaaugcagugaa

SEQ ID NO: 1100210 - RNA, 16 nt, Homo sapiens
uccuaaggacacacua

SEQ ID NO: 1100211 - RNA, 21 nt, Homo sapiens
uccuaaugauuagcacuuaau

SEQ ID NO: 1100212 - RNA, 17 nt, Homo sapiens
uccuacagauagucaaa

SEQ ID NO: 1100213 - RNA, 19 nt, Homo sapiens
uccuaccuauauuacacaa

SEQ ID NO: 1100214 - RNA, 22 nt, Homo sapiens
uccuauuuauaagagugccgua

SEQ ID NO: 1100215 - RNA, 20 nt, Homo sapiens
uccuauuuuaaaaccaugca

SEQ ID NO: 1100216 - RNA, 12 nt, Homo sapiens
uccucagugucc

SEQ ID NO: 1100217 - RNA, 13 nt, Homo sapiens
uccucauuccuga

SEQ ID NO: 1100218 - RNA, 17 nt, Homo sapiens
uccuccacaauagcaga

SEQ ID NO: 1100219 - RNA, 16 nt, Homo sapiens
uccuccaucuuagaua

SEQ ID NO: 1100220 - RNA, 15 nt, Homo sapiens
uccucccucauucca

SEQ ID NO: 1100221 - RNA, 22 nt, Homo sapiens
ugguacugcacauuuuguacaa

SEQ ID NO: 1100222 - RNA, 22 nt, Homo sapiens
ugguagaacguaaccacggaaa

SEQ ID NO: 1100223 - RNA, 17 nt, Homo sapiens
ugguagccucacuuuua

SEQ ID NO: 1100224 - RNA, 22 nt, Homo sapiens
ugguagguuugaaugacguguc

SEQ ID NO: 1100225 - RNA, 18 nt, Homo sapiens
uguggaggagcucaggac

SEQ ID NO: 1100226 - RNA, 16 nt, Homo sapiens
uguggccccaacacaa

SEQ ID NO: 1100227 - RNA, 16 nt, Homo sapiens
uguggcuaaaugccua

SEQ ID NO: 1100228 - RNA, 17 nt, Homo sapiens
ugugggagccugcaaac

SEQ ID NO: 1100229 - RNA, 13 nt, Homo sapiens
ugugguacaagca

SEQ ID NO: 1100230 - RNA, 19 nt, Homo sapiens
ugugguggugggugccugu

SEQ ID NO: 1100231 - RNA, 20 nt, Homo sapiens
ugugguuuaugucaucauac

SEQ ID NO: 1100232 - RNA, 22 nt, Homo sapiens
uguguacccacuccucacugcc

SEQ ID NO: 1100233 - RNA, 15 nt, Homo sapiens
uguguccuugugugc

SEQ ID NO: 1100234 - RNA, 21 nt, Homo sapiens
ugugugcacguacacacacau

SEQ ID NO: 1100235 - RNA, 13 nt, Homo sapiens
uguguguagccaa

SEQ ID NO: 1100236 - RNA, 13 nt, Homo sapiens
uguguuaguaaua

SEQ ID NO: 1100237 - RNA, 15 nt, Homo sapiens
uguguucaguacaau

SEQ ID NO: 1100238 - RNA, 19 nt, Homo sapiens
uguguuccuaacauaaaau

SEQ ID NO: 1100239 - RNA, 19 nt, Homo sapiens
uguguucucuauugcugcu

SEQ ID NO: 1100240 - RNA, 15 nt, Homo sapiens
uguuaaaauguacac

SEQ ID NO: 1100241 - RNA, 12 nt, Homo sapiens
uguuaacaaugc

SEQ ID NO: 1100242 - RNA, 20 nt, Homo sapiens
uguuacacaugacacucuuc

SEQ ID NO: 1100243 - RNA, 15 nt, Homo sapiens
uguuaccuccuauaa

SEQ ID NO: 1100244 - RNA, 20 nt, Homo sapiens
uguuacgcacacguacuuaa

SEQ ID NO: 1100245 - RNA, 14 nt, Homo sapiens
uguuaucagucaua

SEQ ID NO: 1100246 - RNA, 20 nt, Homo sapiens
uguuaucuguguagcaagcu

SEQ ID NO: 1100247 - RNA, 15 nt, Homo sapiens
uguucaguugacuua

SEQ ID NO: 1100248 - RNA, 18 nt, Homo sapiens
uguucauguuacucauga

SEQ ID NO: 1100249 - RNA, 17 nt, Homo sapiens
uguuccugaugugccag

SEQ ID NO: 1100250 - RNA, 16 nt, Homo sapiens
uguucucugaggacac

SEQ ID NO: 1100251 - RNA, 16 nt, Homo sapiens
uguucugggacacagu

SEQ ID NO: 1100252 - RNA, 13 nt, Homo sapiens
uguugacaugugc

SEQ ID NO: 1100253 - RNA, 13 nt, Homo sapiens
uguugagugagau

SEQ ID NO: 1100254 - RNA, 11 nt, Homo sapiens
uguugauccca

SEQ ID NO: 1100255 - RNA, 14 nt, Homo sapiens
uguugauuacauaa

SEQ ID NO: 1100256 - RNA, 19 nt, Homo sapiens
uguuggacccgcucuggac

SEQ ID NO: 1100257 - RNA, 16 nt, Homo sapiens
uguugucacaccugaa

SEQ ID NO: 1100258 - RNA, 16 nt, Homo sapiens
uguuuacccaguauuc

SEQ ID NO: 1100259 - RNA, 23 nt, Homo sapiens
uguuuagaagagccugacugugu

SEQ ID NO: 1100260 - RNA, 12 nt, Homo sapiens
uguuuaguugca

SEQ ID NO: 1100261 - RNA, 15 nt, Homo sapiens
uguuuauacagcuca

SEQ ID NO: 1100262 - RNA, 18 nt, Homo sapiens
uguuucuaaaacuauggu

SEQ ID NO: 1100263 - RNA, 21 nt, Homo sapiens
uguuucuaaaacuaugguucc

SEQ ID NO: 1100264 - RNA, 18 nt, Homo sapiens
uguuucuggggacaccag

SEQ ID NO: 1100265 - RNA, 22 nt, Homo sapiens
uguuucuggggacaccagccau

SEQ ID NO: 1100266 - RNA, 19 nt, Homo sapiens
uguuuucaccucauaugcu

SEQ ID NO: 1100267 - RNA, 20 nt, Homo sapiens
uguuuucuugccaaugaggu

SEQ ID NO: 1100268 - RNA, 23 nt, Homo sapiens
uguuuuuacccugccccugccuu

SEQ ID NO: 1100269 - RNA, 12 nt, Homo sapiens
uuaaaaacuaaa

SEQ ID NO: 1100270 - RNA, 19 nt, Homo sapiens
uuaaaaagauguauguucc

SEQ ID NO: 1100271 - RNA, 19 nt, Homo sapiens
uuaaaacacagcuuuacaa

SEQ ID NO: 1100272 - RNA, 15 nt, Homo sapiens
uuaaaaucauaaaua

SEQ ID NO: 1100273 - RNA, 14 nt, Homo sapiens
uuaaaaugagaucg

SEQ ID NO: 1100274 - RNA, 23 nt, Homo sapiens
uuaaaauuaaaugcauguccuca

SEQ ID NO: 1100275 - RNA, 15 nt, Homo sapiens
uuaaacaagugcacu

SEQ ID NO: 1100276 - RNA, 21 nt, Homo sapiens
uuaaacccugccccacuucuc

SEQ ID NO: 1100277 - RNA, 21 nt, Homo sapiens
uuaaacucagggagcauuuau

SEQ ID NO: 1100278 - RNA, 20 nt, Homo sapiens
uuaaagccuuuagagccagc

SEQ ID NO: 1100279 - RNA, 19 nt, Homo sapiens
uuaaauaaaucauuaauac

SEQ ID NO: 1100280 - RNA, 17 nt, Homo sapiens
uuaaauaguucaguaua

SEQ ID NO: 1100281 - RNA, 19 nt, Homo sapiens
uuaaaugcauguccucaaa

SEQ ID NO: 1100282 - RNA, 15 nt, Homo sapiens
uuaaauggcuuuaug

SEQ ID NO: 1100283 - RNA, 19 nt, Homo sapiens
uuaaauugcagaugguuaa

SEQ ID NO: 1100284 - RNA, 16 nt, Homo sapiens
uuaaauuguaaaugaa

SEQ ID NO: 1100285 - RNA, 20 nt, Homo sapiens
uuaaauuugggggacuuaca

SEQ ID NO: 1100286 - RNA, 23 nt, Homo sapiens
uuaacaaauuauguuacaucugu

SEQ ID NO: 1100287 - RNA, 14 nt, Homo sapiens
uuaacaaugcagua

SEQ ID NO: 1100288 - RNA, 14 nt, Homo sapiens
uuaacgucaucuca

SEQ ID NO: 1100289 - RNA, 21 nt, Homo sapiens
uuaacugguauauacauauau

SEQ ID NO: 1100290 - RNA, 23 nt, Homo sapiens
uuaagaagaaauacccacuaaca

SEQ ID NO: 1100291 - RNA, 18 nt, Homo sapiens
uuaaggagguagcuccca

SEQ ID NO: 1100292 - RNA, 21 nt, Homo sapiens
uuaaggagguagcucccagca

SEQ ID NO: 1100293 - RNA, 16 nt, Homo sapiens
uuaagggaaggaacuc

SEQ ID NO: 1100294 - RNA, 16 nt, Homo sapiens
uuaaguaaaccaaaaa

SEQ ID NO: 1100295 - RNA, 17 nt, Homo sapiens
uuaaguaaaccaaaaag

SEQ ID NO: 1100296 - RNA, 14 nt, Homo sapiens
uuaaguaauuuugc

SEQ ID NO: 1100297 - RNA, 16 nt, Homo sapiens
uuaauaaauucagaua

SEQ ID NO: 1100298 - RNA, 23 nt, Homo sapiens
uuaauauguuaaccucaguguca

SEQ ID NO: 1100299 - RNA, 13 nt, Homo sapiens
uuaauauguucau

SEQ ID NO: 1100300 - RNA, 16 nt, Homo sapiens
uuaauauguucauuaa

SEQ ID NO: 1100301 - RNA, 20 nt, Homo sapiens
uuaaugaacaaauggccuuu

SEQ ID NO: 1100302 - RNA, 12 nt, Homo sapiens
uuaaugagauag

SEQ ID NO: 1100303 - RNA, 20 nt, Homo sapiens
uuaauggcucaugaccugga

SEQ ID NO: 1100304 - RNA, 18 nt, Homo sapiens
uuaauggguacaauguac

SEQ ID NO: 1100305 - RNA, 17 nt, Homo sapiens
uuaauuggaauucugga

SEQ ID NO: 1100306 - RNA, 21 nt, Homo sapiens
uuaauuucuacacacccauag

SEQ ID NO: 1100307 - RNA, 13 nt, Homo sapiens
uuacaaauucaag

SEQ ID NO: 1100308 - RNA, 19 nt, Homo sapiens
uuacaauuauggaaauaua

SEQ ID NO: 1100309 - RNA, 12 nt, Homo sapiens
uuacacauguau

SEQ ID NO: 1100310 - RNA, 20 nt, Homo sapiens
uucaucagacuccugugcaa

SEQ ID NO: 1100311 - RNA, 14 nt, Homo sapiens
uucaucagcauuua

SEQ ID NO: 1100312 - RNA, 20 nt, Homo sapiens
uucaucucaggccucccuca

SEQ ID NO: 1100313 - RNA, 13 nt, Homo sapiens
uucaucuguucau

SEQ ID NO: 1100314 - RNA, 11 nt, Homo sapiens
uucaugaacac

SEQ ID NO: 1100315 - RNA, 22 nt, Homo sapiens
uucauuaaauuuucuaugcuua

SEQ ID NO: 1100316 - RNA, 19 nt, Homo sapiens
uuccaaauuggauacugcu

SEQ ID NO: 1100317 - RNA, 18 nt, Homo sapiens
uuccaagauaaaaccaga

SEQ ID NO: 1100318 - RNA, 20 nt, Homo sapiens
uuccacaccuagcaucucau

SEQ ID NO: 1100319 - RNA, 17 nt, Homo sapiens
uuccagcuagugaccca

SEQ ID NO: 1100320 - RNA, 19 nt, Homo sapiens
uuccaggaaaaucugcacu

SEQ ID NO: 1100321 - RNA, 19 nt, Homo sapiens
uuccaguucaucuauggca

SEQ ID NO: 1100322 - RNA, 22 nt, Homo sapiens
uuccaugagaacagcaggguag

SEQ ID NO: 1100323 - RNA, 12 nt, Homo sapiens
uuccauguuaaa

SEQ ID NO: 1100324 - RNA, 18 nt, Homo sapiens
uuccauuucgccccucau

SEQ ID NO: 1100325 - RNA, 16 nt, Homo sapiens
uucccaagagcaucau

SEQ ID NO: 1100326 - RNA, 19 nt, Homo sapiens
uucccacagcacuaauuca

SEQ ID NO: 1100327 - RNA, 22 nt, Homo sapiens
uucccacuggaggucacauuca

SEQ ID NO: 1100328 - RNA, 13 nt, Homo sapiens
uucccagcugucu

SEQ ID NO: 1100329 - RNA, 23 nt, Homo sapiens
uucccaucacuggagcaccaggc

SEQ ID NO: 1100330 - RNA, 13 nt, Homo sapiens
uuccccagugugg

SEQ ID NO: 1100331 - RNA, 14 nt, Homo sapiens
uucccucucuugcc

SEQ ID NO: 1100332 - RNA, 18 nt, Homo sapiens
uucccugaccucccucua

SEQ ID NO: 1100333 - RNA, 12 nt, Homo sapiens
uuccuaacauaa

SEQ ID NO: 1100334 - RNA, 20 nt, Homo sapiens
uuccuauuuggggcuugcau

SEQ ID NO: 1100335 - RNA, 17 nt, Homo sapiens
uuccucagauggacaag

SEQ ID NO: 1100336 - RNA, 16 nt, Homo sapiens
uuccucaguccuggaa

SEQ ID NO: 1100337 - RNA, 21 nt, Homo sapiens
uuccuccuaaauuuccagggg

SEQ ID NO: 1100338 - RNA, 16 nt, Homo sapiens
uuccucgccucuccca

SEQ ID NO: 1100339 - RNA, 23 nt, Homo sapiens
uuccucucugaguggacuggccu

SEQ ID NO: 1100340 - RNA, 16 nt, Homo sapiens
uuccugagaccacaga

SEQ ID NO: 1100341 - RNA, 14 nt, Homo sapiens
uuccugccaccagu

SEQ ID NO: 1100342 - RNA, 19 nt, Homo sapiens
uuccuggaguacaaacaca

SEQ ID NO: 1100343 - RNA, 11 nt, Homo sapiens
uuccugugaaa

SEQ ID NO: 1100344 - RNA, 20 nt, Homo sapiens
uuccuucagugcaucuggga

SEQ ID NO: 1100345 - RNA, 17 nt, Homo sapiens
uuccuugaucuguauau

SEQ ID NO: 1100346 - RNA, 20 nt, Homo sapiens
uuccuuuuaaaacacuucca

SEQ ID NO: 1100347 - RNA, 15 nt, Homo sapiens
uucgagguggaucac

SEQ ID NO: 1100348 - RNA, 18 nt, Homo sapiens
uucgguacuuacccggag

SEQ ID NO: 1100349 - RNA, 23 nt, Homo sapiens
uucuaaucuuguuaaauugcuua

SEQ ID NO: 1100350 - RNA, 15 nt, Homo sapiens
uucuaaugugugaau

SEQ ID NO: 1100351 - RNA, 14 nt, Homo sapiens
uucuacaaccagag

SEQ ID NO: 1100352 - RNA, 21 nt, Homo sapiens
uucuaccuuuaaaauuuacca

SEQ ID NO: 1100353 - RNA, 15 nt, Homo sapiens
uucuacugugacuga

SEQ ID NO: 1100354 - RNA, 13 nt, Homo sapiens
uucuagcuacaau

SEQ ID NO: 1100355 - RNA, 16 nt, Homo sapiens
uucuaggaagcuccag

SEQ ID NO: 1100356 - RNA, 15 nt, Homo sapiens
uucuaggcaucccag

SEQ ID NO: 1100357 - RNA, 22 nt, Homo sapiens
uucuaguguaacacugcaagaa

SEQ ID NO: 1100358 - RNA, 19 nt, Homo sapiens
uucuaucugggcuguugcu

SEQ ID NO: 1100359 - RNA, 21 nt, Homo sapiens
uucuauugaaaaaucaccaca

SEQ ID NO: 1100360 - RNA, 15 nt, Homo sapiens
uucuauuuauuuacu

SEQ ID NO: 1100361 - RNA, 16 nt, Homo sapiens
uucuauuuuuguagaa

SEQ ID NO: 1100362 - RNA, 22 nt, Homo sapiens
uucucaaaugcuaaaugcaaac

SEQ ID NO: 1100363 - RNA, 16 nt, Homo sapiens
uucucacuccaccacc

SEQ ID NO: 1100364 - RNA, 22 nt, Homo sapiens
uucucagaccugcgcacuccau

SEQ ID NO: 1100365 - RNA, 18 nt, Homo sapiens
uucucaucauauuguaug

SEQ ID NO: 1100366 - RNA, 23 nt, Homo sapiens
uucuccagacccaccacaccgca

SEQ ID NO: 1100367 - RNA, 15 nt, Homo sapiens
uucuccuguugcaau

SEQ ID NO: 1100368 - RNA, 15 nt, Homo sapiens
uucucuacucuggaa

SEQ ID NO: 1100369 - RNA, 17 nt, Homo sapiens
uucucuggguagguguu

SEQ ID NO: 1100370 - RNA, 15 nt, Homo sapiens
uucucuuugccucaa

SEQ ID NO: 1100371 - RNA, 22 nt, Homo sapiens
uucugaauuauuaugucucaaa

SEQ ID NO: 1100372 - RNA, 19 nt, Homo sapiens
uucugcuaccucacugggg

SEQ ID NO: 1100373 - RNA, 20 nt, Homo sapiens
uucuggacccguucaacuuu

SEQ ID NO: 1100374 - RNA, 15 nt, Homo sapiens
uucuggcacugguug

SEQ ID NO: 1100375 - RNA, 18 nt, Homo sapiens
uucuggccucagaccaac

SEQ ID NO: 1100376 - RNA, 16 nt, Homo sapiens
uucuuacaaacaugug

SEQ ID NO: 1100377 - RNA, 20 nt, Homo sapiens
uucuuauuuuguaauaaacu

SEQ ID NO: 1100378 - RNA, 17 nt, Homo sapiens
uucuucaugcaaugaca

SEQ ID NO: 1100379 - RNA, 14 nt, Homo sapiens
uucuuccaucugau

SEQ ID NO: 1100380 - RNA, 23 nt, Homo sapiens
uucuucuaaugagucgacuuuga

SEQ ID NO: 1100381 - RNA, 19 nt, Homo sapiens
uucuuuaaauuucaucuca

SEQ ID NO: 1100382 - RNA, 22 nt, Homo sapiens
uucuuucccuagaggcaaacau

SEQ ID NO: 1100383 - RNA, 20 nt, Homo sapiens
uucuuugggauugcuaugaa

SEQ ID NO: 1100384 - RNA, 17 nt, Homo sapiens
uucuuuguaccaucugu

SEQ ID NO: 1100385 - RNA, 16 nt, Homo sapiens
uucuuuuaaaccauuu

SEQ ID NO: 1100386 - RNA, 16 nt, Homo sapiens
uucuuuuucacacuga

SEQ ID NO: 1100387 - RNA, 17 nt, Homo sapiens
uucuuuuucacacugau

SEQ ID NO: 1100388 - RNA, 18 nt, Homo sapiens
uucuuuuucguuggugua

SEQ ID NO: 1100389 - RNA, 13 nt, Homo sapiens
uugaaaaccuggc

SEQ ID NO: 1100390 - RNA, 17 nt, Homo sapiens
uugaaaauaauuguucc

SEQ ID NO: 1100391 - RNA, 12 nt, Homo sapiens
uugaaaauguuc

SEQ ID NO: 1100392 - RNA, 13 nt, Homo sapiens
uugaaaccaaaga

SEQ ID NO: 1100393 - RNA, 17 nt, Homo sapiens
uugaaauaccagugaac

SEQ ID NO: 1100394 - RNA, 21 nt, Homo sapiens
uugaaauaccagugaaccaaa

SEQ ID NO: 1100395 - RNA, 23 nt, Homo sapiens
uugaaauaccagugaaccaaaga

SEQ ID NO: 1100396 - RNA, 14 nt, Homo sapiens
uugaaauaguugau

SEQ ID NO: 1100397 - RNA, 23 nt, Homo sapiens
uugaacaacuaggcuucagcaua

SEQ ID NO: 1100398 - RNA, 12 nt, Homo sapiens
uugaacaucuca

SEQ ID NO: 1100399 - RNA, 21 nt, Homo sapiens
uauggacucaguuuucuugca

SEQ ID NO: 1100400 - RNA, 14 nt, Homo sapiens
uauggacucugcac

SEQ ID NO: 1100401 - RNA, 15 nt, Homo sapiens
uauggacucugcaca

SEQ ID NO: 1100402 - RNA, 17 nt, Homo sapiens
uauggcugccugcaucu

SEQ ID NO: 1100403 - RNA, 20 nt, Homo sapiens
uaugggggcacugaggacca

SEQ ID NO: 1100404 - RNA, 14 nt, Homo sapiens
uauggguacauucc

SEQ ID NO: 1100405 - RNA, 17 nt, Homo sapiens
ucccagccacucgggag

SEQ ID NO: 1100406 - RNA, 15 nt, Homo sapiens
ucccagcuacucggg

SEQ ID NO: 1100407 - RNA, 15 nt, Homo sapiens
ucccaggaacugggc

SEQ ID NO: 1100408 - RNA, 23 nt, Homo sapiens
ucccaugugcauggaaauguccu

SEQ ID NO: 1100409 - RNA, 18 nt, Homo sapiens
uccccaagugaccuauac

SEQ ID NO: 1100410 - RNA, 14 nt, Homo sapiens
uccccacacugacc

SEQ ID NO: 1100411 - RNA, 23 nt, Homo sapiens
uccccaggucucuccacugcucu

SEQ ID NO: 1100412 - RNA, 20 nt, Homo sapiens
uccccauuaguauccuguua

SEQ ID NO: 1100413 - RNA, 20 nt, Homo sapiens
ucccccaccuucaagcaccc

SEQ ID NO: 1100414 - RNA, 15 nt, Homo sapiens
uccccccucacucca

SEQ ID NO: 1100415 - RNA, 14 nt, Homo sapiens
uccccgggggagga

SEQ ID NO: 1100416 - RNA, 22 nt, Homo sapiens
uccccgggggcagacaccugug

SEQ ID NO: 1100417 - RNA, 23 nt, Homo sapiens
uccccgggggcagacaccugugc

SEQ ID NO: 1100418 - RNA, 22 nt, Homo sapiens
uccccuagcuuuccccagacac

SEQ ID NO: 1100419 - RNA, 12 nt, Homo sapiens
uccccuccccca

SEQ ID NO: 1100420 - RNA, 18 nt, Homo sapiens
uccccucccccacucuau

SEQ ID NO: 1100421 - RNA, 20 nt, Homo sapiens
uccccuggaacugucucuca

SEQ ID NO: 1100422 - RNA, 14 nt, Homo sapiens
ucccggaccugugg

SEQ ID NO: 1100423 - RNA, 16 nt, Homo sapiens
ucccggguguguacac

SEQ ID NO: 1100424 - RNA, 22 nt, Homo sapiens
ucccuaauccuccaagucuuca

SEQ ID NO: 1100425 - RNA, 20 nt, Homo sapiens
ucccucccuggcucugccag

SEQ ID NO: 1100426 - RNA, 15 nt, Homo sapiens
ucccucuaaguggaa

SEQ ID NO: 1100427 - RNA, 14 nt, Homo sapiens
ucccucuggcccug

SEQ ID NO: 1100428 - RNA, 19 nt, Homo sapiens
ucccucuuugccuguguga

SEQ ID NO: 1100429 - RNA, 18 nt, Homo sapiens
ucccugaacaucugugug

SEQ ID NO: 1100430 - RNA, 20 nt, Homo sapiens
ucccugggccugcugcugag

SEQ ID NO: 1100431 - RNA, 12 nt, Homo sapiens
ucccuguacaau

SEQ ID NO: 1100432 - RNA, 19 nt, Homo sapiens
ucccuucgauauaugacuu

SEQ ID NO: 1100433 - RNA, 23 nt, Homo sapiens
uccggugucuggaaaagcacuuu

SEQ ID NO: 1100434 - RNA, 14 nt, Homo sapiens
uccgucaccucaga

SEQ ID NO: 1100435 - RNA, 19 nt, Homo sapiens
uccgucucaaaaaaagggc

SEQ ID NO: 1100436 - RNA, 16 nt, Homo sapiens
uccuacaguggcuguc

SEQ ID NO: 1100437 - RNA, 17 nt, Homo sapiens
uccuacaguggcuguca

SEQ ID NO: 1100438 - RNA, 15 nt, Homo sapiens
uccuaccuauauuac

SEQ ID NO: 1100439 - RNA, 18 nt, Homo sapiens
uccuacucugugucaggu

SEQ ID NO: 1100440 - RNA, 20 nt, Homo sapiens
uccuaggccacaccaucucc

SEQ ID NO: 1100441 - RNA, 19 nt, Homo sapiens
uccuauuaaaacacagcuu

SEQ ID NO: 1100442 - RNA, 17 nt, Homo sapiens
uccuauucuauugcagu

SEQ ID NO: 1100443 - RNA, 24 nt, Homo sapiens
uccucagggacagagacaccugca

SEQ ID NO: 1100444 - RNA, 21 nt, Homo sapiens
uccucaggggccugcccagug

SEQ ID NO: 1100445 - RNA, 12 nt, Homo sapiens
uccuccaggcaa

SEQ ID NO: 1100446 - RNA, 15 nt, Homo sapiens
uccuccgucaccuca

SEQ ID NO: 1100447 - RNA, 19 nt, Homo sapiens
uccuccgucaccucagaga

SEQ ID NO: 1100448 - RNA, 14 nt, Homo sapiens
uccuccuuugccua

SEQ ID NO: 1100449 - RNA, 19 nt, Homo sapiens
uccucuccccagcaaguga

SEQ ID NO: 1100450 - RNA, 17 nt, Homo sapiens
uccucucccugcaccug

SEQ ID NO: 1100451 - RNA, 15 nt, Homo sapiens
uccucugccaccucc

SEQ ID NO: 1100452 - RNA, 19 nt, Homo sapiens
uccucuguccaggcacugc

SEQ ID NO: 1100453 - RNA, 11 nt, Homo sapiens
uccucuucuau

SEQ ID NO: 1100454 - RNA, 23 nt, Homo sapiens
uccugagaggugcugcaggcaaa

SEQ ID NO: 1100455 - RNA, 21 nt, Homo sapiens
uccugauaaacauuaaacacu

SEQ ID NO: 1100456 - RNA, 20 nt, Homo sapiens
uccugcagccuccuccugac

SEQ ID NO: 1100457 - RNA, 19 nt, Homo sapiens
uccugccaccagucacugu

SEQ ID NO: 1100458 - RNA, 16 nt, Homo sapiens
uccugcuagcuguaga

SEQ ID NO: 1100459 - RNA, 22 nt, Homo sapiens
uccugcuggaugcgugcccuga

SEQ ID NO: 1100460 - RNA, 23 nt, Homo sapiens
uccuggaaccaaucccgugaaag

SEQ ID NO: 1100461 - RNA, 15 nt, Homo sapiens
uccuggaaugaagca

SEQ ID NO: 1100462 - RNA, 16 nt, Homo sapiens
uccuggccucaaguga

SEQ ID NO: 1100463 - RNA, 15 nt, Homo sapiens
uccuggcugagagag

SEQ ID NO: 1100464 - RNA, 22 nt, Homo sapiens
uccugggagagaaggagaucag

SEQ ID NO: 1100465 - RNA, 16 nt, Homo sapiens
uccugggagugagcug

SEQ ID NO: 1100466 - RNA, 18 nt, Homo sapiens
uccugguauuauuuacaa

SEQ ID NO: 1100467 - RNA, 14 nt, Homo sapiens
uccuguauucuaca

SEQ ID NO: 1100468 - RNA, 22 nt, Homo sapiens
uccugugugugcgccuacagga

SEQ ID NO: 1100469 - RNA, 24 nt, Homo sapiens
uccuguugcaaugacacauaggaa

SEQ ID NO: 1100470 - RNA, 17 nt, Homo sapiens
uccuguuuacacucggg

SEQ ID NO: 1100471 - RNA, 14 nt, Homo sapiens
uccuuccuucccug

SEQ ID NO: 1100472 - RNA, 17 nt, Homo sapiens
uccuuuagcgcccaguu

SEQ ID NO: 1100473 - RNA, 16 nt, Homo sapiens
uccuuuggccauucca

SEQ ID NO: 1100474 - RNA, 19 nt, Homo sapiens
ucgaagcuccgugagugaa

SEQ ID NO: 1100475 - RNA, 19 nt, Homo sapiens
ucgaccacuuuucaguuca

SEQ ID NO: 1100476 - RNA, 16 nt, Homo sapiens
ucgagaccaaccugac

SEQ ID NO: 1100477 - RNA, 15 nt, Homo sapiens
ucgagucuaccucuu

SEQ ID NO: 1100478 - RNA, 15 nt, Homo sapiens
ucgaguuuacuucau

SEQ ID NO: 1100479 - RNA, 12 nt, Homo sapiens
ucgauuagacug

SEQ ID NO: 1100480 - RNA, 23 nt, Homo sapiens
ucgccucucccaccccaugcauu

SEQ ID NO: 1100481 - RNA, 22 nt, Homo sapiens
ucgggaggcugaggcggaagaa

SEQ ID NO: 1100482 - RNA, 13 nt, Homo sapiens
ucguagccaucuc

SEQ ID NO: 1100483 - RNA, 17 nt, Homo sapiens
ucuaaaacugccuucca

SEQ ID NO: 1100484 - RNA, 14 nt, Homo sapiens
ucuaaauagcccuu

SEQ ID NO: 1100485 - RNA, 23 nt, Homo sapiens
ucuaaaugaagugcaaauuugau

SEQ ID NO: 1100486 - RNA, 19 nt, Homo sapiens
ucuaacuagaaaucugcca

SEQ ID NO: 1100487 - RNA, 20 nt, Homo sapiens
ucuaacuagaaaucugccaa

SEQ ID NO: 1100488 - RNA, 13 nt, Homo sapiens
ccauaauguuaca

SEQ ID NO: 1100489 - RNA, 13 nt, Homo sapiens
ccauagaaacuga

SEQ ID NO: 1100490 - RNA, 16 nt, Homo sapiens
ccauagaaacugaggc

SEQ ID NO: 1100491 - RNA, 20 nt, Homo sapiens
ccauagcaagauugcuuaaa

SEQ ID NO: 1100492 - RNA, 22 nt, Homo sapiens
ccauaugaauuuacuacuuuaa

SEQ ID NO: 1100493 - RNA, 23 nt, Homo sapiens
ccauaugaauuuacuacuuuaaa

SEQ ID NO: 1100494 - RNA, 19 nt, Homo sapiens
ccaucaacaagucuugaaa

SEQ ID NO: 1100495 - RNA, 12 nt, Homo sapiens
ccauccagguuc

SEQ ID NO: 1100496 - RNA, 13 nt, Homo sapiens
ccauccuauuuaa

SEQ ID NO: 1100497 - RNA, 16 nt, Homo sapiens
ccaucucugauuuuca

SEQ ID NO: 1100498 - RNA, 22 nt, Homo sapiens
ccaucugucuugccagccagaa

SEQ ID NO: 1100499 - RNA, 22 nt, Homo sapiens
ccaucuuuugugagauguaauu

SEQ ID NO: 1100500 - RNA, 23 nt, Homo sapiens
ccaugaaaaugcaacaacaugua

SEQ ID NO: 1100501 - RNA, 14 nt, Homo sapiens
ccaugaaucaaaga

SEQ ID NO: 1100502 - RNA, 20 nt, Homo sapiens
ccaugaggcaaugucaggaa

SEQ ID NO: 1100503 - RNA, 15 nt, Homo sapiens
ccaugcgcugcucaa

SEQ ID NO: 1100504 - RNA, 14 nt, Homo sapiens
ccaugcuucuugcc

SEQ ID NO: 1100505 - RNA, 19 nt, Homo sapiens
ccaugguaugaaggugauu

SEQ ID NO: 1100506 - RNA, 19 nt, Homo sapiens
ccauguaccaguguacugc

SEQ ID NO: 1100507 - RNA, 21 nt, Homo sapiens
ccauguaccaguguacugcuu

SEQ ID NO: 1100508 - RNA, 17 nt, Homo sapiens
ccauguuggccaggcug

SEQ ID NO: 1100509 - RNA, 11 nt, Homo sapiens
ccauucuugga

SEQ ID NO: 1100510 - RNA, 21 nt, Homo sapiens
ccauuuguuggggcaguggua

SEQ ID NO: 1100511 - RNA, 19 nt, Homo sapiens
ccauuuuggaaguuuucag

SEQ ID NO: 1100512 - RNA, 18 nt, Homo sapiens
cccaacuccuuccagcua

SEQ ID NO: 1100513 - RNA, 17 nt, Homo sapiens
cccaauaaaagugacuc

SEQ ID NO: 1100514 - RNA, 17 nt, Homo sapiens
cccacagaacugcuuac

SEQ ID NO: 1100515 - RNA, 13 nt, Homo sapiens
cccacagguauga

SEQ ID NO: 1100516 - RNA, 15 nt, Homo sapiens
cccaccaucaugucu

SEQ ID NO: 1100517 - RNA, 19 nt, Homo sapiens
cccaccaugcgcugcucaa

SEQ ID NO: 1100518 - RNA, 14 nt, Homo sapiens
cccagaauagcuuu

SEQ ID NO: 1100519 - RNA, 11 nt, Homo sapiens
cccagcacugu

SEQ ID NO: 1100520 - RNA, 15 nt, Homo sapiens
cccagcagggccuca

SEQ ID NO: 1100521 - RNA, 18 nt, Homo sapiens
cccagcaugcugagauua

SEQ ID NO: 1100522 - RNA, 17 nt, Homo sapiens
cccagcccuauggaugu

SEQ ID NO: 1100523 - RNA, 16 nt, Homo sapiens
cccagcuacucaggag

SEQ ID NO: 1100524 - RNA, 17 nt, Homo sapiens
cccagggaagccaaaag

SEQ ID NO: 1100525 - RNA, 18 nt, Homo sapiens
cccagguggcugacccag

SEQ ID NO: 1100526 - RNA, 16 nt, Homo sapiens
cccagucucccaccuu

SEQ ID NO: 1100527 - RNA, 16 nt, Homo sapiens
cccagugcuaccucuc

SEQ ID NO: 1100528 - RNA, 23 nt, Homo sapiens
cccaguguggccccagcccgaca

SEQ ID NO: 1100529 - RNA, 21 nt, Homo sapiens
cccaguguuugggguguuuca

SEQ ID NO: 1100530 - RNA, 16 nt, Homo sapiens
cccauccccuuuccuc

SEQ ID NO: 1100531 - RNA, 23 nt, Homo sapiens
cccaucuuguuucacacuaguca

SEQ ID NO: 1100532 - RNA, 22 nt, Homo sapiens
cccaugaguagugcccacuuga

SEQ ID NO: 1100533 - RNA, 18 nt, Homo sapiens
cccaugcucaaccacugu

SEQ ID NO: 1100534 - RNA, 17 nt, Homo sapiens
cccauuccuauuucuua

SEQ ID NO: 1100535 - RNA, 14 nt, Homo sapiens
cccauuuugcaaaa

SEQ ID NO: 1100536 - RNA, 22 nt, Homo sapiens
ccccacacugaccuguguuccc

SEQ ID NO: 1100537 - RNA, 18 nt, Homo sapiens
ccccaccagccaccucuu

SEQ ID NO: 1100538 - RNA, 22 nt, Homo sapiens
ccccaccugccauuugcacccu

SEQ ID NO: 1100539 - RNA, 14 nt, Homo sapiens
ccccaccuggcuca

SEQ ID NO: 1100540 - RNA, 18 nt, Homo sapiens
ccccagaacacagugccu

SEQ ID NO: 1100541 - RNA, 17 nt, Homo sapiens
ccccagcaagagcacaa

SEQ ID NO: 1100542 - RNA, 15 nt, Homo sapiens
ccccagugcccacag

SEQ ID NO: 1100543 - RNA, 15 nt, Homo sapiens
cccccugccagugcc

SEQ ID NO: 1100544 - RNA, 14 nt, Homo sapiens
cccccuggagagaa

SEQ ID NO: 1100545 - RNA, 22 nt, Homo sapiens
ccccgugaaugcuuaccuguga

SEQ ID NO: 1100546 - RNA, 20 nt, Homo sapiens
ccccucauuguuuauuaaca

SEQ ID NO: 1100547 - RNA, 19 nt, Homo sapiens
ccccuggaacugucucuca

SEQ ID NO: 1100548 - RNA, 23 nt, Homo sapiens
ccccuggggcuucuccugaccca

SEQ ID NO: 1100549 - RNA, 22 nt, Homo sapiens
cccgacugugaaaguaugugau

SEQ ID NO: 1100550 - RNA, 22 nt, Homo sapiens
cccgccucuucuucuucagaag

SEQ ID NO: 1100551 - RNA, 22 nt, Homo sapiens
cccuaaauguggacaucaugaa

SEQ ID NO: 1100552 - RNA, 23 nt, Homo sapiens
cccuaaggaaaucaaaucccauu

SEQ ID NO: 1100553 - RNA, 14 nt, Homo sapiens
cccuaggagaccaa

SEQ ID NO: 1100554 - RNA, 16 nt, Homo sapiens
cccuauccacccagcc

SEQ ID NO: 1100555 - RNA, 11 nt, Homo sapiens
cccucagggau

SEQ ID NO: 1100556 - RNA, 20 nt, Homo sapiens
cccuccccauucagacacuu

SEQ ID NO: 1100557 - RNA, 16 nt, Homo sapiens
cccucuacuccaugca

SEQ ID NO: 1100558 - RNA, 18 nt, Homo sapiens
cccugaguggaucuccaa

SEQ ID NO: 1100559 - RNA, 17 nt, Homo sapiens
cccugcaggaaaacuga

SEQ ID NO: 1100560 - RNA, 16 nt, Homo sapiens
cccugccccacuucuc

SEQ ID NO: 1100561 - RNA, 16 nt, Homo sapiens
cccugcuugcacuuug

SEQ ID NO: 1100562 - RNA, 21 nt, Homo sapiens
cccuggcugaccccaaagagc

SEQ ID NO: 1100563 - RNA, 16 nt, Homo sapiens
cccugggcucaucagc

SEQ ID NO: 1100564 - RNA, 14 nt, Homo sapiens
cccuguaugauucc

SEQ ID NO: 1100565 - RNA, 21 nt, Homo sapiens
cccuuccaugucgccucugca

SEQ ID NO: 1100566 - RNA, 19 nt, Homo sapiens
cccuuccuacagauaguca

SEQ ID NO: 1100567 - RNA, 12 nt, Homo sapiens
cccuugcauuag

SEQ ID NO: 1100568 - RNA, 16 nt, Homo sapiens
ccgagagagauggaau

SEQ ID NO: 1100569 - RNA, 16 nt, Homo sapiens
ccgcaccuugucaugu

SEQ ID NO: 1100570 - RNA, 13 nt, Homo sapiens
ccgccccagacac

SEQ ID NO: 1100571 - RNA, 14 nt, Homo sapiens
ccgcucuggaccaa

SEQ ID NO: 1100572 - RNA, 13 nt, Homo sapiens
ccgcuugccauau

SEQ ID NO: 1100573 - RNA, 15 nt, Homo sapiens
ccgcuuucaugaaca

SEQ ID NO: 1100574 - RNA, 12 nt, Homo sapiens
ccggcugcgugg

SEQ ID NO: 1100575 - RNA, 21 nt, Homo sapiens
ccgggagaggagaucagggcg

SEQ ID NO: 1100576 - RNA, 20 nt, Homo sapiens
ccgggcugggagcucugcag

SEQ ID NO: 1100577 - RNA, 23 nt, Homo sapiens
uauucucaguguagggcagagag

SEQ ID NO: 1100578 - RNA, 21 nt, Homo sapiens
uauucuuggagaacuuuccau

SEQ ID NO: 1100579 - RNA, 19 nt, Homo sapiens
uauugaagaaaagcacuuu

SEQ ID NO: 1100580 - RNA, 18 nt, Homo sapiens
uauugauguuuccagaaa

SEQ ID NO: 1100581 - RNA, 20 nt, Homo sapiens
uauugauguuuccagaaaau

SEQ ID NO: 1100582 - RNA, 15 nt, Homo sapiens
uauugcauaugcaua

SEQ ID NO: 1100583 - RNA, 19 nt, Homo sapiens
uauuuaacuggcuucagcc

SEQ ID NO: 1100584 - RNA, 19 nt, Homo sapiens
ucagacauuugguauauua

SEQ ID NO: 1100585 - RNA, 16 nt, Homo sapiens
ucagacuuacuuacuc

SEQ ID NO: 1100586 - RNA, 16 nt, Homo sapiens
ucagagacuaucugau

SEQ ID NO: 1100587 - RNA, 20 nt, Homo sapiens
ucagagagcuaaauuacaau

SEQ ID NO: 1100588 - RNA, 17 nt, Homo sapiens
ucagaguugcuuuucua

SEQ ID NO: 1100589 - RNA, 18 nt, Homo sapiens
ucagauaaacaacaaaua

SEQ ID NO: 1100590 - RNA, 14 nt, Homo sapiens
ucuacaaaggccau

SEQ ID NO: 1100591 - RNA, 17 nt, Homo sapiens
ucuacaagcaaauggag

SEQ ID NO: 1100592 - RNA, 19 nt, Homo sapiens
ucuacacaguaaaaacuug

SEQ ID NO: 1100593 - RNA, 15 nt, Homo sapiens
ucuacacauacugca

SEQ ID NO: 1100594 - RNA, 21 nt, Homo sapiens
ucuacaguuaggguugaguua

SEQ ID NO: 1100595 - RNA, 15 nt, Homo sapiens
ucuacuaaaaauaca

SEQ ID NO: 1100596 - RNA, 17 nt, Homo sapiens
ucuacugagacaugacu

SEQ ID NO: 1100597 - RNA, 18 nt, Homo sapiens
ucuacuggucuuguggaa

SEQ ID NO: 1100598 - RNA, 16 nt, Homo sapiens
ucuacuuaaugagaua

SEQ ID NO: 1100599 - RNA, 19 nt, Homo sapiens
ucuagaagcgguuuccagg

SEQ ID NO: 1100600 - RNA, 22 nt, Homo sapiens
ucuagacacugccacacagggu

SEQ ID NO: 1100601 - RNA, 15 nt, Homo sapiens
ucuagagaacaugcc

SEQ ID NO: 1100602 - RNA, 20 nt, Homo sapiens
ucuaguauuccagaccugaa

SEQ ID NO: 1100603 - RNA, 17 nt, Homo sapiens
ucuaguuagcugcuuua

SEQ ID NO: 1100604 - RNA, 23 nt, Homo sapiens
ucuauacuagggacuggaucuca

SEQ ID NO: 1100605 - RNA, 21 nt, Homo sapiens
ucuauagagaaaaacuuucau

SEQ ID NO: 1100606 - RNA, 16 nt, Homo sapiens
ucuauauaauguagua

SEQ ID NO: 1100607 - RNA, 21 nt, Homo sapiens
ucuaugagauagguacuauua

SEQ ID NO: 1100608 - RNA, 22 nt, Homo sapiens
ucuaugagauagguacuauuau

SEQ ID NO: 1100609 - RNA, 21 nt, Homo sapiens
ucuaugccagcucagucccau

SEQ ID NO: 1100610 - RNA, 23 nt, Homo sapiens
ucuauggcaguccagccagcucc

SEQ ID NO: 1100611 - RNA, 23 nt, Homo sapiens
ucuaugggacucaaugcacugac

SEQ ID NO: 1100612 - RNA, 20 nt, Homo sapiens
ucuauucuuuguaccaucug

SEQ ID NO: 1100613 - RNA, 20 nt, Homo sapiens
ucuauugaaaaaucaccaca

SEQ ID NO: 1100614 - RNA, 19 nt, Homo sapiens
ucucaaauccugaugcugu

SEQ ID NO: 1100615 - RNA, 16 nt, Homo sapiens
ucucaaaugcacaucu

SEQ ID NO: 1100616 - RNA, 14 nt, Homo sapiens
ucucaaauucucaa

SEQ ID NO: 1100617 - RNA, 14 nt, Homo sapiens
ucucacaagcacuu

SEQ ID NO: 1100618 - RNA, 20 nt, Homo sapiens
ucucacuauguugcccaggc

SEQ ID NO: 1100619 - RNA, 18 nt, Homo sapiens
ucucacuguugcccaggc

SEQ ID NO: 1100620 - RNA, 18 nt, Homo sapiens
ucucacuugugcaguguu

SEQ ID NO: 1100621 - RNA, 14 nt, Homo sapiens
ucucagaagguauu

SEQ ID NO: 1100622 - RNA, 14 nt, Homo sapiens
ucucagaauucuuc

SEQ ID NO: 1100623 - RNA, 23 nt, Homo sapiens
ucucaucaguguccucuugcuca

SEQ ID NO: 1100624 - RNA, 15 nt, Homo sapiens
ucucauuuaagggaa

SEQ ID NO: 1100625 - RNA, 14 nt, Homo sapiens
ucuccaaaugagau

SEQ ID NO: 1100626 - RNA, 22 nt, Homo sapiens
ucuccaccaacuggagcacuga

SEQ ID NO: 1100627 - RNA, 12 nt, Homo sapiens
ucuccacugcuc

SEQ ID NO: 1100628 - RNA, 14 nt, Homo sapiens
ucuccacuuuguug

SEQ ID NO: 1100629 - RNA, 20 nt, Homo sapiens
ucuccaggauugaagagcau

SEQ ID NO: 1100630 - RNA, 18 nt, Homo sapiens
ucuccaucucugucucaa

SEQ ID NO: 1100631 - RNA, 20 nt, Homo sapiens
ucuccucuggggaagaccuu

SEQ ID NO: 1100632 - RNA, 22 nt, Homo sapiens
ucuccugggcccgcuuugccug

SEQ ID NO: 1100633 - RNA, 18 nt, Homo sapiens
ucuccuguauaaucucuc

SEQ ID NO: 1100634 - RNA, 16 nt, Homo sapiens
ucuccuguccaaccua

SEQ ID NO: 1100635 - RNA, 16 nt, Homo sapiens
ucuccuuggaggacag

SEQ ID NO: 1100636 - RNA, 22 nt, Homo sapiens
ucucuaucuggaauuuaauuaa

SEQ ID NO: 1100637 - RNA, 15 nt, Homo sapiens
ucucuccagccugac

SEQ ID NO: 1100638 - RNA, 16 nt, Homo sapiens
ucucucucucuacaaa

SEQ ID NO: 1100639 - RNA, 20 nt, Homo sapiens
ucucugggagacuuucccua

SEQ ID NO: 1100640 - RNA, 20 nt, Homo sapiens
ucucuggguagguguugaaa

SEQ ID NO: 1100641 - RNA, 19 nt, Homo sapiens
ucucugugcuuugacucac

SEQ ID NO: 1100642 - RNA, 16 nt, Homo sapiens
ucucuuauauaguauu

SEQ ID NO: 1100643 - RNA, 19 nt, Homo sapiens
ucugaaaauuaacacugcu

SEQ ID NO: 1100644 - RNA, 13 nt, Homo sapiens
ucugaaacuucau

SEQ ID NO: 1100645 - RNA, 16 nt, Homo sapiens
ucugaaaugaccucaa

SEQ ID NO: 1100646 - RNA, 20 nt, Homo sapiens
ucugaagucacaucacagga

SEQ ID NO: 1100647 - RNA, 15 nt, Homo sapiens
ucugaaugacaucaa

SEQ ID NO: 1100648 - RNA, 13 nt, Homo sapiens
ucugaauugacug

SEQ ID NO: 1100649 - RNA, 15 nt, Homo sapiens
ucugaauugacugua

SEQ ID NO: 1100650 - RNA, 13 nt, Homo sapiens
ucugacacacagc

SEQ ID NO: 1100651 - RNA, 18 nt, Homo sapiens
ucugaccauuucaggggu

SEQ ID NO: 1100652 - RNA, 15 nt, Homo sapiens
ucugacuuugagacg

SEQ ID NO: 1100653 - RNA, 20 nt, Homo sapiens
ucugagcaagagcuggcaaa

SEQ ID NO: 1100654 - RNA, 11 nt, Homo sapiens
ucugagcccac

SEQ ID NO: 1100655 - RNA, 15 nt, Homo sapiens
ucugagcuagugauu

SEQ ID NO: 1100656 - RNA, 22 nt, Homo sapiens
ucugaggcgccccaacccgugg

SEQ ID NO: 1100657 - RNA, 20 nt, Homo sapiens
ucugauaaugaaaauuauga

SEQ ID NO: 1100658 - RNA, 20 nt, Homo sapiens
ucugauacccagagcauuac

SEQ ID NO: 1100659 - RNA, 21 nt, Homo sapiens
ucugaugaccuaaccuaagca

SEQ ID NO: 1100660 - RNA, 22 nt, Homo sapiens
ucugaugaccuaaccuaagcaa

SEQ ID NO: 1100661 - RNA, 21 nt, Homo sapiens
ucugauucgaaugacacuguu

SEQ ID NO: 1100662 - RNA, 14 nt, Homo sapiens
ucugauuggcucac

SEQ ID NO: 1100663 - RNA, 23 nt, Homo sapiens
ucugcagcccggcgccaccaucc

SEQ ID NO: 1100664 - RNA, 15 nt, Homo sapiens
ucugcauguguguug

SEQ ID NO: 1100665 - RNA, 14 nt, Homo sapiens
ucugcccagaauuc

SEQ ID NO: 1100666 - RNA, 16 nt, Homo sapiens
ucugcccugggcucau

SEQ ID NO: 1100667 - RNA, 14 nt, Homo sapiens
ucugccucugacac

SEQ ID NO: 1100668 - RNA, 22 nt, Homo sapiens
ucugccugauaggacccauauu

SEQ ID NO: 1100669 - RNA, 18 nt, Homo sapiens
ucugcucugaugcaucag

SEQ ID NO: 1100670 - RNA, 18 nt, Homo sapiens
ucugcugacagacacagg

SEQ ID NO: 1100671 - RNA, 19 nt, Homo sapiens
ucugcuggccuggaucucc

SEQ ID NO: 1100672 - RNA, 14 nt, Homo sapiens
ucuggaaaagcaaa

SEQ ID NO: 1100673 - RNA, 15 nt, Homo sapiens
ucuggaaaagcacuu

SEQ ID NO: 1100674 - RNA, 21 nt, Homo sapiens
ucuggaaaagcacuuuacaga

SEQ ID NO: 1100675 - RNA, 21 nt, Homo sapiens
ucuggauggauuugaagcaaa

SEQ ID NO: 1100676 - RNA, 17 nt, Homo sapiens
ucuggauggcaccagag

SEQ ID NO: 1100677 - RNA, 22 nt, Homo sapiens
ucuggcaucucuuucugcaaag

SEQ ID NO: 1100678 - RNA, 16 nt, Homo sapiens
uauuuacauuuuccaa

SEQ ID NO: 1100679 - RNA, 18 nt, Homo sapiens
uauuuauaagagugccgu

SEQ ID NO: 1100680 - RNA, 19 nt, Homo sapiens
uauuuaucagugacagagu

SEQ ID NO: 1100681 - RNA, 14 nt, Homo sapiens
uauuuaugccucug

SEQ ID NO: 1100682 - RNA, 21 nt, Homo sapiens
uauuuggaauaauaauuuucc

SEQ ID NO: 1100683 - RNA, 15 nt, Homo sapiens
uauuuguuugugcau

SEQ ID NO: 1100684 - RNA, 18 nt, Homo sapiens
uauuuucccucucuugcc

SEQ ID NO: 1100685 - RNA, 15 nt, Homo sapiens
uauuuuuaugugcaa

SEQ ID NO: 1100686 - RNA, 23 nt, Homo sapiens
uauuuuucaaagauguguugcua

SEQ ID NO: 1100687 - RNA, 17 nt, Homo sapiens
ucaaaacagagauguga

SEQ ID NO: 1100688 - RNA, 19 nt, Homo sapiens
ucaaaacagagaugugaua

SEQ ID NO: 1100689 - RNA, 21 nt, Homo sapiens
ucaaaacccaacaugacuguu

SEQ ID NO: 1100690 - RNA, 14 nt, Homo sapiens
ucaaagacauggaa

SEQ ID NO: 1100691 - RNA, 19 nt, Homo sapiens
ucaaagagggagugcauuu

SEQ ID NO: 1100692 - RNA, 21 nt, Homo sapiens
ucaaagcuuuuuccagaggcu

SEQ ID NO: 1100693 - RNA, 16 nt, Homo sapiens
ucaaaguaaaacuugc

SEQ ID NO: 1100694 - RNA, 13 nt, Homo sapiens
ucaaauaaaaagu

SEQ ID NO: 1100695 - RNA, 14 nt, Homo sapiens
ucaaauagcauaag

SEQ ID NO: 1100696 - RNA, 17 nt, Homo sapiens
ucaaauauuaccaaaaa

SEQ ID NO: 1100697 - RNA, 21 nt, Homo sapiens
ucaaaucaguccuuugauucc

SEQ ID NO: 1100698 - RNA, 23 nt, Homo sapiens
ucaaaucaguccuuugauuccau

SEQ ID NO: 1100699 - RNA, 16 nt, Homo sapiens
ucaaaugacccaaaga

SEQ ID NO: 1100700 - RNA, 16 nt, Homo sapiens
ucaaaugcacaucuca

SEQ ID NO: 1100701 - RNA, 20 nt, Homo sapiens
ucaaauuuugcauuguguga

SEQ ID NO: 1100702 - RNA, 15 nt, Homo sapiens
ucaaccaauguagaa

SEQ ID NO: 1100703 - RNA, 13 nt, Homo sapiens
ucaaccacugugg

SEQ ID NO: 1100704 - RNA, 17 nt, Homo sapiens
ucaaccaggaacaugua

SEQ ID NO: 1100705 - RNA, 21 nt, Homo sapiens
ucaaccuccugggcuaaguga

SEQ ID NO: 1100706 - RNA, 22 nt, Homo sapiens
ucaacugaaaagacucaguguu

SEQ ID NO: 1100707 - RNA, 23 nt, Homo sapiens
ucaacuggagacacuauuuaucu

SEQ ID NO: 1100708 - RNA, 19 nt, Homo sapiens
ucaacuucagagacuaucu

SEQ ID NO: 1100709 - RNA, 14 nt, Homo sapiens
ucaagaaaacugga

SEQ ID NO: 1100710 - RNA, 13 nt, Homo sapiens
ucaagacaccaaa

SEQ ID NO: 1100711 - RNA, 18 nt, Homo sapiens
ucaagcacccuguucccu

SEQ ID NO: 1100712 - RNA, 18 nt, Homo sapiens
ucaagcccuuuacuugac

SEQ ID NO: 1100713 - RNA, 17 nt, Homo sapiens
ucaagcuagaaggccac

SEQ ID NO: 1100714 - RNA, 18 nt, Homo sapiens
ucaagcuagaaggccaca

SEQ ID NO: 1100715 - RNA, 20 nt, Homo sapiens
ucaagggauguauuggaaca

SEQ ID NO: 1100716 - RNA, 18 nt, Homo sapiens
ucaagggguguucaguua

SEQ ID NO: 1100717 - RNA, 19 nt, Homo sapiens
ucaaguccuacaagcuaaa

SEQ ID NO: 1100718 - RNA, 23 nt, Homo sapiens
ucaagucuucccugaucaaguca

SEQ ID NO: 1100719 - RNA, 13 nt, Homo sapiens
ucaaugaccugua

SEQ ID NO: 1100720 - RNA, 20 nt, Homo sapiens
ucaauuccaccugcaaucaa

SEQ ID NO: 1100721 - RNA, 22 nt, Homo sapiens
ucaauuucuggaaaacugccuu

SEQ ID NO: 1100722 - RNA, 18 nt, Homo sapiens
ucacaaccaccuaaucag

SEQ ID NO: 1100723 - RNA, 16 nt, Homo sapiens
ucacaaccagccacac

SEQ ID NO: 1100724 - RNA, 16 nt, Homo sapiens
ucacaagaagaccaga

SEQ ID NO: 1100725 - RNA, 13 nt, Homo sapiens
ucacaagcacuuu

SEQ ID NO: 1100726 - RNA, 11 nt, Homo sapiens
ucacacacagg

SEQ ID NO: 1100727 - RNA, 22 nt, Homo sapiens
ucacacagcccauaaagcaaga

SEQ ID NO: 1100728 - RNA, 19 nt, Homo sapiens
ucacagaacuauguacuuu

SEQ ID NO: 1100729 - RNA, 23 nt, Homo sapiens
ucacaucuuaugcuaacuguaga

SEQ ID NO: 1100730 - RNA, 21 nt, Homo sapiens
ucacaugcuagcaacauacca

SEQ ID NO: 1100731 - RNA, 18 nt, Homo sapiens
ucacauggccuaugcaca

SEQ ID NO: 1100732 - RNA, 14 nt, Homo sapiens
ucacauucaggaag

SEQ ID NO: 1100733 - RNA, 14 nt, Homo sapiens
ucacauugugccuu

SEQ ID NO: 1100734 - RNA, 12 nt, Homo sapiens
ucaccaagccca

SEQ ID NO: 1100735 - RNA, 15 nt, Homo sapiens
ucaccaagcccaguu

SEQ ID NO: 1100736 - RNA, 18 nt, Homo sapiens
ucaccacaccaaaccucu

SEQ ID NO: 1100737 - RNA, 15 nt, Homo sapiens
ucaccagauuugcua

SEQ ID NO: 1100738 - RNA, 21 nt, Homo sapiens
ucacccagcuaaucuguaggg

SEQ ID NO: 1100739 - RNA, 16 nt, Homo sapiens
ucaccgacaacaugcu

SEQ ID NO: 1100740 - RNA, 14 nt, Homo sapiens
ucaccgugagcagc

SEQ ID NO: 1100741 - RNA, 12 nt, Homo sapiens
ucaccucaggcc

SEQ ID NO: 1100742 - RNA, 15 nt, Homo sapiens
ucaccucugccucaa

SEQ ID NO: 1100743 - RNA, 14 nt, Homo sapiens
ucaccuuccagugu

SEQ ID NO: 1100744 - RNA, 14 nt, Homo sapiens
ucacgauauuauua

SEQ ID NO: 1100745 - RNA, 19 nt, Homo sapiens
ucacgcaacuugaaauuau

SEQ ID NO: 1100746 - RNA, 19 nt, Homo sapiens
ucacgccuguaaucccagc

SEQ ID NO: 1100747 - RNA, 18 nt, Homo sapiens
ucacucuuccugcaagga

SEQ ID NO: 1100748 - RNA, 22 nt, Homo sapiens
ucacugaagaaaccuucagauu

SEQ ID NO: 1100749 - RNA, 21 nt, Homo sapiens
ucacugggccuccaaccaugu

SEQ ID NO: 1100750 - RNA, 22 nt, Homo sapiens
ucacuuaacugauguuacugaa

SEQ ID NO: 1100751 - RNA, 19 nt, Homo sapiens
ucacuucgaugacuggaua

SEQ ID NO: 1100752 - RNA, 13 nt, Homo sapiens
ucacuuguacaaa

SEQ ID NO: 1100753 - RNA, 16 nt, Homo sapiens
ucacuuuaauucucau

SEQ ID NO: 1100754 - RNA, 14 nt, Homo sapiens
ucacuuuguuaaaa

SEQ ID NO: 1100755 - RNA, 17 nt, Homo sapiens
ucacuuuuaaugaacaa

SEQ ID NO: 1100756 - RNA, 17 nt, Homo sapiens
ucagaaaagaaaaccau

SEQ ID NO: 1100757 - RNA, 15 nt, Homo sapiens
ucagaacauccucca

SEQ ID NO: 1100758 - RNA, 19 nt, Homo sapiens
ucagaaguuucucagcucc

SEQ ID NO: 1100759 - RNA, 18 nt, Homo sapiens
ucagaaguuucuucuuua

SEQ ID NO: 1100760 - RNA, 19 nt, Homo sapiens
ucagaauuucuuugucauu

SEQ ID NO: 1100761 - RNA, 17 nt, Homo sapiens
uugggaauugcaugcca

SEQ ID NO: 1100762 - RNA, 22 nt, Homo sapiens
uugggaggcugaggcaagagaa

SEQ ID NO: 1100763 - RNA, 16 nt, Homo sapiens
uugggcuggugucacc

SEQ ID NO: 1100764 - RNA, 13 nt, Homo sapiens
uugguauauuucc

SEQ ID NO: 1100765 - RNA, 13 nt, Homo sapiens
uuggucaugcuuc

SEQ ID NO: 1100766 - RNA, 21 nt, Homo sapiens
uuguaaaccaucgcgugcaau

SEQ ID NO: 1100767 - RNA, 17 nt, Homo sapiens
uuguaaauagcucaggu

SEQ ID NO: 1100768 - RNA, 13 nt, Homo sapiens
uuguaacuccacc

SEQ ID NO: 1100769 - RNA, 20 nt, Homo sapiens
uuguaagaguggaaccaaca

SEQ ID NO: 1100770 - RNA, 21 nt, Homo sapiens
uuguagagccagggucucacu

SEQ ID NO: 1100771 - RNA, 21 nt, Homo sapiens
uuguagugguauagaguacug

SEQ ID NO: 1100772 - RNA, 12 nt, Homo sapiens
uugucagaauuu

SEQ ID NO: 1100773 - RNA, 18 nt, Homo sapiens
uugucauucaagccugug

SEQ ID NO: 1100774 - RNA, 10 nt, Homo sapiens
uugucucaag

SEQ ID NO: 1100775 - RNA, 19 nt, Homo sapiens
uugugagcacucuacugca

SEQ ID NO: 1100776 - RNA, 20 nt, Homo sapiens
uugugagcacucuacugcaa

SEQ ID NO: 1100777 - RNA, 18 nt, Homo sapiens
uugugaucuaucaauagu

SEQ ID NO: 1100778 - RNA, 18 nt, Homo sapiens
uugugauuuuugaacaau

SEQ ID NO: 1100779 - RNA, 16 nt, Homo sapiens
uugugccucuggcugc

SEQ ID NO: 1100780 - RNA, 20 nt, Homo sapiens
uugugguuuaugucaucaua

SEQ ID NO: 1100781 - RNA, 14 nt, Homo sapiens
uuguguacaaagua

SEQ ID NO: 1100782 - RNA, 16 nt, Homo sapiens
uugugugguggcaccu

SEQ ID NO: 1100783 - RNA, 22 nt, Homo sapiens
uuguguguguguguugauccca

SEQ ID NO: 1100784 - RNA, 12 nt, Homo sapiens
uuguuaaugcau

SEQ ID NO: 1100785 - RNA, 12 nt, Homo sapiens
uuguucugauaa

SEQ ID NO: 1100786 - RNA, 17 nt, Homo sapiens
uuguuggccaaagccaa

SEQ ID NO: 1100787 - RNA, 17 nt, Homo sapiens
uuguuuccauucuuguc

SEQ ID NO: 1100788 - RNA, 18 nt, Homo sapiens
uuguuuccauucuugucc

SEQ ID NO: 1100789 - RNA, 13 nt, Homo sapiens
uuguuucuacuuu

SEQ ID NO: 1100790 - RNA, 17 nt, Homo sapiens
aagcaccugccgaccuc

SEQ ID NO: 1100791 - RNA, 17 nt, Homo sapiens
aagcacuguuucucuca

SEQ ID NO: 1100792 - RNA, 23 nt, Homo sapiens
aagcagcacauagcacugggaac

SEQ ID NO: 1100793 - RNA, 21 nt, Homo sapiens
aagcaguguuuucaccucaua

SEQ ID NO: 1100794 - RNA, 19 nt, Homo sapiens
aagcaucaaagcacuguuu

SEQ ID NO: 1100795 - RNA, 23 nt, Homo sapiens
aagcaugucucaauaguaaaaga

SEQ ID NO: 1100796 - RNA, 18 nt, Homo sapiens
aagcauuucccccaggga

SEQ ID NO: 1100797 - RNA, 20 nt, Homo sapiens
aagccacagcuggugguauc

SEQ ID NO: 1100798 - RNA, 21 nt, Homo sapiens
aagccaccuuccagugagcuc

SEQ ID NO: 1100799 - RNA, 11 nt, Homo sapiens
aagccacugaa

SEQ ID NO: 1100800 - RNA, 22 nt, Homo sapiens
aagccauaguggagagaacuga

SEQ ID NO: 1100801 - RNA, 19 nt, Homo sapiens
aagcccccacuucucucca

SEQ ID NO: 1100802 - RNA, 20 nt, Homo sapiens
aagcccccacuucucuccag

SEQ ID NO: 1100803 - RNA, 18 nt, Homo sapiens
aagcccccuacugagaaa

SEQ ID NO: 1100804 - RNA, 14 nt, Homo sapiens
aagcccuaagugac

SEQ ID NO: 1100805 - RNA, 12 nt, Homo sapiens
aagcccuugaac

SEQ ID NO: 1100806 - RNA, 13 nt, Homo sapiens
aagcuccucguga

SEQ ID NO: 1100807 - RNA, 15 nt, Homo sapiens
aagcuccucgugaua

SEQ ID NO: 1100808 - RNA, 19 nt, Homo sapiens
aagcucuuuaugacuguuu

SEQ ID NO: 1100809 - RNA, 21 nt, Homo sapiens
aagcugaggugcccaggagaa

SEQ ID NO: 1100810 - RNA, 21 nt, Homo sapiens
aagcugcugagaaucuagccu

SEQ ID NO: 1100811 - RNA, 19 nt, Homo sapiens
aagcuguuuccauagggug

SEQ ID NO: 1100812 - RNA, 12 nt, Homo sapiens
aagcuuugaacc

SEQ ID NO: 1100813 - RNA, 22 nt, Homo sapiens
aaggaacucuggcuuccaggua

SEQ ID NO: 1100814 - RNA, 12 nt, Homo sapiens
aaggaacuggaa

SEQ ID NO: 1100815 - RNA, 22 nt, Homo sapiens
aaggacaccuccuuccucaguc

SEQ ID NO: 1100816 - RNA, 21 nt, Homo sapiens
aaggacggccuucaacugaaa

SEQ ID NO: 1100817 - RNA, 17 nt, Homo sapiens
aaggagaacuauccaaa

SEQ ID NO: 1100818 - RNA, 23 nt, Homo sapiens
aaggagacucaccucugccucaa

SEQ ID NO: 1100819 - RNA, 15 nt, Homo sapiens
aaggaugacacugcc

SEQ ID NO: 1100820 - RNA, 18 nt, Homo sapiens
aaggauggagccagcucu

SEQ ID NO: 1100821 - RNA, 22 nt, Homo sapiens
aaggauguuuugucccauuucc

SEQ ID NO: 1100822 - RNA, 17 nt, Homo sapiens
aaggcacguuuggcauu

SEQ ID NO: 1100823 - RNA, 19 nt, Homo sapiens
aaggcaggaggaucacuug

SEQ ID NO: 1100824 - RNA, 16 nt, Homo sapiens
aaggcaggcagggcuc

SEQ ID NO: 1100825 - RNA, 15 nt, Homo sapiens
aaggcauuucuauca

SEQ ID NO: 1100826 - RNA, 13 nt, Homo sapiens
aaggcucagucuc

SEQ ID NO: 1100827 - RNA, 15 nt, Homo sapiens
aagggauaguccaaa

SEQ ID NO: 1100828 - RNA, 17 nt, Homo sapiens
aagggauaguccaaaga

SEQ ID NO: 1100829 - RNA, 18 nt, Homo sapiens
aagggauaguccaaagac

SEQ ID NO: 1100830 - RNA, 9 nt, Homo sapiens
aagggccag

SEQ ID NO: 1100831 - RNA, 19 nt, Homo sapiens
aaggggcacgccugcccag

SEQ ID NO: 1100832 - RNA, 13 nt, Homo sapiens
aaggguacugaaa

SEQ ID NO: 1100833 - RNA, 12 nt, Homo sapiens
aagggucuuccu

SEQ ID NO: 1100834 - RNA, 20 nt, Homo sapiens
aagguagcccagcacuguga

SEQ ID NO: 1100835 - RNA, 16 nt, Homo sapiens
aaggucccuuguuucc

SEQ ID NO: 1100836 - RNA, 16 nt, Homo sapiens
aaggugaagagaccaa

SEQ ID NO: 1100837 - RNA, 14 nt, Homo sapiens
aaggugcuugccug

SEQ ID NO: 1100838 - RNA, 16 nt, Homo sapiens
aaggugucauacagau

SEQ ID NO: 1100839 - RNA, 22 nt, Homo sapiens
aagguuuccaagauaaaaccag

SEQ ID NO: 1100840 - RNA, 20 nt, Homo sapiens
aaguaaaacuugcugccuga

SEQ ID NO: 1100841 - RNA, 15 nt, Homo sapiens
aaguaaauauuucag

SEQ ID NO: 1100842 - RNA, 15 nt, Homo sapiens
aaguaacuuuuacaa

SEQ ID NO: 1100843 - RNA, 15 nt, Homo sapiens
aaguaaguaccacuc

SEQ ID NO: 1100844 - RNA, 18 nt, Homo sapiens
aaguaaguaccacucagg

SEQ ID NO: 1100845 - RNA, 23 nt, Homo sapiens
aaguaauuaucgggaacaguguu

SEQ ID NO: 1100846 - RNA, 24 nt, Homo sapiens
aaguaauuccuguauucuacagca

SEQ ID NO: 1100847 - RNA, 13 nt, Homo sapiens
aaguaauuuugcc

SEQ ID NO: 1100848 - RNA, 22 nt, Homo sapiens
aaguacaaccugaauacccuuu

SEQ ID NO: 1100849 - RNA, 18 nt, Homo sapiens
aaguacuucuccacccug

SEQ ID NO: 1100850 - RNA, 17 nt, Homo sapiens
aaguagcacccuggauu

SEQ ID NO: 1100851 - RNA, 18 nt, Homo sapiens
aaguagguuuacauucau

SEQ ID NO: 1100852 - RNA, 16 nt, Homo sapiens
aaguaugagggaaaau

SEQ ID NO: 1100853 - RNA, 17 nt, Homo sapiens
aaguaugagggaaaaug

SEQ ID NO: 1100854 - RNA, 12 nt, Homo sapiens
aaguauuagcca

SEQ ID NO: 1100855 - RNA, 19 nt, Homo sapiens
aaguauuauuuauuugaau

SEQ ID NO: 1100856 - RNA, 13 nt, Homo sapiens
aagucaaggagaa

SEQ ID NO: 1100857 - RNA, 12 nt, Homo sapiens
aagucacacaga

SEQ ID NO: 1100858 - RNA, 14 nt, Homo sapiens
aagucacacagaca

SEQ ID NO: 1100859 - RNA, 12 nt, Homo sapiens
aagucacacagu

SEQ ID NO: 1100860 - RNA, 18 nt, Homo sapiens
aagucaccggagcuuuca

SEQ ID NO: 1100861 - RNA, 19 nt, Homo sapiens
aagucucugacucuugccu

SEQ ID NO: 1100862 - RNA, 23 nt, Homo sapiens
aagucuuuccgucucccuaaaau

SEQ ID NO: 1100863 - RNA, 23 nt, Homo sapiens
aagugaagaaaagugaaugcuca

SEQ ID NO: 1100864 - RNA, 19 nt, Homo sapiens
aagugaccuauaccugugu

SEQ ID NO: 1100865 - RNA, 15 nt, Homo sapiens
aagugagacaaucac

SEQ ID NO: 1100866 - RNA, 19 nt, Homo sapiens
aagugauccucccaccuca

SEQ ID NO: 1100867 - RNA, 20 nt, Homo sapiens
aagugauccucccaccucag

SEQ ID NO: 1100868 - RNA, 19 nt, Homo sapiens
aagugcgccuugcaaaaaa

SEQ ID NO: 1100869 - RNA, 18 nt, Homo sapiens
aagugguaggaaagccuc

SEQ ID NO: 1100870 - RNA, 20 nt, Homo sapiens
aaguguguugggaauugcau

SEQ ID NO: 1100871 - RNA, 13 nt, Homo sapiens
aaguguguuuccu

SEQ ID NO: 1100872 - RNA, 19 nt, Homo sapiens
agccugaauuuuguugcug

SEQ ID NO: 1100873 - RNA, 16 nt, Homo sapiens
agccugacuguguuca

SEQ ID NO: 1100874 - RNA, 13 nt, Homo sapiens
agccugagccaca

SEQ ID NO: 1100875 - RNA, 16 nt, Homo sapiens
aguuccuuucaauggu

SEQ ID NO: 1100876 - RNA, 17 nt, Homo sapiens
aguucuuuuacuguaau

SEQ ID NO: 1100877 - RNA, 16 nt, Homo sapiens
aguugaacaucucacu

SEQ ID NO: 1100878 - RNA, 22 nt, Homo sapiens
aguugacuugacagaacacugu

SEQ ID NO: 1100879 - RNA, 20 nt, Homo sapiens
aguugaucuacaaaggccau

SEQ ID NO: 1100880 - RNA, 20 nt, Homo sapiens
aguuguuccuuaagucagaa

SEQ ID NO: 1100881 - RNA, 19 nt, Homo sapiens
aguuuaucauugggagaag

SEQ ID NO: 1100882 - RNA, 13 nt, Homo sapiens
aguuuaucuuuca

SEQ ID NO: 1100883 - RNA, 19 nt, Homo sapiens
aguuuccaaucccauagau

SEQ ID NO: 1100884 - RNA, 16 nt, Homo sapiens
aguuucuaguaucaca

SEQ ID NO: 1100885 - RNA, 19 nt, Homo sapiens
aguuucuucuuuaggcauu

SEQ ID NO: 1100886 - RNA, 13 nt, Homo sapiens
aguuugagaccag

SEQ ID NO: 1100887 - RNA, 13 nt, Homo sapiens
aguuugauuucau

SEQ ID NO: 1100888 - RNA, 19 nt, Homo sapiens
aguuuuuacaaaauacuau

SEQ ID NO: 1100889 - RNA, 15 nt, Homo sapiens
aguuuuuguuucaca

SEQ ID NO: 1100890 - RNA, 22 nt, Homo sapiens
auaaaacgcaaagggcugaaag

SEQ ID NO: 1100891 - RNA, 13 nt, Homo sapiens
auaaaagcacuua

SEQ ID NO: 1100892 - RNA, 17 nt, Homo sapiens
auaaaagcacuuacuuc

SEQ ID NO: 1100893 - RNA, 20 nt, Homo sapiens
auaaaauuaugccauagcaa

SEQ ID NO: 1100894 - RNA, 22 nt, Homo sapiens
auaaacaacuuaauguucugaa

SEQ ID NO: 1100895 - RNA, 14 nt, Homo sapiens
auaaacacccauga

SEQ ID NO: 1100896 - RNA, 15 nt, Homo sapiens
aaauauuauuugcua

SEQ ID NO: 1100897 - RNA, 16 nt, Homo sapiens
aaauauugauuucuac

SEQ ID NO: 1100898 - RNA, 18 nt, Homo sapiens
aaauauuugcuaugaagc

SEQ ID NO: 1100899 - RNA, 18 nt, Homo sapiens
aaauauuuuuaugugcaa

SEQ ID NO: 1100900 - RNA, 20 nt, Homo sapiens
aaaucaccacaccaaaccuc

SEQ ID NO: 1100901 - RNA, 11 nt, Homo sapiens
aaauccaaaga

SEQ ID NO: 1100902 - RNA, 15 nt, Homo sapiens
aaauccaguuuccca

SEQ ID NO: 1100903 - RNA, 23 nt, Homo sapiens
aaaucugaggaaggugcuugccu

SEQ ID NO: 1100904 - RNA, 14 nt, Homo sapiens
aaaugaauguuguc

SEQ ID NO: 1100905 - RNA, 18 nt, Homo sapiens
aaaugcauccauuccuca

SEQ ID NO: 1100906 - RNA, 17 nt, Homo sapiens
aaaugcauguccucaaa

SEQ ID NO: 1100907 - RNA, 13 nt, Homo sapiens
aaauguaacuuga

SEQ ID NO: 1100908 - RNA, 11 nt, Homo sapiens
aaauguacaau

SEQ ID NO: 1100909 - RNA, 22 nt, Homo sapiens
aaauguacacuggauauguugu

SEQ ID NO: 1100910 - RNA, 16 nt, Homo sapiens
aaauguacauuaauua

SEQ ID NO: 1100911 - RNA, 22 nt, Homo sapiens
aaauguccuccaacaauaaaga

SEQ ID NO: 1100912 - RNA, 14 nt, Homo sapiens
aaaugugcuuaugu

SEQ ID NO: 1100913 - RNA, 21 nt, Homo sapiens
aaauguucagcuucagacuuu

SEQ ID NO: 1100914 - RNA, 12 nt, Homo sapiens
aaauguuucuca

SEQ ID NO: 1100915 - RNA, 15 nt, Homo sapiens
aaauuaaacccugcc

SEQ ID NO: 1100916 - RNA, 18 nt, Homo sapiens
aaauuaaaugcauguccu

SEQ ID NO: 1100917 - RNA, 19 nt, Homo sapiens
aaauuaagagauacauucc

SEQ ID NO: 1100918 - RNA, 16 nt, Homo sapiens
aaauuacaauugucau

SEQ ID NO: 1100919 - RNA, 15 nt, Homo sapiens
aaauuacuucucucu

SEQ ID NO: 1100920 - RNA, 14 nt, Homo sapiens
aaauuaugccauag

SEQ ID NO: 1100921 - RNA, 17 nt, Homo sapiens
aaauucaaccacuguaa

SEQ ID NO: 1100922 - RNA, 15 nt, Homo sapiens
aaauucaagccuuag

SEQ ID NO: 1100923 - RNA, 20 nt, Homo sapiens
aaauucauggugcacugagc

SEQ ID NO: 1100924 - RNA, 12 nt, Homo sapiens
aaauuccuguag

SEQ ID NO: 1100925 - RNA, 15 nt, Homo sapiens
aaauucuuuuucaca

SEQ ID NO: 1100926 - RNA, 15 nt, Homo sapiens
aaauuggauacugcu

SEQ ID NO: 1100927 - RNA, 16 nt, Homo sapiens
aaauuguuuuuacuga

SEQ ID NO: 1100928 - RNA, 14 nt, Homo sapiens
aaauuuaccacaga

SEQ ID NO: 1100929 - RNA, 13 nt, Homo sapiens
aaauuuauugcuu

SEQ ID NO: 1100930 - RNA, 21 nt, Homo sapiens
aaauuuggauuuacgacugaa

SEQ ID NO: 1100931 - RNA, 22 nt, Homo sapiens
aaauuugggggacuuacaugau

SEQ ID NO: 1100932 - RNA, 15 nt, Homo sapiens
aacaaacaaacaauu

SEQ ID NO: 1100933 - RNA, 23 nt, Homo sapiens
aacaaagugagacccccaucucu

SEQ ID NO: 1100934 - RNA, 17 nt, Homo sapiens
aacaaauagucuaucaa

SEQ ID NO: 1100935 - RNA, 14 nt, Homo sapiens
aacaaauggccuuu

SEQ ID NO: 1100936 - RNA, 14 nt, Homo sapiens
aacaacaaauaauu

SEQ ID NO: 1100937 - RNA, 22 nt, Homo sapiens
aacaaccuggucacaggacucu

SEQ ID NO: 1100938 - RNA, 14 nt, Homo sapiens
aacaacguaaacuu

SEQ ID NO: 1100939 - RNA, 19 nt, Homo sapiens
aacaacuguggucaauccg

SEQ ID NO: 1100940 - RNA, 23 nt, Homo sapiens
aacaacuugucuauuaccuguua

SEQ ID NO: 1100941 - RNA, 19 nt, Homo sapiens
aacaagaguugucuugucc

SEQ ID NO: 1100942 - RNA, 12 nt, Homo sapiens
aacaagaucugc

SEQ ID NO: 1100943 - RNA, 16 nt, Homo sapiens
aacaauggagauauca

SEQ ID NO: 1100944 - RNA, 20 nt, Homo sapiens
aacacaagugcgccuugcaa

SEQ ID NO: 1100945 - RNA, 12 nt, Homo sapiens
aacacagccugg

SEQ ID NO: 1100946 - RNA, 17 nt, Homo sapiens
aacaccaaaaagggauc

SEQ ID NO: 1100947 - RNA, 16 nt, Homo sapiens
aacaccaccaaaugac

SEQ ID NO: 1100948 - RNA, 17 nt, Homo sapiens
aacacucagaagccugg

SEQ ID NO: 1100949 - RNA, 22 nt, Homo sapiens
aacacugcaagaagucuugaga

SEQ ID NO: 1100950 - RNA, 18 nt, Homo sapiens
aacagaaagcauccuaaa

SEQ ID NO: 1100951 - RNA, 16 nt, Homo sapiens
aacagaagcuuccauu

SEQ ID NO: 1100952 - RNA, 13 nt, Homo sapiens
aacagacaacaga

SEQ ID NO: 1100953 - RNA, 13 nt, Homo sapiens
aacagaggccaug

SEQ ID NO: 1100954 - RNA, 16 nt, Homo sapiens
aacagauuguuugcaa

SEQ ID NO: 1100955 - RNA, 16 nt, Homo sapiens
aacagcauaacuaaau

SEQ ID NO: 1100956 - RNA, 17 nt, Homo sapiens
aacagccaacagguggc

SEQ ID NO: 1100957 - RNA, 15 nt, Homo sapiens
aacaggaaucucaga

SEQ ID NO: 1100958 - RNA, 15 nt, Homo sapiens
aacaggggccaaacu

SEQ ID NO: 1100959 - RNA, 15 nt, Homo sapiens
aacaguaacugccau

SEQ ID NO: 1100960 - RNA, 23 nt, Homo sapiens
aacauaucaaacauauguauaca

SEQ ID NO: 1100961 - RNA, 20 nt, Homo sapiens
aacauaugcauuaugaaguu

SEQ ID NO: 1100962 - RNA, 15 nt, Homo sapiens
aacaucucacuuugc

SEQ ID NO: 1100963 - RNA, 16 nt, Homo sapiens
aacauggagaggacuu

SEQ ID NO: 1100964 - RNA, 22 nt, Homo sapiens
aacauggugaaaccucaucucu

SEQ ID NO: 1100965 - RNA, 24 nt, Homo sapiens
aacauggugaaaccucaucucuac

SEQ ID NO: 1100966 - RNA, 11 nt, Homo sapiens
aacauucugua

SEQ ID NO: 1100967 - RNA, 22 nt, Homo sapiens
aacauugugccaugucaaacaa

SEQ ID NO: 1100968 - RNA, 20 nt, Homo sapiens
aacauuucuauagccaaaaa

SEQ ID NO: 1100969 - RNA, 20 nt, Homo sapiens
aacauuucucaaaugcacau

SEQ ID NO: 1100970 - RNA, 9 nt, Homo sapiens
aaccaauga

SEQ ID NO: 1100971 - RNA, 21 nt, Homo sapiens
aaccacguguuuugacaucau

SEQ ID NO: 1100972 - RNA, 18 nt, Homo sapiens
aaccagcagaaaagugcu

SEQ ID NO: 1100973 - RNA, 20 nt, Homo sapiens
aaccagcagaaaagugcuua

SEQ ID NO: 1100974 - RNA, 16 nt, Homo sapiens
aaccaguuaugugaau

SEQ ID NO: 1100975 - RNA, 18 nt, Homo sapiens
aaccaguuaugugaauga

SEQ ID NO: 1100976 - RNA, 14 nt, Homo sapiens
aaccauagcacagg

SEQ ID NO: 1100977 - RNA, 13 nt, Homo sapiens
aaccauccaucug

SEQ ID NO: 1100978 - RNA, 22 nt, Homo sapiens
uguaauuaaguaaaccaaaaag

SEQ ID NO: 1100979 - RNA, 22 nt, Homo sapiens
uguacauguguagccugugcau

SEQ ID NO: 1100980 - RNA, 17 nt, Homo sapiens
uguacauuccugauacu

SEQ ID NO: 1100981 - RNA, 19 nt, Homo sapiens
uguacauuccugauacugg

SEQ ID NO: 1100982 - RNA, 13 nt, Homo sapiens
uguaccaguguga

SEQ ID NO: 1100983 - RNA, 14 nt, Homo sapiens
uguacccuuccuac

SEQ ID NO: 1100984 - RNA, 21 nt, Homo sapiens
uguacuguaauagugugauua

SEQ ID NO: 1100985 - RNA, 19 nt, Homo sapiens
uguacuuuaaaaagaugua

SEQ ID NO: 1100986 - RNA, 22 nt, Homo sapiens
uguagcaucuucuggagucucc

SEQ ID NO: 1100987 - RNA, 20 nt, Homo sapiens
uguagcauuucuugauguug

SEQ ID NO: 1100988 - RNA, 23 nt, Homo sapiens
uguagcuuugcucuuugguagaa

SEQ ID NO: 1100989 - RNA, 12 nt, Homo sapiens
uguaggaagauu

SEQ ID NO: 1100990 - RNA, 21 nt, Homo sapiens
uguauaaccccaccuugccaa

SEQ ID NO: 1100991 - RNA, 23 nt, Homo sapiens
uguauaaccccaccuugccaagc

SEQ ID NO: 1100992 - RNA, 16 nt, Homo sapiens
uguauauacauauuau

SEQ ID NO: 1100993 - RNA, 21 nt, Homo sapiens
uguauauuaagguguggcuuu

SEQ ID NO: 1100994 - RNA, 13 nt, Homo sapiens
uguauccugauaa

SEQ ID NO: 1100995 - RNA, 16 nt, Homo sapiens
uguaucuuauucacau

SEQ ID NO: 1100996 - RNA, 17 nt, Homo sapiens
uguauguuccucuauga

SEQ ID NO: 1100997 - RNA, 18 nt, Homo sapiens
uguauuguuaaugcauca

SEQ ID NO: 1100998 - RNA, 18 nt, Homo sapiens
ugucaccagcugccaaaa

SEQ ID NO: 1100999 - RNA, 18 nt, Homo sapiens
ugucagaaacucgaugaa

SEQ ID NO: 1101000 - RNA, 19 nt, Homo sapiens
ugucagucugggugucuca

SEQ ID NO: 1101001 - RNA, 23 nt, Homo sapiens
ugucaucaaauauuaccaaaaaa

SEQ ID NO: 1101002 - RNA, 16 nt, Homo sapiens
ugucaucauacaugac

SEQ ID NO: 1101003 - RNA, 13 nt, Homo sapiens
ugucauccagaaa

SEQ ID NO: 1101004 - RNA, 19 nt, Homo sapiens
ugucaugauuucaaugauu

SEQ ID NO: 1101005 - RNA, 23 nt, Homo sapiens
ugucauuaaauggggcucacaaa

SEQ ID NO: 1101006 - RNA, 12 nt, Homo sapiens
ugucccaaagaa

SEQ ID NO: 1101007 - RNA, 16 nt, Homo sapiens
ugucccagaaaaagca

SEQ ID NO: 1101008 - RNA, 16 nt, Homo sapiens
ugucgauuucaccaag

SEQ ID NO: 1101009 - RNA, 19 nt, Homo sapiens
ugucgccaggcuagagugc

SEQ ID NO: 1101010 - RNA, 16 nt, Homo sapiens
ugucuaauaguuauuc

SEQ ID NO: 1101011 - RNA, 16 nt, Homo sapiens
ugucuauaauggaaac

SEQ ID NO: 1101012 - RNA, 16 nt, Homo sapiens
ugucucaaauucaugg

SEQ ID NO: 1101013 - RNA, 22 nt, Homo sapiens
ugucuccuccagcgugguggaa

SEQ ID NO: 1101014 - RNA, 21 nt, Homo sapiens
ugucucggagggauuccccua

SEQ ID NO: 1101015 - RNA, 13 nt, Homo sapiens
ugucucucaugaa

SEQ ID NO: 1101016 - RNA, 21 nt, Homo sapiens
ugucugauuggcucacccaag

SEQ ID NO: 1101017 - RNA, 15 nt, Homo sapiens
ugucuguuaacuuaa

SEQ ID NO: 1101018 - RNA, 22 nt, Homo sapiens
ugucuuacagagaaaagacaua

SEQ ID NO: 1101019 - RNA, 18 nt, Homo sapiens
ugucuucauagcagauuu

SEQ ID NO: 1101020 - RNA, 12 nt, Homo sapiens
ugucuuccauaa

SEQ ID NO: 1101021 - RNA, 15 nt, Homo sapiens
ugucuugccagccag

SEQ ID NO: 1101022 - RNA, 17 nt, Homo sapiens
ugucuugccagccagaa

SEQ ID NO: 1101023 - RNA, 18 nt, Homo sapiens
ugucuuggacacuguaca

SEQ ID NO: 1101024 - RNA, 22 nt, Homo sapiens
ugucuugggaauuuucuuccaa

SEQ ID NO: 1101025 - RNA, 22 nt, Homo sapiens
ugucuuguccccucuugaccca

SEQ ID NO: 1101026 - RNA, 13 nt, Homo sapiens
ugucuuucuccaa

SEQ ID NO: 1101027 - RNA, 22 nt, Homo sapiens
ugugaaaguaugugauaucuga

SEQ ID NO: 1101028 - RNA, 12 nt, Homo sapiens
ugugaaagucag

SEQ ID NO: 1101029 - RNA, 15 nt, Homo sapiens
ugugaaccaccacac

SEQ ID NO: 1101030 - RNA, 16 nt, Homo sapiens
ugugaacccaggacaa

SEQ ID NO: 1101031 - RNA, 17 nt, Homo sapiens
ugugaaggucuugccug

SEQ ID NO: 1101032 - RNA, 18 nt, Homo sapiens
ugugaccaaaaguuacau

SEQ ID NO: 1101033 - RNA, 21 nt, Homo sapiens
ugugaccaaaaguuacauguu

SEQ ID NO: 1101034 - RNA, 18 nt, Homo sapiens
ugugacccagggugcauu

SEQ ID NO: 1101035 - RNA, 19 nt, Homo sapiens
ugugacuuuuucagaguug

SEQ ID NO: 1101036 - RNA, 12 nt, Homo sapiens
ugugagcaagaa

SEQ ID NO: 1101037 - RNA, 18 nt, Homo sapiens
ugugaucuaucaauaguc

SEQ ID NO: 1101038 - RNA, 20 nt, Homo sapiens
ugugaucuaucaauagucaa

SEQ ID NO: 1101039 - RNA, 18 nt, Homo sapiens
ugugauuuuugaacaaua

SEQ ID NO: 1101040 - RNA, 20 nt, Homo sapiens
ugugcaccccuccccauuca

SEQ ID NO: 1101041 - RNA, 13 nt, Homo sapiens
ugugcagacugug

SEQ ID NO: 1101042 - RNA, 20 nt, Homo sapiens
ugugcagguuuugaaaaugu

SEQ ID NO: 1101043 - RNA, 16 nt, Homo sapiens
ugugcaucuguacuca

SEQ ID NO: 1101044 - RNA, 23 nt, Homo sapiens
ugugccaaacuaccguucccaaa

SEQ ID NO: 1101045 - RNA, 14 nt, Homo sapiens
ugugccaugugcca

SEQ ID NO: 1101046 - RNA, 15 nt, Homo sapiens
ugugcccacgugugc

SEQ ID NO: 1101047 - RNA, 15 nt, Homo sapiens
ugugcgccuacagga

SEQ ID NO: 1101048 - RNA, 24 nt, Homo sapiens
ugugcucugaucauccacugugcc

SEQ ID NO: 1101049 - RNA, 19 nt, Homo sapiens
ugugcugacuaacuauaag

SEQ ID NO: 1101050 - RNA, 15 nt, Homo sapiens
ugugcuucacauaau

SEQ ID NO: 1101051 - RNA, 18 nt, Homo sapiens
ugugcuucucuuuguccc

SEQ ID NO: 1101052 - RNA, 17 nt, Homo sapiens
ugagaaaagcuuugaac

SEQ ID NO: 1101053 - RNA, 20 nt, Homo sapiens
ugagaaagccuucauaagcc

SEQ ID NO: 1101054 - RNA, 20 nt, Homo sapiens
ugagaaggacaccuccuucc

SEQ ID NO: 1101055 - RNA, 20 nt, Homo sapiens
ugagaagugucuaaaaacac

SEQ ID NO: 1101056 - RNA, 22 nt, Homo sapiens
ugagaccagccugggcagcaua

SEQ ID NO: 1101057 - RNA, 20 nt, Homo sapiens
ugagacccccaucucuacaa

SEQ ID NO: 1101058 - RNA, 16 nt, Homo sapiens
ugagaccgaaucucac

SEQ ID NO: 1101059 - RNA, 14 nt, Homo sapiens
ugagagacccaagg

SEQ ID NO: 1101060 - RNA, 11 nt, Homo sapiens
ugagauaacca

SEQ ID NO: 1101061 - RNA, 23 nt, Homo sapiens
ugagaucgugccguuacucucca

SEQ ID NO: 1101062 - RNA, 16 nt, Homo sapiens
ugagcacaucugggag

SEQ ID NO: 1101063 - RNA, 18 nt, Homo sapiens
ugagcacccccucauucc

SEQ ID NO: 1101064 - RNA, 14 nt, Homo sapiens
ugagcaccuacuua

SEQ ID NO: 1101065 - RNA, 15 nt, Homo sapiens
ugagcacucuacugc

SEQ ID NO: 1101066 - RNA, 14 nt, Homo sapiens
ugagcacugccagg

SEQ ID NO: 1101067 - RNA, 19 nt, Homo sapiens
ugagcaggcugagcaccuc

SEQ ID NO: 1101068 - RNA, 16 nt, Homo sapiens
ugagcauuagcuacuu

SEQ ID NO: 1101069 - RNA, 13 nt, Homo sapiens
ugagccacugcac

SEQ ID NO: 1101070 - RNA, 16 nt, Homo sapiens
ugagcuccccaaaaac

SEQ ID NO: 1101071 - RNA, 19 nt, Homo sapiens
ugagcuccccaaaaaccuc

SEQ ID NO: 1101072 - RNA, 19 nt, Homo sapiens
ugagcugcccccaaaucaa

SEQ ID NO: 1101073 - RNA, 14 nt, Homo sapiens
ugagcuggcccuuu

SEQ ID NO: 1101074 - RNA, 12 nt, Homo sapiens
ugaggacaaaga

SEQ ID NO: 1101075 - RNA, 23 nt, Homo sapiens
ugaggacuuaaaauauuccugca

SEQ ID NO: 1101076 - RNA, 12 nt, Homo sapiens
ugaggauuucaa

SEQ ID NO: 1101077 - RNA, 15 nt, Homo sapiens
ugaggcaaaggccag

SEQ ID NO: 1101078 - RNA, 17 nt, Homo sapiens
ugaggcaggaggaucac

SEQ ID NO: 1101079 - RNA, 17 nt, Homo sapiens
ugaggcggauggcugug

SEQ ID NO: 1101080 - RNA, 14 nt, Homo sapiens
ugagguacagcaga

SEQ ID NO: 1101081 - RNA, 16 nt, Homo sapiens
ugaggucaccuggaau

SEQ ID NO: 1101082 - RNA, 17 nt, Homo sapiens
ugaggugcccaggagaa

SEQ ID NO: 1101083 - RNA, 15 nt, Homo sapiens
ugagucuccugugcc

SEQ ID NO: 1101084 - RNA, 22 nt, Homo sapiens
ugagucucuaugaucuuggcac

SEQ ID NO: 1101085 - RNA, 12 nt, Homo sapiens
ugaguuacuuga

SEQ ID NO: 1101086 - RNA, 22 nt, Homo sapiens
ugaguugcacagcuaugaaggc

SEQ ID NO: 1101087 - RNA, 21 nt, Homo sapiens
ugaguuuuugauagcuuuauu

SEQ ID NO: 1101088 - RNA, 14 nt, Homo sapiens
ugauacccugaauu

SEQ ID NO: 1101089 - RNA, 13 nt, Homo sapiens
ugauaugacuguu

SEQ ID NO: 1101090 - RNA, 19 nt, Homo sapiens
ugauauguucaacuggaga

SEQ ID NO: 1101091 - RNA, 17 nt, Homo sapiens
ugaucaauccuucuuau

SEQ ID NO: 1101092 - RNA, 21 nt, Homo sapiens
ugauccacaaaaacaacuuau

SEQ ID NO: 1101093 - RNA, 15 nt, Homo sapiens
ugaucgugccuauaa

SEQ ID NO: 1101094 - RNA, 17 nt, Homo sapiens
ugaucuugauugugggu

SEQ ID NO: 1101095 - RNA, 14 nt, Homo sapiens
ugaugaccaagaau

SEQ ID NO: 1101096 - RNA, 18 nt, Homo sapiens
ugaugaggccucuuggac

SEQ ID NO: 1101097 - RNA, 15 nt, Homo sapiens
ugauggcaccacugc

SEQ ID NO: 1101098 - RNA, 14 nt, Homo sapiens
ugaugggguggaag

SEQ ID NO: 1101099 - RNA, 14 nt, Homo sapiens
ugaugguugccagg

SEQ ID NO: 1101100 - RNA, 18 nt, Homo sapiens
ugauuaaaaucuggcaaa

SEQ ID NO: 1101101 - RNA, 13 nt, Homo sapiens
ugauucacaauga

SEQ ID NO: 1101102 - RNA, 20 nt, Homo sapiens
ugauugaaucugauuggaca

SEQ ID NO: 1101103 - RNA, 13 nt, Homo sapiens
ugauuggcucacc

SEQ ID NO: 1101104 - RNA, 21 nt, Homo sapiens
ugauuuuauacauagucacaa

SEQ ID NO: 1101105 - RNA, 18 nt, Homo sapiens
ugcaaaccauagcacagg

SEQ ID NO: 1101106 - RNA, 18 nt, Homo sapiens
ugcaaacuuguaucugaa

SEQ ID NO: 1101107 - RNA, 19 nt, Homo sapiens
ugcaaaggcgucugaaugu

SEQ ID NO: 1101108 - RNA, 17 nt, Homo sapiens
ugcaaaguuacagaugc

SEQ ID NO: 1101109 - RNA, 21 nt, Homo sapiens
ugcaaauccuugauacugcuc

SEQ ID NO: 1101110 - RNA, 16 nt, Homo sapiens
ugcaagugacaucucu

SEQ ID NO: 1101111 - RNA, 15 nt, Homo sapiens
ugcaaucucuugucu

SEQ ID NO: 1101112 - RNA, 14 nt, Homo sapiens
ugcaauugaccucu

SEQ ID NO: 1101113 - RNA, 15 nt, Homo sapiens
ugcacaaagcccuuc

SEQ ID NO: 1101114 - RNA, 9 nt, Homo sapiens
ugcacaauu

SEQ ID NO: 1101115 - RNA, 11 nt, Homo sapiens
ugcacacuugu

SEQ ID NO: 1101116 - RNA, 19 nt, Homo sapiens
ugcacacuuguauauugaa

SEQ ID NO: 1101117 - RNA, 15 nt, Homo sapiens
ugcacaucacaacau

SEQ ID NO: 1101118 - RNA, 22 nt, Homo sapiens
ugcaccagugccgccugugccc

SEQ ID NO: 1101119 - RNA, 14 nt, Homo sapiens
ugcaccccaugagu

SEQ ID NO: 1101120 - RNA, 22 nt, Homo sapiens
ugcaccccuccccauucacaga

SEQ ID NO: 1101121 - RNA, 16 nt, Homo sapiens
ugcaccugccagccug

SEQ ID NO: 1101122 - RNA, 18 nt, Homo sapiens
ugcaccuguacucaggag

SEQ ID NO: 1101123 - RNA, 21 nt, Homo sapiens
ugcaccuugugucuguacacg

SEQ ID NO: 1101124 - RNA, 22 nt, Homo sapiens
ugcaccuugugucuguacacgu

SEQ ID NO: 1101125 - RNA, 15 nt, Homo sapiens
ugcacugagggccac

SEQ ID NO: 1101126 - RNA, 15 nt, Homo sapiens
ugcacuugcuggaag

SEQ ID NO: 1101127 - RNA, 18 nt, Homo sapiens
ugcagaauccaaaguaaa

SEQ ID NO: 1101128 - RNA, 12 nt, Homo sapiens
ugcagacugugg

SEQ ID NO: 1101129 - RNA, 22 nt, Homo sapiens
ugcagcagugagucucuucaga

SEQ ID NO: 1101130 - RNA, 19 nt, Homo sapiens
ugcagcccagaauagcuuu

SEQ ID NO: 1101131 - RNA, 16 nt, Homo sapiens
ugcagccgugcaggag

SEQ ID NO: 1101132 - RNA, 14 nt, Homo sapiens
ugcagggacugcca

SEQ ID NO: 1101133 - RNA, 22 nt, Homo sapiens
ugcauaaucauaugguugacag

SEQ ID NO: 1101134 - RNA, 17 nt, Homo sapiens
ugcauagugcuaagaaa

SEQ ID NO: 1101135 - RNA, 21 nt, Homo sapiens
ugcauaguucccauguuaaau

SEQ ID NO: 1101136 - RNA, 18 nt, Homo sapiens
ugcauauaaaaugcuuua

SEQ ID NO: 1101137 - RNA, 13 nt, Homo sapiens
ugcauauauacau

SEQ ID NO: 1101138 - RNA, 15 nt, Homo sapiens
ugcaucuguacucac

SEQ ID NO: 1101139 - RNA, 19 nt, Homo sapiens
ugcaugauuuuauacauag

SEQ ID NO: 1101140 - RNA, 20 nt, Homo sapiens
ugcauggaacccccagaaua

SEQ ID NO: 1101141 - RNA, 16 nt, Homo sapiens
ugaaagggguugugaa

SEQ ID NO: 1101142 - RNA, 13 nt, Homo sapiens
ugaaagugguuug

SEQ ID NO: 1101143 - RNA, 13 nt, Homo sapiens
ugaaaguguaaaa

SEQ ID NO: 1101144 - RNA, 18 nt, Homo sapiens
ugaaauaccagugaacca

SEQ ID NO: 1101145 - RNA, 21 nt, Homo sapiens
ugaaauaccagugaaccaaag

SEQ ID NO: 1101146 - RNA, 19 nt, Homo sapiens
ugaaauuuaauauagcuau

SEQ ID NO: 1101147 - RNA, 19 nt, Homo sapiens
ugaacacagccugggacca

SEQ ID NO: 1101148 - RNA, 16 nt, Homo sapiens
ugaacagccaaaugca

SEQ ID NO: 1101149 - RNA, 18 nt, Homo sapiens
ugaacaucucacuuugcc

SEQ ID NO: 1101150 - RNA, 18 nt, Homo sapiens
ugaacaugugaaguuaua

SEQ ID NO: 1101151 - RNA, 12 nt, Homo sapiens
ugaacauuugcu

SEQ ID NO: 1101152 - RNA, 13 nt, Homo sapiens
ugaaccacaucuu

SEQ ID NO: 1101153 - RNA, 14 nt, Homo sapiens
ugaacugagccuag

SEQ ID NO: 1101154 - RNA, 22 nt, Homo sapiens
ugaacuggguacuuguggacac

SEQ ID NO: 1101155 - RNA, 16 nt, Homo sapiens
ugaacuuucacauagc

SEQ ID NO: 1101156 - RNA, 21 nt, Homo sapiens
ugaacuuuuuaagaugaggca

SEQ ID NO: 1101157 - RNA, 20 nt, Homo sapiens
ugaagaaaagcacuuuuuaa

SEQ ID NO: 1101158 - RNA, 21 nt, Homo sapiens
ugaagaaaagugaaugcucaa

SEQ ID NO: 1101159 - RNA, 18 nt, Homo sapiens
ugaagaacaguaacugcc

SEQ ID NO: 1101160 - RNA, 16 nt, Homo sapiens
ugaagaauauuguuaa

SEQ ID NO: 1101161 - RNA, 15 nt, Homo sapiens
ugaagacaacagcau

SEQ ID NO: 1101162 - RNA, 21 nt, Homo sapiens
ugaagaugccagugaaacuuc

SEQ ID NO: 1101163 - RNA, 17 nt, Homo sapiens
ugaagcuggaagcacug

SEQ ID NO: 1101164 - RNA, 20 nt, Homo sapiens
ugaaggaaaaccucacuuga

SEQ ID NO: 1101165 - RNA, 19 nt, Homo sapiens
ugaaggacgugucucagga

SEQ ID NO: 1101166 - RNA, 17 nt, Homo sapiens
ugaaggagaaaaugcau

SEQ ID NO: 1101167 - RNA, 18 nt, Homo sapiens
ugaagggggcggccuaug

SEQ ID NO: 1101168 - RNA, 13 nt, Homo sapiens
ugaaguagaaucc

SEQ ID NO: 1101169 - RNA, 14 nt, Homo sapiens
ugaagucacacagu

SEQ ID NO: 1101170 - RNA, 18 nt, Homo sapiens
ugaagugaugauggauga

SEQ ID NO: 1101171 - RNA, 19 nt, Homo sapiens
ugaauaaaguugaagcuaa

SEQ ID NO: 1101172 - RNA, 22 nt, Homo sapiens
ugaauaauuuucuggcacuggu

SEQ ID NO: 1101173 - RNA, 20 nt, Homo sapiens
ugaauagaaaaaguaaucaa

SEQ ID NO: 1101174 - RNA, 17 nt, Homo sapiens
ugaauauaaacacuaua

SEQ ID NO: 1101175 - RNA, 22 nt, Homo sapiens
ugaauauaaauuuguguucuca

SEQ ID NO: 1101176 - RNA, 17 nt, Homo sapiens
ugaaucagacccuaccc

SEQ ID NO: 1101177 - RNA, 14 nt, Homo sapiens
ugaauccaucagga

SEQ ID NO: 1101178 - RNA, 22 nt, Homo sapiens
ugaauccaucaggacuugggaa

SEQ ID NO: 1101179 - RNA, 18 nt, Homo sapiens
ugaauccucucucugugu

SEQ ID NO: 1101180 - RNA, 17 nt, Homo sapiens
ugaaucuaaaagcuuuu

SEQ ID NO: 1101181 - RNA, 11 nt, Homo sapiens
ugaaucuacaa

SEQ ID NO: 1101182 - RNA, 15 nt, Homo sapiens
ugaaucuguacccuu

SEQ ID NO: 1101183 - RNA, 19 nt, Homo sapiens
ugaauguguugauuugaga

SEQ ID NO: 1101184 - RNA, 21 nt, Homo sapiens
ugaauuuggccugcacuaauu

SEQ ID NO: 1101185 - RNA, 20 nt, Homo sapiens
ugaauuuuguguguaccugu

SEQ ID NO: 1101186 - RNA, 19 nt, Homo sapiens
ugacaaccuuuguguaaua

SEQ ID NO: 1101187 - RNA, 12 nt, Homo sapiens
ugacacacagca

SEQ ID NO: 1101188 - RNA, 15 nt, Homo sapiens
ugacacacagcacuc

SEQ ID NO: 1101189 - RNA, 16 nt, Homo sapiens
ugacacacagcacucu

SEQ ID NO: 1101190 - RNA, 13 nt, Homo sapiens
ugacacacagcuc

SEQ ID NO: 1101191 - RNA, 15 nt, Homo sapiens
ugacaccucacugag

SEQ ID NO: 1101192 - RNA, 18 nt, Homo sapiens
ugacacgucugccuaccc

SEQ ID NO: 1101193 - RNA, 18 nt, Homo sapiens
ugacagaagcuucugccc

SEQ ID NO: 1101194 - RNA, 18 nt, Homo sapiens
ugacagaguucacuauaa

SEQ ID NO: 1101195 - RNA, 14 nt, Homo sapiens
ugacaggaagccca

SEQ ID NO: 1101196 - RNA, 18 nt, Homo sapiens
ugacaguaaaucacacaa

SEQ ID NO: 1101197 - RNA, 13 nt, Homo sapiens
ugacaguaugcau

SEQ ID NO: 1101198 - RNA, 16 nt, Homo sapiens
ugacaugggugugcca

SEQ ID NO: 1101199 - RNA, 14 nt, Homo sapiens
ugacauuguuggcc

SEQ ID NO: 1101200 - RNA, 20 nt, Homo sapiens
ugaccaagauacuuaagugc

SEQ ID NO: 1101201 - RNA, 20 nt, Homo sapiens
ugaccccaucaccuacucac

SEQ ID NO: 1101202 - RNA, 22 nt, Homo sapiens
ugaccccuguccccacacugac

SEQ ID NO: 1101203 - RNA, 23 nt, Homo sapiens
ugaccccuguccccacacugacc

SEQ ID NO: 1101204 - RNA, 19 nt, Homo sapiens
ugacccuccuguccagcag

SEQ ID NO: 1101205 - RNA, 23 nt, Homo sapiens
ugaccgagucuaggaaugcuuuu

SEQ ID NO: 1101206 - RNA, 15 nt, Homo sapiens
ugaccuccuccugcc

SEQ ID NO: 1101207 - RNA, 20 nt, Homo sapiens
ugaccugcugagcucugaga

SEQ ID NO: 1101208 - RNA, 15 nt, Homo sapiens
ugaccuguguucccu

SEQ ID NO: 1101209 - RNA, 14 nt, Homo sapiens
ugaccuugaucaag

SEQ ID NO: 1101210 - RNA, 21 nt, Homo sapiens
ugaccuuguugcaugauguau

SEQ ID NO: 1101211 - RNA, 22 nt, Homo sapiens
ugaccuuguugcaugauguauu

SEQ ID NO: 1101212 - RNA, 22 nt, Homo sapiens
ugacgucacuggaccacugggc

SEQ ID NO: 1101213 - RNA, 18 nt, Homo sapiens
ugacuaaagcagggacaa

SEQ ID NO: 1101214 - RNA, 19 nt, Homo sapiens
ugacuccucuaagccacuc

SEQ ID NO: 1101215 - RNA, 16 nt, Homo sapiens
ugacucugacuuugag

SEQ ID NO: 1101216 - RNA, 12 nt, Homo sapiens
ugacucuugccu

SEQ ID NO: 1101217 - RNA, 22 nt, Homo sapiens
ugacuugcagaguucauggaau

SEQ ID NO: 1101218 - RNA, 17 nt, Homo sapiens
ugacuuuuucagaguug

SEQ ID NO: 1101219 - RNA, 16 nt, Homo sapiens
ugagaaaagcuuugaa

SEQ ID NO: 1101220 - RNA, 15 nt, Homo sapiens
ucugaaccacuuugc

SEQ ID NO: 1101221 - RNA, 17 nt, Homo sapiens
ucugaagucaguuucua

SEQ ID NO: 1101222 - RNA, 16 nt, Homo sapiens
ucugaauaacauuugu

SEQ ID NO: 1101223 - RNA, 15 nt, Homo sapiens
ucugacccacugcuu

SEQ ID NO: 1101224 - RNA, 19 nt, Homo sapiens
ucugagaaaagcuuugaac

SEQ ID NO: 1101225 - RNA, 17 nt, Homo sapiens
ucugagaauuccaagga

SEQ ID NO: 1101226 - RNA, 15 nt, Homo sapiens
ucugagcacccccuc

SEQ ID NO: 1101227 - RNA, 12 nt, Homo sapiens
ucugagcaccua

SEQ ID NO: 1101228 - RNA, 20 nt, Homo sapiens
ucugagcuagugauuugccu

SEQ ID NO: 1101229 - RNA, 15 nt, Homo sapiens
ucugaggaaggugcu

SEQ ID NO: 1101230 - RNA, 18 nt, Homo sapiens
ucugaggcuuccagagag

SEQ ID NO: 1101231 - RNA, 13 nt, Homo sapiens
ucugagugacaug

SEQ ID NO: 1101232 - RNA, 18 nt, Homo sapiens
ucugaguuccugcaugcc

SEQ ID NO: 1101233 - RNA, 22 nt, Homo sapiens
ucugaucauccacugugccaug

SEQ ID NO: 1101234 - RNA, 16 nt, Homo sapiens
ucugaugggucccaaa

SEQ ID NO: 1101235 - RNA, 18 nt, Homo sapiens
ucugauuuccuaauguca

SEQ ID NO: 1101236 - RNA, 15 nt, Homo sapiens
ucugcacaugucuug

SEQ ID NO: 1101237 - RNA, 21 nt, Homo sapiens
ucugcagggggugugucugcu

SEQ ID NO: 1101238 - RNA, 23 nt, Homo sapiens
ucugcagggggugugucugcuca

SEQ ID NO: 1101239 - RNA, 21 nt, Homo sapiens
ucugcauuaucugaggucaca

SEQ ID NO: 1101240 - RNA, 16 nt, Homo sapiens
ucugcccagaauucua

SEQ ID NO: 1101241 - RNA, 22 nt, Homo sapiens
ucugcccccgucuucucuccau

SEQ ID NO: 1101242 - RNA, 19 nt, Homo sapiens
ucugccucugacacacagc

SEQ ID NO: 1101243 - RNA, 15 nt, Homo sapiens
ucugccugaaccugg

SEQ ID NO: 1101244 - RNA, 17 nt, Homo sapiens
ucugccugaagucacac

SEQ ID NO: 1101245 - RNA, 13 nt, Homo sapiens
ucugccugggcuu

SEQ ID NO: 1101246 - RNA, 22 nt, Homo sapiens
ucugccugggcuuaugcccuca

SEQ ID NO: 1101247 - RNA, 13 nt, Homo sapiens
ucugcucaggaau

SEQ ID NO: 1101248 - RNA, 19 nt, Homo sapiens
ucuggaaaacucaggauuc

SEQ ID NO: 1101249 - RNA, 17 nt, Homo sapiens
ucuggagucuccagugg

SEQ ID NO: 1101250 - RNA, 20 nt, Homo sapiens
ucuggcaacccuagucugcu

SEQ ID NO: 1101251 - RNA, 13 nt, Homo sapiens
ucuggcaucucuu

SEQ ID NO: 1101252 - RNA, 16 nt, Homo sapiens
ucugggagacuuuccc

SEQ ID NO: 1101253 - RNA, 20 nt, Homo sapiens
ucugggauucccaccaaggu

SEQ ID NO: 1101254 - RNA, 14 nt, Homo sapiens
ucuguaagagaauu

SEQ ID NO: 1101255 - RNA, 17 nt, Homo sapiens
ucuguaaggaacuggaa

SEQ ID NO: 1101256 - RNA, 14 nt, Homo sapiens
ucugucccaaagaa

SEQ ID NO: 1101257 - RNA, 23 nt, Homo sapiens
ucugucuugaugugucaucuaau

SEQ ID NO: 1101258 - RNA, 16 nt, Homo sapiens
ucugugcuuugacuca

SEQ ID NO: 1101259 - RNA, 21 nt, Homo sapiens
ucuguguagcaagcuauucaa

SEQ ID NO: 1101260 - RNA, 22 nt, Homo sapiens
ucuuacuuugaguuagugccau

SEQ ID NO: 1101261 - RNA, 15 nt, Homo sapiens
ucuuagugucacuua

SEQ ID NO: 1101262 - RNA, 18 nt, Homo sapiens
ucuuauuagaacaggcaa

SEQ ID NO: 1101263 - RNA, 18 nt, Homo sapiens
ucuuauucucacuccacc

SEQ ID NO: 1101264 - RNA, 17 nt, Homo sapiens
ucuuauuuaauuuuugc

SEQ ID NO: 1101265 - RNA, 15 nt, Homo sapiens
ucuucaaaugucuaa

SEQ ID NO: 1101266 - RNA, 21 nt, Homo sapiens
ucuucagagagcuaaauuaca

SEQ ID NO: 1101267 - RNA, 11 nt, Homo sapiens
ucuucagccac

SEQ ID NO: 1101268 - RNA, 11 nt, Homo sapiens
ucuucagccau

SEQ ID NO: 1101269 - RNA, 12 nt, Homo sapiens
ucuucaugcaau

SEQ ID NO: 1101270 - RNA, 14 nt, Homo sapiens
ucuucauggccaua

SEQ ID NO: 1101271 - RNA, 18 nt, Homo sapiens
ucuucauguuucaggaga

SEQ ID NO: 1101272 - RNA, 18 nt, Homo sapiens
ucuuccaaagcacauuga

SEQ ID NO: 1101273 - RNA, 20 nt, Homo sapiens
ucuuccagaaggcaaaaaga

SEQ ID NO: 1101274 - RNA, 13 nt, Homo sapiens
ucuuccaucugau

SEQ ID NO: 1101275 - RNA, 19 nt, Homo sapiens
ucuuccaucugauugugau

SEQ ID NO: 1101276 - RNA, 20 nt, Homo sapiens
ucuuccuaccaaauauaaac

SEQ ID NO: 1101277 - RNA, 17 nt, Homo sapiens
ucuuccucacuaugaca

SEQ ID NO: 1101278 - RNA, 16 nt, Homo sapiens
ucuucuaaaaugcuuu

SEQ ID NO: 1101279 - RNA, 23 nt, Homo sapiens
ucuucuaaaaugcuuuuaauuaa

SEQ ID NO: 1101280 - RNA, 15 nt, Homo sapiens
ucuucuacaaccaga

SEQ ID NO: 1101281 - RNA, 16 nt, Homo sapiens
ucuucugagcaccuac

SEQ ID NO: 1101282 - RNA, 16 nt, Homo sapiens
ucuucugggaacuucc

SEQ ID NO: 1101283 - RNA, 16 nt, Homo sapiens
ucuucuuuuaaaccau

SEQ ID NO: 1101284 - RNA, 15 nt, Homo sapiens
ucuugacauucacuu

SEQ ID NO: 1101285 - RNA, 22 nt, Homo sapiens
ucuugaccucaggugauccacc

SEQ ID NO: 1101286 - RNA, 17 nt, Homo sapiens
ucuugcagucaucagaa

SEQ ID NO: 1101287 - RNA, 22 nt, Homo sapiens
ucuugccugaauccaucaggac

SEQ ID NO: 1101288 - RNA, 22 nt, Homo sapiens
ucuuguuucaauuccaccugca

SEQ ID NO: 1101289 - RNA, 18 nt, Homo sapiens
ucuuguuuuaagugccuu

SEQ ID NO: 1101290 - RNA, 20 nt, Homo sapiens
ucuuuaagaaucuauuuccu

SEQ ID NO: 1101291 - RNA, 19 nt, Homo sapiens
ucuuuaagaguauguugcu

SEQ ID NO: 1101292 - RNA, 19 nt, Homo sapiens
ucuuuaggagacuaaugga

SEQ ID NO: 1101293 - RNA, 18 nt, Homo sapiens
ucuuucuaacuccaguga

SEQ ID NO: 1101294 - RNA, 18 nt, Homo sapiens
ucuuucuaaugugugaau

SEQ ID NO: 1101295 - RNA, 11 nt, Homo sapiens
ucuuuugcucu

SEQ ID NO: 1101296 - RNA, 22 nt, Homo sapiens
ugaaaaacagaaagcauccuaa

SEQ ID NO: 1101297 - RNA, 12 nt, Homo sapiens
ugaaaauguuca

SEQ ID NO: 1101298 - RNA, 16 nt, Homo sapiens
ugaaaauuaacacugc

SEQ ID NO: 1101299 - RNA, 17 nt, Homo sapiens
uaggagacagucucaag

SEQ ID NO: 1101300 - RNA, 15 nt, Homo sapiens
uaggagcaaagccug

SEQ ID NO: 1101301 - RNA, 22 nt, Homo sapiens
uagggaugccuuucuaguccua

SEQ ID NO: 1101302 - RNA, 19 nt, Homo sapiens
uagggcaauauugccaugg

SEQ ID NO: 1101303 - RNA, 16 nt, Homo sapiens
uaggggucaggcucca

SEQ ID NO: 1101304 - RNA, 12 nt, Homo sapiens
uagguagcuuua

SEQ ID NO: 1101305 - RNA, 20 nt, Homo sapiens
uaggugacagagugagacuc

SEQ ID NO: 1101306 - RNA, 14 nt, Homo sapiens
uagguuuacauuca

SEQ ID NO: 1101307 - RNA, 14 nt, Homo sapiens
uagguuuuguacaa

SEQ ID NO: 1101308 - RNA, 16 nt, Homo sapiens
uaguaacauagacaaa

SEQ ID NO: 1101309 - RNA, 21 nt, Homo sapiens
uaguaacuacuuuuuauacuc

SEQ ID NO: 1101310 - RNA, 23 nt, Homo sapiens
uaguacuugggagaccuguaauc

SEQ ID NO: 1101311 - RNA, 13 nt, Homo sapiens
uagucaaaccaua

SEQ ID NO: 1101312 - RNA, 20 nt, Homo sapiens
uagucacauggccuaugcac

SEQ ID NO: 1101313 - RNA, 23 nt, Homo sapiens
uagucagcgcaguuuagcaguua

SEQ ID NO: 1101314 - RNA, 16 nt, Homo sapiens
uaguccaaagacuuaa

SEQ ID NO: 1101315 - RNA, 18 nt, Homo sapiens
uagucccagcuacucaga

SEQ ID NO: 1101316 - RNA, 19 nt, Homo sapiens
uagugagaaacugauuuau

SEQ ID NO: 1101317 - RNA, 19 nt, Homo sapiens
uaguguaacacugcaagaa

SEQ ID NO: 1101318 - RNA, 12 nt, Homo sapiens
uagugucacuua

SEQ ID NO: 1101319 - RNA, 15 nt, Homo sapiens
uaguugaacaucuca

SEQ ID NO: 1101320 - RNA, 15 nt, Homo sapiens
uaguuguaucucuuu

SEQ ID NO: 1101321 - RNA, 22 nt, Homo sapiens
uauaaacauugguauauuucca

SEQ ID NO: 1101322 - RNA, 19 nt, Homo sapiens
uauaaaggccagcgccaga

SEQ ID NO: 1101323 - RNA, 22 nt, Homo sapiens
uauaaagugaucaguaugcugu

SEQ ID NO: 1101324 - RNA, 18 nt, Homo sapiens
uauaaauguguggugcua

SEQ ID NO: 1101325 - RNA, 21 nt, Homo sapiens
uauaaccagacacauacucau

SEQ ID NO: 1101326 - RNA, 21 nt, Homo sapiens
uauaacuaguccuuuacuaau

SEQ ID NO: 1101327 - RNA, 21 nt, Homo sapiens
uauaagcaagaaggcaaaaau

SEQ ID NO: 1101328 - RNA, 18 nt, Homo sapiens
uauaagcauguauauucu

SEQ ID NO: 1101329 - RNA, 14 nt, Homo sapiens
uauacaaacaugug

SEQ ID NO: 1101330 - RNA, 19 nt, Homo sapiens
uauacagauucuagccaaa

SEQ ID NO: 1101331 - RNA, 22 nt, Homo sapiens
uauacuuuuuucuuauuuaacu

SEQ ID NO: 1101332 - RNA, 21 nt, Homo sapiens
uauagcgauugaaagggcaau

SEQ ID NO: 1101333 - RNA, 21 nt, Homo sapiens
uauaguuuauugacaauaauu

SEQ ID NO: 1101334 - RNA, 21 nt, Homo sapiens
uauauaaugguuuacugcugu

SEQ ID NO: 1101335 - RNA, 15 nt, Homo sapiens
uauauaucaaggaug

SEQ ID NO: 1101336 - RNA, 19 nt, Homo sapiens
uauauauuuauaacucauc

SEQ ID NO: 1101337 - RNA, 15 nt, Homo sapiens
uauaucccauugaaa

SEQ ID NO: 1101338 - RNA, 13 nt, Homo sapiens
uauauguaugugu

SEQ ID NO: 1101339 - RNA, 14 nt, Homo sapiens
uauauuaccucaaa

SEQ ID NO: 1101340 - RNA, 15 nt, Homo sapiens
uauauuuauacucua

SEQ ID NO: 1101341 - RNA, 17 nt, Homo sapiens
uauauuuccauucaugc

SEQ ID NO: 1101342 - RNA, 17 nt, Homo sapiens
uauauuugaauaucauu

SEQ ID NO: 1101343 - RNA, 20 nt, Homo sapiens
uauauuuugugcuaucagac

SEQ ID NO: 1101344 - RNA, 15 nt, Homo sapiens
uaucaaaacauauca

SEQ ID NO: 1101345 - RNA, 21 nt, Homo sapiens
uaucaagccaguacgugcuaa

SEQ ID NO: 1101346 - RNA, 16 nt, Homo sapiens
uaucacauauuugaua

SEQ ID NO: 1101347 - RNA, 14 nt, Homo sapiens
uaucacaucacuua

SEQ ID NO: 1101348 - RNA, 14 nt, Homo sapiens
uaucacgauauuau

SEQ ID NO: 1101349 - RNA, 16 nt, Homo sapiens
uaucagaccucugauc

SEQ ID NO: 1101350 - RNA, 21 nt, Homo sapiens
uauccacaucuuuaaguauug

SEQ ID NO: 1101351 - RNA, 22 nt, Homo sapiens
uauccacccagcccauucucuc

SEQ ID NO: 1101352 - RNA, 19 nt, Homo sapiens
uauccagaggguugugauu

SEQ ID NO: 1101353 - RNA, 22 nt, Homo sapiens
uauccugauaaacauuaaacac

SEQ ID NO: 1101354 - RNA, 22 nt, Homo sapiens
uaucggagacagugaucuccau

SEQ ID NO: 1101355 - RNA, 17 nt, Homo sapiens
uaucgggaacaguguuu

SEQ ID NO: 1101356 - RNA, 23 nt, Homo sapiens
uaucuaauauguaacaagccacc

SEQ ID NO: 1101357 - RNA, 21 nt, Homo sapiens
uaucugaacacauacuagaaa

SEQ ID NO: 1101358 - RNA, 14 nt, Homo sapiens
uaucugaggucaca

SEQ ID NO: 1101359 - RNA, 14 nt, Homo sapiens
uaucugaguugacu

SEQ ID NO: 1101360 - RNA, 23 nt, Homo sapiens
uaucugauuuccuaaugucagag

SEQ ID NO: 1101361 - RNA, 19 nt, Homo sapiens
uaucugccuuagacaaagg

SEQ ID NO: 1101362 - RNA, 21 nt, Homo sapiens
uaucugcucuuaggugcuucu

SEQ ID NO: 1101363 - RNA, 20 nt, Homo sapiens
uaugaaagacuuacaggccu

SEQ ID NO: 1101364 - RNA, 16 nt, Homo sapiens
uaugaaaugggcuuua

SEQ ID NO: 1101365 - RNA, 23 nt, Homo sapiens
uaugaguuuuugauagcuuuauu

SEQ ID NO: 1101366 - RNA, 17 nt, Homo sapiens
uaugaucacggcucacu

SEQ ID NO: 1101367 - RNA, 14 nt, Homo sapiens
uaugcacauaugga

SEQ ID NO: 1101368 - RNA, 12 nt, Homo sapiens
uaugccauagca

SEQ ID NO: 1101369 - RNA, 14 nt, Homo sapiens
uaugcuacuacaaa

SEQ ID NO: 1101370 - RNA, 16 nt, Homo sapiens
uaugcugcuguuuaca

SEQ ID NO: 1101371 - RNA, 16 nt, Homo sapiens
uauggacucaguuuuc

SEQ ID NO: 1101372 - RNA, 12 nt, Homo sapiens
uauggacucugc

SEQ ID NO: 1101373 - RNA, 15 nt, Homo sapiens
uauggagagcccugg

SEQ ID NO: 1101374 - RNA, 19 nt, Homo sapiens
uauggccaggggacacugu

SEQ ID NO: 1101375 - RNA, 19 nt, Homo sapiens
uauggcugccugcaucuau

SEQ ID NO: 1101376 - RNA, 21 nt, Homo sapiens
uaugggccaagcccagcuuaa

SEQ ID NO: 1101377 - RNA, 15 nt, Homo sapiens
uaugggggcacugag

SEQ ID NO: 1101378 - RNA, 14 nt, Homo sapiens
uauguaaugcuuua

SEQ ID NO: 1101379 - RNA, 20 nt, Homo sapiens
uauguaguccguuaacacua

SEQ ID NO: 1101380 - RNA, 19 nt, Homo sapiens
uauguauauguauaucuau

SEQ ID NO: 1101381 - RNA, 20 nt, Homo sapiens
uaugucaauuuguauaucau

SEQ ID NO: 1101382 - RNA, 20 nt, Homo sapiens
uaugucaggcaaagugcugc

SEQ ID NO: 1101383 - RNA, 21 nt, Homo sapiens
uaugucaggcaaagugcugcu

SEQ ID NO: 1101384 - RNA, 13 nt, Homo sapiens
uaugucaucauac

SEQ ID NO: 1101385 - RNA, 13 nt, Homo sapiens
uacauuaguacac

SEQ ID NO: 1101386 - RNA, 12 nt, Homo sapiens
uacauucaugag

SEQ ID NO: 1101387 - RNA, 20 nt, Homo sapiens
uacauucuuuaucuugacau

SEQ ID NO: 1101388 - RNA, 15 nt, Homo sapiens
uacauuucuguucau

SEQ ID NO: 1101389 - RNA, 18 nt, Homo sapiens
uacauuuuauaucuggau

SEQ ID NO: 1101390 - RNA, 23 nt, Homo sapiens
uaccacagaaguucaauacucau

SEQ ID NO: 1101391 - RNA, 18 nt, Homo sapiens
uaccaccccuuccugucc

SEQ ID NO: 1101392 - RNA, 18 nt, Homo sapiens
uaccagugaaccaaagag

SEQ ID NO: 1101393 - RNA, 20 nt, Homo sapiens
uacccagagaauauauacau

SEQ ID NO: 1101394 - RNA, 13 nt, Homo sapiens
uaccccaccacga

SEQ ID NO: 1101395 - RNA, 23 nt, Homo sapiens
uaccccaccacgauguggcccug

SEQ ID NO: 1101396 - RNA, 22 nt, Homo sapiens
uaccccugcuaaggaguucuca

SEQ ID NO: 1101397 - RNA, 18 nt, Homo sapiens
uacccuguaacaugcaau

SEQ ID NO: 1101398 - RNA, 23 nt, Homo sapiens
uacccuuccuacagauagucaaa

SEQ ID NO: 1101399 - RNA, 18 nt, Homo sapiens
uaccgcgucuacccuggg

SEQ ID NO: 1101400 - RNA, 17 nt, Homo sapiens
uaccuaccacagugucu

SEQ ID NO: 1101401 - RNA, 15 nt, Homo sapiens
uaccuauauuacaca

SEQ ID NO: 1101402 - RNA, 13 nt, Homo sapiens
uaccucagccuag

SEQ ID NO: 1101403 - RNA, 18 nt, Homo sapiens
uaccuuuaaaauuuacca

SEQ ID NO: 1101404 - RNA, 13 nt, Homo sapiens
uacguaucugcuc

SEQ ID NO: 1101405 - RNA, 17 nt, Homo sapiens
uacgugccaggcacugu

SEQ ID NO: 1101406 - RNA, 12 nt, Homo sapiens
uacuaaagacag

SEQ ID NO: 1101407 - RNA, 18 nt, Homo sapiens
uacuaaagucacauauaa

SEQ ID NO: 1101408 - RNA, 21 nt, Homo sapiens
uacuacuugccacacacuguu

SEQ ID NO: 1101409 - RNA, 14 nt, Homo sapiens
uacuagcaguguuu

SEQ ID NO: 1101410 - RNA, 18 nt, Homo sapiens
uacuaugcucuagagaaa

SEQ ID NO: 1101411 - RNA, 16 nt, Homo sapiens
uacuauggaaagcagc

SEQ ID NO: 1101412 - RNA, 21 nt, Homo sapiens
uacucacccagggacuccagu

SEQ ID NO: 1101413 - RNA, 23 nt, Homo sapiens
uacucauuuggaaaugcuacaaa

SEQ ID NO: 1101414 - RNA, 21 nt, Homo sapiens
uacugaaagguuacccuguaa

SEQ ID NO: 1101415 - RNA, 15 nt, Homo sapiens
uacugaacacuucaa

SEQ ID NO: 1101416 - RNA, 14 nt, Homo sapiens
uacugagagcaugu

SEQ ID NO: 1101417 - RNA, 20 nt, Homo sapiens
uacugcacauuuuguacaaa

SEQ ID NO: 1101418 - RNA, 19 nt, Homo sapiens
uacugcuucuuuucacuuc

SEQ ID NO: 1101419 - RNA, 17 nt, Homo sapiens
uacugggaaauuacuua

SEQ ID NO: 1101420 - RNA, 18 nt, Homo sapiens
uacugguuucaguugaca

SEQ ID NO: 1101421 - RNA, 12 nt, Homo sapiens
uacuguacuuaa

SEQ ID NO: 1101422 - RNA, 16 nt, Homo sapiens
uacuuacaugcauuac

SEQ ID NO: 1101423 - RNA, 17 nt, Homo sapiens
uacuuauucuagauuac

SEQ ID NO: 1101424 - RNA, 18 nt, Homo sapiens
uacuuauuuuccaauaaa

SEQ ID NO: 1101425 - RNA, 19 nt, Homo sapiens
uacuucauuuucagaguga

SEQ ID NO: 1101426 - RNA, 15 nt, Homo sapiens
uacuuuaccuccuau

SEQ ID NO: 1101427 - RNA, 17 nt, Homo sapiens
uacuuucuguugccaca

SEQ ID NO: 1101428 - RNA, 20 nt, Homo sapiens
uacuuuucagaauugaagga

SEQ ID NO: 1101429 - RNA, 19 nt, Homo sapiens
uagaaaaguuauguagaaa

SEQ ID NO: 1101430 - RNA, 14 nt, Homo sapiens
uagaaaguucaaaa

SEQ ID NO: 1101431 - RNA, 11 nt, Homo sapiens
uagaaccucac

SEQ ID NO: 1101432 - RNA, 17 nt, Homo sapiens
uagaacguaaccacgga

SEQ ID NO: 1101433 - RNA, 18 nt, Homo sapiens
uagaacuauuaaaacagc

SEQ ID NO: 1101434 - RNA, 18 nt, Homo sapiens
uagaacucuccaucuuau

SEQ ID NO: 1101435 - RNA, 12 nt, Homo sapiens
uagaauugggaa

SEQ ID NO: 1101436 - RNA, 22 nt, Homo sapiens
uagacuguacuuauuuuccaau

SEQ ID NO: 1101437 - RNA, 17 nt, Homo sapiens
uagagaaauuugccaau

SEQ ID NO: 1101438 - RNA, 18 nt, Homo sapiens
uagagaauaccaguguua

SEQ ID NO: 1101439 - RNA, 20 nt, Homo sapiens
uagagaucuauguacuguaa

SEQ ID NO: 1101440 - RNA, 18 nt, Homo sapiens
uagagccagggucucacu

SEQ ID NO: 1101441 - RNA, 21 nt, Homo sapiens
uagaggacagcaacuggugau

SEQ ID NO: 1101442 - RNA, 12 nt, Homo sapiens
uagaggagcaac

SEQ ID NO: 1101443 - RNA, 20 nt, Homo sapiens
uagaggugcucauucauuua

SEQ ID NO: 1101444 - RNA, 13 nt, Homo sapiens
uagagucacugac

SEQ ID NO: 1101445 - RNA, 18 nt, Homo sapiens
uagaguguuaucagucau

SEQ ID NO: 1101446 - RNA, 23 nt, Homo sapiens
uagauaaaagaaccgagcaauuu

SEQ ID NO: 1101447 - RNA, 13 nt, Homo sapiens
uagaucuccugua

SEQ ID NO: 1101448 - RNA, 13 nt, Homo sapiens
uagcaacuacagu

SEQ ID NO: 1101449 - RNA, 16 nt, Homo sapiens
uagcaauugacuguca

SEQ ID NO: 1101450 - RNA, 21 nt, Homo sapiens
uagcacaauuuauauuuuccc

SEQ ID NO: 1101451 - RNA, 12 nt, Homo sapiens
uagcagaaggca

SEQ ID NO: 1101452 - RNA, 18 nt, Homo sapiens
uagcagaaggcaagcacc

SEQ ID NO: 1101453 - RNA, 21 nt, Homo sapiens
uagcagaaguauaaagugauc

SEQ ID NO: 1101454 - RNA, 16 nt, Homo sapiens
uagcaggcacaggaca

SEQ ID NO: 1101455 - RNA, 18 nt, Homo sapiens
uagcagggaaacagcuaa

SEQ ID NO: 1101456 - RNA, 16 nt, Homo sapiens
uagccagugaaaaacu

SEQ ID NO: 1101457 - RNA, 12 nt, Homo sapiens
uagcccagcacu

SEQ ID NO: 1101458 - RNA, 13 nt, Homo sapiens
uagcccagcacug

SEQ ID NO: 1101459 - RNA, 16 nt, Homo sapiens
uagcccagcacuguga

SEQ ID NO: 1101460 - RNA, 16 nt, Homo sapiens
uagccucuccaggaau

SEQ ID NO: 1101461 - RNA, 20 nt, Homo sapiens
uagcgcugccgcaccccaga

SEQ ID NO: 1101462 - RNA, 13 nt, Homo sapiens
uagcggucaauuu

SEQ ID NO: 1101463 - RNA, 17 nt, Homo sapiens
uagcggucaauuugccu

SEQ ID NO: 1101464 - RNA, 14 nt, Homo sapiens
uagcuauugcaugu

SEQ ID NO: 1101465 - RNA, 12 nt, Homo sapiens
uagcucuauggg

SEQ ID NO: 1101466 - RNA, 23 nt, Homo sapiens
uagcugguucacacugaccaaga

SEQ ID NO: 1101467 - RNA, 15 nt, Homo sapiens
uagcuuagaccucag

SEQ ID NO: 1101468 - RNA, 16 nt, Homo sapiens
uagcuuagaccucagc

SEQ ID NO: 1101469 - RNA, 22 nt, Homo sapiens
uagcuuuagggcaauauugcca

SEQ ID NO: 1101470 - RNA, 23 nt, Homo sapiens
uagcuuuagggcaauauugccau

SEQ ID NO: 1101471 - RNA, 16 nt, Homo sapiens
uaggaagagaaaccag

SEQ ID NO: 1101472 - RNA, 20 nt, Homo sapiens
uaggaaguauggcaugaaca

SEQ ID NO: 1101473 - RNA, 17 nt, Homo sapiens
aagcccaagugaaauca

SEQ ID NO: 1101474 - RNA, 17 nt, Homo sapiens
aagcccccacuucucuc

SEQ ID NO: 1101475 - RNA, 22 nt, Homo sapiens
aagccccuuacuaugaucucag

SEQ ID NO: 1101476 - RNA, 13 nt, Homo sapiens
aagcccuugaacc

SEQ ID NO: 1101477 - RNA, 18 nt, Homo sapiens
aagcggagguugcaggga

SEQ ID NO: 1101478 - RNA, 18 nt, Homo sapiens
aagcgugagccacugcac

SEQ ID NO: 1101479 - RNA, 15 nt, Homo sapiens
aagcguuugcacaga

SEQ ID NO: 1101480 - RNA, 22 nt, Homo sapiens
aagcuaaauccuuuacuguuag

SEQ ID NO: 1101481 - RNA, 16 nt, Homo sapiens
aagcuaacagggaagg

SEQ ID NO: 1101482 - RNA, 24 nt, Homo sapiens
aagcuauugauguuuccagaaaau

SEQ ID NO: 1101483 - RNA, 19 nt, Homo sapiens
aagcugggauaaucacauu

SEQ ID NO: 1101484 - RNA, 21 nt, Homo sapiens
aagcugggauaaucacauuau

SEQ ID NO: 1101485 - RNA, 15 nt, Homo sapiens
aagcuguccuugagc

SEQ ID NO: 1101486 - RNA, 23 nt, Homo sapiens
aagcuguccuugagcuguccuau

SEQ ID NO: 1101487 - RNA, 22 nt, Homo sapiens
aagcuguguccuugcaccugca

SEQ ID NO: 1101488 - RNA, 23 nt, Homo sapiens
aagcuguguccuugcaccugcau

SEQ ID NO: 1101489 - RNA, 17 nt, Homo sapiens
aagcuguuccacuucuc

SEQ ID NO: 1101490 - RNA, 12 nt, Homo sapiens
aagcuuauguca

SEQ ID NO: 1101491 - RNA, 14 nt, Homo sapiens
aagcuucaagugau

SEQ ID NO: 1101492 - RNA, 12 nt, Homo sapiens
aagcuucuaucc

SEQ ID NO: 1101493 - RNA, 22 nt, Homo sapiens
aaggaaacuugaaucaaagcag

SEQ ID NO: 1101494 - RNA, 23 nt, Homo sapiens
aaggaagaaauuccaggaaaauc

SEQ ID NO: 1101495 - RNA, 15 nt, Homo sapiens
aaggaagccacagcu

SEQ ID NO: 1101496 - RNA, 13 nt, Homo sapiens
aaggaccagguua

SEQ ID NO: 1101497 - RNA, 19 nt, Homo sapiens
aaggacgagggaugggauu

SEQ ID NO: 1101498 - RNA, 16 nt, Homo sapiens
aaggacgugucucagg

SEQ ID NO: 1101499 - RNA, 18 nt, Homo sapiens
aaggagaacuauccaaaa

SEQ ID NO: 1101500 - RNA, 22 nt, Homo sapiens
aaggagauauggcuaguggcaa

SEQ ID NO: 1101501 - RNA, 21 nt, Homo sapiens
aaggagauucaaacucaauga

SEQ ID NO: 1101502 - RNA, 22 nt, Homo sapiens
aaggagauucaaacucaaugau

SEQ ID NO: 1101503 - RNA, 21 nt, Homo sapiens
aaggaggcuuaggacuuucca

SEQ ID NO: 1101504 - RNA, 15 nt, Homo sapiens
aaggaucucucagga

SEQ ID NO: 1101505 - RNA, 14 nt, Homo sapiens
aaggauugugauau

SEQ ID NO: 1101506 - RNA, 13 nt, Homo sapiens
aaggcaagcacca

SEQ ID NO: 1101507 - RNA, 14 nt, Homo sapiens
aaggcacaggugua

SEQ ID NO: 1101508 - RNA, 16 nt, Homo sapiens
aaggcaggaggaucac

SEQ ID NO: 1101509 - RNA, 15 nt, Homo sapiens
aaggccacaugucac

SEQ ID NO: 1101510 - RNA, 20 nt, Homo sapiens
aaggcccagacaggcucagg

SEQ ID NO: 1101511 - RNA, 21 nt, Homo sapiens
aaggcccucuauuucucucuu

SEQ ID NO: 1101512 - RNA, 17 nt, Homo sapiens
aaggccuggggugaccc

SEQ ID NO: 1101513 - RNA, 17 nt, Homo sapiens
aaggcucagucucagga

SEQ ID NO: 1101514 - RNA, 12 nt, Homo sapiens
aaggcucuacac

SEQ ID NO: 1101515 - RNA, 17 nt, Homo sapiens
aagggcaauaaaugccc

SEQ ID NO: 1101516 - RNA, 14 nt, Homo sapiens
aaggggcuuugucc

SEQ ID NO: 1101517 - RNA, 22 nt, Homo sapiens
aaggguaccuugaacacugggg

SEQ ID NO: 1101518 - RNA, 23 nt, Homo sapiens
aaggguuauagacugccaugcua

SEQ ID NO: 1101519 - RNA, 20 nt, Homo sapiens
aaggguucagagacucaggg

SEQ ID NO: 1101520 - RNA, 17 nt, Homo sapiens
aaggucccuuguuucca

SEQ ID NO: 1101521 - RNA, 14 nt, Homo sapiens
aaggucuugccuga

SEQ ID NO: 1101522 - RNA, 12 nt, Homo sapiens
aagguuacugau

SEQ ID NO: 1101523 - RNA, 15 nt, Homo sapiens
aaguaaaccaaaaag

SEQ ID NO: 1101524 - RNA, 17 nt, Homo sapiens
aaguaauguuaauucuu

SEQ ID NO: 1101525 - RNA, 12 nt, Homo sapiens
aaguaauuuugc

SEQ ID NO: 1101526 - RNA, 17 nt, Homo sapiens
aaguaauuuugccaucc

SEQ ID NO: 1101527 - RNA, 15 nt, Homo sapiens
aaguaccuguaguga

SEQ ID NO: 1101528 - RNA, 18 nt, Homo sapiens
aaguaccuguagugagaa

SEQ ID NO: 1101529 - RNA, 16 nt, Homo sapiens
aaguagaauccuaaau

SEQ ID NO: 1101530 - RNA, 20 nt, Homo sapiens
aaguagaauuauaucuaauu

SEQ ID NO: 1101531 - RNA, 14 nt, Homo sapiens
uaacaagccagauu

SEQ ID NO: 1101532 - RNA, 20 nt, Homo sapiens
uaacaaguagcacccuggau

SEQ ID NO: 1101533 - RNA, 22 nt, Homo sapiens
uaacagauuugcauaugucuau

SEQ ID NO: 1101534 - RNA, 20 nt, Homo sapiens
uaacagggagacugcaucuc

SEQ ID NO: 1101535 - RNA, 19 nt, Homo sapiens
uaacaguucacuuuuuaca

SEQ ID NO: 1101536 - RNA, 20 nt, Homo sapiens
uaacaguugugaugacuaug

SEQ ID NO: 1101537 - RNA, 22 nt, Homo sapiens
uaacauaauuuguacauaugua

SEQ ID NO: 1101538 - RNA, 20 nt, Homo sapiens
uaacauugggaaaucuuaua

SEQ ID NO: 1101539 - RNA, 13 nt, Homo sapiens
uaacccucucuuc

SEQ ID NO: 1101540 - RNA, 19 nt, Homo sapiens
uaacuagaaaucugccaau

SEQ ID NO: 1101541 - RNA, 22 nt, Homo sapiens
uaacuaguccuuuacuaaucca

SEQ ID NO: 1101542 - RNA, 17 nt, Homo sapiens
uaacucaauauuuucca

SEQ ID NO: 1101543 - RNA, 16 nt, Homo sapiens
uaacuccagugaagua

SEQ ID NO: 1101544 - RNA, 21 nt, Homo sapiens
uaacugcacacaugguuucca

SEQ ID NO: 1101545 - RNA, 18 nt, Homo sapiens
uaacuggcuacugggaaa

SEQ ID NO: 1101546 - RNA, 17 nt, Homo sapiens
uaacuuauaucaucagc

SEQ ID NO: 1101547 - RNA, 16 nt, Homo sapiens
uaacuuguauauucca

SEQ ID NO: 1101548 - RNA, 17 nt, Homo sapiens
uaacuuuuguaagacaa

SEQ ID NO: 1101549 - RNA, 17 nt, Homo sapiens
uaagaaaacaucacuga

SEQ ID NO: 1101550 - RNA, 16 nt, Homo sapiens
uaagaaagcaagccaa

SEQ ID NO: 1101551 - RNA, 17 nt, Homo sapiens
uaagaaaucauggcauu

SEQ ID NO: 1101552 - RNA, 15 nt, Homo sapiens
uaagaagcucuggcc

SEQ ID NO: 1101553 - RNA, 17 nt, Homo sapiens
uaagaccauaacagcca

SEQ ID NO: 1101554 - RNA, 16 nt, Homo sapiens
uaagagauacauuccc

SEQ ID NO: 1101555 - RNA, 22 nt, Homo sapiens
uaagagugccguaacaacugug

SEQ ID NO: 1101556 - RNA, 14 nt, Homo sapiens
uaagccacucuucc

SEQ ID NO: 1101557 - RNA, 20 nt, Homo sapiens
uaagccacucuuccaaaggc

SEQ ID NO: 1101558 - RNA, 16 nt, Homo sapiens
uaagcuaucuucaaau

SEQ ID NO: 1101559 - RNA, 18 nt, Homo sapiens
uaagcugggauaaucaca

SEQ ID NO: 1101560 - RNA, 20 nt, Homo sapiens
uaagcugggauaaucacauu

SEQ ID NO: 1101561 - RNA, 16 nt, Homo sapiens
uaaggaagaaucuucu

SEQ ID NO: 1101562 - RNA, 14 nt, Homo sapiens
uaaggaucucucag

SEQ ID NO: 1101563 - RNA, 20 nt, Homo sapiens
uaagguaauuucuguguauu

SEQ ID NO: 1101564 - RNA, 13 nt, Homo sapiens
uaagguacuagca

SEQ ID NO: 1101565 - RNA, 15 nt, Homo sapiens
uaaggucaaugccag

SEQ ID NO: 1101566 - RNA, 14 nt, Homo sapiens
uaaguaaaccaaaa

SEQ ID NO: 1101567 - RNA, 23 nt, Homo sapiens
uaaguauucuucaucagcauuua

SEQ ID NO: 1101568 - RNA, 15 nt, Homo sapiens
uaaguuugauuucau

SEQ ID NO: 1101569 - RNA, 21 nt, Homo sapiens
uaauaagcaaagggagcacug

SEQ ID NO: 1101570 - RNA, 14 nt, Homo sapiens
uaauaucugugagg

SEQ ID NO: 1101571 - RNA, 14 nt, Homo sapiens
uaauauguucauua

SEQ ID NO: 1101572 - RNA, 16 nt, Homo sapiens
uaauauuuuuagcucu

SEQ ID NO: 1101573 - RNA, 22 nt, Homo sapiens
uaaucagguccucagagaauuu

SEQ ID NO: 1101574 - RNA, 13 nt, Homo sapiens
uaaugaacaugug

SEQ ID NO: 1101575 - RNA, 16 nt, Homo sapiens
uaaugauuagcacuua

SEQ ID NO: 1101576 - RNA, 17 nt, Homo sapiens
uaaugauuagcacuuaa

SEQ ID NO: 1101577 - RNA, 16 nt, Homo sapiens
uaaugcucgucugugu

SEQ ID NO: 1101578 - RNA, 13 nt, Homo sapiens
uaaugggacacua

SEQ ID NO: 1101579 - RNA, 18 nt, Homo sapiens
uaaugguuuuuaaugucu

SEQ ID NO: 1101580 - RNA, 14 nt, Homo sapiens
uaaugucaccaccu

SEQ ID NO: 1101581 - RNA, 15 nt, Homo sapiens
uaaugucaccaccuu

SEQ ID NO: 1101582 - RNA, 14 nt, Homo sapiens
uaaugucugagcua

SEQ ID NO: 1101583 - RNA, 22 nt, Homo sapiens
uaauguuguaauucaugccagg

SEQ ID NO: 1101584 - RNA, 17 nt, Homo sapiens
uaauuaaguaaaccaaa

SEQ ID NO: 1101585 - RNA, 17 nt, Homo sapiens
uaauuagggguugcuaa

SEQ ID NO: 1101586 - RNA, 21 nt, Homo sapiens
uaauuaucggaagcagugccu

SEQ ID NO: 1101587 - RNA, 13 nt, Homo sapiens
uaauuaucugauc

SEQ ID NO: 1101588 - RNA, 13 nt, Homo sapiens
uaauucauaauua

SEQ ID NO: 1101589 - RNA, 22 nt, Homo sapiens
uaauucggaagggaaaacaguc

SEQ ID NO: 1101590 - RNA, 12 nt, Homo sapiens
uaauucuacuaa

SEQ ID NO: 1101591 - RNA, 20 nt, Homo sapiens
uaauucuuauuuaaguuauu

SEQ ID NO: 1101592 - RNA, 12 nt, Homo sapiens
uaauuguguaca

SEQ ID NO: 1101593 - RNA, 21 nt, Homo sapiens
uaauugugugacuuuuucaga

SEQ ID NO: 1101594 - RNA, 19 nt, Homo sapiens
uaauuugaaauuugacuca

SEQ ID NO: 1101595 - RNA, 21 nt, Homo sapiens
uaauuuuccuggaaagacuga

SEQ ID NO: 1101596 - RNA, 13 nt, Homo sapiens
uaauuuuugcaau

SEQ ID NO: 1101597 - RNA, 17 nt, Homo sapiens
uacaaacucccacuugu

SEQ ID NO: 1101598 - RNA, 11 nt, Homo sapiens
uacaaccagag

SEQ ID NO: 1101599 - RNA, 17 nt, Homo sapiens
uacaaccugaauacccu

SEQ ID NO: 1101600 - RNA, 19 nt, Homo sapiens
uacaagcauucugucuuga

SEQ ID NO: 1101601 - RNA, 23 nt, Homo sapiens
uacaauccuuugaguuauaguuu

SEQ ID NO: 1101602 - RNA, 14 nt, Homo sapiens
uacaaucucaaauu

SEQ ID NO: 1101603 - RNA, 18 nt, Homo sapiens
uacaaucucaaauucuca

SEQ ID NO: 1101604 - RNA, 19 nt, Homo sapiens
uacacacccauagugcaca

SEQ ID NO: 1101605 - RNA, 11 nt, Homo sapiens
uacacaugaca

SEQ ID NO: 1101606 - RNA, 18 nt, Homo sapiens
uacaccuaugucauuuca

SEQ ID NO: 1101607 - RNA, 19 nt, Homo sapiens
uacagaaugaaucccauaa

SEQ ID NO: 1101608 - RNA, 18 nt, Homo sapiens
uacagacuucuccagacc

SEQ ID NO: 1101609 - RNA, 18 nt, Homo sapiens
uacagagaaaagacauaa

SEQ ID NO: 1101610 - RNA, 13 nt, Homo sapiens
uacagauagucaa

SEQ ID NO: 1101611 - RNA, 15 nt, Homo sapiens
uacaggagugagcac

SEQ ID NO: 1101612 - RNA, 17 nt, Homo sapiens
uacaggccucgcuacaa

SEQ ID NO: 1101613 - RNA, 16 nt, Homo sapiens
uacaggugugagucac

SEQ ID NO: 1101614 - RNA, 13 nt, Homo sapiens
uacagugacuguc

SEQ ID NO: 1101615 - RNA, 12 nt, Homo sapiens
uacaguguuauu

SEQ ID NO: 1101616 - RNA, 17 nt, Homo sapiens
uacauauauaugucagg

SEQ ID NO: 1101617 - RNA, 15 nt, Homo sapiens
uacaugaauugcauu

SEQ ID NO: 1101618 - RNA, 20 nt, Homo sapiens
uacaugacucagcauaccug

SEQ ID NO: 1101619 - RNA, 17 nt, Homo sapiens
uacaugcauuacugcau

SEQ ID NO: 1101620 - RNA, 21 nt, Homo sapiens
uucaugaacacagccugggac

SEQ ID NO: 1101621 - RNA, 15 nt, Homo sapiens
uucauguaaccaaga

SEQ ID NO: 1101622 - RNA, 18 nt, Homo sapiens
uucauucucuuauauagu

SEQ ID NO: 1101623 - RNA, 21 nt, Homo sapiens
uucauugaccaagaugaucac

SEQ ID NO: 1101624 - RNA, 23 nt, Homo sapiens
uucauuucagauaaacaacaaau

SEQ ID NO: 1101625 - RNA, 18 nt, Homo sapiens
uucauuuuaacaucugag

SEQ ID NO: 1101626 - RNA, 21 nt, Homo sapiens
uuccaaaccugacagauguca

SEQ ID NO: 1101627 - RNA, 19 nt, Homo sapiens
uuccaaaucuuaauucaac

SEQ ID NO: 1101628 - RNA, 17 nt, Homo sapiens
uuccaagauaaaaccag

SEQ ID NO: 1101629 - RNA, 13 nt, Homo sapiens
uuccaaugcauug

SEQ ID NO: 1101630 - RNA, 18 nt, Homo sapiens
uuccacuucucuagagaa

SEQ ID NO: 1101631 - RNA, 22 nt, Homo sapiens
uuccagaaggcaaaaagacauu

SEQ ID NO: 1101632 - RNA, 19 nt, Homo sapiens
uuccauaaacacccaugaa

SEQ ID NO: 1101633 - RNA, 16 nt, Homo sapiens
uuccaugaaaaugcaa

SEQ ID NO: 1101634 - RNA, 23 nt, Homo sapiens
uuccaugucgccucugcauucag

SEQ ID NO: 1101635 - RNA, 15 nt, Homo sapiens
uuccauuccaagccu

SEQ ID NO: 1101636 - RNA, 20 nt, Homo sapiens
uucccaauaaaagugacucu

SEQ ID NO: 1101637 - RNA, 16 nt, Homo sapiens
uucccaauacauacca

SEQ ID NO: 1101638 - RNA, 13 nt, Homo sapiens
uucccacauucau

SEQ ID NO: 1101639 - RNA, 19 nt, Homo sapiens
uuaauuuuugauacuaagc

SEQ ID NO: 1101640 - RNA, 14 nt, Homo sapiens
uuacaaauuuaauu

SEQ ID NO: 1101641 - RNA, 16 nt, Homo sapiens
uuacaaugcagaauuu

SEQ ID NO: 1101642 - RNA, 19 nt, Homo sapiens
uuacacaguugcugucaua

SEQ ID NO: 1101643 - RNA, 18 nt, Homo sapiens
uuacagagaaaagacaua

SEQ ID NO: 1101644 - RNA, 12 nt, Homo sapiens
uuacaguguaug

SEQ ID NO: 1101645 - RNA, 22 nt, Homo sapiens
uuacauuauuaaauguuucuca

SEQ ID NO: 1101646 - RNA, 20 nt, Homo sapiens
uuaccaggcaccaaaagaag

SEQ ID NO: 1101647 - RNA, 12 nt, Homo sapiens
uuaccucugaua

SEQ ID NO: 1101648 - RNA, 17 nt, Homo sapiens
uuaccuuaaaaaguaau

SEQ ID NO: 1101649 - RNA, 11 nt, Homo sapiens
uuacuacuauu

SEQ ID NO: 1101650 - RNA, 13 nt, Homo sapiens
uuacuacuugcca

SEQ ID NO: 1101651 - RNA, 14 nt, Homo sapiens
uuacuaugaucuca

SEQ ID NO: 1101652 - RNA, 16 nt, Homo sapiens
uuacuaugaucucagg

SEQ ID NO: 1101653 - RNA, 23 nt, Homo sapiens
uuacuauuuauugcugaaugacu

SEQ ID NO: 1101654 - RNA, 16 nt, Homo sapiens
uuacucaugacuccuu

SEQ ID NO: 1101655 - RNA, 21 nt, Homo sapiens
uuacucaugugcagguuuuga

SEQ ID NO: 1101656 - RNA, 24 nt, Homo sapiens
uuacuguaauuggugacaauguca

SEQ ID NO: 1101657 - RNA, 13 nt, Homo sapiens
uggaggaccugag

SEQ ID NO: 1101658 - RNA, 18 nt, Homo sapiens
uggagugcaguggugcga

SEQ ID NO: 1101659 - RNA, 20 nt, Homo sapiens
uggauaauaacuagaucucc

SEQ ID NO: 1101660 - RNA, 16 nt, Homo sapiens
uggauacugcugccaa

SEQ ID NO: 1101661 - RNA, 14 nt, Homo sapiens
uggauagucugucc

SEQ ID NO: 1101662 - RNA, 14 nt, Homo sapiens
uggauccacugugc

SEQ ID NO: 1101663 - RNA, 16 nt, Homo sapiens
uggaucuguccaagga

SEQ ID NO: 1101664 - RNA, 14 nt, Homo sapiens
uggaugaagcucug

SEQ ID NO: 1101665 - RNA, 21 nt, Homo sapiens
uggaugaaggacgugucucag

SEQ ID NO: 1101666 - RNA, 12 nt, Homo sapiens
uggauugagggu

SEQ ID NO: 1101667 - RNA, 13 nt, Homo sapiens
uggcaagugaauu

SEQ ID NO: 1101668 - RNA, 20 nt, Homo sapiens
uggcaaugaaaaauucucag

SEQ ID NO: 1101669 - RNA, 14 nt, Homo sapiens
uggcacugguugua

SEQ ID NO: 1101670 - RNA, 21 nt, Homo sapiens
uggcagcgccucaucuucaac

SEQ ID NO: 1101671 - RNA, 16 nt, Homo sapiens
uggcaggagaaucaau

SEQ ID NO: 1101672 - RNA, 21 nt, Homo sapiens
uggcagugggagcugccuguu

SEQ ID NO: 1101673 - RNA, 19 nt, Homo sapiens
uggcauacgccuguagucc

SEQ ID NO: 1101674 - RNA, 21 nt, Homo sapiens
uggcauucacacagcccauaa

SEQ ID NO: 1101675 - RNA, 13 nt, Homo sapiens
uggccaaagccaa

SEQ ID NO: 1101676 - RNA, 18 nt, Homo sapiens
uggccaaccaaagacacu

SEQ ID NO: 1101677 - RNA, 18 nt, Homo sapiens
uggccaggcuggucucaa

SEQ ID NO: 1101678 - RNA, 17 nt, Homo sapiens
uggccagugugauccca

SEQ ID NO: 1101679 - RNA, 17 nt, Homo sapiens
uggccaugcuucuugcc

SEQ ID NO: 1101680 - RNA, 17 nt, Homo sapiens
uggccccugcccggcug

SEQ ID NO: 1101681 - RNA, 22 nt, Homo sapiens
uggccuaugcacauauggacuc

SEQ ID NO: 1101682 - RNA, 15 nt, Homo sapiens
uggccucaagugauu

SEQ ID NO: 1101683 - RNA, 15 nt, Homo sapiens
uggccuucaguguac

SEQ ID NO: 1101684 - RNA, 23 nt, Homo sapiens
uggcggcccccccagcugucauc

SEQ ID NO: 1101685 - RNA, 14 nt, Homo sapiens
uggcuaauucccag

SEQ ID NO: 1101686 - RNA, 19 nt, Homo sapiens
uggcugaaaaucacuauaa

SEQ ID NO: 1101687 - RNA, 16 nt, Homo sapiens
uggcugaggauuucaa

SEQ ID NO: 1101688 - RNA, 18 nt, Homo sapiens
uggcuguuauucuuccac

SEQ ID NO: 1101689 - RNA, 14 nt, Homo sapiens
uggcuuacuccagg

SEQ ID NO: 1101690 - RNA, 22 nt, Homo sapiens
uggcuuccagguaucuccagga

SEQ ID NO: 1101691 - RNA, 18 nt, Homo sapiens
uggcuuuagcuaccucac

SEQ ID NO: 1101692 - RNA, 14 nt, Homo sapiens
ugggaaauuacuua

SEQ ID NO: 1101693 - RNA, 14 nt, Homo sapiens
ugggacuacaggca

SEQ ID NO: 1101694 - RNA, 13 nt, Homo sapiens
ugggacugagaug

SEQ ID NO: 1101695 - RNA, 16 nt, Homo sapiens
ugggaggguaccagca

SEQ ID NO: 1101696 - RNA, 19 nt, Homo sapiens
ugggaggguaccagcagaa

SEQ ID NO: 1101697 - RNA, 20 nt, Homo sapiens
ugggaucaagaaggggacag

SEQ ID NO: 1101698 - RNA, 19 nt, Homo sapiens
ugggauuuaaagccuuuag

SEQ ID NO: 1101699 - RNA, 15 nt, Homo sapiens
ugggcagcuugagag

SEQ ID NO: 1101700 - RNA, 14 nt, Homo sapiens
ugggcaugcucagc

SEQ ID NO: 1101701 - RNA, 23 nt, Homo sapiens
ugggccuagggacagacugcaag

SEQ ID NO: 1101702 - RNA, 21 nt, Homo sapiens
ugggcgacagaagucuugucu

SEQ ID NO: 1101703 - RNA, 21 nt, Homo sapiens
ugggcucaucagccuuccuga

SEQ ID NO: 1101704 - RNA, 16 nt, Homo sapiens
uggggaagcugugaaa

SEQ ID NO: 1101705 - RNA, 22 nt, Homo sapiens
uggggacaccagccaucaugug

SEQ ID NO: 1101706 - RNA, 15 nt, Homo sapiens
uggggagauggaguu

SEQ ID NO: 1101707 - RNA, 18 nt, Homo sapiens
uggggagccugagccaca

SEQ ID NO: 1101708 - RNA, 20 nt, Homo sapiens
uggggcagcuugaggguugg

SEQ ID NO: 1101709 - RNA, 23 nt, Homo sapiens
ugggggaaaguguugaccacaga

SEQ ID NO: 1101710 - RNA, 18 nt, Homo sapiens
ugggggaggcggcacauu

SEQ ID NO: 1101711 - RNA, 19 nt, Homo sapiens
ugggggaggcggcacauug

SEQ ID NO: 1101712 - RNA, 21 nt, Homo sapiens
ugggguauuuaccacagcagc

SEQ ID NO: 1101713 - RNA, 19 nt, Homo sapiens
ugggguugcaaccacugca

SEQ ID NO: 1101714 - RNA, 19 nt, Homo sapiens
uggguacaauguacauuau

SEQ ID NO: 1101715 - RNA, 21 nt, Homo sapiens
ugggucuucccuguaugauuc

SEQ ID NO: 1101716 - RNA, 15 nt, Homo sapiens
ugggugaauguguga

SEQ ID NO: 1101717 - RNA, 21 nt, Homo sapiens
uggguggggcugcuccuccag

SEQ ID NO: 1101718 - RNA, 20 nt, Homo sapiens
ugggugucaagagggucuga

SEQ ID NO: 1101719 - RNA, 17 nt, Homo sapiens
uggguguuuaaaaaagu

SEQ ID NO: 1101720 - RNA, 14 nt, Homo sapiens
ugguaaaauacuuc

SEQ ID NO: 1101721 - RNA, 15 nt, Homo sapiens
ugguaaauuaguauu

SEQ ID NO: 1101722 - RNA, 12 nt, Homo sapiens
ugguaacugcac

SEQ ID NO: 1101723 - RNA, 23 nt, Homo sapiens
ugguaacuuuuuuuuaaagcuca

SEQ ID NO: 1101724 - RNA, 20 nt, Homo sapiens
ugguacaaucucaaauucuc

SEQ ID NO: 1101725 - RNA, 14 nt, Homo sapiens
ugguacagcacugu

SEQ ID NO: 1101726 - RNA, 15 nt, Homo sapiens
ugguagccucacuuu

SEQ ID NO: 1101727 - RNA, 21 nt, Homo sapiens
ugguauaauuauuuacucuua

SEQ ID NO: 1101728 - RNA, 23 nt, Homo sapiens
ugguauguguguguaugcuacua

SEQ ID NO: 1101729 - RNA, 19 nt, Homo sapiens
ugguauuauuuacaaugca

SEQ ID NO: 1101730 - RNA, 18 nt, Homo sapiens
uggucacaagcacaaagc

SEQ ID NO: 1101731 - RNA, 14 nt, Homo sapiens
ugguccaggguuga

SEQ ID NO: 1101732 - RNA, 21 nt, Homo sapiens
uggucccaaguaguagugucu

SEQ ID NO: 1101733 - RNA, 20 nt, Homo sapiens
uggucuuguggaauugggag

SEQ ID NO: 1101734 - RNA, 17 nt, Homo sapiens
uggucuuuauuccuccc

SEQ ID NO: 1101735 - RNA, 20 nt, Homo sapiens
uggucuuuccuaucauggag

SEQ ID NO: 1101736 - RNA, 19 nt, Homo sapiens
uggugaaaccucaucucua

SEQ ID NO: 1101737 - RNA, 17 nt, Homo sapiens
uggugcacugagcugca

SEQ ID NO: 1101738 - RNA, 20 nt, Homo sapiens
ugguggcacacgccuguaau

SEQ ID NO: 1101739 - RNA, 17 nt, Homo sapiens
uggugggccacguguuc

SEQ ID NO: 1101740 - RNA, 17 nt, Homo sapiens
uggugggugccuguaau

SEQ ID NO: 1101741 - RNA, 14 nt, Homo sapiens
ugguggucagggag

SEQ ID NO: 1101742 - RNA, 12 nt, Homo sapiens
uggugucugucc

SEQ ID NO: 1101743 - RNA, 19 nt, Homo sapiens
ugguguucaaaaaaacacu

SEQ ID NO: 1101744 - RNA, 19 nt, Homo sapiens
ugguuccaugccugagggu

SEQ ID NO: 1101745 - RNA, 16 nt, Homo sapiens
ugguuuaugucaucau

SEQ ID NO: 1101746 - RNA, 22 nt, Homo sapiens
ugcauguccucuuguugcugag

SEQ ID NO: 1101747 - RNA, 18 nt, Homo sapiens
ugcauugcuaaaauauua

SEQ ID NO: 1101748 - RNA, 20 nt, Homo sapiens
ugcauuuauggucaacacuu

SEQ ID NO: 1101749 - RNA, 17 nt, Homo sapiens
ugcauuucugucucucu

SEQ ID NO: 1101750 - RNA, 13 nt, Homo sapiens
ugcauuugcacua

SEQ ID NO: 1101751 - RNA, 19 nt, Homo sapiens
ugccaaggaugacacugcc

SEQ ID NO: 1101752 - RNA, 19 nt, Homo sapiens
ugccacacccuccccauuc

SEQ ID NO: 1101753 - RNA, 13 nt, Homo sapiens
ugccaccagucac

SEQ ID NO: 1101754 - RNA, 15 nt, Homo sapiens
ugccaccugucuguc

SEQ ID NO: 1101755 - RNA, 14 nt, Homo sapiens
ugccacugccucuu

SEQ ID NO: 1101756 - RNA, 11 nt, Homo sapiens
ugccagugaaa

SEQ ID NO: 1101757 - RNA, 21 nt, Homo sapiens
ugccauagaggacagcaacug

SEQ ID NO: 1101758 - RNA, 17 nt, Homo sapiens
ugccaugucuuguucag

SEQ ID NO: 1101759 - RNA, 19 nt, Homo sapiens
ugcccagccucgcaugcca

SEQ ID NO: 1101760 - RNA, 19 nt, Homo sapiens
ugcccccagccucuguccc

SEQ ID NO: 1101761 - RNA, 16 nt, Homo sapiens
ugccccccuugccaga

SEQ ID NO: 1101762 - RNA, 18 nt, Homo sapiens
ugccccgccuccccgaaa

SEQ ID NO: 1101763 - RNA, 16 nt, Homo sapiens
ugccccucaccugccu

SEQ ID NO: 1101764 - RNA, 17 nt, Homo sapiens
ugcccuggauccaucag

SEQ ID NO: 1101765 - RNA, 23 nt, Homo sapiens
ugcccuguuguguauagaugcaa

SEQ ID NO: 1101766 - RNA, 13 nt, Homo sapiens
ugccuacauuccc

SEQ ID NO: 1101767 - RNA, 17 nt, Homo sapiens
ugccuagaggugcucau

SEQ ID NO: 1101768 - RNA, 15 nt, Homo sapiens
ugccucagaccugac

SEQ ID NO: 1101769 - RNA, 18 nt, Homo sapiens
ugccucugacacacagcu

SEQ ID NO: 1101770 - RNA, 14 nt, Homo sapiens
ugccucugucucac

SEQ ID NO: 1101771 - RNA, 15 nt, Homo sapiens
ugccuggcaaggccu

SEQ ID NO: 1101772 - RNA, 15 nt, Homo sapiens
ugccugugugagcau

SEQ ID NO: 1101773 - RNA, 16 nt, Homo sapiens
ugccuuccacaauuca

SEQ ID NO: 1101774 - RNA, 15 nt, Homo sapiens
ugccuuccuguuuaa

SEQ ID NO: 1101775 - RNA, 15 nt, Homo sapiens
ugccuugaagccacu

SEQ ID NO: 1101776 - RNA, 20 nt, Homo sapiens
ugccuuuucaucuaauguga

SEQ ID NO: 1101777 - RNA, 17 nt, Homo sapiens
ugcgaccgugaccagga

SEQ ID NO: 1101778 - RNA, 15 nt, Homo sapiens
ugcgagcauuucccu

SEQ ID NO: 1101779 - RNA, 14 nt, Homo sapiens
ugcgccuugcaaaa

SEQ ID NO: 1101780 - RNA, 22 nt, Homo sapiens
ugcuaacuagcuuggaaacugg

SEQ ID NO: 1101781 - RNA, 24 nt, Homo sapiens
ugcuaauuaaaaaguuaaucuuca

SEQ ID NO: 1101782 - RNA, 16 nt, Homo sapiens
ugcuacucuaguauuc

SEQ ID NO: 1101783 - RNA, 12 nt, Homo sapiens
ugcuauuugccu

SEQ ID NO: 1101784 - RNA, 17 nt, Homo sapiens
ugcuccccuuccugcca

SEQ ID NO: 1101785 - RNA, 16 nt, Homo sapiens
ugcucccuccacagcu

SEQ ID NO: 1101786 - RNA, 20 nt, Homo sapiens
ugcucugaggcuuccagaga

SEQ ID NO: 1101787 - RNA, 15 nt, Homo sapiens
ugcucuuagcugucu

SEQ ID NO: 1101788 - RNA, 23 nt, Homo sapiens
ugcucuuugauucaaagcacugu

SEQ ID NO: 1101789 - RNA, 15 nt, Homo sapiens
ugcugagaaggacac

SEQ ID NO: 1101790 - RNA, 15 nt, Homo sapiens
ugcugaucgugcuaa

SEQ ID NO: 1101791 - RNA, 21 nt, Homo sapiens
ugcugccaaacacccaugccc

SEQ ID NO: 1101792 - RNA, 14 nt, Homo sapiens
ugcugcuguuuaca

SEQ ID NO: 1101793 - RNA, 16 nt, Homo sapiens
ugcuguacuugaugac

SEQ ID NO: 1101794 - RNA, 15 nt, Homo sapiens
ugcuuaccugugaga

SEQ ID NO: 1101795 - RNA, 15 nt, Homo sapiens
ugcuuaguaucucau

SEQ ID NO: 1101796 - RNA, 17 nt, Homo sapiens
ugcuucaggauaccaua

SEQ ID NO: 1101797 - RNA, 13 nt, Homo sapiens
ugcuucucugggg

SEQ ID NO: 1101798 - RNA, 13 nt, Homo sapiens
ugcuugcacuuug

SEQ ID NO: 1101799 - RNA, 14 nt, Homo sapiens
ugcuuggguguaac

SEQ ID NO: 1101800 - RNA, 22 nt, Homo sapiens
ugcuuugcaggaagugucuaga

SEQ ID NO: 1101801 - RNA, 21 nt, Homo sapiens
ugcuuuucuucccagcaaagg

SEQ ID NO: 1101802 - RNA, 17 nt, Homo sapiens
ugcuuuuguccuguuau

SEQ ID NO: 1101803 - RNA, 16 nt, Homo sapiens
ugcuuuuugacaugaa

SEQ ID NO: 1101804 - RNA, 22 nt, Homo sapiens
uggaaaagcacuuuacagauga

SEQ ID NO: 1101805 - RNA, 17 nt, Homo sapiens
uggaaagaaucuaauag

SEQ ID NO: 1101806 - RNA, 16 nt, Homo sapiens
uggaaagacugauugu

SEQ ID NO: 1101807 - RNA, 14 nt, Homo sapiens
uggaaagcagccau

SEQ ID NO: 1101808 - RNA, 19 nt, Homo sapiens
uggaaagcaucaccucagg

SEQ ID NO: 1101809 - RNA, 22 nt, Homo sapiens
uggaaaggcucagucucaggag

SEQ ID NO: 1101810 - RNA, 18 nt, Homo sapiens
uggaaauccuguuacuua

SEQ ID NO: 1101811 - RNA, 19 nt, Homo sapiens
uggaaauccuguuacuuaa

SEQ ID NO: 1101812 - RNA, 18 nt, Homo sapiens
uggaaauuaaacccugcc

SEQ ID NO: 1101813 - RNA, 15 nt, Homo sapiens
uggaacagugcagga

SEQ ID NO: 1101814 - RNA, 23 nt, Homo sapiens
uggaacuacauuaguacacagca

SEQ ID NO: 1101815 - RNA, 18 nt, Homo sapiens
uggaacucagcugucugu

SEQ ID NO: 1101816 - RNA, 15 nt, Homo sapiens
uggaacugucucuca

SEQ ID NO: 1101817 - RNA, 17 nt, Homo sapiens
uggaagacuaucuuacu

SEQ ID NO: 1101818 - RNA, 18 nt, Homo sapiens
uggaagaggcaccugucc

SEQ ID NO: 1101819 - RNA, 19 nt, Homo sapiens
uggaagagggcgaguucag

SEQ ID NO: 1101820 - RNA, 14 nt, Homo sapiens
uggaagcacagcuu

SEQ ID NO: 1101821 - RNA, 15 nt, Homo sapiens
uggaagcucugaagu

SEQ ID NO: 1101822 - RNA, 18 nt, Homo sapiens
uggaagcuguguccuugc

SEQ ID NO: 1101823 - RNA, 21 nt, Homo sapiens
uggaagggaagugagaaacca

SEQ ID NO: 1101824 - RNA, 21 nt, Homo sapiens
uggaauacuugaaaaccucau

SEQ ID NO: 1101825 - RNA, 21 nt, Homo sapiens
uggaaucagucguuggcaccu

SEQ ID NO: 1101826 - RNA, 23 nt, Homo sapiens
uggaauuuucuuacccauauauc

SEQ ID NO: 1101827 - RNA, 15 nt, Homo sapiens
uggacauaagacaga

SEQ ID NO: 1101828 - RNA, 17 nt, Homo sapiens
uggacauaagacagaca

SEQ ID NO: 1101829 - RNA, 16 nt, Homo sapiens
uggacucaguuuucuu

SEQ ID NO: 1101830 - RNA, 15 nt, Homo sapiens
uggacugucauagaa

SEQ ID NO: 1101831 - RNA, 15 nt, Homo sapiens
uggagaaaaugaaga

SEQ ID NO: 1101832 - RNA, 22 nt, Homo sapiens
uggagaaauaaaaauaccucuu

SEQ ID NO: 1101833 - RNA, 15 nt, Homo sapiens
uggagcagaaagcca

SEQ ID NO: 1101834 - RNA, 20 nt, Homo sapiens
uggagcgagcagaugcaauc

SEQ ID NO: 1101835 - RNA, 16 nt, Homo sapiens
ccaaauuauuguccaa

SEQ ID NO: 1101836 - RNA, 22 nt, Homo sapiens
ccaaauuggauacugcugccaa

SEQ ID NO: 1101837 - RNA, 18 nt, Homo sapiens
ccaacaacuccaggaaaa

SEQ ID NO: 1101838 - RNA, 21 nt, Homo sapiens
ccaacagaagcuuccauucca

SEQ ID NO: 1101839 - RNA, 18 nt, Homo sapiens
ccaacagucaaaacagag

SEQ ID NO: 1101840 - RNA, 14 nt, Homo sapiens
ccaacauugagaug

SEQ ID NO: 1101841 - RNA, 23 nt, Homo sapiens
ccaaccauguucccuucuucuua

SEQ ID NO: 1101842 - RNA, 23 nt, Homo sapiens
ccaacugcuguucauguuacuca

SEQ ID NO: 1101843 - RNA, 21 nt, Homo sapiens
ccaacuucauuugaugcuaaa

SEQ ID NO: 1101844 - RNA, 20 nt, Homo sapiens
ccaagacucugaaaucucag

SEQ ID NO: 1101845 - RNA, 21 nt, Homo sapiens
ccaagcuguuccacuucucua

SEQ ID NO: 1101846 - RNA, 16 nt, Homo sapiens
ccaaggaaacuugaau

SEQ ID NO: 1101847 - RNA, 19 nt, Homo sapiens
ccaaggaggaaaaacagac

SEQ ID NO: 1101848 - RNA, 20 nt, Homo sapiens
ccaaggcuauauuucuggga

SEQ ID NO: 1101849 - RNA, 14 nt, Homo sapiens
ccaagggucuuccu

SEQ ID NO: 1101850 - RNA, 15 nt, Homo sapiens
ccaaguugaaaucag

SEQ ID NO: 1101851 - RNA, 12 nt, Homo sapiens
ccaauaccuccu

SEQ ID NO: 1101852 - RNA, 21 nt, Homo sapiens
ccaauaccuccuccagaucag

SEQ ID NO: 1101853 - RNA, 14 nt, Homo sapiens
ccaaucauuuuaau

SEQ ID NO: 1101854 - RNA, 14 nt, Homo sapiens
ccaaucccgugaaa

SEQ ID NO: 1101855 - RNA, 22 nt, Homo sapiens
ccaaugaggucugaaauggagg

SEQ ID NO: 1101856 - RNA, 13 nt, Homo sapiens
ccaaugauucaua

SEQ ID NO: 1101857 - RNA, 15 nt, Homo sapiens
ccaauuaugugacaa

SEQ ID NO: 1101858 - RNA, 14 nt, Homo sapiens
ccacacacagagga

SEQ ID NO: 1101859 - RNA, 14 nt, Homo sapiens
ccacagaagccagg

SEQ ID NO: 1101860 - RNA, 19 nt, Homo sapiens
ccacagaugcuugugauuu

SEQ ID NO: 1101861 - RNA, 17 nt, Homo sapiens
ccacagcuucugcagca

SEQ ID NO: 1101862 - RNA, 21 nt, Homo sapiens
ccacaucuugcucugcugaca

SEQ ID NO: 1101863 - RNA, 22 nt, Homo sapiens
ccacaugugacacauaugcacc

SEQ ID NO: 1101864 - RNA, 10 nt, Homo sapiens
ccaccucuca

SEQ ID NO: 1101865 - RNA, 17 nt, Homo sapiens
ccaccuuggcucaaguc

SEQ ID NO: 1101866 - RNA, 21 nt, Homo sapiens
ccacgaggagcuuccagugca

SEQ ID NO: 1101867 - RNA, 18 nt, Homo sapiens
ccacgcuggagugcagug

SEQ ID NO: 1101868 - RNA, 21 nt, Homo sapiens
ccacggcaggccccugcagga

SEQ ID NO: 1101869 - RNA, 16 nt, Homo sapiens
ccacuaggacucugag

SEQ ID NO: 1101870 - RNA, 13 nt, Homo sapiens
ccacuauggucau

SEQ ID NO: 1101871 - RNA, 15 nt, Homo sapiens
ccacucaggccaaca

SEQ ID NO: 1101872 - RNA, 21 nt, Homo sapiens
ccacucugaauaccaagugug

SEQ ID NO: 1101873 - RNA, 15 nt, Homo sapiens
ccacucugcucugau

SEQ ID NO: 1101874 - RNA, 18 nt, Homo sapiens
ccacugaacauuugcuuu

SEQ ID NO: 1101875 - RNA, 19 nt, Homo sapiens
ccacuuaaaaaauguccau

SEQ ID NO: 1101876 - RNA, 23 nt, Homo sapiens
ccacuuaccuagauucuacauau

SEQ ID NO: 1101877 - RNA, 18 nt, Homo sapiens
ccacuucuuaaugcuuuc

SEQ ID NO: 1101878 - RNA, 17 nt, Homo sapiens
ccagaacaguuuguaca

SEQ ID NO: 1101879 - RNA, 15 nt, Homo sapiens
ccagaaguuccucaa

SEQ ID NO: 1101880 - RNA, 16 nt, Homo sapiens
ccagacaggcucaggu

SEQ ID NO: 1101881 - RNA, 17 nt, Homo sapiens
ccagacaggcucagguu

SEQ ID NO: 1101882 - RNA, 13 nt, Homo sapiens
ccagaccuuuuau

SEQ ID NO: 1101883 - RNA, 19 nt, Homo sapiens
ccagagaggguggugaccu

SEQ ID NO: 1101884 - RNA, 14 nt, Homo sapiens
ccagagcaaaauaa

SEQ ID NO: 1101885 - RNA, 20 nt, Homo sapiens
ccagagccccccacaaugau

SEQ ID NO: 1101886 - RNA, 16 nt, Homo sapiens
ccagagcuacugacua

SEQ ID NO: 1101887 - RNA, 14 nt, Homo sapiens
ccagaggcugcaga

SEQ ID NO: 1101888 - RNA, 13 nt, Homo sapiens
ccagagugcugcc

SEQ ID NO: 1101889 - RNA, 20 nt, Homo sapiens
ccagauggccgggacaugca

SEQ ID NO: 1101890 - RNA, 12 nt, Homo sapiens
ccagauugcaac

SEQ ID NO: 1101891 - RNA, 20 nt, Homo sapiens
ccagcaaugauguccagaag

SEQ ID NO: 1101892 - RNA, 11 nt, Homo sapiens
ccagcacucug

SEQ ID NO: 1101893 - RNA, 12 nt, Homo sapiens
ccagcacuuugg

SEQ ID NO: 1101894 - RNA, 21 nt, Homo sapiens
ccagcagguagugggugaaug

SEQ ID NO: 1101895 - RNA, 23 nt, Homo sapiens
ccagcagugugucaggugcugca

SEQ ID NO: 1101896 - RNA, 18 nt, Homo sapiens
ccagcaugcugagauuac

SEQ ID NO: 1101897 - RNA, 20 nt, Homo sapiens
ccagccaucaugugccugga

SEQ ID NO: 1101898 - RNA, 14 nt, Homo sapiens
ccagccuccaugcu

SEQ ID NO: 1101899 - RNA, 20 nt, Homo sapiens
ccagccugggcagcauagca

SEQ ID NO: 1101900 - RNA, 19 nt, Homo sapiens
ccagcucccuaggagacca

SEQ ID NO: 1101901 - RNA, 18 nt, Homo sapiens
ccagcugcucccaaauaa

SEQ ID NO: 1101902 - RNA, 11 nt, Homo sapiens
ccagcugucau

SEQ ID NO: 1101903 - RNA, 21 nt, Homo sapiens
ccagcuuguuugugaaacaaa

SEQ ID NO: 1101904 - RNA, 22 nt, Homo sapiens
ccaggaagguagcccagcacug

SEQ ID NO: 1101905 - RNA, 16 nt, Homo sapiens
ccaggacucacccuca

SEQ ID NO: 1101906 - RNA, 22 nt, Homo sapiens
ccaggaguucgaggcugcaguc

SEQ ID NO: 1101907 - RNA, 19 nt, Homo sapiens
ccaggaugaguuacuugaa

SEQ ID NO: 1101908 - RNA, 14 nt, Homo sapiens
ccaggcacugcugc

SEQ ID NO: 1101909 - RNA, 18 nt, Homo sapiens
ccaggcaggucuugaacu

SEQ ID NO: 1101910 - RNA, 22 nt, Homo sapiens
ccaggcccggggcuggcggcua

SEQ ID NO: 1101911 - RNA, 20 nt, Homo sapiens
ccaggcuggagugcaguggu

SEQ ID NO: 1101912 - RNA, 14 nt, Homo sapiens
ccaggcuguuucuu

SEQ ID NO: 1101913 - RNA, 15 nt, Homo sapiens
ccagggaugacaugu

SEQ ID NO: 1101914 - RNA, 22 nt, Homo sapiens
ccaguauuuuuauuucuuuaau

SEQ ID NO: 1101915 - RNA, 22 nt, Homo sapiens
ccagucacugucccucaaauga

SEQ ID NO: 1101916 - RNA, 12 nt, Homo sapiens
ccaguccaugag

SEQ ID NO: 1101917 - RNA, 20 nt, Homo sapiens
ccagucuugucauugccagc

SEQ ID NO: 1101918 - RNA, 16 nt, Homo sapiens
ccagugaaccaaagag

SEQ ID NO: 1101919 - RNA, 19 nt, Homo sapiens
ccaguggugaagaaaacuc

SEQ ID NO: 1101920 - RNA, 21 nt, Homo sapiens
ccaguguaaagaauaaaugaa

SEQ ID NO: 1101921 - RNA, 14 nt, Homo sapiens
ccaguguacugcuu

SEQ ID NO: 1101922 - RNA, 11 nt, Homo sapiens
ccaguuuccaa

SEQ ID NO: 1101923 - RNA, 16 nt, Homo sapiens
ccaguuugcuuugccc

SEQ ID NO: 1101924 - RNA, 14 nt, Homo sapiens
cauuuaucccucaa

SEQ ID NO: 1101925 - RNA, 17 nt, Homo sapiens
cauuucaggggucguca

SEQ ID NO: 1101926 - RNA, 23 nt, Homo sapiens
cauuuccuccgucaccucagaga

SEQ ID NO: 1101927 - RNA, 21 nt, Homo sapiens
cauuucuauuuauuuacugag

SEQ ID NO: 1101928 - RNA, 20 nt, Homo sapiens
cauuugaguugcccaucuug

SEQ ID NO: 1101929 - RNA, 13 nt, Homo sapiens
cauuugcacuauu

SEQ ID NO: 1101930 - RNA, 21 nt, Homo sapiens
cauuuguacugaccccaucac

SEQ ID NO: 1101931 - RNA, 21 nt, Homo sapiens
cauuuguuggaaugaauuaaa

SEQ ID NO: 1101932 - RNA, 15 nt, Homo sapiens
cauuuuaagaguuac

SEQ ID NO: 1101933 - RNA, 22 nt, Homo sapiens
cauuuuacccuuggcucaaucc

SEQ ID NO: 1101934 - RNA, 15 nt, Homo sapiens
cauuuuauaucugga

SEQ ID NO: 1101935 - RNA, 17 nt, Homo sapiens
cauuuuaugucauuaaa

SEQ ID NO: 1101936 - RNA, 14 nt, Homo sapiens
cauuuugcaaaauu

SEQ ID NO: 1101937 - RNA, 19 nt, Homo sapiens
cauuuugcaaaauuuccag

SEQ ID NO: 1101938 - RNA, 22 nt, Homo sapiens
cauuuuggaaguuuucaggacu

SEQ ID NO: 1101939 - RNA, 15 nt, Homo sapiens
cauuuuguuauagaa

SEQ ID NO: 1101940 - RNA, 18 nt, Homo sapiens
ccaaaauaaaaccagcuc

SEQ ID NO: 1101941 - RNA, 17 nt, Homo sapiens
ccaaaauuaccaaaaau

SEQ ID NO: 1101942 - RNA, 14 nt, Homo sapiens
ccaaacucugccag

SEQ ID NO: 1101943 - RNA, 15 nt, Homo sapiens
ccaaacucugccagc

SEQ ID NO: 1101944 - RNA, 17 nt, Homo sapiens
ccaaagagaaaagauua

SEQ ID NO: 1101945 - RNA, 16 nt, Homo sapiens
ccaaagagacuggagc

SEQ ID NO: 1101946 - RNA, 23 nt, Homo sapiens
ccaaagagacuggagcaucugac

SEQ ID NO: 1101947 - RNA, 20 nt, Homo sapiens
ccaaaguaaauguccugcua

SEQ ID NO: 1101948 - RNA, 13 nt, Homo sapiens
ccaaaguguuaau

SEQ ID NO: 1101949 - RNA, 14 nt, Homo sapiens
ccaaauaaacucca

SEQ ID NO: 1101950 - RNA, 22 nt, Homo sapiens
ccaaaucuuaauucaacuagua

SEQ ID NO: 1101951 - RNA, 18 nt, Homo sapiens
auauuccauccauauacu

SEQ ID NO: 1101952 - RNA, 18 nt, Homo sapiens
auauucccacagcacuaa

SEQ ID NO: 1101953 - RNA, 10 nt, Homo sapiens
auauucuugg

SEQ ID NO: 1101954 - RNA, 22 nt, Homo sapiens
auauucuuuaaauuucaucuca

SEQ ID NO: 1101955 - RNA, 16 nt, Homo sapiens
auauugaaaagauagg

SEQ ID NO: 1101956 - RNA, 15 nt, Homo sapiens
auauuuauagcaauc

SEQ ID NO: 1101957 - RNA, 19 nt, Homo sapiens
auauuuauggggggagaac

SEQ ID NO: 1101958 - RNA, 14 nt, Homo sapiens
auauuucaggcaua

SEQ ID NO: 1101959 - RNA, 16 nt, Homo sapiens
auauuucccaauacau

SEQ ID NO: 1101960 - RNA, 16 nt, Homo sapiens
auauuugaauaucauu

SEQ ID NO: 1101961 - RNA, 16 nt, Homo sapiens
auauuuugcauaguac

SEQ ID NO: 1101962 - RNA, 19 nt, Homo sapiens
auauuuuuaugugcaauaa

SEQ ID NO: 1101963 - RNA, 17 nt, Homo sapiens
auauuuuucaaccagca

SEQ ID NO: 1101964 - RNA, 14 nt, Homo sapiens
aucaaaacucuccu

SEQ ID NO: 1101965 - RNA, 18 nt, Homo sapiens
aucaaaagcuuauucauc

SEQ ID NO: 1101966 - RNA, 16 nt, Homo sapiens
aucaaaaucacuaucu

SEQ ID NO: 1101967 - RNA, 11 nt, Homo sapiens
aucaaccagca

SEQ ID NO: 1101968 - RNA, 13 nt, Homo sapiens
aucaaugucacuu

SEQ ID NO: 1101969 - RNA, 21 nt, Homo sapiens
aucaauucuauuacgugcaau

SEQ ID NO: 1101970 - RNA, 16 nt, Homo sapiens
aucaauuuuuauacau

SEQ ID NO: 1101971 - RNA, 23 nt, Homo sapiens
aucacagggccccagaaggcagg

SEQ ID NO: 1101972 - RNA, 21 nt, Homo sapiens
aucacaguguuugcaauggug

SEQ ID NO: 1101973 - RNA, 21 nt, Homo sapiens
aucacauagaagcuguccuug

SEQ ID NO: 1101974 - RNA, 22 nt, Homo sapiens
aucacggcucacugcagccuca

SEQ ID NO: 1101975 - RNA, 15 nt, Homo sapiens
aucacguuaccccaa

SEQ ID NO: 1101976 - RNA, 15 nt, Homo sapiens
aucacuuggagccag

SEQ ID NO: 1101977 - RNA, 17 nt, Homo sapiens
aucacuuggagccagga

SEQ ID NO: 1101978 - RNA, 13 nt, Homo sapiens
aucagaucugucu

SEQ ID NO: 1101979 - RNA, 18 nt, Homo sapiens
aucagcagagaacuggaa

SEQ ID NO: 1101980 - RNA, 11 nt, Homo sapiens
aucagugaugg

SEQ ID NO: 1101981 - RNA, 20 nt, Homo sapiens
aucaguguccucuugcucaa

SEQ ID NO: 1101982 - RNA, 21 nt, Homo sapiens
aucaguuaacauuaacaucua

SEQ ID NO: 1101983 - RNA, 13 nt, Homo sapiens
aucaguuacuggu

SEQ ID NO: 1101984 - RNA, 12 nt, Homo sapiens
aucaguuugacu

SEQ ID NO: 1101985 - RNA, 22 nt, Homo sapiens
aucauacuaccggcuacaucaa

SEQ ID NO: 1101986 - RNA, 17 nt, Homo sapiens
aucaugaaaagugcugu

SEQ ID NO: 1101987 - RNA, 12 nt, Homo sapiens
aucaugaauauu

SEQ ID NO: 1101988 - RNA, 13 nt, Homo sapiens
aucauuccuugag

SEQ ID NO: 1101989 - RNA, 19 nt, Homo sapiens
auccaaccccccaccugcc

SEQ ID NO: 1101990 - RNA, 18 nt, Homo sapiens
auccaagaaucagugaag

SEQ ID NO: 1101991 - RNA, 23 nt, Homo sapiens
auccaagcgaggucaacagagaa

SEQ ID NO: 1101992 - RNA, 22 nt, Homo sapiens
auccacaaaaacaacuuauuau

SEQ ID NO: 1101993 - RNA, 15 nt, Homo sapiens
auccacccaccucag

SEQ ID NO: 1101994 - RNA, 16 nt, Homo sapiens
auccacccaccucagc

SEQ ID NO: 1101995 - RNA, 11 nt, Homo sapiens
auccacugugc

SEQ ID NO: 1101996 - RNA, 13 nt, Homo sapiens
auccacugugcca

SEQ ID NO: 1101997 - RNA, 20 nt, Homo sapiens
auccagaccucuacaagcaa

SEQ ID NO: 1101998 - RNA, 21 nt, Homo sapiens
auccauguuaguuuuuacuuu

SEQ ID NO: 1101999 - RNA, 23 nt, Homo sapiens
aucccagagcccagggcauccca

SEQ ID NO: 1102000 - RNA, 12 nt, Homo sapiens
aucccagcacuu

SEQ ID NO: 1102001 - RNA, 21 nt, Homo sapiens
aucccagcaugcugagauuac

SEQ ID NO: 1102002 - RNA, 14 nt, Homo sapiens
aucccagcuacuca

SEQ ID NO: 1102003 - RNA, 15 nt, Homo sapiens
aucccagcuacucaa

SEQ ID NO: 1102004 - RNA, 17 nt, Homo sapiens
aucccagcuacucaaga

SEQ ID NO: 1102005 - RNA, 21 nt, Homo sapiens
aucccaggggaccacaccucc

SEQ ID NO: 1102006 - RNA, 18 nt, Homo sapiens
auccccagcgauucccuc

SEQ ID NO: 1102007 - RNA, 20 nt, Homo sapiens
aucccugcagccugguagaa

SEQ ID NO: 1102008 - RNA, 13 nt, Homo sapiens
auccgaaguauga

SEQ ID NO: 1102009 - RNA, 17 nt, Homo sapiens
auccguaguucccugaa

SEQ ID NO: 1102010 - RNA, 21 nt, Homo sapiens
auccuaggcuuaaaugcaaua

SEQ ID NO: 1102011 - RNA, 21 nt, Homo sapiens
auccuaugguuucuccaucca

SEQ ID NO: 1102012 - RNA, 22 nt, Homo sapiens
auccuaugguuucuccauccaa

SEQ ID NO: 1102013 - RNA, 15 nt, Homo sapiens
auccucccaccucag

SEQ ID NO: 1102014 - RNA, 15 nt, Homo sapiens
auccuccugccucag

SEQ ID NO: 1102015 - RNA, 14 nt, Homo sapiens
auccugaugcuguu

SEQ ID NO: 1102016 - RNA, 16 nt, Homo sapiens
auccugcgagcuccuu

SEQ ID NO: 1102017 - RNA, 12 nt, Homo sapiens
auccuguuacuu

SEQ ID NO: 1102018 - RNA, 15 nt, Homo sapiens
auccuucaccagagc

SEQ ID NO: 1102019 - RNA, 13 nt, Homo sapiens
aaaaaaaauacuu

SEQ ID NO: 1102020 - RNA, 14 nt, Homo sapiens
aaaaaaauugcaca

SEQ ID NO: 1102021 - RNA, 21 nt, Homo sapiens
aaaaaaauuuuauagugucuu

SEQ ID NO: 1102022 - RNA, 15 nt, Homo sapiens
aaaaaaugcauuuaa

SEQ ID NO: 1102023 - RNA, 12 nt, Homo sapiens
aaaaacauuugu

SEQ ID NO: 1102024 - RNA, 18 nt, Homo sapiens
aaaaaccaauagcuuuaa

SEQ ID NO: 1102025 - RNA, 13 nt, Homo sapiens
aaaaaguaaucaa

SEQ ID NO: 1102026 - RNA, 17 nt, Homo sapiens
aaaaaugaugggacaau

SEQ ID NO: 1102027 - RNA, 18 nt, Homo sapiens
aaaacagccucacagaag

SEQ ID NO: 1102028 - RNA, 22 nt, Homo sapiens
aaaacauaugcauuaugaaguu

SEQ ID NO: 1102029 - RNA, 13 nt, Homo sapiens
aaaacaugacuuu

SEQ ID NO: 1102030 - RNA, 22 nt, Homo sapiens
aaaaccaaaagaacaagaauuu

SEQ ID NO: 1102031 - RNA, 19 nt, Homo sapiens
aaaaccagaaucauaauuu

SEQ ID NO: 1102032 - RNA, 13 nt, Homo sapiens
aaaacccagagag

SEQ ID NO: 1102033 - RNA, 20 nt, Homo sapiens
aaaaccucaugacagccaga

SEQ ID NO: 1102034 - RNA, 13 nt, Homo sapiens
aaaaccuccagua

SEQ ID NO: 1102035 - RNA, 14 nt, Homo sapiens
aaaaccuuacuuaa

SEQ ID NO: 1102036 - RNA, 14 nt, Homo sapiens
aaaacuaauaauca

SEQ ID NO: 1102037 - RNA, 20 nt, Homo sapiens
aaaacuaauuuccucugaca

SEQ ID NO: 1102038 - RNA, 21 nt, Homo sapiens
aaaacuccacagucaauauua

SEQ ID NO: 1102039 - RNA, 11 nt, Homo sapiens
aaaacugagug

SEQ ID NO: 1102040 - RNA, 17 nt, Homo sapiens
aaaacugauuuuuagcu

SEQ ID NO: 1102041 - RNA, 20 nt, Homo sapiens
aaaguuauauuuacuuuaaa

SEQ ID NO: 1102042 - RNA, 23 nt, Homo sapiens
aaaguuaugguacuauguuagcc

SEQ ID NO: 1102043 - RNA, 23 nt, Homo sapiens
aaaguucccuacuuccugugacu

SEQ ID NO: 1102044 - RNA, 11 nt, Homo sapiens
aaauaaauuca

SEQ ID NO: 1102045 - RNA, 21 nt, Homo sapiens
aaauaacuaggcguggacuua

SEQ ID NO: 1102046 - RNA, 16 nt, Homo sapiens
aaauacaaauuggaca

SEQ ID NO: 1102047 - RNA, 19 nt, Homo sapiens
aaauaccagugaaccaaag

SEQ ID NO: 1102048 - RNA, 19 nt, Homo sapiens
aaauacuucuugaagccga

SEQ ID NO: 1102049 - RNA, 16 nt, Homo sapiens
aaauauaaacuugugu

SEQ ID NO: 1102050 - RNA, 18 nt, Homo sapiens
aaauauacaaacaugugg

SEQ ID NO: 1102051 - RNA, 14 nt, Homo sapiens
aaauauauuucaga

SEQ ID NO: 1102052 - RNA, 13 nt, Homo sapiens
aaauauuccugca

SEQ ID NO: 1102053 - RNA, 23 nt, Homo sapiens
aaauauuuaugagaaaguucuca

SEQ ID NO: 1102054 - RNA, 23 nt, Homo sapiens
aaauauuuuauaugaaauguuuc

SEQ ID NO: 1102055 - RNA, 20 nt, Homo sapiens
aaauauuuuuaugugcaaua

SEQ ID NO: 1102056 - RNA, 15 nt, Homo sapiens
aaaucaaugucacuu

SEQ ID NO: 1102057 - RNA, 16 nt, Homo sapiens
aaaucaaugucacuua

SEQ ID NO: 1102058 - RNA, 13 nt, Homo sapiens
aaaucaucucuca

SEQ ID NO: 1102059 - RNA, 11 nt, Homo sapiens
aaauccuugau

SEQ ID NO: 1102060 - RNA, 12 nt, Homo sapiens
aaauccuugaua

SEQ ID NO: 1102061 - RNA, 17 nt, Homo sapiens
aaaucugggcauugagc

SEQ ID NO: 1102062 - RNA, 22 nt, Homo sapiens
aaaucuuaaaagcccuaaguga

SEQ ID NO: 1102063 - RNA, 13 nt, Homo sapiens
aaaucuuccuugu

SEQ ID NO: 1102064 - RNA, 22 nt, Homo sapiens
aaaucuugguugaugccaaaaa

SEQ ID NO: 1102065 - RNA, 13 nt, Homo sapiens
aaaugaaucuuac

SEQ ID NO: 1102066 - RNA, 17 nt, Homo sapiens
aaaugacagauguugaa

SEQ ID NO: 1102067 - RNA, 18 nt, Homo sapiens
aaaugacccaaagaccaa

SEQ ID NO: 1102068 - RNA, 15 nt, Homo sapiens
aaaugcaaacacugu

SEQ ID NO: 1102069 - RNA, 13 nt, Homo sapiens
aaaugcaagguga

SEQ ID NO: 1102070 - RNA, 23 nt, Homo sapiens
aaaugcaaggugaacaccacuuu

SEQ ID NO: 1102071 - RNA, 18 nt, Homo sapiens
aaaugcaguccagaauaa

SEQ ID NO: 1102072 - RNA, 17 nt, Homo sapiens
aaaugcauggugcaguu

SEQ ID NO: 1102073 - RNA, 16 nt, Homo sapiens
aaaugcauguccucaa

SEQ ID NO: 1102074 - RNA, 21 nt, Homo sapiens
aaaugcccaucuaugucccuu

SEQ ID NO: 1102075 - RNA, 17 nt, Homo sapiens
aaaugcuacaaacauau

SEQ ID NO: 1102076 - RNA, 23 nt, Homo sapiens
aaauggggauauguuaacuauug

SEQ ID NO: 1102077 - RNA, 15 nt, Homo sapiens
aaauguaauugaaua

SEQ ID NO: 1102078 - RNA, 20 nt, Homo sapiens
aaauguaguauggccugugu

SEQ ID NO: 1102079 - RNA, 19 nt, Homo sapiens
aaaugucuaagguaguaac

SEQ ID NO: 1102080 - RNA, 19 nt, Homo sapiens
aaaugucuggucuguccac

SEQ ID NO: 1102081 - RNA, 19 nt, Homo sapiens
aaaugucuuaaucaugaga

SEQ ID NO: 1102082 - RNA, 17 nt, Homo sapiens
aaauguggacaucauga

SEQ ID NO: 1102083 - RNA, 22 nt, Homo sapiens
aaauguuauuuuuuaauuauua

SEQ ID NO: 1102084 - RNA, 20 nt, Homo sapiens
aaauuaagagauacauuccc

SEQ ID NO: 1102085 - RNA, 21 nt, Homo sapiens
aaauuaagagauacauucccu

SEQ ID NO: 1102086 - RNA, 17 nt, Homo sapiens
aaauuagcugugugaaa

SEQ ID NO: 1102087 - RNA, 14 nt, Homo sapiens
aaauucaaacugcc

SEQ ID NO: 1102088 - RNA, 14 nt, Homo sapiens
aaauuccuguagca

SEQ ID NO: 1102089 - RNA, 18 nt, Homo sapiens
aaauuccuguugucugac

SEQ ID NO: 1102090 - RNA, 18 nt, Homo sapiens
aaauucucaaccuaccac

SEQ ID NO: 1102091 - RNA, 18 nt, Homo sapiens
aaauucucucucuugcag

SEQ ID NO: 1102092 - RNA, 22 nt, Homo sapiens
aaauucuuuuucacacugaugu

SEQ ID NO: 1102093 - RNA, 17 nt, Homo sapiens
aaauugaacuucaggga

SEQ ID NO: 1102094 - RNA, 15 nt, Homo sapiens
aaauugccugacgaa

SEQ ID NO: 1102095 - RNA, 15 nt, Homo sapiens
aaauugcuccuugac

SEQ ID NO: 1102096 - RNA, 15 nt, Homo sapiens
aaauugcuuauucua

SEQ ID NO: 1102097 - RNA, 23 nt, Homo sapiens
aaauuuccaggggccucccaagg

SEQ ID NO: 1102098 - RNA, 23 nt, Homo sapiens
aaauuuccaguaccuuugucaca

SEQ ID NO: 1102099 - RNA, 20 nt, Homo sapiens
aaauuucuucgaucccaagg

SEQ ID NO: 1102100 - RNA, 24 nt, Homo sapiens
aaauuuggauuuacgacugaagaa

SEQ ID NO: 1102101 - RNA, 17 nt, Homo sapiens
aacaaagaacaagcauu

SEQ ID NO: 1102102 - RNA, 18 nt, Homo sapiens
aacaaauuagguuuugua

SEQ ID NO: 1102103 - RNA, 19 nt, Homo sapiens
aacaacguaaacuuccuaa

SEQ ID NO: 1102104 - RNA, 15 nt, Homo sapiens
aacaacuucuuugua

SEQ ID NO: 1102105 - RNA, 21 nt, Homo sapiens
aacaacuugucuauuaccugu

SEQ ID NO: 1102106 - RNA, 14 nt, Homo sapiens
aacaagaauuggaa

SEQ ID NO: 1102107 - RNA, 17 nt, Homo sapiens
aacaagacaaagcaaag

SEQ ID NO: 1102108 - RNA, 22 nt, Homo sapiens
aacaauguaugugaaaguguaa

SEQ ID NO: 1102109 - RNA, 13 nt, Homo sapiens
aacacaagccaca

SEQ ID NO: 1102110 - RNA, 15 nt, Homo sapiens
aacacauacuagaaa

SEQ ID NO: 1102111 - RNA, 23 nt, Homo sapiens
aacaccacuuugucucugagaac

SEQ ID NO: 1102112 - RNA, 15 nt, Homo sapiens
aacacccaugaauca

SEQ ID NO: 1102113 - RNA, 20 nt, Homo sapiens
aacacccaugaaucaaagac

SEQ ID NO: 1102114 - RNA, 19 nt, Homo sapiens
aacacccgacuccucaaaa

SEQ ID NO: 1102115 - RNA, 20 nt, Homo sapiens
aacacccgacuccucaaaag

SEQ ID NO: 1102116 - RNA, 22 nt, Homo sapiens
aacacccuguagguucuugaua

SEQ ID NO: 1102117 - RNA, 17 nt, Homo sapiens
aacacggccuacugagc

SEQ ID NO: 1102118 - RNA, 19 nt, Homo sapiens
aacacuaguuuugugccag

SEQ ID NO: 1102119 - RNA, 14 nt, Homo sapiens
aacacucucugaga

SEQ ID NO: 1102120 - RNA, 14 nt, Homo sapiens
aacagaacuaugga

SEQ ID NO: 1102121 - RNA, 23 nt, Homo sapiens
aacagccaaaacuccacagucaa

SEQ ID NO: 1102122 - RNA, 22 nt, Homo sapiens
aacaggggccaaacugguggga

SEQ ID NO: 1102123 - RNA, 22 nt, Homo sapiens
aacagguuuucaccauagccua

SEQ ID NO: 1102124 - RNA, 16 nt, Homo sapiens
aacaguagcagggaau

SEQ ID NO: 1102125 - RNA, 14 nt, Homo sapiens
aacagugcuguucu

SEQ ID NO: 1102126 - RNA, 18 nt, Homo sapiens
aacaguugugaugacuau

SEQ ID NO: 1102127 - RNA, 19 nt, Homo sapiens
aacauaaaacaaugaagga

SEQ ID NO: 1102128 - RNA, 19 nt, Homo sapiens
aacauaaagagaacucugg

SEQ ID NO: 1102129 - RNA, 16 nt, Homo sapiens
aacauagacagaagaa

SEQ ID NO: 1102130 - RNA, 16 nt, Homo sapiens
aacauagagaucuaug

SEQ ID NO: 1102131 - RNA, 19 nt, Homo sapiens
aagacagauuaccaaagaa

SEQ ID NO: 1102132 - RNA, 18 nt, Homo sapiens
aagacauggaauuaccuu

SEQ ID NO: 1102133 - RNA, 18 nt, Homo sapiens
aagaccaagacacagauc

SEQ ID NO: 1102134 - RNA, 14 nt, Homo sapiens
aagaccaauauuca

SEQ ID NO: 1102135 - RNA, 22 nt, Homo sapiens
aagaccaauauucaaaugcgua

SEQ ID NO: 1102136 - RNA, 13 nt, Homo sapiens
aagaccagacugu

SEQ ID NO: 1102137 - RNA, 11 nt, Homo sapiens
aagacccagug

SEQ ID NO: 1102138 - RNA, 23 nt, Homo sapiens
aagacuauaaaaaaaugcauuua

SEQ ID NO: 1102139 - RNA, 14 nt, Homo sapiens
aagacuuaacuggu

SEQ ID NO: 1102140 - RNA, 19 nt, Homo sapiens
aagagaacauuucuagaaa

SEQ ID NO: 1102141 - RNA, 19 nt, Homo sapiens
aagagacuggagcaucuga

SEQ ID NO: 1102142 - RNA, 20 nt, Homo sapiens
aagagacuggagcaucugac

SEQ ID NO: 1102143 - RNA, 21 nt, Homo sapiens
aagagagaaagaaguaggcau

SEQ ID NO: 1102144 - RNA, 21 nt, Homo sapiens
aagagagaacaacuacuguga

SEQ ID NO: 1102145 - RNA, 20 nt, Homo sapiens
aagagaucacaauacucaaa

SEQ ID NO: 1102146 - RNA, 21 nt, Homo sapiens
aagagcaucaugccucugagg

SEQ ID NO: 1102147 - RNA, 19 nt, Homo sapiens
aagagcuggcaaagguggc

SEQ ID NO: 1102148 - RNA, 17 nt, Homo sapiens
aagagggagaagggaug

SEQ ID NO: 1102149 - RNA, 18 nt, Homo sapiens
aagagggccugugggagc

SEQ ID NO: 1102150 - RNA, 22 nt, Homo sapiens
aagagggcgaguucagcaaaga

SEQ ID NO: 1102151 - RNA, 12 nt, Homo sapiens
aagaggggaaaa

SEQ ID NO: 1102152 - RNA, 12 nt, Homo sapiens
aagaggugaccc

SEQ ID NO: 1102153 - RNA, 14 nt, Homo sapiens
aagaggugacccca

SEQ ID NO: 1102154 - RNA, 19 nt, Homo sapiens
aagagugagacuccgucuc

SEQ ID NO: 1102155 - RNA, 20 nt, Homo sapiens
aagagugagacuccgucuca

SEQ ID NO: 1102156 - RNA, 16 nt, Homo sapiens
aagauaaaaccagagc

SEQ ID NO: 1102157 - RNA, 14 nt, Homo sapiens
aagaucccuauuau

SEQ ID NO: 1102158 - RNA, 18 nt, Homo sapiens
aagauggcuuuuucuccu

SEQ ID NO: 1102159 - RNA, 14 nt, Homo sapiens
aagauguaaggaau

SEQ ID NO: 1102160 - RNA, 22 nt, Homo sapiens
aagauucacuaaagcagcacau

SEQ ID NO: 1102161 - RNA, 19 nt, Homo sapiens
aagcacauaugaacuggac

SEQ ID NO: 1102162 - RNA, 12 nt, Homo sapiens
aagcacccuguu

SEQ ID NO: 1102163 - RNA, 23 nt, Homo sapiens
aagcaccuagccucgcucuuggc

SEQ ID NO: 1102164 - RNA, 17 nt, Homo sapiens
aagcagauuuaacaauu

SEQ ID NO: 1102165 - RNA, 18 nt, Homo sapiens
aagcagugccuuccauaa

SEQ ID NO: 1102166 - RNA, 16 nt, Homo sapiens
aagcaucaccucaggc

SEQ ID NO: 1102167 - RNA, 24 nt, Homo sapiens
aagcaucucagccuaccaugagaa

SEQ ID NO: 1102168 - RNA, 13 nt, Homo sapiens
aagcaucugugua

SEQ ID NO: 1102169 - RNA, 15 nt, Homo sapiens
aagcauuuacuuuga

SEQ ID NO: 1102170 - RNA, 18 nt, Homo sapiens
aagccacauggcugggau

SEQ ID NO: 1102171 - RNA, 15 nt, Homo sapiens
aagccacucuuccaa

SEQ ID NO: 1102172 - RNA, 19 nt, Homo sapiens
aagccagcugcaggaauca

SEQ ID NO: 1102173 - RNA, 17 nt, Homo sapiens
aagccaggguccugagu

SEQ ID NO: 1102174 - RNA, 19 nt, Homo sapiens
aagccaggguccugagugg

SEQ ID NO: 1102175 - RNA, 21 nt, Homo sapiens
aagccaggguccugaguggcu

SEQ ID NO: 1102176 - RNA, 23 nt, Homo sapiens
aagccauaguggagagaacugaa

SEQ ID NO: 1102177 - RNA, 16 nt, Homo sapiens
aagccauuauucacua

SEQ ID NO: 1102178 - RNA, 15 nt, Homo sapiens
aagccuaccaaugua

SEQ ID NO: 1102179 - RNA, 20 nt, Homo sapiens
aagccucugguggaaccugc

SEQ ID NO: 1102180 - RNA, 13 nt, Homo sapiens
aagccugaggcug

SEQ ID NO: 1102181 - RNA, 18 nt, Homo sapiens
aagccuuuugcucacaaa

SEQ ID NO: 1102182 - RNA, 17 nt, Homo sapiens
aagcgugagccacugca

SEQ ID NO: 1102183 - RNA, 20 nt, Homo sapiens
aagcuaaaauuagaugaacu

SEQ ID NO: 1102184 - RNA, 17 nt, Homo sapiens
aagcuagaaggccacau

SEQ ID NO: 1102185 - RNA, 14 nt, Homo sapiens
aagcucugaaguca

SEQ ID NO: 1102186 - RNA, 16 nt, Homo sapiens
aagcucugaagucaca

SEQ ID NO: 1102187 - RNA, 14 nt, Homo sapiens
aagcuggaagcaca

SEQ ID NO: 1102188 - RNA, 22 nt, Homo sapiens
aagcuggugccccacugaauuu

SEQ ID NO: 1102189 - RNA, 22 nt, Homo sapiens
aagcugugaaagaaccaaaaga

SEQ ID NO: 1102190 - RNA, 21 nt, Homo sapiens
aagcuuguauauacauauuau

SEQ ID NO: 1102191 - RNA, 16 nt, Homo sapiens
aagcuugucugaucgu

SEQ ID NO: 1102192 - RNA, 16 nt, Homo sapiens
aaggaacuggaacaca

SEQ ID NO: 1102193 - RNA, 13 nt, Homo sapiens
aaggaaucugugc

SEQ ID NO: 1102194 - RNA, 15 nt, Homo sapiens
aaggacgugucucag

SEQ ID NO: 1102195 - RNA, 14 nt, Homo sapiens
aaggagaaaaugca

SEQ ID NO: 1102196 - RNA, 15 nt, Homo sapiens
aaggagaaaaugcau

SEQ ID NO: 1102197 - RNA, 16 nt, Homo sapiens
aaggagaacuauccaa

SEQ ID NO: 1102198 - RNA, 19 nt, Homo sapiens
aaggagaacuauccaaaac

SEQ ID NO: 1102199 - RNA, 19 nt, Homo sapiens
aaggagacaaaacuagaga

SEQ ID NO: 1102200 - RNA, 22 nt, Homo sapiens
aaggaggacgguuaacuuguau

SEQ ID NO: 1102201 - RNA, 14 nt, Homo sapiens
aaggagguagcucc

SEQ ID NO: 1102202 - RNA, 23 nt, Homo sapiens
aaggauggagccagcucugcauu

SEQ ID NO: 1102203 - RNA, 12 nt, Homo sapiens
aaggcaaaaaga

SEQ ID NO: 1102204 - RNA, 22 nt, Homo sapiens
aaggcauaugcuggcccauaaa

SEQ ID NO: 1102205 - RNA, 21 nt, Homo sapiens
aaggccaagaaucaagcuaga

SEQ ID NO: 1102206 - RNA, 19 nt, Homo sapiens
aaggccacaugucaccgug

SEQ ID NO: 1102207 - RNA, 19 nt, Homo sapiens
aaggcccucuauuucucuc

SEQ ID NO: 1102208 - RNA, 19 nt, Homo sapiens
aaggcuauauuucugggau

SEQ ID NO: 1102209 - RNA, 22 nt, Homo sapiens
aaggcucugagcaaauguggcu

SEQ ID NO: 1102210 - RNA, 12 nt, Homo sapiens
aaggcugccuca

SEQ ID NO: 1102211 - RNA, 13 nt, Homo sapiens
aaggcugccucag

SEQ ID NO: 1102212 - RNA, 17 nt, Homo sapiens
aaggcugcuguguagcu

SEQ ID NO: 1102213 - RNA, 14 nt, Homo sapiens
aagggaaagccaga

SEQ ID NO: 1102214 - RNA, 20 nt, Homo sapiens
aagggaaggcugcuguguag

SEQ ID NO: 1102215 - RNA, 17 nt, Homo sapiens
aagggagggcucugagg

SEQ ID NO: 1102216 - RNA, 18 nt, Homo sapiens
aagggauccguacauuca

SEQ ID NO: 1102217 - RNA, 16 nt, Homo sapiens
aagggcaggugcuuca

SEQ ID NO: 1102218 - RNA, 23 nt, Homo sapiens
aaggguaccuugaacacuggggg

SEQ ID NO: 1102219 - RNA, 17 nt, Homo sapiens
aagguagcccagcacug

SEQ ID NO: 1102220 - RNA, 17 nt, Homo sapiens
aagguaguaacuuucca

SEQ ID NO: 1102221 - RNA, 18 nt, Homo sapiens
agugaauaaccacuuaaa

SEQ ID NO: 1102222 - RNA, 19 nt, Homo sapiens
agugacaugggugugccag

SEQ ID NO: 1102223 - RNA, 15 nt, Homo sapiens
agugagaaaccagcc

SEQ ID NO: 1102224 - RNA, 13 nt, Homo sapiens
agugagaaacuga

SEQ ID NO: 1102225 - RNA, 20 nt, Homo sapiens
agugagacccccaucucuac

SEQ ID NO: 1102226 - RNA, 16 nt, Homo sapiens
agugagcucuggauga

SEQ ID NO: 1102227 - RNA, 15 nt, Homo sapiens
agugagcugauauca

SEQ ID NO: 1102228 - RNA, 21 nt, Homo sapiens
agugauaucccccagccucaa

SEQ ID NO: 1102229 - RNA, 22 nt, Homo sapiens
agugauaucccccagccucaag

SEQ ID NO: 1102230 - RNA, 17 nt, Homo sapiens
agugauaugauguguag

SEQ ID NO: 1102231 - RNA, 19 nt, Homo sapiens
agugaucaguaugcuguuu

SEQ ID NO: 1102232 - RNA, 19 nt, Homo sapiens
agugauccucccaccucag

SEQ ID NO: 1102233 - RNA, 21 nt, Homo sapiens
agugcagugagccgagaucac

SEQ ID NO: 1102234 - RNA, 23 nt, Homo sapiens
agugcaguggugcgaucuuggcu

SEQ ID NO: 1102235 - RNA, 21 nt, Homo sapiens
agugcauuuaugagcucuuca

SEQ ID NO: 1102236 - RNA, 18 nt, Homo sapiens
agugccgccugugcccac

SEQ ID NO: 1102237 - RNA, 16 nt, Homo sapiens
agugccguaacaacug

SEQ ID NO: 1102238 - RNA, 15 nt, Homo sapiens
agugcgccuugcaaa

SEQ ID NO: 1102239 - RNA, 16 nt, Homo sapiens
agugcgccuugcaaaa

SEQ ID NO: 1102240 - RNA, 16 nt, Homo sapiens
agugcuuggguggugg

SEQ ID NO: 1102241 - RNA, 20 nt, Homo sapiens
aguggauuuuccugaauauu

SEQ ID NO: 1102242 - RNA, 13 nt, Homo sapiens
agugggacccaua

SEQ ID NO: 1102243 - RNA, 16 nt, Homo sapiens
agugguauauacauau

SEQ ID NO: 1102244 - RNA, 17 nt, Homo sapiens
aguggugcgaucuuggc

SEQ ID NO: 1102245 - RNA, 23 nt, Homo sapiens
aguguauuuuauguguggcccaa

SEQ ID NO: 1102246 - RNA, 22 nt, Homo sapiens
aguguauuuuuguuuaaucaaa

SEQ ID NO: 1102247 - RNA, 20 nt, Homo sapiens
agugucaccagcugccaaaa

SEQ ID NO: 1102248 - RNA, 12 nt, Homo sapiens
agugucacuuac

SEQ ID NO: 1102249 - RNA, 21 nt, Homo sapiens
agugucacuuaccuagauuua

SEQ ID NO: 1102250 - RNA, 17 nt, Homo sapiens
aguguccucuugcucaa

SEQ ID NO: 1102251 - RNA, 14 nt, Homo sapiens
agugucuugaaugu

SEQ ID NO: 1102252 - RNA, 17 nt, Homo sapiens
agugugaauaaaguuag

SEQ ID NO: 1102253 - RNA, 15 nt, Homo sapiens
agugugucacacuga

SEQ ID NO: 1102254 - RNA, 16 nt, Homo sapiens
agugugucacacugag

SEQ ID NO: 1102255 - RNA, 17 nt, Homo sapiens
aguguuccucaccaaua

SEQ ID NO: 1102256 - RNA, 12 nt, Homo sapiens
aguguugcuugg

SEQ ID NO: 1102257 - RNA, 20 nt, Homo sapiens
aguguuggaaaaugugcaau

SEQ ID NO: 1102258 - RNA, 20 nt, Homo sapiens
aguguuuagaagagccugac

SEQ ID NO: 1102259 - RNA, 16 nt, Homo sapiens
aguguuuucaccucau

SEQ ID NO: 1102260 - RNA, 21 nt, Homo sapiens
aguuaaggggagcaacagagg

SEQ ID NO: 1102261 - RNA, 15 nt, Homo sapiens
aguuaauacuuaaca

SEQ ID NO: 1102262 - RNA, 19 nt, Homo sapiens
aguucaauaaaugucuguu

SEQ ID NO: 1102263 - RNA, 21 nt, Homo sapiens
aguucacaggccagaaaacau

SEQ ID NO: 1102264 - RNA, 22 nt, Homo sapiens
aguucacuuuuuacagugcuau

SEQ ID NO: 1102265 - RNA, 10 nt, Homo sapiens
aguucagugg

SEQ ID NO: 1102266 - RNA, 19 nt, Homo sapiens
aguucauacccuguuacca

SEQ ID NO: 1102267 - RNA, 16 nt, Homo sapiens
aguucauauguaccau

SEQ ID NO: 1102268 - RNA, 17 nt, Homo sapiens
aguucauauguaccaug

SEQ ID NO: 1102269 - RNA, 19 nt, Homo sapiens
aguucgcagccacccugag

SEQ ID NO: 1102270 - RNA, 22 nt, Homo sapiens
aguucuggaagggacuuuagag

SEQ ID NO: 1102271 - RNA, 16 nt, Homo sapiens
aguucuuuuacuguaa

SEQ ID NO: 1102272 - RNA, 13 nt, Homo sapiens
aguugaaacaaga

SEQ ID NO: 1102273 - RNA, 14 nt, Homo sapiens
aguugaacaucuca

SEQ ID NO: 1102274 - RNA, 19 nt, Homo sapiens
aguugagaaagaagagaag

SEQ ID NO: 1102275 - RNA, 15 nt, Homo sapiens
aguugagucuccucu

SEQ ID NO: 1102276 - RNA, 22 nt, Homo sapiens
aguugagucuccucucugagac

SEQ ID NO: 1102277 - RNA, 17 nt, Homo sapiens
aguuggaccagaggaag

SEQ ID NO: 1102278 - RNA, 23 nt, Homo sapiens
aguugugagcacucuacugcaag

SEQ ID NO: 1102279 - RNA, 18 nt, Homo sapiens
aguuuaauaacuaccuaa

SEQ ID NO: 1102280 - RNA, 17 nt, Homo sapiens
aguuucacaaaguuugu

SEQ ID NO: 1102281 - RNA, 18 nt, Homo sapiens
aguuucuaucauucugcu

SEQ ID NO: 1102282 - RNA, 14 nt, Homo sapiens
aguuugaucaaauc

SEQ ID NO: 1102283 - RNA, 17 nt, Homo sapiens
aguuuggaacucuaccc

SEQ ID NO: 1102284 - RNA, 22 nt, Homo sapiens
aguuuguacagacguaugcuua

SEQ ID NO: 1102285 - RNA, 13 nt, Homo sapiens
aguuuuaguugca

SEQ ID NO: 1102286 - RNA, 18 nt, Homo sapiens
aguuuuauuuuuguagag

SEQ ID NO: 1102287 - RNA, 22 nt, Homo sapiens
aguuuuucagaaagcauuacau

SEQ ID NO: 1102288 - RNA, 13 nt, Homo sapiens
auaaaaacacuua

SEQ ID NO: 1102289 - RNA, 13 nt, Homo sapiens
auaaaaacauaaa

SEQ ID NO: 1102290 - RNA, 13 nt, Homo sapiens
auaaaacaaugaa

SEQ ID NO: 1102291 - RNA, 21 nt, Homo sapiens
auaaaaccaucaaaaauauuc

SEQ ID NO: 1102292 - RNA, 16 nt, Homo sapiens
auaaaagcacuuacuu

SEQ ID NO: 1102293 - RNA, 22 nt, Homo sapiens
auaaaagccucugguggaaccu

SEQ ID NO: 1102294 - RNA, 18 nt, Homo sapiens
auaaaaugaaagggucaa

SEQ ID NO: 1102295 - RNA, 18 nt, Homo sapiens
auaaaaugaauacaauua

SEQ ID NO: 1102296 - RNA, 21 nt, Homo sapiens
auaaacaacuuaauguucuga

SEQ ID NO: 1102297 - RNA, 19 nt, Homo sapiens
auaaacauuaaacacugua

SEQ ID NO: 1102298 - RNA, 14 nt, Homo sapiens
auaaacuagaucuc

SEQ ID NO: 1102299 - RNA, 15 nt, Homo sapiens
auaaagaccugagaa

SEQ ID NO: 1102300 - RNA, 14 nt, Homo sapiens
auaaagcccuugaa

SEQ ID NO: 1102301 - RNA, 18 nt, Homo sapiens
auaaaggcugagcucuua

SEQ ID NO: 1102302 - RNA, 17 nt, Homo sapiens
auaaaguuggugacaga

SEQ ID NO: 1102303 - RNA, 15 nt, Homo sapiens
auaaauaaaguuucu

SEQ ID NO: 1102304 - RNA, 19 nt, Homo sapiens
auaaaucaacuccagcucc

SEQ ID NO: 1102305 - RNA, 15 nt, Homo sapiens
auaaaucaguuaugu

SEQ ID NO: 1102306 - RNA, 21 nt, Homo sapiens
auaaaucugagccuaaaucua

SEQ ID NO: 1102307 - RNA, 12 nt, Homo sapiens
auaaaugaaucu

SEQ ID NO: 1102308 - RNA, 17 nt, Homo sapiens
auaaaugaaucuuacuc

SEQ ID NO: 1102309 - RNA, 14 nt, Homo sapiens
auaaauggacaaau

SEQ ID NO: 1102310 - RNA, 17 nt, Homo sapiens
auaaauguacauuaauu

SEQ ID NO: 1102311 - RNA, 14 nt, Homo sapiens
auaaauucaaacca

SEQ ID NO: 1102312 - RNA, 17 nt, Homo sapiens
auggauguuugucaaaa

SEQ ID NO: 1102313 - RNA, 18 nt, Homo sapiens
auggcaguccagccagcu

SEQ ID NO: 1102314 - RNA, 21 nt, Homo sapiens
auggcaguccagccagcuccu

SEQ ID NO: 1102315 - RNA, 18 nt, Homo sapiens
auggccagugugauccca

SEQ ID NO: 1102316 - RNA, 18 nt, Homo sapiens
auggcccaaauccagugu

SEQ ID NO: 1102317 - RNA, 17 nt, Homo sapiens
auggcugugccucugcc

SEQ ID NO: 1102318 - RNA, 16 nt, Homo sapiens
augggacucaaugcac

SEQ ID NO: 1102319 - RNA, 13 nt, Homo sapiens
augggaugaaugg

SEQ ID NO: 1102320 - RNA, 16 nt, Homo sapiens
augguaaaaguuacuu

SEQ ID NO: 1102321 - RNA, 14 nt, Homo sapiens
augguaacugcaca

SEQ ID NO: 1102322 - RNA, 16 nt, Homo sapiens
augguaauuguugcua

SEQ ID NO: 1102323 - RNA, 18 nt, Homo sapiens
augguacuauguuagccc

SEQ ID NO: 1102324 - RNA, 20 nt, Homo sapiens
auggucaacacuuaaggguu

SEQ ID NO: 1102325 - RNA, 18 nt, Homo sapiens
auggucacaagcacaaag

SEQ ID NO: 1102326 - RNA, 21 nt, Homo sapiens
augguccuggggcucugugca

SEQ ID NO: 1102327 - RNA, 20 nt, Homo sapiens
auggugaaaccucaucucua

SEQ ID NO: 1102328 - RNA, 21 nt, Homo sapiens
auggugaaaccucaucucuac

SEQ ID NO: 1102329 - RNA, 15 nt, Homo sapiens
auggugcacugagcu

SEQ ID NO: 1102330 - RNA, 17 nt, Homo sapiens
auggugggcacagaagu

SEQ ID NO: 1102331 - RNA, 21 nt, Homo sapiens
augguguguuccuaacauaaa

SEQ ID NO: 1102332 - RNA, 15 nt, Homo sapiens
augguugccaggacg

SEQ ID NO: 1102333 - RNA, 15 nt, Homo sapiens
augguuuacugcugu

SEQ ID NO: 1102334 - RNA, 21 nt, Homo sapiens
augguuugcaaggaagccaca

SEQ ID NO: 1102335 - RNA, 21 nt, Homo sapiens
augguuuucuccaagagcuac

SEQ ID NO: 1102336 - RNA, 21 nt, Homo sapiens
auguaaaauaaguauuuccau

SEQ ID NO: 1102337 - RNA, 17 nt, Homo sapiens
auguaaacagugccugc

SEQ ID NO: 1102338 - RNA, 17 nt, Homo sapiens
auguaaacccucaaggg

SEQ ID NO: 1102339 - RNA, 18 nt, Homo sapiens
auguaaaccuaagcacgu

SEQ ID NO: 1102340 - RNA, 12 nt, Homo sapiens
auguaaccaaga

SEQ ID NO: 1102341 - RNA, 23 nt, Homo sapiens
auguaguccguuaacacuacuua

SEQ ID NO: 1102342 - RNA, 20 nt, Homo sapiens
auguauuuguuugcaauuuu

SEQ ID NO: 1102343 - RNA, 17 nt, Homo sapiens
augucaaauaucucaga

SEQ ID NO: 1102344 - RNA, 14 nt, Homo sapiens
augucaauugucag

SEQ ID NO: 1102345 - RNA, 15 nt, Homo sapiens
augucacugcucuug

SEQ ID NO: 1102346 - RNA, 21 nt, Homo sapiens
augucaggcaaagugcugcug

SEQ ID NO: 1102347 - RNA, 18 nt, Homo sapiens
augucauauuggcaguug

SEQ ID NO: 1102348 - RNA, 17 nt, Homo sapiens
augucauuucauuuccu

SEQ ID NO: 1102349 - RNA, 20 nt, Homo sapiens
augucauuuugguacuuugg

SEQ ID NO: 1102350 - RNA, 22 nt, Homo sapiens
auguccaauggaguucagagau

SEQ ID NO: 1102351 - RNA, 15 nt, Homo sapiens
augucccaacuugua

SEQ ID NO: 1102352 - RNA, 23 nt, Homo sapiens
augucccuugcugugagcaagaa

SEQ ID NO: 1102353 - RNA, 19 nt, Homo sapiens
auguccuaaggacacacua

SEQ ID NO: 1102354 - RNA, 20 nt, Homo sapiens
augucucuuuaaugucacag

SEQ ID NO: 1102355 - RNA, 12 nt, Homo sapiens
augucugagcua

SEQ ID NO: 1102356 - RNA, 14 nt, Homo sapiens
augucuggucuguc

SEQ ID NO: 1102357 - RNA, 20 nt, Homo sapiens
augucuucucguuaaggaga

SEQ ID NO: 1102358 - RNA, 16 nt, Homo sapiens
augugaguguguguga

SEQ ID NO: 1102359 - RNA, 22 nt, Homo sapiens
augugaguugcacagcuaugaa

SEQ ID NO: 1102360 - RNA, 10 nt, Homo sapiens
augugcaaua

SEQ ID NO: 1102361 - RNA, 11 nt, Homo sapiens
augugccaagg

SEQ ID NO: 1102362 - RNA, 15 nt, Homo sapiens
augugcccacaggga

SEQ ID NO: 1102363 - RNA, 15 nt, Homo sapiens
augugcuucacauaa

SEQ ID NO: 1102364 - RNA, 21 nt, Homo sapiens
augugggguccccaucauccc

SEQ ID NO: 1102365 - RNA, 22 nt, Homo sapiens
augugggguccccaucauccca

SEQ ID NO: 1102366 - RNA, 14 nt, Homo sapiens
augugguagccuca

SEQ ID NO: 1102367 - RNA, 20 nt, Homo sapiens
auguguaaauggagcuugua

SEQ ID NO: 1102368 - RNA, 22 nt, Homo sapiens
auguguauugaagaaaagcacu

SEQ ID NO: 1102369 - RNA, 22 nt, Homo sapiens
auguguguguaugcuacuacaa

SEQ ID NO: 1102370 - RNA, 21 nt, Homo sapiens
auguguucauuaaagcaugaa

SEQ ID NO: 1102371 - RNA, 12 nt, Homo sapiens
auguguuuacuu

SEQ ID NO: 1102372 - RNA, 17 nt, Homo sapiens
auguuacacuaagggug

SEQ ID NO: 1102373 - RNA, 19 nt, Homo sapiens
auguuaggaaaauuucaca

SEQ ID NO: 1102374 - RNA, 14 nt, Homo sapiens
auguucauuaaauu

SEQ ID NO: 1102375 - RNA, 14 nt, Homo sapiens
auguuccucaaaag

SEQ ID NO: 1102376 - RNA, 19 nt, Homo sapiens
auguugccaccuguuaaaa

SEQ ID NO: 1102377 - RNA, 12 nt, Homo sapiens
auguuuacuucu

SEQ ID NO: 1102378 - RNA, 20 nt, Homo sapiens
auguuuacuuuucagggcau

SEQ ID NO: 1102379 - RNA, 22 nt, Homo sapiens
auguuugcuauugacaagucau

SEQ ID NO: 1102380 - RNA, 21 nt, Homo sapiens
auuaaacaagugcacuugaac

SEQ ID NO: 1102381 - RNA, 19 nt, Homo sapiens
auuaaacuugucagaauuu

SEQ ID NO: 1102382 - RNA, 13 nt, Homo sapiens
auuaaagcuguua

SEQ ID NO: 1102383 - RNA, 22 nt, Homo sapiens
auuaaaugcauguccucaaaac

SEQ ID NO: 1102384 - RNA, 19 nt, Homo sapiens
auuaagggaauaagccaug

SEQ ID NO: 1102385 - RNA, 15 nt, Homo sapiens
auuaaucaacuuucc

SEQ ID NO: 1102386 - RNA, 17 nt, Homo sapiens
auuaaugaacugugaca

SEQ ID NO: 1102387 - RNA, 22 nt, Homo sapiens
auuaaugacaaaggcacugagg

SEQ ID NO: 1102388 - RNA, 20 nt, Homo sapiens
auuaauuagauuuucuugca

SEQ ID NO: 1102389 - RNA, 14 nt, Homo sapiens
auuaauucuacuaa

SEQ ID NO: 1102390 - RNA, 16 nt, Homo sapiens
auuacauggcaguguu

SEQ ID NO: 1102391 - RNA, 15 nt, Homo sapiens
auuacugcaugcacu

SEQ ID NO: 1102392 - RNA, 22 nt, Homo sapiens
auuagacuggaacuugaacuga

SEQ ID NO: 1102393 - RNA, 18 nt, Homo sapiens
auuagaggucuccaaaau

SEQ ID NO: 1102394 - RNA, 16 nt, Homo sapiens
auuagaugaacucaac

SEQ ID NO: 1102395 - RNA, 12 nt, Homo sapiens
auuagcugugau

SEQ ID NO: 1102396 - RNA, 18 nt, Homo sapiens
auuauaaauaaaugccaa

SEQ ID NO: 1102397 - RNA, 12 nt, Homo sapiens
auuauaacuuaa

SEQ ID NO: 1102398 - RNA, 17 nt, Homo sapiens
auuauaauauacuauau

SEQ ID NO: 1102399 - RNA, 20 nt, Homo sapiens
auuauagaguauacuaaaaa

SEQ ID NO: 1102400 - RNA, 19 nt, Homo sapiens
auuauagauuuucauguuc

SEQ ID NO: 1102401 - RNA, 19 nt, Homo sapiens
auuauauacuauguaugga

SEQ ID NO: 1102402 - RNA, 14 nt, Homo sapiens
cacaggcccggcuc

SEQ ID NO: 1102403 - RNA, 16 nt, Homo sapiens
cacauacaauuugcac

SEQ ID NO: 1102404 - RNA, 12 nt, Homo sapiens
cacauacauugc

SEQ ID NO: 1102405 - RNA, 13 nt, Homo sapiens
cacauacuagaaa

SEQ ID NO: 1102406 - RNA, 20 nt, Homo sapiens
cacauacugcaugcucagga

SEQ ID NO: 1102407 - RNA, 19 nt, Homo sapiens
cacauagaagcuguccuug

SEQ ID NO: 1102408 - RNA, 22 nt, Homo sapiens
cacauauggacucugcacauga

SEQ ID NO: 1102409 - RNA, 22 nt, Homo sapiens
cacauccaaccccccaccugcc

SEQ ID NO: 1102410 - RNA, 15 nt, Homo sapiens
cacaucccuuugaaa

SEQ ID NO: 1102411 - RNA, 23 nt, Homo sapiens
cacaugaaucccacccacaugug

SEQ ID NO: 1102412 - RNA, 19 nt, Homo sapiens
cacaugcacgugugugcac

SEQ ID NO: 1102413 - RNA, 16 nt, Homo sapiens
cacaugguuuccaagg

SEQ ID NO: 1102414 - RNA, 20 nt, Homo sapiens
cacaugucuuguacaugugu

SEQ ID NO: 1102415 - RNA, 15 nt, Homo sapiens
cacaugugacacaua

SEQ ID NO: 1102416 - RNA, 17 nt, Homo sapiens
cacaugugacacauaug

SEQ ID NO: 1102417 - RNA, 14 nt, Homo sapiens
cacaugugcacaug

SEQ ID NO: 1102418 - RNA, 16 nt, Homo sapiens
cacauuggcagugugu

SEQ ID NO: 1102419 - RNA, 19 nt, Homo sapiens
cacauuucuccuguuuaca

SEQ ID NO: 1102420 - RNA, 15 nt, Homo sapiens
caccaaaucaucucu

SEQ ID NO: 1102421 - RNA, 16 nt, Homo sapiens
caccaccuucccagcu

SEQ ID NO: 1102422 - RNA, 13 nt, Homo sapiens
caccacgaauuug

SEQ ID NO: 1102423 - RNA, 15 nt, Homo sapiens
caccacuuugucucu

SEQ ID NO: 1102424 - RNA, 18 nt, Homo sapiens
caccagaggcugcagaag

SEQ ID NO: 1102425 - RNA, 14 nt, Homo sapiens
caccagccaucaug

SEQ ID NO: 1102426 - RNA, 15 nt, Homo sapiens
caccagucacugucc

SEQ ID NO: 1102427 - RNA, 18 nt, Homo sapiens
caccauccugcagccucc

SEQ ID NO: 1102428 - RNA, 16 nt, Homo sapiens
caccaugcgcugcuca

SEQ ID NO: 1102429 - RNA, 18 nt, Homo sapiens
caccauguuugagcucag

SEQ ID NO: 1102430 - RNA, 17 nt, Homo sapiens
cacccaugaaucaaaga

SEQ ID NO: 1102431 - RNA, 13 nt, Homo sapiens
cacccaugccaua

SEQ ID NO: 1102432 - RNA, 19 nt, Homo sapiens
cacccaugccauagaaacu

SEQ ID NO: 1102433 - RNA, 17 nt, Homo sapiens
cacccaugcccagcugu

SEQ ID NO: 1102434 - RNA, 14 nt, Homo sapiens
cacccaugugccaa

SEQ ID NO: 1102435 - RNA, 14 nt, Homo sapiens
caccccacggaugu

SEQ ID NO: 1102436 - RNA, 16 nt, Homo sapiens
caccccuuauccagga

SEQ ID NO: 1102437 - RNA, 18 nt, Homo sapiens
cacccgccgccuccugca

SEQ ID NO: 1102438 - RNA, 23 nt, Homo sapiens
cacccuggaaucaagaugucaga

SEQ ID NO: 1102439 - RNA, 19 nt, Homo sapiens
caccuacgcgagucuuacu

SEQ ID NO: 1102440 - RNA, 12 nt, Homo sapiens
caccuagccucg

SEQ ID NO: 1102441 - RNA, 16 nt, Homo sapiens
caccuaugucauuuca

SEQ ID NO: 1102442 - RNA, 20 nt, Homo sapiens
caccucagagacauacaccu

SEQ ID NO: 1102443 - RNA, 20 nt, Homo sapiens
caccucuugggcaugcucag

SEQ ID NO: 1102444 - RNA, 16 nt, Homo sapiens
caccugcuucugaacu

SEQ ID NO: 1102445 - RNA, 17 nt, Homo sapiens
caccugggguauggcau

SEQ ID NO: 1102446 - RNA, 18 nt, Homo sapiens
caccuucaagcacccugu

SEQ ID NO: 1102447 - RNA, 17 nt, Homo sapiens
caccuucaauacuucau

SEQ ID NO: 1102448 - RNA, 13 nt, Homo sapiens
caccuuccaguga

SEQ ID NO: 1102449 - RNA, 14 nt, Homo sapiens
caccuucuucagcc

SEQ ID NO: 1102450 - RNA, 17 nt, Homo sapiens
caccuugccaagcuuuc

SEQ ID NO: 1102451 - RNA, 17 nt, Homo sapiens
caccuugugucuguaca

SEQ ID NO: 1102452 - RNA, 23 nt, Homo sapiens
caccuuugcaaaguuacagaugc

SEQ ID NO: 1102453 - RNA, 16 nt, Homo sapiens
cacgaacccaccugcu

SEQ ID NO: 1102454 - RNA, 16 nt, Homo sapiens
cacgaucguuaugcug

SEQ ID NO: 1102455 - RNA, 13 nt, Homo sapiens
cacgccuguaauc

SEQ ID NO: 1102456 - RNA, 17 nt, Homo sapiens
cacgcuggagugcagug

SEQ ID NO: 1102457 - RNA, 18 nt, Homo sapiens
cacggaucaauagacugu

SEQ ID NO: 1102458 - RNA, 17 nt, Homo sapiens
cacggauccauguagca

SEQ ID NO: 1102459 - RNA, 18 nt, Homo sapiens
cacguacacacacauaca

SEQ ID NO: 1102460 - RNA, 17 nt, Homo sapiens
cacguguguguguuuca

SEQ ID NO: 1102461 - RNA, 17 nt, Homo sapiens
cacuaaggugugcucug

SEQ ID NO: 1102462 - RNA, 19 nt, Homo sapiens
cacuauuuaucugugcaaa

SEQ ID NO: 1102463 - RNA, 13 nt, Homo sapiens
cacucuacccuau

SEQ ID NO: 1102464 - RNA, 19 nt, Homo sapiens
cacucuacccuauacaacu

SEQ ID NO: 1102465 - RNA, 22 nt, Homo sapiens
cacucuuauugcccacgcugga

SEQ ID NO: 1102466 - RNA, 23 nt, Homo sapiens
cacugaaugccucaaugugacca

SEQ ID NO: 1102467 - RNA, 20 nt, Homo sapiens
cacugaggcagguucgugcc

SEQ ID NO: 1102468 - RNA, 13 nt, Homo sapiens
cacugagggccac

SEQ ID NO: 1102469 - RNA, 13 nt, Homo sapiens
cacugcacuccag

SEQ ID NO: 1102470 - RNA, 14 nt, Homo sapiens
cacugcucaagaag

SEQ ID NO: 1102471 - RNA, 17 nt, Homo sapiens
cacuggauauguuguua

SEQ ID NO: 1102472 - RNA, 13 nt, Homo sapiens
cacuggcauuaaa

SEQ ID NO: 1102473 - RNA, 22 nt, Homo sapiens
cacuguaaucuuaaaaguguaa

SEQ ID NO: 1102474 - RNA, 20 nt, Homo sapiens
cacuuaaaaaauguccauga

SEQ ID NO: 1102475 - RNA, 12 nt, Homo sapiens
cacuuaauaauu

SEQ ID NO: 1102476 - RNA, 24 nt, Homo sapiens
cacuucauugaccaagaugaucac

SEQ ID NO: 1102477 - RNA, 12 nt, Homo sapiens
cacuucucagga

SEQ ID NO: 1102478 - RNA, 18 nt, Homo sapiens
cacuugaaugugucacua

SEQ ID NO: 1102479 - RNA, 21 nt, Homo sapiens
cacuugcagacucuacagagg

SEQ ID NO: 1102480 - RNA, 21 nt, Homo sapiens
cacuugugcaguguugacagu

SEQ ID NO: 1102481 - RNA, 20 nt, Homo sapiens
cacuuuaauucucaugugau

SEQ ID NO: 1102482 - RNA, 22 nt, Homo sapiens
cagaaaacauaugcauuaugaa

SEQ ID NO: 1102483 - RNA, 16 nt, Homo sapiens
cagaaaagaaaaccau

SEQ ID NO: 1102484 - RNA, 23 nt, Homo sapiens
cagaaaagugcuuagaaaguuau

SEQ ID NO: 1102485 - RNA, 20 nt, Homo sapiens
cagaaaccaguuaugugaau

SEQ ID NO: 1102486 - RNA, 20 nt, Homo sapiens
cagaaagaaggacacuugua

SEQ ID NO: 1102487 - RNA, 21 nt, Homo sapiens
cagaaagaaggacacuuguau

SEQ ID NO: 1102488 - RNA, 17 nt, Homo sapiens
cagaaagcauccuaaau

SEQ ID NO: 1102489 - RNA, 18 nt, Homo sapiens
cagaaaguggccaugcca

SEQ ID NO: 1102490 - RNA, 22 nt, Homo sapiens
cagaacacugucuugaagacaa

SEQ ID NO: 1102491 - RNA, 14 nt, Homo sapiens
cagaacaguuugua

SEQ ID NO: 1102492 - RNA, 17 nt, Homo sapiens
cagaaccccuacaugaa

SEQ ID NO: 1102493 - RNA, 23 nt, Homo sapiens
cauauucugggcuccuggaacca

SEQ ID NO: 1102494 - RNA, 16 nt, Homo sapiens
cauauucuguuggcca

SEQ ID NO: 1102495 - RNA, 15 nt, Homo sapiens
cauauuggacugaua

SEQ ID NO: 1102496 - RNA, 22 nt, Homo sapiens
cauauuggcaguuggaggacac

SEQ ID NO: 1102497 - RNA, 18 nt, Homo sapiens
cauauuguauguaaguaa

SEQ ID NO: 1102498 - RNA, 23 nt, Homo sapiens
caucaaaucaguccuuugauucc

SEQ ID NO: 1102499 - RNA, 16 nt, Homo sapiens
caucaauuuuuauaca

SEQ ID NO: 1102500 - RNA, 23 nt, Homo sapiens
caucacugaaaugcuagcugcaa

SEQ ID NO: 1102501 - RNA, 19 nt, Homo sapiens
caucagcagagaacuggaa

SEQ ID NO: 1102502 - RNA, 18 nt, Homo sapiens
caucaguuacugguuuca

SEQ ID NO: 1102503 - RNA, 16 nt, Homo sapiens
caucauacaugacuca

SEQ ID NO: 1102504 - RNA, 21 nt, Homo sapiens
caucauucauuuuuguuguug

SEQ ID NO: 1102505 - RNA, 18 nt, Homo sapiens
cauccaaggagaaacaga

SEQ ID NO: 1102506 - RNA, 22 nt, Homo sapiens
cauccaauucuuugaauuuccc

SEQ ID NO: 1102507 - RNA, 15 nt, Homo sapiens
caucccaucaucuug

SEQ ID NO: 1102508 - RNA, 10 nt, Homo sapiens
caucccaugg

SEQ ID NO: 1102509 - RNA, 21 nt, Homo sapiens
caucccugggccugcugcuga

SEQ ID NO: 1102510 - RNA, 17 nt, Homo sapiens
cauccuccacaauagca

SEQ ID NO: 1102511 - RNA, 17 nt, Homo sapiens
caucuaagcugcagcuu

SEQ ID NO: 1102512 - RNA, 20 nt, Homo sapiens
caucuagaggcuuccuucau

SEQ ID NO: 1102513 - RNA, 16 nt, Homo sapiens
caucuccacccugagc

SEQ ID NO: 1102514 - RNA, 14 nt, Homo sapiens
caucucgaccacuu

SEQ ID NO: 1102515 - RNA, 11 nt, Homo sapiens
caucucugucu

SEQ ID NO: 1102516 - RNA, 20 nt, Homo sapiens
caucugacucacaagaagac

SEQ ID NO: 1102517 - RNA, 23 nt, Homo sapiens
caucugucuugccagccagaagc

SEQ ID NO: 1102518 - RNA, 18 nt, Homo sapiens
caucuuccuggaagcaga

SEQ ID NO: 1102519 - RNA, 22 nt, Homo sapiens
caucuucuggagucuccagugg

SEQ ID NO: 1102520 - RNA, 21 nt, Homo sapiens
caucuuucuucuauuuuauuc

SEQ ID NO: 1102521 - RNA, 21 nt, Homo sapiens
caugaaaaauugcuaugacua

SEQ ID NO: 1102522 - RNA, 13 nt, Homo sapiens
caugaaaucugag

SEQ ID NO: 1102523 - RNA, 17 nt, Homo sapiens
caugaacagaaacaaua

SEQ ID NO: 1102524 - RNA, 22 nt, Homo sapiens
caugaacaucuuuaggagacua

SEQ ID NO: 1102525 - RNA, 13 nt, Homo sapiens
caugaagaccaca

SEQ ID NO: 1102526 - RNA, 18 nt, Homo sapiens
caugaagcccaagugaaa

SEQ ID NO: 1102527 - RNA, 21 nt, Homo sapiens
caugaagcccaagugaaauca

SEQ ID NO: 1102528 - RNA, 21 nt, Homo sapiens
caugaaggugucauacagauu

SEQ ID NO: 1102529 - RNA, 20 nt, Homo sapiens
caugaaguguguuuccuuca

SEQ ID NO: 1102530 - RNA, 15 nt, Homo sapiens
caugaaucaaagaca

SEQ ID NO: 1102531 - RNA, 23 nt, Homo sapiens
caugaaucccacccacaugugac

SEQ ID NO: 1102532 - RNA, 16 nt, Homo sapiens
caugacaaaguuacaa

SEQ ID NO: 1102533 - RNA, 13 nt, Homo sapiens
caugaccuggaaa

SEQ ID NO: 1102534 - RNA, 15 nt, Homo sapiens
caugagaauaaagau

SEQ ID NO: 1102535 - RNA, 18 nt, Homo sapiens
caugagaccacuguuauc

SEQ ID NO: 1102536 - RNA, 17 nt, Homo sapiens
caugagguacagcagaa

SEQ ID NO: 1102537 - RNA, 22 nt, Homo sapiens
caugagugauucuugacauuca

SEQ ID NO: 1102538 - RNA, 17 nt, Homo sapiens
caugaguuuaugggaau

SEQ ID NO: 1102539 - RNA, 15 nt, Homo sapiens
caugaugaauuacuu

SEQ ID NO: 1102540 - RNA, 14 nt, Homo sapiens
caugaugagaguuu

SEQ ID NO: 1102541 - RNA, 21 nt, Homo sapiens
caugaugccgcucuucuguca

SEQ ID NO: 1102542 - RNA, 19 nt, Homo sapiens
caugauggagcgcaccugc

SEQ ID NO: 1102543 - RNA, 16 nt, Homo sapiens
caugauuucauuucaa

SEQ ID NO: 1102544 - RNA, 22 nt, Homo sapiens
caugauuucauuucaacuguuu

SEQ ID NO: 1102545 - RNA, 16 nt, Homo sapiens
caugauuuuauacaua

SEQ ID NO: 1102546 - RNA, 16 nt, Homo sapiens
caugcauuacugcaug

SEQ ID NO: 1102547 - RNA, 21 nt, Homo sapiens
caugcauuacugcaugcacuu

SEQ ID NO: 1102548 - RNA, 13 nt, Homo sapiens
caugcccucaauc

SEQ ID NO: 1102549 - RNA, 14 nt, Homo sapiens
caugccucugaggc

SEQ ID NO: 1102550 - RNA, 15 nt, Homo sapiens
caugccugggaaaug

SEQ ID NO: 1102551 - RNA, 14 nt, Homo sapiens
caugcgcugcucaa

SEQ ID NO: 1102552 - RNA, 19 nt, Homo sapiens
caugcucaaccacuguggc

SEQ ID NO: 1102553 - RNA, 21 nt, Homo sapiens
caugcugugugcuggagacac

SEQ ID NO: 1102554 - RNA, 23 nt, Homo sapiens
caugcuuucccaccagcauguca

SEQ ID NO: 1102555 - RNA, 17 nt, Homo sapiens
cauggaaauguccucca

SEQ ID NO: 1102556 - RNA, 22 nt, Homo sapiens
cauggaacucagcugucugugg

SEQ ID NO: 1102557 - RNA, 19 nt, Homo sapiens
cauggaccaagaaugagcu

SEQ ID NO: 1102558 - RNA, 16 nt, Homo sapiens
cauggccuaugcacau

SEQ ID NO: 1102559 - RNA, 19 nt, Homo sapiens
cauggccuaugcacauaug

SEQ ID NO: 1102560 - RNA, 23 nt, Homo sapiens
cauggcugggauuuaaagccuuu

SEQ ID NO: 1102561 - RNA, 19 nt, Homo sapiens
cauggucccacaucccugg

SEQ ID NO: 1102562 - RNA, 13 nt, Homo sapiens
cauguaaccaaga

SEQ ID NO: 1102563 - RNA, 22 nt, Homo sapiens
cauguaaccaagaguauuccau

SEQ ID NO: 1102564 - RNA, 15 nt, Homo sapiens
cauguaccaucaaua

SEQ ID NO: 1102565 - RNA, 17 nt, Homo sapiens
cauguaucuaugcauuu

SEQ ID NO: 1102566 - RNA, 22 nt, Homo sapiens
cauguaugucuuggacacugua

SEQ ID NO: 1102567 - RNA, 15 nt, Homo sapiens
caugugacacauaug

SEQ ID NO: 1102568 - RNA, 18 nt, Homo sapiens
caugugacacauaugcac

SEQ ID NO: 1102569 - RNA, 19 nt, Homo sapiens
caugugacacauaugcacc

SEQ ID NO: 1102570 - RNA, 14 nt, Homo sapiens
caugugcacaugca

SEQ ID NO: 1102571 - RNA, 17 nt, Homo sapiens
caugugcacaugcacgu

SEQ ID NO: 1102572 - RNA, 19 nt, Homo sapiens
cauguggaagcacuuuaag

SEQ ID NO: 1102573 - RNA, 18 nt, Homo sapiens
cauguggcguauugggcc

SEQ ID NO: 1102574 - RNA, 17 nt, Homo sapiens
cauguggcuaaaugccu

SEQ ID NO: 1102575 - RNA, 21 nt, Homo sapiens
cauguugccaugaggccuuuc

SEQ ID NO: 1102576 - RNA, 22 nt, Homo sapiens
cauguugccaugaggccuuucc

SEQ ID NO: 1102577 - RNA, 14 nt, Homo sapiens
cauuaauacaaaga

SEQ ID NO: 1102578 - RNA, 15 nt, Homo sapiens
cauuacugcaugcac

SEQ ID NO: 1102579 - RNA, 17 nt, Homo sapiens
cauuacuugcacaagcu

SEQ ID NO: 1102580 - RNA, 13 nt, Homo sapiens
cauuagagucagc

SEQ ID NO: 1102581 - RNA, 17 nt, Homo sapiens
cauuauuucaaccgcuu

SEQ ID NO: 1102582 - RNA, 23 nt, Homo sapiens
cauuauuucaaccgcuugccaua

SEQ ID NO: 1102583 - RNA, 22 nt, Homo sapiens
gaaccugcuaaggcugccucag

SEQ ID NO: 1102584 - RNA, 21 nt, Homo sapiens
gaacuacaaagcuucuauccc

SEQ ID NO: 1102585 - RNA, 20 nt, Homo sapiens
gaacuagaagaaagggcaag

SEQ ID NO: 1102586 - RNA, 14 nt, Homo sapiens
gaacuauguacuuu

SEQ ID NO: 1102587 - RNA, 18 nt, Homo sapiens
gaacuauuuauuucaccc

SEQ ID NO: 1102588 - RNA, 21 nt, Homo sapiens
gaacucaaggaaaucuguguc

SEQ ID NO: 1102589 - RNA, 22 nt, Homo sapiens
gaacugaauaaacaggaaaaug

SEQ ID NO: 1102590 - RNA, 16 nt, Homo sapiens
gaacuggguacuugug

SEQ ID NO: 1102591 - RNA, 12 nt, Homo sapiens
gaacugugacag

SEQ ID NO: 1102592 - RNA, 17 nt, Homo sapiens
gaacuugaacugauuca

SEQ ID NO: 1102593 - RNA, 19 nt, Homo sapiens
gaagaaauuccaggaaaau

SEQ ID NO: 1102594 - RNA, 17 nt, Homo sapiens
gaagaacaaaucugggc

SEQ ID NO: 1102595 - RNA, 20 nt, Homo sapiens
gaagaacaguaacugccauc

SEQ ID NO: 1102596 - RNA, 12 nt, Homo sapiens
gaagaacugacu

SEQ ID NO: 1102597 - RNA, 12 nt, Homo sapiens
gaagaagcuaaa

SEQ ID NO: 1102598 - RNA, 23 nt, Homo sapiens
gaagacccaguguaaagaauaaa

SEQ ID NO: 1102599 - RNA, 21 nt, Homo sapiens
gaagaccuucugaagaucuca

SEQ ID NO: 1102600 - RNA, 19 nt, Homo sapiens
gaagacuauauuguacaca

SEQ ID NO: 1102601 - RNA, 12 nt, Homo sapiens
gaagacuggaag

SEQ ID NO: 1102602 - RNA, 18 nt, Homo sapiens
gaagagauuucaacauau

SEQ ID NO: 1102603 - RNA, 11 nt, Homo sapiens
gaagagcauug

SEQ ID NO: 1102604 - RNA, 17 nt, Homo sapiens
gaagauggaaaaaguau

SEQ ID NO: 1102605 - RNA, 20 nt, Homo sapiens
gaagauggauguuugucaaa

SEQ ID NO: 1102606 - RNA, 21 nt, Homo sapiens
gaagauggauguuugucaaaa

SEQ ID NO: 1102607 - RNA, 24 nt, Homo sapiens
gaagauuuuaugcugcuguuuaca

SEQ ID NO: 1102608 - RNA, 13 nt, Homo sapiens
gaagcacugcugu

SEQ ID NO: 1102609 - RNA, 19 nt, Homo sapiens
gaagcagugccuuccauaa

SEQ ID NO: 1102610 - RNA, 20 nt, Homo sapiens
gaagccacugaagcugggau

SEQ ID NO: 1102611 - RNA, 22 nt, Homo sapiens
gaagcuauugauguuuccagaa

SEQ ID NO: 1102612 - RNA, 23 nt, Homo sapiens
gaagcuguccuugagcuguccua

SEQ ID NO: 1102613 - RNA, 14 nt, Homo sapiens
gaaggacauuuucu

SEQ ID NO: 1102614 - RNA, 12 nt, Homo sapiens
gaaggagaaaau

SEQ ID NO: 1102615 - RNA, 16 nt, Homo sapiens
gaaggagaucagggca

SEQ ID NO: 1102616 - RNA, 15 nt, Homo sapiens
gaagggaaagccaga

SEQ ID NO: 1102617 - RNA, 20 nt, Homo sapiens
gaagggggcggccuaugacu

SEQ ID NO: 1102618 - RNA, 22 nt, Homo sapiens
gaagguagcccagcacugugaa

SEQ ID NO: 1102619 - RNA, 21 nt, Homo sapiens
gaaggucuugccugaauccau

SEQ ID NO: 1102620 - RNA, 17 nt, Homo sapiens
gaaggugcugacaaaga

SEQ ID NO: 1102621 - RNA, 13 nt, Homo sapiens
gaagguugcucua

SEQ ID NO: 1102622 - RNA, 19 nt, Homo sapiens
gaagguuuguauauuguca

SEQ ID NO: 1102623 - RNA, 14 nt, Homo sapiens
gaaguaaaagcaaa

SEQ ID NO: 1102624 - RNA, 16 nt, Homo sapiens
gaaguauaaagugauc

SEQ ID NO: 1102625 - RNA, 19 nt, Homo sapiens
gaagucacacaguauuacu

SEQ ID NO: 1102626 - RNA, 21 nt, Homo sapiens
gaagucaucuuagcuuuccac

SEQ ID NO: 1102627 - RNA, 13 nt, Homo sapiens
gaagucucuucca

SEQ ID NO: 1102628 - RNA, 12 nt, Homo sapiens
gaagucuuccau

SEQ ID NO: 1102629 - RNA, 16 nt, Homo sapiens
gaaguuccaguguucu

SEQ ID NO: 1102630 - RNA, 17 nt, Homo sapiens
gaaguucuuuuacugua

SEQ ID NO: 1102631 - RNA, 20 nt, Homo sapiens
gaaguugcagugagcugaua

SEQ ID NO: 1102632 - RNA, 11 nt, Homo sapiens
gaaguuucauc

SEQ ID NO: 1102633 - RNA, 16 nt, Homo sapiens
gaauaaagcccuugaa

SEQ ID NO: 1102634 - RNA, 18 nt, Homo sapiens
gaauaaauaaauguaucu

SEQ ID NO: 1102635 - RNA, 17 nt, Homo sapiens
gaauaaaugaaucuuac

SEQ ID NO: 1102636 - RNA, 15 nt, Homo sapiens
gaauaaccacuuaaa

SEQ ID NO: 1102637 - RNA, 13 nt, Homo sapiens
gaauaagaagcaa

SEQ ID NO: 1102638 - RNA, 12 nt, Homo sapiens
gaauaaggccuu

SEQ ID NO: 1102639 - RNA, 15 nt, Homo sapiens
gaauaauuguguaca

SEQ ID NO: 1102640 - RNA, 18 nt, Homo sapiens
gaauacccuuuucugacc

SEQ ID NO: 1102641 - RNA, 17 nt, Homo sapiens
gaauauaaacacuauau

SEQ ID NO: 1102642 - RNA, 20 nt, Homo sapiens
gaauaucauuaaauuggaau

SEQ ID NO: 1102643 - RNA, 19 nt, Homo sapiens
gaauauggugggcacagaa

SEQ ID NO: 1102644 - RNA, 15 nt, Homo sapiens
gaaucacuugaacuc

SEQ ID NO: 1102645 - RNA, 15 nt, Homo sapiens
gaaucacuugcacuc

SEQ ID NO: 1102646 - RNA, 12 nt, Homo sapiens
gaaucagacuca

SEQ ID NO: 1102647 - RNA, 18 nt, Homo sapiens
gaaucagacuucacacug

SEQ ID NO: 1102648 - RNA, 18 nt, Homo sapiens
gaaucauuaauacaaaga

SEQ ID NO: 1102649 - RNA, 20 nt, Homo sapiens
gaauccaaagaucacauauu

SEQ ID NO: 1102650 - RNA, 12 nt, Homo sapiens
gaauccaugcuu

SEQ ID NO: 1102651 - RNA, 17 nt, Homo sapiens
gaaucgcuuaaaccugg

SEQ ID NO: 1102652 - RNA, 14 nt, Homo sapiens
gaaucuuacuccuu

SEQ ID NO: 1102653 - RNA, 17 nt, Homo sapiens
gaaugacucugacuuug

SEQ ID NO: 1102654 - RNA, 17 nt, Homo sapiens
gaaugaggcaauuucaa

SEQ ID NO: 1102655 - RNA, 21 nt, Homo sapiens
gaaugauucccucuugcuauu

SEQ ID NO: 1102656 - RNA, 22 nt, Homo sapiens
gaaugauuuagguacgucaaag

SEQ ID NO: 1102657 - RNA, 24 nt, Homo sapiens
gaaugcacacuagccucuccagga

SEQ ID NO: 1102658 - RNA, 20 nt, Homo sapiens
gaauguauugaacuuggaaa

SEQ ID NO: 1102659 - RNA, 17 nt, Homo sapiens
gaaugugauauuugaag

SEQ ID NO: 1102660 - RNA, 17 nt, Homo sapiens
gaauguuuacacucuuu

SEQ ID NO: 1102661 - RNA, 19 nt, Homo sapiens
gaauucuaagcuggugccc

SEQ ID NO: 1102662 - RNA, 22 nt, Homo sapiens
gaauucugcuaccucacugggg

SEQ ID NO: 1102663 - RNA, 13 nt, Homo sapiens
gaauucuugaguu

SEQ ID NO: 1102664 - RNA, 23 nt, Homo sapiens
gaauuguuuccuuauuugcacuu

SEQ ID NO: 1102665 - RNA, 14 nt, Homo sapiens
gaauuuacuacuuu

SEQ ID NO: 1102666 - RNA, 17 nt, Homo sapiens
gaauuuauucaauuccu

SEQ ID NO: 1102667 - RNA, 20 nt, Homo sapiens
gaauuucuaaaaaacagagg

SEQ ID NO: 1102668 - RNA, 16 nt, Homo sapiens
gaauuugccuguaaca

SEQ ID NO: 1102669 - RNA, 14 nt, Homo sapiens
gacaaaccagagca

SEQ ID NO: 1102670 - RNA, 17 nt, Homo sapiens
gacaaagaaacccaagu

SEQ ID NO: 1102671 - RNA, 12 nt, Homo sapiens
gacaacauuucu

SEQ ID NO: 1102672 - RNA, 18 nt, Homo sapiens
gacaacauuucuauagcc

SEQ ID NO: 1102673 - RNA, 21 nt, Homo sapiens
gacacagcucuucuccaggcu

SEQ ID NO: 1102674 - RNA, 17 nt, Homo sapiens
gcacugaggaccagcca

SEQ ID NO: 1102675 - RNA, 14 nt, Homo sapiens
gcacugagggccac

SEQ ID NO: 1102676 - RNA, 21 nt, Homo sapiens
gcacuugaacauuuuaauauu

SEQ ID NO: 1102677 - RNA, 18 nt, Homo sapiens
gcacuuuacagaugagau

SEQ ID NO: 1102678 - RNA, 15 nt, Homo sapiens
gcagaaaaacucugg

SEQ ID NO: 1102679 - RNA, 12 nt, Homo sapiens
gcagaaagccag

SEQ ID NO: 1102680 - RNA, 13 nt, Homo sapiens
gcagaaccaaagc

SEQ ID NO: 1102681 - RNA, 21 nt, Homo sapiens
gcagaagaauugaacccagga

SEQ ID NO: 1102682 - RNA, 21 nt, Homo sapiens
gcagacucuacagaggccaug

SEQ ID NO: 1102683 - RNA, 23 nt, Homo sapiens
gcagagaccuugcgaccaugugu

SEQ ID NO: 1102684 - RNA, 19 nt, Homo sapiens
gcagagguaaaagugugag

SEQ ID NO: 1102685 - RNA, 18 nt, Homo sapiens
gcagagugauucaggggc

SEQ ID NO: 1102686 - RNA, 19 nt, Homo sapiens
gcagauacaggaaaagcug

SEQ ID NO: 1102687 - RNA, 23 nt, Homo sapiens
gcagaucuuuuugugaaauucaa

SEQ ID NO: 1102688 - RNA, 9 nt, Homo sapiens
gcagcacuu

SEQ ID NO: 1102689 - RNA, 22 nt, Homo sapiens
gcagcacuuuaacccucucuuc

SEQ ID NO: 1102690 - RNA, 20 nt, Homo sapiens
gcagcccggcgccaccaucc

SEQ ID NO: 1102691 - RNA, 18 nt, Homo sapiens
gcagcucaggcacacuuc

SEQ ID NO: 1102692 - RNA, 23 nt, Homo sapiens
gcaggacacaagcacaguuuuaa

SEQ ID NO: 1102693 - RNA, 22 nt, Homo sapiens
gcaggaggcuagcaaagcuuaa

SEQ ID NO: 1102694 - RNA, 20 nt, Homo sapiens
gcaggaguagcugagcucac

SEQ ID NO: 1102695 - RNA, 16 nt, Homo sapiens
gcagggacugccaguc

SEQ ID NO: 1102696 - RNA, 18 nt, Homo sapiens
gcagguagugggugaaug

SEQ ID NO: 1102697 - RNA, 21 nt, Homo sapiens
gcagguuaacagcugucuaug

SEQ ID NO: 1102698 - RNA, 16 nt, Homo sapiens
gcagguucgugcccug

SEQ ID NO: 1102699 - RNA, 17 nt, Homo sapiens
gcaguacuuuaccuccu

SEQ ID NO: 1102700 - RNA, 16 nt, Homo sapiens
gcaguauggccauggg

SEQ ID NO: 1102701 - RNA, 20 nt, Homo sapiens
gcagucacacuguuacucca

SEQ ID NO: 1102702 - RNA, 18 nt, Homo sapiens
gcagugugucacacugag

SEQ ID NO: 1102703 - RNA, 14 nt, Homo sapiens
gcaguuggcagaaa

SEQ ID NO: 1102704 - RNA, 19 nt, Homo sapiens
gcauaagaaaacuaagaaa

SEQ ID NO: 1102705 - RNA, 20 nt, Homo sapiens
gcauaguucccauguuaaau

SEQ ID NO: 1102706 - RNA, 13 nt, Homo sapiens
gcauaugucuaua

SEQ ID NO: 1102707 - RNA, 15 nt, Homo sapiens
gcaucaaauauuugu

SEQ ID NO: 1102708 - RNA, 22 nt, Homo sapiens
gcauccaucugggcuaccccac

SEQ ID NO: 1102709 - RNA, 19 nt, Homo sapiens
gcaucccaugggggugcug

SEQ ID NO: 1102710 - RNA, 20 nt, Homo sapiens
gcauccuggccaacauggug

SEQ ID NO: 1102711 - RNA, 12 nt, Homo sapiens
gcaucucaaaaa

SEQ ID NO: 1102712 - RNA, 13 nt, Homo sapiens
gcaucucagccua

SEQ ID NO: 1102713 - RNA, 14 nt, Homo sapiens
gcaucucuguguac

SEQ ID NO: 1102714 - RNA, 17 nt, Homo sapiens
gcaucucuguguaccca

SEQ ID NO: 1102715 - RNA, 18 nt, Homo sapiens
gcaugagaaucacuugaa

SEQ ID NO: 1102716 - RNA, 20 nt, Homo sapiens
gcaugagagaauuguaucau

SEQ ID NO: 1102717 - RNA, 14 nt, Homo sapiens
gcaugccagagccu

SEQ ID NO: 1102718 - RNA, 20 nt, Homo sapiens
gcaugcuuaaauauugaaua

SEQ ID NO: 1102719 - RNA, 15 nt, Homo sapiens
gcauggaacagugca

SEQ ID NO: 1102720 - RNA, 21 nt, Homo sapiens
gcauggacaccccuuauccag

SEQ ID NO: 1102721 - RNA, 14 nt, Homo sapiens
gcauggugcaguug

SEQ ID NO: 1102722 - RNA, 14 nt, Homo sapiens
gcaugucacuccca

SEQ ID NO: 1102723 - RNA, 22 nt, Homo sapiens
gcauguuuugcccaccagauca

SEQ ID NO: 1102724 - RNA, 14 nt, Homo sapiens
gcauuaaaaaugca

SEQ ID NO: 1102725 - RNA, 14 nt, Homo sapiens
gcauucacaucuca

SEQ ID NO: 1102726 - RNA, 12 nt, Homo sapiens
gcauuucuuauu

SEQ ID NO: 1102727 - RNA, 16 nt, Homo sapiens
gccaaaauauugcuua

SEQ ID NO: 1102728 - RNA, 17 nt, Homo sapiens
gccaaacccaugaggca

SEQ ID NO: 1102729 - RNA, 18 nt, Homo sapiens
gccaagaaguugcucuga

SEQ ID NO: 1102730 - RNA, 18 nt, Homo sapiens
gccaagaaucaagcuaga

SEQ ID NO: 1102731 - RNA, 18 nt, Homo sapiens
gccaaggaugacacugcc

SEQ ID NO: 1102732 - RNA, 14 nt, Homo sapiens
gccaauuagcaauu

SEQ ID NO: 1102733 - RNA, 21 nt, Homo sapiens
gccacagaccuaggauuucau

SEQ ID NO: 1102734 - RNA, 21 nt, Homo sapiens
gccacaucugugucucuggaa

SEQ ID NO: 1102735 - RNA, 17 nt, Homo sapiens
gccaccagucacugucc

SEQ ID NO: 1102736 - RNA, 21 nt, Homo sapiens
gccacgaggagcuuccagugc

SEQ ID NO: 1102737 - RNA, 18 nt, Homo sapiens
gccacugguuucucagaa

SEQ ID NO: 1102738 - RNA, 17 nt, Homo sapiens
gccagcaaugaugucca

SEQ ID NO: 1102739 - RNA, 23 nt, Homo sapiens
gccaggccagagggagugacaga

SEQ ID NO: 1102740 - RNA, 18 nt, Homo sapiens
gccagggcccugcagagg

SEQ ID NO: 1102741 - RNA, 14 nt, Homo sapiens
gccagggucucacu

SEQ ID NO: 1102742 - RNA, 23 nt, Homo sapiens
gccaguguuuagaagagccugac

SEQ ID NO: 1102743 - RNA, 14 nt, Homo sapiens
gccauacuuuacaa

SEQ ID NO: 1102744 - RNA, 22 nt, Homo sapiens
gccaucagggugggccacucuc

SEQ ID NO: 1102745 - RNA, 18 nt, Homo sapiens
gccaugggccuccugugu

SEQ ID NO: 1102746 - RNA, 11 nt, Homo sapiens
gccauucugau

SEQ ID NO: 1102747 - RNA, 13 nt, Homo sapiens
gcccacaucccag

SEQ ID NO: 1102748 - RNA, 23 nt, Homo sapiens
gcccacguggaggcccaccugcc

SEQ ID NO: 1102749 - RNA, 14 nt, Homo sapiens
gcccagaauugcau

SEQ ID NO: 1102750 - RNA, 20 nt, Homo sapiens
gcccagcagggccucaaagu

SEQ ID NO: 1102751 - RNA, 13 nt, Homo sapiens
gcccagcccagcu

SEQ ID NO: 1102752 - RNA, 15 nt, Homo sapiens
gcccagcugcaccug

SEQ ID NO: 1102753 - RNA, 19 nt, Homo sapiens
gcccaggcuggagugcagu

SEQ ID NO: 1102754 - RNA, 16 nt, Homo sapiens
gcccagggaagccaaa

SEQ ID NO: 1102755 - RNA, 20 nt, Homo sapiens
gcccagggaagccaaaagau

SEQ ID NO: 1102756 - RNA, 22 nt, Homo sapiens
gcccauggcuuuagcuaccuca

SEQ ID NO: 1102757 - RNA, 23 nt, Homo sapiens
gcccauggcuuuagcuaccucac

SEQ ID NO: 1102758 - RNA, 22 nt, Homo sapiens
gcccauuggcucccaucugaac

SEQ ID NO: 1102759 - RNA, 23 nt, Homo sapiens
gccccagcacuaaagcaguggac

SEQ ID NO: 1102760 - RNA, 18 nt, Homo sapiens
gcccccccagcugucauc

SEQ ID NO: 1102761 - RNA, 13 nt, Homo sapiens
gccccgacuccag

SEQ ID NO: 1102762 - RNA, 14 nt, Homo sapiens
gccccucaccugcc

SEQ ID NO: 1102763 - RNA, 13 nt, Homo sapiens
gccccucauuuau

SEQ ID NO: 1102764 - RNA, 15 nt, Homo sapiens
gggaguguugucaca

SEQ ID NO: 1102765 - RNA, 17 nt, Homo sapiens
gggauccguacauucaa

SEQ ID NO: 1102766 - RNA, 23 nt, Homo sapiens
gggaucuuccuugggaugaucuu

SEQ ID NO: 1102767 - RNA, 17 nt, Homo sapiens
gggauguuucugucaca

SEQ ID NO: 1102768 - RNA, 12 nt, Homo sapiens
gggcaacaaagu

SEQ ID NO: 1102769 - RNA, 17 nt, Homo sapiens
gggcaacgacgguuuca

SEQ ID NO: 1102770 - RNA, 18 nt, Homo sapiens
gggcagacaccugugcac

SEQ ID NO: 1102771 - RNA, 17 nt, Homo sapiens
gggcagcauagcaagac

SEQ ID NO: 1102772 - RNA, 16 nt, Homo sapiens
gggcagcccagccucu

SEQ ID NO: 1102773 - RNA, 11 nt, Homo sapiens
gggccaucuca

SEQ ID NO: 1102774 - RNA, 21 nt, Homo sapiens
gggcccacagggaacccugcu

SEQ ID NO: 1102775 - RNA, 13 nt, Homo sapiens
gggccccagagag

SEQ ID NO: 1102776 - RNA, 15 nt, Homo sapiens
gggcccugcacagau

SEQ ID NO: 1102777 - RNA, 20 nt, Homo sapiens
gggccgcuguguuuggagac

SEQ ID NO: 1102778 - RNA, 14 nt, Homo sapiens
gggccugcugcuga

SEQ ID NO: 1102779 - RNA, 19 nt, Homo sapiens
gggcucagcagccagagga

SEQ ID NO: 1102780 - RNA, 14 nt, Homo sapiens
gggcugcccugcca

SEQ ID NO: 1102781 - RNA, 19 nt, Homo sapiens
gggcugugucguagccaag

SEQ ID NO: 1102782 - RNA, 14 nt, Homo sapiens
ggggaaugaucucu

SEQ ID NO: 1102783 - RNA, 12 nt, Homo sapiens
ggggaugugcac

SEQ ID NO: 1102784 - RNA, 13 nt, Homo sapiens
ggggcaucccaga

SEQ ID NO: 1102785 - RNA, 19 nt, Homo sapiens
ggggccucuuucugugcuu

SEQ ID NO: 1102786 - RNA, 23 nt, Homo sapiens
gggguccuguuaacgucaucuca

SEQ ID NO: 1102787 - RNA, 19 nt, Homo sapiens
ggguaaccaaauguuggcc

SEQ ID NO: 1102788 - RNA, 14 nt, Homo sapiens
gggugccccacuaa

SEQ ID NO: 1102789 - RNA, 11 nt, Homo sapiens
gggugccugua

SEQ ID NO: 1102790 - RNA, 16 nt, Homo sapiens
gggugcgguggcucac

SEQ ID NO: 1102791 - RNA, 11 nt, Homo sapiens
gggugggagag

SEQ ID NO: 1102792 - RNA, 19 nt, Homo sapiens
ggguggucugagcaccccc

SEQ ID NO: 1102793 - RNA, 12 nt, Homo sapiens
gggugugucucu

SEQ ID NO: 1102794 - RNA, 18 nt, Homo sapiens
ggguuagcucacgugucu

SEQ ID NO: 1102795 - RNA, 15 nt, Homo sapiens
gguaaaaguuacuua

SEQ ID NO: 1102796 - RNA, 23 nt, Homo sapiens
gguaacuuuuuuuuaaagcucau

SEQ ID NO: 1102797 - RNA, 20 nt, Homo sapiens
gguaauauaaaguguaauag

SEQ ID NO: 1102798 - RNA, 14 nt, Homo sapiens
gguacauauuucuu

SEQ ID NO: 1102799 - RNA, 20 nt, Homo sapiens
gguagaaaaggcuagguaca

SEQ ID NO: 1102800 - RNA, 19 nt, Homo sapiens
gguaguacuccugcaaaau

SEQ ID NO: 1102801 - RNA, 12 nt, Homo sapiens
gguaguggguga

SEQ ID NO: 1102802 - RNA, 17 nt, Homo sapiens
ggucacauugugccuuu

SEQ ID NO: 1102803 - RNA, 18 nt, Homo sapiens
gguccacccagcaaagag

SEQ ID NO: 1102804 - RNA, 22 nt, Homo sapiens
gguccagcuugcucuucagugg

SEQ ID NO: 1102805 - RNA, 19 nt, Homo sapiens
ggucccaggcagagaauca

SEQ ID NO: 1102806 - RNA, 21 nt, Homo sapiens
gguccucuacuuaaugagaua

SEQ ID NO: 1102807 - RNA, 15 nt, Homo sapiens
gguccugagcacugc

SEQ ID NO: 1102808 - RNA, 18 nt, Homo sapiens
gguccugaguggcugaaa

SEQ ID NO: 1102809 - RNA, 13 nt, Homo sapiens
gguccugcauuuc

SEQ ID NO: 1102810 - RNA, 21 nt, Homo sapiens
ggucucuggcccuucuugccu

SEQ ID NO: 1102811 - RNA, 15 nt, Homo sapiens
ggugcagaggugagc

SEQ ID NO: 1102812 - RNA, 22 nt, Homo sapiens
ggugcgaucuuggcucacugca

SEQ ID NO: 1102813 - RNA, 16 nt, Homo sapiens
gguggcucuccaguua

SEQ ID NO: 1102814 - RNA, 19 nt, Homo sapiens
ggugggccuccucugucca

SEQ ID NO: 1102815 - RNA, 13 nt, Homo sapiens
ggugucacugggc

SEQ ID NO: 1102816 - RNA, 22 nt, Homo sapiens
ggugucauacagauuugcaaag

SEQ ID NO: 1102817 - RNA, 18 nt, Homo sapiens
ggugucuggaaaagcacu

SEQ ID NO: 1102818 - RNA, 20 nt, Homo sapiens
ggugugaaccaccacaccca

SEQ ID NO: 1102819 - RNA, 22 nt, Homo sapiens
ggugugcaaacuuguaucugaa

SEQ ID NO: 1102820 - RNA, 13 nt, Homo sapiens
gguguugacaugu

SEQ ID NO: 1102821 - RNA, 14 nt, Homo sapiens
gguuaaauuugaau

SEQ ID NO: 1102822 - RNA, 12 nt, Homo sapiens
gguuaucaacca

SEQ ID NO: 1102823 - RNA, 19 nt, Homo sapiens
gguucagcuaagcuaggaa

SEQ ID NO: 1102824 - RNA, 22 nt, Homo sapiens
gguucccaauaaaagugacucu

SEQ ID NO: 1102825 - RNA, 19 nt, Homo sapiens
gguuccugagcucacugaa

SEQ ID NO: 1102826 - RNA, 12 nt, Homo sapiens
gguuuacugcug

SEQ ID NO: 1102827 - RNA, 13 nt, Homo sapiens
gguuuuuucacau

SEQ ID NO: 1102828 - RNA, 14 nt, Homo sapiens
guaaaaacuuguac

SEQ ID NO: 1102829 - RNA, 17 nt, Homo sapiens
guaaaacuauauucuca

SEQ ID NO: 1102830 - RNA, 23 nt, Homo sapiens
guaaaacuauauucucaguguag

SEQ ID NO: 1102831 - RNA, 21 nt, Homo sapiens
guaaaauagaauguuacuuug

SEQ ID NO: 1102832 - RNA, 11 nt, Homo sapiens
guaaaugugau

SEQ ID NO: 1102833 - RNA, 15 nt, Homo sapiens
guaaauucaaccacu

SEQ ID NO: 1102834 - RNA, 18 nt, Homo sapiens
guaacaugcaauuuugca

SEQ ID NO: 1102835 - RNA, 16 nt, Homo sapiens
guaaccaaauguuggc

SEQ ID NO: 1102836 - RNA, 16 nt, Homo sapiens
guaacucaucugucac

SEQ ID NO: 1102837 - RNA, 23 nt, Homo sapiens
guaacugcacacaugguuuccaa

SEQ ID NO: 1102838 - RNA, 19 nt, Homo sapiens
guaagcugcucuauuguag

SEQ ID NO: 1102839 - RNA, 21 nt, Homo sapiens
guaagguaauuucuguguauu

SEQ ID NO: 1102840 - RNA, 21 nt, Homo sapiens
guaauaccuuaguuuuuucca

SEQ ID NO: 1102841 - RNA, 20 nt, Homo sapiens
guaaucccagcuacuuggga

SEQ ID NO: 1102842 - RNA, 15 nt, Homo sapiens
guaaugucaccaccu

SEQ ID NO: 1102843 - RNA, 23 nt, Homo sapiens
guaauucuaaaugaauguuuaca

SEQ ID NO: 1102844 - RNA, 18 nt, Homo sapiens
guaauuugauacugaccu

SEQ ID NO: 1102845 - RNA, 19 nt, Homo sapiens
guaauuugauacugaccuu

SEQ ID NO: 1102846 - RNA, 12 nt, Homo sapiens
guacaaucucaa

SEQ ID NO: 1102847 - RNA, 17 nt, Homo sapiens
guacagaauucugcuac

SEQ ID NO: 1102848 - RNA, 22 nt, Homo sapiens
guacagaauuuuuaaugacuuu

SEQ ID NO: 1102849 - RNA, 18 nt, Homo sapiens
guaccuugaacacugggg

SEQ ID NO: 1102850 - RNA, 24 nt, Homo sapiens
guacuaagcaguaagcuaucuuca

SEQ ID NO: 1102851 - RNA, 21 nt, Homo sapiens
guacuacugcugcaaagugca

SEQ ID NO: 1102852 - RNA, 16 nt, Homo sapiens
guacuagcaguguuuc

SEQ ID NO: 1102853 - RNA, 20 nt, Homo sapiens
guacuauuauccccauuucu

SEQ ID NO: 1102854 - RNA, 16 nt, Homo sapiens
guacucagcgaaugaa

SEQ ID NO: 1102855 - RNA, 16 nt, Homo sapiens
uaagaaaauacauaag

SEQ ID NO: 1102856 - RNA, 22 nt, Homo sapiens
uaagaagaaauacccacuaaca

SEQ ID NO: 1102857 - RNA, 12 nt, Homo sapiens
uaagaagcucug

SEQ ID NO: 1102858 - RNA, 16 nt, Homo sapiens
uaagaggcgacuuccu

SEQ ID NO: 1102859 - RNA, 19 nt, Homo sapiens
uaagagugccguaacaacu

SEQ ID NO: 1102860 - RNA, 15 nt, Homo sapiens
uaagauuagaaugaa

SEQ ID NO: 1102861 - RNA, 15 nt, Homo sapiens
uaagcagaagcacau

SEQ ID NO: 1102862 - RNA, 19 nt, Homo sapiens
uaagcagaagcacauauga

SEQ ID NO: 1102863 - RNA, 22 nt, Homo sapiens
uaagccacauggcugggauuua

SEQ ID NO: 1102864 - RNA, 16 nt, Homo sapiens
uaagcuaggaaugaaa

SEQ ID NO: 1102865 - RNA, 12 nt, Homo sapiens
uaagcucuggcu

SEQ ID NO: 1102866 - RNA, 12 nt, Homo sapiens
uaagcugggaua

SEQ ID NO: 1102867 - RNA, 12 nt, Homo sapiens
uaaguauuucca

SEQ ID NO: 1102868 - RNA, 14 nt, Homo sapiens
uaaguucuauugaa

SEQ ID NO: 1102869 - RNA, 14 nt, Homo sapiens
uaaguuuaucuuuc

SEQ ID NO: 1102870 - RNA, 14 nt, Homo sapiens
uaaguuucugggac

SEQ ID NO: 1102871 - RNA, 15 nt, Homo sapiens
uaauaaacucucuag

SEQ ID NO: 1102872 - RNA, 15 nt, Homo sapiens
uaauacagggcauuu

SEQ ID NO: 1102873 - RNA, 22 nt, Homo sapiens
uaauaccuuaguuuuuuccaca

SEQ ID NO: 1102874 - RNA, 18 nt, Homo sapiens
uaauacuccuaagacuua

SEQ ID NO: 1102875 - RNA, 17 nt, Homo sapiens
uaauauaaaguguaaua

SEQ ID NO: 1102876 - RNA, 15 nt, Homo sapiens
uaauauaugcucaac

SEQ ID NO: 1102877 - RNA, 21 nt, Homo sapiens
uaauauccuaaacaucauuca

SEQ ID NO: 1102878 - RNA, 12 nt, Homo sapiens
uaauaucuguga

SEQ ID NO: 1102879 - RNA, 19 nt, Homo sapiens
uaauauggggaugcagcau

SEQ ID NO: 1102880 - RNA, 16 nt, Homo sapiens
uaauaugguaaugcac

SEQ ID NO: 1102881 - RNA, 21 nt, Homo sapiens
uaaucaaaacccaacaugacu

SEQ ID NO: 1102882 - RNA, 20 nt, Homo sapiens
uaaucuuugaaagcugaaua

SEQ ID NO: 1102883 - RNA, 18 nt, Homo sapiens
uaaugaacagaacauaga

SEQ ID NO: 1102884 - RNA, 19 nt, Homo sapiens
uaaugaaguuaagaaccug

SEQ ID NO: 1102885 - RNA, 15 nt, Homo sapiens
uaaugauagcuacug

SEQ ID NO: 1102886 - RNA, 17 nt, Homo sapiens
uaaugcuguugccucau

SEQ ID NO: 1102887 - RNA, 16 nt, Homo sapiens
uaaugguugacugggu

SEQ ID NO: 1102888 - RNA, 17 nt, Homo sapiens
uaauguauacacaugga

SEQ ID NO: 1102889 - RNA, 23 nt, Homo sapiens
uaaugugaaguagaauccuaaau

SEQ ID NO: 1102890 - RNA, 20 nt, Homo sapiens
uaauuaaacaagugcacuug

SEQ ID NO: 1102891 - RNA, 15 nt, Homo sapiens
uaauuaagggaaucc

SEQ ID NO: 1102892 - RNA, 14 nt, Homo sapiens
uaauugauuucaag

SEQ ID NO: 1102893 - RNA, 14 nt, Homo sapiens
uaauugcauauaaa

SEQ ID NO: 1102894 - RNA, 23 nt, Homo sapiens
uaauuggcaugaaggugucauac

SEQ ID NO: 1102895 - RNA, 15 nt, Homo sapiens
uaauuuaguuucaua

SEQ ID NO: 1102896 - RNA, 17 nt, Homo sapiens
uaauuucaggaauugaa

SEQ ID NO: 1102897 - RNA, 16 nt, Homo sapiens
uaauuugaauggugca

SEQ ID NO: 1102898 - RNA, 20 nt, Homo sapiens
uacaaaaauaguagaacaag

SEQ ID NO: 1102899 - RNA, 16 nt, Homo sapiens
uacaaaaaugagcuag

SEQ ID NO: 1102900 - RNA, 20 nt, Homo sapiens
uacaaaaaugagcuaggcau

SEQ ID NO: 1102901 - RNA, 18 nt, Homo sapiens
uacaaaguagagaaguau

SEQ ID NO: 1102902 - RNA, 21 nt, Homo sapiens
uacaacuuccacuccaaguga

SEQ ID NO: 1102903 - RNA, 14 nt, Homo sapiens
uacaagaaccugcu

SEQ ID NO: 1102904 - RNA, 15 nt, Homo sapiens
uacaagagccaugua

SEQ ID NO: 1102905 - RNA, 19 nt, Homo sapiens
uacaauaauucuaugagau

SEQ ID NO: 1102906 - RNA, 22 nt, Homo sapiens
uacaauuauggaaauauaguuc

SEQ ID NO: 1102907 - RNA, 20 nt, Homo sapiens
uacacacccauagugcacac

SEQ ID NO: 1102908 - RNA, 21 nt, Homo sapiens
uacacauguaucuaugcauuu

SEQ ID NO: 1102909 - RNA, 15 nt, Homo sapiens
uacacguguccugua

SEQ ID NO: 1102910 - RNA, 20 nt, Homo sapiens
uacacuccagccugagcaac

SEQ ID NO: 1102911 - RNA, 15 nt, Homo sapiens
uacagaugcacccca

SEQ ID NO: 1102912 - RNA, 19 nt, Homo sapiens
uacagauuuuagacaagga

SEQ ID NO: 1102913 - RNA, 21 nt, Homo sapiens
uacagcaacaggaaucucaga

SEQ ID NO: 1102914 - RNA, 17 nt, Homo sapiens
uacagccagaagcccau

SEQ ID NO: 1102915 - RNA, 16 nt, Homo sapiens
uacagugagccaagau

SEQ ID NO: 1102916 - RNA, 13 nt, Homo sapiens
uacagugcuauuu

SEQ ID NO: 1102917 - RNA, 16 nt, Homo sapiens
uacaguguauguacua

SEQ ID NO: 1102918 - RNA, 20 nt, Homo sapiens
uacaguguauguacuaagca

SEQ ID NO: 1102919 - RNA, 19 nt, Homo sapiens
uacauaccacuuugaauag

SEQ ID NO: 1102920 - RNA, 14 nt, Homo sapiens
uacaugcauuacug

SEQ ID NO: 1102921 - RNA, 15 nt, Homo sapiens
uacauuaauuaccuu

SEQ ID NO: 1102922 - RNA, 18 nt, Homo sapiens
uacauugccaauuuucca

SEQ ID NO: 1102923 - RNA, 14 nt, Homo sapiens
uaccaaucauuuua

SEQ ID NO: 1102924 - RNA, 16 nt, Homo sapiens
uaccacaaacacauua

SEQ ID NO: 1102925 - RNA, 22 nt, Homo sapiens
uaccacagaaguucaauacuca

SEQ ID NO: 1102926 - RNA, 19 nt, Homo sapiens
uaccacugauuuggagaua

SEQ ID NO: 1102927 - RNA, 23 nt, Homo sapiens
uaccagcagugugucaggugcug

SEQ ID NO: 1102928 - RNA, 15 nt, Homo sapiens
uaccagcucacuccc

SEQ ID NO: 1102929 - RNA, 16 nt, Homo sapiens
uaccagugaaccaaag

SEQ ID NO: 1102930 - RNA, 17 nt, Homo sapiens
uaccauauacagcucag

SEQ ID NO: 1102931 - RNA, 14 nt, Homo sapiens
uaccaugccucucc

SEQ ID NO: 1102932 - RNA, 17 nt, Homo sapiens
uacccaaggcucuucuc

SEQ ID NO: 1102933 - RNA, 20 nt, Homo sapiens
uacccccugaaagugacaga

SEQ ID NO: 1102934 - RNA, 15 nt, Homo sapiens
uaccuaccacagugu

SEQ ID NO: 1102935 - RNA, 13 nt, Homo sapiens
uaccuauauuaca

SEQ ID NO: 1102936 - RNA, 18 nt, Homo sapiens
uaccucacuaugcugcuu

SEQ ID NO: 1102937 - RNA, 13 nt, Homo sapiens
uaccucucucuuc

SEQ ID NO: 1102938 - RNA, 13 nt, Homo sapiens
uaccugggcauuc

SEQ ID NO: 1102939 - RNA, 21 nt, Homo sapiens
uaccugggcauucuuguuuca

SEQ ID NO: 1102940 - RNA, 16 nt, Homo sapiens
uaccuguagugagaaa

SEQ ID NO: 1102941 - RNA, 20 nt, Homo sapiens
uaccuguguuucuugccuca

SEQ ID NO: 1102942 - RNA, 23 nt, Homo sapiens
uaccuguuaguauuauuguugca

SEQ ID NO: 1102943 - RNA, 23 nt, Homo sapiens
uaccuuagauuagcucuggacca

SEQ ID NO: 1102944 - RNA, 17 nt, Homo sapiens
uaccuugagccaguaau

SEQ ID NO: 1102945 - RNA, 21 nt, Homo sapiens
uacgcucauuguagaaaagcu

SEQ ID NO: 1102946 - RNA, 20 nt, Homo sapiens
uuagaggaagaaaaccagcg

SEQ ID NO: 1102947 - RNA, 22 nt, Homo sapiens
uuagauacagagacuuggggaa

SEQ ID NO: 1102948 - RNA, 20 nt, Homo sapiens
uuagauuguuaaaauaacua

SEQ ID NO: 1102949 - RNA, 22 nt, Homo sapiens
uuagcuaccucacuaugcugcu

SEQ ID NO: 1102950 - RNA, 23 nt, Homo sapiens
uuagcuaccucacuaugcugcuu

SEQ ID NO: 1102951 - RNA, 12 nt, Homo sapiens
uuagcucugauc

SEQ ID NO: 1102952 - RNA, 17 nt, Homo sapiens
uuagcuuagaccucagc

SEQ ID NO: 1102953 - RNA, 14 nt, Homo sapiens
uuagcuuuacaaau

SEQ ID NO: 1102954 - RNA, 21 nt, Homo sapiens
uuaggaccaauaccuccucca

SEQ ID NO: 1102955 - RNA, 13 nt, Homo sapiens
uuaggacuuucca

SEQ ID NO: 1102956 - RNA, 17 nt, Homo sapiens
uuagguuuuguacaauu

SEQ ID NO: 1102957 - RNA, 17 nt, Homo sapiens
uuaguaacauagacaaa

SEQ ID NO: 1102958 - RNA, 16 nt, Homo sapiens
uuaguaauuucuugcu

SEQ ID NO: 1102959 - RNA, 13 nt, Homo sapiens
uuaguaucucauc

SEQ ID NO: 1102960 - RNA, 11 nt, Homo sapiens
uuaguauuuau

SEQ ID NO: 1102961 - RNA, 17 nt, Homo sapiens
uuaguuaagucauccac

SEQ ID NO: 1102962 - RNA, 21 nt, Homo sapiens
uuauaauucuugaaugaggca

SEQ ID NO: 1102963 - RNA, 20 nt, Homo sapiens
uuauacaaaauaauuuaacu

SEQ ID NO: 1102964 - RNA, 15 nt, Homo sapiens
uuauauuuacuuuaa

SEQ ID NO: 1102965 - RNA, 18 nt, Homo sapiens
uuauauuuugugcuauca

SEQ ID NO: 1102966 - RNA, 23 nt, Homo sapiens
uuaucaaaaucuuucagcacuca

SEQ ID NO: 1102967 - RNA, 12 nt, Homo sapiens
uuaucaucugaa

SEQ ID NO: 1102968 - RNA, 12 nt, Homo sapiens
uuauccaugccu

SEQ ID NO: 1102969 - RNA, 12 nt, Homo sapiens
uuaucugugcaa

SEQ ID NO: 1102970 - RNA, 13 nt, Homo sapiens
uuaucugugcaaa

SEQ ID NO: 1102971 - RNA, 20 nt, Homo sapiens
uuaucuuauuuaauuuuugc

SEQ ID NO: 1102972 - RNA, 15 nt, Homo sapiens
uuaucuugacauuca

SEQ ID NO: 1102973 - RNA, 22 nt, Homo sapiens
uuaugaagcaagccccacuuau

SEQ ID NO: 1102974 - RNA, 12 nt, Homo sapiens
uuaugacuguuu

SEQ ID NO: 1102975 - RNA, 18 nt, Homo sapiens
uuaugagaaaguucucau

SEQ ID NO: 1102976 - RNA, 15 nt, Homo sapiens
uuaugcccucagaug

SEQ ID NO: 1102977 - RNA, 15 nt, Homo sapiens
uuaugccuucacuuu

SEQ ID NO: 1102978 - RNA, 21 nt, Homo sapiens
uuaugccuucacuuuacaaau

SEQ ID NO: 1102979 - RNA, 17 nt, Homo sapiens
uuauguauuuaugaccu

SEQ ID NO: 1102980 - RNA, 15 nt, Homo sapiens
uuaugucaucauaca

SEQ ID NO: 1102981 - RNA, 14 nt, Homo sapiens
uuaugucucaaaau

SEQ ID NO: 1102982 - RNA, 11 nt, Homo sapiens
uuaugugcaau

SEQ ID NO: 1102983 - RNA, 14 nt, Homo sapiens
uuauuaaugacaaa

SEQ ID NO: 1102984 - RNA, 12 nt, Homo sapiens
uuauuaccucug

SEQ ID NO: 1102985 - RNA, 21 nt, Homo sapiens
uuauuaccucugauaccucaa

SEQ ID NO: 1102986 - RNA, 15 nt, Homo sapiens
uuauuauaugacuag

SEQ ID NO: 1102987 - RNA, 16 nt, Homo sapiens
uuauuauuagauucuc

SEQ ID NO: 1102988 - RNA, 14 nt, Homo sapiens
uuauuccucccuca

SEQ ID NO: 1102989 - RNA, 20 nt, Homo sapiens
uuauuuacaaugcagaauuu

SEQ ID NO: 1102990 - RNA, 16 nt, Homo sapiens
uuauuuugaaaauaau

SEQ ID NO: 1102991 - RNA, 12 nt, Homo sapiens
uucaaaagugga

SEQ ID NO: 1102992 - RNA, 13 nt, Homo sapiens
uucaaaccaggau

SEQ ID NO: 1102993 - RNA, 22 nt, Homo sapiens
uucaaagcacuguuucucucac

SEQ ID NO: 1102994 - RNA, 11 nt, Homo sapiens
uucaaccacug

SEQ ID NO: 1102995 - RNA, 20 nt, Homo sapiens
uucaacccucagccuugaaa

SEQ ID NO: 1102996 - RNA, 17 nt, Homo sapiens
uucaacuaguaccacag

SEQ ID NO: 1102997 - RNA, 15 nt, Homo sapiens
uucaagaaagcuuca

SEQ ID NO: 1102998 - RNA, 20 nt, Homo sapiens
uucaagaccagccugaccaa

SEQ ID NO: 1102999 - RNA, 23 nt, Homo sapiens
uucaaggcauuucuaucacauau

SEQ ID NO: 1103000 - RNA, 22 nt, Homo sapiens
uucaagugauauauguauuuau

SEQ ID NO: 1103001 - RNA, 21 nt, Homo sapiens
uucaauaaaguaucuacaugc

SEQ ID NO: 1103002 - RNA, 13 nt, Homo sapiens
uucaauacuucau

SEQ ID NO: 1103003 - RNA, 12 nt, Homo sapiens
uucaaugaacaa

SEQ ID NO: 1103004 - RNA, 16 nt, Homo sapiens
uucacaaccagccaca

SEQ ID NO: 1103005 - RNA, 16 nt, Homo sapiens
uucacacugaccaaga

SEQ ID NO: 1103006 - RNA, 10 nt, Homo sapiens
uucacauaaa

SEQ ID NO: 1103007 - RNA, 21 nt, Homo sapiens
uucacauuugauguacaugug

SEQ ID NO: 1103008 - RNA, 15 nt, Homo sapiens
uucaccagauuugcu

SEQ ID NO: 1103009 - RNA, 16 nt, Homo sapiens
uucaccuggaagcauu

SEQ ID NO: 1103010 - RNA, 14 nt, Homo sapiens
uucacgcaacuuga

SEQ ID NO: 1103011 - RNA, 18 nt, Homo sapiens
uucacuauaaaugguguu

SEQ ID NO: 1103012 - RNA, 18 nt, Homo sapiens
uucacuguagaaugauuu

SEQ ID NO: 1103013 - RNA, 16 nt, Homo sapiens
uucacuuauugacuau

SEQ ID NO: 1103014 - RNA, 15 nt, Homo sapiens
uucagaagacacugc

SEQ ID NO: 1103015 - RNA, 17 nt, Homo sapiens
uucagaagagaugggcu

SEQ ID NO: 1103016 - RNA, 19 nt, Homo sapiens
uucagagugacacccaaga

SEQ ID NO: 1103017 - RNA, 13 nt, Homo sapiens
uucagccaccucu

SEQ ID NO: 1103018 - RNA, 20 nt, Homo sapiens
uucagccuagccgaccucag

SEQ ID NO: 1103019 - RNA, 21 nt, Homo sapiens
uucagccuagccgaccucagc

SEQ ID NO: 1103020 - RNA, 15 nt, Homo sapiens
uucagccugaggcug

SEQ ID NO: 1103021 - RNA, 20 nt, Homo sapiens
uucagcgagacccuugcauu

SEQ ID NO: 1103022 - RNA, 20 nt, Homo sapiens
uucaggacuuaacggcucca

SEQ ID NO: 1103023 - RNA, 18 nt, Homo sapiens
uucagguacuaaauaccu

SEQ ID NO: 1103024 - RNA, 18 nt, Homo sapiens
uucagugcuguacuugau

SEQ ID NO: 1103025 - RNA, 13 nt, Homo sapiens
uucagugcuucuu

SEQ ID NO: 1103026 - RNA, 18 nt, Homo sapiens
uucaucaauuuucacuug

SEQ ID NO: 1103027 - RNA, 22 nt, Homo sapiens
uucaucagacuccugugcaacu

SEQ ID NO: 1103028 - RNA, 14 nt, Homo sapiens
uucaucucugccaa

SEQ ID NO: 1103029 - RNA, 16 nt, Homo sapiens
uucaugcauuugcacu

SEQ ID NO: 1103030 - RNA, 12 nt, Homo sapiens
uucauggaccaa

SEQ ID NO: 1103031 - RNA, 18 nt, Homo sapiens
uucauggugcacugagcu

SEQ ID NO: 1103032 - RNA, 14 nt, Homo sapiens
uucauuuccgugaa

SEQ ID NO: 1103033 - RNA, 20 nt, Homo sapiens
uuccaaaggcauaagacccu

SEQ ID NO: 1103034 - RNA, 20 nt, Homo sapiens
uuccaacuaacguacauuca

SEQ ID NO: 1103035 - RNA, 16 nt, Homo sapiens
uuccacaauucacuag

SEQ ID NO: 1103036 - RNA, 18 nt, Homo sapiens
uuccacaccuagcaucuc

SEQ ID NO: 1103037 - RNA, 20 nt, Homo sapiens
uugaggccugcccucaggga

SEQ ID NO: 1103038 - RNA, 20 nt, Homo sapiens
uugagugacucgaggguugg

SEQ ID NO: 1103039 - RNA, 14 nt, Homo sapiens
uugauaaugggaug

SEQ ID NO: 1103040 - RNA, 17 nt, Homo sapiens
uugaucaaaucuaaugu

SEQ ID NO: 1103041 - RNA, 18 nt, Homo sapiens
uugauuaaaaucuggcaa

SEQ ID NO: 1103042 - RNA, 22 nt, Homo sapiens
uugauucacaaugaaaugcucu

SEQ ID NO: 1103043 - RNA, 17 nt, Homo sapiens
uugcaaccacugcaacg

SEQ ID NO: 1103044 - RNA, 15 nt, Homo sapiens
uugcaagacauagaa

SEQ ID NO: 1103045 - RNA, 22 nt, Homo sapiens
uugcacagcccacacaugaacc

SEQ ID NO: 1103046 - RNA, 16 nt, Homo sapiens
uugcacccaugccaua

SEQ ID NO: 1103047 - RNA, 14 nt, Homo sapiens
uugcaccuuucuag

SEQ ID NO: 1103048 - RNA, 22 nt, Homo sapiens
uugcacgugcucuucuguucuc

SEQ ID NO: 1103049 - RNA, 20 nt, Homo sapiens
uugcauaguaccaaucauuu

SEQ ID NO: 1103050 - RNA, 18 nt, Homo sapiens
uugcauuaaaaaugcaua

SEQ ID NO: 1103051 - RNA, 18 nt, Homo sapiens
uugccaugucuuguucag

SEQ ID NO: 1103052 - RNA, 14 nt, Homo sapiens
uugccauguuggcc

SEQ ID NO: 1103053 - RNA, 16 nt, Homo sapiens
uugcccaccagaucau

SEQ ID NO: 1103054 - RNA, 17 nt, Homo sapiens
uugcccagagaugccuc

SEQ ID NO: 1103055 - RNA, 21 nt, Homo sapiens
uugcccaggcuggagugcagu

SEQ ID NO: 1103056 - RNA, 19 nt, Homo sapiens
uugccccacccaacaagcc

SEQ ID NO: 1103057 - RNA, 17 nt, Homo sapiens
uugcccuucacaguguu

SEQ ID NO: 1103058 - RNA, 19 nt, Homo sapiens
uugcccuugcccugaccuc

SEQ ID NO: 1103059 - RNA, 14 nt, Homo sapiens
uugccuaaauccaa

SEQ ID NO: 1103060 - RNA, 16 nt, Homo sapiens
uugccuggaagcacau

SEQ ID NO: 1103061 - RNA, 16 nt, Homo sapiens
uugccugugugagcau

SEQ ID NO: 1103062 - RNA, 17 nt, Homo sapiens
uugcuacugguucagca

SEQ ID NO: 1103063 - RNA, 15 nt, Homo sapiens
uugcuuauucuaggu

SEQ ID NO: 1103064 - RNA, 22 nt, Homo sapiens
uugcuuauucuaggucuguaau

SEQ ID NO: 1103065 - RNA, 20 nt, Homo sapiens
uugcuuuaaaguaccuguag

SEQ ID NO: 1103066 - RNA, 19 nt, Homo sapiens
uuggaaaggaccuuaccug

SEQ ID NO: 1103067 - RNA, 22 nt, Homo sapiens
uuggaagagggcgaguucagca

SEQ ID NO: 1103068 - RNA, 14 nt, Homo sapiens
uuggaauucuggau

SEQ ID NO: 1103069 - RNA, 16 nt, Homo sapiens
uuggagcagaaagcca

SEQ ID NO: 1103070 - RNA, 16 nt, Homo sapiens
uuggaugcacuuuaua

SEQ ID NO: 1103071 - RNA, 20 nt, Homo sapiens
uuggauuuguuuaaaaacca

SEQ ID NO: 1103072 - RNA, 13 nt, Homo sapiens
uuggcaugaaggu

SEQ ID NO: 1103073 - RNA, 21 nt, Homo sapiens
uuggcugacggugaaccgcau

SEQ ID NO: 1103074 - RNA, 15 nt, Homo sapiens
uugggaauugcaugc

SEQ ID NO: 1103075 - RNA, 21 nt, Homo sapiens
uugggcaccucgacuugugaa

SEQ ID NO: 1103076 - RNA, 15 nt, Homo sapiens
uugggcaugcucagc

SEQ ID NO: 1103077 - RNA, 21 nt, Homo sapiens
uugguacuagauacugaaugu

SEQ ID NO: 1103078 - RNA, 14 nt, Homo sapiens
uugguauauuucca

SEQ ID NO: 1103079 - RNA, 13 nt, Homo sapiens
uuggucacugcua

SEQ ID NO: 1103080 - RNA, 20 nt, Homo sapiens
uuguaacgaagacacagacu

SEQ ID NO: 1103081 - RNA, 17 nt, Homo sapiens
uuguaaguugaagcaaa

SEQ ID NO: 1103082 - RNA, 12 nt, Homo sapiens
uuguacauauug

SEQ ID NO: 1103083 - RNA, 16 nt, Homo sapiens
uuguaccagugugaau

SEQ ID NO: 1103084 - RNA, 23 nt, Homo sapiens
uuguacccuuccuacagauaguc

SEQ ID NO: 1103085 - RNA, 14 nt, Homo sapiens
uuguauaucaugaa

SEQ ID NO: 1103086 - RNA, 15 nt, Homo sapiens
uuguaugagguuuga

SEQ ID NO: 1103087 - RNA, 21 nt, Homo sapiens
uugucaauauuaaauacagac

SEQ ID NO: 1103088 - RNA, 22 nt, Homo sapiens
uugucauguggcuaaaugccua

SEQ ID NO: 1103089 - RNA, 13 nt, Homo sapiens
uugucauuuauaa

SEQ ID NO: 1103090 - RNA, 14 nt, Homo sapiens
uuguccuaugucaa

SEQ ID NO: 1103091 - RNA, 20 nt, Homo sapiens
uugucuguuuuuguaacuua

SEQ ID NO: 1103092 - RNA, 20 nt, Homo sapiens
uuguggguuuuuucacauaa

SEQ ID NO: 1103093 - RNA, 17 nt, Homo sapiens
uugugucuggcaguuua

SEQ ID NO: 1103094 - RNA, 16 nt, Homo sapiens
uuguucagaagacaca

SEQ ID NO: 1103095 - RNA, 15 nt, Homo sapiens
uuguugagaguguga

SEQ ID NO: 1103096 - RNA, 14 nt, Homo sapiens
uuguugcagccaaa

SEQ ID NO: 1103097 - RNA, 20 nt, Homo sapiens
uuguuuccauucuuguccug

SEQ ID NO: 1103098 - RNA, 20 nt, Homo sapiens
uuuaaaaccugugugccauu

SEQ ID NO: 1103099 - RNA, 15 nt, Homo sapiens
uuuaaaccgcuaaaa

SEQ ID NO: 1103100 - RNA, 18 nt, Homo sapiens
uuuaaacuauaagcaaga

SEQ ID NO: 1103101 - RNA, 20 nt, Homo sapiens
uuuaaaugaugauuccuuga

SEQ ID NO: 1103102 - RNA, 21 nt, Homo sapiens
uuuaaauggcuuuaugcuagu

SEQ ID NO: 1103103 - RNA, 14 nt, Homo sapiens
uuuaaauuagauaa

SEQ ID NO: 1103104 - RNA, 12 nt, Homo sapiens
uuuaaauucucu

SEQ ID NO: 1103105 - RNA, 21 nt, Homo sapiens
uuuaacuagaauuuauucaau

SEQ ID NO: 1103106 - RNA, 13 nt, Homo sapiens
uuuaagaaucuau

SEQ ID NO: 1103107 - RNA, 12 nt, Homo sapiens
uuuaaggauaaa

SEQ ID NO: 1103108 - RNA, 12 nt, Homo sapiens
uuuaauagcaaa

SEQ ID NO: 1103109 - RNA, 20 nt, Homo sapiens
uuuaauaucugagaagugua

SEQ ID NO: 1103110 - RNA, 16 nt, Homo sapiens
uuuaauuugauaguau

SEQ ID NO: 1103111 - RNA, 18 nt, Homo sapiens
uuuacagugcuauuuacu

SEQ ID NO: 1103112 - RNA, 14 nt, Homo sapiens
uuuaccacagcagc

SEQ ID NO: 1103113 - RNA, 20 nt, Homo sapiens
uuuaccacuaugcaauauau

SEQ ID NO: 1103114 - RNA, 16 nt, Homo sapiens
uuuacuacuauucugu

SEQ ID NO: 1103115 - RNA, 19 nt, Homo sapiens
uuuacugucuguaagagaa

SEQ ID NO: 1103116 - RNA, 14 nt, Homo sapiens
uuuagaagagccug

SEQ ID NO: 1103117 - RNA, 18 nt, Homo sapiens
uuuagcaggguacauauu

SEQ ID NO: 1103118 - RNA, 19 nt, Homo sapiens
uuuaggaccaauaccuccu

SEQ ID NO: 1103119 - RNA, 14 nt, Homo sapiens
uuuagugucuugaa

SEQ ID NO: 1103120 - RNA, 16 nt, Homo sapiens
uuuauaagagugccgu

SEQ ID NO: 1103121 - RNA, 18 nt, Homo sapiens
uuuauaugaaauguuuca

SEQ ID NO: 1103122 - RNA, 18 nt, Homo sapiens
uuuauauuuuuauagaca

SEQ ID NO: 1103123 - RNA, 16 nt, Homo sapiens
uuuaucauuaccauua

SEQ ID NO: 1103124 - RNA, 13 nt, Homo sapiens
uuuaucugugcaa

SEQ ID NO: 1103125 - RNA, 14 nt, Homo sapiens
uuuaugagcucuuc

SEQ ID NO: 1103126 - RNA, 13 nt, Homo sapiens
uuuaugaguacuu

SEQ ID NO: 1103127 - RNA, 15 nt, Homo sapiens
uuuauuaaugaacug

SEQ ID NO: 1103128 - RNA, 17 nt, Homo sapiens
accccugcuauauacua

SEQ ID NO: 1103129 - RNA, 22 nt, Homo sapiens
acccggcucccccugcuucuca

SEQ ID NO: 1103130 - RNA, 15 nt, Homo sapiens
acccuaaauguggac

SEQ ID NO: 1103131 - RNA, 14 nt, Homo sapiens
acccuccuguccag

SEQ ID NO: 1103132 - RNA, 22 nt, Homo sapiens
acccuccuuucaccacaugugc

SEQ ID NO: 1103133 - RNA, 14 nt, Homo sapiens
acccucucuucccu

SEQ ID NO: 1103134 - RNA, 16 nt, Homo sapiens
acccugaagauuucag

SEQ ID NO: 1103135 - RNA, 21 nt, Homo sapiens
acccugaaugguuccaugccu

SEQ ID NO: 1103136 - RNA, 13 nt, Homo sapiens
accgagcaauuuu

SEQ ID NO: 1103137 - RNA, 23 nt, Homo sapiens
accgauuugcacccaugccauag

SEQ ID NO: 1103138 - RNA, 15 nt, Homo sapiens
accggcuacaucaaa

SEQ ID NO: 1103139 - RNA, 19 nt, Homo sapiens
accguggaccuuccugcca

SEQ ID NO: 1103140 - RNA, 17 nt, Homo sapiens
accuaagcaaaaccacu

SEQ ID NO: 1103141 - RNA, 15 nt, Homo sapiens
accuacuuacaugca

SEQ ID NO: 1103142 - RNA, 13 nt, Homo sapiens
accuaggauuuca

SEQ ID NO: 1103143 - RNA, 17 nt, Homo sapiens
accucaaccuaugguau

SEQ ID NO: 1103144 - RNA, 12 nt, Homo sapiens
accucaguuuua

SEQ ID NO: 1103145 - RNA, 21 nt, Homo sapiens
accucauuuaccauaaaaauc

SEQ ID NO: 1103146 - RNA, 15 nt, Homo sapiens
accucccaguuugcu

SEQ ID NO: 1103147 - RNA, 21 nt, Homo sapiens
accuccuacgucaaacaugaa

SEQ ID NO: 1103148 - RNA, 18 nt, Homo sapiens
accucgacccacucucaa

SEQ ID NO: 1103149 - RNA, 14 nt, Homo sapiens
accucucaauuucu

SEQ ID NO: 1103150 - RNA, 21 nt, Homo sapiens
accucuccccuggaacugucu

SEQ ID NO: 1103151 - RNA, 17 nt, Homo sapiens
accucugccugaaguca

SEQ ID NO: 1103152 - RNA, 23 nt, Homo sapiens
accucugccugaagucacacagu

SEQ ID NO: 1103153 - RNA, 15 nt, Homo sapiens
accucuugucagugc

SEQ ID NO: 1103154 - RNA, 20 nt, Homo sapiens
accugaaggacgagggaugg

SEQ ID NO: 1103155 - RNA, 16 nt, Homo sapiens
accugaucccacgagg

SEQ ID NO: 1103156 - RNA, 23 nt, Homo sapiens
accugcaccuccccccacugcag

SEQ ID NO: 1103157 - RNA, 13 nt, Homo sapiens
accugcaggccaa

SEQ ID NO: 1103158 - RNA, 18 nt, Homo sapiens
accugcugagcucugaga

SEQ ID NO: 1103159 - RNA, 16 nt, Homo sapiens
accuggcacaauggcu

SEQ ID NO: 1103160 - RNA, 16 nt, Homo sapiens
accugggcccuggggc

SEQ ID NO: 1103161 - RNA, 19 nt, Homo sapiens
accuggggucaucgauuca

SEQ ID NO: 1103162 - RNA, 13 nt, Homo sapiens
accuguagugaga

SEQ ID NO: 1103163 - RNA, 14 nt, Homo sapiens
accugugcacccca

SEQ ID NO: 1103164 - RNA, 17 nt, Homo sapiens
accuguggggccccaga

SEQ ID NO: 1103165 - RNA, 19 nt, Homo sapiens
accuguggugauguugcca

SEQ ID NO: 1103166 - RNA, 13 nt, Homo sapiens
accuguuacuuga

SEQ ID NO: 1103167 - RNA, 20 nt, Homo sapiens
accuguuacuugaaauacca

SEQ ID NO: 1103168 - RNA, 23 nt, Homo sapiens
accuguuaucuguguuugcugag

SEQ ID NO: 1103169 - RNA, 16 nt, Homo sapiens
accuuaaaaaguaauu

SEQ ID NO: 1103170 - RNA, 14 nt, Homo sapiens
accuucaacuucca

SEQ ID NO: 1103171 - RNA, 22 nt, Homo sapiens
accuucaauaaaguaucuacau

SEQ ID NO: 1103172 - RNA, 18 nt, Homo sapiens
accuucaauacuucauga

SEQ ID NO: 1103173 - RNA, 19 nt, Homo sapiens
accuucagauuuguguuau

SEQ ID NO: 1103174 - RNA, 21 nt, Homo sapiens
accuucagauuuguguuauaa

SEQ ID NO: 1103175 - RNA, 19 nt, Homo sapiens
accuucaugucacugcucu

SEQ ID NO: 1103176 - RNA, 21 nt, Homo sapiens
accuucuaggaagcuccaguu

SEQ ID NO: 1103177 - RNA, 17 nt, Homo sapiens
accuucugaagaucuca

SEQ ID NO: 1103178 - RNA, 16 nt, Homo sapiens
accuugaacacugggg

SEQ ID NO: 1103179 - RNA, 18 nt, Homo sapiens
accuuggacuccucccac

SEQ ID NO: 1103180 - RNA, 21 nt, Homo sapiens
acgaggagcuuccagugcaug

SEQ ID NO: 1103181 - RNA, 19 nt, Homo sapiens
acgagggaugggauuucau

SEQ ID NO: 1103182 - RNA, 15 nt, Homo sapiens
acgccacucauuuca

SEQ ID NO: 1103183 - RNA, 21 nt, Homo sapiens
acgccacugcacuauagccua

SEQ ID NO: 1103184 - RNA, 15 nt, Homo sapiens
acgccacugcacucc

SEQ ID NO: 1103185 - RNA, 22 nt, Homo sapiens
acgguggccuaggguacaggca

SEQ ID NO: 1103186 - RNA, 13 nt, Homo sapiens
acguaaacuuccu

SEQ ID NO: 1103187 - RNA, 16 nt, Homo sapiens
acgucaaacaugaagu

SEQ ID NO: 1103188 - RNA, 14 nt, Homo sapiens
acgucugacaggca

SEQ ID NO: 1103189 - RNA, 19 nt, Homo sapiens
acgugugcagacuguggcu

SEQ ID NO: 1103190 - RNA, 16 nt, Homo sapiens
acuaaaaauacaaaaa

SEQ ID NO: 1103191 - RNA, 18 nt, Homo sapiens
acuaaacaacuaccuccu

SEQ ID NO: 1103192 - RNA, 21 nt, Homo sapiens
acuaaacaacuaccuccucag

SEQ ID NO: 1103193 - RNA, 14 nt, Homo sapiens
acuaaacauuuugu

SEQ ID NO: 1103194 - RNA, 14 nt, Homo sapiens
acuaauggaaauau

SEQ ID NO: 1103195 - RNA, 13 nt, Homo sapiens
acuacacuccagc

SEQ ID NO: 1103196 - RNA, 13 nt, Homo sapiens
acuacaugcacuu

SEQ ID NO: 1103197 - RNA, 14 nt, Homo sapiens
acuacugugaucag

SEQ ID NO: 1103198 - RNA, 14 nt, Homo sapiens
acuagaacucucca

SEQ ID NO: 1103199 - RNA, 18 nt, Homo sapiens
acuagagggauacacuga

SEQ ID NO: 1103200 - RNA, 11 nt, Homo sapiens
acuagaucucc

SEQ ID NO: 1103201 - RNA, 14 nt, Homo sapiens
acuagaucuccuau

SEQ ID NO: 1103202 - RNA, 17 nt, Homo sapiens
acuagcagcugcaguca

SEQ ID NO: 1103203 - RNA, 23 nt, Homo sapiens
acuagggacuggaucucagccuc

SEQ ID NO: 1103204 - RNA, 19 nt, Homo sapiens
acuaguauuguccauauca

SEQ ID NO: 1103205 - RNA, 18 nt, Homo sapiens
acuaucaaacugaagcca

SEQ ID NO: 1103206 - RNA, 16 nt, Homo sapiens
acuaucugauuuccua

SEQ ID NO: 1103207 - RNA, 12 nt, Homo sapiens
acuaugcugcuu

SEQ ID NO: 1103208 - RNA, 18 nt, Homo sapiens
acuauggaaagcagccau

SEQ ID NO: 1103209 - RNA, 18 nt, Homo sapiens
acuauggcccugggagag

SEQ ID NO: 1103210 - RNA, 15 nt, Homo sapiens
acuauguuucuauuc

SEQ ID NO: 1103211 - RNA, 16 nt, Homo sapiens
acuauuagacaugaaa

SEQ ID NO: 1103212 - RNA, 18 nt, Homo sapiens
acuauucuuaacuauuca

SEQ ID NO: 1103213 - RNA, 18 nt, Homo sapiens
acuauugaaguugcagau

SEQ ID NO: 1103214 - RNA, 16 nt, Homo sapiens
acuauuuuaacuggga

SEQ ID NO: 1103215 - RNA, 17 nt, Homo sapiens
acucaaggaauuugcau

SEQ ID NO: 1103216 - RNA, 21 nt, Homo sapiens
acucaaguuuuuacaaaauac

SEQ ID NO: 1103217 - RNA, 20 nt, Homo sapiens
acucacaagaagaccagacu

SEQ ID NO: 1103218 - RNA, 15 nt, Homo sapiens
acucacagucucuuu

SEQ ID NO: 1103219 - RNA, 16 nt, Homo sapiens
agacucagcucugaca

SEQ ID NO: 1103220 - RNA, 17 nt, Homo sapiens
agacucaguuugucaga

SEQ ID NO: 1103221 - RNA, 14 nt, Homo sapiens
agacugaaagaaua

SEQ ID NO: 1103222 - RNA, 16 nt, Homo sapiens
agacugaagauggaaa

SEQ ID NO: 1103223 - RNA, 20 nt, Homo sapiens
agacugaagauggaaaaagu

SEQ ID NO: 1103224 - RNA, 22 nt, Homo sapiens
agacuguggcugcuagcacuug

SEQ ID NO: 1103225 - RNA, 23 nt, Homo sapiens
agacuguugcucaaaucuauuca

SEQ ID NO: 1103226 - RNA, 13 nt, Homo sapiens
agacuucccugaa

SEQ ID NO: 1103227 - RNA, 15 nt, Homo sapiens
agagaaaagucuacc

SEQ ID NO: 1103228 - RNA, 18 nt, Homo sapiens
agagaaagaaguaggcau

SEQ ID NO: 1103229 - RNA, 21 nt, Homo sapiens
agagaaagagagagaauucuu

SEQ ID NO: 1103230 - RNA, 14 nt, Homo sapiens
agagaagaggcugg

SEQ ID NO: 1103231 - RNA, 14 nt, Homo sapiens
agagaauucacuuu

SEQ ID NO: 1103232 - RNA, 15 nt, Homo sapiens
agagacccagaucuc

SEQ ID NO: 1103233 - RNA, 21 nt, Homo sapiens
agagaccuugcgaccaugugu

SEQ ID NO: 1103234 - RNA, 17 nt, Homo sapiens
agagagauauaucugaa

SEQ ID NO: 1103235 - RNA, 14 nt, Homo sapiens
agagagauggaaua

SEQ ID NO: 1103236 - RNA, 22 nt, Homo sapiens
agagagauggaauaaagcccuu

SEQ ID NO: 1103237 - RNA, 13 nt, Homo sapiens
agagauacauucc

SEQ ID NO: 1103238 - RNA, 21 nt, Homo sapiens
agagauggaauaaagcccuug

SEQ ID NO: 1103239 - RNA, 23 nt, Homo sapiens
agagauggaauaaagcccuugaa

SEQ ID NO: 1103240 - RNA, 16 nt, Homo sapiens
agagauucuugugccu

SEQ ID NO: 1103241 - RNA, 16 nt, Homo sapiens
agagauuugaauagaa

SEQ ID NO: 1103242 - RNA, 19 nt, Homo sapiens
agagcaagacucugucuca

SEQ ID NO: 1103243 - RNA, 13 nt, Homo sapiens
agagcacacugua

SEQ ID NO: 1103244 - RNA, 20 nt, Homo sapiens
agagcacacuuaugggccaa

SEQ ID NO: 1103245 - RNA, 21 nt, Homo sapiens
agagcauggaaaaauacugcc

SEQ ID NO: 1103246 - RNA, 13 nt, Homo sapiens
agagccagggucu

SEQ ID NO: 1103247 - RNA, 22 nt, Homo sapiens
agagcccuucaugcauuugcac

SEQ ID NO: 1103248 - RNA, 22 nt, Homo sapiens
agagcuuacaagacccuaugaa

SEQ ID NO: 1103249 - RNA, 17 nt, Homo sapiens
agaggaagaaaaccagc

SEQ ID NO: 1103250 - RNA, 19 nt, Homo sapiens
agaggaagagcugcaacgg

SEQ ID NO: 1103251 - RNA, 19 nt, Homo sapiens
agaggcagggucucacucu

SEQ ID NO: 1103252 - RNA, 19 nt, Homo sapiens
agaggcugcagaaggccaa

SEQ ID NO: 1103253 - RNA, 13 nt, Homo sapiens
agaggggaaaaug

SEQ ID NO: 1103254 - RNA, 16 nt, Homo sapiens
agaggggacauuuccc

SEQ ID NO: 1103255 - RNA, 15 nt, Homo sapiens
agaggggcuguccau

SEQ ID NO: 1103256 - RNA, 14 nt, Homo sapiens
agaguccucuggau

SEQ ID NO: 1103257 - RNA, 23 nt, Homo sapiens
agagugaaauaauuaaaaaccac

SEQ ID NO: 1103258 - RNA, 22 nt, Homo sapiens
agagugccguaacaacuguggu

SEQ ID NO: 1103259 - RNA, 23 nt, Homo sapiens
agagugccguaacaacugugguc

SEQ ID NO: 1103260 - RNA, 22 nt, Homo sapiens
agaguguuuggggguuccguga

SEQ ID NO: 1103261 - RNA, 23 nt, Homo sapiens
agauaaaagaaccgagcaauuuu

SEQ ID NO: 1103262 - RNA, 17 nt, Homo sapiens
agauaaacaacaaauaa

SEQ ID NO: 1103263 - RNA, 23 nt, Homo sapiens
agauaacagcuuaacauuuacau

SEQ ID NO: 1103264 - RNA, 13 nt, Homo sapiens
agauaacucuccu

SEQ ID NO: 1103265 - RNA, 13 nt, Homo sapiens
agauaacugagaa

SEQ ID NO: 1103266 - RNA, 15 nt, Homo sapiens
agauaauaucuguga

SEQ ID NO: 1103267 - RNA, 21 nt, Homo sapiens
agauaaucgagucuaccucuu

SEQ ID NO: 1103268 - RNA, 19 nt, Homo sapiens
agauacuuugucagcaaua

SEQ ID NO: 1103269 - RNA, 23 nt, Homo sapiens
agauagauauuccuauugugcaa

SEQ ID NO: 1103270 - RNA, 18 nt, Homo sapiens
agauagaugguacucucc

SEQ ID NO: 1103271 - RNA, 18 nt, Homo sapiens
agauagguacuauuaucc

SEQ ID NO: 1103272 - RNA, 17 nt, Homo sapiens
agauauacugggagaaa

SEQ ID NO: 1103273 - RNA, 18 nt, Homo sapiens
agauauuaaaugauguuu

SEQ ID NO: 1103274 - RNA, 16 nt, Homo sapiens
agaucacauauucuag

SEQ ID NO: 1103275 - RNA, 18 nt, Homo sapiens
agaucacgccacugcacu

SEQ ID NO: 1103276 - RNA, 15 nt, Homo sapiens
agaucguuguuuaca

SEQ ID NO: 1103277 - RNA, 13 nt, Homo sapiens
agaucugucuuga

SEQ ID NO: 1103278 - RNA, 22 nt, Homo sapiens
agaucugucuugaugugucauc

SEQ ID NO: 1103279 - RNA, 17 nt, Homo sapiens
agaugaagacaacagca

SEQ ID NO: 1103280 - RNA, 18 nt, Homo sapiens
agaugaagacaacagcau

SEQ ID NO: 1103281 - RNA, 13 nt, Homo sapiens
agaugagauuccc

SEQ ID NO: 1103282 - RNA, 15 nt, Homo sapiens
agaugagcagucaca

SEQ ID NO: 1103283 - RNA, 20 nt, Homo sapiens
agaugauuaaacagacuuua

SEQ ID NO: 1103284 - RNA, 18 nt, Homo sapiens
agauggaauaaagcccuu

SEQ ID NO: 1103285 - RNA, 12 nt, Homo sapiens
agauggaguucu

SEQ ID NO: 1103286 - RNA, 21 nt, Homo sapiens
agauggaguucuugugccaua

SEQ ID NO: 1103287 - RNA, 16 nt, Homo sapiens
agauggauagucuguc

SEQ ID NO: 1103288 - RNA, 16 nt, Homo sapiens
agauggauguuuguca

SEQ ID NO: 1103289 - RNA, 18 nt, Homo sapiens
agauggauguuugucaaa

SEQ ID NO: 1103290 - RNA, 23 nt, Homo sapiens
agauggccgggacaugcagcucu

SEQ ID NO: 1103291 - RNA, 21 nt, Homo sapiens
agaugguggugagcacaucug

SEQ ID NO: 1103292 - RNA, 21 nt, Homo sapiens
agauuaccaaagaagauuuug

SEQ ID NO: 1103293 - RNA, 23 nt, Homo sapiens
agauuauauaucauaaaguaugc

SEQ ID NO: 1103294 - RNA, 21 nt, Homo sapiens
agauucccacccaauucaaaa

SEQ ID NO: 1103295 - RNA, 16 nt, Homo sapiens
agauuguuaaaauaac

SEQ ID NO: 1103296 - RNA, 23 nt, Homo sapiens
agauuguucuguccaguuuccaa

SEQ ID NO: 1103297 - RNA, 14 nt, Homo sapiens
agauuuaacacuaa

SEQ ID NO: 1103298 - RNA, 16 nt, Homo sapiens
agauuucaacauauca

SEQ ID NO: 1103299 - RNA, 18 nt, Homo sapiens
agcaaagcuuaaaugccu

SEQ ID NO: 1103300 - RNA, 18 nt, Homo sapiens
agcaaagguuggccuuac

SEQ ID NO: 1103301 - RNA, 17 nt, Homo sapiens
agcaaaguuuuaccugu

SEQ ID NO: 1103302 - RNA, 15 nt, Homo sapiens
agcaaauguggcucc

SEQ ID NO: 1103303 - RNA, 16 nt, Homo sapiens
agcaaauguggcuccu

SEQ ID NO: 1103304 - RNA, 21 nt, Homo sapiens
agcaacacucuauauuuagau

SEQ ID NO: 1103305 - RNA, 18 nt, Homo sapiens
agcaagacuucucuuugc

SEQ ID NO: 1103306 - RNA, 14 nt, Homo sapiens
agcaagcuauucaa

SEQ ID NO: 1103307 - RNA, 18 nt, Homo sapiens
agcaaucugagagauuug

SEQ ID NO: 1103308 - RNA, 16 nt, Homo sapiens
agcaauguaacauuaa

SEQ ID NO: 1103309 - RNA, 13 nt, Homo sapiens
cgcaacaguuuuu

SEQ ID NO: 1103310 - RNA, 16 nt, Homo sapiens
cgcaccacuguguauu

SEQ ID NO: 1103311 - RNA, 11 nt, Homo sapiens
cgcaccugccc

SEQ ID NO: 1103312 - RNA, 16 nt, Homo sapiens
cgcaucaggccuggca

SEQ ID NO: 1103313 - RNA, 21 nt, Homo sapiens
cgcccagucuggaaugcagug

SEQ ID NO: 1103314 - RNA, 15 nt, Homo sapiens
cgccuaugaucccag

SEQ ID NO: 1103315 - RNA, 21 nt, Homo sapiens
cgccuaugaucccagcacuuu

SEQ ID NO: 1103316 - RNA, 11 nt, Homo sapiens
cgcgugcacac

SEQ ID NO: 1103317 - RNA, 19 nt, Homo sapiens
cggaagcccuugccugaaa

SEQ ID NO: 1103318 - RNA, 20 nt, Homo sapiens
cggaaugaaccacaucuugc

SEQ ID NO: 1103319 - RNA, 14 nt, Homo sapiens
cggagaguacagug

SEQ ID NO: 1103320 - RNA, 12 nt, Homo sapiens
cggagcuuucaa

SEQ ID NO: 1103321 - RNA, 17 nt, Homo sapiens
cggcaaccccaguucug

SEQ ID NO: 1103322 - RNA, 19 nt, Homo sapiens
cggcagcuugagccuguca

SEQ ID NO: 1103323 - RNA, 19 nt, Homo sapiens
cgggagaggagaucagggc

SEQ ID NO: 1103324 - RNA, 22 nt, Homo sapiens
cgggaggauguucugggacaca

SEQ ID NO: 1103325 - RNA, 17 nt, Homo sapiens
cgggauuugaagcugua

SEQ ID NO: 1103326 - RNA, 16 nt, Homo sapiens
cgguggacccagggau

SEQ ID NO: 1103327 - RNA, 18 nt, Homo sapiens
cggugucuggaaaagcac

SEQ ID NO: 1103328 - RNA, 22 nt, Homo sapiens
cggugucuggaaaagcacuuua

SEQ ID NO: 1103329 - RNA, 14 nt, Homo sapiens
cguaacaacugugg

SEQ ID NO: 1103330 - RNA, 13 nt, Homo sapiens
cguagccaucucu

SEQ ID NO: 1103331 - RNA, 21 nt, Homo sapiens
cguaucugcucuuaggugcuu

SEQ ID NO: 1103332 - RNA, 15 nt, Homo sapiens
cgucccaugugcaug

SEQ ID NO: 1103333 - RNA, 20 nt, Homo sapiens
cgugauaaugcagacuuccu

SEQ ID NO: 1103334 - RNA, 20 nt, Homo sapiens
cgugccccgccuccccgaaa

SEQ ID NO: 1103335 - RNA, 20 nt, Homo sapiens
cguggaauugugcugaguug

SEQ ID NO: 1103336 - RNA, 13 nt, Homo sapiens
cguggacucugca

SEQ ID NO: 1103337 - RNA, 17 nt, Homo sapiens
cguggacucugcacaug

SEQ ID NO: 1103338 - RNA, 22 nt, Homo sapiens
cguggacucugcacaugucuug

SEQ ID NO: 1103339 - RNA, 13 nt, Homo sapiens
cguguagugucug

SEQ ID NO: 1103340 - RNA, 16 nt, Homo sapiens
cguguucucacacugg

SEQ ID NO: 1103341 - RNA, 23 nt, Homo sapiens
cguuccuguuagcauaaugugag

SEQ ID NO: 1103342 - RNA, 23 nt, Homo sapiens
cguuuugugugguggcaccuccu

SEQ ID NO: 1103343 - RNA, 15 nt, Homo sapiens
cuaaaaaugcaacuu

SEQ ID NO: 1103344 - RNA, 13 nt, Homo sapiens
cuaaaauauuauu

SEQ ID NO: 1103345 - RNA, 14 nt, Homo sapiens
cuaaacccaaauaa

SEQ ID NO: 1103346 - RNA, 20 nt, Homo sapiens
cuaaacugcuguuaauugau

SEQ ID NO: 1103347 - RNA, 12 nt, Homo sapiens
cuaaagacagaa

SEQ ID NO: 1103348 - RNA, 15 nt, Homo sapiens
cuaaagucacauaua

SEQ ID NO: 1103349 - RNA, 14 nt, Homo sapiens
cuaaauccaaagaa

SEQ ID NO: 1103350 - RNA, 18 nt, Homo sapiens
cuaaaucugccuuuucau

SEQ ID NO: 1103351 - RNA, 16 nt, Homo sapiens
cuaaaugcagugaauu

SEQ ID NO: 1103352 - RNA, 11 nt, Homo sapiens
cuaaauuucca

SEQ ID NO: 1103353 - RNA, 20 nt, Homo sapiens
cuaacacagccaucaaggga

SEQ ID NO: 1103354 - RNA, 23 nt, Homo sapiens
cuaacacccagucuguuccccau

SEQ ID NO: 1103355 - RNA, 15 nt, Homo sapiens
cuaacccccagugcc

SEQ ID NO: 1103356 - RNA, 13 nt, Homo sapiens
cuaacuccaguga

SEQ ID NO: 1103357 - RNA, 14 nt, Homo sapiens
cuaacuguaugugu

SEQ ID NO: 1103358 - RNA, 21 nt, Homo sapiens
cuaacuuuuuugcuauccagc

SEQ ID NO: 1103359 - RNA, 19 nt, Homo sapiens
cuaagaaauaugcacaaua

SEQ ID NO: 1103360 - RNA, 14 nt, Homo sapiens
cuaagauggcuuuu

SEQ ID NO: 1103361 - RNA, 17 nt, Homo sapiens
cuaagcacguagagaug

SEQ ID NO: 1103362 - RNA, 17 nt, Homo sapiens
cuaagccacucuuccaa

SEQ ID NO: 1103363 - RNA, 12 nt, Homo sapiens
cuaagccuccuu

SEQ ID NO: 1103364 - RNA, 18 nt, Homo sapiens
cuaagccuguugagacuu

SEQ ID NO: 1103365 - RNA, 18 nt, Homo sapiens
cuaaguggaauagccucc

SEQ ID NO: 1103366 - RNA, 13 nt, Homo sapiens
cuaauaaacaauu

SEQ ID NO: 1103367 - RNA, 16 nt, Homo sapiens
cuaauaaucaccauau

SEQ ID NO: 1103368 - RNA, 17 nt, Homo sapiens
cuaauauguaacaagcc

SEQ ID NO: 1103369 - RNA, 15 nt, Homo sapiens
cuaauccuccaaguc

SEQ ID NO: 1103370 - RNA, 19 nt, Homo sapiens
cuaaugagucgacuuugag

SEQ ID NO: 1103371 - RNA, 16 nt, Homo sapiens
cuaaugauuagcacuu

SEQ ID NO: 1103372 - RNA, 15 nt, Homo sapiens
cuaaugucagaguag

SEQ ID NO: 1103373 - RNA, 23 nt, Homo sapiens
cuaauuaaaaaguuaaucuucau

SEQ ID NO: 1103374 - RNA, 17 nt, Homo sapiens
cuaauuggcaugaaggu

SEQ ID NO: 1103375 - RNA, 17 nt, Homo sapiens
cuaauuuaaaccagcag

SEQ ID NO: 1103376 - RNA, 18 nt, Homo sapiens
cuaauuugauguuuacag

SEQ ID NO: 1103377 - RNA, 15 nt, Homo sapiens
cuacaaaaaacaaca

SEQ ID NO: 1103378 - RNA, 23 nt, Homo sapiens
cuacaaacucccacuugucaugu

SEQ ID NO: 1103379 - RNA, 21 nt, Homo sapiens
cuacacacccauagugcacac

SEQ ID NO: 1103380 - RNA, 11 nt, Homo sapiens
cuacacauaua

SEQ ID NO: 1103381 - RNA, 14 nt, Homo sapiens
cuacagaggccaug

SEQ ID NO: 1103382 - RNA, 15 nt, Homo sapiens
cuaccacagugucug

SEQ ID NO: 1103383 - RNA, 13 nt, Homo sapiens
cuacccccugaaa

SEQ ID NO: 1103384 - RNA, 23 nt, Homo sapiens
cuacccggcccagagaccccuuc

SEQ ID NO: 1103385 - RNA, 19 nt, Homo sapiens
cuaccucacuaugcugcuu

SEQ ID NO: 1103386 - RNA, 14 nt, Homo sapiens
cuaccuucauguca

SEQ ID NO: 1103387 - RNA, 18 nt, Homo sapiens
cuacgugccaggcacugu

SEQ ID NO: 1103388 - RNA, 14 nt, Homo sapiens
cuacuaaaaacaca

SEQ ID NO: 1103389 - RNA, 21 nt, Homo sapiens
cuacucacacaggcauuuccu

SEQ ID NO: 1103390 - RNA, 21 nt, Homo sapiens
cuacucugugccagagccugg

SEQ ID NO: 1103391 - RNA, 15 nt, Homo sapiens
cuacugagacaugac

SEQ ID NO: 1103392 - RNA, 19 nt, Homo sapiens
cuacugggaaauuacuuau

SEQ ID NO: 1103393 - RNA, 15 nt, Homo sapiens
cuacuuaaugagaua

SEQ ID NO: 1103394 - RNA, 19 nt, Homo sapiens
cuacuugggaggcugaggc

SEQ ID NO: 1103395 - RNA, 17 nt, Homo sapiens
cuacuuguaaaggugcu

SEQ ID NO: 1103396 - RNA, 18 nt, Homo sapiens
cuacuuugauaugacugu

SEQ ID NO: 1103397 - RNA, 20 nt, Homo sapiens
cuacuuuuucuagcuacaau

SEQ ID NO: 1103398 - RNA, 16 nt, Homo sapiens
cuagaaaucugccaau

SEQ ID NO: 1103399 - RNA, 17 nt, Homo sapiens
cuagagaaaagucuacc

SEQ ID NO: 1103400 - RNA, 13 nt, Homo sapiens
cuccccacucuag

SEQ ID NO: 1103401 - RNA, 14 nt, Homo sapiens
cucccccaccuuca

SEQ ID NO: 1103402 - RNA, 22 nt, Homo sapiens
cucccuaaaauaaaaaccagaa

SEQ ID NO: 1103403 - RNA, 15 nt, Homo sapiens
cucccucauuccacc

SEQ ID NO: 1103404 - RNA, 22 nt, Homo sapiens
cuccgcugggaggaaccugaac

SEQ ID NO: 1103405 - RNA, 13 nt, Homo sapiens
cuccucagacugc

SEQ ID NO: 1103406 - RNA, 17 nt, Homo sapiens
cuccucguaugcaugga

SEQ ID NO: 1103407 - RNA, 20 nt, Homo sapiens
cuccugcaggugucuaucca

SEQ ID NO: 1103408 - RNA, 15 nt, Homo sapiens
cuccugcccaggaga

SEQ ID NO: 1103409 - RNA, 16 nt, Homo sapiens
cuccugccuacauucc

SEQ ID NO: 1103410 - RNA, 20 nt, Homo sapiens
cuccuggccucaagugauuc

SEQ ID NO: 1103411 - RNA, 14 nt, Homo sapiens
cuccugugcaacuu

SEQ ID NO: 1103412 - RNA, 18 nt, Homo sapiens
cuccugugucuugcaaug

SEQ ID NO: 1103413 - RNA, 24 nt, Homo sapiens
cuccuuucaccacaugugcacaug

SEQ ID NO: 1103414 - RNA, 23 nt, Homo sapiens
cuccuuuugcuugaaaccaaaga

SEQ ID NO: 1103415 - RNA, 16 nt, Homo sapiens
cucgaugaagcccaau

SEQ ID NO: 1103416 - RNA, 22 nt, Homo sapiens
cucgauuauucccuguacaaua

SEQ ID NO: 1103417 - RNA, 17 nt, Homo sapiens
cucgcaugccagagccu

SEQ ID NO: 1103418 - RNA, 11 nt, Homo sapiens
cucguccuccc

SEQ ID NO: 1103419 - RNA, 15 nt, Homo sapiens
cucgucucucugcaa

SEQ ID NO: 1103420 - RNA, 20 nt, Homo sapiens
cucuaaaaauaaaaugaugu

SEQ ID NO: 1103421 - RNA, 17 nt, Homo sapiens
cucuaacgccugagccc

SEQ ID NO: 1103422 - RNA, 20 nt, Homo sapiens
cucuacuaaaaauacaaaaa

SEQ ID NO: 1103423 - RNA, 17 nt, Homo sapiens
cucuacuccuaccucag

SEQ ID NO: 1103424 - RNA, 18 nt, Homo sapiens
cucuacuccuaccucagc

SEQ ID NO: 1103425 - RNA, 13 nt, Homo sapiens
cucuacucuggaa

SEQ ID NO: 1103426 - RNA, 19 nt, Homo sapiens
cucuacugcaagacuuaaa

SEQ ID NO: 1103427 - RNA, 12 nt, Homo sapiens
cucuaguuuuaa

SEQ ID NO: 1103428 - RNA, 17 nt, Homo sapiens
cucuaugaucuuggcac

SEQ ID NO: 1103429 - RNA, 19 nt, Homo sapiens
cucuaugccagcucagucc

SEQ ID NO: 1103430 - RNA, 17 nt, Homo sapiens
cucuccccagcaaguga

SEQ ID NO: 1103431 - RNA, 15 nt, Homo sapiens
cucuccgaccagaca

SEQ ID NO: 1103432 - RNA, 16 nt, Homo sapiens
cucuccuuguucugau

SEQ ID NO: 1103433 - RNA, 14 nt, Homo sapiens
cucucgaugccacu

SEQ ID NO: 1103434 - RNA, 20 nt, Homo sapiens
cucucuacccggcccagaga

SEQ ID NO: 1103435 - RNA, 12 nt, Homo sapiens
cucucucugugu

SEQ ID NO: 1103436 - RNA, 18 nt, Homo sapiens
cucucugagacugcuaag

SEQ ID NO: 1103437 - RNA, 23 nt, Homo sapiens
cucucuugcaggaaggacuauga

SEQ ID NO: 1103438 - RNA, 19 nt, Homo sapiens
cucugaaaucucagaauuc

SEQ ID NO: 1103439 - RNA, 11 nt, Homo sapiens
cucugaaguca

SEQ ID NO: 1103440 - RNA, 23 nt, Homo sapiens
cucugaagucacaucacaggaca

SEQ ID NO: 1103441 - RNA, 22 nt, Homo sapiens
cucugagaacagacguuaccaa

SEQ ID NO: 1103442 - RNA, 20 nt, Homo sapiens
cucugagcaaauguggcucc

SEQ ID NO: 1103443 - RNA, 15 nt, Homo sapiens
cucugauacccagag

SEQ ID NO: 1103444 - RNA, 12 nt, Homo sapiens
cucugcacaugu

SEQ ID NO: 1103445 - RNA, 21 nt, Homo sapiens
cucugcauccgacacccaccc

SEQ ID NO: 1103446 - RNA, 20 nt, Homo sapiens
cucugcccaaacauaaagag

SEQ ID NO: 1103447 - RNA, 18 nt, Homo sapiens
cucugccucccuagcuuu

SEQ ID NO: 1103448 - RNA, 23 nt, Homo sapiens
cucugcuccccagugcuaccucu

SEQ ID NO: 1103449 - RNA, 23 nt, Homo sapiens
cucugcuuuucuucccagcaaag

SEQ ID NO: 1103450 - RNA, 14 nt, Homo sapiens
cucuggaacccagg

SEQ ID NO: 1103451 - RNA, 11 nt, Homo sapiens
cucuggaccaa

SEQ ID NO: 1103452 - RNA, 22 nt, Homo sapiens
cucuggguagguguugaaaaug

SEQ ID NO: 1103453 - RNA, 18 nt, Homo sapiens
cucuguccacucugaaua

SEQ ID NO: 1103454 - RNA, 14 nt, Homo sapiens
cucugugaaaucag

SEQ ID NO: 1103455 - RNA, 14 nt, Homo sapiens
cucugugucaggug

SEQ ID NO: 1103456 - RNA, 18 nt, Homo sapiens
cucuuauagaaaguucaa

SEQ ID NO: 1103457 - RNA, 22 nt, Homo sapiens
cucuuccaguuugcuuugcccu

SEQ ID NO: 1103458 - RNA, 18 nt, Homo sapiens
cucuuccccuugcccuug

SEQ ID NO: 1103459 - RNA, 13 nt, Homo sapiens
cucuucccgggau

SEQ ID NO: 1103460 - RNA, 16 nt, Homo sapiens
cucuucccgggaucac

SEQ ID NO: 1103461 - RNA, 18 nt, Homo sapiens
cucuucccgggaucacuu

SEQ ID NO: 1103462 - RNA, 22 nt, Homo sapiens
cucuuccuacccaaccacucaa

SEQ ID NO: 1103463 - RNA, 23 nt, Homo sapiens
cucuucuacguauaaauaugaaa

SEQ ID NO: 1103464 - RNA, 20 nt, Homo sapiens
cucuucugggaacuuccuca

SEQ ID NO: 1103465 - RNA, 14 nt, Homo sapiens
cucuugaaccacag

SEQ ID NO: 1103466 - RNA, 13 nt, Homo sapiens
cucuugaggccag

SEQ ID NO: 1103467 - RNA, 12 nt, Homo sapiens
cucuugcucaaa

SEQ ID NO: 1103468 - RNA, 16 nt, Homo sapiens
cucuugucucacaugc

SEQ ID NO: 1103469 - RNA, 21 nt, Homo sapiens
cucuugugcccuucugagccc

SEQ ID NO: 1103470 - RNA, 19 nt, Homo sapiens
cucuuuauuuuuugauuga

SEQ ID NO: 1103471 - RNA, 13 nt, Homo sapiens
cucuuucuugacu

SEQ ID NO: 1103472 - RNA, 20 nt, Homo sapiens
cucuuuuguuccuggcuuug

SEQ ID NO: 1103473 - RNA, 23 nt, Homo sapiens
cugaaaaccauccaucuguggaa

SEQ ID NO: 1103474 - RNA, 13 nt, Homo sapiens
cugaaaaucacua

SEQ ID NO: 1103475 - RNA, 17 nt, Homo sapiens
cugaaagugacagagac

SEQ ID NO: 1103476 - RNA, 15 nt, Homo sapiens
cugaaagugguuuga

SEQ ID NO: 1103477 - RNA, 23 nt, Homo sapiens
cugaaauuuuaauugaacuaaca

SEQ ID NO: 1103478 - RNA, 15 nt, Homo sapiens
cugaaggucccaccu

SEQ ID NO: 1103479 - RNA, 12 nt, Homo sapiens
cugaaggugcug

SEQ ID NO: 1103480 - RNA, 13 nt, Homo sapiens
cugaagucacaca

SEQ ID NO: 1103481 - RNA, 14 nt, Homo sapiens
cugaagucacauca

SEQ ID NO: 1103482 - RNA, 18 nt, Homo sapiens
cugaaugccucaauguga

SEQ ID NO: 1103483 - RNA, 19 nt, Homo sapiens
cugaauuuggccugcacua

SEQ ID NO: 1103484 - RNA, 20 nt, Homo sapiens
cugacagaaaugcaaucucc

SEQ ID NO: 1103485 - RNA, 13 nt, Homo sapiens
cugaccaaagaga

SEQ ID NO: 1103486 - RNA, 12 nt, Homo sapiens
cugaccaagaga

SEQ ID NO: 1103487 - RNA, 13 nt, Homo sapiens
cugacccacugcu

SEQ ID NO: 1103488 - RNA, 14 nt, Homo sapiens
cugaccccaaagag

SEQ ID NO: 1103489 - RNA, 14 nt, Homo sapiens
cugaccuguguucc

SEQ ID NO: 1103490 - RNA, 15 nt, Homo sapiens
cugacuaacuauaag

SEQ ID NO: 1103491 - RNA, 14 nt, Homo sapiens
cuucaauacuucau

SEQ ID NO: 1103492 - RNA, 15 nt, Homo sapiens
cuucaaugcuuccuc

SEQ ID NO: 1103493 - RNA, 23 nt, Homo sapiens
cuucacuaccaaaugagcauuag

SEQ ID NO: 1103494 - RNA, 21 nt, Homo sapiens
cuucacuucaguugcuuugca

SEQ ID NO: 1103495 - RNA, 16 nt, Homo sapiens
cuucagaagacacugc

SEQ ID NO: 1103496 - RNA, 16 nt, Homo sapiens
cuucagauuuguguua

SEQ ID NO: 1103497 - RNA, 22 nt, Homo sapiens
cuucagccuagccgaccucagc

SEQ ID NO: 1103498 - RNA, 21 nt, Homo sapiens
cuucagggcuggaaaagucac

SEQ ID NO: 1103499 - RNA, 21 nt, Homo sapiens
cuucauccucugagugugacc

SEQ ID NO: 1103500 - RNA, 22 nt, Homo sapiens
cuucauccucugagugugacca

SEQ ID NO: 1103501 - RNA, 19 nt, Homo sapiens
cuuccaaacagaacuaugg

SEQ ID NO: 1103502 - RNA, 14 nt, Homo sapiens
cuuccaaaccugac

SEQ ID NO: 1103503 - RNA, 15 nt, Homo sapiens
cuuccagcuagugac

SEQ ID NO: 1103504 - RNA, 22 nt, Homo sapiens
cuuccagugguaccagcucacu

SEQ ID NO: 1103505 - RNA, 14 nt, Homo sapiens
cuucccuaaugaag

SEQ ID NO: 1103506 - RNA, 17 nt, Homo sapiens
cuuccucacuaugacac

SEQ ID NO: 1103507 - RNA, 18 nt, Homo sapiens
cuuccucacuaugacacu

SEQ ID NO: 1103508 - RNA, 16 nt, Homo sapiens
cuuccucagcuguaga

SEQ ID NO: 1103509 - RNA, 16 nt, Homo sapiens
cuuccugccaccaguc

SEQ ID NO: 1103510 - RNA, 19 nt, Homo sapiens
cuuccuggaguacaaacac

SEQ ID NO: 1103511 - RNA, 12 nt, Homo sapiens
cuuccuguaaca

SEQ ID NO: 1103512 - RNA, 16 nt, Homo sapiens
cuucgauggcauccug

SEQ ID NO: 1103513 - RNA, 14 nt, Homo sapiens
cuucgcugaccucg

SEQ ID NO: 1103514 - RNA, 22 nt, Homo sapiens
cuucgggagggcacucacaugc

SEQ ID NO: 1103515 - RNA, 22 nt, Homo sapiens
cuucgguuuguauuuagugucu

SEQ ID NO: 1103516 - RNA, 18 nt, Homo sapiens
cuucuauuccauggcuaa

SEQ ID NO: 1103517 - RNA, 15 nt, Homo sapiens
cuucuccaaaugaga

SEQ ID NO: 1103518 - RNA, 17 nt, Homo sapiens
cuucuccaaaugagauc

SEQ ID NO: 1103519 - RNA, 18 nt, Homo sapiens
cuucucuacagacuucuc

SEQ ID NO: 1103520 - RNA, 21 nt, Homo sapiens
cuucucuguucauuuccucaa

SEQ ID NO: 1103521 - RNA, 20 nt, Homo sapiens
cuucuggagucuccaguggu

SEQ ID NO: 1103522 - RNA, 16 nt, Homo sapiens
cuucugggaacuuccu

SEQ ID NO: 1103523 - RNA, 23 nt, Homo sapiens
cuucugggaagacaacuaggaua

SEQ ID NO: 1103524 - RNA, 17 nt, Homo sapiens
cuucuguccuacucugu

SEQ ID NO: 1103525 - RNA, 17 nt, Homo sapiens
cuucuuagcaccacaaa

SEQ ID NO: 1103526 - RNA, 14 nt, Homo sapiens
cuucuucagaagac

SEQ ID NO: 1103527 - RNA, 14 nt, Homo sapiens
cuucuuuuccaauu

SEQ ID NO: 1103528 - RNA, 14 nt, Homo sapiens
cuugaaaccaaaga

SEQ ID NO: 1103529 - RNA, 14 nt, Homo sapiens
cuugaaaugcauua

SEQ ID NO: 1103530 - RNA, 13 nt, Homo sapiens
cuugaacacuggg

SEQ ID NO: 1103531 - RNA, 14 nt, Homo sapiens
cuugaacacugggg

SEQ ID NO: 1103532 - RNA, 23 nt, Homo sapiens
cuugaauguaagaacaugaccuc

SEQ ID NO: 1103533 - RNA, 19 nt, Homo sapiens
cuugaccucaggugaucca

SEQ ID NO: 1103534 - RNA, 15 nt, Homo sapiens
cuugagccaguaauu

SEQ ID NO: 1103535 - RNA, 17 nt, Homo sapiens
cuugauccacagaaaua

SEQ ID NO: 1103536 - RNA, 13 nt, Homo sapiens
cuugaucuguaua

SEQ ID NO: 1103537 - RNA, 19 nt, Homo sapiens
cuugauguugcuuagucac

SEQ ID NO: 1103538 - RNA, 12 nt, Homo sapiens
cuugauucacaa

SEQ ID NO: 1103539 - RNA, 16 nt, Homo sapiens
cuugauucacaaugaa

SEQ ID NO: 1103540 - RNA, 15 nt, Homo sapiens
cuugauuucagguca

SEQ ID NO: 1103541 - RNA, 14 nt, Homo sapiens
cuugauuuuagccu

SEQ ID NO: 1103542 - RNA, 20 nt, Homo sapiens
cuugcacuccggagguagag

SEQ ID NO: 1103543 - RNA, 15 nt, Homo sapiens
cuugcauacagagac

SEQ ID NO: 1103544 - RNA, 20 nt, Homo sapiens
cuugcccagagaugccucca

SEQ ID NO: 1103545 - RNA, 14 nt, Homo sapiens
cuugcuauauugcc

SEQ ID NO: 1103546 - RNA, 13 nt, Homo sapiens
cuugcugccugaa

SEQ ID NO: 1103547 - RNA, 19 nt, Homo sapiens
cuuggacuauuauaauuua

SEQ ID NO: 1103548 - RNA, 23 nt, Homo sapiens
cuuggaggagggcuguaggaaga

SEQ ID NO: 1103549 - RNA, 19 nt, Homo sapiens
cuugggaguguugucacac

SEQ ID NO: 1103550 - RNA, 17 nt, Homo sapiens
cuuggucuaagugugcu

SEQ ID NO: 1103551 - RNA, 23 nt, Homo sapiens
cuuguaaaccaucgcgugcaaug

SEQ ID NO: 1103552 - RNA, 18 nt, Homo sapiens
cuuguagcagaaggcaag

SEQ ID NO: 1103553 - RNA, 14 nt, Homo sapiens
cuuguauauacaua

SEQ ID NO: 1103554 - RNA, 15 nt, Homo sapiens
cuuguaucugaagac

SEQ ID NO: 1103555 - RNA, 12 nt, Homo sapiens
cuugucucaaga

SEQ ID NO: 1103556 - RNA, 15 nt, Homo sapiens
cuugucucaagaaga

SEQ ID NO: 1103557 - RNA, 21 nt, Homo sapiens
cuugugauuuuugaacaauac

SEQ ID NO: 1103558 - RNA, 11 nt, Homo sapiens
cuugugccaua

SEQ ID NO: 1103559 - RNA, 15 nt, Homo sapiens
cuuguguguuuugag

SEQ ID NO: 1103560 - RNA, 15 nt, Homo sapiens
cuuguguuaugaagc

SEQ ID NO: 1103561 - RNA, 22 nt, Homo sapiens
cuuguucugucaccaauguacc

SEQ ID NO: 1103562 - RNA, 23 nt, Homo sapiens
cuuguuucacacuagucacauuc

SEQ ID NO: 1103563 - RNA, 14 nt, Homo sapiens
cuuguuuucuugcc

SEQ ID NO: 1103564 - RNA, 22 nt, Homo sapiens
cuuuaaaauaaaauaauuuuau

SEQ ID NO: 1103565 - RNA, 18 nt, Homo sapiens
cuuuaaauuucaucucag

SEQ ID NO: 1103566 - RNA, 20 nt, Homo sapiens
cuuuaauucucaugugaucc

SEQ ID NO: 1103567 - RNA, 11 nt, Homo sapiens
cuuuaauuuca

SEQ ID NO: 1103568 - RNA, 18 nt, Homo sapiens
cuuuaccugagaccaguu

SEQ ID NO: 1103569 - RNA, 15 nt, Homo sapiens
cuuuacguaucugcu

SEQ ID NO: 1103570 - RNA, 18 nt, Homo sapiens
cuuuacuguuagucauuu

SEQ ID NO: 1103571 - RNA, 11 nt, Homo sapiens
cuuuacuugac

SEQ ID NO: 1103572 - RNA, 21 nt, Homo sapiens
cuuuagagaauaccaguguua

SEQ ID NO: 1103573 - RNA, 23 nt, Homo sapiens
cuuuagaguagcaugagagaauu

SEQ ID NO: 1103574 - RNA, 21 nt, Homo sapiens
cuuuagcuaccucacuaugcu

SEQ ID NO: 1103575 - RNA, 19 nt, Homo sapiens
cuuuagggcuuauggccag

SEQ ID NO: 1103576 - RNA, 16 nt, Homo sapiens
cuuuaggugccuccug

SEQ ID NO: 1103577 - RNA, 21 nt, Homo sapiens
cuuuauauuuuuaacuuuaag

SEQ ID NO: 1103578 - RNA, 18 nt, Homo sapiens
cuuuaucuaauaccucug

SEQ ID NO: 1103579 - RNA, 16 nt, Homo sapiens
cuuuauguuacuacau

SEQ ID NO: 1103580 - RNA, 19 nt, Homo sapiens
cuuuauguuacuacaugca

SEQ ID NO: 1103581 - RNA, 24 nt, Homo sapiens
cuuucaacuuaaaucacugaggca

SEQ ID NO: 1103582 - RNA, 16 nt, Homo sapiens
uccagaaggcaaaaag

SEQ ID NO: 1103583 - RNA, 14 nt, Homo sapiens
uccagacccggcug

SEQ ID NO: 1103584 - RNA, 16 nt, Homo sapiens
uccagaggugauggua

SEQ ID NO: 1103585 - RNA, 18 nt, Homo sapiens
uccagcacagaaggaauc

SEQ ID NO: 1103586 - RNA, 20 nt, Homo sapiens
uccagccugggcaacagagc

SEQ ID NO: 1103587 - RNA, 23 nt, Homo sapiens
uccaggaagguagcccagcacug

SEQ ID NO: 1103588 - RNA, 20 nt, Homo sapiens
uccaggaugaguuacuugaa

SEQ ID NO: 1103589 - RNA, 17 nt, Homo sapiens
uccagugguaccagcuc

SEQ ID NO: 1103590 - RNA, 19 nt, Homo sapiens
uccauaaacacccaugaau

SEQ ID NO: 1103591 - RNA, 18 nt, Homo sapiens
uccaucccgcccuuccca

SEQ ID NO: 1103592 - RNA, 15 nt, Homo sapiens
uccaucucaaaaaau

SEQ ID NO: 1103593 - RNA, 15 nt, Homo sapiens
uccaucuccacucca

SEQ ID NO: 1103594 - RNA, 14 nt, Homo sapiens
uccaugccugggaa

SEQ ID NO: 1103595 - RNA, 22 nt, Homo sapiens
uccauuuauugcacucagcuuu

SEQ ID NO: 1103596 - RNA, 10 nt, Homo sapiens
ucccaaagaa

SEQ ID NO: 1103597 - RNA, 15 nt, Homo sapiens
ucccaaauaaacucc

SEQ ID NO: 1103598 - RNA, 12 nt, Homo sapiens
ucccaaccugau

SEQ ID NO: 1103599 - RNA, 21 nt, Homo sapiens
ucccaacuccucccuauccua

SEQ ID NO: 1103600 - RNA, 17 nt, Homo sapiens
ucccaacucgaugggca

SEQ ID NO: 1103601 - RNA, 20 nt, Homo sapiens
ucccaagagcaucaugccuc

SEQ ID NO: 1103602 - RNA, 22 nt, Homo sapiens
ucccaauaaaagugacucucag

SEQ ID NO: 1103603 - RNA, 14 nt, Homo sapiens
ucccacagcacuaa

SEQ ID NO: 1103604 - RNA, 14 nt, Homo sapiens
ucccacagggccag

SEQ ID NO: 1103605 - RNA, 16 nt, Homo sapiens
ucccacccacauguga

SEQ ID NO: 1103606 - RNA, 19 nt, Homo sapiens
ucccacccacaugugacac

SEQ ID NO: 1103607 - RNA, 13 nt, Homo sapiens
ucccagcacuuug

SEQ ID NO: 1103608 - RNA, 19 nt, Homo sapiens
ucccagcccuauggaugug

SEQ ID NO: 1103609 - RNA, 13 nt, Homo sapiens
ucccagcuacuca

SEQ ID NO: 1103610 - RNA, 15 nt, Homo sapiens
ucccagcuacuuggg

SEQ ID NO: 1103611 - RNA, 19 nt, Homo sapiens
ucccaggccccaugaccuc

SEQ ID NO: 1103612 - RNA, 15 nt, Homo sapiens
ucccauucuugcaug

SEQ ID NO: 1103613 - RNA, 23 nt, Homo sapiens
ucccauugucaccuaacucugaa

SEQ ID NO: 1103614 - RNA, 20 nt, Homo sapiens
ucccauuuccugagaccaca

SEQ ID NO: 1103615 - RNA, 22 nt, Homo sapiens
ucccauuuguaauguaucuuau

SEQ ID NO: 1103616 - RNA, 22 nt, Homo sapiens
uccccaauuaucuuauuuaauu

SEQ ID NO: 1103617 - RNA, 11 nt, Homo sapiens
uccccagcucc

SEQ ID NO: 1103618 - RNA, 18 nt, Homo sapiens
uccccgcagagcucccuu

SEQ ID NO: 1103619 - RNA, 15 nt, Homo sapiens
uccccuccucacagu

SEQ ID NO: 1103620 - RNA, 23 nt, Homo sapiens
uccccuggggucucugcugcauu

SEQ ID NO: 1103621 - RNA, 19 nt, Homo sapiens
ucccgggagaggagaucag

SEQ ID NO: 1103622 - RNA, 20 nt, Homo sapiens
ucccuaaaauaaaaaccaga

SEQ ID NO: 1103623 - RNA, 13 nt, Homo sapiens
ucccuaucaaaac

SEQ ID NO: 1103624 - RNA, 17 nt, Homo sapiens
ucccuccuuauuuuuga

SEQ ID NO: 1103625 - RNA, 21 nt, Homo sapiens
ucccuccuuauuuuugaauug

SEQ ID NO: 1103626 - RNA, 19 nt, Homo sapiens
ucccucuaauuuaucuugu

SEQ ID NO: 1103627 - RNA, 21 nt, Homo sapiens
ucccucugagaauuccaagga

SEQ ID NO: 1103628 - RNA, 14 nt, Homo sapiens
ucccucuuugccug

SEQ ID NO: 1103629 - RNA, 23 nt, Homo sapiens
ucccuggggucacaugcuuuguu

SEQ ID NO: 1103630 - RNA, 12 nt, Homo sapiens
ucccuuccugac

SEQ ID NO: 1103631 - RNA, 18 nt, Homo sapiens
ucccuuuccuacucucag

SEQ ID NO: 1103632 - RNA, 19 nt, Homo sapiens
uccuaaaggcccacuggca

SEQ ID NO: 1103633 - RNA, 14 nt, Homo sapiens
uccuaaauuuccag

SEQ ID NO: 1103634 - RNA, 20 nt, Homo sapiens
uccuaacaaguagcacccug

SEQ ID NO: 1103635 - RNA, 14 nt, Homo sapiens
uccuacaagcuaaa

SEQ ID NO: 1103636 - RNA, 12 nt, Homo sapiens
uccuaccucagc

SEQ ID NO: 1103637 - RNA, 21 nt, Homo sapiens
uccuauggaaggguaauuuga

SEQ ID NO: 1103638 - RNA, 20 nt, Homo sapiens
uccuauuucuuauagucaau

SEQ ID NO: 1103639 - RNA, 18 nt, Homo sapiens
uccucacaguugccaugu

SEQ ID NO: 1103640 - RNA, 22 nt, Homo sapiens
uccucagagaauuucuaccauu

SEQ ID NO: 1103641 - RNA, 13 nt, Homo sapiens
uccucagcugaca

SEQ ID NO: 1103642 - RNA, 22 nt, Homo sapiens
uccucccccaccuucaagcacc

SEQ ID NO: 1103643 - RNA, 22 nt, Homo sapiens
uccucccuuguggcuuccucag

SEQ ID NO: 1103644 - RNA, 19 nt, Homo sapiens
uccuccuuguucuacucau

SEQ ID NO: 1103645 - RNA, 13 nt, Homo sapiens
uccucguagccau

SEQ ID NO: 1103646 - RNA, 20 nt, Homo sapiens
uccucuaagccacucuucca

SEQ ID NO: 1103647 - RNA, 13 nt, Homo sapiens
uccugagcacugc

SEQ ID NO: 1103648 - RNA, 22 nt, Homo sapiens
uccugagugugggcuucugaaa

SEQ ID NO: 1103649 - RNA, 14 nt, Homo sapiens
uccugauacugggu

SEQ ID NO: 1103650 - RNA, 15 nt, Homo sapiens
uccugcaccgagaga

SEQ ID NO: 1103651 - RNA, 15 nt, Homo sapiens
uccugccuacauucc

SEQ ID NO: 1103652 - RNA, 16 nt, Homo sapiens
uccugccuucauggaa

SEQ ID NO: 1103653 - RNA, 15 nt, Homo sapiens
uccuggacagcugug

SEQ ID NO: 1103654 - RNA, 18 nt, Homo sapiens
uccugggggaugugcacg

SEQ ID NO: 1103655 - RNA, 20 nt, Homo sapiens
uccugggggaugugcacggc

SEQ ID NO: 1103656 - RNA, 17 nt, Homo sapiens
uccuggucugcucagga

SEQ ID NO: 1103657 - RNA, 19 nt, Homo sapiens
uccuguauucuacagcaga

SEQ ID NO: 1103658 - RNA, 22 nt, Homo sapiens
uccuguauucuacagcagauac

SEQ ID NO: 1103659 - RNA, 13 nt, Homo sapiens
uccuguuacuuaa

SEQ ID NO: 1103660 - RNA, 16 nt, Homo sapiens
uccuuagagacaucaa

SEQ ID NO: 1103661 - RNA, 18 nt, Homo sapiens
uccuuagcuuagaccuca

SEQ ID NO: 1103662 - RNA, 20 nt, Homo sapiens
uccuuagcuuagaccucagc

SEQ ID NO: 1103663 - RNA, 13 nt, Homo sapiens
uccuucagugcau

SEQ ID NO: 1103664 - RNA, 12 nt, Homo sapiens
uccuucauuucc

SEQ ID NO: 1103665 - RNA, 16 nt, Homo sapiens
uccuucccccaucccc

SEQ ID NO: 1103666 - RNA, 19 nt, Homo sapiens
uccuuccucaguccuggaa

SEQ ID NO: 1103667 - RNA, 17 nt, Homo sapiens
uccuugauacugcucau

SEQ ID NO: 1103668 - RNA, 13 nt, Homo sapiens
uccuugauucaca

SEQ ID NO: 1103669 - RNA, 14 nt, Homo sapiens
uccuugcaccugca

SEQ ID NO: 1103670 - RNA, 18 nt, Homo sapiens
uccuugggaugaucuuga

SEQ ID NO: 1103671 - RNA, 20 nt, Homo sapiens
uccuugugguuuaugucauc

SEQ ID NO: 1103672 - RNA, 15 nt, Homo sapiens
uccuuuacuaaucca

SEQ ID NO: 1103673 - RNA, 19 nt, Homo sapiens
ugagcagacugcaaaucug

SEQ ID NO: 1103674 - RNA, 17 nt, Homo sapiens
ugagcaguagaagccug

SEQ ID NO: 1103675 - RNA, 18 nt, Homo sapiens
ugagcauggucacaagca

SEQ ID NO: 1103676 - RNA, 22 nt, Homo sapiens
ugagccagccuugcaguaggca

SEQ ID NO: 1103677 - RNA, 17 nt, Homo sapiens
ugagccugucacguggu

SEQ ID NO: 1103678 - RNA, 19 nt, Homo sapiens
ugagcucacugaaaagacu

SEQ ID NO: 1103679 - RNA, 22 nt, Homo sapiens
ugagcugcaacuucuuacuucc

SEQ ID NO: 1103680 - RNA, 20 nt, Homo sapiens
ugagcugguuugucaaacaa

SEQ ID NO: 1103681 - RNA, 14 nt, Homo sapiens
ugaggcaaaggcca

SEQ ID NO: 1103682 - RNA, 23 nt, Homo sapiens
ugaggcaggaggaucacagugac

SEQ ID NO: 1103683 - RNA, 20 nt, Homo sapiens
ugaggcaugagaaucacuug

SEQ ID NO: 1103684 - RNA, 17 nt, Homo sapiens
ugaggcauuuuuacuac

SEQ ID NO: 1103685 - RNA, 21 nt, Homo sapiens
ugaggcggguggaucacuuga

SEQ ID NO: 1103686 - RNA, 16 nt, Homo sapiens
ugagggaaaaugagua

SEQ ID NO: 1103687 - RNA, 20 nt, Homo sapiens
ugagggacuggaaccaggga

SEQ ID NO: 1103688 - RNA, 20 nt, Homo sapiens
ugagucaccaagcccaguua

SEQ ID NO: 1103689 - RNA, 14 nt, Homo sapiens
ugagucaugaucuc

SEQ ID NO: 1103690 - RNA, 20 nt, Homo sapiens
ugagucaugaucucccugcc

SEQ ID NO: 1103691 - RNA, 14 nt, Homo sapiens
ugagucgaggacag

SEQ ID NO: 1103692 - RNA, 21 nt, Homo sapiens
ugagugacaugggugugccag

SEQ ID NO: 1103693 - RNA, 22 nt, Homo sapiens
ugaguggcugaaauaaaagccu

SEQ ID NO: 1103694 - RNA, 16 nt, Homo sapiens
ugaguuauuuugcuaa

SEQ ID NO: 1103695 - RNA, 19 nt, Homo sapiens
ugaguugcccaucuuguuu

SEQ ID NO: 1103696 - RNA, 20 nt, Homo sapiens
ugaguuuuugauagcuuuau

SEQ ID NO: 1103697 - RNA, 21 nt, Homo sapiens
ugauaaacauuaaacacugua

SEQ ID NO: 1103698 - RNA, 15 nt, Homo sapiens
ugauaaggaugauaa

SEQ ID NO: 1103699 - RNA, 22 nt, Homo sapiens
ugauacccaaguuauugggaug

SEQ ID NO: 1103700 - RNA, 16 nt, Homo sapiens
ugauagaguguuauca

SEQ ID NO: 1103701 - RNA, 11 nt, Homo sapiens
ugauagcuuua

SEQ ID NO: 1103702 - RNA, 15 nt, Homo sapiens
ugauauugcauaugc

SEQ ID NO: 1103703 - RNA, 17 nt, Homo sapiens
ugauauuuuuacuugca

SEQ ID NO: 1103704 - RNA, 11 nt, Homo sapiens
ugaucaaguca

SEQ ID NO: 1103705 - RNA, 12 nt, Homo sapiens
ugaucaauccuu

SEQ ID NO: 1103706 - RNA, 18 nt, Homo sapiens
ugaucacggcucacugca

SEQ ID NO: 1103707 - RNA, 21 nt, Homo sapiens
ugauccacagaaauacaugaa

SEQ ID NO: 1103708 - RNA, 17 nt, Homo sapiens
ugauccacccaccucag

SEQ ID NO: 1103709 - RNA, 17 nt, Homo sapiens
ugaucccuagcugugac

SEQ ID NO: 1103710 - RNA, 16 nt, Homo sapiens
ugauccguuccauugc

SEQ ID NO: 1103711 - RNA, 14 nt, Homo sapiens
ugaucuuugcagac

SEQ ID NO: 1103712 - RNA, 19 nt, Homo sapiens
ugaugacagacacuucuaa

SEQ ID NO: 1103713 - RNA, 16 nt, Homo sapiens
ugauggccaggccaga

SEQ ID NO: 1103714 - RNA, 15 nt, Homo sapiens
ugaugggaucuguaa

SEQ ID NO: 1103715 - RNA, 19 nt, Homo sapiens
ugaugguaacugcacacau

SEQ ID NO: 1103716 - RNA, 16 nt, Homo sapiens
ugaugguaagacugua

SEQ ID NO: 1103717 - RNA, 16 nt, Homo sapiens
ugauguacuacauuaa

SEQ ID NO: 1103718 - RNA, 15 nt, Homo sapiens
ugaugugaguugcac

SEQ ID NO: 1103719 - RNA, 15 nt, Homo sapiens
ugauuacuaugcucu

SEQ ID NO: 1103720 - RNA, 13 nt, Homo sapiens
ugauuagcacuua

SEQ ID NO: 1103721 - RNA, 15 nt, Homo sapiens
ugauuagcacuuaau

SEQ ID NO: 1103722 - RNA, 15 nt, Homo sapiens
ugauuauuaaagucc

SEQ ID NO: 1103723 - RNA, 21 nt, Homo sapiens
ugauucacaaugaaaugcucu

SEQ ID NO: 1103724 - RNA, 18 nt, Homo sapiens
ugauucagacagcuuaug

SEQ ID NO: 1103725 - RNA, 14 nt, Homo sapiens
ugauucgaaugaca

SEQ ID NO: 1103726 - RNA, 22 nt, Homo sapiens
ugauucuccugccucagccucc

SEQ ID NO: 1103727 - RNA, 16 nt, Homo sapiens
ugauugacacacagca

SEQ ID NO: 1103728 - RNA, 21 nt, Homo sapiens
ugauugacacacagcacucuc

SEQ ID NO: 1103729 - RNA, 19 nt, Homo sapiens
ugauuggacauuuucuuca

SEQ ID NO: 1103730 - RNA, 16 nt, Homo sapiens
ugauuuaugaucacuu

SEQ ID NO: 1103731 - RNA, 13 nt, Homo sapiens
ugauuucaagacc

SEQ ID NO: 1103732 - RNA, 13 nt, Homo sapiens
ugauuucaggaua

SEQ ID NO: 1103733 - RNA, 18 nt, Homo sapiens
ugauuuuauacauaguca

SEQ ID NO: 1103734 - RNA, 21 nt, Homo sapiens
ugcaaaaaaaaacuuugacaa

SEQ ID NO: 1103735 - RNA, 19 nt, Homo sapiens
ugcaaacucacugcucaag

SEQ ID NO: 1103736 - RNA, 16 nt, Homo sapiens
ugcaaaggugugcaaa

SEQ ID NO: 1103737 - RNA, 13 nt, Homo sapiens
ugcaacaacaugu

SEQ ID NO: 1103738 - RNA, 23 nt, Homo sapiens
ugcaauaaaagguauugagccau

SEQ ID NO: 1103739 - RNA, 18 nt, Homo sapiens
ugcaauaaaauaguauug

SEQ ID NO: 1103740 - RNA, 13 nt, Homo sapiens
ugcacacaccaga

SEQ ID NO: 1103741 - RNA, 15 nt, Homo sapiens
ugcacagcuaugaag

SEQ ID NO: 1103742 - RNA, 22 nt, Homo sapiens
ugcacauauggacucugcacau

SEQ ID NO: 1103743 - RNA, 13 nt, Homo sapiens
ugcacaugaaucc

SEQ ID NO: 1103744 - RNA, 20 nt, Homo sapiens
ugcacaugucuuguacaugu

SEQ ID NO: 1103745 - RNA, 13 nt, Homo sapiens
ugcaccaaaucau

SEQ ID NO: 1103746 - RNA, 17 nt, Homo sapiens
ugcaccaaaucaucucu

SEQ ID NO: 1103747 - RNA, 20 nt, Homo sapiens
ugcacuccagccugggcaac

SEQ ID NO: 1103748 - RNA, 21 nt, Homo sapiens
ugcagaauacaguaagcugcu

SEQ ID NO: 1103749 - RNA, 17 nt, Homo sapiens
ugcagaauccaaaguaa

SEQ ID NO: 1103750 - RNA, 15 nt, Homo sapiens
ugcagacucacugug

SEQ ID NO: 1103751 - RNA, 20 nt, Homo sapiens
ugcagacucuacagaggcca

SEQ ID NO: 1103752 - RNA, 16 nt, Homo sapiens
ugcagagcugaagauu

SEQ ID NO: 1103753 - RNA, 16 nt, Homo sapiens
ugcagaguaggcagcu

SEQ ID NO: 1103754 - RNA, 23 nt, Homo sapiens
ugcagaugagcagucacacuguu

SEQ ID NO: 1103755 - RNA, 16 nt, Homo sapiens
ugcagccaaacagagc

SEQ ID NO: 1103756 - RNA, 15 nt, Homo sapiens
ugcagcugugccaua

SEQ ID NO: 1103757 - RNA, 15 nt, Homo sapiens
ugcagcuuccuguca

SEQ ID NO: 1103758 - RNA, 20 nt, Homo sapiens
ugcagucaacaguucaaaga

SEQ ID NO: 1103759 - RNA, 14 nt, Homo sapiens
ugcagugggccauc

SEQ ID NO: 1103760 - RNA, 18 nt, Homo sapiens
ugcauaaaugugguacaa

SEQ ID NO: 1103761 - RNA, 21 nt, Homo sapiens
ugcauaaaugugguacaagca

SEQ ID NO: 1103762 - RNA, 19 nt, Homo sapiens
ugcauagagccacguaugu

SEQ ID NO: 1103763 - RNA, 15 nt, Homo sapiens
ugcaugaaucuguac

SEQ ID NO: 1103764 - RNA, 18 nt, Homo sapiens
ugaaaauuaugagucucu

SEQ ID NO: 1103765 - RNA, 12 nt, Homo sapiens
ugaaaccaaaga

SEQ ID NO: 1103766 - RNA, 16 nt, Homo sapiens
ugaaacccuguaucua

SEQ ID NO: 1103767 - RNA, 15 nt, Homo sapiens
ugaaaccucaucucu

SEQ ID NO: 1103768 - RNA, 19 nt, Homo sapiens
ugaaacuucauaaauguuc

SEQ ID NO: 1103769 - RNA, 23 nt, Homo sapiens
ugaaacuuguuuauuauguacaa

SEQ ID NO: 1103770 - RNA, 17 nt, Homo sapiens
ugaaagaaccaaaagag

SEQ ID NO: 1103771 - RNA, 21 nt, Homo sapiens
ugaaagaaccaaaagagauca

SEQ ID NO: 1103772 - RNA, 14 nt, Homo sapiens
ugaaagaccuucuc

SEQ ID NO: 1103773 - RNA, 12 nt, Homo sapiens
ugaaagaugcaa

SEQ ID NO: 1103774 - RNA, 21 nt, Homo sapiens
ugguuucauuucuacugugac

SEQ ID NO: 1103775 - RNA, 18 nt, Homo sapiens
ugguuucccaagagcuac

SEQ ID NO: 1103776 - RNA, 20 nt, Homo sapiens
uguaaaauaaguauuuccau

SEQ ID NO: 1103777 - RNA, 13 nt, Homo sapiens
uguaaacagcucu

SEQ ID NO: 1103778 - RNA, 18 nt, Homo sapiens
uguaaagaauaaaugaau

SEQ ID NO: 1103779 - RNA, 22 nt, Homo sapiens
uguaaagaauaaaugaaucuua

SEQ ID NO: 1103780 - RNA, 15 nt, Homo sapiens
uguaacaagccagau

SEQ ID NO: 1103781 - RNA, 15 nt, Homo sapiens
uguaacauuaauucu

SEQ ID NO: 1103782 - RNA, 15 nt, Homo sapiens
uguaauaaaucugag

SEQ ID NO: 1103783 - RNA, 13 nt, Homo sapiens
uguaaucccagca

SEQ ID NO: 1103784 - RNA, 22 nt, Homo sapiens
uguaaucccagcaugcugagau

SEQ ID NO: 1103785 - RNA, 17 nt, Homo sapiens
uguaaucccagcuacau

SEQ ID NO: 1103786 - RNA, 19 nt, Homo sapiens
uguaaucccagcuacuugg

SEQ ID NO: 1103787 - RNA, 12 nt, Homo sapiens
uguaaugcauag

SEQ ID NO: 1103788 - RNA, 17 nt, Homo sapiens
uguaaugucaccaccuu

SEQ ID NO: 1103789 - RNA, 16 nt, Homo sapiens
ugugcuugucaucugc

SEQ ID NO: 1103790 - RNA, 13 nt, Homo sapiens
uguggacacagcu

SEQ ID NO: 1103791 - RNA, 16 nt, Homo sapiens
uguggagagugagaau

SEQ ID NO: 1103792 - RNA, 17 nt, Homo sapiens
uguggagagugagaaua

SEQ ID NO: 1103793 - RNA, 15 nt, Homo sapiens
uguggcccaagacaa

SEQ ID NO: 1103794 - RNA, 23 nt, Homo sapiens
uguggcccagggaagccaaaaga

SEQ ID NO: 1103795 - RNA, 13 nt, Homo sapiens
ugugggacugaga

SEQ ID NO: 1103796 - RNA, 13 nt, Homo sapiens
ugugggcugcaga

SEQ ID NO: 1103797 - RNA, 17 nt, Homo sapiens
uguggguuuuuucacau

SEQ ID NO: 1103798 - RNA, 16 nt, Homo sapiens
ugugguacaagcauuc

SEQ ID NO: 1103799 - RNA, 16 nt, Homo sapiens
ugugguacaaucucaa

SEQ ID NO: 1103800 - RNA, 20 nt, Homo sapiens
uguggucaauccgaaguaug

SEQ ID NO: 1103801 - RNA, 21 nt, Homo sapiens
ugugguccgaagucuuccaua

SEQ ID NO: 1103802 - RNA, 16 nt, Homo sapiens
uguguagcucugucca

SEQ ID NO: 1103803 - RNA, 20 nt, Homo sapiens
uguguagcucuguccacucu

SEQ ID NO: 1103804 - RNA, 12 nt, Homo sapiens
ugugucuguaca

SEQ ID NO: 1103805 - RNA, 16 nt, Homo sapiens
ugugucuguacacgug

SEQ ID NO: 1103806 - RNA, 17 nt, Homo sapiens
ugugugaaggucuugcc

SEQ ID NO: 1103807 - RNA, 16 nt, Homo sapiens
ugugugggcugcagau

SEQ ID NO: 1103808 - RNA, 14 nt, Homo sapiens
uguguguaccugug

SEQ ID NO: 1103809 - RNA, 12 nt, Homo sapiens
uguguguagcca

SEQ ID NO: 1103810 - RNA, 13 nt, Homo sapiens
uguguucagugcc

SEQ ID NO: 1103811 - RNA, 18 nt, Homo sapiens
uguguucucuauugcugc

SEQ ID NO: 1103812 - RNA, 13 nt, Homo sapiens
uguguuugcugag

SEQ ID NO: 1103813 - RNA, 13 nt, Homo sapiens
uguuaaacacgug

SEQ ID NO: 1103814 - RNA, 14 nt, Homo sapiens
uguuaacuauugua

SEQ ID NO: 1103815 - RNA, 14 nt, Homo sapiens
uguuaauaucuuga

SEQ ID NO: 1103816 - RNA, 14 nt, Homo sapiens
uguuacacaugaca

SEQ ID NO: 1103817 - RNA, 16 nt, Homo sapiens
uguucccccgcuggca

SEQ ID NO: 1103818 - RNA, 20 nt, Homo sapiens
uguucccuccccgaucaucu

SEQ ID NO: 1103819 - RNA, 22 nt, Homo sapiens
uguucccuccccgaucaucuuu

SEQ ID NO: 1103820 - RNA, 15 nt, Homo sapiens
uguucuuagcugaac

SEQ ID NO: 1103821 - RNA, 21 nt, Homo sapiens
uguucuuagcugaacaaugaa

SEQ ID NO: 1103822 - RNA, 14 nt, Homo sapiens
uguugacaugugcu

SEQ ID NO: 1103823 - RNA, 21 nt, Homo sapiens
uguugaugaggccucuuggac

SEQ ID NO: 1103824 - RNA, 16 nt, Homo sapiens
uguugcaaugacacau

SEQ ID NO: 1103825 - RNA, 21 nt, Homo sapiens
uguuguggguuuuuucacaua

SEQ ID NO: 1103826 - RNA, 22 nt, Homo sapiens
uguuguggguuuuuucacauaa

SEQ ID NO: 1103827 - RNA, 14 nt, Homo sapiens
uguuuacuuuaugu

SEQ ID NO: 1103828 - RNA, 19 nt, Homo sapiens
uguuucuaaaacuaugguu

SEQ ID NO: 1103829 - RNA, 23 nt, Homo sapiens
uguuugaaugaguuuauauggaa

SEQ ID NO: 1103830 - RNA, 23 nt, Homo sapiens
uguuugucauagggcaguuggaa

SEQ ID NO: 1103831 - RNA, 16 nt, Homo sapiens
uguuuguggaacaaaa

SEQ ID NO: 1103832 - RNA, 22 nt, Homo sapiens
uguuuuagcuccuugacuccuu

SEQ ID NO: 1103833 - RNA, 20 nt, Homo sapiens
uguuuuaucauuaccauuaa

SEQ ID NO: 1103834 - RNA, 21 nt, Homo sapiens
uguuuucuaaaguuguucaca

SEQ ID NO: 1103835 - RNA, 22 nt, Homo sapiens
uguuuuguaucaaaaucacuau

SEQ ID NO: 1103836 - RNA, 15 nt, Homo sapiens
uguuuuuaacaacua

SEQ ID NO: 1103837 - RNA, 13 nt, Homo sapiens
uguuuuuaagcug

SEQ ID NO: 1103838 - RNA, 17 nt, Homo sapiens
uuaaaaaaauaagaaga

SEQ ID NO: 1103839 - RNA, 11 nt, Homo sapiens
uuaaaaaccac

SEQ ID NO: 1103840 - RNA, 20 nt, Homo sapiens
uuaaaacaacacucacauuu

SEQ ID NO: 1103841 - RNA, 22 nt, Homo sapiens
uuaaaacaacacucacauuuau

SEQ ID NO: 1103842 - RNA, 13 nt, Homo sapiens
uuaaaacacagcu

SEQ ID NO: 1103843 - RNA, 12 nt, Homo sapiens
uuaaaagaauuu

SEQ ID NO: 1103844 - RNA, 14 nt, Homo sapiens
uuaaaauagcaaaa

SEQ ID NO: 1103845 - RNA, 19 nt, Homo sapiens
uuaaaauagcaaaagaaga

SEQ ID NO: 1103846 - RNA, 16 nt, Homo sapiens
uuaaaaucauucaaua

SEQ ID NO: 1103847 - RNA, 17 nt, Homo sapiens
uuaaacaaauguaugau

SEQ ID NO: 1103848 - RNA, 13 nt, Homo sapiens
uuaaacaccugac

SEQ ID NO: 1103849 - RNA, 19 nt, Homo sapiens
uuaaacauaggaaagaaga

SEQ ID NO: 1103850 - RNA, 20 nt, Homo sapiens
uuaaacccugccccacuucu

SEQ ID NO: 1103851 - RNA, 22 nt, Homo sapiens
uuaaaggcugugguaguacucc

SEQ ID NO: 1103852 - RNA, 19 nt, Homo sapiens
uuaaaguaaugagcaugau

SEQ ID NO: 1103853 - RNA, 19 nt, Homo sapiens
uuaaaguuguuugugccuu

SEQ ID NO: 1103854 - RNA, 14 nt, Homo sapiens
uuaaaugaacauca

SEQ ID NO: 1103855 - RNA, 18 nt, Homo sapiens
uuaaaugcaauauuccug

SEQ ID NO: 1103856 - RNA, 13 nt, Homo sapiens
uuaaaugcauguc

SEQ ID NO: 1103857 - RNA, 15 nt, Homo sapiens
uuaaauguuucucaa

SEQ ID NO: 1103858 - RNA, 15 nt, Homo sapiens
uuaaauuucaucuca

SEQ ID NO: 1103859 - RNA, 21 nt, Homo sapiens
uuaaccugaauuauuccaacu

SEQ ID NO: 1103860 - RNA, 16 nt, Homo sapiens
uuaacgucaucucagg

SEQ ID NO: 1103861 - RNA, 15 nt, Homo sapiens
uuaacugauguuacu

SEQ ID NO: 1103862 - RNA, 17 nt, Homo sapiens
uuaacugugaaccugga

SEQ ID NO: 1103863 - RNA, 15 nt, Homo sapiens
uuaacuuaacauucu

SEQ ID NO: 1103864 - RNA, 14 nt, Homo sapiens
uuaagagauacauu

SEQ ID NO: 1103865 - RNA, 16 nt, Homo sapiens
uuaagggaauaagcca

SEQ ID NO: 1103866 - RNA, 19 nt, Homo sapiens
uuaaggggagcaacagagg

SEQ ID NO: 1103867 - RNA, 20 nt, Homo sapiens
uuaaguuauugauguuuuaa

SEQ ID NO: 1103868 - RNA, 13 nt, Homo sapiens
uuaauaaagaagu

SEQ ID NO: 1103869 - RNA, 21 nt, Homo sapiens
uuaauaacuuguccuauguca

SEQ ID NO: 1103870 - RNA, 12 nt, Homo sapiens
uuaauauguuca

SEQ ID NO: 1103871 - RNA, 20 nt, Homo sapiens
uuaaucuuucuuuaccugag

SEQ ID NO: 1103872 - RNA, 20 nt, Homo sapiens
uuaaugaacaugugaaguua

SEQ ID NO: 1103873 - RNA, 18 nt, Homo sapiens
uuaauggugccuucauuu

SEQ ID NO: 1103874 - RNA, 17 nt, Homo sapiens
uuaaugucuggugcuuu

SEQ ID NO: 1103875 - RNA, 17 nt, Homo sapiens
uuaauuaauauguucau

SEQ ID NO: 1103876 - RNA, 18 nt, Homo sapiens
uuaauuagggguugcuaa

SEQ ID NO: 1103877 - RNA, 17 nt, Homo sapiens
uuaauucucaugugauc

SEQ ID NO: 1103878 - RNA, 17 nt, Homo sapiens
aaguugcucugaaguca

SEQ ID NO: 1103879 - RNA, 20 nt, Homo sapiens
aaguugcugaugaacucuua

SEQ ID NO: 1103880 - RNA, 17 nt, Homo sapiens
aaguuuagugcccucau

SEQ ID NO: 1103881 - RNA, 20 nt, Homo sapiens
aaguuuagugcccucaucca

SEQ ID NO: 1103882 - RNA, 14 nt, Homo sapiens
aaguuuaucuuuca

SEQ ID NO: 1103883 - RNA, 21 nt, Homo sapiens
aaguuuuguggaggagcucag

SEQ ID NO: 1103884 - RNA, 20 nt, Homo sapiens
aaguuuuucagaaagcauua

SEQ ID NO: 1103885 - RNA, 18 nt, Homo sapiens
aauaaaaacccuguaugg

SEQ ID NO: 1103886 - RNA, 14 nt, Homo sapiens
aauaaaacauuccu

SEQ ID NO: 1103887 - RNA, 13 nt, Homo sapiens
aauaaaagccucu

SEQ ID NO: 1103888 - RNA, 18 nt, Homo sapiens
aauaaaauuuaggaccaa

SEQ ID NO: 1103889 - RNA, 23 nt, Homo sapiens
aauaaauuggugauaaguggaaa

SEQ ID NO: 1103890 - RNA, 16 nt, Homo sapiens
aauacacaacacacac

SEQ ID NO: 1103891 - RNA, 18 nt, Homo sapiens
aauaccagugaaccaaag

SEQ ID NO: 1103892 - RNA, 20 nt, Homo sapiens
aauaccagugaaccaaagag

SEQ ID NO: 1103893 - RNA, 22 nt, Homo sapiens
aauaccagugaaccaaagagac

SEQ ID NO: 1103894 - RNA, 20 nt, Homo sapiens
aauagaagaacauccaagga

SEQ ID NO: 1103895 - RNA, 21 nt, Homo sapiens
aauagaauauaauuaucggaa

SEQ ID NO: 1103896 - RNA, 23 nt, Homo sapiens
aauagaucaaaguccagcaggca

SEQ ID NO: 1103897 - RNA, 22 nt, Homo sapiens
aauagcacauccuccaacguua

SEQ ID NO: 1103898 - RNA, 17 nt, Homo sapiens
aauagcuaaauaccuca

SEQ ID NO: 1103899 - RNA, 17 nt, Homo sapiens
aauagcuauugcaugua

SEQ ID NO: 1103900 - RNA, 23 nt, Homo sapiens
aauagcugggacuacagguguga

SEQ ID NO: 1103901 - RNA, 12 nt, Homo sapiens
aauaguauuuau

SEQ ID NO: 1103902 - RNA, 17 nt, Homo sapiens
aauauaagaacuugaua

SEQ ID NO: 1103903 - RNA, 17 nt, Homo sapiens
aauauaucaauguaaca

SEQ ID NO: 1103904 - RNA, 15 nt, Homo sapiens
aauaucaguuacuca

SEQ ID NO: 1103905 - RNA, 14 nt, Homo sapiens
aauaugaauugaca

SEQ ID NO: 1103906 - RNA, 23 nt, Homo sapiens
aauaugaucauguaaaugauuau

SEQ ID NO: 1103907 - RNA, 19 nt, Homo sapiens
aauaugcacaauagcaguu

SEQ ID NO: 1103908 - RNA, 20 nt, Homo sapiens
aauauggugggcacagaagu

SEQ ID NO: 1103909 - RNA, 17 nt, Homo sapiens
aauauuauuugcuaauu

SEQ ID NO: 1103910 - RNA, 14 nt, Homo sapiens
aauauucauuguau

SEQ ID NO: 1103911 - RNA, 12 nt, Homo sapiens
aauauuccugaa

SEQ ID NO: 1103912 - RNA, 17 nt, Homo sapiens
aauauuuauuaccucug

SEQ ID NO: 1103913 - RNA, 15 nt, Homo sapiens
aauauuugcuaugaa

SEQ ID NO: 1103914 - RNA, 23 nt, Homo sapiens
aauauuuuccaugaaaaugcaac

SEQ ID NO: 1103915 - RNA, 20 nt, Homo sapiens
aauauuuuguaacuauuaca

SEQ ID NO: 1103916 - RNA, 17 nt, Homo sapiens
aauauuuuuaugugcaa

SEQ ID NO: 1103917 - RNA, 15 nt, Homo sapiens
aaucaaccagcagga

SEQ ID NO: 1103918 - RNA, 14 nt, Homo sapiens
aaucaagagugagu

SEQ ID NO: 1103919 - RNA, 14 nt, Homo sapiens
aaucacuugcacuc

SEQ ID NO: 1103920 - RNA, 20 nt, Homo sapiens
aaucagacuucacacugcaa

SEQ ID NO: 1103921 - RNA, 19 nt, Homo sapiens
aaucauaaauauaaucuaa

SEQ ID NO: 1103922 - RNA, 21 nt, Homo sapiens
aaucaucucucaucacuuuuc

SEQ ID NO: 1103923 - RNA, 13 nt, Homo sapiens
aaucaugagauaa

SEQ ID NO: 1103924 - RNA, 14 nt, Homo sapiens
aaucauggcauuca

SEQ ID NO: 1103925 - RNA, 15 nt, Homo sapiens
aaucauggcauucac

SEQ ID NO: 1103926 - RNA, 16 nt, Homo sapiens
aaucauuaauacucuu

SEQ ID NO: 1103927 - RNA, 17 nt, Homo sapiens
aaucauuuuaauuauua

SEQ ID NO: 1103928 - RNA, 16 nt, Homo sapiens
aauccaucaggacuug

SEQ ID NO: 1103929 - RNA, 20 nt, Homo sapiens
aaucccagcaugcugagauu

SEQ ID NO: 1103930 - RNA, 22 nt, Homo sapiens
aaucccagcaugcugagauuac

SEQ ID NO: 1103931 - RNA, 14 nt, Homo sapiens
aaucccggcuguca

SEQ ID NO: 1103932 - RNA, 14 nt, Homo sapiens
aauccgaaguauga

SEQ ID NO: 1103933 - RNA, 19 nt, Homo sapiens
aauccuuuacuguuaguca

SEQ ID NO: 1103934 - RNA, 14 nt, Homo sapiens
aaucgaacuaugaa

SEQ ID NO: 1103935 - RNA, 16 nt, Homo sapiens
aaucgagucuaccucu

SEQ ID NO: 1103936 - RNA, 17 nt, Homo sapiens
aaucgagucuaccucuu

SEQ ID NO: 1103937 - RNA, 15 nt, Homo sapiens
aaucuaauacacuuu

SEQ ID NO: 1103938 - RNA, 16 nt, Homo sapiens
aaucuaucuauauaau

SEQ ID NO: 1103939 - RNA, 23 nt, Homo sapiens
aaucuauuuccuuuccagucauu

SEQ ID NO: 1103940 - RNA, 19 nt, Homo sapiens
aaucuccacuguuauucua

SEQ ID NO: 1103941 - RNA, 17 nt, Homo sapiens
aaucuccccuccucaca

SEQ ID NO: 1103942 - RNA, 16 nt, Homo sapiens
aaucucucuccuguau

SEQ ID NO: 1103943 - RNA, 16 nt, Homo sapiens
aaucuuccugccucag

SEQ ID NO: 1103944 - RNA, 19 nt, Homo sapiens
aaucuuguuaaauugcuua

SEQ ID NO: 1103945 - RNA, 20 nt, Homo sapiens
aaucuuucagcacucagaaa

SEQ ID NO: 1103946 - RNA, 24 nt, Homo sapiens
aaugaaagcauguggcauguucau

SEQ ID NO: 1103947 - RNA, 12 nt, Homo sapiens
aaugaacuguga

SEQ ID NO: 1103948 - RNA, 15 nt, Homo sapiens
aaugaacugugacag

SEQ ID NO: 1103949 - RNA, 13 nt, Homo sapiens
aaugaagugcaaa

SEQ ID NO: 1103950 - RNA, 15 nt, Homo sapiens
aaugaauacaauuaa

SEQ ID NO: 1103951 - RNA, 16 nt, Homo sapiens
aaugaaugcuauugaa

SEQ ID NO: 1103952 - RNA, 14 nt, Homo sapiens
aaugacaucuucaa

SEQ ID NO: 1103953 - RNA, 13 nt, Homo sapiens
aaugacccaaaga

SEQ ID NO: 1103954 - RNA, 12 nt, Homo sapiens
aaugaccuguau

SEQ ID NO: 1103955 - RNA, 20 nt, Homo sapiens
aaugacuuugaaaaccuggc

SEQ ID NO: 1103956 - RNA, 19 nt, Homo sapiens
aaugagcugguuugucaaa

SEQ ID NO: 1103957 - RNA, 16 nt, Homo sapiens
aaugagggccaagaaa

SEQ ID NO: 1103958 - RNA, 16 nt, Homo sapiens
aaugcaacaacaugua

SEQ ID NO: 1103959 - RNA, 11 nt, Homo sapiens
aaugcaacuuc

SEQ ID NO: 1103960 - RNA, 16 nt, Homo sapiens
acaaauucaagccuua

SEQ ID NO: 1103961 - RNA, 21 nt, Homo sapiens
acaaauucuuuuucacacuga

SEQ ID NO: 1103962 - RNA, 23 nt, Homo sapiens
acaacagcaaaacuccaucucaa

SEQ ID NO: 1103963 - RNA, 14 nt, Homo sapiens
acaacauuuacuua

SEQ ID NO: 1103964 - RNA, 13 nt, Homo sapiens
acaaccagccaca

SEQ ID NO: 1103965 - RNA, 13 nt, Homo sapiens
acaaccuuugugu

SEQ ID NO: 1103966 - RNA, 12 nt, Homo sapiens
uuacuucaugag

SEQ ID NO: 1103967 - RNA, 12 nt, Homo sapiens
uuagaacuauua

SEQ ID NO: 1103968 - RNA, 16 nt, Homo sapiens
uuagaagucacacagu

SEQ ID NO: 1103969 - RNA, 22 nt, Homo sapiens
uuagacaugacugaugacauau

SEQ ID NO: 1103970 - RNA, 18 nt, Homo sapiens
uuagaggaagaaaaccag

SEQ ID NO: 1103971 - RNA, 15 nt, Homo sapiens
uuagccagugaugcu

SEQ ID NO: 1103972 - RNA, 13 nt, Homo sapiens
uuagcugaacaau

SEQ ID NO: 1103973 - RNA, 23 nt, Homo sapiens
uuagcuguaaauacaugugugga

SEQ ID NO: 1103974 - RNA, 12 nt, Homo sapiens
uuaggcauuaaa

SEQ ID NO: 1103975 - RNA, 21 nt, Homo sapiens
uuaggugcuucuucacuucag

SEQ ID NO: 1103976 - RNA, 14 nt, Homo sapiens
uuagguuuuguaca

SEQ ID NO: 1103977 - RNA, 14 nt, Homo sapiens
uuaguauaaguaca

SEQ ID NO: 1103978 - RNA, 18 nt, Homo sapiens
uuagucugucauccagaa

SEQ ID NO: 1103979 - RNA, 21 nt, Homo sapiens
uuagugucuugaauguaagaa

SEQ ID NO: 1103980 - RNA, 16 nt, Homo sapiens
uuauaaacuagaucuc

SEQ ID NO: 1103981 - RNA, 21 nt, Homo sapiens
uuauaaacuuuagaguagcau

SEQ ID NO: 1103982 - RNA, 19 nt, Homo sapiens
uuauaauaaaauugguguu

SEQ ID NO: 1103983 - RNA, 21 nt, Homo sapiens
uuauagaauauuuauuaccuc

SEQ ID NO: 1103984 - RNA, 18 nt, Homo sapiens
uuauagccgaaaugaucu

SEQ ID NO: 1103985 - RNA, 15 nt, Homo sapiens
uuauaucagccugag

SEQ ID NO: 1103986 - RNA, 13 nt, Homo sapiens
uuauaucaucagc

SEQ ID NO: 1103987 - RNA, 17 nt, Homo sapiens
uuauaugaaauguuuca

SEQ ID NO: 1103988 - RNA, 11 nt, Homo sapiens
uuauauggaaa

SEQ ID NO: 1103989 - RNA, 14 nt, Homo sapiens
uuauauugguauaa

SEQ ID NO: 1103990 - RNA, 14 nt, Homo sapiens
uuaucagucauaac

SEQ ID NO: 1103991 - RNA, 20 nt, Homo sapiens
uuaucaucucgaccacuuuu

SEQ ID NO: 1103992 - RNA, 21 nt, Homo sapiens
uuauccagaggguugugauuu

SEQ ID NO: 1103993 - RNA, 13 nt, Homo sapiens
uuauccugcauuu

SEQ ID NO: 1103994 - RNA, 17 nt, Homo sapiens
uuauccugcuagcugua

SEQ ID NO: 1103995 - RNA, 20 nt, Homo sapiens
uuaucugaucgggauaacaa

SEQ ID NO: 1103996 - RNA, 15 nt, Homo sapiens
uuaugaaaaagaaga

SEQ ID NO: 1103997 - RNA, 22 nt, Homo sapiens
uuaugagcucuucauguuucag

SEQ ID NO: 1103998 - RNA, 23 nt, Homo sapiens
uuaugagucucuaugaucuuggc

SEQ ID NO: 1103999 - RNA, 21 nt, Homo sapiens
uuaugcagaauccaaaguaaa

SEQ ID NO: 1104000 - RNA, 23 nt, Homo sapiens
uuaugccauagcaagauugcuua

SEQ ID NO: 1104001 - RNA, 19 nt, Homo sapiens
uuaugucaucauacaugac

SEQ ID NO: 1104002 - RNA, 16 nt, Homo sapiens
uuaugucucagaccac

SEQ ID NO: 1104003 - RNA, 20 nt, Homo sapiens
uuauuaaugaacugugacag

SEQ ID NO: 1104004 - RNA, 14 nt, Homo sapiens
uuauuaauucauua

SEQ ID NO: 1104005 - RNA, 13 nt, Homo sapiens
uuauuaugucuca

SEQ ID NO: 1104006 - RNA, 13 nt, Homo sapiens
uuauucacuguaa

SEQ ID NO: 1104007 - RNA, 13 nt, Homo sapiens
uuauuccaacucc

SEQ ID NO: 1104008 - RNA, 21 nt, Homo sapiens
uuauuccucccucaugagcac

SEQ ID NO: 1104009 - RNA, 22 nt, Homo sapiens
uuauugcuugauacuuuugaca

SEQ ID NO: 1104010 - RNA, 19 nt, Homo sapiens
uuauugggcaagugauuga

SEQ ID NO: 1104011 - RNA, 23 nt, Homo sapiens
uuauuguuuauuuaucagugaca

SEQ ID NO: 1104012 - RNA, 14 nt, Homo sapiens
uuauuuacaaugca

SEQ ID NO: 1104013 - RNA, 16 nt, Homo sapiens
uuauuuacaaugcaga

SEQ ID NO: 1104014 - RNA, 18 nt, Homo sapiens
uucaaaagguuauauacc

SEQ ID NO: 1104015 - RNA, 18 nt, Homo sapiens
uucaaacugcaugauuca

SEQ ID NO: 1104016 - RNA, 16 nt, Homo sapiens
uucaagccugugaaua

SEQ ID NO: 1104017 - RNA, 18 nt, Homo sapiens
uucaaguuagcucaggag

SEQ ID NO: 1104018 - RNA, 20 nt, Homo sapiens
uucaauaaagcugcugagaa

SEQ ID NO: 1104019 - RNA, 22 nt, Homo sapiens
uucaauucucauuugucacaca

SEQ ID NO: 1104020 - RNA, 19 nt, Homo sapiens
uucacaaaguuuguucccu

SEQ ID NO: 1104021 - RNA, 15 nt, Homo sapiens
uucacaaugaaaugc

SEQ ID NO: 1104022 - RNA, 19 nt, Homo sapiens
uucaccaagaaguggagac

SEQ ID NO: 1104023 - RNA, 18 nt, Homo sapiens
uucaccacaugugcacau

SEQ ID NO: 1104024 - RNA, 14 nt, Homo sapiens
uucaccugaucaua

SEQ ID NO: 1104025 - RNA, 20 nt, Homo sapiens
uucacuguagaaugauuuca

SEQ ID NO: 1104026 - RNA, 23 nt, Homo sapiens
uucagaauguacggaaagaugau

SEQ ID NO: 1104027 - RNA, 19 nt, Homo sapiens
uucagauauauuuuucaca

SEQ ID NO: 1104028 - RNA, 14 nt, Homo sapiens
uucagccaccucuc

SEQ ID NO: 1104029 - RNA, 16 nt, Homo sapiens
uucagccucucccacc

SEQ ID NO: 1104030 - RNA, 23 nt, Homo sapiens
uucagcuucagacuuuuaucaaa

SEQ ID NO: 1104031 - RNA, 18 nt, Homo sapiens
uucagggaauuucaggaa

SEQ ID NO: 1104032 - RNA, 17 nt, Homo sapiens
uucagugcuguacuuga

SEQ ID NO: 1104033 - RNA, 21 nt, Homo sapiens
uucaucaauuuuuauacauau

SEQ ID NO: 1104034 - RNA, 14 nt, Homo sapiens
uucaucuaauguga

SEQ ID NO: 1104035 - RNA, 15 nt, Homo sapiens
uucaucuauucuuuc

SEQ ID NO: 1104036 - RNA, 18 nt, Homo sapiens
uucaucuauuucugagaa

SEQ ID NO: 1104037 - RNA, 13 nt, Homo sapiens
aucucucuacucc

SEQ ID NO: 1104038 - RNA, 18 nt, Homo sapiens
aucucugccaagccuauu

SEQ ID NO: 1104039 - RNA, 16 nt, Homo sapiens
aucucuuccuacccaa

SEQ ID NO: 1104040 - RNA, 15 nt, Homo sapiens
aucucuuugauguca

SEQ ID NO: 1104041 - RNA, 21 nt, Homo sapiens
aucucuuuugaauccaugcuu

SEQ ID NO: 1104042 - RNA, 19 nt, Homo sapiens
aucugaacacauacuagaa

SEQ ID NO: 1104043 - RNA, 16 nt, Homo sapiens
aucugaaccacuuugc

SEQ ID NO: 1104044 - RNA, 16 nt, Homo sapiens
aucugagaaacuuaaa

SEQ ID NO: 1104045 - RNA, 20 nt, Homo sapiens
aucugaggaaggugcuugcc

SEQ ID NO: 1104046 - RNA, 22 nt, Homo sapiens
aucugaggaaggugcuugccug

SEQ ID NO: 1104047 - RNA, 22 nt, Homo sapiens
aucugggcuaccccacccaagu

SEQ ID NO: 1104048 - RNA, 17 nt, Homo sapiens
aucuggguucacugcaa

SEQ ID NO: 1104049 - RNA, 13 nt, Homo sapiens
aucuguaaggaac

SEQ ID NO: 1104050 - RNA, 18 nt, Homo sapiens
aucuguaaggaacuggaa

SEQ ID NO: 1104051 - RNA, 23 nt, Homo sapiens
aucuuagcuucuauuauagccac

SEQ ID NO: 1104052 - RNA, 15 nt, Homo sapiens
aucuuauauaguuua

SEQ ID NO: 1104053 - RNA, 22 nt, Homo sapiens
aucuuauuuaauuuuugcaauu

SEQ ID NO: 1104054 - RNA, 17 nt, Homo sapiens
aucuugcucugcugaca

SEQ ID NO: 1104055 - RNA, 18 nt, Homo sapiens
aucuuucuuuaccugaga

SEQ ID NO: 1104056 - RNA, 12 nt, Homo sapiens
aucuuugcagac

SEQ ID NO: 1104057 - RNA, 14 nt, Homo sapiens
aucuuuugugagau

SEQ ID NO: 1104058 - RNA, 13 nt, Homo sapiens
augaaaaaauuag

SEQ ID NO: 1104059 - RNA, 13 nt, Homo sapiens
augaaaaugucag

SEQ ID NO: 1104060 - RNA, 22 nt, Homo sapiens
augaaauccugcuucaguguau

SEQ ID NO: 1104061 - RNA, 14 nt, Homo sapiens
augaaaucugagga

SEQ ID NO: 1104062 - RNA, 16 nt, Homo sapiens
augaaaugggcuuuaa

SEQ ID NO: 1104063 - RNA, 21 nt, Homo sapiens
augaaaugucuggucugucca

SEQ ID NO: 1104064 - RNA, 20 nt, Homo sapiens
augaaauguuucacuaugau

SEQ ID NO: 1104065 - RNA, 15 nt, Homo sapiens
augaacucuuaauca

SEQ ID NO: 1104066 - RNA, 15 nt, Homo sapiens
augaagacccagugu

SEQ ID NO: 1104067 - RNA, 18 nt, Homo sapiens
augaagacccaguguaaa

SEQ ID NO: 1104068 - RNA, 19 nt, Homo sapiens
augaagacccaguguaaag

SEQ ID NO: 1104069 - RNA, 21 nt, Homo sapiens
augaagaugucuaauaguuau

SEQ ID NO: 1104070 - RNA, 12 nt, Homo sapiens
augaagcuggaa

SEQ ID NO: 1104071 - RNA, 20 nt, Homo sapiens
augaauagagaguauguaau

SEQ ID NO: 1104072 - RNA, 21 nt, Homo sapiens
augaauauuuuugucauuaaa

SEQ ID NO: 1104073 - RNA, 19 nt, Homo sapiens
augaaucccauaauugaca

SEQ ID NO: 1104074 - RNA, 12 nt, Homo sapiens
augaaugcacac

SEQ ID NO: 1104075 - RNA, 18 nt, Homo sapiens
augaauugacagacuguu

SEQ ID NO: 1104076 - RNA, 12 nt, Homo sapiens
augacacugagc

SEQ ID NO: 1104077 - RNA, 13 nt, Homo sapiens
augacagccagag

SEQ ID NO: 1104078 - RNA, 13 nt, Homo sapiens
augacccaaagac

SEQ ID NO: 1104079 - RNA, 15 nt, Homo sapiens
augacccaaagacca

SEQ ID NO: 1104080 - RNA, 18 nt, Homo sapiens
augaccuguauuuugcca

SEQ ID NO: 1104081 - RNA, 17 nt, Homo sapiens
augaccuuguugcauga

SEQ ID NO: 1104082 - RNA, 19 nt, Homo sapiens
augacuaaagcagggacaa

SEQ ID NO: 1104083 - RNA, 22 nt, Homo sapiens
augacuguuuuuauaugcacau

SEQ ID NO: 1104084 - RNA, 19 nt, Homo sapiens
augacuugggcacccccag

SEQ ID NO: 1104085 - RNA, 20 nt, Homo sapiens
augagaaaguucucauuuaa

SEQ ID NO: 1104086 - RNA, 20 nt, Homo sapiens
augagcauuagcuacuuuuc

SEQ ID NO: 1104087 - RNA, 21 nt, Homo sapiens
augagccucagcauccuggca

SEQ ID NO: 1104088 - RNA, 15 nt, Homo sapiens
augaggcaaugucag

SEQ ID NO: 1104089 - RNA, 22 nt, Homo sapiens
augaggccuuuccccagugugg

SEQ ID NO: 1104090 - RNA, 15 nt, Homo sapiens
augauaaaagcacuu

SEQ ID NO: 1104091 - RNA, 18 nt, Homo sapiens
augauauugcauaugcau

SEQ ID NO: 1104092 - RNA, 20 nt, Homo sapiens
augaucagcuguuugucaua

SEQ ID NO: 1104093 - RNA, 22 nt, Homo sapiens
augaucgcgccacuacacucca

SEQ ID NO: 1104094 - RNA, 14 nt, Homo sapiens
augaugccaaaaua

SEQ ID NO: 1104095 - RNA, 20 nt, Homo sapiens
augauuagcacuuaauaauu

SEQ ID NO: 1104096 - RNA, 14 nt, Homo sapiens
augauucauaacaa

SEQ ID NO: 1104097 - RNA, 15 nt, Homo sapiens
augauuccuugagca

SEQ ID NO: 1104098 - RNA, 16 nt, Homo sapiens
augauugugaccucca

SEQ ID NO: 1104099 - RNA, 16 nt, Homo sapiens
augcaacaacauguau

SEQ ID NO: 1104100 - RNA, 18 nt, Homo sapiens
augcaacaacauguauaa

SEQ ID NO: 1104101 - RNA, 18 nt, Homo sapiens
augcaaccuuuggaugca

SEQ ID NO: 1104102 - RNA, 24 nt, Homo sapiens
augcaaccuuuggaugcacuuuau

SEQ ID NO: 1104103 - RNA, 16 nt, Homo sapiens
augcaagcgacaggaa

SEQ ID NO: 1104104 - RNA, 18 nt, Homo sapiens
augcaaucucuugucuca

SEQ ID NO: 1104105 - RNA, 22 nt, Homo sapiens
auguucacuuauugacuauuau

SEQ ID NO: 1104106 - RNA, 19 nt, Homo sapiens
auguucagaauguacggaa

SEQ ID NO: 1104107 - RNA, 17 nt, Homo sapiens
auguuuaaaaacauucc

SEQ ID NO: 1104108 - RNA, 14 nt, Homo sapiens
auguuugaaugagu

SEQ ID NO: 1104109 - RNA, 17 nt, Homo sapiens
auguuugcuauugacaa

SEQ ID NO: 1104110 - RNA, 13 nt, Homo sapiens
auguuuugcccac

SEQ ID NO: 1104111 - RNA, 18 nt, Homo sapiens
auuaaaaaugaaagccaa

SEQ ID NO: 1104112 - RNA, 19 nt, Homo sapiens
auuaaacaccugacacauc

SEQ ID NO: 1104113 - RNA, 14 nt, Homo sapiens
auuaaacacuguaa

SEQ ID NO: 1104114 - RNA, 19 nt, Homo sapiens
auuaaaugcauguccucaa

SEQ ID NO: 1104115 - RNA, 18 nt, Homo sapiens
auuaacuuugaccagagu

SEQ ID NO: 1104116 - RNA, 16 nt, Homo sapiens
auuaagguguggcuuu

SEQ ID NO: 1104117 - RNA, 17 nt, Homo sapiens
auuaaguaaaccaaaaa

SEQ ID NO: 1104118 - RNA, 20 nt, Homo sapiens
auuaauauggggaugcagca

SEQ ID NO: 1104119 - RNA, 16 nt, Homo sapiens
auuacaacuagaucaa

SEQ ID NO: 1104120 - RNA, 13 nt, Homo sapiens
auuacagguguga

SEQ ID NO: 1104121 - RNA, 23 nt, Homo sapiens
auuacaggugugaaccaccacac

SEQ ID NO: 1104122 - RNA, 22 nt, Homo sapiens
auuacaguccguccaccaccuc

SEQ ID NO: 1104123 - RNA, 15 nt, Homo sapiens
auuacauccagaaag

SEQ ID NO: 1104124 - RNA, 21 nt, Homo sapiens
auuaccucaaauuccuaauaa

SEQ ID NO: 1104125 - RNA, 16 nt, Homo sapiens
auuaccuguuaguauu

SEQ ID NO: 1104126 - RNA, 20 nt, Homo sapiens
auuacugcaugcacuucuua

SEQ ID NO: 1104127 - RNA, 15 nt, Homo sapiens
auuacuucagggcug

SEQ ID NO: 1104128 - RNA, 15 nt, Homo sapiens
auuagcucuggacca

SEQ ID NO: 1104129 - RNA, 23 nt, Homo sapiens
auuagcuguaaauacaugugugg

SEQ ID NO: 1104130 - RNA, 13 nt, Homo sapiens
auuagcugugauu

SEQ ID NO: 1104131 - RNA, 20 nt, Homo sapiens
auuaggaucuaugcaauuuu

SEQ ID NO: 1104132 - RNA, 23 nt, Homo sapiens
auuauaaaaauaauauaugcuca

SEQ ID NO: 1104133 - RNA, 15 nt, Homo sapiens
auuauaacugcauag

SEQ ID NO: 1104134 - RNA, 16 nt, Homo sapiens
auuauagccacauccc

SEQ ID NO: 1104135 - RNA, 17 nt, Homo sapiens
auuaucgggaacagugu

SEQ ID NO: 1104136 - RNA, 21 nt, Homo sapiens
auuaucgggagcagugucuuc

SEQ ID NO: 1104137 - RNA, 18 nt, Homo sapiens
agucaauuuuacaauuau

SEQ ID NO: 1104138 - RNA, 21 nt, Homo sapiens
agucacauggccuaugcacau

SEQ ID NO: 1104139 - RNA, 13 nt, Homo sapiens
agucaccaggaau

SEQ ID NO: 1104140 - RNA, 14 nt, Homo sapiens
agucagaugcccag

SEQ ID NO: 1104141 - RNA, 20 nt, Homo sapiens
agucaugaagcccaagugaa

SEQ ID NO: 1104142 - RNA, 20 nt, Homo sapiens
aguccagaauaagugcuguu

SEQ ID NO: 1104143 - RNA, 14 nt, Homo sapiens
aguccauauuucaa

SEQ ID NO: 1104144 - RNA, 18 nt, Homo sapiens
agucccaccuuggcugca

SEQ ID NO: 1104145 - RNA, 13 nt, Homo sapiens
agucccugacucu

SEQ ID NO: 1104146 - RNA, 20 nt, Homo sapiens
aguccguuaacacuacuuaa

SEQ ID NO: 1104147 - RNA, 17 nt, Homo sapiens
aguccuagccacucagg

SEQ ID NO: 1104148 - RNA, 17 nt, Homo sapiens
aguccuauucuauugca

SEQ ID NO: 1104149 - RNA, 14 nt, Homo sapiens
aguccuauuugcac

SEQ ID NO: 1104150 - RNA, 19 nt, Homo sapiens
aguccuuucuaaguauuuu

SEQ ID NO: 1104151 - RNA, 17 nt, Homo sapiens
aguccuuugauuccauu

SEQ ID NO: 1104152 - RNA, 17 nt, Homo sapiens
agucgaucaagggaugu

SEQ ID NO: 1104153 - RNA, 18 nt, Homo sapiens
agucucuaugaucuuggc

SEQ ID NO: 1104154 - RNA, 18 nt, Homo sapiens
agucucugcccaaacaua

SEQ ID NO: 1104155 - RNA, 21 nt, Homo sapiens
agucucugugcuuugacucac

SEQ ID NO: 1104156 - RNA, 14 nt, Homo sapiens
agucuuaauauaua

SEQ ID NO: 1104157 - RNA, 16 nt, Homo sapiens
agugaaagccagauuc

SEQ ID NO: 1104158 - RNA, 15 nt, Homo sapiens
agugaaggagccagu

SEQ ID NO: 1104159 - RNA, 11 nt, Homo sapiens
agugacagagg

SEQ ID NO: 1104160 - RNA, 16 nt, Homo sapiens
agugacccacaugcca

SEQ ID NO: 1104161 - RNA, 21 nt, Homo sapiens
agugaccgaaagguuauguua

SEQ ID NO: 1104162 - RNA, 20 nt, Homo sapiens
agugacuuuagaaacaaauu

SEQ ID NO: 1104163 - RNA, 13 nt, Homo sapiens
agugagagggcau

SEQ ID NO: 1104164 - RNA, 22 nt, Homo sapiens
agugagccugaauuuuguugcu

SEQ ID NO: 1104165 - RNA, 17 nt, Homo sapiens
agugauugacacacagc

SEQ ID NO: 1104166 - RNA, 18 nt, Homo sapiens
agugcaaaguuauucccc

SEQ ID NO: 1104167 - RNA, 23 nt, Homo sapiens
agugcaucugggaagauuucuac

SEQ ID NO: 1104168 - RNA, 12 nt, Homo sapiens
agugccaggacu

SEQ ID NO: 1104169 - RNA, 13 nt, Homo sapiens
agugccugcugaa

SEQ ID NO: 1104170 - RNA, 14 nt, Homo sapiens
agugccuggcaagg

SEQ ID NO: 1104171 - RNA, 18 nt, Homo sapiens
agugcggacaaguuuuaa

SEQ ID NO: 1104172 - RNA, 22 nt, Homo sapiens
agugcugagaaggacaccuccu

SEQ ID NO: 1104173 - RNA, 18 nt, Homo sapiens
agugcuugccaccaccag

SEQ ID NO: 1104174 - RNA, 23 nt, Homo sapiens
aguggcaaccuugucucuaugcc

SEQ ID NO: 1104175 - RNA, 19 nt, Homo sapiens
agugggaggugagaccacc

SEQ ID NO: 1104176 - RNA, 13 nt, Homo sapiens
aguggguggugga

SEQ ID NO: 1104177 - RNA, 16 nt, Homo sapiens
agugggugguggaucu

SEQ ID NO: 1104178 - RNA, 13 nt, Homo sapiens
aguguaacacugc

SEQ ID NO: 1104179 - RNA, 15 nt, Homo sapiens
aguguaauugagaag

SEQ ID NO: 1104180 - RNA, 21 nt, Homo sapiens
aguguauuuuauguguggccc

SEQ ID NO: 1104181 - RNA, 14 nt, Homo sapiens
aguguccucuugcu

SEQ ID NO: 1104182 - RNA, 12 nt, Homo sapiens
agugugauccca

SEQ ID NO: 1104183 - RNA, 14 nt, Homo sapiens
agugugaucccaag

SEQ ID NO: 1104184 - RNA, 15 nt, Homo sapiens
agugugcugcaugga

SEQ ID NO: 1104185 - RNA, 12 nt, Homo sapiens
aguguggcccag

SEQ ID NO: 1104186 - RNA, 16 nt, Homo sapiens
aguguguuuccuucag

SEQ ID NO: 1104187 - RNA, 22 nt, Homo sapiens
aguguuaucagucauaacuaaa

SEQ ID NO: 1104188 - RNA, 21 nt, Homo sapiens
aguguuggaaaaugugcaaua

SEQ ID NO: 1104189 - RNA, 16 nt, Homo sapiens
aguguuugcaauggug

SEQ ID NO: 1104190 - RNA, 20 nt, Homo sapiens
aguguuuuuuagauacagag

SEQ ID NO: 1104191 - RNA, 18 nt, Homo sapiens
aguuaaaaguguugauua

SEQ ID NO: 1104192 - RNA, 22 nt, Homo sapiens
aguuaagcagccuuucugugga

SEQ ID NO: 1104193 - RNA, 18 nt, Homo sapiens
aguuacaaauucaaggag

SEQ ID NO: 1104194 - RNA, 18 nt, Homo sapiens
aguuacagaugcacccca

SEQ ID NO: 1104195 - RNA, 15 nt, Homo sapiens
aguuagguagcuuua

SEQ ID NO: 1104196 - RNA, 11 nt, Homo sapiens
aguuaggugug

SEQ ID NO: 1104197 - RNA, 17 nt, Homo sapiens
aguuaggugugccaaac

SEQ ID NO: 1104198 - RNA, 13 nt, Homo sapiens
aguuagugccaua

SEQ ID NO: 1104199 - RNA, 22 nt, Homo sapiens
aguuauaaaucaaugucacuua

SEQ ID NO: 1104200 - RNA, 19 nt, Homo sapiens
aguuauuccccaucuucca

SEQ ID NO: 1104201 - RNA, 13 nt, Homo sapiens
aguucagcaaaga

SEQ ID NO: 1104202 - RNA, 19 nt, Homo sapiens
aguuccaugaagaccacau

SEQ ID NO: 1104203 - RNA, 15 nt, Homo sapiens
aguuccuucagcuuc

SEQ ID NO: 1104204 - RNA, 18 nt, Homo sapiens
aguuccuugaucuguaua

SEQ ID NO: 1104205 - RNA, 16 nt, Homo sapiens
auauacauaugacaua

SEQ ID NO: 1104206 - RNA, 14 nt, Homo sapiens
auauaccuuacuga

SEQ ID NO: 1104207 - RNA, 20 nt, Homo sapiens
auauaguaacuacuuuuuau

SEQ ID NO: 1104208 - RNA, 21 nt, Homo sapiens
auaucauccugccuucaugga

SEQ ID NO: 1104209 - RNA, 23 nt, Homo sapiens
auaucaugccccuguacuccagc

SEQ ID NO: 1104210 - RNA, 16 nt, Homo sapiens
auauccagauggcaug

SEQ ID NO: 1104211 - RNA, 13 nt, Homo sapiens
auaucucaucucu

SEQ ID NO: 1104212 - RNA, 21 nt, Homo sapiens
auaucugaacacauacuagaa

SEQ ID NO: 1104213 - RNA, 19 nt, Homo sapiens
auaucugagaaguguauau

SEQ ID NO: 1104214 - RNA, 21 nt, Homo sapiens
auaucugugaggugcugauga

SEQ ID NO: 1104215 - RNA, 17 nt, Homo sapiens
auaucuguggucuucaa

SEQ ID NO: 1104216 - RNA, 18 nt, Homo sapiens
auaugaauuuacuacuuu

SEQ ID NO: 1104217 - RNA, 16 nt, Homo sapiens
auaugauauguaaaca

SEQ ID NO: 1104218 - RNA, 21 nt, Homo sapiens
auaugcacaauagcaguugaa

SEQ ID NO: 1104219 - RNA, 18 nt, Homo sapiens
auauggaaaaaaugaacu

SEQ ID NO: 1104220 - RNA, 16 nt, Homo sapiens
auauggcagugucuuu

SEQ ID NO: 1104221 - RNA, 14 nt, Homo sapiens
auauguaccaugua

SEQ ID NO: 1104222 - RNA, 21 nt, Homo sapiens
auauuaaucaacuuuccuuaa

SEQ ID NO: 1104223 - RNA, 15 nt, Homo sapiens
auauuaugucauuca

SEQ ID NO: 1104224 - RNA, 18 nt, Homo sapiens
auauucaauaaagcugcu

SEQ ID NO: 1104225 - RNA, 17 nt, Homo sapiens
auauuccaccauucaca

SEQ ID NO: 1104226 - RNA, 22 nt, Homo sapiens
aaccaugagaccacuguuauca

SEQ ID NO: 1104227 - RNA, 15 nt, Homo sapiens
aaccaugcccaagaa

SEQ ID NO: 1104228 - RNA, 17 nt, Homo sapiens
aacccaacaugacuguu

SEQ ID NO: 1104229 - RNA, 12 nt, Homo sapiens
aacccaccagcc

SEQ ID NO: 1104230 - RNA, 15 nt, Homo sapiens
aacccacugugcuua

SEQ ID NO: 1104231 - RNA, 20 nt, Homo sapiens
aacccaggagauggaaguug

SEQ ID NO: 1104232 - RNA, 16 nt, Homo sapiens
aacccccugacauuau

SEQ ID NO: 1104233 - RNA, 22 nt, Homo sapiens
aacccugcuugcacuuuguaac

SEQ ID NO: 1104234 - RNA, 18 nt, Homo sapiens
aaauagacaacucuucca

SEQ ID NO: 1104235 - RNA, 23 nt, Homo sapiens
aaauagcccuuggaucaguaugg

SEQ ID NO: 1104236 - RNA, 14 nt, Homo sapiens
aaauauacaaacau

SEQ ID NO: 1104237 - RNA, 23 nt, Homo sapiens
aaauauauaaugguuuacugcug

SEQ ID NO: 1104238 - RNA, 21 nt, Homo sapiens
aaauauauuuuaugauuuaaa

SEQ ID NO: 1104239 - RNA, 22 nt, Homo sapiens
aaauaugcaccaaaucaucucu

SEQ ID NO: 1104240 - RNA, 22 nt, Homo sapiens
aaauauuauugguguuuaccca

SEQ ID NO: 1104241 - RNA, 13 nt, Homo sapiens
agaccacucugcu

SEQ ID NO: 1104242 - RNA, 19 nt, Homo sapiens
agaccaguugggagcacug

SEQ ID NO: 1104243 - RNA, 16 nt, Homo sapiens
agaccauaauguuaca

SEQ ID NO: 1104244 - RNA, 15 nt, Homo sapiens
agacccaguguaaag

SEQ ID NO: 1104245 - RNA, 19 nt, Homo sapiens
agaccccaaggcccagaca

SEQ ID NO: 1104246 - RNA, 19 nt, Homo sapiens
agaccccacccugaggucc

SEQ ID NO: 1104247 - RNA, 12 nt, Homo sapiens
agaccucuacaa

SEQ ID NO: 1104248 - RNA, 16 nt, Homo sapiens
agaccugacaagcacu

SEQ ID NO: 1104249 - RNA, 23 nt, Homo sapiens
agacucaaagagggagugcauuu

SEQ ID NO: 1104250 - RNA, 20 nt, Homo sapiens
agacucagggccccagcacu

SEQ ID NO: 1104251 - RNA, 21 nt, Homo sapiens
agacucagggccccagcacua

SEQ ID NO: 1104252 - RNA, 13 nt, Homo sapiens
agacucugucuca

SEQ ID NO: 1104253 - RNA, 16 nt, Homo sapiens
agacugacaccucacu

SEQ ID NO: 1104254 - RNA, 18 nt, Homo sapiens
agacugcuaaguaggggc

SEQ ID NO: 1104255 - RNA, 17 nt, Homo sapiens
agacuggaagcacagcu

SEQ ID NO: 1104256 - RNA, 18 nt, Homo sapiens
agacuggauucgugacaa

SEQ ID NO: 1104257 - RNA, 14 nt, Homo sapiens
agacuguugcucaa

SEQ ID NO: 1104258 - RNA, 17 nt, Homo sapiens
agacuuauguauuagcu

SEQ ID NO: 1104259 - RNA, 23 nt, Homo sapiens
agagaacuggaaagacauagcca

SEQ ID NO: 1104260 - RNA, 15 nt, Homo sapiens
agagaauaccagugu

SEQ ID NO: 1104261 - RNA, 19 nt, Homo sapiens
agagacagauaacucuccu

SEQ ID NO: 1104262 - RNA, 18 nt, Homo sapiens
agagacuaucugauuucc

SEQ ID NO: 1104263 - RNA, 13 nt, Homo sapiens
agagacugaguca

SEQ ID NO: 1104264 - RNA, 17 nt, Homo sapiens
agagagaugaucgugcc

SEQ ID NO: 1104265 - RNA, 13 nt, Homo sapiens
agagagauggaau

SEQ ID NO: 1104266 - RNA, 16 nt, Homo sapiens
agagagggcuuucuca

SEQ ID NO: 1104267 - RNA, 17 nt, Homo sapiens
agagaggggacauuucc

SEQ ID NO: 1104268 - RNA, 17 nt, Homo sapiens
agagaggguggugaccu

SEQ ID NO: 1104269 - RNA, 15 nt, Homo sapiens
agagauauaucugaa

SEQ ID NO: 1104270 - RNA, 21 nt, Homo sapiens
agagaugauucggauuugaca

SEQ ID NO: 1104271 - RNA, 19 nt, Homo sapiens
agagcacacuguagcauua

SEQ ID NO: 1104272 - RNA, 14 nt, Homo sapiens
agagcaucaugccu

SEQ ID NO: 1104273 - RNA, 16 nt, Homo sapiens
agagccagggcugaug

SEQ ID NO: 1104274 - RNA, 14 nt, Homo sapiens
agagcccaugcuca

SEQ ID NO: 1104275 - RNA, 23 nt, Homo sapiens
agagcccuucaugcauuugcacu

SEQ ID NO: 1104276 - RNA, 19 nt, Homo sapiens
agagccucuggcaucucuu

SEQ ID NO: 1104277 - RNA, 19 nt, Homo sapiens
agagcuggggagggagagc

SEQ ID NO: 1104278 - RNA, 17 nt, Homo sapiens
agagcuuuuuuacauaa

SEQ ID NO: 1104279 - RNA, 14 nt, Homo sapiens
agaggacuccuuaa

SEQ ID NO: 1104280 - RNA, 23 nt, Homo sapiens
agaggagguuuggggucugccac

SEQ ID NO: 1104281 - RNA, 19 nt, Homo sapiens
agaggauuuaacugugaac

SEQ ID NO: 1104282 - RNA, 14 nt, Homo sapiens
agaggcgcccuccc

SEQ ID NO: 1104283 - RNA, 16 nt, Homo sapiens
agaggcugugguggcu

SEQ ID NO: 1104284 - RNA, 14 nt, Homo sapiens
agagggcccaggca

SEQ ID NO: 1104285 - RNA, 20 nt, Homo sapiens
agaggggaaaccaguguagc

SEQ ID NO: 1104286 - RNA, 16 nt, Homo sapiens
agaguagagggcacug

SEQ ID NO: 1104287 - RNA, 14 nt, Homo sapiens
agagucacugaccc

SEQ ID NO: 1104288 - RNA, 22 nt, Homo sapiens
agagucaggaagggaaagccag

SEQ ID NO: 1104289 - RNA, 16 nt, Homo sapiens
agagugaaauaauuaa

SEQ ID NO: 1104290 - RNA, 16 nt, Homo sapiens
agagugacacccaaga

SEQ ID NO: 1104291 - RNA, 19 nt, Homo sapiens
agagugagacuccgucuca

SEQ ID NO: 1104292 - RNA, 20 nt, Homo sapiens
agagugagagacauuaacuc

SEQ ID NO: 1104293 - RNA, 19 nt, Homo sapiens
agagugcugccaguccucu

SEQ ID NO: 1104294 - RNA, 22 nt, Homo sapiens
agaguggaaccaacacuaacau

SEQ ID NO: 1104295 - RNA, 17 nt, Homo sapiens
agaguggcccagaauug

SEQ ID NO: 1104296 - RNA, 14 nt, Homo sapiens
agaguucauggaau

SEQ ID NO: 1104297 - RNA, 12 nt, Homo sapiens
agaguugaaccu

SEQ ID NO: 1104298 - RNA, 19 nt, Homo sapiens
agaguugcuuuucuaaucu

SEQ ID NO: 1104299 - RNA, 12 nt, Homo sapiens
agaguuugcaaa

SEQ ID NO: 1104300 - RNA, 14 nt, Homo sapiens
agauaaaaccagag

SEQ ID NO: 1104301 - RNA, 22 nt, Homo sapiens
agauaacagcuuaacauuuaca

SEQ ID NO: 1104302 - RNA, 17 nt, Homo sapiens
agauaauuauaauauac

SEQ ID NO: 1104303 - RNA, 13 nt, Homo sapiens
agauaauugccau

SEQ ID NO: 1104304 - RNA, 18 nt, Homo sapiens
agauacuuuuguaaauaa

SEQ ID NO: 1104305 - RNA, 20 nt, Homo sapiens
agauaguagcauacauuuau

SEQ ID NO: 1104306 - RNA, 17 nt, Homo sapiens
agauaucaguuaucaau

SEQ ID NO: 1104307 - RNA, 16 nt, Homo sapiens
agauauuuccauuucu

SEQ ID NO: 1104308 - RNA, 20 nt, Homo sapiens
agauauuucccaauacauac

SEQ ID NO: 1104309 - RNA, 15 nt, Homo sapiens
agaucacaauacuca

SEQ ID NO: 1104310 - RNA, 20 nt, Homo sapiens
agaucauccagaaguuccuc

SEQ ID NO: 1104311 - RNA, 14 nt, Homo sapiens
agaucauggcccac

SEQ ID NO: 1104312 - RNA, 12 nt, Homo sapiens
agaucauuucag

SEQ ID NO: 1104313 - RNA, 16 nt, Homo sapiens
agaucuauguacugua

SEQ ID NO: 1104314 - RNA, 16 nt, Homo sapiens
agaugaagacaacagc

SEQ ID NO: 1104315 - RNA, 15 nt, Homo sapiens
agaugaccugcugcu

SEQ ID NO: 1104316 - RNA, 19 nt, Homo sapiens
agaugagauucccucuccu

SEQ ID NO: 1104317 - RNA, 19 nt, Homo sapiens
agaugagcagucacacugu

SEQ ID NO: 1104318 - RNA, 18 nt, Homo sapiens
agaugcaaucucuugucu

SEQ ID NO: 1104319 - RNA, 17 nt, Homo sapiens
agauggaauaaagcccu

SEQ ID NO: 1104320 - RNA, 15 nt, Homo sapiens
agauggccgggacau

SEQ ID NO: 1104321 - RNA, 19 nt, Homo sapiens
agauggccgggacaugcag

SEQ ID NO: 1104322 - RNA, 22 nt, Homo sapiens
agaugggcaaauuaaggcauaa

SEQ ID NO: 1104323 - RNA, 17 nt, Homo sapiens
agauguaccauguuaaa

SEQ ID NO: 1104324 - RNA, 16 nt, Homo sapiens
agauuaaacaaacaaa

SEQ ID NO: 1104325 - RNA, 20 nt, Homo sapiens
agauuagcucuggaccagcc

SEQ ID NO: 1104326 - RNA, 17 nt, Homo sapiens
agauucaaacucaauga

SEQ ID NO: 1104327 - RNA, 18 nt, Homo sapiens
uaugucuuggacacugua

SEQ ID NO: 1104328 - RNA, 11 nt, Homo sapiens
uaugugcaaua

SEQ ID NO: 1104329 - RNA, 18 nt, Homo sapiens
uauguuacuacaugcacu

SEQ ID NO: 1104330 - RNA, 20 nt, Homo sapiens
uauguuuaaaaacauucccc

SEQ ID NO: 1104331 - RNA, 23 nt, Homo sapiens
uaggaagugaccgagucuaggaa

SEQ ID NO: 1104332 - RNA, 21 nt, Homo sapiens
uaggacuauggguacauucca

SEQ ID NO: 1104333 - RNA, 19 nt, Homo sapiens
uacauguguggauguguaa

SEQ ID NO: 1104334 - RNA, 23 nt, Homo sapiens
gugcagaugagcagucacacugu

SEQ ID NO: 1104335 - RNA, 20 nt, Homo sapiens
gugcagugagccgagaucac

SEQ ID NO: 1104336 - RNA, 18 nt, Homo sapiens
gugcauagagccacguau

SEQ ID NO: 1104337 - RNA, 16 nt, Homo sapiens
gugcauguugccauga

SEQ ID NO: 1104338 - RNA, 17 nt, Homo sapiens
gugcauuuaugagcucu

SEQ ID NO: 1104339 - RNA, 15 nt, Homo sapiens
gugcauuucugucuc

SEQ ID NO: 1104340 - RNA, 21 nt, Homo sapiens
gugccauuuuaagaguuacuu

SEQ ID NO: 1104341 - RNA, 22 nt, Homo sapiens
gugccuguaaucccagcuacau

SEQ ID NO: 1104342 - RNA, 17 nt, Homo sapiens
gugcuacacuugcaccu

SEQ ID NO: 1104343 - RNA, 12 nt, Homo sapiens
gugcuaccucuc

SEQ ID NO: 1104344 - RNA, 20 nt, Homo sapiens
gugcuaucgcaccacugugu

SEQ ID NO: 1104345 - RNA, 22 nt, Homo sapiens
gugcucggcuguaaacagcucu

SEQ ID NO: 1104346 - RNA, 16 nt, Homo sapiens
gugcugccaguccucu

SEQ ID NO: 1104347 - RNA, 15 nt, Homo sapiens
gugcuggagacacuc

SEQ ID NO: 1104348 - RNA, 20 nt, Homo sapiens
gugcugggauuacaggugua

SEQ ID NO: 1104349 - RNA, 15 nt, Homo sapiens
gugcuucagccugag

SEQ ID NO: 1104350 - RNA, 12 nt, Homo sapiens
guggacaccugc

SEQ ID NO: 1104351 - RNA, 16 nt, Homo sapiens
guggacaggacuaaca

SEQ ID NO: 1104352 - RNA, 21 nt, Homo sapiens
guggagaaauuccuugauuca

SEQ ID NO: 1104353 - RNA, 17 nt, Homo sapiens
guggagaugcagaggua

SEQ ID NO: 1104354 - RNA, 17 nt, Homo sapiens
guggagguugcagugag

SEQ ID NO: 1104355 - RNA, 15 nt, Homo sapiens
guggauccacugugc

SEQ ID NO: 1104356 - RNA, 21 nt, Homo sapiens
guggcagauaaucagccucuu

SEQ ID NO: 1104357 - RNA, 16 nt, Homo sapiens
guggcagauuuaguga

SEQ ID NO: 1104358 - RNA, 21 nt, Homo sapiens
guggcagcugcuuuugucuau

SEQ ID NO: 1104359 - RNA, 17 nt, Homo sapiens
guggcauucacaucuca

SEQ ID NO: 1104360 - RNA, 18 nt, Homo sapiens
guggcauucacaucucau

SEQ ID NO: 1104361 - RNA, 18 nt, Homo sapiens
guggccaugcuucuugcc

SEQ ID NO: 1104362 - RNA, 19 nt, Homo sapiens
gugggccacguguucucac

SEQ ID NO: 1104363 - RNA, 14 nt, Homo sapiens
gugguacagcacug

SEQ ID NO: 1104364 - RNA, 19 nt, Homo sapiens
gugguaggaaagccucacu

SEQ ID NO: 1104365 - RNA, 18 nt, Homo sapiens
guggucaaaccgcacuca

SEQ ID NO: 1104366 - RNA, 21 nt, Homo sapiens
gugguuuaugucaucauacau

SEQ ID NO: 1104367 - RNA, 19 nt, Homo sapiens
guguaaagaauaaaugaau

SEQ ID NO: 1104368 - RNA, 14 nt, Homo sapiens
guguaacaggucuc

SEQ ID NO: 1104369 - RNA, 14 nt, Homo sapiens
guguaaguaauuau

SEQ ID NO: 1104370 - RNA, 21 nt, Homo sapiens
guguagcugugaccugcugag

SEQ ID NO: 1104371 - RNA, 14 nt, Homo sapiens
guguccagcacaga

SEQ ID NO: 1104372 - RNA, 15 nt, Homo sapiens
guguccgcuuucaug

SEQ ID NO: 1104373 - RNA, 19 nt, Homo sapiens
gugucuggaaaagcacuuu

SEQ ID NO: 1104374 - RNA, 19 nt, Homo sapiens
gugugagcaucucugugua

SEQ ID NO: 1104375 - RNA, 18 nt, Homo sapiens
guguggccccagcccgac

SEQ ID NO: 1104376 - RNA, 20 nt, Homo sapiens
guguguugucugugcagcug

SEQ ID NO: 1104377 - RNA, 23 nt, Homo sapiens
guguuacccaguaacucaucugu

SEQ ID NO: 1104378 - RNA, 21 nt, Homo sapiens
guguuacgcacacguacuuaa

SEQ ID NO: 1104379 - RNA, 21 nt, Homo sapiens
guguuaucagucauaacuaaa

SEQ ID NO: 1104380 - RNA, 13 nt, Homo sapiens
guguucagugccu

SEQ ID NO: 1104381 - RNA, 12 nt, Homo sapiens
guguugauccca

SEQ ID NO: 1104382 - RNA, 23 nt, Homo sapiens
guguugggaauugcaugccaucu

SEQ ID NO: 1104383 - RNA, 11 nt, Homo sapiens
guuaacuuaau

SEQ ID NO: 1104384 - RNA, 14 nt, Homo sapiens
guuaauacuuaaca

SEQ ID NO: 1104385 - RNA, 14 nt, Homo sapiens
guuaaugguuugaa

SEQ ID NO: 1104386 - RNA, 22 nt, Homo sapiens
guuacaaauucaaggagauaua

SEQ ID NO: 1104387 - RNA, 17 nt, Homo sapiens
guuaccuuucccaugcu

SEQ ID NO: 1104388 - RNA, 14 nt, Homo sapiens
guuacuacaugcac

SEQ ID NO: 1104389 - RNA, 19 nt, Homo sapiens
guuacuguggccaguauuu

SEQ ID NO: 1104390 - RNA, 13 nt, Homo sapiens
guuagcaggaaau

SEQ ID NO: 1104391 - RNA, 23 nt, Homo sapiens
guuaggaaaauuucacauuaaua

SEQ ID NO: 1104392 - RNA, 16 nt, Homo sapiens
guuaggugugccaaac

SEQ ID NO: 1104393 - RNA, 23 nt, Homo sapiens
guuaguaauaaacgucuugccac

SEQ ID NO: 1104394 - RNA, 22 nt, Homo sapiens
guuauaaaucaaugucacuuaa

SEQ ID NO: 1104395 - RNA, 23 nt, Homo sapiens
guuauaaaucaaugucacuuaaa

SEQ ID NO: 1104396 - RNA, 22 nt, Homo sapiens
guuauccugcuagcuguagaaa

SEQ ID NO: 1104397 - RNA, 13 nt, Homo sapiens
guuaugccucaug

SEQ ID NO: 1104398 - RNA, 13 nt, Homo sapiens
guuaugugaauga

SEQ ID NO: 1104399 - RNA, 17 nt, Homo sapiens
guucacgcaacuugaaa

SEQ ID NO: 1104400 - RNA, 16 nt, Homo sapiens
guucagcuucagacuu

SEQ ID NO: 1104401 - RNA, 16 nt, Homo sapiens
guucagguaacaggca

SEQ ID NO: 1104402 - RNA, 13 nt, Homo sapiens
guuccauguuaaa

SEQ ID NO: 1104403 - RNA, 12 nt, Homo sapiens
guuccucaaaag

SEQ ID NO: 1104404 - RNA, 20 nt, Homo sapiens
guuccuuuauuuuauguaaa

SEQ ID NO: 1104405 - RNA, 14 nt, Homo sapiens
guucucacacuggu

SEQ ID NO: 1104406 - RNA, 16 nt, Homo sapiens
guucucuauugcugcu

SEQ ID NO: 1104407 - RNA, 17 nt, Homo sapiens
guucucuauugcugcuc

SEQ ID NO: 1104408 - RNA, 19 nt, Homo sapiens
guucugaugggucccaaaa

SEQ ID NO: 1104409 - RNA, 18 nt, Homo sapiens
guucuuacuacuugccac

SEQ ID NO: 1104410 - RNA, 13 nt, Homo sapiens
guucuuagcugaa

SEQ ID NO: 1104411 - RNA, 16 nt, Homo sapiens
guucuuagugucacuu

SEQ ID NO: 1104412 - RNA, 15 nt, Homo sapiens
guucuuccuaccaaa

SEQ ID NO: 1104413 - RNA, 18 nt, Homo sapiens
guucuuccuaccaaauau

SEQ ID NO: 1104414 - RNA, 14 nt, Homo sapiens
guugagaacaaaaa

SEQ ID NO: 1104415 - RNA, 18 nt, Homo sapiens
guugaggggcuccuggaa

SEQ ID NO: 1104416 - RNA, 20 nt, Homo sapiens
guugauaaauuccacuggac

SEQ ID NO: 1104417 - RNA, 15 nt, Homo sapiens
guugaucccaagaca

SEQ ID NO: 1104418 - RNA, 20 nt, Homo sapiens
guugcauuaaaaaugcauau

SEQ ID NO: 1104419 - RNA, 20 nt, Homo sapiens
guugcguggacucugcacau

SEQ ID NO: 1104420 - RNA, 18 nt, Homo sapiens
guugcucaaaucuauuca

SEQ ID NO: 1104421 - RNA, 15 nt, Homo sapiens
guugcuggacuguca

SEQ ID NO: 1104422 - RNA, 22 nt, Homo sapiens
guuggccagugugacaaggauu

SEQ ID NO: 1104423 - RNA, 13 nt, Homo sapiens
gggcugcagauuu

SEQ ID NO: 1104424 - RNA, 16 nt, Homo sapiens
gggcugcagauuuccu

SEQ ID NO: 1104425 - RNA, 13 nt, Homo sapiens
gggcugcuuccca

SEQ ID NO: 1104426 - RNA, 19 nt, Homo sapiens
ggggccuagggagccgcac

SEQ ID NO: 1104427 - RNA, 15 nt, Homo sapiens
gggggccgugcccag

SEQ ID NO: 1104428 - RNA, 16 nt, Homo sapiens
ggguacuacugcugca

SEQ ID NO: 1104429 - RNA, 18 nt, Homo sapiens
ggguccuccacaauaagg

SEQ ID NO: 1104430 - RNA, 20 nt, Homo sapiens
gggugcgagagaggugggca

SEQ ID NO: 1104431 - RNA, 13 nt, Homo sapiens
ggguguguguagc

SEQ ID NO: 1104432 - RNA, 17 nt, Homo sapiens
ggguguguguagccaag

SEQ ID NO: 1104433 - RNA, 13 nt, Homo sapiens
ggguucacugcaa

SEQ ID NO: 1104434 - RNA, 22 nt, Homo sapiens
ggguugucaagagagagucaaa

SEQ ID NO: 1104435 - RNA, 21 nt, Homo sapiens
ggguuuguuuuucaaagccug

SEQ ID NO: 1104436 - RNA, 14 nt, Homo sapiens
gguaauuguugcua

SEQ ID NO: 1104437 - RNA, 22 nt, Homo sapiens
gguaauuugauacugaccuugu

SEQ ID NO: 1104438 - RNA, 19 nt, Homo sapiens
gguagcaauucuacccaga

SEQ ID NO: 1104439 - RNA, 13 nt, Homo sapiens
gguauauuuccau

SEQ ID NO: 1104440 - RNA, 13 nt, Homo sapiens
gguaucaggugcu

SEQ ID NO: 1104441 - RNA, 15 nt, Homo sapiens
ggucacauucaggaa

SEQ ID NO: 1104442 - RNA, 11 nt, Homo sapiens
ggucauuugcu

SEQ ID NO: 1104443 - RNA, 17 nt, Homo sapiens
ggucccaccuccauuug

SEQ ID NO: 1104444 - RNA, 16 nt, Homo sapiens
ggucccugccaguguu

SEQ ID NO: 1104445 - RNA, 17 nt, Homo sapiens
gguccgaagucuuccau

SEQ ID NO: 1104446 - RNA, 18 nt, Homo sapiens
ggucggggggguccccau

SEQ ID NO: 1104447 - RNA, 21 nt, Homo sapiens
ggucguggagagcuaggagca

SEQ ID NO: 1104448 - RNA, 16 nt, Homo sapiens
ggucugauuucaggau

SEQ ID NO: 1104449 - RNA, 20 nt, Homo sapiens
ggucuuggccgacucaggga

SEQ ID NO: 1104450 - RNA, 20 nt, Homo sapiens
ggucuuuauuccucccucau

SEQ ID NO: 1104451 - RNA, 18 nt, Homo sapiens
ggugaaaccucaucucua

SEQ ID NO: 1104452 - RNA, 14 nt, Homo sapiens
ggugcaaaucaaug

SEQ ID NO: 1104453 - RNA, 18 nt, Homo sapiens
ggugcaaauccuacugaa

SEQ ID NO: 1104454 - RNA, 18 nt, Homo sapiens
ggugcaguugacagcagg

SEQ ID NO: 1104455 - RNA, 17 nt, Homo sapiens
ggugcaugaagguuucu

SEQ ID NO: 1104456 - RNA, 12 nt, Homo sapiens
ggugcuucagga

SEQ ID NO: 1104457 - RNA, 17 nt, Homo sapiens
gguggagguugcaguga

SEQ ID NO: 1104458 - RNA, 17 nt, Homo sapiens
gguggauccacugugca

SEQ ID NO: 1104459 - RNA, 21 nt, Homo sapiens
gguggaugccugguggcagcu

SEQ ID NO: 1104460 - RNA, 15 nt, Homo sapiens
gguggcgcgcaccug

SEQ ID NO: 1104461 - RNA, 15 nt, Homo sapiens
ggugugaaagucaga

SEQ ID NO: 1104462 - RNA, 13 nt, Homo sapiens
gguugcagugagc

SEQ ID NO: 1104463 - RNA, 17 nt, Homo sapiens
gguuuggggucugccac

SEQ ID NO: 1104464 - RNA, 19 nt, Homo sapiens
gguuuguguuugaguuuua

SEQ ID NO: 1104465 - RNA, 16 nt, Homo sapiens
guaaaagugugagcag

SEQ ID NO: 1104466 - RNA, 13 nt, Homo sapiens
guaaaauauuuau

SEQ ID NO: 1104467 - RNA, 13 nt, Homo sapiens
guaaacauaauuc

SEQ ID NO: 1104468 - RNA, 15 nt, Homo sapiens
guaaagaaguuugau

SEQ ID NO: 1104469 - RNA, 19 nt, Homo sapiens
guaacaacuguggucaauc

SEQ ID NO: 1104470 - RNA, 14 nt, Homo sapiens
guaacauagacaaa

SEQ ID NO: 1104471 - RNA, 16 nt, Homo sapiens
guaacauuaauucuac

SEQ ID NO: 1104472 - RNA, 18 nt, Homo sapiens
guaaccaagaguauucca

SEQ ID NO: 1104473 - RNA, 22 nt, Homo sapiens
guaaccuccacaguagcauuuc

SEQ ID NO: 1104474 - RNA, 16 nt, Homo sapiens
guaacuccaccaaccc

SEQ ID NO: 1104475 - RNA, 19 nt, Homo sapiens
guaacuccagcucugcucc

SEQ ID NO: 1104476 - RNA, 15 nt, Homo sapiens
guaagacgaaugauu

SEQ ID NO: 1104477 - RNA, 14 nt, Homo sapiens
guaaggaacuggaa

SEQ ID NO: 1104478 - RNA, 20 nt, Homo sapiens
guaaguaccacucaggccaa

SEQ ID NO: 1104479 - RNA, 15 nt, Homo sapiens
guaauaaacucucua

SEQ ID NO: 1104480 - RNA, 16 nt, Homo sapiens
guaauaaacucucuag

SEQ ID NO: 1104481 - RNA, 16 nt, Homo sapiens
guaaucccagcacuuu

SEQ ID NO: 1104482 - RNA, 22 nt, Homo sapiens
guaaugaaacaaagaguucaag

SEQ ID NO: 1104483 - RNA, 20 nt, Homo sapiens
guaauuuagcaguccaaaga

SEQ ID NO: 1104484 - RNA, 20 nt, Homo sapiens
guacaaacacaggauuugua

SEQ ID NO: 1104485 - RNA, 14 nt, Homo sapiens
guacagugagccaa

SEQ ID NO: 1104486 - RNA, 21 nt, Homo sapiens
guacauauggaaauccuguua

SEQ ID NO: 1104487 - RNA, 17 nt, Homo sapiens
guaccagaacuauuuau

SEQ ID NO: 1104488 - RNA, 17 nt, Homo sapiens
guaccaguguacugcuu

SEQ ID NO: 1104489 - RNA, 14 nt, Homo sapiens
guacccaccgggcc

SEQ ID NO: 1104490 - RNA, 16 nt, Homo sapiens
guaccgcgucuacccu

SEQ ID NO: 1104491 - RNA, 15 nt, Homo sapiens
guacuaguccaucau

SEQ ID NO: 1104492 - RNA, 18 nt, Homo sapiens
guacucuccaaaggcccu

SEQ ID NO: 1104493 - RNA, 19 nt, Homo sapiens
guagaagccugcagcggca

SEQ ID NO: 1104494 - RNA, 16 nt, Homo sapiens
guagaagucucuucca

SEQ ID NO: 1104495 - RNA, 14 nt, Homo sapiens
guagauaacagauu

SEQ ID NO: 1104496 - RNA, 16 nt, Homo sapiens
guagccugugcaugua

SEQ ID NO: 1104497 - RNA, 13 nt, Homo sapiens
guagggaugccuu

SEQ ID NO: 1104498 - RNA, 22 nt, Homo sapiens
guaguuaggaaauaaaaccuuu

SEQ ID NO: 1104499 - RNA, 20 nt, Homo sapiens
guauaaccccaccuugccaa

SEQ ID NO: 1104500 - RNA, 12 nt, Homo sapiens
guauaauggggc

SEQ ID NO: 1104501 - RNA, 18 nt, Homo sapiens
guauaaugguugacuggg

SEQ ID NO: 1104502 - RNA, 15 nt, Homo sapiens
guauauacaauaaca

SEQ ID NO: 1104503 - RNA, 15 nt, Homo sapiens
guauauauauauagu

SEQ ID NO: 1104504 - RNA, 16 nt, Homo sapiens
guaucaggugcugcca

SEQ ID NO: 1104505 - RNA, 18 nt, Homo sapiens
guauccaauuaugugaca

SEQ ID NO: 1104506 - RNA, 20 nt, Homo sapiens
guaucuagcucuaguucaaa

SEQ ID NO: 1104507 - RNA, 14 nt, Homo sapiens
guaucuaugcauuu

SEQ ID NO: 1104508 - RNA, 14 nt, Homo sapiens
guaucucuaugugg

SEQ ID NO: 1104509 - RNA, 18 nt, Homo sapiens
guauggcaugaacaucuu

SEQ ID NO: 1104510 - RNA, 19 nt, Homo sapiens
guauguaaguaauugcauu

SEQ ID NO: 1104511 - RNA, 12 nt, Homo sapiens
guauuaaacuug

SEQ ID NO: 1104512 - RNA, 20 nt, Homo sapiens
guauuauuuacaaugcagaa

SEQ ID NO: 1104513 - RNA, 17 nt, Homo sapiens
cagugcuguacuugaug

SEQ ID NO: 1104514 - RNA, 21 nt, Homo sapiens
cagugcuguggccugggcaag

SEQ ID NO: 1104515 - RNA, 17 nt, Homo sapiens
cagugcuucagccugag

SEQ ID NO: 1104516 - RNA, 23 nt, Homo sapiens
caguggcauucacaucucaugua

SEQ ID NO: 1104517 - RNA, 21 nt, Homo sapiens
cagugggugccccccuugcca

SEQ ID NO: 1104518 - RNA, 18 nt, Homo sapiens
caguggugcgaucuuggc

SEQ ID NO: 1104519 - RNA, 21 nt, Homo sapiens
caguguauguacuaagcagua

SEQ ID NO: 1104520 - RNA, 12 nt, Homo sapiens
cagugucauuua

SEQ ID NO: 1104521 - RNA, 15 nt, Homo sapiens
cagugucuuccauaa

SEQ ID NO: 1104522 - RNA, 13 nt, Homo sapiens
cagugugucacac

SEQ ID NO: 1104523 - RNA, 12 nt, Homo sapiens
caguguuuagaa

SEQ ID NO: 1104524 - RNA, 23 nt, Homo sapiens
caguguuuagaagagccugacug

SEQ ID NO: 1104525 - RNA, 16 nt, Homo sapiens
caguguuugcaauggu

SEQ ID NO: 1104526 - RNA, 19 nt, Homo sapiens
caguguuugcaaugguguu

SEQ ID NO: 1104527 - RNA, 20 nt, Homo sapiens
caguguuugggguguuucaa

SEQ ID NO: 1104528 - RNA, 16 nt, Homo sapiens
caguguuuucaccuca

SEQ ID NO: 1104529 - RNA, 19 nt, Homo sapiens
caguuaugcagaauccaaa

SEQ ID NO: 1104530 - RNA, 21 nt, Homo sapiens
caguucaggagucccaaggaa

SEQ ID NO: 1104531 - RNA, 14 nt, Homo sapiens
caguucugcuccuc

SEQ ID NO: 1104532 - RNA, 14 nt, Homo sapiens
caguugacagcagg

SEQ ID NO: 1104533 - RNA, 13 nt, Homo sapiens
caguugacuuacu

SEQ ID NO: 1104534 - RNA, 19 nt, Homo sapiens
caguuucuaucauucugcu

SEQ ID NO: 1104535 - RNA, 16 nt, Homo sapiens
caguuuucuugcagau

SEQ ID NO: 1104536 - RNA, 17 nt, Homo sapiens
cauaaacugugugcaga

SEQ ID NO: 1104537 - RNA, 17 nt, Homo sapiens
cauaacugaaggcauau

SEQ ID NO: 1104538 - RNA, 11 nt, Homo sapiens
cauaagccuac

SEQ ID NO: 1104539 - RNA, 21 nt, Homo sapiens
cauaauccagagauaauugcc

SEQ ID NO: 1104540 - RNA, 17 nt, Homo sapiens
cauaaugaaugcuauug

SEQ ID NO: 1104541 - RNA, 19 nt, Homo sapiens
cauaaugaaugcuauugaa

SEQ ID NO: 1104542 - RNA, 20 nt, Homo sapiens
cauaaugaaugcuauugaaa

SEQ ID NO: 1104543 - RNA, 22 nt, Homo sapiens
cauaauuaaacaugauccugag

SEQ ID NO: 1104544 - RNA, 14 nt, Homo sapiens
cauaauuagaacaa

SEQ ID NO: 1104545 - RNA, 22 nt, Homo sapiens
cauaccagaccacucugcuuca

SEQ ID NO: 1104546 - RNA, 21 nt, Homo sapiens
cauagaaauuacacccaaaga

SEQ ID NO: 1104547 - RNA, 13 nt, Homo sapiens
cauagagaucuau

SEQ ID NO: 1104548 - RNA, 23 nt, Homo sapiens
cauagagaucuauguacuguaau

SEQ ID NO: 1104549 - RNA, 17 nt, Homo sapiens
cauagcaagauugcuua

SEQ ID NO: 1104550 - RNA, 15 nt, Homo sapiens
cauagcagugcuuga

SEQ ID NO: 1104551 - RNA, 12 nt, Homo sapiens
cauagccuauaa

SEQ ID NO: 1104552 - RNA, 15 nt, Homo sapiens
cauagggccuccuua

SEQ ID NO: 1104553 - RNA, 21 nt, Homo sapiens
cauaguaugguggcuggguug

SEQ ID NO: 1104554 - RNA, 13 nt, Homo sapiens
cauauauauguca

SEQ ID NO: 1104555 - RNA, 14 nt, Homo sapiens
cauauauaugucag

SEQ ID NO: 1104556 - RNA, 11 nt, Homo sapiens
cauaugaacug

SEQ ID NO: 1104557 - RNA, 14 nt, Homo sapiens
cauaugcuguggac

SEQ ID NO: 1104558 - RNA, 15 nt, Homo sapiens
cauauggacucugca

SEQ ID NO: 1104559 - RNA, 23 nt, Homo sapiens
cauauucuuuaaauuucaucuca

SEQ ID NO: 1104560 - RNA, 21 nt, Homo sapiens
cauauuggacugauaaucucu

SEQ ID NO: 1104561 - RNA, 20 nt, Homo sapiens
caucaaauauuaccaaaaaa

SEQ ID NO: 1104562 - RNA, 23 nt, Homo sapiens
caucaacaagaguugucuugucc

SEQ ID NO: 1104563 - RNA, 21 nt, Homo sapiens
caucaauuuuuauacauauca

SEQ ID NO: 1104564 - RNA, 16 nt, Homo sapiens
caucacaggacacggg

SEQ ID NO: 1104565 - RNA, 14 nt, Homo sapiens
caucacugaaaugc

SEQ ID NO: 1104566 - RNA, 21 nt, Homo sapiens
caucagacuccugugcaacuu

SEQ ID NO: 1104567 - RNA, 15 nt, Homo sapiens
caucagcauaccuuu

SEQ ID NO: 1104568 - RNA, 21 nt, Homo sapiens
caucaguguccucuugcucaa

SEQ ID NO: 1104569 - RNA, 22 nt, Homo sapiens
caucaguguccucuugcucaaa

SEQ ID NO: 1104570 - RNA, 18 nt, Homo sapiens
caucauggcuaucugugg

SEQ ID NO: 1104571 - RNA, 16 nt, Homo sapiens
cauccagguucagcuu

SEQ ID NO: 1104572 - RNA, 17 nt, Homo sapiens
cauccaguucaugagaa

SEQ ID NO: 1104573 - RNA, 12 nt, Homo sapiens
cauccaucagcu

SEQ ID NO: 1104574 - RNA, 19 nt, Homo sapiens
cauccaugagaguuucaaa

SEQ ID NO: 1104575 - RNA, 13 nt, Homo sapiens
caucccagagccc

SEQ ID NO: 1104576 - RNA, 17 nt, Homo sapiens
caucccagcugcuccca

SEQ ID NO: 1104577 - RNA, 21 nt, Homo sapiens
caucccaugggggugcugcag

SEQ ID NO: 1104578 - RNA, 16 nt, Homo sapiens
cauccccagcgauucc

SEQ ID NO: 1104579 - RNA, 15 nt, Homo sapiens
cauccucaaagcccc

SEQ ID NO: 1104580 - RNA, 21 nt, Homo sapiens
caucucacuuugccccaguua

SEQ ID NO: 1104581 - RNA, 20 nt, Homo sapiens
gagaggugggcagcagcuca

SEQ ID NO: 1104582 - RNA, 20 nt, Homo sapiens
gagaguccucuggauggcac

SEQ ID NO: 1104583 - RNA, 18 nt, Homo sapiens
gagauaaugucaaaauca

SEQ ID NO: 1104584 - RNA, 20 nt, Homo sapiens
gagauauggcuaguggcaau

SEQ ID NO: 1104585 - RNA, 16 nt, Homo sapiens
gagaucguuguuuaca

SEQ ID NO: 1104586 - RNA, 20 nt, Homo sapiens
gagaucguuguuuacagugu

SEQ ID NO: 1104587 - RNA, 23 nt, Homo sapiens
gagauggccuggggaagcuguga

SEQ ID NO: 1104588 - RNA, 14 nt, Homo sapiens
cagccugggaccag

SEQ ID NO: 1104589 - RNA, 16 nt, Homo sapiens
cagcgaacaugccuga

SEQ ID NO: 1104590 - RNA, 19 nt, Homo sapiens
cagcgaaccaauauuugua

SEQ ID NO: 1104591 - RNA, 17 nt, Homo sapiens
cagcgaaugaaugcugu

SEQ ID NO: 1104592 - RNA, 16 nt, Homo sapiens
cagcgagcccuggugg

SEQ ID NO: 1104593 - RNA, 24 nt, Homo sapiens
cagcgccaccucuugucagugcuc

SEQ ID NO: 1104594 - RNA, 19 nt, Homo sapiens
cagcggaggagaccagcuc

SEQ ID NO: 1104595 - RNA, 20 nt, Homo sapiens
cagcggcacaaaugcaccuc

SEQ ID NO: 1104596 - RNA, 14 nt, Homo sapiens
cagcuaaugggaca

SEQ ID NO: 1104597 - RNA, 19 nt, Homo sapiens
cagcuagaaauaagcccaa

SEQ ID NO: 1104598 - RNA, 17 nt, Homo sapiens
cagcuaggaugugcauu

SEQ ID NO: 1104599 - RNA, 20 nt, Homo sapiens
cagcuccagaauaccuucuu

SEQ ID NO: 1104600 - RNA, 21 nt, Homo sapiens
cagcucugcauuaucugaggu

SEQ ID NO: 1104601 - RNA, 16 nt, Homo sapiens
cagcugaacagccaaa

SEQ ID NO: 1104602 - RNA, 14 nt, Homo sapiens
cagcugcaccugcc

SEQ ID NO: 1104603 - RNA, 17 nt, Homo sapiens
cagcugcaucuacucag

SEQ ID NO: 1104604 - RNA, 23 nt, Homo sapiens
cagcugccaaaaucguagguguu

SEQ ID NO: 1104605 - RNA, 18 nt, Homo sapiens
cagcugcuuguugucaag

SEQ ID NO: 1104606 - RNA, 13 nt, Homo sapiens
cagcugucauuca

SEQ ID NO: 1104607 - RNA, 22 nt, Homo sapiens
cagcuucaucaauuuuuauaca

SEQ ID NO: 1104608 - RNA, 16 nt, Homo sapiens
cagcuugcucuucagu

SEQ ID NO: 1104609 - RNA, 19 nt, Homo sapiens
cagcuuguaaauagcucag

SEQ ID NO: 1104610 - RNA, 15 nt, Homo sapiens
caggaaaaucugcac

SEQ ID NO: 1104611 - RNA, 14 nt, Homo sapiens
caggaaaaugccag

SEQ ID NO: 1104612 - RNA, 17 nt, Homo sapiens
caggaaagaugaugcaa

SEQ ID NO: 1104613 - RNA, 14 nt, Homo sapiens
caggaaauaguguu

SEQ ID NO: 1104614 - RNA, 16 nt, Homo sapiens
caggaagaugaaagag

SEQ ID NO: 1104615 - RNA, 17 nt, Homo sapiens
caggaaucaugaucuga

SEQ ID NO: 1104616 - RNA, 15 nt, Homo sapiens
caggaaucucagaga

SEQ ID NO: 1104617 - RNA, 16 nt, Homo sapiens
caggaaucucagagac

SEQ ID NO: 1104618 - RNA, 21 nt, Homo sapiens
caggacacggggcaguggcaa

SEQ ID NO: 1104619 - RNA, 22 nt, Homo sapiens
caggagaggggcagaacagccg

SEQ ID NO: 1104620 - RNA, 21 nt, Homo sapiens
caggagggguuaaagcugccg

SEQ ID NO: 1104621 - RNA, 22 nt, Homo sapiens
caggauuuuagugcuugccacc

SEQ ID NO: 1104622 - RNA, 18 nt, Homo sapiens
caggcagagaaucauacu

SEQ ID NO: 1104623 - RNA, 12 nt, Homo sapiens
caggcaggccac

SEQ ID NO: 1104624 - RNA, 18 nt, Homo sapiens
caggccagaaaacauaug

SEQ ID NO: 1104625 - RNA, 17 nt, Homo sapiens
caggccauacuuuacaa

SEQ ID NO: 1104626 - RNA, 22 nt, Homo sapiens
caggccuguguagcugugaccu

SEQ ID NO: 1104627 - RNA, 21 nt, Homo sapiens
caggccuuaauuuucaguaua

SEQ ID NO: 1104628 - RNA, 23 nt, Homo sapiens
caggcugagcaccucagccuuua

SEQ ID NO: 1104629 - RNA, 22 nt, Homo sapiens
cagggaacccugcuugcacuuu

SEQ ID NO: 1104630 - RNA, 15 nt, Homo sapiens
cagggagacugcauc

SEQ ID NO: 1104631 - RNA, 18 nt, Homo sapiens
cagggagacugcaucuca

SEQ ID NO: 1104632 - RNA, 21 nt, Homo sapiens
cagggagacugcaucucaaaa

SEQ ID NO: 1104633 - RNA, 14 nt, Homo sapiens
cagggcaaucaaug

SEQ ID NO: 1104634 - RNA, 13 nt, Homo sapiens
cagggcaucccau

SEQ ID NO: 1104635 - RNA, 18 nt, Homo sapiens
cagggcauuuugguccaa

SEQ ID NO: 1104636 - RNA, 21 nt, Homo sapiens
cagggcccugcagaggggaaa

SEQ ID NO: 1104637 - RNA, 21 nt, Homo sapiens
cagggcucagccuggugggcc

SEQ ID NO: 1104638 - RNA, 23 nt, Homo sapiens
cagggcuggaaaagucacacaga

SEQ ID NO: 1104639 - RNA, 15 nt, Homo sapiens
caggggaccacaccu

SEQ ID NO: 1104640 - RNA, 17 nt, Homo sapiens
caggggaccacaccucc

SEQ ID NO: 1104641 - RNA, 19 nt, Homo sapiens
caggguccagacccugaag

SEQ ID NO: 1104642 - RNA, 12 nt, Homo sapiens
cagggucucacu

SEQ ID NO: 1104643 - RNA, 14 nt, Homo sapiens
caggguugaucaca

SEQ ID NO: 1104644 - RNA, 21 nt, Homo sapiens
caggguuuugccauguuggcc

SEQ ID NO: 1104645 - RNA, 20 nt, Homo sapiens
cagguagaacacaaggucau

SEQ ID NO: 1104646 - RNA, 14 nt, Homo sapiens
caggucaacaucua

SEQ ID NO: 1104647 - RNA, 21 nt, Homo sapiens
caggucaacuucagagacuau

SEQ ID NO: 1104648 - RNA, 22 nt, Homo sapiens
cagguccucuacuuaaugagau

SEQ ID NO: 1104649 - RNA, 14 nt, Homo sapiens
caggucuagacuuu

SEQ ID NO: 1104650 - RNA, 17 nt, Homo sapiens
caggucuagacuuucuc

SEQ ID NO: 1104651 - RNA, 21 nt, Homo sapiens
caggucucuccacugcucuca

SEQ ID NO: 1104652 - RNA, 14 nt, Homo sapiens
caggugcugccauc

SEQ ID NO: 1104653 - RNA, 15 nt, Homo sapiens
cagguggccuagcag

SEQ ID NO: 1104654 - RNA, 19 nt, Homo sapiens
cagguuuugaaaauguaca

SEQ ID NO: 1104655 - RNA, 15 nt, Homo sapiens
caguaaaaacuugua

SEQ ID NO: 1104656 - RNA, 19 nt, Homo sapiens
caguaaauauuaaccugaa

SEQ ID NO: 1104657 - RNA, 20 nt, Homo sapiens
caguaagcugcucuauugua

SEQ ID NO: 1104658 - RNA, 15 nt, Homo sapiens
caguagcacaaguua

SEQ ID NO: 1104659 - RNA, 16 nt, Homo sapiens
caguagcuguggugag

SEQ ID NO: 1104660 - RNA, 20 nt, Homo sapiens
caguaggcaguagacuauaa

SEQ ID NO: 1104661 - RNA, 15 nt, Homo sapiens
caguaugaaugaugu

SEQ ID NO: 1104662 - RNA, 19 nt, Homo sapiens
cagucaccgacaacaugcu

SEQ ID NO: 1104663 - RNA, 21 nt, Homo sapiens
cagucauaacuaaauaaagcu

SEQ ID NO: 1104664 - RNA, 23 nt, Homo sapiens
caguccugggagaaccucaggcu

SEQ ID NO: 1104665 - RNA, 22 nt, Homo sapiens
cagucucggguggcuagucaga

SEQ ID NO: 1104666 - RNA, 13 nt, Homo sapiens
cagucucugggag

SEQ ID NO: 1104667 - RNA, 14 nt, Homo sapiens
cagugaaagccaga

SEQ ID NO: 1104668 - RNA, 15 nt, Homo sapiens
cagugaaccaaagag

SEQ ID NO: 1104669 - RNA, 21 nt, Homo sapiens
cagugaaccaaagagacugga

SEQ ID NO: 1104670 - RNA, 17 nt, Homo sapiens
cagugacuuuagaaaca

SEQ ID NO: 1104671 - RNA, 16 nt, Homo sapiens
cagugcccucauuuua

SEQ ID NO: 1104672 - RNA, 16 nt, Homo sapiens
cagugccuggcaaggc

SEQ ID NO: 1104673 - RNA, 15 nt, Homo sapiens
cagugccuuccauaa

SEQ ID NO: 1104674 - RNA, 16 nt, Homo sapiens
cagugccuuccauaau

SEQ ID NO: 1104675 - RNA, 14 nt, Homo sapiens
cagugcuaccucuc

SEQ ID NO: 1104676 - RNA, 17 nt, Homo sapiens
cagugcucggcuguaaa

SEQ ID NO: 1104677 - RNA, 17 nt, Homo sapiens
cacugugcuuacaguga

SEQ ID NO: 1104678 - RNA, 14 nt, Homo sapiens
cacuguugcccagg

SEQ ID NO: 1104679 - RNA, 17 nt, Homo sapiens
cacuguugcccaggcug

SEQ ID NO: 1104680 - RNA, 22 nt, Homo sapiens
cacuguuuaacugggagugaua

SEQ ID NO: 1104681 - RNA, 18 nt, Homo sapiens
cacuuaaaaaauguccau

SEQ ID NO: 1104682 - RNA, 16 nt, Homo sapiens
cacuuaauaauugcau

SEQ ID NO: 1104683 - RNA, 21 nt, Homo sapiens
cacuucgaugacuggauacag

SEQ ID NO: 1104684 - RNA, 20 nt, Homo sapiens
cacuucucaucauauuguau

SEQ ID NO: 1104685 - RNA, 21 nt, Homo sapiens
cacuucucuagagaacaugcc

SEQ ID NO: 1104686 - RNA, 13 nt, Homo sapiens
cacuucucuccag

SEQ ID NO: 1104687 - RNA, 21 nt, Homo sapiens
cacuucuuacaauaauucuau

SEQ ID NO: 1104688 - RNA, 19 nt, Homo sapiens
cacuugggucuucccugua

SEQ ID NO: 1104689 - RNA, 12 nt, Homo sapiens
cacuuguaugcu

SEQ ID NO: 1104690 - RNA, 20 nt, Homo sapiens
cagaaaaacucugggaaaua

SEQ ID NO: 1104691 - RNA, 17 nt, Homo sapiens
cagaaaaguagaauuau

SEQ ID NO: 1104692 - RNA, 18 nt, Homo sapiens
cagaaacaaaaacacuaa

SEQ ID NO: 1104693 - RNA, 12 nt, Homo sapiens
cagaaagcauua

SEQ ID NO: 1104694 - RNA, 19 nt, Homo sapiens
cagaaagccaggguccuga

SEQ ID NO: 1104695 - RNA, 19 nt, Homo sapiens
cagaaaggagaacuaucca

SEQ ID NO: 1104696 - RNA, 15 nt, Homo sapiens
cagaaauacaugaaa

SEQ ID NO: 1104697 - RNA, 13 nt, Homo sapiens
cagaacacugucu

SEQ ID NO: 1104698 - RNA, 16 nt, Homo sapiens
cagaacacugucuuga

SEQ ID NO: 1104699 - RNA, 17 nt, Homo sapiens
cagaacccagauuuccu

SEQ ID NO: 1104700 - RNA, 20 nt, Homo sapiens
cagaacuuaaggauggagcc

SEQ ID NO: 1104701 - RNA, 18 nt, Homo sapiens
cagaagaauauucaggac

SEQ ID NO: 1104702 - RNA, 12 nt, Homo sapiens
cagaaggggugg

SEQ ID NO: 1104703 - RNA, 19 nt, Homo sapiens
cagaaguuucuucuuuagg

SEQ ID NO: 1104704 - RNA, 17 nt, Homo sapiens
cagaauaaauaugcuca

SEQ ID NO: 1104705 - RNA, 14 nt, Homo sapiens
cagaaucccggcug

SEQ ID NO: 1104706 - RNA, 22 nt, Homo sapiens
cagaaucccggcugucaagggg

SEQ ID NO: 1104707 - RNA, 18 nt, Homo sapiens
cagaaugaugccaaaaua

SEQ ID NO: 1104708 - RNA, 18 nt, Homo sapiens
cagacacaggcccggcuc

SEQ ID NO: 1104709 - RNA, 15 nt, Homo sapiens
cagacaggcucaggu

SEQ ID NO: 1104710 - RNA, 17 nt, Homo sapiens
cagacauguggugggac

SEQ ID NO: 1104711 - RNA, 15 nt, Homo sapiens
cagaccugacugccu

SEQ ID NO: 1104712 - RNA, 18 nt, Homo sapiens
cagacuccugugcaacuu

SEQ ID NO: 1104713 - RNA, 16 nt, Homo sapiens
cagacuguaggauuug

SEQ ID NO: 1104714 - RNA, 18 nt, Homo sapiens
cagacuguaggauuugaa

SEQ ID NO: 1104715 - RNA, 16 nt, Homo sapiens
cagacuguggcugcag

SEQ ID NO: 1104716 - RNA, 20 nt, Homo sapiens
cagacuucccugaauguauu

SEQ ID NO: 1104717 - RNA, 20 nt, Homo sapiens
cagagaaaauaaaagcacuu

SEQ ID NO: 1104718 - RNA, 14 nt, Homo sapiens
cagagaaaguacuu

SEQ ID NO: 1104719 - RNA, 14 nt, Homo sapiens
cagagaacccugug

SEQ ID NO: 1104720 - RNA, 14 nt, Homo sapiens
cagagacaccugca

SEQ ID NO: 1104721 - RNA, 20 nt, Homo sapiens
cagagacauacaccuauguc

SEQ ID NO: 1104722 - RNA, 17 nt, Homo sapiens
cagagacccagaucuca

SEQ ID NO: 1104723 - RNA, 23 nt, Homo sapiens
cagagagggcagagggguaggca

SEQ ID NO: 1104724 - RNA, 19 nt, Homo sapiens
cagagaggggacauuuccc

SEQ ID NO: 1104725 - RNA, 20 nt, Homo sapiens
cagagaggggacauuucccu

SEQ ID NO: 1104726 - RNA, 16 nt, Homo sapiens
cagagauaauugccau

SEQ ID NO: 1104727 - RNA, 23 nt, Homo sapiens
cagagaugggcaaagcugugcac

SEQ ID NO: 1104728 - RNA, 16 nt, Homo sapiens
cagagcagaaccaaag

SEQ ID NO: 1104729 - RNA, 14 nt, Homo sapiens
cagagcucccuucc

SEQ ID NO: 1104730 - RNA, 13 nt, Homo sapiens
cagagcuuccuua

SEQ ID NO: 1104731 - RNA, 21 nt, Homo sapiens
cagaggauuuaacugugaacc

SEQ ID NO: 1104732 - RNA, 18 nt, Homo sapiens
cagaggcugcagaaggcc

SEQ ID NO: 1104733 - RNA, 20 nt, Homo sapiens
cagagggcguguuguuuuac

SEQ ID NO: 1104734 - RNA, 12 nt, Homo sapiens
cagaguaaaaua

SEQ ID NO: 1104735 - RNA, 16 nt, Homo sapiens
cagagucaaauuugaa

SEQ ID NO: 1104736 - RNA, 12 nt, Homo sapiens
cagaguccuaca

SEQ ID NO: 1104737 - RNA, 19 nt, Homo sapiens
cagagucucacuguugccc

SEQ ID NO: 1104738 - RNA, 18 nt, Homo sapiens
cagauaaacaacaaauaa

SEQ ID NO: 1104739 - RNA, 21 nt, Homo sapiens
cagauacuucccauuuuggaa

SEQ ID NO: 1104740 - RNA, 11 nt, Homo sapiens
cagauagucaa

SEQ ID NO: 1104741 - RNA, 14 nt, Homo sapiens
cagaucaaauuuca

SEQ ID NO: 1104742 - RNA, 20 nt, Homo sapiens
caauuccaaaggaaucucca

SEQ ID NO: 1104743 - RNA, 20 nt, Homo sapiens
caauuccauuuccaguucau

SEQ ID NO: 1104744 - RNA, 16 nt, Homo sapiens
caauuuguauaucaug

SEQ ID NO: 1104745 - RNA, 17 nt, Homo sapiens
cacaaaaugcaagguga

SEQ ID NO: 1104746 - RNA, 12 nt, Homo sapiens
cacaagcacuuu

SEQ ID NO: 1104747 - RNA, 18 nt, Homo sapiens
cacaagcuggaagcacau

SEQ ID NO: 1104748 - RNA, 16 nt, Homo sapiens
cacaagcuuguauaua

SEQ ID NO: 1104749 - RNA, 15 nt, Homo sapiens
cacaaggcugaccaa

SEQ ID NO: 1104750 - RNA, 20 nt, Homo sapiens
cacaaggcugaccaagagag

SEQ ID NO: 1104751 - RNA, 21 nt, Homo sapiens
cacaaggcugaccaagagaga

SEQ ID NO: 1104752 - RNA, 23 nt, Homo sapiens
cacaaggggaaggguacugaaaa

SEQ ID NO: 1104753 - RNA, 17 nt, Homo sapiens
cacaaucugggacuuuc

SEQ ID NO: 1104754 - RNA, 12 nt, Homo sapiens
cacaauucacua

SEQ ID NO: 1104755 - RNA, 21 nt, Homo sapiens
cacaauuccauuuccaguuca

SEQ ID NO: 1104756 - RNA, 13 nt, Homo sapiens
cacacacauacac

SEQ ID NO: 1104757 - RNA, 12 nt, Homo sapiens
cacaccaucucc

SEQ ID NO: 1104758 - RNA, 14 nt, Homo sapiens
cacacccuccccau

SEQ ID NO: 1104759 - RNA, 22 nt, Homo sapiens
cacaccuuauauuuacguauga

SEQ ID NO: 1104760 - RNA, 16 nt, Homo sapiens
cacacgcgugcacaca

SEQ ID NO: 1104761 - RNA, 22 nt, Homo sapiens
cacacugauguagauaacagcu

SEQ ID NO: 1104762 - RNA, 17 nt, Homo sapiens
cacagaaauacaugaaa

SEQ ID NO: 1104763 - RNA, 21 nt, Homo sapiens
cacagaacuauguacuuuaaa

SEQ ID NO: 1104764 - RNA, 14 nt, Homo sapiens
cacagaagccagga

SEQ ID NO: 1104765 - RNA, 18 nt, Homo sapiens
cacagaaggaaucugugc

SEQ ID NO: 1104766 - RNA, 16 nt, Homo sapiens
cacagacugcgauuug

SEQ ID NO: 1104767 - RNA, 23 nt, Homo sapiens
cacagccgcagccucccucugac

SEQ ID NO: 1104768 - RNA, 20 nt, Homo sapiens
cacagcggaggagaccagcu

SEQ ID NO: 1104769 - RNA, 23 nt, Homo sapiens
cacagcuucugcagcagacuguc

SEQ ID NO: 1104770 - RNA, 21 nt, Homo sapiens
cacaggauuuguaauuccuua

SEQ ID NO: 1104771 - RNA, 18 nt, Homo sapiens
cacaggcagguccagggu

SEQ ID NO: 1104772 - RNA, 13 nt, Homo sapiens
cacagguguaaau

SEQ ID NO: 1104773 - RNA, 23 nt, Homo sapiens
cacaguauuacuucugcuacaua

SEQ ID NO: 1104774 - RNA, 15 nt, Homo sapiens
cacagucucugggag

SEQ ID NO: 1104775 - RNA, 22 nt, Homo sapiens
cacagucucuuuaaucuucagu

SEQ ID NO: 1104776 - RNA, 21 nt, Homo sapiens
cacauaaacacauacauugcc

SEQ ID NO: 1104777 - RNA, 12 nt, Homo sapiens
cacauaaaggua

SEQ ID NO: 1104778 - RNA, 21 nt, Homo sapiens
cacauacugcaugcucaggac

SEQ ID NO: 1104779 - RNA, 13 nt, Homo sapiens
cacauauggacuc

SEQ ID NO: 1104780 - RNA, 15 nt, Homo sapiens
cacauggccuaugca

SEQ ID NO: 1104781 - RNA, 16 nt, Homo sapiens
cacauggccuaugcac

SEQ ID NO: 1104782 - RNA, 19 nt, Homo sapiens
cacauggccuaugcacaua

SEQ ID NO: 1104783 - RNA, 15 nt, Homo sapiens
cacauguaacauaga

SEQ ID NO: 1104784 - RNA, 19 nt, Homo sapiens
cacaugucuuguacaugug

SEQ ID NO: 1104785 - RNA, 20 nt, Homo sapiens
cacaugugacacauaugcac

SEQ ID NO: 1104786 - RNA, 23 nt, Homo sapiens
cacauucuuaacacauguccuug

SEQ ID NO: 1104787 - RNA, 15 nt, Homo sapiens
cacauuugauguaca

SEQ ID NO: 1104788 - RNA, 23 nt, Homo sapiens
cacauuugauuauauacuaugua

SEQ ID NO: 1104789 - RNA, 24 nt, Homo sapiens
cacauuugauuauauacuauguau

SEQ ID NO: 1104790 - RNA, 20 nt, Homo sapiens
cacauuuugcauuagacaga

SEQ ID NO: 1104791 - RNA, 23 nt, Homo sapiens
cacauuuugcauuagacagauga

SEQ ID NO: 1104792 - RNA, 18 nt, Homo sapiens
caccaaaucaucucucau

SEQ ID NO: 1104793 - RNA, 22 nt, Homo sapiens
caccaaaucaucucucaucacu

SEQ ID NO: 1104794 - RNA, 17 nt, Homo sapiens
caccagccuaagaagcu

SEQ ID NO: 1104795 - RNA, 15 nt, Homo sapiens
caccagcugccaaaa

SEQ ID NO: 1104796 - RNA, 21 nt, Homo sapiens
caccagugccgccugugccca

SEQ ID NO: 1104797 - RNA, 16 nt, Homo sapiens
caccaguuccuuucaa

SEQ ID NO: 1104798 - RNA, 22 nt, Homo sapiens
caccaucuuuugugagauguaa

SEQ ID NO: 1104799 - RNA, 19 nt, Homo sapiens
caccauucacauuugaugu

SEQ ID NO: 1104800 - RNA, 23 nt, Homo sapiens
cacccaaaagucaaaaggugccu

SEQ ID NO: 1104801 - RNA, 21 nt, Homo sapiens
cacccaagagggcugcuuccc

SEQ ID NO: 1104802 - RNA, 13 nt, Homo sapiens
cacccagcaaaga

SEQ ID NO: 1104803 - RNA, 15 nt, Homo sapiens
cacccaugaaucaaa

SEQ ID NO: 1104804 - RNA, 18 nt, Homo sapiens
cacccaugaaucaaagac

SEQ ID NO: 1104805 - RNA, 16 nt, Homo sapiens
cacccaugcccagcug

SEQ ID NO: 1104806 - RNA, 13 nt, Homo sapiens
cacccccagucuc

SEQ ID NO: 1104807 - RNA, 13 nt, Homo sapiens
caccccucaaaaa

SEQ ID NO: 1104808 - RNA, 16 nt, Homo sapiens
cacccgacuccucaaa

SEQ ID NO: 1104809 - RNA, 17 nt, Homo sapiens
cacccgacuccucaaaa

SEQ ID NO: 1104810 - RNA, 22 nt, Homo sapiens
cacccuccuuucaccacaugug

SEQ ID NO: 1104811 - RNA, 20 nt, Homo sapiens
cacccugaggagucugaggu

SEQ ID NO: 1104812 - RNA, 20 nt, Homo sapiens
cacccuguagguucuugaua

SEQ ID NO: 1104813 - RNA, 21 nt, Homo sapiens
caccguggaccuuccugccac

SEQ ID NO: 1104814 - RNA, 18 nt, Homo sapiens
caccuacucacacaggca

SEQ ID NO: 1104815 - RNA, 17 nt, Homo sapiens
caccuacuuacaugcau

SEQ ID NO: 1104816 - RNA, 18 nt, Homo sapiens
caccuacuuacaugcauu

SEQ ID NO: 1104817 - RNA, 19 nt, Homo sapiens
caccucaaauacauaccua

SEQ ID NO: 1104818 - RNA, 20 nt, Homo sapiens
caccuccgccccagacacac

SEQ ID NO: 1104819 - RNA, 15 nt, Homo sapiens
caccuccuacgucaa

SEQ ID NO: 1104820 - RNA, 18 nt, Homo sapiens
caccucuugucagugcuc

SEQ ID NO: 1104821 - RNA, 21 nt, Homo sapiens
caccugaauuucuguuugaau

SEQ ID NO: 1104822 - RNA, 18 nt, Homo sapiens
caccugcuucugaacuca

SEQ ID NO: 1104823 - RNA, 16 nt, Homo sapiens
caccugggguauggca

SEQ ID NO: 1104824 - RNA, 14 nt, Homo sapiens
caccuugacagggc

SEQ ID NO: 1104825 - RNA, 14 nt, Homo sapiens
caccuugucaugua

SEQ ID NO: 1104826 - RNA, 16 nt, Homo sapiens
caccuugucauguacc

SEQ ID NO: 1104827 - RNA, 15 nt, Homo sapiens
caccuugugucugua

SEQ ID NO: 1104828 - RNA, 13 nt, Homo sapiens
cacgcgugcacac

SEQ ID NO: 1104829 - RNA, 16 nt, Homo sapiens
cacgcuggagugcagu

SEQ ID NO: 1104830 - RNA, 18 nt, Homo sapiens
cacgcuuuuugaaaaagc

SEQ ID NO: 1104831 - RNA, 15 nt, Homo sapiens
cacgugugcagacug

SEQ ID NO: 1104832 - RNA, 12 nt, Homo sapiens
agcuuucugucc

SEQ ID NO: 1104833 - RNA, 17 nt, Homo sapiens
aggaaaaggccuggggu

SEQ ID NO: 1104834 - RNA, 15 nt, Homo sapiens
aggaaaauuucacau

SEQ ID NO: 1104835 - RNA, 12 nt, Homo sapiens
aggaaacuugca

SEQ ID NO: 1104836 - RNA, 20 nt, Homo sapiens
aggaaauauucuguaaucuu

SEQ ID NO: 1104837 - RNA, 14 nt, Homo sapiens
aggaacagaguaua

SEQ ID NO: 1104838 - RNA, 12 nt, Homo sapiens
aggaacucuggc

SEQ ID NO: 1104839 - RNA, 16 nt, Homo sapiens
aggaagaaaaccagcg

SEQ ID NO: 1104840 - RNA, 13 nt, Homo sapiens
aggaagaacaaau

SEQ ID NO: 1104841 - RNA, 22 nt, Homo sapiens
aggaagaccaagacacagauca

SEQ ID NO: 1104842 - RNA, 15 nt, Homo sapiens
aggaagagugugcuu

SEQ ID NO: 1104843 - RNA, 14 nt, Homo sapiens
aggaagcuccaguu

SEQ ID NO: 1104844 - RNA, 16 nt, Homo sapiens
aggaaggugcuugccu

SEQ ID NO: 1104845 - RNA, 23 nt, Homo sapiens
aggaaggugcuugccugggacca

SEQ ID NO: 1104846 - RNA, 15 nt, Homo sapiens
aggaaucugugcaga

SEQ ID NO: 1104847 - RNA, 17 nt, Homo sapiens
aggaauuaaguuaggga

SEQ ID NO: 1104848 - RNA, 22 nt, Homo sapiens
aggacaauucacuucauugacc

SEQ ID NO: 1104849 - RNA, 21 nt, Homo sapiens
aggacagggaggugaccccag

SEQ ID NO: 1104850 - RNA, 21 nt, Homo sapiens
aggacaugaaaaauugcuaug

SEQ ID NO: 1104851 - RNA, 22 nt, Homo sapiens
aggacauucuggaaaagcaaaa

SEQ ID NO: 1104852 - RNA, 13 nt, Homo sapiens
aggaccuuaccug

SEQ ID NO: 1104853 - RNA, 21 nt, Homo sapiens
aggacgguuaacuuguauauu

SEQ ID NO: 1104854 - RNA, 13 nt, Homo sapiens
aggacgugucuca

SEQ ID NO: 1104855 - RNA, 20 nt, Homo sapiens
aggacuuaacggcuccagga

SEQ ID NO: 1104856 - RNA, 17 nt, Homo sapiens
aggacuucugccugaac

SEQ ID NO: 1104857 - RNA, 16 nt, Homo sapiens
aggagaaaaugcauua

SEQ ID NO: 1104858 - RNA, 13 nt, Homo sapiens
aggagaaggugcc

SEQ ID NO: 1104859 - RNA, 20 nt, Homo sapiens
aggagauggaaguugcagug

SEQ ID NO: 1104860 - RNA, 22 nt, Homo sapiens
aggagcaaauguuucugcagua

SEQ ID NO: 1104861 - RNA, 16 nt, Homo sapiens
aggagcuaaacaugcu

SEQ ID NO: 1104862 - RNA, 15 nt, Homo sapiens
aggagcuuccagugc

SEQ ID NO: 1104863 - RNA, 20 nt, Homo sapiens
aggaggcuuaggacuuucca

SEQ ID NO: 1104864 - RNA, 21 nt, Homo sapiens
aggagggagggacacuuaccc

SEQ ID NO: 1104865 - RNA, 23 nt, Homo sapiens
aggagggcgugacucacccaagc

SEQ ID NO: 1104866 - RNA, 19 nt, Homo sapiens
aggagggguuaaagcugcc

SEQ ID NO: 1104867 - RNA, 22 nt, Homo sapiens
aggaggugcuaucgcaccacug

SEQ ID NO: 1104868 - RNA, 22 nt, Homo sapiens
aggaguucucaucccucuguca

SEQ ID NO: 1104869 - RNA, 13 nt, Homo sapiens
aggaugacacugc

SEQ ID NO: 1104870 - RNA, 21 nt, Homo sapiens
aggaugauaaaagcacuuacu

SEQ ID NO: 1104871 - RNA, 16 nt, Homo sapiens
aggaugugcauucucc

SEQ ID NO: 1104872 - RNA, 17 nt, Homo sapiens
aggauguucugggacac

SEQ ID NO: 1104873 - RNA, 17 nt, Homo sapiens
aggauucauguggaaua

SEQ ID NO: 1104874 - RNA, 20 nt, Homo sapiens
aggcaaaauugauauacuuu

SEQ ID NO: 1104875 - RNA, 13 nt, Homo sapiens
aggcaaaggcaau

SEQ ID NO: 1104876 - RNA, 15 nt, Homo sapiens
aucccaagguuucca

SEQ ID NO: 1104877 - RNA, 17 nt, Homo sapiens
aucccacccacauguga

SEQ ID NO: 1104878 - RNA, 17 nt, Homo sapiens
aucccauccaucagcuc

SEQ ID NO: 1104879 - RNA, 19 nt, Homo sapiens
aucccauugucaccuaacu

SEQ ID NO: 1104880 - RNA, 14 nt, Homo sapiens
auccccagccagaa

SEQ ID NO: 1104881 - RNA, 15 nt, Homo sapiens
aucccccagccucaa

SEQ ID NO: 1104882 - RNA, 13 nt, Homo sapiens
auccccuuuauua

SEQ ID NO: 1104883 - RNA, 18 nt, Homo sapiens
aucccgugaaagaauuau

SEQ ID NO: 1104884 - RNA, 14 nt, Homo sapiens
aucccuacaaaaaa

SEQ ID NO: 1104885 - RNA, 18 nt, Homo sapiens
aucccucugucaggguca

SEQ ID NO: 1104886 - RNA, 19 nt, Homo sapiens
auccgaaguaugagggaaa

SEQ ID NO: 1104887 - RNA, 13 nt, Homo sapiens
auccguacauuca

SEQ ID NO: 1104888 - RNA, 15 nt, Homo sapiens
auccuaacacauuau

SEQ ID NO: 1104889 - RNA, 15 nt, Homo sapiens
auccuacaacuucca

SEQ ID NO: 1104890 - RNA, 11 nt, Homo sapiens
auccuauuuau

SEQ ID NO: 1104891 - RNA, 14 nt, Homo sapiens
auccucccaccuca

SEQ ID NO: 1104892 - RNA, 13 nt, Homo sapiens
auccucucucugu

SEQ ID NO: 1104893 - RNA, 18 nt, Homo sapiens
auccugcuagcuguagaa

SEQ ID NO: 1104894 - RNA, 18 nt, Homo sapiens
auccugucuuuaaggaaa

SEQ ID NO: 1104895 - RNA, 13 nt, Homo sapiens
auccuuuacuguu

SEQ ID NO: 1104896 - RNA, 16 nt, Homo sapiens
aucgaucuguacugua

SEQ ID NO: 1104897 - RNA, 16 nt, Homo sapiens
aucgcugccuugccau

SEQ ID NO: 1104898 - RNA, 17 nt, Homo sapiens
aucggagacagugaucu

SEQ ID NO: 1104899 - RNA, 16 nt, Homo sapiens
aucgggagcagugucu

SEQ ID NO: 1104900 - RNA, 12 nt, Homo sapiens
aucgugcuaaau

SEQ ID NO: 1104901 - RNA, 16 nt, Homo sapiens
aucguuagaggagcaa

SEQ ID NO: 1104902 - RNA, 14 nt, Homo sapiens
aucuaaauagcccu

SEQ ID NO: 1104903 - RNA, 18 nt, Homo sapiens
aucuacuucaacacuuca

SEQ ID NO: 1104904 - RNA, 22 nt, Homo sapiens
aucuacuucaacacuucaugua

SEQ ID NO: 1104905 - RNA, 18 nt, Homo sapiens
aucuagaggcuuccuuca

SEQ ID NO: 1104906 - RNA, 16 nt, Homo sapiens
aucucaagagcccugu

SEQ ID NO: 1104907 - RNA, 15 nt, Homo sapiens
aucucacaagcacuu

SEQ ID NO: 1104908 - RNA, 16 nt, Homo sapiens
aucucauggaaacugg

SEQ ID NO: 1104909 - RNA, 20 nt, Homo sapiens
aucucuaaacugcuguuaau

SEQ ID NO: 1104910 - RNA, 12 nt, Homo sapiens
aucucuaugugg

SEQ ID NO: 1104911 - RNA, 13 nt, Homo sapiens
aucucucaucacu

SEQ ID NO: 1104912 - RNA, 13 nt, Homo sapiens
aucugaaccacuu

SEQ ID NO: 1104913 - RNA, 20 nt, Homo sapiens
aucugaguugacuugacaga

SEQ ID NO: 1104914 - RNA, 14 nt, Homo sapiens
aucugcagcuaacu

SEQ ID NO: 1104915 - RNA, 17 nt, Homo sapiens
aaguagguuuacauuca

SEQ ID NO: 1104916 - RNA, 23 nt, Homo sapiens
aaguauacaauaaagucuuaccu

SEQ ID NO: 1104917 - RNA, 18 nt, Homo sapiens
aaguauauauucuacaca

SEQ ID NO: 1104918 - RNA, 14 nt, Homo sapiens
aaguaugccuuccu

SEQ ID NO: 1104919 - RNA, 18 nt, Homo sapiens
aaguaugugaauaugaau

SEQ ID NO: 1104920 - RNA, 23 nt, Homo sapiens
aaguauucuucaucagcauuuaa

SEQ ID NO: 1104921 - RNA, 12 nt, Homo sapiens
aagucacauaua

SEQ ID NO: 1104922 - RNA, 21 nt, Homo sapiens
aagucauggcccaaauccagu

SEQ ID NO: 1104923 - RNA, 19 nt, Homo sapiens
aaguccuacaagcuaaaau

SEQ ID NO: 1104924 - RNA, 18 nt, Homo sapiens
aagucucugacucuugcc

SEQ ID NO: 1104925 - RNA, 17 nt, Homo sapiens
aagucuuauuuccucaa

SEQ ID NO: 1104926 - RNA, 11 nt, Homo sapiens
aagucuuccau

SEQ ID NO: 1104927 - RNA, 22 nt, Homo sapiens
aagucuuccauagagacuuugu

SEQ ID NO: 1104928 - RNA, 11 nt, Homo sapiens
aagugaccuau

SEQ ID NO: 1104929 - RNA, 14 nt, Homo sapiens
aagugagacugaca

SEQ ID NO: 1104930 - RNA, 23 nt, Homo sapiens
aagugcugggauuacagguguga

SEQ ID NO: 1104931 - RNA, 17 nt, Homo sapiens
aaguggcuaauucaauu

SEQ ID NO: 1104932 - RNA, 15 nt, Homo sapiens
aaguguaaauccuuu

SEQ ID NO: 1104933 - RNA, 14 nt, Homo sapiens
aaguguaauagauu

SEQ ID NO: 1104934 - RNA, 15 nt, Homo sapiens
aaguuaagcagccuu

SEQ ID NO: 1104935 - RNA, 23 nt, Homo sapiens
aaguuaagcagccuuucugugga

SEQ ID NO: 1104936 - RNA, 14 nt, Homo sapiens
aaguuaauuuuccc

SEQ ID NO: 1104937 - RNA, 17 nt, Homo sapiens
aaguuacauguuugcac

SEQ ID NO: 1104938 - RNA, 22 nt, Homo sapiens
aaguuagggaauggcacagccc

SEQ ID NO: 1104939 - RNA, 16 nt, Homo sapiens
aaguuauugauguuuu

SEQ ID NO: 1104940 - RNA, 15 nt, Homo sapiens
aaguucaauacucau

SEQ ID NO: 1104941 - RNA, 14 nt, Homo sapiens
aaguucauaggguc

SEQ ID NO: 1104942 - RNA, 22 nt, Homo sapiens
aaguucgaagcuccgugaguga

SEQ ID NO: 1104943 - RNA, 17 nt, Homo sapiens
aaguugcugaugaacuc

SEQ ID NO: 1104944 - RNA, 14 nt, Homo sapiens
aauaaaaaaauaca

SEQ ID NO: 1104945 - RNA, 13 nt, Homo sapiens
aauaaaaacugac

SEQ ID NO: 1104946 - RNA, 24 nt, Homo sapiens
aauaaaacccaacagauacuggaa

SEQ ID NO: 1104947 - RNA, 15 nt, Homo sapiens
aaaaugcaacaacau

SEQ ID NO: 1104948 - RNA, 13 nt, Homo sapiens
aaaaugcauuuaa

SEQ ID NO: 1104949 - RNA, 14 nt, Homo sapiens
aaaauggacauauu

SEQ ID NO: 1104950 - RNA, 19 nt, Homo sapiens
aaaauguccaugauggaau

SEQ ID NO: 1104951 - RNA, 12 nt, Homo sapiens
aaaaugugcaau

SEQ ID NO: 1104952 - RNA, 20 nt, Homo sapiens
aaaauuaaaugcauguccuc

SEQ ID NO: 1104953 - RNA, 23 nt, Homo sapiens
aaaauuaaaugcauguccucaaa

SEQ ID NO: 1104954 - RNA, 15 nt, Homo sapiens
aaaauucuuggaaua

SEQ ID NO: 1104955 - RNA, 16 nt, Homo sapiens
aaaauugaacuacuug

SEQ ID NO: 1104956 - RNA, 14 nt, Homo sapiens
aaacaaaacaaaac

SEQ ID NO: 1104957 - RNA, 15 nt, Homo sapiens
aaacaagugcacuug

SEQ ID NO: 1104958 - RNA, 12 nt, Homo sapiens
aaacacuguaau

SEQ ID NO: 1104959 - RNA, 13 nt, Homo sapiens
aaacacuucucau

SEQ ID NO: 1104960 - RNA, 19 nt, Homo sapiens
aaacagauuguuugcaaag

SEQ ID NO: 1104961 - RNA, 16 nt, Homo sapiens
aaacaggaccacaaaa

SEQ ID NO: 1104962 - RNA, 19 nt, Homo sapiens
aaacauaaagagaacucug

SEQ ID NO: 1104963 - RNA, 14 nt, Homo sapiens
aaacauaugcauua

SEQ ID NO: 1104964 - RNA, 15 nt, Homo sapiens
aaacauuccugugaa

SEQ ID NO: 1104965 - RNA, 15 nt, Homo sapiens
aaacauugugccaug

SEQ ID NO: 1104966 - RNA, 11 nt, Homo sapiens
aaaccaaagau

SEQ ID NO: 1104967 - RNA, 13 nt, Homo sapiens
aaaccaaugauuc

SEQ ID NO: 1104968 - RNA, 14 nt, Homo sapiens
aaaccaaugauuca

SEQ ID NO: 1104969 - RNA, 15 nt, Homo sapiens
aaaccacuagaacuc

SEQ ID NO: 1104970 - RNA, 16 nt, Homo sapiens
aaaccacuagaacucu

SEQ ID NO: 1104971 - RNA, 21 nt, Homo sapiens
aaaccacuagaacucuccauc

SEQ ID NO: 1104972 - RNA, 23 nt, Homo sapiens
aaaccaugcagcuucaucaauuu

SEQ ID NO: 1104973 - RNA, 13 nt, Homo sapiens
aaaccccaucucu

SEQ ID NO: 1104974 - RNA, 13 nt, Homo sapiens
aaacccucaaggg

SEQ ID NO: 1104975 - RNA, 17 nt, Homo sapiens
aaaccguaauuuuauua

SEQ ID NO: 1104976 - RNA, 13 nt, Homo sapiens
aaaccucaucucu

SEQ ID NO: 1104977 - RNA, 17 nt, Homo sapiens
aaaccuccggugugaga

SEQ ID NO: 1104978 - RNA, 14 nt, Homo sapiens
aaaccuuacuuaaa

SEQ ID NO: 1104979 - RNA, 19 nt, Homo sapiens
aaaccuuucaaauuucaca

SEQ ID NO: 1104980 - RNA, 16 nt, Homo sapiens
aaacuaacacccaguc

SEQ ID NO: 1104981 - RNA, 13 nt, Homo sapiens
aaacuauauucuc

SEQ ID NO: 1104982 - RNA, 13 nt, Homo sapiens
aaacuccaucuca

SEQ ID NO: 1104983 - RNA, 16 nt, Homo sapiens
aaacuuagcaacuugg

SEQ ID NO: 1104984 - RNA, 21 nt, Homo sapiens
aaacuuccuaaugauuagcac

SEQ ID NO: 1104985 - RNA, 19 nt, Homo sapiens
aaacuuguaaaugcuguca

SEQ ID NO: 1104986 - RNA, 17 nt, Homo sapiens
aaacuuuagaguagcau

SEQ ID NO: 1104987 - RNA, 22 nt, Homo sapiens
aaagaaacguacuuaacugugu

SEQ ID NO: 1104988 - RNA, 19 nt, Homo sapiens
aaagaacacgaauugcuca

SEQ ID NO: 1104989 - RNA, 16 nt, Homo sapiens
aaagaagacuggaagc

SEQ ID NO: 1104990 - RNA, 22 nt, Homo sapiens
aaagaauaauaugcugccaaau

SEQ ID NO: 1104991 - RNA, 20 nt, Homo sapiens
aaagaccaauauucaaaugc

SEQ ID NO: 1104992 - RNA, 14 nt, Homo sapiens
aaagaccugagaac

SEQ ID NO: 1104993 - RNA, 20 nt, Homo sapiens
aaagagaauaaagacuucau

SEQ ID NO: 1104994 - RNA, 16 nt, Homo sapiens
aaagagccuggagaag

SEQ ID NO: 1104995 - RNA, 20 nt, Homo sapiens
aaagauaacaagaucuuuca

SEQ ID NO: 1104996 - RNA, 19 nt, Homo sapiens
aaagauaugcuaagcagua

SEQ ID NO: 1104997 - RNA, 14 nt, Homo sapiens
aaagaugaugcaag

SEQ ID NO: 1104998 - RNA, 15 nt, Homo sapiens
aaagauggaugugcu

SEQ ID NO: 1104999 - RNA, 19 nt, Homo sapiens
aaagauguuugucagauau

SEQ ID NO: 1105000 - RNA, 23 nt, Homo sapiens
aaagcaagacagauuaccaaaga

SEQ ID NO: 1105001 - RNA, 23 nt, Homo sapiens
aaagcagcacauagcacugggaa

SEQ ID NO: 1105002 - RNA, 12 nt, Homo sapiens
aaagcagcaucu

SEQ ID NO: 1105003 - RNA, 15 nt, Homo sapiens
aaagcaguguuuuca

SEQ ID NO: 1105004 - RNA, 13 nt, Homo sapiens
aaagcaugucuca

SEQ ID NO: 1105005 - RNA, 22 nt, Homo sapiens
aaagccaggguccugaguggcu

SEQ ID NO: 1105006 - RNA, 18 nt, Homo sapiens
aaagcccaaccuccugac

SEQ ID NO: 1105007 - RNA, 15 nt, Homo sapiens
aaagcccuuccaugu

SEQ ID NO: 1105008 - RNA, 14 nt, Homo sapiens
aaagcccuugaacc

SEQ ID NO: 1105009 - RNA, 19 nt, Homo sapiens
aaagcccuuuuauaccucc

SEQ ID NO: 1105010 - RNA, 17 nt, Homo sapiens
aaagcugcuugacuauc

SEQ ID NO: 1105011 - RNA, 23 nt, Homo sapiens
aaagcuguuuauuuauucacugu

SEQ ID NO: 1105012 - RNA, 18 nt, Homo sapiens
aaagcuucuaucccagga

SEQ ID NO: 1105013 - RNA, 14 nt, Homo sapiens
aaagcuuugaaccc

SEQ ID NO: 1105014 - RNA, 17 nt, Homo sapiens
aaaggagaacuauccaa

SEQ ID NO: 1105015 - RNA, 12 nt, Homo sapiens
aaaggagccugu

SEQ ID NO: 1105016 - RNA, 21 nt, Homo sapiens
aaaggcuagguacacagcucu

SEQ ID NO: 1105017 - RNA, 14 nt, Homo sapiens
aaaggucauugugg

SEQ ID NO: 1105018 - RNA, 20 nt, Homo sapiens
aaagugagacccccaucucu

SEQ ID NO: 1105019 - RNA, 20 nt, Homo sapiens
aaagugcugcuggaaguaga

SEQ ID NO: 1105020 - RNA, 14 nt, Homo sapiens
aaaguggccaugcc

SEQ ID NO: 1105021 - RNA, 14 nt, Homo sapiens
aaaguuucagagaa

SEQ ID NO: 1105022 - RNA, 17 nt, Homo sapiens
aaaguuucucuuuucaa

SEQ ID NO: 1105023 - RNA, 15 nt, Homo sapiens
aaauaaaagcacuua

SEQ ID NO: 1105024 - RNA, 22 nt, Homo sapiens
aaauaaaguauauauagaaucu

SEQ ID NO: 1105025 - RNA, 16 nt, Homo sapiens
aaauaaauguguaaau

SEQ ID NO: 1105026 - RNA, 12 nt, Homo sapiens
aaauaaauucaa

SEQ ID NO: 1105027 - RNA, 13 nt, Homo sapiens
aaauaauacagga

SEQ ID NO: 1105028 - RNA, 16 nt, Homo sapiens
aaauacccacuaacaa

SEQ ID NO: 1105029 - RNA, 15 nt, Homo sapiens
aaauacuucuugaag

SEQ ID NO: 1105030 - RNA, 14 nt, Homo sapiens
aaauagaccucuca

SEQ ID NO: 1105031 - RNA, 14 nt, Homo sapiens
aaauagcaaaagaa

SEQ ID NO: 1105032 - RNA, 14 nt, Homo sapiens
aaauagcaucugcu

SEQ ID NO: 1105033 - RNA, 15 nt, Homo sapiens
aaauauaaacuugug

SEQ ID NO: 1105034 - RNA, 17 nt, Homo sapiens
aaauauaagaacuugau

SEQ ID NO: 1105035 - RNA, 17 nt, Homo sapiens
aaauauacaaacaugug

SEQ ID NO: 1105036 - RNA, 17 nt, Homo sapiens
aaauaucacaucacuua

SEQ ID NO: 1105037 - RNA, 21 nt, Homo sapiens
aaaucgugacaacacuugugu

SEQ ID NO: 1105038 - RNA, 22 nt, Homo sapiens
aaaucugccugauaggacccau

SEQ ID NO: 1105039 - RNA, 21 nt, Homo sapiens
aaaucuguuuuucuaacuggg

SEQ ID NO: 1105040 - RNA, 15 nt, Homo sapiens
aaaugaaagcaugug

SEQ ID NO: 1105041 - RNA, 14 nt, Homo sapiens
aaaugaaucuuacu

SEQ ID NO: 1105042 - RNA, 13 nt, Homo sapiens
aaaugacccaaag

SEQ ID NO: 1105043 - RNA, 16 nt, Homo sapiens
aaaugcaaacacugug

SEQ ID NO: 1105044 - RNA, 11 nt, Homo sapiens
aaaugcaacuu

SEQ ID NO: 1105045 - RNA, 13 nt, Homo sapiens
aaaugcauguccu

SEQ ID NO: 1105046 - RNA, 15 nt, Homo sapiens
aaaugcauguccuca

SEQ ID NO: 1105047 - RNA, 19 nt, Homo sapiens
aaauggggauauguuaacu

SEQ ID NO: 1105048 - RNA, 20 nt, Homo sapiens
aaauguaauacuccuaagac

SEQ ID NO: 1105049 - RNA, 13 nt, Homo sapiens
aaauguacacugg

SEQ ID NO: 1105050 - RNA, 17 nt, Homo sapiens
aaauguagguaugaaua

SEQ ID NO: 1105051 - RNA, 13 nt, Homo sapiens
aaauguccaugau

SEQ ID NO: 1105052 - RNA, 21 nt, Homo sapiens
aaaugucucuuuaaugucaca

SEQ ID NO: 1105053 - RNA, 18 nt, Homo sapiens
aaaugucuggucugucca

SEQ ID NO: 1105054 - RNA, 21 nt, Homo sapiens
aaaugucuguuucaaugaccu

SEQ ID NO: 1105055 - RNA, 12 nt, Homo sapiens
aaaugugcaaua

SEQ ID NO: 1105056 - RNA, 19 nt, Homo sapiens
aaauguucagaagguugcu

SEQ ID NO: 1105057 - RNA, 14 nt, Homo sapiens
aaauuaaaguauac

SEQ ID NO: 1105058 - RNA, 20 nt, Homo sapiens
aaauuaaaugcauguccuca

SEQ ID NO: 1105059 - RNA, 18 nt, Homo sapiens
aaauuaaauugcagaugg

SEQ ID NO: 1105060 - RNA, 15 nt, Homo sapiens
aaauuacaauuguca

SEQ ID NO: 1105061 - RNA, 16 nt, Homo sapiens
aaauuauaucucagua

SEQ ID NO: 1105062 - RNA, 16 nt, Homo sapiens
aaauuauuguauuaca

SEQ ID NO: 1105063 - RNA, 21 nt, Homo sapiens
aaauuauuuuaaaaacuaaaa

SEQ ID NO: 1105064 - RNA, 23 nt, Homo sapiens
aaauuccuuagcuuagaccucag

SEQ ID NO: 1105065 - RNA, 21 nt, Homo sapiens
aaauucuacugaacacuucaa

SEQ ID NO: 1105066 - RNA, 20 nt, Homo sapiens
aaauugcuuauucuaggucu

SEQ ID NO: 1105067 - RNA, 15 nt, Homo sapiens
aaauuguacauuuga

SEQ ID NO: 1105068 - RNA, 24 nt, Homo sapiens
aaauugucuuuugucauguggcua

SEQ ID NO: 1105069 - RNA, 17 nt, Homo sapiens
aaauuuaauauagcuau

SEQ ID NO: 1105070 - RNA, 16 nt, Homo sapiens
aaauuugaauuucagu

SEQ ID NO: 1105071 - RNA, 22 nt, Homo sapiens
aaauuugacucaugaacuauuu

SEQ ID NO: 1105072 - RNA, 12 nt, Homo sapiens
aaauuuuacuuu

SEQ ID NO: 1105073 - RNA, 19 nt, Homo sapiens
aacaaaagcuuuucuuucc

SEQ ID NO: 1105074 - RNA, 22 nt, Homo sapiens
aacaaauuagguuuuguacaau

SEQ ID NO: 1105075 - RNA, 15 nt, Homo sapiens
aacaaauugaugcaa

SEQ ID NO: 1105076 - RNA, 15 nt, Homo sapiens
aacaaccuggucaca

SEQ ID NO: 1105077 - RNA, 19 nt, Homo sapiens
aacaaccuggucacaggac

SEQ ID NO: 1105078 - RNA, 14 nt, Homo sapiens
aacaacuacuguga

SEQ ID NO: 1105079 - RNA, 19 nt, Homo sapiens
aacaacuuaauguucugaa

SEQ ID NO: 1105080 - RNA, 22 nt, Homo sapiens
aacaagcauuucccccagggaa

SEQ ID NO: 1105081 - RNA, 22 nt, Homo sapiens
aacaagccaacgacaaagccaa

SEQ ID NO: 1105082 - RNA, 20 nt, Homo sapiens
aacaauacgugaaagaugca

SEQ ID NO: 1105083 - RNA, 14 nt, Homo sapiens
aacaauucaaguga

SEQ ID NO: 1105084 - RNA, 14 nt, Homo sapiens
aacacaagccacag

SEQ ID NO: 1105085 - RNA, 16 nt, Homo sapiens
aacacaagccacagaa

SEQ ID NO: 1105086 - RNA, 12 nt, Homo sapiens
aacacagugcug

SEQ ID NO: 1105087 - RNA, 21 nt, Homo sapiens
aacaccacuuugucucugaga

SEQ ID NO: 1105088 - RNA, 22 nt, Homo sapiens
aacaccacuuugucucugagaa

SEQ ID NO: 1105089 - RNA, 23 nt, Homo sapiens
aacacgaauugcucaaugcauga

SEQ ID NO: 1105090 - RNA, 20 nt, Homo sapiens
aacagaacauagacagaaga

SEQ ID NO: 1105091 - RNA, 14 nt, Homo sapiens
aacagaagcuucca

SEQ ID NO: 1105092 - RNA, 15 nt, Homo sapiens
aacagacaacagaag

SEQ ID NO: 1105093 - RNA, 15 nt, Homo sapiens
aacagagccuucaca

SEQ ID NO: 1105094 - RNA, 19 nt, Homo sapiens
aacagagccuucacaacca

SEQ ID NO: 1105095 - RNA, 22 nt, Homo sapiens
aacagauggauagucuguccaa

SEQ ID NO: 1105096 - RNA, 21 nt, Homo sapiens
aacagcaaaacuccaucucaa

SEQ ID NO: 1105097 - RNA, 15 nt, Homo sapiens
aacagccaaaugcau

SEQ ID NO: 1105098 - RNA, 16 nt, Homo sapiens
aacagccugacaacau

SEQ ID NO: 1105099 - RNA, 14 nt, Homo sapiens
aacagcucucaccu

SEQ ID NO: 1105100 - RNA, 18 nt, Homo sapiens
aacaggcucaauauuccu

SEQ ID NO: 1105101 - RNA, 17 nt, Homo sapiens
aacaggggccaaacugg

SEQ ID NO: 1105102 - RNA, 11 nt, Homo sapiens
aacaguucaaa

SEQ ID NO: 1105103 - RNA, 22 nt, Homo sapiens
aacaguuuuuuaugcuaaucag

SEQ ID NO: 1105104 - RNA, 16 nt, Homo sapiens
aacauaaauuuaucau

SEQ ID NO: 1105105 - RNA, 20 nt, Homo sapiens
aacauaaauuuaucaucucg

SEQ ID NO: 1105106 - RNA, 21 nt, Homo sapiens
aacauaaauuucuuuaaucau

SEQ ID NO: 1105107 - RNA, 17 nt, Homo sapiens
aacauaagguacuagca

SEQ ID NO: 1105108 - RNA, 19 nt, Homo sapiens
aacauaagguacuagcagu

SEQ ID NO: 1105109 - RNA, 13 nt, Homo sapiens
aacauaccagacc

SEQ ID NO: 1105110 - RNA, 19 nt, Homo sapiens
aacauaucaaacauaugua

SEQ ID NO: 1105111 - RNA, 23 nt, Homo sapiens
aacauauguauacaaauuguuuc

SEQ ID NO: 1105112 - RNA, 14 nt, Homo sapiens
aagaguuacuuaau

SEQ ID NO: 1105113 - RNA, 15 nt, Homo sapiens
aagauaacugagaau

SEQ ID NO: 1105114 - RNA, 23 nt, Homo sapiens
aagaucaaaagcuuauucaucug

SEQ ID NO: 1105115 - RNA, 21 nt, Homo sapiens
aagaugccagugaaacuucaa

SEQ ID NO: 1105116 - RNA, 17 nt, Homo sapiens
aagauggauguuuguca

SEQ ID NO: 1105117 - RNA, 21 nt, Homo sapiens
aagauggcugugccucugccu

SEQ ID NO: 1105118 - RNA, 23 nt, Homo sapiens
aagauuccugguuaaauuugaau

SEQ ID NO: 1105119 - RNA, 20 nt, Homo sapiens
aagauuuugccacauuugau

SEQ ID NO: 1105120 - RNA, 18 nt, Homo sapiens
aagcaaaaccacugagcu

SEQ ID NO: 1105121 - RNA, 17 nt, Homo sapiens
aagcaacagauggauag

SEQ ID NO: 1105122 - RNA, 20 nt, Homo sapiens
aagcaacauaaaacaaugaa

SEQ ID NO: 1105123 - RNA, 13 nt, Homo sapiens
aagcaaggccaaa

SEQ ID NO: 1105124 - RNA, 12 nt, Homo sapiens
aagcacaugugu

SEQ ID NO: 1105125 - RNA, 15 nt, Homo sapiens
aagcagaagcacaua

SEQ ID NO: 1105126 - RNA, 19 nt, Homo sapiens
aagcagguggcaucucuaa

SEQ ID NO: 1105127 - RNA, 19 nt, Homo sapiens
aagcaguaagcuaucuuca

SEQ ID NO: 1105128 - RNA, 20 nt, Homo sapiens
aagcaguaagcuaucuucaa

SEQ ID NO: 1105129 - RNA, 15 nt, Homo sapiens
aagcaucaccucagg

SEQ ID NO: 1105130 - RNA, 16 nt, Homo sapiens
aagccaaacucugcca

SEQ ID NO: 1105131 - RNA, 17 nt, Homo sapiens
aagccaaacucugccag

SEQ ID NO: 1105132 - RNA, 19 nt, Homo sapiens
aagccaaauuuauaugcca

SEQ ID NO: 1105133 - RNA, 17 nt, Homo sapiens
aagccacagaagccagg

SEQ ID NO: 1105134 - RNA, 15 nt, Homo sapiens
aagcccaauauuaua

SEQ ID NO: 1105135 - RNA, 16 nt, Homo sapiens
aagccccggacucagg

SEQ ID NO: 1105136 - RNA, 23 nt, Homo sapiens
aagccccuuacuaugaucucagg

SEQ ID NO: 1105137 - RNA, 15 nt, Homo sapiens
aagcccuuuacuuga

SEQ ID NO: 1105138 - RNA, 14 nt, Homo sapiens
aagccggccggcug

SEQ ID NO: 1105139 - RNA, 22 nt, Homo sapiens
aagccucuggaaaacucaggau

SEQ ID NO: 1105140 - RNA, 20 nt, Homo sapiens
aagccuuggggauucuucca

SEQ ID NO: 1105141 - RNA, 21 nt, Homo sapiens
aagccuuuagagccagcccau

SEQ ID NO: 1105142 - RNA, 16 nt, Homo sapiens
aagccuuuugcucaca

SEQ ID NO: 1105143 - RNA, 22 nt, Homo sapiens
aagcuaaaauuagaugaacuca

SEQ ID NO: 1105144 - RNA, 23 nt, Homo sapiens
aagcucugcuccucuccccagca

SEQ ID NO: 1105145 - RNA, 22 nt, Homo sapiens
aagcuuccauuccaagccugac

SEQ ID NO: 1105146 - RNA, 13 nt, Homo sapiens
aaggaacuggaac

SEQ ID NO: 1105147 - RNA, 12 nt, Homo sapiens
aaggacaccucc

SEQ ID NO: 1105148 - RNA, 14 nt, Homo sapiens
aaggacacuuguau

SEQ ID NO: 1105149 - RNA, 16 nt, Homo sapiens
aaggacuaugaaaagc

SEQ ID NO: 1105150 - RNA, 15 nt, Homo sapiens
aaggagaacuaucca

SEQ ID NO: 1105151 - RNA, 23 nt, Homo sapiens
aaggagauauggcuaguggcaau

SEQ ID NO: 1105152 - RNA, 19 nt, Homo sapiens
aaggagccugugaacccag

SEQ ID NO: 1105153 - RNA, 21 nt, Homo sapiens
aaggaggacgguuaacuugua

SEQ ID NO: 1105154 - RNA, 12 nt, Homo sapiens
aaggaugaauga

SEQ ID NO: 1105155 - RNA, 20 nt, Homo sapiens
aaggcaacauuuccgaagac

SEQ ID NO: 1105156 - RNA, 13 nt, Homo sapiens
aaggcacaggugu

SEQ ID NO: 1105157 - RNA, 15 nt, Homo sapiens
aaggcagccaggcug

SEQ ID NO: 1105158 - RNA, 21 nt, Homo sapiens
aaggcaguguuccucaccaau

SEQ ID NO: 1105159 - RNA, 14 nt, Homo sapiens
aaggccacauguca

SEQ ID NO: 1105160 - RNA, 22 nt, Homo sapiens
aaggccagcgccagaacccaga

SEQ ID NO: 1105161 - RNA, 12 nt, Homo sapiens
aaggcugaccaa

SEQ ID NO: 1105162 - RNA, 17 nt, Homo sapiens
aaggcugaccaagagag

SEQ ID NO: 1105163 - RNA, 14 nt, Homo sapiens
aaggcugagcucuu

SEQ ID NO: 1105164 - RNA, 14 nt, Homo sapiens
aaggcugcugugua

SEQ ID NO: 1105165 - RNA, 22 nt, Homo sapiens
aaggcuggcugaaaaucacuau

SEQ ID NO: 1105166 - RNA, 13 nt, Homo sapiens
aagggaaacuauu

SEQ ID NO: 1105167 - RNA, 16 nt, Homo sapiens
aagggauaguccaaag

SEQ ID NO: 1105168 - RNA, 16 nt, Homo sapiens
aagggaucuuccuugg

SEQ ID NO: 1105169 - RNA, 20 nt, Homo sapiens
aaggggacagcgccaccucu

SEQ ID NO: 1105170 - RNA, 21 nt, Homo sapiens
aaggguuauagacugccaugc

SEQ ID NO: 1105171 - RNA, 13 nt, Homo sapiens
aagguagcccagc

SEQ ID NO: 1105172 - RNA, 15 nt, Homo sapiens
aaggucucugaacuc

SEQ ID NO: 1105173 - RNA, 20 nt, Homo sapiens
aaggucuugccugaauccau

SEQ ID NO: 1105174 - RNA, 17 nt, Homo sapiens
aaggugugcaaacuugu

SEQ ID NO: 1105175 - RNA, 16 nt, Homo sapiens
aagguuaacagauaca

SEQ ID NO: 1105176 - RNA, 18 nt, Homo sapiens
aagguucccucugagaau

SEQ ID NO: 1105177 - RNA, 19 nt, Homo sapiens
aaguaacuuuuacaaaaca

SEQ ID NO: 1105178 - RNA, 17 nt, Homo sapiens
aaguaaguuugauuuca

SEQ ID NO: 1105179 - RNA, 15 nt, Homo sapiens
aaguaccacucaggc

SEQ ID NO: 1105180 - RNA, 16 nt, Homo sapiens
aaguacccugugcuca

SEQ ID NO: 1105181 - RNA, 12 nt, Homo sapiens
aaguagcaauuu

SEQ ID NO: 1105182 - RNA, 16 nt, Homo sapiens
aaguaguagugucuuc

SEQ ID NO: 1105183 - RNA, 17 nt, Homo sapiens
acuccacagucaauauu

SEQ ID NO: 1105184 - RNA, 13 nt, Homo sapiens
acuccagugguga

SEQ ID NO: 1105185 - RNA, 12 nt, Homo sapiens
acuccaucucaa

SEQ ID NO: 1105186 - RNA, 22 nt, Homo sapiens
acuccucaaaagcaaaugagau

SEQ ID NO: 1105187 - RNA, 13 nt, Homo sapiens
acuccugcaaaau

SEQ ID NO: 1105188 - RNA, 17 nt, Homo sapiens
acuccuuagagacauca

SEQ ID NO: 1105189 - RNA, 17 nt, Homo sapiens
acuccuuugcauuccau

SEQ ID NO: 1105190 - RNA, 16 nt, Homo sapiens
acucuacugcaagacu

SEQ ID NO: 1105191 - RNA, 14 nt, Homo sapiens
acucuaguauucca

SEQ ID NO: 1105192 - RNA, 11 nt, Homo sapiens
acucucuaggg

SEQ ID NO: 1105193 - RNA, 13 nt, Homo sapiens
acucucugagaug

SEQ ID NO: 1105194 - RNA, 23 nt, Homo sapiens
acucugaggcucuuucugggcca

SEQ ID NO: 1105195 - RNA, 19 nt, Homo sapiens
acucugcacaugucuugua

SEQ ID NO: 1105196 - RNA, 13 nt, Homo sapiens
acucugcucugau

SEQ ID NO: 1105197 - RNA, 17 nt, Homo sapiens
acucuuauuugguauaa

SEQ ID NO: 1105198 - RNA, 22 nt, Homo sapiens
acucuucugagcaccuacuuac

SEQ ID NO: 1105199 - RNA, 19 nt, Homo sapiens
acucuuguuuucaguuuca

SEQ ID NO: 1105200 - RNA, 15 nt, Homo sapiens
acugaaaacuguaaa

SEQ ID NO: 1105201 - RNA, 15 nt, Homo sapiens
acugaccagccucca

SEQ ID NO: 1105202 - RNA, 22 nt, Homo sapiens
acugaccccaucaccuacucac

SEQ ID NO: 1105203 - RNA, 13 nt, Homo sapiens
acugacccuggag

SEQ ID NO: 1105204 - RNA, 13 nt, Homo sapiens
acugagcggacag

SEQ ID NO: 1105205 - RNA, 22 nt, Homo sapiens
acugaggccuucucaaacuuua

SEQ ID NO: 1105206 - RNA, 23 nt, Homo sapiens
acugaguccucguagccaucucu

SEQ ID NO: 1105207 - RNA, 20 nt, Homo sapiens
acugauuuuuagcuuuacaa

SEQ ID NO: 1105208 - RNA, 14 nt, Homo sapiens
acugcaaaucugcc

SEQ ID NO: 1105209 - RNA, 19 nt, Homo sapiens
acugcaaaucugccugaua

SEQ ID NO: 1105210 - RNA, 14 nt, Homo sapiens
acugcacucuagcc

SEQ ID NO: 1105211 - RNA, 16 nt, Homo sapiens
acugcaguauggccau

SEQ ID NO: 1105212 - RNA, 17 nt, Homo sapiens
acugcaugcacuucuua

SEQ ID NO: 1105213 - RNA, 19 nt, Homo sapiens
acugccaggagggacaaag

SEQ ID NO: 1105214 - RNA, 18 nt, Homo sapiens
acugcuuggaacuggaau

SEQ ID NO: 1105215 - RNA, 21 nt, Homo sapiens
acuggaauaagaagcaaauaa

SEQ ID NO: 1105216 - RNA, 14 nt, Homo sapiens
acuggauauguugu

SEQ ID NO: 1105217 - RNA, 16 nt, Homo sapiens
acuggauauguuguua

SEQ ID NO: 1105218 - RNA, 19 nt, Homo sapiens
acuggauauguuguuaaac

SEQ ID NO: 1105219 - RNA, 15 nt, Homo sapiens
acuggaugaggucau

SEQ ID NO: 1105220 - RNA, 14 nt, Homo sapiens
acuggcugcaaagg

SEQ ID NO: 1105221 - RNA, 19 nt, Homo sapiens
acugggccuccaaccaugu

SEQ ID NO: 1105222 - RNA, 15 nt, Homo sapiens
acugguuucaguuga

SEQ ID NO: 1105223 - RNA, 14 nt, Homo sapiens
acugguuucucaga

SEQ ID NO: 1105224 - RNA, 12 nt, Homo sapiens
acugucacuguu

SEQ ID NO: 1105225 - RNA, 14 nt, Homo sapiens
acugucucucauga

SEQ ID NO: 1105226 - RNA, 20 nt, Homo sapiens
acugugcguuuuagaguaug

SEQ ID NO: 1105227 - RNA, 23 nt, Homo sapiens
acuguggagaaauaaaaauaccu

SEQ ID NO: 1105228 - RNA, 19 nt, Homo sapiens
acuguguucagugccuugg

SEQ ID NO: 1105229 - RNA, 13 nt, Homo sapiens
acuguugcccagg

SEQ ID NO: 1105230 - RNA, 13 nt, Homo sapiens
acuguugcucaaa

SEQ ID NO: 1105231 - RNA, 15 nt, Homo sapiens
acuguuucuuaccuu

SEQ ID NO: 1105232 - RNA, 17 nt, Homo sapiens
acuuaaaaaaaugacag

SEQ ID NO: 1105233 - RNA, 17 nt, Homo sapiens
acuuaacauugauuuau

SEQ ID NO: 1105234 - RNA, 19 nt, Homo sapiens
acuuaaccagcacauuucu

SEQ ID NO: 1105235 - RNA, 17 nt, Homo sapiens
acuuaacugugugaaga

SEQ ID NO: 1105236 - RNA, 14 nt, Homo sapiens
acuuacaugauuca

SEQ ID NO: 1105237 - RNA, 20 nt, Homo sapiens
acuuacccuaaaacaugugu

SEQ ID NO: 1105238 - RNA, 17 nt, Homo sapiens
acuuaccuagauucuac

SEQ ID NO: 1105239 - RNA, 22 nt, Homo sapiens
acuuauauggaaauucugcuca

SEQ ID NO: 1105240 - RNA, 18 nt, Homo sapiens
acuucacuuuaauucuca

SEQ ID NO: 1105241 - RNA, 18 nt, Homo sapiens
acuucagagcacacuuau

SEQ ID NO: 1105242 - RNA, 13 nt, Homo sapiens
acuuccacuccaa

SEQ ID NO: 1105243 - RNA, 16 nt, Homo sapiens
acuuccauuaacuuag

SEQ ID NO: 1105244 - RNA, 23 nt, Homo sapiens
acuucuaacuagaaaucugccaa

SEQ ID NO: 1105245 - RNA, 19 nt, Homo sapiens
agaaagccuucauaagccu

SEQ ID NO: 1105246 - RNA, 20 nt, Homo sapiens
agaaagggagggcucugagg

SEQ ID NO: 1105247 - RNA, 14 nt, Homo sapiens
agaaaguacuucuc

SEQ ID NO: 1105248 - RNA, 19 nt, Homo sapiens
agaaauaaaaauaccucuu

SEQ ID NO: 1105249 - RNA, 15 nt, Homo sapiens
agaaauaaacuuugg

SEQ ID NO: 1105250 - RNA, 17 nt, Homo sapiens
agaaauagacaguauau

SEQ ID NO: 1105251 - RNA, 14 nt, Homo sapiens
agaaauaggacaau

SEQ ID NO: 1105252 - RNA, 12 nt, Homo sapiens
agaaaucugcca

SEQ ID NO: 1105253 - RNA, 22 nt, Homo sapiens
agaaauuccaggaaaaucugca

SEQ ID NO: 1105254 - RNA, 23 nt, Homo sapiens
agaaauuccaggaaaaucugcac

SEQ ID NO: 1105255 - RNA, 16 nt, Homo sapiens
agaacaacuacuguga

SEQ ID NO: 1105256 - RNA, 15 nt, Homo sapiens
agaacaggcaaguga

SEQ ID NO: 1105257 - RNA, 17 nt, Homo sapiens
agaacaguaacugccau

SEQ ID NO: 1105258 - RNA, 21 nt, Homo sapiens
agaaccugcuaaggcugccuc

SEQ ID NO: 1105259 - RNA, 12 nt, Homo sapiens
agaacucuccau

SEQ ID NO: 1105260 - RNA, 22 nt, Homo sapiens
agaacucuccaucuuauuuuca

SEQ ID NO: 1105261 - RNA, 15 nt, Homo sapiens
agaagaaagggcaag

SEQ ID NO: 1105262 - RNA, 17 nt, Homo sapiens
agaagaacauccaagga

SEQ ID NO: 1105263 - RNA, 13 nt, Homo sapiens
agaagacuggaag

SEQ ID NO: 1105264 - RNA, 19 nt, Homo sapiens
agaagauuuuaugcugcug

SEQ ID NO: 1105265 - RNA, 13 nt, Homo sapiens
agaagauuuugcc

SEQ ID NO: 1105266 - RNA, 16 nt, Homo sapiens
agaagcacauaugaac

SEQ ID NO: 1105267 - RNA, 15 nt, Homo sapiens
agaagcuguccuuga

SEQ ID NO: 1105268 - RNA, 16 nt, Homo sapiens
agaaggacaccuccuu

SEQ ID NO: 1105269 - RNA, 22 nt, Homo sapiens
agaaggcaugaaauugucuagc

SEQ ID NO: 1105270 - RNA, 10 nt, Homo sapiens
agaagggaug

SEQ ID NO: 1105271 - RNA, 22 nt, Homo sapiens
agaaggggacagcgccaccucu

SEQ ID NO: 1105272 - RNA, 14 nt, Homo sapiens
agaagguugcucua

SEQ ID NO: 1105273 - RNA, 16 nt, Homo sapiens
agaaguauaaagugau

SEQ ID NO: 1105274 - RNA, 22 nt, Homo sapiens
agaagucaugaagcccaaguga

SEQ ID NO: 1105275 - RNA, 21 nt, Homo sapiens
agaagucauggcccaaaucca

SEQ ID NO: 1105276 - RNA, 13 nt, Homo sapiens
agaagucuugucu

SEQ ID NO: 1105277 - RNA, 14 nt, Homo sapiens
agaaguggagacuu

SEQ ID NO: 1105278 - RNA, 14 nt, Homo sapiens
agaauaaaugaauc

SEQ ID NO: 1105279 - RNA, 14 nt, Homo sapiens
agaauagcuuugaa

SEQ ID NO: 1105280 - RNA, 14 nt, Homo sapiens
agaauauuguuaaa

SEQ ID NO: 1105281 - RNA, 18 nt, Homo sapiens
agaaucacuugaacccgg

SEQ ID NO: 1105282 - RNA, 17 nt, Homo sapiens
agaaucacuugcacucc

SEQ ID NO: 1105283 - RNA, 16 nt, Homo sapiens
agaauccaaagaucac

SEQ ID NO: 1105284 - RNA, 18 nt, Homo sapiens
agaaucgaccucacuguc

SEQ ID NO: 1105285 - RNA, 19 nt, Homo sapiens
agaauucacuuuaccuuca

SEQ ID NO: 1105286 - RNA, 13 nt, Homo sapiens
agaauuguaucau

SEQ ID NO: 1105287 - RNA, 21 nt, Homo sapiens
agaauuuauucaauuccucug

SEQ ID NO: 1105288 - RNA, 18 nt, Homo sapiens
agacaacagcauaacuaa

SEQ ID NO: 1105289 - RNA, 13 nt, Homo sapiens
agacaacauuucu

SEQ ID NO: 1105290 - RNA, 21 nt, Homo sapiens
agacaagcuuguccauguaau

SEQ ID NO: 1105291 - RNA, 20 nt, Homo sapiens
agacagcaggcauaaggcac

SEQ ID NO: 1105292 - RNA, 15 nt, Homo sapiens
agacaggcucagguu

SEQ ID NO: 1105293 - RNA, 18 nt, Homo sapiens
agacaggguuuugccaug

SEQ ID NO: 1105294 - RNA, 13 nt, Homo sapiens
agacagucucaag

SEQ ID NO: 1105295 - RNA, 18 nt, Homo sapiens
agacaguggaucaugaaa

SEQ ID NO: 1105296 - RNA, 21 nt, Homo sapiens
agacauauucuuggagaacuu

SEQ ID NO: 1105297 - RNA, 13 nt, Homo sapiens
agaccacauccac

SEQ ID NO: 1105298 - RNA, 15 nt, Homo sapiens
agaccacuguuauca

SEQ ID NO: 1105299 - RNA, 23 nt, Homo sapiens
agaccagacuguggagaaauaaa

SEQ ID NO: 1105300 - RNA, 21 nt, Homo sapiens
agacccaguguaaagaauaaa

SEQ ID NO: 1105301 - RNA, 12 nt, Homo sapiens
agacccggcugc

SEQ ID NO: 1105302 - RNA, 12 nt, Homo sapiens
agacccuaugaa

SEQ ID NO: 1105303 - RNA, 14 nt, Homo sapiens
agaccgaaucucac

SEQ ID NO: 1105304 - RNA, 15 nt, Homo sapiens
agaccugacaagcac

SEQ ID NO: 1105305 - RNA, 19 nt, Homo sapiens
agaccugacaagcacugcu

SEQ ID NO: 1105306 - RNA, 19 nt, Homo sapiens
agaccuguaaucauauaau

SEQ ID NO: 1105307 - RNA, 15 nt, Homo sapiens
agacggccaagugaa

SEQ ID NO: 1105308 - RNA, 19 nt, Homo sapiens
agacuaguugaacaucuca

SEQ ID NO: 1105309 - RNA, 22 nt, Homo sapiens
agacuauaagcagaagcacaua

SEQ ID NO: 1105310 - RNA, 22 nt, Homo sapiens
agacuaugaggaauauuugcaa

SEQ ID NO: 1105311 - RNA, 17 nt, Homo sapiens
agacuauugugccuuag

SEQ ID NO: 1105312 - RNA, 13 nt, Homo sapiens
agacucacugugg

SEQ ID NO: 1105313 - RNA, 15 nt, Homo sapiens
agacucacuguggga

SEQ ID NO: 1105314 - RNA, 17 nt, Homo sapiens
agacucacugugggaag

SEQ ID NO: 1105315 - RNA, 15 nt, Homo sapiens
agacuccugugcaac

SEQ ID NO: 1105316 - RNA, 20 nt, Homo sapiens
agacucuacagaggccaugg

SEQ ID NO: 1105317 - RNA, 13 nt, Homo sapiens
agacugcaucuca

SEQ ID NO: 1105318 - RNA, 14 nt, Homo sapiens
agacugcaucucaa

SEQ ID NO: 1105319 - RNA, 18 nt, Homo sapiens
agacuggaacuugaacug

SEQ ID NO: 1105320 - RNA, 15 nt, Homo sapiens
agacuguugcucaaa

SEQ ID NO: 1105321 - RNA, 17 nt, Homo sapiens
agacuuaaaucacagau

SEQ ID NO: 1105322 - RNA, 17 nt, Homo sapiens
agacuuacuuacuccca

SEQ ID NO: 1105323 - RNA, 19 nt, Homo sapiens
agacuucucuuugccucaa

SEQ ID NO: 1105324 - RNA, 15 nt, Homo sapiens
agacuugacagugga

SEQ ID NO: 1105325 - RNA, 20 nt, Homo sapiens
agacuuuaccacuaugcaau

SEQ ID NO: 1105326 - RNA, 15 nt, Homo sapiens
agagaaaaaccaaug

SEQ ID NO: 1105327 - RNA, 21 nt, Homo sapiens
agagaaaaacuuucauuuuug

SEQ ID NO: 1105328 - RNA, 15 nt, Homo sapiens
agagaaaagaaacca

SEQ ID NO: 1105329 - RNA, 15 nt, Homo sapiens
agagaaaagacauaa

SEQ ID NO: 1105330 - RNA, 16 nt, Homo sapiens
agagaaaguacuucuc

SEQ ID NO: 1105331 - RNA, 14 nt, Homo sapiens
agagaacaacuacu

SEQ ID NO: 1105332 - RNA, 19 nt, Homo sapiens
agagaaggcuuccuccagc

SEQ ID NO: 1105333 - RNA, 22 nt, Homo sapiens
agagaauuguaucauuugaaca

SEQ ID NO: 1105334 - RNA, 18 nt, Homo sapiens
agagacaauaaaacauuc

SEQ ID NO: 1105335 - RNA, 21 nt, Homo sapiens
agagacaauaaaacauuccug

SEQ ID NO: 1105336 - RNA, 13 nt, Homo sapiens
agagacaccugca

SEQ ID NO: 1105337 - RNA, 21 nt, Homo sapiens
agagacaggguuuugccaugu

SEQ ID NO: 1105338 - RNA, 12 nt, Homo sapiens
agagacccaagg

SEQ ID NO: 1105339 - RNA, 16 nt, Homo sapiens
agagaccccuuccuuu

SEQ ID NO: 1105340 - RNA, 21 nt, Homo sapiens
agagacuuggggaaauugcuu

SEQ ID NO: 1105341 - RNA, 16 nt, Homo sapiens
agagagauauaucuga

SEQ ID NO: 1105342 - RNA, 15 nt, Homo sapiens
agagaucuauguacu

SEQ ID NO: 1105343 - RNA, 19 nt, Homo sapiens
agagauggaauaaagcccu

SEQ ID NO: 1105344 - RNA, 20 nt, Homo sapiens
agagcaagacucugucucaa

SEQ ID NO: 1105345 - RNA, 15 nt, Homo sapiens
agagcagaaccaaag

SEQ ID NO: 1105346 - RNA, 14 nt, Homo sapiens
agagccagcucucu

SEQ ID NO: 1105347 - RNA, 18 nt, Homo sapiens
agagcccagggcauccca

SEQ ID NO: 1105348 - RNA, 14 nt, Homo sapiens
agagccuggagaag

SEQ ID NO: 1105349 - RNA, 16 nt, Homo sapiens
agaggaagaaaaccag

SEQ ID NO: 1105350 - RNA, 12 nt, Homo sapiens
agaggagcacua

SEQ ID NO: 1105351 - RNA, 16 nt, Homo sapiens
agaggauuuaacugug

SEQ ID NO: 1105352 - RNA, 13 nt, Homo sapiens
agaggcagagaaa

SEQ ID NO: 1105353 - RNA, 21 nt, Homo sapiens
agaggcgcccucccuuccuga

SEQ ID NO: 1105354 - RNA, 14 nt, Homo sapiens
agaggcuccugucc

SEQ ID NO: 1105355 - RNA, 15 nt, Homo sapiens
agaggcuuccuucau

SEQ ID NO: 1105356 - RNA, 13 nt, Homo sapiens
agagggagugcau

SEQ ID NO: 1105357 - RNA, 20 nt, Homo sapiens
agaggggaacagacuggaag

SEQ ID NO: 1105358 - RNA, 21 nt, Homo sapiens
agagguaaaagugugagcagu

SEQ ID NO: 1105359 - RNA, 19 nt, Homo sapiens
agaguagagggcacugggu

SEQ ID NO: 1105360 - RNA, 12 nt, Homo sapiens
agagucacugac

SEQ ID NO: 1105361 - RNA, 15 nt, Homo sapiens
agagucauuguuaca

SEQ ID NO: 1105362 - RNA, 21 nt, Homo sapiens
agaguccuauuugcacuguag

SEQ ID NO: 1105363 - RNA, 20 nt, Homo sapiens
agagugagacuccgucucaa

SEQ ID NO: 1105364 - RNA, 16 nt, Homo sapiens
agagugagagggcaug

SEQ ID NO: 1105365 - RNA, 21 nt, Homo sapiens
agagugccguaacaacugugg

SEQ ID NO: 1105366 - RNA, 21 nt, Homo sapiens
agauaaaaccagagcaggaaa

SEQ ID NO: 1105367 - RNA, 18 nt, Homo sapiens
agauaaccuguacuucaa

SEQ ID NO: 1105368 - RNA, 16 nt, Homo sapiens
agauaauaucugugag

SEQ ID NO: 1105369 - RNA, 14 nt, Homo sapiens
agauagaaccugga

SEQ ID NO: 1105370 - RNA, 20 nt, Homo sapiens
agauagaaccuggagccacu

SEQ ID NO: 1105371 - RNA, 21 nt, Homo sapiens
agauagcaucuuauacgagua

SEQ ID NO: 1105372 - RNA, 15 nt, Homo sapiens
agauaucucaucucu

SEQ ID NO: 1105373 - RNA, 15 nt, Homo sapiens
agaucacgccacugc

SEQ ID NO: 1105374 - RNA, 17 nt, Homo sapiens
agaucacgccacugcac

SEQ ID NO: 1105375 - RNA, 11 nt, Homo sapiens
agaucagggca

SEQ ID NO: 1105376 - RNA, 17 nt, Homo sapiens
agaucauuuucuuaucu

SEQ ID NO: 1105377 - RNA, 17 nt, Homo sapiens
agaucgcgccacugcac

SEQ ID NO: 1105378 - RNA, 18 nt, Homo sapiens
agaucuauguacuguaau

SEQ ID NO: 1105379 - RNA, 17 nt, Homo sapiens
agaucuuucaggaaaga

SEQ ID NO: 1105380 - RNA, 20 nt, Homo sapiens
agaucuuucaggaaagacgg

SEQ ID NO: 1105381 - RNA, 22 nt, Homo sapiens
agaugaacuauuagacaugaaa

SEQ ID NO: 1105382 - RNA, 19 nt, Homo sapiens
agaugaaucauugauugaa

SEQ ID NO: 1105383 - RNA, 12 nt, Homo sapiens
agaugaugcaag

SEQ ID NO: 1105384 - RNA, 20 nt, Homo sapiens
agaugcugcaaauaaauuca

SEQ ID NO: 1105385 - RNA, 14 nt, Homo sapiens
agauggaguucuug

SEQ ID NO: 1105386 - RNA, 18 nt, Homo sapiens
agauggauagucugucca

SEQ ID NO: 1105387 - RNA, 19 nt, Homo sapiens
agauggauagucuguccaa

SEQ ID NO: 1105388 - RNA, 19 nt, Homo sapiens
agauggauguuugucaaaa

SEQ ID NO: 1105389 - RNA, 21 nt, Homo sapiens
agauggauguuugucaaaaag

SEQ ID NO: 1105390 - RNA, 22 nt, Homo sapiens
agauggauguuugucaaaaagu

SEQ ID NO: 1105391 - RNA, 20 nt, Homo sapiens
agauggcgcuauugcacucc

SEQ ID NO: 1105392 - RNA, 16 nt, Homo sapiens
agauggcugugccucu

SEQ ID NO: 1105393 - RNA, 20 nt, Homo sapiens
agaugggcaaagcugugcac

SEQ ID NO: 1105394 - RNA, 22 nt, Homo sapiens
agauggguauuaaacuugucag

SEQ ID NO: 1105395 - RNA, 13 nt, Homo sapiens
auggguacauucc

SEQ ID NO: 1105396 - RNA, 17 nt, Homo sapiens
augggugugccaggcua

SEQ ID NO: 1105397 - RNA, 21 nt, Homo sapiens
augguacuaguguuuuuuaga

SEQ ID NO: 1105398 - RNA, 20 nt, Homo sapiens
augguccuggggcucugugc

SEQ ID NO: 1105399 - RNA, 17 nt, Homo sapiens
augguggugagcacauc

SEQ ID NO: 1105400 - RNA, 17 nt, Homo sapiens
augguguaaugcacaau

SEQ ID NO: 1105401 - RNA, 13 nt, Homo sapiens
augguuucuccag

SEQ ID NO: 1105402 - RNA, 15 nt, Homo sapiens
auguaaaccuaagca

SEQ ID NO: 1105403 - RNA, 14 nt, Homo sapiens
auguaacauuaauu

SEQ ID NO: 1105404 - RNA, 16 nt, Homo sapiens
auguaaugcauaggaa

SEQ ID NO: 1105405 - RNA, 18 nt, Homo sapiens
auguaggguaaggugccu

SEQ ID NO: 1105406 - RNA, 19 nt, Homo sapiens
auguauggaugaaagcaau

SEQ ID NO: 1105407 - RNA, 22 nt, Homo sapiens
auguaugucuuggacacuguac

SEQ ID NO: 1105408 - RNA, 17 nt, Homo sapiens
auguauuggaacauguc

SEQ ID NO: 1105409 - RNA, 21 nt, Homo sapiens
auguauuuauauuuugugcua

SEQ ID NO: 1105410 - RNA, 16 nt, Homo sapiens
augucaaauaucucag

SEQ ID NO: 1105411 - RNA, 17 nt, Homo sapiens
augucacaauccugucc

SEQ ID NO: 1105412 - RNA, 13 nt, Homo sapiens
augucaccaccuu

SEQ ID NO: 1105413 - RNA, 20 nt, Homo sapiens
augucaccguggaccuuccu

SEQ ID NO: 1105414 - RNA, 17 nt, Homo sapiens
augucagaaaccaguua

SEQ ID NO: 1105415 - RNA, 12 nt, Homo sapiens
augucauucauu

SEQ ID NO: 1105416 - RNA, 22 nt, Homo sapiens
augucuccaucucugucucaaa

SEQ ID NO: 1105417 - RNA, 17 nt, Homo sapiens
augucuuggacacugua

SEQ ID NO: 1105418 - RNA, 17 nt, Homo sapiens
augucuuguacaugugu

SEQ ID NO: 1105419 - RNA, 11 nt, Homo sapiens
augugcaauaa

SEQ ID NO: 1105420 - RNA, 19 nt, Homo sapiens
augugcagguuuugaaaau

SEQ ID NO: 1105421 - RNA, 13 nt, Homo sapiens
augugccuggaaa

SEQ ID NO: 1105422 - RNA, 13 nt, Homo sapiens
augugggacaccu

SEQ ID NO: 1105423 - RNA, 20 nt, Homo sapiens
auguguagggaaaguuaaaa

SEQ ID NO: 1105424 - RNA, 16 nt, Homo sapiens
auguguggauguguaa

SEQ ID NO: 1105425 - RNA, 20 nt, Homo sapiens
auguguugccuggaagcaca

SEQ ID NO: 1105426 - RNA, 22 nt, Homo sapiens
auguuaaaaaaauaagaagaau

SEQ ID NO: 1105427 - RNA, 22 nt, Homo sapiens
auguuaagacuugacaguggaa

SEQ ID NO: 1105428 - RNA, 18 nt, Homo sapiens
auguuaagcucuuuauga

SEQ ID NO: 1105429 - RNA, 12 nt, Homo sapiens
auguuacuuugg

SEQ ID NO: 1105430 - RNA, 12 nt, Homo sapiens
auguuagccuca

SEQ ID NO: 1105431 - RNA, 23 nt, Homo sapiens
auguuaggaaaauuucacauuaa

SEQ ID NO: 1105432 - RNA, 19 nt, Homo sapiens
auguuagggugcucuggaa

SEQ ID NO: 1105433 - RNA, 14 nt, Homo sapiens
auguucaacuggag

SEQ ID NO: 1105434 - RNA, 17 nt, Homo sapiens
auguucucugaggacac

SEQ ID NO: 1105435 - RNA, 20 nt, Homo sapiens
auguucugggacacaguuca

SEQ ID NO: 1105436 - RNA, 21 nt, Homo sapiens
auguuucaggagagaguugaa

SEQ ID NO: 1105437 - RNA, 15 nt, Homo sapiens
auguuucauuuucau

SEQ ID NO: 1105438 - RNA, 13 nt, Homo sapiens
auguuucuauucu

SEQ ID NO: 1105439 - RNA, 15 nt, Homo sapiens
auuaaaaaccacuga

SEQ ID NO: 1105440 - RNA, 17 nt, Homo sapiens
auuaaaacacagcuuua

SEQ ID NO: 1105441 - RNA, 19 nt, Homo sapiens
auuaaacaagugcacuuga

SEQ ID NO: 1105442 - RNA, 13 nt, Homo sapiens
auuaaacaccuga

SEQ ID NO: 1105443 - RNA, 12 nt, Homo sapiens
auuaaacacugu

SEQ ID NO: 1105444 - RNA, 13 nt, Homo sapiens
auuaaacacugua

SEQ ID NO: 1105445 - RNA, 17 nt, Homo sapiens
auuaaauacagacacua

SEQ ID NO: 1105446 - RNA, 13 nt, Homo sapiens
auuaaaugcaugu

SEQ ID NO: 1105447 - RNA, 20 nt, Homo sapiens
aucucuugucucacaugcua

SEQ ID NO: 1105448 - RNA, 16 nt, Homo sapiens
aucugaacacauacua

SEQ ID NO: 1105449 - RNA, 11 nt, Homo sapiens
aucugaauaua

SEQ ID NO: 1105450 - RNA, 16 nt, Homo sapiens
aucugacucacaagaa

SEQ ID NO: 1105451 - RNA, 18 nt, Homo sapiens
aucugagaaaagcuuuga

SEQ ID NO: 1105452 - RNA, 18 nt, Homo sapiens
aucugcuuguauuuucca

SEQ ID NO: 1105453 - RNA, 20 nt, Homo sapiens
aucuggaguugaacagcaaa

SEQ ID NO: 1105454 - RNA, 19 nt, Homo sapiens
aucuguaaggaacuggaac

SEQ ID NO: 1105455 - RNA, 16 nt, Homo sapiens
aucuguauauacaaua

SEQ ID NO: 1105456 - RNA, 17 nt, Homo sapiens
aucugugcaaauccuug

SEQ ID NO: 1105457 - RNA, 18 nt, Homo sapiens
aucuuccugccucaggcu

SEQ ID NO: 1105458 - RNA, 19 nt, Homo sapiens
aucuuggacugacauuuag

SEQ ID NO: 1105459 - RNA, 17 nt, Homo sapiens
augaaaaccauuaccug

SEQ ID NO: 1105460 - RNA, 16 nt, Homo sapiens
augaaaauuaggauuu

SEQ ID NO: 1105461 - RNA, 17 nt, Homo sapiens
augaaacaaauaaucac

SEQ ID NO: 1105462 - RNA, 18 nt, Homo sapiens
augaaagacuuacaggcc

SEQ ID NO: 1105463 - RNA, 19 nt, Homo sapiens
augaaaugauaaagauguc

SEQ ID NO: 1105464 - RNA, 18 nt, Homo sapiens
augaacaugugaaguuau

SEQ ID NO: 1105465 - RNA, 21 nt, Homo sapiens
augaacuauuuacauuuucca

SEQ ID NO: 1105466 - RNA, 16 nt, Homo sapiens
augaacucuuaaucaa

SEQ ID NO: 1105467 - RNA, 23 nt, Homo sapiens
augaaggugucauacagauuugc

SEQ ID NO: 1105468 - RNA, 21 nt, Homo sapiens
augaagguuucugaaaauuaa

SEQ ID NO: 1105469 - RNA, 14 nt, Homo sapiens
augaaucaaagaca

SEQ ID NO: 1105470 - RNA, 18 nt, Homo sapiens
augaaucauugauugaau

SEQ ID NO: 1105471 - RNA, 19 nt, Homo sapiens
augaaugaggucccaggca

SEQ ID NO: 1105472 - RNA, 16 nt, Homo sapiens
augacaaaggcacuga

SEQ ID NO: 1105473 - RNA, 16 nt, Homo sapiens
augacacucuucugaa

SEQ ID NO: 1105474 - RNA, 19 nt, Homo sapiens
augacagcucuucuaagga

SEQ ID NO: 1105475 - RNA, 13 nt, Homo sapiens
augacaucacuug

SEQ ID NO: 1105476 - RNA, 14 nt, Homo sapiens
augacaucuucaaa

SEQ ID NO: 1105477 - RNA, 23 nt, Homo sapiens
augacccccaaccaaguggcucc

SEQ ID NO: 1105478 - RNA, 13 nt, Homo sapiens
augaccuggaaau

SEQ ID NO: 1105479 - RNA, 10 nt, Homo sapiens
augacuaugc

SEQ ID NO: 1105480 - RNA, 20 nt, Homo sapiens
augacuauguuucuauucua

SEQ ID NO: 1105481 - RNA, 17 nt, Homo sapiens
augacucagcauaccug

SEQ ID NO: 1105482 - RNA, 15 nt, Homo sapiens
augacuccuuucucu

SEQ ID NO: 1105483 - RNA, 20 nt, Homo sapiens
augagaguagagggcacugg

SEQ ID NO: 1105484 - RNA, 17 nt, Homo sapiens
augaggaauauuugcaa

SEQ ID NO: 1105485 - RNA, 22 nt, Homo sapiens
augaggacuugugucucugugc

SEQ ID NO: 1105486 - RNA, 18 nt, Homo sapiens
augagugauucuugacau

SEQ ID NO: 1105487 - RNA, 14 nt, Homo sapiens
augaguuacuugaa

SEQ ID NO: 1105488 - RNA, 22 nt, Homo sapiens
augaguuacuugaaauuugccu

SEQ ID NO: 1105489 - RNA, 18 nt, Homo sapiens
augaguuuauauggaaaa

SEQ ID NO: 1105490 - RNA, 21 nt, Homo sapiens
augaguuuuugauagcuuuau

SEQ ID NO: 1105491 - RNA, 13 nt, Homo sapiens
augauaaaagcac

SEQ ID NO: 1105492 - RNA, 17 nt, Homo sapiens
augauaaaagcacuuac

SEQ ID NO: 1105493 - RNA, 20 nt, Homo sapiens
augaucacggcucacugcag

SEQ ID NO: 1105494 - RNA, 13 nt, Homo sapiens
augaucucccugc

SEQ ID NO: 1105495 - RNA, 18 nt, Homo sapiens
augaucuuguuaaugcau

SEQ ID NO: 1105496 - RNA, 13 nt, Homo sapiens
augaucuuuucaa

SEQ ID NO: 1105497 - RNA, 19 nt, Homo sapiens
augaugagaguuucuguua

SEQ ID NO: 1105498 - RNA, 17 nt, Homo sapiens
augaugcuaccaugccu

SEQ ID NO: 1105499 - RNA, 18 nt, Homo sapiens
augaugcuaccaugccuc

SEQ ID NO: 1105500 - RNA, 15 nt, Homo sapiens
augauguguagggcu

SEQ ID NO: 1105501 - RNA, 19 nt, Homo sapiens
caauucuccuguugcaaug

SEQ ID NO: 1105502 - RNA, 18 nt, Homo sapiens
caauucuuugaauuuccc

SEQ ID NO: 1105503 - RNA, 19 nt, Homo sapiens
caauuuaauuccauaauca

SEQ ID NO: 1105504 - RNA, 13 nt, Homo sapiens
caauuugccuuuu

SEQ ID NO: 1105505 - RNA, 14 nt, Homo sapiens
caauuuuugaacaa

SEQ ID NO: 1105506 - RNA, 21 nt, Homo sapiens
cacaaaaguccacugaugcaa

SEQ ID NO: 1105507 - RNA, 17 nt, Homo sapiens
cacaacauuuacuuaac

SEQ ID NO: 1105508 - RNA, 14 nt, Homo sapiens
cacaacccaagaau

SEQ ID NO: 1105509 - RNA, 20 nt, Homo sapiens
cacaagaagaccagacugug

SEQ ID NO: 1105510 - RNA, 13 nt, Homo sapiens
cacaagcacaaag

SEQ ID NO: 1105511 - RNA, 18 nt, Homo sapiens
cacaagccacagaagcca

SEQ ID NO: 1105512 - RNA, 20 nt, Homo sapiens
cacaagcuuguauauacaua

SEQ ID NO: 1105513 - RNA, 16 nt, Homo sapiens
cacaaggucacuagau

SEQ ID NO: 1105514 - RNA, 16 nt, Homo sapiens
cacaauuccauuucca

SEQ ID NO: 1105515 - RNA, 15 nt, Homo sapiens
cacacaaggugcaaa

SEQ ID NO: 1105516 - RNA, 16 nt, Homo sapiens
cacacaaggugcaaau

SEQ ID NO: 1105517 - RNA, 12 nt, Homo sapiens
cacacagcacuc

SEQ ID NO: 1105518 - RNA, 14 nt, Homo sapiens
cacacgcgugcaca

SEQ ID NO: 1105519 - RNA, 14 nt, Homo sapiens
cacacguacuuaaa

SEQ ID NO: 1105520 - RNA, 18 nt, Homo sapiens
cacacugugcguuuuaga

SEQ ID NO: 1105521 - RNA, 18 nt, Homo sapiens
cacacuuguauauugaaa

SEQ ID NO: 1105522 - RNA, 12 nt, Homo sapiens
cacagaacugcu

SEQ ID NO: 1105523 - RNA, 16 nt, Homo sapiens
cacagaccaccugcuu

SEQ ID NO: 1105524 - RNA, 17 nt, Homo sapiens
cacagagccugccucag

SEQ ID NO: 1105525 - RNA, 14 nt, Homo sapiens
cacagagguuuuaa

SEQ ID NO: 1105526 - RNA, 14 nt, Homo sapiens
cacagauauuucca

SEQ ID NO: 1105527 - RNA, 22 nt, Homo sapiens
cacagaugauuaaacagacuuu

SEQ ID NO: 1105528 - RNA, 16 nt, Homo sapiens
cacagcacuaauucaa

SEQ ID NO: 1105529 - RNA, 20 nt, Homo sapiens
cacagcagcugaacagccaa

SEQ ID NO: 1105530 - RNA, 15 nt, Homo sapiens
cacagccaucaaggg

SEQ ID NO: 1105531 - RNA, 21 nt, Homo sapiens
cacagcggaggagaccagcuc

SEQ ID NO: 1105532 - RNA, 13 nt, Homo sapiens
cacagcuaugaag

SEQ ID NO: 1105533 - RNA, 14 nt, Homo sapiens
cacagcuaugaagg

SEQ ID NO: 1105534 - RNA, 15 nt, Homo sapiens
cacagcuaugaaggc

SEQ ID NO: 1105535 - RNA, 18 nt, Homo sapiens
cacaggauccuauucuca

SEQ ID NO: 1105536 - RNA, 22 nt, Homo sapiens
cacaggcagcuggaugagacuu

SEQ ID NO: 1105537 - RNA, 23 nt, Homo sapiens
cacaggccuguguagcugugacc

SEQ ID NO: 1105538 - RNA, 20 nt, Homo sapiens
cacagggaugaccuggaguc

SEQ ID NO: 1105539 - RNA, 14 nt, Homo sapiens
cacaguagcauuuc

SEQ ID NO: 1105540 - RNA, 15 nt, Homo sapiens
cacaguugccaugua

SEQ ID NO: 1105541 - RNA, 20 nt, Homo sapiens
cacauaauuugaauggugca

SEQ ID NO: 1105542 - RNA, 16 nt, Homo sapiens
cacauacugcaugcuc

SEQ ID NO: 1105543 - RNA, 13 nt, Homo sapiens
cacauaugcaccu

SEQ ID NO: 1105544 - RNA, 17 nt, Homo sapiens
cacauauggacucugca

SEQ ID NO: 1105545 - RNA, 18 nt, Homo sapiens
cacauauggacucugcac

SEQ ID NO: 1105546 - RNA, 12 nt, Homo sapiens
cacaucugggag

SEQ ID NO: 1105547 - RNA, 14 nt, Homo sapiens
cacaugcacgugug

SEQ ID NO: 1105548 - RNA, 21 nt, Homo sapiens
cacauggccuaugcacauaug

SEQ ID NO: 1105549 - RNA, 14 nt, Homo sapiens
cacauggcugggau

SEQ ID NO: 1105550 - RNA, 19 nt, Homo sapiens
cacauguaucuaugcauuu

SEQ ID NO: 1105551 - RNA, 19 nt, Homo sapiens
cacaugugacacauaugca

SEQ ID NO: 1105552 - RNA, 16 nt, Homo sapiens
cacaugugcacaugca

SEQ ID NO: 1105553 - RNA, 16 nt, Homo sapiens
cacauuacuugcacaa

SEQ ID NO: 1105554 - RNA, 20 nt, Homo sapiens
cacauuaucgggagcagugu

SEQ ID NO: 1105555 - RNA, 15 nt, Homo sapiens
cacauugugccuuuu

SEQ ID NO: 1105556 - RNA, 18 nt, Homo sapiens
cacauuuauauauauaug

SEQ ID NO: 1105557 - RNA, 13 nt, Homo sapiens
caccaaagcuggc

SEQ ID NO: 1105558 - RNA, 18 nt, Homo sapiens
caccaacuggagcacuga

SEQ ID NO: 1105559 - RNA, 14 nt, Homo sapiens
caccaagcccaguu

SEQ ID NO: 1105560 - RNA, 14 nt, Homo sapiens
caccacaugugcac

SEQ ID NO: 1105561 - RNA, 23 nt, Homo sapiens
caccagaggcugcagaaggccaa

SEQ ID NO: 1105562 - RNA, 21 nt, Homo sapiens
caccagaggucagguguucaa

SEQ ID NO: 1105563 - RNA, 14 nt, Homo sapiens
cacccaaaagucaa

SEQ ID NO: 1105564 - RNA, 13 nt, Homo sapiens
cacccacauguga

SEQ ID NO: 1105565 - RNA, 14 nt, Homo sapiens
cacccaugccauag

SEQ ID NO: 1105566 - RNA, 14 nt, Homo sapiens
cacccccgugucca

SEQ ID NO: 1105567 - RNA, 15 nt, Homo sapiens
caccgacaacaugcu

SEQ ID NO: 1105568 - RNA, 21 nt, Homo sapiens
caccgugaccccuguccccac

SEQ ID NO: 1105569 - RNA, 23 nt, Homo sapiens
caccuagcaucucaugagugcca

SEQ ID NO: 1105570 - RNA, 17 nt, Homo sapiens
caccuaugucauuucau

SEQ ID NO: 1105571 - RNA, 17 nt, Homo sapiens
caccucaaauacauacc

SEQ ID NO: 1105572 - RNA, 13 nt, Homo sapiens
caccuccauuugc

SEQ ID NO: 1105573 - RNA, 22 nt, Homo sapiens
caccuccuuccucaguccugga

SEQ ID NO: 1105574 - RNA, 16 nt, Homo sapiens
caccuggcucaccuug

SEQ ID NO: 1105575 - RNA, 18 nt, Homo sapiens
caccuguuaaaauguaca

SEQ ID NO: 1105576 - RNA, 16 nt, Homo sapiens
cacgccuguaauccca

SEQ ID NO: 1105577 - RNA, 16 nt, Homo sapiens
cacgguggcucaggcc

SEQ ID NO: 1105578 - RNA, 15 nt, Homo sapiens
cacgugucuauaaug

SEQ ID NO: 1105579 - RNA, 21 nt, Homo sapiens
cacucacauuuauucugcuca

SEQ ID NO: 1105580 - RNA, 22 nt, Homo sapiens
cacuccaccacccaaaagucaa

SEQ ID NO: 1105581 - RNA, 16 nt, Homo sapiens
cacucccuggcucuca

SEQ ID NO: 1105582 - RNA, 14 nt, Homo sapiens
cacucugaaacuga

SEQ ID NO: 1105583 - RNA, 20 nt, Homo sapiens
cacucuuauagaaaguucaa

SEQ ID NO: 1105584 - RNA, 22 nt, Homo sapiens
cacucuuaugaaaugggcuuua

SEQ ID NO: 1105585 - RNA, 21 nt, Homo sapiens
cacucuucugaauugacugua

SEQ ID NO: 1105586 - RNA, 10 nt, Homo sapiens
cacugagaua

SEQ ID NO: 1105587 - RNA, 13 nt, Homo sapiens
cacugcaagaagu

SEQ ID NO: 1105588 - RNA, 17 nt, Homo sapiens
cacugccagucacgagc

SEQ ID NO: 1105589 - RNA, 13 nt, Homo sapiens
cacuggguugacu

SEQ ID NO: 1105590 - RNA, 11 nt, Homo sapiens
cacuguacaag

SEQ ID NO: 1105591 - RNA, 19 nt, Homo sapiens
cacugugccaugugccagg

SEQ ID NO: 1105592 - RNA, 14 nt, Homo sapiens
cacugugggaccaa

SEQ ID NO: 1105593 - RNA, 16 nt, Homo sapiens
cacugugggcuuuuau

SEQ ID NO: 1105594 - RNA, 14 nt, Homo sapiens
cacuguuucucuca

SEQ ID NO: 1105595 - RNA, 16 nt, Homo sapiens
cacuucacuaccaaau

SEQ ID NO: 1105596 - RNA, 16 nt, Homo sapiens
cacuucauggaccaag

SEQ ID NO: 1105597 - RNA, 19 nt, Homo sapiens
cacuucuaaaugaagugca

SEQ ID NO: 1105598 - RNA, 19 nt, Homo sapiens
cacuucucaucauauugua

SEQ ID NO: 1105599 - RNA, 18 nt, Homo sapiens
cacuucucuacucuggaa

SEQ ID NO: 1105600 - RNA, 20 nt, Homo sapiens
cacuucuuacaauaauucua

SEQ ID NO: 1105601 - RNA, 20 nt, Homo sapiens
cacuugccuucuucacccag

SEQ ID NO: 1105602 - RNA, 22 nt, Homo sapiens
cacuuguauauugaaaagauag

SEQ ID NO: 1105603 - RNA, 19 nt, Homo sapiens
cacuuugggaggcugaggc

SEQ ID NO: 1105604 - RNA, 22 nt, Homo sapiens
cagaaaaaaauaaaaacauaaa

SEQ ID NO: 1105605 - RNA, 16 nt, Homo sapiens
cagaaaacauaugcau

SEQ ID NO: 1105606 - RNA, 16 nt, Homo sapiens
cagaaagcauccuaaa

SEQ ID NO: 1105607 - RNA, 11 nt, Homo sapiens
cagaaaugcaa

SEQ ID NO: 1105608 - RNA, 15 nt, Homo sapiens
cagaagcacauauga

SEQ ID NO: 1105609 - RNA, 19 nt, Homo sapiens
cagaaggcaaaaagacauu

SEQ ID NO: 1105610 - RNA, 14 nt, Homo sapiens
cagaagguauuccu

SEQ ID NO: 1105611 - RNA, 15 nt, Homo sapiens
cagaagguugcucua

SEQ ID NO: 1105612 - RNA, 17 nt, Homo sapiens
cagaauauggacaaaga

SEQ ID NO: 1105613 - RNA, 18 nt, Homo sapiens
cagaaucccggcugucaa

SEQ ID NO: 1105614 - RNA, 19 nt, Homo sapiens
cagaauccuacaacuucca

SEQ ID NO: 1105615 - RNA, 13 nt, Homo sapiens
cagaauucuucag

SEQ ID NO: 1105616 - RNA, 18 nt, Homo sapiens
cagaauuuuuugaguaau

SEQ ID NO: 1105617 - RNA, 16 nt, Homo sapiens
cagacaacagaaguca

SEQ ID NO: 1105618 - RNA, 16 nt, Homo sapiens
cagacaggcucagguu

SEQ ID NO: 1105619 - RNA, 22 nt, Homo sapiens
cagaccacuauucuuaacuauu

SEQ ID NO: 1105620 - RNA, 17 nt, Homo sapiens
cagaccucuacaagcaa

SEQ ID NO: 1105621 - RNA, 14 nt, Homo sapiens
cagacucacugugg

SEQ ID NO: 1105622 - RNA, 15 nt, Homo sapiens
cagacucacuguggg

SEQ ID NO: 1105623 - RNA, 16 nt, Homo sapiens
cagacucacuguggga

SEQ ID NO: 1105624 - RNA, 15 nt, Homo sapiens
cagacuccugugcaa

SEQ ID NO: 1105625 - RNA, 16 nt, Homo sapiens
cagacuccugugcaac

SEQ ID NO: 1105626 - RNA, 21 nt, Homo sapiens
cagacucuacagaggccaugg

SEQ ID NO: 1105627 - RNA, 14 nt, Homo sapiens
cagacuuuagcuua

SEQ ID NO: 1105628 - RNA, 16 nt, Homo sapiens
cagagaaaagacauaa

SEQ ID NO: 1105629 - RNA, 21 nt, Homo sapiens
cagagaaaauaaaagcacuua

SEQ ID NO: 1105630 - RNA, 18 nt, Homo sapiens
cagagaaggcuuccucca

SEQ ID NO: 1105631 - RNA, 20 nt, Homo sapiens
cagagaaucauacuuagcaa

SEQ ID NO: 1105632 - RNA, 18 nt, Homo sapiens
cagagacccagaucucau

SEQ ID NO: 1105633 - RNA, 16 nt, Homo sapiens
cagagacuaucugauu

SEQ ID NO: 1105634 - RNA, 20 nt, Homo sapiens
cagagacuaucugauuuccu

SEQ ID NO: 1105635 - RNA, 22 nt, Homo sapiens
cagagagaggggagaagccugg

SEQ ID NO: 1105636 - RNA, 17 nt, Homo sapiens
cccuuacuaugaucuca

SEQ ID NO: 1105637 - RNA, 16 nt, Homo sapiens
cccuuauuuucaagaa

SEQ ID NO: 1105638 - RNA, 17 nt, Homo sapiens
cccuucacauacccucc

SEQ ID NO: 1105639 - RNA, 21 nt, Homo sapiens
cccuucuuuaaaucaaaagcu

SEQ ID NO: 1105640 - RNA, 19 nt, Homo sapiens
cccuuuccuacucucagga

SEQ ID NO: 1105641 - RNA, 21 nt, Homo sapiens
cccuuuccugggggaugugca

SEQ ID NO: 1105642 - RNA, 19 nt, Homo sapiens
cccuuugaugauuaauuca

SEQ ID NO: 1105643 - RNA, 18 nt, Homo sapiens
ccgaacuuuaauuucagg

SEQ ID NO: 1105644 - RNA, 23 nt, Homo sapiens
ccgcaacaguuuuuuaugcuaau

SEQ ID NO: 1105645 - RNA, 16 nt, Homo sapiens
ccgcauggaacagugc

SEQ ID NO: 1105646 - RNA, 20 nt, Homo sapiens
ccgcauggaacagugcagga

SEQ ID NO: 1105647 - RNA, 18 nt, Homo sapiens
ccgccuccaaaugccaac

SEQ ID NO: 1105648 - RNA, 18 nt, Homo sapiens
ccggcaccuacaucccca

SEQ ID NO: 1105649 - RNA, 19 nt, Homo sapiens
ccgggagccucuccuugcc

SEQ ID NO: 1105650 - RNA, 17 nt, Homo sapiens
ccgggcaauccagacag

SEQ ID NO: 1105651 - RNA, 19 nt, Homo sapiens
ccgggcaauccagacagca

SEQ ID NO: 1105652 - RNA, 13 nt, Homo sapiens
ccggugaagugca

SEQ ID NO: 1105653 - RNA, 18 nt, Homo sapiens
ccguaacaacugugguca

SEQ ID NO: 1105654 - RNA, 22 nt, Homo sapiens
ccgucaccucagagacauacac

SEQ ID NO: 1105655 - RNA, 12 nt, Homo sapiens
ccgucucaaaaa

SEQ ID NO: 1105656 - RNA, 14 nt, Homo sapiens
ccgucuuuguauca

SEQ ID NO: 1105657 - RNA, 17 nt, Homo sapiens
ccuaagacuuauguauu

SEQ ID NO: 1105658 - RNA, 15 nt, Homo sapiens
ccuaaggaucucuca

SEQ ID NO: 1105659 - RNA, 18 nt, Homo sapiens
ccuaaggaucucucagga

SEQ ID NO: 1105660 - RNA, 19 nt, Homo sapiens
ccuaaugauuagcacuuaa

SEQ ID NO: 1105661 - RNA, 13 nt, Homo sapiens
ccuacccccugaa

SEQ ID NO: 1105662 - RNA, 14 nt, Homo sapiens
ccuacucuguguca

SEQ ID NO: 1105663 - RNA, 16 nt, Homo sapiens
ccuacuucuuuugcuc

SEQ ID NO: 1105664 - RNA, 13 nt, Homo sapiens
ccuacuuuagcca

SEQ ID NO: 1105665 - RNA, 16 nt, Homo sapiens
ccuagauucuacauau

SEQ ID NO: 1105666 - RNA, 21 nt, Homo sapiens
ccuagcuaccuucucuaccca

SEQ ID NO: 1105667 - RNA, 23 nt, Homo sapiens
ccuaucagaaguuucucagcucc

SEQ ID NO: 1105668 - RNA, 21 nt, Homo sapiens
ccuaugaaaaaauuaguugag

SEQ ID NO: 1105669 - RNA, 12 nt, Homo sapiens
ccuaugauccca

SEQ ID NO: 1105670 - RNA, 16 nt, Homo sapiens
ccuauucuauugcagu

SEQ ID NO: 1105671 - RNA, 22 nt, Homo sapiens
ccuauuuuaauuggaauucugg

SEQ ID NO: 1105672 - RNA, 15 nt, Homo sapiens
ccucaaaaagauuuc

SEQ ID NO: 1105673 - RNA, 22 nt, Homo sapiens
ccucaaaguuggggcaggcugg

SEQ ID NO: 1105674 - RNA, 17 nt, Homo sapiens
ccucaaaugacccaaag

SEQ ID NO: 1105675 - RNA, 18 nt, Homo sapiens
ccucaagggccaggacuu

SEQ ID NO: 1105676 - RNA, 14 nt, Homo sapiens
ccuuuacuaaucca

SEQ ID NO: 1105677 - RNA, 15 nt, Homo sapiens
ccuuuccccagugug

SEQ ID NO: 1105678 - RNA, 19 nt, Homo sapiens
ccuuuccuccccaccuucc

SEQ ID NO: 1105679 - RNA, 17 nt, Homo sapiens
ccuuucucuaaaacugc

SEQ ID NO: 1105680 - RNA, 21 nt, Homo sapiens
ccuuucucuccagccugacuu

SEQ ID NO: 1105681 - RNA, 16 nt, Homo sapiens
ccuuucuucaccaaau

SEQ ID NO: 1105682 - RNA, 23 nt, Homo sapiens
ccuuugccccaaggcugcucaga

SEQ ID NO: 1105683 - RNA, 19 nt, Homo sapiens
ccuuuggaugcacuuuaua

SEQ ID NO: 1105684 - RNA, 17 nt, Homo sapiens
ccuuuuccgucuuugua

SEQ ID NO: 1105685 - RNA, 17 nt, Homo sapiens
cgaagcccuuccagugg

SEQ ID NO: 1105686 - RNA, 13 nt, Homo sapiens
cgaaugacacugu

SEQ ID NO: 1105687 - RNA, 20 nt, Homo sapiens
cgacagaagucuugucucaa

SEQ ID NO: 1105688 - RNA, 15 nt, Homo sapiens
cgagagaggugggca

SEQ ID NO: 1105689 - RNA, 17 nt, Homo sapiens
cgagaucacgccacugc

SEQ ID NO: 1105690 - RNA, 21 nt, Homo sapiens
cgagaucacgccacugcacuc

SEQ ID NO: 1105691 - RNA, 21 nt, Homo sapiens
cgagauugcaccauugcgcuc

SEQ ID NO: 1105692 - RNA, 15 nt, Homo sapiens
cgagcagcugagcag

SEQ ID NO: 1105693 - RNA, 22 nt, Homo sapiens
cgagcuaugaucgcgccacuac

SEQ ID NO: 1105694 - RNA, 19 nt, Homo sapiens
cgaggacagggaggugacc

SEQ ID NO: 1105695 - RNA, 21 nt, Homo sapiens
cgaggagcuuccagugcaugu

SEQ ID NO: 1105696 - RNA, 22 nt, Homo sapiens
cgagggaugggauuucauguaa

SEQ ID NO: 1105697 - RNA, 13 nt, Homo sapiens
cgaguucagcaaa

SEQ ID NO: 1105698 - RNA, 16 nt, Homo sapiens
cgaguucagcaaagag

SEQ ID NO: 1105699 - RNA, 17 nt, Homo sapiens
cgaguuguuggcugcuc

SEQ ID NO: 1105700 - RNA, 20 nt, Homo sapiens
cgaugaauguguugauuuga

SEQ ID NO: 1105701 - RNA, 20 nt, Homo sapiens
cgcaugcccucaaucccagc

SEQ ID NO: 1105702 - RNA, 13 nt, Homo sapiens
cgcauucccugag

SEQ ID NO: 1105703 - RNA, 21 nt, Homo sapiens
cgccccucauuuaucccucaa

SEQ ID NO: 1105704 - RNA, 22 nt, Homo sapiens
cgccuguaaucccagcacuuug

SEQ ID NO: 1105705 - RNA, 20 nt, Homo sapiens
cgcgcaccuguaaucccagc

SEQ ID NO: 1105706 - RNA, 16 nt, Homo sapiens
cgcuacaccacucugg

SEQ ID NO: 1105707 - RNA, 22 nt, Homo sapiens
cggaaccugaaggugcugacaa

SEQ ID NO: 1105708 - RNA, 18 nt, Homo sapiens
cggaagcccuugccugaa

SEQ ID NO: 1105709 - RNA, 14 nt, Homo sapiens
cggacaaguuuuaa

SEQ ID NO: 1105710 - RNA, 17 nt, Homo sapiens
cggacaguuuauuuguu

SEQ ID NO: 1105711 - RNA, 22 nt, Homo sapiens
cggagccauuuuuagcucugau

SEQ ID NO: 1105712 - RNA, 21 nt, Homo sapiens
cggaucuggggcucugggaua

SEQ ID NO: 1105713 - RNA, 19 nt, Homo sapiens
cggcaucgggccaucucag

SEQ ID NO: 1105714 - RNA, 21 nt, Homo sapiens
cgggaagcgaugaauuuggag

SEQ ID NO: 1105715 - RNA, 15 nt, Homo sapiens
cggguggaucaccug

SEQ ID NO: 1105716 - RNA, 14 nt, Homo sapiens
cggucccacacugg

SEQ ID NO: 1105717 - RNA, 19 nt, Homo sapiens
cggugucuggaaaagcacu

SEQ ID NO: 1105718 - RNA, 20 nt, Homo sapiens
cgguuuguauuuagugucuu

SEQ ID NO: 1105719 - RNA, 14 nt, Homo sapiens
cguaguucccugaa

SEQ ID NO: 1105720 - RNA, 17 nt, Homo sapiens
cgucagccacaccuguc

SEQ ID NO: 1105721 - RNA, 22 nt, Homo sapiens
cgucaguaguuugagaccagcc

SEQ ID NO: 1105722 - RNA, 18 nt, Homo sapiens
cgucucaaaaacaaaaca

SEQ ID NO: 1105723 - RNA, 14 nt, Homo sapiens
cgucuucucuccau

SEQ ID NO: 1105724 - RNA, 14 nt, Homo sapiens
cgugacaacaugcg

SEQ ID NO: 1105725 - RNA, 9 nt, Homo sapiens
cgugcaaua

SEQ ID NO: 1105726 - RNA, 16 nt, Homo sapiens
cgugcacacaccagag

SEQ ID NO: 1105727 - RNA, 17 nt, Homo sapiens
cgugcacacaccagagc

SEQ ID NO: 1105728 - RNA, 18 nt, Homo sapiens
cuaugucauuucauuucc

SEQ ID NO: 1105729 - RNA, 13 nt, Homo sapiens
cuaugugggacac

SEQ ID NO: 1105730 - RNA, 20 nt, Homo sapiens
cuauuaaaacagccaaaacu

SEQ ID NO: 1105731 - RNA, 14 nt, Homo sapiens
cuauuaccaugaga

SEQ ID NO: 1105732 - RNA, 15 nt, Homo sapiens
cuauuagacaugaaa

SEQ ID NO: 1105733 - RNA, 21 nt, Homo sapiens
cuauuauaaaaccauguugau

SEQ ID NO: 1105734 - RNA, 16 nt, Homo sapiens
cuauucagacaagcaa

SEQ ID NO: 1105735 - RNA, 22 nt, Homo sapiens
cuauuccauggcuaacuggcga

SEQ ID NO: 1105736 - RNA, 13 nt, Homo sapiens
cuauucuauugca

SEQ ID NO: 1105737 - RNA, 13 nt, Homo sapiens
cuauucucaccag

SEQ ID NO: 1105738 - RNA, 22 nt, Homo sapiens
cuauucucuccucagacugcuc

SEQ ID NO: 1105739 - RNA, 19 nt, Homo sapiens
cuauugaaaaaucaccaca

SEQ ID NO: 1105740 - RNA, 19 nt, Homo sapiens
cuauugcauguaaaaugca

SEQ ID NO: 1105741 - RNA, 23 nt, Homo sapiens
cuauuuccuuuccagucauuuca

SEQ ID NO: 1105742 - RNA, 15 nt, Homo sapiens
cuauuuuauucccuu

SEQ ID NO: 1105743 - RNA, 23 nt, Homo sapiens
cuauuuuuauuuguuugugcauu

SEQ ID NO: 1105744 - RNA, 17 nt, Homo sapiens
cucaaaaaaagggcaau

SEQ ID NO: 1105745 - RNA, 22 nt, Homo sapiens
cucaaacucuugaccucaggug

SEQ ID NO: 1105746 - RNA, 19 nt, Homo sapiens
cucaaagcccccacuucuc

SEQ ID NO: 1105747 - RNA, 20 nt, Homo sapiens
cucaaauaaaaagugcuuuu

SEQ ID NO: 1105748 - RNA, 21 nt, Homo sapiens
cucaaaugacccaaagaccaa

SEQ ID NO: 1105749 - RNA, 18 nt, Homo sapiens
cucaaaugcacaucucau

SEQ ID NO: 1105750 - RNA, 21 nt, Homo sapiens
cucaaaugcacaucucauggc

SEQ ID NO: 1105751 - RNA, 14 nt, Homo sapiens
cucaaccuauggua

SEQ ID NO: 1105752 - RNA, 18 nt, Homo sapiens
cucaacguugcuccccau

SEQ ID NO: 1105753 - RNA, 16 nt, Homo sapiens
cucaagaugaaggcaa

SEQ ID NO: 1105754 - RNA, 17 nt, Homo sapiens
cucaaggaauuugcauu

SEQ ID NO: 1105755 - RNA, 23 nt, Homo sapiens
cucaaggguuauagacugccaug

SEQ ID NO: 1105756 - RNA, 17 nt, Homo sapiens
cucaagucuucccugau

SEQ ID NO: 1105757 - RNA, 15 nt, Homo sapiens
cucaaugcacugaca

SEQ ID NO: 1105758 - RNA, 17 nt, Homo sapiens
cucacaacuguuuuuga

SEQ ID NO: 1105759 - RNA, 21 nt, Homo sapiens
cucacaagaagaccagacugu

SEQ ID NO: 1105760 - RNA, 14 nt, Homo sapiens
cucacaagcacuuu

SEQ ID NO: 1105761 - RNA, 17 nt, Homo sapiens
cucacauaucugucauu

SEQ ID NO: 1105762 - RNA, 17 nt, Homo sapiens
cucaccuguuacugaaa

SEQ ID NO: 1105763 - RNA, 19 nt, Homo sapiens
cucugccagccacauccaa

SEQ ID NO: 1105764 - RNA, 14 nt, Homo sapiens
cucugcugaaggaa

SEQ ID NO: 1105765 - RNA, 22 nt, Homo sapiens
cucuggaaaacucaggauucuc

SEQ ID NO: 1105766 - RNA, 17 nt, Homo sapiens
cucuggaaaaugugacc

SEQ ID NO: 1105767 - RNA, 11 nt, Homo sapiens
cucuggaccag

SEQ ID NO: 1105768 - RNA, 15 nt, Homo sapiens
cucuggaccagccug

SEQ ID NO: 1105769 - RNA, 16 nt, Homo sapiens
cucuggaccagccugu

SEQ ID NO: 1105770 - RNA, 17 nt, Homo sapiens
cucugucgccaggcuag

SEQ ID NO: 1105771 - RNA, 22 nt, Homo sapiens
cucuguguuucuggggacacca

SEQ ID NO: 1105772 - RNA, 15 nt, Homo sapiens
cucuguucauuuccu

SEQ ID NO: 1105773 - RNA, 17 nt, Homo sapiens
cucuuaaucaaauagca

SEQ ID NO: 1105774 - RNA, 16 nt, Homo sapiens
cucuuaguaacauaga

SEQ ID NO: 1105775 - RNA, 19 nt, Homo sapiens
cucuuauagaaaguucaaa

SEQ ID NO: 1105776 - RNA, 19 nt, Homo sapiens
cucuucaacugaccagccu

SEQ ID NO: 1105777 - RNA, 20 nt, Homo sapiens
cucuucccgggaucacuuaa

SEQ ID NO: 1105778 - RNA, 16 nt, Homo sapiens
cucuuccugcaaggac

SEQ ID NO: 1105779 - RNA, 18 nt, Homo sapiens
cucuugucucacaugcua

SEQ ID NO: 1105780 - RNA, 15 nt, Homo sapiens
cucuuuaaugucaca

SEQ ID NO: 1105781 - RNA, 20 nt, Homo sapiens
cucuuucuuggugucugucc

SEQ ID NO: 1105782 - RNA, 14 nt, Homo sapiens
cucuuuguccccaa

SEQ ID NO: 1105783 - RNA, 17 nt, Homo sapiens
cucuuuucccacauuca

SEQ ID NO: 1105784 - RNA, 17 nt, Homo sapiens
cucuuuugaauccaugc

SEQ ID NO: 1105785 - RNA, 23 nt, Homo sapiens
cugaaaaaugguaauuguugcua

SEQ ID NO: 1105786 - RNA, 22 nt, Homo sapiens
cugaaaagaucugaagguccca

SEQ ID NO: 1105787 - RNA, 15 nt, Homo sapiens
cugaaagccauuugu

SEQ ID NO: 1105788 - RNA, 16 nt, Homo sapiens
cugaaauaaaagccuc

SEQ ID NO: 1105789 - RNA, 22 nt, Homo sapiens
cugaaauuauuuuuaaggauaa

SEQ ID NO: 1105790 - RNA, 18 nt, Homo sapiens
cugaaccaucccugaugu

SEQ ID NO: 1105791 - RNA, 15 nt, Homo sapiens
cugaacccauuuuga

SEQ ID NO: 1105792 - RNA, 13 nt, Homo sapiens
cugaagaaaccuu

SEQ ID NO: 1105793 - RNA, 14 nt, Homo sapiens
cugaauccaucagg

SEQ ID NO: 1105794 - RNA, 21 nt, Homo sapiens
cugaaugguuccaugccugag

SEQ ID NO: 1105795 - RNA, 20 nt, Homo sapiens
cugaauguauugaacuugga

SEQ ID NO: 1105796 - RNA, 20 nt, Homo sapiens
cugaauuuggccugcacuaa

SEQ ID NO: 1105797 - RNA, 19 nt, Homo sapiens
cugacaaagaugaccugcu

SEQ ID NO: 1105798 - RNA, 14 nt, Homo sapiens
cugacagaaaugca

SEQ ID NO: 1105799 - RNA, 17 nt, Homo sapiens
cugacagaaaugcaauc

SEQ ID NO: 1105800 - RNA, 13 nt, Homo sapiens
cugacccacagcc

SEQ ID NO: 1105801 - RNA, 13 nt, Homo sapiens
cugaccccaaaga

SEQ ID NO: 1105802 - RNA, 22 nt, Homo sapiens
cugacccuaaauguggacauca

SEQ ID NO: 1105803 - RNA, 17 nt, Homo sapiens
cugaccucgugauccac

SEQ ID NO: 1105804 - RNA, 14 nt, Homo sapiens
cugacgaacuccuu

SEQ ID NO: 1105805 - RNA, 21 nt, Homo sapiens
cugacuauugaaguugcagau

SEQ ID NO: 1105806 - RNA, 20 nt, Homo sapiens
cugacucacaagaagaccag

SEQ ID NO: 1105807 - RNA, 22 nt, Homo sapiens
cugacuccuuagagacaucaaa

SEQ ID NO: 1105808 - RNA, 21 nt, Homo sapiens
cugacucucugugaccugccc

SEQ ID NO: 1105809 - RNA, 15 nt, Homo sapiens
cugacugaugacaaa

SEQ ID NO: 1105810 - RNA, 22 nt, Homo sapiens
cugacuguguucagugccuugg

SEQ ID NO: 1105811 - RNA, 17 nt, Homo sapiens
cugagaaauguucagaa

SEQ ID NO: 1105812 - RNA, 18 nt, Homo sapiens
cugagacaugacuaggaa

SEQ ID NO: 1105813 - RNA, 23 nt, Homo sapiens
cugagaccaguugggagcacugg

SEQ ID NO: 1105814 - RNA, 22 nt, Homo sapiens
cugagcaccuacuuacaugcau

SEQ ID NO: 1105815 - RNA, 18 nt, Homo sapiens
cugagcaccucagccuuu

SEQ ID NO: 1105816 - RNA, 11 nt, Homo sapiens
cugagccugac

SEQ ID NO: 1105817 - RNA, 17 nt, Homo sapiens
cugagcgagcacaccuu

SEQ ID NO: 1105818 - RNA, 18 nt, Homo sapiens
cugagcgagcacaccuuc

SEQ ID NO: 1105819 - RNA, 17 nt, Homo sapiens
cugagcuagugauuugc

SEQ ID NO: 1105820 - RNA, 20 nt, Homo sapiens
cugagcugaacccauuuuga

SEQ ID NO: 1105821 - RNA, 22 nt, Homo sapiens
cugaggaagcacagcagcaucu

SEQ ID NO: 1105822 - RNA, 15 nt, Homo sapiens
cugaggaaggugcuu

SEQ ID NO: 1105823 - RNA, 22 nt, Homo sapiens
cugaggcaagagaauugcuuga

SEQ ID NO: 1105824 - RNA, 17 nt, Homo sapiens
cugaggcagacagcagc

SEQ ID NO: 1105825 - RNA, 20 nt, Homo sapiens
cugaggcauuuuuacuacua

SEQ ID NO: 1105826 - RNA, 21 nt, Homo sapiens
cugaggggggccgugcccagg

SEQ ID NO: 1105827 - RNA, 15 nt, Homo sapiens
cugagguccugagca

SEQ ID NO: 1105828 - RNA, 15 nt, Homo sapiens
cugagucugcagaug

SEQ ID NO: 1105829 - RNA, 22 nt, Homo sapiens
cugagugcaccacuucaaguga

SEQ ID NO: 1105830 - RNA, 14 nt, Homo sapiens
cugaguggaucucc

SEQ ID NO: 1105831 - RNA, 19 nt, Homo sapiens
cugaguuauuuugcuaaac

SEQ ID NO: 1105832 - RNA, 16 nt, Homo sapiens
cugaguuccugcaugc

SEQ ID NO: 1105833 - RNA, 20 nt, Homo sapiens
cugauaaacauuaaacacug

SEQ ID NO: 1105834 - RNA, 21 nt, Homo sapiens
cugauaaacauuaaacacugu

SEQ ID NO: 1105835 - RNA, 22 nt, Homo sapiens
cugauaaacauuaaacacugua

SEQ ID NO: 1105836 - RNA, 15 nt, Homo sapiens
cugauacccagagca

SEQ ID NO: 1105837 - RNA, 15 nt, Homo sapiens
cugaugacaaaccca

SEQ ID NO: 1105838 - RNA, 22 nt, Homo sapiens
cugaugaccuaaccuaagcaaa

SEQ ID NO: 1105839 - RNA, 19 nt, Homo sapiens
cugauuuuuagcuuuacaa

SEQ ID NO: 1105840 - RNA, 13 nt, Homo sapiens
cugcaacggaauu

SEQ ID NO: 1105841 - RNA, 17 nt, Homo sapiens
cugcaagugacaucucu

SEQ ID NO: 1105842 - RNA, 19 nt, Homo sapiens
cugcacaugucuuguacau

SEQ ID NO: 1105843 - RNA, 15 nt, Homo sapiens
cugcacccucgauga

SEQ ID NO: 1105844 - RNA, 13 nt, Homo sapiens
cugcaccgagaga

SEQ ID NO: 1105845 - RNA, 24 nt, Homo sapiens
cugcaccgagagagauggaauaaa

SEQ ID NO: 1105846 - RNA, 23 nt, Homo sapiens
cugcacuauagccuaggugacag

SEQ ID NO: 1105847 - RNA, 20 nt, Homo sapiens
cugcacuccagccugggcaa

SEQ ID NO: 1105848 - RNA, 14 nt, Homo sapiens
cugcacuugcagac

SEQ ID NO: 1105849 - RNA, 14 nt, Homo sapiens
cugcagaggauuua

SEQ ID NO: 1105850 - RNA, 20 nt, Homo sapiens
cugcagcugcuuguugucaa

SEQ ID NO: 1105851 - RNA, 15 nt, Homo sapiens
auuucaccaagaagu

SEQ ID NO: 1105852 - RNA, 18 nt, Homo sapiens
auuucagauaaacaacaa

SEQ ID NO: 1105853 - RNA, 12 nt, Homo sapiens
auuucagauauc

SEQ ID NO: 1105854 - RNA, 23 nt, Homo sapiens
auuucagguuuuguaaagaugcc

SEQ ID NO: 1105855 - RNA, 16 nt, Homo sapiens
auuucauuagaggaag

SEQ ID NO: 1105856 - RNA, 11 nt, Homo sapiens
auuuccagggg

SEQ ID NO: 1105857 - RNA, 23 nt, Homo sapiens
auuuccaggggccucccaaggaa

SEQ ID NO: 1105858 - RNA, 15 nt, Homo sapiens
auuucccaauacaua

SEQ ID NO: 1105859 - RNA, 15 nt, Homo sapiens
auuucccucccggga

SEQ ID NO: 1105860 - RNA, 16 nt, Homo sapiens
auuuccuaaugucaga

SEQ ID NO: 1105861 - RNA, 20 nt, Homo sapiens
auuuccuaaugucagaguag

SEQ ID NO: 1105862 - RNA, 21 nt, Homo sapiens
auuuccuuuccagucauuuca

SEQ ID NO: 1105863 - RNA, 15 nt, Homo sapiens
auuucuagguaggaa

SEQ ID NO: 1105864 - RNA, 21 nt, Homo sapiens
auuucucaaaugcacaucuca

SEQ ID NO: 1105865 - RNA, 17 nt, Homo sapiens
auuucuuuuccaaaauu

SEQ ID NO: 1105866 - RNA, 17 nt, Homo sapiens
auuugacucaugaacua

SEQ ID NO: 1105867 - RNA, 15 nt, Homo sapiens
auuugauaguauugu

SEQ ID NO: 1105868 - RNA, 15 nt, Homo sapiens
auuugauguacaugu

SEQ ID NO: 1105869 - RNA, 13 nt, Homo sapiens
auuugcuaucaaa

SEQ ID NO: 1105870 - RNA, 20 nt, Homo sapiens
auuugggggacuuacaugau

SEQ ID NO: 1105871 - RNA, 18 nt, Homo sapiens
auuuuaaaaacuaaaaag

SEQ ID NO: 1105872 - RNA, 13 nt, Homo sapiens
auuuuaagugcuu

SEQ ID NO: 1105873 - RNA, 22 nt, Homo sapiens
auuuuaauaaaaugaaaggguc

SEQ ID NO: 1105874 - RNA, 15 nt, Homo sapiens
auuuuagugcuugcc

SEQ ID NO: 1105875 - RNA, 15 nt, Homo sapiens
auuuuaguuccuuua

SEQ ID NO: 1105876 - RNA, 23 nt, Homo sapiens
auuuuauaugaaauguuucacua

SEQ ID NO: 1105877 - RNA, 13 nt, Homo sapiens
auuuuaugcugcu

SEQ ID NO: 1105878 - RNA, 21 nt, Homo sapiens
auuuuaugugcuucacauaau

SEQ ID NO: 1105879 - RNA, 19 nt, Homo sapiens
auuuucaacauaacugaag

SEQ ID NO: 1105880 - RNA, 18 nt, Homo sapiens
auuuucauuuaacuacaa

SEQ ID NO: 1105881 - RNA, 17 nt, Homo sapiens
auuuuccuccaggcaaa

SEQ ID NO: 1105882 - RNA, 20 nt, Homo sapiens
auuuuccugaauauuaaucc

SEQ ID NO: 1105883 - RNA, 18 nt, Homo sapiens
auuuuccugcauaaucau

SEQ ID NO: 1105884 - RNA, 12 nt, Homo sapiens
auuuucuaugcu

SEQ ID NO: 1105885 - RNA, 15 nt, Homo sapiens
auuuugcagcaguga

SEQ ID NO: 1105886 - RNA, 12 nt, Homo sapiens
auuuugcauuag

SEQ ID NO: 1105887 - RNA, 18 nt, Homo sapiens
auuuugggguaagacuuu

SEQ ID NO: 1105888 - RNA, 20 nt, Homo sapiens
auuuuguaauaaacucucua

SEQ ID NO: 1105889 - RNA, 23 nt, Homo sapiens
auuuugucugcuuaguaucucau

SEQ ID NO: 1105890 - RNA, 23 nt, Homo sapiens
gaucuaaauagcccuuggaucag

SEQ ID NO: 1105891 - RNA, 18 nt, Homo sapiens
gaucuaucaauagucaag

SEQ ID NO: 1105892 - RNA, 16 nt, Homo sapiens
gaucucacaagcacuu

SEQ ID NO: 1105893 - RNA, 19 nt, Homo sapiens
gaucuguaaggaacuggaa

SEQ ID NO: 1105894 - RNA, 20 nt, Homo sapiens
gaucuguaaggaacuggaac

SEQ ID NO: 1105895 - RNA, 16 nt, Homo sapiens
gaucuugcauucccag

SEQ ID NO: 1105896 - RNA, 20 nt, Homo sapiens
gaucuugcauucccaguggu

SEQ ID NO: 1105897 - RNA, 19 nt, Homo sapiens
gaugaaggacgugucucag

SEQ ID NO: 1105898 - RNA, 18 nt, Homo sapiens
gaugaccaaucucuguga

SEQ ID NO: 1105899 - RNA, 16 nt, Homo sapiens
gaugagagagugcuga

SEQ ID NO: 1105900 - RNA, 14 nt, Homo sapiens
gaugcaagcaccug

SEQ ID NO: 1105901 - RNA, 15 nt, Homo sapiens
gaugcaauacaagau

SEQ ID NO: 1105902 - RNA, 17 nt, Homo sapiens
gaugcagccgugcagga

SEQ ID NO: 1105903 - RNA, 15 nt, Homo sapiens
gaugcuaccaugccu

SEQ ID NO: 1105904 - RNA, 19 nt, Homo sapiens
gaugcuacucuaguauucc

SEQ ID NO: 1105905 - RNA, 20 nt, Homo sapiens
gauggaauaaagcccuugaa

SEQ ID NO: 1105906 - RNA, 22 nt, Homo sapiens
gauggaauauuccccuaucucu

SEQ ID NO: 1105907 - RNA, 14 nt, Homo sapiens
gauggcaccagagg

SEQ ID NO: 1105908 - RNA, 17 nt, Homo sapiens
gauggccgggacaugca

SEQ ID NO: 1105909 - RNA, 21 nt, Homo sapiens
gauggcugacuuugcucuuuc

SEQ ID NO: 1105910 - RNA, 15 nt, Homo sapiens
gauggugacuuccuc

SEQ ID NO: 1105911 - RNA, 13 nt, Homo sapiens
gaugucaucuucc

SEQ ID NO: 1105912 - RNA, 17 nt, Homo sapiens
uaugguuucuccaucca

SEQ ID NO: 1105913 - RNA, 13 nt, Homo sapiens
uauguacuaagca

SEQ ID NO: 1105914 - RNA, 16 nt, Homo sapiens
uauguacuaagcagua

SEQ ID NO: 1105915 - RNA, 13 nt, Homo sapiens
uauguauggaaua

SEQ ID NO: 1105916 - RNA, 10 nt, Homo sapiens
uaugugcaau

SEQ ID NO: 1105917 - RNA, 16 nt, Homo sapiens
uaugugcuucacauaa

SEQ ID NO: 1105918 - RNA, 12 nt, Homo sapiens
uaugugggacac

SEQ ID NO: 1105919 - RNA, 17 nt, Homo sapiens
uauguuacuacaugcac

SEQ ID NO: 1105920 - RNA, 19 nt, Homo sapiens
uauguuacuacaugcacuu

SEQ ID NO: 1105921 - RNA, 17 nt, Homo sapiens
uauguugguacuuggac

SEQ ID NO: 1105922 - RNA, 17 nt, Homo sapiens
uauguuuacuucucacc

SEQ ID NO: 1105923 - RNA, 16 nt, Homo sapiens
uauuaaaacacagcuu

SEQ ID NO: 1105924 - RNA, 14 nt, Homo sapiens
uauuaaagcaccaa

SEQ ID NO: 1105925 - RNA, 17 nt, Homo sapiens
uauuaagguguggcuuu

SEQ ID NO: 1105926 - RNA, 16 nt, Homo sapiens
uauuaauauucauugu

SEQ ID NO: 1105927 - RNA, 21 nt, Homo sapiens
uauuaaucaacuuuccuuaaa

SEQ ID NO: 1105928 - RNA, 21 nt, Homo sapiens
uauuacacaaaaaaguauaga

SEQ ID NO: 1105929 - RNA, 13 nt, Homo sapiens
uauuaccaaaaaa

SEQ ID NO: 1105930 - RNA, 13 nt, Homo sapiens
uauuaccaugaga

SEQ ID NO: 1105931 - RNA, 14 nt, Homo sapiens
uauuacgugcaaua

SEQ ID NO: 1105932 - RNA, 16 nt, Homo sapiens
uauuacgugcaauacu

SEQ ID NO: 1105933 - RNA, 21 nt, Homo sapiens
uauuaguuaggugugccaaac

SEQ ID NO: 1105934 - RNA, 18 nt, Homo sapiens
uauuauuguugcauuaaa

SEQ ID NO: 1105935 - RNA, 17 nt, Homo sapiens
uauucaauaaagcugcu

SEQ ID NO: 1105936 - RNA, 19 nt, Homo sapiens
uauucaauggaaagcugcu

SEQ ID NO: 1105937 - RNA, 23 nt, Homo sapiens
uauucaauggugagcagacugca

SEQ ID NO: 1105938 - RNA, 18 nt, Homo sapiens
uauucauuagcugugauu

SEQ ID NO: 1105939 - RNA, 17 nt, Homo sapiens
uauuccaccauucacau

SEQ ID NO: 1105940 - RNA, 13 nt, Homo sapiens
uauuccugcauuu

SEQ ID NO: 1105941 - RNA, 15 nt, Homo sapiens
uauucuaggucugua

SEQ ID NO: 1105942 - RNA, 17 nt, Homo sapiens
uauucucacuccaccac

SEQ ID NO: 1105943 - RNA, 14 nt, Homo sapiens
uauucucuaagaua

SEQ ID NO: 1105944 - RNA, 15 nt, Homo sapiens
uauucuucauaacaa

SEQ ID NO: 1105945 - RNA, 22 nt, Homo sapiens
uauugaaaaaucaccacaccaa

SEQ ID NO: 1105946 - RNA, 18 nt, Homo sapiens
uauugaaaagguuaacag

SEQ ID NO: 1105947 - RNA, 21 nt, Homo sapiens
uauuggaaaggucauuguggc

SEQ ID NO: 1105948 - RNA, 18 nt, Homo sapiens
uauugggccauagccuau

SEQ ID NO: 1105949 - RNA, 14 nt, Homo sapiens
uauugguguuuacc

SEQ ID NO: 1105950 - RNA, 17 nt, Homo sapiens
uauugguguuuacccag

SEQ ID NO: 1105951 - RNA, 16 nt, Homo sapiens
uauugugccucuggcu

SEQ ID NO: 1105952 - RNA, 23 nt, Homo sapiens
uauuuaaaaaauaaaaaaauaca

SEQ ID NO: 1105953 - RNA, 15 nt, Homo sapiens
uauuuacauaugaaa

SEQ ID NO: 1105954 - RNA, 13 nt, Homo sapiens
uauuuauaacuca

SEQ ID NO: 1105955 - RNA, 12 nt, Homo sapiens
uauuuauacucu

SEQ ID NO: 1105956 - RNA, 13 nt, Homo sapiens
uauuuaugaaggc

SEQ ID NO: 1105957 - RNA, 21 nt, Homo sapiens
uauuuaugagaaaguucucau

SEQ ID NO: 1105958 - RNA, 15 nt, Homo sapiens
uauuuauugcugaau

SEQ ID NO: 1105959 - RNA, 19 nt, Homo sapiens
uauuucaauguuagccuca

SEQ ID NO: 1105960 - RNA, 12 nt, Homo sapiens
uauuucaggcau

SEQ ID NO: 1105961 - RNA, 14 nt, Homo sapiens
uauuucauaaacaa

SEQ ID NO: 1105962 - RNA, 13 nt, Homo sapiens
uauuugaauauca

SEQ ID NO: 1105963 - RNA, 14 nt, Homo sapiens
uauuugaauaucau

SEQ ID NO: 1105964 - RNA, 17 nt, Homo sapiens
uauuugcaagacauaga

SEQ ID NO: 1105965 - RNA, 19 nt, Homo sapiens
uauuugcauguuaccuccu

SEQ ID NO: 1105966 - RNA, 17 nt, Homo sapiens
uauuuguauaauggugu

SEQ ID NO: 1105967 - RNA, 15 nt, Homo sapiens
uauuuuaagcauucu

SEQ ID NO: 1105968 - RNA, 23 nt, Homo sapiens
uauuuuauguaaacccucaaggg

SEQ ID NO: 1105969 - RNA, 17 nt, Homo sapiens
uauuuuguaauaaacuc

SEQ ID NO: 1105970 - RNA, 21 nt, Homo sapiens
uauuuuuagacagagucucac

SEQ ID NO: 1105971 - RNA, 17 nt, Homo sapiens
uauuuuuuaaguauuua

SEQ ID NO: 1105972 - RNA, 15 nt, Homo sapiens
uauuuuuucuacaca

SEQ ID NO: 1105973 - RNA, 20 nt, Homo sapiens
ucaaaaauacucacauggcu

SEQ ID NO: 1105974 - RNA, 18 nt, Homo sapiens
ucaaaacauugugccaug

SEQ ID NO: 1105975 - RNA, 18 nt, Homo sapiens
ucaaaacccaacaugacu

SEQ ID NO: 1105976 - RNA, 15 nt, Homo sapiens
ucaaaagagucuuaa

SEQ ID NO: 1105977 - RNA, 20 nt, Homo sapiens
ucaaaaucuuucagcacuca

SEQ ID NO: 1105978 - RNA, 20 nt, Homo sapiens
ucaaacaaauagucuaucaa

SEQ ID NO: 1105979 - RNA, 21 nt, Homo sapiens
ucaaacauauguauacaaauu

SEQ ID NO: 1105980 - RNA, 19 nt, Homo sapiens
ucaaacucuugaccucagg

SEQ ID NO: 1105981 - RNA, 21 nt, Homo sapiens
ucaaacugcaugauucaugcc

SEQ ID NO: 1105982 - RNA, 21 nt, Homo sapiens
ucaaagagggagugcauuuau

SEQ ID NO: 1105983 - RNA, 12 nt, Homo sapiens
ucaaagcacugu

SEQ ID NO: 1105984 - RNA, 20 nt, Homo sapiens
ucaaagcacuguuucucuca

SEQ ID NO: 1105985 - RNA, 13 nt, Homo sapiens
ucaaagcaguagu

SEQ ID NO: 1105986 - RNA, 16 nt, Homo sapiens
ucaaauauuaccaaaa

SEQ ID NO: 1105987 - RNA, 20 nt, Homo sapiens
ucaaauauuaccaaaaaagu

SEQ ID NO: 1105988 - RNA, 15 nt, Homo sapiens
ucaaauccugaugcu

SEQ ID NO: 1105989 - RNA, 22 nt, Homo sapiens
ucaaaugacccaaagaccaaua

SEQ ID NO: 1105990 - RNA, 17 nt, Homo sapiens
ucaaaugcacaucucau

SEQ ID NO: 1105991 - RNA, 17 nt, Homo sapiens
ucaacaagaguugucuu

SEQ ID NO: 1105992 - RNA, 12 nt, Homo sapiens
ucaacacuuaag

SEQ ID NO: 1105993 - RNA, 21 nt, Homo sapiens
ucaacauucccccaacauuac

SEQ ID NO: 1105994 - RNA, 18 nt, Homo sapiens
ucaaccaggaacauguaa

SEQ ID NO: 1105995 - RNA, 17 nt, Homo sapiens
ucaaccgcuugccauau

SEQ ID NO: 1105996 - RNA, 17 nt, Homo sapiens
ucaagaugacagcucuu

SEQ ID NO: 1105997 - RNA, 14 nt, Homo sapiens
ucauugauugaaua

SEQ ID NO: 1105998 - RNA, 14 nt, Homo sapiens
ucauuuaagggaaa

SEQ ID NO: 1105999 - RNA, 21 nt, Homo sapiens
ucauuuauucuucuuuuccaa

SEQ ID NO: 1106000 - RNA, 12 nt, Homo sapiens
ucauuugaacaa

SEQ ID NO: 1106001 - RNA, 20 nt, Homo sapiens
ucucaggagcuugcaagaag

SEQ ID NO: 1106002 - RNA, 23 nt, Homo sapiens
ucucaucaacaaagaaauauuau

SEQ ID NO: 1106003 - RNA, 14 nt, Homo sapiens
ucucaucacuuuuc

SEQ ID NO: 1106004 - RNA, 22 nt, Homo sapiens
ucucaucagaaaugucaucaaa

SEQ ID NO: 1106005 - RNA, 13 nt, Homo sapiens
gccucagugccac

SEQ ID NO: 1106006 - RNA, 16 nt, Homo sapiens
gccuccaagcuccauc

SEQ ID NO: 1106007 - RNA, 18 nt, Homo sapiens
gccuccaccgcugccuaa

SEQ ID NO: 1106008 - RNA, 14 nt, Homo sapiens
gccuccaugcugcc

SEQ ID NO: 1106009 - RNA, 18 nt, Homo sapiens
gccuccuuuugcuugaaa

SEQ ID NO: 1106010 - RNA, 14 nt, Homo sapiens
gccucuacugggaa

SEQ ID NO: 1106011 - RNA, 22 nt, Homo sapiens
gccucugccccuggccuuugag

SEQ ID NO: 1106012 - RNA, 18 nt, Homo sapiens
gccucuucgcugaccucg

SEQ ID NO: 1106013 - RNA, 19 nt, Homo sapiens
gccucuucgcugaccucga

SEQ ID NO: 1106014 - RNA, 15 nt, Homo sapiens
gccugaagucacaca

SEQ ID NO: 1106015 - RNA, 13 nt, Homo sapiens
gccugaccaacau

SEQ ID NO: 1106016 - RNA, 22 nt, Homo sapiens
gccugacuagaccccacccuga

SEQ ID NO: 1106017 - RNA, 18 nt, Homo sapiens
gccugagucuccugugcc

SEQ ID NO: 1106018 - RNA, 18 nt, Homo sapiens
gccugauaggacccauau

SEQ ID NO: 1106019 - RNA, 22 nt, Homo sapiens
gccugcaaacucacugcucaag

SEQ ID NO: 1106020 - RNA, 12 nt, Homo sapiens
gccugcccuccc

SEQ ID NO: 1106021 - RNA, 22 nt, Homo sapiens
gccugcuauuugaaguguaauu

SEQ ID NO: 1106022 - RNA, 18 nt, Homo sapiens
gccugcugcugagaaccu

SEQ ID NO: 1106023 - RNA, 18 nt, Homo sapiens
gccuggccggcuccaguu

SEQ ID NO: 1106024 - RNA, 20 nt, Homo sapiens
gccuggccuccugccucuac

SEQ ID NO: 1106025 - RNA, 17 nt, Homo sapiens
gccugggcuuaugcccu

SEQ ID NO: 1106026 - RNA, 14 nt, Homo sapiens
gccugguggcagcu

SEQ ID NO: 1106027 - RNA, 14 nt, Homo sapiens
gccuguaaucccag

SEQ ID NO: 1106028 - RNA, 13 nt, Homo sapiens
gccuguguagcug

SEQ ID NO: 1106029 - RNA, 17 nt, Homo sapiens
gccuguguagcugugac

SEQ ID NO: 1106030 - RNA, 15 nt, Homo sapiens
gccuucuucacccag

SEQ ID NO: 1106031 - RNA, 15 nt, Homo sapiens
gccuugcaguaggca

SEQ ID NO: 1106032 - RNA, 22 nt, Homo sapiens
gccuuuugcucacaaaaccugg

SEQ ID NO: 1106033 - RNA, 22 nt, Homo sapiens
gcgcaagccuguaaucccagcu

SEQ ID NO: 1106034 - RNA, 15 nt, Homo sapiens
gcggagaguacagug

SEQ ID NO: 1106035 - RNA, 12 nt, Homo sapiens
gcgugcacacac

SEQ ID NO: 1106036 - RNA, 12 nt, Homo sapiens
gcuaaaugcaaa

SEQ ID NO: 1106037 - RNA, 18 nt, Homo sapiens
gcuaagaaagcaagccaa

SEQ ID NO: 1106038 - RNA, 21 nt, Homo sapiens
gcuaagauuuagagaugaauu

SEQ ID NO: 1106039 - RNA, 15 nt, Homo sapiens
gcuacaccacucugg

SEQ ID NO: 1106040 - RNA, 19 nt, Homo sapiens
gcuaccucacuaugcugcu

SEQ ID NO: 1106041 - RNA, 21 nt, Homo sapiens
gcuagaaggccacaugucacc

SEQ ID NO: 1106042 - RNA, 22 nt, Homo sapiens
gcuagacaagcuuguccaugua

SEQ ID NO: 1106043 - RNA, 13 nt, Homo sapiens
gcuagcaacauac

SEQ ID NO: 1106044 - RNA, 20 nt, Homo sapiens
gcuagcaacauaccagacca

SEQ ID NO: 1106045 - RNA, 21 nt, Homo sapiens
gcuagcugcaagugacaucuc

SEQ ID NO: 1106046 - RNA, 17 nt, Homo sapiens
gcuaggaaugaaauccu

SEQ ID NO: 1106047 - RNA, 15 nt, Homo sapiens
gcuaggaugugcauu

SEQ ID NO: 1106048 - RNA, 15 nt, Homo sapiens
gcuagggaguggucu

SEQ ID NO: 1106049 - RNA, 21 nt, Homo sapiens
gcuagucuauggucaguugag

SEQ ID NO: 1106050 - RNA, 15 nt, Homo sapiens
gcuaguuugaccuca

SEQ ID NO: 1106051 - RNA, 23 nt, Homo sapiens
gcuaucagacuguaggauuugaa

SEQ ID NO: 1106052 - RNA, 15 nt, Homo sapiens
gcuauccaaauaacu

SEQ ID NO: 1106053 - RNA, 11 nt, Homo sapiens
gcuauuugccu

SEQ ID NO: 1106054 - RNA, 19 nt, Homo sapiens
gcucaauauuccugaauga

SEQ ID NO: 1106055 - RNA, 17 nt, Homo sapiens
gcucaaugcaugaaucu

SEQ ID NO: 1106056 - RNA, 16 nt, Homo sapiens
gcucacgugucuuuag

SEQ ID NO: 1106057 - RNA, 22 nt, Homo sapiens
gcucacucccugggaaaggggu

SEQ ID NO: 1106058 - RNA, 19 nt, Homo sapiens
gcucagcccugacuggugc

SEQ ID NO: 1106059 - RNA, 21 nt, Homo sapiens
gcucagguuuccuuccuucgc

SEQ ID NO: 1106060 - RNA, 15 nt, Homo sapiens
gcucagucucaggag

SEQ ID NO: 1106061 - RNA, 20 nt, Homo sapiens
gcucaugaccuggaaauaaa

SEQ ID NO: 1106062 - RNA, 15 nt, Homo sapiens
gcuccuucuguccua

SEQ ID NO: 1106063 - RNA, 15 nt, Homo sapiens
gcucggggugcacag

SEQ ID NO: 1106064 - RNA, 20 nt, Homo sapiens
gcucuagagaaaagucuacc

SEQ ID NO: 1106065 - RNA, 19 nt, Homo sapiens
gcucucagaagguauuccu

SEQ ID NO: 1106066 - RNA, 15 nt, Homo sapiens
gcucugacauucuga

SEQ ID NO: 1106067 - RNA, 20 nt, Homo sapiens
gcucugagaggcccuggauc

SEQ ID NO: 1106068 - RNA, 14 nt, Homo sapiens
gcucugcaugugug

SEQ ID NO: 1106069 - RNA, 18 nt, Homo sapiens
gcucuggaaaaugugacc

SEQ ID NO: 1106070 - RNA, 17 nt, Homo sapiens
gcucugggauagcugac

SEQ ID NO: 1106071 - RNA, 19 nt, Homo sapiens
gcucuuaggugcuucuuca

SEQ ID NO: 1106072 - RNA, 13 nt, Homo sapiens
gcugaaaaucacu

SEQ ID NO: 1106073 - RNA, 16 nt, Homo sapiens
gcugagucaaucaaua

SEQ ID NO: 1106074 - RNA, 16 nt, Homo sapiens
gcugagugcaccacuu

SEQ ID NO: 1106075 - RNA, 14 nt, Homo sapiens
ugguauauuuccau

SEQ ID NO: 1106076 - RNA, 21 nt, Homo sapiens
ugguauguguguguaugcuac

SEQ ID NO: 1106077 - RNA, 20 nt, Homo sapiens
uggucaauccgaaguaugag

SEQ ID NO: 1106078 - RNA, 13 nt, Homo sapiens
uggugcacugagc

SEQ ID NO: 1106079 - RNA, 15 nt, Homo sapiens
ugguggaucugucca

SEQ ID NO: 1106080 - RNA, 16 nt, Homo sapiens
ugguggaucuguccaa

SEQ ID NO: 1106081 - RNA, 12 nt, Homo sapiens
uggugggaauca

SEQ ID NO: 1106082 - RNA, 17 nt, Homo sapiens
ugguggugggugccugu

SEQ ID NO: 1106083 - RNA, 17 nt, Homo sapiens
ugguguaaugcacaauu

SEQ ID NO: 1106084 - RNA, 13 nt, Homo sapiens
uggugucuguccu

SEQ ID NO: 1106085 - RNA, 21 nt, Homo sapiens
ugguguucaaaaaaacacuag

SEQ ID NO: 1106086 - RNA, 20 nt, Homo sapiens
ugguuaucuaauauguaaca

SEQ ID NO: 1106087 - RNA, 12 nt, Homo sapiens
ugguucucucca

SEQ ID NO: 1106088 - RNA, 16 nt, Homo sapiens
ugguugaugccaaaaa

SEQ ID NO: 1106089 - RNA, 20 nt, Homo sapiens
ugguuggccgugguccagcu

SEQ ID NO: 1106090 - RNA, 22 nt, Homo sapiens
ugguuggccgugguccagcucu

SEQ ID NO: 1106091 - RNA, 14 nt, Homo sapiens
ugguuuacugcugu

SEQ ID NO: 1106092 - RNA, 15 nt, Homo sapiens
ugguuuaugucauca

SEQ ID NO: 1106093 - RNA, 21 nt, Homo sapiens
ugguuuucacauacacucaaa

SEQ ID NO: 1106094 - RNA, 17 nt, Homo sapiens
uguaaaauagaauguua

SEQ ID NO: 1106095 - RNA, 17 nt, Homo sapiens
uguaaagaauaaaugaa

SEQ ID NO: 1106096 - RNA, 13 nt, Homo sapiens
uguaauaaacucu

SEQ ID NO: 1106097 - RNA, 14 nt, Homo sapiens
uguaaucauauaau

SEQ ID NO: 1106098 - RNA, 19 nt, Homo sapiens
uguaaucccagcacuuugg

SEQ ID NO: 1106099 - RNA, 13 nt, Homo sapiens
uguacaccaaggu

SEQ ID NO: 1106100 - RNA, 19 nt, Homo sapiens
uguacaguguguaaagugu

SEQ ID NO: 1106101 - RNA, 20 nt, Homo sapiens
uguacaguuauacauaccuc

SEQ ID NO: 1106102 - RNA, 20 nt, Homo sapiens
uguacauguguagccugugc

SEQ ID NO: 1106103 - RNA, 14 nt, Homo sapiens
uguaccaguguacu

SEQ ID NO: 1106104 - RNA, 19 nt, Homo sapiens
uguacuauguuaauaacuu

SEQ ID NO: 1106105 - RNA, 20 nt, Homo sapiens
uguagaaugauuucaugcua

SEQ ID NO: 1106106 - RNA, 16 nt, Homo sapiens
uguagagcuucuggca

SEQ ID NO: 1106107 - RNA, 22 nt, Homo sapiens
uguagcauuucuugauguugcu

SEQ ID NO: 1106108 - RNA, 14 nt, Homo sapiens
uguagccccaguga

SEQ ID NO: 1106109 - RNA, 20 nt, Homo sapiens
uguagccucgccgucuguga

SEQ ID NO: 1106110 - RNA, 22 nt, Homo sapiens
uguagccucgccgucugugaau

SEQ ID NO: 1106111 - RNA, 15 nt, Homo sapiens
uguagcucuguccac

SEQ ID NO: 1106112 - RNA, 21 nt, Homo sapiens
uguauacagauucuagccaaa

SEQ ID NO: 1106113 - RNA, 18 nt, Homo sapiens
uguaucaaaaucacuauc

SEQ ID NO: 1106114 - RNA, 13 nt, Homo sapiens
uguaucagaguug

SEQ ID NO: 1106115 - RNA, 19 nt, Homo sapiens
uguaucccaacuccuauaa

SEQ ID NO: 1106116 - RNA, 18 nt, Homo sapiens
uguaucggagacagugau

SEQ ID NO: 1106117 - RNA, 13 nt, Homo sapiens
uguaucuaugcau

SEQ ID NO: 1106118 - RNA, 14 nt, Homo sapiens
uguauuuguuccca

SEQ ID NO: 1106119 - RNA, 17 nt, Homo sapiens
ugucaaguauaaaguca

SEQ ID NO: 1106120 - RNA, 14 nt, Homo sapiens
ugucacaccugaaa

SEQ ID NO: 1106121 - RNA, 22 nt, Homo sapiens
ugucacuacucacagucucuuu

SEQ ID NO: 1106122 - RNA, 21 nt, Homo sapiens
ugucagaaaccaguuauguga

SEQ ID NO: 1106123 - RNA, 13 nt, Homo sapiens
ugucagaguagaa

SEQ ID NO: 1106124 - RNA, 12 nt, Homo sapiens
ugucagugcucg

SEQ ID NO: 1106125 - RNA, 21 nt, Homo sapiens
ugucauauggaagaguuaaaa

SEQ ID NO: 1106126 - RNA, 17 nt, Homo sapiens
uguccaugccuacagau

SEQ ID NO: 1106127 - RNA, 20 nt, Homo sapiens
uguccaugccuacagauaau

SEQ ID NO: 1106128 - RNA, 22 nt, Homo sapiens
ugucccaacucgaugggcacag

SEQ ID NO: 1106129 - RNA, 23 nt, Homo sapiens
ugucccucaaaugacccaaagac

SEQ ID NO: 1106130 - RNA, 17 nt, Homo sapiens
ugucccucacugccuuc

SEQ ID NO: 1106131 - RNA, 16 nt, Homo sapiens
uguccucuugcucaaa

SEQ ID NO: 1106132 - RNA, 21 nt, Homo sapiens
uguccuuuuggcacugagaua

SEQ ID NO: 1106133 - RNA, 17 nt, Homo sapiens
ugucgauuucaccaaga

SEQ ID NO: 1106134 - RNA, 13 nt, Homo sapiens
ugucguagccaag

SEQ ID NO: 1106135 - RNA, 15 nt, Homo sapiens
ugucuauaauggaaa

SEQ ID NO: 1106136 - RNA, 16 nt, Homo sapiens
ugucuauguauguuau

SEQ ID NO: 1106137 - RNA, 13 nt, Homo sapiens
ugucucugagaac

SEQ ID NO: 1106138 - RNA, 16 nt, Homo sapiens
ugucucugcucuugcc

SEQ ID NO: 1106139 - RNA, 18 nt, Homo sapiens
ugucucuuuaaugucaca

SEQ ID NO: 1106140 - RNA, 18 nt, Homo sapiens
ugucuggaaaagcacuuu

SEQ ID NO: 1106141 - RNA, 10 nt, Homo sapiens
ugucuguccu

SEQ ID NO: 1106142 - RNA, 13 nt, Homo sapiens
ugucuuagcugua

SEQ ID NO: 1106143 - RNA, 17 nt, Homo sapiens
ugucuuagcuguauaca

SEQ ID NO: 1106144 - RNA, 22 nt, Homo sapiens
ugucuuugacuugguuaaagga

SEQ ID NO: 1106145 - RNA, 16 nt, Homo sapiens
ugugaaagaaccaaaa

SEQ ID NO: 1106146 - RNA, 23 nt, Homo sapiens
ugugaaauucaaccugugucuua

SEQ ID NO: 1106147 - RNA, 20 nt, Homo sapiens
ugugaauaaaaacccuguau

SEQ ID NO: 1106148 - RNA, 22 nt, Homo sapiens
ugugaauaaaaacccuguaugg

SEQ ID NO: 1106149 - RNA, 13 nt, Homo sapiens
ugugacacauaug

SEQ ID NO: 1106150 - RNA, 15 nt, Homo sapiens
ugugacacauaugca

SEQ ID NO: 1106151 - RNA, 20 nt, Homo sapiens
ugugacuuuuucagaguugc

SEQ ID NO: 1106152 - RNA, 19 nt, Homo sapiens
ugugauauuuuuacuugca

SEQ ID NO: 1106153 - RNA, 23 nt, Homo sapiens
ugugcaccccuccccauucacag

SEQ ID NO: 1106154 - RNA, 21 nt, Homo sapiens
ugugcaguguugacaguucau

SEQ ID NO: 1106155 - RNA, 18 nt, Homo sapiens
ugugcaguuaauacuuaa

SEQ ID NO: 1106156 - RNA, 19 nt, Homo sapiens
ugugcaguuaauacuuaac

SEQ ID NO: 1106157 - RNA, 17 nt, Homo sapiens
ugugccccuguaaauag

SEQ ID NO: 1106158 - RNA, 15 nt, Homo sapiens
ugugccucagccucc

SEQ ID NO: 1106159 - RNA, 12 nt, Homo sapiens
ugugccuggaaa

SEQ ID NO: 1106160 - RNA, 14 nt, Homo sapiens
uuacauucaucuca

SEQ ID NO: 1106161 - RNA, 22 nt, Homo sapiens
uuacauuuccaaaugaaugacc

SEQ ID NO: 1106162 - RNA, 21 nt, Homo sapiens
uuaccaggcaccaaaagaagu

SEQ ID NO: 1106163 - RNA, 15 nt, Homo sapiens
uuaccucacagugau

SEQ ID NO: 1106164 - RNA, 17 nt, Homo sapiens
uuaccuuggucaugcuu

SEQ ID NO: 1106165 - RNA, 12 nt, Homo sapiens
uuacgugcaaua

SEQ ID NO: 1106166 - RNA, 13 nt, Homo sapiens
uuacuaaacauuu

SEQ ID NO: 1106167 - RNA, 18 nt, Homo sapiens
uuacuaaagucacauaua

SEQ ID NO: 1106168 - RNA, 12 nt, Homo sapiens
uuacuacaugca

SEQ ID NO: 1106169 - RNA, 17 nt, Homo sapiens
uuacuaugaucucagga

SEQ ID NO: 1106170 - RNA, 23 nt, Homo sapiens
uuacucaaggaauuugcauuuag

SEQ ID NO: 1106171 - RNA, 12 nt, Homo sapiens
uuacuccagugg

SEQ ID NO: 1106172 - RNA, 12 nt, Homo sapiens
uuacugaaguua

SEQ ID NO: 1106173 - RNA, 15 nt, Homo sapiens
uuacuucacuuuaau

SEQ ID NO: 1106174 - RNA, 16 nt, Homo sapiens
uuacuugcauugaaua

SEQ ID NO: 1106175 - RNA, 16 nt, Homo sapiens
uuacuuuauguuacua

SEQ ID NO: 1106176 - RNA, 22 nt, Homo sapiens
uuagauaaucgagucuaccucu

SEQ ID NO: 1106177 - RNA, 17 nt, Homo sapiens
uuagauuagcucuggac

SEQ ID NO: 1106178 - RNA, 17 nt, Homo sapiens
uuagcaauugacuguca

SEQ ID NO: 1106179 - RNA, 16 nt, Homo sapiens
uuagcaggguacauau

SEQ ID NO: 1106180 - RNA, 13 nt, Homo sapiens
uuagcuaccucac

SEQ ID NO: 1106181 - RNA, 22 nt, Homo sapiens
uuagcucuguucuuuauaacaa

SEQ ID NO: 1106182 - RNA, 16 nt, Homo sapiens
uuagcugaacaaugaa

SEQ ID NO: 1106183 - RNA, 15 nt, Homo sapiens
uuagcugucugcuca

SEQ ID NO: 1106184 - RNA, 16 nt, Homo sapiens
uuagguuuuguacaau

SEQ ID NO: 1106185 - RNA, 15 nt, Homo sapiens
uuaguaucucaucaa

SEQ ID NO: 1106186 - RNA, 19 nt, Homo sapiens
uuauaaaaauacaacuaga

SEQ ID NO: 1106187 - RNA, 23 nt, Homo sapiens
uuauaagagugccguaacaacug

SEQ ID NO: 1106188 - RNA, 14 nt, Homo sapiens
uuauaagcauguau

SEQ ID NO: 1106189 - RNA, 16 nt, Homo sapiens
uuauaauaauguucuc

SEQ ID NO: 1106190 - RNA, 19 nt, Homo sapiens
uuauaauaauguucucugg

SEQ ID NO: 1106191 - RNA, 12 nt, Homo sapiens
uuauaaucuuuu

SEQ ID NO: 1106192 - RNA, 12 nt, Homo sapiens
uuauacauauca

SEQ ID NO: 1106193 - RNA, 13 nt, Homo sapiens
uuauacauaucag

SEQ ID NO: 1106194 - RNA, 21 nt, Homo sapiens
uuauagcaauguaacauuaau

SEQ ID NO: 1106195 - RNA, 14 nt, Homo sapiens
uuauagguuuccac

SEQ ID NO: 1106196 - RNA, 15 nt, Homo sapiens
uuauagguuuccacu

SEQ ID NO: 1106197 - RNA, 14 nt, Homo sapiens
uuauauaauuuugc

SEQ ID NO: 1106198 - RNA, 21 nt, Homo sapiens
uuauauaauuuugcagcagaa

SEQ ID NO: 1106199 - RNA, 19 nt, Homo sapiens
uuauauauuuauaacucau

SEQ ID NO: 1106200 - RNA, 16 nt, Homo sapiens
uuaucagugauggucu

SEQ ID NO: 1106201 - RNA, 18 nt, Homo sapiens
uuaucgggagcagugucu

SEQ ID NO: 1106202 - RNA, 17 nt, Homo sapiens
uuaucuguguugucucu

SEQ ID NO: 1106203 - RNA, 15 nt, Homo sapiens
uuaugaggcuauuaa

SEQ ID NO: 1106204 - RNA, 11 nt, Homo sapiens
uuaugcugcug

SEQ ID NO: 1106205 - RNA, 11 nt, Homo sapiens
uuaugugacaa

SEQ ID NO: 1106206 - RNA, 12 nt, Homo sapiens
uuaugugacaac

SEQ ID NO: 1106207 - RNA, 13 nt, Homo sapiens
uuauuaaaaacug

SEQ ID NO: 1106208 - RNA, 15 nt, Homo sapiens
uuauuaccucugaua

SEQ ID NO: 1106209 - RNA, 17 nt, Homo sapiens
uuauucauuagcuguga

SEQ ID NO: 1106210 - RNA, 15 nt, Homo sapiens
uuauucccuuucaca

SEQ ID NO: 1106211 - RNA, 14 nt, Homo sapiens
uuauuguaccucuc

SEQ ID NO: 1106212 - RNA, 16 nt, Homo sapiens
uuauugugaucuauca

SEQ ID NO: 1106213 - RNA, 16 nt, Homo sapiens
uuauuguugcauuaaa

SEQ ID NO: 1106214 - RNA, 11 nt, Homo sapiens
uuauuuccaca

SEQ ID NO: 1106215 - RNA, 19 nt, Homo sapiens
uuauuuuuauaucagccug

SEQ ID NO: 1106216 - RNA, 17 nt, Homo sapiens
uuauuuuuuuacuuccu

SEQ ID NO: 1106217 - RNA, 17 nt, Homo sapiens
uucaaacugcaugauuc

SEQ ID NO: 1106218 - RNA, 19 nt, Homo sapiens
uucaaacugcaugauucau

SEQ ID NO: 1106219 - RNA, 18 nt, Homo sapiens
uucaaagaagucauggcc

SEQ ID NO: 1106220 - RNA, 15 nt, Homo sapiens
uucaaccacuguaaa

SEQ ID NO: 1106221 - RNA, 11 nt, Homo sapiens
uucaacuggag

SEQ ID NO: 1106222 - RNA, 16 nt, Homo sapiens
uucaaguuaaagugaa

SEQ ID NO: 1106223 - RNA, 12 nt, Homo sapiens
uucaauacucau

SEQ ID NO: 1106224 - RNA, 12 nt, Homo sapiens
uucaauacuuca

SEQ ID NO: 1106225 - RNA, 20 nt, Homo sapiens
uucacauaaacacauacauu

SEQ ID NO: 1106226 - RNA, 19 nt, Homo sapiens
uucacauacacucaaacaa

SEQ ID NO: 1106227 - RNA, 22 nt, Homo sapiens
uucaccaaaucuugguugaugc

SEQ ID NO: 1106228 - RNA, 17 nt, Homo sapiens
uucaccacaugugcaca

SEQ ID NO: 1106229 - RNA, 20 nt, Homo sapiens
uucaccuuccagugucucgg

SEQ ID NO: 1106230 - RNA, 12 nt, Homo sapiens
uucacuacauua

SEQ ID NO: 1106231 - RNA, 15 nt, Homo sapiens
uucacugcacaagau

SEQ ID NO: 1106232 - RNA, 14 nt, Homo sapiens
uucacuuauugacu

SEQ ID NO: 1106233 - RNA, 14 nt, Homo sapiens
uucacuuuacaaau

SEQ ID NO: 1106234 - RNA, 17 nt, Homo sapiens
uucagaacauccuccaa

SEQ ID NO: 1106235 - RNA, 15 nt, Homo sapiens
uucagagaagucagu

SEQ ID NO: 1106236 - RNA, 23 nt, Homo sapiens
uucagaguugcuuuaaaguaccu

SEQ ID NO: 1106237 - RNA, 18 nt, Homo sapiens
uucagcgaacaugccuga

SEQ ID NO: 1106238 - RNA, 19 nt, Homo sapiens
uucagcgagacccuugcau

SEQ ID NO: 1106239 - RNA, 16 nt, Homo sapiens
uucagcucuguuuuac

SEQ ID NO: 1106240 - RNA, 17 nt, Homo sapiens
uucaggaagaugaaaga

SEQ ID NO: 1106241 - RNA, 21 nt, Homo sapiens
uucaggaagguacaaacacaa

SEQ ID NO: 1106242 - RNA, 18 nt, Homo sapiens
uucaggagcugaagccca

SEQ ID NO: 1106243 - RNA, 22 nt, Homo sapiens
uucaguugacaaaauauauaau

SEQ ID NO: 1106244 - RNA, 16 nt, Homo sapiens
uucauacccuguuacc

SEQ ID NO: 1106245 - RNA, 23 nt, Homo sapiens
uucaucaauuuuuauacauauca

SEQ ID NO: 1106246 - RNA, 14 nt, Homo sapiens
uugaaccuaaacau

SEQ ID NO: 1106247 - RNA, 15 nt, Homo sapiens
uugaacuacuuggga

SEQ ID NO: 1106248 - RNA, 14 nt, Homo sapiens
uugaagaaaagcac

SEQ ID NO: 1106249 - RNA, 21 nt, Homo sapiens
uugaauaaagccugcuuuuua

SEQ ID NO: 1106250 - RNA, 18 nt, Homo sapiens
uugaauagaaaaaguaau

SEQ ID NO: 1106251 - RNA, 12 nt, Homo sapiens
uugaauaucauu

SEQ ID NO: 1106252 - RNA, 17 nt, Homo sapiens
uugaaucaaagcaguua

SEQ ID NO: 1106253 - RNA, 20 nt, Homo sapiens
uugaaucuacaaaaaacaac

SEQ ID NO: 1106254 - RNA, 15 nt, Homo sapiens
uugacagaacacugu

SEQ ID NO: 1106255 - RNA, 19 nt, Homo sapiens
uugacaguucauauguacc

SEQ ID NO: 1106256 - RNA, 12 nt, Homo sapiens
uugacaucaugu

SEQ ID NO: 1106257 - RNA, 11 nt, Homo sapiens
uugaccacaga

SEQ ID NO: 1106258 - RNA, 12 nt, Homo sapiens
uugaccacagag

SEQ ID NO: 1106259 - RNA, 20 nt, Homo sapiens
uugacuauuauagaauggaa

SEQ ID NO: 1106260 - RNA, 21 nt, Homo sapiens
uugacucuuguuuucaguuuc

SEQ ID NO: 1106261 - RNA, 22 nt, Homo sapiens
uugacuggguuucucuguauag

SEQ ID NO: 1106262 - RNA, 17 nt, Homo sapiens
uugacuugacagaacac

SEQ ID NO: 1106263 - RNA, 20 nt, Homo sapiens
uugagaaagaagagaagaag

SEQ ID NO: 1106264 - RNA, 17 nt, Homo sapiens
uugagacaggaugguua

SEQ ID NO: 1106265 - RNA, 13 nt, Homo sapiens
uugagaccagccu

SEQ ID NO: 1106266 - RNA, 18 nt, Homo sapiens
uugagacuauugagauau

SEQ ID NO: 1106267 - RNA, 14 nt, Homo sapiens
uugagcuguccuau

SEQ ID NO: 1106268 - RNA, 19 nt, Homo sapiens
uugaggcggauggcuguga

SEQ ID NO: 1106269 - RNA, 15 nt, Homo sapiens
uugaguaauucuagc

SEQ ID NO: 1106270 - RNA, 22 nt, Homo sapiens
uugauacugaccuuguagcuau

SEQ ID NO: 1106271 - RNA, 23 nt, Homo sapiens
uugauauuucaauguuagccuca

SEQ ID NO: 1106272 - RNA, 20 nt, Homo sapiens
uugaucccuguuacccagag

SEQ ID NO: 1106273 - RNA, 23 nt, Homo sapiens
uugauggugcuccccuuccugcc

SEQ ID NO: 1106274 - RNA, 17 nt, Homo sapiens
uugaugugaaacauuau

SEQ ID NO: 1106275 - RNA, 14 nt, Homo sapiens
uugauuaaaacauu

SEQ ID NO: 1106276 - RNA, 16 nt, Homo sapiens
uugauuaaaacauuau

SEQ ID NO: 1106277 - RNA, 17 nt, Homo sapiens
uugauucacaaugaaau

SEQ ID NO: 1106278 - RNA, 20 nt, Homo sapiens
uugauugcguggaauugugc

SEQ ID NO: 1106279 - RNA, 19 nt, Homo sapiens
uugauuuaauaucugagaa

SEQ ID NO: 1106280 - RNA, 15 nt, Homo sapiens
uugcaagaaucauua

SEQ ID NO: 1106281 - RNA, 23 nt, Homo sapiens
uugcacagcucuccggucucucu

SEQ ID NO: 1106282 - RNA, 15 nt, Homo sapiens
uugcagcagaagcca

SEQ ID NO: 1106283 - RNA, 13 nt, Homo sapiens
uugcauaugcaua

SEQ ID NO: 1106284 - RNA, 16 nt, Homo sapiens
uugcauaugucuauau

SEQ ID NO: 1106285 - RNA, 16 nt, Homo sapiens
uugccacaacccuguu

SEQ ID NO: 1106286 - RNA, 18 nt, Homo sapiens
uugccagaugcaauacaa

SEQ ID NO: 1106287 - RNA, 21 nt, Homo sapiens
uugcccccugugcccucugga

SEQ ID NO: 1106288 - RNA, 14 nt, Homo sapiens
uugccuaaacccua

SEQ ID NO: 1106289 - RNA, 19 nt, Homo sapiens
uugcgccacugcacuccag

SEQ ID NO: 1106290 - RNA, 22 nt, Homo sapiens
uugcuaagaagcgagcacugac

SEQ ID NO: 1106291 - RNA, 13 nt, Homo sapiens
uugcucuuuggua

SEQ ID NO: 1106292 - RNA, 22 nt, Homo sapiens
uugcugccaaacacccaugccc

SEQ ID NO: 1106293 - RNA, 14 nt, Homo sapiens
uugcuggacuguca

SEQ ID NO: 1106294 - RNA, 21 nt, Homo sapiens
uugcugucauaagaaugaaua

SEQ ID NO: 1106295 - RNA, 17 nt, Homo sapiens
uuggaaaaugugcaaua

SEQ ID NO: 1106296 - RNA, 20 nt, Homo sapiens
uuggaagaggacuccuuaaa

SEQ ID NO: 1106297 - RNA, 18 nt, Homo sapiens
uuggaaguguucccugag

SEQ ID NO: 1106298 - RNA, 14 nt, Homo sapiens
uuggaauacuugaa

SEQ ID NO: 1106299 - RNA, 15 nt, Homo sapiens
uuggaaugaauucuc

SEQ ID NO: 1106300 - RNA, 12 nt, Homo sapiens
uuggaauucugg

SEQ ID NO: 1106301 - RNA, 16 nt, Homo sapiens
uuggaccauccuauuu

SEQ ID NO: 1106302 - RNA, 17 nt, Homo sapiens
uuggacccgcucuggac

SEQ ID NO: 1106303 - RNA, 17 nt, Homo sapiens
uuggacugauaaucucu

SEQ ID NO: 1106304 - RNA, 23 nt, Homo sapiens
uuggagaaggcccacugaggcag

SEQ ID NO: 1106305 - RNA, 15 nt, Homo sapiens
uuggauguggagcuc

SEQ ID NO: 1106306 - RNA, 12 nt, Homo sapiens
uuggcagugugu

SEQ ID NO: 1106307 - RNA, 18 nt, Homo sapiens
uuggcaugaaggugucau

SEQ ID NO: 1106308 - RNA, 15 nt, Homo sapiens
uuggccagugugaca

SEQ ID NO: 1106309 - RNA, 20 nt, Homo sapiens
uuggcuaucuacugagacau

SEQ ID NO: 1106310 - RNA, 14 nt, Homo sapiens
uuggcucaauccuc

SEQ ID NO: 1106311 - RNA, 16 nt, Homo sapiens
uuggcucacugcaacu

SEQ ID NO: 1106312 - RNA, 20 nt, Homo sapiens
uuggggaugagaaagguuga

SEQ ID NO: 1106313 - RNA, 13 nt, Homo sapiens
uuggggcuuuuac

SEQ ID NO: 1106314 - RNA, 19 nt, Homo sapiens
uuggucacugcuacaccuu

SEQ ID NO: 1106315 - RNA, 12 nt, Homo sapiens
uuggucucagcu

SEQ ID NO: 1106316 - RNA, 23 nt, Homo sapiens
uugguuaaaggaaguuuguucac

SEQ ID NO: 1106317 - RNA, 14 nt, Homo sapiens
uuguaauaaacucu

SEQ ID NO: 1106318 - RNA, 15 nt, Homo sapiens
uuguaauuccuuacu

SEQ ID NO: 1106319 - RNA, 18 nt, Homo sapiens
uuguacaaagauaugcua

SEQ ID NO: 1106320 - RNA, 17 nt, Homo sapiens
uuguaccagugugaaua

SEQ ID NO: 1106321 - RNA, 13 nt, Homo sapiens
uuguacucuugcu

SEQ ID NO: 1106322 - RNA, 14 nt, Homo sapiens
uuguacugacccca

SEQ ID NO: 1106323 - RNA, 21 nt, Homo sapiens
uuguagaguggcccagaauug

SEQ ID NO: 1106324 - RNA, 23 nt, Homo sapiens
uuguauauauauuuuguguauaa

SEQ ID NO: 1106325 - RNA, 21 nt, Homo sapiens
uuguauauuccaccauucaca

SEQ ID NO: 1106326 - RNA, 14 nt, Homo sapiens
uuguaucugaagac

SEQ ID NO: 1106327 - RNA, 22 nt, Homo sapiens
uuguauguuaaguuacuucacu

SEQ ID NO: 1106328 - RNA, 15 nt, Homo sapiens
uuguauugcauauau

SEQ ID NO: 1106329 - RNA, 20 nt, Homo sapiens
uugucagaauuucuuuguca

SEQ ID NO: 1106330 - RNA, 11 nt, Homo sapiens
uugucucaaga

SEQ ID NO: 1106331 - RNA, 14 nt, Homo sapiens
uugugaucauccca

SEQ ID NO: 1106332 - RNA, 13 nt, Homo sapiens
uuguguucucaaa

SEQ ID NO: 1106333 - RNA, 23 nt, Homo sapiens
uuguguuuuuuuuuuaaauagac

SEQ ID NO: 1106334 - RNA, 20 nt, Homo sapiens
uuguuacagguguacuaugg

SEQ ID NO: 1106335 - RNA, 15 nt, Homo sapiens
uuuguaccaguguga

SEQ ID NO: 1106336 - RNA, 13 nt, Homo sapiens
uuugugugauuga

SEQ ID NO: 1106337 - RNA, 20 nt, Homo sapiens
uuuguguguaccugugacua

SEQ ID NO: 1106338 - RNA, 18 nt, Homo sapiens
uuuguuauuuuuccccaa

SEQ ID NO: 1106339 - RNA, 19 nt, Homo sapiens
uuuguuuaaaaaccaaaua

SEQ ID NO: 1106340 - RNA, 15 nt, Homo sapiens
uuuuaacacauaacu

SEQ ID NO: 1106341 - RNA, 14 nt, Homo sapiens
uuuuaagacuauaa

SEQ ID NO: 1106342 - RNA, 18 nt, Homo sapiens
uuuuagcgugcucacuga

SEQ ID NO: 1106343 - RNA, 20 nt, Homo sapiens
uuuuagucuaauugaauccc

SEQ ID NO: 1106344 - RNA, 21 nt, Homo sapiens
uuuuauauauuaugucauuca

SEQ ID NO: 1106345 - RNA, 19 nt, Homo sapiens
uuuuauccacuuaccuaga

SEQ ID NO: 1106346 - RNA, 13 nt, Homo sapiens
uuuuaucugccuu

SEQ ID NO: 1106347 - RNA, 21 nt, Homo sapiens
uuuuaugccuucacuuuacaa

SEQ ID NO: 1106348 - RNA, 23 nt, Homo sapiens
uuuuauguguggcccaagacaau

SEQ ID NO: 1106349 - RNA, 22 nt, Homo sapiens
uuuuccacaagauucccagaga

SEQ ID NO: 1106350 - RNA, 19 nt, Homo sapiens
uuuucguguaucucuaugu

SEQ ID NO: 1106351 - RNA, 19 nt, Homo sapiens
uuuucuggaauacaugaaa

SEQ ID NO: 1106352 - RNA, 15 nt, Homo sapiens
uuuucugugcuuuga

SEQ ID NO: 1106353 - RNA, 18 nt, Homo sapiens
uuuucuuauuuaacuuaa

SEQ ID NO: 1106354 - RNA, 18 nt, Homo sapiens
uuuugaaaaagcgaaaaa

SEQ ID NO: 1106355 - RNA, 22 nt, Homo sapiens
uuuugcauuugaauaaagccug

SEQ ID NO: 1106356 - RNA, 19 nt, Homo sapiens
uuuuggcagcaaaguguca

SEQ ID NO: 1106357 - RNA, 13 nt, Homo sapiens
uuuuggccaaagu

SEQ ID NO: 1106358 - RNA, 19 nt, Homo sapiens
uuuuguaauaaacucucua

SEQ ID NO: 1106359 - RNA, 19 nt, Homo sapiens
uuuugucuaugggacucaa

SEQ ID NO: 1106360 - RNA, 21 nt, Homo sapiens
uuuugucugcuuaguaucuca

SEQ ID NO: 1106361 - RNA, 21 nt, Homo sapiens
uuuuuacacauguaucuaugc

SEQ ID NO: 1106362 - RNA, 17 nt, Homo sapiens
uuuuuacuccaguggug

SEQ ID NO: 1106363 - RNA, 16 nt, Homo sapiens
uuuuuaugugcaauaa

SEQ ID NO: 1106364 - RNA, 23 nt, Homo sapiens
uuuuucagaaagcauuacauuuc

SEQ ID NO: 1106365 - RNA, 14 nt, Homo sapiens
uucaacauauaccu

SEQ ID NO: 1106366 - RNA, 12 nt, Homo sapiens
uucaaccagcau

SEQ ID NO: 1106367 - RNA, 19 nt, Homo sapiens
uucaacuaguaccacagaa

SEQ ID NO: 1106368 - RNA, 16 nt, Homo sapiens
uucaagagauucuugu

SEQ ID NO: 1106369 - RNA, 18 nt, Homo sapiens
uucaagcacccuguuccc

SEQ ID NO: 1106370 - RNA, 16 nt, Homo sapiens
uucaagccuuagauaa

SEQ ID NO: 1106371 - RNA, 21 nt, Homo sapiens
uucaaggcauuucuaucacau

SEQ ID NO: 1106372 - RNA, 22 nt, Homo sapiens
uucaaguuaaagugaauaacca

SEQ ID NO: 1106373 - RNA, 14 nt, Homo sapiens
uucaaguugagaac

SEQ ID NO: 1106374 - RNA, 16 nt, Homo sapiens
uucaauacuucaugau

SEQ ID NO: 1106375 - RNA, 15 nt, Homo sapiens
uucaaugaccuguau

SEQ ID NO: 1106376 - RNA, 17 nt, Homo sapiens
uucaaugcuuccuccuu

SEQ ID NO: 1106377 - RNA, 11 nt, Homo sapiens
uucacacugca

SEQ ID NO: 1106378 - RNA, 22 nt, Homo sapiens
uucacauauauguaauuuagca

SEQ ID NO: 1106379 - RNA, 13 nt, Homo sapiens
uucacuucagagc

SEQ ID NO: 1106380 - RNA, 12 nt, Homo sapiens
uucacuuuacaa

SEQ ID NO: 1106381 - RNA, 13 nt, Homo sapiens
uucacuuuacaaa

SEQ ID NO: 1106382 - RNA, 21 nt, Homo sapiens
uucacuuuuuacagugcuauu

SEQ ID NO: 1106383 - RNA, 18 nt, Homo sapiens
uucagaagaaaaagaagc

SEQ ID NO: 1106384 - RNA, 14 nt, Homo sapiens
uucagaagacacug

SEQ ID NO: 1106385 - RNA, 17 nt, Homo sapiens
uucagaagguugcucua

SEQ ID NO: 1106386 - RNA, 17 nt, Homo sapiens
uucagacacuucaugga

SEQ ID NO: 1106387 - RNA, 13 nt, Homo sapiens
uucagagauguac

SEQ ID NO: 1106388 - RNA, 22 nt, Homo sapiens
uucagagggcguguuguuuuac

SEQ ID NO: 1106389 - RNA, 14 nt, Homo sapiens
uucagccccuccuc

SEQ ID NO: 1106390 - RNA, 20 nt, Homo sapiens
uucagcuccagcucaccagc

SEQ ID NO: 1106391 - RNA, 16 nt, Homo sapiens
uucagcuucagacuuu

SEQ ID NO: 1106392 - RNA, 14 nt, Homo sapiens
uucaguggcagcug

SEQ ID NO: 1106393 - RNA, 19 nt, Homo sapiens
uucaguugaucacuggcaa

SEQ ID NO: 1106394 - RNA, 21 nt, Homo sapiens
uucaguuggcugacuuccaca

SEQ ID NO: 1106395 - RNA, 16 nt, Homo sapiens
uucaguuguacuucca

SEQ ID NO: 1106396 - RNA, 20 nt, Homo sapiens
uucauauguaccauguacau

SEQ ID NO: 1106397 - RNA, 22 nt, Homo sapiens
uucauggugcacugagcugcaa

SEQ ID NO: 1106398 - RNA, 19 nt, Homo sapiens
uucauguaauaaaucugag

SEQ ID NO: 1106399 - RNA, 14 nt, Homo sapiens
uucaugucacugcu

SEQ ID NO: 1106400 - RNA, 14 nt, Homo sapiens
uucauguuacucau

SEQ ID NO: 1106401 - RNA, 18 nt, Homo sapiens
uucauuaauacagggcau

SEQ ID NO: 1106402 - RNA, 15 nt, Homo sapiens
uucauuguguucucu

SEQ ID NO: 1106403 - RNA, 19 nt, Homo sapiens
uucauuucagauaaacaac

SEQ ID NO: 1106404 - RNA, 20 nt, Homo sapiens
uucauuuuaacaucugagaa

SEQ ID NO: 1106405 - RNA, 14 nt, Homo sapiens
uuccaaaugaauga

SEQ ID NO: 1106406 - RNA, 13 nt, Homo sapiens
uuccagacugcuu

SEQ ID NO: 1106407 - RNA, 21 nt, Homo sapiens
uuccaucugauugugauguga

SEQ ID NO: 1106408 - RNA, 16 nt, Homo sapiens
uucccaaacuugacag

SEQ ID NO: 1106409 - RNA, 14 nt, Homo sapiens
uucccaauacauac

SEQ ID NO: 1106410 - RNA, 14 nt, Homo sapiens
uuccccuccugacc

SEQ ID NO: 1106411 - RNA, 21 nt, Homo sapiens
uuccccuugcccagggcucag

SEQ ID NO: 1106412 - RNA, 20 nt, Homo sapiens
uucccugaaaacccagagag

SEQ ID NO: 1106413 - RNA, 18 nt, Homo sapiens
uucccuuggauguagucu

SEQ ID NO: 1106414 - RNA, 20 nt, Homo sapiens
uuccuaauaaguuugaucaa

SEQ ID NO: 1106415 - RNA, 13 nt, Homo sapiens
uuccuaaugauua

SEQ ID NO: 1106416 - RNA, 12 nt, Homo sapiens
uuccucaccaau

SEQ ID NO: 1106417 - RNA, 16 nt, Homo sapiens
uuccucagaucaucca

SEQ ID NO: 1106418 - RNA, 20 nt, Homo sapiens
uuccucagggacagagacac

SEQ ID NO: 1106419 - RNA, 15 nt, Homo sapiens
uuccugaaugaaaua

SEQ ID NO: 1106420 - RNA, 16 nt, Homo sapiens
uuccuugauucacaau

SEQ ID NO: 1106421 - RNA, 20 nt, Homo sapiens
uucgaaaccuguccauaaag

SEQ ID NO: 1106422 - RNA, 20 nt, Homo sapiens
uucgacccuuucucugagag

SEQ ID NO: 1106423 - RNA, 20 nt, Homo sapiens
uucgagaccagccuggccaa

SEQ ID NO: 1106424 - RNA, 21 nt, Homo sapiens
uucgaggcgguuuccaggaag

SEQ ID NO: 1106425 - RNA, 17 nt, Homo sapiens
uuaaacaccugacacau

SEQ ID NO: 1106426 - RNA, 13 nt, Homo sapiens
uuaaacaugagaa

SEQ ID NO: 1106427 - RNA, 18 nt, Homo sapiens
uuaaacuauaagcaagaa

SEQ ID NO: 1106428 - RNA, 18 nt, Homo sapiens
uuaaacuuaccugggcau

SEQ ID NO: 1106429 - RNA, 20 nt, Homo sapiens
uuaaagaaaaaaaaagucag

SEQ ID NO: 1106430 - RNA, 16 nt, Homo sapiens
uuaaaggcuuuuggca

SEQ ID NO: 1106431 - RNA, 13 nt, Homo sapiens
uuaaaguaccugu

SEQ ID NO: 1106432 - RNA, 22 nt, Homo sapiens
uuaaaucacagauggguauuaa

SEQ ID NO: 1106433 - RNA, 18 nt, Homo sapiens
uuaaaugcauguccucaa

SEQ ID NO: 1106434 - RNA, 14 nt, Homo sapiens
uuaaauggcuuuau

SEQ ID NO: 1106435 - RNA, 11 nt, Homo sapiens
uuaaauugcag

SEQ ID NO: 1106436 - RNA, 16 nt, Homo sapiens
uuaagaaccugaauau

SEQ ID NO: 1106437 - RNA, 17 nt, Homo sapiens
uuaagagauacauuccc

SEQ ID NO: 1106438 - RNA, 20 nt, Homo sapiens
uuaagaggcagggucucacu

SEQ ID NO: 1106439 - RNA, 15 nt, Homo sapiens
uuaagaguuacuuaa

SEQ ID NO: 1106440 - RNA, 19 nt, Homo sapiens
uuaagaguuguaugaacau

SEQ ID NO: 1106441 - RNA, 22 nt, Homo sapiens
uuaagcugggauaaucacauua

SEQ ID NO: 1106442 - RNA, 17 nt, Homo sapiens
uuaagcuuaugucagac

SEQ ID NO: 1106443 - RNA, 17 nt, Homo sapiens
uuaagguagaaccucac

SEQ ID NO: 1106444 - RNA, 20 nt, Homo sapiens
uuaagucauccacagcccaa

SEQ ID NO: 1106445 - RNA, 19 nt, Homo sapiens
uuaagucucugacucuugc

SEQ ID NO: 1106446 - RNA, 12 nt, Homo sapiens
uuaagugccuuu

SEQ ID NO: 1106447 - RNA, 15 nt, Homo sapiens
uuaaguuuaucuuuc

SEQ ID NO: 1106448 - RNA, 13 nt, Homo sapiens
uuaauacaaagaa

SEQ ID NO: 1106449 - RNA, 20 nt, Homo sapiens
uuaauacagggcauuuuggu

SEQ ID NO: 1106450 - RNA, 21 nt, Homo sapiens
uuaauaguuuugauccuaaau

SEQ ID NO: 1106451 - RNA, 17 nt, Homo sapiens
uuaaugaacugugacag

SEQ ID NO: 1106452 - RNA, 22 nt, Homo sapiens
uuaaugaagacccaguguaaag

SEQ ID NO: 1106453 - RNA, 15 nt, Homo sapiens
uuaauggugccuuca

SEQ ID NO: 1106454 - RNA, 18 nt, Homo sapiens
uuaauuagauuuucuugc

SEQ ID NO: 1106455 - RNA, 17 nt, Homo sapiens
uuaauuuucaguauaau

SEQ ID NO: 1106456 - RNA, 13 nt, Homo sapiens
uuaauuuuugcaa

SEQ ID NO: 1106457 - RNA, 20 nt, Homo sapiens
uuacaauaauucuaugagau

SEQ ID NO: 1106458 - RNA, 15 nt, Homo sapiens
uuacaaugcagaauu

SEQ ID NO: 1106459 - RNA, 12 nt, Homo sapiens
uuacacaugaca

SEQ ID NO: 1106460 - RNA, 22 nt, Homo sapiens
uuacacauguaucuaugcauuu

SEQ ID NO: 1106461 - RNA, 15 nt, Homo sapiens
uuacacguaccucuc

SEQ ID NO: 1106462 - RNA, 11 nt, Homo sapiens
uuacagcugcc

SEQ ID NO: 1106463 - RNA, 22 nt, Homo sapiens
uuacagguguacuauggcugua

SEQ ID NO: 1106464 - RNA, 22 nt, Homo sapiens
uuacagugacugucguguuuac

SEQ ID NO: 1106465 - RNA, 15 nt, Homo sapiens
uuacaugauucauuu

SEQ ID NO: 1106466 - RNA, 15 nt, Homo sapiens
uuacauuuccaaaug

SEQ ID NO: 1106467 - RNA, 12 nt, Homo sapiens
uuacccauauau

SEQ ID NO: 1106468 - RNA, 14 nt, Homo sapiens
uuaccuccuaucag

SEQ ID NO: 1106469 - RNA, 13 nt, Homo sapiens
uuacgugagccag

SEQ ID NO: 1106470 - RNA, 15 nt, Homo sapiens
uuacuacaugcacuu

SEQ ID NO: 1106471 - RNA, 20 nt, Homo sapiens
uuacuacuauucuguuaaaa

SEQ ID NO: 1106472 - RNA, 17 nt, Homo sapiens
uuacuuaccuaaacaga

SEQ ID NO: 1106473 - RNA, 16 nt, Homo sapiens
uuacuucccuaaugaa

SEQ ID NO: 1106474 - RNA, 16 nt, Homo sapiens
uuacuuuguguucacc

SEQ ID NO: 1106475 - RNA, 13 nt, Homo sapiens
uuagacagaugac

SEQ ID NO: 1106476 - RNA, 14 nt, Homo sapiens
uuagagacaucaaa

SEQ ID NO: 1106477 - RNA, 18 nt, Homo sapiens
uuagcacuauuuacauac

SEQ ID NO: 1106478 - RNA, 15 nt, Homo sapiens
uuagcagcucuuccc

SEQ ID NO: 1106479 - RNA, 12 nt, Homo sapiens
uuagcuuuacaa

SEQ ID NO: 1106480 - RNA, 13 nt, Homo sapiens
uuagguagcuuua

SEQ ID NO: 1106481 - RNA, 18 nt, Homo sapiens
uuaggugugccaaacuac

SEQ ID NO: 1106482 - RNA, 12 nt, Homo sapiens
uuaguaauuucu

SEQ ID NO: 1106483 - RNA, 19 nt, Homo sapiens
uuaguacacagcaccagaa

SEQ ID NO: 1106484 - RNA, 20 nt, Homo sapiens
uuaguacacagcaccagaau

SEQ ID NO: 1106485 - RNA, 19 nt, Homo sapiens
uguuccuugucacugguag

SEQ ID NO: 1106486 - RNA, 18 nt, Homo sapiens
uguucucaaaugcuaaau

SEQ ID NO: 1106487 - RNA, 20 nt, Homo sapiens
uguucuggccucagaccaac

SEQ ID NO: 1106488 - RNA, 19 nt, Homo sapiens
uguucuugcagucaucaga

SEQ ID NO: 1106489 - RNA, 12 nt, Homo sapiens
uguugaucccaa

SEQ ID NO: 1106490 - RNA, 18 nt, Homo sapiens
uguugccuggaagcacau

SEQ ID NO: 1106491 - RNA, 17 nt, Homo sapiens
uguuggaaaaugugcaa

SEQ ID NO: 1106492 - RNA, 18 nt, Homo sapiens
uguuggaaaaugugcaau

SEQ ID NO: 1106493 - RNA, 19 nt, Homo sapiens
uguuggaaaaugugcaaua

SEQ ID NO: 1106494 - RNA, 21 nt, Homo sapiens
uguuggaaaggaccuuaccug

SEQ ID NO: 1106495 - RNA, 20 nt, Homo sapiens
uguuggccaaagccaaagcu

SEQ ID NO: 1106496 - RNA, 16 nt, Homo sapiens
uguuggggcaguggua

SEQ ID NO: 1106497 - RNA, 21 nt, Homo sapiens
uguuuacuucucaccauuuga

SEQ ID NO: 1106498 - RNA, 17 nt, Homo sapiens
uguuucccgcuccaaga

SEQ ID NO: 1106499 - RNA, 14 nt, Homo sapiens
uguuucccguauug

SEQ ID NO: 1106500 - RNA, 17 nt, Homo sapiens
uguuugagcgcagagua

SEQ ID NO: 1106501 - RNA, 17 nt, Homo sapiens
uguuugucagauaugau

SEQ ID NO: 1106502 - RNA, 20 nt, Homo sapiens
uguuugugaaacaaaaaagu

SEQ ID NO: 1106503 - RNA, 13 nt, Homo sapiens
uguuuuagcuccu

SEQ ID NO: 1106504 - RNA, 17 nt, Homo sapiens
uguuuuagcuccuugac

SEQ ID NO: 1106505 - RNA, 13 nt, Homo sapiens
uguuuuaucauua

SEQ ID NO: 1106506 - RNA, 12 nt, Homo sapiens
uguuuucaccuc

SEQ ID NO: 1106507 - RNA, 17 nt, Homo sapiens
uguuuugcccaccagau

SEQ ID NO: 1106508 - RNA, 20 nt, Homo sapiens
uuaaaaaaaguauauauucu

SEQ ID NO: 1106509 - RNA, 23 nt, Homo sapiens
uuaaaaacuaaaaagccaucuga

SEQ ID NO: 1106510 - RNA, 17 nt, Homo sapiens
uuaaaaaugaaagccaa

SEQ ID NO: 1106511 - RNA, 23 nt, Homo sapiens
uuaaaauauuuuuaugugcaaua

SEQ ID NO: 1106512 - RNA, 21 nt, Homo sapiens
uuaaaaucauucaauaucuga

SEQ ID NO: 1106513 - RNA, 21 nt, Homo sapiens
uuaaaaucuggcaaaguuaua

SEQ ID NO: 1106514 - RNA, 16 nt, Homo sapiens
uuaaaauuagugagau

SEQ ID NO: 1106515 - RNA, 12 nt, Homo sapiens
ucuggccucaga

SEQ ID NO: 1106516 - RNA, 16 nt, Homo sapiens
ucugggaagauuucua

SEQ ID NO: 1106517 - RNA, 15 nt, Homo sapiens
ucuggggacaccagc

SEQ ID NO: 1106518 - RNA, 23 nt, Homo sapiens
ucugggucuuucugacaucagca

SEQ ID NO: 1106519 - RNA, 14 nt, Homo sapiens
ucuggucuguccac

SEQ ID NO: 1106520 - RNA, 17 nt, Homo sapiens
ucuggugcuuucuguca

SEQ ID NO: 1106521 - RNA, 14 nt, Homo sapiens
ucuguaaggaacug

SEQ ID NO: 1106522 - RNA, 17 nt, Homo sapiens
ucugucauccagaaaau

SEQ ID NO: 1106523 - RNA, 15 nt, Homo sapiens
ucuguccaaggcaca

SEQ ID NO: 1106524 - RNA, 22 nt, Homo sapiens
ucuguccacucugaauaccaag

SEQ ID NO: 1106525 - RNA, 13 nt, Homo sapiens
ucugucuggcuga

SEQ ID NO: 1106526 - RNA, 17 nt, Homo sapiens
ucugugaagaaugaagu

SEQ ID NO: 1106527 - RNA, 17 nt, Homo sapiens
ucugugcuuugacucac

SEQ ID NO: 1106528 - RNA, 13 nt, Homo sapiens
ucuguguaaccuc

SEQ ID NO: 1106529 - RNA, 14 nt, Homo sapiens
ucuguuaaaaucag

SEQ ID NO: 1106530 - RNA, 17 nt, Homo sapiens
ucuguuggccaguguga

SEQ ID NO: 1106531 - RNA, 16 nt, Homo sapiens
ucuuaaaauaacuuau

SEQ ID NO: 1106532 - RNA, 16 nt, Homo sapiens
ucuuaacuauucaaug

SEQ ID NO: 1106533 - RNA, 15 nt, Homo sapiens
ucuuaauaggcuuua

SEQ ID NO: 1106534 - RNA, 16 nt, Homo sapiens
ucuuaauaggcuuuau

SEQ ID NO: 1106535 - RNA, 13 nt, Homo sapiens
ucuuaaugcuuuc

SEQ ID NO: 1106536 - RNA, 19 nt, Homo sapiens
ucuuacaauaauucuauga

SEQ ID NO: 1106537 - RNA, 11 nt, Homo sapiens
ucuuagcuguc

SEQ ID NO: 1106538 - RNA, 16 nt, Homo sapiens
ucuuagcugucugcuc

SEQ ID NO: 1106539 - RNA, 17 nt, Homo sapiens
ucuuagcugucugcuca

SEQ ID NO: 1106540 - RNA, 17 nt, Homo sapiens
ucuuauagaaaguucaa

SEQ ID NO: 1106541 - RNA, 17 nt, Homo sapiens
ucuuauauaguauucau

SEQ ID NO: 1106542 - RNA, 15 nt, Homo sapiens
ucuuauguuugcuuu

SEQ ID NO: 1106543 - RNA, 14 nt, Homo sapiens
ucuuauuugcaaua

SEQ ID NO: 1106544 - RNA, 21 nt, Homo sapiens
ucuucaacccccugacauuau

SEQ ID NO: 1106545 - RNA, 11 nt, Homo sapiens
ucuucauggcc

SEQ ID NO: 1106546 - RNA, 15 nt, Homo sapiens
ucuuccagaaggcaa

SEQ ID NO: 1106547 - RNA, 18 nt, Homo sapiens
ucuucccgggaucacuua

SEQ ID NO: 1106548 - RNA, 23 nt, Homo sapiens
ucuucccuguaugauuccuugau

SEQ ID NO: 1106549 - RNA, 16 nt, Homo sapiens
ucuuccuaguauauua

SEQ ID NO: 1106550 - RNA, 21 nt, Homo sapiens
ucuuccucccucauuccaccu

SEQ ID NO: 1106551 - RNA, 15 nt, Homo sapiens
ucuucgcugcuagag

SEQ ID NO: 1106552 - RNA, 16 nt, Homo sapiens
ucuucuacaaccagag

SEQ ID NO: 1106553 - RNA, 18 nt, Homo sapiens
ucuucugaauugacugua

SEQ ID NO: 1106554 - RNA, 19 nt, Homo sapiens
ucuucuuuuuuugugaugu

SEQ ID NO: 1106555 - RNA, 13 nt, Homo sapiens
ucuugaaagcugu

SEQ ID NO: 1106556 - RNA, 20 nt, Homo sapiens
ucuugaaccccuggccucaa

SEQ ID NO: 1106557 - RNA, 17 nt, Homo sapiens
ucuugacauucaaggca

SEQ ID NO: 1106558 - RNA, 16 nt, Homo sapiens
ucuuggaauacuugaa

SEQ ID NO: 1106559 - RNA, 21 nt, Homo sapiens
ucuuggagcgagcagaugcaa

SEQ ID NO: 1106560 - RNA, 15 nt, Homo sapiens
ucuugguacuacuag

SEQ ID NO: 1106561 - RNA, 17 nt, Homo sapiens
ucuugucucacaugcua

SEQ ID NO: 1106562 - RNA, 22 nt, Homo sapiens
ucuuguuguggaggcugaaaag

SEQ ID NO: 1106563 - RNA, 12 nt, Homo sapiens
ucuuuaccugag

SEQ ID NO: 1106564 - RNA, 14 nt, Homo sapiens
ucuuuaugacuguu

SEQ ID NO: 1106565 - RNA, 14 nt, Homo sapiens
ucuuucagcacuca

SEQ ID NO: 1106566 - RNA, 20 nt, Homo sapiens
ucuuucccuuuaucaguuug

SEQ ID NO: 1106567 - RNA, 18 nt, Homo sapiens
ucuuuccuuuugcaacaa

SEQ ID NO: 1106568 - RNA, 20 nt, Homo sapiens
ucuuucuaacuccagugaag

SEQ ID NO: 1106569 - RNA, 22 nt, Homo sapiens
ucuuucuaacuccagugaagua

SEQ ID NO: 1106570 - RNA, 14 nt, Homo sapiens
ucuuucugugcuuc

SEQ ID NO: 1106571 - RNA, 17 nt, Homo sapiens
ucuuucuuuaccugaga

SEQ ID NO: 1106572 - RNA, 20 nt, Homo sapiens
ucuuugauucaaagcacugu

SEQ ID NO: 1106573 - RNA, 20 nt, Homo sapiens
ucuuugcagacaggcaagca

SEQ ID NO: 1106574 - RNA, 12 nt, Homo sapiens
ucuuugccucaa

SEQ ID NO: 1106575 - RNA, 21 nt, Homo sapiens
ucuuuguaaugucaccaccuu

SEQ ID NO: 1106576 - RNA, 17 nt, Homo sapiens
ugaaaaacagaaagcau

SEQ ID NO: 1106577 - RNA, 21 nt, Homo sapiens
ugaaaaacuauuaacaacuug

SEQ ID NO: 1106578 - RNA, 22 nt, Homo sapiens
ugaaaaaugguaauuguugcua

SEQ ID NO: 1106579 - RNA, 22 nt, Homo sapiens
ugaaaacucacagaacuaugua

SEQ ID NO: 1106580 - RNA, 21 nt, Homo sapiens
ugaaaagcuagaauugagugu

SEQ ID NO: 1106581 - RNA, 19 nt, Homo sapiens
ugaaaagguuaacagauac

SEQ ID NO: 1106582 - RNA, 18 nt, Homo sapiens
ugaaaauaauuguuccaa

SEQ ID NO: 1106583 - RNA, 22 nt, Homo sapiens
ugaaaauaauuguuccaaauga

SEQ ID NO: 1106584 - RNA, 21 nt, Homo sapiens
ugaaaaugucagaaaccaguu

SEQ ID NO: 1106585 - RNA, 16 nt, Homo sapiens
ugaaacacacaggcca

SEQ ID NO: 1106586 - RNA, 15 nt, Homo sapiens
ugaaacuuaauuaca

SEQ ID NO: 1106587 - RNA, 20 nt, Homo sapiens
ugaaacuucauaaauguuca

SEQ ID NO: 1106588 - RNA, 19 nt, Homo sapiens
ugaaagaugcaagcaccug

SEQ ID NO: 1106589 - RNA, 11 nt, Homo sapiens
ugaaagcaauc

SEQ ID NO: 1106590 - RNA, 12 nt, Homo sapiens
ugaaagccaaau

SEQ ID NO: 1106591 - RNA, 16 nt, Homo sapiens
ugaaagugacagagac

SEQ ID NO: 1106592 - RNA, 13 nt, Homo sapiens
ugaaauaccagug

SEQ ID NO: 1106593 - RNA, 14 nt, Homo sapiens
ugaaauaccaguga

SEQ ID NO: 1106594 - RNA, 16 nt, Homo sapiens
ugaaaucagaagccua

SEQ ID NO: 1106595 - RNA, 11 nt, Homo sapiens
ugaaaugcuag

SEQ ID NO: 1106596 - RNA, 20 nt, Homo sapiens
ugaaaugucuggucugucca

SEQ ID NO: 1106597 - RNA, 21 nt, Homo sapiens
ugaaauuugacucaugaacua

SEQ ID NO: 1106598 - RNA, 16 nt, Homo sapiens
ugaaauuuuaauugaa

SEQ ID NO: 1106599 - RNA, 16 nt, Homo sapiens
ugaacaaauggccuuu

SEQ ID NO: 1106600 - RNA, 16 nt, Homo sapiens
ucagauagaaugacag

SEQ ID NO: 1106601 - RNA, 15 nt, Homo sapiens
ucagauuuguguuau

SEQ ID NO: 1106602 - RNA, 12 nt, Homo sapiens
ucagcauaccuu

SEQ ID NO: 1106603 - RNA, 18 nt, Homo sapiens
ucagccacaccugucagc

SEQ ID NO: 1106604 - RNA, 19 nt, Homo sapiens
ucagccgcuucugacugcu

SEQ ID NO: 1106605 - RNA, 22 nt, Homo sapiens
ucagccucugaucaguuucaca

SEQ ID NO: 1106606 - RNA, 20 nt, Homo sapiens
ucagccucuuaaagcugccu

SEQ ID NO: 1106607 - RNA, 17 nt, Homo sapiens
ucagccuugaaaaacaa

SEQ ID NO: 1106608 - RNA, 23 nt, Homo sapiens
ucaggagaggggcagaacagccg

SEQ ID NO: 1106609 - RNA, 17 nt, Homo sapiens
ucaggaggcugaggcag

SEQ ID NO: 1106610 - RNA, 18 nt, Homo sapiens
ucaggaguuccuaaccag

SEQ ID NO: 1106611 - RNA, 19 nt, Homo sapiens
ucaggaucaagaaaguguu

SEQ ID NO: 1106612 - RNA, 15 nt, Homo sapiens
ucagggagcauuuau

SEQ ID NO: 1106613 - RNA, 18 nt, Homo sapiens
ucaggguguuaaggcagu

SEQ ID NO: 1106614 - RNA, 14 nt, Homo sapiens
ucagguggaaaaac

SEQ ID NO: 1106615 - RNA, 18 nt, Homo sapiens
ucaguauaaaagacaaaa

SEQ ID NO: 1106616 - RNA, 20 nt, Homo sapiens
ucaguaugggaaccccaaau

SEQ ID NO: 1106617 - RNA, 19 nt, Homo sapiens
ucaguccuggucugcucag

SEQ ID NO: 1106618 - RNA, 14 nt, Homo sapiens
ucagucuuggaguu

SEQ ID NO: 1106619 - RNA, 14 nt, Homo sapiens
ucagugaaagccag

SEQ ID NO: 1106620 - RNA, 20 nt, Homo sapiens
ucagugaaagccagauucaa

SEQ ID NO: 1106621 - RNA, 19 nt, Homo sapiens
ucagugcucggcagucaua

SEQ ID NO: 1106622 - RNA, 23 nt, Homo sapiens
ucaguguaccgcgucuacccugg

SEQ ID NO: 1106623 - RNA, 13 nt, Homo sapiens
ucaguuaacauua

SEQ ID NO: 1106624 - RNA, 22 nt, Homo sapiens
ucaguuuuaucuuuaaucuccu

SEQ ID NO: 1106625 - RNA, 16 nt, Homo sapiens
ucauaauccagagaua

SEQ ID NO: 1106626 - RNA, 15 nt, Homo sapiens
ucauaauuagaacaa

SEQ ID NO: 1106627 - RNA, 14 nt, Homo sapiens
ucauacaugacuca

SEQ ID NO: 1106628 - RNA, 16 nt, Homo sapiens
ucauaccaucugcugc

SEQ ID NO: 1106629 - RNA, 14 nt, Homo sapiens
ucauagcugagauu

SEQ ID NO: 1106630 - RNA, 15 nt, Homo sapiens
ucauagggucucuuc

SEQ ID NO: 1106631 - RNA, 21 nt, Homo sapiens
ucaucaacaaagaaauauuau

SEQ ID NO: 1106632 - RNA, 23 nt, Homo sapiens
ucaucagcuaucguuaguguauu

SEQ ID NO: 1106633 - RNA, 17 nt, Homo sapiens
ucaucauacaugacuca

SEQ ID NO: 1106634 - RNA, 23 nt, Homo sapiens
ucaucccaucuaagcugcagcuu

SEQ ID NO: 1106635 - RNA, 16 nt, Homo sapiens
ucaucuauaacaugca

SEQ ID NO: 1106636 - RNA, 17 nt, Homo sapiens
ucaucuauaacaugcau

SEQ ID NO: 1106637 - RNA, 14 nt, Homo sapiens
ucaucucauuccaa

SEQ ID NO: 1106638 - RNA, 16 nt, Homo sapiens
ucaucucucaucacuu

SEQ ID NO: 1106639 - RNA, 22 nt, Homo sapiens
ucaugaacacagccugggacca

SEQ ID NO: 1106640 - RNA, 17 nt, Homo sapiens
ucaugaagcccaaguga

SEQ ID NO: 1106641 - RNA, 23 nt, Homo sapiens
ucaugcucagcccugacuggugc

SEQ ID NO: 1106642 - RNA, 17 nt, Homo sapiens
ucauggaaacuggccag

SEQ ID NO: 1106643 - RNA, 22 nt, Homo sapiens
ucauguauauguguucauuaaa

SEQ ID NO: 1106644 - RNA, 23 nt, Homo sapiens
ucauuagaggaagaaaaccagcg

SEQ ID NO: 1106645 - RNA, 15 nt, Homo sapiens
ucauuauuugcagag

SEQ ID NO: 1106646 - RNA, 16 nt, Homo sapiens
ucauuccaccuuccca

SEQ ID NO: 1106647 - RNA, 17 nt, Homo sapiens
ucauuccaccuucccau

SEQ ID NO: 1106648 - RNA, 23 nt, Homo sapiens
ucauucucuuauauaguauucau

SEQ ID NO: 1106649 - RNA, 15 nt, Homo sapiens
ucauugaaguauuuu

SEQ ID NO: 1106650 - RNA, 22 nt, Homo sapiens
ucauuuccuccgucaccucaga

SEQ ID NO: 1106651 - RNA, 15 nt, Homo sapiens
ucauuucuacuguga

SEQ ID NO: 1106652 - RNA, 14 nt, Homo sapiens
ucauuugaugcuaa

SEQ ID NO: 1106653 - RNA, 19 nt, Homo sapiens
ucauuuuaacaucugagaa

SEQ ID NO: 1106654 - RNA, 19 nt, Homo sapiens
uccaaaggcauaagacccu

SEQ ID NO: 1106655 - RNA, 18 nt, Homo sapiens
uccaagcuucaagugaua

SEQ ID NO: 1106656 - RNA, 18 nt, Homo sapiens
uccaaggaguuccaugaa

SEQ ID NO: 1106657 - RNA, 15 nt, Homo sapiens
uccaaggggcuuugu

SEQ ID NO: 1106658 - RNA, 12 nt, Homo sapiens
uccaagucuuca

SEQ ID NO: 1106659 - RNA, 15 nt, Homo sapiens
uccacagucucuggg

SEQ ID NO: 1106660 - RNA, 15 nt, Homo sapiens
uccacugcucucagc

SEQ ID NO: 1106661 - RNA, 14 nt, Homo sapiens
uccacugugccaug

SEQ ID NO: 1106662 - RNA, 21 nt, Homo sapiens
uccacuuaccuagauucuaca

SEQ ID NO: 1106663 - RNA, 20 nt, Homo sapiens
uccacuucuuaaugcuuucc

SEQ ID NO: 1106664 - RNA, 21 nt, Homo sapiens
uccagaaagaaggacacuugu

SEQ ID NO: 1106665 - RNA, 16 nt, Homo sapiens
uccagaggguugugau

SEQ ID NO: 1106666 - RNA, 18 nt, Homo sapiens
uccagaggguugugauuu

SEQ ID NO: 1106667 - RNA, 23 nt, Homo sapiens
uccagaggugaugguaacugcac

SEQ ID NO: 1106668 - RNA, 19 nt, Homo sapiens
uccagccgcugcacaucac

SEQ ID NO: 1106669 - RNA, 23 nt, Homo sapiens
uccaggcaaaauugauauacuuu

SEQ ID NO: 1106670 - RNA, 14 nt, Homo sapiens
uccagugagcuuau

SEQ ID NO: 1106671 - RNA, 18 nt, Homo sapiens
uccagugcauguugccau

SEQ ID NO: 1106672 - RNA, 15 nt, Homo sapiens
uccaguuuccaaagg

SEQ ID NO: 1106673 - RNA, 16 nt, Homo sapiens
uccaucaacacugcgc

SEQ ID NO: 1106674 - RNA, 15 nt, Homo sapiens
uccaucccgaaaauc

SEQ ID NO: 1106675 - RNA, 19 nt, Homo sapiens
uccaucuguggaaaugaca

SEQ ID NO: 1106676 - RNA, 16 nt, Homo sapiens
uccaugcugccuccag

SEQ ID NO: 1106677 - RNA, 17 nt, Homo sapiens
uccauggcagcuggucu

SEQ ID NO: 1106678 - RNA, 22 nt, Homo sapiens
uccaugucgccucugcauucag

SEQ ID NO: 1106679 - RNA, 12 nt, Homo sapiens
ucccaacucgau

SEQ ID NO: 1106680 - RNA, 18 nt, Homo sapiens
ucccaacucgaugggcac

SEQ ID NO: 1106681 - RNA, 17 nt, Homo sapiens
ucccacccacaugugac

SEQ ID NO: 1106682 - RNA, 14 nt, Homo sapiens
ucccaccucagccu

SEQ ID NO: 1106683 - RNA, 23 nt, Homo sapiens
ucccaccuccauuugcaauugac

SEQ ID NO: 1106684 - RNA, 22 nt, Homo sapiens
ucccaccucuucucuuccugua

SEQ ID NO: 1106685 - RNA, 23 nt, Homo sapiens
ucccaccucuucucuuccuguaa

SEQ ID NO: 1106686 - RNA, 15 nt, Homo sapiens
ucccacucaguccau

SEQ ID NO: 1106687 - RNA, 19 nt, Homo sapiens
ucccagcaugcugagauua

SEQ ID NO: 1106688 - RNA, 11 nt, Homo sapiens
ucccagcauug

SEQ ID NO: 1106689 - RNA, 17 nt, Homo sapiens
ucuaacuccagugaagu

SEQ ID NO: 1106690 - RNA, 17 nt, Homo sapiens
ucuaagccuuuccauaa

SEQ ID NO: 1106691 - RNA, 15 nt, Homo sapiens
ucuaagucuccaaga

SEQ ID NO: 1106692 - RNA, 18 nt, Homo sapiens
ucuaauauuuuuagcucu

SEQ ID NO: 1106693 - RNA, 23 nt, Homo sapiens
ucuaauuuauacaaaauaauuua

SEQ ID NO: 1106694 - RNA, 17 nt, Homo sapiens
uacuccaggagacccac

SEQ ID NO: 1106695 - RNA, 15 nt, Homo sapiens
uacucccauuuuccc

SEQ ID NO: 1106696 - RNA, 15 nt, Homo sapiens
uacucuaagucucca

SEQ ID NO: 1106697 - RNA, 17 nt, Homo sapiens
uacucuuucacucaggc

SEQ ID NO: 1106698 - RNA, 13 nt, Homo sapiens
uacugacugauga

SEQ ID NO: 1106699 - RNA, 14 nt, Homo sapiens
uacugcaugcacuu

SEQ ID NO: 1106700 - RNA, 15 nt, Homo sapiens
uacugcaugcacuuc

SEQ ID NO: 1106701 - RNA, 23 nt, Homo sapiens
uacugcuuucaacuuaaaucacu

SEQ ID NO: 1106702 - RNA, 18 nt, Homo sapiens
uacuggucuuguggaauu

SEQ ID NO: 1106703 - RNA, 13 nt, Homo sapiens
uacuuacaugcau

SEQ ID NO: 1106704 - RNA, 20 nt, Homo sapiens
uacuuauauguaaaguauua

SEQ ID NO: 1106705 - RNA, 12 nt, Homo sapiens
uacuuauuuucc

SEQ ID NO: 1106706 - RNA, 13 nt, Homo sapiens
uacuuauuuucca

SEQ ID NO: 1106707 - RNA, 12 nt, Homo sapiens
uacuucucacca

SEQ ID NO: 1106708 - RNA, 15 nt, Homo sapiens
uacuugaaaaccuca

SEQ ID NO: 1106709 - RNA, 14 nt, Homo sapiens
uacuugaaauacca

SEQ ID NO: 1106710 - RNA, 19 nt, Homo sapiens
uacuugaaauaccagugaa

SEQ ID NO: 1106711 - RNA, 14 nt, Homo sapiens
uacuugcacaagcu

SEQ ID NO: 1106712 - RNA, 17 nt, Homo sapiens
uacuugccacacacugu

SEQ ID NO: 1106713 - RNA, 18 nt, Homo sapiens
uacuugccacacacuguu

SEQ ID NO: 1106714 - RNA, 16 nt, Homo sapiens
uacuuguaaaggugcu

SEQ ID NO: 1106715 - RNA, 15 nt, Homo sapiens
uacuuuaaagagcuu

SEQ ID NO: 1106716 - RNA, 21 nt, Homo sapiens
uacuuuauguuacuacaugca

SEQ ID NO: 1106717 - RNA, 21 nt, Homo sapiens
uacuuucaucuauucuuuccc

SEQ ID NO: 1106718 - RNA, 19 nt, Homo sapiens
uacuuugaguuagugccau

SEQ ID NO: 1106719 - RNA, 17 nt, Homo sapiens
uacuuuucuuuccucag

SEQ ID NO: 1106720 - RNA, 16 nt, Homo sapiens
uacuuuuuauacucca

SEQ ID NO: 1106721 - RNA, 22 nt, Homo sapiens
uacuuuuuucuuauuuaacuua

SEQ ID NO: 1106722 - RNA, 23 nt, Homo sapiens
uagaaaaacuuuuaaacaugaga

SEQ ID NO: 1106723 - RNA, 20 nt, Homo sapiens
uagaaaaguuauguagaaaa

SEQ ID NO: 1106724 - RNA, 17 nt, Homo sapiens
uagaaccucaccuguua

SEQ ID NO: 1106725 - RNA, 17 nt, Homo sapiens
uagaaccuggagccacu

SEQ ID NO: 1106726 - RNA, 18 nt, Homo sapiens
uagaagauuuuaugcugc

SEQ ID NO: 1106727 - RNA, 20 nt, Homo sapiens
uagaagauuuuaugcugcug

SEQ ID NO: 1106728 - RNA, 20 nt, Homo sapiens
uagaauaauacuagucuuau

SEQ ID NO: 1106729 - RNA, 17 nt, Homo sapiens
uagaauuggagaguaaa

SEQ ID NO: 1106730 - RNA, 13 nt, Homo sapiens
uagaauuuauuca

SEQ ID NO: 1106731 - RNA, 16 nt, Homo sapiens
uagacaagcuugucca

SEQ ID NO: 1106732 - RNA, 16 nt, Homo sapiens
uagacagagucucacu

SEQ ID NO: 1106733 - RNA, 20 nt, Homo sapiens
uagacaugaaaucugaggaa

SEQ ID NO: 1106734 - RNA, 21 nt, Homo sapiens
uagagacaggguuuugccaug

SEQ ID NO: 1106735 - RNA, 23 nt, Homo sapiens
uagaggugcucauucauuuaaca

SEQ ID NO: 1106736 - RNA, 22 nt, Homo sapiens
uagagugcccuuaaaauaauga

SEQ ID NO: 1106737 - RNA, 15 nt, Homo sapiens
uagauaaauuucaau

SEQ ID NO: 1106738 - RNA, 19 nt, Homo sapiens
uagaucaaggagcccagaa

SEQ ID NO: 1106739 - RNA, 14 nt, Homo sapiens
uagcaaaauugagg

SEQ ID NO: 1106740 - RNA, 16 nt, Homo sapiens
uagcauugagugcuuu

SEQ ID NO: 1106741 - RNA, 16 nt, Homo sapiens
uagccaggauccacaa

SEQ ID NO: 1106742 - RNA, 14 nt, Homo sapiens
uagccgaccucagc

SEQ ID NO: 1106743 - RNA, 17 nt, Homo sapiens
uagccucgcucuuggca

SEQ ID NO: 1106744 - RNA, 18 nt, Homo sapiens
uagccuuagaagucacac

SEQ ID NO: 1106745 - RNA, 21 nt, Homo sapiens
uagccuucucuguucauuucc

SEQ ID NO: 1106746 - RNA, 21 nt, Homo sapiens
uagcuaccucacuaugcugcu

SEQ ID NO: 1106747 - RNA, 22 nt, Homo sapiens
uagcucuccugggguucuggga

SEQ ID NO: 1106748 - RNA, 11 nt, Homo sapiens
uagcucugauc

SEQ ID NO: 1106749 - RNA, 12 nt, Homo sapiens
uagcucuuucag

SEQ ID NO: 1106750 - RNA, 12 nt, Homo sapiens
uagcugagcuca

SEQ ID NO: 1106751 - RNA, 14 nt, Homo sapiens
uagcugagcucaca

SEQ ID NO: 1106752 - RNA, 15 nt, Homo sapiens
uagcugucugcucag

SEQ ID NO: 1106753 - RNA, 17 nt, Homo sapiens
uagcuuaaauaaauuca

SEQ ID NO: 1106754 - RNA, 14 nt, Homo sapiens
uagcuuagaccuca

SEQ ID NO: 1106755 - RNA, 19 nt, Homo sapiens
uagcuuagaccucagccug

SEQ ID NO: 1106756 - RNA, 16 nt, Homo sapiens
uaggacaauucacuuc

SEQ ID NO: 1106757 - RNA, 17 nt, Homo sapiens
uaggaccaauaccuccu

SEQ ID NO: 1106758 - RNA, 16 nt, Homo sapiens
uaggacucugaggcuc

SEQ ID NO: 1106759 - RNA, 22 nt, Homo sapiens
uaggaggaaaaagaaaugcauu

SEQ ID NO: 1106760 - RNA, 22 nt, Homo sapiens
uaggagguuccggugucuggaa

SEQ ID NO: 1106761 - RNA, 22 nt, Homo sapiens
uaggcauuaaauuuuagcaaag

SEQ ID NO: 1106762 - RNA, 12 nt, Homo sapiens
uaggcuuaucaa

SEQ ID NO: 1106763 - RNA, 22 nt, Homo sapiens
uaggggacuaauucacuggcga

SEQ ID NO: 1106764 - RNA, 21 nt, Homo sapiens
uagggucaggcggggugcugu

SEQ ID NO: 1106765 - RNA, 16 nt, Homo sapiens
uagguacgucaaagca

SEQ ID NO: 1106766 - RNA, 14 nt, Homo sapiens
uaggugugccaaac

SEQ ID NO: 1106767 - RNA, 15 nt, Homo sapiens
uaguaacaguuguga

SEQ ID NO: 1106768 - RNA, 21 nt, Homo sapiens
uaguaagaaaacaucacugaa

SEQ ID NO: 1106769 - RNA, 19 nt, Homo sapiens
uagucacauggccuaugca

SEQ ID NO: 1106770 - RNA, 22 nt, Homo sapiens
uagucacauggccuaugcacau

SEQ ID NO: 1106771 - RNA, 14 nt, Homo sapiens
uaguccguuaacac

SEQ ID NO: 1106772 - RNA, 22 nt, Homo sapiens
uaguccguuaacacuacuuaaa

SEQ ID NO: 1106773 - RNA, 18 nt, Homo sapiens
uagucuccuuugcacuga

SEQ ID NO: 1106774 - RNA, 16 nt, Homo sapiens
uagugauuugccucaa

SEQ ID NO: 1106775 - RNA, 17 nt, Homo sapiens
uagugcacacuuguaua

SEQ ID NO: 1106776 - RNA, 15 nt, Homo sapiens
uagugcccucaucca

SEQ ID NO: 1106777 - RNA, 19 nt, Homo sapiens
uaguggccaaauagcacau

SEQ ID NO: 1106778 - RNA, 23 nt, Homo sapiens
uaguggcuuccuccgucugcaau

SEQ ID NO: 1106779 - RNA, 14 nt, Homo sapiens
uaguguaacacugc

SEQ ID NO: 1106780 - RNA, 23 nt, Homo sapiens
uagugucuugaauguaagaacau

SEQ ID NO: 1106781 - RNA, 18 nt, Homo sapiens
uaguguuaauaucuugaa

SEQ ID NO: 1106782 - RNA, 21 nt, Homo sapiens
uaguugaucuacaaaggccau

SEQ ID NO: 1106783 - RNA, 23 nt, Homo sapiens
uaguugaucuacaaaggccaugg

SEQ ID NO: 1106784 - RNA, 19 nt, Homo sapiens
uaguugcguggacucugca

SEQ ID NO: 1106785 - RNA, 22 nt, Homo sapiens
uaguuuauuuuguuacacuaaa

SEQ ID NO: 1106786 - RNA, 16 nt, Homo sapiens
uauaaaucaaugucac

SEQ ID NO: 1106787 - RNA, 14 nt, Homo sapiens
uauaaaugcaugau

SEQ ID NO: 1106788 - RNA, 20 nt, Homo sapiens
uauaacuaguccuuuacuaa

SEQ ID NO: 1106789 - RNA, 20 nt, Homo sapiens
uauaagcagaagcacauaug

SEQ ID NO: 1106790 - RNA, 20 nt, Homo sapiens
uauaagcagauuuaacaauu

SEQ ID NO: 1106791 - RNA, 19 nt, Homo sapiens
uauaauuauuuacucuuau

SEQ ID NO: 1106792 - RNA, 11 nt, Homo sapiens
uauacagcuca

SEQ ID NO: 1106793 - RNA, 21 nt, Homo sapiens
uauacauucuuuaucuugaca

SEQ ID NO: 1106794 - RNA, 20 nt, Homo sapiens
uauaccuguguuucuugccu

SEQ ID NO: 1106795 - RNA, 15 nt, Homo sapiens
uauacuguacuuaau

SEQ ID NO: 1106796 - RNA, 17 nt, Homo sapiens
uauagaauggaacucaa

SEQ ID NO: 1106797 - RNA, 16 nt, Homo sapiens
uauagauauguagaua

SEQ ID NO: 1106798 - RNA, 18 nt, Homo sapiens
uauagcguggguuaucag

SEQ ID NO: 1106799 - RNA, 22 nt, Homo sapiens
uauaggaucauuuguuggaaug

SEQ ID NO: 1106800 - RNA, 14 nt, Homo sapiens
uauaguacuggcau

SEQ ID NO: 1106801 - RNA, 21 nt, Homo sapiens
uauaguggccaaauagcacau

SEQ ID NO: 1106802 - RNA, 21 nt, Homo sapiens
uauagugucuugggaauuuuc

SEQ ID NO: 1106803 - RNA, 16 nt, Homo sapiens
uauauauacauguaua

SEQ ID NO: 1106804 - RNA, 19 nt, Homo sapiens
uauauauucuacacauaua

SEQ ID NO: 1106805 - RNA, 21 nt, Homo sapiens
uauaucauaaaguaugccuuc

SEQ ID NO: 1106806 - RNA, 20 nt, Homo sapiens
uauauccagauggcaugugu

SEQ ID NO: 1106807 - RNA, 17 nt, Homo sapiens
uauaucgcuuaaucuua

SEQ ID NO: 1106808 - RNA, 17 nt, Homo sapiens
uauaucuguggucuuca

SEQ ID NO: 1106809 - RNA, 17 nt, Homo sapiens
uauauuauaaucuucca

SEQ ID NO: 1106810 - RNA, 13 nt, Homo sapiens
uauauuauggaag

SEQ ID NO: 1106811 - RNA, 19 nt, Homo sapiens
uauauuaugguguaaugca

SEQ ID NO: 1106812 - RNA, 14 nt, Homo sapiens
uauauuuauacucu

SEQ ID NO: 1106813 - RNA, 21 nt, Homo sapiens
uauauuuucccucucuugccu

SEQ ID NO: 1106814 - RNA, 23 nt, Homo sapiens
uaucaaggauguucuggcuuuac

SEQ ID NO: 1106815 - RNA, 13 nt, Homo sapiens
uaucaauagucaa

SEQ ID NO: 1106816 - RNA, 15 nt, Homo sapiens
uaucaauuacagucc

SEQ ID NO: 1106817 - RNA, 17 nt, Homo sapiens
uaucauuuugcacgugc

SEQ ID NO: 1106818 - RNA, 19 nt, Homo sapiens
uauccaagaaucagugaag

SEQ ID NO: 1106819 - RNA, 17 nt, Homo sapiens
uauccaggacucuguca

SEQ ID NO: 1106820 - RNA, 11 nt, Homo sapiens
uauccaugccu

SEQ ID NO: 1106821 - RNA, 20 nt, Homo sapiens
uauccgaacuuuaauuucag

SEQ ID NO: 1106822 - RNA, 17 nt, Homo sapiens
uaucgggagcagugucu

SEQ ID NO: 1106823 - RNA, 13 nt, Homo sapiens
uaucuaucuuaua

SEQ ID NO: 1106824 - RNA, 13 nt, Homo sapiens
uaucuaugcauuu

SEQ ID NO: 1106825 - RNA, 18 nt, Homo sapiens
uaucuguauuuucauuua

SEQ ID NO: 1106826 - RNA, 17 nt, Homo sapiens
uaucuguguuugcugag

SEQ ID NO: 1106827 - RNA, 20 nt, Homo sapiens
uaucuucauacaaugacaag

SEQ ID NO: 1106828 - RNA, 21 nt, Homo sapiens
uaugaaaaagaagaaucucau

SEQ ID NO: 1106829 - RNA, 14 nt, Homo sapiens
uaugaacuugagga

SEQ ID NO: 1106830 - RNA, 22 nt, Homo sapiens
uaugacuguuuuuauaugcaca

SEQ ID NO: 1106831 - RNA, 23 nt, Homo sapiens
uaugacuguuuuuauaugcacau

SEQ ID NO: 1106832 - RNA, 17 nt, Homo sapiens
uaugagaaaguucucau

SEQ ID NO: 1106833 - RNA, 14 nt, Homo sapiens
uaugaggcuauuaa

SEQ ID NO: 1106834 - RNA, 23 nt, Homo sapiens
uaugagucucuaugaucuuggca

SEQ ID NO: 1106835 - RNA, 21 nt, Homo sapiens
uaugaguuuuugauagcuuua

SEQ ID NO: 1106836 - RNA, 14 nt, Homo sapiens
uaugaucauguaaa

SEQ ID NO: 1106837 - RNA, 20 nt, Homo sapiens
uaugaugauuugcuaucaaa

SEQ ID NO: 1106838 - RNA, 20 nt, Homo sapiens
uaugauggguguuuuuagca

SEQ ID NO: 1106839 - RNA, 20 nt, Homo sapiens
uaugcaauauaucaauguaa

SEQ ID NO: 1106840 - RNA, 19 nt, Homo sapiens
uaugcaccaaaucaucucu

SEQ ID NO: 1106841 - RNA, 15 nt, Homo sapiens
uaugcuccaguaugg

SEQ ID NO: 1106842 - RNA, 16 nt, Homo sapiens
uauggaacucucucca

SEQ ID NO: 1106843 - RNA, 19 nt, Homo sapiens
uauggcagugucuuuccac

SEQ ID NO: 1106844 - RNA, 19 nt, Homo sapiens
uauguaccauguacaugaa

SEQ ID NO: 1106845 - RNA, 23 nt, Homo sapiens
uauguauggaugaaagcaaucug

SEQ ID NO: 1106846 - RNA, 22 nt, Homo sapiens
uaugucaggcaaagugcugcug

SEQ ID NO: 1106847 - RNA, 16 nt, Homo sapiens
uaugucaguuugcagu

SEQ ID NO: 1106848 - RNA, 20 nt, Homo sapiens
uaugucuuggacacuguaca

SEQ ID NO: 1106849 - RNA, 15 nt, Homo sapiens
uaugugcuucacaua

SEQ ID NO: 1106850 - RNA, 14 nt, Homo sapiens
uaugugucuuuauc

SEQ ID NO: 1106851 - RNA, 18 nt, Homo sapiens
uauguuaauaacuugucc

SEQ ID NO: 1106852 - RNA, 22 nt, Homo sapiens
uauguucaacuggagacacuau

SEQ ID NO: 1106853 - RNA, 12 nt, Homo sapiens
uauguugcccag

SEQ ID NO: 1106854 - RNA, 14 nt, Homo sapiens
uauuaauucauuaa

SEQ ID NO: 1106855 - RNA, 17 nt, Homo sapiens
uauuagcaacugugcua

SEQ ID NO: 1106856 - RNA, 12 nt, Homo sapiens
uauuauggauga

SEQ ID NO: 1106857 - RNA, 20 nt, Homo sapiens
uauuauguaguccguuaaca

SEQ ID NO: 1106858 - RNA, 14 nt, Homo sapiens
uauuaugucucaaa

SEQ ID NO: 1106859 - RNA, 13 nt, Homo sapiens
uauucaauggaaa

SEQ ID NO: 1106860 - RNA, 14 nt, Homo sapiens
uauucagacaagca

SEQ ID NO: 1106861 - RNA, 17 nt, Homo sapiens
uauuccauuuuuacuaa

SEQ ID NO: 1106862 - RNA, 17 nt, Homo sapiens
uauucccacagcacuaa

SEQ ID NO: 1106863 - RNA, 19 nt, Homo sapiens
uauucucacuccaccaccc

SEQ ID NO: 1106864 - RNA, 18 nt, Homo sapiens
gggcuaccccacccaagu

SEQ ID NO: 1106865 - RNA, 16 nt, Homo sapiens
gggcugagcccuggca

SEQ ID NO: 1106866 - RNA, 15 nt, Homo sapiens
gggcugcgagcauuu

SEQ ID NO: 1106867 - RNA, 19 nt, Homo sapiens
gggcugcgagcauuucccu

SEQ ID NO: 1106868 - RNA, 16 nt, Homo sapiens
gggcuuauccaugccu

SEQ ID NO: 1106869 - RNA, 16 nt, Homo sapiens
gggcuuuuacaccagu

SEQ ID NO: 1106870 - RNA, 17 nt, Homo sapiens
ggggaagaccuuguccc

SEQ ID NO: 1106871 - RNA, 23 nt, Homo sapiens
ggggagcugggguacagguuugg

SEQ ID NO: 1106872 - RNA, 22 nt, Homo sapiens
ggggccucuuucugugcuucuc

SEQ ID NO: 1106873 - RNA, 10 nt, Homo sapiens
ggggcuuccu

SEQ ID NO: 1106874 - RNA, 17 nt, Homo sapiens
ggggcuuuuacaccagu

SEQ ID NO: 1106875 - RNA, 19 nt, Homo sapiens
ggguauuuaccacagcagc

SEQ ID NO: 1106876 - RNA, 14 nt, Homo sapiens
gggucaguaaggaa

SEQ ID NO: 1106877 - RNA, 15 nt, Homo sapiens
gggucaucgauucaa

SEQ ID NO: 1106878 - RNA, 20 nt, Homo sapiens
gggucuuugugagagugagc

SEQ ID NO: 1106879 - RNA, 16 nt, Homo sapiens
gggugauuucagagag

SEQ ID NO: 1106880 - RNA, 22 nt, Homo sapiens
gguaaaaauauaagaacuugau

SEQ ID NO: 1106881 - RNA, 17 nt, Homo sapiens
gguaaaaccccaucucu

SEQ ID NO: 1106882 - RNA, 20 nt, Homo sapiens
gguaguacuccugcaaaauu

SEQ ID NO: 1106883 - RNA, 20 nt, Homo sapiens
gguauaaugguugacugggu

SEQ ID NO: 1106884 - RNA, 23 nt, Homo sapiens
gguaugaucacggcucacugcag

SEQ ID NO: 1106885 - RNA, 21 nt, Homo sapiens
gguauuaaauugauguugcug

SEQ ID NO: 1106886 - RNA, 17 nt, Homo sapiens
gguauuuaccacagcag

SEQ ID NO: 1106887 - RNA, 18 nt, Homo sapiens
ggucaaaauagugccacu

SEQ ID NO: 1106888 - RNA, 22 nt, Homo sapiens
ggucaggcggggugcuguggug

SEQ ID NO: 1106889 - RNA, 19 nt, Homo sapiens
ggucagguguucaagacca

SEQ ID NO: 1106890 - RNA, 15 nt, Homo sapiens
ggucccugccagugu

SEQ ID NO: 1106891 - RNA, 19 nt, Homo sapiens
gguccugaguggcugaaau

SEQ ID NO: 1106892 - RNA, 21 nt, Homo sapiens
gguccuguuaacgucaucuca

SEQ ID NO: 1106893 - RNA, 14 nt, Homo sapiens
ggucugugugauga

SEQ ID NO: 1106894 - RNA, 13 nt, Homo sapiens
ggucuugccugaa

SEQ ID NO: 1106895 - RNA, 18 nt, Homo sapiens
ggucuuuauuccucccuc

SEQ ID NO: 1106896 - RNA, 20 nt, Homo sapiens
ggucuuugcaagaaucauua

SEQ ID NO: 1106897 - RNA, 16 nt, Homo sapiens
ggugaaagauggaacu

SEQ ID NO: 1106898 - RNA, 19 nt, Homo sapiens
ggugagccgagauugcacc

SEQ ID NO: 1106899 - RNA, 14 nt, Homo sapiens
ggugauacccaagu

SEQ ID NO: 1106900 - RNA, 19 nt, Homo sapiens
ggugaucaauuaaauguag

SEQ ID NO: 1106901 - RNA, 17 nt, Homo sapiens
gguggcucacgccugua

SEQ ID NO: 1106902 - RNA, 14 nt, Homo sapiens
ggugggacagggac

SEQ ID NO: 1106903 - RNA, 12 nt, Homo sapiens
gguuaacagcug

SEQ ID NO: 1106904 - RNA, 15 nt, Homo sapiens
gguuauagacugcca

SEQ ID NO: 1106905 - RNA, 18 nt, Homo sapiens
gguugaucacacucuggg

SEQ ID NO: 1106906 - RNA, 18 nt, Homo sapiens
gguuuuuguuaccuuuau

SEQ ID NO: 1106907 - RNA, 15 nt, Homo sapiens
guaaaacuauauucu

SEQ ID NO: 1106908 - RNA, 16 nt, Homo sapiens
guaaaacuauauucuc

SEQ ID NO: 1106909 - RNA, 14 nt, Homo sapiens
guaaaagcaaaaaa

SEQ ID NO: 1106910 - RNA, 14 nt, Homo sapiens
guaaaaucuuggca

SEQ ID NO: 1106911 - RNA, 13 nt, Homo sapiens
guaaaccaaaaag

SEQ ID NO: 1106912 - RNA, 20 nt, Homo sapiens
guaaagaauaaaugaaucuu

SEQ ID NO: 1106913 - RNA, 22 nt, Homo sapiens
guaaaguauuauuuauuugaau

SEQ ID NO: 1106914 - RNA, 17 nt, Homo sapiens
guaaauagcucaggugu

SEQ ID NO: 1106915 - RNA, 15 nt, Homo sapiens
guaaauguccugcua

SEQ ID NO: 1106916 - RNA, 15 nt, Homo sapiens
guaaauguuuagguu

SEQ ID NO: 1106917 - RNA, 13 nt, Homo sapiens
guaacaacugugg

SEQ ID NO: 1106918 - RNA, 18 nt, Homo sapiens
guaacacaagccacagaa

SEQ ID NO: 1106919 - RNA, 16 nt, Homo sapiens
guaacauccuuucuau

SEQ ID NO: 1106920 - RNA, 17 nt, Homo sapiens
guaaccaagaguauucc

SEQ ID NO: 1106921 - RNA, 20 nt, Homo sapiens
guaaucccagcuacauggga

SEQ ID NO: 1106922 - RNA, 12 nt, Homo sapiens
guaaugcacaau

SEQ ID NO: 1106923 - RNA, 19 nt, Homo sapiens
guaauuaaguaaaccaaaa

SEQ ID NO: 1106924 - RNA, 17 nt, Homo sapiens
guaauuaauaaacgaag

SEQ ID NO: 1106925 - RNA, 23 nt, Homo sapiens
guaauugcauuucugcucuucca

SEQ ID NO: 1106926 - RNA, 15 nt, Homo sapiens
guacaagcauucugu

SEQ ID NO: 1106927 - RNA, 15 nt, Homo sapiens
guacaggcaacaaug

SEQ ID NO: 1106928 - RNA, 20 nt, Homo sapiens
guacauuccugauacugggu

SEQ ID NO: 1106929 - RNA, 14 nt, Homo sapiens
guaccucucuuaua

SEQ ID NO: 1106930 - RNA, 19 nt, Homo sapiens
guacgucugguguucucaa

SEQ ID NO: 1106931 - RNA, 17 nt, Homo sapiens
guacuccuuaaauuuau

SEQ ID NO: 1106932 - RNA, 22 nt, Homo sapiens
guagagacaggguuuugccaug

SEQ ID NO: 1106933 - RNA, 14 nt, Homo sapiens
guagagucacugac

SEQ ID NO: 1106934 - RNA, 14 nt, Homo sapiens
guagauaacagcuu

SEQ ID NO: 1106935 - RNA, 18 nt, Homo sapiens
guagcaaguucuagagaa

SEQ ID NO: 1106936 - RNA, 15 nt, Homo sapiens
guagcauacauuuau

SEQ ID NO: 1106937 - RNA, 18 nt, Homo sapiens
guagcauuucuugauguu

SEQ ID NO: 1106938 - RNA, 14 nt, Homo sapiens
guagcccagcacug

SEQ ID NO: 1106939 - RNA, 17 nt, Homo sapiens
guagcccagcacuguga

SEQ ID NO: 1106940 - RNA, 20 nt, Homo sapiens
guagcuaagugaaaagguca

SEQ ID NO: 1106941 - RNA, 14 nt, Homo sapiens
guaggguugccaga

SEQ ID NO: 1106942 - RNA, 20 nt, Homo sapiens
guaguauggccugugucacu

SEQ ID NO: 1106943 - RNA, 21 nt, Homo sapiens
guauaaccuucaugaugaauu

SEQ ID NO: 1106944 - RNA, 10 nt, Homo sapiens
guauaaucuc

SEQ ID NO: 1106945 - RNA, 16 nt, Homo sapiens
guauaauuuaacuuca

SEQ ID NO: 1106946 - RNA, 21 nt, Homo sapiens
guauauauucuacacauauau

SEQ ID NO: 1106947 - RNA, 22 nt, Homo sapiens
guauaucaugaaacacuucuca

SEQ ID NO: 1106948 - RNA, 14 nt, Homo sapiens
guaucaaaaucacu

SEQ ID NO: 1106949 - RNA, 12 nt, Homo sapiens
guaucaucagau

SEQ ID NO: 1106950 - RNA, 19 nt, Homo sapiens
guaucuagcucuaguucaa

SEQ ID NO: 1106951 - RNA, 15 nt, Homo sapiens
guaugacucuccucu

SEQ ID NO: 1106952 - RNA, 18 nt, Homo sapiens
guauggaauacaguguua

SEQ ID NO: 1106953 - RNA, 16 nt, Homo sapiens
guugggaauugcaugc

SEQ ID NO: 1106954 - RNA, 14 nt, Homo sapiens
guuguauugcauau

SEQ ID NO: 1106955 - RNA, 20 nt, Homo sapiens
guugugagcacucuacugca

SEQ ID NO: 1106956 - RNA, 19 nt, Homo sapiens
guuguguuaacaaugcagu

SEQ ID NO: 1106957 - RNA, 19 nt, Homo sapiens
guuguuaaugaaaauguca

SEQ ID NO: 1106958 - RNA, 20 nt, Homo sapiens
guuguuaaugaaaaugucag

SEQ ID NO: 1106959 - RNA, 17 nt, Homo sapiens
guuuaaaaaaaguauau

SEQ ID NO: 1106960 - RNA, 22 nt, Homo sapiens
guuuaacugggagugauaugau

SEQ ID NO: 1106961 - RNA, 21 nt, Homo sapiens
guuuacccaguauuccauuuu

SEQ ID NO: 1106962 - RNA, 12 nt, Homo sapiens
guuuacugcugu

SEQ ID NO: 1106963 - RNA, 17 nt, Homo sapiens
guuuagaagagccugac

SEQ ID NO: 1106964 - RNA, 15 nt, Homo sapiens
guuuaugucaucaua

SEQ ID NO: 1106965 - RNA, 20 nt, Homo sapiens
guuuaugucaucauacauga

SEQ ID NO: 1106966 - RNA, 18 nt, Homo sapiens
guuucacuaugauuuucu

SEQ ID NO: 1106967 - RNA, 16 nt, Homo sapiens
guuucaguugacaaaa

SEQ ID NO: 1106968 - RNA, 17 nt, Homo sapiens
guuucccauaauuuucu

SEQ ID NO: 1106969 - RNA, 23 nt, Homo sapiens
guuucccgcuccaagagaauuca

SEQ ID NO: 1106970 - RNA, 20 nt, Homo sapiens
guuucuauucuaaguaauuc

SEQ ID NO: 1106971 - RNA, 14 nt, Homo sapiens
guuucuggggacac

SEQ ID NO: 1106972 - RNA, 21 nt, Homo sapiens
guuucuggggacaccagccau

SEQ ID NO: 1106973 - RNA, 22 nt, Homo sapiens
guuugagaauaugaucauguaa

SEQ ID NO: 1106974 - RNA, 18 nt, Homo sapiens
guuuuagaguaugcaaga

SEQ ID NO: 1106975 - RNA, 12 nt, Homo sapiens
guuuucaucucu

SEQ ID NO: 1106976 - RNA, 16 nt, Homo sapiens
guuuucuugccaauga

SEQ ID NO: 1106977 - RNA, 18 nt, Homo sapiens
guuuuguaccaacacaca

SEQ ID NO: 1106978 - RNA, 19 nt, Homo sapiens
guuuuguggaggagcucag

SEQ ID NO: 1106979 - RNA, 21 nt, Homo sapiens
guuuuucaagaaaacuggaaa

SEQ ID NO: 1106980 - RNA, 22 nt, Homo sapiens
uaaaaaacauaaauuucuuuaa

SEQ ID NO: 1106981 - RNA, 15 nt, Homo sapiens
uaaaaaacauuugua

SEQ ID NO: 1106982 - RNA, 23 nt, Homo sapiens
uaaaaacaugagaaaugugaacu

SEQ ID NO: 1106983 - RNA, 21 nt, Homo sapiens
uaaaaaccaaauaagcaucug

SEQ ID NO: 1106984 - RNA, 22 nt, Homo sapiens
uaaaaaccaaauaagcaucugu

SEQ ID NO: 1106985 - RNA, 13 nt, Homo sapiens
uaaaaacuuguac

SEQ ID NO: 1106986 - RNA, 14 nt, Homo sapiens
uaaaaaguggcuaa

SEQ ID NO: 1106987 - RNA, 17 nt, Homo sapiens
uaaaaaguuaaucuuca

SEQ ID NO: 1106988 - RNA, 18 nt, Homo sapiens
uaaaaaguuaaucuucau

SEQ ID NO: 1106989 - RNA, 12 nt, Homo sapiens
uaaaaaguugca

SEQ ID NO: 1106990 - RNA, 16 nt, Homo sapiens
uaaaaauacaaaaaau

SEQ ID NO: 1106991 - RNA, 15 nt, Homo sapiens
uaaaaaugaaagcca

SEQ ID NO: 1106992 - RNA, 15 nt, Homo sapiens
uaaaaaugcaacuuc

SEQ ID NO: 1106993 - RNA, 11 nt, Homo sapiens
uaaaacaaaca

SEQ ID NO: 1106994 - RNA, 17 nt, Homo sapiens
uaaaacacagcuuuaca

SEQ ID NO: 1106995 - RNA, 22 nt, Homo sapiens
uaaaacagccaaaacuccacag

SEQ ID NO: 1106996 - RNA, 12 nt, Homo sapiens
uaaaacaugugu

SEQ ID NO: 1106997 - RNA, 23 nt, Homo sapiens
uaaaacauuauagauuuucaugu

SEQ ID NO: 1106998 - RNA, 18 nt, Homo sapiens
uaaaacauuccugugaaa

SEQ ID NO: 1106999 - RNA, 13 nt, Homo sapiens
uaaaaccagagca

SEQ ID NO: 1107000 - RNA, 12 nt, Homo sapiens
uaaaaccuuuca

SEQ ID NO: 1107001 - RNA, 19 nt, Homo sapiens
uaaaacuaugguucccaau

SEQ ID NO: 1107002 - RNA, 21 nt, Homo sapiens
uaaaacugauuuuuagcuuua

SEQ ID NO: 1107003 - RNA, 23 nt, Homo sapiens
uaaaagaaaaaguaugugaauau

SEQ ID NO: 1107004 - RNA, 15 nt, Homo sapiens
uaaaagccucuggug

SEQ ID NO: 1107005 - RNA, 15 nt, Homo sapiens
uaaaagugacucuca

SEQ ID NO: 1107006 - RNA, 23 nt, Homo sapiens
uaaaaguuuaggguuuucucuug

SEQ ID NO: 1107007 - RNA, 22 nt, Homo sapiens
uaaaauaaauaaaugcaauaug

SEQ ID NO: 1107008 - RNA, 24 nt, Homo sapiens
uaaaauaacuuauaucaucagcau

SEQ ID NO: 1107009 - RNA, 17 nt, Homo sapiens
uaaaauaaguauuucca

SEQ ID NO: 1107010 - RNA, 14 nt, Homo sapiens
uaaaauagccacuu

SEQ ID NO: 1107011 - RNA, 15 nt, Homo sapiens
uaaaauauacaaaca

SEQ ID NO: 1107012 - RNA, 20 nt, Homo sapiens
uaaaauauuuuuaugugcaa

SEQ ID NO: 1107013 - RNA, 21 nt, Homo sapiens
uaaaaucauaaauauaaucua

SEQ ID NO: 1107014 - RNA, 15 nt, Homo sapiens
uaaaaucuggcaaag

SEQ ID NO: 1107015 - RNA, 21 nt, Homo sapiens
uaaaaugauuguaguaaucug

SEQ ID NO: 1107016 - RNA, 22 nt, Homo sapiens
uaaaauuaaaugcauguccuca

SEQ ID NO: 1107017 - RNA, 18 nt, Homo sapiens
uaaaauuaugccauagca

SEQ ID NO: 1107018 - RNA, 18 nt, Homo sapiens
uaaaauugaacuacuugg

SEQ ID NO: 1107019 - RNA, 17 nt, Homo sapiens
uaaacaaaggaauuaug

SEQ ID NO: 1107020 - RNA, 14 nt, Homo sapiens
uaaacaaauaacaa

SEQ ID NO: 1107021 - RNA, 17 nt, Homo sapiens
uaaacaaauaacaaugu

SEQ ID NO: 1107022 - RNA, 18 nt, Homo sapiens
uaaacaaauguaugauua

SEQ ID NO: 1107023 - RNA, 23 nt, Homo sapiens
uaaacaaauguaugauuacauca

SEQ ID NO: 1107024 - RNA, 13 nt, Homo sapiens
uaaacaagugcac

SEQ ID NO: 1107025 - RNA, 18 nt, Homo sapiens
uaaacacauacauugcca

SEQ ID NO: 1107026 - RNA, 14 nt, Homo sapiens
uaaacacccaugaa

SEQ ID NO: 1107027 - RNA, 21 nt, Homo sapiens
uaaacagacuuuagcuuacag

SEQ ID NO: 1107028 - RNA, 20 nt, Homo sapiens
uaaacagugagccugaauuu

SEQ ID NO: 1107029 - RNA, 22 nt, Homo sapiens
uaaacauugguaagaaugagcu

SEQ ID NO: 1107030 - RNA, 22 nt, Homo sapiens
uaaacccaaauaaauguguaaa

SEQ ID NO: 1107031 - RNA, 15 nt, Homo sapiens
uaaacuacuuguaaa

SEQ ID NO: 1107032 - RNA, 17 nt, Homo sapiens
uaaacuaucuuggugaa

SEQ ID NO: 1107033 - RNA, 21 nt, Homo sapiens
uaaagaaaaguagguuuacau

SEQ ID NO: 1107034 - RNA, 22 nt, Homo sapiens
uaaagaauaaaugaaucuuacu

SEQ ID NO: 1107035 - RNA, 14 nt, Homo sapiens
uaaagagcauggaa

SEQ ID NO: 1107036 - RNA, 16 nt, Homo sapiens
uaaagaggcgucuugu

SEQ ID NO: 1107037 - RNA, 22 nt, Homo sapiens
uaaagcugccggcacagaacuu

SEQ ID NO: 1107038 - RNA, 23 nt, Homo sapiens
uaaagcuuguuuguucuaguuag

SEQ ID NO: 1107039 - RNA, 22 nt, Homo sapiens
uaaaggcuuuuggcagcaaagu

SEQ ID NO: 1107040 - RNA, 23 nt, Homo sapiens
uaaagggcaggugguucuaauau

SEQ ID NO: 1107041 - RNA, 21 nt, Homo sapiens
gcaaucugagagauuugaaua

SEQ ID NO: 1107042 - RNA, 13 nt, Homo sapiens
gcaauucuaccca

SEQ ID NO: 1107043 - RNA, 14 nt, Homo sapiens
gcaauugacuguca

SEQ ID NO: 1107044 - RNA, 17 nt, Homo sapiens
gcacaaaccuuacuaug

SEQ ID NO: 1107045 - RNA, 21 nt, Homo sapiens
gcacaaagcucaagaugacag

SEQ ID NO: 1107046 - RNA, 15 nt, Homo sapiens
gcacaugucuuguac

SEQ ID NO: 1107047 - RNA, 22 nt, Homo sapiens
gcacauugaaagagaaccaguu

SEQ ID NO: 1107048 - RNA, 19 nt, Homo sapiens
gcaccaaaucaucucucau

SEQ ID NO: 1107049 - RNA, 17 nt, Homo sapiens
gcaccccccaagcuguu

SEQ ID NO: 1107050 - RNA, 17 nt, Homo sapiens
gcacccuucuuuccucu

SEQ ID NO: 1107051 - RNA, 18 nt, Homo sapiens
gcaccgggccacagagaa

SEQ ID NO: 1107052 - RNA, 18 nt, Homo sapiens
gcaccuacuuacaugcau

SEQ ID NO: 1107053 - RNA, 16 nt, Homo sapiens
gcaccuguacucagga

SEQ ID NO: 1107054 - RNA, 22 nt, Homo sapiens
gcaccuugucauguaccaucaa

SEQ ID NO: 1107055 - RNA, 15 nt, Homo sapiens
gcacgaauggaagag

SEQ ID NO: 1107056 - RNA, 21 nt, Homo sapiens
gcacuauuauggaugaaggac

SEQ ID NO: 1107057 - RNA, 16 nt, Homo sapiens
gcacucaaccaaccuc

SEQ ID NO: 1107058 - RNA, 14 nt, Homo sapiens
gcacucacaugccg

SEQ ID NO: 1107059 - RNA, 18 nt, Homo sapiens
gcacucacccaugugcca

SEQ ID NO: 1107060 - RNA, 22 nt, Homo sapiens
gcacucagaaaagaaaaccauu

SEQ ID NO: 1107061 - RNA, 21 nt, Homo sapiens
gcacugcuaggcgagugccag

SEQ ID NO: 1107062 - RNA, 22 nt, Homo sapiens
gcacuuuaacccucucuucccu

SEQ ID NO: 1107063 - RNA, 21 nt, Homo sapiens
gcacuuuacagaugagauucc

SEQ ID NO: 1107064 - RNA, 12 nt, Homo sapiens
gcagacaccugu

SEQ ID NO: 1107065 - RNA, 16 nt, Homo sapiens
gcagacucacuguggg

SEQ ID NO: 1107066 - RNA, 22 nt, Homo sapiens
gcagagagguggagaacuggga

SEQ ID NO: 1107067 - RNA, 18 nt, Homo sapiens
gcagaggugagcagagga

SEQ ID NO: 1107068 - RNA, 21 nt, Homo sapiens
gcagaugagcagucacacugu

SEQ ID NO: 1107069 - RNA, 14 nt, Homo sapiens
gcagcagaagccaa

SEQ ID NO: 1107070 - RNA, 19 nt, Homo sapiens
gcagcaggaggcuagcaaa

SEQ ID NO: 1107071 - RNA, 18 nt, Homo sapiens
gcagcauagcaagacaca

SEQ ID NO: 1107072 - RNA, 17 nt, Homo sapiens
gcagccccacacccgcc

SEQ ID NO: 1107073 - RNA, 20 nt, Homo sapiens
gcagcccuaaggaucucuca

SEQ ID NO: 1107074 - RNA, 16 nt, Homo sapiens
gcagccuccuccugac

SEQ ID NO: 1107075 - RNA, 18 nt, Homo sapiens
gcagcgccucaucuucaa

SEQ ID NO: 1107076 - RNA, 20 nt, Homo sapiens
gcaggaggaucacagugacc

SEQ ID NO: 1107077 - RNA, 17 nt, Homo sapiens
gcaggaggauugcuuga

SEQ ID NO: 1107078 - RNA, 21 nt, Homo sapiens
gcaggaggcuagcaaagcuua

SEQ ID NO: 1107079 - RNA, 14 nt, Homo sapiens
gcaggaguagcuga

SEQ ID NO: 1107080 - RNA, 15 nt, Homo sapiens
gcaggaguagcugag

SEQ ID NO: 1107081 - RNA, 20 nt, Homo sapiens
gcaggcagccccacacccgc

SEQ ID NO: 1107082 - RNA, 24 nt, Homo sapiens
gcagggaauugauccacuucuuaa

SEQ ID NO: 1107083 - RNA, 20 nt, Homo sapiens
gcagggggugugucugcuca

SEQ ID NO: 1107084 - RNA, 19 nt, Homo sapiens
gcagggguccuugguguga

SEQ ID NO: 1107085 - RNA, 23 nt, Homo sapiens
gcagggguccuuggugugacccu

SEQ ID NO: 1107086 - RNA, 21 nt, Homo sapiens
gcaggugcuucaggauaccau

SEQ ID NO: 1107087 - RNA, 20 nt, Homo sapiens
gcaguagacuauaagcagaa

SEQ ID NO: 1107088 - RNA, 13 nt, Homo sapiens
gcaguauggccau

SEQ ID NO: 1107089 - RNA, 19 nt, Homo sapiens
gcagucaacaguucaaaga

SEQ ID NO: 1107090 - RNA, 23 nt, Homo sapiens
gcagugacgugcaccuguacuca

SEQ ID NO: 1107091 - RNA, 21 nt, Homo sapiens
gcagugacuuuagaaacaaau

SEQ ID NO: 1107092 - RNA, 17 nt, Homo sapiens
gcaguguuuucaccuca

SEQ ID NO: 1107093 - RNA, 22 nt, Homo sapiens
gcaguucgcagccacccugagg

SEQ ID NO: 1107094 - RNA, 17 nt, Homo sapiens
gcauaacuaaauuauuu

SEQ ID NO: 1107095 - RNA, 22 nt, Homo sapiens
gcaucauuauuugcagagacag

SEQ ID NO: 1107096 - RNA, 14 nt, Homo sapiens
gcaucccaggggac

SEQ ID NO: 1107097 - RNA, 18 nt, Homo sapiens
gcauccuggcacccggcc

SEQ ID NO: 1107098 - RNA, 22 nt, Homo sapiens
gcaucuauucuuuguaccaucu

SEQ ID NO: 1107099 - RNA, 23 nt, Homo sapiens
gcaucuauucuuuguaccaucug

SEQ ID NO: 1107100 - RNA, 22 nt, Homo sapiens
gcaucuucuggagucuccagug

SEQ ID NO: 1107101 - RNA, 13 nt, Homo sapiens
gcaugaccauccu

SEQ ID NO: 1107102 - RNA, 19 nt, Homo sapiens
gcaugauuuuauacauagu

SEQ ID NO: 1107103 - RNA, 13 nt, Homo sapiens
gcaugcucaggac

SEQ ID NO: 1107104 - RNA, 18 nt, Homo sapiens
gcauggaacagugcagga

SEQ ID NO: 1107105 - RNA, 13 nt, Homo sapiens
gcauggugcaguu

SEQ ID NO: 1107106 - RNA, 20 nt, Homo sapiens
gcauguuggcccagaccuca

SEQ ID NO: 1107107 - RNA, 18 nt, Homo sapiens
gcauuaaaaaugcauaua

SEQ ID NO: 1107108 - RNA, 15 nt, Homo sapiens
gcauuaaagugcugu

SEQ ID NO: 1107109 - RNA, 17 nt, Homo sapiens
gcauuagaaacugaaaa

SEQ ID NO: 1107110 - RNA, 20 nt, Homo sapiens
gcauuuuacugucuguaaga

SEQ ID NO: 1107111 - RNA, 16 nt, Homo sapiens
gcauuuuuacuacuau

SEQ ID NO: 1107112 - RNA, 14 nt, Homo sapiens
gccaaaaauagcua

SEQ ID NO: 1107113 - RNA, 14 nt, Homo sapiens
gccaaauuuuggcc

SEQ ID NO: 1107114 - RNA, 23 nt, Homo sapiens
gccaagcuuucuucuacaaccag

SEQ ID NO: 1107115 - RNA, 15 nt, Homo sapiens
gccacagaagccagg

SEQ ID NO: 1107116 - RNA, 21 nt, Homo sapiens
gccacguauguuuuuguguau

SEQ ID NO: 1107117 - RNA, 21 nt, Homo sapiens
gccacguguucucacacuggu

SEQ ID NO: 1107118 - RNA, 21 nt, Homo sapiens
gccacucaggaggcugaggca

SEQ ID NO: 1107119 - RNA, 17 nt, Homo sapiens
gccacuccugcuucucu

SEQ ID NO: 1107120 - RNA, 21 nt, Homo sapiens
gccagauguggagucuguguc

SEQ ID NO: 1107121 - RNA, 23 nt, Homo sapiens
gccagcccugccuggaggaccug

SEQ ID NO: 1107122 - RNA, 18 nt, Homo sapiens
gccagcugcaucuacuca

SEQ ID NO: 1107123 - RNA, 16 nt, Homo sapiens
gccaggacgaauugag

SEQ ID NO: 1107124 - RNA, 14 nt, Homo sapiens
gccauaacagacca

SEQ ID NO: 1107125 - RNA, 14 nt, Homo sapiens
gccaucaagggaau

SEQ ID NO: 1107126 - RNA, 18 nt, Homo sapiens
gccaucacccccuacccc

SEQ ID NO: 1107127 - RNA, 21 nt, Homo sapiens
gccauccuaggcuuaaaugca

SEQ ID NO: 1107128 - RNA, 23 nt, Homo sapiens
gccaugaggccuuuccccagugu

SEQ ID NO: 1107129 - RNA, 15 nt, Homo sapiens
gccaugcuucuugcc

SEQ ID NO: 1107130 - RNA, 22 nt, Homo sapiens
gccauguaccaguguacugcuu

SEQ ID NO: 1107131 - RNA, 21 nt, Homo sapiens
gcccaaauggcucugugaaau

SEQ ID NO: 1107132 - RNA, 22 nt, Homo sapiens
gcccaagcagagugauucaggg

SEQ ID NO: 1107133 - RNA, 11 nt, Homo sapiens
gcccagaauug

SEQ ID NO: 1107134 - RNA, 15 nt, Homo sapiens
gcccaggcaggccac

SEQ ID NO: 1107135 - RNA, 17 nt, Homo sapiens
gcccaggccugccuguu

SEQ ID NO: 1107136 - RNA, 20 nt, Homo sapiens
gcccagggcaucccaugggg

SEQ ID NO: 1107137 - RNA, 20 nt, Homo sapiens
gcccaggggcccacagggaa

SEQ ID NO: 1107138 - RNA, 19 nt, Homo sapiens
gcccaggucaacaucuaag

SEQ ID NO: 1107139 - RNA, 21 nt, Homo sapiens
gcccauuggcucccaucugaa

SEQ ID NO: 1107140 - RNA, 19 nt, Homo sapiens
gccccaugaccuccagcuu

SEQ ID NO: 1107141 - RNA, 15 nt, Homo sapiens
gccccugcccggcug

SEQ ID NO: 1107142 - RNA, 21 nt, Homo sapiens
gccccuuggcgggcagcccag

SEQ ID NO: 1107143 - RNA, 21 nt, Homo sapiens
gcccgucauguuccucaaaag

SEQ ID NO: 1107144 - RNA, 16 nt, Homo sapiens
gcccuggcugacccca

SEQ ID NO: 1107145 - RNA, 20 nt, Homo sapiens
gcccuggcugaccccaaaga

SEQ ID NO: 1107146 - RNA, 19 nt, Homo sapiens
gcccugggccccaccaccu

SEQ ID NO: 1107147 - RNA, 17 nt, Homo sapiens
gcccuuuggguacuacu

SEQ ID NO: 1107148 - RNA, 19 nt, Homo sapiens
gccgcauucccugagucac

SEQ ID NO: 1107149 - RNA, 13 nt, Homo sapiens
gccggacguggug

SEQ ID NO: 1107150 - RNA, 13 nt, Homo sapiens
gccgggacaugca

SEQ ID NO: 1107151 - RNA, 23 nt, Homo sapiens
gccuacagauaauuuauuuugua

SEQ ID NO: 1107152 - RNA, 19 nt, Homo sapiens
gccuacaggagugagcacu

SEQ ID NO: 1107153 - RNA, 22 nt, Homo sapiens
gccuacccccugaaagugacag

SEQ ID NO: 1107154 - RNA, 13 nt, Homo sapiens
gccuagcuuucau

SEQ ID NO: 1107155 - RNA, 14 nt, Homo sapiens
gccuaggugacaga

SEQ ID NO: 1107156 - RNA, 14 nt, Homo sapiens
gccuauaaucccag

SEQ ID NO: 1107157 - RNA, 19 nt, Homo sapiens
gccuaugcacauauggacu

SEQ ID NO: 1107158 - RNA, 14 nt, Homo sapiens
gccucaaagcaagc

SEQ ID NO: 1107159 - RNA, 18 nt, Homo sapiens
gccucaggggccucaggg

SEQ ID NO: 1107160 - RNA, 20 nt, Homo sapiens
gccucauuuuuuuccuugca

SEQ ID NO: 1107161 - RNA, 19 nt, Homo sapiens
gccuccaaggggcuuuguc

SEQ ID NO: 1107162 - RNA, 21 nt, Homo sapiens
gccuccaggagccuacccccu

SEQ ID NO: 1107163 - RNA, 20 nt, Homo sapiens
gccucgguggccaugcuucu

SEQ ID NO: 1107164 - RNA, 13 nt, Homo sapiens
gccucugacucac

SEQ ID NO: 1107165 - RNA, 12 nt, Homo sapiens
gccucuggaaaa

SEQ ID NO: 1107166 - RNA, 21 nt, Homo sapiens
gccucuggaaaacucaggauu

SEQ ID NO: 1107167 - RNA, 19 nt, Homo sapiens
gccucuuccucccucauuc

SEQ ID NO: 1107168 - RNA, 14 nt, Homo sapiens
gccugaaagcaaga

SEQ ID NO: 1107169 - RNA, 18 nt, Homo sapiens
gccugacgaacuccuuga

SEQ ID NO: 1107170 - RNA, 22 nt, Homo sapiens
gccugaugggguggaaggcaug

SEQ ID NO: 1107171 - RNA, 16 nt, Homo sapiens
gccugcacuaauuuga

SEQ ID NO: 1107172 - RNA, 14 nt, Homo sapiens
gccugcagacucac

SEQ ID NO: 1107173 - RNA, 21 nt, Homo sapiens
gccugcccagugcacuugcug

SEQ ID NO: 1107174 - RNA, 19 nt, Homo sapiens
gccugcccccagcacuccu

SEQ ID NO: 1107175 - RNA, 22 nt, Homo sapiens
gccugcuuggggggugaugagg

SEQ ID NO: 1107176 - RNA, 20 nt, Homo sapiens
gccuggaaauuaaacccugc

SEQ ID NO: 1107177 - RNA, 23 nt, Homo sapiens
gccuggaucuccccacucuaggg

SEQ ID NO: 1107178 - RNA, 19 nt, Homo sapiens
gccuggcaagugggugaaa

SEQ ID NO: 1107179 - RNA, 15 nt, Homo sapiens
gccuggcuucuggag

SEQ ID NO: 1107180 - RNA, 16 nt, Homo sapiens
gccugggcaacaacag

SEQ ID NO: 1107181 - RNA, 18 nt, Homo sapiens
gccugggcuguggacaga

SEQ ID NO: 1107182 - RNA, 17 nt, Homo sapiens
gccugguagaauuggga

SEQ ID NO: 1107183 - RNA, 17 nt, Homo sapiens
gccuguagccccaguga

SEQ ID NO: 1107184 - RNA, 17 nt, Homo sapiens
gccugugugagcaucuc

SEQ ID NO: 1107185 - RNA, 18 nt, Homo sapiens
gccugugugagcaucucu

SEQ ID NO: 1107186 - RNA, 17 nt, Homo sapiens
gccuguucauggcagau

SEQ ID NO: 1107187 - RNA, 19 nt, Homo sapiens
gccuuaaguaauguuaauu

SEQ ID NO: 1107188 - RNA, 21 nt, Homo sapiens
gccuucacuccggugugccug

SEQ ID NO: 1107189 - RNA, 15 nt, Homo sapiens
gccuucacuuuacaa

SEQ ID NO: 1107190 - RNA, 14 nt, Homo sapiens
gccuucauaagccu

SEQ ID NO: 1107191 - RNA, 22 nt, Homo sapiens
gccuucucuguucauuuccuca

SEQ ID NO: 1107192 - RNA, 22 nt, Homo sapiens
gccuuggggauucuuccaucug

SEQ ID NO: 1107193 - RNA, 21 nt, Homo sapiens
gccuuuaguuuuaacaguuca

SEQ ID NO: 1107194 - RNA, 21 nt, Homo sapiens
gccuuuauuaaaaacugagug

SEQ ID NO: 1107195 - RNA, 16 nt, Homo sapiens
gccuuuccccagugug

SEQ ID NO: 1107196 - RNA, 17 nt, Homo sapiens
gccuuucuuauuugcaa

SEQ ID NO: 1107197 - RNA, 19 nt, Homo sapiens
gccuuucuuauuugcaaua

SEQ ID NO: 1107198 - RNA, 18 nt, Homo sapiens
gcgaaggggcccuggucc

SEQ ID NO: 1107199 - RNA, 21 nt, Homo sapiens
gcgacagaagucuugucucaa

SEQ ID NO: 1107200 - RNA, 22 nt, Homo sapiens
gcgacagaagucuugucucaag

SEQ ID NO: 1107201 - RNA, 13 nt, Homo sapiens
gcgagcacaccuu

SEQ ID NO: 1107202 - RNA, 17 nt, Homo sapiens
gcgauugaaagggcaau

SEQ ID NO: 1107203 - RNA, 14 nt, Homo sapiens
gcgcaucaggccug

SEQ ID NO: 1107204 - RNA, 19 nt, Homo sapiens
gcgccagaacccagauuuc

SEQ ID NO: 1107205 - RNA, 17 nt, Homo sapiens
gcgccuccuuccuugcu

SEQ ID NO: 1107206 - RNA, 17 nt, Homo sapiens
gcgcugcucaaccucuc

SEQ ID NO: 1107207 - RNA, 20 nt, Homo sapiens
gcgcugguggaccacaggca

SEQ ID NO: 1107208 - RNA, 16 nt, Homo sapiens
gcggagguuccaguga

SEQ ID NO: 1107209 - RNA, 17 nt, Homo sapiens
gcggcacauuggcagug

SEQ ID NO: 1107210 - RNA, 20 nt, Homo sapiens
gcgucgcuggacaacccaga

SEQ ID NO: 1107211 - RNA, 16 nt, Homo sapiens
gcgugagccacugcac

SEQ ID NO: 1107212 - RNA, 20 nt, Homo sapiens
gcguggacucugcacauguc

SEQ ID NO: 1107213 - RNA, 19 nt, Homo sapiens
gcgugguggcgggcaccua

SEQ ID NO: 1107214 - RNA, 20 nt, Homo sapiens
gcuaacccccuucuacugag

SEQ ID NO: 1107215 - RNA, 16 nt, Homo sapiens
gcuacaaacauaucaa

SEQ ID NO: 1107216 - RNA, 20 nt, Homo sapiens
gcuacaccacucuggcagcc

SEQ ID NO: 1107217 - RNA, 16 nt, Homo sapiens
gcuaccucacuggggu

SEQ ID NO: 1107218 - RNA, 18 nt, Homo sapiens
gcuacucagaagccugag

SEQ ID NO: 1107219 - RNA, 13 nt, Homo sapiens
gcuagaaggccac

SEQ ID NO: 1107220 - RNA, 15 nt, Homo sapiens
gcuagcaaauuugag

SEQ ID NO: 1107221 - RNA, 14 nt, Homo sapiens
gcuaggaagugacc

SEQ ID NO: 1107222 - RNA, 16 nt, Homo sapiens
gcuaucacacaguggg

SEQ ID NO: 1107223 - RNA, 21 nt, Homo sapiens
gcuaucugcauuuauaaaugu

SEQ ID NO: 1107224 - RNA, 23 nt, Homo sapiens
gcuaugaggguccccgggagcac

SEQ ID NO: 1107225 - RNA, 16 nt, Homo sapiens
gcucaaaucuauucag

SEQ ID NO: 1107226 - RNA, 22 nt, Homo sapiens
gcucaaccacuguggcguucug

SEQ ID NO: 1107227 - RNA, 23 nt, Homo sapiens
gcucaauauuccugaaugaaaua

SEQ ID NO: 1107228 - RNA, 18 nt, Homo sapiens
gcucaccagccccagugc

SEQ ID NO: 1107229 - RNA, 21 nt, Homo sapiens
gcucacccaagcaaggccaaa

SEQ ID NO: 1107230 - RNA, 19 nt, Homo sapiens
gcucagagcagaaccaaag

SEQ ID NO: 1107231 - RNA, 18 nt, Homo sapiens
gcucagaggcccaggaau

SEQ ID NO: 1107232 - RNA, 21 nt, Homo sapiens
gcucagcccugacuggugcua

SEQ ID NO: 1107233 - RNA, 22 nt, Homo sapiens
gcucaggaggcuuggaaagcau

SEQ ID NO: 1107234 - RNA, 21 nt, Homo sapiens
gcuccaagagaauucacuuua

SEQ ID NO: 1107235 - RNA, 22 nt, Homo sapiens
gcuccacuuucagugaaagcau

SEQ ID NO: 1107236 - RNA, 15 nt, Homo sapiens
gcuccaggacucccu

SEQ ID NO: 1107237 - RNA, 22 nt, Homo sapiens
gcuccaguauggaagaaugggg

SEQ ID NO: 1107238 - RNA, 14 nt, Homo sapiens
gcucccagcacuca

SEQ ID NO: 1107239 - RNA, 15 nt, Homo sapiens
gcuccccagugcuac

SEQ ID NO: 1107240 - RNA, 15 nt, Homo sapiens
gcuccugucugccag

SEQ ID NO: 1107241 - RNA, 13 nt, Homo sapiens
gcucuaguucaaa

SEQ ID NO: 1107242 - RNA, 18 nt, Homo sapiens
gcucugaucauccacugu

SEQ ID NO: 1107243 - RNA, 22 nt, Homo sapiens
gcucugcacagggaugaccugg

SEQ ID NO: 1107244 - RNA, 17 nt, Homo sapiens
gcucugcuggucacugg

SEQ ID NO: 1107245 - RNA, 20 nt, Homo sapiens
gcucuggccaaccaaagaca

SEQ ID NO: 1107246 - RNA, 18 nt, Homo sapiens
gcucuuucccuuuaucag

SEQ ID NO: 1107247 - RNA, 20 nt, Homo sapiens
gcugaaaaucacuauaacca

SEQ ID NO: 1107248 - RNA, 20 nt, Homo sapiens
gcugagauugcgccacugca

SEQ ID NO: 1107249 - RNA, 16 nt, Homo sapiens
gcugaggcaagagaau

SEQ ID NO: 1107250 - RNA, 14 nt, Homo sapiens
gcugagucugcaga

SEQ ID NO: 1107251 - RNA, 19 nt, Homo sapiens
gcugagugcaccacuucaa

SEQ ID NO: 1107252 - RNA, 21 nt, Homo sapiens
gcugaucaguuuuuucaccug

SEQ ID NO: 1107253 - RNA, 21 nt, Homo sapiens
gcugaugaacucuuaaucaaa

SEQ ID NO: 1107254 - RNA, 18 nt, Homo sapiens
gcugcaaagugcaaauac

SEQ ID NO: 1107255 - RNA, 14 nt, Homo sapiens
gcugcagaaggcca

SEQ ID NO: 1107256 - RNA, 14 nt, Homo sapiens
gcugcaggaaucaa

SEQ ID NO: 1107257 - RNA, 18 nt, Homo sapiens
gcugcauuugugucaucu

SEQ ID NO: 1107258 - RNA, 18 nt, Homo sapiens
gcugcucagaggggcccc

SEQ ID NO: 1107259 - RNA, 14 nt, Homo sapiens
gcugcucugugguc

SEQ ID NO: 1107260 - RNA, 10 nt, Homo sapiens
gcugcugaga

SEQ ID NO: 1107261 - RNA, 19 nt, Homo sapiens
gcugcugagaaucuagccu

SEQ ID NO: 1107262 - RNA, 12 nt, Homo sapiens
gcugcuguguag

SEQ ID NO: 1107263 - RNA, 20 nt, Homo sapiens
gcuggaaaagucacacagac

SEQ ID NO: 1107264 - RNA, 12 nt, Homo sapiens
gcuggaagcaca

SEQ ID NO: 1107265 - RNA, 14 nt, Homo sapiens
gcuggcagccaccc

SEQ ID NO: 1107266 - RNA, 14 nt, Homo sapiens
gcuggcgugcagug

SEQ ID NO: 1107267 - RNA, 16 nt, Homo sapiens
gcugggacuacaggug

SEQ ID NO: 1107268 - RNA, 21 nt, Homo sapiens
gcugggauguuucugucacau

SEQ ID NO: 1107269 - RNA, 15 nt, Homo sapiens
gcugggcucgccaca

SEQ ID NO: 1107270 - RNA, 19 nt, Homo sapiens
gcuggucucugcugaaggu

SEQ ID NO: 1107271 - RNA, 19 nt, Homo sapiens
guaugucuuggacacugua

SEQ ID NO: 1107272 - RNA, 22 nt, Homo sapiens
guauucacacaccccucaaaaa

SEQ ID NO: 1107273 - RNA, 16 nt, Homo sapiens
guauucuacagcagau

SEQ ID NO: 1107274 - RNA, 13 nt, Homo sapiens
guauucuucauca

SEQ ID NO: 1107275 - RNA, 13 nt, Homo sapiens
guauugugcauag

SEQ ID NO: 1107276 - RNA, 21 nt, Homo sapiens
guauuuauauuagagugcccu

SEQ ID NO: 1107277 - RNA, 13 nt, Homo sapiens
guauuuucauuua

SEQ ID NO: 1107278 - RNA, 12 nt, Homo sapiens
guauuuugccag

SEQ ID NO: 1107279 - RNA, 14 nt, Homo sapiens
guauuuugccagac

SEQ ID NO: 1107280 - RNA, 23 nt, Homo sapiens
gucaaaacagauuguuugcaaag

SEQ ID NO: 1107281 - RNA, 22 nt, Homo sapiens
gucaaggcccggccccaucaga

SEQ ID NO: 1107282 - RNA, 21 nt, Homo sapiens
gucaauauuaaauacagacac

SEQ ID NO: 1107283 - RNA, 14 nt, Homo sapiens
gucacaauccuaac

SEQ ID NO: 1107284 - RNA, 18 nt, Homo sapiens
gucacauggccuaugcac

SEQ ID NO: 1107285 - RNA, 13 nt, Homo sapiens
gucacugggcuac

SEQ ID NO: 1107286 - RNA, 13 nt, Homo sapiens
gucagaguagaag

SEQ ID NO: 1107287 - RNA, 23 nt, Homo sapiens
gucaggaacagaaggaugaauga

SEQ ID NO: 1107288 - RNA, 19 nt, Homo sapiens
gucaggaaucaugaucuga

SEQ ID NO: 1107289 - RNA, 13 nt, Homo sapiens
gucauauauucau

SEQ ID NO: 1107290 - RNA, 16 nt, Homo sapiens
gucauccacagcccaa

SEQ ID NO: 1107291 - RNA, 23 nt, Homo sapiens
gucaugauggcaccacugcacuc

SEQ ID NO: 1107292 - RNA, 13 nt, Homo sapiens
gucaugauuucaa

SEQ ID NO: 1107293 - RNA, 14 nt, Homo sapiens
gucauuucauuucc

SEQ ID NO: 1107294 - RNA, 17 nt, Homo sapiens
guccaaagaacaagaaa

SEQ ID NO: 1107295 - RNA, 19 nt, Homo sapiens
guccaaggcacaaaccuua

SEQ ID NO: 1107296 - RNA, 14 nt, Homo sapiens
guccacucugaaua

SEQ ID NO: 1107297 - RNA, 21 nt, Homo sapiens
guccagacccugaagauuuca

SEQ ID NO: 1107298 - RNA, 18 nt, Homo sapiens
guccagcuugcucuucag

SEQ ID NO: 1107299 - RNA, 17 nt, Homo sapiens
guccaggguugaucaca

SEQ ID NO: 1107300 - RNA, 13 nt, Homo sapiens
guccaguuuccaa

SEQ ID NO: 1107301 - RNA, 17 nt, Homo sapiens
gucccagcuacucagaa

SEQ ID NO: 1107302 - RNA, 18 nt, Homo sapiens
gucccagcuacucaggag

SEQ ID NO: 1107303 - RNA, 21 nt, Homo sapiens
gucccucaaaugacccaaaga

SEQ ID NO: 1107304 - RNA, 14 nt, Homo sapiens
gucccugccagugu

SEQ ID NO: 1107305 - RNA, 17 nt, Homo sapiens
gucccuugcugugagca

SEQ ID NO: 1107306 - RNA, 18 nt, Homo sapiens
gucccuugcuguuuucau

SEQ ID NO: 1107307 - RNA, 21 nt, Homo sapiens
gucccuugcuguuuucaucuc

SEQ ID NO: 1107308 - RNA, 21 nt, Homo sapiens
guccgcuuucaugaacacagc

SEQ ID NO: 1107309 - RNA, 18 nt, Homo sapiens
guccuaaggacacacuaa

SEQ ID NO: 1107310 - RNA, 18 nt, Homo sapiens
guccuacucugugucagg

SEQ ID NO: 1107311 - RNA, 23 nt, Homo sapiens
guccuccuuguucuacucauaua

SEQ ID NO: 1107312 - RNA, 14 nt, Homo sapiens
guccugagcacugc

SEQ ID NO: 1107313 - RNA, 20 nt, Homo sapiens
guccugagcacugccaggag

SEQ ID NO: 1107314 - RNA, 16 nt, Homo sapiens
guccugcagcuucggg

SEQ ID NO: 1107315 - RNA, 19 nt, Homo sapiens
guccuggucugcucaggaa

SEQ ID NO: 1107316 - RNA, 22 nt, Homo sapiens
guccugguggggcagcuccucu

SEQ ID NO: 1107317 - RNA, 22 nt, Homo sapiens
guccuucaaguuagcucaggag

SEQ ID NO: 1107318 - RNA, 14 nt, Homo sapiens
guccuugugugcau

SEQ ID NO: 1107319 - RNA, 15 nt, Homo sapiens
gucgacuuugagcug

SEQ ID NO: 1107320 - RNA, 16 nt, Homo sapiens
gucggcacgucccaug

SEQ ID NO: 1107321 - RNA, 22 nt, Homo sapiens
gucggcacgucccaugugcaug

SEQ ID NO: 1107322 - RNA, 13 nt, Homo sapiens
gucgguguguaau

SEQ ID NO: 1107323 - RNA, 16 nt, Homo sapiens
gucuaaaaacaccaaa

SEQ ID NO: 1107324 - RNA, 18 nt, Homo sapiens
gucuaaaaacaccaaaaa

SEQ ID NO: 1107325 - RNA, 18 nt, Homo sapiens
gucuaugggacucaaugc

SEQ ID NO: 1107326 - RNA, 17 nt, Homo sapiens
gucucagaccacuauuc

SEQ ID NO: 1107327 - RNA, 18 nt, Homo sapiens
gucuccaucucugucuca

SEQ ID NO: 1107328 - RNA, 22 nt, Homo sapiens
gucuccucuuaaaaaauaaaaa

SEQ ID NO: 1107329 - RNA, 18 nt, Homo sapiens
gucucuaugaucuuggca

SEQ ID NO: 1107330 - RNA, 20 nt, Homo sapiens
gucucucuaaacccaaauaa

SEQ ID NO: 1107331 - RNA, 16 nt, Homo sapiens
gucucuggaacccagg

SEQ ID NO: 1107332 - RNA, 17 nt, Homo sapiens
gucucuuccaguuugcu

SEQ ID NO: 1107333 - RNA, 21 nt, Homo sapiens
gucucuuuaaugucacaggca

SEQ ID NO: 1107334 - RNA, 16 nt, Homo sapiens
gucugaucguucaaag

SEQ ID NO: 1107335 - RNA, 19 nt, Homo sapiens
gucugauuggcucacccaa

SEQ ID NO: 1107336 - RNA, 17 nt, Homo sapiens
gucugcuuaguaucuca

SEQ ID NO: 1107337 - RNA, 17 nt, Homo sapiens
gucuggaaaagcacuuu

SEQ ID NO: 1107338 - RNA, 16 nt, Homo sapiens
gucuggaaugcagugg

SEQ ID NO: 1107339 - RNA, 17 nt, Homo sapiens
gucuguaagagaauucu

SEQ ID NO: 1107340 - RNA, 20 nt, Homo sapiens
gucuuaagccuuuugcucac

SEQ ID NO: 1107341 - RNA, 13 nt, Homo sapiens
gucuucccuguau

SEQ ID NO: 1107342 - RNA, 15 nt, Homo sapiens
gucuuggacacugua

SEQ ID NO: 1107343 - RNA, 18 nt, Homo sapiens
gucuuggacacuguacaa

SEQ ID NO: 1107344 - RNA, 13 nt, Homo sapiens
gugaaccaaagag

SEQ ID NO: 1107345 - RNA, 23 nt, Homo sapiens
gugaaccaccacacccagcccac

SEQ ID NO: 1107346 - RNA, 18 nt, Homo sapiens
gugaacccaggacaagca

SEQ ID NO: 1107347 - RNA, 14 nt, Homo sapiens
gugaaucagacccu

SEQ ID NO: 1107348 - RNA, 13 nt, Homo sapiens
gugaaugaucucu

SEQ ID NO: 1107349 - RNA, 12 nt, Homo sapiens
gugacacauaug

SEQ ID NO: 1107350 - RNA, 13 nt, Homo sapiens
gugacacauaugc

SEQ ID NO: 1107351 - RNA, 13 nt, Homo sapiens
gugacacccaaga

SEQ ID NO: 1107352 - RNA, 20 nt, Homo sapiens
gugacaucucuuugauguca

SEQ ID NO: 1107353 - RNA, 13 nt, Homo sapiens
gugagauguaauu

SEQ ID NO: 1107354 - RNA, 21 nt, Homo sapiens
gugagcacuaaggugugcucu

SEQ ID NO: 1107355 - RNA, 17 nt, Homo sapiens
gugaguugcacagcuau

SEQ ID NO: 1107356 - RNA, 18 nt, Homo sapiens
gugauccacccaccucag

SEQ ID NO: 1107357 - RNA, 22 nt, Homo sapiens
gugaucccuagcugugaccucu

SEQ ID NO: 1107358 - RNA, 13 nt, Homo sapiens
gugauccucccac

SEQ ID NO: 1107359 - RNA, 21 nt, Homo sapiens
gugauugacacacagcacucu

SEQ ID NO: 1107360 - RNA, 13 nt, Homo sapiens
gugauuucagaga

SEQ ID NO: 1107361 - RNA, 19 nt, Homo sapiens
gugauuucagagagggcag

SEQ ID NO: 1107362 - RNA, 14 nt, Homo sapiens
gugcaugugcaguc

SEQ ID NO: 1107363 - RNA, 22 nt, Homo sapiens
gugcauuaacuuaaaagauuca

SEQ ID NO: 1107364 - RNA, 16 nt, Homo sapiens
gugcauuuaugagcuc

SEQ ID NO: 1107365 - RNA, 21 nt, Homo sapiens
gugccagcccugcauugcuga

SEQ ID NO: 1107366 - RNA, 15 nt, Homo sapiens
gugcccaccaacauc

SEQ ID NO: 1107367 - RNA, 18 nt, Homo sapiens
gugccguaacaacugugg

SEQ ID NO: 1107368 - RNA, 13 nt, Homo sapiens
gugccugcugcug

SEQ ID NO: 1107369 - RNA, 18 nt, Homo sapiens
gugccuggccuggcacac

SEQ ID NO: 1107370 - RNA, 19 nt, Homo sapiens
gugccuucauuugggaugc

SEQ ID NO: 1107371 - RNA, 14 nt, Homo sapiens
gugccuuccauaau

SEQ ID NO: 1107372 - RNA, 17 nt, Homo sapiens
gugcuaucgcaccacug

SEQ ID NO: 1107373 - RNA, 15 nt, Homo sapiens
gugcucacugaccug

SEQ ID NO: 1107374 - RNA, 21 nt, Homo sapiens
gugcucauucauuuaacagag

SEQ ID NO: 1107375 - RNA, 15 nt, Homo sapiens
gugcucggcagucau

SEQ ID NO: 1107376 - RNA, 23 nt, Homo sapiens
gugcucggcagucauacuggggu

SEQ ID NO: 1107377 - RNA, 15 nt, Homo sapiens
gugcucggcuguaaa

SEQ ID NO: 1107378 - RNA, 17 nt, Homo sapiens
gugcucugaucauccac

SEQ ID NO: 1107379 - RNA, 18 nt, Homo sapiens
gugcugcagccaggagga

SEQ ID NO: 1107380 - RNA, 18 nt, Homo sapiens
gugcugggauuacaggug

SEQ ID NO: 1107381 - RNA, 18 nt, Homo sapiens
guggaaccaacacuaaca

SEQ ID NO: 1107382 - RNA, 22 nt, Homo sapiens
guggcagaauggggugcaugaa

SEQ ID NO: 1107383 - RNA, 22 nt, Homo sapiens
guggcaucucuaauuggaagaa

SEQ ID NO: 1107384 - RNA, 17 nt, Homo sapiens
guggccagcacucugaa

SEQ ID NO: 1107385 - RNA, 19 nt, Homo sapiens
guggcccagggaagccaaa

SEQ ID NO: 1107386 - RNA, 17 nt, Homo sapiens
guggcuaaaugccuaau

SEQ ID NO: 1107387 - RNA, 21 nt, Homo sapiens
gugggguaaccaaauguuggc

SEQ ID NO: 1107388 - RNA, 20 nt, Homo sapiens
gugggguccccaucauccca

SEQ ID NO: 1107389 - RNA, 22 nt, Homo sapiens
gugggugccccccuugccagac

SEQ ID NO: 1107390 - RNA, 12 nt, Homo sapiens
guggguggugga

SEQ ID NO: 1107391 - RNA, 20 nt, Homo sapiens
guggucuuugaauaaagucu

SEQ ID NO: 1107392 - RNA, 21 nt, Homo sapiens
guggugagccgagauugcacc

SEQ ID NO: 1107393 - RNA, 18 nt, Homo sapiens
gugguggagaaccacagc

SEQ ID NO: 1107394 - RNA, 13 nt, Homo sapiens
gugguugcuguug

SEQ ID NO: 1107395 - RNA, 14 nt, Homo sapiens
guguagauugcgug

SEQ ID NO: 1107396 - RNA, 22 nt, Homo sapiens
guguagcucuguccacucugaa

SEQ ID NO: 1107397 - RNA, 15 nt, Homo sapiens
guguagugucuguaa

SEQ ID NO: 1107398 - RNA, 16 nt, Homo sapiens
guguauuuugagauaa

SEQ ID NO: 1107399 - RNA, 22 nt, Homo sapiens
guguauuuugagauaaugucaa

SEQ ID NO: 1107400 - RNA, 21 nt, Homo sapiens
gugucacuacucacagucucu

SEQ ID NO: 1107401 - RNA, 19 nt, Homo sapiens
gugucacucagcaguggga

SEQ ID NO: 1107402 - RNA, 17 nt, Homo sapiens
gugugaagaaauggaau

SEQ ID NO: 1107403 - RNA, 15 nt, Homo sapiens
gugugcagacugugg

SEQ ID NO: 1107404 - RNA, 22 nt, Homo sapiens
guguggcccagggaagccaaaa

SEQ ID NO: 1107405 - RNA, 22 nt, Homo sapiens
gugugucccccuaugcuccagu

SEQ ID NO: 1107406 - RNA, 18 nt, Homo sapiens
guguguuuggaagacuau

SEQ ID NO: 1107407 - RNA, 14 nt, Homo sapiens
guguuaacaaugca

SEQ ID NO: 1107408 - RNA, 16 nt, Homo sapiens
guguuccucaccaaua

SEQ ID NO: 1107409 - RNA, 21 nt, Homo sapiens
guguugaagaagaguuugcaa

SEQ ID NO: 1107410 - RNA, 14 nt, Homo sapiens
guguugaccacaga

SEQ ID NO: 1107411 - RNA, 15 nt, Homo sapiens
guguuucuggggaca

SEQ ID NO: 1107412 - RNA, 16 nt, Homo sapiens
guguuucuugccucau

SEQ ID NO: 1107413 - RNA, 13 nt, Homo sapiens
guguuugcugagg

SEQ ID NO: 1107414 - RNA, 22 nt, Homo sapiens
guguuuuugcuaucacacagug

SEQ ID NO: 1107415 - RNA, 18 nt, Homo sapiens
guuaacgucaucucaggg

SEQ ID NO: 1107416 - RNA, 13 nt, Homo sapiens
guuaauaaagaag

SEQ ID NO: 1107417 - RNA, 21 nt, Homo sapiens
guuacagcgagaggcagagaa

SEQ ID NO: 1107418 - RNA, 16 nt, Homo sapiens
guuacaucacaguguu

SEQ ID NO: 1107419 - RNA, 19 nt, Homo sapiens
guuacuaaagucacauaua

SEQ ID NO: 1107420 - RNA, 20 nt, Homo sapiens
guuacuguggccaguauuuu

SEQ ID NO: 1107421 - RNA, 15 nt, Homo sapiens
guuacuucacuuuaa

SEQ ID NO: 1107422 - RNA, 14 nt, Homo sapiens
guuagcaucuggcu

SEQ ID NO: 1107423 - RNA, 15 nt, Homo sapiens
guuaguaucaucaga

SEQ ID NO: 1107424 - RNA, 17 nt, Homo sapiens
guuauaaaucaauguca

SEQ ID NO: 1107425 - RNA, 18 nt, Homo sapiens
guuauaaaucaaugucac

SEQ ID NO: 1107426 - RNA, 19 nt, Homo sapiens
guuauaaaucaaugucacu

SEQ ID NO: 1107427 - RNA, 15 nt, Homo sapiens
guuauagacugccau

SEQ ID NO: 1107428 - RNA, 13 nt, Homo sapiens
guuauauauauca

SEQ ID NO: 1107429 - RNA, 18 nt, Homo sapiens
guuaucuaauauguaaca

SEQ ID NO: 1107430 - RNA, 21 nt, Homo sapiens
guuauuucucccuuguguuag

SEQ ID NO: 1107431 - RNA, 19 nt, Homo sapiens
guucauauuggacugauaa

SEQ ID NO: 1107432 - RNA, 20 nt, Homo sapiens
guucccucuuucuuucuuuu

SEQ ID NO: 1107433 - RNA, 16 nt, Homo sapiens
guucgagaccaaccug

SEQ ID NO: 1107434 - RNA, 22 nt, Homo sapiens
guucucaaauauuugcuaugaa

SEQ ID NO: 1107435 - RNA, 21 nt, Homo sapiens
guucucucuuaguaacauaga

SEQ ID NO: 1107436 - RNA, 14 nt, Homo sapiens
guucugauaaugaa

SEQ ID NO: 1107437 - RNA, 11 nt, Homo sapiens
guucuuaccug

SEQ ID NO: 1107438 - RNA, 14 nt, Homo sapiens
guucuuuuacugua

SEQ ID NO: 1107439 - RNA, 19 nt, Homo sapiens
guugaaaucagaagccuac

SEQ ID NO: 1107440 - RNA, 19 nt, Homo sapiens
guugaacaucucacuuugc

SEQ ID NO: 1107441 - RNA, 18 nt, Homo sapiens
guugaaccguuucuuuaa

SEQ ID NO: 1107442 - RNA, 16 nt, Homo sapiens
guugagacuuagauaa

SEQ ID NO: 1107443 - RNA, 19 nt, Homo sapiens
guugagaguugcuggugua

SEQ ID NO: 1107444 - RNA, 15 nt, Homo sapiens
guugcaugauguauu

SEQ ID NO: 1107445 - RNA, 18 nt, Homo sapiens
guuggaaaaugugcaaua

SEQ ID NO: 1107446 - RNA, 22 nt, Homo sapiens
guuggauuuguuuaaaaaccaa

SEQ ID NO: 1107447 - RNA, 23 nt, Homo sapiens
guuggcccagaccucaggugcua

SEQ ID NO: 1107448 - RNA, 15 nt, Homo sapiens
guuggccugguggcc

SEQ ID NO: 1107449 - RNA, 22 nt, Homo sapiens
ggaaauaaaauuuaggaccaau

SEQ ID NO: 1107450 - RNA, 21 nt, Homo sapiens
ggaaauguaacuugaagcagc

SEQ ID NO: 1107451 - RNA, 13 nt, Homo sapiens
ggaacucucucca

SEQ ID NO: 1107452 - RNA, 14 nt, Homo sapiens
ggaacucucuccac

SEQ ID NO: 1107453 - RNA, 20 nt, Homo sapiens
ggaacucuggcuuccaggua

SEQ ID NO: 1107454 - RNA, 19 nt, Homo sapiens
ggaagaaacaaaguugaac

SEQ ID NO: 1107455 - RNA, 14 nt, Homo sapiens
ggaagaccaagaca

SEQ ID NO: 1107456 - RNA, 18 nt, Homo sapiens
ggaagagcugcaacggaa

SEQ ID NO: 1107457 - RNA, 23 nt, Homo sapiens
ggaagauucccucuuccugccaa

SEQ ID NO: 1107458 - RNA, 23 nt, Homo sapiens
ggaagcauuuguuucuacuuuga

SEQ ID NO: 1107459 - RNA, 14 nt, Homo sapiens
ggaaggagugagau

SEQ ID NO: 1107460 - RNA, 16 nt, Homo sapiens
ggaaggcugcugugua

SEQ ID NO: 1107461 - RNA, 14 nt, Homo sapiens
ggaauaaagcccuu

SEQ ID NO: 1107462 - RNA, 15 nt, Homo sapiens
ggaauaaggccuuaa

SEQ ID NO: 1107463 - RNA, 20 nt, Homo sapiens
ggaauauuugcaagacauag

SEQ ID NO: 1107464 - RNA, 21 nt, Homo sapiens
ggaauuaggaagaccaagaca

SEQ ID NO: 1107465 - RNA, 15 nt, Homo sapiens
ggaauuuucuuccaa

SEQ ID NO: 1107466 - RNA, 19 nt, Homo sapiens
ggacaccccuuauccagga

SEQ ID NO: 1107467 - RNA, 22 nt, Homo sapiens
ggacaccuggccgccuccagga

SEQ ID NO: 1107468 - RNA, 18 nt, Homo sapiens
ggacacuaauacaccagg

SEQ ID NO: 1107469 - RNA, 11 nt, Homo sapiens
ggacacuguac

SEQ ID NO: 1107470 - RNA, 15 nt, Homo sapiens
ggacaggcauguucu

SEQ ID NO: 1107471 - RNA, 17 nt, Homo sapiens
ggacaguccugggagaa

SEQ ID NO: 1107472 - RNA, 14 nt, Homo sapiens
ggaccaacccuguu

SEQ ID NO: 1107473 - RNA, 13 nt, Homo sapiens
ggaccacaccucc

SEQ ID NO: 1107474 - RNA, 18 nt, Homo sapiens
ggacgccacucauuucau

SEQ ID NO: 1107475 - RNA, 19 nt, Homo sapiens
ggacuauuuaugaaggcaa

SEQ ID NO: 1107476 - RNA, 21 nt, Homo sapiens
ggacuccccaggccaggccac

SEQ ID NO: 1107477 - RNA, 11 nt, Homo sapiens
ggacugagaug

SEQ ID NO: 1107478 - RNA, 22 nt, Homo sapiens
ggacuucuccuccaguggaccu

SEQ ID NO: 1107479 - RNA, 13 nt, Homo sapiens
ggacuuguaggga

SEQ ID NO: 1107480 - RNA, 18 nt, Homo sapiens
ggagaaucacuugcacuc

SEQ ID NO: 1107481 - RNA, 21 nt, Homo sapiens
ggagacucaccucugccucaa

SEQ ID NO: 1107482 - RNA, 12 nt, Homo sapiens
ggagacuuguau

SEQ ID NO: 1107483 - RNA, 14 nt, Homo sapiens
ggagagaacugaau

SEQ ID NO: 1107484 - RNA, 16 nt, Homo sapiens
ggagaguacagugagc

SEQ ID NO: 1107485 - RNA, 15 nt, Homo sapiens
ggagcaaauguuucu

SEQ ID NO: 1107486 - RNA, 13 nt, Homo sapiens
ggagcacuggguu

SEQ ID NO: 1107487 - RNA, 13 nt, Homo sapiens
ggagcgcaccugc

SEQ ID NO: 1107488 - RNA, 16 nt, Homo sapiens
ggaggaccugagccug

SEQ ID NO: 1107489 - RNA, 20 nt, Homo sapiens
ggaggauguucugggacaca

SEQ ID NO: 1107490 - RNA, 21 nt, Homo sapiens
ggaggcugcucggggugcaca

SEQ ID NO: 1107491 - RNA, 21 nt, Homo sapiens
ggaggcuugccccacccaaca

SEQ ID NO: 1107492 - RNA, 22 nt, Homo sapiens
ggagggcgugacucacccaagc

SEQ ID NO: 1107493 - RNA, 22 nt, Homo sapiens
ggagguagcucccagcacucaa

SEQ ID NO: 1107494 - RNA, 23 nt, Homo sapiens
ggaggucgggauggggcuuguag

SEQ ID NO: 1107495 - RNA, 20 nt, Homo sapiens
ggaggugaccccagguuucu

SEQ ID NO: 1107496 - RNA, 14 nt, Homo sapiens
ggauagucugucca

SEQ ID NO: 1107497 - RNA, 18 nt, Homo sapiens
ggaucaagaaggggacag

SEQ ID NO: 1107498 - RNA, 21 nt, Homo sapiens
ggauccuauucucaccaggaa

SEQ ID NO: 1107499 - RNA, 15 nt, Homo sapiens
ggaucuaucuguauu

SEQ ID NO: 1107500 - RNA, 19 nt, Homo sapiens
ggaucuccaaggaccaggu

SEQ ID NO: 1107501 - RNA, 15 nt, Homo sapiens
acuucagucuuggag

SEQ ID NO: 1107502 - RNA, 14 nt, Homo sapiens
acuucccuaaugaa

SEQ ID NO: 1107503 - RNA, 16 nt, Homo sapiens
acuucccuaaugaagu

SEQ ID NO: 1107504 - RNA, 14 nt, Homo sapiens
acuuccuaaugauu

SEQ ID NO: 1107505 - RNA, 19 nt, Homo sapiens
acuuccugugacuucagcu

SEQ ID NO: 1107506 - RNA, 16 nt, Homo sapiens
acuucucuuugccuca

SEQ ID NO: 1107507 - RNA, 24 nt, Homo sapiens
acuucuuacaauaauucuaugaga

SEQ ID NO: 1107508 - RNA, 13 nt, Homo sapiens
acuugaaauacca

SEQ ID NO: 1107509 - RNA, 22 nt, Homo sapiens
acuugaacugauucacaucuca

SEQ ID NO: 1107510 - RNA, 21 nt, Homo sapiens
acuugaaucaaagcaguuaac

SEQ ID NO: 1107511 - RNA, 23 nt, Homo sapiens
acuugaggacacauguccagugg

SEQ ID NO: 1107512 - RNA, 21 nt, Homo sapiens
acuugaugacagacacuucua

SEQ ID NO: 1107513 - RNA, 21 nt, Homo sapiens
acuugcaccugguacugcaca

SEQ ID NO: 1107514 - RNA, 22 nt, Homo sapiens
acuugcaccugguacugcacau

SEQ ID NO: 1107515 - RNA, 22 nt, Homo sapiens
acuugcagauacauucaugagg

SEQ ID NO: 1107516 - RNA, 14 nt, Homo sapiens
acuugcugccugaa

SEQ ID NO: 1107517 - RNA, 22 nt, Homo sapiens
acuugugcugaucgugcuaaau

SEQ ID NO: 1107518 - RNA, 14 nt, Homo sapiens
acuuguggacacag

SEQ ID NO: 1107519 - RNA, 19 nt, Homo sapiens
acuuuaaagcguuugcaca

SEQ ID NO: 1107520 - RNA, 13 nt, Homo sapiens
acuuuaauucuca

SEQ ID NO: 1107521 - RNA, 22 nt, Homo sapiens
acuuuccauagggccuccuuag

SEQ ID NO: 1107522 - RNA, 22 nt, Homo sapiens
acuuucuguugccacaacccug

SEQ ID NO: 1107523 - RNA, 18 nt, Homo sapiens
acuuugaguuagugccau

SEQ ID NO: 1107524 - RNA, 22 nt, Homo sapiens
acuuugguggccacauaagcca

SEQ ID NO: 1107525 - RNA, 22 nt, Homo sapiens
acuuuuaaguugcugaugaacu

SEQ ID NO: 1107526 - RNA, 23 nt, Homo sapiens
acuuuuaaguugcugaugaacuc

SEQ ID NO: 1107527 - RNA, 14 nt, Homo sapiens
acuuuuccuuugaa

SEQ ID NO: 1107528 - RNA, 21 nt, Homo sapiens
acuuuucuuuccucagaucau

SEQ ID NO: 1107529 - RNA, 20 nt, Homo sapiens
acuuuugugcuccccuuugc

SEQ ID NO: 1107530 - RNA, 18 nt, Homo sapiens
acuuuuuacagugcuauu

SEQ ID NO: 1107531 - RNA, 22 nt, Homo sapiens
acuuuuuucuuauuuaacuuaa

SEQ ID NO: 1107532 - RNA, 13 nt, Homo sapiens
agaaaaaccaaug

SEQ ID NO: 1107533 - RNA, 14 nt, Homo sapiens
agaaaacaugacuu

SEQ ID NO: 1107534 - RNA, 12 nt, Homo sapiens
agaaaaccagcg

SEQ ID NO: 1107535 - RNA, 16 nt, Homo sapiens
agaaaacgaacuggga

SEQ ID NO: 1107536 - RNA, 14 nt, Homo sapiens
agaaaacuggaaau

SEQ ID NO: 1107537 - RNA, 19 nt, Homo sapiens
agaaaagauuuaaguaauu

SEQ ID NO: 1107538 - RNA, 13 nt, Homo sapiens
agaaaagcacuuu

SEQ ID NO: 1107539 - RNA, 21 nt, Homo sapiens
agaaaaguagguuuacauuca

SEQ ID NO: 1107540 - RNA, 17 nt, Homo sapiens
agaaaauaaaagcacuu

SEQ ID NO: 1107541 - RNA, 16 nt, Homo sapiens
agaaaccagagucaaa

SEQ ID NO: 1107542 - RNA, 21 nt, Homo sapiens
agaaaccuuauuguaccucuc

SEQ ID NO: 1107543 - RNA, 17 nt, Homo sapiens
agaaacuuccuuugaga

SEQ ID NO: 1107544 - RNA, 22 nt, Homo sapiens
agaaaggagaacuauccaaaac

SEQ ID NO: 1107545 - RNA, 22 nt, Homo sapiens
agaaagguaaacaaacaaauaa

SEQ ID NO: 1107546 - RNA, 14 nt, Homo sapiens
agaaaugacuuuga

SEQ ID NO: 1107547 - RNA, 14 nt, Homo sapiens
agaaauuagcugug

SEQ ID NO: 1107548 - RNA, 13 nt, Homo sapiens
agaaauuccugua

SEQ ID NO: 1107549 - RNA, 15 nt, Homo sapiens
agaacaacuacugug

SEQ ID NO: 1107550 - RNA, 20 nt, Homo sapiens
agaacaagcaacauaaaaca

SEQ ID NO: 1107551 - RNA, 16 nt, Homo sapiens
agaacacaaggucauu

SEQ ID NO: 1107552 - RNA, 15 nt, Homo sapiens
agaacagcagacuca

SEQ ID NO: 1107553 - RNA, 19 nt, Homo sapiens
agaacaguaacugccauca

SEQ ID NO: 1107554 - RNA, 12 nt, Homo sapiens
agaaccaaagca

SEQ ID NO: 1107555 - RNA, 19 nt, Homo sapiens
agaaccaugguaugaaggu

SEQ ID NO: 1107556 - RNA, 11 nt, Homo sapiens
agaaccucagg

SEQ ID NO: 1107557 - RNA, 21 nt, Homo sapiens
agaacggcaugugaauucugu

SEQ ID NO: 1107558 - RNA, 12 nt, Homo sapiens
agaacuauccaa

SEQ ID NO: 1107559 - RNA, 18 nt, Homo sapiens
agaacucugggcugcuac

SEQ ID NO: 1107560 - RNA, 22 nt, Homo sapiens
agaacuggaggaguuccuugau

SEQ ID NO: 1107561 - RNA, 19 nt, Homo sapiens
agaagacacugaugggcaa

SEQ ID NO: 1107562 - RNA, 13 nt, Homo sapiens
agaagaccagacu

SEQ ID NO: 1107563 - RNA, 14 nt, Homo sapiens
agaagaguuugcaa

SEQ ID NO: 1107564 - RNA, 18 nt, Homo sapiens
agaagauuuuaugcugcu

SEQ ID NO: 1107565 - RNA, 21 nt, Homo sapiens
agaagauuuugccacauuuga

SEQ ID NO: 1107566 - RNA, 23 nt, Homo sapiens
agaagccucugccucccuagcuu

SEQ ID NO: 1107567 - RNA, 16 nt, Homo sapiens
agaaggcacaggugua

SEQ ID NO: 1107568 - RNA, 14 nt, Homo sapiens
agaagguccuuaau

SEQ ID NO: 1107569 - RNA, 17 nt, Homo sapiens
agaaguaaaagcuaauu

SEQ ID NO: 1107570 - RNA, 20 nt, Homo sapiens
agaagucucuuccaguuugc

SEQ ID NO: 1107571 - RNA, 17 nt, Homo sapiens
agaauaauuguguacaa

SEQ ID NO: 1107572 - RNA, 19 nt, Homo sapiens
agaauauuuauuaccucug

SEQ ID NO: 1107573 - RNA, 19 nt, Homo sapiens
agaaucauugaaguauuuu

SEQ ID NO: 1107574 - RNA, 11 nt, Homo sapiens
agaauccaaag

SEQ ID NO: 1107575 - RNA, 18 nt, Homo sapiens
agaauccuacaacuucca

SEQ ID NO: 1107576 - RNA, 19 nt, Homo sapiens
agaaucuauuuccuuucca

SEQ ID NO: 1107577 - RNA, 14 nt, Homo sapiens
agaaugaaguggag

SEQ ID NO: 1107578 - RNA, 13 nt, Homo sapiens
agaauggaacuca

SEQ ID NO: 1107579 - RNA, 19 nt, Homo sapiens
agaauugcuugaacccagg

SEQ ID NO: 1107580 - RNA, 15 nt, Homo sapiens
agaauuuguccaaua

SEQ ID NO: 1107581 - RNA, 15 nt, Homo sapiens
agacaacauuucuca

SEQ ID NO: 1107582 - RNA, 21 nt, Homo sapiens
agacaauggcuuacuccagga

SEQ ID NO: 1107583 - RNA, 15 nt, Homo sapiens
agacacgcucuucua

SEQ ID NO: 1107584 - RNA, 21 nt, Homo sapiens
agacagaaccccuacaugaaa

SEQ ID NO: 1107585 - RNA, 20 nt, Homo sapiens
agacagaguuuucacucuua

SEQ ID NO: 1107586 - RNA, 22 nt, Homo sapiens
agacagaguuuucacucuuauu

SEQ ID NO: 1107587 - RNA, 19 nt, Homo sapiens
agacaggguuuugccaugu

SEQ ID NO: 1107588 - RNA, 14 nt, Homo sapiens
agacaguucaagaa

SEQ ID NO: 1107589 - RNA, 15 nt, Homo sapiens
agacaguucaagaaa

SEQ ID NO: 1107590 - RNA, 14 nt, Homo sapiens
cacacuucucagga

SEQ ID NO: 1107591 - RNA, 12 nt, Homo sapiens
cacagaaguagc

SEQ ID NO: 1107592 - RNA, 11 nt, Homo sapiens
cacagacacac

SEQ ID NO: 1107593 - RNA, 15 nt, Homo sapiens
cacagacagauccca

SEQ ID NO: 1107594 - RNA, 16 nt, Homo sapiens
cacagcacucucuaaa

SEQ ID NO: 1107595 - RNA, 15 nt, Homo sapiens
cacagcagcugaaca

SEQ ID NO: 1107596 - RNA, 15 nt, Homo sapiens
cacagccugggacca

SEQ ID NO: 1107597 - RNA, 24 nt, Homo sapiens
cacagcuaugaaggcuguacacug

SEQ ID NO: 1107598 - RNA, 20 nt, Homo sapiens
cacagcuucauuuccugugu

SEQ ID NO: 1107599 - RNA, 22 nt, Homo sapiens
cacagcuucugcagcagacugu

SEQ ID NO: 1107600 - RNA, 19 nt, Homo sapiens
cacaggcaucuacacagcc

SEQ ID NO: 1107601 - RNA, 13 nt, Homo sapiens
cacaggggagcag

SEQ ID NO: 1107602 - RNA, 17 nt, Homo sapiens
cacagucucugggagac

SEQ ID NO: 1107603 - RNA, 20 nt, Homo sapiens
cacagucucugggagacuuu

SEQ ID NO: 1107604 - RNA, 21 nt, Homo sapiens
cacagucucugggagacuuuc

SEQ ID NO: 1107605 - RNA, 22 nt, Homo sapiens
cacagugagucgaggacaggga

SEQ ID NO: 1107606 - RNA, 11 nt, Homo sapiens
cacagugucug

SEQ ID NO: 1107607 - RNA, 18 nt, Homo sapiens
cacaguuagguagcuuua

SEQ ID NO: 1107608 - RNA, 22 nt, Homo sapiens
cacauaaugaaugcuauugaaa

SEQ ID NO: 1107609 - RNA, 15 nt, Homo sapiens
cacauacaauuugca

SEQ ID NO: 1107610 - RNA, 12 nt, Homo sapiens
cacauagcacag

SEQ ID NO: 1107611 - RNA, 19 nt, Homo sapiens
cacaucugugucucuggaa

SEQ ID NO: 1107612 - RNA, 14 nt, Homo sapiens
cacaucuugcucug

SEQ ID NO: 1107613 - RNA, 21 nt, Homo sapiens
cacaugaaaaccauuaccuga

SEQ ID NO: 1107614 - RNA, 23 nt, Homo sapiens
cacaugcuagcaacauaccagac

SEQ ID NO: 1107615 - RNA, 18 nt, Homo sapiens
cacauggccuaugcacau

SEQ ID NO: 1107616 - RNA, 18 nt, Homo sapiens
cacauguaacauagauuu

SEQ ID NO: 1107617 - RNA, 15 nt, Homo sapiens
cacauguaucuaugc

SEQ ID NO: 1107618 - RNA, 16 nt, Homo sapiens
cacaugucuuguacau

SEQ ID NO: 1107619 - RNA, 22 nt, Homo sapiens
cacaugucuuguacauguguag

SEQ ID NO: 1107620 - RNA, 18 nt, Homo sapiens
cacaugugacacauaugc

SEQ ID NO: 1107621 - RNA, 17 nt, Homo sapiens
cacaugugcacaugcac

SEQ ID NO: 1107622 - RNA, 16 nt, Homo sapiens
cacauuaauuagauuu

SEQ ID NO: 1107623 - RNA, 17 nt, Homo sapiens
cacauuacuugcacaag

SEQ ID NO: 1107624 - RNA, 23 nt, Homo sapiens
cacauuaucgggagcagugucuu

SEQ ID NO: 1107625 - RNA, 15 nt, Homo sapiens
cacauuggcagugug

SEQ ID NO: 1107626 - RNA, 17 nt, Homo sapiens
cacauuggcaguguguc

SEQ ID NO: 1107627 - RNA, 19 nt, Homo sapiens
cacauuuauucugcucaca

SEQ ID NO: 1107628 - RNA, 15 nt, Homo sapiens
caccaaaaagggauc

SEQ ID NO: 1107629 - RNA, 20 nt, Homo sapiens
caccaaaucaucucucauca

SEQ ID NO: 1107630 - RNA, 21 nt, Homo sapiens
caccaauguacccaccgggcc

SEQ ID NO: 1107631 - RNA, 15 nt, Homo sapiens
caccacaugugcaca

SEQ ID NO: 1107632 - RNA, 21 nt, Homo sapiens
caccacccucccaccaugcgc

SEQ ID NO: 1107633 - RNA, 20 nt, Homo sapiens
caccacuuugucucugagaa

SEQ ID NO: 1107634 - RNA, 14 nt, Homo sapiens
caccagaauguaua

SEQ ID NO: 1107635 - RNA, 21 nt, Homo sapiens
caccagaggcugcagaaggcc

SEQ ID NO: 1107636 - RNA, 17 nt, Homo sapiens
caccagccaucaugugc

SEQ ID NO: 1107637 - RNA, 17 nt, Homo sapiens
caccagccccagcaaga

SEQ ID NO: 1107638 - RNA, 20 nt, Homo sapiens
caccauucacauuugaugua

SEQ ID NO: 1107639 - RNA, 15 nt, Homo sapiens
cacccaacaagccau

SEQ ID NO: 1107640 - RNA, 12 nt, Homo sapiens
cacccacaugug

SEQ ID NO: 1107641 - RNA, 22 nt, Homo sapiens
cacccauagugcacacuuguau

SEQ ID NO: 1107642 - RNA, 21 nt, Homo sapiens
caccccucaaaaaaagccuuu

SEQ ID NO: 1107643 - RNA, 19 nt, Homo sapiens
cacccggcucccccugcuu

SEQ ID NO: 1107644 - RNA, 22 nt, Homo sapiens
caccgauugcaggacacaagca

SEQ ID NO: 1107645 - RNA, 17 nt, Homo sapiens
caccgcucuccugccua

SEQ ID NO: 1107646 - RNA, 15 nt, Homo sapiens
caccuagcaucucau

SEQ ID NO: 1107647 - RNA, 19 nt, Homo sapiens
aggaggcuuggaaagcauc

SEQ ID NO: 1107648 - RNA, 15 nt, Homo sapiens
aggagggcuguagga

SEQ ID NO: 1107649 - RNA, 23 nt, Homo sapiens
aggaggugcuaucgcaccacugu

SEQ ID NO: 1107650 - RNA, 16 nt, Homo sapiens
aggauauuuucuucca

SEQ ID NO: 1107651 - RNA, 17 nt, Homo sapiens
aggauauuuucuuccaa

SEQ ID NO: 1107652 - RNA, 14 nt, Homo sapiens
aggaucucucagga

SEQ ID NO: 1107653 - RNA, 15 nt, Homo sapiens
aggauuucaugauuu

SEQ ID NO: 1107654 - RNA, 13 nt, Homo sapiens
aggcaaaaagaca

SEQ ID NO: 1107655 - RNA, 15 nt, Homo sapiens
aggcaaccagaggaa

SEQ ID NO: 1107656 - RNA, 14 nt, Homo sapiens
aggcagagaaucau

SEQ ID NO: 1107657 - RNA, 20 nt, Homo sapiens
aggcagagaaucauacuuag

SEQ ID NO: 1107658 - RNA, 20 nt, Homo sapiens
aggcaggaggaucacuugga

SEQ ID NO: 1107659 - RNA, 16 nt, Homo sapiens
aggcaugagaaucacu

SEQ ID NO: 1107660 - RNA, 16 nt, Homo sapiens
aggcaugauguuaacc

SEQ ID NO: 1107661 - RNA, 21 nt, Homo sapiens
aggcauggcuggggugggggu

SEQ ID NO: 1107662 - RNA, 22 nt, Homo sapiens
aggcauuaaauuuuagcaaaga

SEQ ID NO: 1107663 - RNA, 20 nt, Homo sapiens
aggccagagggagugacaga

SEQ ID NO: 1107664 - RNA, 13 nt, Homo sapiens
aggcccaagagau

SEQ ID NO: 1107665 - RNA, 18 nt, Homo sapiens
aggcccacuggcauuaaa

SEQ ID NO: 1107666 - RNA, 19 nt, Homo sapiens
aggcccagggaggugaccc

SEQ ID NO: 1107667 - RNA, 23 nt, Homo sapiens
aggccccuggucugcccugggcu

SEQ ID NO: 1107668 - RNA, 22 nt, Homo sapiens
aggccuauaaccccagcucccu

SEQ ID NO: 1107669 - RNA, 21 nt, Homo sapiens
aggccuuuccccaguguggcc

SEQ ID NO: 1107670 - RNA, 18 nt, Homo sapiens
aggcggauggcugugacc

SEQ ID NO: 1107671 - RNA, 19 nt, Homo sapiens
aggcggcacauuggcagug

SEQ ID NO: 1107672 - RNA, 17 nt, Homo sapiens
aggcgggagcaucucuu

SEQ ID NO: 1107673 - RNA, 20 nt, Homo sapiens
aggcggguggaucacuugag

SEQ ID NO: 1107674 - RNA, 16 nt, Homo sapiens
aggcuagcaaagcuua

SEQ ID NO: 1107675 - RNA, 15 nt, Homo sapiens
aggcucacaacuguu

SEQ ID NO: 1107676 - RNA, 19 nt, Homo sapiens
aggcugagugagccacaga

SEQ ID NO: 1107677 - RNA, 20 nt, Homo sapiens
aggcugcagcgagcuaugau

SEQ ID NO: 1107678 - RNA, 21 nt, Homo sapiens
aggcuggcagauuuccaaaag

SEQ ID NO: 1107679 - RNA, 13 nt, Homo sapiens
aggcuuccuucau

SEQ ID NO: 1107680 - RNA, 17 nt, Homo sapiens
aggcuuccuucauuucc

SEQ ID NO: 1107681 - RNA, 14 nt, Homo sapiens
agggaaagccagaa

SEQ ID NO: 1107682 - RNA, 14 nt, Homo sapiens
agggaaaguuaaaa

SEQ ID NO: 1107683 - RNA, 21 nt, Homo sapiens
agggaacccugcuugcacuuu

SEQ ID NO: 1107684 - RNA, 19 nt, Homo sapiens
agggaaggcugcuguguag

SEQ ID NO: 1107685 - RNA, 14 nt, Homo sapiens
agggaaugacuugg

SEQ ID NO: 1107686 - RNA, 17 nt, Homo sapiens
agggacuuuagagaaua

SEQ ID NO: 1107687 - RNA, 15 nt, Homo sapiens
agggagacugcaucu

SEQ ID NO: 1107688 - RNA, 15 nt, Homo sapiens
agggagagccaucac

SEQ ID NO: 1107689 - RNA, 19 nt, Homo sapiens
agggaugucacgucuugaa

SEQ ID NO: 1107690 - RNA, 16 nt, Homo sapiens
agggccccagcacuaa

SEQ ID NO: 1107691 - RNA, 16 nt, Homo sapiens
agggccccuguucccc

SEQ ID NO: 1107692 - RNA, 12 nt, Homo sapiens
agggcucugagg

SEQ ID NO: 1107693 - RNA, 18 nt, Homo sapiens
agggcugcgagcauuucc

SEQ ID NO: 1107694 - RNA, 15 nt, Homo sapiens
agggcuuauggccag

SEQ ID NO: 1107695 - RNA, 15 nt, Homo sapiens
agggcuuucucagga

SEQ ID NO: 1107696 - RNA, 17 nt, Homo sapiens
aggggaggaucacugga

SEQ ID NO: 1107697 - RNA, 12 nt, Homo sapiens
aggggguugugg

SEQ ID NO: 1107698 - RNA, 20 nt, Homo sapiens
aggguccugaguggcugaaa

SEQ ID NO: 1107699 - RNA, 13 nt, Homo sapiens
agggucucuucag

SEQ ID NO: 1107700 - RNA, 17 nt, Homo sapiens
agggucuuugcaagaau

SEQ ID NO: 1107701 - RNA, 23 nt, Homo sapiens
aggguguaucuagcucuaguuca

SEQ ID NO: 1107702 - RNA, 17 nt, Homo sapiens
agguaaacaaacaaaua

SEQ ID NO: 1107703 - RNA, 16 nt, Homo sapiens
agguacagcagaaagg

SEQ ID NO: 1107704 - RNA, 14 nt, Homo sapiens
aggucagguguuca

SEQ ID NO: 1107705 - RNA, 18 nt, Homo sapiens
agguccugagcacugcca

SEQ ID NO: 1107706 - RNA, 20 nt, Homo sapiens
aggugauccacccaccucag

SEQ ID NO: 1107707 - RNA, 15 nt, Homo sapiens
aggugcuucuucacu

SEQ ID NO: 1107708 - RNA, 16 nt, Homo sapiens
agguggagaacuggga

SEQ ID NO: 1107709 - RNA, 19 nt, Homo sapiens
agguggcaggaccaggacu

SEQ ID NO: 1107710 - RNA, 21 nt, Homo sapiens
aggugucugcacccaggggug

SEQ ID NO: 1107711 - RNA, 13 nt, Homo sapiens
aggugugccaaac

SEQ ID NO: 1107712 - RNA, 16 nt, Homo sapiens
agguguucaagaccag

SEQ ID NO: 1107713 - RNA, 19 nt, Homo sapiens
agguucuucuaaaauugaa

SEQ ID NO: 1107714 - RNA, 12 nt, Homo sapiens
agguucuugaua

SEQ ID NO: 1107715 - RNA, 16 nt, Homo sapiens
acuauugaaaucaagc

SEQ ID NO: 1107716 - RNA, 21 nt, Homo sapiens
acuauugaaguugcagauuca

SEQ ID NO: 1107717 - RNA, 13 nt, Homo sapiens
acuauugagauau

SEQ ID NO: 1107718 - RNA, 14 nt, Homo sapiens
acucaaaagagaga

SEQ ID NO: 1107719 - RNA, 12 nt, Homo sapiens
acucaaacaauc

SEQ ID NO: 1107720 - RNA, 19 nt, Homo sapiens
acucaagaggcugaggcag

SEQ ID NO: 1107721 - RNA, 18 nt, Homo sapiens
acucaaguuuuuacaaaa

SEQ ID NO: 1107722 - RNA, 12 nt, Homo sapiens
acucacaugccg

SEQ ID NO: 1107723 - RNA, 23 nt, Homo sapiens
acucacaugccgcccccagcagc

SEQ ID NO: 1107724 - RNA, 21 nt, Homo sapiens
acucacugacucuucuaugca

SEQ ID NO: 1107725 - RNA, 21 nt, Homo sapiens
acucaggaggcugaggcagga

SEQ ID NO: 1107726 - RNA, 12 nt, Homo sapiens
acucaggaucca

SEQ ID NO: 1107727 - RNA, 14 nt, Homo sapiens
acucaucugucacc

SEQ ID NO: 1107728 - RNA, 12 nt, Homo sapiens
acucaugaacua

SEQ ID NO: 1107729 - RNA, 13 nt, Homo sapiens
acucaugaacuau

SEQ ID NO: 1107730 - RNA, 15 nt, Homo sapiens
acucauuucaucuca

SEQ ID NO: 1107731 - RNA, 18 nt, Homo sapiens
acuccaagcuucaaguga

SEQ ID NO: 1107732 - RNA, 23 nt, Homo sapiens
acuccacagcggaggagaccagc

SEQ ID NO: 1107733 - RNA, 21 nt, Homo sapiens
acuccagauuuuuuacagcug

SEQ ID NO: 1107734 - RNA, 13 nt, Homo sapiens
acuccagccugag

SEQ ID NO: 1107735 - RNA, 16 nt, Homo sapiens
acuccauuacuaaaga

SEQ ID NO: 1107736 - RNA, 14 nt, Homo sapiens
acucccauuuuccc

SEQ ID NO: 1107737 - RNA, 21 nt, Homo sapiens
acucccucccuggcucugcca

SEQ ID NO: 1107738 - RNA, 12 nt, Homo sapiens
acuccuguuacu

SEQ ID NO: 1107739 - RNA, 21 nt, Homo sapiens
acuccuugugguuuaugucau

SEQ ID NO: 1107740 - RNA, 23 nt, Homo sapiens
acuccuuucucuaaaacugccuu

SEQ ID NO: 1107741 - RNA, 19 nt, Homo sapiens
acuccuuugcauuccauga

SEQ ID NO: 1107742 - RNA, 13 nt, Homo sapiens
acucuaaguucua

SEQ ID NO: 1107743 - RNA, 13 nt, Homo sapiens
acucuacccuaua

SEQ ID NO: 1107744 - RNA, 23 nt, Homo sapiens
acucucauuccccagguggcuga

SEQ ID NO: 1107745 - RNA, 16 nt, Homo sapiens
acucugaaacugagaa

SEQ ID NO: 1107746 - RNA, 17 nt, Homo sapiens
acucugaauaccaagug

SEQ ID NO: 1107747 - RNA, 13 nt, Homo sapiens
acucugacuuuga

SEQ ID NO: 1107748 - RNA, 12 nt, Homo sapiens
acucugcacaug

SEQ ID NO: 1107749 - RNA, 14 nt, Homo sapiens
acucugcacaugaa

SEQ ID NO: 1107750 - RNA, 14 nt, Homo sapiens
acucugcacauguc

SEQ ID NO: 1107751 - RNA, 20 nt, Homo sapiens
acucugcacaugucuuguac

SEQ ID NO: 1107752 - RNA, 23 nt, Homo sapiens
acucugcuucauuuuugggagaa

SEQ ID NO: 1107753 - RNA, 23 nt, Homo sapiens
acucuggggagccugagccacaa

SEQ ID NO: 1107754 - RNA, 21 nt, Homo sapiens
acucuuauagaaaguucaaaa

SEQ ID NO: 1107755 - RNA, 16 nt, Homo sapiens
acucuuaugaaauggg

SEQ ID NO: 1107756 - RNA, 15 nt, Homo sapiens
acucuucugaauuga

SEQ ID NO: 1107757 - RNA, 14 nt, Homo sapiens
acugaacauuugcu

SEQ ID NO: 1107758 - RNA, 17 nt, Homo sapiens
acugacaccucacugag

SEQ ID NO: 1107759 - RNA, 19 nt, Homo sapiens
acugacacuuugccagaaa

SEQ ID NO: 1107760 - RNA, 16 nt, Homo sapiens
acugacauuguuggcc

SEQ ID NO: 1107761 - RNA, 11 nt, Homo sapiens
acugaccagcc

SEQ ID NO: 1107762 - RNA, 19 nt, Homo sapiens
acugaccagccuccaugcu

SEQ ID NO: 1107763 - RNA, 15 nt, Homo sapiens
acugaccugccugua

SEQ ID NO: 1107764 - RNA, 15 nt, Homo sapiens
aucugccuuuaccua

SEQ ID NO: 1107765 - RNA, 19 nt, Homo sapiens
aucugcuccucccauuccc

SEQ ID NO: 1107766 - RNA, 13 nt, Homo sapiens
aucuggaauuuaa

SEQ ID NO: 1107767 - RNA, 15 nt, Homo sapiens
aucugggauucccac

SEQ ID NO: 1107768 - RNA, 23 nt, Homo sapiens
aucuguauauacaauaacauaau

SEQ ID NO: 1107769 - RNA, 14 nt, Homo sapiens
aucuguccaaggaa

SEQ ID NO: 1107770 - RNA, 22 nt, Homo sapiens
aucugugcaaauccuugauacu

SEQ ID NO: 1107771 - RNA, 16 nt, Homo sapiens
aucuguggucuucaaa

SEQ ID NO: 1107772 - RNA, 16 nt, Homo sapiens
aucugugucucuggaa

SEQ ID NO: 1107773 - RNA, 22 nt, Homo sapiens
aucugugucucuggaacccagg

SEQ ID NO: 1107774 - RNA, 15 nt, Homo sapiens
aucuguguugucucu

SEQ ID NO: 1107775 - RNA, 13 nt, Homo sapiens
aucuguucauuca

SEQ ID NO: 1107776 - RNA, 20 nt, Homo sapiens
aucuguuugaucccuguuac

SEQ ID NO: 1107777 - RNA, 21 nt, Homo sapiens
aucuguuugaucccuguuacc

SEQ ID NO: 1107778 - RNA, 14 nt, Homo sapiens
aucuuaaaugccag

SEQ ID NO: 1107779 - RNA, 14 nt, Homo sapiens
aucuuagcuuucca

SEQ ID NO: 1107780 - RNA, 17 nt, Homo sapiens
aucuuagcuuuccacag

SEQ ID NO: 1107781 - RNA, 20 nt, Homo sapiens
aucuuagcuuuccacaggag

SEQ ID NO: 1107782 - RNA, 13 nt, Homo sapiens
aucuuauguuaaa

SEQ ID NO: 1107783 - RNA, 22 nt, Homo sapiens
aucuucaaacauguacaaaauc

SEQ ID NO: 1107784 - RNA, 17 nt, Homo sapiens
aucuucaaugcuuccuc

SEQ ID NO: 1107785 - RNA, 19 nt, Homo sapiens
aucuucauacaaugacaag

SEQ ID NO: 1107786 - RNA, 20 nt, Homo sapiens
aucuucauacaaugacaagu

SEQ ID NO: 1107787 - RNA, 14 nt, Homo sapiens
aucuuggacugaca

SEQ ID NO: 1107788 - RNA, 23 nt, Homo sapiens
aucuuuuaguuuuaguugcagaa

SEQ ID NO: 1107789 - RNA, 19 nt, Homo sapiens
augaaagacuuacaggccu

SEQ ID NO: 1107790 - RNA, 22 nt, Homo sapiens
augaaaugaggucagagccugc

SEQ ID NO: 1107791 - RNA, 20 nt, Homo sapiens
augaaaugucuggucugucc

SEQ ID NO: 1107792 - RNA, 21 nt, Homo sapiens
augaacacagccugggaccag

SEQ ID NO: 1107793 - RNA, 21 nt, Homo sapiens
augaaccacguguuuugacau

SEQ ID NO: 1107794 - RNA, 17 nt, Homo sapiens
augaacuggaccugcac

SEQ ID NO: 1107795 - RNA, 13 nt, Homo sapiens
augaacugugaca

SEQ ID NO: 1107796 - RNA, 13 nt, Homo sapiens
augaacuuugucc

SEQ ID NO: 1107797 - RNA, 20 nt, Homo sapiens
augaagcaagccccacuuau

SEQ ID NO: 1107798 - RNA, 18 nt, Homo sapiens
augaaggacgugucucag

SEQ ID NO: 1107799 - RNA, 14 nt, Homo sapiens
augaaggcuguaca

SEQ ID NO: 1107800 - RNA, 20 nt, Homo sapiens
augaaggcuguacacugcac

SEQ ID NO: 1107801 - RNA, 12 nt, Homo sapiens
augaagugcaaa

SEQ ID NO: 1107802 - RNA, 20 nt, Homo sapiens
augaaguguguuuccuucag

SEQ ID NO: 1107803 - RNA, 18 nt, Homo sapiens
augaauauuuuguaacua

SEQ ID NO: 1107804 - RNA, 20 nt, Homo sapiens
augaauauuuuguaacuauu

SEQ ID NO: 1107805 - RNA, 15 nt, Homo sapiens
augaaucuuacuccu

SEQ ID NO: 1107806 - RNA, 17 nt, Homo sapiens
augaaugauguuuuaga

SEQ ID NO: 1107807 - RNA, 19 nt, Homo sapiens
augaauugcauuuuacuuu

SEQ ID NO: 1107808 - RNA, 15 nt, Homo sapiens
augaauuuacuacuu

SEQ ID NO: 1107809 - RNA, 20 nt, Homo sapiens
augacaaaguuacaaauuca

SEQ ID NO: 1107810 - RNA, 17 nt, Homo sapiens
augacagccagagccug

SEQ ID NO: 1107811 - RNA, 18 nt, Homo sapiens
augacagcugucccuguc

SEQ ID NO: 1107812 - RNA, 16 nt, Homo sapiens
augacauuuuugauaa

SEQ ID NO: 1107813 - RNA, 17 nt, Homo sapiens
augaccugcugcuguug

SEQ ID NO: 1107814 - RNA, 18 nt, Homo sapiens
augaccuuauaguguuaa

SEQ ID NO: 1107815 - RNA, 17 nt, Homo sapiens
augacguguccuacagc

SEQ ID NO: 1107816 - RNA, 16 nt, Homo sapiens
augacugaugacauau

SEQ ID NO: 1107817 - RNA, 14 nt, Homo sapiens
auguguggugcuaa

SEQ ID NO: 1107818 - RNA, 20 nt, Homo sapiens
auguguguuguccuucagca

SEQ ID NO: 1107819 - RNA, 14 nt, Homo sapiens
auguuaagacuuga

SEQ ID NO: 1107820 - RNA, 19 nt, Homo sapiens
auguuaagacuugacagug

SEQ ID NO: 1107821 - RNA, 16 nt, Homo sapiens
auguuacuacaugcac

SEQ ID NO: 1107822 - RNA, 18 nt, Homo sapiens
auguuacuacaugcacuu

SEQ ID NO: 1107823 - RNA, 21 nt, Homo sapiens
auguuacucaugacuccuuuc

SEQ ID NO: 1107824 - RNA, 18 nt, Homo sapiens
auguuagaaguccaggca

SEQ ID NO: 1107825 - RNA, 14 nt, Homo sapiens
auguucugggacac

SEQ ID NO: 1107826 - RNA, 16 nt, Homo sapiens
auguucugggacacag

SEQ ID NO: 1107827 - RNA, 14 nt, Homo sapiens
auguugcccaggca

SEQ ID NO: 1107828 - RNA, 18 nt, Homo sapiens
auguuguaauucaugcca

SEQ ID NO: 1107829 - RNA, 14 nt, Homo sapiens
auguuuccagaaaa

SEQ ID NO: 1107830 - RNA, 22 nt, Homo sapiens
auguuucugucacaucagcucc

SEQ ID NO: 1107831 - RNA, 13 nt, Homo sapiens
auguuugucagau

SEQ ID NO: 1107832 - RNA, 17 nt, Homo sapiens
auguuuuagccagugau

SEQ ID NO: 1107833 - RNA, 22 nt, Homo sapiens
auguuuugucccauuuccuugg

SEQ ID NO: 1107834 - RNA, 15 nt, Homo sapiens
auuaaaaacugagug

SEQ ID NO: 1107835 - RNA, 17 nt, Homo sapiens
auuaaaaaugcauauac

SEQ ID NO: 1107836 - RNA, 13 nt, Homo sapiens
auuaaaagaaucc

SEQ ID NO: 1107837 - RNA, 18 nt, Homo sapiens
auuaaacagacuuuagcu

SEQ ID NO: 1107838 - RNA, 20 nt, Homo sapiens
auuaaacagacuuuagcuua

SEQ ID NO: 1107839 - RNA, 20 nt, Homo sapiens
auuaaacuugucagaauuuc

SEQ ID NO: 1107840 - RNA, 15 nt, Homo sapiens
auuaaauaaaucauu

SEQ ID NO: 1107841 - RNA, 18 nt, Homo sapiens
auuaaaugcauguccuca

SEQ ID NO: 1107842 - RNA, 20 nt, Homo sapiens
auuaaccugaauuauuccaa

SEQ ID NO: 1107843 - RNA, 17 nt, Homo sapiens
auuaacuuaaaagauuc

SEQ ID NO: 1107844 - RNA, 13 nt, Homo sapiens
auuaauauuugcu

SEQ ID NO: 1107845 - RNA, 15 nt, Homo sapiens
auuaaugaacuguga

SEQ ID NO: 1107846 - RNA, 24 nt, Homo sapiens
auuaauuaaacaagugcacuugaa

SEQ ID NO: 1107847 - RNA, 14 nt, Homo sapiens
auuacaauugucau

SEQ ID NO: 1107848 - RNA, 21 nt, Homo sapiens
auuacccccucauuguuuauu

SEQ ID NO: 1107849 - RNA, 17 nt, Homo sapiens
auuaccucugauaccuc

SEQ ID NO: 1107850 - RNA, 19 nt, Homo sapiens
auuacgugcaauacuucaa

SEQ ID NO: 1107851 - RNA, 18 nt, Homo sapiens
acagcagauacuuuguca

SEQ ID NO: 1107852 - RNA, 17 nt, Homo sapiens
acagcaggugccuggug

SEQ ID NO: 1107853 - RNA, 18 nt, Homo sapiens
acagcccauaaagcaaga

SEQ ID NO: 1107854 - RNA, 21 nt, Homo sapiens
acagcggaggagaccagcuca

SEQ ID NO: 1107855 - RNA, 14 nt, Homo sapiens
acagcucuucucca

SEQ ID NO: 1107856 - RNA, 16 nt, Homo sapiens
acagcuuaacauuuac

SEQ ID NO: 1107857 - RNA, 18 nt, Homo sapiens
acaggacuaacacucaga

SEQ ID NO: 1107858 - RNA, 19 nt, Homo sapiens
acaggauccuauucucacc

SEQ ID NO: 1107859 - RNA, 18 nt, Homo sapiens
acaggauuuguaauuccu

SEQ ID NO: 1107860 - RNA, 14 nt, Homo sapiens
acaggcaagugaag

SEQ ID NO: 1107861 - RNA, 12 nt, Homo sapiens
acaggcaugcac

SEQ ID NO: 1107862 - RNA, 18 nt, Homo sapiens
acaggccauacuuuacaa

SEQ ID NO: 1107863 - RNA, 23 nt, Homo sapiens
acaggcugccucaugacccuccu

SEQ ID NO: 1107864 - RNA, 15 nt, Homo sapiens
acagggaggugaccc

SEQ ID NO: 1107865 - RNA, 19 nt, Homo sapiens
acagguggcaggaccagga

SEQ ID NO: 1107866 - RNA, 21 nt, Homo sapiens
acagguggccuagcaggcaca

SEQ ID NO: 1107867 - RNA, 15 nt, Homo sapiens
acaggugugagucac

SEQ ID NO: 1107868 - RNA, 19 nt, Homo sapiens
acagguguuuauacagcuc

SEQ ID NO: 1107869 - RNA, 14 nt, Homo sapiens
acaguaacugccau

SEQ ID NO: 1107870 - RNA, 14 nt, Homo sapiens
acagucucaagcac

SEQ ID NO: 1107871 - RNA, 17 nt, Homo sapiens
acagucucaagcacuaa

SEQ ID NO: 1107872 - RNA, 19 nt, Homo sapiens
acagugccuggcaaggccu

SEQ ID NO: 1107873 - RNA, 18 nt, Homo sapiens
acaguuauacauaccucu

SEQ ID NO: 1107874 - RNA, 23 nt, Homo sapiens
acaguucaauucucauuugucac

SEQ ID NO: 1107875 - RNA, 13 nt, Homo sapiens
acaguuccuucag

SEQ ID NO: 1107876 - RNA, 16 nt, Homo sapiens
acauaaacacauacau

SEQ ID NO: 1107877 - RNA, 19 nt, Homo sapiens
acauaaacacauacauugc

SEQ ID NO: 1107878 - RNA, 13 nt, Homo sapiens
acauaacuugaua

SEQ ID NO: 1107879 - RNA, 15 nt, Homo sapiens
acauaagacagacag

SEQ ID NO: 1107880 - RNA, 20 nt, Homo sapiens
acauaagaccauaacagcca

SEQ ID NO: 1107881 - RNA, 19 nt, Homo sapiens
acauaagcaaagacuauga

SEQ ID NO: 1107882 - RNA, 21 nt, Homo sapiens
acauacaccuaugucauuuca

SEQ ID NO: 1107883 - RNA, 22 nt, Homo sapiens
acauacaggccauacuuuacaa

SEQ ID NO: 1107884 - RNA, 21 nt, Homo sapiens
acauacauugccaauuuucca

SEQ ID NO: 1107885 - RNA, 19 nt, Homo sapiens
acauagacaaaaaauuuga

SEQ ID NO: 1107886 - RNA, 13 nt, Homo sapiens
acauagagaucua

SEQ ID NO: 1107887 - RNA, 14 nt, Homo sapiens
acauauauguauau

SEQ ID NO: 1107888 - RNA, 17 nt, Homo sapiens
acccaugcccagcugua

SEQ ID NO: 1107889 - RNA, 13 nt, Homo sapiens
accccacccaagu

SEQ ID NO: 1107890 - RNA, 21 nt, Homo sapiens
accccagaaauaggacaauuc

SEQ ID NO: 1107891 - RNA, 17 nt, Homo sapiens
accccagcucccuagga

SEQ ID NO: 1107892 - RNA, 23 nt, Homo sapiens
accccaggacgccacucauuuca

SEQ ID NO: 1107893 - RNA, 18 nt, Homo sapiens
accccaucaccuacucac

SEQ ID NO: 1107894 - RNA, 14 nt, Homo sapiens
acccccagccuggg

SEQ ID NO: 1107895 - RNA, 14 nt, Homo sapiens
acccccuucagugc

SEQ ID NO: 1107896 - RNA, 15 nt, Homo sapiens
acccgcucuggacca

SEQ ID NO: 1107897 - RNA, 17 nt, Homo sapiens
acccguucaacuuuucc

SEQ ID NO: 1107898 - RNA, 18 nt, Homo sapiens
acccugccccugccuuga

SEQ ID NO: 1107899 - RNA, 17 nt, Homo sapiens
acccugcucuccgacca

SEQ ID NO: 1107900 - RNA, 16 nt, Homo sapiens
acccugggauucagga

SEQ ID NO: 1107901 - RNA, 19 nt, Homo sapiens
acccugucuaaaaaacaua

SEQ ID NO: 1107902 - RNA, 13 nt, Homo sapiens
acccugugcucaa

SEQ ID NO: 1107903 - RNA, 14 nt, Homo sapiens
acccuguuuuacaa

SEQ ID NO: 1107904 - RNA, 18 nt, Homo sapiens
accgagagagauggaaua

SEQ ID NO: 1107905 - RNA, 20 nt, Homo sapiens
accgagcgcuuucuggaaaa

SEQ ID NO: 1107906 - RNA, 21 nt, Homo sapiens
accgcauggaacagugcagga

SEQ ID NO: 1107907 - RNA, 21 nt, Homo sapiens
accgggcacucagaagacacu

SEQ ID NO: 1107908 - RNA, 21 nt, Homo sapiens
accuaagacuauguugguacu

SEQ ID NO: 1107909 - RNA, 14 nt, Homo sapiens
accuacuuacaugc

SEQ ID NO: 1107910 - RNA, 18 nt, Homo sapiens
accuacuuacaugcauua

SEQ ID NO: 1107911 - RNA, 19 nt, Homo sapiens
accucacugaggaagggag

SEQ ID NO: 1107912 - RNA, 17 nt, Homo sapiens
accucagugucauuuau

SEQ ID NO: 1107913 - RNA, 15 nt, Homo sapiens
accucccagcccuau

SEQ ID NO: 1107914 - RNA, 18 nt, Homo sapiens
accuccgccccagacaca

SEQ ID NO: 1107915 - RNA, 20 nt, Homo sapiens
accucugccugaagucacac

SEQ ID NO: 1107916 - RNA, 19 nt, Homo sapiens
accucuucucuuccuguaa

SEQ ID NO: 1107917 - RNA, 18 nt, Homo sapiens
accucuugggcaugcuca

SEQ ID NO: 1107918 - RNA, 20 nt, Homo sapiens
accucuugggcaugcucagc

SEQ ID NO: 1107919 - RNA, 21 nt, Homo sapiens
accucuuuauuuuuugauuga

SEQ ID NO: 1107920 - RNA, 22 nt, Homo sapiens
accucuuuauuuuuugauugaa

SEQ ID NO: 1107921 - RNA, 17 nt, Homo sapiens
accucuuugucagucug

SEQ ID NO: 1107922 - RNA, 18 nt, Homo sapiens
accugaaccugggaacca

SEQ ID NO: 1107923 - RNA, 13 nt, Homo sapiens
accugagccugcc

SEQ ID NO: 1107924 - RNA, 18 nt, Homo sapiens
accuggccgccuccagga

SEQ ID NO: 1107925 - RNA, 16 nt, Homo sapiens
accuguaaucauauaa

SEQ ID NO: 1107926 - RNA, 20 nt, Homo sapiens
accuguagugagaaacugau

SEQ ID NO: 1107927 - RNA, 23 nt, Homo sapiens
accugugucuuauagguuuccac

SEQ ID NO: 1107928 - RNA, 20 nt, Homo sapiens
accuguguggacaggacuaa

SEQ ID NO: 1107929 - RNA, 15 nt, Homo sapiens
accuguuacuugaaa

SEQ ID NO: 1107930 - RNA, 21 nt, Homo sapiens
accuuauaguguuaauaucuu

SEQ ID NO: 1107931 - RNA, 13 nt, Homo sapiens
accuucaauacuu

SEQ ID NO: 1107932 - RNA, 14 nt, Homo sapiens
accuucagugaaag

SEQ ID NO: 1107933 - RNA, 17 nt, Homo sapiens
accuugugucuguacac

SEQ ID NO: 1107934 - RNA, 23 nt, Homo sapiens
accuuuauuaaugaacugugaca

SEQ ID NO: 1107935 - RNA, 13 nt, Homo sapiens
accuuucccucac

SEQ ID NO: 1107936 - RNA, 19 nt, Homo sapiens
accuuuggaugcacuuuau

SEQ ID NO: 1107937 - RNA, 14 nt, Homo sapiens
accuuuguguaaua

SEQ ID NO: 1107938 - RNA, 15 nt, Homo sapiens
ucucugacucuugcc

SEQ ID NO: 1107939 - RNA, 16 nt, Homo sapiens
ucucugucuggcugua

SEQ ID NO: 1107940 - RNA, 19 nt, Homo sapiens
ucucuguguuacccaguaa

SEQ ID NO: 1107941 - RNA, 17 nt, Homo sapiens
ucucuugucucacaugc

SEQ ID NO: 1107942 - RNA, 13 nt, Homo sapiens
ucucuuucuuauu

SEQ ID NO: 1107943 - RNA, 14 nt, Homo sapiens
ucucuuugccucaa

SEQ ID NO: 1107944 - RNA, 23 nt, Homo sapiens
ucucuuuuuagagaaauuugcca

SEQ ID NO: 1107945 - RNA, 14 nt, Homo sapiens
ucugaaacuuaauu

SEQ ID NO: 1107946 - RNA, 18 nt, Homo sapiens
ucugaaacuuaauuacau

SEQ ID NO: 1107947 - RNA, 19 nt, Homo sapiens
ucugaacacauacuagaaa

SEQ ID NO: 1107948 - RNA, 14 nt, Homo sapiens
uucccagcucuccc

SEQ ID NO: 1107949 - RNA, 14 nt, Homo sapiens
uucccauucuugca

SEQ ID NO: 1107950 - RNA, 16 nt, Homo sapiens
uucccgggaucacuua

SEQ ID NO: 1107951 - RNA, 18 nt, Homo sapiens
uucccguauugacaggaa

SEQ ID NO: 1107952 - RNA, 19 nt, Homo sapiens
uucccuacuuccugugacu

SEQ ID NO: 1107953 - RNA, 22 nt, Homo sapiens
uucccugaauguauugaacuug

SEQ ID NO: 1107954 - RNA, 13 nt, Homo sapiens
uucccugagucac

SEQ ID NO: 1107955 - RNA, 16 nt, Homo sapiens
uuccuacagauaguca

SEQ ID NO: 1107956 - RNA, 17 nt, Homo sapiens
uuccuacccaaccacuc

SEQ ID NO: 1107957 - RNA, 22 nt, Homo sapiens
uuccuauuuuaaaaccaugcag

SEQ ID NO: 1107958 - RNA, 12 nt, Homo sapiens
uuccucacuaug

SEQ ID NO: 1107959 - RNA, 20 nt, Homo sapiens
uuccucacuaugacacugag

SEQ ID NO: 1107960 - RNA, 13 nt, Homo sapiens
uuccucagaucau

SEQ ID NO: 1107961 - RNA, 20 nt, Homo sapiens
uuccuccgucaccucagaga

SEQ ID NO: 1107962 - RNA, 13 nt, Homo sapiens
uuccucuccagcc

SEQ ID NO: 1107963 - RNA, 15 nt, Homo sapiens
uuccugauacugggu

SEQ ID NO: 1107964 - RNA, 22 nt, Homo sapiens
uuccuuagcuuagaccucagcc

SEQ ID NO: 1107965 - RNA, 11 nt, Homo sapiens
uuccuugagaa

SEQ ID NO: 1107966 - RNA, 17 nt, Homo sapiens
uuccuugggaugaucuu

SEQ ID NO: 1107967 - RNA, 16 nt, Homo sapiens
uucgaaugacacuguu

SEQ ID NO: 1107968 - RNA, 17 nt, Homo sapiens
uucgauggcauccugca

SEQ ID NO: 1107969 - RNA, 21 nt, Homo sapiens
uucgggagggcacucacaugc

SEQ ID NO: 1107970 - RNA, 22 nt, Homo sapiens
uucgggagggcacucacaugcc

SEQ ID NO: 1107971 - RNA, 16 nt, Homo sapiens
uucgugccccagagau

SEQ ID NO: 1107972 - RNA, 17 nt, Homo sapiens
uucuaaaugaagugcaa

SEQ ID NO: 1107973 - RNA, 20 nt, Homo sapiens
uucuaacauguuuugugcag

SEQ ID NO: 1107974 - RNA, 18 nt, Homo sapiens
uucuaaguauuuuauucc

SEQ ID NO: 1107975 - RNA, 14 nt, Homo sapiens
uucuacacauauau

SEQ ID NO: 1107976 - RNA, 17 nt, Homo sapiens
uucuaccuggucucucc

SEQ ID NO: 1107977 - RNA, 22 nt, Homo sapiens
uucuacuuucaucuauucuuuc

SEQ ID NO: 1107978 - RNA, 17 nt, Homo sapiens
uucuaggaagcuccagu

SEQ ID NO: 1107979 - RNA, 20 nt, Homo sapiens
uucuauggccauuacuaaca

SEQ ID NO: 1107980 - RNA, 17 nt, Homo sapiens
uucuauuacgugcaaua

SEQ ID NO: 1107981 - RNA, 22 nt, Homo sapiens
uucuauuacgugcaauacuuca

SEQ ID NO: 1107982 - RNA, 15 nt, Homo sapiens
uucuauucuaaguaa

SEQ ID NO: 1107983 - RNA, 23 nt, Homo sapiens
uucucaaaugcacaucucauggc

SEQ ID NO: 1107984 - RNA, 12 nt, Homo sapiens
uucucacacugg

SEQ ID NO: 1107985 - RNA, 18 nt, Homo sapiens
uucucaggacacaggccu

SEQ ID NO: 1107986 - RNA, 20 nt, Homo sapiens
uucucaguaaauauuaaccu

SEQ ID NO: 1107987 - RNA, 20 nt, Homo sapiens
uucucaguguagggcagaga

SEQ ID NO: 1107988 - RNA, 21 nt, Homo sapiens
uucucaucauauuguauguaa

SEQ ID NO: 1107989 - RNA, 15 nt, Homo sapiens
uucucauuugucaca

SEQ ID NO: 1107990 - RNA, 11 nt, Homo sapiens
uucuccugacc

SEQ ID NO: 1107991 - RNA, 22 nt, Homo sapiens
uucuccuuggaggacaguggga

SEQ ID NO: 1107992 - RNA, 15 nt, Homo sapiens
uucucucguaacugg

SEQ ID NO: 1107993 - RNA, 23 nt, Homo sapiens
uucucucugugguggagaaccac

SEQ ID NO: 1107994 - RNA, 14 nt, Homo sapiens
uucucuuugccuca

SEQ ID NO: 1107995 - RNA, 16 nt, Homo sapiens
uucugaauugacugua

SEQ ID NO: 1107996 - RNA, 18 nt, Homo sapiens
uucugacaucagcagaga

SEQ ID NO: 1107997 - RNA, 23 nt, Homo sapiens
uucugagcaccuacuuacaugca

SEQ ID NO: 1107998 - RNA, 13 nt, Homo sapiens
uucugagugacau

SEQ ID NO: 1107999 - RNA, 14 nt, Homo sapiens
uucuggaauguaau

SEQ ID NO: 1108000 - RNA, 18 nt, Homo sapiens
uucuggagucuccagugg

SEQ ID NO: 1108001 - RNA, 21 nt, Homo sapiens
uucugggaguucccugaacau

SEQ ID NO: 1108002 - RNA, 15 nt, Homo sapiens
uucugguuacugugg

SEQ ID NO: 1108003 - RNA, 17 nt, Homo sapiens
uucuguccaguuuccaa

SEQ ID NO: 1108004 - RNA, 21 nt, Homo sapiens
uucuguccuuuuggcacugag

SEQ ID NO: 1108005 - RNA, 18 nt, Homo sapiens
uucuuaaucuccacuguu

SEQ ID NO: 1108006 - RNA, 13 nt, Homo sapiens
uucuuacaaacau

SEQ ID NO: 1108007 - RNA, 15 nt, Homo sapiens
uucuuacccauauau

SEQ ID NO: 1108008 - RNA, 14 nt, Homo sapiens
uucuuauaauauua

SEQ ID NO: 1108009 - RNA, 17 nt, Homo sapiens
uucuuccuaccaaauau

SEQ ID NO: 1108010 - RNA, 17 nt, Homo sapiens
uucuucucuuaauuuca

SEQ ID NO: 1108011 - RNA, 16 nt, Homo sapiens
uucuucuguauguuag

SEQ ID NO: 1108012 - RNA, 13 nt, Homo sapiens
uucuugcagauca

SEQ ID NO: 1108013 - RNA, 12 nt, Homo sapiens
uucuugccucau

SEQ ID NO: 1108014 - RNA, 15 nt, Homo sapiens
uucuuuacauuugau

SEQ ID NO: 1108015 - RNA, 14 nt, Homo sapiens
uucuuuaccugaga

SEQ ID NO: 1108016 - RNA, 15 nt, Homo sapiens
uucuuuuacuguaau

SEQ ID NO: 1108017 - RNA, 13 nt, Homo sapiens
uucuuuugcucuu

SEQ ID NO: 1108018 - RNA, 13 nt, Homo sapiens
uccguacauucaa

SEQ ID NO: 1108019 - RNA, 16 nt, Homo sapiens
uccguaguucccugaa

SEQ ID NO: 1108020 - RNA, 16 nt, Homo sapiens
uccgucaccucagaga

SEQ ID NO: 1108021 - RNA, 17 nt, Homo sapiens
uccuaaugauuagcacu

SEQ ID NO: 1108022 - RNA, 19 nt, Homo sapiens
uccuaggccacaccaucuc

SEQ ID NO: 1108023 - RNA, 19 nt, Homo sapiens
uccuaggggccgagggaaa

SEQ ID NO: 1108024 - RNA, 18 nt, Homo sapiens
uccuauuuuaaaaccaug

SEQ ID NO: 1108025 - RNA, 19 nt, Homo sapiens
uccucaagggccaggacuu

SEQ ID NO: 1108026 - RNA, 15 nt, Homo sapiens
uccucaguguccuca

SEQ ID NO: 1108027 - RNA, 22 nt, Homo sapiens
uccuccacaauaaggucaaugc

SEQ ID NO: 1108028 - RNA, 14 nt, Homo sapiens
uccucccaccucag

SEQ ID NO: 1108029 - RNA, 15 nt, Homo sapiens
uccucccaccucagc

SEQ ID NO: 1108030 - RNA, 13 nt, Homo sapiens
uccucgucucucu

SEQ ID NO: 1108031 - RNA, 11 nt, Homo sapiens
uccucugacau

SEQ ID NO: 1108032 - RNA, 16 nt, Homo sapiens
uccucuuguugcugag

SEQ ID NO: 1108033 - RNA, 17 nt, Homo sapiens
uccugauaaacauuaaa

SEQ ID NO: 1108034 - RNA, 20 nt, Homo sapiens
uccugcacgccguggagcau

SEQ ID NO: 1108035 - RNA, 17 nt, Homo sapiens
uccugccgcaacaguuu

SEQ ID NO: 1108036 - RNA, 14 nt, Homo sapiens
uccugccucaggcu

SEQ ID NO: 1108037 - RNA, 19 nt, Homo sapiens
uccugccucuacugggaag

SEQ ID NO: 1108038 - RNA, 18 nt, Homo sapiens
uccuggaguacaaacaca

SEQ ID NO: 1108039 - RNA, 19 nt, Homo sapiens
uccuggccaacauggugaa

SEQ ID NO: 1108040 - RNA, 14 nt, Homo sapiens
uccuggcugagaga

SEQ ID NO: 1108041 - RNA, 22 nt, Homo sapiens
uccuggcuggaccagccacugu

SEQ ID NO: 1108042 - RNA, 17 nt, Homo sapiens
uccugggcuaagugauc

SEQ ID NO: 1108043 - RNA, 23 nt, Homo sapiens
uccugguuaaauuugaauuucag

SEQ ID NO: 1108044 - RNA, 20 nt, Homo sapiens
uccuguccaaccuaaccccu

SEQ ID NO: 1108045 - RNA, 13 nt, Homo sapiens
uccugucugccag

SEQ ID NO: 1108046 - RNA, 11 nt, Homo sapiens
uccugugaaag

SEQ ID NO: 1108047 - RNA, 11 nt, Homo sapiens
uccugugcaac

SEQ ID NO: 1108048 - RNA, 20 nt, Homo sapiens
uccugugggugugucucucg

SEQ ID NO: 1108049 - RNA, 20 nt, Homo sapiens
uccugugucuugcaauggca

SEQ ID NO: 1108050 - RNA, 19 nt, Homo sapiens
uccuguuagcauaauguga

SEQ ID NO: 1108051 - RNA, 19 nt, Homo sapiens
uccuuagcuuagaccucag

SEQ ID NO: 1108052 - RNA, 16 nt, Homo sapiens
uccuuccagcuaguga

SEQ ID NO: 1108053 - RNA, 15 nt, Homo sapiens
uccuucugcuggaua

SEQ ID NO: 1108054 - RNA, 22 nt, Homo sapiens
uccuuuggccauuccaacagcu

SEQ ID NO: 1108055 - RNA, 17 nt, Homo sapiens
ucgagguagguggauca

SEQ ID NO: 1108056 - RNA, 20 nt, Homo sapiens
ucgauuagacuggacagcuu

SEQ ID NO: 1108057 - RNA, 18 nt, Homo sapiens
ucgcccaggagacauccg

SEQ ID NO: 1108058 - RNA, 12 nt, Homo sapiens
ucgcuacaagaa

SEQ ID NO: 1108059 - RNA, 19 nt, Homo sapiens
ucgcuacaagaaccugcua

SEQ ID NO: 1108060 - RNA, 22 nt, Homo sapiens
ucgcuccugugucuugcaaugg

SEQ ID NO: 1108061 - RNA, 18 nt, Homo sapiens
ucggagacagugaucucc

SEQ ID NO: 1108062 - RNA, 19 nt, Homo sapiens
ucggcaucgggccaucuca

SEQ ID NO: 1108063 - RNA, 10 nt, Homo sapiens
ucggggagcu

SEQ ID NO: 1108064 - RNA, 13 nt, Homo sapiens
ucgugacaacaug

SEQ ID NO: 1108065 - RNA, 15 nt, Homo sapiens
ucuaaaaugcuuuua

SEQ ID NO: 1108066 - RNA, 16 nt, Homo sapiens
ucuaaacugcuguuaa

SEQ ID NO: 1108067 - RNA, 18 nt, Homo sapiens
ucuaagucuccaagaaua

SEQ ID NO: 1108068 - RNA, 19 nt, Homo sapiens
ucuaagugguauauacaua

SEQ ID NO: 1108069 - RNA, 12 nt, Homo sapiens
ucuacacagccu

SEQ ID NO: 1108070 - RNA, 19 nt, Homo sapiens
ucuacacauacugcaugcu

SEQ ID NO: 1108071 - RNA, 17 nt, Homo sapiens
ucuaccaggucaaaaua

SEQ ID NO: 1108072 - RNA, 17 nt, Homo sapiens
ucuaccccugcuaagga

SEQ ID NO: 1108073 - RNA, 18 nt, Homo sapiens
ucuacccggcccagagac

SEQ ID NO: 1108074 - RNA, 20 nt, Homo sapiens
ucuacccggcccagagaccc

SEQ ID NO: 1108075 - RNA, 22 nt, Homo sapiens
ucuaccugaccaacaguuccuu

SEQ ID NO: 1108076 - RNA, 18 nt, Homo sapiens
ucuacugagacaugacua

SEQ ID NO: 1108077 - RNA, 16 nt, Homo sapiens
ucuagacuugugcuga

SEQ ID NO: 1108078 - RNA, 15 nt, Homo sapiens
ucuaguaucacauag

SEQ ID NO: 1108079 - RNA, 21 nt, Homo sapiens
ucuagucuccuuugcacugag

SEQ ID NO: 1108080 - RNA, 20 nt, Homo sapiens
ucuaguucaaauuauuugga

SEQ ID NO: 1108081 - RNA, 20 nt, Homo sapiens
ucuauaauggaaacauuuac

SEQ ID NO: 1108082 - RNA, 13 nt, Homo sapiens
ucuaucuuauaua

SEQ ID NO: 1108083 - RNA, 21 nt, Homo sapiens
ucuauuaccuguuaguauuau

SEQ ID NO: 1108084 - RNA, 16 nt, Homo sapiens
ucuauuauaaaaccau

SEQ ID NO: 1108085 - RNA, 20 nt, Homo sapiens
ucucaaacucuugaccucag

SEQ ID NO: 1108086 - RNA, 13 nt, Homo sapiens
ucucaaauucuca

SEQ ID NO: 1108087 - RNA, 15 nt, Homo sapiens
ucucacaagcacuuu

SEQ ID NO: 1108088 - RNA, 15 nt, Homo sapiens
ucucacuaaaaugga

SEQ ID NO: 1108089 - RNA, 16 nt, Homo sapiens
ucucagaauccaaaga

SEQ ID NO: 1108090 - RNA, 20 nt, Homo sapiens
ucucagaccugcgcacucca

SEQ ID NO: 1108091 - RNA, 21 nt, Homo sapiens
ucucagccuaccaugagaaua

SEQ ID NO: 1108092 - RNA, 15 nt, Homo sapiens
ucucagccucugauc

SEQ ID NO: 1108093 - RNA, 15 nt, Homo sapiens
ucucaugaaccucaa

SEQ ID NO: 1108094 - RNA, 21 nt, Homo sapiens
ucucaugagugccaagcaaaa

SEQ ID NO: 1108095 - RNA, 17 nt, Homo sapiens
ucuccagacccaccaca

SEQ ID NO: 1108096 - RNA, 21 nt, Homo sapiens
ucuccagguccucuacuuaau

SEQ ID NO: 1108097 - RNA, 17 nt, Homo sapiens
ucucccccugggcucug

SEQ ID NO: 1108098 - RNA, 16 nt, Homo sapiens
ucucccuggggucaca

SEQ ID NO: 1108099 - RNA, 16 nt, Homo sapiens
ucuccuguauaaucuc

SEQ ID NO: 1108100 - RNA, 18 nt, Homo sapiens
ucuccuuugcacugaggg

SEQ ID NO: 1108101 - RNA, 13 nt, Homo sapiens
ucucuaaaacugc

SEQ ID NO: 1108102 - RNA, 14 nt, Homo sapiens
ucucucaugaaccu

SEQ ID NO: 1108103 - RNA, 14 nt, Homo sapiens
ucucuccagccuga

SEQ ID NO: 1108104 - RNA, 18 nt, Homo sapiens
ucucuccuuguucugaua

SEQ ID NO: 1108105 - RNA, 11 nt, Homo sapiens
ucucucugugg

SEQ ID NO: 1108106 - RNA, 15 nt, Homo sapiens
ucucucuugcaggaa

SEQ ID NO: 1108107 - RNA, 15 nt, Homo sapiens
cuauuauaaaaccau

SEQ ID NO: 1108108 - RNA, 23 nt, Homo sapiens
cuauuauagaauggaacucaagg

SEQ ID NO: 1108109 - RNA, 17 nt, Homo sapiens
cuauucuaaguaauucc

SEQ ID NO: 1108110 - RNA, 14 nt, Homo sapiens
cuauucucuccuca

SEQ ID NO: 1108111 - RNA, 12 nt, Homo sapiens
cuauugcugcuc

SEQ ID NO: 1108112 - RNA, 18 nt, Homo sapiens
cuauugcugcucucucac

SEQ ID NO: 1108113 - RNA, 23 nt, Homo sapiens
cuauuuggggcuugcaugccaaa

SEQ ID NO: 1108114 - RNA, 18 nt, Homo sapiens
cuauuuguuguuuuuaac

SEQ ID NO: 1108115 - RNA, 22 nt, Homo sapiens
cuauuuuuauuuguuugugcau

SEQ ID NO: 1108116 - RNA, 15 nt, Homo sapiens
cucaaauacauaccu

SEQ ID NO: 1108117 - RNA, 14 nt, Homo sapiens
cucaaaucuauuca

SEQ ID NO: 1108118 - RNA, 17 nt, Homo sapiens
cucaaaugacccaaaga

SEQ ID NO: 1108119 - RNA, 18 nt, Homo sapiens
cucaaaugacccaaagac

SEQ ID NO: 1108120 - RNA, 22 nt, Homo sapiens
cucaaaugacccaaagaccaau

SEQ ID NO: 1108121 - RNA, 13 nt, Homo sapiens
cucaaaugcacau

SEQ ID NO: 1108122 - RNA, 17 nt, Homo sapiens
cucaaaugcacaucuca

SEQ ID NO: 1108123 - RNA, 14 nt, Homo sapiens
cucaagcacuaaaa

SEQ ID NO: 1108124 - RNA, 21 nt, Homo sapiens
cucaaguuuuucagaaagcau

SEQ ID NO: 1108125 - RNA, 19 nt, Homo sapiens
cucaaguuuuuguuuugua

SEQ ID NO: 1108126 - RNA, 12 nt, Homo sapiens
cucaaugcauga

SEQ ID NO: 1108127 - RNA, 18 nt, Homo sapiens
cucaaugcaugaaucugu

SEQ ID NO: 1108128 - RNA, 18 nt, Homo sapiens
cucaaugcuuuucuagca

SEQ ID NO: 1108129 - RNA, 13 nt, Homo sapiens
cucacacuauggc

SEQ ID NO: 1108130 - RNA, 16 nt, Homo sapiens
cucacagaacuaugua

SEQ ID NO: 1108131 - RNA, 17 nt, Homo sapiens
cucacauuuauucugcu

SEQ ID NO: 1108132 - RNA, 23 nt, Homo sapiens
cucacccccagcuuugcuaccaa

SEQ ID NO: 1108133 - RNA, 18 nt, Homo sapiens
cucacccuguaccacaaa

SEQ ID NO: 1108134 - RNA, 20 nt, Homo sapiens
cucaccuugugcuggggaca

SEQ ID NO: 1108135 - RNA, 20 nt, Homo sapiens
cucacgccuguaaucccagc

SEQ ID NO: 1108136 - RNA, 15 nt, Homo sapiens
cucacuaugcugcuu

SEQ ID NO: 1108137 - RNA, 17 nt, Homo sapiens
cucacuccacacuggca

SEQ ID NO: 1108138 - RNA, 15 nt, Homo sapiens
cucacuccaccaccc

SEQ ID NO: 1108139 - RNA, 14 nt, Homo sapiens
cucacuccuguuac

SEQ ID NO: 1108140 - RNA, 20 nt, Homo sapiens
cucacuugaaugugucacua

SEQ ID NO: 1108141 - RNA, 12 nt, Homo sapiens
cucacuuugccc

SEQ ID NO: 1108142 - RNA, 16 nt, Homo sapiens
cucagaauccaaagau

SEQ ID NO: 1108143 - RNA, 23 nt, Homo sapiens
cucagagaauuucuaccauuuca

SEQ ID NO: 1108144 - RNA, 15 nt, Homo sapiens
cucagccacccugug

SEQ ID NO: 1108145 - RNA, 22 nt, Homo sapiens
cucaggacacuaauacaccagg

SEQ ID NO: 1108146 - RNA, 17 nt, Homo sapiens
cucaggcuuccuuggca

SEQ ID NO: 1108147 - RNA, 15 nt, Homo sapiens
cucaggcuugaaaug

SEQ ID NO: 1108148 - RNA, 15 nt, Homo sapiens
cucagugucauuuau

SEQ ID NO: 1108149 - RNA, 13 nt, Homo sapiens
cucaguuccugcc

SEQ ID NO: 1108150 - RNA, 20 nt, Homo sapiens
cucauauauaucuaucuuau

SEQ ID NO: 1108151 - RNA, 14 nt, Homo sapiens
cucaucaacaaaga

SEQ ID NO: 1108152 - RNA, 17 nt, Homo sapiens
cucaucagaaaugucau

SEQ ID NO: 1108153 - RNA, 13 nt, Homo sapiens
cucaucagccuuc

SEQ ID NO: 1108154 - RNA, 22 nt, Homo sapiens
cucaucauaaaauaaaguauau

SEQ ID NO: 1108155 - RNA, 14 nt, Homo sapiens
cucaucauuccuug

SEQ ID NO: 1108156 - RNA, 15 nt, Homo sapiens
cucaucccucuguca

SEQ ID NO: 1108157 - RNA, 11 nt, Homo sapiens
cucaugacagc

SEQ ID NO: 1108158 - RNA, 13 nt, Homo sapiens
cucauuagacugg

SEQ ID NO: 1108159 - RNA, 13 nt, Homo sapiens
cucauuccaccuu

SEQ ID NO: 1108160 - RNA, 16 nt, Homo sapiens
cucauuccaccuuccc

SEQ ID NO: 1108161 - RNA, 15 nt, Homo sapiens
cucauuucaucucau

SEQ ID NO: 1108162 - RNA, 19 nt, Homo sapiens
cucauuugucacacacuuu

SEQ ID NO: 1108163 - RNA, 13 nt, Homo sapiens
cuccaagcuccau

SEQ ID NO: 1108164 - RNA, 23 nt, Homo sapiens
cuccacaauagcagacaguguuu

SEQ ID NO: 1108165 - RNA, 12 nt, Homo sapiens
cuccacccuaua

SEQ ID NO: 1108166 - RNA, 16 nt, Homo sapiens
cuccagaacaaaccuc

SEQ ID NO: 1108167 - RNA, 17 nt, Homo sapiens
cuccaggaugaguuacu

SEQ ID NO: 1108168 - RNA, 22 nt, Homo sapiens
cuccaggaugaguuacuugaaa

SEQ ID NO: 1108169 - RNA, 22 nt, Homo sapiens
cuccaucuuauuuucauguaua

SEQ ID NO: 1108170 - RNA, 16 nt, Homo sapiens
cucccacacuccccca

SEQ ID NO: 1108171 - RNA, 22 nt, Homo sapiens
cuccccauucacagagccuuuu

SEQ ID NO: 1108172 - RNA, 16 nt, Homo sapiens
cucccccugcuucuca

SEQ ID NO: 1108173 - RNA, 23 nt, Homo sapiens
cuccccgggggcagacaccugug

SEQ ID NO: 1108174 - RNA, 18 nt, Homo sapiens
cuccccuuguacucuugc

SEQ ID NO: 1108175 - RNA, 14 nt, Homo sapiens
cucccuguccuccu

SEQ ID NO: 1108176 - RNA, 16 nt, Homo sapiens
cuccggccugaugaca

SEQ ID NO: 1108177 - RNA, 20 nt, Homo sapiens
cuccuaaacaaaaacacauu

SEQ ID NO: 1108178 - RNA, 14 nt, Homo sapiens
cuccuaaauuucca

SEQ ID NO: 1108179 - RNA, 22 nt, Homo sapiens
cuccucacaguugccauguaga

SEQ ID NO: 1108180 - RNA, 21 nt, Homo sapiens
cuccucccaggaacugggcca

SEQ ID NO: 1108181 - RNA, 14 nt, Homo sapiens
cuccucuugccacu

SEQ ID NO: 1108182 - RNA, 14 nt, Homo sapiens
cuccugccuacuca

SEQ ID NO: 1108183 - RNA, 19 nt, Homo sapiens
auuucuggaaaacugccuu

SEQ ID NO: 1108184 - RNA, 21 nt, Homo sapiens
auuucugggucuuucugacau

SEQ ID NO: 1108185 - RNA, 15 nt, Homo sapiens
auuucugucucucuc

SEQ ID NO: 1108186 - RNA, 18 nt, Homo sapiens
auuucuuuaagaaucuau

SEQ ID NO: 1108187 - RNA, 19 nt, Homo sapiens
auuugaagcaucacauaaa

SEQ ID NO: 1108188 - RNA, 14 nt, Homo sapiens
auuugcaagacaua

SEQ ID NO: 1108189 - RNA, 15 nt, Homo sapiens
auuugcaagacauag

SEQ ID NO: 1108190 - RNA, 11 nt, Homo sapiens
auuugcacuau

SEQ ID NO: 1108191 - RNA, 15 nt, Homo sapiens
auuuggccugcacua

SEQ ID NO: 1108192 - RNA, 20 nt, Homo sapiens
auuuguauaaugguguuacu

SEQ ID NO: 1108193 - RNA, 17 nt, Homo sapiens
auuuguugagaguguga

SEQ ID NO: 1108194 - RNA, 21 nt, Homo sapiens
auuuguuguuuuuaacaacua

SEQ ID NO: 1108195 - RNA, 14 nt, Homo sapiens
auuuguuugugcau

SEQ ID NO: 1108196 - RNA, 17 nt, Homo sapiens
auuuuaaaacagaagaa

SEQ ID NO: 1108197 - RNA, 18 nt, Homo sapiens
auuuuauauauuauguca

SEQ ID NO: 1108198 - RNA, 22 nt, Homo sapiens
auuuuauauauuaugucauuca

SEQ ID NO: 1108199 - RNA, 14 nt, Homo sapiens
auuuuauucccaag

SEQ ID NO: 1108200 - RNA, 18 nt, Homo sapiens
auuuucaaauucuacuga

SEQ ID NO: 1108201 - RNA, 19 nt, Homo sapiens
auuuucaagaaacugagga

SEQ ID NO: 1108202 - RNA, 16 nt, Homo sapiens
auuuucauguauaugu

SEQ ID NO: 1108203 - RNA, 20 nt, Homo sapiens
auuuucauuuaacuacaaau

SEQ ID NO: 1108204 - RNA, 22 nt, Homo sapiens
auuuucccuucgauauaugacu

SEQ ID NO: 1108205 - RNA, 16 nt, Homo sapiens
auuuuccuccaggcaa

SEQ ID NO: 1108206 - RNA, 19 nt, Homo sapiens
auuuucuggaauacaugaa

SEQ ID NO: 1108207 - RNA, 12 nt, Homo sapiens
auuuucuuccaa

SEQ ID NO: 1108208 - RNA, 15 nt, Homo sapiens
auuuugauccaagcu

SEQ ID NO: 1108209 - RNA, 17 nt, Homo sapiens
auuuugcauaguaccaa

SEQ ID NO: 1108210 - RNA, 21 nt, Homo sapiens
auuuuguaauaaacucucuag

SEQ ID NO: 1108211 - RNA, 20 nt, Homo sapiens
auuuuguguucaguacaauu

SEQ ID NO: 1108212 - RNA, 15 nt, Homo sapiens
auuuuguuacacuaa

SEQ ID NO: 1108213 - RNA, 16 nt, Homo sapiens
auuuuuacacauguau

SEQ ID NO: 1108214 - RNA, 17 nt, Homo sapiens
auuuuuauagacaaaua

SEQ ID NO: 1108215 - RNA, 20 nt, Homo sapiens
auuuuucaaccagcauuuua

SEQ ID NO: 1108216 - RNA, 22 nt, Homo sapiens
auuuuugucgaguuuacuucau

SEQ ID NO: 1108217 - RNA, 20 nt, Homo sapiens
auuuuuguuucuuccaaagc

SEQ ID NO: 1108218 - RNA, 17 nt, Homo sapiens
caaaaauagacaacugu

SEQ ID NO: 1108219 - RNA, 21 nt, Homo sapiens
caaaaaugaaagcaugucuca

SEQ ID NO: 1108220 - RNA, 22 nt, Homo sapiens
caaaaauugaagagagauauau

SEQ ID NO: 1108221 - RNA, 18 nt, Homo sapiens
caaaaccacuagaacucu

SEQ ID NO: 1108222 - RNA, 23 nt, Homo sapiens
caaaacuuccuguuuguggaaca

SEQ ID NO: 1108223 - RNA, 22 nt, Homo sapiens
caaaagcaagacuguugcucaa

SEQ ID NO: 1108224 - RNA, 20 nt, Homo sapiens
caaaaguuacauguuugcac

SEQ ID NO: 1108225 - RNA, 15 nt, Homo sapiens
caaaauaacauuuga

SEQ ID NO: 1108226 - RNA, 24 nt, Homo sapiens
caaaaucuaccaggucaaaauagu

SEQ ID NO: 1108227 - RNA, 23 nt, Homo sapiens
caaacacaagugcgccuugcaaa

SEQ ID NO: 1108228 - RNA, 15 nt, Homo sapiens
caaacacccaugccc

SEQ ID NO: 1108229 - RNA, 18 nt, Homo sapiens
caaaccauaaacuucaug

SEQ ID NO: 1108230 - RNA, 17 nt, Homo sapiens
caaaccuuacuauggaa

SEQ ID NO: 1108231 - RNA, 19 nt, Homo sapiens
caaacguuuugaacuaaua

SEQ ID NO: 1108232 - RNA, 22 nt, Homo sapiens
caaacugccuauauugauaaaa

SEQ ID NO: 1108233 - RNA, 12 nt, Homo sapiens
caaagacaugga

SEQ ID NO: 1108234 - RNA, 15 nt, Homo sapiens
caaagacuuaacugg

SEQ ID NO: 1108235 - RNA, 17 nt, Homo sapiens
caaagauauauacacag

SEQ ID NO: 1108236 - RNA, 13 nt, Homo sapiens
caaagcaaagcca

SEQ ID NO: 1108237 - RNA, 13 nt, Homo sapiens
caaagcaccagcu

SEQ ID NO: 1108238 - RNA, 14 nt, Homo sapiens
caaaguauuugcug

SEQ ID NO: 1108239 - RNA, 21 nt, Homo sapiens
caaagugcugcuggaaguaga

SEQ ID NO: 1108240 - RNA, 15 nt, Homo sapiens
caaauaaauaucauc

SEQ ID NO: 1108241 - RNA, 22 nt, Homo sapiens
caaauaagcaucuguguaaccu

SEQ ID NO: 1108242 - RNA, 18 nt, Homo sapiens
ucaucagcauaccuuuau

SEQ ID NO: 1108243 - RNA, 14 nt, Homo sapiens
ucaucagcauuuaa

SEQ ID NO: 1108244 - RNA, 17 nt, Homo sapiens
ucaucagccuuccugac

SEQ ID NO: 1108245 - RNA, 23 nt, Homo sapiens
ucaucaguguccucuugcucaaa

SEQ ID NO: 1108246 - RNA, 21 nt, Homo sapiens
ucaucauaaaauaaaguauau

SEQ ID NO: 1108247 - RNA, 18 nt, Homo sapiens
ucaucauacaugacucag

SEQ ID NO: 1108248 - RNA, 22 nt, Homo sapiens
ucaucuacacagcaguaugaau

SEQ ID NO: 1108249 - RNA, 20 nt, Homo sapiens
ucaucucaggccucccucaa

SEQ ID NO: 1108250 - RNA, 19 nt, Homo sapiens
uugaugauuaauucaccuu

SEQ ID NO: 1108251 - RNA, 22 nt, Homo sapiens
uugauggauuaauuaaauaagu

SEQ ID NO: 1108252 - RNA, 15 nt, Homo sapiens
uugauuagacuccua

SEQ ID NO: 1108253 - RNA, 17 nt, Homo sapiens
uugauucaaagcacugu

SEQ ID NO: 1108254 - RNA, 10 nt, Homo sapiens
uugauuucaa

SEQ ID NO: 1108255 - RNA, 11 nt, Homo sapiens
uugcacuuugu

SEQ ID NO: 1108256 - RNA, 14 nt, Homo sapiens
uugcagacaggcaa

SEQ ID NO: 1108257 - RNA, 20 nt, Homo sapiens
uugcagcagugagucucuuc

SEQ ID NO: 1108258 - RNA, 23 nt, Homo sapiens
uugcaugccaucuccacccugag

SEQ ID NO: 1108259 - RNA, 22 nt, Homo sapiens
uugcauuaaaaaugcauauacu

SEQ ID NO: 1108260 - RNA, 14 nt, Homo sapiens
uugccacacacugu

SEQ ID NO: 1108261 - RNA, 15 nt, Homo sapiens
uugccauaaagucaa

SEQ ID NO: 1108262 - RNA, 19 nt, Homo sapiens
uugcccugaguggaucucc

SEQ ID NO: 1108263 - RNA, 17 nt, Homo sapiens
uugccuaaauccaaaga

SEQ ID NO: 1108264 - RNA, 15 nt, Homo sapiens
uugcuaaaauauuau

SEQ ID NO: 1108265 - RNA, 11 nt, Homo sapiens
uugcucaaggc

SEQ ID NO: 1108266 - RNA, 13 nt, Homo sapiens
uugcugugagcaa

SEQ ID NO: 1108267 - RNA, 13 nt, Homo sapiens
uugcuguuuccuu

SEQ ID NO: 1108268 - RNA, 14 nt, Homo sapiens
uugcuuuaaaguac

SEQ ID NO: 1108269 - RNA, 17 nt, Homo sapiens
uuggaaagcaucaccuc

SEQ ID NO: 1108270 - RNA, 23 nt, Homo sapiens
uuggaaagcaucaccucaggcca

SEQ ID NO: 1108271 - RNA, 20 nt, Homo sapiens
uuggaaguguucccugagaa

SEQ ID NO: 1108272 - RNA, 19 nt, Homo sapiens
uuggaauacuugaaaaccu

SEQ ID NO: 1108273 - RNA, 21 nt, Homo sapiens
uuggacccgcucuggaccaac

SEQ ID NO: 1108274 - RNA, 13 nt, Homo sapiens
uuggagacggcca

SEQ ID NO: 1108275 - RNA, 21 nt, Homo sapiens
uuggauaauaacuagaucucc

SEQ ID NO: 1108276 - RNA, 14 nt, Homo sapiens
uuggauguggagcu

SEQ ID NO: 1108277 - RNA, 23 nt, Homo sapiens
uuggcagaaaggauguuuugucc

SEQ ID NO: 1108278 - RNA, 22 nt, Homo sapiens
uuggcugcauaaaugugguaca

SEQ ID NO: 1108279 - RNA, 22 nt, Homo sapiens
uugggaaacagagaacccugug

SEQ ID NO: 1108280 - RNA, 13 nt, Homo sapiens
uugggagcacugg

SEQ ID NO: 1108281 - RNA, 16 nt, Homo sapiens
uugguaacauccuuuc

SEQ ID NO: 1108282 - RNA, 21 nt, Homo sapiens
uugguacuacuagaugucuuu

SEQ ID NO: 1108283 - RNA, 20 nt, Homo sapiens
uuguaaaauauuuaugagaa

SEQ ID NO: 1108284 - RNA, 23 nt, Homo sapiens
uuguaaguggucgcuuacuuuga

SEQ ID NO: 1108285 - RNA, 16 nt, Homo sapiens
uuguaaugucaccacc

SEQ ID NO: 1108286 - RNA, 20 nt, Homo sapiens
uuguacagacguaugcuuau

SEQ ID NO: 1108287 - RNA, 15 nt, Homo sapiens
uuguacauauggaaa

SEQ ID NO: 1108288 - RNA, 16 nt, Homo sapiens
uuguacauuccugaua

SEQ ID NO: 1108289 - RNA, 19 nt, Homo sapiens
uuguacauuccugauacug

SEQ ID NO: 1108290 - RNA, 14 nt, Homo sapiens
uuguaccaguguga

SEQ ID NO: 1108291 - RNA, 15 nt, Homo sapiens
uuguagcagaaggca

SEQ ID NO: 1108292 - RNA, 16 nt, Homo sapiens
uuguauauuauggaag

SEQ ID NO: 1108293 - RNA, 19 nt, Homo sapiens
uuguauauugucagauauu

SEQ ID NO: 1108294 - RNA, 16 nt, Homo sapiens
uugucaaaaaguggau

SEQ ID NO: 1108295 - RNA, 18 nt, Homo sapiens
uugucaagagagagucaa

SEQ ID NO: 1108296 - RNA, 12 nt, Homo sapiens
uugucauucaag

SEQ ID NO: 1108297 - RNA, 15 nt, Homo sapiens
uugucgaguuuacuu

SEQ ID NO: 1108298 - RNA, 22 nt, Homo sapiens
uugucucucuaaacccaaauaa

SEQ ID NO: 1108299 - RNA, 23 nt, Homo sapiens
uugucucucuaaacccaaauaaa

SEQ ID NO: 1108300 - RNA, 14 nt, Homo sapiens
uugucugugcagcu

SEQ ID NO: 1108301 - RNA, 23 nt, Homo sapiens
uugugaaagaaggagcaagagaa

SEQ ID NO: 1108302 - RNA, 15 nt, Homo sapiens
uugugucuguacacg

SEQ ID NO: 1108303 - RNA, 19 nt, Homo sapiens
uuguuaaaaccuuacuuaa

SEQ ID NO: 1108304 - RNA, 21 nt, Homo sapiens
uuguuaaacacgugucuauaa

SEQ ID NO: 1108305 - RNA, 13 nt, Homo sapiens
uuguuaaugcauu

SEQ ID NO: 1108306 - RNA, 18 nt, Homo sapiens
uuguuaccuuuaugguuu

SEQ ID NO: 1108307 - RNA, 19 nt, Homo sapiens
uuguuaccuuucccaugcu

SEQ ID NO: 1108308 - RNA, 15 nt, Homo sapiens
uuguucaguugacuu

SEQ ID NO: 1108309 - RNA, 23 nt, Homo sapiens
uuguuuggucacugcuacaccuu

SEQ ID NO: 1108310 - RNA, 19 nt, Homo sapiens
uuguuugugaaacaaaaaa

SEQ ID NO: 1108311 - RNA, 19 nt, Homo sapiens
uuuaaaauuaaaugcaugu

SEQ ID NO: 1108312 - RNA, 17 nt, Homo sapiens
uuuaacaaaacaagaaa

SEQ ID NO: 1108313 - RNA, 15 nt, Homo sapiens
uuuaacaucugagaa

SEQ ID NO: 1108314 - RNA, 17 nt, Homo sapiens
uuuaacuuaacauucug

SEQ ID NO: 1108315 - RNA, 17 nt, Homo sapiens
uuuaagaguuacuuaau

SEQ ID NO: 1108316 - RNA, 16 nt, Homo sapiens
uuuaagauaaacagaa

SEQ ID NO: 1108317 - RNA, 15 nt, Homo sapiens
uuuaaguaauuuugc

SEQ ID NO: 1108318 - RNA, 15 nt, Homo sapiens
ccugggcucaucagc

SEQ ID NO: 1108319 - RNA, 16 nt, Homo sapiens
ccugggcuuaugcccu

SEQ ID NO: 1108320 - RNA, 14 nt, Homo sapiens
ccuggggcauccca

SEQ ID NO: 1108321 - RNA, 13 nt, Homo sapiens
ccuggggugaccc

SEQ ID NO: 1108322 - RNA, 17 nt, Homo sapiens
ccuggucaacaugguga

SEQ ID NO: 1108323 - RNA, 19 nt, Homo sapiens
ccuggucaacauggugaaa

SEQ ID NO: 1108324 - RNA, 22 nt, Homo sapiens
ccuggugggccuccucugucca

SEQ ID NO: 1108325 - RNA, 21 nt, Homo sapiens
ccugguuaaauuugaauuuca

SEQ ID NO: 1108326 - RNA, 18 nt, Homo sapiens
ccuguaaucccagcacuu

SEQ ID NO: 1108327 - RNA, 18 nt, Homo sapiens
ccuguagccccagugaca

SEQ ID NO: 1108328 - RNA, 14 nt, Homo sapiens
ccuguagugagaaa

SEQ ID NO: 1108329 - RNA, 16 nt, Homo sapiens
ccugucuuucagcauu

SEQ ID NO: 1108330 - RNA, 18 nt, Homo sapiens
ccugucuuucagcauuca

SEQ ID NO: 1108331 - RNA, 12 nt, Homo sapiens
ccugugagauaa

SEQ ID NO: 1108332 - RNA, 19 nt, Homo sapiens
ccugugggggcggcugugg

SEQ ID NO: 1108333 - RNA, 23 nt, Homo sapiens
ccugugggggcggcuguggggga

SEQ ID NO: 1108334 - RNA, 18 nt, Homo sapiens
ccugugggugugucucuc

SEQ ID NO: 1108335 - RNA, 22 nt, Homo sapiens
ccuguguaaaacuauauucuca

SEQ ID NO: 1108336 - RNA, 23 nt, Homo sapiens
ccugugucuuauagguuuccacu

SEQ ID NO: 1108337 - RNA, 17 nt, Homo sapiens
ccugugugagcaucucu

SEQ ID NO: 1108338 - RNA, 23 nt, Homo sapiens
ccuguuacuugaaauaccaguga

SEQ ID NO: 1108339 - RNA, 21 nt, Homo sapiens
ccuguucuuccuaccaaauau

SEQ ID NO: 1108340 - RNA, 23 nt, Homo sapiens
ccuuaaacucagggagcauuuau

SEQ ID NO: 1108341 - RNA, 20 nt, Homo sapiens
ccuuaacucaucuguuaucc

SEQ ID NO: 1108342 - RNA, 15 nt, Homo sapiens
ccuuacuaugaucuc

SEQ ID NO: 1108343 - RNA, 21 nt, Homo sapiens
ccuuacuauggaaagcagcca

SEQ ID NO: 1108344 - RNA, 22 nt, Homo sapiens
ccuuagauuagcucuggaccag

SEQ ID NO: 1108345 - RNA, 23 nt, Homo sapiens
ccuucacaaccagccacacagag

SEQ ID NO: 1108346 - RNA, 14 nt, Homo sapiens
ccuucacuuuacaa

SEQ ID NO: 1108347 - RNA, 17 nt, Homo sapiens
ccuucagcauaauucgg

SEQ ID NO: 1108348 - RNA, 15 nt, Homo sapiens
ccuuccuggacagcu

SEQ ID NO: 1108349 - RNA, 18 nt, Homo sapiens
ccuucgggagggcacuca

SEQ ID NO: 1108350 - RNA, 14 nt, Homo sapiens
ccuucgguuuguau

SEQ ID NO: 1108351 - RNA, 14 nt, Homo sapiens
ccuucucuacccau

SEQ ID NO: 1108352 - RNA, 19 nt, Homo sapiens
ccuugaaggucacucuucc

SEQ ID NO: 1108353 - RNA, 22 nt, Homo sapiens
ccuugauggagauauuuacaug

SEQ ID NO: 1108354 - RNA, 17 nt, Homo sapiens
ccuugcaaaaaaaaacu

SEQ ID NO: 1108355 - RNA, 14 nt, Homo sapiens
ccuugcccagagau

SEQ ID NO: 1108356 - RNA, 15 nt, Homo sapiens
ccuuggcucaauccu

SEQ ID NO: 1108357 - RNA, 21 nt, Homo sapiens
ccuuguguacaguuauuuaug

SEQ ID NO: 1108358 - RNA, 19 nt, Homo sapiens
ccuuguguguuuugagagu

SEQ ID NO: 1108359 - RNA, 20 nt, Homo sapiens
ccuuuaaauccuuccaugaa

SEQ ID NO: 1108360 - RNA, 23 nt, Homo sapiens
ccuuuauuaaugaacugugacag

SEQ ID NO: 1108361 - RNA, 16 nt, Homo sapiens
ccuuucaccacaugug

SEQ ID NO: 1108362 - RNA, 11 nt, Homo sapiens
ccuuuccauaa

SEQ ID NO: 1108363 - RNA, 22 nt, Homo sapiens
ccuuuccucugcagcacuuuaa

SEQ ID NO: 1108364 - RNA, 19 nt, Homo sapiens
ccuuugaggcaaaggccag

SEQ ID NO: 1108365 - RNA, 18 nt, Homo sapiens
ccuuuguguauucaucuu

SEQ ID NO: 1108366 - RNA, 14 nt, Homo sapiens
ccuuuuaaaacacu

SEQ ID NO: 1108367 - RNA, 21 nt, Homo sapiens
ccuuuuauucauauuuucaca

SEQ ID NO: 1108368 - RNA, 17 nt, Homo sapiens
ccuuuuauuucuuaaac

SEQ ID NO: 1108369 - RNA, 22 nt, Homo sapiens
ccuuuugcaacaagacaaagca

SEQ ID NO: 1108370 - RNA, 22 nt, Homo sapiens
cgaagaccuucugaagaucuca

SEQ ID NO: 1108371 - RNA, 22 nt, Homo sapiens
cgaauggaagaggcaccugucc

SEQ ID NO: 1108372 - RNA, 13 nt, Homo sapiens
cgacaaagccaaa

SEQ ID NO: 1108373 - RNA, 16 nt, Homo sapiens
cgaccccucagugcuc

SEQ ID NO: 1108374 - RNA, 23 nt, Homo sapiens
cgacgguuucaaaccaggauuuu

SEQ ID NO: 1108375 - RNA, 18 nt, Homo sapiens
cgagggaugggauuucau

SEQ ID NO: 1108376 - RNA, 17 nt, Homo sapiens
cgaguuguggaaagccu

SEQ ID NO: 1108377 - RNA, 23 nt, Homo sapiens
cgauaaagaacacgaauugcuca

SEQ ID NO: 1108378 - RNA, 18 nt, Homo sapiens
cgaucuggguucacugca

SEQ ID NO: 1108379 - RNA, 20 nt, Homo sapiens
cgaucuggguucacugcaac

SEQ ID NO: 1108380 - RNA, 20 nt, Homo sapiens
cgcaaagggcugaaagccau

SEQ ID NO: 1108381 - RNA, 16 nt, Homo sapiens
cgcaagagaacauuuc

SEQ ID NO: 1108382 - RNA, 17 nt, Homo sapiens
cgcacaaggcugaccaa

SEQ ID NO: 1108383 - RNA, 20 nt, Homo sapiens
cgcacaaggcugaccaagag

SEQ ID NO: 1108384 - RNA, 21 nt, Homo sapiens
cgcacaaggcugaccaagaga

SEQ ID NO: 1108385 - RNA, 16 nt, Homo sapiens
cgcaccuugucaugua

SEQ ID NO: 1108386 - RNA, 20 nt, Homo sapiens
cgccucucccaccccaugca

SEQ ID NO: 1108387 - RNA, 16 nt, Homo sapiens
cgccuggccccugggc

SEQ ID NO: 1108388 - RNA, 10 nt, Homo sapiens
cgcucuggac

SEQ ID NO: 1108389 - RNA, 22 nt, Homo sapiens
cgcucuuggcagguacucagcg

SEQ ID NO: 1108390 - RNA, 14 nt, Homo sapiens
cgcugccuugccau

SEQ ID NO: 1108391 - RNA, 18 nt, Homo sapiens
cuauauacuauaugauuc

SEQ ID NO: 1108392 - RNA, 18 nt, Homo sapiens
cuauauguaguauaaaga

SEQ ID NO: 1108393 - RNA, 16 nt, Homo sapiens
cuaucaauuacagucc

SEQ ID NO: 1108394 - RNA, 15 nt, Homo sapiens
cuaucacacaguggg

SEQ ID NO: 1108395 - RNA, 18 nt, Homo sapiens
cuaugaaaauuauaucuc

SEQ ID NO: 1108396 - RNA, 19 nt, Homo sapiens
cuaugaaugauacccugaa

SEQ ID NO: 1108397 - RNA, 14 nt, Homo sapiens
cuaugcacauaugg

SEQ ID NO: 1108398 - RNA, 20 nt, Homo sapiens
cuauggagagcccugggacc

SEQ ID NO: 1108399 - RNA, 15 nt, Homo sapiens
cuaugggggcacuga

SEQ ID NO: 1108400 - RNA, 20 nt, Homo sapiens
cuauguauggaugaaagcaa

SEQ ID NO: 1108401 - RNA, 22 nt, Homo sapiens
cuauguauggaugaaagcaauc

SEQ ID NO: 1108402 - RNA, 23 nt, Homo sapiens
cuaugugggacaccucaaauaca

SEQ ID NO: 1108403 - RNA, 14 nt, Homo sapiens
cuauguugcccagg

SEQ ID NO: 1108404 - RNA, 21 nt, Homo sapiens
cuauuaaaagaauccaaauuc

SEQ ID NO: 1108405 - RNA, 15 nt, Homo sapiens
ugauacauaugugaa

SEQ ID NO: 1108406 - RNA, 13 nt, Homo sapiens
ugauagcuuuauu

SEQ ID NO: 1108407 - RNA, 14 nt, Homo sapiens
ugauauauuuucca

SEQ ID NO: 1108408 - RNA, 18 nt, Homo sapiens
ugauaucccccagccuca

SEQ ID NO: 1108409 - RNA, 20 nt, Homo sapiens
ugauaugaaaaauaugauau

SEQ ID NO: 1108410 - RNA, 18 nt, Homo sapiens
ugauauguaaacauaauu

SEQ ID NO: 1108411 - RNA, 17 nt, Homo sapiens
ugauauugcauaugcau

SEQ ID NO: 1108412 - RNA, 21 nt, Homo sapiens
ugaucaggcuauguauggaau

SEQ ID NO: 1108413 - RNA, 17 nt, Homo sapiens
ugauccguuccauugca

SEQ ID NO: 1108414 - RNA, 23 nt, Homo sapiens
ugaucggagccuccucucucaaa

SEQ ID NO: 1108415 - RNA, 17 nt, Homo sapiens
ugaucuaucaauaguca

SEQ ID NO: 1108416 - RNA, 13 nt, Homo sapiens
ugaugaucuuugc

SEQ ID NO: 1108417 - RNA, 21 nt, Homo sapiens
ugauggcaccacugcacucca

SEQ ID NO: 1108418 - RNA, 13 nt, Homo sapiens
ugauguccagaag

SEQ ID NO: 1108419 - RNA, 15 nt, Homo sapiens
ugaugugaaacauua

SEQ ID NO: 1108420 - RNA, 15 nt, Homo sapiens
ugauuaaaacauuau

SEQ ID NO: 1108421 - RNA, 17 nt, Homo sapiens
ugauuaaacagacuuua

SEQ ID NO: 1108422 - RNA, 19 nt, Homo sapiens
ugauugacacacagcacuc

SEQ ID NO: 1108423 - RNA, 18 nt, Homo sapiens
ugauuggccccacugacg

SEQ ID NO: 1108424 - RNA, 21 nt, Homo sapiens
ugauuguuuaauuguagguca

SEQ ID NO: 1108425 - RNA, 14 nt, Homo sapiens
ugauuugcuaucaa

SEQ ID NO: 1108426 - RNA, 21 nt, Homo sapiens
ugcaaaggcgcagugcuucuc

SEQ ID NO: 1108427 - RNA, 14 nt, Homo sapiens
ugcaacaacaugua

SEQ ID NO: 1108428 - RNA, 20 nt, Homo sapiens
ugcaaggcccucuauuucuc

SEQ ID NO: 1108429 - RNA, 22 nt, Homo sapiens
ugcaaggugaacaccacuuugu

SEQ ID NO: 1108430 - RNA, 14 nt, Homo sapiens
ugcaauauguauua

SEQ ID NO: 1108431 - RNA, 18 nt, Homo sapiens
ugcaaucucuugucucac

SEQ ID NO: 1108432 - RNA, 17 nt, Homo sapiens
ugcacaaagcccuucca

SEQ ID NO: 1108433 - RNA, 18 nt, Homo sapiens
ugcaccccuccccauuca

SEQ ID NO: 1108434 - RNA, 20 nt, Homo sapiens
ugcaccgagagagauggaau

SEQ ID NO: 1108435 - RNA, 14 nt, Homo sapiens
ugcacgcacugcgu

SEQ ID NO: 1108436 - RNA, 13 nt, Homo sapiens
ugcacggcagcuu

SEQ ID NO: 1108437 - RNA, 19 nt, Homo sapiens
ugcacgggagaauauacaa

SEQ ID NO: 1108438 - RNA, 14 nt, Homo sapiens
ugcacgugugugca

SEQ ID NO: 1108439 - RNA, 19 nt, Homo sapiens
ugcacguguguguguuuca

SEQ ID NO: 1108440 - RNA, 13 nt, Homo sapiens
ugcagaaggccaa

SEQ ID NO: 1108441 - RNA, 17 nt, Homo sapiens
ugcagcagaagccaaau

SEQ ID NO: 1108442 - RNA, 21 nt, Homo sapiens
ugcagcggcacaaaugcaccu

SEQ ID NO: 1108443 - RNA, 22 nt, Homo sapiens
ugcagcugcuuguugucaagua

SEQ ID NO: 1108444 - RNA, 22 nt, Homo sapiens
ugcagcuuccugucaacacuuc

SEQ ID NO: 1108445 - RNA, 23 nt, Homo sapiens
ugcagcuucggggcaagugagac

SEQ ID NO: 1108446 - RNA, 17 nt, Homo sapiens
ugcaggauuucuucaca

SEQ ID NO: 1108447 - RNA, 19 nt, Homo sapiens
ugcaguauggccaugggcu

SEQ ID NO: 1108448 - RNA, 18 nt, Homo sapiens
ugcagugguaugaucacg

SEQ ID NO: 1108449 - RNA, 15 nt, Homo sapiens
ugcaguuaauacuua

SEQ ID NO: 1108450 - RNA, 15 nt, Homo sapiens
ugcaguuuccaaucc

SEQ ID NO: 1108451 - RNA, 18 nt, Homo sapiens
ugcauccguaguucccug

SEQ ID NO: 1108452 - RNA, 13 nt, Homo sapiens
ugcaucuacucag

SEQ ID NO: 1108453 - RNA, 11 nt, Homo sapiens
ugcaugccaaa

SEQ ID NO: 1108454 - RNA, 14 nt, Homo sapiens
ugcaugcucaggac

SEQ ID NO: 1108455 - RNA, 13 nt, Homo sapiens
ugcauguccucaa

SEQ ID NO: 1108456 - RNA, 17 nt, Homo sapiens
ugcauuacugcaugcac

SEQ ID NO: 1108457 - RNA, 20 nt, Homo sapiens
ugcauuacugcaugcacuuc

SEQ ID NO: 1108458 - RNA, 17 nt, Homo sapiens
ugcauuuuuaaauacaa

SEQ ID NO: 1108459 - RNA, 19 nt, Homo sapiens
ugccacaucugugucucug

SEQ ID NO: 1108460 - RNA, 17 nt, Homo sapiens
ugccaccuccuggaagg

SEQ ID NO: 1108461 - RNA, 14 nt, Homo sapiens
ugccagacaugugg

SEQ ID NO: 1108462 - RNA, 18 nt, Homo sapiens
ugccagacuuaaaucaca

SEQ ID NO: 1108463 - RNA, 15 nt, Homo sapiens
ugccaggccuggcaa

SEQ ID NO: 1108464 - RNA, 14 nt, Homo sapiens
ugccauagcaagau

SEQ ID NO: 1108465 - RNA, 23 nt, Homo sapiens
ugccauccuaggcuuaaaugcaa

SEQ ID NO: 1108466 - RNA, 19 nt, Homo sapiens
ugcccacgcuggagugcag

SEQ ID NO: 1108467 - RNA, 15 nt, Homo sapiens
ugcccacuacgugcc

SEQ ID NO: 1108468 - RNA, 21 nt, Homo sapiens
ugcccagaauucccagcuguc

SEQ ID NO: 1108469 - RNA, 20 nt, Homo sapiens
ugcccaggcuggagugcagu

SEQ ID NO: 1108470 - RNA, 15 nt, Homo sapiens
ugcccagggcucagc

SEQ ID NO: 1108471 - RNA, 13 nt, Homo sapiens
ugcccagugcacu

SEQ ID NO: 1108472 - RNA, 21 nt, Homo sapiens
ugcccagugcacuugcuggaa

SEQ ID NO: 1108473 - RNA, 17 nt, Homo sapiens
ugccccagagaugggca

SEQ ID NO: 1108474 - RNA, 17 nt, Homo sapiens
ugccccccuugccagac

SEQ ID NO: 1108475 - RNA, 16 nt, Homo sapiens
ugccccuggccuuuga

SEQ ID NO: 1108476 - RNA, 15 nt, Homo sapiens
ugccccuguaaauag

SEQ ID NO: 1108477 - RNA, 18 nt, Homo sapiens
ugcccuucuuucuacccu

SEQ ID NO: 1108478 - RNA, 22 nt, Homo sapiens
ugcccuuggccugaagucccag

SEQ ID NO: 1108479 - RNA, 17 nt, Homo sapiens
ugccguaacaacugugg

SEQ ID NO: 1108480 - RNA, 22 nt, Homo sapiens
ugccuccauucugaccauuuca

SEQ ID NO: 1108481 - RNA, 23 nt, Homo sapiens
ugccuccucccugggcagaaagu

SEQ ID NO: 1108482 - RNA, 20 nt, Homo sapiens
ugccucugacacacagcucu

SEQ ID NO: 1108483 - RNA, 15 nt, Homo sapiens
ugccugaauccauca

SEQ ID NO: 1108484 - RNA, 21 nt, Homo sapiens
ugccuggugggccacguguuc

SEQ ID NO: 1108485 - RNA, 21 nt, Homo sapiens
ugccugugugggacugagaug

SEQ ID NO: 1108486 - RNA, 20 nt, Homo sapiens
ugccuguucccauucuugca

SEQ ID NO: 1108487 - RNA, 21 nt, Homo sapiens
ugcgacuucacaaaaugcaag

SEQ ID NO: 1108488 - RNA, 14 nt, Homo sapiens
ugcgagcauuuccc

SEQ ID NO: 1108489 - RNA, 17 nt, Homo sapiens
ugcgaucuggguucacu

SEQ ID NO: 1108490 - RNA, 21 nt, Homo sapiens
ugcgaucuggguucacugcaa

SEQ ID NO: 1108491 - RNA, 21 nt, Homo sapiens
ugcgccacugcacuccagucu

SEQ ID NO: 1108492 - RNA, 13 nt, Homo sapiens
ugcgcugcucaac

SEQ ID NO: 1108493 - RNA, 14 nt, Homo sapiens
ugcguggacucugc

SEQ ID NO: 1108494 - RNA, 16 nt, Homo sapiens
cacugaccugccugua

SEQ ID NO: 1108495 - RNA, 19 nt, Homo sapiens
cacugagcugggcaccaca

SEQ ID NO: 1108496 - RNA, 17 nt, Homo sapiens
cacugaggaccagccau

SEQ ID NO: 1108497 - RNA, 22 nt, Homo sapiens
cacugaggcauuuuuacuacua

SEQ ID NO: 1108498 - RNA, 18 nt, Homo sapiens
cacugaugggcaaccccc

SEQ ID NO: 1108499 - RNA, 21 nt, Homo sapiens
cacugcaccgggccacagaga

SEQ ID NO: 1108500 - RNA, 19 nt, Homo sapiens
cacugcacuauagccuagg

SEQ ID NO: 1108501 - RNA, 18 nt, Homo sapiens
cacugggccuccaaccau

SEQ ID NO: 1108502 - RNA, 21 nt, Homo sapiens
cacugggcugcagagacugga

SEQ ID NO: 1108503 - RNA, 15 nt, Homo sapiens
cacuguuucucucac

SEQ ID NO: 1108504 - RNA, 16 nt, Homo sapiens
cacuuauugacuauua

SEQ ID NO: 1108505 - RNA, 17 nt, Homo sapiens
cacuucucacaucuuau

SEQ ID NO: 1108506 - RNA, 20 nt, Homo sapiens
cacuucucaggacacaggcc

SEQ ID NO: 1108507 - RNA, 17 nt, Homo sapiens
cacuucucuacucugga

SEQ ID NO: 1108508 - RNA, 22 nt, Homo sapiens
cacuucucuccaggcuguuucu

SEQ ID NO: 1108509 - RNA, 20 nt, Homo sapiens
cacuuuaccuucagcaguua

SEQ ID NO: 1108510 - RNA, 20 nt, Homo sapiens
cacuuugggaggcugaggcg

SEQ ID NO: 1108511 - RNA, 16 nt, Homo sapiens
cagaaaaacucuggga

SEQ ID NO: 1108512 - RNA, 16 nt, Homo sapiens
cagaaaagcaccugcc

SEQ ID NO: 1108513 - RNA, 15 nt, Homo sapiens
cagaaagcauuacau

SEQ ID NO: 1108514 - RNA, 17 nt, Homo sapiens
cagaaagguuaguauca

SEQ ID NO: 1108515 - RNA, 19 nt, Homo sapiens
cagaaaguggccaugccac

SEQ ID NO: 1108516 - RNA, 14 nt, Homo sapiens
cagaacacagugcc

SEQ ID NO: 1108517 - RNA, 13 nt, Homo sapiens
cagaaccaaagca

SEQ ID NO: 1108518 - RNA, 16 nt, Homo sapiens
cagaacccagauuucc

SEQ ID NO: 1108519 - RNA, 18 nt, Homo sapiens
cagaaccccuacaugaaa

SEQ ID NO: 1108520 - RNA, 14 nt, Homo sapiens
cagaagccucugcc

SEQ ID NO: 1108521 - RNA, 16 nt, Homo sapiens
cagaaggcaaaaagac

SEQ ID NO: 1108522 - RNA, 15 nt, Homo sapiens
cagaagucuugucuc

SEQ ID NO: 1108523 - RNA, 20 nt, Homo sapiens
cagaagucuugucucaagaa

SEQ ID NO: 1108524 - RNA, 19 nt, Homo sapiens
cagaauacaguaagcugcu

SEQ ID NO: 1108525 - RNA, 23 nt, Homo sapiens
cagaauagcuuugaauguggccc

SEQ ID NO: 1108526 - RNA, 20 nt, Homo sapiens
cagaaucgcuaauagaacca

SEQ ID NO: 1108527 - RNA, 21 nt, Homo sapiens
cagaauguauauuaaggugug

SEQ ID NO: 1108528 - RNA, 12 nt, Homo sapiens
cagacaacagaa

SEQ ID NO: 1108529 - RNA, 16 nt, Homo sapiens
cagacacuaaguuaua

SEQ ID NO: 1108530 - RNA, 14 nt, Homo sapiens
cagaccccaaggcc

SEQ ID NO: 1108531 - RNA, 16 nt, Homo sapiens
cagaccucaggugcua

SEQ ID NO: 1108532 - RNA, 22 nt, Homo sapiens
cagaccucuacaagcaaaugga

SEQ ID NO: 1108533 - RNA, 18 nt, Homo sapiens
cagaccuuuuauccacuu

SEQ ID NO: 1108534 - RNA, 16 nt, Homo sapiens
cagacuacagccagaa

SEQ ID NO: 1108535 - RNA, 19 nt, Homo sapiens
cagacuauuaaaacuaaua

SEQ ID NO: 1108536 - RNA, 13 nt, Homo sapiens
cagacucacugug

SEQ ID NO: 1108537 - RNA, 13 nt, Homo sapiens
cagacuuaaauca

SEQ ID NO: 1108538 - RNA, 17 nt, Homo sapiens
cagacuucacacugcaa

SEQ ID NO: 1108539 - RNA, 14 nt, Homo sapiens
cagacuucccugaa

SEQ ID NO: 1108540 - RNA, 14 nt, Homo sapiens
cagacuucuccaga

SEQ ID NO: 1108541 - RNA, 17 nt, Homo sapiens
cagagaaagaagagaca

SEQ ID NO: 1108542 - RNA, 15 nt, Homo sapiens
cagagaacccugugg

SEQ ID NO: 1108543 - RNA, 20 nt, Homo sapiens
cagagaacuggaaagacaua

SEQ ID NO: 1108544 - RNA, 20 nt, Homo sapiens
cagagaaggcuuccuccagc

SEQ ID NO: 1108545 - RNA, 13 nt, Homo sapiens
cagagaagucagu

SEQ ID NO: 1108546 - RNA, 18 nt, Homo sapiens
cagagaauauauacauuc

SEQ ID NO: 1108547 - RNA, 16 nt, Homo sapiens
cagagacaggaaaauc

SEQ ID NO: 1108548 - RNA, 18 nt, Homo sapiens
cagagacaggcccaagag

SEQ ID NO: 1108549 - RNA, 20 nt, Homo sapiens
cagagacaggcccaagagau

SEQ ID NO: 1108550 - RNA, 17 nt, Homo sapiens
cagagacggaagccuuu

SEQ ID NO: 1108551 - RNA, 13 nt, Homo sapiens
cagagaugggcaa

SEQ ID NO: 1108552 - RNA, 20 nt, Homo sapiens
cagagcccagggcaucccau

SEQ ID NO: 1108553 - RNA, 20 nt, Homo sapiens
cagaggagggcgugacucac

SEQ ID NO: 1108554 - RNA, 22 nt, Homo sapiens
ugaguuacuuccuaucaagcca

SEQ ID NO: 1108555 - RNA, 19 nt, Homo sapiens
ugaguuugggauuguggua

SEQ ID NO: 1108556 - RNA, 15 nt, Homo sapiens
ugauaaaagcacuua

SEQ ID NO: 1108557 - RNA, 16 nt, Homo sapiens
ugauaaugcagacuuc

SEQ ID NO: 1108558 - RNA, 18 nt, Homo sapiens
uaacaguugugaugacua

SEQ ID NO: 1108559 - RNA, 20 nt, Homo sapiens
uaacauagauuuauguaaug

SEQ ID NO: 1108560 - RNA, 21 nt, Homo sapiens
uaacaucuauuauaaaaccau

SEQ ID NO: 1108561 - RNA, 13 nt, Homo sapiens
uaacauugauuua

SEQ ID NO: 1108562 - RNA, 14 nt, Homo sapiens
uaacauugauuuau

SEQ ID NO: 1108563 - RNA, 13 nt, Homo sapiens
uaaccaaauuauu

SEQ ID NO: 1108564 - RNA, 15 nt, Homo sapiens
uaaccccaccuugcc

SEQ ID NO: 1108565 - RNA, 23 nt, Homo sapiens
uaaccuguuuauauaauuuugca

SEQ ID NO: 1108566 - RNA, 15 nt, Homo sapiens
uaacgucaucucagg

SEQ ID NO: 1108567 - RNA, 22 nt, Homo sapiens
uaacuacaaauuaucauacuac

SEQ ID NO: 1108568 - RNA, 18 nt, Homo sapiens
uaacuagaaaucugccaa

SEQ ID NO: 1108569 - RNA, 12 nt, Homo sapiens
uaacuagaauuu

SEQ ID NO: 1108570 - RNA, 17 nt, Homo sapiens
uaacuagaauuuauuca

SEQ ID NO: 1108571 - RNA, 19 nt, Homo sapiens
uaacuaguauuguccauau

SEQ ID NO: 1108572 - RNA, 15 nt, Homo sapiens
uaacucuggugcucu

SEQ ID NO: 1108573 - RNA, 17 nt, Homo sapiens
uaacugccuuguguaca

SEQ ID NO: 1108574 - RNA, 13 nt, Homo sapiens
uaacuuauuuucc

SEQ ID NO: 1108575 - RNA, 21 nt, Homo sapiens
uaacuuggagagggacgaaga

SEQ ID NO: 1108576 - RNA, 14 nt, Homo sapiens
uaagaaaacuaaga

SEQ ID NO: 1108577 - RNA, 14 nt, Homo sapiens
uaagaaccugaaua

SEQ ID NO: 1108578 - RNA, 20 nt, Homo sapiens
uaagaagcaaauaaauauca

SEQ ID NO: 1108579 - RNA, 14 nt, Homo sapiens
uaagaaugcugguu

SEQ ID NO: 1108580 - RNA, 24 nt, Homo sapiens
uaagaguagcaaguucuagagaag

SEQ ID NO: 1108581 - RNA, 24 nt, Homo sapiens
uaagaguggaaccaacacuaacau

SEQ ID NO: 1108582 - RNA, 22 nt, Homo sapiens
uaagauacuggacuccucuucc

SEQ ID NO: 1108583 - RNA, 14 nt, Homo sapiens
uaagcaaaaccacu

SEQ ID NO: 1108584 - RNA, 16 nt, Homo sapiens
uaagcaaagacuauga

SEQ ID NO: 1108585 - RNA, 15 nt, Homo sapiens
uaagccuuuccauaa

SEQ ID NO: 1108586 - RNA, 12 nt, Homo sapiens
uaaggaacugga

SEQ ID NO: 1108587 - RNA, 21 nt, Homo sapiens
uaagggcuggucucugcugaa

SEQ ID NO: 1108588 - RNA, 15 nt, Homo sapiens
uaaguaaaccaaaaa

SEQ ID NO: 1108589 - RNA, 16 nt, Homo sapiens
uaaguaaaccaaaaag

SEQ ID NO: 1108590 - RNA, 18 nt, Homo sapiens
uaaguaaguuugauuuca

SEQ ID NO: 1108591 - RNA, 17 nt, Homo sapiens
uaaguaccacucaggcc

SEQ ID NO: 1108592 - RNA, 19 nt, Homo sapiens
uaagugcuuuguaauggga

SEQ ID NO: 1108593 - RNA, 15 nt, Homo sapiens
uaaguuacuucacuu

SEQ ID NO: 1108594 - RNA, 19 nt, Homo sapiens
uaaguuagggaauggcaca

SEQ ID NO: 1108595 - RNA, 16 nt, Homo sapiens
uaauaacuagaucucc

SEQ ID NO: 1108596 - RNA, 14 nt, Homo sapiens
uaauagacacugga

SEQ ID NO: 1108597 - RNA, 18 nt, Homo sapiens
uaauaguuuugauccuaa

SEQ ID NO: 1108598 - RNA, 14 nt, Homo sapiens
uaauauaugcucaa

SEQ ID NO: 1108599 - RNA, 20 nt, Homo sapiens
uaauaucugugaggugcuga

SEQ ID NO: 1108600 - RNA, 14 nt, Homo sapiens
uaauaugcugccaa

SEQ ID NO: 1108601 - RNA, 15 nt, Homo sapiens
uaaucccagcacuuu

SEQ ID NO: 1108602 - RNA, 21 nt, Homo sapiens
uaaucccagcaugcugagauu

SEQ ID NO: 1108603 - RNA, 20 nt, Homo sapiens
uaaucccagcuacuugggag

SEQ ID NO: 1108604 - RNA, 22 nt, Homo sapiens
uaaucuggacuccucuguccag

SEQ ID NO: 1108605 - RNA, 14 nt, Homo sapiens
uacagauagucaaa

SEQ ID NO: 1108606 - RNA, 13 nt, Homo sapiens
uacagaugggcaa

SEQ ID NO: 1108607 - RNA, 19 nt, Homo sapiens
uacaggcaacaaugagcag

SEQ ID NO: 1108608 - RNA, 13 nt, Homo sapiens
uacaggugugaac

SEQ ID NO: 1108609 - RNA, 14 nt, Homo sapiens
uacaggugugaguc

SEQ ID NO: 1108610 - RNA, 14 nt, Homo sapiens
uacaguggcuguca

SEQ ID NO: 1108611 - RNA, 20 nt, Homo sapiens
uacauaaaggugguaugugu

SEQ ID NO: 1108612 - RNA, 13 nt, Homo sapiens
uacauaagaccau

SEQ ID NO: 1108613 - RNA, 22 nt, Homo sapiens
uacauaaucaaagcuaccugug

SEQ ID NO: 1108614 - RNA, 23 nt, Homo sapiens
uacauacaggccauacuuuacaa

SEQ ID NO: 1108615 - RNA, 16 nt, Homo sapiens
uacauaccuacugacu

SEQ ID NO: 1108616 - RNA, 18 nt, Homo sapiens
uacauaguucuuacuacu

SEQ ID NO: 1108617 - RNA, 15 nt, Homo sapiens
uacauauauauguca

SEQ ID NO: 1108618 - RNA, 20 nt, Homo sapiens
uacauauggaaauccuguua

SEQ ID NO: 1108619 - RNA, 18 nt, Homo sapiens
uacauccagaaagaagga

SEQ ID NO: 1108620 - RNA, 23 nt, Homo sapiens
uacaugcauuacugcaugcacuu

SEQ ID NO: 1108621 - RNA, 17 nt, Homo sapiens
uacaugggguuuucaau

SEQ ID NO: 1108622 - RNA, 16 nt, Homo sapiens
uacauguguagccugu

SEQ ID NO: 1108623 - RNA, 16 nt, Homo sapiens
uacauucaacagauca

SEQ ID NO: 1108624 - RNA, 12 nt, Homo sapiens
uacauucccugg

SEQ ID NO: 1108625 - RNA, 23 nt, Homo sapiens
uacauuguuugucugucuucaua

SEQ ID NO: 1108626 - RNA, 15 nt, Homo sapiens
uacauuuuuguacac

SEQ ID NO: 1108627 - RNA, 16 nt, Homo sapiens
uaccaaaugagcauua

SEQ ID NO: 1108628 - RNA, 15 nt, Homo sapiens
uaccaaguguguugg

SEQ ID NO: 1108629 - RNA, 13 nt, Homo sapiens
uaccaaucauuuu

SEQ ID NO: 1108630 - RNA, 17 nt, Homo sapiens
uaccagugaaccaaaga

SEQ ID NO: 1108631 - RNA, 16 nt, Homo sapiens
uaccaguguacugcuu

SEQ ID NO: 1108632 - RNA, 15 nt, Homo sapiens
uaccaugccucucca

SEQ ID NO: 1108633 - RNA, 16 nt, Homo sapiens
uacccaauuuaauucc

SEQ ID NO: 1108634 - RNA, 23 nt, Homo sapiens
uacccagagaauauauacauucu

SEQ ID NO: 1108635 - RNA, 22 nt, Homo sapiens
uacccauauaucuuauguuaaa

SEQ ID NO: 1108636 - RNA, 18 nt, Homo sapiens
uacccccguggucuuuga

SEQ ID NO: 1108637 - RNA, 16 nt, Homo sapiens
uacccggcccagagac

SEQ ID NO: 1108638 - RNA, 17 nt, Homo sapiens
uaccucugauaccucaa

SEQ ID NO: 1108639 - RNA, 18 nt, Homo sapiens
uaccugaccaacaguucc

SEQ ID NO: 1108640 - RNA, 15 nt, Homo sapiens
uaccugugagauaac

SEQ ID NO: 1108641 - RNA, 20 nt, Homo sapiens
uaccuguggugauguugcca

SEQ ID NO: 1108642 - RNA, 18 nt, Homo sapiens
uaccuguguuucuugccu

SEQ ID NO: 1108643 - RNA, 16 nt, Homo sapiens
uaccuguuaguauuau

SEQ ID NO: 1108644 - RNA, 17 nt, Homo sapiens
uaccuugaacacugggg

SEQ ID NO: 1108645 - RNA, 22 nt, Homo sapiens
uaccuuuaaaauuuaccacaga

SEQ ID NO: 1108646 - RNA, 15 nt, Homo sapiens
uacgucaaagcagua

SEQ ID NO: 1108647 - RNA, 19 nt, Homo sapiens
uacguuugaaauaguugau

SEQ ID NO: 1108648 - RNA, 15 nt, Homo sapiens
uacuacuauucuguu

SEQ ID NO: 1108649 - RNA, 12 nt, Homo sapiens
uacuauguuaau

SEQ ID NO: 1108650 - RNA, 12 nt, Homo sapiens
uacucaaaagag

SEQ ID NO: 1108651 - RNA, 21 nt, Homo sapiens
aaguauacauuuuugcauugc

SEQ ID NO: 1108652 - RNA, 17 nt, Homo sapiens
aaguauauauucuacac

SEQ ID NO: 1108653 - RNA, 20 nt, Homo sapiens
aaguauccaauuaugugaca

SEQ ID NO: 1108654 - RNA, 20 nt, Homo sapiens
aagucaugaagcccaaguga

SEQ ID NO: 1108655 - RNA, 18 nt, Homo sapiens
aagucauuuuaacuuuau

SEQ ID NO: 1108656 - RNA, 17 nt, Homo sapiens
aaguccuuucuaaguau

SEQ ID NO: 1108657 - RNA, 19 nt, Homo sapiens
aagugagacccccaucucu

SEQ ID NO: 1108658 - RNA, 20 nt, Homo sapiens
aagugagacccccaucucua

SEQ ID NO: 1108659 - RNA, 23 nt, Homo sapiens
aagugagacccccaucucuacaa

SEQ ID NO: 1108660 - RNA, 14 nt, Homo sapiens
aaguggccaugcca

SEQ ID NO: 1108661 - RNA, 19 nt, Homo sapiens
aagugguaggaaagccuca

SEQ ID NO: 1108662 - RNA, 20 nt, Homo sapiens
aaguggucgcuuacuuugag

SEQ ID NO: 1108663 - RNA, 21 nt, Homo sapiens
aaguguuuuaauuucuacaca

SEQ ID NO: 1108664 - RNA, 15 nt, Homo sapiens
aaguuaaagugaaua

SEQ ID NO: 1108665 - RNA, 19 nt, Homo sapiens
aaguuacaaauucaaggag

SEQ ID NO: 1108666 - RNA, 19 nt, Homo sapiens
aaguuauuguguugccuua

SEQ ID NO: 1108667 - RNA, 22 nt, Homo sapiens
aaguucccuacuuccugugacu

SEQ ID NO: 1108668 - RNA, 15 nt, Homo sapiens
aaguuccucuagugc

SEQ ID NO: 1108669 - RNA, 19 nt, Homo sapiens
aaguucugguaugaacuug

SEQ ID NO: 1108670 - RNA, 16 nt, Homo sapiens
aaugacccaaagacca

SEQ ID NO: 1108671 - RNA, 12 nt, Homo sapiens
aaugacuauaaa

SEQ ID NO: 1108672 - RNA, 20 nt, Homo sapiens
aaugagaucguuguuuacag

SEQ ID NO: 1108673 - RNA, 19 nt, Homo sapiens
aaugaguuagaacuauuaa

SEQ ID NO: 1108674 - RNA, 17 nt, Homo sapiens
aaugaguuuauauggaa

SEQ ID NO: 1108675 - RNA, 19 nt, Homo sapiens
aaugauaaagaugucaaau

SEQ ID NO: 1108676 - RNA, 20 nt, Homo sapiens
aaugauccguuccauugcaa

SEQ ID NO: 1108677 - RNA, 16 nt, Homo sapiens
aaugaugggacaauaa

SEQ ID NO: 1108678 - RNA, 19 nt, Homo sapiens
aaugauucauaacaaugua

SEQ ID NO: 1108679 - RNA, 24 nt, Homo sapiens
aaugcaugauuuuauacauaguca

SEQ ID NO: 1108680 - RNA, 16 nt, Homo sapiens
aaugcauguccucaaa

SEQ ID NO: 1108681 - RNA, 17 nt, Homo sapiens
aaugcauguccucaaaa

SEQ ID NO: 1108682 - RNA, 21 nt, Homo sapiens
aaugcauuauaggaucauuug

SEQ ID NO: 1108683 - RNA, 16 nt, Homo sapiens
aaugcauugcuaaaau

SEQ ID NO: 1108684 - RNA, 15 nt, Homo sapiens
aaugcuaaaugcaaa

SEQ ID NO: 1108685 - RNA, 15 nt, Homo sapiens
aaugcuuaccuguga

SEQ ID NO: 1108686 - RNA, 15 nt, Homo sapiens
aauggaaacauuuac

SEQ ID NO: 1108687 - RNA, 15 nt, Homo sapiens
aauggaauacugaaa

SEQ ID NO: 1108688 - RNA, 15 nt, Homo sapiens
aauggcucugugaaa

SEQ ID NO: 1108689 - RNA, 14 nt, Homo sapiens
aauggggccuguua

SEQ ID NO: 1108690 - RNA, 23 nt, Homo sapiens
aauggggccuguuacacaugaca

SEQ ID NO: 1108691 - RNA, 16 nt, Homo sapiens
acaaauuauguuacau

SEQ ID NO: 1108692 - RNA, 17 nt, Homo sapiens
acaacaaccuggucaca

SEQ ID NO: 1108693 - RNA, 22 nt, Homo sapiens
acaacagcaaaacuccaucuca

SEQ ID NO: 1108694 - RNA, 19 nt, Homo sapiens
acaacaugcgaccgugacc

SEQ ID NO: 1108695 - RNA, 14 nt, Homo sapiens
acaacauuucucaa

SEQ ID NO: 1108696 - RNA, 21 nt, Homo sapiens
acaaccaugagaccacuguua

SEQ ID NO: 1108697 - RNA, 18 nt, Homo sapiens
acaacuguggucaauccg

SEQ ID NO: 1108698 - RNA, 19 nt, Homo sapiens
acaacuugucuauuaccug

SEQ ID NO: 1108699 - RNA, 19 nt, Homo sapiens
acaagaaccugcuaaggcu

SEQ ID NO: 1108700 - RNA, 22 nt, Homo sapiens
acaagaauuucuugguaagaag

SEQ ID NO: 1108701 - RNA, 11 nt, Homo sapiens
acaagauuccc

SEQ ID NO: 1108702 - RNA, 17 nt, Homo sapiens
acaagccaacuuguaaa

SEQ ID NO: 1108703 - RNA, 14 nt, Homo sapiens
acaagccauagugg

SEQ ID NO: 1108704 - RNA, 17 nt, Homo sapiens
acaagcuggaagcacau

SEQ ID NO: 1108705 - RNA, 18 nt, Homo sapiens
acaagcuuguauauacau

SEQ ID NO: 1108706 - RNA, 16 nt, Homo sapiens
acaaggcugaccaaga

SEQ ID NO: 1108707 - RNA, 18 nt, Homo sapiens
acaaguauguugagaguu

SEQ ID NO: 1108708 - RNA, 12 nt, Homo sapiens
acaagugcacuu

SEQ ID NO: 1108709 - RNA, 13 nt, Homo sapiens
acaauaucuucau

SEQ ID NO: 1108710 - RNA, 22 nt, Homo sapiens
acaaucaugagucagacauuug

SEQ ID NO: 1108711 - RNA, 18 nt, Homo sapiens
acaaucugggacuuucac

SEQ ID NO: 1108712 - RNA, 15 nt, Homo sapiens
acaaugaaaugcucu

SEQ ID NO: 1108713 - RNA, 22 nt, Homo sapiens
acaguucaauucucauuuguca

SEQ ID NO: 1108714 - RNA, 18 nt, Homo sapiens
acauaauaaagacagauc

SEQ ID NO: 1108715 - RNA, 13 nt, Homo sapiens
acauacacucaaa

SEQ ID NO: 1108716 - RNA, 15 nt, Homo sapiens
acauagacagaagaa

SEQ ID NO: 1108717 - RNA, 22 nt, Homo sapiens
acauaguucuuacuacuugcca

SEQ ID NO: 1108718 - RNA, 16 nt, Homo sapiens
acauauaggagcaaua

SEQ ID NO: 1108719 - RNA, 22 nt, Homo sapiens
acauauaggagcaauacuauua

SEQ ID NO: 1108720 - RNA, 12 nt, Homo sapiens
acauaugcaccu

SEQ ID NO: 1108721 - RNA, 17 nt, Homo sapiens
acauauggacucugcac

SEQ ID NO: 1108722 - RNA, 20 nt, Homo sapiens
acauauggacucugcacaug

SEQ ID NO: 1108723 - RNA, 22 nt, Homo sapiens
acauauucuuggagaacuuucc

SEQ ID NO: 1108724 - RNA, 14 nt, Homo sapiens
acaucaacauuccc

SEQ ID NO: 1108725 - RNA, 20 nt, Homo sapiens
acaucagcagagaacuggaa

SEQ ID NO: 1108726 - RNA, 22 nt, Homo sapiens
acauccaaccccccaccugcca

SEQ ID NO: 1108727 - RNA, 16 nt, Homo sapiens
acaucccauugcccug

SEQ ID NO: 1108728 - RNA, 23 nt, Homo sapiens
acauccuccaauuccacagucuc

SEQ ID NO: 1108729 - RNA, 19 nt, Homo sapiens
acaucuugcucugcugaca

SEQ ID NO: 1108730 - RNA, 13 nt, Homo sapiens
acaugaaugcaca

SEQ ID NO: 1108731 - RNA, 13 nt, Homo sapiens
acaugacuaggaa

SEQ ID NO: 1108732 - RNA, 11 nt, Homo sapiens
acaugacuguu

SEQ ID NO: 1108733 - RNA, 12 nt, Homo sapiens
acaugacuguuu

SEQ ID NO: 1108734 - RNA, 14 nt, Homo sapiens
acaugcacauuuau

SEQ ID NO: 1108735 - RNA, 23 nt, Homo sapiens
acaugcagcccagaauagcuuug

SEQ ID NO: 1108736 - RNA, 15 nt, Homo sapiens
aggagacucaccucu

SEQ ID NO: 1108737 - RNA, 22 nt, Homo sapiens
aggagaggggcagaacagccgc

SEQ ID NO: 1108738 - RNA, 16 nt, Homo sapiens
aggagcuuccagugca

SEQ ID NO: 1108739 - RNA, 18 nt, Homo sapiens
aggagggacaagaaucaa

SEQ ID NO: 1108740 - RNA, 22 nt, Homo sapiens
aggagggaugcugccugaguca

SEQ ID NO: 1108741 - RNA, 22 nt, Homo sapiens
aggagguagcucccagcacuca

SEQ ID NO: 1108742 - RNA, 19 nt, Homo sapiens
aggagguuuggggucugcc

SEQ ID NO: 1108743 - RNA, 13 nt, Homo sapiens
aggaguuccuuga

SEQ ID NO: 1108744 - RNA, 18 nt, Homo sapiens
aggaguuugagaccagcc

SEQ ID NO: 1108745 - RNA, 16 nt, Homo sapiens
aggaugacacugccag

SEQ ID NO: 1108746 - RNA, 19 nt, Homo sapiens
aggauuccaaaguuuugaa

SEQ ID NO: 1108747 - RNA, 15 nt, Homo sapiens
aggauuuugauccaa

SEQ ID NO: 1108748 - RNA, 22 nt, Homo sapiens
aggcacugcugcccagccucca

SEQ ID NO: 1108749 - RNA, 16 nt, Homo sapiens
aggcagagaaucauac

SEQ ID NO: 1108750 - RNA, 15 nt, Homo sapiens
aggcagagacaauaa

SEQ ID NO: 1108751 - RNA, 23 nt, Homo sapiens
aggcagagacaauaaaacauucc

SEQ ID NO: 1108752 - RNA, 21 nt, Homo sapiens
aggcagagauagaaccuggag

SEQ ID NO: 1108753 - RNA, 19 nt, Homo sapiens
aggcagcuggaugagacuu

SEQ ID NO: 1108754 - RNA, 15 nt, Homo sapiens
aggcaggaggaucac

SEQ ID NO: 1108755 - RNA, 23 nt, Homo sapiens
aggcaggaggaucacagugaccu

SEQ ID NO: 1108756 - RNA, 23 nt, Homo sapiens
aggcaggggugggagagccagcu

SEQ ID NO: 1108757 - RNA, 14 nt, Homo sapiens
aggcauuucuauca

SEQ ID NO: 1108758 - RNA, 21 nt, Homo sapiens
aggccagagggagugacagag

SEQ ID NO: 1108759 - RNA, 14 nt, Homo sapiens
aggccagagugcug

SEQ ID NO: 1108760 - RNA, 19 nt, Homo sapiens
aggcccaggucaacaucua

SEQ ID NO: 1108761 - RNA, 14 nt, Homo sapiens
aggccccaugaccu

SEQ ID NO: 1108762 - RNA, 20 nt, Homo sapiens
aggccgggcacgguggcuca

SEQ ID NO: 1108763 - RNA, 13 nt, Homo sapiens
aggccucccucaa

SEQ ID NO: 1108764 - RNA, 18 nt, Homo sapiens
aggccucuuggaccucug

SEQ ID NO: 1108765 - RNA, 12 nt, Homo sapiens
aggccugccugu

SEQ ID NO: 1108766 - RNA, 18 nt, Homo sapiens
aggccuggccagaugcac

SEQ ID NO: 1108767 - RNA, 19 nt, Homo sapiens
agguuaucaaccauaugaa

SEQ ID NO: 1108768 - RNA, 20 nt, Homo sapiens
agguugaggggcuccuggaa

SEQ ID NO: 1108769 - RNA, 13 nt, Homo sapiens
aguaaacaaugaa

SEQ ID NO: 1108770 - RNA, 13 nt, Homo sapiens
aguaaaccaaaaa

SEQ ID NO: 1108771 - RNA, 13 nt, Homo sapiens
aguaaaguuuaaa

SEQ ID NO: 1108772 - RNA, 20 nt, Homo sapiens
aguaagaaaacaucacugaa

SEQ ID NO: 1108773 - RNA, 19 nt, Homo sapiens
aguaauaaacgucuugcca

SEQ ID NO: 1108774 - RNA, 16 nt, Homo sapiens
aguacaguagcuuaaa

SEQ ID NO: 1108775 - RNA, 18 nt, Homo sapiens
aguacagugagccaagau

SEQ ID NO: 1108776 - RNA, 19 nt, Homo sapiens
aguacuuacccuaaaacau

SEQ ID NO: 1108777 - RNA, 22 nt, Homo sapiens
aguagaagauuuuaugcugcug

SEQ ID NO: 1108778 - RNA, 15 nt, Homo sapiens
aguagagaaguaucc

SEQ ID NO: 1108779 - RNA, 16 nt, Homo sapiens
aguagcauacauuuau

SEQ ID NO: 1108780 - RNA, 14 nt, Homo sapiens
aguagcugagcuca

SEQ ID NO: 1108781 - RNA, 12 nt, Homo sapiens
aguagucucugu

SEQ ID NO: 1108782 - RNA, 15 nt, Homo sapiens
aguauauaguauauu

SEQ ID NO: 1108783 - RNA, 21 nt, Homo sapiens
aguauauuuauagucacaaga

SEQ ID NO: 1108784 - RNA, 13 nt, Homo sapiens
aguauccacuuug

SEQ ID NO: 1108785 - RNA, 12 nt, Homo sapiens
aguaugcauuaa

SEQ ID NO: 1108786 - RNA, 17 nt, Homo sapiens
aguauguuaagcucuuu

SEQ ID NO: 1108787 - RNA, 20 nt, Homo sapiens
aguauuauuguugcauuaaa

SEQ ID NO: 1108788 - RNA, 20 nt, Homo sapiens
aguauuccagaccugaagaa

SEQ ID NO: 1108789 - RNA, 22 nt, Homo sapiens
aguauuugcugaauggggaccu

SEQ ID NO: 1108790 - RNA, 17 nt, Homo sapiens
agucaacaguucaaaga

SEQ ID NO: 1108791 - RNA, 15 nt, Homo sapiens
agucacacagacaca

SEQ ID NO: 1108792 - RNA, 21 nt, Homo sapiens
agucacugucccucaaaugac

SEQ ID NO: 1108793 - RNA, 20 nt, Homo sapiens
agucagacuuacuuacuccc

SEQ ID NO: 1108794 - RNA, 16 nt, Homo sapiens
agucaguaauugccaa

SEQ ID NO: 1108795 - RNA, 22 nt, Homo sapiens
agucaguuucuaucauucugcu

SEQ ID NO: 1108796 - RNA, 22 nt, Homo sapiens
agucauccacagcccaagggcg

SEQ ID NO: 1108797 - RNA, 21 nt, Homo sapiens
agucauuugcugagcauguac

SEQ ID NO: 1108798 - RNA, 23 nt, Homo sapiens
agucccugacucucugugaccug

SEQ ID NO: 1108799 - RNA, 13 nt, Homo sapiens
auaaaaacccugu

SEQ ID NO: 1108800 - RNA, 15 nt, Homo sapiens
auaaaaauaccucuu

SEQ ID NO: 1108801 - RNA, 22 nt, Homo sapiens
auaaaaccagagcaggaaagau

SEQ ID NO: 1108802 - RNA, 16 nt, Homo sapiens
auaaaauaguauugaa

SEQ ID NO: 1108803 - RNA, 15 nt, Homo sapiens
auaaaaugauguaug

SEQ ID NO: 1108804 - RNA, 16 nt, Homo sapiens
auaaaauuaugccaua

SEQ ID NO: 1108805 - RNA, 19 nt, Homo sapiens
auaaacacauacauugcca

SEQ ID NO: 1108806 - RNA, 18 nt, Homo sapiens
auaaacacccaugaauca

SEQ ID NO: 1108807 - RNA, 23 nt, Homo sapiens
auaaacacccaugaaucaaagac

SEQ ID NO: 1108808 - RNA, 21 nt, Homo sapiens
auaaacauugguauauuucca

SEQ ID NO: 1108809 - RNA, 14 nt, Homo sapiens
auaaacucucuagg

SEQ ID NO: 1108810 - RNA, 13 nt, Homo sapiens
auaaagauguuau

SEQ ID NO: 1108811 - RNA, 15 nt, Homo sapiens
auaaagcaagacaga

SEQ ID NO: 1108812 - RNA, 15 nt, Homo sapiens
auaaagcccuugaac

SEQ ID NO: 1108813 - RNA, 18 nt, Homo sapiens
auaaagcccuugaaccag

SEQ ID NO: 1108814 - RNA, 13 nt, Homo sapiens
auaaagugaucag

SEQ ID NO: 1108815 - RNA, 21 nt, Homo sapiens
auaaaugucuuaaucaugaga

SEQ ID NO: 1108816 - RNA, 14 nt, Homo sapiens
auaaauguguaaau

SEQ ID NO: 1108817 - RNA, 14 nt, Homo sapiens
auaaauuugguucu

SEQ ID NO: 1108818 - RNA, 12 nt, Homo sapiens
auaaccacuuaa

SEQ ID NO: 1108819 - RNA, 20 nt, Homo sapiens
auaaccccagcucccuagga

SEQ ID NO: 1108820 - RNA, 19 nt, Homo sapiens
auaaccuucaugaugaauu

SEQ ID NO: 1108821 - RNA, 23 nt, Homo sapiens
auaaccuucaugaugaauuacuu

SEQ ID NO: 1108822 - RNA, 22 nt, Homo sapiens
auaacuaggcguggacuuacua

SEQ ID NO: 1108823 - RNA, 14 nt, Homo sapiens
auaacuuauaucau

SEQ ID NO: 1108824 - RNA, 12 nt, Homo sapiens
auaagcaugauc

SEQ ID NO: 1108825 - RNA, 15 nt, Homo sapiens
auaagcuguuuuuau

SEQ ID NO: 1108826 - RNA, 19 nt, Homo sapiens
auaaggaucagaacagcag

SEQ ID NO: 1108827 - RNA, 13 nt, Homo sapiens
auaaguauuucca

SEQ ID NO: 1108828 - RNA, 22 nt, Homo sapiens
auaaguauuuccauaacucaua

SEQ ID NO: 1108829 - RNA, 19 nt, Homo sapiens
auaagucaauuccuagaag

SEQ ID NO: 1108830 - RNA, 16 nt, Homo sapiens
auaaguuccauguuaa

SEQ ID NO: 1108831 - RNA, 16 nt, Homo sapiens
auaauacuagucuuau

SEQ ID NO: 1108832 - RNA, 16 nt, Homo sapiens
auaauaugcugccaaa

SEQ ID NO: 1108833 - RNA, 15 nt, Homo sapiens
auaaucacauuauca

SEQ ID NO: 1108834 - RNA, 16 nt, Homo sapiens
auaaucgagucuaccu

SEQ ID NO: 1108835 - RNA, 18 nt, Homo sapiens
auaaucugaggaagggag

SEQ ID NO: 1108836 - RNA, 20 nt, Homo sapiens
auaaucuuuggguaacuuca

SEQ ID NO: 1108837 - RNA, 21 nt, Homo sapiens
auaaucuuuggguaacuucaa

SEQ ID NO: 1108838 - RNA, 18 nt, Homo sapiens
auaaugcuguugccucau

SEQ ID NO: 1108839 - RNA, 18 nt, Homo sapiens
auaauggggccuguuaca

SEQ ID NO: 1108840 - RNA, 19 nt, Homo sapiens
auaaugguugacuggguuu

SEQ ID NO: 1108841 - RNA, 17 nt, Homo sapiens
auaauguuacauuauua

SEQ ID NO: 1108842 - RNA, 16 nt, Homo sapiens
auaauuaaaaaccacu

SEQ ID NO: 1108843 - RNA, 14 nt, Homo sapiens
auaauucuaugaga

SEQ ID NO: 1108844 - RNA, 12 nt, Homo sapiens
auaauuguguac

SEQ ID NO: 1108845 - RNA, 21 nt, Homo sapiens
auaauuuucuaccuggucucu

SEQ ID NO: 1108846 - RNA, 14 nt, Homo sapiens
auacaauuaaagcu

SEQ ID NO: 1108847 - RNA, 14 nt, Homo sapiens
auacaauuugcacu

SEQ ID NO: 1108848 - RNA, 22 nt, Homo sapiens
auacacacacacgcgugcacac

SEQ ID NO: 1108849 - RNA, 20 nt, Homo sapiens
auacacauccccagccagaa

SEQ ID NO: 1108850 - RNA, 16 nt, Homo sapiens
auaccagugaaccaaa

SEQ ID NO: 1108851 - RNA, 17 nt, Homo sapiens
auaccuuuauugugauc

SEQ ID NO: 1108852 - RNA, 18 nt, Homo sapiens
auaccuuuauugugaucu

SEQ ID NO: 1108853 - RNA, 16 nt, Homo sapiens
auacuaugugggacac

SEQ ID NO: 1108854 - RNA, 18 nt, Homo sapiens
auacuccauacauaacuu

SEQ ID NO: 1108855 - RNA, 15 nt, Homo sapiens
cagccucgcaugcca

SEQ ID NO: 1108856 - RNA, 16 nt, Homo sapiens
cagccucgcaugccag

SEQ ID NO: 1108857 - RNA, 21 nt, Homo sapiens
cagccugaccaacauggugaa

SEQ ID NO: 1108858 - RNA, 19 nt, Homo sapiens
cagccugggcaacagagca

SEQ ID NO: 1108859 - RNA, 19 nt, Homo sapiens
cagccuguuggacccgcuc

SEQ ID NO: 1108860 - RNA, 15 nt, Homo sapiens
cagcggaggagacca

SEQ ID NO: 1108861 - RNA, 21 nt, Homo sapiens
cagcgggaucucguaucuuua

SEQ ID NO: 1108862 - RNA, 13 nt, Homo sapiens
cagcuacucagga

SEQ ID NO: 1108863 - RNA, 13 nt, Homo sapiens
cagcuaugaaggc

SEQ ID NO: 1108864 - RNA, 17 nt, Homo sapiens
cagcucuguccugggag

SEQ ID NO: 1108865 - RNA, 16 nt, Homo sapiens
cagcugcaucuacuca

SEQ ID NO: 1108866 - RNA, 16 nt, Homo sapiens
cagcuggucuuuauuc

SEQ ID NO: 1108867 - RNA, 19 nt, Homo sapiens
cagcuuugcuaccaaagca

SEQ ID NO: 1108868 - RNA, 16 nt, Homo sapiens
caggaaggacuaugaa

SEQ ID NO: 1108869 - RNA, 16 nt, Homo sapiens
caggaaucaugaucug

SEQ ID NO: 1108870 - RNA, 20 nt, Homo sapiens
caggacacaggccuguguag

SEQ ID NO: 1108871 - RNA, 14 nt, Homo sapiens
caggaccucuggac

SEQ ID NO: 1108872 - RNA, 22 nt, Homo sapiens
caggacggaauauagaggagca

SEQ ID NO: 1108873 - RNA, 13 nt, Homo sapiens
caggagaaucacu

SEQ ID NO: 1108874 - RNA, 16 nt, Homo sapiens
caggagcuugauccag

SEQ ID NO: 1108875 - RNA, 19 nt, Homo sapiens
caggagcuugauccagacc

SEQ ID NO: 1108876 - RNA, 18 nt, Homo sapiens
caggaggcuuggaaagca

SEQ ID NO: 1108877 - RNA, 17 nt, Homo sapiens
caggaggugcuaucgca

SEQ ID NO: 1108878 - RNA, 19 nt, Homo sapiens
caggaguucaauaaauguc

SEQ ID NO: 1108879 - RNA, 14 nt, Homo sapiens
caggauaccauaua

SEQ ID NO: 1108880 - RNA, 22 nt, Homo sapiens
caggaucaaaccccgaccaccu

SEQ ID NO: 1108881 - RNA, 14 nt, Homo sapiens
caggaucugaguua

SEQ ID NO: 1108882 - RNA, 13 nt, Homo sapiens
caggaugaguuac

SEQ ID NO: 1108883 - RNA, 15 nt, Homo sapiens
caggcaaaauugaua

SEQ ID NO: 1108884 - RNA, 17 nt, Homo sapiens
caggcaaagugcugcug

SEQ ID NO: 1108885 - RNA, 14 nt, Homo sapiens
caggcaacugaggc

SEQ ID NO: 1108886 - RNA, 13 nt, Homo sapiens
caggcaagcaccu

SEQ ID NO: 1108887 - RNA, 16 nt, Homo sapiens
caggcaagcaccuccu

SEQ ID NO: 1108888 - RNA, 15 nt, Homo sapiens
caggcacugcugccc

SEQ ID NO: 1108889 - RNA, 16 nt, Homo sapiens
caggcagguccagggu

SEQ ID NO: 1108890 - RNA, 16 nt, Homo sapiens
caggcaugcaccagug

SEQ ID NO: 1108891 - RNA, 14 nt, Homo sapiens
caggccaccaggau

SEQ ID NO: 1108892 - RNA, 14 nt, Homo sapiens
caggccaggccacc

SEQ ID NO: 1108893 - RNA, 17 nt, Homo sapiens
caggccaggugcagugg

SEQ ID NO: 1108894 - RNA, 15 nt, Homo sapiens
caggccauacuuuac

SEQ ID NO: 1108895 - RNA, 14 nt, Homo sapiens
caggcccaagagau

SEQ ID NO: 1108896 - RNA, 13 nt, Homo sapiens
caggccccaugac

SEQ ID NO: 1108897 - RNA, 18 nt, Homo sapiens
caggcccggcuccaggcu

SEQ ID NO: 1108898 - RNA, 18 nt, Homo sapiens
caggcugagugagccaca

SEQ ID NO: 1108899 - RNA, 17 nt, Homo sapiens
cagggacccacuucaca

SEQ ID NO: 1108900 - RNA, 19 nt, Homo sapiens
cagggagaccgagcgcuuu

SEQ ID NO: 1108901 - RNA, 16 nt, Homo sapiens
cauccaauucuuugaa

SEQ ID NO: 1108902 - RNA, 16 nt, Homo sapiens
cauccacugugccaug

SEQ ID NO: 1108903 - RNA, 17 nt, Homo sapiens
cauccagaaguuccuca

SEQ ID NO: 1108904 - RNA, 18 nt, Homo sapiens
caucccugaugucugucu

SEQ ID NO: 1108905 - RNA, 20 nt, Homo sapiens
cauccuggccaacaugguga

SEQ ID NO: 1108906 - RNA, 17 nt, Homo sapiens
cauccuucaagaacucu

SEQ ID NO: 1108907 - RNA, 16 nt, Homo sapiens
caucgggccaucucag

SEQ ID NO: 1108908 - RNA, 20 nt, Homo sapiens
caucuaccgaccugucuccc

SEQ ID NO: 1108909 - RNA, 19 nt, Homo sapiens
caucuagaggcuuccuuca

SEQ ID NO: 1108910 - RNA, 18 nt, Homo sapiens
caucuauuauaaaaccau

SEQ ID NO: 1108911 - RNA, 19 nt, Homo sapiens
caucuauuauaaaaccaug

SEQ ID NO: 1108912 - RNA, 14 nt, Homo sapiens
caucucacuuugcc

SEQ ID NO: 1108913 - RNA, 20 nt, Homo sapiens
caucucacuuugccccaguu

SEQ ID NO: 1108914 - RNA, 13 nt, Homo sapiens
caucucauuccaa

SEQ ID NO: 1108915 - RNA, 16 nt, Homo sapiens
caucucauuccaacuu

SEQ ID NO: 1108916 - RNA, 14 nt, Homo sapiens
caucucucuuuaau

SEQ ID NO: 1108917 - RNA, 15 nt, Homo sapiens
caucucugucucaaa

SEQ ID NO: 1108918 - RNA, 14 nt, Homo sapiens
caucugacucacaa

SEQ ID NO: 1108919 - RNA, 18 nt, Homo sapiens
caucugacucacaagaag

SEQ ID NO: 1108920 - RNA, 23 nt, Homo sapiens
caucugacucacaagaagaccag

SEQ ID NO: 1108921 - RNA, 13 nt, Homo sapiens
caucugauuguga

SEQ ID NO: 1108922 - RNA, 14 nt, Homo sapiens
caucugauugugau

SEQ ID NO: 1108923 - RNA, 12 nt, Homo sapiens
caucuguacuca

SEQ ID NO: 1108924 - RNA, 19 nt, Homo sapiens
caucuguggaaaugacagc

SEQ ID NO: 1108925 - RNA, 23 nt, Homo sapiens
caucugugucucuggaacccagg

SEQ ID NO: 1108926 - RNA, 14 nt, Homo sapiens
caucuucuggaguc

SEQ ID NO: 1108927 - RNA, 23 nt, Homo sapiens
caucuugcucugcugacagacac

SEQ ID NO: 1108928 - RNA, 19 nt, Homo sapiens
caugaaauggauacuuaua

SEQ ID NO: 1108929 - RNA, 22 nt, Homo sapiens
caugaaaugucuggucugucca

SEQ ID NO: 1108930 - RNA, 23 nt, Homo sapiens
caugaacaucuuuaggagacuaa

SEQ ID NO: 1108931 - RNA, 12 nt, Homo sapiens
caugaagcugga

SEQ ID NO: 1108932 - RNA, 14 nt, Homo sapiens
caugaauauuucaa

SEQ ID NO: 1108933 - RNA, 14 nt, Homo sapiens
caugaaucaaagac

SEQ ID NO: 1108934 - RNA, 20 nt, Homo sapiens
caugaggaggucagcccauu

SEQ ID NO: 1108935 - RNA, 13 nt, Homo sapiens
caugcacuucuua

SEQ ID NO: 1108936 - RNA, 18 nt, Homo sapiens
caugccgggcgcaguggc

SEQ ID NO: 1108937 - RNA, 13 nt, Homo sapiens
caugccuacagau

SEQ ID NO: 1108938 - RNA, 13 nt, Homo sapiens
caugccucugagg

SEQ ID NO: 1108939 - RNA, 18 nt, Homo sapiens
caugcuagcaacauacca

SEQ ID NO: 1108940 - RNA, 14 nt, Homo sapiens
caugcuggggcaag

SEQ ID NO: 1108941 - RNA, 15 nt, Homo sapiens
caugcugugugcugg

SEQ ID NO: 1108942 - RNA, 17 nt, Homo sapiens
cauggaacagugcagga

SEQ ID NO: 1108943 - RNA, 18 nt, Homo sapiens
gggcacugaggaccagcc

SEQ ID NO: 1108944 - RNA, 15 nt, Homo sapiens
gggcaggaacugcag

SEQ ID NO: 1108945 - RNA, 18 nt, Homo sapiens
gggcaggaguagcugagc

SEQ ID NO: 1108946 - RNA, 22 nt, Homo sapiens
gggcaguucgcagccacccuga

SEQ ID NO: 1108947 - RNA, 13 nt, Homo sapiens
gggccaucucaga

SEQ ID NO: 1108948 - RNA, 23 nt, Homo sapiens
gggccccuuggcgggcagcccag

SEQ ID NO: 1108949 - RNA, 19 nt, Homo sapiens
gggccuauggagagcccug

SEQ ID NO: 1108950 - RNA, 20 nt, Homo sapiens
gggccuggcuggcugagggc

SEQ ID NO: 1108951 - RNA, 15 nt, Homo sapiens
gggccuggggcuccu

SEQ ID NO: 1108952 - RNA, 22 nt, Homo sapiens
gggcugagcccuggcaggauga

SEQ ID NO: 1108953 - RNA, 19 nt, Homo sapiens
gggcuggaaaagucacaca

SEQ ID NO: 1108954 - RNA, 22 nt, Homo sapiens
ggggaccucauuccugggacua

SEQ ID NO: 1108955 - RNA, 19 nt, Homo sapiens
ggggcaagugagacaauca

SEQ ID NO: 1108956 - RNA, 14 nt, Homo sapiens
ggggccuguuacac

SEQ ID NO: 1108957 - RNA, 16 nt, Homo sapiens
ggggcucugugcaggg

SEQ ID NO: 1108958 - RNA, 16 nt, Homo sapiens
gggggcggccuaugac

SEQ ID NO: 1108959 - RNA, 13 nt, Homo sapiens
ggggguuccguga

SEQ ID NO: 1108960 - RNA, 20 nt, Homo sapiens
ggggucgucaccaccucucc

SEQ ID NO: 1108961 - RNA, 22 nt, Homo sapiens
ggguaggcgggaaggaggguua

SEQ ID NO: 1108962 - RNA, 23 nt, Homo sapiens
ccaaaugacaagucacacccucc

SEQ ID NO: 1108963 - RNA, 12 nt, Homo sapiens
ccaaaugagauc

SEQ ID NO: 1108964 - RNA, 15 nt, Homo sapiens
ccaaauggacauaag

SEQ ID NO: 1108965 - RNA, 15 nt, Homo sapiens
ccaacacccugucua

SEQ ID NO: 1108966 - RNA, 21 nt, Homo sapiens
ccaacauggugaaacccugua

SEQ ID NO: 1108967 - RNA, 23 nt, Homo sapiens
ccaacauuacuccauuacuaaag

SEQ ID NO: 1108968 - RNA, 14 nt, Homo sapiens
ccaacccaucagaa

SEQ ID NO: 1108969 - RNA, 15 nt, Homo sapiens
ccaacgacaaagcca

SEQ ID NO: 1108970 - RNA, 19 nt, Homo sapiens
ccaacuaacguacauucaa

SEQ ID NO: 1108971 - RNA, 19 nt, Homo sapiens
ccaacuucauuugaugcua

SEQ ID NO: 1108972 - RNA, 19 nt, Homo sapiens
ccaacuugguuuugcuaca

SEQ ID NO: 1108973 - RNA, 18 nt, Homo sapiens
ccaagaggagacuuuaau

SEQ ID NO: 1108974 - RNA, 22 nt, Homo sapiens
ccaagcagagugauucaggggc

SEQ ID NO: 1108975 - RNA, 13 nt, Homo sapiens
ccaagccugacca

SEQ ID NO: 1108976 - RNA, 17 nt, Homo sapiens
ccaagcuucaacccuca

SEQ ID NO: 1108977 - RNA, 12 nt, Homo sapiens
ccaagcuuucuu

SEQ ID NO: 1108978 - RNA, 15 nt, Homo sapiens
ccaaggaaaauggac

SEQ ID NO: 1108979 - RNA, 16 nt, Homo sapiens
ccaaggcucugagcaa

SEQ ID NO: 1108980 - RNA, 17 nt, Homo sapiens
ccaagugagaaggagau

SEQ ID NO: 1108981 - RNA, 23 nt, Homo sapiens
ccaaugcauugcuaaaauauuau

SEQ ID NO: 1108982 - RNA, 20 nt, Homo sapiens
ccaauucuuugaauuuccca

SEQ ID NO: 1108983 - RNA, 21 nt, Homo sapiens
ccacaauagcagacaguguuu

SEQ ID NO: 1108984 - RNA, 16 nt, Homo sapiens
ccacacggaggcaucu

SEQ ID NO: 1108985 - RNA, 22 nt, Homo sapiens
ccacacuucucaggacacaggc

SEQ ID NO: 1108986 - RNA, 16 nt, Homo sapiens
ccacagaaguucaaua

SEQ ID NO: 1108987 - RNA, 13 nt, Homo sapiens
ccacagcacuaau

SEQ ID NO: 1108988 - RNA, 14 nt, Homo sapiens
ccacaguagcauuu

SEQ ID NO: 1108989 - RNA, 16 nt, Homo sapiens
ccacagucucugggag

SEQ ID NO: 1108990 - RNA, 19 nt, Homo sapiens
ccacaucugugucucugga

SEQ ID NO: 1108991 - RNA, 19 nt, Homo sapiens
ccacaugugacacauaugc

SEQ ID NO: 1108992 - RNA, 14 nt, Homo sapiens
ccacaugugcacau

SEQ ID NO: 1108993 - RNA, 16 nt, Homo sapiens
ccacccaaaagucaaa

SEQ ID NO: 1108994 - RNA, 21 nt, Homo sapiens
ccacccccucccccaucauau

SEQ ID NO: 1108995 - RNA, 20 nt, Homo sapiens
ccacccuccuuucaccacau

SEQ ID NO: 1108996 - RNA, 12 nt, Homo sapiens
ccaccugccauu

SEQ ID NO: 1108997 - RNA, 16 nt, Homo sapiens
ccacguguuuugacau

SEQ ID NO: 1108998 - RNA, 14 nt, Homo sapiens
ccacucugcucuga

SEQ ID NO: 1108999 - RNA, 17 nt, Homo sapiens
ccacugccacacccucc

SEQ ID NO: 1109000 - RNA, 12 nt, Homo sapiens
ccacuggcauua

SEQ ID NO: 1109001 - RNA, 17 nt, Homo sapiens
ccacugguuucucagaa

SEQ ID NO: 1109002 - RNA, 16 nt, Homo sapiens
ccagaacuauuuauuu

SEQ ID NO: 1109003 - RNA, 13 nt, Homo sapiens
gaacggggagaaa

SEQ ID NO: 1109004 - RNA, 19 nt, Homo sapiens
gaacucagcugucuguggc

SEQ ID NO: 1109005 - RNA, 11 nt, Homo sapiens
gaacucuccau

SEQ ID NO: 1109006 - RNA, 18 nt, Homo sapiens
gaacugcgugccaguguc

SEQ ID NO: 1109007 - RNA, 20 nt, Homo sapiens
gaacuugcugcugagugcac

SEQ ID NO: 1109008 - RNA, 15 nt, Homo sapiens
gaacuuucacauagc

SEQ ID NO: 1109009 - RNA, 15 nt, Homo sapiens
gaagaaaaucaacca

SEQ ID NO: 1109010 - RNA, 17 nt, Homo sapiens
gaagaaaaucaaccagc

SEQ ID NO: 1109011 - RNA, 19 nt, Homo sapiens
gaagaacaguaacugccau

SEQ ID NO: 1109012 - RNA, 17 nt, Homo sapiens
gaagaacugacuaguga

SEQ ID NO: 1109013 - RNA, 14 nt, Homo sapiens
gaagaagaaaauca

SEQ ID NO: 1109014 - RNA, 21 nt, Homo sapiens
gaagacccaguguaaagaaua

SEQ ID NO: 1109015 - RNA, 12 nt, Homo sapiens
gaagacuguggc

SEQ ID NO: 1109016 - RNA, 14 nt, Homo sapiens
gaagagaccaagac

SEQ ID NO: 1109017 - RNA, 19 nt, Homo sapiens
gaagagccugacuguguuc

SEQ ID NO: 1109018 - RNA, 24 nt, Homo sapiens
gaagaggccuagccugagccaaag

SEQ ID NO: 1109019 - RNA, 15 nt, Homo sapiens
gaagaguuaaaacag

SEQ ID NO: 1109020 - RNA, 22 nt, Homo sapiens
gaagauucccucuuccugccaa

SEQ ID NO: 1109021 - RNA, 19 nt, Homo sapiens
gaagcagagagguggagaa

SEQ ID NO: 1109022 - RNA, 15 nt, Homo sapiens
gaagcagugccuucc

SEQ ID NO: 1109023 - RNA, 18 nt, Homo sapiens
gaagcaucaaagcacugu

SEQ ID NO: 1109024 - RNA, 13 nt, Homo sapiens
gaagcucacccaa

SEQ ID NO: 1109025 - RNA, 16 nt, Homo sapiens
gaagcucugaagucac

SEQ ID NO: 1109026 - RNA, 14 nt, Homo sapiens
gaagcucuggccaa

SEQ ID NO: 1109027 - RNA, 19 nt, Homo sapiens
gaagcucuggccaaccaaa

SEQ ID NO: 1109028 - RNA, 20 nt, Homo sapiens
gaaggaacucuggcuuccag

SEQ ID NO: 1109029 - RNA, 20 nt, Homo sapiens
gaaggacauuuucucuuuaa

SEQ ID NO: 1109030 - RNA, 15 nt, Homo sapiens
guauaguacuggcau

SEQ ID NO: 1109031 - RNA, 14 nt, Homo sapiens
guauauacauauua

SEQ ID NO: 1109032 - RNA, 23 nt, Homo sapiens
guauaucaugaaacacuucucau

SEQ ID NO: 1109033 - RNA, 18 nt, Homo sapiens
guauauuaaagcaccaaa

SEQ ID NO: 1109034 - RNA, 20 nt, Homo sapiens
guauauuaugguguaaugca

SEQ ID NO: 1109035 - RNA, 19 nt, Homo sapiens
guauccaauuaugugacaa

SEQ ID NO: 1109036 - RNA, 20 nt, Homo sapiens
guaucucuuuugaauccaug

SEQ ID NO: 1109037 - RNA, 11 nt, Homo sapiens
guaugugaaua

SEQ ID NO: 1109038 - RNA, 18 nt, Homo sapiens
guauuauuuacaaugcag

SEQ ID NO: 1109039 - RNA, 20 nt, Homo sapiens
guauucauuuuuucuacccu

SEQ ID NO: 1109040 - RNA, 12 nt, Homo sapiens
guauuccauuuu

SEQ ID NO: 1109041 - RNA, 18 nt, Homo sapiens
guauuccuuuuguguaca

SEQ ID NO: 1109042 - RNA, 14 nt, Homo sapiens
guauuuagugucuu

SEQ ID NO: 1109043 - RNA, 16 nt, Homo sapiens
guauuuagugucuuga

SEQ ID NO: 1109044 - RNA, 19 nt, Homo sapiens
guauuugaaaacucacaga

SEQ ID NO: 1109045 - RNA, 15 nt, Homo sapiens
guauuuucauuuaac

SEQ ID NO: 1109046 - RNA, 14 nt, Homo sapiens
gucaaaaggugccu

SEQ ID NO: 1109047 - RNA, 12 nt, Homo sapiens
gucaaagcagua

SEQ ID NO: 1109048 - RNA, 13 nt, Homo sapiens
gucaaauaucuca

SEQ ID NO: 1109049 - RNA, 22 nt, Homo sapiens
gucaacuucagagacuaucuga

SEQ ID NO: 1109050 - RNA, 21 nt, Homo sapiens
gucaauuuguauaucaugaaa

SEQ ID NO: 1109051 - RNA, 20 nt, Homo sapiens
gucacauaaugaaugcuauu

SEQ ID NO: 1109052 - RNA, 15 nt, Homo sapiens
gucacaugcuuuguu

SEQ ID NO: 1109053 - RNA, 23 nt, Homo sapiens
gucacauggccuaugcacauaug

SEQ ID NO: 1109054 - RNA, 15 nt, Homo sapiens
gucagagaugggcug

SEQ ID NO: 1109055 - RNA, 15 nt, Homo sapiens
gucagccacaccugu

SEQ ID NO: 1109056 - RNA, 18 nt, Homo sapiens
gucagucugggugucuca

SEQ ID NO: 1109057 - RNA, 20 nt, Homo sapiens
gucagucugggugucucagg

SEQ ID NO: 1109058 - RNA, 23 nt, Homo sapiens
gucaguugaggaauaugacuguu

SEQ ID NO: 1109059 - RNA, 21 nt, Homo sapiens
gucaucaaauauuaccaaaaa

SEQ ID NO: 1109060 - RNA, 20 nt, Homo sapiens
guccacucugaauaccaagu

SEQ ID NO: 1109061 - RNA, 17 nt, Homo sapiens
guccagaauaagugcug

SEQ ID NO: 1109062 - RNA, 19 nt, Homo sapiens
guccagaauaagugcuguu

SEQ ID NO: 1109063 - RNA, 13 nt, Homo sapiens
guccagcacagaa

SEQ ID NO: 1109064 - RNA, 13 nt, Homo sapiens
guccagggcggga

SEQ ID NO: 1109065 - RNA, 11 nt, Homo sapiens
guccaugccua

SEQ ID NO: 1109066 - RNA, 19 nt, Homo sapiens
guccauguaauauucccau

SEQ ID NO: 1109067 - RNA, 13 nt, Homo sapiens
gucccaaccugau

SEQ ID NO: 1109068 - RNA, 14 nt, Homo sapiens
gucccacacuggug

SEQ ID NO: 1109069 - RNA, 18 nt, Homo sapiens
gucccacaucccugggcc

SEQ ID NO: 1109070 - RNA, 14 nt, Homo sapiens
gucccagcuacuca

SEQ ID NO: 1109071 - RNA, 16 nt, Homo sapiens
gucccaucugcuccuc

SEQ ID NO: 1109072 - RNA, 17 nt, Homo sapiens
guccccucuugacccau

SEQ ID NO: 1109073 - RNA, 16 nt, Homo sapiens
gucccggguguguaca

SEQ ID NO: 1109074 - RNA, 22 nt, Homo sapiens
guccgacucuucugagcaccua

SEQ ID NO: 1109075 - RNA, 21 nt, Homo sapiens
guccuaugucaauuuguauau

SEQ ID NO: 1109076 - RNA, 11 nt, Homo sapiens
guccucaaaac

SEQ ID NO: 1109077 - RNA, 21 nt, Homo sapiens
guccugcugugugaauuccca

SEQ ID NO: 1109078 - RNA, 22 nt, Homo sapiens
gucuauguaggccccuggucug

SEQ ID NO: 1109079 - RNA, 17 nt, Homo sapiens
gucucacuauguugccc

SEQ ID NO: 1109080 - RNA, 18 nt, Homo sapiens
gucucacugaacuagaag

SEQ ID NO: 1109081 - RNA, 12 nt, Homo sapiens
gucugacaggca

SEQ ID NO: 1109082 - RNA, 16 nt, Homo sapiens
gucugagcuucaguau

SEQ ID NO: 1109083 - RNA, 12 nt, Homo sapiens
gucugagguccu

SEQ ID NO: 1109084 - RNA, 15 nt, Homo sapiens
gucugauuggcucac

SEQ ID NO: 1109085 - RNA, 22 nt, Homo sapiens
gucugcaaugucccuugcacag

SEQ ID NO: 1109086 - RNA, 15 nt, Homo sapiens
gucuugaaacaagca

SEQ ID NO: 1109087 - RNA, 15 nt, Homo sapiens
gucuugccagccaga

SEQ ID NO: 1109088 - RNA, 16 nt, Homo sapiens
gucuugccagccagaa

SEQ ID NO: 1109089 - RNA, 22 nt, Homo sapiens
gucuuuaacaucuugaacuggu

SEQ ID NO: 1109090 - RNA, 21 nt, Homo sapiens
gucuuuguaaugucaccaccu

SEQ ID NO: 1109091 - RNA, 13 nt, Homo sapiens
gugaaacaaaaaa

SEQ ID NO: 1109092 - RNA, 20 nt, Homo sapiens
gugaaauaaaaguagaauaa

SEQ ID NO: 1109093 - RNA, 12 nt, Homo sapiens
gugaaccaaaga

SEQ ID NO: 1109094 - RNA, 15 nt, Homo sapiens
gugaaccaucauuau

SEQ ID NO: 1109095 - RNA, 16 nt, Homo sapiens
gugaacugcgugccag

SEQ ID NO: 1109096 - RNA, 14 nt, Homo sapiens
gugaaggagccagu

SEQ ID NO: 1109097 - RNA, 16 nt, Homo sapiens
gugaauaaccacuuaa

SEQ ID NO: 1109098 - RNA, 20 nt, Homo sapiens
gugaaugcuuaccugugaga

SEQ ID NO: 1109099 - RNA, 13 nt, Homo sapiens
gugacaacaugcg

SEQ ID NO: 1109100 - RNA, 14 nt, Homo sapiens
gugaccagggguga

SEQ ID NO: 1109101 - RNA, 21 nt, Homo sapiens
gugacucuauauagcugauca

SEQ ID NO: 1109102 - RNA, 22 nt, Homo sapiens
gugacuuccucgccucucccac

SEQ ID NO: 1109103 - RNA, 16 nt, Homo sapiens
gugagaagaaaugaca

SEQ ID NO: 1109104 - RNA, 23 nt, Homo sapiens
gugagaccaccucucaauauuca

SEQ ID NO: 1109105 - RNA, 20 nt, Homo sapiens
ggguccacccagcaaagagu

SEQ ID NO: 1109106 - RNA, 15 nt, Homo sapiens
ggguccuugguguga

SEQ ID NO: 1109107 - RNA, 20 nt, Homo sapiens
gggucucacuauguugccca

SEQ ID NO: 1109108 - RNA, 15 nt, Homo sapiens
ggguggaucaccuga

SEQ ID NO: 1109109 - RNA, 16 nt, Homo sapiens
gggugggccacucucc

SEQ ID NO: 1109110 - RNA, 14 nt, Homo sapiens
gggugugucugcuc

SEQ ID NO: 1109111 - RNA, 19 nt, Homo sapiens
ggguguuaaggcagugacu

SEQ ID NO: 1109112 - RNA, 19 nt, Homo sapiens
gguaauaaguacuguguac

SEQ ID NO: 1109113 - RNA, 18 nt, Homo sapiens
gguaauauaaaguguaau

SEQ ID NO: 1109114 - RNA, 21 nt, Homo sapiens
gguauaaugguugacuggguu

SEQ ID NO: 1109115 - RNA, 22 nt, Homo sapiens
gguauauuuccauucaugccaa

SEQ ID NO: 1109116 - RNA, 14 nt, Homo sapiens
gguaucuccaggau

SEQ ID NO: 1109117 - RNA, 12 nt, Homo sapiens
gguaugagcuga

SEQ ID NO: 1109118 - RNA, 18 nt, Homo sapiens
gguaugaucacggcucac

SEQ ID NO: 1109119 - RNA, 17 nt, Homo sapiens
gguccccaucaucccag

SEQ ID NO: 1109120 - RNA, 20 nt, Homo sapiens
gguccugaguggcugaaaua

SEQ ID NO: 1109121 - RNA, 20 nt, Homo sapiens
gguccugcaaucuccagggc

SEQ ID NO: 1109122 - RNA, 22 nt, Homo sapiens
gguccuguuaacgucaucucag

SEQ ID NO: 1109123 - RNA, 23 nt, Homo sapiens
ggucuguuguaggguugccagau

SEQ ID NO: 1109124 - RNA, 19 nt, Homo sapiens
ggugaaaccucaucucuac

SEQ ID NO: 1109125 - RNA, 14 nt, Homo sapiens
ggugacagagcaag

SEQ ID NO: 1109126 - RNA, 17 nt, Homo sapiens
ggugaccccagggcaca

SEQ ID NO: 1109127 - RNA, 19 nt, Homo sapiens
ggugcaugaagguuucuga

SEQ ID NO: 1109128 - RNA, 20 nt, Homo sapiens
ggugcuaucgcaccacugug

SEQ ID NO: 1109129 - RNA, 23 nt, Homo sapiens
ggugcucauucauuuaacagagc

SEQ ID NO: 1109130 - RNA, 17 nt, Homo sapiens
ggugcucuuucccuuua

SEQ ID NO: 1109131 - RNA, 13 nt, Homo sapiens
ggugcugcagcca

SEQ ID NO: 1109132 - RNA, 18 nt, Homo sapiens
ggugcugugguggggaga

SEQ ID NO: 1109133 - RNA, 16 nt, Homo sapiens
gguggaucuguccaag

SEQ ID NO: 1109134 - RNA, 13 nt, Homo sapiens
gguggaugccugg

SEQ ID NO: 1109135 - RNA, 19 nt, Homo sapiens
ggugucuggaaaagcacuu

SEQ ID NO: 1109136 - RNA, 17 nt, Homo sapiens
gguguuacuaaagucac

SEQ ID NO: 1109137 - RNA, 13 nt, Homo sapiens
gguuaacuuguau

SEQ ID NO: 1109138 - RNA, 20 nt, Homo sapiens
gguuaucacuuuucuguaac

SEQ ID NO: 1109139 - RNA, 18 nt, Homo sapiens
gguuccggugucuggaaa

SEQ ID NO: 1109140 - RNA, 13 nt, Homo sapiens
gguuuacugcugu

SEQ ID NO: 1109141 - RNA, 14 nt, Homo sapiens
gguuuccaggccac

SEQ ID NO: 1109142 - RNA, 17 nt, Homo sapiens
gguuucucagaauccaa

SEQ ID NO: 1109143 - RNA, 14 nt, Homo sapiens
gguuucucuguaua

SEQ ID NO: 1109144 - RNA, 17 nt, Homo sapiens
gguuuguugcagccaaa

SEQ ID NO: 1109145 - RNA, 18 nt, Homo sapiens
gguuuguugcagccaaag

SEQ ID NO: 1109146 - RNA, 21 nt, Homo sapiens
guaaaacuauauucucagugu

SEQ ID NO: 1109147 - RNA, 19 nt, Homo sapiens
guaaaacuuagcaacuugg

SEQ ID NO: 1109148 - RNA, 13 nt, Homo sapiens
guaaaaugaaauu

SEQ ID NO: 1109149 - RNA, 15 nt, Homo sapiens
guaaacaaaggaauu

SEQ ID NO: 1109150 - RNA, 12 nt, Homo sapiens
guaaacaaugaa

SEQ ID NO: 1109151 - RNA, 15 nt, Homo sapiens
guaaacagcucugug

SEQ ID NO: 1109152 - RNA, 12 nt, Homo sapiens
guaaaccaaaaa

SEQ ID NO: 1109153 - RNA, 19 nt, Homo sapiens
guaaaucacacaacagguu

SEQ ID NO: 1109154 - RNA, 15 nt, Homo sapiens
guaaauuaguauuua

SEQ ID NO: 1109155 - RNA, 14 nt, Homo sapiens
guaacaacuguggu

SEQ ID NO: 1109156 - RNA, 18 nt, Homo sapiens
guaacaacuguggucaau

SEQ ID NO: 1109157 - RNA, 14 nt, Homo sapiens
guaacaagccagau

SEQ ID NO: 1109158 - RNA, 23 nt, Homo sapiens
guaaccuccacaguagcauuucu

SEQ ID NO: 1109159 - RNA, 19 nt, Homo sapiens
guaacuauuacaccaaaua

SEQ ID NO: 1109160 - RNA, 13 nt, Homo sapiens
guaacuccagcuc

SEQ ID NO: 1109161 - RNA, 17 nt, Homo sapiens
guaacuuuuacaaaaca

SEQ ID NO: 1109162 - RNA, 15 nt, Homo sapiens
guaaggaacuggaac

SEQ ID NO: 1109163 - RNA, 23 nt, Homo sapiens
guaaguugaauggccugccuuga

SEQ ID NO: 1109164 - RNA, 18 nt, Homo sapiens
guaauaaacgucuugcca

SEQ ID NO: 1109165 - RNA, 14 nt, Homo sapiens
guaauaaaucugag

SEQ ID NO: 1109166 - RNA, 17 nt, Homo sapiens
guaauagauguuugaua

SEQ ID NO: 1109167 - RNA, 14 nt, Homo sapiens
guaauccuauuaaa

SEQ ID NO: 1109168 - RNA, 14 nt, Homo sapiens
guaaugaaacaaag

SEQ ID NO: 1109169 - RNA, 18 nt, Homo sapiens
guaauugcauuucugcuc

SEQ ID NO: 1109170 - RNA, 21 nt, Homo sapiens
guaauuucuguguauuuugag

SEQ ID NO: 1109171 - RNA, 19 nt, Homo sapiens
guaauuuugugaaagaagg

SEQ ID NO: 1109172 - RNA, 16 nt, Homo sapiens
guacaauguacauuau

SEQ ID NO: 1109173 - RNA, 16 nt, Homo sapiens
guacacagcaccagaa

SEQ ID NO: 1109174 - RNA, 17 nt, Homo sapiens
guacacguguccuguag

SEQ ID NO: 1109175 - RNA, 22 nt, Homo sapiens
guacagaauucugcuaccucac

SEQ ID NO: 1109176 - RNA, 16 nt, Homo sapiens
guacaggcaacaauga

SEQ ID NO: 1109177 - RNA, 17 nt, Homo sapiens
guacaguuauacauacc

SEQ ID NO: 1109178 - RNA, 14 nt, Homo sapiens
aaaauguacacugg

SEQ ID NO: 1109179 - RNA, 13 nt, Homo sapiens
aaaauguccauga

SEQ ID NO: 1109180 - RNA, 22 nt, Homo sapiens
aaaauguccucccuuguggcuu

SEQ ID NO: 1109181 - RNA, 20 nt, Homo sapiens
aaaaugucuguuaacuuaau

SEQ ID NO: 1109182 - RNA, 16 nt, Homo sapiens
aaaaugucuguuucaa

SEQ ID NO: 1109183 - RNA, 13 nt, Homo sapiens
aaaaugugcaaua

SEQ ID NO: 1109184 - RNA, 13 nt, Homo sapiens
aaaauuaaauugc

SEQ ID NO: 1109185 - RNA, 21 nt, Homo sapiens
aaaauuagccgggcauggugg

SEQ ID NO: 1109186 - RNA, 17 nt, Homo sapiens
aaaauugacuucuugcu

SEQ ID NO: 1109187 - RNA, 17 nt, Homo sapiens
aaaauugugaucagacc

SEQ ID NO: 1109188 - RNA, 16 nt, Homo sapiens
aaacaagcaacagaug

SEQ ID NO: 1109189 - RNA, 13 nt, Homo sapiens
aaacacagugcug

SEQ ID NO: 1109190 - RNA, 21 nt, Homo sapiens
aaacaccggcagaaaacggag

SEQ ID NO: 1109191 - RNA, 14 nt, Homo sapiens
aaacacgugucuau

SEQ ID NO: 1109192 - RNA, 22 nt, Homo sapiens
aaacacuauauggcagugucuu

SEQ ID NO: 1109193 - RNA, 18 nt, Homo sapiens
aaacagagaacccugugg

SEQ ID NO: 1109194 - RNA, 14 nt, Homo sapiens
aaacauaauaucuu

SEQ ID NO: 1109195 - RNA, 14 nt, Homo sapiens
aaacauacccagug

SEQ ID NO: 1109196 - RNA, 19 nt, Homo sapiens
aaacauugguauauuucca

SEQ ID NO: 1109197 - RNA, 16 nt, Homo sapiens
aaaccaauagcuuuaa

SEQ ID NO: 1109198 - RNA, 18 nt, Homo sapiens
aaaccaucaaaaauauuc

SEQ ID NO: 1109199 - RNA, 16 nt, Homo sapiens
aaaccgcacucaccca

SEQ ID NO: 1109200 - RNA, 14 nt, Homo sapiens
aaaccugugugcca

SEQ ID NO: 1109201 - RNA, 12 nt, Homo sapiens
aaaccuuacuua

SEQ ID NO: 1109202 - RNA, 24 nt, Homo sapiens
aaacuaacacagccaucaagggaa

SEQ ID NO: 1109203 - RNA, 20 nt, Homo sapiens
aaacucacagaacuauguac

SEQ ID NO: 1109204 - RNA, 15 nt, Homo sapiens
aaacucacugcucaa

SEQ ID NO: 1109205 - RNA, 14 nt, Homo sapiens
aaacucucuagggc

SEQ ID NO: 1109206 - RNA, 19 nt, Homo sapiens
aaacugauuuuuagcuuua

SEQ ID NO: 1109207 - RNA, 20 nt, Homo sapiens
aaacugauuuuuagcuuuac

SEQ ID NO: 1109208 - RNA, 17 nt, Homo sapiens
aaacugccuuccacaau

SEQ ID NO: 1109209 - RNA, 18 nt, Homo sapiens
aaacugguuuguugcagc

SEQ ID NO: 1109210 - RNA, 20 nt, Homo sapiens
aaacuugaaucaaagcaguu

SEQ ID NO: 1109211 - RNA, 21 nt, Homo sapiens
aaacuugcauacagagacaga

SEQ ID NO: 1109212 - RNA, 17 nt, Homo sapiens
aaacuuguacuauguua

SEQ ID NO: 1109213 - RNA, 13 nt, Homo sapiens
aaacuuguguaug

SEQ ID NO: 1109214 - RNA, 19 nt, Homo sapiens
aaacuuuacucuaagucuc

SEQ ID NO: 1109215 - RNA, 18 nt, Homo sapiens
aaacuuuuaaacaugaga

SEQ ID NO: 1109216 - RNA, 12 nt, Homo sapiens
aaagaaaaccau

SEQ ID NO: 1109217 - RNA, 18 nt, Homo sapiens
aaagaaaucuucauuuau

SEQ ID NO: 1109218 - RNA, 16 nt, Homo sapiens
aaagaaaugcccaucu

SEQ ID NO: 1109219 - RNA, 13 nt, Homo sapiens
aaagaaccaaaag

SEQ ID NO: 1109220 - RNA, 14 nt, Homo sapiens
aaagaagacuggaa

SEQ ID NO: 1109221 - RNA, 15 nt, Homo sapiens
aaagaagauuuugcc

SEQ ID NO: 1109222 - RNA, 17 nt, Homo sapiens
aaagaaggaagugaaga

SEQ ID NO: 1109223 - RNA, 22 nt, Homo sapiens
aaagaaggaauucuaggcaucc

SEQ ID NO: 1109224 - RNA, 14 nt, Homo sapiens
aaagaaguaaaagc

SEQ ID NO: 1109225 - RNA, 15 nt, Homo sapiens
aaagacuacacuguu

SEQ ID NO: 1109226 - RNA, 16 nt, Homo sapiens
aaagacuacacuguug

SEQ ID NO: 1109227 - RNA, 23 nt, Homo sapiens
aaagacuuacaggccucgcuaca

SEQ ID NO: 1109228 - RNA, 17 nt, Homo sapiens
aaagagaaaaaccaaug

SEQ ID NO: 1109229 - RNA, 14 nt, Homo sapiens
aaagaguccuauuu

SEQ ID NO: 1109230 - RNA, 21 nt, Homo sapiens
aaagauggcugugccucugcc

SEQ ID NO: 1109231 - RNA, 21 nt, Homo sapiens
aaagauucccacccaauucaa

SEQ ID NO: 1109232 - RNA, 20 nt, Homo sapiens
aaagcaagacuguugcucaa

SEQ ID NO: 1109233 - RNA, 20 nt, Homo sapiens
aaagcaagcauucagaagaa

SEQ ID NO: 1109234 - RNA, 15 nt, Homo sapiens
aaagcaccuuagcug

SEQ ID NO: 1109235 - RNA, 20 nt, Homo sapiens
aaagcacuguuuaacuggga

SEQ ID NO: 1109236 - RNA, 19 nt, Homo sapiens
aaagcacuuuacagaugag

SEQ ID NO: 1109237 - RNA, 19 nt, Homo sapiens
aaagcaguggacaccagga

SEQ ID NO: 1109238 - RNA, 16 nt, Homo sapiens
aaagcaguguuuucac

SEQ ID NO: 1109239 - RNA, 22 nt, Homo sapiens
aaagcaguguuuucaccucaua

SEQ ID NO: 1109240 - RNA, 16 nt, Homo sapiens
aaagcaucaccucagg

SEQ ID NO: 1109241 - RNA, 20 nt, Homo sapiens
aaagcauguggcauguucau

SEQ ID NO: 1109242 - RNA, 20 nt, Homo sapiens
aaagcauuacauuuccaaau

SEQ ID NO: 1109243 - RNA, 22 nt, Homo sapiens
aaagcauuacauuuccaaauga

SEQ ID NO: 1109244 - RNA, 15 nt, Homo sapiens
aaagccaacagucaa

SEQ ID NO: 1109245 - RNA, 13 nt, Homo sapiens
aaagcccuuccau

SEQ ID NO: 1109246 - RNA, 22 nt, Homo sapiens
aaagccucuggaaaacucagga

SEQ ID NO: 1109247 - RNA, 17 nt, Homo sapiens
aaagcucugaacaaaag

SEQ ID NO: 1109248 - RNA, 13 nt, Homo sapiens
aaagcugcugaca

SEQ ID NO: 1109249 - RNA, 22 nt, Homo sapiens
aaagcugcugagaaucuagccu

SEQ ID NO: 1109250 - RNA, 21 nt, Homo sapiens
aaagcuguguguuuggaagac

SEQ ID NO: 1109251 - RNA, 20 nt, Homo sapiens
aaagcuuaccaaggggaaug

SEQ ID NO: 1109252 - RNA, 13 nt, Homo sapiens
aaaggaaucucca

SEQ ID NO: 1109253 - RNA, 16 nt, Homo sapiens
aaaggagaacuaucca

SEQ ID NO: 1109254 - RNA, 13 nt, Homo sapiens
aaaggaggggaua

SEQ ID NO: 1109255 - RNA, 15 nt, Homo sapiens
aaaggauugaucacu

SEQ ID NO: 1109256 - RNA, 22 nt, Homo sapiens
aaaggcauaagacccuaagccu

SEQ ID NO: 1109257 - RNA, 14 nt, Homo sapiens
aaaggcccucugcu

SEQ ID NO: 1109258 - RNA, 17 nt, Homo sapiens
aaagggagcacuggguu

SEQ ID NO: 1109259 - RNA, 18 nt, Homo sapiens
aaagggauaguccaaaga

SEQ ID NO: 1109260 - RNA, 16 nt, Homo sapiens
aaaguacaaccugaau

SEQ ID NO: 1109261 - RNA, 15 nt, Homo sapiens
aaaguacagaugcag

SEQ ID NO: 1109262 - RNA, 11 nt, Homo sapiens
aaaguauauau

SEQ ID NO: 1109263 - RNA, 12 nt, Homo sapiens
aaaguaucuaca

SEQ ID NO: 1109264 - RNA, 19 nt, Homo sapiens
aaaguauuuuaucugccuu

SEQ ID NO: 1109265 - RNA, 16 nt, Homo sapiens
aaagucaaaaggugcc

SEQ ID NO: 1109266 - RNA, 21 nt, Homo sapiens
aaagucuaccccugcuaagga

SEQ ID NO: 1109267 - RNA, 15 nt, Homo sapiens
aaagucuuaccucag

SEQ ID NO: 1109268 - RNA, 18 nt, Homo sapiens
aaaguuacauguuugcac

SEQ ID NO: 1109269 - RNA, 20 nt, Homo sapiens
aacauccuccaauuccacag

SEQ ID NO: 1109270 - RNA, 20 nt, Homo sapiens
aacaucuauuauaaaaccau

SEQ ID NO: 1109271 - RNA, 15 nt, Homo sapiens
aacaugcacauuuau

SEQ ID NO: 1109272 - RNA, 12 nt, Homo sapiens
aacaugccugau

SEQ ID NO: 1109273 - RNA, 23 nt, Homo sapiens
aacauggugaaaccucaucucua

SEQ ID NO: 1109274 - RNA, 21 nt, Homo sapiens
aacauguggcaaccuguucuu

SEQ ID NO: 1109275 - RNA, 19 nt, Homo sapiens
aacaugugguuaaugccau

SEQ ID NO: 1109276 - RNA, 21 nt, Homo sapiens
aacaugugguuaaugccaugg

SEQ ID NO: 1109277 - RNA, 14 nt, Homo sapiens
aacauguucacuua

SEQ ID NO: 1109278 - RNA, 18 nt, Homo sapiens
aacauuaaacacuguaau

SEQ ID NO: 1109279 - RNA, 13 nt, Homo sapiens
aacauuaugccuu

SEQ ID NO: 1109280 - RNA, 15 nt, Homo sapiens
aacauuccugugaaa

SEQ ID NO: 1109281 - RNA, 20 nt, Homo sapiens
aacauuuuguuauugggcaa

SEQ ID NO: 1109282 - RNA, 14 nt, Homo sapiens
aaccaacacuaaca

SEQ ID NO: 1109283 - RNA, 17 nt, Homo sapiens
aaccaagaguauuccau

SEQ ID NO: 1109284 - RNA, 12 nt, Homo sapiens
aaccaaugauuc

SEQ ID NO: 1109285 - RNA, 23 nt, Homo sapiens
aaccacuuugccucugaaacuua

SEQ ID NO: 1109286 - RNA, 13 nt, Homo sapiens
aaccagccacaca

SEQ ID NO: 1109287 - RNA, 13 nt, Homo sapiens
aaccaucccugau

SEQ ID NO: 1109288 - RNA, 18 nt, Homo sapiens
aaccaucgcgugcaauga

SEQ ID NO: 1109289 - RNA, 19 nt, Homo sapiens
aacccaaaaccucaugaca

SEQ ID NO: 1109290 - RNA, 12 nt, Homo sapiens
aacccaccugcu

SEQ ID NO: 1109291 - RNA, 13 nt, Homo sapiens
aacccugggacgu

SEQ ID NO: 1109292 - RNA, 18 nt, Homo sapiens
aaccgacuuuucuaaagc

SEQ ID NO: 1109293 - RNA, 14 nt, Homo sapiens
aaccuaaacauaga

SEQ ID NO: 1109294 - RNA, 16 nt, Homo sapiens
aaccucaaacugggua

SEQ ID NO: 1109295 - RNA, 15 nt, Homo sapiens
aaccucaagcugcau

SEQ ID NO: 1109296 - RNA, 14 nt, Homo sapiens
aaccucacuugaag

SEQ ID NO: 1109297 - RNA, 23 nt, Homo sapiens
aaccucaguaauuuagaaaucau

SEQ ID NO: 1109298 - RNA, 17 nt, Homo sapiens
aaccugaaccugggaac

SEQ ID NO: 1109299 - RNA, 19 nt, Homo sapiens
aaccugaaggugcugacaa

SEQ ID NO: 1109300 - RNA, 16 nt, Homo sapiens
aaccugaauuauucca

SEQ ID NO: 1109301 - RNA, 18 nt, Homo sapiens
aaccuguccauaaaguaa

SEQ ID NO: 1109302 - RNA, 13 nt, Homo sapiens
aaccugugucuua

SEQ ID NO: 1109303 - RNA, 16 nt, Homo sapiens
aaccuuucaaauuuca

SEQ ID NO: 1109304 - RNA, 15 nt, Homo sapiens
aacgacaaagccaaa

SEQ ID NO: 1109305 - RNA, 21 nt, Homo sapiens
aacgacgguuucaaaccagga

SEQ ID NO: 1109306 - RNA, 15 nt, Homo sapiens
aacgaguuguuggcu

SEQ ID NO: 1109307 - RNA, 22 nt, Homo sapiens
aacgcaaagggcugaaagccau

SEQ ID NO: 1109308 - RNA, 20 nt, Homo sapiens
aacgccugagcccagggagg

SEQ ID NO: 1109309 - RNA, 17 nt, Homo sapiens
aacuaacguacauucaa

SEQ ID NO: 1109310 - RNA, 17 nt, Homo sapiens
aacuaagaaauaugcac

SEQ ID NO: 1109311 - RNA, 19 nt, Homo sapiens
aacuaagaaauaugcacaa

SEQ ID NO: 1109312 - RNA, 22 nt, Homo sapiens
aacuaauaaaagcauaaaugca

SEQ ID NO: 1109313 - RNA, 15 nt, Homo sapiens
aacuaauaaucacca

SEQ ID NO: 1109314 - RNA, 21 nt, Homo sapiens
aacuaauaaucaccauaugcu

SEQ ID NO: 1109315 - RNA, 23 nt, Homo sapiens
aacuaauuuccucugacauguaa

SEQ ID NO: 1109316 - RNA, 23 nt, Homo sapiens
aacuacuuuuguaccagugugaa

SEQ ID NO: 1109317 - RNA, 17 nt, Homo sapiens
aacuagaaaucugccaa

SEQ ID NO: 1109318 - RNA, 16 nt, Homo sapiens
aacuaguguugcuugg

SEQ ID NO: 1109319 - RNA, 18 nt, Homo sapiens
aacuauuuacauuuucca

SEQ ID NO: 1109320 - RNA, 16 nt, Homo sapiens
aacucaacuuugacaa

SEQ ID NO: 1109321 - RNA, 16 nt, Homo sapiens
aacuccuauaauuccc

SEQ ID NO: 1109322 - RNA, 20 nt, Homo sapiens
aacugaccagccuccaugcu

SEQ ID NO: 1109323 - RNA, 18 nt, Homo sapiens
aacugauucacaucucau

SEQ ID NO: 1109324 - RNA, 18 nt, Homo sapiens
aacugauuuaugaucacu

SEQ ID NO: 1109325 - RNA, 21 nt, Homo sapiens
aacugauuuuuagcuuuacaa

SEQ ID NO: 1109326 - RNA, 13 nt, Homo sapiens
aacugcaguaugg

SEQ ID NO: 1109327 - RNA, 22 nt, Homo sapiens
aacugcaguauggccaugggcu

SEQ ID NO: 1109328 - RNA, 11 nt, Homo sapiens
aacuggcugca

SEQ ID NO: 1109329 - RNA, 22 nt, Homo sapiens
aacuguuuuugaagaagggaaa

SEQ ID NO: 1109330 - RNA, 17 nt, Homo sapiens
aacuuaaaaaaaugaca

SEQ ID NO: 1109331 - RNA, 12 nt, Homo sapiens
aacuuaauguuc

SEQ ID NO: 1109332 - RNA, 18 nt, Homo sapiens
aacuuagguuagugacaa

SEQ ID NO: 1109333 - RNA, 12 nt, Homo sapiens
aacuuccacucc

SEQ ID NO: 1109334 - RNA, 19 nt, Homo sapiens
aacuugacaguaaaucaca

SEQ ID NO: 1109335 - RNA, 19 nt, Homo sapiens
aacuugaggacacaugucc

SEQ ID NO: 1109336 - RNA, 20 nt, Homo sapiens
aacuugcacgacgccugcca

SEQ ID NO: 1109337 - RNA, 20 nt, Homo sapiens
aacuuguaucugaagaccua

SEQ ID NO: 1109338 - RNA, 13 nt, Homo sapiens
aacuuuggcuuau

SEQ ID NO: 1109339 - RNA, 13 nt, Homo sapiens
aacuuuugugcuc

SEQ ID NO: 1109340 - RNA, 16 nt, Homo sapiens
aacuuuugugcucccc

SEQ ID NO: 1109341 - RNA, 16 nt, Homo sapiens
aagaaaacaucacuga

SEQ ID NO: 1109342 - RNA, 16 nt, Homo sapiens
aagaaaaccauuuuag

SEQ ID NO: 1109343 - RNA, 23 nt, Homo sapiens
aagaaaaccuuucuucaccaaau

SEQ ID NO: 1109344 - RNA, 12 nt, Homo sapiens
aagaaaacugga

SEQ ID NO: 1109345 - RNA, 22 nt, Homo sapiens
aagaaagcaaugccaaucuuca

SEQ ID NO: 1109346 - RNA, 17 nt, Homo sapiens
aagaaaguguuggcuaa

SEQ ID NO: 1109347 - RNA, 17 nt, Homo sapiens
aagaaauuccuguagca

SEQ ID NO: 1109348 - RNA, 21 nt, Homo sapiens
aagaaauuccuguagcaucuu

SEQ ID NO: 1109349 - RNA, 17 nt, Homo sapiens
aagaaccaaaagagauc

SEQ ID NO: 1109350 - RNA, 20 nt, Homo sapiens
aagaacugacuagugagaug

SEQ ID NO: 1109351 - RNA, 11 nt, Homo sapiens
aagaagacugg

SEQ ID NO: 1109352 - RNA, 20 nt, Homo sapiens
aagaagaguuugcaaaugca

SEQ ID NO: 1109353 - RNA, 16 nt, Homo sapiens
aagaaggaaauagcca

SEQ ID NO: 1109354 - RNA, 21 nt, Homo sapiens
aagaaggaauucuaggcaucc

SEQ ID NO: 1109355 - RNA, 14 nt, Homo sapiens
aagaaguuaaauga

SEQ ID NO: 1109356 - RNA, 17 nt, Homo sapiens
aagaaugaauaauaauu

SEQ ID NO: 1109357 - RNA, 18 nt, Homo sapiens
aagacaacagcauaacua

SEQ ID NO: 1109358 - RNA, 16 nt, Homo sapiens
aagacaacauuucuca

SEQ ID NO: 1109359 - RNA, 16 nt, Homo sapiens
aagacagagcugggau

SEQ ID NO: 1109360 - RNA, 18 nt, Homo sapiens
aggcugaggcaggaggau

SEQ ID NO: 1109361 - RNA, 10 nt, Homo sapiens
aggcugcaaa

SEQ ID NO: 1109362 - RNA, 22 nt, Homo sapiens
aggcugggggcgggggagccaa

SEQ ID NO: 1109363 - RNA, 13 nt, Homo sapiens
aggcuggucucaa

SEQ ID NO: 1109364 - RNA, 12 nt, Homo sapiens
aggcuucuucag

SEQ ID NO: 1109365 - RNA, 23 nt, Homo sapiens
agggaaaguuaaaaguguugauu

SEQ ID NO: 1109366 - RNA, 20 nt, Homo sapiens
agggaagagugcauuuuccc

SEQ ID NO: 1109367 - RNA, 14 nt, Homo sapiens
agggacacuuaccc

SEQ ID NO: 1109368 - RNA, 20 nt, Homo sapiens
agggacugacaaaagacuug

SEQ ID NO: 1109369 - RNA, 18 nt, Homo sapiens
agggacugucgcugcuuc

SEQ ID NO: 1109370 - RNA, 14 nt, Homo sapiens
agggagcacugggu

SEQ ID NO: 1109371 - RNA, 15 nt, Homo sapiens
agggagggcucugag

SEQ ID NO: 1109372 - RNA, 17 nt, Homo sapiens
agggauccguacauuca

SEQ ID NO: 1109373 - RNA, 22 nt, Homo sapiens
agggaucuugcauucccagugg

SEQ ID NO: 1109374 - RNA, 15 nt, Homo sapiens
agggaugaccuggag

SEQ ID NO: 1109375 - RNA, 15 nt, Homo sapiens
agggcacucacaugc

SEQ ID NO: 1109376 - RNA, 16 nt, Homo sapiens
agggcacucacaugcc

SEQ ID NO: 1109377 - RNA, 19 nt, Homo sapiens
agggcgaguucagcaaaga

SEQ ID NO: 1109378 - RNA, 15 nt, Homo sapiens
agggcugaaagccau

SEQ ID NO: 1109379 - RNA, 17 nt, Homo sapiens
agggcuuauccaugccu

SEQ ID NO: 1109380 - RNA, 22 nt, Homo sapiens
aggggaagggccagucugggcu

SEQ ID NO: 1109381 - RNA, 14 nt, Homo sapiens
aggggcccacaggg

SEQ ID NO: 1109382 - RNA, 19 nt, Homo sapiens
agggguggaguuuuguaua

SEQ ID NO: 1109383 - RNA, 16 nt, Homo sapiens
aggguaccuugaacac

SEQ ID NO: 1109384 - RNA, 23 nt, Homo sapiens
aggguagucugguuucuagacuu

SEQ ID NO: 1109385 - RNA, 23 nt, Homo sapiens
agggucuuccuccuaaauuucca

SEQ ID NO: 1109386 - RNA, 23 nt, Homo sapiens
agggugggguaaccaaauguugg

SEQ ID NO: 1109387 - RNA, 19 nt, Homo sapiens
aggguguaucuagcucuag

SEQ ID NO: 1109388 - RNA, 17 nt, Homo sapiens
agguagcccagcacugu

SEQ ID NO: 1109389 - RNA, 14 nt, Homo sapiens
agguagcucccagc

SEQ ID NO: 1109390 - RNA, 13 nt, Homo sapiens
aggucaacaucua

SEQ ID NO: 1109391 - RNA, 14 nt, Homo sapiens
aggucaaugccaga

SEQ ID NO: 1109392 - RNA, 16 nt, Homo sapiens
aggucagagaugggcu

SEQ ID NO: 1109393 - RNA, 18 nt, Homo sapiens
aggucccaccuccauuug

SEQ ID NO: 1109394 - RNA, 23 nt, Homo sapiens
agguccucuacuuaaugagauag

SEQ ID NO: 1109395 - RNA, 16 nt, Homo sapiens
agguccugcauuucuc

SEQ ID NO: 1109396 - RNA, 21 nt, Homo sapiens
aggucgaccccaaagccccuu

SEQ ID NO: 1109397 - RNA, 16 nt, Homo sapiens
aggucugacacgucug

SEQ ID NO: 1109398 - RNA, 19 nt, Homo sapiens
aggugcuaucgcaccacug

SEQ ID NO: 1109399 - RNA, 13 nt, Homo sapiens
aggugcugaugag

SEQ ID NO: 1109400 - RNA, 14 nt, Homo sapiens
agguggggcagcuu

SEQ ID NO: 1109401 - RNA, 22 nt, Homo sapiens
aggugugcaaacuuguaucuga

SEQ ID NO: 1109402 - RNA, 16 nt, Homo sapiens
aggugugccaaacuac

SEQ ID NO: 1109403 - RNA, 14 nt, Homo sapiens
agguuuacauucau

SEQ ID NO: 1109404 - RNA, 16 nt, Homo sapiens
agguuuuuggucugac

SEQ ID NO: 1109405 - RNA, 14 nt, Homo sapiens
aguaaaccaaaaag

SEQ ID NO: 1109406 - RNA, 17 nt, Homo sapiens
aguaaauauuucaggca

SEQ ID NO: 1109407 - RNA, 16 nt, Homo sapiens
aguaagcugcucuauu

SEQ ID NO: 1109408 - RNA, 20 nt, Homo sapiens
aguaaguaccacucaggcca

SEQ ID NO: 1109409 - RNA, 21 nt, Homo sapiens
aguaaguaccacucaggccaa

SEQ ID NO: 1109410 - RNA, 16 nt, Homo sapiens
aguaauguuaauucuu

SEQ ID NO: 1109411 - RNA, 14 nt, Homo sapiens
aguacuggcauggu

SEQ ID NO: 1109412 - RNA, 17 nt, Homo sapiens
aguacuggcaugguacg

SEQ ID NO: 1109413 - RNA, 15 nt, Homo sapiens
aguacuuuaccuccu

SEQ ID NO: 1109414 - RNA, 14 nt, Homo sapiens
aguagaauccuaaa

SEQ ID NO: 1109415 - RNA, 14 nt, Homo sapiens
aguagagacagggu

SEQ ID NO: 1109416 - RNA, 17 nt, Homo sapiens
aguagagggcacugggu

SEQ ID NO: 1109417 - RNA, 19 nt, Homo sapiens
aguagcaaguucuagagaa

SEQ ID NO: 1109418 - RNA, 12 nt, Homo sapiens
aguagcaauuuc

SEQ ID NO: 1109419 - RNA, 13 nt, Homo sapiens
aguagcagggaau

SEQ ID NO: 1109420 - RNA, 10 nt, Homo sapiens
aguagcugag

SEQ ID NO: 1109421 - RNA, 16 nt, Homo sapiens
aguaggacuuuccuaa

SEQ ID NO: 1109422 - RNA, 21 nt, Homo sapiens
aguaggcccggugugguggcu

SEQ ID NO: 1109423 - RNA, 13 nt, Homo sapiens
aguagguuuacau

SEQ ID NO: 1109424 - RNA, 14 nt, Homo sapiens
aguauaaagugauc

SEQ ID NO: 1109425 - RNA, 14 nt, Homo sapiens
aguauaauuuaacu

SEQ ID NO: 1109426 - RNA, 14 nt, Homo sapiens
aguauauauagaau

SEQ ID NO: 1109427 - RNA, 12 nt, Homo sapiens
aguauuccauuu

SEQ ID NO: 1109428 - RNA, 11 nt, Homo sapiens
aguauuuccau

SEQ ID NO: 1109429 - RNA, 21 nt, Homo sapiens
aguauuuuccuccaggcaaaa

SEQ ID NO: 1109430 - RNA, 22 nt, Homo sapiens
agucaaaacagagaugugauaa

SEQ ID NO: 1109431 - RNA, 17 nt, Homo sapiens
agucaaccaauguagaa

SEQ ID NO: 1109432 - RNA, 23 nt, Homo sapiens
agucaauccccucauucaggaaa

SEQ ID NO: 1109433 - RNA, 21 nt, Homo sapiens
agucacaguuagguagcuuua

SEQ ID NO: 1109434 - RNA, 19 nt, Homo sapiens
agucacauggccuaugcac

SEQ ID NO: 1109435 - RNA, 20 nt, Homo sapiens
agucacgagcccgcucugca

SEQ ID NO: 1109436 - RNA, 23 nt, Homo sapiens
agucaggccuuaauuuucaguau

SEQ ID NO: 1109437 - RNA, 17 nt, Homo sapiens
agucaucuuagcuuucc

SEQ ID NO: 1109438 - RNA, 19 nt, Homo sapiens
agucauuugcugagcaugu

SEQ ID NO: 1109439 - RNA, 15 nt, Homo sapiens
agucccagcuacuca

SEQ ID NO: 1109440 - RNA, 22 nt, Homo sapiens
aguccccuccguaggagcucac

SEQ ID NO: 1109441 - RNA, 22 nt, Homo sapiens
agucccuucugagcgagcacac

SEQ ID NO: 1109442 - RNA, 19 nt, Homo sapiens
aguccucguagccaucucu

SEQ ID NO: 1109443 - RNA, 23 nt, Homo sapiens
agucgagcccugcagccaaacag

SEQ ID NO: 1109444 - RNA, 19 nt, Homo sapiens
agucuaccccugcuaagga

SEQ ID NO: 1109445 - RNA, 17 nt, Homo sapiens
agucuaggagcugggag

SEQ ID NO: 1109446 - RNA, 16 nt, Homo sapiens
agucuccccuauguaa

SEQ ID NO: 1109447 - RNA, 17 nt, Homo sapiens
agucuccuuugcacuga

SEQ ID NO: 1109448 - RNA, 21 nt, Homo sapiens
agucugaggccccuuaacuca

SEQ ID NO: 1109449 - RNA, 15 nt, Homo sapiens
agucugguguucuga

SEQ ID NO: 1109450 - RNA, 14 nt, Homo sapiens
agugaaccaaagag

SEQ ID NO: 1109451 - RNA, 16 nt, Homo sapiens
aucugccuuagacaaa

SEQ ID NO: 1109452 - RNA, 21 nt, Homo sapiens
aucugcucuuaggugcuucuu

SEQ ID NO: 1109453 - RNA, 20 nt, Homo sapiens
aucugucuugccagccagaa

SEQ ID NO: 1109454 - RNA, 16 nt, Homo sapiens
aucuguuauccugcua

SEQ ID NO: 1109455 - RNA, 19 nt, Homo sapiens
aucuucaaagcuugaagau

SEQ ID NO: 1109456 - RNA, 15 nt, Homo sapiens
aucuucuuaugcaau

SEQ ID NO: 1109457 - RNA, 12 nt, Homo sapiens
aucuucuuggag

SEQ ID NO: 1109458 - RNA, 20 nt, Homo sapiens
aucuuguuaaauugcuuauu

SEQ ID NO: 1109459 - RNA, 23 nt, Homo sapiens
aucuuuaggagacuaauggaaau

SEQ ID NO: 1109460 - RNA, 12 nt, Homo sapiens
aucuuucaggaa

SEQ ID NO: 1109461 - RNA, 22 nt, Homo sapiens
aucuuuuucucuaaaauagcca

SEQ ID NO: 1109462 - RNA, 18 nt, Homo sapiens
augaaacaaauaaucaca

SEQ ID NO: 1109463 - RNA, 12 nt, Homo sapiens
augaaagcaauc

SEQ ID NO: 1109464 - RNA, 15 nt, Homo sapiens
augaaaugcucuccu

SEQ ID NO: 1109465 - RNA, 13 nt, Homo sapiens
augaaauguuuca

SEQ ID NO: 1109466 - RNA, 12 nt, Homo sapiens
augaacugugac

SEQ ID NO: 1109467 - RNA, 16 nt, Homo sapiens
augaagacccagugua

SEQ ID NO: 1109468 - RNA, 17 nt, Homo sapiens
augaagacccaguguaa

SEQ ID NO: 1109469 - RNA, 17 nt, Homo sapiens
augaaggacgugucuca

SEQ ID NO: 1109470 - RNA, 20 nt, Homo sapiens
augaaggacgugucucagga

SEQ ID NO: 1109471 - RNA, 13 nt, Homo sapiens
augaauacaauua

SEQ ID NO: 1109472 - RNA, 17 nt, Homo sapiens
augaaucaaagacaugg

SEQ ID NO: 1109473 - RNA, 19 nt, Homo sapiens
augaaucaaagacauggaa

SEQ ID NO: 1109474 - RNA, 21 nt, Homo sapiens
augaaucccacccacauguga

SEQ ID NO: 1109475 - RNA, 16 nt, Homo sapiens
augaaucuuacuccuu

SEQ ID NO: 1109476 - RNA, 23 nt, Homo sapiens
augaauguuuacacucuuuguaa

SEQ ID NO: 1109477 - RNA, 14 nt, Homo sapiens
augacaaacccagg

SEQ ID NO: 1109478 - RNA, 15 nt, Homo sapiens
augacaaacccagga

SEQ ID NO: 1109479 - RNA, 15 nt, Homo sapiens
augacaucaacauuc

SEQ ID NO: 1109480 - RNA, 16 nt, Homo sapiens
augacaucaacauucc

SEQ ID NO: 1109481 - RNA, 20 nt, Homo sapiens
augacaucacuuguacaaaa

SEQ ID NO: 1109482 - RNA, 16 nt, Homo sapiens
augacccaaagaccaa

SEQ ID NO: 1109483 - RNA, 17 nt, Homo sapiens
augacccuccuguccag

SEQ ID NO: 1109484 - RNA, 18 nt, Homo sapiens
augaccuaaccuaagcaa

SEQ ID NO: 1109485 - RNA, 21 nt, Homo sapiens
augaccuccguguagugucug

SEQ ID NO: 1109486 - RNA, 11 nt, Homo sapiens
augaccugcug

SEQ ID NO: 1109487 - RNA, 22 nt, Homo sapiens
augacggcugcucgaagaacaa

SEQ ID NO: 1109488 - RNA, 13 nt, Homo sapiens
augacucagcaua

SEQ ID NO: 1109489 - RNA, 15 nt, Homo sapiens
augacucagcauacc

SEQ ID NO: 1109490 - RNA, 22 nt, Homo sapiens
augacuguuuuucggacaguuu

SEQ ID NO: 1109491 - RNA, 20 nt, Homo sapiens
augacuuuaucauuuuguua

SEQ ID NO: 1109492 - RNA, 14 nt, Homo sapiens
augagagaacugga

SEQ ID NO: 1109493 - RNA, 15 nt, Homo sapiens
augagagaacuggag

SEQ ID NO: 1109494 - RNA, 13 nt, Homo sapiens
augagcagucaca

SEQ ID NO: 1109495 - RNA, 19 nt, Homo sapiens
augagccguugugcuccag

SEQ ID NO: 1109496 - RNA, 20 nt, Homo sapiens
augaggccuuuccccagugu

SEQ ID NO: 1109497 - RNA, 13 nt, Homo sapiens
augagggaaaaug

SEQ ID NO: 1109498 - RNA, 17 nt, Homo sapiens
augaggguccccgggag

SEQ ID NO: 1109499 - RNA, 22 nt, Homo sapiens
augaggucauagcagugcuuga

SEQ ID NO: 1109500 - RNA, 16 nt, Homo sapiens
augaguuuauauggaa

SEQ ID NO: 1109501 - RNA, 22 nt, Homo sapiens
augaguuuuugauagcuuuauu

SEQ ID NO: 1109502 - RNA, 14 nt, Homo sapiens
augauagcuacugu

SEQ ID NO: 1109503 - RNA, 12 nt, Homo sapiens
augaucucagga

SEQ ID NO: 1109504 - RNA, 12 nt, Homo sapiens
augaucuuggca

SEQ ID NO: 1109505 - RNA, 19 nt, Homo sapiens
augaugagcuccucuuccu

SEQ ID NO: 1109506 - RNA, 18 nt, Homo sapiens
augaugugggucaaggaa

SEQ ID NO: 1109507 - RNA, 18 nt, Homo sapiens
augauuuagguacgucaa

SEQ ID NO: 1109508 - RNA, 20 nt, Homo sapiens
augauuuuugucgaguuuac

SEQ ID NO: 1109509 - RNA, 15 nt, Homo sapiens
augcaaaguagcaau

SEQ ID NO: 1109510 - RNA, 16 nt, Homo sapiens
augcaaaguagcaauu

SEQ ID NO: 1109511 - RNA, 17 nt, Homo sapiens
augcaacaacauguaua

SEQ ID NO: 1109512 - RNA, 14 nt, Homo sapiens
augcacauauggac

SEQ ID NO: 1109513 - RNA, 12 nt, Homo sapiens
augcacauguaa

SEQ ID NO: 1109514 - RNA, 20 nt, Homo sapiens
augcaccaaaucaucucuca

SEQ ID NO: 1109515 - RNA, 13 nt, Homo sapiens
augcagcucugau

SEQ ID NO: 1109516 - RNA, 18 nt, Homo sapiens
augcagugguaugaucac

SEQ ID NO: 1109517 - RNA, 14 nt, Homo sapiens
augcauguccucaa

SEQ ID NO: 1109518 - RNA, 15 nt, Homo sapiens
augcauguccucaaa

SEQ ID NO: 1109519 - RNA, 14 nt, Homo sapiens
augcauuacugcau

SEQ ID NO: 1109520 - RNA, 23 nt, Homo sapiens
augccauagcaagauugcuuaaa

SEQ ID NO: 1109521 - RNA, 13 nt, Homo sapiens
augcccagcugua

SEQ ID NO: 1109522 - RNA, 20 nt, Homo sapiens
augccgggcgcaguggcuca

SEQ ID NO: 1109523 - RNA, 17 nt, Homo sapiens
augccuucacuuuacaa

SEQ ID NO: 1109524 - RNA, 22 nt, Homo sapiens
augccuuucuaguccuauucua

SEQ ID NO: 1109525 - RNA, 20 nt, Homo sapiens
augcuaccaugccucuccaa

SEQ ID NO: 1109526 - RNA, 17 nt, Homo sapiens
augcuaguuugaccuca

SEQ ID NO: 1109527 - RNA, 14 nt, Homo sapiens
augcuucaguugua

SEQ ID NO: 1109528 - RNA, 15 nt, Homo sapiens
augcuuugcuucaaa

SEQ ID NO: 1109529 - RNA, 23 nt, Homo sapiens
augcuuuguuuccauucuugucc

SEQ ID NO: 1109530 - RNA, 20 nt, Homo sapiens
auggaaauccuguuacuuaa

SEQ ID NO: 1109531 - RNA, 16 nt, Homo sapiens
auggaacucucuccac

SEQ ID NO: 1109532 - RNA, 20 nt, Homo sapiens
auggaauauuccccuaucuc

SEQ ID NO: 1109533 - RNA, 23 nt, Homo sapiens
auggacaccccuuauccaggacu

SEQ ID NO: 1109534 - RNA, 15 nt, Homo sapiens
auggacauaagacag

SEQ ID NO: 1109535 - RNA, 18 nt, Homo sapiens
auggacauaagacagaca

SEQ ID NO: 1109536 - RNA, 12 nt, Homo sapiens
auggacucugca

SEQ ID NO: 1109537 - RNA, 13 nt, Homo sapiens
auggacucugcac

SEQ ID NO: 1109538 - RNA, 12 nt, Homo sapiens
auggagaagcuc

SEQ ID NO: 1109539 - RNA, 18 nt, Homo sapiens
auggagaggggguacaau

SEQ ID NO: 1109540 - RNA, 18 nt, Homo sapiens
auggaguucuugugccau

SEQ ID NO: 1109541 - RNA, 16 nt, Homo sapiens
auggauagucugucca

SEQ ID NO: 1109542 - RNA, 11 nt, Homo sapiens
caaauuucaca

SEQ ID NO: 1109543 - RNA, 19 nt, Homo sapiens
caacacauuacuugcacaa

SEQ ID NO: 1109544 - RNA, 20 nt, Homo sapiens
caacagccugacaacauuuc

SEQ ID NO: 1109545 - RNA, 15 nt, Homo sapiens
caacauguuauuugu

SEQ ID NO: 1109546 - RNA, 17 nt, Homo sapiens
caacauucccccaacau

SEQ ID NO: 1109547 - RNA, 17 nt, Homo sapiens
caaccaaagacacuguc

SEQ ID NO: 1109548 - RNA, 18 nt, Homo sapiens
caaccaggaacauguaac

SEQ ID NO: 1109549 - RNA, 16 nt, Homo sapiens
caaccgcuugccauau

SEQ ID NO: 1109550 - RNA, 19 nt, Homo sapiens
caaccugaucccacgaggg

SEQ ID NO: 1109551 - RNA, 12 nt, Homo sapiens
caacuccuggaa

SEQ ID NO: 1109552 - RNA, 13 nt, Homo sapiens
caacugaccagcc

SEQ ID NO: 1109553 - RNA, 20 nt, Homo sapiens
caacugcagaaaauguccuc

SEQ ID NO: 1109554 - RNA, 22 nt, Homo sapiens
caacugcuguucauguuacuca

SEQ ID NO: 1109555 - RNA, 23 nt, Homo sapiens
caacuguuuuugaagaagggaaa

SEQ ID NO: 1109556 - RNA, 16 nt, Homo sapiens
caacuuaagcugggau

SEQ ID NO: 1109557 - RNA, 17 nt, Homo sapiens
caacuuauuauaugacu

SEQ ID NO: 1109558 - RNA, 14 nt, Homo sapiens
caacuuuugugcuc

SEQ ID NO: 1109559 - RNA, 19 nt, Homo sapiens
caagaagaccagacugugg

SEQ ID NO: 1109560 - RNA, 18 nt, Homo sapiens
caagacacaucccuacaa

SEQ ID NO: 1109561 - RNA, 22 nt, Homo sapiens
caagaccuucuccccauucugc

SEQ ID NO: 1109562 - RNA, 19 nt, Homo sapiens
caagacucugucucaaaaa

SEQ ID NO: 1109563 - RNA, 17 nt, Homo sapiens
caagagcuggcaaaggu

SEQ ID NO: 1109564 - RNA, 16 nt, Homo sapiens
caagaggagacuuuaa

SEQ ID NO: 1109565 - RNA, 13 nt, Homo sapiens
caagaguauucca

SEQ ID NO: 1109566 - RNA, 13 nt, Homo sapiens
caagaucuuucag

SEQ ID NO: 1109567 - RNA, 14 nt, Homo sapiens
caagcaaauggaga

SEQ ID NO: 1109568 - RNA, 13 nt, Homo sapiens
caagcgacaggaa

SEQ ID NO: 1109569 - RNA, 14 nt, Homo sapiens
caagcuagaaggcc

SEQ ID NO: 1109570 - RNA, 23 nt, Homo sapiens
caagcuagaaggccacaugucac

SEQ ID NO: 1109571 - RNA, 16 nt, Homo sapiens
caagcuccucgugaua

SEQ ID NO: 1109572 - RNA, 16 nt, Homo sapiens
caagcuggaagcacau

SEQ ID NO: 1109573 - RNA, 14 nt, Homo sapiens
caagcuuguauaua

SEQ ID NO: 1109574 - RNA, 16 nt, Homo sapiens
caaggcacaaaccuua

SEQ ID NO: 1109575 - RNA, 17 nt, Homo sapiens
caaggcugaccaagaga

SEQ ID NO: 1109576 - RNA, 15 nt, Homo sapiens
caaggggcuuugucc

SEQ ID NO: 1109577 - RNA, 15 nt, Homo sapiens
caaggucauuugcua

SEQ ID NO: 1109578 - RNA, 14 nt, Homo sapiens
caaggucuuugguu

SEQ ID NO: 1109579 - RNA, 17 nt, Homo sapiens
caagucaccggagcuuu

SEQ ID NO: 1109580 - RNA, 16 nt, Homo sapiens
caagugaaggagccag

SEQ ID NO: 1109581 - RNA, 21 nt, Homo sapiens
caaguguguugggaauugcau

SEQ ID NO: 1109582 - RNA, 23 nt, Homo sapiens
caaguuauaaaucaaugucacuu

SEQ ID NO: 1109583 - RNA, 14 nt, Homo sapiens
caauaaaacauucc

SEQ ID NO: 1109584 - RNA, 19 nt, Homo sapiens
caauaaaagugacucucag

SEQ ID NO: 1109585 - RNA, 18 nt, Homo sapiens
caauaaaucaacuccagc

SEQ ID NO: 1109586 - RNA, 15 nt, Homo sapiens
caauaaauuuugcca

SEQ ID NO: 1109587 - RNA, 14 nt, Homo sapiens
caauaucuucauac

SEQ ID NO: 1109588 - RNA, 16 nt, Homo sapiens
caauauuaaauacaga

SEQ ID NO: 1109589 - RNA, 21 nt, Homo sapiens
caauauuaaauacagacacua

SEQ ID NO: 1109590 - RNA, 13 nt, Homo sapiens
caauauugccaug

SEQ ID NO: 1109591 - RNA, 18 nt, Homo sapiens
caauccgaaguaugaggg

SEQ ID NO: 1109592 - RNA, 14 nt, Homo sapiens
caaugaugauuaaa

SEQ ID NO: 1109593 - RNA, 22 nt, Homo sapiens
caaugguuugcaaggaagccac

SEQ ID NO: 1109594 - RNA, 20 nt, Homo sapiens
caaugucagaaacucgauga

SEQ ID NO: 1109595 - RNA, 19 nt, Homo sapiens
caaugucaggaacagaagg

SEQ ID NO: 1109596 - RNA, 18 nt, Homo sapiens
caauuaaaggcaaaggca

SEQ ID NO: 1109597 - RNA, 12 nt, Homo sapiens
caauuaguacag

SEQ ID NO: 1109598 - RNA, 18 nt, Homo sapiens
caauucuacccagagccu

SEQ ID NO: 1109599 - RNA, 20 nt, Homo sapiens
caauucuauuacgugcaaua

SEQ ID NO: 1109600 - RNA, 21 nt, Homo sapiens
caauucuauuacgugcaauac

SEQ ID NO: 1109601 - RNA, 19 nt, Homo sapiens
caauucuuacaaacaugug

SEQ ID NO: 1109602 - RNA, 20 nt, Homo sapiens
caauugacugucacuguucc

SEQ ID NO: 1109603 - RNA, 16 nt, Homo sapiens
caauuugcugccaaac

SEQ ID NO: 1109604 - RNA, 12 nt, Homo sapiens
cacaaaaugcaa

SEQ ID NO: 1109605 - RNA, 18 nt, Homo sapiens
cacaaaccuuacuaugga

SEQ ID NO: 1109606 - RNA, 18 nt, Homo sapiens
cacaaagcccuuccaugu

SEQ ID NO: 1109607 - RNA, 18 nt, Homo sapiens
cacaaagcucaagaugac

SEQ ID NO: 1109608 - RNA, 17 nt, Homo sapiens
cacaaaugcaccuccca

SEQ ID NO: 1109609 - RNA, 12 nt, Homo sapiens
cacaaauuguac

SEQ ID NO: 1109610 - RNA, 18 nt, Homo sapiens
cacaaauuuguaaacuuu

SEQ ID NO: 1109611 - RNA, 13 nt, Homo sapiens
cacaagaagacca

SEQ ID NO: 1109612 - RNA, 15 nt, Homo sapiens
cacaagccacagaag

SEQ ID NO: 1109613 - RNA, 17 nt, Homo sapiens
cacaagcuggaagcaca

SEQ ID NO: 1109614 - RNA, 17 nt, Homo sapiens
cacaaggugcaaaucaa

SEQ ID NO: 1109615 - RNA, 12 nt, Homo sapiens
cacaagugcgcc

SEQ ID NO: 1109616 - RNA, 13 nt, Homo sapiens
cacaauaugaaua

SEQ ID NO: 1109617 - RNA, 20 nt, Homo sapiens
cacaauuuagaaaacauuca

SEQ ID NO: 1109618 - RNA, 18 nt, Homo sapiens
cacaauuuauauuuuccc

SEQ ID NO: 1109619 - RNA, 15 nt, Homo sapiens
cacacaaaaugucac

SEQ ID NO: 1109620 - RNA, 15 nt, Homo sapiens
cacacagcccauaaa

SEQ ID NO: 1109621 - RNA, 20 nt, Homo sapiens
cacacaguauuacuucugcu

SEQ ID NO: 1109622 - RNA, 22 nt, Homo sapiens
cacacccagcccacuucugcca

SEQ ID NO: 1109623 - RNA, 15 nt, Homo sapiens
cacaccccucaaaaa

SEQ ID NO: 1109624 - RNA, 20 nt, Homo sapiens
cacacccgccgccuccugca

SEQ ID NO: 1109625 - RNA, 17 nt, Homo sapiens
cacacccuccccauuca

SEQ ID NO: 1109626 - RNA, 15 nt, Homo sapiens
cacacgcaggaacuc

SEQ ID NO: 1109627 - RNA, 21 nt, Homo sapiens
cacacuguagcauuacagugg

SEQ ID NO: 1109628 - RNA, 23 nt, Homo sapiens
cacagacacacaaaaugucacaa

SEQ ID NO: 1109629 - RNA, 15 nt, Homo sapiens
cacagcacuaauuca

SEQ ID NO: 1109630 - RNA, 21 nt, Homo sapiens
cacagcagccccugcacaaag

SEQ ID NO: 1109631 - RNA, 21 nt, Homo sapiens
cacagcuaugaaggcuguaca

SEQ ID NO: 1109632 - RNA, 14 nt, Homo sapiens
cacaggauuuguaa

SEQ ID NO: 1109633 - RNA, 22 nt, Homo sapiens
cauuccccucgugugacucucu

SEQ ID NO: 1109634 - RNA, 21 nt, Homo sapiens
cauuccugaaagaaacaguua

SEQ ID NO: 1109635 - RNA, 21 nt, Homo sapiens
cauuccugggacuaugcugua

SEQ ID NO: 1109636 - RNA, 17 nt, Homo sapiens
cauucugccugcccagg

SEQ ID NO: 1109637 - RNA, 21 nt, Homo sapiens
cauucugcucuuugauucaaa

SEQ ID NO: 1109638 - RNA, 16 nt, Homo sapiens
cauucugucuugaagg

SEQ ID NO: 1109639 - RNA, 16 nt, Homo sapiens
cauucuuagacuaguu

SEQ ID NO: 1109640 - RNA, 22 nt, Homo sapiens
cauugcaagcuucuuuuaguug

SEQ ID NO: 1109641 - RNA, 22 nt, Homo sapiens
cauuguguucucuauugcugcu

SEQ ID NO: 1109642 - RNA, 15 nt, Homo sapiens
cauuuaauuugaaau

SEQ ID NO: 1109643 - RNA, 12 nt, Homo sapiens
cauuuacuuaac

SEQ ID NO: 1109644 - RNA, 12 nt, Homo sapiens
cauuucaucuca

SEQ ID NO: 1109645 - RNA, 21 nt, Homo sapiens
cauuucaucucauuuaaggga

SEQ ID NO: 1109646 - RNA, 20 nt, Homo sapiens
cauuucauugagggaaaaca

SEQ ID NO: 1109647 - RNA, 17 nt, Homo sapiens
cauuuccgaagaccuuc

SEQ ID NO: 1109648 - RNA, 18 nt, Homo sapiens
cauuucuacugugacuga

SEQ ID NO: 1109649 - RNA, 19 nt, Homo sapiens
cauuucucaaaugcacauc

SEQ ID NO: 1109650 - RNA, 17 nt, Homo sapiens
cauuucuugauguugcu

SEQ ID NO: 1109651 - RNA, 15 nt, Homo sapiens
cauuugauguacaug

SEQ ID NO: 1109652 - RNA, 17 nt, Homo sapiens
cauuuuaacaucugaga

SEQ ID NO: 1109653 - RNA, 18 nt, Homo sapiens
cauuuuaacaucugagaa

SEQ ID NO: 1109654 - RNA, 13 nt, Homo sapiens
cauuuugcaaaau

SEQ ID NO: 1109655 - RNA, 14 nt, Homo sapiens
cauuuugguuuaaa

SEQ ID NO: 1109656 - RNA, 21 nt, Homo sapiens
cauuuuguaaguugaagcaaa

SEQ ID NO: 1109657 - RNA, 23 nt, Homo sapiens
ccaaaaaaaaauacaugcuaaga

SEQ ID NO: 1109658 - RNA, 15 nt, Homo sapiens
ccaaaacuaauuucc

SEQ ID NO: 1109659 - RNA, 15 nt, Homo sapiens
ccaaaaguacuuacc

SEQ ID NO: 1109660 - RNA, 17 nt, Homo sapiens
ccaaaaucguagguguu

SEQ ID NO: 1109661 - RNA, 20 nt, Homo sapiens
ccaaaauuaccaaaaaucuu

SEQ ID NO: 1109662 - RNA, 17 nt, Homo sapiens
ccaaacagaacuaugga

SEQ ID NO: 1109663 - RNA, 22 nt, Homo sapiens
ccaaacccaugaggcaauguca

SEQ ID NO: 1109664 - RNA, 17 nt, Homo sapiens
ccaaagaccaauauuca

SEQ ID NO: 1109665 - RNA, 18 nt, Homo sapiens
ccaaagacuacacuguug

SEQ ID NO: 1109666 - RNA, 13 nt, Homo sapiens
ccaaagagacugg

SEQ ID NO: 1109667 - RNA, 18 nt, Homo sapiens
ccaaaggcauaagacccu

SEQ ID NO: 1109668 - RNA, 14 nt, Homo sapiens
ccaaaguuauccag

SEQ ID NO: 1109669 - RNA, 18 nt, Homo sapiens
ccaaauaaauguguaaau

SEQ ID NO: 1109670 - RNA, 15 nt, Homo sapiens
ccaaaucaucucuca

SEQ ID NO: 1109671 - RNA, 23 nt, Homo sapiens
ccaaauccagugugcaccccucc

SEQ ID NO: 1109672 - RNA, 16 nt, Homo sapiens
ccaaaucccacagggc

SEQ ID NO: 1109673 - RNA, 21 nt, Homo sapiens
ccaaauuaaguauguuugaau

SEQ ID NO: 1109674 - RNA, 13 nt, Homo sapiens
ccaaauugcuacc

SEQ ID NO: 1109675 - RNA, 11 nt, Homo sapiens
ccaacaugacu

SEQ ID NO: 1109676 - RNA, 23 nt, Homo sapiens
ccaacuuguaaauacaccaccuc

SEQ ID NO: 1109677 - RNA, 20 nt, Homo sapiens
ccaagccuuggggauucuuc

SEQ ID NO: 1109678 - RNA, 18 nt, Homo sapiens
ccaaggaugacacugcca

SEQ ID NO: 1109679 - RNA, 21 nt, Homo sapiens
ccaaggaugacacugccaguc

SEQ ID NO: 1109680 - RNA, 16 nt, Homo sapiens
ccaaggcaguguuccu

SEQ ID NO: 1109681 - RNA, 16 nt, Homo sapiens
ccaaguccagguccug

SEQ ID NO: 1109682 - RNA, 16 nt, Homo sapiens
ccaagugccagucuug

SEQ ID NO: 1109683 - RNA, 18 nt, Homo sapiens
ccaauaaaagugacucuc

SEQ ID NO: 1109684 - RNA, 22 nt, Homo sapiens
ccaauuuaaagaaaacuguuaa

SEQ ID NO: 1109685 - RNA, 23 nt, Homo sapiens
ccaauuuucuggaauacaugaaa

SEQ ID NO: 1109686 - RNA, 18 nt, Homo sapiens
ccacaaguccuuguucca

SEQ ID NO: 1109687 - RNA, 18 nt, Homo sapiens
ccacaaucugggacuuuc

SEQ ID NO: 1109688 - RNA, 15 nt, Homo sapiens
ccacagaaauacaug

SEQ ID NO: 1109689 - RNA, 11 nt, Homo sapiens
ccacagggaac

SEQ ID NO: 1109690 - RNA, 10 nt, Homo sapiens
ccacauaaca

SEQ ID NO: 1109691 - RNA, 17 nt, Homo sapiens
ccacaucuugcucugcu

SEQ ID NO: 1109692 - RNA, 20 nt, Homo sapiens
ccacaugugacacauaugca

SEQ ID NO: 1109693 - RNA, 16 nt, Homo sapiens
ccaccacuucuuuuau

SEQ ID NO: 1109694 - RNA, 21 nt, Homo sapiens
ccaccucuugggcaugcucag

SEQ ID NO: 1109695 - RNA, 22 nt, Homo sapiens
ccacgaggagcuuccagugcau

SEQ ID NO: 1109696 - RNA, 14 nt, Homo sapiens
ccacguuaagucca

SEQ ID NO: 1109697 - RNA, 22 nt, Homo sapiens
ccacuggcauuaaagugcugua

SEQ ID NO: 1109698 - RNA, 16 nt, Homo sapiens
ccacuucuaaauagca

SEQ ID NO: 1109699 - RNA, 12 nt, Homo sapiens
ccacuucugcca

SEQ ID NO: 1109700 - RNA, 16 nt, Homo sapiens
ccacuuugucucugag

SEQ ID NO: 1109701 - RNA, 17 nt, Homo sapiens
ccagaaaaccuccagua

SEQ ID NO: 1109702 - RNA, 21 nt, Homo sapiens
ccagaaagaaggacacuugua

SEQ ID NO: 1109703 - RNA, 12 nt, Homo sapiens
ccagaacccaga

SEQ ID NO: 1109704 - RNA, 16 nt, Homo sapiens
ccagaagaauauucag

SEQ ID NO: 1109705 - RNA, 13 nt, Homo sapiens
ccagaauagcuuu

SEQ ID NO: 1109706 - RNA, 17 nt, Homo sapiens
ccagaccucaggugcua

SEQ ID NO: 1109707 - RNA, 15 nt, Homo sapiens
ccagacucagcucca

SEQ ID NO: 1109708 - RNA, 18 nt, Homo sapiens
ccagacuucucuuucuua

SEQ ID NO: 1109709 - RNA, 18 nt, Homo sapiens
ccagagacggaagccuuu

SEQ ID NO: 1109710 - RNA, 20 nt, Homo sapiens
ccagagaggguggugaccuc

SEQ ID NO: 1109711 - RNA, 17 nt, Homo sapiens
ccagagucaaauuugaa

SEQ ID NO: 1109712 - RNA, 12 nt, Homo sapiens
ccagcaaagagu

SEQ ID NO: 1109713 - RNA, 14 nt, Homo sapiens
ccagccaacauggc

SEQ ID NO: 1109714 - RNA, 12 nt, Homo sapiens
ccagccuaagaa

SEQ ID NO: 1109715 - RNA, 16 nt, Homo sapiens
ccagccuccaugcugc

SEQ ID NO: 1109716 - RNA, 18 nt, Homo sapiens
ccagccugggcaacaaag

SEQ ID NO: 1109717 - RNA, 18 nt, Homo sapiens
ccagcgagggcgugucua

SEQ ID NO: 1109718 - RNA, 21 nt, Homo sapiens
ccagcuacucaagaggcugag

SEQ ID NO: 1109719 - RNA, 21 nt, Homo sapiens
ccagcuacucaggaggcugag

SEQ ID NO: 1109720 - RNA, 21 nt, Homo sapiens
ccagcucagucccaucagaga

SEQ ID NO: 1109721 - RNA, 13 nt, Homo sapiens
ccaggaaugccuc

SEQ ID NO: 1109722 - RNA, 23 nt, Homo sapiens
ccaggagaagaaagaggugaccc

SEQ ID NO: 1109723 - RNA, 21 nt, Homo sapiens
ccaggagauggaaguugcagu

SEQ ID NO: 1109724 - RNA, 20 nt, Homo sapiens
gaucggagccuccucucuca

SEQ ID NO: 1109725 - RNA, 20 nt, Homo sapiens
gaucuaagccuuuccauaag

SEQ ID NO: 1109726 - RNA, 17 nt, Homo sapiens
gaucuauguacuguaau

SEQ ID NO: 1109727 - RNA, 14 nt, Homo sapiens
gaucucagccucug

SEQ ID NO: 1109728 - RNA, 19 nt, Homo sapiens
gaucucagccucugaucag

SEQ ID NO: 1109729 - RNA, 18 nt, Homo sapiens
gaucuccaaggaccaggu

SEQ ID NO: 1109730 - RNA, 19 nt, Homo sapiens
gaucuccaaggaccagguu

SEQ ID NO: 1109731 - RNA, 15 nt, Homo sapiens
gaucuccccacucua

SEQ ID NO: 1109732 - RNA, 15 nt, Homo sapiens
gaugaagacaacagc

SEQ ID NO: 1109733 - RNA, 16 nt, Homo sapiens
gaugaagcucuggcca

SEQ ID NO: 1109734 - RNA, 18 nt, Homo sapiens
gaugagcagucacacugu

SEQ ID NO: 1109735 - RNA, 21 nt, Homo sapiens
gaugaggucauagcagugcuu

SEQ ID NO: 1109736 - RNA, 15 nt, Homo sapiens
gaugaguuacuugaa

SEQ ID NO: 1109737 - RNA, 20 nt, Homo sapiens
gaugcaaucucuugucucac

SEQ ID NO: 1109738 - RNA, 23 nt, Homo sapiens
gaugccagccggguaccucaguu

SEQ ID NO: 1109739 - RNA, 16 nt, Homo sapiens
gaugcugccugaguca

SEQ ID NO: 1109740 - RNA, 15 nt, Homo sapiens
gaugcuguugggaaa

SEQ ID NO: 1109741 - RNA, 18 nt, Homo sapiens
gauggaaguugcagugag

SEQ ID NO: 1109742 - RNA, 16 nt, Homo sapiens
gauggaauaaagcccu

SEQ ID NO: 1109743 - RNA, 23 nt, Homo sapiens
gauggaauaaagcccuugaacca

SEQ ID NO: 1109744 - RNA, 16 nt, Homo sapiens
gauggagcgcaccugc

SEQ ID NO: 1109745 - RNA, 19 nt, Homo sapiens
gauggaggucacacuggua

SEQ ID NO: 1109746 - RNA, 16 nt, Homo sapiens
gauggauagucugucc

SEQ ID NO: 1109747 - RNA, 15 nt, Homo sapiens
gauggccaggccaga

SEQ ID NO: 1109748 - RNA, 22 nt, Homo sapiens
gauggguauuaaacuugucaga

SEQ ID NO: 1109749 - RNA, 18 nt, Homo sapiens
gauguaggguaaggugcc

SEQ ID NO: 1109750 - RNA, 19 nt, Homo sapiens
gauguaggguaaggugccu

SEQ ID NO: 1109751 - RNA, 21 nt, Homo sapiens
gaugugaauugccugcagaga

SEQ ID NO: 1109752 - RNA, 15 nt, Homo sapiens
gaugugaguugcaca

SEQ ID NO: 1109753 - RNA, 14 nt, Homo sapiens
gaugugucaucuaa

SEQ ID NO: 1109754 - RNA, 17 nt, Homo sapiens
gauguuacaucacagug

SEQ ID NO: 1109755 - RNA, 20 nt, Homo sapiens
gauuaaacaaacaaacaauu

SEQ ID NO: 1109756 - RNA, 20 nt, Homo sapiens
gauuaauuuguguagauugu

SEQ ID NO: 1109757 - RNA, 22 nt, Homo sapiens
gauuacaagcgugagccacugc

SEQ ID NO: 1109758 - RNA, 18 nt, Homo sapiens
gauuacaggugugaacca

SEQ ID NO: 1109759 - RNA, 16 nt, Homo sapiens
gauuacuucagggcug

SEQ ID NO: 1109760 - RNA, 12 nt, Homo sapiens
gauuagacugga

SEQ ID NO: 1109761 - RNA, 20 nt, Homo sapiens
gauuagcucuggaccagccu

SEQ ID NO: 1109762 - RNA, 23 nt, Homo sapiens
gauucacuaaagcagcacauagc

SEQ ID NO: 1109763 - RNA, 14 nt, Homo sapiens
gauucauuuuaaca

SEQ ID NO: 1109764 - RNA, 20 nt, Homo sapiens
gauucauuuuaacaucugag

SEQ ID NO: 1109765 - RNA, 23 nt, Homo sapiens
gauuccauuuggugaccaucugu

SEQ ID NO: 1109766 - RNA, 12 nt, Homo sapiens
gauucucugggu

SEQ ID NO: 1109767 - RNA, 16 nt, Homo sapiens
gauucuuccaucugau

SEQ ID NO: 1109768 - RNA, 19 nt, Homo sapiens
gauuguuuuugcucaaggc

SEQ ID NO: 1109769 - RNA, 21 nt, Homo sapiens
gauuuaaugaagacccagugu

SEQ ID NO: 1109770 - RNA, 21 nt, Homo sapiens
gauuucuuccagaaggcaaaa

SEQ ID NO: 1109771 - RNA, 23 nt, Homo sapiens
gauuuguauuuauauuagagugc

SEQ ID NO: 1109772 - RNA, 21 nt, Homo sapiens
gcaaaaaaaaacuuugacaaa

SEQ ID NO: 1109773 - RNA, 13 nt, Homo sapiens
gcaaaaucuacca

SEQ ID NO: 1109774 - RNA, 19 nt, Homo sapiens
gcaaagggcugaaagccau

SEQ ID NO: 1109775 - RNA, 18 nt, Homo sapiens
gcaaagguggcucuccag

SEQ ID NO: 1109776 - RNA, 24 nt, Homo sapiens
gcaacagauggauagucuguccaa

SEQ ID NO: 1109777 - RNA, 23 nt, Homo sapiens
gcaacuuaagcugggauaaucac

SEQ ID NO: 1109778 - RNA, 18 nt, Homo sapiens
gcaagaaccaguguuuag

SEQ ID NO: 1109779 - RNA, 18 nt, Homo sapiens
gcaagacuucucuuugcc

SEQ ID NO: 1109780 - RNA, 16 nt, Homo sapiens
gcaagcgacaggaaag

SEQ ID NO: 1109781 - RNA, 20 nt, Homo sapiens
gcaaggcccgagcagcugag

SEQ ID NO: 1109782 - RNA, 17 nt, Homo sapiens
gcaaggccucugccccu

SEQ ID NO: 1109783 - RNA, 16 nt, Homo sapiens
gcaagucccugacucu

SEQ ID NO: 1109784 - RNA, 15 nt, Homo sapiens
gcaaguuaaagaaaa

SEQ ID NO: 1109785 - RNA, 16 nt, Homo sapiens
gcaauaaaauguauuu

SEQ ID NO: 1109786 - RNA, 21 nt, Homo sapiens
gcaauaaaugcccucucugaa

SEQ ID NO: 1109787 - RNA, 19 nt, Homo sapiens
gcaaucugagagauuugaa

SEQ ID NO: 1109788 - RNA, 22 nt, Homo sapiens
gcaaugccaaucuucaguauuu

SEQ ID NO: 1109789 - RNA, 20 nt, Homo sapiens
gcacaaagcucaagaugaca

SEQ ID NO: 1109790 - RNA, 16 nt, Homo sapiens
gcacaaggcugaccaa

SEQ ID NO: 1109791 - RNA, 18 nt, Homo sapiens
gcacaaggcugaccaaga

SEQ ID NO: 1109792 - RNA, 20 nt, Homo sapiens
gcacacuagccucuccagga

SEQ ID NO: 1109793 - RNA, 19 nt, Homo sapiens
gcacagaaggaaucugugc

SEQ ID NO: 1109794 - RNA, 21 nt, Homo sapiens
gcacagaaggaaucugugcag

SEQ ID NO: 1109795 - RNA, 16 nt, Homo sapiens
gcacagauuacuucag

SEQ ID NO: 1109796 - RNA, 19 nt, Homo sapiens
gcacagcccacacaugaac

SEQ ID NO: 1109797 - RNA, 22 nt, Homo sapiens
gcacagcccacacaugaaccau

SEQ ID NO: 1109798 - RNA, 17 nt, Homo sapiens
gcacaucacaacauuua

SEQ ID NO: 1109799 - RNA, 22 nt, Homo sapiens
gcacauuggcagugugucacac

SEQ ID NO: 1109800 - RNA, 20 nt, Homo sapiens
gcaccacugcacuccagccu

SEQ ID NO: 1109801 - RNA, 15 nt, Homo sapiens
gcaccacuguguauu

SEQ ID NO: 1109802 - RNA, 19 nt, Homo sapiens
gcaccacuguguauuuaac

SEQ ID NO: 1109803 - RNA, 15 nt, Homo sapiens
gcaccauugcgcucu

SEQ ID NO: 1109804 - RNA, 18 nt, Homo sapiens
gcacccaugccauagaaa

SEQ ID NO: 1109805 - RNA, 18 nt, Homo sapiens
gcaccgagagagauggaa

SEQ ID NO: 1109806 - RNA, 19 nt, Homo sapiens
gcaccgagagagauggaau

SEQ ID NO: 1109807 - RNA, 20 nt, Homo sapiens
gcaccuacuuacaugcauua

SEQ ID NO: 1109808 - RNA, 20 nt, Homo sapiens
gcaccuucaauacuucauga

SEQ ID NO: 1109809 - RNA, 18 nt, Homo sapiens
gcacgguggcucaggccu

SEQ ID NO: 1109810 - RNA, 17 nt, Homo sapiens
gcacguuuggcauuucu

SEQ ID NO: 1109811 - RNA, 23 nt, Homo sapiens
gcacuaaaaaguggcuaauucaa

SEQ ID NO: 1109812 - RNA, 19 nt, Homo sapiens
gcacuccucugucucugcu

SEQ ID NO: 1109813 - RNA, 21 nt, Homo sapiens
gcacugacauuguuggccaaa

SEQ ID NO: 1109814 - RNA, 16 nt, Homo sapiens
ggagcuuccagugcau

SEQ ID NO: 1109815 - RNA, 16 nt, Homo sapiens
ggaggacacaguuucu

SEQ ID NO: 1109816 - RNA, 17 nt, Homo sapiens
ggagggacacuuaccca

SEQ ID NO: 1109817 - RNA, 23 nt, Homo sapiens
ggagggguuuuggugauacccaa

SEQ ID NO: 1109818 - RNA, 17 nt, Homo sapiens
ggagguagcucccagca

SEQ ID NO: 1109819 - RNA, 21 nt, Homo sapiens
ggaggucccugccaguguuua

SEQ ID NO: 1109820 - RNA, 19 nt, Homo sapiens
ggagguggagguugcagug

SEQ ID NO: 1109821 - RNA, 17 nt, Homo sapiens
ggagguuccggugucug

SEQ ID NO: 1109822 - RNA, 16 nt, Homo sapiens
ggaguggaugcgauaa

SEQ ID NO: 1109823 - RNA, 18 nt, Homo sapiens
ggauaauaacuagaucuc

SEQ ID NO: 1109824 - RNA, 23 nt, Homo sapiens
ggauaaucacauuaucaucugaa

SEQ ID NO: 1109825 - RNA, 17 nt, Homo sapiens
ggauacagaaugaaucc

SEQ ID NO: 1109826 - RNA, 17 nt, Homo sapiens
ggaucucacaagcacuu

SEQ ID NO: 1109827 - RNA, 17 nt, Homo sapiens
ggaugaaagcaaucuga

SEQ ID NO: 1109828 - RNA, 14 nt, Homo sapiens
ggauggcaccagag

SEQ ID NO: 1109829 - RNA, 20 nt, Homo sapiens
ggauguuuugucccauuucc

SEQ ID NO: 1109830 - RNA, 14 nt, Homo sapiens
ggauucaggaaaag

SEQ ID NO: 1109831 - RNA, 23 nt, Homo sapiens
ggauuugaagcaaagcaccagcu

SEQ ID NO: 1109832 - RNA, 18 nt, Homo sapiens
ggauuuguuuaaaaacca

SEQ ID NO: 1109833 - RNA, 18 nt, Homo sapiens
ggauuuuagugcuugcca

SEQ ID NO: 1109834 - RNA, 23 nt, Homo sapiens
ggauuuuuuuguuuucugaugac

SEQ ID NO: 1109835 - RNA, 19 nt, Homo sapiens
ggcaaagguggcucuccag

SEQ ID NO: 1109836 - RNA, 16 nt, Homo sapiens
ggcaacaaagugagac

SEQ ID NO: 1109837 - RNA, 21 nt, Homo sapiens
ggcaacaacagcaaaacucca

SEQ ID NO: 1109838 - RNA, 22 nt, Homo sapiens
ggcaaccuugucucuaugccag

SEQ ID NO: 1109839 - RNA, 17 nt, Homo sapiens
ggcaacgacgguuucaa

SEQ ID NO: 1109840 - RNA, 15 nt, Homo sapiens
ggcacaccgggcacu

SEQ ID NO: 1109841 - RNA, 21 nt, Homo sapiens
ggcacagccagccaaccuaag

SEQ ID NO: 1109842 - RNA, 21 nt, Homo sapiens
ggcaccuccuacgucaaacau

SEQ ID NO: 1109843 - RNA, 22 nt, Homo sapiens
ggcaccuccuacgucaaacaug

SEQ ID NO: 1109844 - RNA, 20 nt, Homo sapiens
ggcacucagaagacacugau

SEQ ID NO: 1109845 - RNA, 16 nt, Homo sapiens
ggcagcacucagugag

SEQ ID NO: 1109846 - RNA, 10 nt, Homo sapiens
ggcagccacc

SEQ ID NO: 1109847 - RNA, 16 nt, Homo sapiens
ggcagcugucauucag

SEQ ID NO: 1109848 - RNA, 22 nt, Homo sapiens
ggcaggaggaucacagugaccu

SEQ ID NO: 1109849 - RNA, 17 nt, Homo sapiens
ggcaucgggccaucuca

SEQ ID NO: 1109850 - RNA, 19 nt, Homo sapiens
ggcaugaaggugucauaca

SEQ ID NO: 1109851 - RNA, 16 nt, Homo sapiens
ggcauuaaagugcugu

SEQ ID NO: 1109852 - RNA, 15 nt, Homo sapiens
ggccaagcugaggug

SEQ ID NO: 1109853 - RNA, 22 nt, Homo sapiens
ggccacguguucucacacuggu

SEQ ID NO: 1109854 - RNA, 23 nt, Homo sapiens
ggccaguauuuuuauuucuuuaa

SEQ ID NO: 1109855 - RNA, 17 nt, Homo sapiens
ggccaugccacccuguu

SEQ ID NO: 1109856 - RNA, 16 nt, Homo sapiens
ggccaugcuucuugcc

SEQ ID NO: 1109857 - RNA, 14 nt, Homo sapiens
ggcccguccggcgg

SEQ ID NO: 1109858 - RNA, 13 nt, Homo sapiens
ggcccugggagag

SEQ ID NO: 1109859 - RNA, 21 nt, Homo sapiens
ggcccuucuugccuacuaugc

SEQ ID NO: 1109860 - RNA, 17 nt, Homo sapiens
ggccuaugcacauaugg

SEQ ID NO: 1109861 - RNA, 16 nt, Homo sapiens
ggccucagaccaacuc

SEQ ID NO: 1109862 - RNA, 19 nt, Homo sapiens
ggccuccugugcaucugua

SEQ ID NO: 1109863 - RNA, 21 nt, Homo sapiens
ggccugaagucccagcauuga

SEQ ID NO: 1109864 - RNA, 18 nt, Homo sapiens
ggccuguguagcugugac

SEQ ID NO: 1109865 - RNA, 16 nt, Homo sapiens
ggccuuguucugucac

SEQ ID NO: 1109866 - RNA, 12 nt, Homo sapiens
ggcuaagugauc

SEQ ID NO: 1109867 - RNA, 21 nt, Homo sapiens
ggcuaauucccagagugugaa

SEQ ID NO: 1109868 - RNA, 17 nt, Homo sapiens
ggcuaccccacccaagu

SEQ ID NO: 1109869 - RNA, 21 nt, Homo sapiens
ggcucaccuugugcuggggac

SEQ ID NO: 1109870 - RNA, 15 nt, Homo sapiens
ggcucacgccuguaa

SEQ ID NO: 1109871 - RNA, 16 nt, Homo sapiens
ggcucaugaccuggaa

SEQ ID NO: 1109872 - RNA, 22 nt, Homo sapiens
ggcuccaccccauccaguucau

SEQ ID NO: 1109873 - RNA, 13 nt, Homo sapiens
ggcucccaucuga

SEQ ID NO: 1109874 - RNA, 19 nt, Homo sapiens
ggcucuccuguagcucucc

SEQ ID NO: 1109875 - RNA, 18 nt, Homo sapiens
ggcugaaauaaaagccuc

SEQ ID NO: 1109876 - RNA, 12 nt, Homo sapiens
ggcugagcucuu

SEQ ID NO: 1109877 - RNA, 15 nt, Homo sapiens
ggcugagcucuuauc

SEQ ID NO: 1109878 - RNA, 21 nt, Homo sapiens
ggcugcucgaagaacaauguc

SEQ ID NO: 1109879 - RNA, 18 nt, Homo sapiens
ggcuggaaaagucacaca

SEQ ID NO: 1109880 - RNA, 22 nt, Homo sapiens
ggcugggguggggguggggaga

SEQ ID NO: 1109881 - RNA, 15 nt, Homo sapiens
ggcuguacacugcac

SEQ ID NO: 1109882 - RNA, 18 nt, Homo sapiens
ggcuguacgucugguguu

SEQ ID NO: 1109883 - RNA, 15 nt, Homo sapiens
ggcuguaucccauga

SEQ ID NO: 1109884 - RNA, 16 nt, Homo sapiens
ggcuguuauucuucca

SEQ ID NO: 1109885 - RNA, 13 nt, Homo sapiens
ggcuuaugcccuc

SEQ ID NO: 1109886 - RNA, 18 nt, Homo sapiens
ggcuucagccucucccac

SEQ ID NO: 1109887 - RNA, 22 nt, Homo sapiens
ggcuuccuccagcggcugggug

SEQ ID NO: 1109888 - RNA, 17 nt, Homo sapiens
ggcuucuguccaaggca

SEQ ID NO: 1109889 - RNA, 14 nt, Homo sapiens
ggcuugcaugccaa

SEQ ID NO: 1109890 - RNA, 20 nt, Homo sapiens
ggcuuuaugcuaguuugacc

SEQ ID NO: 1109891 - RNA, 14 nt, Homo sapiens
ggcuuuuauugcca

SEQ ID NO: 1109892 - RNA, 15 nt, Homo sapiens
gggaaaucuuauauu

SEQ ID NO: 1109893 - RNA, 21 nt, Homo sapiens
gggaagacaacuaggauacuu

SEQ ID NO: 1109894 - RNA, 22 nt, Homo sapiens
gggaagcgaugaauuuggagac

SEQ ID NO: 1109895 - RNA, 20 nt, Homo sapiens
gggacaaaggagccugugaa

SEQ ID NO: 1109896 - RNA, 17 nt, Homo sapiens
gggacacuuacccaagg

SEQ ID NO: 1109897 - RNA, 16 nt, Homo sapiens
gggaccacaccucccu

SEQ ID NO: 1109898 - RNA, 14 nt, Homo sapiens
gggacuuacaugau

SEQ ID NO: 1109899 - RNA, 23 nt, Homo sapiens
gggacuuauguauuuaugaccuu

SEQ ID NO: 1109900 - RNA, 16 nt, Homo sapiens
gggagccucuccuugc

SEQ ID NO: 1109901 - RNA, 19 nt, Homo sapiens
gggagccucuccuugccug

SEQ ID NO: 1109902 - RNA, 23 nt, Homo sapiens
gggaggccgaagcuaacagggaa

SEQ ID NO: 1109903 - RNA, 20 nt, Homo sapiens
gggagguggagguugcagug

SEQ ID NO: 1109904 - RNA, 20 nt, Homo sapiens
guuuuuucaucauaacauaa

SEQ ID NO: 1109905 - RNA, 23 nt, Homo sapiens
uaaaaaaguuucuaguaucacau

SEQ ID NO: 1109906 - RNA, 22 nt, Homo sapiens
uaaaaaauaaauauaauuggga

SEQ ID NO: 1109907 - RNA, 20 nt, Homo sapiens
uaaaaacaccaaaaagggau

SEQ ID NO: 1109908 - RNA, 21 nt, Homo sapiens
uaaaaacauaaaauauacaaa

SEQ ID NO: 1109909 - RNA, 12 nt, Homo sapiens
uaaaaacuaaaa

SEQ ID NO: 1109910 - RNA, 17 nt, Homo sapiens
uaaaaauauaagaacuu

SEQ ID NO: 1109911 - RNA, 15 nt, Homo sapiens
uaaaaauugugauca

SEQ ID NO: 1109912 - RNA, 12 nt, Homo sapiens
uaaaacacagcu

SEQ ID NO: 1109913 - RNA, 22 nt, Homo sapiens
uaaaacagguggagaaauuccu

SEQ ID NO: 1109914 - RNA, 12 nt, Homo sapiens
uaaaacauuccu

SEQ ID NO: 1109915 - RNA, 15 nt, Homo sapiens
uaaaaccccaucucu

SEQ ID NO: 1109916 - RNA, 18 nt, Homo sapiens
uaaaaccugugugccauu

SEQ ID NO: 1109917 - RNA, 22 nt, Homo sapiens
uaaaaccuuacuuaaagcuugu

SEQ ID NO: 1109918 - RNA, 16 nt, Homo sapiens
uaaaacuauauucuca

SEQ ID NO: 1109919 - RNA, 22 nt, Homo sapiens
uaaaagaaaaaguaugugaaua

SEQ ID NO: 1109920 - RNA, 23 nt, Homo sapiens
uaaaagaaccgagcaauuuucug

SEQ ID NO: 1109921 - RNA, 11 nt, Homo sapiens
uaaaagcacuu

SEQ ID NO: 1109922 - RNA, 16 nt, Homo sapiens
uaaaagugacucucag

SEQ ID NO: 1109923 - RNA, 20 nt, Homo sapiens
uaaaauaacuuauaucauca

SEQ ID NO: 1109924 - RNA, 18 nt, Homo sapiens
uaaaauaaggcuccuuca

SEQ ID NO: 1109925 - RNA, 18 nt, Homo sapiens
uaaaauagccacuuaccu

SEQ ID NO: 1109926 - RNA, 22 nt, Homo sapiens
uaaaauagccacuuaccuucaa

SEQ ID NO: 1109927 - RNA, 19 nt, Homo sapiens
uaaaauauuccugcauuug

SEQ ID NO: 1109928 - RNA, 19 nt, Homo sapiens
uaaaauauuuaugagaaag

SEQ ID NO: 1109929 - RNA, 17 nt, Homo sapiens
uaaaaucauucaauauc

SEQ ID NO: 1109930 - RNA, 19 nt, Homo sapiens
uaaaaucuuggcacagaaa

SEQ ID NO: 1109931 - RNA, 17 nt, Homo sapiens
uaaaauuaaaugcaugu

SEQ ID NO: 1109932 - RNA, 18 nt, Homo sapiens
uaaaauuagaugaacuca

SEQ ID NO: 1109933 - RNA, 15 nt, Homo sapiens
uaaaauuaugccaua

SEQ ID NO: 1109934 - RNA, 14 nt, Homo sapiens
uaaacaaacaaaca

SEQ ID NO: 1109935 - RNA, 14 nt, Homo sapiens
uaaacaaauguaug

SEQ ID NO: 1109936 - RNA, 23 nt, Homo sapiens
uaaacacccaugaaucaaagaca

SEQ ID NO: 1109937 - RNA, 21 nt, Homo sapiens
uaaacauccuucaagaacucu

SEQ ID NO: 1109938 - RNA, 14 nt, Homo sapiens
uaaacuagaucucc

SEQ ID NO: 1109939 - RNA, 14 nt, Homo sapiens
uaaacucucuaggg

SEQ ID NO: 1109940 - RNA, 20 nt, Homo sapiens
uaaacuuaauuuuguaaaac

SEQ ID NO: 1109941 - RNA, 15 nt, Homo sapiens
uaaacuuguguauga

SEQ ID NO: 1109942 - RNA, 22 nt, Homo sapiens
uaaagaacacgaauugcucaau

SEQ ID NO: 1109943 - RNA, 19 nt, Homo sapiens
uaaagaauaaaugaaucuu

SEQ ID NO: 1109944 - RNA, 14 nt, Homo sapiens
uaaagaccugagaa

SEQ ID NO: 1109945 - RNA, 15 nt, Homo sapiens
uaaagagaacucugg

SEQ ID NO: 1109946 - RNA, 13 nt, Homo sapiens
uaaagcugcugag

SEQ ID NO: 1109947 - RNA, 21 nt, Homo sapiens
uaaaguauuauuuauuugaau

SEQ ID NO: 1109948 - RNA, 23 nt, Homo sapiens
uaaauacacaacacacacacucu

SEQ ID NO: 1109949 - RNA, 22 nt, Homo sapiens
uaaauauuaaccugaauuauuc

SEQ ID NO: 1109950 - RNA, 16 nt, Homo sapiens
uaaauauuucaggcau

SEQ ID NO: 1109951 - RNA, 23 nt, Homo sapiens
uaaaucccauucauaacuuucau

SEQ ID NO: 1109952 - RNA, 12 nt, Homo sapiens
uaaaucuaauca

SEQ ID NO: 1109953 - RNA, 13 nt, Homo sapiens
uaaaucuaucuau

SEQ ID NO: 1109954 - RNA, 20 nt, Homo sapiens
uaaaucugagccuaaaucua

SEQ ID NO: 1109955 - RNA, 18 nt, Homo sapiens
uaaaucuuccuugugagg

SEQ ID NO: 1109956 - RNA, 16 nt, Homo sapiens
uaaaugccaacauacc

SEQ ID NO: 1109957 - RNA, 17 nt, Homo sapiens
uaaaugccaacauaccc

SEQ ID NO: 1109958 - RNA, 16 nt, Homo sapiens
uaaaugcccucucuga

SEQ ID NO: 1109959 - RNA, 20 nt, Homo sapiens
uaaauggacaaaugcuuaug

SEQ ID NO: 1109960 - RNA, 14 nt, Homo sapiens
uaaauguacauuaa

SEQ ID NO: 1109961 - RNA, 14 nt, Homo sapiens
uaaaugugcuuaug

SEQ ID NO: 1109962 - RNA, 22 nt, Homo sapiens
uaaauuauuuauuuauggagga

SEQ ID NO: 1109963 - RNA, 13 nt, Homo sapiens
uaaauugcuuauu

SEQ ID NO: 1109964 - RNA, 20 nt, Homo sapiens
uaaauuguuuuuacugauga

SEQ ID NO: 1109965 - RNA, 22 nt, Homo sapiens
uaaauuugggggacuuacauga

SEQ ID NO: 1109966 - RNA, 18 nt, Homo sapiens
uaaauuuuauaaucauga

SEQ ID NO: 1109967 - RNA, 15 nt, Homo sapiens
uaacaaagaacaagc

SEQ ID NO: 1109968 - RNA, 16 nt, Homo sapiens
uaacaaagaacaagca

SEQ ID NO: 1109969 - RNA, 18 nt, Homo sapiens
uaacacucagaagccugg

SEQ ID NO: 1109970 - RNA, 15 nt, Homo sapiens
uaacagaacagucac

SEQ ID NO: 1109971 - RNA, 18 nt, Homo sapiens
uaacagcugucuauguau

SEQ ID NO: 1109972 - RNA, 16 nt, Homo sapiens
uaacaggcagauacag

SEQ ID NO: 1109973 - RNA, 21 nt, Homo sapiens
uaacagggagacugcaucuca

SEQ ID NO: 1109974 - RNA, 20 nt, Homo sapiens
uaacauaaaauaaucgucuc

SEQ ID NO: 1109975 - RNA, 22 nt, Homo sapiens
uaacauaaauuuaucaucucga

SEQ ID NO: 1109976 - RNA, 23 nt, Homo sapiens
uaacauaaauuuaucaucucgac

SEQ ID NO: 1109977 - RNA, 17 nt, Homo sapiens
uaacaugcaauuuugca

SEQ ID NO: 1109978 - RNA, 19 nt, Homo sapiens
uaaccagacacauacucau

SEQ ID NO: 1109979 - RNA, 14 nt, Homo sapiens
uaaccucaguguca

SEQ ID NO: 1109980 - RNA, 19 nt, Homo sapiens
uaaccucagugucauuuau

SEQ ID NO: 1109981 - RNA, 20 nt, Homo sapiens
uaaccuccacaguagcauuu

SEQ ID NO: 1109982 - RNA, 12 nt, Homo sapiens
uaaccugaauua

SEQ ID NO: 1109983 - RNA, 17 nt, Homo sapiens
uaaccugaauuauucca

SEQ ID NO: 1109984 - RNA, 22 nt, Homo sapiens
uaaccuguuuauauaauuuugc

SEQ ID NO: 1109985 - RNA, 16 nt, Homo sapiens
uaacgucaucucaggg

SEQ ID NO: 1109986 - RNA, 20 nt, Homo sapiens
uaacuaccuaaacauguuau

SEQ ID NO: 1109987 - RNA, 21 nt, Homo sapiens
uaacuacuuuuuauacuccau

SEQ ID NO: 1109988 - RNA, 18 nt, Homo sapiens
uaacuauaucauccuuua

SEQ ID NO: 1109989 - RNA, 21 nt, Homo sapiens
uaacugaaggagaaggugccc

SEQ ID NO: 1109990 - RNA, 22 nt, Homo sapiens
uaacugcacacaugguuuccaa

SEQ ID NO: 1109991 - RNA, 22 nt, Homo sapiens
uaacuggguaaugaaacaaaga

SEQ ID NO: 1109992 - RNA, 16 nt, Homo sapiens
uaacuugauauagaaa

SEQ ID NO: 1109993 - RNA, 18 nt, Homo sapiens
uaagaaaacaucacugaa

SEQ ID NO: 1109994 - RNA, 16 nt, Homo sapiens
uauucucaguguaggg

SEQ ID NO: 1109995 - RNA, 22 nt, Homo sapiens
uauucuguuggccagugugaca

SEQ ID NO: 1109996 - RNA, 16 nt, Homo sapiens
uauucuuuaaauuuca

SEQ ID NO: 1109997 - RNA, 21 nt, Homo sapiens
uauucuuuaaauuucaucuca

SEQ ID NO: 1109998 - RNA, 11 nt, Homo sapiens
uauugcugcuc

SEQ ID NO: 1109999 - RNA, 14 nt, Homo sapiens
uauuggaacauguc

SEQ ID NO: 1110000 - RNA, 19 nt, Homo sapiens
uauuggacugauaaucucu

SEQ ID NO: 1110001 - RNA, 20 nt, Homo sapiens
uauuggcaguuggaggacac

SEQ ID NO: 1110002 - RNA, 22 nt, Homo sapiens
uauugguccagcuugcucuuca

SEQ ID NO: 1110003 - RNA, 14 nt, Homo sapiens
uauuguccauauca

SEQ ID NO: 1110004 - RNA, 22 nt, Homo sapiens
uauuguuaaaaccuuacuuaaa

SEQ ID NO: 1110005 - RNA, 17 nt, Homo sapiens
uauuuaaguauauagua

SEQ ID NO: 1110006 - RNA, 18 nt, Homo sapiens
uauuuacauacaggccau

SEQ ID NO: 1110007 - RNA, 14 nt, Homo sapiens
uauuuacauuuucc

SEQ ID NO: 1110008 - RNA, 21 nt, Homo sapiens
uauuuacugagcuucucugug

SEQ ID NO: 1110009 - RNA, 21 nt, Homo sapiens
uauuuauauauuuauaacuca

SEQ ID NO: 1110010 - RNA, 16 nt, Homo sapiens
uauuuaucugugcaaa

SEQ ID NO: 1110011 - RNA, 17 nt, Homo sapiens
uauuuaugccucuguau

SEQ ID NO: 1110012 - RNA, 13 nt, Homo sapiens
uauuuauucacug

SEQ ID NO: 1110013 - RNA, 17 nt, Homo sapiens
uauuucaaccgcuugcc

SEQ ID NO: 1110014 - RNA, 15 nt, Homo sapiens
uauuucauaaacaac

SEQ ID NO: 1110015 - RNA, 14 nt, Homo sapiens
uauuuccuuuccag

SEQ ID NO: 1110016 - RNA, 21 nt, Homo sapiens
uauuugaagcaucacauaaaa

SEQ ID NO: 1110017 - RNA, 13 nt, Homo sapiens
uauuugcuaugaa

SEQ ID NO: 1110018 - RNA, 18 nt, Homo sapiens
uauuugguauaaaggguu

SEQ ID NO: 1110019 - RNA, 20 nt, Homo sapiens
uauuuuauauauuaugucau

SEQ ID NO: 1110020 - RNA, 20 nt, Homo sapiens
uauuuuauucccuuucacaa

SEQ ID NO: 1110021 - RNA, 13 nt, Homo sapiens
ucaaaaauacuca

SEQ ID NO: 1110022 - RNA, 16 nt, Homo sapiens
ucaaaaauacucacau

SEQ ID NO: 1110023 - RNA, 21 nt, Homo sapiens
ucaaaaauuagugaaguucuu

SEQ ID NO: 1110024 - RNA, 18 nt, Homo sapiens
ucaaacauauguauacaa

SEQ ID NO: 1110025 - RNA, 18 nt, Homo sapiens
ucaaaccccgaccaccug

SEQ ID NO: 1110026 - RNA, 20 nt, Homo sapiens
ucaaacuccuggacucaugc

SEQ ID NO: 1110027 - RNA, 12 nt, Homo sapiens
ucaaacugcucc

SEQ ID NO: 1110028 - RNA, 23 nt, Homo sapiens
ucaaagauguguugcuauccuga

SEQ ID NO: 1110029 - RNA, 14 nt, Homo sapiens
ucaaagcacuguuu

SEQ ID NO: 1110030 - RNA, 12 nt, Homo sapiens
ucaaagcaguag

SEQ ID NO: 1110031 - RNA, 13 nt, Homo sapiens
ucaaauagcauaa

SEQ ID NO: 1110032 - RNA, 15 nt, Homo sapiens
ucaaaugacccaaag

SEQ ID NO: 1110033 - RNA, 17 nt, Homo sapiens
ucaaaugacccaaagac

SEQ ID NO: 1110034 - RNA, 23 nt, Homo sapiens
ucaaauugucuuuugucaugugg

SEQ ID NO: 1110035 - RNA, 22 nt, Homo sapiens
ucaaauuucuguucucucuucc

SEQ ID NO: 1110036 - RNA, 13 nt, Homo sapiens
ucaacaguucaaa

SEQ ID NO: 1110037 - RNA, 16 nt, Homo sapiens
ucaacaguucaaagaa

SEQ ID NO: 1110038 - RNA, 11 nt, Homo sapiens
ucaaccagcag

SEQ ID NO: 1110039 - RNA, 16 nt, Homo sapiens
ucaaccgcuugccaua

SEQ ID NO: 1110040 - RNA, 21 nt, Homo sapiens
ucaacuuaccaggcaccaaaa

SEQ ID NO: 1110041 - RNA, 16 nt, Homo sapiens
ucaagaacucugggcu

SEQ ID NO: 1110042 - RNA, 15 nt, Homo sapiens
ucaagagacugaguc

SEQ ID NO: 1110043 - RNA, 15 nt, Homo sapiens
ucaaggagcccagaa

SEQ ID NO: 1110044 - RNA, 23 nt, Homo sapiens
ucaaggcccggccccaucagagg

SEQ ID NO: 1110045 - RNA, 22 nt, Homo sapiens
ucaagguguuuugaaaugcaga

SEQ ID NO: 1110046 - RNA, 16 nt, Homo sapiens
ucaagucuucccugau

SEQ ID NO: 1110047 - RNA, 23 nt, Homo sapiens
ucaaguuguuccuuaagucagaa

SEQ ID NO: 1110048 - RNA, 16 nt, Homo sapiens
ucaaguuuuucagaaa

SEQ ID NO: 1110049 - RNA, 17 nt, Homo sapiens
ucaauauuaaauacaga

SEQ ID NO: 1110050 - RNA, 14 nt, Homo sapiens
ucaauauuccugaa

SEQ ID NO: 1110051 - RNA, 21 nt, Homo sapiens
ucaauguuucuuuuaucacga

SEQ ID NO: 1110052 - RNA, 13 nt, Homo sapiens
ucaauuaguacag

SEQ ID NO: 1110053 - RNA, 21 nt, Homo sapiens
ucaauucuauuacgugcaaua

SEQ ID NO: 1110054 - RNA, 17 nt, Homo sapiens
ucaauuucccugacucc

SEQ ID NO: 1110055 - RNA, 19 nt, Homo sapiens
ucaauuuuuauacauauca

SEQ ID NO: 1110056 - RNA, 16 nt, Homo sapiens
ucacaaaccaugcaaa

SEQ ID NO: 1110057 - RNA, 20 nt, Homo sapiens
ucacaacauuuacuuaacag

SEQ ID NO: 1110058 - RNA, 14 nt, Homo sapiens
ucacaaccagccac

SEQ ID NO: 1110059 - RNA, 15 nt, Homo sapiens
ucacaagaagaccag

SEQ ID NO: 1110060 - RNA, 16 nt, Homo sapiens
ucacaauuccauuucc

SEQ ID NO: 1110061 - RNA, 19 nt, Homo sapiens
ucacacagacacacaaaau

SEQ ID NO: 1110062 - RNA, 11 nt, Homo sapiens
ucacacuggug

SEQ ID NO: 1110063 - RNA, 19 nt, Homo sapiens
ucacaggacucugccuccu

SEQ ID NO: 1110064 - RNA, 21 nt, Homo sapiens
ucacaggcagguccaggguuu

SEQ ID NO: 1110065 - RNA, 20 nt, Homo sapiens
ucacagggccccagaaggca

SEQ ID NO: 1110066 - RNA, 14 nt, Homo sapiens
ucacauauaaaagu

SEQ ID NO: 1110067 - RNA, 22 nt, Homo sapiens
ucacaugccgcccccagcagcu

SEQ ID NO: 1110068 - RNA, 19 nt, Homo sapiens
ucacaugcuuuguuuccau

SEQ ID NO: 1110069 - RNA, 17 nt, Homo sapiens
ucacauggccuaugcac

SEQ ID NO: 1110070 - RNA, 18 nt, Homo sapiens
ucacauuaauauuugcug

SEQ ID NO: 1110071 - RNA, 16 nt, Homo sapiens
ucacauuaucaucuga

SEQ ID NO: 1110072 - RNA, 17 nt, Homo sapiens
ucacauuaucaucugaa

SEQ ID NO: 1110073 - RNA, 19 nt, Homo sapiens
ucacauuuauucugcucac

SEQ ID NO: 1110074 - RNA, 19 nt, Homo sapiens
ucaccaagcucacaguucc

SEQ ID NO: 1110075 - RNA, 15 nt, Homo sapiens
ucaccaauaacuuca

SEQ ID NO: 1110076 - RNA, 14 nt, Homo sapiens
ucacccuaccugug

SEQ ID NO: 1110077 - RNA, 13 nt, Homo sapiens
ucaccguggaccu

SEQ ID NO: 1110078 - RNA, 21 nt, Homo sapiens
ucaccucagagacauacaccu

SEQ ID NO: 1110079 - RNA, 16 nt, Homo sapiens
ucaccuguuacugaaa

SEQ ID NO: 1110080 - RNA, 19 nt, Homo sapiens
ucacgaaguuuguucauca

SEQ ID NO: 1110081 - RNA, 16 nt, Homo sapiens
ucacggcucacugcag

SEQ ID NO: 1110082 - RNA, 17 nt, Homo sapiens
ucacuaugacacugagc

SEQ ID NO: 1110083 - RNA, 17 nt, Homo sapiens
ucacucuuauugcccac

SEQ ID NO: 1110084 - RNA, 16 nt, Homo sapiens
ucacugaaaagacuau

SEQ ID NO: 1110085 - RNA, 13 nt, Homo sapiens
uuccacauuaauu

SEQ ID NO: 1110086 - RNA, 20 nt, Homo sapiens
uuccagcuagugacccacau

SEQ ID NO: 1110087 - RNA, 17 nt, Homo sapiens
uuccagugcauguugcc

SEQ ID NO: 1110088 - RNA, 18 nt, Homo sapiens
uuccauaaacacccauga

SEQ ID NO: 1110089 - RNA, 19 nt, Homo sapiens
uuccauaaucuggacuccu

SEQ ID NO: 1110090 - RNA, 15 nt, Homo sapiens
uuccaugaagaccac

SEQ ID NO: 1110091 - RNA, 13 nt, Homo sapiens
uuccauuuaguaa

SEQ ID NO: 1110092 - RNA, 20 nt, Homo sapiens
uuccauuuccaguucaucua

SEQ ID NO: 1110093 - RNA, 20 nt, Homo sapiens
uucccaagcucuagugggaa

SEQ ID NO: 1110094 - RNA, 20 nt, Homo sapiens
uucccaguggucaaaccgca

SEQ ID NO: 1110095 - RNA, 22 nt, Homo sapiens
uuccccucuacuccaugcacau

SEQ ID NO: 1110096 - RNA, 14 nt, Homo sapiens
uucccuaaugaagu

SEQ ID NO: 1110097 - RNA, 20 nt, Homo sapiens
uucccuaucaaaacauauca

SEQ ID NO: 1110098 - RNA, 19 nt, Homo sapiens
uucccucuggcacuccaga

SEQ ID NO: 1110099 - RNA, 20 nt, Homo sapiens
uucccuguaugauuccuuga

SEQ ID NO: 1110100 - RNA, 22 nt, Homo sapiens
uuccucuaugaaaauuauaucu

SEQ ID NO: 1110101 - RNA, 20 nt, Homo sapiens
uuccugggacuaugcuguaa

SEQ ID NO: 1110102 - RNA, 13 nt, Homo sapiens
uuccugguauuau

SEQ ID NO: 1110103 - RNA, 22 nt, Homo sapiens
uuccuguaacacaagccacaga

SEQ ID NO: 1110104 - RNA, 21 nt, Homo sapiens
uuccuugauggagauauuuac

SEQ ID NO: 1110105 - RNA, 16 nt, Homo sapiens
uuccuugggaugaucu

SEQ ID NO: 1110106 - RNA, 21 nt, Homo sapiens
uuccuuuuaaaacacuuccau

SEQ ID NO: 1110107 - RNA, 15 nt, Homo sapiens
uucgaaugacacugu

SEQ ID NO: 1110108 - RNA, 16 nt, Homo sapiens
uucgauggcauccugc

SEQ ID NO: 1110109 - RNA, 19 nt, Homo sapiens
uucuaaagcucugaacaaa

SEQ ID NO: 1110110 - RNA, 22 nt, Homo sapiens
uucuaagugguauauacauaug

SEQ ID NO: 1110111 - RNA, 16 nt, Homo sapiens
uucuaauuggcaugaa

SEQ ID NO: 1110112 - RNA, 13 nt, Homo sapiens
uucuacacaguaa

SEQ ID NO: 1110113 - RNA, 14 nt, Homo sapiens
uucuacagcagaua

SEQ ID NO: 1110114 - RNA, 22 nt, Homo sapiens
uucuagucuccuuugcacugag

SEQ ID NO: 1110115 - RNA, 20 nt, Homo sapiens
uucuauugaaaaaucaccac

SEQ ID NO: 1110116 - RNA, 17 nt, Homo sapiens
uucucacacuauggcag

SEQ ID NO: 1110117 - RNA, 16 nt, Homo sapiens
uucucacacuggugga

SEQ ID NO: 1110118 - RNA, 23 nt, Homo sapiens
uucucaguaaauauuaaccugaa

SEQ ID NO: 1110119 - RNA, 16 nt, Homo sapiens
uucucaucauauugua

SEQ ID NO: 1110120 - RNA, 14 nt, Homo sapiens
uucucaugugaucc

SEQ ID NO: 1110121 - RNA, 23 nt, Homo sapiens
uucuccaccaacuggagcacuga

SEQ ID NO: 1110122 - RNA, 21 nt, Homo sapiens
uucuccaccugaagugaugau

SEQ ID NO: 1110123 - RNA, 17 nt, Homo sapiens
uucucucuuaguaacau

SEQ ID NO: 1110124 - RNA, 18 nt, Homo sapiens
uucucucuuauuccacuu

SEQ ID NO: 1110125 - RNA, 14 nt, Homo sapiens
uucucugaaggaca

SEQ ID NO: 1110126 - RNA, 13 nt, Homo sapiens
uucugacaucagc

SEQ ID NO: 1110127 - RNA, 19 nt, Homo sapiens
uucugcuccucuccaggca

SEQ ID NO: 1110128 - RNA, 18 nt, Homo sapiens
uucuggaggaagaagaca

SEQ ID NO: 1110129 - RNA, 19 nt, Homo sapiens
uucuggcgcaagagaacau

SEQ ID NO: 1110130 - RNA, 16 nt, Homo sapiens
uucugggaacuuccuc

SEQ ID NO: 1110131 - RNA, 18 nt, Homo sapiens
uucugggaacuuccucag

SEQ ID NO: 1110132 - RNA, 16 nt, Homo sapiens
uucuguccaaggcaca

SEQ ID NO: 1110133 - RNA, 13 nt, Homo sapiens
uucuguugccaca

SEQ ID NO: 1110134 - RNA, 22 nt, Homo sapiens
uucuguuucuauucucuccuca

SEQ ID NO: 1110135 - RNA, 17 nt, Homo sapiens
uucuuaaagaguucuua

SEQ ID NO: 1110136 - RNA, 15 nt, Homo sapiens
uucuuaaauaagaaa

SEQ ID NO: 1110137 - RNA, 13 nt, Homo sapiens
uucuuaacuauuc

SEQ ID NO: 1110138 - RNA, 14 nt, Homo sapiens
uucuuaauaggcuu

SEQ ID NO: 1110139 - RNA, 19 nt, Homo sapiens
uucuuaaugcuuuccuccc

SEQ ID NO: 1110140 - RNA, 22 nt, Homo sapiens
uucuuacaauaauucuaugaga

SEQ ID NO: 1110141 - RNA, 19 nt, Homo sapiens
uucuuacuucccuaaugaa

SEQ ID NO: 1110142 - RNA, 14 nt, Homo sapiens
uucuuagugucacu

SEQ ID NO: 1110143 - RNA, 21 nt, Homo sapiens
uucuucuaaugagucgacuuu

SEQ ID NO: 1110144 - RNA, 13 nt, Homo sapiens
uucuucuuuaggc

SEQ ID NO: 1110145 - RNA, 17 nt, Homo sapiens
uucuugcagucaucaga

SEQ ID NO: 1110146 - RNA, 20 nt, Homo sapiens
uucuuguauauuauggaaga

SEQ ID NO: 1110147 - RNA, 13 nt, Homo sapiens
uucuuguugcaaa

SEQ ID NO: 1110148 - RNA, 13 nt, Homo sapiens
uucuuugaaguuu

SEQ ID NO: 1110149 - RNA, 14 nt, Homo sapiens
uucuuuuacuguaa

SEQ ID NO: 1110150 - RNA, 15 nt, Homo sapiens
uucuuuuuuuaugac

SEQ ID NO: 1110151 - RNA, 12 nt, Homo sapiens
uugaaaaccugg

SEQ ID NO: 1110152 - RNA, 17 nt, Homo sapiens
uugaaaagauagggaag

SEQ ID NO: 1110153 - RNA, 21 nt, Homo sapiens
uugaaagugaauaaacuucag

SEQ ID NO: 1110154 - RNA, 15 nt, Homo sapiens
uugaacccaggagau

SEQ ID NO: 1110155 - RNA, 15 nt, Homo sapiens
uugaacugguuguga

SEQ ID NO: 1110156 - RNA, 18 nt, Homo sapiens
uugaacugguugugaaua

SEQ ID NO: 1110157 - RNA, 20 nt, Homo sapiens
uugaaggagaaaaugcauua

SEQ ID NO: 1110158 - RNA, 21 nt, Homo sapiens
uugaaggagaaaaugcauuau

SEQ ID NO: 1110159 - RNA, 20 nt, Homo sapiens
uugaagggcaggugcuucag

SEQ ID NO: 1110160 - RNA, 21 nt, Homo sapiens
uugaaguuuuagcggucaauu

SEQ ID NO: 1110161 - RNA, 19 nt, Homo sapiens
uugaaucccuuaaacucag

SEQ ID NO: 1110162 - RNA, 20 nt, Homo sapiens
uugaaugaguuuauauggaa

SEQ ID NO: 1110163 - RNA, 18 nt, Homo sapiens
uugaaugcggaaccauag

SEQ ID NO: 1110164 - RNA, 15 nt, Homo sapiens
uugacaauaauuuca

SEQ ID NO: 1110165 - RNA, 13 nt, Homo sapiens
uugacacacagca

SEQ ID NO: 1110166 - RNA, 16 nt, Homo sapiens
uugacagaacacuguc

SEQ ID NO: 1110167 - RNA, 17 nt, Homo sapiens
uugacaggaauacuuaa

SEQ ID NO: 1110168 - RNA, 14 nt, Homo sapiens
uugacauaacacua

SEQ ID NO: 1110169 - RNA, 12 nt, Homo sapiens
uugaccucaggu

SEQ ID NO: 1110170 - RNA, 13 nt, Homo sapiens
uugacuaucacau

SEQ ID NO: 1110171 - RNA, 16 nt, Homo sapiens
uugacugagacuggaa

SEQ ID NO: 1110172 - RNA, 18 nt, Homo sapiens
uugagaauacacuaucaa

SEQ ID NO: 1110173 - RNA, 20 nt, Homo sapiens
uugagaauaugaucauguaa

SEQ ID NO: 1110174 - RNA, 13 nt, Homo sapiens
uugagagggauuu

SEQ ID NO: 1110175 - RNA, 23 nt, Homo sapiens
uugagcuccccaaaaaccucacc

SEQ ID NO: 1110176 - RNA, 22 nt, Homo sapiens
accaugagaccacuguuaucaa

SEQ ID NO: 1110177 - RNA, 15 nt, Homo sapiens
accaugcgcugcuca

SEQ ID NO: 1110178 - RNA, 13 nt, Homo sapiens
accauguacauga

SEQ ID NO: 1110179 - RNA, 20 nt, Homo sapiens
accauguacaugaagaagcu

SEQ ID NO: 1110180 - RNA, 19 nt, Homo sapiens
accauuuugggguacccac

SEQ ID NO: 1110181 - RNA, 21 nt, Homo sapiens
accauuuugggguacccacug

SEQ ID NO: 1110182 - RNA, 13 nt, Homo sapiens
acccacuccucac

SEQ ID NO: 1110183 - RNA, 18 nt, Homo sapiens
acccacugugcuuacagu

SEQ ID NO: 1110184 - RNA, 19 nt, Homo sapiens
acccagaaaucauuuuacc

SEQ ID NO: 1110185 - RNA, 23 nt, Homo sapiens
  misc_feature (7)..(7): n is a, c, g or u
acccagnagggcgucgcuggaca

SEQ ID NO: 1110186 - RNA, 22 nt, Homo sapiens
acccaguguaaagaauaaauga

SEQ ID NO: 1110187 - RNA, 22 nt, Homo sapiens
acccaugaaucaaagacaugga

SEQ ID NO: 1110188 - RNA, 13 nt, Homo sapiens
accccaccacuuc

SEQ ID NO: 1110189 - RNA, 13 nt, Homo sapiens
accccaccuugcc

SEQ ID NO: 1110190 - RNA, 17 nt, Homo sapiens
accccaccuugccaagc

SEQ ID NO: 1110191 - RNA, 19 nt, Homo sapiens
acccccguguccaccguga

SEQ ID NO: 1110192 - RNA, 22 nt, Homo sapiens
accccgaccaccugcccaaccu

SEQ ID NO: 1110193 - RNA, 15 nt, Homo sapiens
accccugcuaaggag

SEQ ID NO: 1110194 - RNA, 20 nt, Homo sapiens
accccuggccucaagcaauc

SEQ ID NO: 1110195 - RNA, 14 nt, Homo sapiens
acccgacugugaaa

SEQ ID NO: 1110196 - RNA, 16 nt, Homo sapiens
acccuaaaacaugugu

SEQ ID NO: 1110197 - RNA, 17 nt, Homo sapiens
acccugagguccugcau

SEQ ID NO: 1110198 - RNA, 21 nt, Homo sapiens
acccugcagagcacacaggua

SEQ ID NO: 1110199 - RNA, 19 nt, Homo sapiens
acccuguagguucuugaua

SEQ ID NO: 1110200 - RNA, 18 nt, Homo sapiens
acccuguuuucagcuaaa

SEQ ID NO: 1110201 - RNA, 22 nt, Homo sapiens
acccuuccuacagauagucaaa

SEQ ID NO: 1110202 - RNA, 19 nt, Homo sapiens
accgagagagauggaauaa

SEQ ID NO: 1110203 - RNA, 15 nt, Homo sapiens
accgggcugggagcu

SEQ ID NO: 1110204 - RNA, 14 nt, Homo sapiens
accguggaccuucc

SEQ ID NO: 1110205 - RNA, 17 nt, Homo sapiens
accguggcccuuccugg

SEQ ID NO: 1110206 - RNA, 23 nt, Homo sapiens
accguuuuucaagaaaacuggaa

SEQ ID NO: 1110207 - RNA, 12 nt, Homo sapiens
accuaagcaaca

SEQ ID NO: 1110208 - RNA, 15 nt, Homo sapiens
accuaccacaguguc

SEQ ID NO: 1110209 - RNA, 20 nt, Homo sapiens
accuaccaccccuuccuguc

SEQ ID NO: 1110210 - RNA, 17 nt, Homo sapiens
accuacugacugaugac

SEQ ID NO: 1110211 - RNA, 19 nt, Homo sapiens
accuacuuuucuuuccuca

SEQ ID NO: 1110212 - RNA, 15 nt, Homo sapiens
accucaagcugcauc

SEQ ID NO: 1110213 - RNA, 19 nt, Homo sapiens
accucagccucccaaagug

SEQ ID NO: 1110214 - RNA, 22 nt, Homo sapiens
accucagugucauuuaugaaaa

SEQ ID NO: 1110215 - RNA, 14 nt, Homo sapiens
accucauaugcuau

SEQ ID NO: 1110216 - RNA, 15 nt, Homo sapiens
accucaucucuacua

SEQ ID NO: 1110217 - RNA, 16 nt, Homo sapiens
accucaucucuacuaa

SEQ ID NO: 1110218 - RNA, 18 nt, Homo sapiens
accucauuccugggacua

SEQ ID NO: 1110219 - RNA, 16 nt, Homo sapiens
accuccagaggugaug

SEQ ID NO: 1110220 - RNA, 18 nt, Homo sapiens
accuccagcuuuccugua

SEQ ID NO: 1110221 - RNA, 16 nt, Homo sapiens
accuccuggaaggcag

SEQ ID NO: 1110222 - RNA, 13 nt, Homo sapiens
accucuauauguu

SEQ ID NO: 1110223 - RNA, 13 nt, Homo sapiens
accugaaggugcu

SEQ ID NO: 1110224 - RNA, 13 nt, Homo sapiens
accugagaaccuu

SEQ ID NO: 1110225 - RNA, 17 nt, Homo sapiens
accuggcuuggcuuuaa

SEQ ID NO: 1110226 - RNA, 22 nt, Homo sapiens
accugugacuaaacaacuaccu

SEQ ID NO: 1110227 - RNA, 17 nt, Homo sapiens
accugugcaccccauga

SEQ ID NO: 1110228 - RNA, 21 nt, Homo sapiens
accuguguuucaagcuaccuu

SEQ ID NO: 1110229 - RNA, 22 nt, Homo sapiens
accuguucuuccuaccaaauau

SEQ ID NO: 1110230 - RNA, 15 nt, Homo sapiens
accuuaccagauuuu

SEQ ID NO: 1110231 - RNA, 19 nt, Homo sapiens
accuuagauuagcucugga

SEQ ID NO: 1110232 - RNA, 17 nt, Homo sapiens
accuuauuguaccucuc

SEQ ID NO: 1110233 - RNA, 17 nt, Homo sapiens
accuucaagcacccugu

SEQ ID NO: 1110234 - RNA, 15 nt, Homo sapiens
accuucaauuccugg

SEQ ID NO: 1110235 - RNA, 14 nt, Homo sapiens
accuucaugucacu

SEQ ID NO: 1110236 - RNA, 20 nt, Homo sapiens
accuucaugucacugcucuu

SEQ ID NO: 1110237 - RNA, 15 nt, Homo sapiens
accuuggacuccucc

SEQ ID NO: 1110238 - RNA, 17 nt, Homo sapiens
accuuucaaauuucaca

SEQ ID NO: 1110239 - RNA, 14 nt, Homo sapiens
accuuucugaguga

SEQ ID NO: 1110240 - RNA, 17 nt, Homo sapiens
accuuuggaugcacuuu

SEQ ID NO: 1110241 - RNA, 19 nt, Homo sapiens
acgaacaggggccaaacug

SEQ ID NO: 1110242 - RNA, 15 nt, Homo sapiens
acgaacccaccugcu

SEQ ID NO: 1110243 - RNA, 14 nt, Homo sapiens
acgaaucagacuca

SEQ ID NO: 1110244 - RNA, 13 nt, Homo sapiens
acgaauugagaua

SEQ ID NO: 1110245 - RNA, 22 nt, Homo sapiens
acgacaaagccaaacucugcca

SEQ ID NO: 1110246 - RNA, 22 nt, Homo sapiens
acgcagccugcagacucacugu

SEQ ID NO: 1110247 - RNA, 11 nt, Homo sapiens
acgccacugca

SEQ ID NO: 1110248 - RNA, 19 nt, Homo sapiens
acgcccagccuccucccac

SEQ ID NO: 1110249 - RNA, 17 nt, Homo sapiens
acgccuguaaucccagc

SEQ ID NO: 1110250 - RNA, 18 nt, Homo sapiens
acgccuguaaucccagca

SEQ ID NO: 1110251 - RNA, 20 nt, Homo sapiens
acggaauaaugaguuagaac

SEQ ID NO: 1110252 - RNA, 14 nt, Homo sapiens
acggcucacugcag

SEQ ID NO: 1110253 - RNA, 17 nt, Homo sapiens
acggugaaccgcaugga

SEQ ID NO: 1110254 - RNA, 14 nt, Homo sapiens
acgucaagucuccu

SEQ ID NO: 1110255 - RNA, 15 nt, Homo sapiens
acgugugcagacugu

SEQ ID NO: 1110256 - RNA, 20 nt, Homo sapiens
acguguguguguuucaucug

SEQ ID NO: 1110257 - RNA, 17 nt, Homo sapiens
acguuaaguccaaggag

SEQ ID NO: 1110258 - RNA, 20 nt, Homo sapiens
acguuggccuaacacugggc

SEQ ID NO: 1110259 - RNA, 13 nt, Homo sapiens
acguuuaagccaa

SEQ ID NO: 1110260 - RNA, 13 nt, Homo sapiens
acuaaaaagccau

SEQ ID NO: 1110261 - RNA, 14 nt, Homo sapiens
acuaaaaaucauga

SEQ ID NO: 1110262 - RNA, 12 nt, Homo sapiens
acuaaaagaauu

SEQ ID NO: 1110263 - RNA, 14 nt, Homo sapiens
acuaaaagaauuug

SEQ ID NO: 1110264 - RNA, 15 nt, Homo sapiens
acuaagaaauaugca

SEQ ID NO: 1110265 - RNA, 15 nt, Homo sapiens
acaacuaccuccuca

SEQ ID NO: 1110266 - RNA, 12 nt, Homo sapiens
acaacugugguc

SEQ ID NO: 1110267 - RNA, 17 nt, Homo sapiens
acaacuguggucaaucc

SEQ ID NO: 1110268 - RNA, 16 nt, Homo sapiens
acaacuuccacuccaa

SEQ ID NO: 1110269 - RNA, 22 nt, Homo sapiens
acaagagccauguaccagugua

SEQ ID NO: 1110270 - RNA, 17 nt, Homo sapiens
acaagauaacugagaau

SEQ ID NO: 1110271 - RNA, 20 nt, Homo sapiens
acaagccaacgacaaagcca

SEQ ID NO: 1110272 - RNA, 18 nt, Homo sapiens
acaaggcugaccaagaga

SEQ ID NO: 1110273 - RNA, 20 nt, Homo sapiens
acaagguucccucugagaau

SEQ ID NO: 1110274 - RNA, 16 nt, Homo sapiens
acaagugcacuugaac

SEQ ID NO: 1110275 - RNA, 18 nt, Homo sapiens
acaagugcgccuugcaaa

SEQ ID NO: 1110276 - RNA, 16 nt, Homo sapiens
acaauaaaacauuccu

SEQ ID NO: 1110277 - RNA, 21 nt, Homo sapiens
acaauaaauauucugcaugga

SEQ ID NO: 1110278 - RNA, 16 nt, Homo sapiens
acaauaauucuaugag

SEQ ID NO: 1110279 - RNA, 23 nt, Homo sapiens
acaauacgugaaagaugcaagca

SEQ ID NO: 1110280 - RNA, 18 nt, Homo sapiens
acaauagugauugauaga

SEQ ID NO: 1110281 - RNA, 16 nt, Homo sapiens
acaaugaaaugcucuc

SEQ ID NO: 1110282 - RNA, 17 nt, Homo sapiens
acaauggcuuacuccag

SEQ ID NO: 1110283 - RNA, 11 nt, Homo sapiens
acaauucacuu

SEQ ID NO: 1110284 - RNA, 23 nt, Homo sapiens
acaauuugagcaauucauuucac

SEQ ID NO: 1110285 - RNA, 24 nt, Homo sapiens
acaauuugagcaauucauuucacu

SEQ ID NO: 1110286 - RNA, 15 nt, Homo sapiens
acacaaaaugucaca

SEQ ID NO: 1110287 - RNA, 15 nt, Homo sapiens
acacaaauuuguaaa

SEQ ID NO: 1110288 - RNA, 13 nt, Homo sapiens
acacaaggcacgu

SEQ ID NO: 1110289 - RNA, 12 nt, Homo sapiens
acacaaggucau

SEQ ID NO: 1110290 - RNA, 23 nt, Homo sapiens
acacacccauagugcacacuugu

SEQ ID NO: 1110291 - RNA, 15 nt, Homo sapiens
acacagacugcgauu

SEQ ID NO: 1110292 - RNA, 18 nt, Homo sapiens
acacaggcaaaauccuug

SEQ ID NO: 1110293 - RNA, 15 nt, Homo sapiens
acacauacauugcca

SEQ ID NO: 1110294 - RNA, 17 nt, Homo sapiens
acacaugacacucuucu

SEQ ID NO: 1110295 - RNA, 18 nt, Homo sapiens
acacauuacuugcacaag

SEQ ID NO: 1110296 - RNA, 21 nt, Homo sapiens
acacauucuuaacacaugucc

SEQ ID NO: 1110297 - RNA, 13 nt, Homo sapiens
acaccacgaauuu

SEQ ID NO: 1110298 - RNA, 16 nt, Homo sapiens
acaccacuuugucucu

SEQ ID NO: 1110299 - RNA, 16 nt, Homo sapiens
acaccagguagaacac

SEQ ID NO: 1110300 - RNA, 11 nt, Homo sapiens
acaccaucucc

SEQ ID NO: 1110301 - RNA, 13 nt, Homo sapiens
acaccucccugaa

SEQ ID NO: 1110302 - RNA, 20 nt, Homo sapiens
acaccucuccuuugugacuu

SEQ ID NO: 1110303 - RNA, 15 nt, Homo sapiens
acaccuugacagggc

SEQ ID NO: 1110304 - RNA, 19 nt, Homo sapiens
acaccuugacagggcacac

SEQ ID NO: 1110305 - RNA, 15 nt, Homo sapiens
acacggggcaguggc

SEQ ID NO: 1110306 - RNA, 17 nt, Homo sapiens
acacguaccucucauca

SEQ ID NO: 1110307 - RNA, 15 nt, Homo sapiens
acacguguccuguag

SEQ ID NO: 1110308 - RNA, 14 nt, Homo sapiens
acacuaacauauaa

SEQ ID NO: 1110309 - RNA, 15 nt, Homo sapiens
acacuaauacaccag

SEQ ID NO: 1110310 - RNA, 16 nt, Homo sapiens
acacuaccuuaucagg

SEQ ID NO: 1110311 - RNA, 20 nt, Homo sapiens
acacuauuuaucugugcaaa

SEQ ID NO: 1110312 - RNA, 20 nt, Homo sapiens
acacugagcaagaucuuguc

SEQ ID NO: 1110313 - RNA, 21 nt, Homo sapiens
acacuguaaucuuaaaagugu

SEQ ID NO: 1110314 - RNA, 12 nt, Homo sapiens
acacuguacaag

SEQ ID NO: 1110315 - RNA, 15 nt, Homo sapiens
acacugucuugaaga

SEQ ID NO: 1110316 - RNA, 16 nt, Homo sapiens
acacuuaugggccaag

SEQ ID NO: 1110317 - RNA, 20 nt, Homo sapiens
acacuucuaaaugaagugca

SEQ ID NO: 1110318 - RNA, 18 nt, Homo sapiens
acacuucucaggacacag

SEQ ID NO: 1110319 - RNA, 16 nt, Homo sapiens
acagaaauacaugaaa

SEQ ID NO: 1110320 - RNA, 16 nt, Homo sapiens
acagaagccaggagca

SEQ ID NO: 1110321 - RNA, 16 nt, Homo sapiens
acagaaggaugaauga

SEQ ID NO: 1110322 - RNA, 15 nt, Homo sapiens
acagaaggauguccc

SEQ ID NO: 1110323 - RNA, 13 nt, Homo sapiens
acagaaggggugg

SEQ ID NO: 1110324 - RNA, 18 nt, Homo sapiens
acagaagucuugucucaa

SEQ ID NO: 1110325 - RNA, 19 nt, Homo sapiens
acagacagggccuagcuuu

SEQ ID NO: 1110326 - RNA, 20 nt, Homo sapiens
acagaccuaggauuucauga

SEQ ID NO: 1110327 - RNA, 17 nt, Homo sapiens
acagacuacagccagaa

SEQ ID NO: 1110328 - RNA, 16 nt, Homo sapiens
acagagaaaagacaua

SEQ ID NO: 1110329 - RNA, 20 nt, Homo sapiens
acagagcaagacucugucuc

SEQ ID NO: 1110330 - RNA, 20 nt, Homo sapiens
acagagcgagauuccgucuu

SEQ ID NO: 1110331 - RNA, 20 nt, Homo sapiens
acagagugagacucugucuc

SEQ ID NO: 1110332 - RNA, 13 nt, Homo sapiens
acagauagucaaa

SEQ ID NO: 1110333 - RNA, 14 nt, Homo sapiens
acagauagucaaac

SEQ ID NO: 1110334 - RNA, 17 nt, Homo sapiens
acagauagucaaaccau

SEQ ID NO: 1110335 - RNA, 13 nt, Homo sapiens
acagaucauuuca

SEQ ID NO: 1110336 - RNA, 17 nt, Homo sapiens
acagaugcccccgugaa

SEQ ID NO: 1110337 - RNA, 20 nt, Homo sapiens
acagauggauagucugucca

SEQ ID NO: 1110338 - RNA, 18 nt, Homo sapiens
acagcaaaacuccaucuc

SEQ ID NO: 1110339 - RNA, 14 nt, Homo sapiens
acagcaaaagaaga

SEQ ID NO: 1110340 - RNA, 18 nt, Homo sapiens
acagcagcugaacagcca

SEQ ID NO: 1110341 - RNA, 20 nt, Homo sapiens
acagcagcugaacagccaaa

SEQ ID NO: 1110342 - RNA, 19 nt, Homo sapiens
acagccaggcggcuggaau

SEQ ID NO: 1110343 - RNA, 15 nt, Homo sapiens
acagcccagacuuua

SEQ ID NO: 1110344 - RNA, 20 nt, Homo sapiens
acagccgcuccugucugcca

SEQ ID NO: 1110345 - RNA, 21 nt, Homo sapiens
acagccuauaaccagacacau

SEQ ID NO: 1110346 - RNA, 14 nt, Homo sapiens
acagcuaugaaggc

SEQ ID NO: 1110347 - RNA, 20 nt, Homo sapiens
acagcuaugaaggcuguaca

SEQ ID NO: 1110348 - RNA, 16 nt, Homo sapiens
acagcuccuucugucc

SEQ ID NO: 1110349 - RNA, 17 nt, Homo sapiens
acagcucuguguuucug

SEQ ID NO: 1110350 - RNA, 17 nt, Homo sapiens
acagcuuaacauuuaca

SEQ ID NO: 1110351 - RNA, 19 nt, Homo sapiens
acaggaauacuuaacucaa

SEQ ID NO: 1110352 - RNA, 23 nt, Homo sapiens
acaggcaaugcuggcuguuggcu

SEQ ID NO: 1110353 - RNA, 13 nt, Homo sapiens
acaggcacccacc

SEQ ID NO: 1110354 - RNA, 15 nt, Homo sapiens
acaggccauacuuua

SEQ ID NO: 1110355 - RNA, 19 nt, Homo sapiens
acaggcccggcuccaggcu

SEQ ID NO: 1110356 - RNA, 15 nt, Homo sapiens
acaggggaucaaagu

SEQ ID NO: 1110357 - RNA, 14 nt, Homo sapiens
acaggucaacuuca

SEQ ID NO: 1110358 - RNA, 18 nt, Homo sapiens
acagguccucaguguccu

SEQ ID NO: 1110359 - RNA, 12 nt, Homo sapiens
acagguguaaau

SEQ ID NO: 1110360 - RNA, 15 nt, Homo sapiens
acaguccugggagaa

SEQ ID NO: 1110361 - RNA, 17 nt, Homo sapiens
acagugcccagcuaauu

SEQ ID NO: 1110362 - RNA, 20 nt, Homo sapiens
acagugccuggcaaggccuc

SEQ ID NO: 1110363 - RNA, 19 nt, Homo sapiens
acaguguauguacuaagca

SEQ ID NO: 1110364 - RNA, 20 nt, Homo sapiens
acaguuccuucagcuuccau

SEQ ID NO: 1110365 - RNA, 13 nt, Homo sapiens
acaguugccaugu

SEQ ID NO: 1110366 - RNA, 21 nt, Homo sapiens
acauaaauuuaucaucucgac

SEQ ID NO: 1110367 - RNA, 15 nt, Homo sapiens
acauaaugaaugcua

SEQ ID NO: 1110368 - RNA, 21 nt, Homo sapiens
acauacaauuugcacuguuac

SEQ ID NO: 1110369 - RNA, 12 nt, Homo sapiens
acauagcacaga

SEQ ID NO: 1110370 - RNA, 16 nt, Homo sapiens
acauauauaugucagg

SEQ ID NO: 1110371 - RNA, 13 nt, Homo sapiens
acauaucugucau

SEQ ID NO: 1110372 - RNA, 16 nt, Homo sapiens
acauaugcauuaugaa

SEQ ID NO: 1110373 - RNA, 16 nt, Homo sapiens
acauauggacucugca

SEQ ID NO: 1110374 - RNA, 23 nt, Homo sapiens
acauauucuuuaaauuucaucuc

SEQ ID NO: 1110375 - RNA, 15 nt, Homo sapiens
acauauuuguuaaau

SEQ ID NO: 1110376 - RNA, 21 nt, Homo sapiens
acauccguugugcuugccugc

SEQ ID NO: 1110377 - RNA, 15 nt, Homo sapiens
acaucuaagccuguu

SEQ ID NO: 1110378 - RNA, 19 nt, Homo sapiens
acaucuauuauaaaaccau

SEQ ID NO: 1110379 - RNA, 18 nt, Homo sapiens
acaugaacagaaacaaua

SEQ ID NO: 1110380 - RNA, 15 nt, Homo sapiens
acaugacucagcaua

SEQ ID NO: 1110381 - RNA, 15 nt, Homo sapiens
acaugauccugaguu

SEQ ID NO: 1110382 - RNA, 22 nt, Homo sapiens
acaugauggagcgcaccugccc

SEQ ID NO: 1110383 - RNA, 19 nt, Homo sapiens
acaugcacuuggcugcaua

SEQ ID NO: 1110384 - RNA, 15 nt, Homo sapiens
acaugcgaccgugac

SEQ ID NO: 1110385 - RNA, 20 nt, Homo sapiens
acaugcgaccgugaccagga

SEQ ID NO: 1110386 - RNA, 17 nt, Homo sapiens
acauggccuaugcacau

SEQ ID NO: 1110387 - RNA, 19 nt, Homo sapiens
acauggccuaugcacauau

SEQ ID NO: 1110388 - RNA, 17 nt, Homo sapiens
acauggugaaacccugu

SEQ ID NO: 1110389 - RNA, 20 nt, Homo sapiens
acauggugaaaccucaucuc

SEQ ID NO: 1110390 - RNA, 13 nt, Homo sapiens
acaugugcacaug

SEQ ID NO: 1110391 - RNA, 10 nt, Homo sapiens
acaugugcuu

SEQ ID NO: 1110392 - RNA, 13 nt, Homo sapiens
acaugugguggga

SEQ ID NO: 1110393 - RNA, 23 nt, Homo sapiens
acauuauagauuuucauguucuu

SEQ ID NO: 1110394 - RNA, 15 nt, Homo sapiens
acauuaucaucugaa

SEQ ID NO: 1110395 - RNA, 22 nt, Homo sapiens
acauuaucgggagcagugucuu

SEQ ID NO: 1110396 - RNA, 14 nt, Homo sapiens
acauuaugccuuaa

SEQ ID NO: 1110397 - RNA, 23 nt, Homo sapiens
acauucccuggccuggcucuccu

SEQ ID NO: 1110398 - RNA, 19 nt, Homo sapiens
acauugaaagagaaccagu

SEQ ID NO: 1110399 - RNA, 15 nt, Homo sapiens
acauuggcagugugu

SEQ ID NO: 1110400 - RNA, 23 nt, Homo sapiens
acauuggcagugugucacacuga

SEQ ID NO: 1110401 - RNA, 12 nt, Homo sapiens
acauugugccuu

SEQ ID NO: 1110402 - RNA, 16 nt, Homo sapiens
acauuuccaaaugaau

SEQ ID NO: 1110403 - RNA, 23 nt, Homo sapiens
acauuugaguauccgauucgcca

SEQ ID NO: 1110404 - RNA, 21 nt, Homo sapiens
acauuugauuauauacuaugu

SEQ ID NO: 1110405 - RNA, 15 nt, Homo sapiens
acauuuugcauuaga

SEQ ID NO: 1110406 - RNA, 13 nt, Homo sapiens
accaaaaagggau

SEQ ID NO: 1110407 - RNA, 23 nt, Homo sapiens
accaaagagacuggagcaucuga

SEQ ID NO: 1110408 - RNA, 16 nt, Homo sapiens
accaaaugacaaguca

SEQ ID NO: 1110409 - RNA, 19 nt, Homo sapiens
accaacaguuccuucagcu

SEQ ID NO: 1110410 - RNA, 21 nt, Homo sapiens
accaacccuguuuccugaguu

SEQ ID NO: 1110411 - RNA, 15 nt, Homo sapiens
accaagacucugaaa

SEQ ID NO: 1110412 - RNA, 16 nt, Homo sapiens
accaagaguauuccau

SEQ ID NO: 1110413 - RNA, 19 nt, Homo sapiens
accaagaugaucacaugga

SEQ ID NO: 1110414 - RNA, 21 nt, Homo sapiens
accaaggcgggagcaucucuu

SEQ ID NO: 1110415 - RNA, 13 nt, Homo sapiens
accaaggucuuca

SEQ ID NO: 1110416 - RNA, 15 nt, Homo sapiens
accaaguggcuccca

SEQ ID NO: 1110417 - RNA, 13 nt, Homo sapiens
accaauaccuccu

SEQ ID NO: 1110418 - RNA, 11 nt, Homo sapiens
accacagcagc

SEQ ID NO: 1110419 - RNA, 16 nt, Homo sapiens
accacaggcugccuca

SEQ ID NO: 1110420 - RNA, 15 nt, Homo sapiens
accaccugcuucuga

SEQ ID NO: 1110421 - RNA, 14 nt, Homo sapiens
accacuauucuuaa

SEQ ID NO: 1110422 - RNA, 20 nt, Homo sapiens
accacuauucuuaacuauuc

SEQ ID NO: 1110423 - RNA, 23 nt, Homo sapiens
accacuuuucaguucaguggcau

SEQ ID NO: 1110424 - RNA, 16 nt, Homo sapiens
accagaccacucugcu

SEQ ID NO: 1110425 - RNA, 16 nt, Homo sapiens
accagaggucaggugu

SEQ ID NO: 1110426 - RNA, 17 nt, Homo sapiens
accagagucaaauuuga

SEQ ID NO: 1110427 - RNA, 14 nt, Homo sapiens
accagcugccaaaa

SEQ ID NO: 1110428 - RNA, 21 nt, Homo sapiens
accagcuuguccaacaacucc

SEQ ID NO: 1110429 - RNA, 22 nt, Homo sapiens
accagguagaacacaaggucau

SEQ ID NO: 1110430 - RNA, 15 nt, Homo sapiens
accaggucaucuccu

SEQ ID NO: 1110431 - RNA, 23 nt, Homo sapiens
accagugaaccaaagagacugga

SEQ ID NO: 1110432 - RNA, 17 nt, Homo sapiens
accaguugggagcacug

SEQ ID NO: 1110433 - RNA, 19 nt, Homo sapiens
accaguugggagcacugga

SEQ ID NO: 1110434 - RNA, 16 nt, Homo sapiens
accauaacaacuucau

SEQ ID NO: 1110435 - RNA, 13 nt, Homo sapiens
accauaacagcca

SEQ ID NO: 1110436 - RNA, 14 nt, Homo sapiens
accauaacagccaa

SEQ ID NO: 1110437 - RNA, 17 nt, Homo sapiens
accauauacagcucaga

SEQ ID NO: 1110438 - RNA, 22 nt, Homo sapiens
accaucauuauaaacgugauga

SEQ ID NO: 1110439 - RNA, 11 nt, Homo sapiens
accaucugucu

SEQ ID NO: 1110440 - RNA, 14 nt, Homo sapiens
accaucugucuugc

SEQ ID NO: 1110441 - RNA, 11 nt, Homo sapiens
accaugaagcu

SEQ ID NO: 1110442 - RNA, 19 nt, Homo sapiens
accaugagaccacuguuau

SEQ ID NO: 1110443 - RNA, 22 nt, Homo sapiens
aggaaucggaauccugucgauu

SEQ ID NO: 1110444 - RNA, 12 nt, Homo sapiens
aggaaucucaga

SEQ ID NO: 1110445 - RNA, 17 nt, Homo sapiens
aggaauuugcauuuagu

SEQ ID NO: 1110446 - RNA, 18 nt, Homo sapiens
aggacagggaggugaccc

SEQ ID NO: 1110447 - RNA, 19 nt, Homo sapiens
aggaccaauguugugauua

SEQ ID NO: 1110448 - RNA, 19 nt, Homo sapiens
aggacccauagaugaacua

SEQ ID NO: 1110449 - RNA, 23 nt, Homo sapiens
aggacgccacucauuucaucuca

SEQ ID NO: 1110450 - RNA, 16 nt, Homo sapiens
aggacgugucucagga

SEQ ID NO: 1110451 - RNA, 15 nt, Homo sapiens
aggacuaacacucag

SEQ ID NO: 1110452 - RNA, 23 nt, Homo sapiens
aggacuagggcuuauccaugccu

SEQ ID NO: 1110453 - RNA, 12 nt, Homo sapiens
aggacuccuuaa

SEQ ID NO: 1110454 - RNA, 22 nt, Homo sapiens
aggacuuuaucuaauaccucug

SEQ ID NO: 1110455 - RNA, 21 nt, Homo sapiens
aggagaaggacauuuuacugc

SEQ ID NO: 1110456 - RNA, 12 nt, Homo sapiens
aggagaccaagg

SEQ ID NO: 1110457 - RNA, 19 nt, Homo sapiens
aggagaggggaagggccag

SEQ ID NO: 1110458 - RNA, 14 nt, Homo sapiens
aggagcaauuugca

SEQ ID NO: 1110459 - RNA, 14 nt, Homo sapiens
aggagcuuccagug

SEQ ID NO: 1110460 - RNA, 17 nt, Homo sapiens
aggagcuuccagugcau

SEQ ID NO: 1110461 - RNA, 18 nt, Homo sapiens
aggagcuuccagugcaug

SEQ ID NO: 1110462 - RNA, 15 nt, Homo sapiens
aggagcuugcaagaa

SEQ ID NO: 1110463 - RNA, 21 nt, Homo sapiens
aggaggacgguuaacuuguau

SEQ ID NO: 1110464 - RNA, 21 nt, Homo sapiens
gaacuauuagacaugaaaucu

SEQ ID NO: 1110465 - RNA, 15 nt, Homo sapiens
gaacuccaguacuca

SEQ ID NO: 1110466 - RNA, 19 nt, Homo sapiens
gaacuccaguacucaccca

SEQ ID NO: 1110467 - RNA, 16 nt, Homo sapiens
gaacucgaagcccuuc

SEQ ID NO: 1110468 - RNA, 23 nt, Homo sapiens
gaacucgaagcccuuccaguggu

SEQ ID NO: 1110469 - RNA, 19 nt, Homo sapiens
gaacuggaggaguuccuug

SEQ ID NO: 1110470 - RNA, 18 nt, Homo sapiens
gaacuugauauauuucau

SEQ ID NO: 1110471 - RNA, 14 nt, Homo sapiens
gaagaaaaccagcg

SEQ ID NO: 1110472 - RNA, 22 nt, Homo sapiens
gaagaaauggaaucagcuuuua

SEQ ID NO: 1110473 - RNA, 13 nt, Homo sapiens
gaagaacaguaac

SEQ ID NO: 1110474 - RNA, 17 nt, Homo sapiens
gaagaacauccaaggag

SEQ ID NO: 1110475 - RNA, 11 nt, Homo sapiens
gaagaacugac

SEQ ID NO: 1110476 - RNA, 14 nt, Homo sapiens
gaagaaggacauuu

SEQ ID NO: 1110477 - RNA, 17 nt, Homo sapiens
gaagaaucacaauaauu

SEQ ID NO: 1110478 - RNA, 22 nt, Homo sapiens
gaagacaacagcauaacuaaau

SEQ ID NO: 1110479 - RNA, 15 nt, Homo sapiens
gaagacacugcaaag

SEQ ID NO: 1110480 - RNA, 20 nt, Homo sapiens
gaagaccaagacacagauca

SEQ ID NO: 1110481 - RNA, 17 nt, Homo sapiens
gaagacccaguguaaag

SEQ ID NO: 1110482 - RNA, 20 nt, Homo sapiens
gaagaccuucugaagaucuc

SEQ ID NO: 1110483 - RNA, 17 nt, Homo sapiens
gaagacuauauuguaca

SEQ ID NO: 1110484 - RNA, 17 nt, Homo sapiens
gaagagagagacccuca

SEQ ID NO: 1110485 - RNA, 16 nt, Homo sapiens
gaagagagauauaucu

SEQ ID NO: 1110486 - RNA, 13 nt, Homo sapiens
gaagagcauugca

SEQ ID NO: 1110487 - RNA, 17 nt, Homo sapiens
gaagagccugacugugu

SEQ ID NO: 1110488 - RNA, 20 nt, Homo sapiens
gaagagccugacuguguuca

SEQ ID NO: 1110489 - RNA, 23 nt, Homo sapiens
gaagagggcgaguucagcaaaga

SEQ ID NO: 1110490 - RNA, 21 nt, Homo sapiens
gaagauucccucuuccugcca

SEQ ID NO: 1110491 - RNA, 17 nt, Homo sapiens
gaagcaaauaaauauca

SEQ ID NO: 1110492 - RNA, 17 nt, Homo sapiens
gaagcacagcagcaucu

SEQ ID NO: 1110493 - RNA, 12 nt, Homo sapiens
gaagcacagcuu

SEQ ID NO: 1110494 - RNA, 13 nt, Homo sapiens
gaagcagcugcuu

SEQ ID NO: 1110495 - RNA, 21 nt, Homo sapiens
gaagcaucacauaaaaaugau

SEQ ID NO: 1110496 - RNA, 17 nt, Homo sapiens
gaagcauuuacuuugug

SEQ ID NO: 1110497 - RNA, 18 nt, Homo sapiens
gaagcauuugauuuucaa

SEQ ID NO: 1110498 - RNA, 18 nt, Homo sapiens
gaagcccaugcuuuccca

SEQ ID NO: 1110499 - RNA, 23 nt, Homo sapiens
gaagcccuugccugaaagcaaga

SEQ ID NO: 1110500 - RNA, 19 nt, Homo sapiens
gaagccggccggcugggau

SEQ ID NO: 1110501 - RNA, 17 nt, Homo sapiens
gaagcucacccaauaaa

SEQ ID NO: 1110502 - RNA, 16 nt, Homo sapiens
gaagcuggaagcacug

SEQ ID NO: 1110503 - RNA, 12 nt, Homo sapiens
gaagcugugaaa

SEQ ID NO: 1110504 - RNA, 21 nt, Homo sapiens
gaagcuguguccuugcaccug

SEQ ID NO: 1110505 - RNA, 19 nt, Homo sapiens
gaaggaacucuggcuucca

SEQ ID NO: 1110506 - RNA, 15 nt, Homo sapiens
gaaggacacuuguau

SEQ ID NO: 1110507 - RNA, 22 nt, Homo sapiens
gaaggaggcuuaggacuuucca

SEQ ID NO: 1110508 - RNA, 17 nt, Homo sapiens
gaaggcccacugaggca

SEQ ID NO: 1110509 - RNA, 23 nt, Homo sapiens
gaaggguaccuugaacacugggg

SEQ ID NO: 1110510 - RNA, 14 nt, Homo sapiens
gaagguacaaacac

SEQ ID NO: 1110511 - RNA, 19 nt, Homo sapiens
gaagguagcccagcacugu

SEQ ID NO: 1110512 - RNA, 21 nt, Homo sapiens
gaaggucccaccuccauuugc

SEQ ID NO: 1110513 - RNA, 22 nt, Homo sapiens
gaaggucuugccugaauccauc

SEQ ID NO: 1110514 - RNA, 22 nt, Homo sapiens
gaaguauccaauuaugugacaa

SEQ ID NO: 1110515 - RNA, 15 nt, Homo sapiens
gaaguaugagggaaa

SEQ ID NO: 1110516 - RNA, 22 nt, Homo sapiens
gaaguaugagggaaaaugagua

SEQ ID NO: 1110517 - RNA, 20 nt, Homo sapiens
gaaguauuuuccuccaggca

SEQ ID NO: 1110518 - RNA, 14 nt, Homo sapiens
gaagucacacagua

SEQ ID NO: 1110519 - RNA, 16 nt, Homo sapiens
gaagucuuccauagag

SEQ ID NO: 1110520 - RNA, 15 nt, Homo sapiens
cagaggccauggcag

SEQ ID NO: 1110521 - RNA, 19 nt, Homo sapiens
cagaggcugcagaaggcca

SEQ ID NO: 1110522 - RNA, 15 nt, Homo sapiens
cagaggcuucuucag

SEQ ID NO: 1110523 - RNA, 23 nt, Homo sapiens
cagagggaaaguaaauauuucag

SEQ ID NO: 1110524 - RNA, 11 nt, Homo sapiens
cagagugugaa

SEQ ID NO: 1110525 - RNA, 24 nt, Homo sapiens
cagaguugcuuuaaaguaccugua

SEQ ID NO: 1110526 - RNA, 12 nt, Homo sapiens
cagauagcaucu

SEQ ID NO: 1110527 - RNA, 19 nt, Homo sapiens
cagauauuaaauaacagug

SEQ ID NO: 1110528 - RNA, 14 nt, Homo sapiens
cagauccucacaac

SEQ ID NO: 1110529 - RNA, 19 nt, Homo sapiens
cagauccucacaaccaccu

SEQ ID NO: 1110530 - RNA, 18 nt, Homo sapiens
cagaucuuuuugugaaau

SEQ ID NO: 1110531 - RNA, 20 nt, Homo sapiens
cagaugcaccccaacauuga

SEQ ID NO: 1110532 - RNA, 15 nt, Homo sapiens
cagauggguauuaaa

SEQ ID NO: 1110533 - RNA, 19 nt, Homo sapiens
cagauuuuuacacauguau

SEQ ID NO: 1110534 - RNA, 16 nt, Homo sapiens
cagcaaaagaagacaa

SEQ ID NO: 1110535 - RNA, 13 nt, Homo sapiens
cagcaacaggaau

SEQ ID NO: 1110536 - RNA, 21 nt, Homo sapiens
cagcaacuggugauuguuuca

SEQ ID NO: 1110537 - RNA, 20 nt, Homo sapiens
cagcaagacuucucuuugcc

SEQ ID NO: 1110538 - RNA, 23 nt, Homo sapiens
cagcaagacuucucuuugccuca

SEQ ID NO: 1110539 - RNA, 19 nt, Homo sapiens
cagcacucugaaacugaga

SEQ ID NO: 1110540 - RNA, 16 nt, Homo sapiens
cagcacuuguguuguc

SEQ ID NO: 1110541 - RNA, 20 nt, Homo sapiens
cagcagaaagguuaguauca

SEQ ID NO: 1110542 - RNA, 17 nt, Homo sapiens
cagcagccagcucucag

SEQ ID NO: 1110543 - RNA, 16 nt, Homo sapiens
cagcagcccuaaggau

SEQ ID NO: 1110544 - RNA, 12 nt, Homo sapiens
cagcagcucagc

SEQ ID NO: 1110545 - RNA, 21 nt, Homo sapiens
cagcagcucaggcacacuucu

SEQ ID NO: 1110546 - RNA, 17 nt, Homo sapiens
cagcagcugaacagcca

SEQ ID NO: 1110547 - RNA, 20 nt, Homo sapiens
cagcagguagugggugaaug

SEQ ID NO: 1110548 - RNA, 12 nt, Homo sapiens
cagccacacaga

SEQ ID NO: 1110549 - RNA, 22 nt, Homo sapiens
gaauugaaggagaaaaugcauu

SEQ ID NO: 1110550 - RNA, 21 nt, Homo sapiens
gaauugagauaauaucuguga

SEQ ID NO: 1110551 - RNA, 14 nt, Homo sapiens
gaauugcaugccau

SEQ ID NO: 1110552 - RNA, 15 nt, Homo sapiens
gaauuuaaaaucaua

SEQ ID NO: 1110553 - RNA, 19 nt, Homo sapiens
gaauuuuuuuuaacauucc

SEQ ID NO: 1110554 - RNA, 13 nt, Homo sapiens
gacaaaccagagc

SEQ ID NO: 1110555 - RNA, 15 nt, Homo sapiens
gacaacagguuuuca

SEQ ID NO: 1110556 - RNA, 23 nt, Homo sapiens
gacaauaaaacauuccugugaaa

SEQ ID NO: 1110557 - RNA, 23 nt, Homo sapiens
gacaaugaaaguuugcacuguau

SEQ ID NO: 1110558 - RNA, 20 nt, Homo sapiens
gacaauggcuuacuccagga

SEQ ID NO: 1110559 - RNA, 15 nt, Homo sapiens
gacacauaugcaccu

SEQ ID NO: 1110560 - RNA, 20 nt, Homo sapiens
gacaccucaaauacauaccu

SEQ ID NO: 1110561 - RNA, 13 nt, Homo sapiens
gacaccugugcac

SEQ ID NO: 1110562 - RNA, 20 nt, Homo sapiens
gacacuauuuaucugugcaa

SEQ ID NO: 1110563 - RNA, 13 nt, Homo sapiens
gacagaacacugu

SEQ ID NO: 1110564 - RNA, 17 nt, Homo sapiens
gacagaagaucuauauu

SEQ ID NO: 1110565 - RNA, 19 nt, Homo sapiens
gacagaagucuugucucaa

SEQ ID NO: 1110566 - RNA, 14 nt, Homo sapiens
gacagagucucacu

SEQ ID NO: 1110567 - RNA, 15 nt, Homo sapiens
gacagaucauuucag

SEQ ID NO: 1110568 - RNA, 22 nt, Homo sapiens
gacagcuuguggcaagugaauu

SEQ ID NO: 1110569 - RNA, 15 nt, Homo sapiens
gacaggaaaggcccu

SEQ ID NO: 1110570 - RNA, 16 nt, Homo sapiens
gacaggaaaggcccuc

SEQ ID NO: 1110571 - RNA, 16 nt, Homo sapiens
gacaggacuaacacuc

SEQ ID NO: 1110572 - RNA, 18 nt, Homo sapiens
gacaggacuaacacucag

SEQ ID NO: 1110573 - RNA, 19 nt, Homo sapiens
gacagggccuagcuuucau

SEQ ID NO: 1110574 - RNA, 15 nt, Homo sapiens
gacaguaguccccuc

SEQ ID NO: 1110575 - RNA, 21 nt, Homo sapiens
gacaugaaaucugaggaaggu

SEQ ID NO: 1110576 - RNA, 21 nt, Homo sapiens
gacaugcagcucugaugagag

SEQ ID NO: 1110577 - RNA, 16 nt, Homo sapiens
gacaugggugugccag

SEQ ID NO: 1110578 - RNA, 13 nt, Homo sapiens
gacauuaacucau

SEQ ID NO: 1110579 - RNA, 22 nt, Homo sapiens
gacauucaaggcauuucuauca

SEQ ID NO: 1110580 - RNA, 13 nt, Homo sapiens
gaccaauauucaa

SEQ ID NO: 1110581 - RNA, 22 nt, Homo sapiens
gaccaccucucaauauucaaua

SEQ ID NO: 1110582 - RNA, 17 nt, Homo sapiens
gaccacuguuaucaaaa

SEQ ID NO: 1110583 - RNA, 21 nt, Homo sapiens
gaccacuuuucaguucagugg

SEQ ID NO: 1110584 - RNA, 20 nt, Homo sapiens
gaccaguugggagcacugga

SEQ ID NO: 1110585 - RNA, 20 nt, Homo sapiens
gacccaaagaccaauauuca

SEQ ID NO: 1110586 - RNA, 16 nt, Homo sapiens
gacccagggaugacau

SEQ ID NO: 1110587 - RNA, 18 nt, Homo sapiens
gacccaguguaaagaaua

SEQ ID NO: 1110588 - RNA, 19 nt, Homo sapiens
gacccccaucucuacaaaa

SEQ ID NO: 1110589 - RNA, 17 nt, Homo sapiens
gaccccgcccagcauug

SEQ ID NO: 1110590 - RNA, 17 nt, Homo sapiens
gacccgcucuggaccaa

SEQ ID NO: 1110591 - RNA, 23 nt, Homo sapiens
gacccuaaauguggacaucauga

SEQ ID NO: 1110592 - RNA, 21 nt, Homo sapiens
gacccuacuucuuuugcucuu

SEQ ID NO: 1110593 - RNA, 23 nt, Homo sapiens
gacccuccuggggcucucagugu

SEQ ID NO: 1110594 - RNA, 20 nt, Homo sapiens
gacccucugaaugguccagg

SEQ ID NO: 1110595 - RNA, 11 nt, Homo sapiens
gaccucaggug

SEQ ID NO: 1110596 - RNA, 20 nt, Homo sapiens
gaccucaggugauccaccca

SEQ ID NO: 1110597 - RNA, 15 nt, Homo sapiens
gaccuccagcuuucc

SEQ ID NO: 1110598 - RNA, 18 nt, Homo sapiens
gaccucugccugaaguca

SEQ ID NO: 1110599 - RNA, 12 nt, Homo sapiens
gaccuguguucc

SEQ ID NO: 1110600 - RNA, 22 nt, Homo sapiens
gaccuucuaggaagcuccaguu

SEQ ID NO: 1110601 - RNA, 17 nt, Homo sapiens
gaccuucuccccauucu

SEQ ID NO: 1110602 - RNA, 18 nt, Homo sapiens
gaccuugaaggguaaaga

SEQ ID NO: 1110603 - RNA, 17 nt, Homo sapiens
gaccuuucugagugaca

SEQ ID NO: 1110604 - RNA, 14 nt, Homo sapiens
caggccucccucaa

SEQ ID NO: 1110605 - RNA, 16 nt, Homo sapiens
caggcuggagugcagu

SEQ ID NO: 1110606 - RNA, 13 nt, Homo sapiens
cagggaauuucag

SEQ ID NO: 1110607 - RNA, 15 nt, Homo sapiens
cagggacccacuuca

SEQ ID NO: 1110608 - RNA, 18 nt, Homo sapiens
cagggcucagccuggugg

SEQ ID NO: 1110609 - RNA, 16 nt, Homo sapiens
caggggccucagggga

SEQ ID NO: 1110610 - RNA, 18 nt, Homo sapiens
caggggccugcccagugc

SEQ ID NO: 1110611 - RNA, 20 nt, Homo sapiens
caggggccugcccagugcac

SEQ ID NO: 1110612 - RNA, 20 nt, Homo sapiens
cagggggugugucugcucag

SEQ ID NO: 1110613 - RNA, 23 nt, Homo sapiens
caggggucucccuggagugcagu

SEQ ID NO: 1110614 - RNA, 20 nt, Homo sapiens
cagggucucacuauguugcc

SEQ ID NO: 1110615 - RNA, 21 nt, Homo sapiens
cagggucucacuauguugccc

SEQ ID NO: 1110616 - RNA, 17 nt, Homo sapiens
caggguguuaaggcagu

SEQ ID NO: 1110617 - RNA, 22 nt, Homo sapiens
caggguguuaaggcagugacuu

SEQ ID NO: 1110618 - RNA, 17 nt, Homo sapiens
cagguccucaguguccu

SEQ ID NO: 1110619 - RNA, 13 nt, Homo sapiens
caggugcuucagg

SEQ ID NO: 1110620 - RNA, 15 nt, Homo sapiens
caggugggaaauggu

SEQ ID NO: 1110621 - RNA, 17 nt, Homo sapiens
caggugguccugagacc

SEQ ID NO: 1110622 - RNA, 19 nt, Homo sapiens
cagguguaagccaccgugc

SEQ ID NO: 1110623 - RNA, 14 nt, Homo sapiens
caggugugagucac

SEQ ID NO: 1110624 - RNA, 16 nt, Homo sapiens
cagguguuuauacagc

SEQ ID NO: 1110625 - RNA, 23 nt, Homo sapiens
caguaaaaaacaacuucuuugua

SEQ ID NO: 1110626 - RNA, 17 nt, Homo sapiens
caguaacucaucuguca

SEQ ID NO: 1110627 - RNA, 17 nt, Homo sapiens
caguagcacaaguuauu

SEQ ID NO: 1110628 - RNA, 17 nt, Homo sapiens
caguauauuuauaguca

SEQ ID NO: 1110629 - RNA, 15 nt, Homo sapiens
cagucaacaguucaa

SEQ ID NO: 1110630 - RNA, 16 nt, Homo sapiens
cagucaacaguucaaa

SEQ ID NO: 1110631 - RNA, 23 nt, Homo sapiens
cagucccuuacacguaccucuca

SEQ ID NO: 1110632 - RNA, 22 nt, Homo sapiens
acuaaggugugcucugaucauc

SEQ ID NO: 1110633 - RNA, 16 nt, Homo sapiens
acuacaaagcuucuau

SEQ ID NO: 1110634 - RNA, 11 nt, Homo sapiens
acuacaugcac

SEQ ID NO: 1110635 - RNA, 21 nt, Homo sapiens
acuacaugcacuuggcugcau

SEQ ID NO: 1110636 - RNA, 16 nt, Homo sapiens
acuagaagaaagggca

SEQ ID NO: 1110637 - RNA, 21 nt, Homo sapiens
acuaguugaacaucucacuuu

SEQ ID NO: 1110638 - RNA, 14 nt, Homo sapiens
acuauaaccaucag

SEQ ID NO: 1110639 - RNA, 14 nt, Homo sapiens
acuauagcccaggu

SEQ ID NO: 1110640 - RNA, 16 nt, Homo sapiens
acuauauucucagugu

SEQ ID NO: 1110641 - RNA, 14 nt, Homo sapiens
acuaucacauacaa

SEQ ID NO: 1110642 - RNA, 15 nt, Homo sapiens
acuaucacauacaau

SEQ ID NO: 1110643 - RNA, 18 nt, Homo sapiens
acuaucacauacaauuug

SEQ ID NO: 1110644 - RNA, 13 nt, Homo sapiens
acuaugacacuga

SEQ ID NO: 1110645 - RNA, 13 nt, Homo sapiens
acuaugaucucag

SEQ ID NO: 1110646 - RNA, 14 nt, Homo sapiens
acuaugaucucagg

SEQ ID NO: 1110647 - RNA, 17 nt, Homo sapiens
acuauggguacauucca

SEQ ID NO: 1110648 - RNA, 17 nt, Homo sapiens
acuaugguucccaauaa

SEQ ID NO: 1110649 - RNA, 15 nt, Homo sapiens
acuauguugcccagg

SEQ ID NO: 1110650 - RNA, 16 nt, Homo sapiens
acuauuaaaacuaaua

SEQ ID NO: 1110651 - RNA, 16 nt, Homo sapiens
acuauuacaccaaaua

SEQ ID NO: 1110652 - RNA, 15 nt, Homo sapiens
acuauuaccaugaga

SEQ ID NO: 1110653 - RNA, 17 nt, Homo sapiens
acuauuuaucugugcaa

SEQ ID NO: 1110654 - RNA, 17 nt, Homo sapiens
acuauuuaugaaggcaa

SEQ ID NO: 1110655 - RNA, 21 nt, Homo sapiens
acucaaagagggagugcauuu

SEQ ID NO: 1110656 - RNA, 19 nt, Homo sapiens
acucagggccccagcacua

SEQ ID NO: 1110657 - RNA, 16 nt, Homo sapiens
acucauuucaucucau

SEQ ID NO: 1110658 - RNA, 15 nt, Homo sapiens
acuccagccugggca

SEQ ID NO: 1110659 - RNA, 15 nt, Homo sapiens
acuccaguggugaag

SEQ ID NO: 1110660 - RNA, 14 nt, Homo sapiens
acuccauacauaac

SEQ ID NO: 1110661 - RNA, 15 nt, Homo sapiens
acuccggagguagag

SEQ ID NO: 1110662 - RNA, 19 nt, Homo sapiens
acuccucuguccaggcacu

SEQ ID NO: 1110663 - RNA, 16 nt, Homo sapiens
acuccugcccuguugu

SEQ ID NO: 1110664 - RNA, 14 nt, Homo sapiens
acuccuuccagcua

SEQ ID NO: 1110665 - RNA, 13 nt, Homo sapiens
acucuacugcaag

SEQ ID NO: 1110666 - RNA, 22 nt, Homo sapiens
acucuccccucccucuuccuuc

SEQ ID NO: 1110667 - RNA, 18 nt, Homo sapiens
acucucugugaccugccc

SEQ ID NO: 1110668 - RNA, 18 nt, Homo sapiens
acucugaaaucucagaau

SEQ ID NO: 1110669 - RNA, 14 nt, Homo sapiens
acucugaauaccaa

SEQ ID NO: 1110670 - RNA, 18 nt, Homo sapiens
acucugcacaugucuugu

SEQ ID NO: 1110671 - RNA, 19 nt, Homo sapiens
acucugccagccacaucca

SEQ ID NO: 1110672 - RNA, 22 nt, Homo sapiens
acucugugccagagccuggggc

SEQ ID NO: 1110673 - RNA, 14 nt, Homo sapiens
acucuuaugaaaug

SEQ ID NO: 1110674 - RNA, 21 nt, Homo sapiens
acucuuaugaaaugggcuuua

SEQ ID NO: 1110675 - RNA, 21 nt, Homo sapiens
acucuucugagcaccuacuua

SEQ ID NO: 1110676 - RNA, 16 nt, Homo sapiens
acucuugccuuuccac

SEQ ID NO: 1110677 - RNA, 23 nt, Homo sapiens
acugaaaaaugguaauuguugcu

SEQ ID NO: 1110678 - RNA, 14 nt, Homo sapiens
acugaaaacuguaa

SEQ ID NO: 1110679 - RNA, 19 nt, Homo sapiens
acugaaggcauaugcuggc

SEQ ID NO: 1110680 - RNA, 16 nt, Homo sapiens
acugaccagccuccau

SEQ ID NO: 1110681 - RNA, 18 nt, Homo sapiens
acugaccuuguagcuaua

SEQ ID NO: 1110682 - RNA, 14 nt, Homo sapiens
acugaggaccagcc

SEQ ID NO: 1110683 - RNA, 20 nt, Homo sapiens
acugaggcagacagcagcuc

SEQ ID NO: 1110684 - RNA, 18 nt, Homo sapiens
acugaguccucguagcca

SEQ ID NO: 1110685 - RNA, 18 nt, Homo sapiens
acugaugacaaacccagg

SEQ ID NO: 1110686 - RNA, 19 nt, Homo sapiens
acugaugggcaacccccag

SEQ ID NO: 1110687 - RNA, 22 nt, Homo sapiens
acugauuuaugaucacuuggaa

SEQ ID NO: 1110688 - RNA, 17 nt, Homo sapiens
acugauuuuuagcuuua

SEQ ID NO: 1110689 - RNA, 21 nt, Homo sapiens
acugcacuauagccuagguga

SEQ ID NO: 1110690 - RNA, 14 nt, Homo sapiens
acugcacuccaguc

SEQ ID NO: 1110691 - RNA, 21 nt, Homo sapiens
acugccaucaagaugagagaa

SEQ ID NO: 1110692 - RNA, 20 nt, Homo sapiens
acugccuuccaggagcaauu

SEQ ID NO: 1110693 - RNA, 21 nt, Homo sapiens
acugcgugccaguguccccac

SEQ ID NO: 1110694 - RNA, 14 nt, Homo sapiens
acuggaaccaggga

SEQ ID NO: 1110695 - RNA, 15 nt, Homo sapiens
acuggaagcacagcu

SEQ ID NO: 1110696 - RNA, 13 nt, Homo sapiens
acuggacgcccag

SEQ ID NO: 1110697 - RNA, 21 nt, Homo sapiens
acuggagcaucugacucacaa

SEQ ID NO: 1110698 - RNA, 20 nt, Homo sapiens
acugggagaaaugacuuuga

SEQ ID NO: 1110699 - RNA, 21 nt, Homo sapiens
acugggcuaccgugagaucca

SEQ ID NO: 1110700 - RNA, 17 nt, Homo sapiens
acuggucccaaguagua

SEQ ID NO: 1110701 - RNA, 23 nt, Homo sapiens
acugguucauauuggacugauaa

SEQ ID NO: 1110702 - RNA, 22 nt, Homo sapiens
acuguauguuuacuucucacca

SEQ ID NO: 1110703 - RNA, 23 nt, Homo sapiens
acugugcaggaguggccggggaa

SEQ ID NO: 1110704 - RNA, 18 nt, Homo sapiens
acugugccaugugccagg

SEQ ID NO: 1110705 - RNA, 20 nt, Homo sapiens
acuguuagucauuugcugag

SEQ ID NO: 1110706 - RNA, 14 nt, Homo sapiens
acuuaaaagauuca

SEQ ID NO: 1110707 - RNA, 13 nt, Homo sapiens
acuuaacauucug

SEQ ID NO: 1110708 - RNA, 13 nt, Homo sapiens
acuuaacauugau

SEQ ID NO: 1110709 - RNA, 15 nt, Homo sapiens
acuuaauaauugcau

SEQ ID NO: 1110710 - RNA, 11 nt, Homo sapiens
acuuacccaag

SEQ ID NO: 1110711 - RNA, 18 nt, Homo sapiens
acuuaccuagauuuacag

SEQ ID NO: 1110712 - RNA, 12 nt, Homo sapiens
acuuagcaacuu

SEQ ID NO: 1110713 - RNA, 21 nt, Homo sapiens
acuuauuaugaggcuauuaaa

SEQ ID NO: 1110714 - RNA, 19 nt, Homo sapiens
acuucaagagccucuggca

SEQ ID NO: 1110715 - RNA, 19 nt, Homo sapiens
acuucaaguuaaagugaau

SEQ ID NO: 1110716 - RNA, 14 nt, Homo sapiens
acuucacacacagg

SEQ ID NO: 1110717 - RNA, 20 nt, Homo sapiens
acuucagagacuaucugauu

SEQ ID NO: 1110718 - RNA, 24 nt, Homo sapiens
caugaccuccguguagugucugua

SEQ ID NO: 1110719 - RNA, 20 nt, Homo sapiens
caugacucguauaugucuca

SEQ ID NO: 1110720 - RNA, 14 nt, Homo sapiens
caugagaauaagag

SEQ ID NO: 1110721 - RNA, 19 nt, Homo sapiens
caugagaccacuguuauca

SEQ ID NO: 1110722 - RNA, 21 nt, Homo sapiens
caugagagaauuguaucauuu

SEQ ID NO: 1110723 - RNA, 21 nt, Homo sapiens
caugagccucagcauccuggc

SEQ ID NO: 1110724 - RNA, 18 nt, Homo sapiens
caugagugauucuugaca

SEQ ID NO: 1110725 - RNA, 20 nt, Homo sapiens
caugauggagcgcaccugcc

SEQ ID NO: 1110726 - RNA, 21 nt, Homo sapiens
caugauuuuauacauagucac

SEQ ID NO: 1110727 - RNA, 23 nt, Homo sapiens
caugauuuuauacauagucacaa

SEQ ID NO: 1110728 - RNA, 22 nt, Homo sapiens
caugauuuuuuuuuuucagucc

SEQ ID NO: 1110729 - RNA, 20 nt, Homo sapiens
caugcacuuggcugcauaaa

SEQ ID NO: 1110730 - RNA, 18 nt, Homo sapiens
caugcauuacugcaugca

SEQ ID NO: 1110731 - RNA, 21 nt, Homo sapiens
caugcauuuugcagcagugag

SEQ ID NO: 1110732 - RNA, 20 nt, Homo sapiens
caugccaucuccacccugag

SEQ ID NO: 1110733 - RNA, 16 nt, Homo sapiens
caugcccucaauccca

SEQ ID NO: 1110734 - RNA, 23 nt, Homo sapiens
caugcccuggauccaucaggcca

SEQ ID NO: 1110735 - RNA, 15 nt, Homo sapiens
caugcucaaccacug

SEQ ID NO: 1110736 - RNA, 17 nt, Homo sapiens
caugcuuaaauauugaa

SEQ ID NO: 1110737 - RNA, 13 nt, Homo sapiens
caugcuucuugcc

SEQ ID NO: 1110738 - RNA, 18 nt, Homo sapiens
cauggaacagugcaggac

SEQ ID NO: 1110739 - RNA, 19 nt, Homo sapiens
cauggacaccccuuaucca

SEQ ID NO: 1110740 - RNA, 15 nt, Homo sapiens
cauggccuaugcaca

SEQ ID NO: 1110741 - RNA, 15 nt, Homo sapiens
cauggugcacugagc

SEQ ID NO: 1110742 - RNA, 17 nt, Homo sapiens
cauguaauaaaucugag

SEQ ID NO: 1110743 - RNA, 14 nt, Homo sapiens
cauguaucuaugca

SEQ ID NO: 1110744 - RNA, 12 nt, Homo sapiens
cauguccucaaa

SEQ ID NO: 1110745 - RNA, 14 nt, Homo sapiens
cauguccucaaaac

SEQ ID NO: 1110746 - RNA, 17 nt, Homo sapiens
caugucucaauaguaaa

SEQ ID NO: 1110747 - RNA, 16 nt, Homo sapiens
caugucuuguucagaa

SEQ ID NO: 1110748 - RNA, 20 nt, Homo sapiens
caugugacacauaugcaccu

SEQ ID NO: 1110749 - RNA, 22 nt, Homo sapiens
caugugacacauaugcaccuug

SEQ ID NO: 1110750 - RNA, 22 nt, Homo sapiens
caugugcagucccagcuacuca

SEQ ID NO: 1110751 - RNA, 16 nt, Homo sapiens
cauguggaagcacuuu

SEQ ID NO: 1110752 - RNA, 20 nt, Homo sapiens
cauguggcauguucaucgua

SEQ ID NO: 1110753 - RNA, 18 nt, Homo sapiens
cauguguagccugugcau

SEQ ID NO: 1110754 - RNA, 20 nt, Homo sapiens
cauguguggauguguaaaug

SEQ ID NO: 1110755 - RNA, 21 nt, Homo sapiens
cauguuaggaaaauuucacau

SEQ ID NO: 1110756 - RNA, 16 nt, Homo sapiens
cauguuccucaaaagc

SEQ ID NO: 1110757 - RNA, 22 nt, Homo sapiens
cauguuggccaggcuggucuca

SEQ ID NO: 1110758 - RNA, 23 nt, Homo sapiens
cauguuucccgcuccaagagaau

SEQ ID NO: 1110759 - RNA, 12 nt, Homo sapiens
cauguuuuuacc

SEQ ID NO: 1110760 - RNA, 20 nt, Homo sapiens
cauuaaaaaugaaagccaaa

SEQ ID NO: 1110761 - RNA, 15 nt, Homo sapiens
cauuaaacuuaccug

SEQ ID NO: 1110762 - RNA, 21 nt, Homo sapiens
cauuacugcaugcacuucuua

SEQ ID NO: 1110763 - RNA, 14 nt, Homo sapiens
cauuacuugcacaa

SEQ ID NO: 1110764 - RNA, 14 nt, Homo sapiens
cauuagaaacugaa

SEQ ID NO: 1110765 - RNA, 16 nt, Homo sapiens
cauuaggaacagagua

SEQ ID NO: 1110766 - RNA, 18 nt, Homo sapiens
cauuaggaacagaguaua

SEQ ID NO: 1110767 - RNA, 17 nt, Homo sapiens
cauuauaaacgugauga

SEQ ID NO: 1110768 - RNA, 22 nt, Homo sapiens
cauucaauguuuaugcaaggaa

SEQ ID NO: 1110769 - RNA, 23 nt, Homo sapiens
cauucagaagaaaaagaagcaac

SEQ ID NO: 1110770 - RNA, 16 nt, Homo sapiens
cauucaucucauucca

SEQ ID NO: 1110771 - RNA, 18 nt, Homo sapiens
cauuccagacugcuucca

SEQ ID NO: 1110772 - RNA, 14 nt, Homo sapiens
cauucugaccauuu

SEQ ID NO: 1110773 - RNA, 16 nt, Homo sapiens
cauucugaccauuuca

SEQ ID NO: 1110774 - RNA, 17 nt, Homo sapiens
cauugguaagaaugagc

SEQ ID NO: 1110775 - RNA, 20 nt, Homo sapiens
cauuguuacagguguacuau

SEQ ID NO: 1110776 - RNA, 23 nt, Homo sapiens
cauuuaauuugaaauuugacuca

SEQ ID NO: 1110777 - RNA, 23 nt, Homo sapiens
cauuuacuuaacagaacagucac

SEQ ID NO: 1110778 - RNA, 15 nt, Homo sapiens
cauuuauaaaaccau

SEQ ID NO: 1110779 - RNA, 14 nt, Homo sapiens
gagaagcucaccca

SEQ ID NO: 1110780 - RNA, 15 nt, Homo sapiens
gagaagcucacccaa

SEQ ID NO: 1110781 - RNA, 19 nt, Homo sapiens
gagaaggacaccuccuucc

SEQ ID NO: 1110782 - RNA, 22 nt, Homo sapiens
gagaauggggguggggaggcaa

SEQ ID NO: 1110783 - RNA, 12 nt, Homo sapiens
gagacagucuca

SEQ ID NO: 1110784 - RNA, 18 nt, Homo sapiens
gagaccagcccagccaac

SEQ ID NO: 1110785 - RNA, 15 nt, Homo sapiens
gagacggccaaguga

SEQ ID NO: 1110786 - RNA, 12 nt, Homo sapiens
gagacugaguca

SEQ ID NO: 1110787 - RNA, 17 nt, Homo sapiens
gagacuggagcaucuga

SEQ ID NO: 1110788 - RNA, 21 nt, Homo sapiens
gagagaacaacuacugugauc

SEQ ID NO: 1110789 - RNA, 13 nt, Homo sapiens
gagagaacuggag

SEQ ID NO: 1110790 - RNA, 16 nt, Homo sapiens
gagagagugcugagaa

SEQ ID NO: 1110791 - RNA, 14 nt, Homo sapiens
gagagcaggacagg

SEQ ID NO: 1110792 - RNA, 21 nt, Homo sapiens
gagaggagggaugcugccuga

SEQ ID NO: 1110793 - RNA, 16 nt, Homo sapiens
gagaggggcuguccau

SEQ ID NO: 1110794 - RNA, 21 nt, Homo sapiens
gagaggggcuguccauggcag

SEQ ID NO: 1110795 - RNA, 14 nt, Homo sapiens
gagaguuucuguua

SEQ ID NO: 1110796 - RNA, 18 nt, Homo sapiens
gagauaaccacaaccagg

SEQ ID NO: 1110797 - RNA, 21 nt, Homo sapiens
gagaucguuguuuacagugua

SEQ ID NO: 1110798 - RNA, 23 nt, Homo sapiens
gagaucuucaaugcuuccuccuu

SEQ ID NO: 1110799 - RNA, 17 nt, Homo sapiens
gagauggaauaaagccc

SEQ ID NO: 1110800 - RNA, 19 nt, Homo sapiens
gagauggaauaaagcccuu

SEQ ID NO: 1110801 - RNA, 13 nt, Homo sapiens
gagauggaguucu

SEQ ID NO: 1110802 - RNA, 23 nt, Homo sapiens
gagaugggcuuguuuucuugcca

SEQ ID NO: 1110803 - RNA, 22 nt, Homo sapiens
gagauugcgccacugcacucca

SEQ ID NO: 1110804 - RNA, 22 nt, Homo sapiens
gagcaagacucugucucaaaaa

SEQ ID NO: 1110805 - RNA, 17 nt, Homo sapiens
gagcacaucugggaggc

SEQ ID NO: 1110806 - RNA, 18 nt, Homo sapiens
gagcacccccucauuccc

SEQ ID NO: 1110807 - RNA, 22 nt, Homo sapiens
gagcaccuacuuacaugcauua

SEQ ID NO: 1110808 - RNA, 21 nt, Homo sapiens
gagcagaugcaaucucuuguc

SEQ ID NO: 1110809 - RNA, 13 nt, Homo sapiens
gagcaucaugccu

SEQ ID NO: 1110810 - RNA, 15 nt, Homo sapiens
gagcauuacgugagc

SEQ ID NO: 1110811 - RNA, 17 nt, Homo sapiens
gagccaagcuucaaccc

SEQ ID NO: 1110812 - RNA, 16 nt, Homo sapiens
gagcccugucaguaga

SEQ ID NO: 1110813 - RNA, 18 nt, Homo sapiens
gagccucgguggccaugc

SEQ ID NO: 1110814 - RNA, 20 nt, Homo sapiens
gagccucgguggccaugcuu

SEQ ID NO: 1110815 - RNA, 17 nt, Homo sapiens
gagccugacuguguuca

SEQ ID NO: 1110816 - RNA, 23 nt, Homo sapiens
gagccugacuguguucagugccu

SEQ ID NO: 1110817 - RNA, 16 nt, Homo sapiens
gagccugaggcaugag

SEQ ID NO: 1110818 - RNA, 17 nt, Homo sapiens
gagccugcaaacucacu

SEQ ID NO: 1110819 - RNA, 21 nt, Homo sapiens
gagccuucacaaccagccaca

SEQ ID NO: 1110820 - RNA, 19 nt, Homo sapiens
gagcuaggagcaaagccug

SEQ ID NO: 1110821 - RNA, 15 nt, Homo sapiens
gagcuccccaaaaac

SEQ ID NO: 1110822 - RNA, 16 nt, Homo sapiens
gagcuggaacacucuc

SEQ ID NO: 1110823 - RNA, 13 nt, Homo sapiens
gagcuucaguaua

SEQ ID NO: 1110824 - RNA, 22 nt, Homo sapiens
gagcuuccagugcauguugcca

SEQ ID NO: 1110825 - RNA, 17 nt, Homo sapiens
gagcuugauccagaccu

SEQ ID NO: 1110826 - RNA, 14 nt, Homo sapiens
gaggaagaaaacca

SEQ ID NO: 1110827 - RNA, 16 nt, Homo sapiens
gaggacacaguuucua

SEQ ID NO: 1110828 - RNA, 15 nt, Homo sapiens
gaggaucacagugac

SEQ ID NO: 1110829 - RNA, 14 nt, Homo sapiens
gaggcaaaggccag

SEQ ID NO: 1110830 - RNA, 21 nt, Homo sapiens
gaggcccccuggugugucuga

SEQ ID NO: 1110831 - RNA, 20 nt, Homo sapiens
gaggccugcccucagggauc

SEQ ID NO: 1110832 - RNA, 18 nt, Homo sapiens
gaggcugagacaggagaa

SEQ ID NO: 1110833 - RNA, 12 nt, Homo sapiens
gaggcugcagaa

SEQ ID NO: 1110834 - RNA, 22 nt, Homo sapiens
guacauucaauguuuaugcaag

SEQ ID NO: 1110835 - RNA, 21 nt, Homo sapiens
guaccacucaggccaacaagc

SEQ ID NO: 1110836 - RNA, 23 nt, Homo sapiens
guacccuuccuacagauagucaa

SEQ ID NO: 1110837 - RNA, 20 nt, Homo sapiens
guacuccagccugggugaca

SEQ ID NO: 1110838 - RNA, 21 nt, Homo sapiens
guacuucaaguuaaagugaau

SEQ ID NO: 1110839 - RNA, 22 nt, Homo sapiens
guagaguuugaaggaggugagg

SEQ ID NO: 1110840 - RNA, 18 nt, Homo sapiens
guagcagagucauuguua

SEQ ID NO: 1110841 - RNA, 14 nt, Homo sapiens
guagcucuguccac

SEQ ID NO: 1110842 - RNA, 20 nt, Homo sapiens
guagcucuguccacucugaa

SEQ ID NO: 1110843 - RNA, 15 nt, Homo sapiens
guaggggcagugaug

SEQ ID NO: 1110844 - RNA, 16 nt, Homo sapiens
guagguggaucaccug

SEQ ID NO: 1110845 - RNA, 14 nt, Homo sapiens
guagguucuugaua

SEQ ID NO: 1110846 - RNA, 14 nt, Homo sapiens
guaguagugucuuc

SEQ ID NO: 1110847 - RNA, 14 nt, Homo sapiens
guagugggugaaug

SEQ ID NO: 1110848 - RNA, 19 nt, Homo sapiens
guauaacacaauaugaaua

SEQ ID NO: 1110849 - RNA, 16 nt, Homo sapiens
guauagaguacugcag

SEQ ID NO: 1110850 - RNA, 14 nt, Homo sapiens
auacuggguacaag

SEQ ID NO: 1110851 - RNA, 13 nt, Homo sapiens
auacuuuacaaag

SEQ ID NO: 1110852 - RNA, 18 nt, Homo sapiens
auacuuuggggacuugua

SEQ ID NO: 1110853 - RNA, 12 nt, Homo sapiens
auagaaacugau

SEQ ID NO: 1110854 - RNA, 14 nt, Homo sapiens
auagaaaguucaaa

SEQ ID NO: 1110855 - RNA, 20 nt, Homo sapiens
auagacacuggagacuugga

SEQ ID NO: 1110856 - RNA, 15 nt, Homo sapiens
auagauauguagaua

SEQ ID NO: 1110857 - RNA, 16 nt, Homo sapiens
auagcuauugcaugua

SEQ ID NO: 1110858 - RNA, 14 nt, Homo sapiens
auagcuuccaugag

SEQ ID NO: 1110859 - RNA, 13 nt, Homo sapiens
auaggacaauuca

SEQ ID NO: 1110860 - RNA, 20 nt, Homo sapiens
auaggcccuggaugugccca

SEQ ID NO: 1110861 - RNA, 22 nt, Homo sapiens
auaggcuggagaagcucaccca

SEQ ID NO: 1110862 - RNA, 17 nt, Homo sapiens
auaguaacuacuuuuua

SEQ ID NO: 1110863 - RNA, 11 nt, Homo sapiens
auaguacuggc

SEQ ID NO: 1110864 - RNA, 13 nt, Homo sapiens
auaguacuggcau

SEQ ID NO: 1110865 - RNA, 14 nt, Homo sapiens
auaguauugugcau

SEQ ID NO: 1110866 - RNA, 22 nt, Homo sapiens
auagucaaaccauaaacuucau

SEQ ID NO: 1110867 - RNA, 23 nt, Homo sapiens
auagucacauggccuaugcacau

SEQ ID NO: 1110868 - RNA, 13 nt, Homo sapiens
auagucuguccaa

SEQ ID NO: 1110869 - RNA, 15 nt, Homo sapiens
auaguucuuacuacu

SEQ ID NO: 1110870 - RNA, 22 nt, Homo sapiens
auauaaggaaagugauccaaaa

SEQ ID NO: 1110871 - RNA, 22 nt, Homo sapiens
auauaauguaguaugauguaau

SEQ ID NO: 1110872 - RNA, 12 nt, Homo sapiens
auauacaaauag

SEQ ID NO: 1110873 - RNA, 12 nt, Homo sapiens
auauaccaagcu

SEQ ID NO: 1110874 - RNA, 16 nt, Homo sapiens
auauaggagcaauacu

SEQ ID NO: 1110875 - RNA, 17 nt, Homo sapiens
auauaggagcaauacua

SEQ ID NO: 1110876 - RNA, 18 nt, Homo sapiens
auauaguauucauuuucc

SEQ ID NO: 1110877 - RNA, 16 nt, Homo sapiens
auauauuuauaacuca

SEQ ID NO: 1110878 - RNA, 17 nt, Homo sapiens
auauauuucagauauca

SEQ ID NO: 1110879 - RNA, 23 nt, Homo sapiens
auauauuuuugguugucaauauu

SEQ ID NO: 1110880 - RNA, 19 nt, Homo sapiens
auauccucucagcucucuu

SEQ ID NO: 1110881 - RNA, 15 nt, Homo sapiens
auaucuuauguuaaa

SEQ ID NO: 1110882 - RNA, 20 nt, Homo sapiens
auaucuugaagaauauuguu

SEQ ID NO: 1110883 - RNA, 22 nt, Homo sapiens
auaugaaaugauaaagauguca

SEQ ID NO: 1110884 - RNA, 14 nt, Homo sapiens
cagggaggugaccc

SEQ ID NO: 1110885 - RNA, 20 nt, Homo sapiens
cagggcccugagcucggugg

SEQ ID NO: 1110886 - RNA, 14 nt, Homo sapiens
cagggccucaaagu

SEQ ID NO: 1110887 - RNA, 21 nt, Homo sapiens
caggggccugcccagugcacu

SEQ ID NO: 1110888 - RNA, 19 nt, Homo sapiens
cagggucucacucugucgc

SEQ ID NO: 1110889 - RNA, 21 nt, Homo sapiens
cagggucucacucugucgccc

SEQ ID NO: 1110890 - RNA, 21 nt, Homo sapiens
caggguuagcucacgugucuu

SEQ ID NO: 1110891 - RNA, 15 nt, Homo sapiens
cagguaaugagggac

SEQ ID NO: 1110892 - RNA, 21 nt, Homo sapiens
cagguagaacacaaggucauu

SEQ ID NO: 1110893 - RNA, 21 nt, Homo sapiens
cagguagugggugaaugugug

SEQ ID NO: 1110894 - RNA, 17 nt, Homo sapiens
caggucaucuccuuuca

SEQ ID NO: 1110895 - RNA, 19 nt, Homo sapiens
cagguccucuacuuaauga

SEQ ID NO: 1110896 - RNA, 15 nt, Homo sapiens
caggucuagacuuuc

SEQ ID NO: 1110897 - RNA, 15 nt, Homo sapiens
caggugcugccaucc

SEQ ID NO: 1110898 - RNA, 20 nt, Homo sapiens
cagguggacacacaaggugc

SEQ ID NO: 1110899 - RNA, 16 nt, Homo sapiens
cagguggcaucucuaa

SEQ ID NO: 1110900 - RNA, 19 nt, Homo sapiens
caggugugaaccaccacac

SEQ ID NO: 1110901 - RNA, 20 nt, Homo sapiens
caggugugagccacccugcc

SEQ ID NO: 1110902 - RNA, 17 nt, Homo sapiens
cagguuccaucccgaaa

SEQ ID NO: 1110903 - RNA, 15 nt, Homo sapiens
cagguuuuuggucug

SEQ ID NO: 1110904 - RNA, 16 nt, Homo sapiens
caguaaaaacuuguac

SEQ ID NO: 1110905 - RNA, 20 nt, Homo sapiens
caguagcuuaaauaaauuca

SEQ ID NO: 1110906 - RNA, 20 nt, Homo sapiens
caguauauuuauagucacaa

SEQ ID NO: 1110907 - RNA, 13 nt, Homo sapiens
cagucauuucaau

SEQ ID NO: 1110908 - RNA, 16 nt, Homo sapiens
caguccauagcagaga

SEQ ID NO: 1110909 - RNA, 15 nt, Homo sapiens
cagucccaucagaga

SEQ ID NO: 1110910 - RNA, 11 nt, Homo sapiens
cagucucaagc

SEQ ID NO: 1110911 - RNA, 17 nt, Homo sapiens
cagugacgugcaccugu

SEQ ID NO: 1110912 - RNA, 20 nt, Homo sapiens
cagugacugucguguuuaca

SEQ ID NO: 1110913 - RNA, 22 nt, Homo sapiens
cagugagccgcaucuucuccau

SEQ ID NO: 1110914 - RNA, 20 nt, Homo sapiens
cagugagcugagauugcgcc

SEQ ID NO: 1110915 - RNA, 17 nt, Homo sapiens
cagugagucucuucaga

SEQ ID NO: 1110916 - RNA, 13 nt, Homo sapiens
cagugaucuccau

SEQ ID NO: 1110917 - RNA, 15 nt, Homo sapiens
cagugcauguugcca

SEQ ID NO: 1110918 - RNA, 21 nt, Homo sapiens
cagugcccaccaacaucccau

SEQ ID NO: 1110919 - RNA, 14 nt, Homo sapiens
caguggacaccagg

SEQ ID NO: 1110920 - RNA, 18 nt, Homo sapiens
caguggcauucacaucuc

SEQ ID NO: 1110921 - RNA, 19 nt, Homo sapiens
caguggcauucacaucuca

SEQ ID NO: 1110922 - RNA, 16 nt, Homo sapiens
cagugguaccagcuca

SEQ ID NO: 1110923 - RNA, 16 nt, Homo sapiens
caguguccucaggggc

SEQ ID NO: 1110924 - RNA, 12 nt, Homo sapiens
cagugugacaag

SEQ ID NO: 1110925 - RNA, 23 nt, Homo sapiens
cagugugaucccaagugccaguc

SEQ ID NO: 1110926 - RNA, 17 nt, Homo sapiens
caguguuuucaccucau

SEQ ID NO: 1110927 - RNA, 22 nt, Homo sapiens
cugggccaaguuccucuagugc

SEQ ID NO: 1110928 - RNA, 16 nt, Homo sapiens
cugggccccaccaccu

SEQ ID NO: 1110929 - RNA, 12 nt, Homo sapiens
cugggcucucca

SEQ ID NO: 1110930 - RNA, 19 nt, Homo sapiens
cugggcugcagagacugga

SEQ ID NO: 1110931 - RNA, 22 nt, Homo sapiens
cugggcugcuacccagaaauca

SEQ ID NO: 1110932 - RNA, 15 nt, Homo sapiens
cugggcuucagccuc

SEQ ID NO: 1110933 - RNA, 17 nt, Homo sapiens
cuggggaguuauaaaaa

SEQ ID NO: 1110934 - RNA, 18 nt, Homo sapiens
cuggggcucuaacgccug

SEQ ID NO: 1110935 - RNA, 14 nt, Homo sapiens
cuggggcucugugc

SEQ ID NO: 1110936 - RNA, 16 nt, Homo sapiens
cugggggccucagugc

SEQ ID NO: 1110937 - RNA, 21 nt, Homo sapiens
cugggggccucuuucugugcu

SEQ ID NO: 1110938 - RNA, 15 nt, Homo sapiens
cugggggcuagcaga

SEQ ID NO: 1110939 - RNA, 17 nt, Homo sapiens
cuggguuucucuguaua

SEQ ID NO: 1110940 - RNA, 16 nt, Homo sapiens
cuggucccacucaguc

SEQ ID NO: 1110941 - RNA, 14 nt, Homo sapiens
cugguggucaggga

SEQ ID NO: 1110942 - RNA, 15 nt, Homo sapiens
cugguuagaaaugca

SEQ ID NO: 1110943 - RNA, 14 nt, Homo sapiens
cugguucagccucu

SEQ ID NO: 1110944 - RNA, 19 nt, Homo sapiens
cugguuucucagaauccaa

SEQ ID NO: 1110945 - RNA, 17 nt, Homo sapiens
cuguaaucccagcacuu

SEQ ID NO: 1110946 - RNA, 21 nt, Homo sapiens
cuguaaucccagcacuuuggg

SEQ ID NO: 1110947 - RNA, 21 nt, Homo sapiens
cuguaaucccagcuacuuggg

SEQ ID NO: 1110948 - RNA, 22 nt, Homo sapiens
cuguaauuaaguaaaccaaaaa

SEQ ID NO: 1110949 - RNA, 16 nt, Homo sapiens
cuguaauuuuguagua

SEQ ID NO: 1110950 - RNA, 20 nt, Homo sapiens
cuguagauaaagugguuuga

SEQ ID NO: 1110951 - RNA, 17 nt, Homo sapiens
cuguagugagaaacuga

SEQ ID NO: 1110952 - RNA, 22 nt, Homo sapiens
cuguaguugcguggacucugca

SEQ ID NO: 1110953 - RNA, 23 nt, Homo sapiens
cuguaguugcguggacucugcac

SEQ ID NO: 1110954 - RNA, 20 nt, Homo sapiens
cuguauacagauucuagcca

SEQ ID NO: 1110955 - RNA, 16 nt, Homo sapiens
cuguauaguacuggca

SEQ ID NO: 1110956 - RNA, 14 nt, Homo sapiens
cuguauggcacuua

SEQ ID NO: 1110957 - RNA, 21 nt, Homo sapiens
cugucaacacuucucacaucu

SEQ ID NO: 1110958 - RNA, 23 nt, Homo sapiens
cugucacaucagcuccacuuuca

SEQ ID NO: 1110959 - RNA, 15 nt, Homo sapiens
cugucaccaagccuu

SEQ ID NO: 1110960 - RNA, 13 nt, Homo sapiens
cuguccaaaugga

SEQ ID NO: 1110961 - RNA, 15 nt, Homo sapiens
cuguccccacacuga

SEQ ID NO: 1110962 - RNA, 16 nt, Homo sapiens
cuguccccacagcagg

SEQ ID NO: 1110963 - RNA, 14 nt, Homo sapiens
cugucgcccagucu

SEQ ID NO: 1110964 - RNA, 15 nt, Homo sapiens
cugucucucaugaac

SEQ ID NO: 1110965 - RNA, 17 nt, Homo sapiens
cugucucucaugaaccu

SEQ ID NO: 1110966 - RNA, 18 nt, Homo sapiens
cugucucucaugaaccuc

SEQ ID NO: 1110967 - RNA, 20 nt, Homo sapiens
cugucucucaugaaccucaa

SEQ ID NO: 1110968 - RNA, 16 nt, Homo sapiens
cugucucucucugucc

SEQ ID NO: 1110969 - RNA, 16 nt, Homo sapiens
cugucuggcugaggau

SEQ ID NO: 1110970 - RNA, 20 nt, Homo sapiens
cugugaaagaaccaaaagag

SEQ ID NO: 1110971 - RNA, 23 nt, Homo sapiens
cugugccucgcuccccacucugc

SEQ ID NO: 1110972 - RNA, 17 nt, Homo sapiens
cugugccucugccuguc

SEQ ID NO: 1110973 - RNA, 21 nt, Homo sapiens
cuguggcugcuagcacuugga

SEQ ID NO: 1110974 - RNA, 16 nt, Homo sapiens
cuguggugauguugcc

SEQ ID NO: 1110975 - RNA, 21 nt, Homo sapiens
cuguguaaaacuauauucuca

SEQ ID NO: 1110976 - RNA, 17 nt, Homo sapiens
cuguguaaccuccacag

SEQ ID NO: 1110977 - RNA, 21 nt, Homo sapiens
cuguguacagaauucugcuac

SEQ ID NO: 1110978 - RNA, 23 nt, Homo sapiens
cuguguagcucuguccacucuga

SEQ ID NO: 1110979 - RNA, 15 nt, Homo sapiens
cuguguagcugugac

SEQ ID NO: 1110980 - RNA, 20 nt, Homo sapiens
cugugucuugcaauggcagc

SEQ ID NO: 1110981 - RNA, 23 nt, Homo sapiens
cugugugccauuuuaagaguuac

SEQ ID NO: 1110982 - RNA, 19 nt, Homo sapiens
cuguguguuuuaguuucau

SEQ ID NO: 1110983 - RNA, 18 nt, Homo sapiens
cuguguuucuggggacac

SEQ ID NO: 1110984 - RNA, 17 nt, Homo sapiens
cuguguuucuugccuca

SEQ ID NO: 1110985 - RNA, 20 nt, Homo sapiens
cuguuaacuuaauaguauuu

SEQ ID NO: 1110986 - RNA, 14 nt, Homo sapiens
cuguuacccagaga

SEQ ID NO: 1110987 - RNA, 17 nt, Homo sapiens
cuguuacugaaaguggu

SEQ ID NO: 1110988 - RNA, 22 nt, Homo sapiens
cuguuacuugaaauaccaguga

SEQ ID NO: 1110989 - RNA, 16 nt, Homo sapiens
cuguuagucauuugcu

SEQ ID NO: 1110990 - RNA, 18 nt, Homo sapiens
cuguuauuuaauuagcca

SEQ ID NO: 1110991 - RNA, 19 nt, Homo sapiens
cuguucucaaaugcuaaau

SEQ ID NO: 1110992 - RNA, 22 nt, Homo sapiens
cuguugggaaaaccgauaaaga

SEQ ID NO: 1110993 - RNA, 20 nt, Homo sapiens
cuguuguaggguugccagau

SEQ ID NO: 1110994 - RNA, 19 nt, Homo sapiens
cuguuuccauagggugaca

SEQ ID NO: 1110995 - RNA, 15 nt, Homo sapiens
cuguuuuuauaugca

SEQ ID NO: 1110996 - RNA, 17 nt, Homo sapiens
cuuaaaauauauuucag

SEQ ID NO: 1110997 - RNA, 21 nt, Homo sapiens
cuuaaauaaauucaaaccauu

SEQ ID NO: 1110998 - RNA, 14 nt, Homo sapiens
cuuaacauucugua

SEQ ID NO: 1110999 - RNA, 17 nt, Homo sapiens
cuuaacggcuccaggau

SEQ ID NO: 1111000 - RNA, 14 nt, Homo sapiens
cuuaacuauucaau

SEQ ID NO: 1111001 - RNA, 22 nt, Homo sapiens
cuuaauggcucaugaccuggaa

SEQ ID NO: 1111002 - RNA, 14 nt, Homo sapiens
cuuaauggguacaa

SEQ ID NO: 1111003 - RNA, 22 nt, Homo sapiens
cuuaauguucugaauaauuucu

SEQ ID NO: 1111004 - RNA, 17 nt, Homo sapiens
cuuaccaggcaccaaaa

SEQ ID NO: 1111005 - RNA, 16 nt, Homo sapiens
cuuaccucacagugau

SEQ ID NO: 1111006 - RNA, 16 nt, Homo sapiens
cuuagacuucgacuca

SEQ ID NO: 1111007 - RNA, 23 nt, Homo sapiens
cuuagauuagcucuggaccagcc

SEQ ID NO: 1111008 - RNA, 16 nt, Homo sapiens
cuuagcaccacaaaua

SEQ ID NO: 1111009 - RNA, 16 nt, Homo sapiens
cuuagcugucugcuca

SEQ ID NO: 1111010 - RNA, 17 nt, Homo sapiens
cuuagucacuuauuuca

SEQ ID NO: 1111011 - RNA, 16 nt, Homo sapiens
cuuauaaaaaucuuaa

SEQ ID NO: 1111012 - RNA, 15 nt, Homo sapiens
cuuauaucaucagca

SEQ ID NO: 1111013 - RNA, 17 nt, Homo sapiens
cuuauaucaucagcaua

SEQ ID NO: 1111014 - RNA, 20 nt, Homo sapiens
cuuauaucaucagcauaccu

SEQ ID NO: 1111015 - RNA, 20 nt, Homo sapiens
cuuaugaaaugggcuuuaac

SEQ ID NO: 1111016 - RNA, 15 nt, Homo sapiens
cuuauguauuuauga

SEQ ID NO: 1111017 - RNA, 18 nt, Homo sapiens
cuuauucuaggucuguaa

SEQ ID NO: 1111018 - RNA, 14 nt, Homo sapiens
cuuauuguaccucu

SEQ ID NO: 1111019 - RNA, 14 nt, Homo sapiens
cuuauuguacuugu

SEQ ID NO: 1111020 - RNA, 15 nt, Homo sapiens
cuuauuucauaaaca

SEQ ID NO: 1111021 - RNA, 12 nt, Homo sapiens
cuuauuugcaau

SEQ ID NO: 1111022 - RNA, 14 nt, Homo sapiens
cuuauuugguauaa

SEQ ID NO: 1111023 - RNA, 22 nt, Homo sapiens
cuuauuuuugaauugacugaga

SEQ ID NO: 1111024 - RNA, 21 nt, Homo sapiens
cuucaagugauauauguauuu

SEQ ID NO: 1111025 - RNA, 17 nt, Homo sapiens
cuucagaagacacugca

SEQ ID NO: 1111026 - RNA, 16 nt, Homo sapiens
cuucagagaagucagu

SEQ ID NO: 1111027 - RNA, 14 nt, Homo sapiens
cuucagguggaaaa

SEQ ID NO: 1111028 - RNA, 22 nt, Homo sapiens
cuucagucuugaauuucuaaaa

SEQ ID NO: 1111029 - RNA, 22 nt, Homo sapiens
cuucaucaauuuuuauacauau

SEQ ID NO: 1111030 - RNA, 16 nt, Homo sapiens
cuucaugcauuugcac

SEQ ID NO: 1111031 - RNA, 14 nt, Homo sapiens
cuucauggaacuca

SEQ ID NO: 1111032 - RNA, 22 nt, Homo sapiens
cuucauugaccaagaugaucac

SEQ ID NO: 1111033 - RNA, 18 nt, Homo sapiens
cuucauuugaugcuaaau

SEQ ID NO: 1111034 - RNA, 23 nt, Homo sapiens
cuuccacaccuagcaucucauga

SEQ ID NO: 1111035 - RNA, 15 nt, Homo sapiens
cuuccacuccaagug

SEQ ID NO: 1111036 - RNA, 16 nt, Homo sapiens
cuuccaguuugcuuug

SEQ ID NO: 1111037 - RNA, 13 nt, Homo sapiens
cuuccccacagaa

SEQ ID NO: 1111038 - RNA, 13 nt, Homo sapiens
cuucccugaucaa

SEQ ID NO: 1111039 - RNA, 21 nt, Homo sapiens
cuucccuggcuuguaacucca

SEQ ID NO: 1111040 - RNA, 13 nt, Homo sapiens
cuuccuaccaaau

SEQ ID NO: 1111041 - RNA, 15 nt, Homo sapiens
cuuccuaccaaauau

SEQ ID NO: 1111042 - RNA, 13 nt, Homo sapiens
cuuccugccaagc

SEQ ID NO: 1111043 - RNA, 15 nt, Homo sapiens
cuuccuggaagcaga

SEQ ID NO: 1111044 - RNA, 20 nt, Homo sapiens
cuuccuguaacacaagccac

SEQ ID NO: 1111045 - RNA, 19 nt, Homo sapiens
cuuccuucgcagcuuuuag

SEQ ID NO: 1111046 - RNA, 18 nt, Homo sapiens
cuucuaaaugaagugcaa

SEQ ID NO: 1111047 - RNA, 22 nt, Homo sapiens
cuucuauuccauggcuaacugg

SEQ ID NO: 1111048 - RNA, 16 nt, Homo sapiens
cuucuccaaaugagau

SEQ ID NO: 1111049 - RNA, 21 nt, Homo sapiens
cuucucucggggcgaccccuc

SEQ ID NO: 1111050 - RNA, 14 nt, Homo sapiens
cuucucuuugccuc

SEQ ID NO: 1111051 - RNA, 15 nt, Homo sapiens
cuucucuuugccuca

SEQ ID NO: 1111052 - RNA, 14 nt, Homo sapiens
cuucugaagaucuc

SEQ ID NO: 1111053 - RNA, 19 nt, Homo sapiens
cuucugaagaucucagaua

SEQ ID NO: 1111054 - RNA, 18 nt, Homo sapiens
cuucugccccagcuuugc

SEQ ID NO: 1111055 - RNA, 19 nt, Homo sapiens
cuucuggagucuccagugg

SEQ ID NO: 1111056 - RNA, 16 nt, Homo sapiens
cuucugggaagacaac

SEQ ID NO: 1111057 - RNA, 22 nt, Homo sapiens
cuucuguucucaaaugcuaaau

SEQ ID NO: 1111058 - RNA, 18 nt, Homo sapiens
cuucuucuuagcaccaca

SEQ ID NO: 1111059 - RNA, 20 nt, Homo sapiens
cuucuuuuaguuguaucucu

SEQ ID NO: 1111060 - RNA, 19 nt, Homo sapiens
cuucuuuuauaacuagucc

SEQ ID NO: 1111061 - RNA, 22 nt, Homo sapiens
cuugaaacauagagaucuaugu

SEQ ID NO: 1111062 - RNA, 13 nt, Homo sapiens
cuugaagaacuga

SEQ ID NO: 1111063 - RNA, 16 nt, Homo sapiens
cuugaagaauauuguu

SEQ ID NO: 1111064 - RNA, 18 nt, Homo sapiens
cuugaagacaauggcuua

SEQ ID NO: 1111065 - RNA, 13 nt, Homo sapiens
cuugaaucaaagc

SEQ ID NO: 1111066 - RNA, 17 nt, Homo sapiens
cuugacagaacacuguc

SEQ ID NO: 1111067 - RNA, 14 nt, Homo sapiens
cuugacagggcaca

SEQ ID NO: 1111068 - RNA, 21 nt, Homo sapiens
cuugagaaaccuuauuguacc

SEQ ID NO: 1111069 - RNA, 20 nt, Homo sapiens
cuugagccaguaauuggucc

SEQ ID NO: 1111070 - RNA, 12 nt, Homo sapiens
cuugagcugucc

SEQ ID NO: 1111071 - RNA, 18 nt, Homo sapiens
cuugagcuuggcagcuga

SEQ ID NO: 1111072 - RNA, 22 nt, Homo sapiens
cuugauaaugggaugaauggaa

SEQ ID NO: 1111073 - RNA, 20 nt, Homo sapiens
cuugauuuagcacuauuuac

SEQ ID NO: 1111074 - RNA, 21 nt, Homo sapiens
cuugcagauacauucaugagg

SEQ ID NO: 1111075 - RNA, 13 nt, Homo sapiens
cuugcauacagag

SEQ ID NO: 1111076 - RNA, 18 nt, Homo sapiens
cuugcauacagagacaga

SEQ ID NO: 1111077 - RNA, 12 nt, Homo sapiens
cuugccagacau

SEQ ID NO: 1111078 - RNA, 21 nt, Homo sapiens
cuugccagccagaagccucug

SEQ ID NO: 1111079 - RNA, 16 nt, Homo sapiens
cuugcccugaccuccc

SEQ ID NO: 1111080 - RNA, 16 nt, Homo sapiens
cuugccugaauccauc

SEQ ID NO: 1111081 - RNA, 18 nt, Homo sapiens
cuugccugaauccaucag

SEQ ID NO: 1111082 - RNA, 15 nt, Homo sapiens
cuugcuuuccccggg

SEQ ID NO: 1111083 - RNA, 22 nt, Homo sapiens
cuuggaaagcaucaccucaggc

SEQ ID NO: 1111084 - RNA, 13 nt, Homo sapiens
cuuggacuccucc

SEQ ID NO: 1111085 - RNA, 15 nt, Homo sapiens
cuuggagaacuuucc

SEQ ID NO: 1111086 - RNA, 18 nt, Homo sapiens
cuuggaggccaccgggac

SEQ ID NO: 1111087 - RNA, 20 nt, Homo sapiens
cuuggggagauggaguucuu

SEQ ID NO: 1111088 - RNA, 23 nt, Homo sapiens
cuugggggaggaggaacaaauaa

SEQ ID NO: 1111089 - RNA, 20 nt, Homo sapiens
cuuguaaaggugcugcacug

SEQ ID NO: 1111090 - RNA, 15 nt, Homo sapiens
cuuguauauacauau

SEQ ID NO: 1111091 - RNA, 12 nt, Homo sapiens
cuuguaucugaa

SEQ ID NO: 1111092 - RNA, 21 nt, Homo sapiens
cuugucagugcucggcuguaa

SEQ ID NO: 1111093 - RNA, 16 nt, Homo sapiens
cuugucucacuugugc

SEQ ID NO: 1111094 - RNA, 16 nt, Homo sapiens
cuugugccauagucac

SEQ ID NO: 1111095 - RNA, 18 nt, Homo sapiens
cuugugguuuaugucauc

SEQ ID NO: 1111096 - RNA, 13 nt, Homo sapiens
cuuguugcugagu

SEQ ID NO: 1111097 - RNA, 18 nt, Homo sapiens
cuuuaaaaagcaguccuc

SEQ ID NO: 1111098 - RNA, 15 nt, Homo sapiens
cuuuacaaauauguc

SEQ ID NO: 1111099 - RNA, 20 nt, Homo sapiens
cuuuagagccagcccauggc

SEQ ID NO: 1111100 - RNA, 14 nt, Homo sapiens
cuuuagcuaccuca

SEQ ID NO: 1111101 - RNA, 19 nt, Homo sapiens
cuuuaggagacuaauggaa

SEQ ID NO: 1111102 - RNA, 18 nt, Homo sapiens
cuuuaggcagcagcuuuu

SEQ ID NO: 1111103 - RNA, 17 nt, Homo sapiens
cuuuauagccuguaacc

SEQ ID NO: 1111104 - RNA, 17 nt, Homo sapiens
cuuuaugguuucuccag

SEQ ID NO: 1111105 - RNA, 19 nt, Homo sapiens
cuuuccucagaucauccag

SEQ ID NO: 1111106 - RNA, 20 nt, Homo sapiens
cuuuccugggggaugugcac

SEQ ID NO: 1111107 - RNA, 16 nt, Homo sapiens
cuuucuggaaaagagg

SEQ ID NO: 1111108 - RNA, 15 nt, Homo sapiens
cuuucugggccaagu

SEQ ID NO: 1111109 - RNA, 18 nt, Homo sapiens
cuuucuuauuuuguaaua

SEQ ID NO: 1111110 - RNA, 16 nt, Homo sapiens
cuuucuucaccaaauc

SEQ ID NO: 1111111 - RNA, 17 nt, Homo sapiens
cuuugaauaaagucuga

SEQ ID NO: 1111112 - RNA, 17 nt, Homo sapiens
cuuugaauuucccaguc

SEQ ID NO: 1111113 - RNA, 17 nt, Homo sapiens
cuuugacucaccuguua

SEQ ID NO: 1111114 - RNA, 16 nt, Homo sapiens
cuuugauucaaagcac

SEQ ID NO: 1111115 - RNA, 21 nt, Homo sapiens
cuuugggauugcuaugaauga

SEQ ID NO: 1111116 - RNA, 22 nt, Homo sapiens
cuuugugcaaaagggucuggcu

SEQ ID NO: 1111117 - RNA, 16 nt, Homo sapiens
cuuuuaaaugcauaaa

SEQ ID NO: 1111118 - RNA, 13 nt, Homo sapiens
cuuuuaaguugcu

SEQ ID NO: 1111119 - RNA, 20 nt, Homo sapiens
cuuuuagaccaaaauaugaa

SEQ ID NO: 1111120 - RNA, 23 nt, Homo sapiens
cuuuuagaccaaaauaugaaaga

SEQ ID NO: 1111121 - RNA, 20 nt, Homo sapiens
cuuuuaucugcccagaauuc

SEQ ID NO: 1111122 - RNA, 19 nt, Homo sapiens
cuuuuaucuuggacugaca

SEQ ID NO: 1111123 - RNA, 14 nt, Homo sapiens
cuuuuaugccuuca

SEQ ID NO: 1111124 - RNA, 17 nt, Homo sapiens
cuuuuauucauuagcug

SEQ ID NO: 1111125 - RNA, 20 nt, Homo sapiens
cuuuuauucauuagcuguga

SEQ ID NO: 1111126 - RNA, 15 nt, Homo sapiens
cuuuucauaaccuag

SEQ ID NO: 1111127 - RNA, 18 nt, Homo sapiens
cuuuucauaaccuagccu

SEQ ID NO: 1111128 - RNA, 17 nt, Homo sapiens
cuuuuccaaaauuacuu

SEQ ID NO: 1111129 - RNA, 11 nt, Homo sapiens
cuuuuucacac

SEQ ID NO: 1111130 - RNA, 17 nt, Homo sapiens
cuuuuuuaaaugaagaa

SEQ ID NO: 1111131 - RNA, 21 nt, Homo sapiens
cuuuuuucaaugguaugcaaa

SEQ ID NO: 1111132 - RNA, 22 nt, Homo sapiens
cuuuuuuuugagaauacacuau

SEQ ID NO: 1111133 - RNA, 22 nt, Homo sapiens
gaaaaaccaaugauucauaaca

SEQ ID NO: 1111134 - RNA, 13 nt, Homo sapiens
gaaaaccagcgca

SEQ ID NO: 1111135 - RNA, 23 nt, Homo sapiens
gaaaacugccuuuuaucugccca

SEQ ID NO: 1111136 - RNA, 15 nt, Homo sapiens
gaaaacuggaaaucu

SEQ ID NO: 1111137 - RNA, 18 nt, Homo sapiens
gaaaagaaaaaaaauaau

SEQ ID NO: 1111138 - RNA, 15 nt, Homo sapiens
gaaaagaaaccagag

SEQ ID NO: 1111139 - RNA, 12 nt, Homo sapiens
gaaaagcacuuu

SEQ ID NO: 1111140 - RNA, 21 nt, Homo sapiens
gaaaagcacuuuacagaugag

SEQ ID NO: 1111141 - RNA, 15 nt, Homo sapiens
gaaaagcugcugaca

SEQ ID NO: 1111142 - RNA, 17 nt, Homo sapiens
gaaaauaaaagcacuua

SEQ ID NO: 1111143 - RNA, 18 nt, Homo sapiens
gaaaaucaaccagcagga

SEQ ID NO: 1111144 - RNA, 19 nt, Homo sapiens
gaaaaucugcacugugggc

SEQ ID NO: 1111145 - RNA, 12 nt, Homo sapiens
gaaaaugcauua

SEQ ID NO: 1111146 - RNA, 14 nt, Homo sapiens
gaaaauguacaaua

SEQ ID NO: 1111147 - RNA, 14 nt, Homo sapiens
gaaaauuaacacug

SEQ ID NO: 1111148 - RNA, 15 nt, Homo sapiens
gaaaauuaugagucu

SEQ ID NO: 1111149 - RNA, 20 nt, Homo sapiens
gaaaauuucuucgaucccaa

SEQ ID NO: 1111150 - RNA, 19 nt, Homo sapiens
gaaacaagcaacagaugga

SEQ ID NO: 1111151 - RNA, 15 nt, Homo sapiens
gaaacaagguuuuca

SEQ ID NO: 1111152 - RNA, 22 nt, Homo sapiens
gaaaccagagucaaauuugaaa

SEQ ID NO: 1111153 - RNA, 17 nt, Homo sapiens
gaaacuaacacagccau

SEQ ID NO: 1111154 - RNA, 18 nt, Homo sapiens
gaaacugaaaacuguaaa

SEQ ID NO: 1111155 - RNA, 21 nt, Homo sapiens
gaaacugaggccauuauuuca

SEQ ID NO: 1111156 - RNA, 19 nt, Homo sapiens
gaaacuggaugaggucaua

SEQ ID NO: 1111157 - RNA, 23 nt, Homo sapiens
gaaagaauuauuuuuguguuucu

SEQ ID NO: 1111158 - RNA, 21 nt, Homo sapiens
gaaagacauagccaacugcug

SEQ ID NO: 1111159 - RNA, 18 nt, Homo sapiens
gaaagaguccuauuugca

SEQ ID NO: 1111160 - RNA, 14 nt, Homo sapiens
gaaagauggaacuu

SEQ ID NO: 1111161 - RNA, 19 nt, Homo sapiens
gaaagccucugcugccaug

SEQ ID NO: 1111162 - RNA, 16 nt, Homo sapiens
gaaagggauaguccaa

SEQ ID NO: 1111163 - RNA, 16 nt, Homo sapiens
gaaagguuauguuagc

SEQ ID NO: 1111164 - RNA, 17 nt, Homo sapiens
gaaaguaagugguagcu

SEQ ID NO: 1111165 - RNA, 23 nt, Homo sapiens
gaaaguggccaugccacccuguu

SEQ ID NO: 1111166 - RNA, 14 nt, Homo sapiens
gaaaguucaaaaag

SEQ ID NO: 1111167 - RNA, 15 nt, Homo sapiens
gaaaguuugcacugu

SEQ ID NO: 1111168 - RNA, 16 nt, Homo sapiens
gaaauaaaugauguac

SEQ ID NO: 1111169 - RNA, 13 nt, Homo sapiens
gaaauaauguucu

SEQ ID NO: 1111170 - RNA, 15 nt, Homo sapiens
gaaauaccagugaac

SEQ ID NO: 1111171 - RNA, 17 nt, Homo sapiens
gaaauaccagugaacca

SEQ ID NO: 1111172 - RNA, 15 nt, Homo sapiens
gaaauagacaguaua

SEQ ID NO: 1111173 - RNA, 15 nt, Homo sapiens
gaaauauaaugcaaa

SEQ ID NO: 1111174 - RNA, 16 nt, Homo sapiens
gaaauauuauuggugu

SEQ ID NO: 1111175 - RNA, 20 nt, Homo sapiens
gaaaucagaagccuacuuug

SEQ ID NO: 1111176 - RNA, 20 nt, Homo sapiens
gaaaucugaggaaggugcuu

SEQ ID NO: 1111177 - RNA, 21 nt, Homo sapiens
gaaaugaaacaaauaaucaca

SEQ ID NO: 1111178 - RNA, 17 nt, Homo sapiens
gaaaugauaaagauguc

SEQ ID NO: 1111179 - RNA, 23 nt, Homo sapiens
gaaaugcccaucuaugucccuug

SEQ ID NO: 1111180 - RNA, 21 nt, Homo sapiens
gaaaugcuacaaacauaucaa

SEQ ID NO: 1111181 - RNA, 15 nt, Homo sapiens
gaaauggagaagcuc

SEQ ID NO: 1111182 - RNA, 21 nt, Homo sapiens
gaaaugggcuuuaacaaaaca

SEQ ID NO: 1111183 - RNA, 17 nt, Homo sapiens
gaaauuauaucuguggu

SEQ ID NO: 1111184 - RNA, 14 nt, Homo sapiens
gaacaagcaacaua

SEQ ID NO: 1111185 - RNA, 21 nt, Homo sapiens
gaacaaugaauuauccagcau

SEQ ID NO: 1111186 - RNA, 19 nt, Homo sapiens
gaacacagccugggaccag

SEQ ID NO: 1111187 - RNA, 14 nt, Homo sapiens
gaacacagugccug

SEQ ID NO: 1111188 - RNA, 17 nt, Homo sapiens
gaacacgaauugcucaa

SEQ ID NO: 1111189 - RNA, 20 nt, Homo sapiens
gaacagacaacagaagucau

SEQ ID NO: 1111190 - RNA, 12 nt, Homo sapiens
gaacaucugugu

SEQ ID NO: 1111191 - RNA, 15 nt, Homo sapiens
gaaccaauauuugua

SEQ ID NO: 1111192 - RNA, 17 nt, Homo sapiens
gaaccaaucccgugaaa

SEQ ID NO: 1111193 - RNA, 15 nt, Homo sapiens
gaaccauccuuccca

SEQ ID NO: 1111194 - RNA, 14 nt, Homo sapiens
gaaccaugaagcug

SEQ ID NO: 1111195 - RNA, 17 nt, Homo sapiens
gaaccaugguaugaagg

SEQ ID NO: 1111196 - RNA, 14 nt, Homo sapiens
gaaccucaaacugg

SEQ ID NO: 1111197 - RNA, 23 nt, Homo sapiens
gaacgaguuguuggcugcucccu

SEQ ID NO: 1111198 - RNA, 13 nt, Homo sapiens
gaaggaugaauga

SEQ ID NO: 1111199 - RNA, 23 nt, Homo sapiens
gaaggaugucccggguguguaca

SEQ ID NO: 1111200 - RNA, 21 nt, Homo sapiens
gaaggcccaggucaacaucua

SEQ ID NO: 1111201 - RNA, 10 nt, Homo sapiens
gaagggccag

SEQ ID NO: 1111202 - RNA, 22 nt, Homo sapiens
gaagguauuccuuuuguguaca

SEQ ID NO: 1111203 - RNA, 20 nt, Homo sapiens
gaaggucccaccuccauuug

SEQ ID NO: 1111204 - RNA, 20 nt, Homo sapiens
gaaggugcugacaaagauga

SEQ ID NO: 1111205 - RNA, 22 nt, Homo sapiens
gaaguagaauuuguccaauaac

SEQ ID NO: 1111206 - RNA, 14 nt, Homo sapiens
gaaguaugagggaa

SEQ ID NO: 1111207 - RNA, 22 nt, Homo sapiens
gaaguauuuuccuccaggcaaa

SEQ ID NO: 1111208 - RNA, 13 nt, Homo sapiens
gaagucacaucac

SEQ ID NO: 1111209 - RNA, 15 nt, Homo sapiens
gaagucuugucucaa

SEQ ID NO: 1111210 - RNA, 17 nt, Homo sapiens
gaagucuugucucaaga

SEQ ID NO: 1111211 - RNA, 16 nt, Homo sapiens
gaagugagaaaccagc

SEQ ID NO: 1111212 - RNA, 11 nt, Homo sapiens
gaaguguaauu

SEQ ID NO: 1111213 - RNA, 15 nt, Homo sapiens
gaaguuaagaaccug

SEQ ID NO: 1111214 - RNA, 19 nt, Homo sapiens
gaaguuccaguguucucuc

SEQ ID NO: 1111215 - RNA, 16 nt, Homo sapiens
gaauaaacaggaaaau

SEQ ID NO: 1111216 - RNA, 17 nt, Homo sapiens
gaauaaagcccuugaac

SEQ ID NO: 1111217 - RNA, 14 nt, Homo sapiens
gaauaaaugaaucu

SEQ ID NO: 1111218 - RNA, 22 nt, Homo sapiens
gaauaaaugaaucuuacuccuu

SEQ ID NO: 1111219 - RNA, 17 nt, Homo sapiens
gaauaaauugcuccuug

SEQ ID NO: 1111220 - RNA, 14 nt, Homo sapiens
gaauaccaguguua

SEQ ID NO: 1111221 - RNA, 22 nt, Homo sapiens
gaauacuuaacucaauaauucu

SEQ ID NO: 1111222 - RNA, 23 nt, Homo sapiens
gaauaguguuggaaaaugugcaa

SEQ ID NO: 1111223 - RNA, 19 nt, Homo sapiens
gaauauaaauuuguguucu

SEQ ID NO: 1111224 - RNA, 22 nt, Homo sapiens
gaaucaaagcaguuaacuuuaa

SEQ ID NO: 1111225 - RNA, 16 nt, Homo sapiens
gaauccaaagaucaca

SEQ ID NO: 1111226 - RNA, 21 nt, Homo sapiens
gaauccaucaggacuugggaa

SEQ ID NO: 1111227 - RNA, 14 nt, Homo sapiens
gaaucuacagaaca

SEQ ID NO: 1111228 - RNA, 13 nt, Homo sapiens
gaaugaagcaugu

SEQ ID NO: 1111229 - RNA, 13 nt, Homo sapiens
gaaugacacuguu

SEQ ID NO: 1111230 - RNA, 17 nt, Homo sapiens
gaaugagaagaaugacu

SEQ ID NO: 1111231 - RNA, 17 nt, Homo sapiens
gaaugcaaaccauagca

SEQ ID NO: 1111232 - RNA, 22 nt, Homo sapiens
gaaugcaaaguagcaauuucca

SEQ ID NO: 1111233 - RNA, 17 nt, Homo sapiens
gaaugccucaaugugac

SEQ ID NO: 1111234 - RNA, 15 nt, Homo sapiens
gaaugcggaaccaua

SEQ ID NO: 1111235 - RNA, 20 nt, Homo sapiens
gaaugcggccgcauucccug

SEQ ID NO: 1111236 - RNA, 15 nt, Homo sapiens
gaaugguccaggguu

SEQ ID NO: 1111237 - RNA, 19 nt, Homo sapiens
gaaugugguccagacguca

SEQ ID NO: 1111238 - RNA, 21 nt, Homo sapiens
gaaugugugaaggucuugccu

SEQ ID NO: 1111239 - RNA, 19 nt, Homo sapiens
gaauuauuuuuguguuucu

SEQ ID NO: 1111240 - RNA, 23 nt, Homo sapiens
gaauugagauaauaucugugagg

SEQ ID NO: 1111241 - RNA, 18 nt, Homo sapiens
gaauuucaguaaacaaug

SEQ ID NO: 1111242 - RNA, 14 nt, Homo sapiens
gaauuugguaaauu

SEQ ID NO: 1111243 - RNA, 15 nt, Homo sapiens
gaauuuuaagugcuu

SEQ ID NO: 1111244 - RNA, 14 nt, Homo sapiens
gaauuuucuuccaa

SEQ ID NO: 1111245 - RNA, 13 nt, Homo sapiens
gaauuuuguugcu

SEQ ID NO: 1111246 - RNA, 16 nt, Homo sapiens
gaauuuuuaaacaagu

SEQ ID NO: 1111247 - RNA, 21 nt, Homo sapiens
gacaaagccaaacucugccag

SEQ ID NO: 1111248 - RNA, 16 nt, Homo sapiens
gacaaauaauaagcaa

SEQ ID NO: 1111249 - RNA, 21 nt, Homo sapiens
gacaacauuucucaaaugcac

SEQ ID NO: 1111250 - RNA, 12 nt, Homo sapiens
gacaacauuuua

SEQ ID NO: 1111251 - RNA, 15 nt, Homo sapiens
gacaagcaugguccc

SEQ ID NO: 1111252 - RNA, 21 nt, Homo sapiens
gacaaugucacauaaugaaug

SEQ ID NO: 1111253 - RNA, 13 nt, Homo sapiens
gacacauaugcac

SEQ ID NO: 1111254 - RNA, 14 nt, Homo sapiens
gacaccucacugag

SEQ ID NO: 1111255 - RNA, 15 nt, Homo sapiens
gacacugcaaaggcg

SEQ ID NO: 1111256 - RNA, 18 nt, Homo sapiens
gacacuguaugacucucc

SEQ ID NO: 1111257 - RNA, 15 nt, Homo sapiens
gacagaaaugcaauc

SEQ ID NO: 1111258 - RNA, 22 nt, Homo sapiens
gacagccagagccugucuuuca

SEQ ID NO: 1111259 - RNA, 17 nt, Homo sapiens
gacaguguuuucuggga

SEQ ID NO: 1111260 - RNA, 21 nt, Homo sapiens
gacaguuacucuucaguuuua

SEQ ID NO: 1111261 - RNA, 21 nt, Homo sapiens
gacauaaaugaggaaacucca

SEQ ID NO: 1111262 - RNA, 20 nt, Homo sapiens
guggaccacaggcaucuaca

SEQ ID NO: 1111263 - RNA, 13 nt, Homo sapiens
guggccaguauuu

SEQ ID NO: 1111264 - RNA, 18 nt, Homo sapiens
guggcccagggaagccaa

SEQ ID NO: 1111265 - RNA, 14 nt, Homo sapiens
guggcgacucuaua

SEQ ID NO: 1111266 - RNA, 13 nt, Homo sapiens
gugggacugagau

SEQ ID NO: 1111267 - RNA, 20 nt, Homo sapiens
gugggaggguaccagcagaa

SEQ ID NO: 1111268 - RNA, 12 nt, Homo sapiens
gugguaccagcu

SEQ ID NO: 1111269 - RNA, 15 nt, Homo sapiens
gugguaccagcucac

SEQ ID NO: 1111270 - RNA, 12 nt, Homo sapiens
gugguccagcuc

SEQ ID NO: 1111271 - RNA, 23 nt, Homo sapiens
guggugagccgagauugcaccau

SEQ ID NO: 1111272 - RNA, 23 nt, Homo sapiens
gugguggcauacgccuguagucc

SEQ ID NO: 1111273 - RNA, 18 nt, Homo sapiens
guguaaagaauaaaugaa

SEQ ID NO: 1111274 - RNA, 23 nt, Homo sapiens
guguaaauggagcuuguacauau

SEQ ID NO: 1111275 - RNA, 14 nt, Homo sapiens
guguagccugugca

SEQ ID NO: 1111276 - RNA, 18 nt, Homo sapiens
gugucaugauuucaauga

SEQ ID NO: 1111277 - RNA, 12 nt, Homo sapiens
gugucucaggag

SEQ ID NO: 1111278 - RNA, 18 nt, Homo sapiens
gugugaugggaucuguaa

SEQ ID NO: 1111279 - RNA, 11 nt, Homo sapiens
gugugccaaac

SEQ ID NO: 1111280 - RNA, 14 nt, Homo sapiens
gugugccauuuuaa

SEQ ID NO: 1111281 - RNA, 22 nt, Homo sapiens
guguguaucgcugccuugccau

SEQ ID NO: 1111282 - RNA, 22 nt, Homo sapiens
gugugugcacguacacacacau

SEQ ID NO: 1111283 - RNA, 19 nt, Homo sapiens
guguuacccaguaacucau

SEQ ID NO: 1111284 - RNA, 21 nt, Homo sapiens
guguuauuaaugacaaaggca

SEQ ID NO: 1111285 - RNA, 23 nt, Homo sapiens
guguuauuauuuggcaugcuuaa

SEQ ID NO: 1111286 - RNA, 20 nt, Homo sapiens
guguuggaaaaugugcaaua

SEQ ID NO: 1111287 - RNA, 14 nt, Homo sapiens
guguuucaagcuac

SEQ ID NO: 1111288 - RNA, 13 nt, Homo sapiens
guguuucuugccu

SEQ ID NO: 1111289 - RNA, 17 nt, Homo sapiens
guuaaaaauauuuucug

SEQ ID NO: 1111290 - RNA, 17 nt, Homo sapiens
guuaaacuacuuguaaa

SEQ ID NO: 1111291 - RNA, 19 nt, Homo sapiens
guuaaauaucacaucacuu

SEQ ID NO: 1111292 - RNA, 19 nt, Homo sapiens
guuaaccucagugucauuu

SEQ ID NO: 1111293 - RNA, 19 nt, Homo sapiens
guuaacuuaauaguauuua

SEQ ID NO: 1111294 - RNA, 19 nt, Homo sapiens
guuaaggcagugacuuuag

SEQ ID NO: 1111295 - RNA, 19 nt, Homo sapiens
guuaaggggagcaacagag

SEQ ID NO: 1111296 - RNA, 19 nt, Homo sapiens
guuaauacuuaacauugau

SEQ ID NO: 1111297 - RNA, 21 nt, Homo sapiens
guuacaucacaguguuugcaa

SEQ ID NO: 1111298 - RNA, 18 nt, Homo sapiens
guuacauguuugcaccuu

SEQ ID NO: 1111299 - RNA, 15 nt, Homo sapiens
guuaccaacuaccua

SEQ ID NO: 1111300 - RNA, 20 nt, Homo sapiens
guuacuugaaauaccaguga

SEQ ID NO: 1111301 - RNA, 21 nt, Homo sapiens
guuacuugaaauaccagugaa

SEQ ID NO: 1111302 - RNA, 18 nt, Homo sapiens
guuaggaaauaaaaccuu

SEQ ID NO: 1111303 - RNA, 20 nt, Homo sapiens
guuaguguguugucugugca

SEQ ID NO: 1111304 - RNA, 20 nt, Homo sapiens
guuauaaaucaaugucacuu

SEQ ID NO: 1111305 - RNA, 16 nt, Homo sapiens
guuauaagaaacagag

SEQ ID NO: 1111306 - RNA, 19 nt, Homo sapiens
guuauagaaacugauauau

SEQ ID NO: 1111307 - RNA, 19 nt, Homo sapiens
guuauagauauguagauaa

SEQ ID NO: 1111308 - RNA, 14 nt, Homo sapiens
guuaucaaccauau

SEQ ID NO: 1111309 - RNA, 19 nt, Homo sapiens
guuaucuguguagcaagcu

SEQ ID NO: 1111310 - RNA, 19 nt, Homo sapiens
guuauuuaugccucuguau

SEQ ID NO: 1111311 - RNA, 19 nt, Homo sapiens
guucaaauuuugcauugug

SEQ ID NO: 1111312 - RNA, 19 nt, Homo sapiens
guucaacuuuuccuuugaa

SEQ ID NO: 1111313 - RNA, 20 nt, Homo sapiens
guucaggagucccaaggaaa

SEQ ID NO: 1111314 - RNA, 14 nt, Homo sapiens
guucagugccuugg

SEQ ID NO: 1111315 - RNA, 17 nt, Homo sapiens
guuccaugaagaccaca

SEQ ID NO: 1111316 - RNA, 16 nt, Homo sapiens
guuccuuacugcagaa

SEQ ID NO: 1111317 - RNA, 22 nt, Homo sapiens
guucucuauugcugcucucuca

SEQ ID NO: 1111318 - RNA, 18 nt, Homo sapiens
guucucucguaacugguu

SEQ ID NO: 1111319 - RNA, 15 nt, Homo sapiens
guucugggacacagu

SEQ ID NO: 1111320 - RNA, 16 nt, Homo sapiens
guucugguaugaacuu

SEQ ID NO: 1111321 - RNA, 20 nt, Homo sapiens
guugaacaucucacuuugcc

SEQ ID NO: 1111322 - RNA, 21 nt, Homo sapiens
guugaagaagaguuugcaaau

SEQ ID NO: 1111323 - RNA, 22 nt, Homo sapiens
guugcucaaaucuauucagaca

SEQ ID NO: 1111324 - RNA, 16 nt, Homo sapiens
guugcuggacugucau

SEQ ID NO: 1111325 - RNA, 16 nt, Homo sapiens
guuggaaaaugugcaa

SEQ ID NO: 1111326 - RNA, 19 nt, Homo sapiens
guuggaaccguguccagca

SEQ ID NO: 1111327 - RNA, 22 nt, Homo sapiens
guuggaaccguguccagcacag

SEQ ID NO: 1111328 - RNA, 23 nt, Homo sapiens
guuggaaccguguccagcacaga

SEQ ID NO: 1111329 - RNA, 18 nt, Homo sapiens
guuggacccgcucuggac

SEQ ID NO: 1111330 - RNA, 22 nt, Homo sapiens
guuggacccgcucuggaccaac

SEQ ID NO: 1111331 - RNA, 21 nt, Homo sapiens
guuggccgugguccagcucuu

SEQ ID NO: 1111332 - RNA, 15 nt, Homo sapiens
guugggagcacugga

SEQ ID NO: 1111333 - RNA, 15 nt, Homo sapiens
guugucacaccugaa

SEQ ID NO: 1111334 - RNA, 15 nt, Homo sapiens
guuguucacauauau

SEQ ID NO: 1111335 - RNA, 13 nt, Homo sapiens
guuguuguuguug

SEQ ID NO: 1111336 - RNA, 16 nt, Homo sapiens
guuuaaaaaaaguaua

SEQ ID NO: 1111337 - RNA, 18 nt, Homo sapiens
guuuaaaaaaaguauaua

SEQ ID NO: 1111338 - RNA, 18 nt, Homo sapiens
aaaaaaccuucagugaaa

SEQ ID NO: 1111339 - RNA, 11 nt, Homo sapiens
aaaaaccaaug

SEQ ID NO: 1111340 - RNA, 12 nt, Homo sapiens
aaaaaccaauga

SEQ ID NO: 1111341 - RNA, 11 nt, Homo sapiens
aaaaacuaaaa

SEQ ID NO: 1111342 - RNA, 18 nt, Homo sapiens
aaaaacuaacacccaguc

SEQ ID NO: 1111343 - RNA, 19 nt, Homo sapiens
aaaaacuauuaacaacuug

SEQ ID NO: 1111344 - RNA, 12 nt, Homo sapiens
aaaaacuuccau

SEQ ID NO: 1111345 - RNA, 15 nt, Homo sapiens
aaaaacuuugacaaa

SEQ ID NO: 1111346 - RNA, 13 nt, Homo sapiens
aaaaagcaucaug

SEQ ID NO: 1111347 - RNA, 21 nt, Homo sapiens
aaaaagggauccguacauuca

SEQ ID NO: 1111348 - RNA, 22 nt, Homo sapiens
aaaaagggauccguacauucaa

SEQ ID NO: 1111349 - RNA, 16 nt, Homo sapiens
aaaaaguaaaugugau

SEQ ID NO: 1111350 - RNA, 17 nt, Homo sapiens
aaaaaguuaaucuucau

SEQ ID NO: 1111351 - RNA, 15 nt, Homo sapiens
aaaaaguugcacauu

SEQ ID NO: 1111352 - RNA, 22 nt, Homo sapiens
aaaaaguuucuaguaucacaua

SEQ ID NO: 1111353 - RNA, 21 nt, Homo sapiens
aaaaaucaugagauccuuuaa

SEQ ID NO: 1111354 - RNA, 13 nt, Homo sapiens
aaaaaucuuugau

SEQ ID NO: 1111355 - RNA, 14 nt, Homo sapiens
aaaaaugacuaaaa

SEQ ID NO: 1111356 - RNA, 16 nt, Homo sapiens
aaaaaugcauauacuu

SEQ ID NO: 1111357 - RNA, 13 nt, Homo sapiens
aaaaauugcacaa

SEQ ID NO: 1111358 - RNA, 17 nt, Homo sapiens
aaaacacaaaaguuucu

SEQ ID NO: 1111359 - RNA, 23 nt, Homo sapiens
aaaacacagagaugcugcaaaua

SEQ ID NO: 1111360 - RNA, 13 nt, Homo sapiens
aaaacagaaagca

SEQ ID NO: 1111361 - RNA, 18 nt, Homo sapiens
aaaacagauuguuugcaa

SEQ ID NO: 1111362 - RNA, 11 nt, Homo sapiens
aaaacauaugc

SEQ ID NO: 1111363 - RNA, 12 nt, Homo sapiens
aaaacauaugca

SEQ ID NO: 1111364 - RNA, 13 nt, Homo sapiens
aaaacauuuuacu

SEQ ID NO: 1111365 - RNA, 16 nt, Homo sapiens
aaaaccaauagcuuua

SEQ ID NO: 1111366 - RNA, 14 nt, Homo sapiens
aaaaccauguugau

SEQ ID NO: 1111367 - RNA, 14 nt, Homo sapiens
aaaaccccaucucu

SEQ ID NO: 1111368 - RNA, 13 nt, Homo sapiens
aaaacuaauuucc

SEQ ID NO: 1111369 - RNA, 15 nt, Homo sapiens
aaaacuauauucuca

SEQ ID NO: 1111370 - RNA, 14 nt, Homo sapiens
aaaacuccaucuca

SEQ ID NO: 1111371 - RNA, 16 nt, Homo sapiens
aaaacuccaucucaaa

SEQ ID NO: 1111372 - RNA, 22 nt, Homo sapiens
aaaacucugggaaauaagagag

SEQ ID NO: 1111373 - RNA, 20 nt, Homo sapiens
aaaacugauuuuuagcuuua

SEQ ID NO: 1111374 - RNA, 13 nt, Homo sapiens
aaaacuucucaca

SEQ ID NO: 1111375 - RNA, 15 nt, Homo sapiens
aaaacuuugacaaau

SEQ ID NO: 1111376 - RNA, 18 nt, Homo sapiens
aaaacuuugacaaauuga

SEQ ID NO: 1111377 - RNA, 15 nt, Homo sapiens
aaaagagagaucuug

SEQ ID NO: 1111378 - RNA, 11 nt, Homo sapiens
aaaagcacuuu

SEQ ID NO: 1111379 - RNA, 13 nt, Homo sapiens
aaaagcuuagcag

SEQ ID NO: 1111380 - RNA, 18 nt, Homo sapiens
aaaaguaaguaccacuca

SEQ ID NO: 1111381 - RNA, 22 nt, Homo sapiens
aaaaguaaguaccacucaggcc

SEQ ID NO: 1111382 - RNA, 18 nt, Homo sapiens
aaaagucacacagacaca

SEQ ID NO: 1111383 - RNA, 19 nt, Homo sapiens
aaaaguccuugauuuagca

SEQ ID NO: 1111384 - RNA, 16 nt, Homo sapiens
aaaagugugagcagug

SEQ ID NO: 1111385 - RNA, 15 nt, Homo sapiens
aaaaguuacauguuu

SEQ ID NO: 1111386 - RNA, 16 nt, Homo sapiens
aaaauaaguauuucca

SEQ ID NO: 1111387 - RNA, 13 nt, Homo sapiens
aaaauagcaaaag

SEQ ID NO: 1111388 - RNA, 13 nt, Homo sapiens
aaaauagcaacac

SEQ ID NO: 1111389 - RNA, 21 nt, Homo sapiens
aaaauaguaaaugcuuugugu

SEQ ID NO: 1111390 - RNA, 15 nt, Homo sapiens
aaaauaguagaacaa

SEQ ID NO: 1111391 - RNA, 12 nt, Homo sapiens
aaaauaguagca

SEQ ID NO: 1111392 - RNA, 14 nt, Homo sapiens
aaaauauaaaugca

SEQ ID NO: 1111393 - RNA, 14 nt, Homo sapiens
aaaauauugcuuau

SEQ ID NO: 1111394 - RNA, 20 nt, Homo sapiens
aaaaucacaagcaauaauua

SEQ ID NO: 1111395 - RNA, 11 nt, Homo sapiens
aaaaugaacuu

SEQ ID NO: 1111396 - RNA, 17 nt, Homo sapiens
aaaaugaauacaauuaa

SEQ ID NO: 1111397 - RNA, 23 nt, Homo sapiens
aaaaugagcuaggcaugguggca

SEQ ID NO: 1111398 - RNA, 23 nt, Homo sapiens
aaccagccgaccggcccugcccc

SEQ ID NO: 1111399 - RNA, 15 nt, Homo sapiens
aaccaggaacaugua

SEQ ID NO: 1111400 - RNA, 13 nt, Homo sapiens
aaccauaaacuuc

SEQ ID NO: 1111401 - RNA, 15 nt, Homo sapiens
aaccaugaaaauggg

SEQ ID NO: 1111402 - RNA, 13 nt, Homo sapiens
aacccaggacaag

SEQ ID NO: 1111403 - RNA, 16 nt, Homo sapiens
aaccccagacacuggu

SEQ ID NO: 1111404 - RNA, 12 nt, Homo sapiens
aaccccaucucu

SEQ ID NO: 1111405 - RNA, 23 nt, Homo sapiens
aacccccugacauuaucuuggau

SEQ ID NO: 1111406 - RNA, 15 nt, Homo sapiens
aacccucucuucccu

SEQ ID NO: 1111407 - RNA, 19 nt, Homo sapiens
aacccugccccacuucucu

SEQ ID NO: 1111408 - RNA, 22 nt, Homo sapiens
aaccgcauggaacagugcagga

SEQ ID NO: 1111409 - RNA, 20 nt, Homo sapiens
aaccucaggcuuccuuggca

SEQ ID NO: 1111410 - RNA, 15 nt, Homo sapiens
aaccucauuccccaa

SEQ ID NO: 1111411 - RNA, 21 nt, Homo sapiens
aaccucauuccccaaccacuu

SEQ ID NO: 1111412 - RNA, 17 nt, Homo sapiens
aaccuccacaguagcau

SEQ ID NO: 1111413 - RNA, 20 nt, Homo sapiens
aaccuccccgcagagcuccc

SEQ ID NO: 1111414 - RNA, 23 nt, Homo sapiens
aaccugaauauaaauuuguguuc

SEQ ID NO: 1111415 - RNA, 11 nt, Homo sapiens
aaccuuucaaa

SEQ ID NO: 1111416 - RNA, 15 nt, Homo sapiens
aacgaacugggaaaa

SEQ ID NO: 1111417 - RNA, 23 nt, Homo sapiens
aacgacaaagccaaacucugcca

SEQ ID NO: 1111418 - RNA, 15 nt, Homo sapiens
aacggagagugcuug

SEQ ID NO: 1111419 - RNA, 15 nt, Homo sapiens
aacgucaucucaggg

SEQ ID NO: 1111420 - RNA, 11 nt, Homo sapiens
aacuaccuccu

SEQ ID NO: 1111421 - RNA, 17 nt, Homo sapiens
aacuaccuccucagucu

SEQ ID NO: 1111422 - RNA, 16 nt, Homo sapiens
aacuagaaaucugcca

SEQ ID NO: 1111423 - RNA, 21 nt, Homo sapiens
aacuaguauuguccauaucag

SEQ ID NO: 1111424 - RNA, 14 nt, Homo sapiens
aacuauauucucag

SEQ ID NO: 1111425 - RNA, 19 nt, Homo sapiens
aacuaugguucccaauaaa

SEQ ID NO: 1111426 - RNA, 15 nt, Homo sapiens
aacucacugcucaag

SEQ ID NO: 1111427 - RNA, 13 nt, Homo sapiens
aacucagcugucu

SEQ ID NO: 1111428 - RNA, 17 nt, Homo sapiens
aacucauuagacuggaa

SEQ ID NO: 1111429 - RNA, 13 nt, Homo sapiens
aacuccagcuccc

SEQ ID NO: 1111430 - RNA, 13 nt, Homo sapiens
aacuccaucucaa

SEQ ID NO: 1111431 - RNA, 21 nt, Homo sapiens
aacucuccaucuuauuuucau

SEQ ID NO: 1111432 - RNA, 19 nt, Homo sapiens
aacucuccuacacuuccau

SEQ ID NO: 1111433 - RNA, 22 nt, Homo sapiens
aacucucuccuguauaaucucu

SEQ ID NO: 1111434 - RNA, 16 nt, Homo sapiens
aacucuugaccucagg

SEQ ID NO: 1111435 - RNA, 14 nt, Homo sapiens
aacugaagccagaa

SEQ ID NO: 1111436 - RNA, 22 nt, Homo sapiens
aacugacuagugagauggccug

SEQ ID NO: 1111437 - RNA, 13 nt, Homo sapiens
aacugcgugccag

SEQ ID NO: 1111438 - RNA, 19 nt, Homo sapiens
aacuggaggaguuccuuga

SEQ ID NO: 1111439 - RNA, 16 nt, Homo sapiens
aacuggaugaggucau

SEQ ID NO: 1111440 - RNA, 19 nt, Homo sapiens
aacuggguacuuguggaca

SEQ ID NO: 1111441 - RNA, 19 nt, Homo sapiens
aacugguauauacauauau

SEQ ID NO: 1111442 - RNA, 18 nt, Homo sapiens
aacuguagauaaaguggu

SEQ ID NO: 1111443 - RNA, 22 nt, Homo sapiens
aacugucucucaugaaccucaa

SEQ ID NO: 1111444 - RNA, 22 nt, Homo sapiens
aacuguucuggccucagaccaa

SEQ ID NO: 1111445 - RNA, 22 nt, Homo sapiens
aacuuaccaggcaccaaaagaa

SEQ ID NO: 1111446 - RNA, 13 nt, Homo sapiens
aacuucaagcaaa

SEQ ID NO: 1111447 - RNA, 21 nt, Homo sapiens
aacuuccuaaugauuagcacu

SEQ ID NO: 1111448 - RNA, 23 nt, Homo sapiens
aacuuccuaaugauuagcacuua

SEQ ID NO: 1111449 - RNA, 15 nt, Homo sapiens
aacuugcugcugagu

SEQ ID NO: 1111450 - RNA, 12 nt, Homo sapiens
aacuuguaaaua

SEQ ID NO: 1111451 - RNA, 23 nt, Homo sapiens
aagaaaaagggcugccgggccag

SEQ ID NO: 1111452 - RNA, 12 nt, Homo sapiens
aagaaaaccauu

SEQ ID NO: 1111453 - RNA, 13 nt, Homo sapiens
aagaaaacuggaa

SEQ ID NO: 1111454 - RNA, 12 nt, Homo sapiens
aagaaagggcaa

SEQ ID NO: 1111455 - RNA, 18 nt, Homo sapiens
aagaaaucauggcauuca

SEQ ID NO: 1111456 - RNA, 22 nt, Homo sapiens
aagaaaucauggcauucacaca

SEQ ID NO: 1111457 - RNA, 18 nt, Homo sapiens
aagaaauccaguuuccca

SEQ ID NO: 1111458 - RNA, 17 nt, Homo sapiens
aagaacaguaacugcca

SEQ ID NO: 1111459 - RNA, 18 nt, Homo sapiens
aagaacucugggcugcua

SEQ ID NO: 1111460 - RNA, 14 nt, Homo sapiens
aagaagaaucucau

SEQ ID NO: 1111461 - RNA, 18 nt, Homo sapiens
aagaagagaaccaugaaa

SEQ ID NO: 1111462 - RNA, 23 nt, Homo sapiens
aagaagcaaccucaguaauuuag

SEQ ID NO: 1111463 - RNA, 15 nt, Homo sapiens
aagaagccacagacc

SEQ ID NO: 1111464 - RNA, 17 nt, Homo sapiens
aagaaggacacuuguau

SEQ ID NO: 1111465 - RNA, 13 nt, Homo sapiens
aagaaguggagac

SEQ ID NO: 1111466 - RNA, 15 nt, Homo sapiens
aagaaguucauuuug

SEQ ID NO: 1111467 - RNA, 15 nt, Homo sapiens
aagaauacuucucau

SEQ ID NO: 1111468 - RNA, 15 nt, Homo sapiens
aagaaucaagcuaga

SEQ ID NO: 1111469 - RNA, 15 nt, Homo sapiens
aagaaucacuugaac

SEQ ID NO: 1111470 - RNA, 21 nt, Homo sapiens
aagaaucagaaacaggugcau

SEQ ID NO: 1111471 - RNA, 14 nt, Homo sapiens
acccagaacuggac

SEQ ID NO: 1111472 - RNA, 19 nt, Homo sapiens
acccagauuuccuaacucu

SEQ ID NO: 1111473 - RNA, 13 nt, Homo sapiens
acccagcaaagag

SEQ ID NO: 1111474 - RNA, 19 nt, Homo sapiens
acccaguaacucaucuguc

SEQ ID NO: 1111475 - RNA, 19 nt, Homo sapiens
acccauagugcacacuugu

SEQ ID NO: 1111476 - RNA, 23 nt, Homo sapiens
acccauagugcacacuuguauau

SEQ ID NO: 1111477 - RNA, 14 nt, Homo sapiens
acccauauuacaga

SEQ ID NO: 1111478 - RNA, 20 nt, Homo sapiens
acccauucguggugaucaau

SEQ ID NO: 1111479 - RNA, 13 nt, Homo sapiens
accccaacauuga

SEQ ID NO: 1111480 - RNA, 22 nt, Homo sapiens
accccaccuugccaagcuuucu

SEQ ID NO: 1111481 - RNA, 23 nt, Homo sapiens
accccagauggccgggacaugca

SEQ ID NO: 1111482 - RNA, 20 nt, Homo sapiens
accccagcuagggcuggacu

SEQ ID NO: 1111483 - RNA, 15 nt, Homo sapiens
accccaucucuacua

SEQ ID NO: 1111484 - RNA, 12 nt, Homo sapiens
acccccagugug

SEQ ID NO: 1111485 - RNA, 14 nt, Homo sapiens
accccucagugcuc

SEQ ID NO: 1111486 - RNA, 16 nt, Homo sapiens
acccgcucuggaccaa

SEQ ID NO: 1111487 - RNA, 21 nt, Homo sapiens
acccuaagccuccuuuugcuu

SEQ ID NO: 1111488 - RNA, 20 nt, Homo sapiens
acccuacuucuuuugcucuu

SEQ ID NO: 1111489 - RNA, 18 nt, Homo sapiens
acccuauacaacuggaca

SEQ ID NO: 1111490 - RNA, 23 nt, Homo sapiens
acccuccccauuaguauccuguu

SEQ ID NO: 1111491 - RNA, 22 nt, Homo sapiens
acccuccuggggcucucagugu

SEQ ID NO: 1111492 - RNA, 21 nt, Homo sapiens
acccuccuguccagcagguag

SEQ ID NO: 1111493 - RNA, 14 nt, Homo sapiens
acccucgaugaagc

SEQ ID NO: 1111494 - RNA, 16 nt, Homo sapiens
acccugcauguuggcc

SEQ ID NO: 1111495 - RNA, 14 nt, Homo sapiens
acccuugcauuaga

SEQ ID NO: 1111496 - RNA, 17 nt, Homo sapiens
acccuuucucugagaga

SEQ ID NO: 1111497 - RNA, 14 nt, Homo sapiens
accgcuugccauau

SEQ ID NO: 1111498 - RNA, 21 nt, Homo sapiens
accgggccacuccuuccugcc

SEQ ID NO: 1111499 - RNA, 15 nt, Homo sapiens
accgugaccaggaac

SEQ ID NO: 1111500 - RNA, 17 nt, Homo sapiens
accgugcaugugcaguc

SEQ ID NO: 1111501 - RNA, 22 nt, Homo sapiens
accuaaacauagaaauugccug

SEQ ID NO: 1111502 - RNA, 16 nt, Homo sapiens
accuaaauuugguucu

SEQ ID NO: 1111503 - RNA, 16 nt, Homo sapiens
accuacucacacaggc

SEQ ID NO: 1111504 - RNA, 20 nt, Homo sapiens
accuacuuuucuuuccucag

SEQ ID NO: 1111505 - RNA, 21 nt, Homo sapiens
accuagccuuagaagucacac

SEQ ID NO: 1111506 - RNA, 23 nt, Homo sapiens
accuauaccuguguuucuugccu

SEQ ID NO: 1111507 - RNA, 16 nt, Homo sapiens
accucacuaugcugcu

SEQ ID NO: 1111508 - RNA, 16 nt, Homo sapiens
accucacuccuguuac

SEQ ID NO: 1111509 - RNA, 12 nt, Homo sapiens
accucacugggg

SEQ ID NO: 1111510 - RNA, 22 nt, Homo sapiens
accucaguuuuaucauuuucaa

SEQ ID NO: 1111511 - RNA, 23 nt, Homo sapiens
accuccugaccugucaccgugag

SEQ ID NO: 1111512 - RNA, 13 nt, Homo sapiens
accucguccuccc

SEQ ID NO: 1111513 - RNA, 13 nt, Homo sapiens
accucuacaagca

SEQ ID NO: 1111514 - RNA, 22 nt, Homo sapiens
accucugccugaagucacacag

SEQ ID NO: 1111515 - RNA, 13 nt, Homo sapiens
accucugcucuga

SEQ ID NO: 1111516 - RNA, 21 nt, Homo sapiens
accucugcucugaggcuucca

SEQ ID NO: 1111517 - RNA, 14 nt, Homo sapiens
accucuucucuucc

SEQ ID NO: 1111518 - RNA, 18 nt, Homo sapiens
accucuucucuuccugua

SEQ ID NO: 1111519 - RNA, 20 nt, Homo sapiens
accucuucugggaacuuccu

SEQ ID NO: 1111520 - RNA, 13 nt, Homo sapiens
accucuugggcau

SEQ ID NO: 1111521 - RNA, 13 nt, Homo sapiens
accugaaccuggg

SEQ ID NO: 1111522 - RNA, 19 nt, Homo sapiens
accugaaccugggaaccau

SEQ ID NO: 1111523 - RNA, 19 nt, Homo sapiens
accugcucuccucuugcca

SEQ ID NO: 1111524 - RNA, 16 nt, Homo sapiens
accuggccuucagugu

SEQ ID NO: 1111525 - RNA, 15 nt, Homo sapiens
accuguaaucccagc

SEQ ID NO: 1111526 - RNA, 16 nt, Homo sapiens
accuguauuuugccag

SEQ ID NO: 1111527 - RNA, 18 nt, Homo sapiens
accuguccauaaaguaau

SEQ ID NO: 1111528 - RNA, 19 nt, Homo sapiens
accuguguuucuugccuca

SEQ ID NO: 1111529 - RNA, 19 nt, Homo sapiens
accuguuacugaaaguggu

SEQ ID NO: 1111530 - RNA, 21 nt, Homo sapiens
accuguucuuccuaccaaaua

SEQ ID NO: 1111531 - RNA, 19 nt, Homo sapiens
accuguuuuuaagcuguuu

SEQ ID NO: 1111532 - RNA, 19 nt, Homo sapiens
accuuacuuaaagcuuguu

SEQ ID NO: 1111533 - RNA, 19 nt, Homo sapiens
accuucaauaaaguaucua

SEQ ID NO: 1111534 - RNA, 16 nt, Homo sapiens
accuucaauacuucau

SEQ ID NO: 1111535 - RNA, 16 nt, Homo sapiens
accuucccaugcccug

SEQ ID NO: 1111536 - RNA, 15 nt, Homo sapiens
accuugaacacuggg

SEQ ID NO: 1111537 - RNA, 15 nt, Homo sapiens
accuugcuccugugu

SEQ ID NO: 1111538 - RNA, 15 nt, Homo sapiens
accuugugucuguac

SEQ ID NO: 1111539 - RNA, 21 nt, Homo sapiens
accuuuauuaaugaacuguga

SEQ ID NO: 1111540 - RNA, 21 nt, Homo sapiens
accuuuauugugaucuaucaa

SEQ ID NO: 1111541 - RNA, 12 nt, Homo sapiens
acgaauugcuca

SEQ ID NO: 1111542 - RNA, 18 nt, Homo sapiens
acgcagccugcagacuca

SEQ ID NO: 1111543 - RNA, 23 nt, Homo sapiens
acgcagccugcagacucacugug

SEQ ID NO: 1111544 - RNA, 19 nt, Homo sapiens
acgccacucauuucaucuc

SEQ ID NO: 1111545 - RNA, 21 nt, Homo sapiens
acgccacucauuucaucucau

SEQ ID NO: 1111546 - RNA, 15 nt, Homo sapiens
acgccuguaauccca

SEQ ID NO: 1111547 - RNA, 21 nt, Homo sapiens
acgccuguaaucccagcacuu

SEQ ID NO: 1111548 - RNA, 17 nt, Homo sapiens
acgggagaauauacaaa

SEQ ID NO: 1111549 - RNA, 20 nt, Homo sapiens
acgguggcucacgccuguaa

SEQ ID NO: 1111550 - RNA, 14 nt, Homo sapiens
acguaaacuuccua

SEQ ID NO: 1111551 - RNA, 13 nt, Homo sapiens
acgucaucucagg

SEQ ID NO: 1111552 - RNA, 13 nt, Homo sapiens
acgugucucagga

SEQ ID NO: 1111553 - RNA, 15 nt, Homo sapiens
acuaaaaaaugucua

SEQ ID NO: 1111554 - RNA, 12 nt, Homo sapiens
acuaacacagcc

SEQ ID NO: 1111555 - RNA, 15 nt, Homo sapiens
acuaacguacauuca

SEQ ID NO: 1111556 - RNA, 20 nt, Homo sapiens
acuaagggauggggcagucu

SEQ ID NO: 1111557 - RNA, 20 nt, Homo sapiens
acuaauaaucaccauaugcu

SEQ ID NO: 1111558 - RNA, 17 nt, Homo sapiens
acuaauggaaauauuau

SEQ ID NO: 1111559 - RNA, 17 nt, Homo sapiens
acuaauuuaaaccagca

SEQ ID NO: 1111560 - RNA, 18 nt, Homo sapiens
acuacaauuuaaagcaaa

SEQ ID NO: 1111561 - RNA, 21 nt, Homo sapiens
acuacacacuguguacugcag

SEQ ID NO: 1111562 - RNA, 20 nt, Homo sapiens
acuaccaaaugagcauuagc

SEQ ID NO: 1111563 - RNA, 20 nt, Homo sapiens
acuacgugccaggcacuguu

SEQ ID NO: 1111564 - RNA, 19 nt, Homo sapiens
acuacuugccacacacugu

SEQ ID NO: 1111565 - RNA, 17 nt, Homo sapiens
acuagaagaaagggcaa

SEQ ID NO: 1111566 - RNA, 13 nt, Homo sapiens
acuagauacugaa

SEQ ID NO: 1111567 - RNA, 15 nt, Homo sapiens
acuaggacucugagg

SEQ ID NO: 1111568 - RNA, 20 nt, Homo sapiens
acuagggcuuauccaugccu

SEQ ID NO: 1111569 - RNA, 21 nt, Homo sapiens
acuauaagcagaagcacauau

SEQ ID NO: 1111570 - RNA, 11 nt, Homo sapiens
acuaugcacaa

SEQ ID NO: 1111571 - RNA, 18 nt, Homo sapiens
acuauguugcccaggcag

SEQ ID NO: 1111572 - RNA, 16 nt, Homo sapiens
acuauuaaaacagcca

SEQ ID NO: 1111573 - RNA, 15 nt, Homo sapiens
acuauuagacaugaa

SEQ ID NO: 1111574 - RNA, 16 nt, Homo sapiens
acuauucuauggccau

SEQ ID NO: 1111575 - RNA, 20 nt, Homo sapiens
acuauugaaaucaagcuuau

SEQ ID NO: 1111576 - RNA, 20 nt, Homo sapiens
acucaaacaaucaugaguca

SEQ ID NO: 1111577 - RNA, 12 nt, Homo sapiens
acucacccaagc

SEQ ID NO: 1111578 - RNA, 17 nt, Homo sapiens
acucaccucugccucaa

SEQ ID NO: 1111579 - RNA, 12 nt, Homo sapiens
acucacuguggg

SEQ ID NO: 1111580 - RNA, 17 nt, Homo sapiens
acucagaagacacugau

SEQ ID NO: 1111581 - RNA, 18 nt, Homo sapiens
acucaggccaacaagcca

SEQ ID NO: 1111582 - RNA, 16 nt, Homo sapiens
acucaguuuucuugca

SEQ ID NO: 1111583 - RNA, 20 nt, Homo sapiens
acucauaggcuuauuuccaa

SEQ ID NO: 1111584 - RNA, 16 nt, Homo sapiens
acucauauucugggcu

SEQ ID NO: 1111585 - RNA, 21 nt, Homo sapiens
acucaucugucaccaagccuu

SEQ ID NO: 1111586 - RNA, 22 nt, Homo sapiens
acucauucuucuguacgucuga

SEQ ID NO: 1111587 - RNA, 15 nt, Homo sapiens
auuaaaugcaugucc

SEQ ID NO: 1111588 - RNA, 17 nt, Homo sapiens
auuaaaugcauguccuc

SEQ ID NO: 1111589 - RNA, 18 nt, Homo sapiens
auuaauauguucauuaaa

SEQ ID NO: 1111590 - RNA, 12 nt, Homo sapiens
auuaauucaccu

SEQ ID NO: 1111591 - RNA, 17 nt, Homo sapiens
auuacaacuagaucaag

SEQ ID NO: 1111592 - RNA, 23 nt, Homo sapiens
auuacaagcgugagccacugcac

SEQ ID NO: 1111593 - RNA, 13 nt, Homo sapiens
auuacgugcaaua

SEQ ID NO: 1111594 - RNA, 18 nt, Homo sapiens
auuacugcaugcacuucu

SEQ ID NO: 1111595 - RNA, 14 nt, Homo sapiens
auuacuucugcuac

SEQ ID NO: 1111596 - RNA, 21 nt, Homo sapiens
auuagaaacugaaaacuguaa

SEQ ID NO: 1111597 - RNA, 13 nt, Homo sapiens
auuagaugaacuc

SEQ ID NO: 1111598 - RNA, 19 nt, Homo sapiens
auuagcugaguguagugac

SEQ ID NO: 1111599 - RNA, 13 nt, Homo sapiens
auuauagaaugga

SEQ ID NO: 1111600 - RNA, 13 nt, Homo sapiens
auuaucaucugaa

SEQ ID NO: 1111601 - RNA, 17 nt, Homo sapiens
auuaucgggagcagugu

SEQ ID NO: 1111602 - RNA, 16 nt, Homo sapiens
auuauuagauucucca

SEQ ID NO: 1111603 - RNA, 14 nt, Homo sapiens
auuauuaugucuca

SEQ ID NO: 1111604 - RNA, 18 nt, Homo sapiens
auuauucccuguacaaua

SEQ ID NO: 1111605 - RNA, 15 nt, Homo sapiens
auuauuguauuacau

SEQ ID NO: 1111606 - RNA, 19 nt, Homo sapiens
auucaaccugugucuuaua

SEQ ID NO: 1111607 - RNA, 11 nt, Homo sapiens
auucacaucuc

SEQ ID NO: 1111608 - RNA, 12 nt, Homo sapiens
auucacaucuca

SEQ ID NO: 1111609 - RNA, 16 nt, Homo sapiens
auucacauuugaugua

SEQ ID NO: 1111610 - RNA, 11 nt, Homo sapiens
auucauaacaa

SEQ ID NO: 1111611 - RNA, 18 nt, Homo sapiens
auucauaauuagaacaau

SEQ ID NO: 1111612 - RNA, 18 nt, Homo sapiens
auucauuagcugugauuu

SEQ ID NO: 1111613 - RNA, 12 nt, Homo sapiens
auucauuuuccu

SEQ ID NO: 1111614 - RNA, 22 nt, Homo sapiens
auuccauaaucaaucuaucaau

SEQ ID NO: 1111615 - RNA, 18 nt, Homo sapiens
auuccauuuccaguucau

SEQ ID NO: 1111616 - RNA, 13 nt, Homo sapiens
auucccaccaagg

SEQ ID NO: 1111617 - RNA, 14 nt, Homo sapiens
auucccaccaaggu

SEQ ID NO: 1111618 - RNA, 17 nt, Homo sapiens
auucccauuuugcaaaa

SEQ ID NO: 1111619 - RNA, 22 nt, Homo sapiens
auuccccucgugugacucucuu

SEQ ID NO: 1111620 - RNA, 22 nt, Homo sapiens
auucccuaucaaaacauaucaa

SEQ ID NO: 1111621 - RNA, 14 nt, Homo sapiens
auucccuguacaau

SEQ ID NO: 1111622 - RNA, 14 nt, Homo sapiens
auuccgucuuaaaa

SEQ ID NO: 1111623 - RNA, 20 nt, Homo sapiens
auuccuaagcagugcuugua

SEQ ID NO: 1111624 - RNA, 20 nt, Homo sapiens
auuccuuagcuuagaccuca

SEQ ID NO: 1111625 - RNA, 22 nt, Homo sapiens
auuuugugcaguuaauacuuaa

SEQ ID NO: 1111626 - RNA, 18 nt, Homo sapiens
auuuuuuugagacagagu

SEQ ID NO: 1111627 - RNA, 20 nt, Homo sapiens
caaaaaaaaccuucagugaa

SEQ ID NO: 1111628 - RNA, 14 nt, Homo sapiens
caaaaaacuuuuaa

SEQ ID NO: 1111629 - RNA, 16 nt, Homo sapiens
caaaaaaguauagaaa

SEQ ID NO: 1111630 - RNA, 13 nt, Homo sapiens
caaaaaccucacc

SEQ ID NO: 1111631 - RNA, 22 nt, Homo sapiens
caaaaagaauuccaaccgacca

SEQ ID NO: 1111632 - RNA, 14 nt, Homo sapiens
caaaaauauuccau

SEQ ID NO: 1111633 - RNA, 23 nt, Homo sapiens
caaaaaugaaagcaugucucaau

SEQ ID NO: 1111634 - RNA, 16 nt, Homo sapiens
caaaacauacccagug

SEQ ID NO: 1111635 - RNA, 21 nt, Homo sapiens
caaaacauugugccaugucaa

SEQ ID NO: 1111636 - RNA, 17 nt, Homo sapiens
caaaacauuuuacuuua

SEQ ID NO: 1111637 - RNA, 12 nt, Homo sapiens
caaaaccagcug

SEQ ID NO: 1111638 - RNA, 17 nt, Homo sapiens
caaaacccaacaugacu

SEQ ID NO: 1111639 - RNA, 15 nt, Homo sapiens
caaaaccucaugaca

SEQ ID NO: 1111640 - RNA, 17 nt, Homo sapiens
caaaaccugauguuaaa

SEQ ID NO: 1111641 - RNA, 16 nt, Homo sapiens
caaaacuccaucucaa

SEQ ID NO: 1111642 - RNA, 22 nt, Homo sapiens
caaaacucuccuacacuuccau

SEQ ID NO: 1111643 - RNA, 20 nt, Homo sapiens
caaaagaagacaacauuucu

SEQ ID NO: 1111644 - RNA, 21 nt, Homo sapiens
caaaagcccaauguaaugcau

SEQ ID NO: 1111645 - RNA, 11 nt, Homo sapiens
caaaaguggau

SEQ ID NO: 1111646 - RNA, 19 nt, Homo sapiens
caaaaguuacauguuugca

SEQ ID NO: 1111647 - RNA, 18 nt, Homo sapiens
caaaaguuucuuacucaa

SEQ ID NO: 1111648 - RNA, 22 nt, Homo sapiens
caaaaguuucuuacucaaggaa

SEQ ID NO: 1111649 - RNA, 11 nt, Homo sapiens
caaaauuacuu

SEQ ID NO: 1111650 - RNA, 22 nt, Homo sapiens
caaacacaagugcgccuugcaa

SEQ ID NO: 1111651 - RNA, 18 nt, Homo sapiens
caaacacaggauuuguaa

SEQ ID NO: 1111652 - RNA, 12 nt, Homo sapiens
caaacacccaug

SEQ ID NO: 1111653 - RNA, 17 nt, Homo sapiens
caaacacccaugcccag

SEQ ID NO: 1111654 - RNA, 13 nt, Homo sapiens
caaacacugugua

SEQ ID NO: 1111655 - RNA, 17 nt, Homo sapiens
caaacagaacuauggaa

SEQ ID NO: 1111656 - RNA, 14 nt, Homo sapiens
caaacauaaagaga

SEQ ID NO: 1111657 - RNA, 21 nt, Homo sapiens
caaacucacugcucaagaaga

SEQ ID NO: 1111658 - RNA, 20 nt, Homo sapiens
caaacugccuauauugauaa

SEQ ID NO: 1111659 - RNA, 24 nt, Homo sapiens
caaagaagauuuugccacauuuga

SEQ ID NO: 1111660 - RNA, 20 nt, Homo sapiens
caaagaaggaauucuaggca

SEQ ID NO: 1111661 - RNA, 14 nt, Homo sapiens
caaagagguauuua

SEQ ID NO: 1111662 - RNA, 15 nt, Homo sapiens
caaagcaagcauuca

SEQ ID NO: 1111663 - RNA, 20 nt, Homo sapiens
caaagcacuguuucucucac

SEQ ID NO: 1111664 - RNA, 10 nt, Homo sapiens
caaagccaaa

SEQ ID NO: 1111665 - RNA, 21 nt, Homo sapiens
caaagcuuaaaugccuccuuc

SEQ ID NO: 1111666 - RNA, 20 nt, Homo sapiens
caaagggaaggcugcugugu

SEQ ID NO: 1111667 - RNA, 14 nt, Homo sapiens
caaaggugcuaaau

SEQ ID NO: 1111668 - RNA, 15 nt, Homo sapiens
caaaguagcaauuuc

SEQ ID NO: 1111669 - RNA, 13 nt, Homo sapiens
caaauaaacucca

SEQ ID NO: 1111670 - RNA, 14 nt, Homo sapiens
caaauaaauggagu

SEQ ID NO: 1111671 - RNA, 12 nt, Homo sapiens
caaauagcacau

SEQ ID NO: 1111672 - RNA, 22 nt, Homo sapiens
caaaucaguccuuugauuccau

SEQ ID NO: 1111673 - RNA, 12 nt, Homo sapiens
caaaucaucucu

SEQ ID NO: 1111674 - RNA, 18 nt, Homo sapiens
caaaucccacagggccag

SEQ ID NO: 1111675 - RNA, 11 nt, Homo sapiens
acuucucacca

SEQ ID NO: 1111676 - RNA, 15 nt, Homo sapiens
acuugaaaaccucau

SEQ ID NO: 1111677 - RNA, 22 nt, Homo sapiens
acuugaaauaccagugaaccaa

SEQ ID NO: 1111678 - RNA, 12 nt, Homo sapiens
acuugacagugg

SEQ ID NO: 1111679 - RNA, 19 nt, Homo sapiens
acuugaggcuggcacuccc

SEQ ID NO: 1111680 - RNA, 21 nt, Homo sapiens
acuugaggcuggcacuccccu

SEQ ID NO: 1111681 - RNA, 20 nt, Homo sapiens
acuugaugacccccaaccaa

SEQ ID NO: 1111682 - RNA, 15 nt, Homo sapiens
acuugcauacagaga

SEQ ID NO: 1111683 - RNA, 16 nt, Homo sapiens
acuugcauacagagac

SEQ ID NO: 1111684 - RNA, 17 nt, Homo sapiens
acuuguagggaugccuu

SEQ ID NO: 1111685 - RNA, 18 nt, Homo sapiens
acuuguccuuuuguacca

SEQ ID NO: 1111686 - RNA, 13 nt, Homo sapiens
acuuuaacccucu

SEQ ID NO: 1111687 - RNA, 14 nt, Homo sapiens
acuuuaauucucau

SEQ ID NO: 1111688 - RNA, 20 nt, Homo sapiens
acuuucagguacuaaauacc

SEQ ID NO: 1111689 - RNA, 21 nt, Homo sapiens
acuuugccucugaaacuuaau

SEQ ID NO: 1111690 - RNA, 21 nt, Homo sapiens
acuuugguucucuccaggaag

SEQ ID NO: 1111691 - RNA, 17 nt, Homo sapiens
acuuuuaaguugcugau

SEQ ID NO: 1111692 - RNA, 20 nt, Homo sapiens
acuuuuaaugccuuccacau

SEQ ID NO: 1111693 - RNA, 15 nt, Homo sapiens
agaaaaaacaccacc

SEQ ID NO: 1111694 - RNA, 12 nt, Homo sapiens
agaaaaauuauu

SEQ ID NO: 1111695 - RNA, 15 nt, Homo sapiens
agaaaaccauuuuag

SEQ ID NO: 1111696 - RNA, 13 nt, Homo sapiens
agaaaacuggaaa

SEQ ID NO: 1111697 - RNA, 15 nt, Homo sapiens
agaaaacuguuaaua

SEQ ID NO: 1111698 - RNA, 19 nt, Homo sapiens
agaaaaguagguuuacauu

SEQ ID NO: 1111699 - RNA, 20 nt, Homo sapiens
agaaaccuuauuguaccucu

SEQ ID NO: 1111700 - RNA, 13 nt, Homo sapiens
agaaacucaccau

SEQ ID NO: 1111701 - RNA, 23 nt, Homo sapiens
agaaacugaggccauuauuucaa

SEQ ID NO: 1111702 - RNA, 15 nt, Homo sapiens
agaaagagucaggcc

SEQ ID NO: 1111703 - RNA, 15 nt, Homo sapiens
agaaagccuucauaa

SEQ ID NO: 1111704 - RNA, 17 nt, Homo sapiens
caagaagucaaaguaaa

SEQ ID NO: 1111705 - RNA, 20 nt, Homo sapiens
caagagcaucaugccucuga

SEQ ID NO: 1111706 - RNA, 23 nt, Homo sapiens
caagagccauguaccaguguacu

SEQ ID NO: 1111707 - RNA, 17 nt, Homo sapiens
caagauaaaaccagagc

SEQ ID NO: 1111708 - RNA, 17 nt, Homo sapiens
caagaucuuucaggaaa

SEQ ID NO: 1111709 - RNA, 21 nt, Homo sapiens
caagcauggucccacaucccu

SEQ ID NO: 1111710 - RNA, 21 nt, Homo sapiens
caagcauucagaagaaaaaga

SEQ ID NO: 1111711 - RNA, 18 nt, Homo sapiens
caagccacagaagccagg

SEQ ID NO: 1111712 - RNA, 21 nt, Homo sapiens
caagcuaccuucaugucacug

SEQ ID NO: 1111713 - RNA, 12 nt, Homo sapiens
caagcuauucaa

SEQ ID NO: 1111714 - RNA, 11 nt, Homo sapiens
caagcucugcu

SEQ ID NO: 1111715 - RNA, 16 nt, Homo sapiens
caagcugaggugccca

SEQ ID NO: 1111716 - RNA, 14 nt, Homo sapiens
caaggaaaauggac

SEQ ID NO: 1111717 - RNA, 16 nt, Homo sapiens
caaggaaaauggacau

SEQ ID NO: 1111718 - RNA, 20 nt, Homo sapiens
caaggaaagccccagcacua

SEQ ID NO: 1111719 - RNA, 19 nt, Homo sapiens
caaggauguucuggcuuua

SEQ ID NO: 1111720 - RNA, 22 nt, Homo sapiens
caaggggcugaaaagaucugaa

SEQ ID NO: 1111721 - RNA, 14 nt, Homo sapiens
caaggggcuuuguc

SEQ ID NO: 1111722 - RNA, 17 nt, Homo sapiens
caaggugaacaccacuu

SEQ ID NO: 1111723 - RNA, 18 nt, Homo sapiens
caagguggggggaucaca

SEQ ID NO: 1111724 - RNA, 21 nt, Homo sapiens
caaguaguagugucuuccuag

SEQ ID NO: 1111725 - RNA, 19 nt, Homo sapiens
caaguauguugagaguugc

SEQ ID NO: 1111726 - RNA, 20 nt, Homo sapiens
caaguauuuuaucuguguug

SEQ ID NO: 1111727 - RNA, 19 nt, Homo sapiens
caagucuucccugaucaag

SEQ ID NO: 1111728 - RNA, 19 nt, Homo sapiens
caagucuugaaacaagcaa

SEQ ID NO: 1111729 - RNA, 22 nt, Homo sapiens
caagugaagaaaagugaaugcu

SEQ ID NO: 1111730 - RNA, 18 nt, Homo sapiens
caagugaauuugccugua

SEQ ID NO: 1111731 - RNA, 14 nt, Homo sapiens
caagugcacuugaa

SEQ ID NO: 1111732 - RNA, 15 nt, Homo sapiens
caaguugagaacaaa

SEQ ID NO: 1111733 - RNA, 16 nt, Homo sapiens
caauaaaacauuccug

SEQ ID NO: 1111734 - RNA, 21 nt, Homo sapiens
caauaaaacauuccugugaaa

SEQ ID NO: 1111735 - RNA, 13 nt, Homo sapiens
caauaacagguca

SEQ ID NO: 1111736 - RNA, 17 nt, Homo sapiens
caauaacuucagagaag

SEQ ID NO: 1111737 - RNA, 19 nt, Homo sapiens
caauaaguuccauguuaaa

SEQ ID NO: 1111738 - RNA, 22 nt, Homo sapiens
caauaaguuccauguuaaaaua

SEQ ID NO: 1111739 - RNA, 16 nt, Homo sapiens
caauauaucaauguaa

SEQ ID NO: 1111740 - RNA, 19 nt, Homo sapiens
caauauugccaugguuuua

SEQ ID NO: 1111741 - RNA, 19 nt, Homo sapiens
caaugaaauauuugcuuau

SEQ ID NO: 1111742 - RNA, 22 nt, Homo sapiens
caaugaccuguauuuugccaga

SEQ ID NO: 1111743 - RNA, 10 nt, Homo sapiens
caaugauuca

SEQ ID NO: 1111744 - RNA, 16 nt, Homo sapiens
caaugauucauaacaa

SEQ ID NO: 1111745 - RNA, 20 nt, Homo sapiens
caaugcaccuaaagaaaaac

SEQ ID NO: 1111746 - RNA, 13 nt, Homo sapiens
caaugcagaauuu

SEQ ID NO: 1111747 - RNA, 19 nt, Homo sapiens
caaugcuuccuccuuggaa

SEQ ID NO: 1111748 - RNA, 13 nt, Homo sapiens
caaugucacuuaa

SEQ ID NO: 1111749 - RNA, 21 nt, Homo sapiens
caauguuuaugcaaggaagga

SEQ ID NO: 1111750 - RNA, 14 nt, Homo sapiens
caauuaaaggcaaa

SEQ ID NO: 1111751 - RNA, 12 nt, Homo sapiens
caauucauuuca

SEQ ID NO: 1111752 - RNA, 23 nt, Homo sapiens
ccucaaggguuauagacugccau

SEQ ID NO: 1111753 - RNA, 17 nt, Homo sapiens
ccucaguuuuaucauuu

SEQ ID NO: 1111754 - RNA, 18 nt, Homo sapiens
ccucaugagcacaggguc

SEQ ID NO: 1111755 - RNA, 16 nt, Homo sapiens
ccuccaaaugccaacu

SEQ ID NO: 1111756 - RNA, 22 nt, Homo sapiens
ccuccauuugcaauugaccucu

SEQ ID NO: 1111757 - RNA, 20 nt, Homo sapiens
ccucccaguuugcuggguuu

SEQ ID NO: 1111758 - RNA, 15 nt, Homo sapiens
ccucccuggucccuu

SEQ ID NO: 1111759 - RNA, 16 nt, Homo sapiens
ccuccggugugagaua

SEQ ID NO: 1111760 - RNA, 20 nt, Homo sapiens
ccuccguguagugucuguaa

SEQ ID NO: 1111761 - RNA, 14 nt, Homo sapiens
ccucguaugcaugg

SEQ ID NO: 1111762 - RNA, 12 nt, Homo sapiens
ccucucuugccu

SEQ ID NO: 1111763 - RNA, 19 nt, Homo sapiens
ccucugauacccagagcau

SEQ ID NO: 1111764 - RNA, 14 nt, Homo sapiens
ccucugcagcacuu

SEQ ID NO: 1111765 - RNA, 23 nt, Homo sapiens
ccucuuaaaaaauaaaaacugac

SEQ ID NO: 1111766 - RNA, 19 nt, Homo sapiens
ccucuuaaagcugccugua

SEQ ID NO: 1111767 - RNA, 21 nt, Homo sapiens
ccucuuccgugacgucacugg

SEQ ID NO: 1111768 - RNA, 23 nt, Homo sapiens
ccucuuccugccaagccaccuuc

SEQ ID NO: 1111769 - RNA, 17 nt, Homo sapiens
ccucuucgcugaccucg

SEQ ID NO: 1111770 - RNA, 13 nt, Homo sapiens
ccucuugcuauug

SEQ ID NO: 1111771 - RNA, 13 nt, Homo sapiens
ccucuugcucaaa

SEQ ID NO: 1111772 - RNA, 17 nt, Homo sapiens
ccugaaaauuaugaguc

SEQ ID NO: 1111773 - RNA, 13 nt, Homo sapiens
ccugaagucacac

SEQ ID NO: 1111774 - RNA, 20 nt, Homo sapiens
ccugaagucacacagugagu

SEQ ID NO: 1111775 - RNA, 12 nt, Homo sapiens
ccugaagugaug

SEQ ID NO: 1111776 - RNA, 13 nt, Homo sapiens
ccugaaugaaaua

SEQ ID NO: 1111777 - RNA, 18 nt, Homo sapiens
ccugaaugguuccaugcc

SEQ ID NO: 1111778 - RNA, 15 nt, Homo sapiens
ccugacagaugucag

SEQ ID NO: 1111779 - RNA, 17 nt, Homo sapiens
ccugacccuacuucuuu

SEQ ID NO: 1111780 - RNA, 19 nt, Homo sapiens
ccugaccugucaccgugag

SEQ ID NO: 1111781 - RNA, 18 nt, Homo sapiens
ccugacgaacuccuugau

SEQ ID NO: 1111782 - RNA, 20 nt, Homo sapiens
ccugauaggacccauauucc

SEQ ID NO: 1111783 - RNA, 21 nt, Homo sapiens
ccugaugggguggaaggcaug

SEQ ID NO: 1111784 - RNA, 21 nt, Homo sapiens
ccugcaaacucacugcucaag

SEQ ID NO: 1111785 - RNA, 19 nt, Homo sapiens
ccugcaauucuacaguuuc

SEQ ID NO: 1111786 - RNA, 17 nt, Homo sapiens
ccugcagacucacugug

SEQ ID NO: 1111787 - RNA, 23 nt, Homo sapiens
ccugcauguuggcccagaccuca

SEQ ID NO: 1111788 - RNA, 18 nt, Homo sapiens
ccugcauugcugagucaa

SEQ ID NO: 1111789 - RNA, 15 nt, Homo sapiens
ccugccaguguuuag

SEQ ID NO: 1111790 - RNA, 15 nt, Homo sapiens
ccugccucugacuca

SEQ ID NO: 1111791 - RNA, 20 nt, Homo sapiens
ccugccucugacucacacuu

SEQ ID NO: 1111792 - RNA, 18 nt, Homo sapiens
ccugcucuccucuugcca

SEQ ID NO: 1111793 - RNA, 16 nt, Homo sapiens
ccugcuugcacuuugu

SEQ ID NO: 1111794 - RNA, 18 nt, Homo sapiens
ccugcuuugaggacaaag

SEQ ID NO: 1111795 - RNA, 22 nt, Homo sapiens
ccuggaaauaucaguuacucag

SEQ ID NO: 1111796 - RNA, 21 nt, Homo sapiens
ccuggaugugcccacagggac

SEQ ID NO: 1111797 - RNA, 22 nt, Homo sapiens
ccuggcugagagaggaagagcu

SEQ ID NO: 1111798 - RNA, 16 nt, Homo sapiens
ccuggcuggcugaggg

SEQ ID NO: 1111799 - RNA, 17 nt, Homo sapiens
ccuggguggggcugcuc

SEQ ID NO: 1111800 - RNA, 18 nt, Homo sapiens
ccuggucccuuggagaca

SEQ ID NO: 1111801 - RNA, 19 nt, Homo sapiens
ccuggucccuuggagacaa

SEQ ID NO: 1111802 - RNA, 17 nt, Homo sapiens
cguguacuacaauuuaa

SEQ ID NO: 1111803 - RNA, 20 nt, Homo sapiens
cguguccagcacagaaggaa

SEQ ID NO: 1111804 - RNA, 19 nt, Homo sapiens
cguguguguguuucaucug

SEQ ID NO: 1111805 - RNA, 21 nt, Homo sapiens
cguuaaggagaugggccuuuu

SEQ ID NO: 1111806 - RNA, 20 nt, Homo sapiens
cguugaagaggaagggcaaa

SEQ ID NO: 1111807 - RNA, 23 nt, Homo sapiens
cguuuccugagaagugucuaaaa

SEQ ID NO: 1111808 - RNA, 13 nt, Homo sapiens
cuaaaaaucauga

SEQ ID NO: 1111809 - RNA, 14 nt, Homo sapiens
cuaaacagauauaa

SEQ ID NO: 1111810 - RNA, 23 nt, Homo sapiens
cuaaagcaguguuuucaccucau

SEQ ID NO: 1111811 - RNA, 16 nt, Homo sapiens
cuaaagucacauauaa

SEQ ID NO: 1111812 - RNA, 20 nt, Homo sapiens
cuaaauaauguuaucugugu

SEQ ID NO: 1111813 - RNA, 21 nt, Homo sapiens
cuaaauaauguuaucugugua

SEQ ID NO: 1111814 - RNA, 17 nt, Homo sapiens
cuaaaucaauucuauua

SEQ ID NO: 1111815 - RNA, 21 nt, Homo sapiens
cuaaaugaaaaucgugacaac

SEQ ID NO: 1111816 - RNA, 15 nt, Homo sapiens
cuaaauuugguucua

SEQ ID NO: 1111817 - RNA, 22 nt, Homo sapiens
cuaacaaguagcacccuggauu

SEQ ID NO: 1111818 - RNA, 21 nt, Homo sapiens
cuaacacagccaucaagggaa

SEQ ID NO: 1111819 - RNA, 15 nt, Homo sapiens
cuaacaccaacauaa

SEQ ID NO: 1111820 - RNA, 13 nt, Homo sapiens
cuaacauaaaaua

SEQ ID NO: 1111821 - RNA, 23 nt, Homo sapiens
cuaacccccagugccacagagaa

SEQ ID NO: 1111822 - RNA, 15 nt, Homo sapiens
cuaacuccagugaag

SEQ ID NO: 1111823 - RNA, 22 nt, Homo sapiens
cuaagcaguaagcuaucuucaa

SEQ ID NO: 1111824 - RNA, 20 nt, Homo sapiens
cuaagccacauggcugggau

SEQ ID NO: 1111825 - RNA, 13 nt, Homo sapiens
cuaagccacucuu

SEQ ID NO: 1111826 - RNA, 21 nt, Homo sapiens
cuaagccacucuuccaaaggc

SEQ ID NO: 1111827 - RNA, 11 nt, Homo sapiens
cuaagccuuuc

SEQ ID NO: 1111828 - RNA, 17 nt, Homo sapiens
cuaagccuuuccauaag

SEQ ID NO: 1111829 - RNA, 22 nt, Homo sapiens
cuaagcuggugccccacugaau

SEQ ID NO: 1111830 - RNA, 23 nt, Homo sapiens
cuaagugauccucccaccucagc

SEQ ID NO: 1111831 - RNA, 18 nt, Homo sapiens
cuaauagaaccaagaauu

SEQ ID NO: 1111832 - RNA, 19 nt, Homo sapiens
cuaauccuccaagucuuca

SEQ ID NO: 1111833 - RNA, 21 nt, Homo sapiens
cuaaucuucuuaugcaauuuc

SEQ ID NO: 1111834 - RNA, 12 nt, Homo sapiens
cuaaugggacac

SEQ ID NO: 1111835 - RNA, 14 nt, Homo sapiens
cuaauucaacauau

SEQ ID NO: 1111836 - RNA, 21 nt, Homo sapiens
cuaauucccauuuugcaaaau

SEQ ID NO: 1111837 - RNA, 14 nt, Homo sapiens
cuacaaaggccaug

SEQ ID NO: 1111838 - RNA, 18 nt, Homo sapiens
cuccuguuagcuguuauu

SEQ ID NO: 1111839 - RNA, 16 nt, Homo sapiens
cuccuuagagacauca

SEQ ID NO: 1111840 - RNA, 19 nt, Homo sapiens
cuccuuucuuucuaacucc

SEQ ID NO: 1111841 - RNA, 14 nt, Homo sapiens
cuccuuugcacuga

SEQ ID NO: 1111842 - RNA, 17 nt, Homo sapiens
cucgaagcccuuccagu

SEQ ID NO: 1111843 - RNA, 14 nt, Homo sapiens
cucgcuacaagaac

SEQ ID NO: 1111844 - RNA, 21 nt, Homo sapiens
cucggggcgaccccucagugc

SEQ ID NO: 1111845 - RNA, 22 nt, Homo sapiens
cucgguggccaugcuucuugcc

SEQ ID NO: 1111846 - RNA, 19 nt, Homo sapiens
cucuaaaaauaaaaugaug

SEQ ID NO: 1111847 - RNA, 22 nt, Homo sapiens
cucuaagccacucuuccaaagg

SEQ ID NO: 1111848 - RNA, 16 nt, Homo sapiens
cucuacagacuucucc

SEQ ID NO: 1111849 - RNA, 22 nt, Homo sapiens
cucuacccuauacaacuggaca

SEQ ID NO: 1111850 - RNA, 21 nt, Homo sapiens
cucuagaacaugcacauuuau

SEQ ID NO: 1111851 - RNA, 18 nt, Homo sapiens
cucuagagaaaagucuac

SEQ ID NO: 1111852 - RNA, 21 nt, Homo sapiens
cucuauagacucuaggacaua

SEQ ID NO: 1111853 - RNA, 22 nt, Homo sapiens
cucuauuucucucuuucuuggu

SEQ ID NO: 1111854 - RNA, 20 nt, Homo sapiens
cucucaaauccugaugcugu

SEQ ID NO: 1111855 - RNA, 16 nt, Homo sapiens
cucuccuuuggccauu

SEQ ID NO: 1111856 - RNA, 18 nt, Homo sapiens
cucucuaaaaauaaaaug

SEQ ID NO: 1111857 - RNA, 14 nt, Homo sapiens
cucucuccugucca

SEQ ID NO: 1111858 - RNA, 17 nt, Homo sapiens
cucucugagaugccccu

SEQ ID NO: 1111859 - RNA, 16 nt, Homo sapiens
cucucugcaaggcccu

SEQ ID NO: 1111860 - RNA, 14 nt, Homo sapiens
cucugaacaaaagc

SEQ ID NO: 1111861 - RNA, 12 nt, Homo sapiens
cucugaagucac

SEQ ID NO: 1111862 - RNA, 19 nt, Homo sapiens
cucugaagucacaucacag

SEQ ID NO: 1111863 - RNA, 15 nt, Homo sapiens
cucugacacacagcu

SEQ ID NO: 1111864 - RNA, 15 nt, Homo sapiens
cucugacucuugccu

SEQ ID NO: 1111865 - RNA, 14 nt, Homo sapiens
cucugagaacagac

SEQ ID NO: 1111866 - RNA, 22 nt, Homo sapiens
cucugcacagggaugaccugga

SEQ ID NO: 1111867 - RNA, 14 nt, Homo sapiens
cucugcacaugucu

SEQ ID NO: 1111868 - RNA, 18 nt, Homo sapiens
cucugcacaugucuugua

SEQ ID NO: 1111869 - RNA, 20 nt, Homo sapiens
cucugcacaugucuuguaca

SEQ ID NO: 1111870 - RNA, 15 nt, Homo sapiens
cucugcagcacuuua

SEQ ID NO: 1111871 - RNA, 15 nt, Homo sapiens
cucugcauucuagua

SEQ ID NO: 1111872 - RNA, 23 nt, Homo sapiens
gcuguuuuaauaauuaugugcca

SEQ ID NO: 1111873 - RNA, 21 nt, Homo sapiens
gcuguuuugauuuguacugaa

SEQ ID NO: 1111874 - RNA, 16 nt, Homo sapiens
gcuuaaaugcaauauu

SEQ ID NO: 1111875 - RNA, 15 nt, Homo sapiens
gcuuaggacuuucca

SEQ ID NO: 1111876 - RNA, 14 nt, Homo sapiens
gcuuaggauguuuu

SEQ ID NO: 1111877 - RNA, 21 nt, Homo sapiens
gcuuauucuaggucuguaauu

SEQ ID NO: 1111878 - RNA, 13 nt, Homo sapiens
gcuucagccucuc

SEQ ID NO: 1111879 - RNA, 18 nt, Homo sapiens
gcuucaguggcagcugcu

SEQ ID NO: 1111880 - RNA, 16 nt, Homo sapiens
gcuuccagaaaacccc

SEQ ID NO: 1111881 - RNA, 20 nt, Homo sapiens
gcuucccaugucuuucucca

SEQ ID NO: 1111882 - RNA, 14 nt, Homo sapiens
gcuuccuaacugcu

SEQ ID NO: 1111883 - RNA, 19 nt, Homo sapiens
gcuucucugggggccucuu

SEQ ID NO: 1111884 - RNA, 23 nt, Homo sapiens
gcuugauugcguggaauugugcu

SEQ ID NO: 1111885 - RNA, 22 nt, Homo sapiens
gcuugugauuuuugaacaauac

SEQ ID NO: 1111886 - RNA, 14 nt, Homo sapiens
gcuuguguuuuuaa

SEQ ID NO: 1111887 - RNA, 14 nt, Homo sapiens
gcuuguuuguucua

SEQ ID NO: 1111888 - RNA, 20 nt, Homo sapiens
gcuuuaaacacccuucacau

SEQ ID NO: 1111889 - RNA, 20 nt, Homo sapiens
gcuuucuucuacaaccagag

SEQ ID NO: 1111890 - RNA, 13 nt, Homo sapiens
gcuuugacucacc

SEQ ID NO: 1111891 - RNA, 14 nt, Homo sapiens
gcuuugaggacaaa

SEQ ID NO: 1111892 - RNA, 11 nt, Homo sapiens
gcuuuguccug

SEQ ID NO: 1111893 - RNA, 13 nt, Homo sapiens
gcuuuguuuccau

SEQ ID NO: 1111894 - RNA, 22 nt, Homo sapiens
gcuuuuuucuugaguacuagaa

SEQ ID NO: 1111895 - RNA, 20 nt, Homo sapiens
ggaaaagaaucccugcagcc

SEQ ID NO: 1111896 - RNA, 13 nt, Homo sapiens
ggaaaagcaaaac

SEQ ID NO: 1111897 - RNA, 21 nt, Homo sapiens
ggaaacagagaacccuguggg

SEQ ID NO: 1111898 - RNA, 14 nt, Homo sapiens
ggaaaccaguguag

SEQ ID NO: 1111899 - RNA, 19 nt, Homo sapiens
ggaaacuggaugaggucau

SEQ ID NO: 1111900 - RNA, 20 nt, Homo sapiens
ggaaacuggaugaggucaua

SEQ ID NO: 1111901 - RNA, 16 nt, Homo sapiens
ggaaagaugaucagcu

SEQ ID NO: 1111902 - RNA, 16 nt, Homo sapiens
ggaaagaugaugcaag

SEQ ID NO: 1111903 - RNA, 22 nt, Homo sapiens
ggaaagcaucaccucaggccag

SEQ ID NO: 1111904 - RNA, 15 nt, Homo sapiens
ggaaagccucacuga

SEQ ID NO: 1111905 - RNA, 23 nt, Homo sapiens
ggaaaguaaauauuucaggcaua

SEQ ID NO: 1111906 - RNA, 22 nt, Homo sapiens
ggaacacccgacuccucaaaag

SEQ ID NO: 1111907 - RNA, 14 nt, Homo sapiens
ggaaccaugaagcu

SEQ ID NO: 1111908 - RNA, 19 nt, Homo sapiens
ggaacucuggcuuccaggu

SEQ ID NO: 1111909 - RNA, 16 nt, Homo sapiens
ggaagaaauuccugua

SEQ ID NO: 1111910 - RNA, 19 nt, Homo sapiens
ggaagagcugcaacggaau

SEQ ID NO: 1111911 - RNA, 15 nt, Homo sapiens
ggaagaugaaagagg

SEQ ID NO: 1111912 - RNA, 16 nt, Homo sapiens
ggaagcacauguuuau

SEQ ID NO: 1111913 - RNA, 12 nt, Homo sapiens
ggaagguacaaa

SEQ ID NO: 1111914 - RNA, 22 nt, Homo sapiens
ggaaggugcuugccugggacca

SEQ ID NO: 1111915 - RNA, 15 nt, Homo sapiens
ggaaguuuguucacu

SEQ ID NO: 1111916 - RNA, 21 nt, Homo sapiens
ggaaguuuuguggaggagcuc

SEQ ID NO: 1111917 - RNA, 22 nt, Homo sapiens
ggaauaaauugcuccuugacau

SEQ ID NO: 1111918 - RNA, 22 nt, Homo sapiens
ggaauauuugcaagacauagaa

SEQ ID NO: 1111919 - RNA, 17 nt, Homo sapiens
ggaauccagacccggcu

SEQ ID NO: 1111920 - RNA, 12 nt, Homo sapiens
ggaauuaccuua

SEQ ID NO: 1111921 - RNA, 13 nt, Homo sapiens
ggaauucaucucu

SEQ ID NO: 1111922 - RNA, 16 nt, Homo sapiens
ggacagcgccaccucu

SEQ ID NO: 1111923 - RNA, 13 nt, Homo sapiens
ggacauaagacag

SEQ ID NO: 1111924 - RNA, 16 nt, Homo sapiens
ggacaugaaaaauugc

SEQ ID NO: 1111925 - RNA, 18 nt, Homo sapiens
ggacauugcggacagcca

SEQ ID NO: 1111926 - RNA, 13 nt, Homo sapiens
ggaccaauaccuc

SEQ ID NO: 1111927 - RNA, 14 nt, Homo sapiens
ggaccucaguuuua

SEQ ID NO: 1111928 - RNA, 15 nt, Homo sapiens
ggacgugucucagga

SEQ ID NO: 1111929 - RNA, 13 nt, Homo sapiens
ggacucugcacau

SEQ ID NO: 1111930 - RNA, 14 nt, Homo sapiens
ggacugauaaucuc

SEQ ID NO: 1111931 - RNA, 15 nt, Homo sapiens
ggacuucugccugaa

SEQ ID NO: 1111932 - RNA, 22 nt, Homo sapiens
ggacuuugguucucuccaggaa

SEQ ID NO: 1111933 - RNA, 14 nt, Homo sapiens
ggagaacuauccaa

SEQ ID NO: 1111934 - RNA, 18 nt, Homo sapiens
ggagaagcucacccaaua

SEQ ID NO: 1111935 - RNA, 16 nt, Homo sapiens
ggagaaucgcuuaaac

SEQ ID NO: 1111936 - RNA, 20 nt, Homo sapiens
ggagaguacagugagccaag

SEQ ID NO: 1111937 - RNA, 17 nt, Homo sapiens
ggagcaauuugcacaug

SEQ ID NO: 1111938 - RNA, 17 nt, Homo sapiens
ggagcccagaaaaccuc

SEQ ID NO: 1111939 - RNA, 21 nt, Homo sapiens
ggagccuggcuccguccagga

SEQ ID NO: 1111940 - RNA, 16 nt, Homo sapiens
ggagcgaagcagagag

SEQ ID NO: 1111941 - RNA, 15 nt, Homo sapiens
ggagcuugauccaga

SEQ ID NO: 1111942 - RNA, 15 nt, Homo sapiens
ggaggaccagagcua

SEQ ID NO: 1111943 - RNA, 12 nt, Homo sapiens
ggaggauguucu

SEQ ID NO: 1111944 - RNA, 21 nt, Homo sapiens
ggaggcggcacauuggcagug

SEQ ID NO: 1111945 - RNA, 20 nt, Homo sapiens
ggagggacacuuacccaagg

SEQ ID NO: 1111946 - RNA, 14 nt, Homo sapiens
ggagguugcaguga

SEQ ID NO: 1111947 - RNA, 18 nt, Homo sapiens
ggagugagaucauuuucu

SEQ ID NO: 1111948 - RNA, 12 nt, Homo sapiens
ggagugcaguuu

SEQ ID NO: 1111949 - RNA, 20 nt, Homo sapiens
ggaguucgaggcugcaguca

SEQ ID NO: 1111950 - RNA, 20 nt, Homo sapiens
ggauaaugcuguugccucau

SEQ ID NO: 1111951 - RNA, 23 nt, Homo sapiens
ggauacagucuucuuacuuggaa

SEQ ID NO: 1111952 - RNA, 15 nt, Homo sapiens
ggauauuuucuucca

SEQ ID NO: 1111953 - RNA, 16 nt, Homo sapiens
ggaucacaaggucacu

SEQ ID NO: 1111954 - RNA, 20 nt, Homo sapiens
ggaucacaaggucacuagau

SEQ ID NO: 1111955 - RNA, 16 nt, Homo sapiens
ggaucuguccaaggaa

SEQ ID NO: 1111956 - RNA, 17 nt, Homo sapiens
ggaugaagcucuggcca

SEQ ID NO: 1111957 - RNA, 20 nt, Homo sapiens
ggauggacgaacaggggcca

SEQ ID NO: 1111958 - RNA, 16 nt, Homo sapiens
ggaugugcauucucca

SEQ ID NO: 1111959 - RNA, 20 nt, Homo sapiens
ggaugugcccacagggacca

SEQ ID NO: 1111960 - RNA, 22 nt, Homo sapiens
ggauuccuaagcagugcuugua

SEQ ID NO: 1111961 - RNA, 15 nt, Homo sapiens
gaccucuacaagcaa

SEQ ID NO: 1111962 - RNA, 19 nt, Homo sapiens
gaccugacaagcacugcua

SEQ ID NO: 1111963 - RNA, 19 nt, Homo sapiens
gaccuuccugccaccaguc

SEQ ID NO: 1111964 - RNA, 13 nt, Homo sapiens
gaccuucuaggaa

SEQ ID NO: 1111965 - RNA, 16 nt, Homo sapiens
gaccuuguagcuauau

SEQ ID NO: 1111966 - RNA, 17 nt, Homo sapiens
gacgaacaggggccaaa

SEQ ID NO: 1111967 - RNA, 21 nt, Homo sapiens
gacgguuaacuuguauauucc

SEQ ID NO: 1111968 - RNA, 16 nt, Homo sapiens
gacuaauggaaauauu

SEQ ID NO: 1111969 - RNA, 12 nt, Homo sapiens
gacuacaggugu

SEQ ID NO: 1111970 - RNA, 16 nt, Homo sapiens
gacuagaggcagggag

SEQ ID NO: 1111971 - RNA, 17 nt, Homo sapiens
gacuaguugaacaucuc

SEQ ID NO: 1111972 - RNA, 14 nt, Homo sapiens
gacuaucacauaca

SEQ ID NO: 1111973 - RNA, 14 nt, Homo sapiens
gacuaugaaaagcu

SEQ ID NO: 1111974 - RNA, 19 nt, Homo sapiens
gacuaugaggaauauuugc

SEQ ID NO: 1111975 - RNA, 17 nt, Homo sapiens
gacuauggcuaccaaaa

SEQ ID NO: 1111976 - RNA, 20 nt, Homo sapiens
gacuauuauagaauggaacu

SEQ ID NO: 1111977 - RNA, 20 nt, Homo sapiens
gacucaaagagggagugcau

SEQ ID NO: 1111978 - RNA, 15 nt, Homo sapiens
gacucaauaaaauca

SEQ ID NO: 1111979 - RNA, 16 nt, Homo sapiens
gacucagggaccuaag

SEQ ID NO: 1111980 - RNA, 19 nt, Homo sapiens
gacuccugggcuucagccu

SEQ ID NO: 1111981 - RNA, 22 nt, Homo sapiens
gacuccuuagagacaucaaaau

SEQ ID NO: 1111982 - RNA, 14 nt, Homo sapiens
gacucugcacaugu

SEQ ID NO: 1111983 - RNA, 20 nt, Homo sapiens
gacucuuguuuucaguuuca

SEQ ID NO: 1111984 - RNA, 13 nt, Homo sapiens
gacugacauuuag

SEQ ID NO: 1111985 - RNA, 15 nt, Homo sapiens
gacugcaucucaaaa

SEQ ID NO: 1111986 - RNA, 17 nt, Homo sapiens
gacugccaugcuagaca

SEQ ID NO: 1111987 - RNA, 17 nt, Homo sapiens
gacuggauucgugacaa

SEQ ID NO: 1111988 - RNA, 17 nt, Homo sapiens
gacuguaggauuugaag

SEQ ID NO: 1111989 - RNA, 18 nt, Homo sapiens
gacuuaacugguucauau

SEQ ID NO: 1111990 - RNA, 13 nt, Homo sapiens
gacuucacacugc

SEQ ID NO: 1111991 - RNA, 16 nt, Homo sapiens
gacuucucuuugccuc

SEQ ID NO: 1111992 - RNA, 17 nt, Homo sapiens
gacuucucuuugccuca

SEQ ID NO: 1111993 - RNA, 20 nt, Homo sapiens
gacuuggucugauuucagga

SEQ ID NO: 1111994 - RNA, 23 nt, Homo sapiens
gagaaaccagggagccccuuuga

SEQ ID NO: 1111995 - RNA, 17 nt, Homo sapiens
gagaaaguucucauuua

SEQ ID NO: 1111996 - RNA, 20 nt, Homo sapiens
gagaaauaaaaauaccucuu

SEQ ID NO: 1111997 - RNA, 13 nt, Homo sapiens
gagaaccucaggc

SEQ ID NO: 1111998 - RNA, 16 nt, Homo sapiens
gagaacuauccaaaac

SEQ ID NO: 1111999 - RNA, 23 nt, Homo sapiens
gagaagaagaaaaucaaccagca

SEQ ID NO: 1112000 - RNA, 23 nt, Homo sapiens
gagaagaauuuucagaccccagc

SEQ ID NO: 1112001 - RNA, 14 nt, Homo sapiens
gagaagcagugagc

SEQ ID NO: 1112002 - RNA, 17 nt, Homo sapiens
gagaagcucacccaaua

SEQ ID NO: 1112003 - RNA, 17 nt, Homo sapiens
gagaaggagaucagggc

SEQ ID NO: 1112004 - RNA, 22 nt, Homo sapiens
gagacacuauuuaucugugcaa

SEQ ID NO: 1112005 - RNA, 14 nt, Homo sapiens
gagacaguucaaga

SEQ ID NO: 1112006 - RNA, 15 nt, Homo sapiens
gagacccccaucucu

SEQ ID NO: 1112007 - RNA, 16 nt, Homo sapiens
gagacggccaagugaa

SEQ ID NO: 1112008 - RNA, 14 nt, Homo sapiens
gagacuauguguca

SEQ ID NO: 1112009 - RNA, 13 nt, Homo sapiens
gagacucugucuc

SEQ ID NO: 1112010 - RNA, 19 nt, Homo sapiens
gagagaacuuaaaaaagca

SEQ ID NO: 1112011 - RNA, 16 nt, Homo sapiens
gagagauaccuugaaa

SEQ ID NO: 1112012 - RNA, 14 nt, Homo sapiens
gagagauggaauaa

SEQ ID NO: 1112013 - RNA, 20 nt, Homo sapiens
gagagauggaauaaagcccu

SEQ ID NO: 1112014 - RNA, 19 nt, Homo sapiens
gagagauuuguggaaaaau

SEQ ID NO: 1112015 - RNA, 20 nt, Homo sapiens
gagagcaaauaaagaccuga

SEQ ID NO: 1112016 - RNA, 23 nt, Homo sapiens
gagagcuuucuguccuuuuggca

SEQ ID NO: 1112017 - RNA, 17 nt, Homo sapiens
gagaggaagagcugcaa

SEQ ID NO: 1112018 - RNA, 15 nt, Homo sapiens
gagaguagagggcac

SEQ ID NO: 1112019 - RNA, 18 nt, Homo sapiens
gagaguauauuauguauu

SEQ ID NO: 1112020 - RNA, 16 nt, Homo sapiens
gagaguggaacagaag

SEQ ID NO: 1112021 - RNA, 18 nt, Homo sapiens
gagauaagaucuauagcc

SEQ ID NO: 1112022 - RNA, 21 nt, Homo sapiens
gagaucacgccacugcacuau

SEQ ID NO: 1112023 - RNA, 21 nt, Homo sapiens
gagaugcaggauuucuucaca

SEQ ID NO: 1112024 - RNA, 20 nt, Homo sapiens
gagauggaaguugcagugag

SEQ ID NO: 1112025 - RNA, 17 nt, Homo sapiens
gagauggaggaaaguga

SEQ ID NO: 1112026 - RNA, 23 nt, Homo sapiens
gcagagagguggagaacugggau

SEQ ID NO: 1112027 - RNA, 15 nt, Homo sapiens
gcagcagaagccaaa

SEQ ID NO: 1112028 - RNA, 16 nt, Homo sapiens
gcagcagcucagccuc

SEQ ID NO: 1112029 - RNA, 21 nt, Homo sapiens
gcagcaucuucaaacauguac

SEQ ID NO: 1112030 - RNA, 21 nt, Homo sapiens
gcagccaccaggucaucuccu

SEQ ID NO: 1112031 - RNA, 17 nt, Homo sapiens
gcagccugcagacucac

SEQ ID NO: 1112032 - RNA, 14 nt, Homo sapiens
gcagcuaagccaca

SEQ ID NO: 1112033 - RNA, 13 nt, Homo sapiens
gcagcuuguagcc

SEQ ID NO: 1112034 - RNA, 15 nt, Homo sapiens
gcaggaagugucuag

SEQ ID NO: 1112035 - RNA, 12 nt, Homo sapiens
gcaggaccagga

SEQ ID NO: 1112036 - RNA, 18 nt, Homo sapiens
gcaggaguagcugagcuc

SEQ ID NO: 1112037 - RNA, 24 nt, Homo sapiens
gcaggauuucuucacaccucuccu

SEQ ID NO: 1112038 - RNA, 14 nt, Homo sapiens
gcaggcagccccac

SEQ ID NO: 1112039 - RNA, 21 nt, Homo sapiens
gcaggcagccccacacccgcc

SEQ ID NO: 1112040 - RNA, 15 nt, Homo sapiens
gcagggaaacagcua

SEQ ID NO: 1112041 - RNA, 18 nt, Homo sapiens
gcagggacaauuugcugc

SEQ ID NO: 1112042 - RNA, 15 nt, Homo sapiens
gcagugagcugagau

SEQ ID NO: 1112043 - RNA, 21 nt, Homo sapiens
gcagugagcugauaucaugcc

SEQ ID NO: 1112044 - RNA, 14 nt, Homo sapiens
gcagugugucacac

SEQ ID NO: 1112045 - RNA, 18 nt, Homo sapiens
gcaguguuuucaccucau

SEQ ID NO: 1112046 - RNA, 15 nt, Homo sapiens
ccagaaggcaaaaag

SEQ ID NO: 1112047 - RNA, 21 nt, Homo sapiens
ccagaauaaaacgcaaagggc

SEQ ID NO: 1112048 - RNA, 19 nt, Homo sapiens
ccagacccugaagauuuca

SEQ ID NO: 1112049 - RNA, 23 nt, Homo sapiens
ccagacuucucuuucuuauuuug

SEQ ID NO: 1112050 - RNA, 23 nt, Homo sapiens
ccagagccccccacaaugaugau

SEQ ID NO: 1112051 - RNA, 20 nt, Homo sapiens
ccagagccuggggcucuaac

SEQ ID NO: 1112052 - RNA, 17 nt, Homo sapiens
ccagaggaaacuugcau

SEQ ID NO: 1112053 - RNA, 19 nt, Homo sapiens
ccagaggcuauuauuuuca

SEQ ID NO: 1112054 - RNA, 17 nt, Homo sapiens
ccagaggguugugauuu

SEQ ID NO: 1112055 - RNA, 23 nt, Homo sapiens
ccagaucagauucuucucuuaau

SEQ ID NO: 1112056 - RNA, 14 nt, Homo sapiens
ccagcaaagguugg

SEQ ID NO: 1112057 - RNA, 22 nt, Homo sapiens
ccagcacuaacguaaauacaca

SEQ ID NO: 1112058 - RNA, 18 nt, Homo sapiens
ccagcacucaaccaaccu

SEQ ID NO: 1112059 - RNA, 23 nt, Homo sapiens
ccagcaggaaaguacagaugcag

SEQ ID NO: 1112060 - RNA, 18 nt, Homo sapiens
ccagcagggccucaaagu

SEQ ID NO: 1112061 - RNA, 16 nt, Homo sapiens
ccagcaugucacuccc

SEQ ID NO: 1112062 - RNA, 13 nt, Homo sapiens
ccagccaccucuu

SEQ ID NO: 1112063 - RNA, 17 nt, Homo sapiens
ccagcccauggcuuuag

SEQ ID NO: 1112064 - RNA, 22 nt, Homo sapiens
ccagcccgacaggcaugcacca

SEQ ID NO: 1112065 - RNA, 20 nt, Homo sapiens
ccagccgugaugcucaggcu

SEQ ID NO: 1112066 - RNA, 15 nt, Homo sapiens
ccagccuggccaaca

SEQ ID NO: 1112067 - RNA, 20 nt, Homo sapiens
ccagccugggugacagagca

SEQ ID NO: 1112068 - RNA, 14 nt, Homo sapiens
ccagcuacucagga

SEQ ID NO: 1112069 - RNA, 13 nt, Homo sapiens
ccagcuagugacc

SEQ ID NO: 1112070 - RNA, 15 nt, Homo sapiens
ccagcucagucccau

SEQ ID NO: 1112071 - RNA, 15 nt, Homo sapiens
ccagcuccugggcag

SEQ ID NO: 1112072 - RNA, 19 nt, Homo sapiens
ccagcugcaggaaucaaaa

SEQ ID NO: 1112073 - RNA, 10 nt, Homo sapiens
ccagcuguca

SEQ ID NO: 1112074 - RNA, 17 nt, Homo sapiens
ccaggaguuugagacca

SEQ ID NO: 1112075 - RNA, 17 nt, Homo sapiens
ccaggcuggagugcagu

SEQ ID NO: 1112076 - RNA, 19 nt, Homo sapiens
ccaggcuugucacuagcag

SEQ ID NO: 1112077 - RNA, 23 nt, Homo sapiens
ccaggggaaugaucucugaugac

SEQ ID NO: 1112078 - RNA, 13 nt, Homo sapiens
ccagggucucacu

SEQ ID NO: 1112079 - RNA, 22 nt, Homo sapiens
ccaggguugaucacacucuggg

SEQ ID NO: 1112080 - RNA, 16 nt, Homo sapiens
ccaguaauugguccga

SEQ ID NO: 1112081 - RNA, 16 nt, Homo sapiens
ccaguacgugcuaaca

SEQ ID NO: 1112082 - RNA, 13 nt, Homo sapiens
ccagugaaccaaa

SEQ ID NO: 1112083 - RNA, 17 nt, Homo sapiens
ccaguggaccugaagga

SEQ ID NO: 1112084 - RNA, 18 nt, Homo sapiens
ccaguguacugcuuucaa

SEQ ID NO: 1112085 - RNA, 12 nt, Homo sapiens
ccagugucccca

SEQ ID NO: 1112086 - RNA, 18 nt, Homo sapiens
ccaguucaucuauggcag

SEQ ID NO: 1112087 - RNA, 16 nt, Homo sapiens
ccauaaacacccauga

SEQ ID NO: 1112088 - RNA, 12 nt, Homo sapiens
ccauaacagcca

SEQ ID NO: 1112089 - RNA, 14 nt, Homo sapiens
ccauaauguuacau

SEQ ID NO: 1112090 - RNA, 15 nt, Homo sapiens
ccauagagacuuugu

SEQ ID NO: 1112091 - RNA, 16 nt, Homo sapiens
ccauagagacuuugug

SEQ ID NO: 1112092 - RNA, 15 nt, Homo sapiens
ccauagucacauggc

SEQ ID NO: 1112093 - RNA, 16 nt, Homo sapiens
ccauagucacauggcc

SEQ ID NO: 1112094 - RNA, 19 nt, Homo sapiens
uaaauugcuccuugacauu

SEQ ID NO: 1112095 - RNA, 19 nt, Homo sapiens
uaaauugcuuauucuaggu

SEQ ID NO: 1112096 - RNA, 14 nt, Homo sapiens
uaaauuggcuuauu

SEQ ID NO: 1112097 - RNA, 15 nt, Homo sapiens
uaaauuuaucaucuc

SEQ ID NO: 1112098 - RNA, 16 nt, Homo sapiens
uaaauuuaucaucucg

SEQ ID NO: 1112099 - RNA, 15 nt, Homo sapiens
uaaauuucaucucag

SEQ ID NO: 1112100 - RNA, 20 nt, Homo sapiens
uaaauuugggggacuuacau

SEQ ID NO: 1112101 - RNA, 16 nt, Homo sapiens
uaaauuuguguucuca

SEQ ID NO: 1112102 - RNA, 17 nt, Homo sapiens
uaacaaccccggacaaa

SEQ ID NO: 1112103 - RNA, 19 nt, Homo sapiens
uaacaagguucuucuaaaa

SEQ ID NO: 1112104 - RNA, 21 nt, Homo sapiens
uaacaauguaugugaaagugu

SEQ ID NO: 1112105 - RNA, 16 nt, Homo sapiens
uccuccgucugcaaug

SEQ ID NO: 1112106 - RNA, 20 nt, Homo sapiens
uccucuaguuuuaagacuga

SEQ ID NO: 1112107 - RNA, 19 nt, Homo sapiens
uccucuggauggcaccaga

SEQ ID NO: 1112108 - RNA, 15 nt, Homo sapiens
uccucuugaaccaca

SEQ ID NO: 1112109 - RNA, 22 nt, Homo sapiens
ugugccuuaggaaaagcauuug

SEQ ID NO: 1112110 - RNA, 21 nt, Homo sapiens
ugugcgacuucacaaaaugca

SEQ ID NO: 1112111 - RNA, 23 nt, Homo sapiens
uguggaauauaaagauggcugac

SEQ ID NO: 1112112 - RNA, 24 nt, Homo sapiens
uguggacaggacuaacacucagaa

SEQ ID NO: 1112113 - RNA, 16 nt, Homo sapiens
uuacagagaaucugaa

SEQ ID NO: 1112114 - RNA, 24 nt, Homo sapiens
uuacagcugccugcaguacuuuac

SEQ ID NO: 1112115 - RNA, 12 nt, Homo sapiens
uuacaugauuca

SEQ ID NO: 1112116 - RNA, 12 nt, Homo sapiens
uuacaugcauua

SEQ ID NO: 1112117 - RNA, 14 nt, Homo sapiens
uuguucacauauau

SEQ ID NO: 1112118 - RNA, 23 nt, Homo sapiens
uuguucaucagacuccugugcaa

SEQ ID NO: 1112119 - RNA, 18 nt, Homo sapiens
uuguuccuuaagucagaa

SEQ ID NO: 1112120 - RNA, 15 nt, Homo sapiens
uuguuuuagcuccuu

SEQ ID NO: 1112121 - RNA, 14 nt, Homo sapiens
uuguuuuauauucu

SEQ ID NO: 1112122 - RNA, 15 nt, Homo sapiens
uuuaaaaaaaguaua

SEQ ID NO: 1112123 - RNA, 16 nt, Homo sapiens
uuuaaaaaagcuuaaa

SEQ ID NO: 1112124 - RNA, 15 nt, Homo sapiens
uuuaaaagcaucuca

SEQ ID NO: 1112125 - RNA, 14 nt, Homo sapiens
uuuaaacauaggaa

SEQ ID NO: 1112126 - RNA, 16 nt, Homo sapiens
uuuaaaccagcagaaa

SEQ ID NO: 1112127 - RNA, 14 nt, Homo sapiens
uuuaaauagaccuc

SEQ ID NO: 1112128 - RNA, 15 nt, Homo sapiens
uuuaaauccuuccau

SEQ ID NO: 1112129 - RNA, 14 nt, Homo sapiens
uuuaacacuaaaaa

SEQ ID NO: 1112130 - RNA, 18 nt, Homo sapiens
uuuaacuggcuucagccu

SEQ ID NO: 1112131 - RNA, 18 nt, Homo sapiens
uuuaacugugaaccugga

SEQ ID NO: 1112132 - RNA, 16 nt, Homo sapiens
uuuaagaaucuauuuc

SEQ ID NO: 1112133 - RNA, 13 nt, Homo sapiens
uuuaagcaucaaa

SEQ ID NO: 1112134 - RNA, 18 nt, Homo sapiens
uuuaauaauuaugugcca

SEQ ID NO: 1112135 - RNA, 22 nt, Homo sapiens
uuuaauacaggguagauaaccu

SEQ ID NO: 1112136 - RNA, 16 nt, Homo sapiens
uuuaauagaauauaau

SEQ ID NO: 1112137 - RNA, 19 nt, Homo sapiens
uuuaaucauuuugccucuu

SEQ ID NO: 1112138 - RNA, 20 nt, Homo sapiens
uuuaauucucaugugauccu

SEQ ID NO: 1112139 - RNA, 20 nt, Homo sapiens
uuuacacauguaucuaugca

SEQ ID NO: 1112140 - RNA, 12 nt, Homo sapiens
uuuacaccaguu

SEQ ID NO: 1112141 - RNA, 20 nt, Homo sapiens
uuuaccaaaauucagaacau

SEQ ID NO: 1112142 - RNA, 22 nt, Homo sapiens
uuuaccauaaaaauccuucuca

SEQ ID NO: 1112143 - RNA, 19 nt, Homo sapiens
uuuagagauggggucuugc

SEQ ID NO: 1112144 - RNA, 19 nt, Homo sapiens
uuuagauuaaacaaacaaa

SEQ ID NO: 1112145 - RNA, 19 nt, Homo sapiens
uuuagcgugcucacugacc

SEQ ID NO: 1112146 - RNA, 22 nt, Homo sapiens
uuuagcuaccucacuaugcugc

SEQ ID NO: 1112147 - RNA, 21 nt, Homo sapiens
uuuaggagacagucucaagca

SEQ ID NO: 1112148 - RNA, 17 nt, Homo sapiens
uuuauaaauguguggug

SEQ ID NO: 1112149 - RNA, 13 nt, Homo sapiens
uuuauauaugaag

SEQ ID NO: 1112150 - RNA, 18 nt, Homo sapiens
uuuaugguguguuccuaa

SEQ ID NO: 1112151 - RNA, 22 nt, Homo sapiens
uuuaugucucagaccacuauuc

SEQ ID NO: 1112152 - RNA, 11 nt, Homo sapiens
uuuaugugcaa

SEQ ID NO: 1112153 - RNA, 13 nt, Homo sapiens
uuuauuaccucug

SEQ ID NO: 1112154 - RNA, 16 nt, Homo sapiens
uuuauuaccucugaua

SEQ ID NO: 1112155 - RNA, 23 nt, Homo sapiens
uuuauuaguuaggugugccaaac

SEQ ID NO: 1112156 - RNA, 19 nt, Homo sapiens
uuuauucauuagcugugau

SEQ ID NO: 1112157 - RNA, 21 nt, Homo sapiens
uuuauucauuagcugugauuu

SEQ ID NO: 1112158 - RNA, 20 nt, Homo sapiens
uuucaaaaauuacacuacaa

SEQ ID NO: 1112159 - RNA, 14 nt, Homo sapiens
uuucaacauaucau

SEQ ID NO: 1112160 - RNA, 13 nt, Homo sapiens
uuucaaccagcau

SEQ ID NO: 1112161 - RNA, 18 nt, Homo sapiens
uuucaaccgcuugccaua

SEQ ID NO: 1112162 - RNA, 18 nt, Homo sapiens
uuucaagaaaacuggaaa

SEQ ID NO: 1112163 - RNA, 11 nt, Homo sapiens
uuucaccacau

SEQ ID NO: 1112164 - RNA, 18 nt, Homo sapiens
uuucagauaaacaacaaa

SEQ ID NO: 1112165 - RNA, 18 nt, Homo sapiens
uuucauaaccuagccuua

SEQ ID NO: 1112166 - RNA, 18 nt, Homo sapiens
uuuccaagauaaaaccag

SEQ ID NO: 1112167 - RNA, 21 nt, Homo sapiens
uuuccacauaaagguauuuag

SEQ ID NO: 1112168 - RNA, 15 nt, Homo sapiens
uuuccacugccaaaa

SEQ ID NO: 1112169 - RNA, 12 nt, Homo sapiens
uuucccaccacc

SEQ ID NO: 1112170 - RNA, 18 nt, Homo sapiens
uuucccgcuccaagagaa

SEQ ID NO: 1112171 - RNA, 15 nt, Homo sapiens
uuucccuugaacugu

SEQ ID NO: 1112172 - RNA, 18 nt, Homo sapiens
uuuccuaaaugcagugaa

SEQ ID NO: 1112173 - RNA, 15 nt, Homo sapiens
uuuccuccaggcaaa

SEQ ID NO: 1112174 - RNA, 13 nt, Homo sapiens
uuuccuccccacc

SEQ ID NO: 1112175 - RNA, 14 nt, Homo sapiens
uuuccucugcagca

SEQ ID NO: 1112176 - RNA, 21 nt, Homo sapiens
uuucuaaagcucugaacaaaa

SEQ ID NO: 1112177 - RNA, 12 nt, Homo sapiens
uuucuaucauuc

SEQ ID NO: 1112178 - RNA, 21 nt, Homo sapiens
uuucucagcucccaaggcucu

SEQ ID NO: 1112179 - RNA, 16 nt, Homo sapiens
uuucugucacaucagc

SEQ ID NO: 1112180 - RNA, 18 nt, Homo sapiens
uuucuuacccauauaucu

SEQ ID NO: 1112181 - RNA, 22 nt, Homo sapiens
uuucuucagagagcuaaauuac

SEQ ID NO: 1112182 - RNA, 23 nt, Homo sapiens
uuucuuccagaaggcaaaaagac

SEQ ID NO: 1112183 - RNA, 16 nt, Homo sapiens
uuugaaaaagcgaaaa

SEQ ID NO: 1112184 - RNA, 19 nt, Homo sapiens
uuugaagguauaaccuuca

SEQ ID NO: 1112185 - RNA, 12 nt, Homo sapiens
uuugaaguagga

SEQ ID NO: 1112186 - RNA, 14 nt, Homo sapiens
uuugaauaucauua

SEQ ID NO: 1112187 - RNA, 17 nt, Homo sapiens
uuugaaugaguuuauau

SEQ ID NO: 1112188 - RNA, 19 nt, Homo sapiens
uuugaccucauuuguaaaa

SEQ ID NO: 1112189 - RNA, 13 nt, Homo sapiens
uuugacucaugaa

SEQ ID NO: 1112190 - RNA, 23 nt, Homo sapiens
uuugacucaugaacuauuuacau

SEQ ID NO: 1112191 - RNA, 19 nt, Homo sapiens
uuugagcaauucauuucac

SEQ ID NO: 1112192 - RNA, 16 nt, Homo sapiens
uuugaggcaaaggcca

SEQ ID NO: 1112193 - RNA, 21 nt, Homo sapiens
uuugaggcaaaggccagcagc

SEQ ID NO: 1112194 - RNA, 19 nt, Homo sapiens
uuugagugucuuugacuug

SEQ ID NO: 1112195 - RNA, 15 nt, Homo sapiens
uuugaguugaauuua

SEQ ID NO: 1112196 - RNA, 19 nt, Homo sapiens
uuugauacaagaaagcaau

SEQ ID NO: 1112197 - RNA, 20 nt, Homo sapiens
uuugauacucccagucuugu

SEQ ID NO: 1112198 - RNA, 21 nt, Homo sapiens
uuugauuauauacuauguaug

SEQ ID NO: 1112199 - RNA, 21 nt, Homo sapiens
uuugcaaaauuuccaguaccu

SEQ ID NO: 1112200 - RNA, 19 nt, Homo sapiens
uuugcagcagugagucucu

SEQ ID NO: 1112201 - RNA, 21 nt, Homo sapiens
uuuggaaguguucccugagaa

SEQ ID NO: 1112202 - RNA, 21 nt, Homo sapiens
uuugggagaaaacuucucaca

SEQ ID NO: 1112203 - RNA, 18 nt, Homo sapiens
uuugguucucuccaggaa

SEQ ID NO: 1112204 - RNA, 21 nt, Homo sapiens
uuuguagagccagggucucac

SEQ ID NO: 1112205 - RNA, 12 nt, Homo sapiens
uuugucauauau

SEQ ID NO: 1112206 - RNA, 18 nt, Homo sapiens
uuugucauucaagccugu

SEQ ID NO: 1112207 - RNA, 13 nt, Homo sapiens
uuuuaacaucuga

SEQ ID NO: 1112208 - RNA, 13 nt, Homo sapiens
uuuuaacauucca

SEQ ID NO: 1112209 - RNA, 20 nt, Homo sapiens
uuuuacaaauuuaauuuugc

SEQ ID NO: 1112210 - RNA, 12 nt, Homo sapiens
uuuuacaccagu

SEQ ID NO: 1112211 - RNA, 13 nt, Homo sapiens
uuuuagacagagu

SEQ ID NO: 1112212 - RNA, 12 nt, Homo sapiens
uuuuagaguaug

SEQ ID NO: 1112213 - RNA, 15 nt, Homo sapiens
uuuuauagucugaaa

SEQ ID NO: 1112214 - RNA, 12 nt, Homo sapiens
uuuuauauccac

SEQ ID NO: 1112215 - RNA, 21 nt, Homo sapiens
uuuuauuuuuaugugcucuca

SEQ ID NO: 1112216 - RNA, 13 nt, Homo sapiens
uuuucacacugau

SEQ ID NO: 1112217 - RNA, 15 nt, Homo sapiens
uuuucagaccccagc

SEQ ID NO: 1112218 - RNA, 17 nt, Homo sapiens
uuuucauugauaugaaa

SEQ ID NO: 1112219 - RNA, 15 nt, Homo sapiens
uuuuccuccaggcaa

SEQ ID NO: 1112220 - RNA, 15 nt, Homo sapiens
uuuucucugugcuuc

SEQ ID NO: 1112221 - RNA, 15 nt, Homo sapiens
uuuucuugccaauga

SEQ ID NO: 1112222 - RNA, 22 nt, Homo sapiens
uuuugucugcuuaguaucucau

SEQ ID NO: 1112223 - RNA, 15 nt, Homo sapiens
uuuuguuauugggca

SEQ ID NO: 1112224 - RNA, 12 nt, Homo sapiens
uuuuuagcuuua

SEQ ID NO: 1112225 - RNA, 14 nt, Homo sapiens
uuuuuauacauauc

SEQ ID NO: 1112226 - RNA, 19 nt, Homo sapiens
uuuuucaagaaaacuggaa

SEQ ID NO: 1112227 - RNA, 14 nt, Homo sapiens
uuuuuguacacauc

SEQ ID NO: 1112228 - RNA, 21 nt, Homo sapiens
uuuuuguuucuuccaaagcac

SEQ ID NO: 1112229 - RNA, 18 nt, Homo sapiens
uuuuuuaaaaaagcuuaa

SEQ ID NO: 1112230 - RNA, 12 nt, Homo sapiens
uuuuuugauuga

SEQ ID NO: 1112231 - RNA, 22 nt, Homo sapiens
cucaaagagggagugcauuuau

SEQ ID NO: 1112232 - RNA, 20 nt, Homo sapiens
cucaaauauuugcuaugaag

SEQ ID NO: 1112233 - RNA, 23 nt, Homo sapiens
cucaaaucuauucagacaagcaa

SEQ ID NO: 1112234 - RNA, 20 nt, Homo sapiens
cucaaaugacccaaagacca

SEQ ID NO: 1112235 - RNA, 20 nt, Homo sapiens
cucaaauucauggugcacug

SEQ ID NO: 1112236 - RNA, 19 nt, Homo sapiens
cucaagucuucccugauca

SEQ ID NO: 1112237 - RNA, 23 nt, Homo sapiens
cucaaguuuuucagaaagcauua

SEQ ID NO: 1112238 - RNA, 15 nt, Homo sapiens
cucaauauuccugaa

SEQ ID NO: 1112239 - RNA, 15 nt, Homo sapiens
cucacaagaagacca

SEQ ID NO: 1112240 - RNA, 16 nt, Homo sapiens
cucacaagaagaccag

SEQ ID NO: 1112241 - RNA, 13 nt, Homo sapiens
cucacaagcacuu

SEQ ID NO: 1112242 - RNA, 18 nt, Homo sapiens
cucacagaagaauaugac

SEQ ID NO: 1112243 - RNA, 19 nt, Homo sapiens
cucacauuuauucugcuca

SEQ ID NO: 1112244 - RNA, 23 nt, Homo sapiens
cucaccuguuacuugaaauacca

SEQ ID NO: 1112245 - RNA, 18 nt, Homo sapiens
cucacgcccagccuccuc

SEQ ID NO: 1112246 - RNA, 15 nt, Homo sapiens
cucacucuuaugaaa

SEQ ID NO: 1112247 - RNA, 18 nt, Homo sapiens
cucacuugugcaguguug

SEQ ID NO: 1112248 - RNA, 22 nt, Homo sapiens
cucagaagacacugaugggcaa

SEQ ID NO: 1112249 - RNA, 23 nt, Homo sapiens
cucagacagaaccccuacaugaa

SEQ ID NO: 1112250 - RNA, 20 nt, Homo sapiens
cucaggguccagacccugaa

SEQ ID NO: 1112251 - RNA, 17 nt, Homo sapiens
cucagucccaucagaga

SEQ ID NO: 1112252 - RNA, 13 nt, Homo sapiens
cucagugggacaa

SEQ ID NO: 1112253 - RNA, 21 nt, Homo sapiens
cucaguuugucagacuuuaaa

SEQ ID NO: 1112254 - RNA, 12 nt, Homo sapiens
cucaugugaucc

SEQ ID NO: 1112255 - RNA, 14 nt, Homo sapiens
cucauuguagaaaa

SEQ ID NO: 1112256 - RNA, 22 nt, Homo sapiens
cucauuguuuauuaacaaauua

SEQ ID NO: 1112257 - RNA, 16 nt, Homo sapiens
cucauuuaucccucaa

SEQ ID NO: 1112258 - RNA, 13 nt, Homo sapiens
cucauuugucaca

SEQ ID NO: 1112259 - RNA, 14 nt, Homo sapiens
cuccaauuccacag

SEQ ID NO: 1112260 - RNA, 17 nt, Homo sapiens
cuccacagucaauauua

SEQ ID NO: 1112261 - RNA, 18 nt, Homo sapiens
cuccaccaacccaucaga

SEQ ID NO: 1112262 - RNA, 21 nt, Homo sapiens
cuccaccaacuggagcacuga

SEQ ID NO: 1112263 - RNA, 19 nt, Homo sapiens
cuccacccuauauguagua

SEQ ID NO: 1112264 - RNA, 13 nt, Homo sapiens
cuccacuccagau

SEQ ID NO: 1112265 - RNA, 23 nt, Homo sapiens
cuccagaauggucuuucuaaugu

SEQ ID NO: 1112266 - RNA, 16 nt, Homo sapiens
cuccagcucaccagcc

SEQ ID NO: 1112267 - RNA, 22 nt, Homo sapiens
cuccagcucaccagccccagug

SEQ ID NO: 1112268 - RNA, 19 nt, Homo sapiens
cuccaggagccuacccccu

SEQ ID NO: 1112269 - RNA, 13 nt, Homo sapiens
cuccaggcaaaau

SEQ ID NO: 1112270 - RNA, 14 nt, Homo sapiens
cuccaggcucuuug

SEQ ID NO: 1112271 - RNA, 17 nt, Homo sapiens
cuccagugguugcuguu

SEQ ID NO: 1112272 - RNA, 18 nt, Homo sapiens
cuccauacauaacuugau

SEQ ID NO: 1112273 - RNA, 19 nt, Homo sapiens
cuccauccaauucuuugaa

SEQ ID NO: 1112274 - RNA, 14 nt, Homo sapiens
cuccaucucugucu

SEQ ID NO: 1112275 - RNA, 15 nt, Homo sapiens
cuccauuacuaaaga

SEQ ID NO: 1112276 - RNA, 19 nt, Homo sapiens
cucccaaauugcugggauu

SEQ ID NO: 1112277 - RNA, 13 nt, Homo sapiens
cuccccaccuuca

SEQ ID NO: 1112278 - RNA, 18 nt, Homo sapiens
cuccccagcaagugagag

SEQ ID NO: 1112279 - RNA, 12 nt, Homo sapiens
cuccccuaucca

SEQ ID NO: 1112280 - RNA, 23 nt, Homo sapiens
cuccccuauguaaaacuuagcaa

SEQ ID NO: 1112281 - RNA, 19 nt, Homo sapiens
cuccccucccccacucuau

SEQ ID NO: 1112282 - RNA, 13 nt, Homo sapiens
cucccucauucca

SEQ ID NO: 1112283 - RNA, 16 nt, Homo sapiens
cucccucugaccugca

SEQ ID NO: 1112284 - RNA, 15 nt, Homo sapiens
cucccuggccucacg

SEQ ID NO: 1112285 - RNA, 15 nt, Homo sapiens
cucccuguaacucca

SEQ ID NO: 1112286 - RNA, 15 nt, Homo sapiens
cuccguguagugucu

SEQ ID NO: 1112287 - RNA, 20 nt, Homo sapiens
cuccucacaguugccaugua

SEQ ID NO: 1112288 - RNA, 20 nt, Homo sapiens
cuccuccagggccacgugcc

SEQ ID NO: 1112289 - RNA, 19 nt, Homo sapiens
cuccucccaggaacugggc

SEQ ID NO: 1112290 - RNA, 13 nt, Homo sapiens
cuccugcuggaug

SEQ ID NO: 1112291 - RNA, 23 nt, Homo sapiens
cuccuggaaaggcucagucucag

SEQ ID NO: 1112292 - RNA, 23 nt, Homo sapiens
cuccugggagagaaggagaucag

SEQ ID NO: 1112293 - RNA, 14 nt, Homo sapiens
cuccuuggugccug

SEQ ID NO: 1112294 - RNA, 17 nt, Homo sapiens
cuccuuuauugcuccug

SEQ ID NO: 1112295 - RNA, 14 nt, Homo sapiens
cucgccgucuguga

SEQ ID NO: 1112296 - RNA, 16 nt, Homo sapiens
cucggccuccaagggg

SEQ ID NO: 1112297 - RNA, 22 nt, Homo sapiens
cucggccuccaaggggcuuugu

SEQ ID NO: 1112298 - RNA, 23 nt, Homo sapiens
cucgguggccaugcuucuugccc

SEQ ID NO: 1112299 - RNA, 20 nt, Homo sapiens
cucguauaugucucaggucc

SEQ ID NO: 1112300 - RNA, 14 nt, Homo sapiens
cucuaaaucuuccu

SEQ ID NO: 1112301 - RNA, 19 nt, Homo sapiens
cucuaagccacucuuccaa

SEQ ID NO: 1112302 - RNA, 15 nt, Homo sapiens
cucuacccuauacaa

SEQ ID NO: 1112303 - RNA, 16 nt, Homo sapiens
cucuacuuaaugagau

SEQ ID NO: 1112304 - RNA, 15 nt, Homo sapiens
cucuagagaacaugc

SEQ ID NO: 1112305 - RNA, 15 nt, Homo sapiens
cucuauguggaucua

SEQ ID NO: 1112306 - RNA, 19 nt, Homo sapiens
cucuauugcugcucucuca

SEQ ID NO: 1112307 - RNA, 23 nt, Homo sapiens
cucucaggaucaagaaaguguug

SEQ ID NO: 1112308 - RNA, 14 nt, Homo sapiens
cucuccuugccugg

SEQ ID NO: 1112309 - RNA, 22 nt, Homo sapiens
cucugaaacuuaauuacaucca

SEQ ID NO: 1112310 - RNA, 21 nt, Homo sapiens
cucugaggacacuaaccacgc

SEQ ID NO: 1112311 - RNA, 12 nt, Homo sapiens
cucugauaccuc

SEQ ID NO: 1112312 - RNA, 13 nt, Homo sapiens
cucugcacauguc

SEQ ID NO: 1112313 - RNA, 14 nt, Homo sapiens
cucugcagcacuuu

SEQ ID NO: 1112314 - RNA, 20 nt, Homo sapiens
cucugcauuaucugagguca

SEQ ID NO: 1112315 - RNA, 14 nt, Homo sapiens
cucugcucuugccu

SEQ ID NO: 1112316 - RNA, 13 nt, Homo sapiens
cucugcugcauuu

SEQ ID NO: 1112317 - RNA, 19 nt, Homo sapiens
cucuggaccagccuguugg

SEQ ID NO: 1112318 - RNA, 22 nt, Homo sapiens
cucuggaugaagcucuggccaa

SEQ ID NO: 1112319 - RNA, 22 nt, Homo sapiens
cucuggcaucucuuucugcaaa

SEQ ID NO: 1112320 - RNA, 16 nt, Homo sapiens
cucuguccacucugaa

SEQ ID NO: 1112321 - RNA, 12 nt, Homo sapiens
cucugugcuuug

SEQ ID NO: 1112322 - RNA, 18 nt, Homo sapiens
cucugugcuuugacucac

SEQ ID NO: 1112323 - RNA, 14 nt, Homo sapiens
cucuguucauuucc

SEQ ID NO: 1112324 - RNA, 15 nt, Homo sapiens
cucuuauuugguaua

SEQ ID NO: 1112325 - RNA, 18 nt, Homo sapiens
cucuucaacugaccagcc

SEQ ID NO: 1112326 - RNA, 21 nt, Homo sapiens
cucuucaacugaccagccucc

SEQ ID NO: 1112327 - RNA, 22 nt, Homo sapiens
cucuucagaauauggacaaaga

SEQ ID NO: 1112328 - RNA, 22 nt, Homo sapiens
cucuucagguucuuagugucac

SEQ ID NO: 1112329 - RNA, 13 nt, Homo sapiens
cucuuccugccaa

SEQ ID NO: 1112330 - RNA, 23 nt, Homo sapiens
cucuucucuuccuguaacacaag

SEQ ID NO: 1112331 - RNA, 17 nt, Homo sapiens
cucuucugggaacuucc

SEQ ID NO: 1112332 - RNA, 13 nt, Homo sapiens
cucuuggugccuc

SEQ ID NO: 1112333 - RNA, 17 nt, Homo sapiens
cucuuuaaauggcuuua

SEQ ID NO: 1112334 - RNA, 15 nt, Homo sapiens
cucuuuaaucuucag

SEQ ID NO: 1112335 - RNA, 13 nt, Homo sapiens
cucuuuaugacug

SEQ ID NO: 1112336 - RNA, 17 nt, Homo sapiens
cucuuuucaaaacauuu

SEQ ID NO: 1112337 - RNA, 17 nt, Homo sapiens
cugaaaauuaacacugc

SEQ ID NO: 1112338 - RNA, 19 nt, Homo sapiens
cugaaaugcuagcugcaag

SEQ ID NO: 1112339 - RNA, 14 nt, Homo sapiens
cugaaccacuuugc

SEQ ID NO: 1112340 - RNA, 16 nt, Homo sapiens
cugaaccugggaacca

SEQ ID NO: 1112341 - RNA, 18 nt, Homo sapiens
cugaacugagccuagcua

SEQ ID NO: 1112342 - RNA, 15 nt, Homo sapiens
cugaagaacaguaac

SEQ ID NO: 1112343 - RNA, 22 nt, Homo sapiens
cugaagaacaguaacugccauc

SEQ ID NO: 1112344 - RNA, 18 nt, Homo sapiens
cugaagaaucacaauaau

SEQ ID NO: 1112345 - RNA, 20 nt, Homo sapiens
cugaagucaguuucuaucau

SEQ ID NO: 1112346 - RNA, 14 nt, Homo sapiens
cugacaagcacugc

SEQ ID NO: 1112347 - RNA, 16 nt, Homo sapiens
cugacaccucacugag

SEQ ID NO: 1112348 - RNA, 18 nt, Homo sapiens
cugaccaaagagaagcaa

SEQ ID NO: 1112349 - RNA, 19 nt, Homo sapiens
cugaccaaagagaagcaaa

SEQ ID NO: 1112350 - RNA, 15 nt, Homo sapiens
cugaccaagagagaa

SEQ ID NO: 1112351 - RNA, 17 nt, Homo sapiens
cugaccaagauacuuaa

SEQ ID NO: 1112352 - RNA, 16 nt, Homo sapiens
cugaccuguguucccu

SEQ ID NO: 1112353 - RNA, 21 nt, Homo sapiens
cugacucacaagaagaccaga

SEQ ID NO: 1112354 - RNA, 18 nt, Homo sapiens
cugacuuugagacggugu

SEQ ID NO: 1112355 - RNA, 19 nt, Homo sapiens
cugagaaacccaccagccu

SEQ ID NO: 1112356 - RNA, 16 nt, Homo sapiens
cugagaaggacaccuc

SEQ ID NO: 1112357 - RNA, 16 nt, Homo sapiens
cugagaauuccaagga

SEQ ID NO: 1112358 - RNA, 19 nt, Homo sapiens
cugagacuauuuuaacugg

SEQ ID NO: 1112359 - RNA, 22 nt, Homo sapiens
cugagagacccaaggaggaaaa

SEQ ID NO: 1112360 - RNA, 16 nt, Homo sapiens
cugagcaccuacuuac

SEQ ID NO: 1112361 - RNA, 13 nt, Homo sapiens
cugagccuagcua

SEQ ID NO: 1112362 - RNA, 17 nt, Homo sapiens
cugagccugccgagcaa

SEQ ID NO: 1112363 - RNA, 16 nt, Homo sapiens
cugagcuagugauuug

SEQ ID NO: 1112364 - RNA, 21 nt, Homo sapiens
cugaguagcuaggacuauggg

SEQ ID NO: 1112365 - RNA, 12 nt, Homo sapiens
cugagugacaug

SEQ ID NO: 1112366 - RNA, 15 nt, Homo sapiens
cugagugagccacag

SEQ ID NO: 1112367 - RNA, 14 nt, Homo sapiens
cugaguggcugaaa

SEQ ID NO: 1112368 - RNA, 12 nt, Homo sapiens
cugauaccucaa

SEQ ID NO: 1112369 - RNA, 22 nt, Homo sapiens
cugaucagcaugggaaugugcc

SEQ ID NO: 1112370 - RNA, 14 nt, Homo sapiens
cugaucgugcuaaa

SEQ ID NO: 1112371 - RNA, 19 nt, Homo sapiens
cugauucccaagcucugcu

SEQ ID NO: 1112372 - RNA, 16 nt, Homo sapiens
cugauuuuuagcuuua

SEQ ID NO: 1112373 - RNA, 17 nt, Homo sapiens
cugauuuuuagcuuuac

SEQ ID NO: 1112374 - RNA, 21 nt, Homo sapiens
cugcacaaagcccuuccaugu

SEQ ID NO: 1112375 - RNA, 22 nt, Homo sapiens
cugcacagauauuuccauuucu

SEQ ID NO: 1112376 - RNA, 17 nt, Homo sapiens
cugcacaugucuuguac

SEQ ID NO: 1112377 - RNA, 20 nt, Homo sapiens
cugcacauuuuguacaaaga

SEQ ID NO: 1112378 - RNA, 20 nt, Homo sapiens
cugcaccgagagagauggaa

SEQ ID NO: 1112379 - RNA, 22 nt, Homo sapiens
cugcaccgagagagauggaaua

SEQ ID NO: 1112380 - RNA, 14 nt, Homo sapiens
cugcagaaggccaa

SEQ ID NO: 1112381 - RNA, 18 nt, Homo sapiens
cugcagacucacuguggg

SEQ ID NO: 1112382 - RNA, 23 nt, Homo sapiens
cugcagaggggaaaccaguguag

SEQ ID NO: 1112383 - RNA, 21 nt, Homo sapiens
cugcagcacuucacuaccaaa

SEQ ID NO: 1112384 - RNA, 13 nt, Homo sapiens
cugcagcacuuua

SEQ ID NO: 1112385 - RNA, 14 nt, Homo sapiens
cugcagcacuuuaa

SEQ ID NO: 1112386 - RNA, 21 nt, Homo sapiens
cugcagccccgcgccuccuuc

SEQ ID NO: 1112387 - RNA, 16 nt, Homo sapiens
cugcagcuuccuguca

SEQ ID NO: 1112388 - RNA, 13 nt, Homo sapiens
cugcaggccaaga

SEQ ID NO: 1112389 - RNA, 13 nt, Homo sapiens
cugcaguauggcc

SEQ ID NO: 1112390 - RNA, 23 nt, Homo sapiens
cugcaugcacuucuuacaauaau

SEQ ID NO: 1112391 - RNA, 12 nt, Homo sapiens
cugccaagccac

SEQ ID NO: 1112392 - RNA, 16 nt, Homo sapiens
cugccagccacaucca

SEQ ID NO: 1112393 - RNA, 15 nt, Homo sapiens
cugccagucacgagc

SEQ ID NO: 1112394 - RNA, 23 nt, Homo sapiens
cugccuccagaauggucuuucua

SEQ ID NO: 1112395 - RNA, 15 nt, Homo sapiens
cugccugaagucaca

SEQ ID NO: 1112396 - RNA, 14 nt, Homo sapiens
cugccuuguguaca

SEQ ID NO: 1112397 - RNA, 14 nt, Homo sapiens
cugcuaaggcugcc

SEQ ID NO: 1112398 - RNA, 12 nt, Homo sapiens
cugcuaccucac

SEQ ID NO: 1112399 - RNA, 18 nt, Homo sapiens
cugcuauaggucagagau

SEQ ID NO: 1112400 - RNA, 22 nt, Homo sapiens
cugcucaagagaagcacaugaa

SEQ ID NO: 1112401 - RNA, 20 nt, Homo sapiens
cugcucgaagaacaauguca

SEQ ID NO: 1112402 - RNA, 18 nt, Homo sapiens
cugcucuccgaccagaca

SEQ ID NO: 1112403 - RNA, 15 nt, Homo sapiens
cugcucuuaggugcu

SEQ ID NO: 1112404 - RNA, 14 nt, Homo sapiens
cugcugacaguguu

SEQ ID NO: 1112405 - RNA, 15 nt, Homo sapiens
cugcugcaaagugca

SEQ ID NO: 1112406 - RNA, 19 nt, Homo sapiens
cugcuucacaaaccuugcu

SEQ ID NO: 1112407 - RNA, 17 nt, Homo sapiens
cugcuucuuuucacuuc

SEQ ID NO: 1112408 - RNA, 16 nt, Homo sapiens
cugcuuguauuuucca

SEQ ID NO: 1112409 - RNA, 17 nt, Homo sapiens
cugcuuuuuaaguguua

SEQ ID NO: 1112410 - RNA, 19 nt, Homo sapiens
cugcuuuuugacaugaaca

SEQ ID NO: 1112411 - RNA, 18 nt, Homo sapiens
cuggaaaacucaggauuc

SEQ ID NO: 1112412 - RNA, 19 nt, Homo sapiens
cuggaaaagucacacagac

SEQ ID NO: 1112413 - RNA, 16 nt, Homo sapiens
cuggaaagacauagcc

SEQ ID NO: 1112414 - RNA, 20 nt, Homo sapiens
cuggaaaggcucagucucag

SEQ ID NO: 1112415 - RNA, 23 nt, Homo sapiens
cuggaaaggcucagucucaggag

SEQ ID NO: 1112416 - RNA, 20 nt, Homo sapiens
cuggaaaucuggauuuucag

SEQ ID NO: 1112417 - RNA, 16 nt, Homo sapiens
cuggaacugucucuca

SEQ ID NO: 1112418 - RNA, 23 nt, Homo sapiens
cuggaagcauguaggagaaucca

SEQ ID NO: 1112419 - RNA, 14 nt, Homo sapiens
cuggaauacaugaa

SEQ ID NO: 1112420 - RNA, 20 nt, Homo sapiens
cuggaauguaaucaauguuu

SEQ ID NO: 1112421 - RNA, 13 nt, Homo sapiens
cuggacaagccaa

SEQ ID NO: 1112422 - RNA, 22 nt, Homo sapiens
cuggaggaagaagacacauucc

SEQ ID NO: 1112423 - RNA, 17 nt, Homo sapiens
cuggaggaguuccuuga

SEQ ID NO: 1112424 - RNA, 21 nt, Homo sapiens
cuggaggcagaaucccggcug

SEQ ID NO: 1112425 - RNA, 13 nt, Homo sapiens
cuggagugcagug

SEQ ID NO: 1112426 - RNA, 13 nt, Homo sapiens
cuggauccaucag

SEQ ID NO: 1112427 - RNA, 15 nt, Homo sapiens
cuggaucuaucugua

SEQ ID NO: 1112428 - RNA, 20 nt, Homo sapiens
cuggcagagaaggcuuccuc

SEQ ID NO: 1112429 - RNA, 19 nt, Homo sapiens
cuggccaaccaaagacacu

SEQ ID NO: 1112430 - RNA, 19 nt, Homo sapiens
cuggcucuucucucggggc

SEQ ID NO: 1112431 - RNA, 18 nt, Homo sapiens
cuggcugagcugaaccca

SEQ ID NO: 1112432 - RNA, 13 nt, Homo sapiens
cuggcugcaguga

SEQ ID NO: 1112433 - RNA, 23 nt, Homo sapiens
cuggcuuccagguaucuccagga

SEQ ID NO: 1112434 - RNA, 17 nt, Homo sapiens
cuggcuuuacauuuuau

SEQ ID NO: 1112435 - RNA, 15 nt, Homo sapiens
cugggagaaccucag

SEQ ID NO: 1112436 - RNA, 18 nt, Homo sapiens
cugggauuacagguguga

SEQ ID NO: 1112437 - RNA, 17 nt, Homo sapiens
cugggccugcugcugag

SEQ ID NO: 1112438 - RNA, 19 nt, Homo sapiens
cuggggaagcugugaaaga

SEQ ID NO: 1112439 - RNA, 15 nt, Homo sapiens
cuggggacaccagcc

SEQ ID NO: 1112440 - RNA, 18 nt, Homo sapiens
cuggggacaccagccauc

SEQ ID NO: 1112441 - RNA, 19 nt, Homo sapiens
cuggggccuguacugccug

SEQ ID NO: 1112442 - RNA, 16 nt, Homo sapiens
cuggggcucucagugu

SEQ ID NO: 1112443 - RNA, 22 nt, Homo sapiens
cugggggaggggacauugaaca

SEQ ID NO: 1112444 - RNA, 23 nt, Homo sapiens
cugggguggggguggggagaccu

SEQ ID NO: 1112445 - RNA, 22 nt, Homo sapiens
cuggguacaagagccauguacc

SEQ ID NO: 1112446 - RNA, 23 nt, Homo sapiens
cuggguggcuacucugugccaga

SEQ ID NO: 1112447 - RNA, 15 nt, Homo sapiens
cugguggaaccugca

SEQ ID NO: 1112448 - RNA, 14 nt, Homo sapiens
cugguggaggagcu

SEQ ID NO: 1112449 - RNA, 15 nt, Homo sapiens
cuguaacacaagcca

SEQ ID NO: 1112450 - RNA, 15 nt, Homo sapiens
cuguaacaugcaauu

SEQ ID NO: 1112451 - RNA, 14 nt, Homo sapiens
cuguaaccagauua

SEQ ID NO: 1112452 - RNA, 13 nt, Homo sapiens
cuguacacugcac

SEQ ID NO: 1112453 - RNA, 13 nt, Homo sapiens
cuguacucaggag

SEQ ID NO: 1112454 - RNA, 16 nt, Homo sapiens
cuguagauaaaguggu

SEQ ID NO: 1112455 - RNA, 18 nt, Homo sapiens
cuguagcauuacaguggg

SEQ ID NO: 1112456 - RNA, 20 nt, Homo sapiens
cuguauuuugccagacuuaa

SEQ ID NO: 1112457 - RNA, 22 nt, Homo sapiens
cuguccaaggcacaaaccuuac

SEQ ID NO: 1112458 - RNA, 23 nt, Homo sapiens
cugucccccugagaucagagucc

SEQ ID NO: 1112459 - RNA, 14 nt, Homo sapiens
cuguccuauggaag

SEQ ID NO: 1112460 - RNA, 22 nt, Homo sapiens
cugucgcugcuucgugggauac

SEQ ID NO: 1112461 - RNA, 17 nt, Homo sapiens
cugucucugcucuugcc

SEQ ID NO: 1112462 - RNA, 16 nt, Homo sapiens
cugucugucccaaaga

SEQ ID NO: 1112463 - RNA, 14 nt, Homo sapiens
cugucugucugucu

SEQ ID NO: 1112464 - RNA, 20 nt, Homo sapiens
cugugaauaaaaacccugua

SEQ ID NO: 1112465 - RNA, 22 nt, Homo sapiens
cugugaccugcugagcucugag

SEQ ID NO: 1112466 - RNA, 23 nt, Homo sapiens
cugugaccugcugagcucugaga

SEQ ID NO: 1112467 - RNA, 16 nt, Homo sapiens
cugugagauaaccaca

SEQ ID NO: 1112468 - RNA, 15 nt, Homo sapiens
cugugcaccccauga

SEQ ID NO: 1112469 - RNA, 18 nt, Homo sapiens
cugugcuucucuuugucc

SEQ ID NO: 1112470 - RNA, 15 nt, Homo sapiens
cugugcuuugacuca

SEQ ID NO: 1112471 - RNA, 21 nt, Homo sapiens
cugugcuuugagagggauuug

SEQ ID NO: 1112472 - RNA, 18 nt, Homo sapiens
cuguggccuguuaacugg

SEQ ID NO: 1112473 - RNA, 16 nt, Homo sapiens
cuguggcggugccugg

SEQ ID NO: 1112474 - RNA, 15 nt, Homo sapiens
cuguggcugcuagca

SEQ ID NO: 1112475 - RNA, 19 nt, Homo sapiens
cuguggcuucccaugucuu

SEQ ID NO: 1112476 - RNA, 19 nt, Homo sapiens
cugugggggaggucccugc

SEQ ID NO: 1112477 - RNA, 13 nt, Homo sapiens
cugugguggagaa

SEQ ID NO: 1112478 - RNA, 14 nt, Homo sapiens
cuguguaaccucca

SEQ ID NO: 1112479 - RNA, 12 nt, Homo sapiens
cuguguacccac

SEQ ID NO: 1112480 - RNA, 18 nt, Homo sapiens
cuguguagcucuguccac

SEQ ID NO: 1112481 - RNA, 17 nt, Homo sapiens
cuguguccgcuuucaug

SEQ ID NO: 1112482 - RNA, 19 nt, Homo sapiens
cuguguccuugcaccugca

SEQ ID NO: 1112483 - RNA, 15 nt, Homo sapiens
cugugucguagccaa

SEQ ID NO: 1112484 - RNA, 15 nt, Homo sapiens
cugugugagcaucuc

SEQ ID NO: 1112485 - RNA, 12 nt, Homo sapiens
cugugugccauu

SEQ ID NO: 1112486 - RNA, 20 nt, Homo sapiens
cuguguguccuugugugcau

SEQ ID NO: 1112487 - RNA, 17 nt, Homo sapiens
cuguuaacgucaucuca

SEQ ID NO: 1112488 - RNA, 21 nt, Homo sapiens
cuguuaacgucaucucagggu

SEQ ID NO: 1112489 - RNA, 17 nt, Homo sapiens
cuguuacuuaccuaaac

SEQ ID NO: 1112490 - RNA, 18 nt, Homo sapiens
cuguuacuugaaauacca

SEQ ID NO: 1112491 - RNA, 12 nt, Homo sapiens
cuguuaguauua

SEQ ID NO: 1112492 - RNA, 23 nt, Homo sapiens
cuguuauccugcuagcuguagaa

SEQ ID NO: 1112493 - RNA, 19 nt, Homo sapiens
cuguuccacuucucuagag

SEQ ID NO: 1112494 - RNA, 14 nt, Homo sapiens
cuguuggucugucc

SEQ ID NO: 1112495 - RNA, 17 nt, Homo sapiens
cuguuuauauugguaua

SEQ ID NO: 1112496 - RNA, 18 nt, Homo sapiens
cuguuucaaugaccugua

SEQ ID NO: 1112497 - RNA, 13 nt, Homo sapiens
cuguuucuauucu

SEQ ID NO: 1112498 - RNA, 22 nt, Homo sapiens
cuguuuuaauaauuaugugcca

SEQ ID NO: 1112499 - RNA, 17 nt, Homo sapiens
cuguuuuuguaguggua

SEQ ID NO: 1112500 - RNA, 15 nt, Homo sapiens
cuuaaaaaaugucca

SEQ ID NO: 1112501 - RNA, 16 nt, Homo sapiens
cuuaaaaaauguccau

SEQ ID NO: 1112502 - RNA, 13 nt, Homo sapiens
cuuaagcugggau

SEQ ID NO: 1112503 - RNA, 16 nt, Homo sapiens
cuuaaucuccacuguu

SEQ ID NO: 1112504 - RNA, 14 nt, Homo sapiens
cuuaauuuucagua

SEQ ID NO: 1112505 - RNA, 17 nt, Homo sapiens
cuuaauuuucaguauaa

SEQ ID NO: 1112506 - RNA, 18 nt, Homo sapiens
cuuacaaacaugugguua

SEQ ID NO: 1112507 - RNA, 22 nt, Homo sapiens
cuuacaauaauucuaugagaua

SEQ ID NO: 1112508 - RNA, 13 nt, Homo sapiens
cuuacaugcauua

SEQ ID NO: 1112509 - RNA, 15 nt, Homo sapiens
cuuacaugcauuacu

SEQ ID NO: 1112510 - RNA, 19 nt, Homo sapiens
cuuaccuagauucuacaua

SEQ ID NO: 1112511 - RNA, 17 nt, Homo sapiens
cuuacgaaauccuuugu

SEQ ID NO: 1112512 - RNA, 14 nt, Homo sapiens
cuuacuuugaguua

SEQ ID NO: 1112513 - RNA, 14 nt, Homo sapiens
cuuagaaauuguaa

SEQ ID NO: 1112514 - RNA, 20 nt, Homo sapiens
cuuagauuagcucuggacca

SEQ ID NO: 1112515 - RNA, 17 nt, Homo sapiens
cuuagcugaacaaugaa

SEQ ID NO: 1112516 - RNA, 17 nt, Homo sapiens
cuuagcuuagaccucag

SEQ ID NO: 1112517 - RNA, 21 nt, Homo sapiens
cuuagcuucuauuauagccac

SEQ ID NO: 1112518 - RNA, 21 nt, Homo sapiens
cuuauacgaguaauaugccug

SEQ ID NO: 1112519 - RNA, 23 nt, Homo sapiens
cuuauacgaguaauaugccugcu

SEQ ID NO: 1112520 - RNA, 15 nt, Homo sapiens
cuuaugaaacuaaga

SEQ ID NO: 1112521 - RNA, 18 nt, Homo sapiens
cuuaugucucuacauggu

SEQ ID NO: 1112522 - RNA, 14 nt, Homo sapiens
cuuauugacuauua

SEQ ID NO: 1112523 - RNA, 13 nt, Homo sapiens
cuuauuugguaua

SEQ ID NO: 1112524 - RNA, 19 nt, Homo sapiens
cuuauuuguauaauggugu

SEQ ID NO: 1112525 - RNA, 17 nt, Homo sapiens
cuuauuuuugacagugu

SEQ ID NO: 1112526 - RNA, 23 nt, Homo sapiens
cuucaaauugucuuuugucaugu

SEQ ID NO: 1112527 - RNA, 16 nt, Homo sapiens
cuucaaguuagcucag

SEQ ID NO: 1112528 - RNA, 19 nt, Homo sapiens
cuucaaguuagcucaggag

SEQ ID NO: 1112529 - RNA, 22 nt, Homo sapiens
cuucacaaccagccacacagag

SEQ ID NO: 1112530 - RNA, 15 nt, Homo sapiens
cuucacuaccaaaug

SEQ ID NO: 1112531 - RNA, 13 nt, Homo sapiens
cuucacuuuacaa

SEQ ID NO: 1112532 - RNA, 20 nt, Homo sapiens
cuucagaauauggacaaaga

SEQ ID NO: 1112533 - RNA, 19 nt, Homo sapiens
cuucagccaucaacaagag

SEQ ID NO: 1112534 - RNA, 21 nt, Homo sapiens
cuucagccuagccgaccucag

SEQ ID NO: 1112535 - RNA, 16 nt, Homo sapiens
cuucagugggagaaaa

SEQ ID NO: 1112536 - RNA, 18 nt, Homo sapiens
cuucauggaacucagcug

SEQ ID NO: 1112537 - RNA, 21 nt, Homo sapiens
cuucauggaacucagcugucu

SEQ ID NO: 1112538 - RNA, 20 nt, Homo sapiens
cuucaugucacugcucuuga

SEQ ID NO: 1112539 - RNA, 14 nt, Homo sapiens
cuucauuuccguga

SEQ ID NO: 1112540 - RNA, 19 nt, Homo sapiens
cuuccacaauucacuagac

SEQ ID NO: 1112541 - RNA, 16 nt, Homo sapiens
cuuccagugcauguug

SEQ ID NO: 1112542 - RNA, 22 nt, Homo sapiens
cuuccagugcauguugccauga

SEQ ID NO: 1112543 - RNA, 21 nt, Homo sapiens
cuuccauaauuaugacaguua

SEQ ID NO: 1112544 - RNA, 22 nt, Homo sapiens
cuuccauaauuaugacaguuau

SEQ ID NO: 1112545 - RNA, 24 nt, Homo sapiens
cuuccauuaacuuagcauguguug

SEQ ID NO: 1112546 - RNA, 20 nt, Homo sapiens
cuucccacagcauuccucca

SEQ ID NO: 1112547 - RNA, 21 nt, Homo sapiens
cuucccaugucuuucuccaaa

SEQ ID NO: 1112548 - RNA, 13 nt, Homo sapiens
cuuccccuugccc

SEQ ID NO: 1112549 - RNA, 19 nt, Homo sapiens
cuuccccuugcccuugccc

SEQ ID NO: 1112550 - RNA, 14 nt, Homo sapiens
cuuccuaccaaaua

SEQ ID NO: 1112551 - RNA, 22 nt, Homo sapiens
cuuccugacccuccgcugcaga

SEQ ID NO: 1112552 - RNA, 18 nt, Homo sapiens
cuuccuggacagcugugc

SEQ ID NO: 1112553 - RNA, 18 nt, Homo sapiens
cuuccuggaguacaaaca

SEQ ID NO: 1112554 - RNA, 13 nt, Homo sapiens
cuucgaugacugg

SEQ ID NO: 1112555 - RNA, 21 nt, Homo sapiens
cuucgauggcauccugcagug

SEQ ID NO: 1112556 - RNA, 12 nt, Homo sapiens
cuucgguuugua

SEQ ID NO: 1112557 - RNA, 20 nt, Homo sapiens
cuucuaaaugaagugcaaau

SEQ ID NO: 1112558 - RNA, 20 nt, Homo sapiens
cuucucaggacacaggccug

SEQ ID NO: 1112559 - RNA, 18 nt, Homo sapiens
cuucucaucauauuguau

SEQ ID NO: 1112560 - RNA, 12 nt, Homo sapiens
cuucuccugacc

SEQ ID NO: 1112561 - RNA, 16 nt, Homo sapiens
cuucucguuaaggaga

SEQ ID NO: 1112562 - RNA, 11 nt, Homo sapiens
cuucucuccau

SEQ ID NO: 1112563 - RNA, 15 nt, Homo sapiens
cuucucuuccuguaa

SEQ ID NO: 1112564 - RNA, 16 nt, Homo sapiens
cuucucuuugucccca

SEQ ID NO: 1112565 - RNA, 18 nt, Homo sapiens
cuucugggaacuuccuca

SEQ ID NO: 1112566 - RNA, 21 nt, Homo sapiens
cuucuuacaauaauucuauga

SEQ ID NO: 1112567 - RNA, 18 nt, Homo sapiens
cuugaaacaagcaacaga

SEQ ID NO: 1112568 - RNA, 13 nt, Homo sapiens
cuugaaaccaaag

SEQ ID NO: 1112569 - RNA, 12 nt, Homo sapiens
cuugaaauacca

SEQ ID NO: 1112570 - RNA, 16 nt, Homo sapiens
cuugaaauaccaguga

SEQ ID NO: 1112571 - RNA, 22 nt, Homo sapiens
cuugaaauaccagugaaccaaa

SEQ ID NO: 1112572 - RNA, 16 nt, Homo sapiens
cuugaaauuauaucug

SEQ ID NO: 1112573 - RNA, 22 nt, Homo sapiens
cuugaacugauucacaucucau

SEQ ID NO: 1112574 - RNA, 15 nt, Homo sapiens
cuugaaggcccaggu

SEQ ID NO: 1112575 - RNA, 15 nt, Homo sapiens
cuugaaugugucacu

SEQ ID NO: 1112576 - RNA, 20 nt, Homo sapiens
cuugacaguaaaucacacaa

SEQ ID NO: 1112577 - RNA, 20 nt, Homo sapiens
cuugaccucaggugauccac

SEQ ID NO: 1112578 - RNA, 12 nt, Homo sapiens
cuugacuaucac

SEQ ID NO: 1112579 - RNA, 15 nt, Homo sapiens
cuugacuaucacaua

SEQ ID NO: 1112580 - RNA, 18 nt, Homo sapiens
cuugacuaucacauacaa

SEQ ID NO: 1112581 - RNA, 18 nt, Homo sapiens
cuugauggagauauuuac

SEQ ID NO: 1112582 - RNA, 15 nt, Homo sapiens
cuugauucacaauga

SEQ ID NO: 1112583 - RNA, 16 nt, Homo sapiens
cuugccaccaccagau

SEQ ID NO: 1112584 - RNA, 13 nt, Homo sapiens
cuugcccuuuacg

SEQ ID NO: 1112585 - RNA, 19 nt, Homo sapiens
cuugccuggugaccuacua

SEQ ID NO: 1112586 - RNA, 17 nt, Homo sapiens
cuugcuccuguguaaaa

SEQ ID NO: 1112587 - RNA, 12 nt, Homo sapiens
cuugcugugagc

SEQ ID NO: 1112588 - RNA, 17 nt, Homo sapiens
cuugcuguuuucaucuc

SEQ ID NO: 1112589 - RNA, 22 nt, Homo sapiens
cuugcuuaugacaucacuugua

SEQ ID NO: 1112590 - RNA, 23 nt, Homo sapiens
cuuggaaagcaucaccucaggcc

SEQ ID NO: 1112591 - RNA, 18 nt, Homo sapiens
cuuggaaugaauucucuc

SEQ ID NO: 1112592 - RNA, 20 nt, Homo sapiens
cuuggagacaaaaucuuaaa

SEQ ID NO: 1112593 - RNA, 17 nt, Homo sapiens
cuuggccgacucaggga

SEQ ID NO: 1112594 - RNA, 14 nt, Homo sapiens
cuugggaugaucuu

SEQ ID NO: 1112595 - RNA, 23 nt, Homo sapiens
cuuguaaauagcucagguguccc

SEQ ID NO: 1112596 - RNA, 18 nt, Homo sapiens
cuuguaauucuaaaugaa

SEQ ID NO: 1112597 - RNA, 17 nt, Homo sapiens
cuuguagccagccgggg

SEQ ID NO: 1112598 - RNA, 15 nt, Homo sapiens
cuuguccauguaaua

SEQ ID NO: 1112599 - RNA, 22 nt, Homo sapiens
cuugucccaacucgaugggcac

SEQ ID NO: 1112600 - RNA, 17 nt, Homo sapiens
cuugucccugcccagaa

SEQ ID NO: 1112601 - RNA, 15 nt, Homo sapiens
cuuguccuaugucaa

SEQ ID NO: 1112602 - RNA, 23 nt, Homo sapiens
cuuguguguguguguugauccca

SEQ ID NO: 1112603 - RNA, 20 nt, Homo sapiens
cuuguuaaauugcuuauucu

SEQ ID NO: 1112604 - RNA, 15 nt, Homo sapiens
cuuguuaccuuuccc

SEQ ID NO: 1112605 - RNA, 17 nt, Homo sapiens
cuuuaaaguaccuguag

SEQ ID NO: 1112606 - RNA, 15 nt, Homo sapiens
cuuuaaauccuucca

SEQ ID NO: 1112607 - RNA, 15 nt, Homo sapiens
cuuuaaauggcuuua

SEQ ID NO: 1112608 - RNA, 13 nt, Homo sapiens
cuuuaacaaaaca

SEQ ID NO: 1112609 - RNA, 19 nt, Homo sapiens
cuuuaauucucaugugauc

SEQ ID NO: 1112610 - RNA, 15 nt, Homo sapiens
cuuuaccacuaugca

SEQ ID NO: 1112611 - RNA, 19 nt, Homo sapiens
cuuuacuguuagucauuug

SEQ ID NO: 1112612 - RNA, 15 nt, Homo sapiens
cuuuagcgcccaguu

SEQ ID NO: 1112613 - RNA, 17 nt, Homo sapiens
cuuuaucuugacauuca

SEQ ID NO: 1112614 - RNA, 21 nt, Homo sapiens
cuuuaugcuaguuugaccuca

SEQ ID NO: 1112615 - RNA, 22 nt, Homo sapiens
cuuuaugcuaguuugaccucau

SEQ ID NO: 1112616 - RNA, 17 nt, Homo sapiens
cuuuauuaaugaacugu

SEQ ID NO: 1112617 - RNA, 14 nt, Homo sapiens
cuuuauugugaucu

SEQ ID NO: 1112618 - RNA, 15 nt, Homo sapiens
cuuuauugugaucua

SEQ ID NO: 1112619 - RNA, 17 nt, Homo sapiens
cuuucacauagcacaga

SEQ ID NO: 1112620 - RNA, 19 nt, Homo sapiens
cuuucaccacaugugcaca

SEQ ID NO: 1112621 - RNA, 14 nt, Homo sapiens
cuuucacucaggcu

SEQ ID NO: 1112622 - RNA, 19 nt, Homo sapiens
cuuucccuuuaucaguuug

SEQ ID NO: 1112623 - RNA, 14 nt, Homo sapiens
cuuuccuacucuca

SEQ ID NO: 1112624 - RNA, 16 nt, Homo sapiens
cuuuccucagaucauc

SEQ ID NO: 1112625 - RNA, 13 nt, Homo sapiens
cuuuccuguucca

SEQ ID NO: 1112626 - RNA, 18 nt, Homo sapiens
cuuuccuguuccagagag

SEQ ID NO: 1112627 - RNA, 21 nt, Homo sapiens
cuuucucaggaccuaguugcu

SEQ ID NO: 1112628 - RNA, 13 nt, Homo sapiens
cuuucugagugac

SEQ ID NO: 1112629 - RNA, 15 nt, Homo sapiens
cuuucuguugccaca

SEQ ID NO: 1112630 - RNA, 19 nt, Homo sapiens
cuuucuuauuuuguaauaa

SEQ ID NO: 1112631 - RNA, 13 nt, Homo sapiens
cuuugaauguggc

SEQ ID NO: 1112632 - RNA, 15 nt, Homo sapiens
cuuugacaaauugaa

SEQ ID NO: 1112633 - RNA, 19 nt, Homo sapiens
cuuugacucaccuguuacu

SEQ ID NO: 1112634 - RNA, 16 nt, Homo sapiens
cuuugagaacaaugga

SEQ ID NO: 1112635 - RNA, 14 nt, Homo sapiens
cuuugauaugacug

SEQ ID NO: 1112636 - RNA, 13 nt, Homo sapiens
cuuugcacugagg

SEQ ID NO: 1112637 - RNA, 15 nt, Homo sapiens
cuuugcucuuuggua

SEQ ID NO: 1112638 - RNA, 14 nt, Homo sapiens
cuuuggccauucca

SEQ ID NO: 1112639 - RNA, 15 nt, Homo sapiens
cuuuggccauuccaa

SEQ ID NO: 1112640 - RNA, 15 nt, Homo sapiens
cuuuguacuuugugc

SEQ ID NO: 1112641 - RNA, 15 nt, Homo sapiens
cuuugucagcaauac

SEQ ID NO: 1112642 - RNA, 18 nt, Homo sapiens
cuuuuaaaacacuuccau

SEQ ID NO: 1112643 - RNA, 16 nt, Homo sapiens
cuuuuaguuguaucuc

SEQ ID NO: 1112644 - RNA, 21 nt, Homo sapiens
cuuuuccccggucccuugaga

SEQ ID NO: 1112645 - RNA, 16 nt, Homo sapiens
cuuuucuaacucuccc

SEQ ID NO: 1112646 - RNA, 20 nt, Homo sapiens
cuuuugcuugaaaccaaaga

SEQ ID NO: 1112647 - RNA, 22 nt, Homo sapiens
cuuuugugcuccccuuugccua

SEQ ID NO: 1112648 - RNA, 21 nt, Homo sapiens
cuuuuguggauugacaguagu

SEQ ID NO: 1112649 - RNA, 13 nt, Homo sapiens
cuuuuguguacag

SEQ ID NO: 1112650 - RNA, 12 nt, Homo sapiens
cuuuuuccagag

SEQ ID NO: 1112651 - RNA, 22 nt, Homo sapiens
cuuuuuuuauaucagaaugagg

SEQ ID NO: 1112652 - RNA, 20 nt, Homo sapiens
gaaaaaggcuggcugaaaau

SEQ ID NO: 1112653 - RNA, 15 nt, Homo sapiens
gaaaaccagcgcaag

SEQ ID NO: 1112654 - RNA, 22 nt, Homo sapiens
gaaaaccucauuuaccauaaaa

SEQ ID NO: 1112655 - RNA, 14 nt, Homo sapiens
gaaaacuucucaca

SEQ ID NO: 1112656 - RNA, 20 nt, Homo sapiens
gaaaagcugcugacaguguu

SEQ ID NO: 1112657 - RNA, 14 nt, Homo sapiens
gaaaagguuaacag

SEQ ID NO: 1112658 - RNA, 14 nt, Homo sapiens
gaaaagucuacccc

SEQ ID NO: 1112659 - RNA, 12 nt, Homo sapiens
gaaaaguguuau

SEQ ID NO: 1112660 - RNA, 17 nt, Homo sapiens
gaaaaguuauguagaaa

SEQ ID NO: 1112661 - RNA, 17 nt, Homo sapiens
gaaaauaauuguuccaa

SEQ ID NO: 1112662 - RNA, 13 nt, Homo sapiens
gaaaaugcauuau

SEQ ID NO: 1112663 - RNA, 22 nt, Homo sapiens
gaaaaugccagagcuugugaac

SEQ ID NO: 1112664 - RNA, 15 nt, Homo sapiens
gaaaauguccucccu

SEQ ID NO: 1112665 - RNA, 12 nt, Homo sapiens
gaaaaugugcaa

SEQ ID NO: 1112666 - RNA, 14 nt, Homo sapiens
gaaaauuauaucuc

SEQ ID NO: 1112667 - RNA, 16 nt, Homo sapiens
gaaaauugaaugcaaa

SEQ ID NO: 1112668 - RNA, 18 nt, Homo sapiens
gaaacagagaacccugug

SEQ ID NO: 1112669 - RNA, 22 nt, Homo sapiens
gaaacagaggcgucucacauuu

SEQ ID NO: 1112670 - RNA, 16 nt, Homo sapiens
gaaacauuaugccuua

SEQ ID NO: 1112671 - RNA, 21 nt, Homo sapiens
gaaacauuuuguggucauuaa

SEQ ID NO: 1112672 - RNA, 23 nt, Homo sapiens
gaaaccuucagauuuguguuaua

SEQ ID NO: 1112673 - RNA, 17 nt, Homo sapiens
gaaagaaggacacuugu

SEQ ID NO: 1112674 - RNA, 14 nt, Homo sapiens
gaaagaaguaggca

SEQ ID NO: 1112675 - RNA, 17 nt, Homo sapiens
gaaagacuuacaggccu

SEQ ID NO: 1112676 - RNA, 21 nt, Homo sapiens
cuaaaaaguggcuaauucaau

SEQ ID NO: 1112677 - RNA, 17 nt, Homo sapiens
cuaaaaaucaugagauc

SEQ ID NO: 1112678 - RNA, 18 nt, Homo sapiens
cuaaaacuaugguuccca

SEQ ID NO: 1112679 - RNA, 15 nt, Homo sapiens
cuaaaauuagaugaa

SEQ ID NO: 1112680 - RNA, 19 nt, Homo sapiens
cuaaaauuagaugaacuca

SEQ ID NO: 1112681 - RNA, 21 nt, Homo sapiens
cuaaagucacauauaaaaguu

SEQ ID NO: 1112682 - RNA, 16 nt, Homo sapiens
cuaaauaauacaggau

SEQ ID NO: 1112683 - RNA, 15 nt, Homo sapiens
cuaaauuuccagggg

SEQ ID NO: 1112684 - RNA, 19 nt, Homo sapiens
cuaacaaagaacaagcauu

SEQ ID NO: 1112685 - RNA, 16 nt, Homo sapiens
cuaaccagccugguca

SEQ ID NO: 1112686 - RNA, 14 nt, Homo sapiens
cuaacucuggugcu

SEQ ID NO: 1112687 - RNA, 20 nt, Homo sapiens
cuaagaaaucauggcauuca

SEQ ID NO: 1112688 - RNA, 23 nt, Homo sapiens
cuaagaaaucauggcauucacac

SEQ ID NO: 1112689 - RNA, 15 nt, Homo sapiens
cuaagcaaaaccacu

SEQ ID NO: 1112690 - RNA, 21 nt, Homo sapiens
cuaagguaguaacuuuccaua

SEQ ID NO: 1112691 - RNA, 14 nt, Homo sapiens
cuaaggugugcucu

SEQ ID NO: 1112692 - RNA, 17 nt, Homo sapiens
cuaauaaacauccuuca

SEQ ID NO: 1112693 - RNA, 15 nt, Homo sapiens
cuaauaccucugugu

SEQ ID NO: 1112694 - RNA, 22 nt, Homo sapiens
cuaauagagugguacagcacug

SEQ ID NO: 1112695 - RNA, 19 nt, Homo sapiens
cuaauauuuuuagcucugu

SEQ ID NO: 1112696 - RNA, 20 nt, Homo sapiens
cuaaugauuagcacuuaaua

SEQ ID NO: 1112697 - RNA, 15 nt, Homo sapiens
cuaauucaacauaua

SEQ ID NO: 1112698 - RNA, 18 nt, Homo sapiens
cuaauucccagaguguga

SEQ ID NO: 1112699 - RNA, 19 nt, Homo sapiens
cuaauuggcaugaaggugu

SEQ ID NO: 1112700 - RNA, 21 nt, Homo sapiens
cuaauuuauccugaaauuuca

SEQ ID NO: 1112701 - RNA, 21 nt, Homo sapiens
cuaauuuccucugacauguaa

SEQ ID NO: 1112702 - RNA, 17 nt, Homo sapiens
cuaauuuuuuguuguuu

SEQ ID NO: 1112703 - RNA, 20 nt, Homo sapiens
cuacaaaaaauaaaaacacu

SEQ ID NO: 1112704 - RNA, 24 nt, Homo sapiens
cuacaaacauaucaaacauaugua

SEQ ID NO: 1112705 - RNA, 15 nt, Homo sapiens
cuacaaccagagccc

SEQ ID NO: 1112706 - RNA, 16 nt, Homo sapiens
cuacaagcaaauggag

SEQ ID NO: 1112707 - RNA, 13 nt, Homo sapiens
cuacacagccugg

SEQ ID NO: 1112708 - RNA, 12 nt, Homo sapiens
cuacacauauau

SEQ ID NO: 1112709 - RNA, 15 nt, Homo sapiens
cuaccuaaacauguu

SEQ ID NO: 1112710 - RNA, 19 nt, Homo sapiens
cuaccuggucucuccuugu

SEQ ID NO: 1112711 - RNA, 17 nt, Homo sapiens
cuaccuguggugauguu

SEQ ID NO: 1112712 - RNA, 17 nt, Homo sapiens
cuaccuucucuacccau

SEQ ID NO: 1112713 - RNA, 18 nt, Homo sapiens
cuacguauaaauaugaaa

SEQ ID NO: 1112714 - RNA, 22 nt, Homo sapiens
cuacgucaaacaugaagugugu

SEQ ID NO: 1112715 - RNA, 14 nt, Homo sapiens
cuacguuaacccau

SEQ ID NO: 1112716 - RNA, 21 nt, Homo sapiens
cuacguuaugaaaacagaugc

SEQ ID NO: 1112717 - RNA, 14 nt, Homo sapiens
cuacugagccuuca

SEQ ID NO: 1112718 - RNA, 19 nt, Homo sapiens
cuacuuccugugacuucag

SEQ ID NO: 1112719 - RNA, 18 nt, Homo sapiens
cuacuugccacacacugu

SEQ ID NO: 1112720 - RNA, 17 nt, Homo sapiens
cuacuugggagcuauga

SEQ ID NO: 1112721 - RNA, 20 nt, Homo sapiens
cuagaaauaagcccaacaga

SEQ ID NO: 1112722 - RNA, 17 nt, Homo sapiens
cuagaagaaagggcaag

SEQ ID NO: 1112723 - RNA, 18 nt, Homo sapiens
cuagaaggccacauguca

SEQ ID NO: 1112724 - RNA, 12 nt, Homo sapiens
cuagagacucaa

SEQ ID NO: 1112725 - RNA, 18 nt, Homo sapiens
cuagagcacacuguagca

SEQ ID NO: 1112726 - RNA, 12 nt, Homo sapiens
cuagaggugcuc

SEQ ID NO: 1112727 - RNA, 15 nt, Homo sapiens
cuagauacugaaugu

SEQ ID NO: 1112728 - RNA, 15 nt, Homo sapiens
cuagauccacacaca

SEQ ID NO: 1112729 - RNA, 16 nt, Homo sapiens
cuagcacuuggagcca

SEQ ID NO: 1112730 - RNA, 22 nt, Homo sapiens
cuagcaucucaugagugccaag

SEQ ID NO: 1112731 - RNA, 15 nt, Homo sapiens
cuagcugugaccucu

SEQ ID NO: 1112732 - RNA, 13 nt, Homo sapiens
cuaggagaccaag

SEQ ID NO: 1112733 - RNA, 15 nt, Homo sapiens
cuaggagaccaaggc

SEQ ID NO: 1112734 - RNA, 21 nt, Homo sapiens
cuaggccacuccuccaaagga

SEQ ID NO: 1112735 - RNA, 23 nt, Homo sapiens
cuagguucuaaaaauugugauca

SEQ ID NO: 1112736 - RNA, 18 nt, Homo sapiens
cuaguauuguccauauca

SEQ ID NO: 1112737 - RNA, 16 nt, Homo sapiens
cuaguccuuuacuaau

SEQ ID NO: 1112738 - RNA, 20 nt, Homo sapiens
cuaguucaaauuauuuggaa

SEQ ID NO: 1112739 - RNA, 16 nt, Homo sapiens
cuaguugaacaucuca

SEQ ID NO: 1112740 - RNA, 23 nt, Homo sapiens
cuaguugaacaucucacuuugcc

SEQ ID NO: 1112741 - RNA, 13 nt, Homo sapiens
gauuucaggauac

SEQ ID NO: 1112742 - RNA, 20 nt, Homo sapiens
gauuuccaaaagacuugaag

SEQ ID NO: 1112743 - RNA, 12 nt, Homo sapiens
gauuugaacccc

SEQ ID NO: 1112744 - RNA, 13 nt, Homo sapiens
gauuuguguuaua

SEQ ID NO: 1112745 - RNA, 14 nt, Homo sapiens
gauuuuaugcugcu

SEQ ID NO: 1112746 - RNA, 13 nt, Homo sapiens
gauuuuuacacau

SEQ ID NO: 1112747 - RNA, 17 nt, Homo sapiens
gauuuuuagcuuuacaa

SEQ ID NO: 1112748 - RNA, 21 nt, Homo sapiens
gcaaaaaaauuaaauuauuua

SEQ ID NO: 1112749 - RNA, 19 nt, Homo sapiens
gcaaaaccacuagaacucu

SEQ ID NO: 1112750 - RNA, 23 nt, Homo sapiens
gcaaaacugccgcaagucugcag

SEQ ID NO: 1112751 - RNA, 18 nt, Homo sapiens
gcaaacucacugcucaag

SEQ ID NO: 1112752 - RNA, 20 nt, Homo sapiens
gcaaagagugggccgcugug

SEQ ID NO: 1112753 - RNA, 11 nt, Homo sapiens
gcaaagccugu

SEQ ID NO: 1112754 - RNA, 21 nt, Homo sapiens
gcaaaggggaggcaucagugu

SEQ ID NO: 1112755 - RNA, 13 nt, Homo sapiens
gcaaauaucuuga

SEQ ID NO: 1112756 - RNA, 21 nt, Homo sapiens
gcaaauccuugauacugcuca

SEQ ID NO: 1112757 - RNA, 23 nt, Homo sapiens
gcaaauguaguauggccuguguc

SEQ ID NO: 1112758 - RNA, 18 nt, Homo sapiens
gcaaauguuucugcagua

SEQ ID NO: 1112759 - RNA, 20 nt, Homo sapiens
gcaacaaugagcagaccaac

SEQ ID NO: 1112760 - RNA, 22 nt, Homo sapiens
gcaacaggaaucucagagacag

SEQ ID NO: 1112761 - RNA, 12 nt, Homo sapiens
gcaacaguuuuu

SEQ ID NO: 1112762 - RNA, 11 nt, Homo sapiens
gcaacauaaaa

SEQ ID NO: 1112763 - RNA, 13 nt, Homo sapiens
gcaaccccaguuc

SEQ ID NO: 1112764 - RNA, 19 nt, Homo sapiens
gcaaccuuuggaugcacuu

SEQ ID NO: 1112765 - RNA, 22 nt, Homo sapiens
gcaacugaggcagacagcagcu

SEQ ID NO: 1112766 - RNA, 22 nt, Homo sapiens
gcaacuuaagcugggauaauca

SEQ ID NO: 1112767 - RNA, 17 nt, Homo sapiens
gcaagacuguugcucaa

SEQ ID NO: 1112768 - RNA, 18 nt, Homo sapiens
gcaagacuguugcucaaa

SEQ ID NO: 1112769 - RNA, 15 nt, Homo sapiens
gcaagcuauucaaug

SEQ ID NO: 1112770 - RNA, 22 nt, Homo sapiens
gcaagugauugaaaauaguaaa

SEQ ID NO: 1112771 - RNA, 22 nt, Homo sapiens
gcaauaacguuuaagccaaaac

SEQ ID NO: 1112772 - RNA, 21 nt, Homo sapiens
gcaauacuauuauauuaugua

SEQ ID NO: 1112773 - RNA, 16 nt, Homo sapiens
gcaaucacugaucuca

SEQ ID NO: 1112774 - RNA, 21 nt, Homo sapiens
gcaaucucuugucucacaugc

SEQ ID NO: 1112775 - RNA, 22 nt, Homo sapiens
gcaaucucuugucucacaugcu

SEQ ID NO: 1112776 - RNA, 15 nt, Homo sapiens
gcuguaaauacaugu

SEQ ID NO: 1112777 - RNA, 17 nt, Homo sapiens
gcugugaaagaaccaaa

SEQ ID NO: 1112778 - RNA, 13 nt, Homo sapiens
gcuguugagugag

SEQ ID NO: 1112779 - RNA, 18 nt, Homo sapiens
gcuguugaugaggccucu

SEQ ID NO: 1112780 - RNA, 20 nt, Homo sapiens
gcuguuuccauagggugaca

SEQ ID NO: 1112781 - RNA, 15 nt, Homo sapiens
gcuguuuucuucuau

SEQ ID NO: 1112782 - RNA, 19 nt, Homo sapiens
gcuguuuuuauauauguga

SEQ ID NO: 1112783 - RNA, 17 nt, Homo sapiens
gcuuaaauauugaauaa

SEQ ID NO: 1112784 - RNA, 13 nt, Homo sapiens
gcuuaaaugcaau

SEQ ID NO: 1112785 - RNA, 14 nt, Homo sapiens
gcuuaaaugcaaua

SEQ ID NO: 1112786 - RNA, 18 nt, Homo sapiens
gcuuauccaugccuggga

SEQ ID NO: 1112787 - RNA, 18 nt, Homo sapiens
gcuucaagugauauaugu

SEQ ID NO: 1112788 - RNA, 13 nt, Homo sapiens
gcuucagccugag

SEQ ID NO: 1112789 - RNA, 15 nt, Homo sapiens
gcuucaguggcagcu

SEQ ID NO: 1112790 - RNA, 21 nt, Homo sapiens
gcuucaucaauuuuuauacau

SEQ ID NO: 1112791 - RNA, 23 nt, Homo sapiens
gcuucaucaauuuuuauacauau

SEQ ID NO: 1112792 - RNA, 18 nt, Homo sapiens
gcuucauuuuugggagaa

SEQ ID NO: 1112793 - RNA, 18 nt, Homo sapiens
gcuuccuucauuuccucc

SEQ ID NO: 1112794 - RNA, 13 nt, Homo sapiens
gcuucuccugacc

SEQ ID NO: 1112795 - RNA, 13 nt, Homo sapiens
gcuucuuuucacu

SEQ ID NO: 1112796 - RNA, 23 nt, Homo sapiens
gcuucuuuucacuucagagcaca

SEQ ID NO: 1112797 - RNA, 15 nt, Homo sapiens
gcuugagccugucac

SEQ ID NO: 1112798 - RNA, 17 nt, Homo sapiens
gcuugagccugucacgu

SEQ ID NO: 1112799 - RNA, 17 nt, Homo sapiens
gcuugggcccugcacag

SEQ ID NO: 1112800 - RNA, 16 nt, Homo sapiens
gcuuguauauacauau

SEQ ID NO: 1112801 - RNA, 14 nt, Homo sapiens
gcuuuacauuuuau

SEQ ID NO: 1112802 - RNA, 13 nt, Homo sapiens
gcuuuagggcaau

SEQ ID NO: 1112803 - RNA, 21 nt, Homo sapiens
gcuuuauuuuuuaaguauuua

SEQ ID NO: 1112804 - RNA, 15 nt, Homo sapiens
gcuuugaggacaaag

SEQ ID NO: 1112805 - RNA, 14 nt, Homo sapiens
gcuuugccugcuug

SEQ ID NO: 1112806 - RNA, 14 nt, Homo sapiens
gcuuuuuaauugag

SEQ ID NO: 1112807 - RNA, 21 nt, Homo sapiens
ggaaaagagcgcaucaggccu

SEQ ID NO: 1112808 - RNA, 19 nt, Homo sapiens
ggaaaagcaaaacuguagg

SEQ ID NO: 1112809 - RNA, 20 nt, Homo sapiens
ggaaaagcugcugacagugu

SEQ ID NO: 1112810 - RNA, 22 nt, Homo sapiens
ggaaaaugugcaauaugugaug

SEQ ID NO: 1112811 - RNA, 17 nt, Homo sapiens
ggaaaauuucacauuaa

SEQ ID NO: 1112812 - RNA, 19 nt, Homo sapiens
ggaaagccucacugauaua

SEQ ID NO: 1112813 - RNA, 18 nt, Homo sapiens
aagauggcugacuuugcu

SEQ ID NO: 1112814 - RNA, 15 nt, Homo sapiens
aagaugucaaauauc

SEQ ID NO: 1112815 - RNA, 22 nt, Homo sapiens
aagauguguugcuauccugaaa

SEQ ID NO: 1112816 - RNA, 15 nt, Homo sapiens
aagauuauauaucau

SEQ ID NO: 1112817 - RNA, 16 nt, Homo sapiens
aagauuuuaugcugcu

SEQ ID NO: 1112818 - RNA, 17 nt, Homo sapiens
aagauuuugccacauuu

SEQ ID NO: 1112819 - RNA, 22 nt, Homo sapiens
aagcaaucugagagauuugaau

SEQ ID NO: 1112820 - RNA, 17 nt, Homo sapiens
ggccugcccucagggau

SEQ ID NO: 1112821 - RNA, 16 nt, Homo sapiens
ggccuggccagaugca

SEQ ID NO: 1112822 - RNA, 20 nt, Homo sapiens
ggccuggccccuucuccucu

SEQ ID NO: 1112823 - RNA, 19 nt, Homo sapiens
ggccuggggugacccggca

SEQ ID NO: 1112824 - RNA, 17 nt, Homo sapiens
ggcgaguucagcaaaga

SEQ ID NO: 1112825 - RNA, 16 nt, Homo sapiens
ggcggauggcugugac

SEQ ID NO: 1112826 - RNA, 19 nt, Homo sapiens
ggcugagagaggaagagcu

SEQ ID NO: 1112827 - RNA, 14 nt, Homo sapiens
ggcugagcucuuau

SEQ ID NO: 1112828 - RNA, 15 nt, Homo sapiens
ggcugaggauuucaa

SEQ ID NO: 1112829 - RNA, 22 nt, Homo sapiens
ggcugggggccucagugccacu

SEQ ID NO: 1112830 - RNA, 23 nt, Homo sapiens
ggcuguccauggcagcuggucuu

SEQ ID NO: 1112831 - RNA, 19 nt, Homo sapiens
ggcuuccagagaguccucu

SEQ ID NO: 1112832 - RNA, 13 nt, Homo sapiens
ggcuucuccugac

SEQ ID NO: 1112833 - RNA, 16 nt, Homo sapiens
ggcuugaaaugcauua

SEQ ID NO: 1112834 - RNA, 22 nt, Homo sapiens
gggaaaccaguguagccuugcc

SEQ ID NO: 1112835 - RNA, 21 nt, Homo sapiens
gggaaaggauauuuucuucca

SEQ ID NO: 1112836 - RNA, 19 nt, Homo sapiens
gggaaaguaaauauuucag

SEQ ID NO: 1112837 - RNA, 12 nt, Homo sapiens
gggaaauugcuu

SEQ ID NO: 1112838 - RNA, 12 nt, Homo sapiens
gggaagccaaaa

SEQ ID NO: 1112839 - RNA, 21 nt, Homo sapiens
gggaagcugggggaagggugg

SEQ ID NO: 1112840 - RNA, 16 nt, Homo sapiens
gggacaaaggagccug

SEQ ID NO: 1112841 - RNA, 21 nt, Homo sapiens
gggacaaaggagccugugaac

SEQ ID NO: 1112842 - RNA, 14 nt, Homo sapiens
gggacaagaaucaa

SEQ ID NO: 1112843 - RNA, 13 nt, Homo sapiens
gggacaccagcca

SEQ ID NO: 1112844 - RNA, 22 nt, Homo sapiens
gggacagcgccaccucuuguca

SEQ ID NO: 1112845 - RNA, 12 nt, Homo sapiens
gggacaugcagc

SEQ ID NO: 1112846 - RNA, 13 nt, Homo sapiens
gggagaaaugacu

SEQ ID NO: 1112847 - RNA, 20 nt, Homo sapiens
gggagacggagguugcagug

SEQ ID NO: 1112848 - RNA, 22 nt, Homo sapiens
gggagagaacuuaaaaaagcaa

SEQ ID NO: 1112849 - RNA, 15 nt, Homo sapiens
gggagcuaugaucca

SEQ ID NO: 1112850 - RNA, 17 nt, Homo sapiens
gggaggaagcagguuga

SEQ ID NO: 1112851 - RNA, 20 nt, Homo sapiens
gggaggcggagguuccagug

SEQ ID NO: 1112852 - RNA, 22 nt, Homo sapiens
gggaggcggcacauuggcagug

SEQ ID NO: 1112853 - RNA, 23 nt, Homo sapiens
gggauaaguaaguuugauuucau

SEQ ID NO: 1112854 - RNA, 22 nt, Homo sapiens
gggaucuguaaggaacuggaac

SEQ ID NO: 1112855 - RNA, 22 nt, Homo sapiens
gggaugcugccugagucaccca

SEQ ID NO: 1112856 - RNA, 10 nt, Homo sapiens
gggauguuuu

SEQ ID NO: 1112857 - RNA, 19 nt, Homo sapiens
gggauuggagggaagacag

SEQ ID NO: 1112858 - RNA, 17 nt, Homo sapiens
gggauuggggaagacug

SEQ ID NO: 1112859 - RNA, 17 nt, Homo sapiens
gggcaacagagcaagau

SEQ ID NO: 1112860 - RNA, 15 nt, Homo sapiens
gggcaauccagacag

SEQ ID NO: 1112861 - RNA, 15 nt, Homo sapiens
gggcagaucaccaga

SEQ ID NO: 1112862 - RNA, 15 nt, Homo sapiens
gggcagcauagcaag

SEQ ID NO: 1112863 - RNA, 15 nt, Homo sapiens
gggcagggguuccca

SEQ ID NO: 1112864 - RNA, 22 nt, Homo sapiens
gggcaugcuggggcaagucccu

SEQ ID NO: 1112865 - RNA, 16 nt, Homo sapiens
gggccagggcccugca

SEQ ID NO: 1112866 - RNA, 15 nt, Homo sapiens
gggccccaccaccua

SEQ ID NO: 1112867 - RNA, 23 nt, Homo sapiens
gggccugccaaggaugacacugc

SEQ ID NO: 1112868 - RNA, 15 nt, Homo sapiens
gggccugcugcugag

SEQ ID NO: 1112869 - RNA, 16 nt, Homo sapiens
gggccuggcuggcuga

SEQ ID NO: 1112870 - RNA, 19 nt, Homo sapiens
gggccuguuacacaugaca

SEQ ID NO: 1112871 - RNA, 21 nt, Homo sapiens
aaaaaacauuuguacauuccu

SEQ ID NO: 1112872 - RNA, 16 nt, Homo sapiens
aaaaaccaaauaagca

SEQ ID NO: 1112873 - RNA, 17 nt, Homo sapiens
aaaaagaagcaaccuca

SEQ ID NO: 1112874 - RNA, 15 nt, Homo sapiens
aaaaagccaucugau

SEQ ID NO: 1112875 - RNA, 15 nt, Homo sapiens
aaaaaguaugugaau

SEQ ID NO: 1112876 - RNA, 17 nt, Homo sapiens
aaaaauacucacauggc

SEQ ID NO: 1112877 - RNA, 18 nt, Homo sapiens
aaaaauauucuccaugga

SEQ ID NO: 1112878 - RNA, 11 nt, Homo sapiens
aaaaaugauuu

SEQ ID NO: 1112879 - RNA, 24 nt, Homo sapiens
aaaaauugacuucuugcuuguaca

SEQ ID NO: 1112880 - RNA, 15 nt, Homo sapiens
aaaacagucgaucaa

SEQ ID NO: 1112881 - RNA, 11 nt, Homo sapiens
aaaacauauca

SEQ ID NO: 1112882 - RNA, 11 nt, Homo sapiens
aaaacaucacu

SEQ ID NO: 1112883 - RNA, 13 nt, Homo sapiens
aaaacaucacuga

SEQ ID NO: 1112884 - RNA, 14 nt, Homo sapiens
aaaacauuccccaa

SEQ ID NO: 1112885 - RNA, 20 nt, Homo sapiens
aaaacauugugccaugucaa

SEQ ID NO: 1112886 - RNA, 10 nt, Homo sapiens
aaaaccaaug

SEQ ID NO: 1112887 - RNA, 18 nt, Homo sapiens
aaaaccccaucucuacua

SEQ ID NO: 1112888 - RNA, 13 nt, Homo sapiens
aaaaccucacuug

SEQ ID NO: 1112889 - RNA, 19 nt, Homo sapiens
aaaaccucauuuaccauaa

SEQ ID NO: 1112890 - RNA, 18 nt, Homo sapiens
aaaaccugugugccauuu

SEQ ID NO: 1112891 - RNA, 18 nt, Homo sapiens
aaaaccuuucaaauuuca

SEQ ID NO: 1112892 - RNA, 11 nt, Homo sapiens
aaaacucuccu

SEQ ID NO: 1112893 - RNA, 18 nt, Homo sapiens
aaaacucuucuacuuuca

SEQ ID NO: 1112894 - RNA, 11 nt, Homo sapiens
aaaacugacuc

SEQ ID NO: 1112895 - RNA, 14 nt, Homo sapiens
aaaacuugcugccu

SEQ ID NO: 1112896 - RNA, 18 nt, Homo sapiens
aaaagaaccgagcaauuu

SEQ ID NO: 1112897 - RNA, 16 nt, Homo sapiens
aaaagaagcaaccuca

SEQ ID NO: 1112898 - RNA, 11 nt, Homo sapiens
aaaagacauaa

SEQ ID NO: 1112899 - RNA, 16 nt, Homo sapiens
aaaagauaacaagauc

SEQ ID NO: 1112900 - RNA, 20 nt, Homo sapiens
aaaagcuuauucaucuguuu

SEQ ID NO: 1112901 - RNA, 21 nt, Homo sapiens
aaaagggauccguacauucaa

SEQ ID NO: 1112902 - RNA, 21 nt, Homo sapiens
aaaaguggcuaauucaauuua

SEQ ID NO: 1112903 - RNA, 14 nt, Homo sapiens
aaaaguuaaacuac

SEQ ID NO: 1112904 - RNA, 19 nt, Homo sapiens
aaaaguuacauguuugcac

SEQ ID NO: 1112905 - RNA, 13 nt, Homo sapiens
aaaaguuacuuau

SEQ ID NO: 1112906 - RNA, 15 nt, Homo sapiens
aaaaguuaugguacu

SEQ ID NO: 1112907 - RNA, 22 nt, Homo sapiens
aaaaguuuggccgggugcggug

SEQ ID NO: 1112908 - RNA, 20 nt, Homo sapiens
aaaauaaacuggggaguuau

SEQ ID NO: 1112909 - RNA, 12 nt, Homo sapiens
aaaauaccucuu

SEQ ID NO: 1112910 - RNA, 23 nt, Homo sapiens
aaaauacuaugugggacaccuca

SEQ ID NO: 1112911 - RNA, 11 nt, Homo sapiens
aaaauagccac

SEQ ID NO: 1112912 - RNA, 23 nt, Homo sapiens
ggaguaguugcuacucuucagaa

SEQ ID NO: 1112913 - RNA, 20 nt, Homo sapiens
ggagugacggucccacacug

SEQ ID NO: 1112914 - RNA, 19 nt, Homo sapiens
ggauaauaacuagaucucc

SEQ ID NO: 1112915 - RNA, 20 nt, Homo sapiens
ggauaguccaaagacuuaac

SEQ ID NO: 1112916 - RNA, 22 nt, Homo sapiens
ggaucaagaaggggacagcgcc

SEQ ID NO: 1112917 - RNA, 23 nt, Homo sapiens
ggaugaggaaccucaaacugggu

SEQ ID NO: 1112918 - RNA, 13 nt, Homo sapiens
ggaugaggucaua

SEQ ID NO: 1112919 - RNA, 19 nt, Homo sapiens
ggaugaucuugauuguggg

SEQ ID NO: 1112920 - RNA, 21 nt, Homo sapiens
ggauggacgaacaggggccaa

SEQ ID NO: 1112921 - RNA, 23 nt, Homo sapiens
ggauggacgaacaggggccaaac

SEQ ID NO: 1112922 - RNA, 21 nt, Homo sapiens
ggauggggcagucucugccca

SEQ ID NO: 1112923 - RNA, 22 nt, Homo sapiens
ggaugucuccaucucugucuca

SEQ ID NO: 1112924 - RNA, 16 nt, Homo sapiens
ggauguucugggacac

SEQ ID NO: 1112925 - RNA, 20 nt, Homo sapiens
ggauuacagguguaagccac

SEQ ID NO: 1112926 - RNA, 17 nt, Homo sapiens
ggauucuuccaucugau

SEQ ID NO: 1112927 - RNA, 16 nt, Homo sapiens
ggauugcuaugaauga

SEQ ID NO: 1112928 - RNA, 18 nt, Homo sapiens
ggcaaagugagacugaca

SEQ ID NO: 1112929 - RNA, 14 nt, Homo sapiens
ggcaacaaugagca

SEQ ID NO: 1112930 - RNA, 18 nt, Homo sapiens
ggcaacagagcaagaucc

SEQ ID NO: 1112931 - RNA, 22 nt, Homo sapiens
ggcaaggacggccuucaacuga

SEQ ID NO: 1112932 - RNA, 14 nt, Homo sapiens
ggcaagggguuucc

SEQ ID NO: 1112933 - RNA, 15 nt, Homo sapiens
ggcaagggguuucca

SEQ ID NO: 1112934 - RNA, 21 nt, Homo sapiens
ggcaauaaguuccauguuaaa

SEQ ID NO: 1112935 - RNA, 16 nt, Homo sapiens
ggcacaaaugcaccuc

SEQ ID NO: 1112936 - RNA, 21 nt, Homo sapiens
ggcacacaucaggaguucaau

SEQ ID NO: 1112937 - RNA, 15 nt, Homo sapiens
ggcacauuggcagug

SEQ ID NO: 1112938 - RNA, 16 nt, Homo sapiens
ggcacgucccaugugc

SEQ ID NO: 1112939 - RNA, 18 nt, Homo sapiens
ggcacucagaagacacug

SEQ ID NO: 1112940 - RNA, 18 nt, Homo sapiens
ggcagcauagcaagacac

SEQ ID NO: 1112941 - RNA, 22 nt, Homo sapiens
ggcagccacacuucucaggaca

SEQ ID NO: 1112942 - RNA, 19 nt, Homo sapiens
ggcagucucugcccaaaca

SEQ ID NO: 1112943 - RNA, 14 nt, Homo sapiens
ggcagugggaccca

SEQ ID NO: 1112944 - RNA, 20 nt, Homo sapiens
ggcaugagggaucacagggc

SEQ ID NO: 1112945 - RNA, 16 nt, Homo sapiens
ggcauucacaucucau

SEQ ID NO: 1112946 - RNA, 22 nt, Homo sapiens
ggccaagcccagcuuaauggcu

SEQ ID NO: 1112947 - RNA, 15 nt, Homo sapiens
ggccaaguuccucua

SEQ ID NO: 1112948 - RNA, 19 nt, Homo sapiens
ggccagagggagugacaga

SEQ ID NO: 1112949 - RNA, 17 nt, Homo sapiens
ggccagcugcaucuacu

SEQ ID NO: 1112950 - RNA, 20 nt, Homo sapiens
ggccaggaguuugagaccag

SEQ ID NO: 1112951 - RNA, 18 nt, Homo sapiens
ggccaggggacacuguau

SEQ ID NO: 1112952 - RNA, 18 nt, Homo sapiens
ggccaugcuucuugcccc

SEQ ID NO: 1112953 - RNA, 16 nt, Homo sapiens
ggccccugcccggcug

SEQ ID NO: 1112954 - RNA, 18 nt, Homo sapiens
ggcccuggaugugcccac

SEQ ID NO: 1112955 - RNA, 18 nt, Homo sapiens
ggccgcuguguuuggaga

SEQ ID NO: 1112956 - RNA, 18 nt, Homo sapiens
ggccgggcaauccagaca

SEQ ID NO: 1112957 - RNA, 15 nt, Homo sapiens
ggccuaacacugggc

SEQ ID NO: 1112958 - RNA, 17 nt, Homo sapiens
ggccuaacacugggcug

SEQ ID NO: 1112959 - RNA, 23 nt, Homo sapiens
ggccuaacacugggcugcagaga

SEQ ID NO: 1112960 - RNA, 13 nt, Homo sapiens
ggccuaugcacau

SEQ ID NO: 1112961 - RNA, 14 nt, Homo sapiens
ggccuccugccucu

SEQ ID NO: 1112962 - RNA, 15 nt, Homo sapiens
ggccucuuucugugc

SEQ ID NO: 1112963 - RNA, 23 nt, Homo sapiens
ggccugccuugaagccacugaag

SEQ ID NO: 1112964 - RNA, 22 nt, Homo sapiens
ggccuuaauuuucaguauaauu

SEQ ID NO: 1112965 - RNA, 17 nt, Homo sapiens
ggcgaaucuacagaaca

SEQ ID NO: 1112966 - RNA, 13 nt, Homo sapiens
ggcgcagugcuuc

SEQ ID NO: 1112967 - RNA, 18 nt, Homo sapiens
ggcuauauuucugggaug

SEQ ID NO: 1112968 - RNA, 15 nt, Homo sapiens
ggcuaucugcauuua

SEQ ID NO: 1112969 - RNA, 16 nt, Homo sapiens
ggcucagucucaggag

SEQ ID NO: 1112970 - RNA, 13 nt, Homo sapiens
ggcucaugaccug

SEQ ID NO: 1112971 - RNA, 13 nt, Homo sapiens
ggcugacggugaa

SEQ ID NO: 1112972 - RNA, 13 nt, Homo sapiens
ggcugagcugaac

SEQ ID NO: 1112973 - RNA, 18 nt, Homo sapiens
ggcugcucggggugcaca

SEQ ID NO: 1112974 - RNA, 13 nt, Homo sapiens
ggcugggugguga

SEQ ID NO: 1112975 - RNA, 23 nt, Homo sapiens
ggcuggugcuguggccaggguga

SEQ ID NO: 1112976 - RNA, 16 nt, Homo sapiens
ggcuucaguggcagcu

SEQ ID NO: 1112977 - RNA, 15 nt, Homo sapiens
ggcuuccuucauuuc

SEQ ID NO: 1112978 - RNA, 17 nt, Homo sapiens
ggcuuccuucauuuccu

SEQ ID NO: 1112979 - RNA, 22 nt, Homo sapiens
ggcuuucuggagaggagggaug

SEQ ID NO: 1112980 - RNA, 18 nt, Homo sapiens
ggcuuuuggcagcaaagu

SEQ ID NO: 1112981 - RNA, 17 nt, Homo sapiens
gggaaauucacacugug

SEQ ID NO: 1112982 - RNA, 21 nt, Homo sapiens
gggaacuggccaagcugaggu

SEQ ID NO: 1112983 - RNA, 15 nt, Homo sapiens
gggaagagugcauuu

SEQ ID NO: 1112984 - RNA, 17 nt, Homo sapiens
gggaaggcugcugugua

SEQ ID NO: 1112985 - RNA, 16 nt, Homo sapiens
gggacucaaugcacug

SEQ ID NO: 1112986 - RNA, 17 nt, Homo sapiens
gggagacugcaucucaa

SEQ ID NO: 1112987 - RNA, 15 nt, Homo sapiens
gggagagccagaccc

SEQ ID NO: 1112988 - RNA, 13 nt, Homo sapiens
gggagcagugucu

SEQ ID NO: 1112989 - RNA, 14 nt, Homo sapiens
gggaggucccugcc

SEQ ID NO: 1112990 - RNA, 13 nt, Homo sapiens
gggauauguuaac

SEQ ID NO: 1112991 - RNA, 15 nt, Homo sapiens
gggaucacuaaggga

SEQ ID NO: 1112992 - RNA, 16 nt, Homo sapiens
gggaucuugcauuccc

SEQ ID NO: 1112993 - RNA, 15 nt, Homo sapiens
gggaugggauuucau

SEQ ID NO: 1112994 - RNA, 11 nt, Homo sapiens
gggaugugcac

SEQ ID NO: 1112995 - RNA, 14 nt, Homo sapiens
gggcaacaaaguga

SEQ ID NO: 1112996 - RNA, 12 nt, Homo sapiens
gggcaacagagc

SEQ ID NO: 1112997 - RNA, 16 nt, Homo sapiens
gggcaagucccugacu

SEQ ID NO: 1112998 - RNA, 14 nt, Homo sapiens
gggccugcccagug

SEQ ID NO: 1112999 - RNA, 12 nt, Homo sapiens
gggcgcgguggc

SEQ ID NO: 1113000 - RNA, 14 nt, Homo sapiens
aaaaucaugaauau

SEQ ID NO: 1113001 - RNA, 15 nt, Homo sapiens
aaaaugaaagccaaa

SEQ ID NO: 1113002 - RNA, 15 nt, Homo sapiens
aaaaugugcaauaug

SEQ ID NO: 1113003 - RNA, 19 nt, Homo sapiens
aaaauuaaaugcauguccu

SEQ ID NO: 1113004 - RNA, 22 nt, Homo sapiens
aaaauuaaaugcauguccucaa

SEQ ID NO: 1113005 - RNA, 16 nt, Homo sapiens
aaaauuaaauugcaga

SEQ ID NO: 1113006 - RNA, 21 nt, Homo sapiens
aaaauuaagagauacauuccc

SEQ ID NO: 1113007 - RNA, 23 nt, Homo sapiens
aaaauuauuuaaaccgcuaaaag

SEQ ID NO: 1113008 - RNA, 19 nt, Homo sapiens
aaaauuuaccacagacuau

SEQ ID NO: 1113009 - RNA, 21 nt, Homo sapiens
aaacaaauaaucacauugacu

SEQ ID NO: 1113010 - RNA, 18 nt, Homo sapiens
aaacaaauagucuaucaa

SEQ ID NO: 1113011 - RNA, 17 nt, Homo sapiens
aaacaaugaagacaauu

SEQ ID NO: 1113012 - RNA, 22 nt, Homo sapiens
aaacacaagugcgccuugcaaa

SEQ ID NO: 1113013 - RNA, 16 nt, Homo sapiens
aaacacagcuuuacaa

SEQ ID NO: 1113014 - RNA, 17 nt, Homo sapiens
aaacaccaaaaagggau

SEQ ID NO: 1113015 - RNA, 17 nt, Homo sapiens
aaacagagaacccugug

SEQ ID NO: 1113016 - RNA, 15 nt, Homo sapiens
aaacagagaugugau

SEQ ID NO: 1113017 - RNA, 19 nt, Homo sapiens
aaacauaauaucuugaaga

SEQ ID NO: 1113018 - RNA, 16 nt, Homo sapiens
aaacauaucaauucaa

SEQ ID NO: 1113019 - RNA, 19 nt, Homo sapiens
aaacaugaccuuccacaau

SEQ ID NO: 1113020 - RNA, 20 nt, Homo sapiens
aaacaugugguuaaugccau

SEQ ID NO: 1113021 - RNA, 23 nt, Homo sapiens
aaacaugugguuaaugccaugga

SEQ ID NO: 1113022 - RNA, 15 nt, Homo sapiens
aaacauguucacuua

SEQ ID NO: 1113023 - RNA, 21 nt, Homo sapiens
aaacauuaaaagaagacugga

SEQ ID NO: 1113024 - RNA, 23 nt, Homo sapiens
aaacauugauuauaagcauguau

SEQ ID NO: 1113025 - RNA, 19 nt, Homo sapiens
aaacauugugccaugucaa

SEQ ID NO: 1113026 - RNA, 15 nt, Homo sapiens
aaacauuuauggaau

SEQ ID NO: 1113027 - RNA, 12 nt, Homo sapiens
aaacccaaauaa

SEQ ID NO: 1113028 - RNA, 23 nt, Homo sapiens
aaacccaaauaaauguguaaaug

SEQ ID NO: 1113029 - RNA, 15 nt, Homo sapiens
aaaccuaagcacgua

SEQ ID NO: 1113030 - RNA, 15 nt, Homo sapiens
aaaccucaucucuac

SEQ ID NO: 1113031 - RNA, 22 nt, Homo sapiens
aaaccucuauauguugcugaaa

SEQ ID NO: 1113032 - RNA, 17 nt, Homo sapiens
aaaccugugugccauuu

SEQ ID NO: 1113033 - RNA, 23 nt, Homo sapiens
aaacuacuuuuguaccaguguga

SEQ ID NO: 1113034 - RNA, 14 nt, Homo sapiens
aaacuauauucuca

SEQ ID NO: 1113035 - RNA, 17 nt, Homo sapiens
aaacuaugguucccaau

SEQ ID NO: 1113036 - RNA, 13 nt, Homo sapiens
aaacucaaaauau

SEQ ID NO: 1113037 - RNA, 19 nt, Homo sapiens
aaacugaggcccuugggca

SEQ ID NO: 1113038 - RNA, 12 nt, Homo sapiens
aaacuugacagu

SEQ ID NO: 1113039 - RNA, 21 nt, Homo sapiens
aaacuuuagaguagcaugaga

SEQ ID NO: 1113040 - RNA, 24 nt, Homo sapiens
aaagaagauuuugccacauuugau

SEQ ID NO: 1113041 - RNA, 17 nt, Homo sapiens
aaagaaggacacuugua

SEQ ID NO: 1113042 - RNA, 21 nt, Homo sapiens
aaagaaggcacagguguaaau

SEQ ID NO: 1113043 - RNA, 18 nt, Homo sapiens
aaagaauaaaugaaucuu

SEQ ID NO: 1113044 - RNA, 14 nt, Homo sapiens
aaagacauagccaa

SEQ ID NO: 1113045 - RNA, 17 nt, Homo sapiens
aaagacuaugaggaaua

SEQ ID NO: 1113046 - RNA, 18 nt, Homo sapiens
aaagacuuaacugguuca

SEQ ID NO: 1113047 - RNA, 21 nt, Homo sapiens
aaagagaagcaaaaucuacca

SEQ ID NO: 1113048 - RNA, 23 nt, Homo sapiens
aaagagagaucuugauccacaga

SEQ ID NO: 1113049 - RNA, 16 nt, Homo sapiens
aaagauguuugucaga

SEQ ID NO: 1113050 - RNA, 23 nt, Homo sapiens
aaagauuggacaccccugcuaua

SEQ ID NO: 1113051 - RNA, 21 nt, Homo sapiens
aaagcaaucugagagauuuga

SEQ ID NO: 1113052 - RNA, 13 nt, Homo sapiens
aaagcaucaccuc

SEQ ID NO: 1113053 - RNA, 18 nt, Homo sapiens
aaagccaaacucugccag

SEQ ID NO: 1113054 - RNA, 18 nt, Homo sapiens
aaagcugugcacuugcag

SEQ ID NO: 1113055 - RNA, 22 nt, Homo sapiens
aaaggaccuuaccuguguuuca

SEQ ID NO: 1113056 - RNA, 18 nt, Homo sapiens
aaaggagaacuauccaaa

SEQ ID NO: 1113057 - RNA, 15 nt, Homo sapiens
aaaggagccugugaa

SEQ ID NO: 1113058 - RNA, 16 nt, Homo sapiens
aaaggagccugugaac

SEQ ID NO: 1113059 - RNA, 21 nt, Homo sapiens
aaaggauguuuugucccauuu

SEQ ID NO: 1113060 - RNA, 18 nt, Homo sapiens
aaagggcccagagagggu

SEQ ID NO: 1113061 - RNA, 17 nt, Homo sapiens
aaagggcugaaagccau

SEQ ID NO: 1113062 - RNA, 23 nt, Homo sapiens
aaagguauuaaauugauguugcu

SEQ ID NO: 1113063 - RNA, 16 nt, Homo sapiens
aaagguugaagcacca

SEQ ID NO: 1113064 - RNA, 14 nt, Homo sapiens
aaagguugacucaa

SEQ ID NO: 1113065 - RNA, 16 nt, Homo sapiens
aaagguugagauguaa

SEQ ID NO: 1113066 - RNA, 18 nt, Homo sapiens
aaagguuuaugaaaaaga

SEQ ID NO: 1113067 - RNA, 18 nt, Homo sapiens
aaaguacccugugcucaa

SEQ ID NO: 1113068 - RNA, 23 nt, Homo sapiens
aaaguacucuuuaagagugaaau

SEQ ID NO: 1113069 - RNA, 14 nt, Homo sapiens
aaaguacuucucca

SEQ ID NO: 1113070 - RNA, 19 nt, Homo sapiens
aaaguagguuuacauucau

SEQ ID NO: 1113071 - RNA, 18 nt, Homo sapiens
aaaguauuuuaucugccu

SEQ ID NO: 1113072 - RNA, 19 nt, Homo sapiens
aaagugaucaguaugcugu

SEQ ID NO: 1113073 - RNA, 15 nt, Homo sapiens
aaaguuguuugugcc

SEQ ID NO: 1113074 - RNA, 18 nt, Homo sapiens
aaaguuguuugugccuuu

SEQ ID NO: 1113075 - RNA, 14 nt, Homo sapiens
aaauaaaagcacuu

SEQ ID NO: 1113076 - RNA, 12 nt, Homo sapiens
aaauaaaagccu

SEQ ID NO: 1113077 - RNA, 14 nt, Homo sapiens
aaauaaggcuccuu

SEQ ID NO: 1113078 - RNA, 16 nt, Homo sapiens
aaauaauugauuucaa

SEQ ID NO: 1113079 - RNA, 14 nt, Homo sapiens
aaauacacaacaca

SEQ ID NO: 1113080 - RNA, 20 nt, Homo sapiens
aaauaccagugaaccaaaga

SEQ ID NO: 1113081 - RNA, 22 nt, Homo sapiens
auaaacacccaugaaucaaaga

SEQ ID NO: 1113082 - RNA, 22 nt, Homo sapiens
auaaacaggaaaaugccagagc

SEQ ID NO: 1113083 - RNA, 13 nt, Homo sapiens
auaaagacuucau

SEQ ID NO: 1113084 - RNA, 15 nt, Homo sapiens
auaaagagaacucug

SEQ ID NO: 1113085 - RNA, 17 nt, Homo sapiens
auaaagcccuugaacca

SEQ ID NO: 1113086 - RNA, 14 nt, Homo sapiens
auaaauaugcucag

SEQ ID NO: 1113087 - RNA, 16 nt, Homo sapiens
auaaaucaacuccagc

SEQ ID NO: 1113088 - RNA, 17 nt, Homo sapiens
auaaaugauguacuaca

SEQ ID NO: 1113089 - RNA, 22 nt, Homo sapiens
auaaaugcaugauuuuauacau

SEQ ID NO: 1113090 - RNA, 19 nt, Homo sapiens
auaaauguaaauauguaca

SEQ ID NO: 1113091 - RNA, 20 nt, Homo sapiens
auaaauguaaauauguacac

SEQ ID NO: 1113092 - RNA, 20 nt, Homo sapiens
auaaauguauaggcagaugu

SEQ ID NO: 1113093 - RNA, 18 nt, Homo sapiens
auaaaugugguacaagca

SEQ ID NO: 1113094 - RNA, 18 nt, Homo sapiens
auaaauguguaaaugugg

SEQ ID NO: 1113095 - RNA, 21 nt, Homo sapiens
auaaauuggugauaaguggaa

SEQ ID NO: 1113096 - RNA, 22 nt, Homo sapiens
auaaauuggugauaaguggaaa

SEQ ID NO: 1113097 - RNA, 19 nt, Homo sapiens
auaacaaccccggacaaau

SEQ ID NO: 1113098 - RNA, 14 nt, Homo sapiens
auaaccuagccuua

SEQ ID NO: 1113099 - RNA, 14 nt, Homo sapiens
auaacuagaucucc

SEQ ID NO: 1113100 - RNA, 18 nt, Homo sapiens
auaacuuguccuauguca

SEQ ID NO: 1113101 - RNA, 23 nt, Homo sapiens
auaagcaaagggagcacuggguu

SEQ ID NO: 1113102 - RNA, 16 nt, Homo sapiens
auaagcaucuguguaa

SEQ ID NO: 1113103 - RNA, 18 nt, Homo sapiens
auaauacaggauugucua

SEQ ID NO: 1113104 - RNA, 15 nt, Homo sapiens
auaauaucugugagg

SEQ ID NO: 1113105 - RNA, 22 nt, Homo sapiens
auaaucucuuuaaauggcuuua

SEQ ID NO: 1113106 - RNA, 14 nt, Homo sapiens
auaaugguuuacug

SEQ ID NO: 1113107 - RNA, 17 nt, Homo sapiens
auaaugguuuacugcug

SEQ ID NO: 1113108 - RNA, 18 nt, Homo sapiens
auaaugguuuuuaauguc

SEQ ID NO: 1113109 - RNA, 15 nt, Homo sapiens
auaauuaaaaaccac

SEQ ID NO: 1113110 - RNA, 15 nt, Homo sapiens
auaauucccuaucuu

SEQ ID NO: 1113111 - RNA, 22 nt, Homo sapiens
auaauucuuuucuuuuccauuu

SEQ ID NO: 1113112 - RNA, 22 nt, Homo sapiens
auaauugguuagaaccuccuau

SEQ ID NO: 1113113 - RNA, 16 nt, Homo sapiens
auaauuguguacaaag

SEQ ID NO: 1113114 - RNA, 15 nt, Homo sapiens
auaauuuaacuucag

SEQ ID NO: 1113115 - RNA, 16 nt, Homo sapiens
auacaagaaagcaaug

SEQ ID NO: 1113116 - RNA, 19 nt, Homo sapiens
auacaagaaagcaaugcca

SEQ ID NO: 1113117 - RNA, 19 nt, Homo sapiens
auacaccaccucacuccug

SEQ ID NO: 1113118 - RNA, 22 nt, Homo sapiens
auacacugaaguuaacagagac

SEQ ID NO: 1113119 - RNA, 14 nt, Homo sapiens
auacagaaugaauc

SEQ ID NO: 1113120 - RNA, 18 nt, Homo sapiens
auacaguaagcugcucua

SEQ ID NO: 1113121 - RNA, 14 nt, Homo sapiens
auacauaccacuuu

SEQ ID NO: 1113122 - RNA, 11 nt, Homo sapiens
auacauaucag

SEQ ID NO: 1113123 - RNA, 13 nt, Homo sapiens
auaccaagcuugu

SEQ ID NO: 1113124 - RNA, 19 nt, Homo sapiens
auaccagugaaccaaagag

SEQ ID NO: 1113125 - RNA, 21 nt, Homo sapiens
auacccaaguuauugggaugu

SEQ ID NO: 1113126 - RNA, 20 nt, Homo sapiens
auacguuugaaauaguugau

SEQ ID NO: 1113127 - RNA, 16 nt, Homo sapiens
auacuaccggcuacau

SEQ ID NO: 1113128 - RNA, 19 nt, Homo sapiens
auacuaccggcuacaucaa

SEQ ID NO: 1113129 - RNA, 22 nt, Homo sapiens
auacuagaaagcucugcaugug

SEQ ID NO: 1113130 - RNA, 17 nt, Homo sapiens
auacuucaauacuucau

SEQ ID NO: 1113131 - RNA, 12 nt, Homo sapiens
auagaaacugag

SEQ ID NO: 1113132 - RNA, 19 nt, Homo sapiens
auagaagaugaaucauuga

SEQ ID NO: 1113133 - RNA, 20 nt, Homo sapiens
auagacugccaugcuagaca

SEQ ID NO: 1113134 - RNA, 15 nt, Homo sapiens
auagagccacguaug

SEQ ID NO: 1113135 - RNA, 13 nt, Homo sapiens
auagaguacugca

SEQ ID NO: 1113136 - RNA, 21 nt, Homo sapiens
auagagugguacagcacuguu

SEQ ID NO: 1113137 - RNA, 22 nt, Homo sapiens
auagauuuucauguucuugcag

SEQ ID NO: 1113138 - RNA, 13 nt, Homo sapiens
auagcaagacaca

SEQ ID NO: 1113139 - RNA, 17 nt, Homo sapiens
auagccuaggugacaga

SEQ ID NO: 1113140 - RNA, 13 nt, Homo sapiens
auaguccaaagac

SEQ ID NO: 1113141 - RNA, 17 nt, Homo sapiens
auagucccagcuacuca

SEQ ID NO: 1113142 - RNA, 14 nt, Homo sapiens
auagugcacacuug

SEQ ID NO: 1113143 - RNA, 23 nt, Homo sapiens
auaguguuggaaaaugugcaaua

SEQ ID NO: 1113144 - RNA, 19 nt, Homo sapiens
auaguuuuucauuguacca

SEQ ID NO: 1113145 - RNA, 16 nt, Homo sapiens
auauaaauuuguguuc

SEQ ID NO: 1113146 - RNA, 19 nt, Homo sapiens
auauaaauuuguguucuca

SEQ ID NO: 1113147 - RNA, 16 nt, Homo sapiens
auauaaugcaaaccau

SEQ ID NO: 1113148 - RNA, 15 nt, Homo sapiens
auauacaaacaugug

SEQ ID NO: 1113149 - RNA, 15 nt, Homo sapiens
auccuuuacuguuag

SEQ ID NO: 1113150 - RNA, 14 nt, Homo sapiens
aucgggccaucuca

SEQ ID NO: 1113151 - RNA, 12 nt, Homo sapiens
aucuacacagcc

SEQ ID NO: 1113152 - RNA, 18 nt, Homo sapiens
aucuacugagacaugacu

SEQ ID NO: 1113153 - RNA, 18 nt, Homo sapiens
aucuagaucaauuaauuc

SEQ ID NO: 1113154 - RNA, 17 nt, Homo sapiens
aucuagcucuaguucaa

SEQ ID NO: 1113155 - RNA, 12 nt, Homo sapiens
aucuauaucucu

SEQ ID NO: 1113156 - RNA, 17 nt, Homo sapiens
aucuaucuguauuuuca

SEQ ID NO: 1113157 - RNA, 14 nt, Homo sapiens
aucucaaauucuca

SEQ ID NO: 1113158 - RNA, 16 nt, Homo sapiens
aucucacaagcacuuu

SEQ ID NO: 1113159 - RNA, 17 nt, Homo sapiens
aucucacucuguugccc

SEQ ID NO: 1113160 - RNA, 19 nt, Homo sapiens
aucucacucuguugcccag

SEQ ID NO: 1113161 - RNA, 15 nt, Homo sapiens
aucucagccuaccau

SEQ ID NO: 1113162 - RNA, 20 nt, Homo sapiens
aucucaggagcuugcaagaa

SEQ ID NO: 1113163 - RNA, 22 nt, Homo sapiens
aucucaggagcuugcaagaagc

SEQ ID NO: 1113164 - RNA, 19 nt, Homo sapiens
aucuccacccugagccuga

SEQ ID NO: 1113165 - RNA, 13 nt, Homo sapiens
aucuccacuguua

SEQ ID NO: 1113166 - RNA, 21 nt, Homo sapiens
aucuccaggauugaagagcau

SEQ ID NO: 1113167 - RNA, 22 nt, Homo sapiens
aucucccugccgccucaaugug

SEQ ID NO: 1113168 - RNA, 23 nt, Homo sapiens
aucucuacaaaaaauaaaaacac

SEQ ID NO: 1113169 - RNA, 13 nt, Homo sapiens
aucucuaugugga

SEQ ID NO: 1113170 - RNA, 18 nt, Homo sapiens
augcaccuugugucugua

SEQ ID NO: 1113171 - RNA, 13 nt, Homo sapiens
augcagacuuccu

SEQ ID NO: 1113172 - RNA, 16 nt, Homo sapiens
augcagccgugcagga

SEQ ID NO: 1113173 - RNA, 17 nt, Homo sapiens
augcaguccagaauaag

SEQ ID NO: 1113174 - RNA, 15 nt, Homo sapiens
augcauauacuuuaa

SEQ ID NO: 1113175 - RNA, 15 nt, Homo sapiens
augcauugcuaaaau

SEQ ID NO: 1113176 - RNA, 17 nt, Homo sapiens
augccaccuccuggaag

SEQ ID NO: 1113177 - RNA, 23 nt, Homo sapiens
augccacuccugcuucucugggg

SEQ ID NO: 1113178 - RNA, 21 nt, Homo sapiens
augccagagacggaagccuuu

SEQ ID NO: 1113179 - RNA, 23 nt, Homo sapiens
augccagugaaacuucaagcaaa

SEQ ID NO: 1113180 - RNA, 15 nt, Homo sapiens
augccauagcaagau

SEQ ID NO: 1113181 - RNA, 15 nt, Homo sapiens
augccggugaucccu

SEQ ID NO: 1113182 - RNA, 22 nt, Homo sapiens
augccuaauaaacaauucaagu

SEQ ID NO: 1113183 - RNA, 15 nt, Homo sapiens
augccuacagauaau

SEQ ID NO: 1113184 - RNA, 12 nt, Homo sapiens
augccucugagg

SEQ ID NO: 1113185 - RNA, 22 nt, Homo sapiens
augccuuuucccaaaauguuga

SEQ ID NO: 1113186 - RNA, 22 nt, Homo sapiens
augcuaguuugaccucauuugu

SEQ ID NO: 1113187 - RNA, 18 nt, Homo sapiens
augcugcaaauaaauuca

SEQ ID NO: 1113188 - RNA, 20 nt, Homo sapiens
augcugccaaccagcuuguc

SEQ ID NO: 1113189 - RNA, 15 nt, Homo sapiens
augcugcuguuuaca

SEQ ID NO: 1113190 - RNA, 15 nt, Homo sapiens
augcuguugccucau

SEQ ID NO: 1113191 - RNA, 18 nt, Homo sapiens
agauucccacccaauuca

SEQ ID NO: 1113192 - RNA, 19 nt, Homo sapiens
agauucccucuuccugcca

SEQ ID NO: 1113193 - RNA, 20 nt, Homo sapiens
agauucccucuuccugccaa

SEQ ID NO: 1113194 - RNA, 21 nt, Homo sapiens
ggaucuguaaggaacuggaac

SEQ ID NO: 1113195 - RNA, 12 nt, Homo sapiens
ggaugaauggaa

SEQ ID NO: 1113196 - RNA, 21 nt, Homo sapiens
ggaugugcccacagggaccaa

SEQ ID NO: 1113197 - RNA, 16 nt, Homo sapiens
ggcaaaaaaauuaaau

SEQ ID NO: 1113198 - RNA, 20 nt, Homo sapiens
ggcaaaaccacuagaacucu

SEQ ID NO: 1113199 - RNA, 23 nt, Homo sapiens
ggcaaacccaaaaccucaugaca

SEQ ID NO: 1113200 - RNA, 14 nt, Homo sapiens
ggcaacucggagag

SEQ ID NO: 1113201 - RNA, 23 nt, Homo sapiens
ggcacaaaugcaccucccaguuu

SEQ ID NO: 1113202 - RNA, 20 nt, Homo sapiens
ggcacaaauuguacauuuga

SEQ ID NO: 1113203 - RNA, 18 nt, Homo sapiens
ggcacauuggcagugugu

SEQ ID NO: 1113204 - RNA, 15 nt, Homo sapiens
ggcaccgagaacucg

SEQ ID NO: 1113205 - RNA, 14 nt, Homo sapiens
ggcacgguggcuca

SEQ ID NO: 1113206 - RNA, 22 nt, Homo sapiens
ggcagaagaauugaacccagga

SEQ ID NO: 1113207 - RNA, 13 nt, Homo sapiens
ggcagagccuuug

SEQ ID NO: 1113208 - RNA, 13 nt, Homo sapiens
ggcagcagcucag

SEQ ID NO: 1113209 - RNA, 18 nt, Homo sapiens
ggcagccaggcuggcaga

SEQ ID NO: 1113210 - RNA, 21 nt, Homo sapiens
ggcaggaguagcugagcucac

SEQ ID NO: 1113211 - RNA, 16 nt, Homo sapiens
ggcagucauacugggg

SEQ ID NO: 1113212 - RNA, 15 nt, Homo sapiens
ggcaguccagccagc

SEQ ID NO: 1113213 - RNA, 17 nt, Homo sapiens
ggcaguccagccagcuc

SEQ ID NO: 1113214 - RNA, 17 nt, Homo sapiens
ggcaguuggaggacaca

SEQ ID NO: 1113215 - RNA, 18 nt, Homo sapiens
ggcaucgggccaucucag

SEQ ID NO: 1113216 - RNA, 16 nt, Homo sapiens
ggcaugaaggugucau

SEQ ID NO: 1113217 - RNA, 14 nt, Homo sapiens
ggcaugcaccagug

SEQ ID NO: 1113218 - RNA, 15 nt, Homo sapiens
ggcauggcuggggug

SEQ ID NO: 1113219 - RNA, 21 nt, Homo sapiens
ggccaagaaagagucaggccu

SEQ ID NO: 1113220 - RNA, 18 nt, Homo sapiens
ggccaagcaccuagccuc

SEQ ID NO: 1113221 - RNA, 15 nt, Homo sapiens
ggccacaccaucucc

SEQ ID NO: 1113222 - RNA, 16 nt, Homo sapiens
ggccagcagcagauaa

SEQ ID NO: 1113223 - RNA, 16 nt, Homo sapiens
ggccagguuaugccuc

SEQ ID NO: 1113224 - RNA, 11 nt, Homo sapiens
ggccaguguga

SEQ ID NO: 1113225 - RNA, 23 nt, Homo sapiens
ggccauuccaacagcucaagucu

SEQ ID NO: 1113226 - RNA, 21 nt, Homo sapiens
ggcccaaagcccagcucuuug

SEQ ID NO: 1113227 - RNA, 15 nt, Homo sapiens
ggcccagaccucagg

SEQ ID NO: 1113228 - RNA, 15 nt, Homo sapiens
ggccccagaacacag

SEQ ID NO: 1113229 - RNA, 15 nt, Homo sapiens
ggccccccuccaggc

SEQ ID NO: 1113230 - RNA, 17 nt, Homo sapiens
ggccccugggccugcca

SEQ ID NO: 1113231 - RNA, 16 nt, Homo sapiens
ggccuccugugugugc

SEQ ID NO: 1113232 - RNA, 14 nt, Homo sapiens
caaagcuaccugug

SEQ ID NO: 1113233 - RNA, 23 nt, Homo sapiens
caaagcucaagaugacagcucuu

SEQ ID NO: 1113234 - RNA, 15 nt, Homo sapiens
caaaggaaucagcug

SEQ ID NO: 1113235 - RNA, 15 nt, Homo sapiens
caaaggcacugaggc

SEQ ID NO: 1113236 - RNA, 16 nt, Homo sapiens
caaaggcucuacacau

SEQ ID NO: 1113237 - RNA, 16 nt, Homo sapiens
caaagguuaucaacca

SEQ ID NO: 1113238 - RNA, 16 nt, Homo sapiens
caaaguguuaaucuua

SEQ ID NO: 1113239 - RNA, 17 nt, Homo sapiens
caaaguuuugaagucau

SEQ ID NO: 1113240 - RNA, 15 nt, Homo sapiens
caaauaaagaccuga

SEQ ID NO: 1113241 - RNA, 17 nt, Homo sapiens
caaauaaauguguaaau

SEQ ID NO: 1113242 - RNA, 16 nt, Homo sapiens
caaauaaauucauaca

SEQ ID NO: 1113243 - RNA, 18 nt, Homo sapiens
caaauaagcaucugugua

SEQ ID NO: 1113244 - RNA, 15 nt, Homo sapiens
caaauagucuaucaa

SEQ ID NO: 1113245 - RNA, 14 nt, Homo sapiens
caaaucaucucuca

SEQ ID NO: 1113246 - RNA, 16 nt, Homo sapiens
caaauccugaugcugu

SEQ ID NO: 1113247 - RNA, 14 nt, Homo sapiens
caaaugacccaaag

SEQ ID NO: 1113248 - RNA, 16 nt, Homo sapiens
caaaugacccaaagac

SEQ ID NO: 1113249 - RNA, 13 nt, Homo sapiens
caaauggacauaa

SEQ ID NO: 1113250 - RNA, 18 nt, Homo sapiens
caaauuagguuuuguaca

SEQ ID NO: 1113251 - RNA, 16 nt, Homo sapiens
caaauucauggugcac

SEQ ID NO: 1113252 - RNA, 17 nt, Homo sapiens
caaauucuuuuucacac

SEQ ID NO: 1113253 - RNA, 14 nt, Homo sapiens
caacaagccauagu

SEQ ID NO: 1113254 - RNA, 24 nt, Homo sapiens
caacacucacauuuauucugcuca

SEQ ID NO: 1113255 - RNA, 11 nt, Homo sapiens
caacacuuaag

SEQ ID NO: 1113256 - RNA, 18 nt, Homo sapiens
caacagaagcuuccauuc

SEQ ID NO: 1113257 - RNA, 13 nt, Homo sapiens
caacagagcaaga

SEQ ID NO: 1113258 - RNA, 22 nt, Homo sapiens
caacagauggauagucugucca

SEQ ID NO: 1113259 - RNA, 15 nt, Homo sapiens
caacaguucaaagaa

SEQ ID NO: 1113260 - RNA, 12 nt, Homo sapiens
caacaguuccuu

SEQ ID NO: 1113261 - RNA, 14 nt, Homo sapiens
caacaguuccuuca

SEQ ID NO: 1113262 - RNA, 18 nt, Homo sapiens
caacaguuuuuuaugcua

SEQ ID NO: 1113263 - RNA, 20 nt, Homo sapiens
caacauaacugaaggcauau

SEQ ID NO: 1113264 - RNA, 14 nt, Homo sapiens
auuguugcauuaaa

SEQ ID NO: 1113265 - RNA, 13 nt, Homo sapiens
auuguuucuggaa

SEQ ID NO: 1113266 - RNA, 13 nt, Homo sapiens
auuuaaacuucuu

SEQ ID NO: 1113267 - RNA, 21 nt, Homo sapiens
auuuaaaguuguuugugccuu

SEQ ID NO: 1113268 - RNA, 22 nt, Homo sapiens
auuuaaggaagaaucuucugcc

SEQ ID NO: 1113269 - RNA, 16 nt, Homo sapiens
auuuaauuuuugcaau

SEQ ID NO: 1113270 - RNA, 21 nt, Homo sapiens
auuuacaugaauugcauuuua

SEQ ID NO: 1113271 - RNA, 19 nt, Homo sapiens
auuuaccacagacuauuaa

SEQ ID NO: 1113272 - RNA, 12 nt, Homo sapiens
auuuagugucuu

SEQ ID NO: 1113273 - RNA, 19 nt, Homo sapiens
auuuauaaacuagaucucc

SEQ ID NO: 1113274 - RNA, 16 nt, Homo sapiens
auuuauauauauaugu

SEQ ID NO: 1113275 - RNA, 14 nt, Homo sapiens
auuuaucugugcaa

SEQ ID NO: 1113276 - RNA, 15 nt, Homo sapiens
auuuaucugugcaaa

SEQ ID NO: 1113277 - RNA, 14 nt, Homo sapiens
auuuaugagcucuu

SEQ ID NO: 1113278 - RNA, 20 nt, Homo sapiens
auuuauggucaacacuuaag

SEQ ID NO: 1113279 - RNA, 22 nt, Homo sapiens
auuuaugucucagaccacuauu

SEQ ID NO: 1113280 - RNA, 17 nt, Homo sapiens
auuuauuaccucugaua

SEQ ID NO: 1113281 - RNA, 16 nt, Homo sapiens
auuuauuuauggagga

SEQ ID NO: 1113282 - RNA, 17 nt, Homo sapiens
auuuauuuuuuuacuuc

SEQ ID NO: 1113283 - RNA, 20 nt, Homo sapiens
auuucaugauuucauuucaa

SEQ ID NO: 1113284 - RNA, 15 nt, Homo sapiens
auuucauguaaccaa

SEQ ID NO: 1113285 - RNA, 14 nt, Homo sapiens
auuucccccaggga

SEQ ID NO: 1113286 - RNA, 23 nt, Homo sapiens
auuuccugugucuuuuuucacua

SEQ ID NO: 1113287 - RNA, 19 nt, Homo sapiens
auuucuauuuuuguagaag

SEQ ID NO: 1113288 - RNA, 17 nt, Homo sapiens
auuucucaaaugcacau

SEQ ID NO: 1113289 - RNA, 23 nt, Homo sapiens
auuucucauuugaguauuacaau

SEQ ID NO: 1113290 - RNA, 16 nt, Homo sapiens
auuucuuauagucaau

SEQ ID NO: 1113291 - RNA, 16 nt, Homo sapiens
auuugacucaugaacu

SEQ ID NO: 1113292 - RNA, 21 nt, Homo sapiens
auuugauaaacuaaaagcaua

SEQ ID NO: 1113293 - RNA, 23 nt, Homo sapiens
auuugauaguugguguucaaaaa

SEQ ID NO: 1113294 - RNA, 17 nt, Homo sapiens
auuugccaauuuacuuu

SEQ ID NO: 1113295 - RNA, 21 nt, Homo sapiens
auuugccuguaacaagccaga

SEQ ID NO: 1113296 - RNA, 15 nt, Homo sapiens
aaugguuuacugcug

SEQ ID NO: 1113297 - RNA, 13 nt, Homo sapiens
aauguauugaacu

SEQ ID NO: 1113298 - RNA, 12 nt, Homo sapiens
aauguccuccaa

SEQ ID NO: 1113299 - RNA, 16 nt, Homo sapiens
aaugucuggucugucc

SEQ ID NO: 1113300 - RNA, 16 nt, Homo sapiens
aaugucuguuaacuua

SEQ ID NO: 1113301 - RNA, 14 nt, Homo sapiens
aaugucuuaaucau

SEQ ID NO: 1113302 - RNA, 19 nt, Homo sapiens
aaugucuuuuuaagcuuau

SEQ ID NO: 1113303 - RNA, 22 nt, Homo sapiens
aauguguauugaagaaaagcac

SEQ ID NO: 1113304 - RNA, 15 nt, Homo sapiens
aauguuacauuauua

SEQ ID NO: 1113305 - RNA, 21 nt, Homo sapiens
aauguuauuuuuuaauuauua

SEQ ID NO: 1113306 - RNA, 15 nt, Homo sapiens
aauguuguaauucau

SEQ ID NO: 1113307 - RNA, 14 nt, Homo sapiens
aauguuuacacucu

SEQ ID NO: 1113308 - RNA, 13 nt, Homo sapiens
aauuaaaaaccac

SEQ ID NO: 1113309 - RNA, 21 nt, Homo sapiens
aauuaaaaaguuaaucuucau

SEQ ID NO: 1113310 - RNA, 14 nt, Homo sapiens
aauuaaacccugcc

SEQ ID NO: 1113311 - RNA, 13 nt, Homo sapiens
aauuaaaugcaug

SEQ ID NO: 1113312 - RNA, 18 nt, Homo sapiens
aauuaaaugcauguccuc

SEQ ID NO: 1113313 - RNA, 22 nt, Homo sapiens
aauuaaaugcauguccucaaaa

SEQ ID NO: 1113314 - RNA, 12 nt, Homo sapiens
aauuaacacugc

SEQ ID NO: 1113315 - RNA, 14 nt, Homo sapiens
aauuagaugaacuc

SEQ ID NO: 1113316 - RNA, 21 nt, Homo sapiens
aauuagccagugaaaaacuau

SEQ ID NO: 1113317 - RNA, 21 nt, Homo sapiens
aauuagcugugugaaauacca

SEQ ID NO: 1113318 - RNA, 19 nt, Homo sapiens
aauuaggagaggcagagau

SEQ ID NO: 1113319 - RNA, 15 nt, Homo sapiens
aauuaugagucucua

SEQ ID NO: 1113320 - RNA, 12 nt, Homo sapiens
aauuaugccaua

SEQ ID NO: 1113321 - RNA, 21 nt, Homo sapiens
aauuauuauuuauauauguau

SEQ ID NO: 1113322 - RNA, 19 nt, Homo sapiens
aauucaacuaguaccacag

SEQ ID NO: 1113323 - RNA, 16 nt, Homo sapiens
aauucagaacauccuc

SEQ ID NO: 1113324 - RNA, 20 nt, Homo sapiens
aauuccacagucucugggag

SEQ ID NO: 1113325 - RNA, 18 nt, Homo sapiens
aauuccauuuccaguuca

SEQ ID NO: 1113326 - RNA, 13 nt, Homo sapiens
aauuccucuggga

SEQ ID NO: 1113327 - RNA, 15 nt, Homo sapiens
aauuccuguauucua

SEQ ID NO: 1113328 - RNA, 14 nt, Homo sapiens
aauuccuugauuca

SEQ ID NO: 1113329 - RNA, 22 nt, Homo sapiens
aauucucagucaguaauugcca

SEQ ID NO: 1113330 - RNA, 20 nt, Homo sapiens
aauucucauuugucacacac

SEQ ID NO: 1113331 - RNA, 19 nt, Homo sapiens
aauucuccuguugcaauga

SEQ ID NO: 1113332 - RNA, 17 nt, Homo sapiens
aauucucucucuugcag

SEQ ID NO: 1113333 - RNA, 22 nt, Homo sapiens
aauucugagcuggcccuuucca

SEQ ID NO: 1113334 - RNA, 13 nt, Homo sapiens
aauucugugaaga

SEQ ID NO: 1113335 - RNA, 18 nt, Homo sapiens
aauucuuacaaacaugug

SEQ ID NO: 1113336 - RNA, 19 nt, Homo sapiens
aauucuuacaaacaugugg

SEQ ID NO: 1113337 - RNA, 18 nt, Homo sapiens
aauucuuuuucacacuga

SEQ ID NO: 1113338 - RNA, 14 nt, Homo sapiens
aauugaacuaacaa

SEQ ID NO: 1113339 - RNA, 21 nt, Homo sapiens
aauugaccuuuugacuuaaag

SEQ ID NO: 1113340 - RNA, 13 nt, Homo sapiens
aauugacugucac

SEQ ID NO: 1113341 - RNA, 14 nt, Homo sapiens
aauugauguugcug

SEQ ID NO: 1113342 - RNA, 10 nt, Homo sapiens
aauugcacaa

SEQ ID NO: 1113343 - RNA, 17 nt, Homo sapiens
aauugcucaaugcauga

SEQ ID NO: 1113344 - RNA, 14 nt, Homo sapiens
aauuggguuuuaaa

SEQ ID NO: 1113345 - RNA, 16 nt, Homo sapiens
aauugucuuuugucau

SEQ ID NO: 1113346 - RNA, 19 nt, Homo sapiens
aauugugaucagaccauaa

SEQ ID NO: 1113347 - RNA, 23 nt, Homo sapiens
aauuuaaaaauaagaaaauacau

SEQ ID NO: 1113348 - RNA, 21 nt, Homo sapiens
aauuuaaaacacagagaugcu

SEQ ID NO: 1113349 - RNA, 21 nt, Homo sapiens
aauuuaggaccaauaccuccu

SEQ ID NO: 1113350 - RNA, 14 nt, Homo sapiens
aauuuauauuuucc

SEQ ID NO: 1113351 - RNA, 12 nt, Homo sapiens
aagacccagugu

SEQ ID NO: 1113352 - RNA, 19 nt, Homo sapiens
aagacccaguguaaagaau

SEQ ID NO: 1113353 - RNA, 17 nt, Homo sapiens
aagacuauauuguacac

SEQ ID NO: 1113354 - RNA, 17 nt, Homo sapiens
aagacuauugugccuua

SEQ ID NO: 1113355 - RNA, 15 nt, Homo sapiens
aagacuuaacugguu

SEQ ID NO: 1113356 - RNA, 14 nt, Homo sapiens
aagagaacauuucu

SEQ ID NO: 1113357 - RNA, 13 nt, Homo sapiens
aagagacugaguc

SEQ ID NO: 1113358 - RNA, 17 nt, Homo sapiens
aagagagagacccucac

SEQ ID NO: 1113359 - RNA, 21 nt, Homo sapiens
aagagagaucuugauccacag

SEQ ID NO: 1113360 - RNA, 21 nt, Homo sapiens
aagagaggaaugccuguguga

SEQ ID NO: 1113361 - RNA, 23 nt, Homo sapiens
aagagaucacaauacucaaaaga

SEQ ID NO: 1113362 - RNA, 14 nt, Homo sapiens
aagagcccugucag

SEQ ID NO: 1113363 - RNA, 19 nt, Homo sapiens
aagagccugacuguguuca

SEQ ID NO: 1113364 - RNA, 21 nt, Homo sapiens
aagaguucuuaaggauuguga

SEQ ID NO: 1113365 - RNA, 19 nt, Homo sapiens
aagauaacaagaucuuuca

SEQ ID NO: 1113366 - RNA, 15 nt, Homo sapiens
aagaucuauauugua

SEQ ID NO: 1113367 - RNA, 17 nt, Homo sapiens
aagaucuugucuccacu

SEQ ID NO: 1113368 - RNA, 17 nt, Homo sapiens
aagaugaagacaacagc

SEQ ID NO: 1113369 - RNA, 13 nt, Homo sapiens
aagauuuaaguaa

SEQ ID NO: 1113370 - RNA, 21 nt, Homo sapiens
aagcaaagacuaugaggaaua

SEQ ID NO: 1113371 - RNA, 23 nt, Homo sapiens
aagcaacagauggauagucuguc

SEQ ID NO: 1113372 - RNA, 18 nt, Homo sapiens
aagcaagacguccuggaa

SEQ ID NO: 1113373 - RNA, 20 nt, Homo sapiens
aagcaagacuguugcucaaa

SEQ ID NO: 1113374 - RNA, 20 nt, Homo sapiens
aagcagagugauucaggggc

SEQ ID NO: 1113375 - RNA, 18 nt, Homo sapiens
aagcagguggcaucucua

SEQ ID NO: 1113376 - RNA, 16 nt, Homo sapiens
aagcaucacuugggau

SEQ ID NO: 1113377 - RNA, 20 nt, Homo sapiens
aagcaucauuauuugcagag

SEQ ID NO: 1113378 - RNA, 23 nt, Homo sapiens
aagcaucucagccuaccaugaga

SEQ ID NO: 1113379 - RNA, 21 nt, Homo sapiens
aagcaucuguguaaccuccac

SEQ ID NO: 1113380 - RNA, 14 nt, Homo sapiens
aagcauuuacuuug

SEQ ID NO: 1113381 - RNA, 22 nt, Homo sapiens
aagccacguuaaguccaaggag

SEQ ID NO: 1113382 - RNA, 13 nt, Homo sapiens
aauaaaagcacuu

SEQ ID NO: 1113383 - RNA, 14 nt, Homo sapiens
aauaaaagcacuua

SEQ ID NO: 1113384 - RNA, 17 nt, Homo sapiens
aauaaacgucuugccac

SEQ ID NO: 1113385 - RNA, 16 nt, Homo sapiens
aauaaacucucuaggg

SEQ ID NO: 1113386 - RNA, 14 nt, Homo sapiens
aauaaagcuugcaa

SEQ ID NO: 1113387 - RNA, 17 nt, Homo sapiens
aauaaauaaaaauauuc

SEQ ID NO: 1113388 - RNA, 15 nt, Homo sapiens
aauaaauaugcucag

SEQ ID NO: 1113389 - RNA, 19 nt, Homo sapiens
aauaaaugauguacuacau

SEQ ID NO: 1113390 - RNA, 16 nt, Homo sapiens
aauaaauguacauuaa

SEQ ID NO: 1113391 - RNA, 14 nt, Homo sapiens
aauaaauugcuccu

SEQ ID NO: 1113392 - RNA, 14 nt, Homo sapiens
aauaaccacuuaaa

SEQ ID NO: 1113393 - RNA, 19 nt, Homo sapiens
aauaacuagaucuccugua

SEQ ID NO: 1113394 - RNA, 15 nt, Homo sapiens
aauaagcaucugugu

SEQ ID NO: 1113395 - RNA, 15 nt, Homo sapiens
aauaagguacaagaa

SEQ ID NO: 1113396 - RNA, 22 nt, Homo sapiens
aauaauagacacuggagacuug

SEQ ID NO: 1113397 - RNA, 21 nt, Homo sapiens
aauaaugaguuagaacuauua

SEQ ID NO: 1113398 - RNA, 22 nt, Homo sapiens
aauaaugaguuagaacuauuaa

SEQ ID NO: 1113399 - RNA, 20 nt, Homo sapiens
aauaauguuguaauucaugc

SEQ ID NO: 1113400 - RNA, 20 nt, Homo sapiens
aauaauuaaaaaccacugaa

SEQ ID NO: 1113401 - RNA, 14 nt, Homo sapiens
aauaauuaugugcc

SEQ ID NO: 1113402 - RNA, 20 nt, Homo sapiens
aauaccucaaccuaugguau

SEQ ID NO: 1113403 - RNA, 19 nt, Homo sapiens
aauaccuccuccagaucag

SEQ ID NO: 1113404 - RNA, 14 nt, Homo sapiens
aauacuccuaagac

SEQ ID NO: 1113405 - RNA, 19 nt, Homo sapiens
aauagaaccaagaauucua

SEQ ID NO: 1113406 - RNA, 14 nt, Homo sapiens
aauagcucuuucag

SEQ ID NO: 1113407 - RNA, 14 nt, Homo sapiens
aauaguaaaugcuu

SEQ ID NO: 1113408 - RNA, 16 nt, Homo sapiens
aauaguucaguauaaa

SEQ ID NO: 1113409 - RNA, 19 nt, Homo sapiens
aauaguuuugauccuaaau

SEQ ID NO: 1113410 - RNA, 14 nt, Homo sapiens
aauauaaacacuau

SEQ ID NO: 1113411 - RNA, 13 nt, Homo sapiens
aauauaaaugcau

SEQ ID NO: 1113412 - RNA, 15 nt, Homo sapiens
aauauaguagcagga

SEQ ID NO: 1113413 - RNA, 17 nt, Homo sapiens
aauauccgaacuuuaau

SEQ ID NO: 1113414 - RNA, 22 nt, Homo sapiens
aauaucugagaaguguauauag

SEQ ID NO: 1113415 - RNA, 19 nt, Homo sapiens
aauaugcaccaaaucaucu

SEQ ID NO: 1113416 - RNA, 14 nt, Homo sapiens
aauaugucaguuug

SEQ ID NO: 1113417 - RNA, 13 nt, Homo sapiens
aauauuaaauaca

SEQ ID NO: 1113418 - RNA, 14 nt, Homo sapiens
aauauuaccaaaaa

SEQ ID NO: 1113419 - RNA, 11 nt, Homo sapiens
aauauucaaua

SEQ ID NO: 1113420 - RNA, 18 nt, Homo sapiens
aauauuuauauauuugaa

SEQ ID NO: 1113421 - RNA, 20 nt, Homo sapiens
aauauuuauuauuuucaccu

SEQ ID NO: 1113422 - RNA, 17 nt, Homo sapiens
aauauuugcaagacaua

SEQ ID NO: 1113423 - RNA, 18 nt, Homo sapiens
aauauuuuaagacuauaa

SEQ ID NO: 1113424 - RNA, 13 nt, Homo sapiens
aaucaaauagcau

SEQ ID NO: 1113425 - RNA, 17 nt, Homo sapiens
aaucaauguucacgcaa

SEQ ID NO: 1113426 - RNA, 22 nt, Homo sapiens
aaucaggcugaggugucuuaag

SEQ ID NO: 1113427 - RNA, 22 nt, Homo sapiens
aaucauaugguugacaguaugc

SEQ ID NO: 1113428 - RNA, 22 nt, Homo sapiens
aaucaugagauccuuuaaaucc

SEQ ID NO: 1113429 - RNA, 16 nt, Homo sapiens
aaucauuuaaauauua

SEQ ID NO: 1113430 - RNA, 16 nt, Homo sapiens
aaucauuuugccucuu

SEQ ID NO: 1113431 - RNA, 20 nt, Homo sapiens
aauccaacccaugaugagcu

SEQ ID NO: 1113432 - RNA, 19 nt, Homo sapiens
aauccagagauaauugcca

SEQ ID NO: 1113433 - RNA, 17 nt, Homo sapiens
aaucccacccacaugug

SEQ ID NO: 1113434 - RNA, 14 nt, Homo sapiens
aaucccagcacuuu

SEQ ID NO: 1113435 - RNA, 16 nt, Homo sapiens
aaucccagcuacucaa

SEQ ID NO: 1113436 - RNA, 15 nt, Homo sapiens
aaucccagcuacuug

SEQ ID NO: 1113437 - RNA, 14 nt, Homo sapiens
aaucccgugaaaga

SEQ ID NO: 1113438 - RNA, 17 nt, Homo sapiens
aauccuauuaaaacaca

SEQ ID NO: 1113439 - RNA, 12 nt, Homo sapiens
agggcacugggu

SEQ ID NO: 1113440 - RNA, 18 nt, Homo sapiens
agggccaagcaccuagcc

SEQ ID NO: 1113441 - RNA, 10 nt, Homo sapiens
agggccaguc

SEQ ID NO: 1113442 - RNA, 13 nt, Homo sapiens
agggcugccugaa

SEQ ID NO: 1113443 - RNA, 21 nt, Homo sapiens
aggggaccacaccucccugaa

SEQ ID NO: 1113444 - RNA, 20 nt, Homo sapiens
agggggguugugaggccugg

SEQ ID NO: 1113445 - RNA, 21 nt, Homo sapiens
aggguaccuugaacacugggg

SEQ ID NO: 1113446 - RNA, 19 nt, Homo sapiens
agggucaggcggggugcug

SEQ ID NO: 1113447 - RNA, 14 nt, Homo sapiens
agggucuggcuguc

SEQ ID NO: 1113448 - RNA, 13 nt, Homo sapiens
aggguggugaccu

SEQ ID NO: 1113449 - RNA, 19 nt, Homo sapiens
aggguugggcuggugucac

SEQ ID NO: 1113450 - RNA, 23 nt, Homo sapiens
aggguuggguucaucugagcaag

SEQ ID NO: 1113451 - RNA, 23 nt, Homo sapiens
agguaauccuauuaaaacacagc

SEQ ID NO: 1113452 - RNA, 22 nt, Homo sapiens
agguacagcaacaggaaucuca

SEQ ID NO: 1113453 - RNA, 20 nt, Homo sapiens
agguagcccagcacugugaa

SEQ ID NO: 1113454 - RNA, 18 nt, Homo sapiens
agguagcuuuagggcaau

SEQ ID NO: 1113455 - RNA, 18 nt, Homo sapiens
aggucacauugugccuuu

SEQ ID NO: 1113456 - RNA, 22 nt, Homo sapiens
aggucagagccugcaguuauua

SEQ ID NO: 1113457 - RNA, 15 nt, Homo sapiens
aggucaggaguucga

SEQ ID NO: 1113458 - RNA, 16 nt, Homo sapiens
agguccucaguguccu

SEQ ID NO: 1113459 - RNA, 13 nt, Homo sapiens
agguccucuacuu

SEQ ID NO: 1113460 - RNA, 15 nt, Homo sapiens
aggucucugaacuca

SEQ ID NO: 1113461 - RNA, 16 nt, Homo sapiens
aggucugaaauggagg

SEQ ID NO: 1113462 - RNA, 15 nt, Homo sapiens
aggucuugccugaau

SEQ ID NO: 1113463 - RNA, 21 nt, Homo sapiens
aggucuugccugaauccauca

SEQ ID NO: 1113464 - RNA, 13 nt, Homo sapiens
aggugacagagug

SEQ ID NO: 1113465 - RNA, 15 nt, Homo sapiens
aggugaccccagggc

SEQ ID NO: 1113466 - RNA, 16 nt, Homo sapiens
aggugauccacccacc

SEQ ID NO: 1113467 - RNA, 18 nt, Homo sapiens
aggugaugguaacugcac

SEQ ID NO: 1113468 - RNA, 15 nt, Homo sapiens
aggugcccaggagaa

SEQ ID NO: 1113469 - RNA, 14 nt, Homo sapiens
aggugcugacaaag

SEQ ID NO: 1113470 - RNA, 13 nt, Homo sapiens
agguggcucucca

SEQ ID NO: 1113471 - RNA, 16 nt, Homo sapiens
aggugggaaaugguau

SEQ ID NO: 1113472 - RNA, 19 nt, Homo sapiens
aggugggaucacuaaggga

SEQ ID NO: 1113473 - RNA, 17 nt, Homo sapiens
aggugggcagcagcuca

SEQ ID NO: 1113474 - RNA, 19 nt, Homo sapiens
agguggugggggcagggau

SEQ ID NO: 1113475 - RNA, 17 nt, Homo sapiens
aggugucuuaagccuuu

SEQ ID NO: 1113476 - RNA, 21 nt, Homo sapiens
agguuacccuguaacaugcaa

SEQ ID NO: 1113477 - RNA, 12 nt, Homo sapiens
agguuccaguga

SEQ ID NO: 1113478 - RNA, 14 nt, Homo sapiens
agguucuguguguc

SEQ ID NO: 1113479 - RNA, 18 nt, Homo sapiens
agguucuuagugucacuu

SEQ ID NO: 1113480 - RNA, 19 nt, Homo sapiens
agguucuuagugucacuua

SEQ ID NO: 1113481 - RNA, 13 nt, Homo sapiens
agguuuacauuca

SEQ ID NO: 1113482 - RNA, 19 nt, Homo sapiens
agguuuccuuccuucgcag

SEQ ID NO: 1113483 - RNA, 20 nt, Homo sapiens
agguuuuaugaaaagaauaa

SEQ ID NO: 1113484 - RNA, 14 nt, Homo sapiens
aguaacaguuguga

SEQ ID NO: 1113485 - RNA, 22 nt, Homo sapiens
agauggcugugccucugccugu

SEQ ID NO: 1113486 - RNA, 18 nt, Homo sapiens
agaugguggugagcacau

SEQ ID NO: 1113487 - RNA, 22 nt, Homo sapiens
agauguaagguaauuucugugu

SEQ ID NO: 1113488 - RNA, 18 nt, Homo sapiens
agaugugaugcugguacc

SEQ ID NO: 1113489 - RNA, 15 nt, Homo sapiens
agauuagcucuggac

SEQ ID NO: 1113490 - RNA, 16 nt, Homo sapiens
agauuauuaagggaau

SEQ ID NO: 1113491 - RNA, 22 nt, Homo sapiens
agauucaaacucaaugaugcua

SEQ ID NO: 1113492 - RNA, 13 nt, Homo sapiens
agauucccucucc

SEQ ID NO: 1113493 - RNA, 18 nt, Homo sapiens
agauucccucuuccugcc

SEQ ID NO: 1113494 - RNA, 18 nt, Homo sapiens
agauucuccaaaugauuu

SEQ ID NO: 1113495 - RNA, 17 nt, Homo sapiens
agauugcgccacugcac

SEQ ID NO: 1113496 - RNA, 17 nt, Homo sapiens
agauuggcucccaacuc

SEQ ID NO: 1113497 - RNA, 15 nt, Homo sapiens
agauuuaacacuaaa

SEQ ID NO: 1113498 - RNA, 20 nt, Homo sapiens
agauuuauguaaugcuuuau

SEQ ID NO: 1113499 - RNA, 21 nt, Homo sapiens
agauuucaaaguuaauuuucc

SEQ ID NO: 1113500 - RNA, 15 nt, Homo sapiens
agauuucaacauauc

SEQ ID NO: 1113501 - RNA, 20 nt, Homo sapiens
agauuuucauguucuugcag

SEQ ID NO: 1113502 - RNA, 20 nt, Homo sapiens
agauuuuuacacauguaucu

SEQ ID NO: 1113503 - RNA, 18 nt, Homo sapiens
agcaaaacuccaucucaa

SEQ ID NO: 1113504 - RNA, 17 nt, Homo sapiens
agcaaauaaagaccuga

SEQ ID NO: 1113505 - RNA, 22 nt, Homo sapiens
agcaaaucuacuucaacacuuc

SEQ ID NO: 1113506 - RNA, 20 nt, Homo sapiens
agcaaauguuucugcaguag

SEQ ID NO: 1113507 - RNA, 18 nt, Homo sapiens
agcaacaggaaucucaga

SEQ ID NO: 1113508 - RNA, 22 nt, Homo sapiens
agcaaccguggcccuuccugga

SEQ ID NO: 1113509 - RNA, 14 nt, Homo sapiens
agcaacugugcuac

SEQ ID NO: 1113510 - RNA, 19 nt, Homo sapiens
agcaagacuucucuuugcc

SEQ ID NO: 1113511 - RNA, 19 nt, Homo sapiens
agcacaauuuauauuuucc

SEQ ID NO: 1113512 - RNA, 18 nt, Homo sapiens
agcaccuacuuacaugca

SEQ ID NO: 1113513 - RNA, 19 nt, Homo sapiens
agcaccuacuuacaugcau

SEQ ID NO: 1113514 - RNA, 21 nt, Homo sapiens
agcaccuacuuacaugcauua

SEQ ID NO: 1113515 - RNA, 15 nt, Homo sapiens
agcacuaaagcagug

SEQ ID NO: 1113516 - RNA, 23 nt, Homo sapiens
agcacuaauucaacauauaccuu

SEQ ID NO: 1113517 - RNA, 14 nt, Homo sapiens
agcacucuacugca

SEQ ID NO: 1113518 - RNA, 12 nt, Homo sapiens
agcacuggguug

SEQ ID NO: 1113519 - RNA, 14 nt, Homo sapiens
agcacuuaauaauu

SEQ ID NO: 1113520 - RNA, 22 nt, Homo sapiens
agcacuuuaacccucucuuccc

SEQ ID NO: 1113521 - RNA, 22 nt, Homo sapiens
agcacuuucccucuuggugccu

SEQ ID NO: 1113522 - RNA, 13 nt, Homo sapiens
agcagaaagccag

SEQ ID NO: 1113523 - RNA, 14 nt, Homo sapiens
agcagagugauuca

SEQ ID NO: 1113524 - RNA, 12 nt, Homo sapiens
agcagaugcaau

SEQ ID NO: 1113525 - RNA, 21 nt, Homo sapiens
agcagaugcaaucucuugucu

SEQ ID NO: 1113526 - RNA, 18 nt, Homo sapiens
agcagcccuaaggaucuc

SEQ ID NO: 1113527 - RNA, 21 nt, Homo sapiens
agcagcucuuccccuuuccug

SEQ ID NO: 1113528 - RNA, 18 nt, Homo sapiens
agacaccuugacagggca

SEQ ID NO: 1113529 - RNA, 18 nt, Homo sapiens
agacacuucauggaccaa

SEQ ID NO: 1113530 - RNA, 18 nt, Homo sapiens
agacagauuaccaaagaa

SEQ ID NO: 1113531 - RNA, 18 nt, Homo sapiens
agacaggucuagacuuuc

SEQ ID NO: 1113532 - RNA, 19 nt, Homo sapiens
agacaggucuagacuuucu

SEQ ID NO: 1113533 - RNA, 19 nt, Homo sapiens
agacaguguuuucugggau

SEQ ID NO: 1113534 - RNA, 18 nt, Homo sapiens
agacauggaauuaccuua

SEQ ID NO: 1113535 - RNA, 18 nt, Homo sapiens
agacauggagacuccugc

SEQ ID NO: 1113536 - RNA, 23 nt, Homo sapiens
agacauuaacucauuagacugga

SEQ ID NO: 1113537 - RNA, 12 nt, Homo sapiens
agaccaaaauaa

SEQ ID NO: 1113538 - RNA, 22 nt, Homo sapiens
agaccaaggcgggagcaucucu

SEQ ID NO: 1113539 - RNA, 18 nt, Homo sapiens
agaccagcccagccaaca

SEQ ID NO: 1113540 - RNA, 14 nt, Homo sapiens
agaccauaauguua

SEQ ID NO: 1113541 - RNA, 16 nt, Homo sapiens
agacccugaagauuuc

SEQ ID NO: 1113542 - RNA, 16 nt, Homo sapiens
agaccuaggauuucau

SEQ ID NO: 1113543 - RNA, 15 nt, Homo sapiens
agaccugacugccug

SEQ ID NO: 1113544 - RNA, 15 nt, Homo sapiens
agaccugagaaccuu

SEQ ID NO: 1113545 - RNA, 19 nt, Homo sapiens
agaccuucugaagaucuca

SEQ ID NO: 1113546 - RNA, 15 nt, Homo sapiens
agacuacagccagaa

SEQ ID NO: 1113547 - RNA, 20 nt, Homo sapiens
agacuaguugaacaucucac

SEQ ID NO: 1113548 - RNA, 21 nt, Homo sapiens
agacuaucuuacuauuucaca

SEQ ID NO: 1113549 - RNA, 14 nt, Homo sapiens
agacucugucucaa

SEQ ID NO: 1113550 - RNA, 19 nt, Homo sapiens
agacugaagauggaaaaag

SEQ ID NO: 1113551 - RNA, 19 nt, Homo sapiens
agacugcugggacuggcca

SEQ ID NO: 1113552 - RNA, 15 nt, Homo sapiens
agacuggaagcacag

SEQ ID NO: 1113553 - RNA, 18 nt, Homo sapiens
agacuggagcaucugacu

SEQ ID NO: 1113554 - RNA, 21 nt, Homo sapiens
agacuuaaauaguucaguaua

SEQ ID NO: 1113555 - RNA, 16 nt, Homo sapiens
agacuucgacucagga

SEQ ID NO: 1113556 - RNA, 19 nt, Homo sapiens
agacuuggggaaauugcuu

SEQ ID NO: 1113557 - RNA, 15 nt, Homo sapiens
agacuuuuaucaaaa

SEQ ID NO: 1113558 - RNA, 16 nt, Homo sapiens
agagaaaaaccaauga

SEQ ID NO: 1113559 - RNA, 21 nt, Homo sapiens
agagaaaccuccggugugaga

SEQ ID NO: 1113560 - RNA, 14 nt, Homo sapiens
agagaaauuugcca

SEQ ID NO: 1113561 - RNA, 12 nt, Homo sapiens
agagaaccauga

SEQ ID NO: 1113562 - RNA, 13 nt, Homo sapiens
agagaacuggagg

SEQ ID NO: 1113563 - RNA, 14 nt, Homo sapiens
agagaaucauacuu

SEQ ID NO: 1113564 - RNA, 13 nt, Homo sapiens
agagaaucugaag

SEQ ID NO: 1113565 - RNA, 12 nt, Homo sapiens
agagacaucaaa

SEQ ID NO: 1113566 - RNA, 23 nt, Homo sapiens
agagaccuugcgaccauguguag

SEQ ID NO: 1113567 - RNA, 13 nt, Homo sapiens
agagacuggagca

SEQ ID NO: 1113568 - RNA, 19 nt, Homo sapiens
agagacuggagcaucugac

SEQ ID NO: 1113569 - RNA, 13 nt, Homo sapiens
agagaggaagagc

SEQ ID NO: 1113570 - RNA, 19 nt, Homo sapiens
agagaggugggcagcagcu

SEQ ID NO: 1113571 - RNA, 16 nt, Homo sapiens
agagaguccucuggau

SEQ ID NO: 1113572 - RNA, 19 nt, Homo sapiens
agagaucacaauacucaaa

SEQ ID NO: 1113573 - RNA, 20 nt, Homo sapiens
aaaacugccuuuuaucugcc

SEQ ID NO: 1113574 - RNA, 17 nt, Homo sapiens
aaaacuugcugccugaa

SEQ ID NO: 1113575 - RNA, 16 nt, Homo sapiens
aaaagaauacagaaag

SEQ ID NO: 1113576 - RNA, 15 nt, Homo sapiens
aaaagaccaguccau

SEQ ID NO: 1113577 - RNA, 17 nt, Homo sapiens
aaaagagagaucuugau

SEQ ID NO: 1113578 - RNA, 15 nt, Homo sapiens
aaaagauuauauauc

SEQ ID NO: 1113579 - RNA, 22 nt, Homo sapiens
aaaagauucccacccaauucaa

SEQ ID NO: 1113580 - RNA, 17 nt, Homo sapiens
aaaagauuuaaguaauu

SEQ ID NO: 1113581 - RNA, 18 nt, Homo sapiens
aaaagauuuguuuuguca

SEQ ID NO: 1113582 - RNA, 13 nt, Homo sapiens
aaaagcaccugcc

SEQ ID NO: 1113583 - RNA, 21 nt, Homo sapiens
aaaagcuuuucuuuccuuuug

SEQ ID NO: 1113584 - RNA, 20 nt, Homo sapiens
aaaaggucauagcugagauu

SEQ ID NO: 1113585 - RNA, 15 nt, Homo sapiens
aaaagguuauauacc

SEQ ID NO: 1113586 - RNA, 14 nt, Homo sapiens
aaaaguauauauuc

SEQ ID NO: 1113587 - RNA, 20 nt, Homo sapiens
aaaaguguuauuauuuggca

SEQ ID NO: 1113588 - RNA, 16 nt, Homo sapiens
aaaaguuauguagaaa

SEQ ID NO: 1113589 - RNA, 12 nt, Homo sapiens
aaaauaacuuau

SEQ ID NO: 1113590 - RNA, 14 nt, Homo sapiens
aaaauaauuguucc

SEQ ID NO: 1113591 - RNA, 19 nt, Homo sapiens
aaaauagaauguuacuuug

SEQ ID NO: 1113592 - RNA, 17 nt, Homo sapiens
aaaauagccacuuaccu

SEQ ID NO: 1113593 - RNA, 20 nt, Homo sapiens
aaaauagcuaaauaccucaa

SEQ ID NO: 1113594 - RNA, 15 nt, Homo sapiens
aaaauagcucuuuca

SEQ ID NO: 1113595 - RNA, 21 nt, Homo sapiens
aaaauauauuucagauaucag

SEQ ID NO: 1113596 - RNA, 19 nt, Homo sapiens
aaaaugaaagcaugucuca

SEQ ID NO: 1113597 - RNA, 22 nt, Homo sapiens
aaaaugagguucaacuguugau

SEQ ID NO: 1113598 - RNA, 18 nt, Homo sapiens
aaaaugaugggacaauaa

SEQ ID NO: 1113599 - RNA, 18 nt, Homo sapiens
aaaaugcauauacuuuaa

SEQ ID NO: 1113600 - RNA, 11 nt, Homo sapiens
aaaauggacau

SEQ ID NO: 1113601 - RNA, 18 nt, Homo sapiens
aaaaugguaauuguugcu

SEQ ID NO: 1113602 - RNA, 14 nt, Homo sapiens
aaaauuaugccaua

SEQ ID NO: 1113603 - RNA, 17 nt, Homo sapiens
aaaauucagagaguuag

SEQ ID NO: 1113604 - RNA, 20 nt, Homo sapiens
aaaauucuugggaguguugu

SEQ ID NO: 1113605 - RNA, 13 nt, Homo sapiens
aaaauugauauac

SEQ ID NO: 1113606 - RNA, 9 nt, Homo sapiens
aaaauugca

SEQ ID NO: 1113607 - RNA, 12 nt, Homo sapiens
aaaauugcacaa

SEQ ID NO: 1113608 - RNA, 21 nt, Homo sapiens
aaaauuuaggaccaauaccuc

SEQ ID NO: 1113609 - RNA, 18 nt, Homo sapiens
aaaauuugaaauuuagcu

SEQ ID NO: 1113610 - RNA, 15 nt, Homo sapiens
aaacaacuaccuccu

SEQ ID NO: 1113611 - RNA, 14 nt, Homo sapiens
aaacaaguauuugu

SEQ ID NO: 1113612 - RNA, 20 nt, Homo sapiens
aaacacccaugaaucaaaga

SEQ ID NO: 1113613 - RNA, 14 nt, Homo sapiens
aaacacccaugccc

SEQ ID NO: 1113614 - RNA, 15 nt, Homo sapiens
aaacacgugucuaua

SEQ ID NO: 1113615 - RNA, 20 nt, Homo sapiens
aaacagaaagcauccuaaau

SEQ ID NO: 1113616 - RNA, 22 nt, Homo sapiens
aaacagagacaggcccaagaga

SEQ ID NO: 1113617 - RNA, 14 nt, Homo sapiens
aaacagcucugugu

SEQ ID NO: 1113618 - RNA, 19 nt, Homo sapiens
aaacagguggagaaauucc

SEQ ID NO: 1113619 - RNA, 15 nt, Homo sapiens
aaacauauguauaca

SEQ ID NO: 1113620 - RNA, 17 nt, Homo sapiens
aaacauauguauacaaa

SEQ ID NO: 1113621 - RNA, 22 nt, Homo sapiens
aaacauguggcaaccuguucuu

SEQ ID NO: 1113622 - RNA, 14 nt, Homo sapiens
aaaccagagucaaa

SEQ ID NO: 1113623 - RNA, 15 nt, Homo sapiens
aaaccagcgcaagga

SEQ ID NO: 1113624 - RNA, 20 nt, Homo sapiens
aaaccaucaaaaauauucca

SEQ ID NO: 1113625 - RNA, 22 nt, Homo sapiens
aaaccugauguuaaaauuccau

SEQ ID NO: 1113626 - RNA, 13 nt, Homo sapiens
aaaccuucaguga

SEQ ID NO: 1113627 - RNA, 18 nt, Homo sapiens
aaacgguaauacgugaaa

SEQ ID NO: 1113628 - RNA, 15 nt, Homo sapiens
aaacuaaaaagccau

SEQ ID NO: 1113629 - RNA, 20 nt, Homo sapiens
aaacucuugaccucagguga

SEQ ID NO: 1113630 - RNA, 18 nt, Homo sapiens
aaacugguuuagcacaau

SEQ ID NO: 1113631 - RNA, 15 nt, Homo sapiens
aaacuucauggucau

SEQ ID NO: 1113632 - RNA, 20 nt, Homo sapiens
aaacuuccuaaugauuagca

SEQ ID NO: 1113633 - RNA, 17 nt, Homo sapiens
aaacuuuggcuuauaaa

SEQ ID NO: 1113634 - RNA, 15 nt, Homo sapiens
aaagaaagaaggaag

SEQ ID NO: 1113635 - RNA, 12 nt, Homo sapiens
aaagaaaugcau

SEQ ID NO: 1113636 - RNA, 14 nt, Homo sapiens
aaagaagauuuugc

SEQ ID NO: 1113637 - RNA, 22 nt, Homo sapiens
aaagaagauuuugccacauuug

SEQ ID NO: 1113638 - RNA, 15 nt, Homo sapiens
aaagaaggacacuug

SEQ ID NO: 1113639 - RNA, 19 nt, Homo sapiens
aaagaagucauggcccaaa

SEQ ID NO: 1113640 - RNA, 14 nt, Homo sapiens
aaagaauacagaaa

SEQ ID NO: 1113641 - RNA, 20 nt, Homo sapiens
aaagacaaaacuuccuguuu

SEQ ID NO: 1113642 - RNA, 21 nt, Homo sapiens
aaagagacuggagcaucugac

SEQ ID NO: 1113643 - RNA, 16 nt, Homo sapiens
aaagagggagugcauu

SEQ ID NO: 1113644 - RNA, 22 nt, Homo sapiens
aaagaguccuauuugcacugua

SEQ ID NO: 1113645 - RNA, 17 nt, Homo sapiens
aaagauuuguuuuguca

SEQ ID NO: 1113646 - RNA, 16 nt, Homo sapiens
aaagcaagacagauua

SEQ ID NO: 1113647 - RNA, 12 nt, Homo sapiens
aaagcaccugcc

SEQ ID NO: 1113648 - RNA, 12 nt, Homo sapiens
aaagcacuguuu

SEQ ID NO: 1113649 - RNA, 18 nt, Homo sapiens
aaagcacuguuucucuca

SEQ ID NO: 1113650 - RNA, 19 nt, Homo sapiens
aaagcagguggcaucucua

SEQ ID NO: 1113651 - RNA, 15 nt, Homo sapiens
aaagcauuugcugug

SEQ ID NO: 1113652 - RNA, 16 nt, Homo sapiens
aaagcccagcucuuug

SEQ ID NO: 1113653 - RNA, 18 nt, Homo sapiens
aaagcccccacuucucuc

SEQ ID NO: 1113654 - RNA, 15 nt, Homo sapiens
aaagcccuugaacca

SEQ ID NO: 1113655 - RNA, 17 nt, Homo sapiens
aaagcccuugaaccagc

SEQ ID NO: 1113656 - RNA, 14 nt, Homo sapiens
aaagccucuggaaa

SEQ ID NO: 1113657 - RNA, 12 nt, Homo sapiens
aaagcuaccugu

SEQ ID NO: 1113658 - RNA, 13 nt, Homo sapiens
aaagcugccugua

SEQ ID NO: 1113659 - RNA, 17 nt, Homo sapiens
aaagcugcugacagugu

SEQ ID NO: 1113660 - RNA, 23 nt, Homo sapiens
aaagcuugucugaucguucaaag

SEQ ID NO: 1113661 - RNA, 22 nt, Homo sapiens
aaaggagccugugaacccagga

SEQ ID NO: 1113662 - RNA, 18 nt, Homo sapiens
aacagacguuaccaauua

SEQ ID NO: 1113663 - RNA, 16 nt, Homo sapiens
aacagagaacccugug

SEQ ID NO: 1113664 - RNA, 11 nt, Homo sapiens
aacagagccuu

SEQ ID NO: 1113665 - RNA, 21 nt, Homo sapiens
aacagauggauagucugucca

SEQ ID NO: 1113666 - RNA, 13 nt, Homo sapiens
aacagcauaacua

SEQ ID NO: 1113667 - RNA, 23 nt, Homo sapiens
aacagcucccuaguggcuuccuc

SEQ ID NO: 1113668 - RNA, 16 nt, Homo sapiens
aacaguaacugccauc

SEQ ID NO: 1113669 - RNA, 20 nt, Homo sapiens
aacaguuccuucagcuucca

SEQ ID NO: 1113670 - RNA, 18 nt, Homo sapiens
aacauaccagaccacucu

SEQ ID NO: 1113671 - RNA, 12 nt, Homo sapiens
aacauagacaga

SEQ ID NO: 1113672 - RNA, 15 nt, Homo sapiens
aacauaucaauucaa

SEQ ID NO: 1113673 - RNA, 20 nt, Homo sapiens
aacaucacugaaaugcuagc

SEQ ID NO: 1113674 - RNA, 21 nt, Homo sapiens
aacaucacugaaaugcuagcu

SEQ ID NO: 1113675 - RNA, 22 nt, Homo sapiens
aacaucaucaggcuuggaauga

SEQ ID NO: 1113676 - RNA, 17 nt, Homo sapiens
aacauuccaaugcauug

SEQ ID NO: 1113677 - RNA, 18 nt, Homo sapiens
aacauugauuauaagcau

SEQ ID NO: 1113678 - RNA, 11 nt, Homo sapiens
aaccacugugg

SEQ ID NO: 1113679 - RNA, 18 nt, Homo sapiens
aaccacuucauucuugaa

SEQ ID NO: 1113680 - RNA, 13 nt, Homo sapiens
aaccagagcagga

SEQ ID NO: 1113681 - RNA, 15 nt, Homo sapiens
aaccauaaacuucau

SEQ ID NO: 1113682 - RNA, 15 nt, Homo sapiens
aaccaucccugaugu

SEQ ID NO: 1113683 - RNA, 14 nt, Homo sapiens
aaccaugguaugaa

SEQ ID NO: 1113684 - RNA, 11 nt, Homo sapiens
aacccaaauaa

SEQ ID NO: 1113685 - RNA, 15 nt, Homo sapiens
aacccaccagccuaa

SEQ ID NO: 1113686 - RNA, 19 nt, Homo sapiens
aacccgugccaaguccagg

SEQ ID NO: 1113687 - RNA, 18 nt, Homo sapiens
aacccugccccacuucuc

SEQ ID NO: 1113688 - RNA, 19 nt, Homo sapiens
aacccuguauggcacuuau

SEQ ID NO: 1113689 - RNA, 19 nt, Homo sapiens
aaccgcuugccauauuccg

SEQ ID NO: 1113690 - RNA, 20 nt, Homo sapiens
aaccgcuugccauauuccga

SEQ ID NO: 1113691 - RNA, 22 nt, Homo sapiens
aaccuagccuuagaagucacac

SEQ ID NO: 1113692 - RNA, 17 nt, Homo sapiens
aaccucaagcugcaucu

SEQ ID NO: 1113693 - RNA, 21 nt, Homo sapiens
aaccucaugacagccagagcc

SEQ ID NO: 1113694 - RNA, 14 nt, Homo sapiens
aaccucauuuacca

SEQ ID NO: 1113695 - RNA, 13 nt, Homo sapiens
aaccugcucuccu

SEQ ID NO: 1113696 - RNA, 20 nt, Homo sapiens
aaccugggaaccaugaagcu

SEQ ID NO: 1113697 - RNA, 14 nt, Homo sapiens
aaccugugugccau

SEQ ID NO: 1113698 - RNA, 23 nt, Homo sapiens
aaccuuugagacuauugagauau

SEQ ID NO: 1113699 - RNA, 14 nt, Homo sapiens
aacguaaauacaca

SEQ ID NO: 1113700 - RNA, 14 nt, Homo sapiens
aacuaaaaagccau

SEQ ID NO: 1113701 - RNA, 17 nt, Homo sapiens
aacuagaauuuauucaa

SEQ ID NO: 1113702 - RNA, 18 nt, Homo sapiens
aacuagcuuggaaacugg

SEQ ID NO: 1113703 - RNA, 13 nt, Homo sapiens
aacuauaagcaag

SEQ ID NO: 1113704 - RNA, 14 nt, Homo sapiens
aacuauaagcaaga

SEQ ID NO: 1113705 - RNA, 19 nt, Homo sapiens
aacuauaagcaugaucuug

SEQ ID NO: 1113706 - RNA, 17 nt, Homo sapiens
aacuauuacaccaaaua

SEQ ID NO: 1113707 - RNA, 21 nt, Homo sapiens
aacuauuggagggugggagag

SEQ ID NO: 1113708 - RNA, 14 nt, Homo sapiens
aacuauuuauuuca

SEQ ID NO: 1113709 - RNA, 11 nt, Homo sapiens
aacucaauauu

SEQ ID NO: 1113710 - RNA, 19 nt, Homo sapiens
aacucaauauuuuccauga

SEQ ID NO: 1113711 - RNA, 20 nt, Homo sapiens
aacucaauauuuuccaugaa

SEQ ID NO: 1113712 - RNA, 15 nt, Homo sapiens
aacucaucugucacc

SEQ ID NO: 1113713 - RNA, 18 nt, Homo sapiens
aacuccccuuguacucuu

SEQ ID NO: 1113714 - RNA, 12 nt, Homo sapiens
aacucucuaggg

SEQ ID NO: 1113715 - RNA, 16 nt, Homo sapiens
aacucugccagccaca

SEQ ID NO: 1113716 - RNA, 17 nt, Homo sapiens
aacucuucuacuuucau

SEQ ID NO: 1113717 - RNA, 14 nt, Homo sapiens
aacucuugaccuca

SEQ ID NO: 1113718 - RNA, 19 nt, Homo sapiens
aacugaggccauuauuuca

SEQ ID NO: 1113719 - RNA, 17 nt, Homo sapiens
aacugcccaaggcaugu

SEQ ID NO: 1113720 - RNA, 17 nt, Homo sapiens
aacuggaauccuuucag

SEQ ID NO: 1113721 - RNA, 18 nt, Homo sapiens
aacuggccaagcugaggu

SEQ ID NO: 1113722 - RNA, 17 nt, Homo sapiens
aacugguuuagcacaau

SEQ ID NO: 1113723 - RNA, 12 nt, Homo sapiens
aacugucucuca

SEQ ID NO: 1113724 - RNA, 15 nt, Homo sapiens
aacuguggucaaucc

SEQ ID NO: 1113725 - RNA, 21 nt, Homo sapiens
aacugugugcagacucaauaa

SEQ ID NO: 1113726 - RNA, 20 nt, Homo sapiens
aacuguugauugcaggaaua

SEQ ID NO: 1113727 - RNA, 15 nt, Homo sapiens
aacuuaaaucacuga

SEQ ID NO: 1113728 - RNA, 22 nt, Homo sapiens
aacuuaagcugggauaaucaca

SEQ ID NO: 1113729 - RNA, 14 nt, Homo sapiens
aacuuauaucauca

SEQ ID NO: 1113730 - RNA, 12 nt, Homo sapiens
aacuucuuguug

SEQ ID NO: 1113731 - RNA, 15 nt, Homo sapiens
aacuugaacugauuc

SEQ ID NO: 1113732 - RNA, 20 nt, Homo sapiens
aacuugaggacacaugucca

SEQ ID NO: 1113733 - RNA, 23 nt, Homo sapiens
aacuugaggacacauguccagug

SEQ ID NO: 1113734 - RNA, 21 nt, Homo sapiens
aacuugggggaccucauuccu

SEQ ID NO: 1113735 - RNA, 18 nt, Homo sapiens
aacuugggggaggaggaa

SEQ ID NO: 1113736 - RNA, 17 nt, Homo sapiens
aacuuguaucugaagac

SEQ ID NO: 1113737 - RNA, 13 nt, Homo sapiens
aacuuguccuaug

SEQ ID NO: 1113738 - RNA, 15 nt, Homo sapiens
aacuuuugugcuccc

SEQ ID NO: 1113739 - RNA, 13 nt, Homo sapiens
aagaaaaccagcg

SEQ ID NO: 1113740 - RNA, 14 nt, Homo sapiens
aagaaaacuggaaa

SEQ ID NO: 1113741 - RNA, 22 nt, Homo sapiens
aagaaaccuucagauuuguguu

SEQ ID NO: 1113742 - RNA, 22 nt, Homo sapiens
aagaaauuccuguagcaucuuc

SEQ ID NO: 1113743 - RNA, 15 nt, Homo sapiens
aagaaccaguguuua

SEQ ID NO: 1113744 - RNA, 13 nt, Homo sapiens
aagaagaccagac

SEQ ID NO: 1113745 - RNA, 16 nt, Homo sapiens
aagaagaguuugcaaa

SEQ ID NO: 1113746 - RNA, 14 nt, Homo sapiens
aagaaguugcucug

SEQ ID NO: 1113747 - RNA, 16 nt, Homo sapiens
aagaaugacuaugcaa

SEQ ID NO: 1113748 - RNA, 22 nt, Homo sapiens
aagaauuuuuuuuaacauucca

SEQ ID NO: 1113749 - RNA, 13 nt, Homo sapiens
aagacaaagcaaa

SEQ ID NO: 1113750 - RNA, 17 nt, Homo sapiens
aagacaaagcaaagcca

SEQ ID NO: 1113751 - RNA, 21 nt, Homo sapiens
aagacauuaccaugaguaaua

SEQ ID NO: 1113752 - RNA, 15 nt, Homo sapiens
aaaggcucagucuca

SEQ ID NO: 1113753 - RNA, 16 nt, Homo sapiens
aaagggauaguccaaa

SEQ ID NO: 1113754 - RNA, 16 nt, Homo sapiens
aaagguuacccuguaa

SEQ ID NO: 1113755 - RNA, 22 nt, Homo sapiens
aaagguugacaauaaaugugcu

SEQ ID NO: 1113756 - RNA, 14 nt, Homo sapiens
aaaguagcaauuuc

SEQ ID NO: 1113757 - RNA, 22 nt, Homo sapiens
aaaguaugccuuccuguuuaaa

SEQ ID NO: 1113758 - RNA, 12 nt, Homo sapiens
aaagugcugcug

SEQ ID NO: 1113759 - RNA, 11 nt, Homo sapiens
aaagugcugua

SEQ ID NO: 1113760 - RNA, 17 nt, Homo sapiens
aaaguguugaccacaga

SEQ ID NO: 1113761 - RNA, 18 nt, Homo sapiens
aaaguuagguuauaagaa

SEQ ID NO: 1113762 - RNA, 17 nt, Homo sapiens
aaauaaaaacacuuaaa

SEQ ID NO: 1113763 - RNA, 14 nt, Homo sapiens
aaauaaaaauauuc

SEQ ID NO: 1113764 - RNA, 13 nt, Homo sapiens
aaauaaaaauucc

SEQ ID NO: 1113765 - RNA, 13 nt, Homo sapiens
aaauaaaugccaa

SEQ ID NO: 1113766 - RNA, 20 nt, Homo sapiens
aaauaagagaaaaaauuaaa

SEQ ID NO: 1113767 - RNA, 13 nt, Homo sapiens
aaauaaucugaca

SEQ ID NO: 1113768 - RNA, 12 nt, Homo sapiens
aaauaaugauuu

SEQ ID NO: 1113769 - RNA, 13 nt, Homo sapiens
aaauacauaccua

SEQ ID NO: 1113770 - RNA, 17 nt, Homo sapiens
aaauaccagugaaccaa

SEQ ID NO: 1113771 - RNA, 17 nt, Homo sapiens
aaauacccacuaacaaa

SEQ ID NO: 1113772 - RNA, 19 nt, Homo sapiens
aaauacccacuaacaaaga

SEQ ID NO: 1113773 - RNA, 11 nt, Homo sapiens
aaauacuucua

SEQ ID NO: 1113774 - RNA, 17 nt, Homo sapiens
aaauagcaaaagaagaa

SEQ ID NO: 1113775 - RNA, 23 nt, Homo sapiens
aaauagcaucugcucuucucuua

SEQ ID NO: 1113776 - RNA, 14 nt, Homo sapiens
aaauagucuaucaa

SEQ ID NO: 1113777 - RNA, 13 nt, Homo sapiens
aaauaguuuuaaa

SEQ ID NO: 1113778 - RNA, 18 nt, Homo sapiens
aaauauaaucuaauacac

SEQ ID NO: 1113779 - RNA, 18 nt, Homo sapiens
aaauaugcaccaaaucau

SEQ ID NO: 1113780 - RNA, 20 nt, Homo sapiens
aaauauuauugguguuuacc

SEQ ID NO: 1113781 - RNA, 17 nt, Homo sapiens
aaauauugcuuaugucu

SEQ ID NO: 1113782 - RNA, 15 nt, Homo sapiens
aaaucaguuauguca

SEQ ID NO: 1113783 - RNA, 20 nt, Homo sapiens
aaaucaucucucaucacuuu

SEQ ID NO: 1113784 - RNA, 15 nt, Homo sapiens
aaauccugaugcugu

SEQ ID NO: 1113785 - RNA, 13 nt, Homo sapiens
aaaucuagaucaa

SEQ ID NO: 1113786 - RNA, 20 nt, Homo sapiens
aaaucuuaauucaacuagua

SEQ ID NO: 1113787 - RNA, 23 nt, Homo sapiens
aaaucuuugauucagacagcuua

SEQ ID NO: 1113788 - RNA, 19 nt, Homo sapiens
aaaugaaacaaauaaucac

SEQ ID NO: 1113789 - RNA, 15 nt, Homo sapiens
aaaugaaucuuacuc

SEQ ID NO: 1113790 - RNA, 14 nt, Homo sapiens
aaaugacccaaaga

SEQ ID NO: 1113791 - RNA, 14 nt, Homo sapiens
aaaugauuaucucc

SEQ ID NO: 1113792 - RNA, 18 nt, Homo sapiens
aaaugcaaacacugugua

SEQ ID NO: 1113793 - RNA, 17 nt, Homo sapiens
aaaugcaacaacaugua

SEQ ID NO: 1113794 - RNA, 14 nt, Homo sapiens
aaaugcagugaauu

SEQ ID NO: 1113795 - RNA, 13 nt, Homo sapiens
aaaugcauggugc

SEQ ID NO: 1113796 - RNA, 22 nt, Homo sapiens
aaauguaaaauaaguauuucca

SEQ ID NO: 1113797 - RNA, 17 nt, Homo sapiens
aaaugucuaagguagua

SEQ ID NO: 1113798 - RNA, 16 nt, Homo sapiens
aaaugucuggucuguc

SEQ ID NO: 1113799 - RNA, 22 nt, Homo sapiens
aaaugugacccagauccucaca

SEQ ID NO: 1113800 - RNA, 12 nt, Homo sapiens
aaauuaaacccu

SEQ ID NO: 1113801 - RNA, 15 nt, Homo sapiens
aaauuaaaugcaugu

SEQ ID NO: 1113802 - RNA, 16 nt, Homo sapiens
aaauuaaaugcauguc

SEQ ID NO: 1113803 - RNA, 12 nt, Homo sapiens
aaauuacuuauu

SEQ ID NO: 1113804 - RNA, 14 nt, Homo sapiens
aaauuauaucucag

SEQ ID NO: 1113805 - RNA, 15 nt, Homo sapiens
aaauuaugauaagga

SEQ ID NO: 1113806 - RNA, 23 nt, Homo sapiens
aaauucauacauaguacauacaa

SEQ ID NO: 1113807 - RNA, 17 nt, Homo sapiens
aaauuccuugauucaca

SEQ ID NO: 1113808 - RNA, 24 nt, Homo sapiens
aaauucucagucaguaauugccaa

SEQ ID NO: 1113809 - RNA, 11 nt, Homo sapiens
aaauugcacaa

SEQ ID NO: 1113810 - RNA, 14 nt, Homo sapiens
aaauugcuuauucu

SEQ ID NO: 1113811 - RNA, 20 nt, Homo sapiens
aaauuggaauuuucuuaccc

SEQ ID NO: 1113812 - RNA, 18 nt, Homo sapiens
aaauuuaauauagcuauu

SEQ ID NO: 1113813 - RNA, 22 nt, Homo sapiens
aaauuuaggaccaauaccuccu

SEQ ID NO: 1113814 - RNA, 19 nt, Homo sapiens
aaauuuccagugagcuuau

SEQ ID NO: 1113815 - RNA, 19 nt, Homo sapiens
aaauuucuucgaucccaag

SEQ ID NO: 1113816 - RNA, 21 nt, Homo sapiens
aaauuugggggacuuacauga

SEQ ID NO: 1113817 - RNA, 18 nt, Homo sapiens
aaauuuuacugacagaaa

SEQ ID NO: 1113818 - RNA, 16 nt, Homo sapiens
aaauuuucuaugcuua

SEQ ID NO: 1113819 - RNA, 21 nt, Homo sapiens
aacaaauuagguuuuguacaa

SEQ ID NO: 1113820 - RNA, 15 nt, Homo sapiens
aacaaauuauguuac

SEQ ID NO: 1113821 - RNA, 20 nt, Homo sapiens
aacaacaaagccaacaguca

SEQ ID NO: 1113822 - RNA, 22 nt, Homo sapiens
aacaacuaggcuucagcauauu

SEQ ID NO: 1113823 - RNA, 12 nt, Homo sapiens
aacaacuguggu

SEQ ID NO: 1113824 - RNA, 17 nt, Homo sapiens
aacaacuguggucaauc

SEQ ID NO: 1113825 - RNA, 18 nt, Homo sapiens
aacaagaaauuguuucuu

SEQ ID NO: 1113826 - RNA, 20 nt, Homo sapiens
aacaagguucccucugagaa

SEQ ID NO: 1113827 - RNA, 21 nt, Homo sapiens
aacaaguauuuguuaauuuag

SEQ ID NO: 1113828 - RNA, 15 nt, Homo sapiens
aacaagugcacuuga

SEQ ID NO: 1113829 - RNA, 22 nt, Homo sapiens
aacaauuccaaaggaaucucca

SEQ ID NO: 1113830 - RNA, 23 nt, Homo sapiens
aacaauuuuaggaggaccagagc

SEQ ID NO: 1113831 - RNA, 14 nt, Homo sapiens
aacacaauaugaau

SEQ ID NO: 1113832 - RNA, 21 nt, Homo sapiens
aacacagcuuuacaacuucca

SEQ ID NO: 1113833 - RNA, 18 nt, Homo sapiens
aacacauuacuugcacaa

SEQ ID NO: 1113834 - RNA, 12 nt, Homo sapiens
aacacccaugaa

SEQ ID NO: 1113835 - RNA, 18 nt, Homo sapiens
aacacccaugaaucaaag

SEQ ID NO: 1113836 - RNA, 13 nt, Homo sapiens
aacacccaugccc

SEQ ID NO: 1113837 - RNA, 11 nt, Homo sapiens
aacacuacuua

SEQ ID NO: 1113838 - RNA, 23 nt, Homo sapiens
aacacucacauuuauucugcuca

SEQ ID NO: 1113839 - RNA, 12 nt, Homo sapiens
aacacugggcug

SEQ ID NO: 1113840 - RNA, 14 nt, Homo sapiens
aacacuucucauca

SEQ ID NO: 1113841 - RNA, 17 nt, Homo sapiens
aacagaaagcauccuaa

SEQ ID NO: 1113842 - RNA, 15 nt, Homo sapiens
gacaggaauacuuaa

SEQ ID NO: 1113843 - RNA, 14 nt, Homo sapiens
gacaggcaugcacc

SEQ ID NO: 1113844 - RNA, 19 nt, Homo sapiens
gacauaagcaaagacuaug

SEQ ID NO: 1113845 - RNA, 21 nt, Homo sapiens
gacauagccaacugcuguuca

SEQ ID NO: 1113846 - RNA, 19 nt, Homo sapiens
gacaugaacagaaacaaua

SEQ ID NO: 1113847 - RNA, 20 nt, Homo sapiens
gacaugggugugccaggcua

SEQ ID NO: 1113848 - RNA, 16 nt, Homo sapiens
gacauuguuggccaaa

SEQ ID NO: 1113849 - RNA, 22 nt, Homo sapiens
gaccaauaaccaugcccaagaa

SEQ ID NO: 1113850 - RNA, 14 nt, Homo sapiens
gaccaauaccuccu

SEQ ID NO: 1113851 - RNA, 17 nt, Homo sapiens
gaccagcccagccaaca

SEQ ID NO: 1113852 - RNA, 15 nt, Homo sapiens
gacccuccuguccag

SEQ ID NO: 1113853 - RNA, 16 nt, Homo sapiens
gaccgaaucucacucu

SEQ ID NO: 1113854 - RNA, 18 nt, Homo sapiens
gaccguuuuuacuaagua

SEQ ID NO: 1113855 - RNA, 15 nt, Homo sapiens
gaccuaggauuucau

SEQ ID NO: 1113856 - RNA, 22 nt, Homo sapiens
gaccucaggugauccacccacc

SEQ ID NO: 1113857 - RNA, 21 nt, Homo sapiens
gaccucuacaagcaaauggag

SEQ ID NO: 1113858 - RNA, 14 nt, Homo sapiens
gaccugagaaccuu

SEQ ID NO: 1113859 - RNA, 14 nt, Homo sapiens
gaccugcaggccaa

SEQ ID NO: 1113860 - RNA, 14 nt, Homo sapiens
gaccuuccugccac

SEQ ID NO: 1113861 - RNA, 23 nt, Homo sapiens
gaccuuccugccaccagucacug

SEQ ID NO: 1113862 - RNA, 22 nt, Homo sapiens
gaccuuuuuuaggaagcaagcu

SEQ ID NO: 1113863 - RNA, 22 nt, Homo sapiens
gacgccacucauuucaucucau

SEQ ID NO: 1113864 - RNA, 21 nt, Homo sapiens
gacgguuucaaaccaggauuu

SEQ ID NO: 1113865 - RNA, 17 nt, Homo sapiens
gacguguccuacagccu

SEQ ID NO: 1113866 - RNA, 16 nt, Homo sapiens
gacuaggugcuugcuu

SEQ ID NO: 1113867 - RNA, 18 nt, Homo sapiens
gacuauguuucuauucua

SEQ ID NO: 1113868 - RNA, 22 nt, Homo sapiens
gacucaagccccggacucaggc

SEQ ID NO: 1113869 - RNA, 17 nt, Homo sapiens
gacucaauaaaaucaug

SEQ ID NO: 1113870 - RNA, 17 nt, Homo sapiens
gacucaaugcacugaca

SEQ ID NO: 1113871 - RNA, 18 nt, Homo sapiens
gacucacaagaagaccag

SEQ ID NO: 1113872 - RNA, 19 nt, Homo sapiens
gacucacacuugggcgcuc

SEQ ID NO: 1113873 - RNA, 13 nt, Homo sapiens
gacucacuguggg

SEQ ID NO: 1113874 - RNA, 19 nt, Homo sapiens
gacucagggccccagcacu

SEQ ID NO: 1113875 - RNA, 21 nt, Homo sapiens
gacucagggccccagcacuaa

SEQ ID NO: 1113876 - RNA, 13 nt, Homo sapiens
gacucaugaacua

SEQ ID NO: 1113877 - RNA, 20 nt, Homo sapiens
gacuccgucucaaaaacaaa

SEQ ID NO: 1113878 - RNA, 13 nt, Homo sapiens
gacuccucaaaag

SEQ ID NO: 1113879 - RNA, 15 nt, Homo sapiens
gacuccucaaaagca

SEQ ID NO: 1113880 - RNA, 16 nt, Homo sapiens
gacuccucuaagccac

SEQ ID NO: 1113881 - RNA, 13 nt, Homo sapiens
gacuccugugcaa

SEQ ID NO: 1113882 - RNA, 17 nt, Homo sapiens
gacucuacagaggccau

SEQ ID NO: 1113883 - RNA, 10 nt, Homo sapiens
gacucugcac

SEQ ID NO: 1113884 - RNA, 20 nt, Homo sapiens
gacucugcacaugucuugua

SEQ ID NO: 1113885 - RNA, 17 nt, Homo sapiens
gacucuugccuuuccac

SEQ ID NO: 1113886 - RNA, 21 nt, Homo sapiens
gacugccaugcuagacaagcu

SEQ ID NO: 1113887 - RNA, 22 nt, Homo sapiens
gacuguugcucaaaucuauuca

SEQ ID NO: 1113888 - RNA, 23 nt, Homo sapiens
gacuucuccuccaguggaccuga

SEQ ID NO: 1113889 - RNA, 18 nt, Homo sapiens
gacuugacagaacacugu

SEQ ID NO: 1113890 - RNA, 22 nt, Homo sapiens
gagaaaagaaaccagagucaaa

SEQ ID NO: 1113891 - RNA, 14 nt, Homo sapiens
gagaaaagacauaa

SEQ ID NO: 1113892 - RNA, 20 nt, Homo sapiens
gagaaaccuuauuguaccuc

SEQ ID NO: 1113893 - RNA, 20 nt, Homo sapiens
gagaaauugaacuucaggga

SEQ ID NO: 1113894 - RNA, 21 nt, Homo sapiens
gagaaauuuaaacuauaagca

SEQ ID NO: 1113895 - RNA, 18 nt, Homo sapiens
gagaacuggaaagacaua

SEQ ID NO: 1113896 - RNA, 17 nt, Homo sapiens
gagaagaaagaggugac

SEQ ID NO: 1113897 - RNA, 21 nt, Homo sapiens
gagaagcaaaaucuaccaggu

SEQ ID NO: 1113898 - RNA, 22 nt, Homo sapiens
gagaaguauccaauuaugugac

SEQ ID NO: 1113899 - RNA, 17 nt, Homo sapiens
gagaaucacuugaacuc

SEQ ID NO: 1113900 - RNA, 17 nt, Homo sapiens
gagaaucacuugcacuc

SEQ ID NO: 1113901 - RNA, 20 nt, Homo sapiens
gagaaucgaccucacuguca

SEQ ID NO: 1113902 - RNA, 21 nt, Homo sapiens
gagacaaaaucuuaaaugcca

SEQ ID NO: 1113903 - RNA, 23 nt, Homo sapiens
gagacacuauuuaucugugcaaa

SEQ ID NO: 1113904 - RNA, 19 nt, Homo sapiens
gagacagaguuuucacucu

SEQ ID NO: 1113905 - RNA, 19 nt, Homo sapiens
gagacagauauacugggag

SEQ ID NO: 1113906 - RNA, 16 nt, Homo sapiens
gagacaggcccaagag

SEQ ID NO: 1113907 - RNA, 12 nt, Homo sapiens
gagacaggguuu

SEQ ID NO: 1113908 - RNA, 15 nt, Homo sapiens
gagacauacaccuau

SEQ ID NO: 1113909 - RNA, 19 nt, Homo sapiens
gagacauacaccuauguca

SEQ ID NO: 1113910 - RNA, 18 nt, Homo sapiens
gagacccagaucucaugg

SEQ ID NO: 1113911 - RNA, 21 nt, Homo sapiens
gagacuaugugucaugauuuc

SEQ ID NO: 1113912 - RNA, 23 nt, Homo sapiens
gagacucagggccccagcacuaa

SEQ ID NO: 1113913 - RNA, 13 nt, Homo sapiens
gagacuccgucuc

SEQ ID NO: 1113914 - RNA, 20 nt, Homo sapiens
gagacugacaccucacugag

SEQ ID NO: 1113915 - RNA, 13 nt, Homo sapiens
gagagaaaaaaga

SEQ ID NO: 1113916 - RNA, 12 nt, Homo sapiens
gagagaacugaa

SEQ ID NO: 1113917 - RNA, 22 nt, Homo sapiens
gagagaucauagcucacuguaa

SEQ ID NO: 1113918 - RNA, 13 nt, Homo sapiens
gagagauggaaua

SEQ ID NO: 1113919 - RNA, 23 nt, Homo sapiens
gagagcuaaauuacaauugucau

SEQ ID NO: 1113920 - RNA, 17 nt, Homo sapiens
gagagcuaggagcaaag

SEQ ID NO: 1113921 - RNA, 22 nt, Homo sapiens
gagaggcccugggguucucccc

SEQ ID NO: 1113922 - RNA, 18 nt, Homo sapiens
gagagggaagagugcauu

SEQ ID NO: 1113923 - RNA, 21 nt, Homo sapiens
gauccaauggaauacugaaaa

SEQ ID NO: 1113924 - RNA, 16 nt, Homo sapiens
gauccacccaccucag

SEQ ID NO: 1113925 - RNA, 15 nt, Homo sapiens
gauccaguugcacua

SEQ ID NO: 1113926 - RNA, 19 nt, Homo sapiens
gaucuaagccuuuccauaa

SEQ ID NO: 1113927 - RNA, 17 nt, Homo sapiens
gaucuaucaauagucaa

SEQ ID NO: 1113928 - RNA, 11 nt, Homo sapiens
gaucuaucugu

SEQ ID NO: 1113929 - RNA, 19 nt, Homo sapiens
gaagaauauucaggacuua

SEQ ID NO: 1113930 - RNA, 23 nt, Homo sapiens
gaagacaauggcuuacuccagga

SEQ ID NO: 1113931 - RNA, 12 nt, Homo sapiens
gaagacacugca

SEQ ID NO: 1113932 - RNA, 21 nt, Homo sapiens
gaagaccaagacacagaucac

SEQ ID NO: 1113933 - RNA, 14 nt, Homo sapiens
gaagacccagugua

SEQ ID NO: 1113934 - RNA, 15 nt, Homo sapiens
gaagacccaguguaa

SEQ ID NO: 1113935 - RNA, 16 nt, Homo sapiens
gaagacccaguguaaa

SEQ ID NO: 1113936 - RNA, 21 nt, Homo sapiens
gaagauaggagagauaccuug

SEQ ID NO: 1113937 - RNA, 15 nt, Homo sapiens
gaagauguaaggaau

SEQ ID NO: 1113938 - RNA, 14 nt, Homo sapiens
gaagauuucagagg

SEQ ID NO: 1113939 - RNA, 12 nt, Homo sapiens
gaagcauuuacu

SEQ ID NO: 1113940 - RNA, 15 nt, Homo sapiens
gaagcauuuacuuug

SEQ ID NO: 1113941 - RNA, 23 nt, Homo sapiens
gaagcucuggccaaccaaagaca

SEQ ID NO: 1113942 - RNA, 22 nt, Homo sapiens
gaagcuguguccuugcaccugc

SEQ ID NO: 1113943 - RNA, 15 nt, Homo sapiens
gaagcuuccauucca

SEQ ID NO: 1113944 - RNA, 13 nt, Homo sapiens
gaaggaagugaag

SEQ ID NO: 1113945 - RNA, 13 nt, Homo sapiens
gaaggacauuuua

SEQ ID NO: 1113946 - RNA, 18 nt, Homo sapiens
gaaggacgugucucagga

SEQ ID NO: 1113947 - RNA, 21 nt, Homo sapiens
gaaggacuaugaaaagcuaga

SEQ ID NO: 1113948 - RNA, 21 nt, Homo sapiens
gaaggagaguccccugaaggu

SEQ ID NO: 1113949 - RNA, 18 nt, Homo sapiens
gaaggagcaagagaacau

SEQ ID NO: 1113950 - RNA, 17 nt, Homo sapiens
gaaggagccagugccca

SEQ ID NO: 1113951 - RNA, 18 nt, Homo sapiens
gaaggagccagugcccac

SEQ ID NO: 1113952 - RNA, 13 nt, Homo sapiens
gaaggcaaaaaga

SEQ ID NO: 1113953 - RNA, 15 nt, Homo sapiens
gaaggccacauguca

SEQ ID NO: 1113954 - RNA, 12 nt, Homo sapiens
gaagggccaguc

SEQ ID NO: 1113955 - RNA, 23 nt, Homo sapiens
gaagguagcccagcacugugaag

SEQ ID NO: 1113956 - RNA, 15 nt, Homo sapiens
gaaggucuugccuga

SEQ ID NO: 1113957 - RNA, 16 nt, Homo sapiens
gaaggugcugacaaag

SEQ ID NO: 1113958 - RNA, 12 nt, Homo sapiens
gaaggugucaua

SEQ ID NO: 1113959 - RNA, 16 nt, Homo sapiens
gaaguaaaagcuaauu

SEQ ID NO: 1113960 - RNA, 18 nt, Homo sapiens
gaaguagaauuuguccaa

SEQ ID NO: 1113961 - RNA, 21 nt, Homo sapiens
gaaguagcucuggugaccuug

SEQ ID NO: 1113962 - RNA, 21 nt, Homo sapiens
gaaguauuuuccuccaggcaa

SEQ ID NO: 1113963 - RNA, 16 nt, Homo sapiens
gaagucucuuccaguu

SEQ ID NO: 1113964 - RNA, 14 nt, Homo sapiens
gaagucuugucuca

SEQ ID NO: 1113965 - RNA, 18 nt, Homo sapiens
gaaguuaagcagccuuuc

SEQ ID NO: 1113966 - RNA, 12 nt, Homo sapiens
gaaguuccucaa

SEQ ID NO: 1113967 - RNA, 14 nt, Homo sapiens
gaauaaaaauugac

SEQ ID NO: 1113968 - RNA, 19 nt, Homo sapiens
gaauaaagcccuugaacca

SEQ ID NO: 1113969 - RNA, 21 nt, Homo sapiens
gaauaaagcccuugaaccagc

SEQ ID NO: 1113970 - RNA, 11 nt, Homo sapiens
gaauaaagccu

SEQ ID NO: 1113971 - RNA, 14 nt, Homo sapiens
gaauaauaccuaag

SEQ ID NO: 1113972 - RNA, 21 nt, Homo sapiens
gaauaauuguguacaaaguag

SEQ ID NO: 1113973 - RNA, 12 nt, Homo sapiens
gaauacaguaag

SEQ ID NO: 1113974 - RNA, 21 nt, Homo sapiens
gaauaccaaguguguugggaa

SEQ ID NO: 1113975 - RNA, 14 nt, Homo sapiens
gaauacuuaacuca

SEQ ID NO: 1113976 - RNA, 22 nt, Homo sapiens
gaauaguguuggaaaaugugca

SEQ ID NO: 1113977 - RNA, 21 nt, Homo sapiens
gaauauagaggagcacuauua

SEQ ID NO: 1113978 - RNA, 21 nt, Homo sapiens
gaauaugaucauguaaaugau

SEQ ID NO: 1113979 - RNA, 13 nt, Homo sapiens
gaauauuguuaaa

SEQ ID NO: 1113980 - RNA, 21 nt, Homo sapiens
gaauauuuauuaccucugaua

SEQ ID NO: 1113981 - RNA, 13 nt, Homo sapiens
gaaucaaagacau

SEQ ID NO: 1113982 - RNA, 16 nt, Homo sapiens
gaaucacuugcacucc

SEQ ID NO: 1113983 - RNA, 14 nt, Homo sapiens
gaaucauuaucuua

SEQ ID NO: 1113984 - RNA, 16 nt, Homo sapiens
gaauccagacccggcu

SEQ ID NO: 1113985 - RNA, 20 nt, Homo sapiens
gaauccaucaggacuuggga

SEQ ID NO: 1113986 - RNA, 20 nt, Homo sapiens
gaaucccacccacaugugac

SEQ ID NO: 1113987 - RNA, 16 nt, Homo sapiens
gaaucccuuaaacuca

SEQ ID NO: 1113988 - RNA, 19 nt, Homo sapiens
gaaucuacaaaaaacaaca

SEQ ID NO: 1113989 - RNA, 13 nt, Homo sapiens
gaaucuacagaac

SEQ ID NO: 1113990 - RNA, 20 nt, Homo sapiens
gaaucugugcagaugagcag

SEQ ID NO: 1113991 - RNA, 23 nt, Homo sapiens
gaaugacguguccuacagccuca

SEQ ID NO: 1113992 - RNA, 14 nt, Homo sapiens
gaaugagaagaaug

SEQ ID NO: 1113993 - RNA, 18 nt, Homo sapiens
gaaugaggucccaggcag

SEQ ID NO: 1113994 - RNA, 20 nt, Homo sapiens
gaaugauucccucuugcuau

SEQ ID NO: 1113995 - RNA, 20 nt, Homo sapiens
gaaugauuuagguacgucaa

SEQ ID NO: 1113996 - RNA, 16 nt, Homo sapiens
gaaugcagugguauga

SEQ ID NO: 1113997 - RNA, 18 nt, Homo sapiens
gaaugcuuaccugugaga

SEQ ID NO: 1113998 - RNA, 19 nt, Homo sapiens
gaauggggugcaugaaggu

SEQ ID NO: 1113999 - RNA, 15 nt, Homo sapiens
gaaugugauauuuga

SEQ ID NO: 1114000 - RNA, 16 nt, Homo sapiens
gaauuaggaagaccaa

SEQ ID NO: 1114001 - RNA, 15 nt, Homo sapiens
gaauuauaaaggcca

SEQ ID NO: 1114002 - RNA, 14 nt, Homo sapiens
gaauuauaucuaau

SEQ ID NO: 1114003 - RNA, 15 nt, Homo sapiens
gaauugaagauguaa

SEQ ID NO: 1114004 - RNA, 15 nt, Homo sapiens
gaauugcaugccauc

SEQ ID NO: 1114005 - RNA, 18 nt, Homo sapiens
gaauugcaugccaucucc

SEQ ID NO: 1114006 - RNA, 15 nt, Homo sapiens
gaauuucuuugucau

SEQ ID NO: 1114007 - RNA, 17 nt, Homo sapiens
gaauuuggccugcacua

SEQ ID NO: 1114008 - RNA, 18 nt, Homo sapiens
gaauuuuguuuguugaug

SEQ ID NO: 1114009 - RNA, 21 nt, Homo sapiens
gacaaaccagagcagagagca

SEQ ID NO: 1114010 - RNA, 12 nt, Homo sapiens
gacaaagccaaa

SEQ ID NO: 1114011 - RNA, 15 nt, Homo sapiens
gacaaaggagccugu

SEQ ID NO: 1114012 - RNA, 18 nt, Homo sapiens
gacaaaggagccugugaa

SEQ ID NO: 1114013 - RNA, 24 nt, Homo sapiens
gacaaaggcucuacacauacugca

SEQ ID NO: 1114014 - RNA, 17 nt, Homo sapiens
gacaaagguuuuccucu

SEQ ID NO: 1114015 - RNA, 21 nt, Homo sapiens
gacaaagguuuuccucuucua

SEQ ID NO: 1114016 - RNA, 16 nt, Homo sapiens
gacaacagcauaacua

SEQ ID NO: 1114017 - RNA, 22 nt, Homo sapiens
gacaagccaacuuguaaauaca

SEQ ID NO: 1114018 - RNA, 20 nt, Homo sapiens
gacaauaaaacauuccugug

SEQ ID NO: 1114019 - RNA, 19 nt, Homo sapiens
cuguauuuugccagacuua

SEQ ID NO: 1114020 - RNA, 16 nt, Homo sapiens
cugucaccaagccuug

SEQ ID NO: 1114021 - RNA, 20 nt, Homo sapiens
cugucaucaauuaaaggcaa

SEQ ID NO: 1114022 - RNA, 15 nt, Homo sapiens
cuguccaguuuccaa

SEQ ID NO: 1114023 - RNA, 18 nt, Homo sapiens
cuguccaguuuccaaagg

SEQ ID NO: 1114024 - RNA, 17 nt, Homo sapiens
cuguccccacacugacc

SEQ ID NO: 1114025 - RNA, 21 nt, Homo sapiens
cuguccccacagcaggugccu

SEQ ID NO: 1114026 - RNA, 19 nt, Homo sapiens
cugucccucaaaugaccca

SEQ ID NO: 1114027 - RNA, 23 nt, Homo sapiens
cugucccucaaaugacccaaaga

SEQ ID NO: 1114028 - RNA, 22 nt, Homo sapiens
cuguccuuuuggcacugagaua

SEQ ID NO: 1114029 - RNA, 19 nt, Homo sapiens
cugucucucaugaaccuca

SEQ ID NO: 1114030 - RNA, 19 nt, Homo sapiens
cugugaaagaaccaaaaga

SEQ ID NO: 1114031 - RNA, 21 nt, Homo sapiens
cugugaauaaaaacccuguau

SEQ ID NO: 1114032 - RNA, 19 nt, Homo sapiens
cugugaccugcugagcucu

SEQ ID NO: 1114033 - RNA, 14 nt, Homo sapiens
cugugaggugcuga

SEQ ID NO: 1114034 - RNA, 20 nt, Homo sapiens
cugugcccacgugugcagac

SEQ ID NO: 1114035 - RNA, 14 nt, Homo sapiens
cugugcguuacuaa

SEQ ID NO: 1114036 - RNA, 21 nt, Homo sapiens
cugugcguuuuagaguaugca

SEQ ID NO: 1114037 - RNA, 16 nt, Homo sapiens
cugugcuuugacucac

SEQ ID NO: 1114038 - RNA, 14 nt, Homo sapiens
cuguggccugggca

SEQ ID NO: 1114039 - RNA, 21 nt, Homo sapiens
cuguggucuucaaauugucuu

SEQ ID NO: 1114040 - RNA, 16 nt, Homo sapiens
cuguguagcugugacc

SEQ ID NO: 1114041 - RNA, 21 nt, Homo sapiens
cuguguauuuaacugccuugu

SEQ ID NO: 1114042 - RNA, 13 nt, Homo sapiens
cugugugaugaug

SEQ ID NO: 1114043 - RNA, 24 nt, Homo sapiens
cuguguuacccaguaacucaucug

SEQ ID NO: 1114044 - RNA, 15 nt, Homo sapiens
cuguguuugcugagg

SEQ ID NO: 1114045 - RNA, 23 nt, Homo sapiens
cuguuacuugaaauaccagugaa

SEQ ID NO: 1114046 - RNA, 17 nt, Homo sapiens
cuguucauguuacucau

SEQ ID NO: 1114047 - RNA, 19 nt, Homo sapiens
cuguucuggccucagacca

SEQ ID NO: 1114048 - RNA, 12 nt, Homo sapiens
cuguuggucugu

SEQ ID NO: 1114049 - RNA, 23 nt, Homo sapiens
cuguuuacaaaagcccaauguaa

SEQ ID NO: 1114050 - RNA, 19 nt, Homo sapiens
cuguuugagaauaugauca

SEQ ID NO: 1114051 - RNA, 24 nt, Homo sapiens
cuguuuuugaagaagggaaauuca

SEQ ID NO: 1114052 - RNA, 16 nt, Homo sapiens
cuuaaaggcuguggua

SEQ ID NO: 1114053 - RNA, 15 nt, Homo sapiens
cuuaaauauugaaua

SEQ ID NO: 1114054 - RNA, 13 nt, Homo sapiens
cuuaaaucacuga

SEQ ID NO: 1114055 - RNA, 15 nt, Homo sapiens
cuuaacugugugaag

SEQ ID NO: 1114056 - RNA, 21 nt, Homo sapiens
cuuaagccuuuugcucacaaa

SEQ ID NO: 1114057 - RNA, 14 nt, Homo sapiens
cuuaauaguauuua

SEQ ID NO: 1114058 - RNA, 14 nt, Homo sapiens
cuuaauauguuaac

SEQ ID NO: 1114059 - RNA, 15 nt, Homo sapiens
cuuaaucaugagaua

SEQ ID NO: 1114060 - RNA, 20 nt, Homo sapiens
cuuaaucuccacuguuauuc

SEQ ID NO: 1114061 - RNA, 21 nt, Homo sapiens
cuuaaugauccguuccauugc

SEQ ID NO: 1114062 - RNA, 19 nt, Homo sapiens
cuuaauggguacaauguac

SEQ ID NO: 1114063 - RNA, 21 nt, Homo sapiens
cuuaauuucauagauuguguu

SEQ ID NO: 1114064 - RNA, 19 nt, Homo sapiens
cuuacaagacccuaugaaa

SEQ ID NO: 1114065 - RNA, 15 nt, Homo sapiens
cuuaccugugagaua

SEQ ID NO: 1114066 - RNA, 14 nt, Homo sapiens
cuuacuguaacgga

SEQ ID NO: 1114067 - RNA, 13 nt, Homo sapiens
cuuagaccucagc

SEQ ID NO: 1114068 - RNA, 22 nt, Homo sapiens
cuuagacuaguugaacaucuca

SEQ ID NO: 1114069 - RNA, 14 nt, Homo sapiens
cuuagcaacuuggg

SEQ ID NO: 1114070 - RNA, 16 nt, Homo sapiens
cuuaguaauagaucac

SEQ ID NO: 1114071 - RNA, 13 nt, Homo sapiens
cuuaguaucucau

SEQ ID NO: 1114072 - RNA, 22 nt, Homo sapiens
cuuaguaucucaucaacaaaga

SEQ ID NO: 1114073 - RNA, 15 nt, Homo sapiens
cuuagugucacuuac

SEQ ID NO: 1114074 - RNA, 18 nt, Homo sapiens
cuuauauaguauucauuu

SEQ ID NO: 1114075 - RNA, 19 nt, Homo sapiens
cuuauauggaaauucugcu

SEQ ID NO: 1114076 - RNA, 20 nt, Homo sapiens
cuuauccaggacucugucaa

SEQ ID NO: 1114077 - RNA, 17 nt, Homo sapiens
cuuauccaugccuggga

SEQ ID NO: 1114078 - RNA, 24 nt, Homo sapiens
cuuauuuuguaauaaacucucuag

SEQ ID NO: 1114079 - RNA, 14 nt, Homo sapiens
cuuauuuuugaauu

SEQ ID NO: 1114080 - RNA, 21 nt, Homo sapiens
cuucaaaacggggcagccaaa

SEQ ID NO: 1114081 - RNA, 22 nt, Homo sapiens
cuucaaaugucuaagguaguaa

SEQ ID NO: 1114082 - RNA, 16 nt, Homo sapiens
cuucaagaacucuggg

SEQ ID NO: 1114083 - RNA, 13 nt, Homo sapiens
cuucacaguguuu

SEQ ID NO: 1114084 - RNA, 14 nt, Homo sapiens
cuucacaguguuuc

SEQ ID NO: 1114085 - RNA, 15 nt, Homo sapiens
cuucacccugaaugg

SEQ ID NO: 1114086 - RNA, 20 nt, Homo sapiens
cuucagaagacacugcaaag

SEQ ID NO: 1114087 - RNA, 23 nt, Homo sapiens
cuucagaagacacugcaaaggcg

SEQ ID NO: 1114088 - RNA, 15 nt, Homo sapiens
cuucagagacuaucu

SEQ ID NO: 1114089 - RNA, 23 nt, Homo sapiens
cuucagagacuaucugauuuccu

SEQ ID NO: 1114090 - RNA, 22 nt, Homo sapiens
cuucagguucuuagugucacuu

SEQ ID NO: 1114091 - RNA, 22 nt, Homo sapiens
cuucaguauuuuuaaauuguaa

SEQ ID NO: 1114092 - RNA, 13 nt, Homo sapiens
cuucaguuuuagg

SEQ ID NO: 1114093 - RNA, 15 nt, Homo sapiens
cuucaugcaaugaca

SEQ ID NO: 1114094 - RNA, 24 nt, Homo sapiens
cuucauuugaugcuaaauaggaga

SEQ ID NO: 1114095 - RNA, 21 nt, Homo sapiens
cuuccaaacagaacuauggaa

SEQ ID NO: 1114096 - RNA, 17 nt, Homo sapiens
cuuccacaccuagcauc

SEQ ID NO: 1114097 - RNA, 19 nt, Homo sapiens
cuuccagguaucuccagga

SEQ ID NO: 1114098 - RNA, 16 nt, Homo sapiens
cuuccauaauguauaa

SEQ ID NO: 1114099 - RNA, 18 nt, Homo sapiens
cuuccaucugauugugau

SEQ ID NO: 1114100 - RNA, 12 nt, Homo sapiens
cuuccaugagaa

SEQ ID NO: 1114101 - RNA, 17 nt, Homo sapiens
cuuccccagacucagcu

SEQ ID NO: 1114102 - RNA, 13 nt, Homo sapiens
cuuccugacccuc

SEQ ID NO: 1114103 - RNA, 17 nt, Homo sapiens
cuuccuggcuucuuacu

SEQ ID NO: 1114104 - RNA, 17 nt, Homo sapiens
cuuccugucaacacuuc

SEQ ID NO: 1114105 - RNA, 16 nt, Homo sapiens
cuuccugugacuucag

SEQ ID NO: 1114106 - RNA, 20 nt, Homo sapiens
cuuccuugggaugaucuuga

SEQ ID NO: 1114107 - RNA, 16 nt, Homo sapiens
cugcagccugguagaa

SEQ ID NO: 1114108 - RNA, 19 nt, Homo sapiens
cugcagcggcacaaaugca

SEQ ID NO: 1114109 - RNA, 15 nt, Homo sapiens
cugcaggaaucaaaa

SEQ ID NO: 1114110 - RNA, 22 nt, Homo sapiens
cugcaggcaaagugagacugac

SEQ ID NO: 1114111 - RNA, 21 nt, Homo sapiens
cugcagucaacaguucaaaga

SEQ ID NO: 1114112 - RNA, 13 nt, Homo sapiens
cugcaucucaaaa

SEQ ID NO: 1114113 - RNA, 14 nt, Homo sapiens
cugcaucucaaaaa

SEQ ID NO: 1114114 - RNA, 18 nt, Homo sapiens
cugcaugcacuucuuaca

SEQ ID NO: 1114115 - RNA, 15 nt, Homo sapiens
cugcaugcucaggac

SEQ ID NO: 1114116 - RNA, 18 nt, Homo sapiens
cugcauuugugucaucuu

SEQ ID NO: 1114117 - RNA, 19 nt, Homo sapiens
cugcauuugugucaucuug

SEQ ID NO: 1114118 - RNA, 16 nt, Homo sapiens
cugccaaaacaaugcc

SEQ ID NO: 1114119 - RNA, 17 nt, Homo sapiens
cugccaccagucacugu

SEQ ID NO: 1114120 - RNA, 12 nt, Homo sapiens
cugccaguguuu

SEQ ID NO: 1114121 - RNA, 20 nt, Homo sapiens
cugcccaaacauaaagagaa

SEQ ID NO: 1114122 - RNA, 18 nt, Homo sapiens
cugcccugccaccugucu

SEQ ID NO: 1114123 - RNA, 23 nt, Homo sapiens
cugccuccauucugaccauuuca

SEQ ID NO: 1114124 - RNA, 19 nt, Homo sapiens
cugccucugucucacugaa

SEQ ID NO: 1114125 - RNA, 17 nt, Homo sapiens
cugccugcaucuauucu

SEQ ID NO: 1114126 - RNA, 18 nt, Homo sapiens
cugccuugauuagacucc

SEQ ID NO: 1114127 - RNA, 13 nt, Homo sapiens
cugccuugccaug

SEQ ID NO: 1114128 - RNA, 14 nt, Homo sapiens
cugcgagcauuucc

SEQ ID NO: 1114129 - RNA, 15 nt, Homo sapiens
cugcgagcauuuccc

SEQ ID NO: 1114130 - RNA, 17 nt, Homo sapiens
cugcgugguugaugauc

SEQ ID NO: 1114131 - RNA, 22 nt, Homo sapiens
cugcuacaccuuagcagcucuu

SEQ ID NO: 1114132 - RNA, 20 nt, Homo sapiens
cugcuauuugaaguguaauu

SEQ ID NO: 1114133 - RNA, 17 nt, Homo sapiens
cugcucugaggcuucca

SEQ ID NO: 1114134 - RNA, 21 nt, Homo sapiens
cugcucugaggcuuccagaga

SEQ ID NO: 1114135 - RNA, 19 nt, Homo sapiens
cugcucugaugcaucagaa

SEQ ID NO: 1114136 - RNA, 18 nt, Homo sapiens
cugcugagugcaccacuu

SEQ ID NO: 1114137 - RNA, 22 nt, Homo sapiens
cugcugcggugucacugggcua

SEQ ID NO: 1114138 - RNA, 13 nt, Homo sapiens
cugcugcugagaa

SEQ ID NO: 1114139 - RNA, 12 nt, Homo sapiens
cugcuguguagc

SEQ ID NO: 1114140 - RNA, 18 nt, Homo sapiens
cugcugugugaauuccca

SEQ ID NO: 1114141 - RNA, 20 nt, Homo sapiens
cugcuuccaauuuucuggaa

SEQ ID NO: 1114142 - RNA, 15 nt, Homo sapiens
cugcuugcacuuugu

SEQ ID NO: 1114143 - RNA, 15 nt, Homo sapiens
cuggaaaacugccuu

SEQ ID NO: 1114144 - RNA, 16 nt, Homo sapiens
cuggaaaagcacuuua

SEQ ID NO: 1114145 - RNA, 14 nt, Homo sapiens
cuggaaaaugugac

SEQ ID NO: 1114146 - RNA, 13 nt, Homo sapiens
cuggaacccagga

SEQ ID NO: 1114147 - RNA, 20 nt, Homo sapiens
cuggaacugucucucaugaa

SEQ ID NO: 1114148 - RNA, 15 nt, Homo sapiens
cuggaccacugggca

SEQ ID NO: 1114149 - RNA, 11 nt, Homo sapiens
cuggacuguca

SEQ ID NO: 1114150 - RNA, 20 nt, Homo sapiens
cuggagucccuucugagcga

SEQ ID NO: 1114151 - RNA, 20 nt, Homo sapiens
cuggagugcaguggugcgau

SEQ ID NO: 1114152 - RNA, 19 nt, Homo sapiens
cuggaucucacaagcacuu

SEQ ID NO: 1114153 - RNA, 19 nt, Homo sapiens
cuggaugagacuuccaaac

SEQ ID NO: 1114154 - RNA, 12 nt, Homo sapiens
cuggaugcgugc

SEQ ID NO: 1114155 - RNA, 17 nt, Homo sapiens
cuggauggcaccagagg

SEQ ID NO: 1114156 - RNA, 21 nt, Homo sapiens
cuggcaaugaaaaauucucag

SEQ ID NO: 1114157 - RNA, 23 nt, Homo sapiens
cuggccuggaucuccccacucua

SEQ ID NO: 1114158 - RNA, 13 nt, Homo sapiens
cuggcgugcagug

SEQ ID NO: 1114159 - RNA, 13 nt, Homo sapiens
cuggcugagcuga

SEQ ID NO: 1114160 - RNA, 23 nt, Homo sapiens
cuggcugcaaaggguaucaggug

SEQ ID NO: 1114161 - RNA, 13 nt, Homo sapiens
cuggcugggcaug

SEQ ID NO: 1114162 - RNA, 15 nt, Homo sapiens
cuggcuucagccucc

SEQ ID NO: 1114163 - RNA, 16 nt, Homo sapiens
cugggaacuuccucag

SEQ ID NO: 1114164 - RNA, 17 nt, Homo sapiens
cugggacuacaggugug

SEQ ID NO: 1114165 - RNA, 16 nt, Homo sapiens
cugggagaaccucagg

SEQ ID NO: 1114166 - RNA, 23 nt, Homo sapiens
cugggagagaaggagaucagggc

SEQ ID NO: 1114167 - RNA, 17 nt, Homo sapiens
cugggaggcggagagua

SEQ ID NO: 1114168 - RNA, 21 nt, Homo sapiens
cugggauguuuugagggucuu

SEQ ID NO: 1114169 - RNA, 23 nt, Homo sapiens
cugggauuacagguguaagccac

SEQ ID NO: 1114170 - RNA, 15 nt, Homo sapiens
cugggccccaccacc

SEQ ID NO: 1114171 - RNA, 22 nt, Homo sapiens
cugggccccaccaccuaggcca

SEQ ID NO: 1114172 - RNA, 14 nt, Homo sapiens
cugggcuaccguga

SEQ ID NO: 1114173 - RNA, 23 nt, Homo sapiens
cugggcucgccacaucccaugag

SEQ ID NO: 1114174 - RNA, 22 nt, Homo sapiens
cugggcuucuguccaaggcaca

SEQ ID NO: 1114175 - RNA, 19 nt, Homo sapiens
cuggggucacaugcuuugu

SEQ ID NO: 1114176 - RNA, 15 nt, Homo sapiens
cugguauauacauau

SEQ ID NO: 1114177 - RNA, 22 nt, Homo sapiens
cugguauuauuuacaaugcaga

SEQ ID NO: 1114178 - RNA, 18 nt, Homo sapiens
cuggucaggcccacugca

SEQ ID NO: 1114179 - RNA, 13 nt, Homo sapiens
cugguccuuccag

SEQ ID NO: 1114180 - RNA, 17 nt, Homo sapiens
cuggugccccacugaau

SEQ ID NO: 1114181 - RNA, 15 nt, Homo sapiens
cugguggaccacagg

SEQ ID NO: 1114182 - RNA, 18 nt, Homo sapiens
cugguggggcagcuccuc

SEQ ID NO: 1114183 - RNA, 15 nt, Homo sapiens
cugguuugaaagccu

SEQ ID NO: 1114184 - RNA, 18 nt, Homo sapiens
cugguuugucaaacaaca

SEQ ID NO: 1114185 - RNA, 15 nt, Homo sapiens
cucuauauauacaug

SEQ ID NO: 1114186 - RNA, 20 nt, Homo sapiens
cucuaugaaaauuauaucuc

SEQ ID NO: 1114187 - RNA, 14 nt, Homo sapiens
cucuauugcugcuc

SEQ ID NO: 1114188 - RNA, 17 nt, Homo sapiens
cucucaauuucuggaaa

SEQ ID NO: 1114189 - RNA, 17 nt, Homo sapiens
cucuccaacaucuucaa

SEQ ID NO: 1114190 - RNA, 14 nt, Homo sapiens
cucuccucuugcca

SEQ ID NO: 1114191 - RNA, 21 nt, Homo sapiens
cucuccuugccuggugaccua

SEQ ID NO: 1114192 - RNA, 19 nt, Homo sapiens
cucuccuuuggccauucca

SEQ ID NO: 1114193 - RNA, 16 nt, Homo sapiens
cucucuaaacccaaau

SEQ ID NO: 1114194 - RNA, 17 nt, Homo sapiens
cucucuaaacccaaaua

SEQ ID NO: 1114195 - RNA, 21 nt, Homo sapiens
cucucuaaaucuuccuuguga

SEQ ID NO: 1114196 - RNA, 15 nt, Homo sapiens
cucucuccacccuau

SEQ ID NO: 1114197 - RNA, 11 nt, Homo sapiens
cucucuugccu

SEQ ID NO: 1114198 - RNA, 20 nt, Homo sapiens
cucugaugagagagugcuga

SEQ ID NO: 1114199 - RNA, 23 nt, Homo sapiens
cucugcauguguguuguccuuca

SEQ ID NO: 1114200 - RNA, 19 nt, Homo sapiens
cucugccagucgguuccca

SEQ ID NO: 1114201 - RNA, 17 nt, Homo sapiens
cucugccuccucuucaa

SEQ ID NO: 1114202 - RNA, 14 nt, Homo sapiens
cucugccugaaguc

SEQ ID NO: 1114203 - RNA, 22 nt, Homo sapiens
cucugccugaagucacacagug

SEQ ID NO: 1114204 - RNA, 18 nt, Homo sapiens
cucuggaaaaugugaccc

SEQ ID NO: 1114205 - RNA, 20 nt, Homo sapiens
cucuggacaggcauguucuc

SEQ ID NO: 1114206 - RNA, 13 nt, Homo sapiens
cucuggaccagcc

SEQ ID NO: 1114207 - RNA, 15 nt, Homo sapiens
cucuggauggcacca

SEQ ID NO: 1114208 - RNA, 13 nt, Homo sapiens
cucugucccucac

SEQ ID NO: 1114209 - RNA, 21 nt, Homo sapiens
cucugugaacgauuuagaaag

SEQ ID NO: 1114210 - RNA, 13 nt, Homo sapiens
cucugugcuuuga

SEQ ID NO: 1114211 - RNA, 20 nt, Homo sapiens
cucuguguacccacuccuca

SEQ ID NO: 1114212 - RNA, 23 nt, Homo sapiens
cucuguguuacccaguaacucau

SEQ ID NO: 1114213 - RNA, 15 nt, Homo sapiens
cucuucaacugacca

SEQ ID NO: 1114214 - RNA, 19 nt, Homo sapiens
cucuucagaaaacccuuuu

SEQ ID NO: 1114215 - RNA, 20 nt, Homo sapiens
cucuuccaaaggcauaagac

SEQ ID NO: 1114216 - RNA, 23 nt, Homo sapiens
cucuucugagcaccuacuuacau

SEQ ID NO: 1114217 - RNA, 14 nt, Homo sapiens
cucuuguugcugag

SEQ ID NO: 1114218 - RNA, 20 nt, Homo sapiens
cucuuucuuauuuuguaaua

SEQ ID NO: 1114219 - RNA, 18 nt, Homo sapiens
cucuuuugaauccaugcu

SEQ ID NO: 1114220 - RNA, 19 nt, Homo sapiens
cucuuuugaauccaugcuu

SEQ ID NO: 1114221 - RNA, 15 nt, Homo sapiens
cugaaaacuggaaua

SEQ ID NO: 1114222 - RNA, 14 nt, Homo sapiens
cugaaaacuguaaa

SEQ ID NO: 1114223 - RNA, 19 nt, Homo sapiens
cugaaaagacucaguguuc

SEQ ID NO: 1114224 - RNA, 23 nt, Homo sapiens
cugaaaaucacuauaaccaucag

SEQ ID NO: 1114225 - RNA, 13 nt, Homo sapiens
cugaaaaucugga

SEQ ID NO: 1114226 - RNA, 13 nt, Homo sapiens
cugaaaauucugu

SEQ ID NO: 1114227 - RNA, 15 nt, Homo sapiens
cugaaauaaaagccu

SEQ ID NO: 1114228 - RNA, 12 nt, Homo sapiens
cugaacagccaa

SEQ ID NO: 1114229 - RNA, 15 nt, Homo sapiens
cugaaccacuuugcc

SEQ ID NO: 1114230 - RNA, 16 nt, Homo sapiens
cugaaccgacuuuucu

SEQ ID NO: 1114231 - RNA, 21 nt, Homo sapiens
cugaagaaaccuucagauuug

SEQ ID NO: 1114232 - RNA, 20 nt, Homo sapiens
cugaagaacaguaacugcca

SEQ ID NO: 1114233 - RNA, 16 nt, Homo sapiens
cugaaggugcugacaa

SEQ ID NO: 1114234 - RNA, 16 nt, Homo sapiens
cugaagucacaucaca

SEQ ID NO: 1114235 - RNA, 15 nt, Homo sapiens
cugaauaaacaggaa

SEQ ID NO: 1114236 - RNA, 19 nt, Homo sapiens
cugaauaccaaguguguug

SEQ ID NO: 1114237 - RNA, 14 nt, Homo sapiens
cugaaugacaucaa

SEQ ID NO: 1114238 - RNA, 18 nt, Homo sapiens
cugaaugauuuccaaaga

SEQ ID NO: 1114239 - RNA, 20 nt, Homo sapiens
cugaaugccucaaugugacc

SEQ ID NO: 1114240 - RNA, 13 nt, Homo sapiens
cugacaagcacug

SEQ ID NO: 1114241 - RNA, 18 nt, Homo sapiens
cugacacacagcucuguc

SEQ ID NO: 1114242 - RNA, 21 nt, Homo sapiens
cugacacuaccuuaucaggca

SEQ ID NO: 1114243 - RNA, 18 nt, Homo sapiens
cugaccccugcaccagcc

SEQ ID NO: 1114244 - RNA, 21 nt, Homo sapiens
cugaccuuucugagugacaug

SEQ ID NO: 1114245 - RNA, 12 nt, Homo sapiens
cugacucuugcc

SEQ ID NO: 1114246 - RNA, 18 nt, Homo sapiens
cugagaaacuuccuuuga

SEQ ID NO: 1114247 - RNA, 15 nt, Homo sapiens
cugagaaauguucag

SEQ ID NO: 1114248 - RNA, 15 nt, Homo sapiens
cugagaaggacaccu

SEQ ID NO: 1114249 - RNA, 12 nt, Homo sapiens
cugagaauucca

SEQ ID NO: 1114250 - RNA, 18 nt, Homo sapiens
cugagacuggaaauauga

SEQ ID NO: 1114251 - RNA, 20 nt, Homo sapiens
cugagagcauguuuuaucau

SEQ ID NO: 1114252 - RNA, 22 nt, Homo sapiens
cugagauugcgccacugcacuc

SEQ ID NO: 1114253 - RNA, 13 nt, Homo sapiens
cugagcccuggca

SEQ ID NO: 1114254 - RNA, 13 nt, Homo sapiens
cugagcucacuga

SEQ ID NO: 1114255 - RNA, 13 nt, Homo sapiens
cugaggauuucaa

SEQ ID NO: 1114256 - RNA, 16 nt, Homo sapiens
cugagugagccacaga

SEQ ID NO: 1114257 - RNA, 15 nt, Homo sapiens
cugagugcaccacuu

SEQ ID NO: 1114258 - RNA, 19 nt, Homo sapiens
cugaguggaucuccaagga

SEQ ID NO: 1114259 - RNA, 16 nt, Homo sapiens
cugaucagcaugggaa

SEQ ID NO: 1114260 - RNA, 21 nt, Homo sapiens
cugaugagagagugcugagaa

SEQ ID NO: 1114261 - RNA, 23 nt, Homo sapiens
cugaugcuuugcuucaaauccau

SEQ ID NO: 1114262 - RNA, 13 nt, Homo sapiens
ccacaccaucucc

SEQ ID NO: 1114263 - RNA, 20 nt, Homo sapiens
ccacagaccuaggauuucau

SEQ ID NO: 1114264 - RNA, 18 nt, Homo sapiens
ccacagagagaggggaga

SEQ ID NO: 1114265 - RNA, 20 nt, Homo sapiens
ccacagcagcugaacagcca

SEQ ID NO: 1114266 - RNA, 19 nt, Homo sapiens
ccaccauucacauuugaug

SEQ ID NO: 1114267 - RNA, 15 nt, Homo sapiens
ccacccaacaagcca

SEQ ID NO: 1114268 - RNA, 13 nt, Homo sapiens
ccacccacaugug

SEQ ID NO: 1114269 - RNA, 16 nt, Homo sapiens
ccacccccucccccau

SEQ ID NO: 1114270 - RNA, 17 nt, Homo sapiens
ccacccccuucagugcc

SEQ ID NO: 1114271 - RNA, 21 nt, Homo sapiens
ccacccugaggagucugaggu

SEQ ID NO: 1114272 - RNA, 21 nt, Homo sapiens
ccaccuacuuuucuuuccuca

SEQ ID NO: 1114273 - RNA, 16 nt, Homo sapiens
ccaccucuccuuuggc

SEQ ID NO: 1114274 - RNA, 22 nt, Homo sapiens
ccaccuguuaaaauguacacug

SEQ ID NO: 1114275 - RNA, 12 nt, Homo sapiens
ccaccuucuuca

SEQ ID NO: 1114276 - RNA, 15 nt, Homo sapiens
ccacggccaggccag

SEQ ID NO: 1114277 - RNA, 13 nt, Homo sapiens
ccacgugugcaga

SEQ ID NO: 1114278 - RNA, 19 nt, Homo sapiens
ccacgugugcagacugugg

SEQ ID NO: 1114279 - RNA, 17 nt, Homo sapiens
ccacucauuucaucuca

SEQ ID NO: 1114280 - RNA, 18 nt, Homo sapiens
ccacucuauacuagggac

SEQ ID NO: 1114281 - RNA, 14 nt, Homo sapiens
ccacuggacuugag

SEQ ID NO: 1114282 - RNA, 15 nt, Homo sapiens
ccacuguguauuuaa

SEQ ID NO: 1114283 - RNA, 22 nt, Homo sapiens
ccagaacaaaccucuauauguu

SEQ ID NO: 1114284 - RNA, 21 nt, Homo sapiens
ccagaagaauauucaggacuu

SEQ ID NO: 1114285 - RNA, 22 nt, Homo sapiens
ccagaaggcagggaaaggcucu

SEQ ID NO: 1114286 - RNA, 19 nt, Homo sapiens
ccagacccaccacaccgca

SEQ ID NO: 1114287 - RNA, 22 nt, Homo sapiens
ccagaccccaaggcccagacag

SEQ ID NO: 1114288 - RNA, 13 nt, Homo sapiens
ccagacccggcug

SEQ ID NO: 1114289 - RNA, 11 nt, Homo sapiens
ccagacugugg

SEQ ID NO: 1114290 - RNA, 23 nt, Homo sapiens
ccagacuuuaccacuaugcaaua

SEQ ID NO: 1114291 - RNA, 21 nt, Homo sapiens
ccagagaggggacauuucccu

SEQ ID NO: 1114292 - RNA, 16 nt, Homo sapiens
ccagagcaggaaagau

SEQ ID NO: 1114293 - RNA, 19 nt, Homo sapiens
ccagagcaggaaagaugau

SEQ ID NO: 1114294 - RNA, 21 nt, Homo sapiens
ccagagccccccacaaugaug

SEQ ID NO: 1114295 - RNA, 22 nt, Homo sapiens
ccagagccugucuuucagcauu

SEQ ID NO: 1114296 - RNA, 15 nt, Homo sapiens
ccagagugcugccag

SEQ ID NO: 1114297 - RNA, 16 nt, Homo sapiens
ccagcaacacaagcug

SEQ ID NO: 1114298 - RNA, 13 nt, Homo sapiens
ccagcacucugaa

SEQ ID NO: 1114299 - RNA, 18 nt, Homo sapiens
ccagcacucugaaacuga

SEQ ID NO: 1114300 - RNA, 13 nt, Homo sapiens
ccagccacacaga

SEQ ID NO: 1114301 - RNA, 23 nt, Homo sapiens
ccagccaucaugugccuggaaau

SEQ ID NO: 1114302 - RNA, 22 nt, Homo sapiens
ccagccugcuaauuccccagau

SEQ ID NO: 1114303 - RNA, 20 nt, Homo sapiens
ccagccugggcaacagagca

SEQ ID NO: 1114304 - RNA, 18 nt, Homo sapiens
ccagcggcugggugguga

SEQ ID NO: 1114305 - RNA, 15 nt, Homo sapiens
ccagcuacucaggag

SEQ ID NO: 1114306 - RNA, 22 nt, Homo sapiens
ccagcugaggcugggggcgggg

SEQ ID NO: 1114307 - RNA, 16 nt, Homo sapiens
ccagcugcaccugcca

SEQ ID NO: 1114308 - RNA, 18 nt, Homo sapiens
ccagcugcaccugccagc

SEQ ID NO: 1114309 - RNA, 16 nt, Homo sapiens
ccagcugcaucuacuc

SEQ ID NO: 1114310 - RNA, 13 nt, Homo sapiens
ccagcugcuccca

SEQ ID NO: 1114311 - RNA, 23 nt, Homo sapiens
ccaggaagguagcccagcacugu

SEQ ID NO: 1114312 - RNA, 13 nt, Homo sapiens
ccaggagacaguu

SEQ ID NO: 1114313 - RNA, 18 nt, Homo sapiens
ccaggaguuugagaccag

SEQ ID NO: 1114314 - RNA, 11 nt, Homo sapiens
ccaggauuuug

SEQ ID NO: 1114315 - RNA, 21 nt, Homo sapiens
ccaggcugagugagccacaga

SEQ ID NO: 1114316 - RNA, 23 nt, Homo sapiens
ccaggcuggcagauuuccaaaag

SEQ ID NO: 1114317 - RNA, 21 nt, Homo sapiens
ccaggcuucacccugaauggu

SEQ ID NO: 1114318 - RNA, 18 nt, Homo sapiens
ccagggaugacauguccc

SEQ ID NO: 1114319 - RNA, 22 nt, Homo sapiens
ccaggggaaugaucucugauga

SEQ ID NO: 1114320 - RNA, 14 nt, Homo sapiens
ccaggggacacugu

SEQ ID NO: 1114321 - RNA, 15 nt, Homo sapiens
ccaggucaacaucua

SEQ ID NO: 1114322 - RNA, 22 nt, Homo sapiens
ccaggucucuccacugcucuca

SEQ ID NO: 1114323 - RNA, 17 nt, Homo sapiens
ccaguaguggacaacag

SEQ ID NO: 1114324 - RNA, 14 nt, Homo sapiens
ccagugaaccaaag

SEQ ID NO: 1114325 - RNA, 15 nt, Homo sapiens
ccagugaaccaaaga

SEQ ID NO: 1114326 - RNA, 17 nt, Homo sapiens
ccagugaaccaaagaga

SEQ ID NO: 1114327 - RNA, 20 nt, Homo sapiens
ccagugcauguugccaugag

SEQ ID NO: 1114328 - RNA, 15 nt, Homo sapiens
ccagugcuaccucuc

SEQ ID NO: 1114329 - RNA, 18 nt, Homo sapiens
ccaguguuauuaaugaca

SEQ ID NO: 1114330 - RNA, 20 nt, Homo sapiens
ccaguguuuagaagagccug

SEQ ID NO: 1114331 - RNA, 13 nt, Homo sapiens
ccauagauggguc

SEQ ID NO: 1114332 - RNA, 19 nt, Homo sapiens
ccauagcaagauugcuuaa

SEQ ID NO: 1114333 - RNA, 20 nt, Homo sapiens
ccauauaucuuauguuaaag

SEQ ID NO: 1114334 - RNA, 22 nt, Homo sapiens
ccaucacccccuaccccagaaa

SEQ ID NO: 1114335 - RNA, 12 nt, Homo sapiens
ccaucacuggag

SEQ ID NO: 1114336 - RNA, 17 nt, Homo sapiens
ccauccaauucuuugaa

SEQ ID NO: 1114337 - RNA, 15 nt, Homo sapiens
ccaucuaugucccuu

SEQ ID NO: 1114338 - RNA, 17 nt, Homo sapiens
ccaucuccuuucaggga

SEQ ID NO: 1114339 - RNA, 23 nt, Homo sapiens
ccaugagaguagagggcacuggg

SEQ ID NO: 1114340 - RNA, 21 nt, Homo sapiens
ccaugccucuccaacaucuuc

SEQ ID NO: 1114341 - RNA, 14 nt, Homo sapiens
ccaugccugagggu

SEQ ID NO: 1114342 - RNA, 21 nt, Homo sapiens
ccauggacagaagaaggcagc

SEQ ID NO: 1114343 - RNA, 16 nt, Homo sapiens
ccaugggggugcugca

SEQ ID NO: 1114344 - RNA, 17 nt, Homo sapiens
ccaugggggugcugcag

SEQ ID NO: 1114345 - RNA, 13 nt, Homo sapiens
ccaugguuuuacu

SEQ ID NO: 1114346 - RNA, 17 nt, Homo sapiens
ccauguaccaguguacu

SEQ ID NO: 1114347 - RNA, 13 nt, Homo sapiens
ccauuuguaaugu

SEQ ID NO: 1114348 - RNA, 14 nt, Homo sapiens
ccauuuugcaaaau

SEQ ID NO: 1114349 - RNA, 23 nt, Homo sapiens
ccauuuuuuucauuguguucucu

SEQ ID NO: 1114350 - RNA, 12 nt, Homo sapiens
cccaaagagccu

SEQ ID NO: 1114351 - RNA, 14 nt, Homo sapiens
cccaaaucccacag

SEQ ID NO: 1114352 - RNA, 20 nt, Homo sapiens
cccaaauuaaguauguuuga

SEQ ID NO: 1114353 - RNA, 18 nt, Homo sapiens
cccaagugaaaucaaagg

SEQ ID NO: 1114354 - RNA, 18 nt, Homo sapiens
cccaaguuauugggaugu

SEQ ID NO: 1114355 - RNA, 22 nt, Homo sapiens
cccacacugaccuguguucccu

SEQ ID NO: 1114356 - RNA, 15 nt, Homo sapiens
cccacagggaccaag

SEQ ID NO: 1114357 - RNA, 19 nt, Homo sapiens
cccacaugugacacauaug

SEQ ID NO: 1114358 - RNA, 23 nt, Homo sapiens
cccacaugugacacauaugcacc

SEQ ID NO: 1114359 - RNA, 14 nt, Homo sapiens
cccacccacaugug

SEQ ID NO: 1114360 - RNA, 17 nt, Homo sapiens
cccacccacaugugaca

SEQ ID NO: 1114361 - RNA, 21 nt, Homo sapiens
cccacccuccuuucaccacau

SEQ ID NO: 1114362 - RNA, 20 nt, Homo sapiens
cccaccuccgccccagacac

SEQ ID NO: 1114363 - RNA, 23 nt, Homo sapiens
cccaccuccgcugggaggaaccu

SEQ ID NO: 1114364 - RNA, 22 nt, Homo sapiens
cccacucccuggcucucagaag

SEQ ID NO: 1114365 - RNA, 15 nt, Homo sapiens
cccacuggcauuaaa

SEQ ID NO: 1114366 - RNA, 15 nt, Homo sapiens
cccacuucugccaua

SEQ ID NO: 1114367 - RNA, 14 nt, Homo sapiens
cccagagaccccuu

SEQ ID NO: 1114368 - RNA, 21 nt, Homo sapiens
cccagagaggggacauuuccc

SEQ ID NO: 1114369 - RNA, 21 nt, Homo sapiens
cccagagcccagggcauccca

SEQ ID NO: 1114370 - RNA, 12 nt, Homo sapiens
cccagaucucau

SEQ ID NO: 1114371 - RNA, 12 nt, Homo sapiens
cccagauugcaa

SEQ ID NO: 1114372 - RNA, 16 nt, Homo sapiens
cccagcaacacaagcu

SEQ ID NO: 1114373 - RNA, 13 nt, Homo sapiens
cccagcuacucag

SEQ ID NO: 1114374 - RNA, 21 nt, Homo sapiens
cccagcuuaauggcucaugac

SEQ ID NO: 1114375 - RNA, 16 nt, Homo sapiens
cccaggaacugggcca

SEQ ID NO: 1114376 - RNA, 15 nt, Homo sapiens
cccaggaccucugga

SEQ ID NO: 1114377 - RNA, 23 nt, Homo sapiens
cccaggagaagaaagaggugacc

SEQ ID NO: 1114378 - RNA, 17 nt, Homo sapiens
cccaggcaaacuugcac

SEQ ID NO: 1114379 - RNA, 17 nt, Homo sapiens
cccaggcuggagugcag

SEQ ID NO: 1114380 - RNA, 22 nt, Homo sapiens
cccaggcuucacccugaauggu

SEQ ID NO: 1114381 - RNA, 13 nt, Homo sapiens
cccagggcuaccc

SEQ ID NO: 1114382 - RNA, 19 nt, Homo sapiens
cccagucuggaaugcagug

SEQ ID NO: 1114383 - RNA, 23 nt, Homo sapiens
cccaguuaaauuuucauuucaga

SEQ ID NO: 1114384 - RNA, 17 nt, Homo sapiens
cccauaauuuucuucau

SEQ ID NO: 1114385 - RNA, 14 nt, Homo sapiens
cccauagcuuccau

SEQ ID NO: 1114386 - RNA, 12 nt, Homo sapiens
cccaucauccca

SEQ ID NO: 1114387 - RNA, 21 nt, Homo sapiens
cccaugaaucaaagacaugga

SEQ ID NO: 1114388 - RNA, 20 nt, Homo sapiens
cccaugcccuggauccauca

SEQ ID NO: 1114389 - RNA, 21 nt, Homo sapiens
cccauggcuuuagcuaccuca

SEQ ID NO: 1114390 - RNA, 18 nt, Homo sapiens
cccaugggggugcugcag

SEQ ID NO: 1114391 - RNA, 22 nt, Homo sapiens
cccauugucaccuaacucugaa

SEQ ID NO: 1114392 - RNA, 17 nt, Homo sapiens
cccauuuugagugacuc

SEQ ID NO: 1114393 - RNA, 13 nt, Homo sapiens
ccccaaagucuua

SEQ ID NO: 1114394 - RNA, 22 nt, Homo sapiens
ccccacuucucuacucuggaag

SEQ ID NO: 1114395 - RNA, 13 nt, Homo sapiens
ccccagacacugg

SEQ ID NO: 1114396 - RNA, 20 nt, Homo sapiens
ccccagauggccgggacaug

SEQ ID NO: 1114397 - RNA, 21 nt, Homo sapiens
ccccaucaucccagcugcucc

SEQ ID NO: 1114398 - RNA, 18 nt, Homo sapiens
ccccaugaccuccagcuu

SEQ ID NO: 1114399 - RNA, 16 nt, Homo sapiens
cccccaucucuacaaa

SEQ ID NO: 1114400 - RNA, 17 nt, Homo sapiens
cccccgucuucucucca

SEQ ID NO: 1114401 - RNA, 21 nt, Homo sapiens
cccccugacauuaucuuggau

SEQ ID NO: 1114402 - RNA, 14 nt, Homo sapiens
cccccuucagugcc

SEQ ID NO: 1114403 - RNA, 13 nt, Homo sapiens
ccccuacaugaaa

SEQ ID NO: 1114404 - RNA, 11 nt, Homo sapiens
ccccucaaaaa

SEQ ID NO: 1114405 - RNA, 22 nt, Homo sapiens
ccccuuauccaggacucuguca

SEQ ID NO: 1114406 - RNA, 21 nt, Homo sapiens
ccccuucuuuuuugucucaag

SEQ ID NO: 1114407 - RNA, 18 nt, Homo sapiens
ccccuugccagacaugug

SEQ ID NO: 1114408 - RNA, 22 nt, Homo sapiens
cccgccgccuccugcaccgaga

SEQ ID NO: 1114409 - RNA, 21 nt, Homo sapiens
cccggcucccccugcuucuca

SEQ ID NO: 1114410 - RNA, 17 nt, Homo sapiens
cccggcugucaaggggu

SEQ ID NO: 1114411 - RNA, 22 nt, Homo sapiens
cccggggcuggcggcuacucag

SEQ ID NO: 1114412 - RNA, 14 nt, Homo sapiens
cccgucauguuccu

SEQ ID NO: 1114413 - RNA, 22 nt, Homo sapiens
cccgucauguuccucaaaagca

SEQ ID NO: 1114414 - RNA, 13 nt, Homo sapiens
cccuaugcuccag

SEQ ID NO: 1114415 - RNA, 20 nt, Homo sapiens
cccucaaaugacccaaagac

SEQ ID NO: 1114416 - RNA, 21 nt, Homo sapiens
cccucaaucccagcuacucaa

SEQ ID NO: 1114417 - RNA, 23 nt, Homo sapiens
cccucugcuuuucuucccagcaa

SEQ ID NO: 1114418 - RNA, 13 nt, Homo sapiens
cccugaacaucug

SEQ ID NO: 1114419 - RNA, 18 nt, Homo sapiens
cccugacauuaucuugga

SEQ ID NO: 1114420 - RNA, 16 nt, Homo sapiens
cccugaccucccagcc

SEQ ID NO: 1114421 - RNA, 16 nt, Homo sapiens
cccugagucaccagga

SEQ ID NO: 1114422 - RNA, 18 nt, Homo sapiens
cccugcagggccaagcac

SEQ ID NO: 1114423 - RNA, 11 nt, Homo sapiens
cccugcauguu

SEQ ID NO: 1114424 - RNA, 19 nt, Homo sapiens
cccugcauugcugagucaa

SEQ ID NO: 1114425 - RNA, 13 nt, Homo sapiens
cccugccaguguu

SEQ ID NO: 1114426 - RNA, 14 nt, Homo sapiens
cccuggagugcagu

SEQ ID NO: 1114427 - RNA, 21 nt, Homo sapiens
cccugggacguggcuagucau

SEQ ID NO: 1114428 - RNA, 19 nt, Homo sapiens
cccugggccccaccaccua

SEQ ID NO: 1114429 - RNA, 21 nt, Homo sapiens
cccuggggcuucuccugaccc

SEQ ID NO: 1114430 - RNA, 22 nt, Homo sapiens
cccuggggcuucuccugaccca

SEQ ID NO: 1114431 - RNA, 11 nt, Homo sapiens
cccuguacaau

SEQ ID NO: 1114432 - RNA, 21 nt, Homo sapiens
cccuguaccacaaacacauua

SEQ ID NO: 1114433 - RNA, 16 nt, Homo sapiens
cccuguuucucuugaa

SEQ ID NO: 1114434 - RNA, 22 nt, Homo sapiens
cccuuauccaggacucugucaa

SEQ ID NO: 1114435 - RNA, 11 nt, Homo sapiens
cccuuucacaa

SEQ ID NO: 1114436 - RNA, 22 nt, Homo sapiens
cccuuuccugggggaugugcac

SEQ ID NO: 1114437 - RNA, 14 nt, Homo sapiens
ccgaagucuuccau

SEQ ID NO: 1114438 - RNA, 21 nt, Homo sapiens
ccgacaggcaugcaccagugc

SEQ ID NO: 1114439 - RNA, 13 nt, Homo sapiens
caugcaaugacau

SEQ ID NO: 1114440 - RNA, 19 nt, Homo sapiens
caugcacuuggcugcauaa

SEQ ID NO: 1114441 - RNA, 19 nt, Homo sapiens
caugccacccuguuuucag

SEQ ID NO: 1114442 - RNA, 17 nt, Homo sapiens
caugccauuuguacuga

SEQ ID NO: 1114443 - RNA, 22 nt, Homo sapiens
caugccucugaggccagccugg

SEQ ID NO: 1114444 - RNA, 13 nt, Homo sapiens
caugcuggggcaa

SEQ ID NO: 1114445 - RNA, 15 nt, Homo sapiens
cauggagaaacccug

SEQ ID NO: 1114446 - RNA, 17 nt, Homo sapiens
cauggccuaugcacaua

SEQ ID NO: 1114447 - RNA, 20 nt, Homo sapiens
caugguaaaaccccaucucu

SEQ ID NO: 1114448 - RNA, 16 nt, Homo sapiens
caugguacuaguguuu

SEQ ID NO: 1114449 - RNA, 13 nt, Homo sapiens
cauggugcacuga

SEQ ID NO: 1114450 - RNA, 22 nt, Homo sapiens
cauguccuauccaaaggaauca

SEQ ID NO: 1114451 - RNA, 16 nt, Homo sapiens
caugucgccucugcau

SEQ ID NO: 1114452 - RNA, 18 nt, Homo sapiens
caugucuuguacaugugu

SEQ ID NO: 1114453 - RNA, 22 nt, Homo sapiens
caugugccagguuuuuggucug

SEQ ID NO: 1114454 - RNA, 19 nt, Homo sapiens
cauguggcuaaaugccuaa

SEQ ID NO: 1114455 - RNA, 19 nt, Homo sapiens
cauguggugggacagggac

SEQ ID NO: 1114456 - RNA, 17 nt, Homo sapiens
cauguguugccuggaag

SEQ ID NO: 1114457 - RNA, 16 nt, Homo sapiens
cauguguuuacuuuau

SEQ ID NO: 1114458 - RNA, 14 nt, Homo sapiens
cauguuccucaaaa

SEQ ID NO: 1114459 - RNA, 15 nt, Homo sapiens
cauguuggcccagac

SEQ ID NO: 1114460 - RNA, 21 nt, Homo sapiens
cauuaaaaaugaaagccaaau

SEQ ID NO: 1114461 - RNA, 17 nt, Homo sapiens
cauuaaaaaugcauaua

SEQ ID NO: 1114462 - RNA, 23 nt, Homo sapiens
cauuaaaaaugcauauacuuuaa

SEQ ID NO: 1114463 - RNA, 13 nt, Homo sapiens
cauuaaacacugu

SEQ ID NO: 1114464 - RNA, 15 nt, Homo sapiens
cauuaaacacuguaa

SEQ ID NO: 1114465 - RNA, 16 nt, Homo sapiens
cauuaauauuugcuga

SEQ ID NO: 1114466 - RNA, 17 nt, Homo sapiens
cauuaccauggagacaa

SEQ ID NO: 1114467 - RNA, 23 nt, Homo sapiens
cauuagaaacugaaaacuguaaa

SEQ ID NO: 1114468 - RNA, 21 nt, Homo sapiens
cauuauagauuuucauguucu

SEQ ID NO: 1114469 - RNA, 18 nt, Homo sapiens
cauuaucgggagcagugu

SEQ ID NO: 1114470 - RNA, 17 nt, Homo sapiens
cauuauuaaauguuucu

SEQ ID NO: 1114471 - RNA, 19 nt, Homo sapiens
cauuauuaaauguuucuca

SEQ ID NO: 1114472 - RNA, 17 nt, Homo sapiens
cauuauuuugaauguga

SEQ ID NO: 1114473 - RNA, 14 nt, Homo sapiens
cauucaacagauca

SEQ ID NO: 1114474 - RNA, 14 nt, Homo sapiens
cauucaacugaaaa

SEQ ID NO: 1114475 - RNA, 18 nt, Homo sapiens
cauucaauguuuaugcaa

SEQ ID NO: 1114476 - RNA, 12 nt, Homo sapiens
cauucacaucuc

SEQ ID NO: 1114477 - RNA, 14 nt, Homo sapiens
cauucacaucucau

SEQ ID NO: 1114478 - RNA, 21 nt, Homo sapiens
cauucacauuugauguacaug

SEQ ID NO: 1114479 - RNA, 12 nt, Homo sapiens
cauucacuuguu

SEQ ID NO: 1114480 - RNA, 17 nt, Homo sapiens
cauucauuuaacagagc

SEQ ID NO: 1114481 - RNA, 15 nt, Homo sapiens
cauucccagugguca

SEQ ID NO: 1114482 - RNA, 21 nt, Homo sapiens
cauucccugagucaccaggaa

SEQ ID NO: 1114483 - RNA, 20 nt, Homo sapiens
cauuccugaaagaaacaguu

SEQ ID NO: 1114484 - RNA, 17 nt, Homo sapiens
cauucuaguacuuggga

SEQ ID NO: 1114485 - RNA, 20 nt, Homo sapiens
cauucugauucgaaugacac

SEQ ID NO: 1114486 - RNA, 16 nt, Homo sapiens
cauucugcucuuugau

SEQ ID NO: 1114487 - RNA, 23 nt, Homo sapiens
cauucuuguuuuaagugccuuua

SEQ ID NO: 1114488 - RNA, 18 nt, Homo sapiens
cauucuuuaucuugacau

SEQ ID NO: 1114489 - RNA, 20 nt, Homo sapiens
cauugaaagagaaccaguuu

SEQ ID NO: 1114490 - RNA, 18 nt, Homo sapiens
cauuguagaaaagcuaua

SEQ ID NO: 1114491 - RNA, 21 nt, Homo sapiens
cauuuaaauuagauaacaaaa

SEQ ID NO: 1114492 - RNA, 22 nt, Homo sapiens
cauuuagaggacauucuggaaa

SEQ ID NO: 1114493 - RNA, 22 nt, Homo sapiens
cauuuaugucucagaccacuau

SEQ ID NO: 1114494 - RNA, 16 nt, Homo sapiens
cauuucuauagccaaa

SEQ ID NO: 1114495 - RNA, 14 nt, Homo sapiens
cauuucuaucacau

SEQ ID NO: 1114496 - RNA, 22 nt, Homo sapiens
cauuucucaaaugcacaucuca

SEQ ID NO: 1114497 - RNA, 23 nt, Homo sapiens
cauuucucaaaugcacaucucau

SEQ ID NO: 1114498 - RNA, 13 nt, Homo sapiens
cauuucuugaugu

SEQ ID NO: 1114499 - RNA, 22 nt, Homo sapiens
cauuucuuuuccaaaauuacuu

SEQ ID NO: 1114500 - RNA, 16 nt, Homo sapiens
cauuugaguauuacaa

SEQ ID NO: 1114501 - RNA, 13 nt, Homo sapiens
cauuuugcauuag

SEQ ID NO: 1114502 - RNA, 21 nt, Homo sapiens
cauuuugcauuagacagauga

SEQ ID NO: 1114503 - RNA, 16 nt, Homo sapiens
cauuuuguacaaagau

SEQ ID NO: 1114504 - RNA, 17 nt, Homo sapiens
ccaaacuugacaguaaa

SEQ ID NO: 1114505 - RNA, 13 nt, Homo sapiens
ccaaagacuacac

SEQ ID NO: 1114506 - RNA, 16 nt, Homo sapiens
ccaaagacuacacugu

SEQ ID NO: 1114507 - RNA, 22 nt, Homo sapiens
ccaaagcaugauugugaccucc

SEQ ID NO: 1114508 - RNA, 17 nt, Homo sapiens
ccaaagugcugggauua

SEQ ID NO: 1114509 - RNA, 19 nt, Homo sapiens
ccaaaugcauggugcaguu

SEQ ID NO: 1114510 - RNA, 14 nt, Homo sapiens
ccaaauuacgugua

SEQ ID NO: 1114511 - RNA, 20 nt, Homo sapiens
ccaaauuacguguacuacaa

SEQ ID NO: 1114512 - RNA, 17 nt, Homo sapiens
ccaaccccccaccugcc

SEQ ID NO: 1114513 - RNA, 14 nt, Homo sapiens
ccaaccuccugacc

SEQ ID NO: 1114514 - RNA, 18 nt, Homo sapiens
ccaagaaugagaagaaug

SEQ ID NO: 1114515 - RNA, 16 nt, Homo sapiens
ccaagacacagaucac

SEQ ID NO: 1114516 - RNA, 10 nt, Homo sapiens
ccaagagcua

SEQ ID NO: 1114517 - RNA, 17 nt, Homo sapiens
ccaagauaaaaccagag

SEQ ID NO: 1114518 - RNA, 20 nt, Homo sapiens
ccaagauaaaaccagagcag

SEQ ID NO: 1114519 - RNA, 12 nt, Homo sapiens
ccaagcucugcu

SEQ ID NO: 1114520 - RNA, 22 nt, Homo sapiens
ccaagcuucaacccucagccuu

SEQ ID NO: 1114521 - RNA, 21 nt, Homo sapiens
ccaaggcaggaggaucacuug

SEQ ID NO: 1114522 - RNA, 14 nt, Homo sapiens
ccaaggcugcucag

SEQ ID NO: 1114523 - RNA, 12 nt, Homo sapiens
ccaauagcuuua

SEQ ID NO: 1114524 - RNA, 16 nt, Homo sapiens
ccaauauuuguagaag

SEQ ID NO: 1114525 - RNA, 14 nt, Homo sapiens
ccaauuuacuuugu

SEQ ID NO: 1114526 - RNA, 19 nt, Homo sapiens
ccacaaucugggacuuuca

SEQ ID NO: 1114527 - RNA, 20 nt, Homo sapiens
ccacaauucacuagaccaga

SEQ ID NO: 1114528 - RNA, 18 nt, Homo sapiens
agccugcagacucacugu

SEQ ID NO: 1114529 - RNA, 21 nt, Homo sapiens
agccugcuuuuguccuguuau

SEQ ID NO: 1114530 - RNA, 14 nt, Homo sapiens
agccugggcaacaa

SEQ ID NO: 1114531 - RNA, 20 nt, Homo sapiens
agccugugaacccaggacaa

SEQ ID NO: 1114532 - RNA, 17 nt, Homo sapiens
agcgagagucugucuca

SEQ ID NO: 1114533 - RNA, 17 nt, Homo sapiens
agcguagcuaagugaaa

SEQ ID NO: 1114534 - RNA, 23 nt, Homo sapiens
agcuaaggucacauugugccuuu

SEQ ID NO: 1114535 - RNA, 23 nt, Homo sapiens
agcuacguauuuaauagcaaaga

SEQ ID NO: 1114536 - RNA, 22 nt, Homo sapiens
agcuacuguuuauuauuuuauu

SEQ ID NO: 1114537 - RNA, 14 nt, Homo sapiens
agcuagaaggccac

SEQ ID NO: 1114538 - RNA, 22 nt, Homo sapiens
agcuaugaaggcuguacacugc

SEQ ID NO: 1114539 - RNA, 16 nt, Homo sapiens
agcuaugaucgcgcca

SEQ ID NO: 1114540 - RNA, 13 nt, Homo sapiens
agcucacagucua

SEQ ID NO: 1114541 - RNA, 16 nt, Homo sapiens
agcucaggcacacuuc

SEQ ID NO: 1114542 - RNA, 18 nt, Homo sapiens
agcuccacuuucagugaa

SEQ ID NO: 1114543 - RNA, 23 nt, Homo sapiens
agcuccuucuguccuacucugug

SEQ ID NO: 1114544 - RNA, 15 nt, Homo sapiens
agcucgguggaccca

SEQ ID NO: 1114545 - RNA, 15 nt, Homo sapiens
agcucugaacaaaag

SEQ ID NO: 1114546 - RNA, 19 nt, Homo sapiens
agcucugcuccucucccca

SEQ ID NO: 1114547 - RNA, 15 nt, Homo sapiens
agcucuggaccagcc

SEQ ID NO: 1114548 - RNA, 20 nt, Homo sapiens
agcucuguuuauaaaaacaa

SEQ ID NO: 1114549 - RNA, 17 nt, Homo sapiens
agcugaacaaugaaugc

SEQ ID NO: 1114550 - RNA, 12 nt, Homo sapiens
agcugaacccau

SEQ ID NO: 1114551 - RNA, 15 nt, Homo sapiens
agcugagauuccugg

SEQ ID NO: 1114552 - RNA, 13 nt, Homo sapiens
agcugcaccugcc

SEQ ID NO: 1114553 - RNA, 14 nt, Homo sapiens
agcugcaccugcca

SEQ ID NO: 1114554 - RNA, 19 nt, Homo sapiens
agcugcagaugccacaccu

SEQ ID NO: 1114555 - RNA, 21 nt, Homo sapiens
agcugcagucaacaguucaaa

SEQ ID NO: 1114556 - RNA, 15 nt, Homo sapiens
agcugcaucuacuca

SEQ ID NO: 1114557 - RNA, 16 nt, Homo sapiens
agcugcucccaaauaa

SEQ ID NO: 1114558 - RNA, 18 nt, Homo sapiens
agcugcucgcacagauua

SEQ ID NO: 1114559 - RNA, 14 nt, Homo sapiens
agcuggaagcacau

SEQ ID NO: 1114560 - RNA, 17 nt, Homo sapiens
agcugggacuacaggug

SEQ ID NO: 1114561 - RNA, 23 nt, Homo sapiens
agcugggauaaucacauuaucau

SEQ ID NO: 1114562 - RNA, 16 nt, Homo sapiens
agcuggugguaucuga

SEQ ID NO: 1114563 - RNA, 17 nt, Homo sapiens
agcugugaccugcugag

SEQ ID NO: 1114564 - RNA, 17 nt, Homo sapiens
agcuguuccacuucucu

SEQ ID NO: 1114565 - RNA, 16 nt, Homo sapiens
agcuguuuucccugac

SEQ ID NO: 1114566 - RNA, 13 nt, Homo sapiens
agcuuacaagacc

SEQ ID NO: 1114567 - RNA, 19 nt, Homo sapiens
agcuucauuuccgugaagg

SEQ ID NO: 1114568 - RNA, 21 nt, Homo sapiens
agcuuccagugcauguugcca

SEQ ID NO: 1114569 - RNA, 16 nt, Homo sapiens
agcuugaaaacucacu

SEQ ID NO: 1114570 - RNA, 14 nt, Homo sapiens
agcuuggaaacugg

SEQ ID NO: 1114571 - RNA, 18 nt, Homo sapiens
agcuuuacaaauauguca

SEQ ID NO: 1114572 - RNA, 12 nt, Homo sapiens
agucuugucuca

SEQ ID NO: 1114573 - RNA, 15 nt, Homo sapiens
agucuugucucaaga

SEQ ID NO: 1114574 - RNA, 20 nt, Homo sapiens
agucuuuauuguguaucaua

SEQ ID NO: 1114575 - RNA, 22 nt, Homo sapiens
agucuuuccgucucccuaaaau

SEQ ID NO: 1114576 - RNA, 16 nt, Homo sapiens
agugaaaaacuauuaa

SEQ ID NO: 1114577 - RNA, 20 nt, Homo sapiens
agugaaagcaucacuuggga

SEQ ID NO: 1114578 - RNA, 14 nt, Homo sapiens
agugaaauaauuaa

SEQ ID NO: 1114579 - RNA, 21 nt, Homo sapiens
agugaaauaauuaaaaaccac

SEQ ID NO: 1114580 - RNA, 16 nt, Homo sapiens
agugaaggagccagug

SEQ ID NO: 1114581 - RNA, 16 nt, Homo sapiens
agugaauaaacuucag

SEQ ID NO: 1114582 - RNA, 22 nt, Homo sapiens
agugacagagacccagaucuca

SEQ ID NO: 1114583 - RNA, 21 nt, Homo sapiens
agugaccaggcucacaacugu

SEQ ID NO: 1114584 - RNA, 19 nt, Homo sapiens
agugacccacaugccauuu

SEQ ID NO: 1114585 - RNA, 20 nt, Homo sapiens
agugagacaaucacagcucc

SEQ ID NO: 1114586 - RNA, 15 nt, Homo sapiens
agugagaucuucaau

SEQ ID NO: 1114587 - RNA, 17 nt, Homo sapiens
agugagcucuggaugaa

SEQ ID NO: 1114588 - RNA, 16 nt, Homo sapiens
agugaguuacagcgag

SEQ ID NO: 1114589 - RNA, 21 nt, Homo sapiens
agugauugacacacagcacuc

SEQ ID NO: 1114590 - RNA, 22 nt, Homo sapiens
agugauugauagaguguuauca

SEQ ID NO: 1114591 - RNA, 16 nt, Homo sapiens
agugauuugccucaac

SEQ ID NO: 1114592 - RNA, 17 nt, Homo sapiens
agugcaaauuugauaca

SEQ ID NO: 1114593 - RNA, 12 nt, Homo sapiens
agugcaccacuu

SEQ ID NO: 1114594 - RNA, 17 nt, Homo sapiens
agugcauguugccauga

SEQ ID NO: 1114595 - RNA, 14 nt, Homo sapiens
agugcccucaucca

SEQ ID NO: 1114596 - RNA, 18 nt, Homo sapiens
agugccuggcaaggccuc

SEQ ID NO: 1114597 - RNA, 14 nt, Homo sapiens
agugccuuuaguuu

SEQ ID NO: 1114598 - RNA, 22 nt, Homo sapiens
agugcuaagaaagcaagccaau

SEQ ID NO: 1114599 - RNA, 12 nt, Homo sapiens
agugcuaccucu

SEQ ID NO: 1114600 - RNA, 13 nt, Homo sapiens
agugcuaccucuc

SEQ ID NO: 1114601 - RNA, 15 nt, Homo sapiens
aguggaucuccaagg

SEQ ID NO: 1114602 - RNA, 16 nt, Homo sapiens
aguggcauucacaucu

SEQ ID NO: 1114603 - RNA, 14 nt, Homo sapiens
aguggccaugccac

SEQ ID NO: 1114604 - RNA, 23 nt, Homo sapiens
aguggcucacgccuaugauccca

SEQ ID NO: 1114605 - RNA, 21 nt, Homo sapiens
aguggcugaaauaaaagccuc

SEQ ID NO: 1114606 - RNA, 17 nt, Homo sapiens
agugggugaauguguga

SEQ ID NO: 1114607 - RNA, 24 nt, Homo sapiens
agugggugguggaucuguccaagg

SEQ ID NO: 1114608 - RNA, 15 nt, Homo sapiens
aguggucgcuuacuu

SEQ ID NO: 1114609 - RNA, 19 nt, Homo sapiens
aguguaaagaauaaaugaa

SEQ ID NO: 1114610 - RNA, 22 nt, Homo sapiens
aguguaccgcgucuacccuggg

SEQ ID NO: 1114611 - RNA, 18 nt, Homo sapiens
aguguccucuugcucaaa

SEQ ID NO: 1114612 - RNA, 23 nt, Homo sapiens
aguguggcccagggaagccaaaa

SEQ ID NO: 1114613 - RNA, 19 nt, Homo sapiens
aguguguugggaauugcau

SEQ ID NO: 1114614 - RNA, 21 nt, Homo sapiens
aguguugaagaagaguuugca

SEQ ID NO: 1114615 - RNA, 19 nt, Homo sapiens
aguuaaggauuguuuuaaa

SEQ ID NO: 1114616 - RNA, 20 nt, Homo sapiens
aguuaaggggagcaacagag

SEQ ID NO: 1114617 - RNA, 13 nt, Homo sapiens
aguuaaucuucau

SEQ ID NO: 1114618 - RNA, 23 nt, Homo sapiens
aguuacccugcauguuggcccag

SEQ ID NO: 1114619 - RNA, 16 nt, Homo sapiens
aguuagguagcuuuag

SEQ ID NO: 1114620 - RNA, 22 nt, Homo sapiens
aguuagguagcuuuagggcaau

SEQ ID NO: 1114621 - RNA, 18 nt, Homo sapiens
aguucaggaagguacaaa

SEQ ID NO: 1114622 - RNA, 20 nt, Homo sapiens
aguucaggaagguacaaaca

SEQ ID NO: 1114623 - RNA, 23 nt, Homo sapiens
aguucaguggcauucacaucuca

SEQ ID NO: 1114624 - RNA, 18 nt, Homo sapiens
aguucauagggucucuuc

SEQ ID NO: 1114625 - RNA, 22 nt, Homo sapiens
aguucaucuauggcaguccagc

SEQ ID NO: 1114626 - RNA, 21 nt, Homo sapiens
aguuccagauuguucugucca

SEQ ID NO: 1114627 - RNA, 18 nt, Homo sapiens
aguuccccucuacuccau

SEQ ID NO: 1114628 - RNA, 23 nt, Homo sapiens
aguucucaucccucugucagggu

SEQ ID NO: 1114629 - RNA, 23 nt, Homo sapiens
aguugaaagaguccuauuugcac

SEQ ID NO: 1114630 - RNA, 15 nt, Homo sapiens
aguugaacaucucac

SEQ ID NO: 1114631 - RNA, 15 nt, Homo sapiens
aguugacuugacaga

SEQ ID NO: 1114632 - RNA, 14 nt, Homo sapiens
aguugaggaauaug

SEQ ID NO: 1114633 - RNA, 21 nt, Homo sapiens
aguugagucuccucucugaga

SEQ ID NO: 1114634 - RNA, 21 nt, Homo sapiens
aguugaugaccaaucucugug

SEQ ID NO: 1114635 - RNA, 16 nt, Homo sapiens
aguugcacauuaggaa

SEQ ID NO: 1114636 - RNA, 18 nt, Homo sapiens
aguugcguggacucugca

SEQ ID NO: 1114637 - RNA, 20 nt, Homo sapiens
aguugcguggacucugcaca

SEQ ID NO: 1114638 - RNA, 16 nt, Homo sapiens
aguugcugaugaacuc

SEQ ID NO: 1114639 - RNA, 22 nt, Homo sapiens
aguuggaaccguguccagcaca

SEQ ID NO: 1114640 - RNA, 22 nt, Homo sapiens
aguugugagcacucuacugcaa

SEQ ID NO: 1114641 - RNA, 15 nt, Homo sapiens
aguuuaagucucuga

SEQ ID NO: 1114642 - RNA, 19 nt, Homo sapiens
aguuuagugcccucaucca

SEQ ID NO: 1114643 - RNA, 23 nt, Homo sapiens
aguuuauuuguugagagugugac

SEQ ID NO: 1114644 - RNA, 22 nt, Homo sapiens
aguuucuucuuuaggcauuaaa

SEQ ID NO: 1114645 - RNA, 17 nt, Homo sapiens
aguuugucagacuuuaa

SEQ ID NO: 1114646 - RNA, 22 nt, Homo sapiens
aguuuguuuuuaaaaaaaucua

SEQ ID NO: 1114647 - RNA, 14 nt, Homo sapiens
auaaaaacccugua

SEQ ID NO: 1114648 - RNA, 21 nt, Homo sapiens
auaaaaacccuguauggcacu

SEQ ID NO: 1114649 - RNA, 12 nt, Homo sapiens
auaaaaauaccu

SEQ ID NO: 1114650 - RNA, 21 nt, Homo sapiens
auaaaagaaccgagcaauuuu

SEQ ID NO: 1114651 - RNA, 21 nt, Homo sapiens
auaaaauauacaaacaugugg

SEQ ID NO: 1114652 - RNA, 19 nt, Homo sapiens
auaaaaugcuuuauuaauu

SEQ ID NO: 1114653 - RNA, 15 nt, Homo sapiens
auaaaauuaugccau

SEQ ID NO: 1114654 - RNA, 20 nt, Homo sapiens
auaaacaaauaacaaugugc

SEQ ID NO: 1114655 - RNA, 20 nt, Homo sapiens
auaaacacccaugaaucaaa

SEQ ID NO: 1114656 - RNA, 15 nt, Homo sapiens
auaaacauccuucaa

SEQ ID NO: 1114657 - RNA, 22 nt, Homo sapiens
auaaacauccuucaagaacucu

SEQ ID NO: 1114658 - RNA, 15 nt, Homo sapiens
auaaacuagaucucc

SEQ ID NO: 1114659 - RNA, 21 nt, Homo sapiens
auaaagaugucaaauaucuca

SEQ ID NO: 1114660 - RNA, 21 nt, Homo sapiens
aauuuuguuuguaauccugua

SEQ ID NO: 1114661 - RNA, 17 nt, Homo sapiens
aauuuuuauacauauca

SEQ ID NO: 1114662 - RNA, 14 nt, Homo sapiens
acaaaaaauuagcu

SEQ ID NO: 1114663 - RNA, 21 nt, Homo sapiens
acaaaaaauuugagaaagccu

SEQ ID NO: 1114664 - RNA, 14 nt, Homo sapiens
acaaaaacaacuua

SEQ ID NO: 1114665 - RNA, 12 nt, Homo sapiens
acaaaaugcaag

SEQ ID NO: 1114666 - RNA, 22 nt, Homo sapiens
acaaacauaucaaacauaugua

SEQ ID NO: 1114667 - RNA, 14 nt, Homo sapiens
acaaagaaauauua

SEQ ID NO: 1114668 - RNA, 15 nt, Homo sapiens
acaaagauaugcuaa

SEQ ID NO: 1114669 - RNA, 21 nt, Homo sapiens
acaaagcaaagccacauuuug

SEQ ID NO: 1114670 - RNA, 13 nt, Homo sapiens
acaaagcuucuau

SEQ ID NO: 1114671 - RNA, 14 nt, Homo sapiens
acaaaguauuugcu

SEQ ID NO: 1114672 - RNA, 16 nt, Homo sapiens
acaaauaaaaaauuca

SEQ ID NO: 1114673 - RNA, 17 nt, Homo sapiens
acaaauaaucacauuga

SEQ ID NO: 1114674 - RNA, 13 nt, Homo sapiens
acaaauguaugau

SEQ ID NO: 1114675 - RNA, 14 nt, Homo sapiens
acaacagaagucau

SEQ ID NO: 1114676 - RNA, 22 nt, Homo sapiens
acaacguaaacuuccuaaugau

SEQ ID NO: 1114677 - RNA, 13 nt, Homo sapiens
acaacuaccuccu

SEQ ID NO: 1114678 - RNA, 21 nt, Homo sapiens
acaacuuccacuccaagugag

SEQ ID NO: 1114679 - RNA, 13 nt, Homo sapiens
acaacuucuuugu

SEQ ID NO: 1114680 - RNA, 18 nt, Homo sapiens
acaacuugucuauuaccu

SEQ ID NO: 1114681 - RNA, 14 nt, Homo sapiens
acaagaaccugcua

SEQ ID NO: 1114682 - RNA, 16 nt, Homo sapiens
acaagaagaccagacu

SEQ ID NO: 1114683 - RNA, 19 nt, Homo sapiens
acaagaagaccagacugug

SEQ ID NO: 1114684 - RNA, 18 nt, Homo sapiens
acaagaguugucuugucc

SEQ ID NO: 1114685 - RNA, 20 nt, Homo sapiens
acaagcgugagccacugcac

SEQ ID NO: 1114686 - RNA, 17 nt, Homo sapiens
acaagcuuguccaugua

SEQ ID NO: 1114687 - RNA, 14 nt, Homo sapiens
acaaguaugaugau

SEQ ID NO: 1114688 - RNA, 22 nt, Homo sapiens
acaaguauucauuuuuucuacc

SEQ ID NO: 1114689 - RNA, 15 nt, Homo sapiens
acaagugcgccuugc

SEQ ID NO: 1114690 - RNA, 18 nt, Homo sapiens
acaaguuuuaauccagaa

SEQ ID NO: 1114691 - RNA, 20 nt, Homo sapiens
acaauaaaggcugagcucuu

SEQ ID NO: 1114692 - RNA, 16 nt, Homo sapiens
acaauaaggucaaugc

SEQ ID NO: 1114693 - RNA, 16 nt, Homo sapiens
acaauacgugaaagau

SEQ ID NO: 1114694 - RNA, 19 nt, Homo sapiens
acaaugaaggaaaaccuca

SEQ ID NO: 1114695 - RNA, 21 nt, Homo sapiens
acaaugaaggaaaaccucacu

SEQ ID NO: 1114696 - RNA, 14 nt, Homo sapiens
acaaugcagaauuu

SEQ ID NO: 1114697 - RNA, 20 nt, Homo sapiens
acaauuccauuuccaguuca

SEQ ID NO: 1114698 - RNA, 15 nt, Homo sapiens
acaauuugcacuguu

SEQ ID NO: 1114699 - RNA, 18 nt, Homo sapiens
acacaaggugcaaaucaa

SEQ ID NO: 1114700 - RNA, 12 nt, Homo sapiens
acacacagcucu

SEQ ID NO: 1114701 - RNA, 13 nt, Homo sapiens
acacacucugcau

SEQ ID NO: 1114702 - RNA, 21 nt, Homo sapiens
acacagagguuuuaaacaguc

SEQ ID NO: 1114703 - RNA, 14 nt, Homo sapiens
acacagcacucucu

SEQ ID NO: 1114704 - RNA, 23 nt, Homo sapiens
acacagcacucucuaaaucuucc

SEQ ID NO: 1114705 - RNA, 16 nt, Homo sapiens
acacagccugggacca

SEQ ID NO: 1114706 - RNA, 21 nt, Homo sapiens
acacaggcccggcuccaggcu

SEQ ID NO: 1114707 - RNA, 17 nt, Homo sapiens
acacaguauuacuucug

SEQ ID NO: 1114708 - RNA, 17 nt, Homo sapiens
acacaucaggaguucaa

SEQ ID NO: 1114709 - RNA, 15 nt, Homo sapiens
acacaugguuuccaa

SEQ ID NO: 1114710 - RNA, 17 nt, Homo sapiens
acacauguccaguggga

SEQ ID NO: 1114711 - RNA, 17 nt, Homo sapiens
acacccaugaaucaaag

SEQ ID NO: 1114712 - RNA, 16 nt, Homo sapiens
acacccgacuccucaa

SEQ ID NO: 1114713 - RNA, 23 nt, Homo sapiens
acacccgccgccuccugcaccga

SEQ ID NO: 1114714 - RNA, 15 nt, Homo sapiens
acaccuaugucauuu

SEQ ID NO: 1114715 - RNA, 16 nt, Homo sapiens
acaccugacacaucuu

SEQ ID NO: 1114716 - RNA, 15 nt, Homo sapiens
acacgaauugcucaa

SEQ ID NO: 1114717 - RNA, 22 nt, Homo sapiens
acacgaauugcucaaugcauga

SEQ ID NO: 1114718 - RNA, 18 nt, Homo sapiens
acacuaacauauaauguu

SEQ ID NO: 1114719 - RNA, 15 nt, Homo sapiens
acacucacauuuauu

SEQ ID NO: 1114720 - RNA, 20 nt, Homo sapiens
acacucacuccacaacccaa

SEQ ID NO: 1114721 - RNA, 22 nt, Homo sapiens
acacucuucugaauugacugua

SEQ ID NO: 1114722 - RNA, 16 nt, Homo sapiens
acacugaccuguguuc

SEQ ID NO: 1114723 - RNA, 20 nt, Homo sapiens
acacugcacgaauggaagag

SEQ ID NO: 1114724 - RNA, 14 nt, Homo sapiens
acacuuacccaagg

SEQ ID NO: 1114725 - RNA, 16 nt, Homo sapiens
acacuuccauuaacuu

SEQ ID NO: 1114726 - RNA, 18 nt, Homo sapiens
acagaagaucuauauugu

SEQ ID NO: 1114727 - RNA, 19 nt, Homo sapiens
acagaaggaaucugugcag

SEQ ID NO: 1114728 - RNA, 15 nt, Homo sapiens
acagaagucuugucu

SEQ ID NO: 1114729 - RNA, 17 nt, Homo sapiens
acagaagucuugucuca

SEQ ID NO: 1114730 - RNA, 17 nt, Homo sapiens
acagagaaaagacauaa

SEQ ID NO: 1114731 - RNA, 14 nt, Homo sapiens
acagagaacccugu

SEQ ID NO: 1114732 - RNA, 17 nt, Homo sapiens
acagaguauauauguac

SEQ ID NO: 1114733 - RNA, 20 nt, Homo sapiens
acagcaaaacuccaucucaa

SEQ ID NO: 1114734 - RNA, 15 nt, Homo sapiens
acagcagcaucuuca

SEQ ID NO: 1114735 - RNA, 17 nt, Homo sapiens
acagcagccccugcaca

SEQ ID NO: 1114736 - RNA, 15 nt, Homo sapiens
acagccucagaggca

SEQ ID NO: 1114737 - RNA, 18 nt, Homo sapiens
acagcgagaggcagagaa

SEQ ID NO: 1114738 - RNA, 13 nt, Homo sapiens
acagcucucaccu

SEQ ID NO: 1114739 - RNA, 16 nt, Homo sapiens
acagcucuucuaagga

SEQ ID NO: 1114740 - RNA, 18 nt, Homo sapiens
acagcucuucuccaggcu

SEQ ID NO: 1114741 - RNA, 21 nt, Homo sapiens
acagcugccugugugggacug

SEQ ID NO: 1114742 - RNA, 15 nt, Homo sapiens
acagcugucccuguc

SEQ ID NO: 1114743 - RNA, 14 nt, Homo sapiens
acaggaaaaugcca

SEQ ID NO: 1114744 - RNA, 18 nt, Homo sapiens
acaggaauacuuaacuca

SEQ ID NO: 1114745 - RNA, 21 nt, Homo sapiens
acaggaauacuuaacucaaua

SEQ ID NO: 1114746 - RNA, 21 nt, Homo sapiens
acaggcaacugaggcagacag

SEQ ID NO: 1114747 - RNA, 14 nt, Homo sapiens
acaggcaagcaccu

SEQ ID NO: 1114748 - RNA, 17 nt, Homo sapiens
acaggcaugcaccagug

SEQ ID NO: 1114749 - RNA, 20 nt, Homo sapiens
acagggagacugcaucucaa

SEQ ID NO: 1114750 - RNA, 19 nt, Homo sapiens
acagggcaugcauuuugca

SEQ ID NO: 1114751 - RNA, 17 nt, Homo sapiens
acuuuaacccucucuuc

SEQ ID NO: 1114752 - RNA, 20 nt, Homo sapiens
acuuuagaguagcaugagag

SEQ ID NO: 1114753 - RNA, 20 nt, Homo sapiens
acuuuauguuacuacaugca

SEQ ID NO: 1114754 - RNA, 19 nt, Homo sapiens
acuuucauuaaagcauuua

SEQ ID NO: 1114755 - RNA, 22 nt, Homo sapiens
acuuuccacuccuggcugagag

SEQ ID NO: 1114756 - RNA, 15 nt, Homo sapiens
acuuugcacagcucu

SEQ ID NO: 1114757 - RNA, 12 nt, Homo sapiens
acuuugugaaaa

SEQ ID NO: 1114758 - RNA, 18 nt, Homo sapiens
acuuuuaaugccuuccac

SEQ ID NO: 1114759 - RNA, 20 nt, Homo sapiens
agaaaagguacauguuuaca

SEQ ID NO: 1114760 - RNA, 16 nt, Homo sapiens
agaaaaucaaccagca

SEQ ID NO: 1114761 - RNA, 21 nt, Homo sapiens
agaaaaucaaccagcaggaaa

SEQ ID NO: 1114762 - RNA, 21 nt, Homo sapiens
agaaacacaaauguaaaauaa

SEQ ID NO: 1114763 - RNA, 20 nt, Homo sapiens
agaaagccuucauaagccua

SEQ ID NO: 1114764 - RNA, 14 nt, Homo sapiens
agaaaguacuucuu

SEQ ID NO: 1114765 - RNA, 12 nt, Homo sapiens
agaaaguucuca

SEQ ID NO: 1114766 - RNA, 19 nt, Homo sapiens
agaaauacccacuaacaaa

SEQ ID NO: 1114767 - RNA, 20 nt, Homo sapiens
agaaauaggacaauucacuu

SEQ ID NO: 1114768 - RNA, 18 nt, Homo sapiens
agaaauuuuacugacaga

SEQ ID NO: 1114769 - RNA, 23 nt, Homo sapiens
agaacaaaccucuauauguugcu

SEQ ID NO: 1114770 - RNA, 23 nt, Homo sapiens
agaacaaaucugggcauugagca

SEQ ID NO: 1114771 - RNA, 12 nt, Homo sapiens
agaacagccgcu

SEQ ID NO: 1114772 - RNA, 15 nt, Homo sapiens
agaacccagauuucc

SEQ ID NO: 1114773 - RNA, 16 nt, Homo sapiens
agaacuauguacuuua

SEQ ID NO: 1114774 - RNA, 18 nt, Homo sapiens
agaacugaauaaacagga

SEQ ID NO: 1114775 - RNA, 13 nt, Homo sapiens
agaacuugauaua

SEQ ID NO: 1114776 - RNA, 21 nt, Homo sapiens
agaagaaaacgaacugggaaa

SEQ ID NO: 1114777 - RNA, 16 nt, Homo sapiens
agaagaaugacuaugc

SEQ ID NO: 1114778 - RNA, 18 nt, Homo sapiens
agaagacaacauuucuca

SEQ ID NO: 1114779 - RNA, 13 nt, Homo sapiens
agaagacacugca

SEQ ID NO: 1114780 - RNA, 19 nt, Homo sapiens
agaagacuauauuguacac

SEQ ID NO: 1114781 - RNA, 20 nt, Homo sapiens
agaagagccugacuguguuc

SEQ ID NO: 1114782 - RNA, 16 nt, Homo sapiens
agaagaggcuggugcu

SEQ ID NO: 1114783 - RNA, 19 nt, Homo sapiens
agaagaggcuggugcugug

SEQ ID NO: 1114784 - RNA, 17 nt, Homo sapiens
agaagauuuugccacau

SEQ ID NO: 1114785 - RNA, 18 nt, Homo sapiens
agaagcaaaaucuaccag

SEQ ID NO: 1114786 - RNA, 18 nt, Homo sapiens
agaagccugggggccugg

SEQ ID NO: 1114787 - RNA, 23 nt, Homo sapiens
agaagcuaaauccuuuacuguua

SEQ ID NO: 1114788 - RNA, 19 nt, Homo sapiens
agaaggacauuuuacugca

SEQ ID NO: 1114789 - RNA, 22 nt, Homo sapiens
agaaggauggcauuuuuugcaa

SEQ ID NO: 1114790 - RNA, 21 nt, Homo sapiens
agaaggcuuccuccagcggcu

SEQ ID NO: 1114791 - RNA, 12 nt, Homo sapiens
agaaggggacag

SEQ ID NO: 1114792 - RNA, 23 nt, Homo sapiens
agaaggggacagcgccaccucuu

SEQ ID NO: 1114793 - RNA, 22 nt, Homo sapiens
agaaggguuuuccacccuggaa

SEQ ID NO: 1114794 - RNA, 22 nt, Homo sapiens
agaaguauccaauuaugugaca

SEQ ID NO: 1114795 - RNA, 14 nt, Homo sapiens
agaagucucuucca

SEQ ID NO: 1114796 - RNA, 14 nt, Homo sapiens
agaagucuugagaa

SEQ ID NO: 1114797 - RNA, 16 nt, Homo sapiens
agaagugucuaaaaac

SEQ ID NO: 1114798 - RNA, 13 nt, Homo sapiens
agaaguuccucaa

SEQ ID NO: 1114799 - RNA, 17 nt, Homo sapiens
agaaguugagagagcaa

SEQ ID NO: 1114800 - RNA, 18 nt, Homo sapiens
agaauaaaaauugacuuc

SEQ ID NO: 1114801 - RNA, 15 nt, Homo sapiens
agaauaaaugaaucu

SEQ ID NO: 1114802 - RNA, 19 nt, Homo sapiens
agaauauacaaauagcaaa

SEQ ID NO: 1114803 - RNA, 21 nt, Homo sapiens
agaaucccggcugucaagggg

SEQ ID NO: 1114804 - RNA, 13 nt, Homo sapiens
agaaucuagccuc

SEQ ID NO: 1114805 - RNA, 17 nt, Homo sapiens
agaaucugcagcuaacu

SEQ ID NO: 1114806 - RNA, 18 nt, Homo sapiens
agaaugaauaauaauuau

SEQ ID NO: 1114807 - RNA, 22 nt, Homo sapiens
agaauggggguggggaggcaag

SEQ ID NO: 1114808 - RNA, 17 nt, Homo sapiens
agaaugugauauuugaa

SEQ ID NO: 1114809 - RNA, 21 nt, Homo sapiens
agaauguuacuuuggaaugac

SEQ ID NO: 1114810 - RNA, 23 nt, Homo sapiens
agaauuugguaaauuaguauuua

SEQ ID NO: 1114811 - RNA, 13 nt, Homo sapiens
agacaaaggcucu

SEQ ID NO: 1114812 - RNA, 21 nt, Homo sapiens
agacaaaggcucuacacauac

SEQ ID NO: 1114813 - RNA, 17 nt, Homo sapiens
agacacaggcccggcuc

SEQ ID NO: 1114814 - RNA, 17 nt, Homo sapiens
agacaccuugacagggc

SEQ ID NO: 1114815 - RNA, 15 nt, Homo sapiens
agacacuauuuaucu

SEQ ID NO: 1114816 - RNA, 20 nt, Homo sapiens
agacaggaugguuacucuug

SEQ ID NO: 1114817 - RNA, 16 nt, Homo sapiens
agacaggcccaagaga

SEQ ID NO: 1114818 - RNA, 14 nt, Homo sapiens
agacaugaaugcac

SEQ ID NO: 1114819 - RNA, 16 nt, Homo sapiens
agacaugaaugcacac

SEQ ID NO: 1114820 - RNA, 19 nt, Homo sapiens
agaccaaaauaugaaagac

SEQ ID NO: 1114821 - RNA, 20 nt, Homo sapiens
agaccaacucucuccuguau

SEQ ID NO: 1114822 - RNA, 19 nt, Homo sapiens
agaccaagacacagaucac

SEQ ID NO: 1114823 - RNA, 13 nt, Homo sapiens
agaccaccucuca

SEQ ID NO: 1114824 - RNA, 14 nt, Homo sapiens
agaccacuauucuu

SEQ ID NO: 1114825 - RNA, 23 nt, Homo sapiens
agaccacuauucuuaacuauuca

SEQ ID NO: 1114826 - RNA, 14 nt, Homo sapiens
agaccagaagugga

SEQ ID NO: 1114827 - RNA, 13 nt, Homo sapiens
agaccaguccaug

SEQ ID NO: 1114828 - RNA, 18 nt, Homo sapiens
agaccaguugggagcacu

SEQ ID NO: 1114829 - RNA, 15 nt, Homo sapiens
agaccauaauguuac

SEQ ID NO: 1114830 - RNA, 17 nt, Homo sapiens
agacccaccacaccgca

SEQ ID NO: 1114831 - RNA, 15 nt, Homo sapiens
agacccagaucucau

SEQ ID NO: 1114832 - RNA, 14 nt, Homo sapiens
agacccaguguaaa

SEQ ID NO: 1114833 - RNA, 15 nt, Homo sapiens
agaccccaaggccca

SEQ ID NO: 1114834 - RNA, 23 nt, Homo sapiens
agaccccacccugagguccugca

SEQ ID NO: 1114835 - RNA, 22 nt, Homo sapiens
agaccucucaauuucuggaaaa

SEQ ID NO: 1114836 - RNA, 24 nt, Homo sapiens
agacuaagcccugucgagacacuu

SEQ ID NO: 1114837 - RNA, 21 nt, Homo sapiens
agacuaugugucaugauuuca

SEQ ID NO: 1114838 - RNA, 15 nt, Homo sapiens
agacuauugagauau

SEQ ID NO: 1114839 - RNA, 12 nt, Homo sapiens
agacucacugug

SEQ ID NO: 1114840 - RNA, 18 nt, Homo sapiens
agacucagcuccagaaua

SEQ ID NO: 1114841 - RNA, 19 nt, Homo sapiens
ccucugaucaguuucacaa

SEQ ID NO: 1114842 - RNA, 15 nt, Homo sapiens
ccucugcagcacuuu

SEQ ID NO: 1114843 - RNA, 21 nt, Homo sapiens
ccucuggauucucugggucua

SEQ ID NO: 1114844 - RNA, 21 nt, Homo sapiens
ccucuggcuggcuaacuggaa

SEQ ID NO: 1114845 - RNA, 21 nt, Homo sapiens
ccucugucucugcucuugccu

SEQ ID NO: 1114846 - RNA, 21 nt, Homo sapiens
ccucuucccgggaucacuuaa

SEQ ID NO: 1114847 - RNA, 16 nt, Homo sapiens
ccucuucgcugaccuc

SEQ ID NO: 1114848 - RNA, 16 nt, Homo sapiens
ccucuuguugcugagu

SEQ ID NO: 1114849 - RNA, 23 nt, Homo sapiens
ccucuuucuuucuuuuguguugg

SEQ ID NO: 1114850 - RNA, 15 nt, Homo sapiens
ccucuuuucucugug

SEQ ID NO: 1114851 - RNA, 18 nt, Homo sapiens
ccucuuuucucugugcuu

SEQ ID NO: 1114852 - RNA, 21 nt, Homo sapiens
ccugaagaacaguaacugcca

SEQ ID NO: 1114853 - RNA, 18 nt, Homo sapiens
ccugaagucccagcauug

SEQ ID NO: 1114854 - RNA, 16 nt, Homo sapiens
ccugacgucaguaguu

SEQ ID NO: 1114855 - RNA, 11 nt, Homo sapiens
ccugacugugu

SEQ ID NO: 1114856 - RNA, 14 nt, Homo sapiens
ccugauacugggua

SEQ ID NO: 1114857 - RNA, 17 nt, Homo sapiens
ccugauacuggguacaa

SEQ ID NO: 1114858 - RNA, 12 nt, Homo sapiens
ccugauguuaaa

SEQ ID NO: 1114859 - RNA, 24 nt, Homo sapiens
ccugcaccgagagagauggaauaa

SEQ ID NO: 1114860 - RNA, 16 nt, Homo sapiens
ccugcagugggccauc

SEQ ID NO: 1114861 - RNA, 21 nt, Homo sapiens
ccugcaguuauuaacacuaac

SEQ ID NO: 1114862 - RNA, 16 nt, Homo sapiens
ccugcccagugcacuu

SEQ ID NO: 1114863 - RNA, 14 nt, Homo sapiens
ccugccuaggaauu

SEQ ID NO: 1114864 - RNA, 10 nt, Homo sapiens
ccugccuuca

SEQ ID NO: 1114865 - RNA, 17 nt, Homo sapiens
ccuggaacugucucuca

SEQ ID NO: 1114866 - RNA, 16 nt, Homo sapiens
ccuggacagcugugcc

SEQ ID NO: 1114867 - RNA, 14 nt, Homo sapiens
ccuggagugcaguu

SEQ ID NO: 1114868 - RNA, 20 nt, Homo sapiens
ccuggaucucacaagcacuu

SEQ ID NO: 1114869 - RNA, 15 nt, Homo sapiens
ccuggccggcaaccc

SEQ ID NO: 1114870 - RNA, 23 nt, Homo sapiens
ccuggccggcuccaguuucccca

SEQ ID NO: 1114871 - RNA, 14 nt, Homo sapiens
ccuggccucaagug

SEQ ID NO: 1114872 - RNA, 18 nt, Homo sapiens
ccuggccuggcacacauc

SEQ ID NO: 1114873 - RNA, 21 nt, Homo sapiens
ccuggccuuugaggcaaaggc

SEQ ID NO: 1114874 - RNA, 18 nt, Homo sapiens
ccugggcaacaaagugag

SEQ ID NO: 1114875 - RNA, 19 nt, Homo sapiens
ccuggggcuucuccugacc

SEQ ID NO: 1114876 - RNA, 16 nt, Homo sapiens
ccuggucugcucagga

SEQ ID NO: 1114877 - RNA, 19 nt, Homo sapiens
ccuggugaccuacuaaaaa

SEQ ID NO: 1114878 - RNA, 15 nt, Homo sapiens
ccugguggucaggga

SEQ ID NO: 1114879 - RNA, 17 nt, Homo sapiens
ccugguuggccgugguc

SEQ ID NO: 1114880 - RNA, 13 nt, Homo sapiens
ccuguaacacaag

SEQ ID NO: 1114881 - RNA, 23 nt, Homo sapiens
ccuguaccacaaacacauuacau

SEQ ID NO: 1114882 - RNA, 15 nt, Homo sapiens
ccuguacgaaccccu

SEQ ID NO: 1114883 - RNA, 17 nt, Homo sapiens
ccuguagguucuugaua

SEQ ID NO: 1114884 - RNA, 18 nt, Homo sapiens
ccuguauucuacagcaga

SEQ ID NO: 1114885 - RNA, 15 nt, Homo sapiens
ccugucuuuaaggaa

SEQ ID NO: 1114886 - RNA, 18 nt, Homo sapiens
ccugugugggacugagau

SEQ ID NO: 1114887 - RNA, 17 nt, Homo sapiens
ccuguguuucuugccuc

SEQ ID NO: 1114888 - RNA, 20 nt, Homo sapiens
ccuguuaaaauguacacugg

SEQ ID NO: 1114889 - RNA, 18 nt, Homo sapiens
ccuguuaacgucaucuca

SEQ ID NO: 1114890 - RNA, 16 nt, Homo sapiens
ccuguuacacaugaca

SEQ ID NO: 1114891 - RNA, 22 nt, Homo sapiens
ccuguuaucuguguuugcugag

SEQ ID NO: 1114892 - RNA, 18 nt, Homo sapiens
ccuguuguaacugcccaa

SEQ ID NO: 1114893 - RNA, 17 nt, Homo sapiens
ccuguuuaaaaaaagua

SEQ ID NO: 1114894 - RNA, 22 nt, Homo sapiens
ccuguuuauauugguauaauua

SEQ ID NO: 1114895 - RNA, 20 nt, Homo sapiens
ccuguuuguggaacaaaagu

SEQ ID NO: 1114896 - RNA, 15 nt, Homo sapiens
ccuuaauauguuaac

SEQ ID NO: 1114897 - RNA, 23 nt, Homo sapiens
ccuuaaugauccguuccauugca

SEQ ID NO: 1114898 - RNA, 15 nt, Homo sapiens
ccuuagaagucacac

SEQ ID NO: 1114899 - RNA, 12 nt, Homo sapiens
ccuuagcagcuc

SEQ ID NO: 1114900 - RNA, 15 nt, Homo sapiens
ccuuagcuggcauua

SEQ ID NO: 1114901 - RNA, 21 nt, Homo sapiens
ccuuauuguaccucucuuaua

SEQ ID NO: 1114902 - RNA, 21 nt, Homo sapiens
ccuuauuuuugaauugacuga

SEQ ID NO: 1114903 - RNA, 19 nt, Homo sapiens
ccuucaaguuagcucagga

SEQ ID NO: 1114904 - RNA, 20 nt, Homo sapiens
ccuuccagcuagugacccac

SEQ ID NO: 1114905 - RNA, 11 nt, Homo sapiens
ccuuccagugg

SEQ ID NO: 1114906 - RNA, 22 nt, Homo sapiens
ccuucucagaccugcgcacucc

SEQ ID NO: 1114907 - RNA, 13 nt, Homo sapiens
ccuugaagccacu

SEQ ID NO: 1114908 - RNA, 18 nt, Homo sapiens
ccuugagcuccccaaaaa

SEQ ID NO: 1114909 - RNA, 18 nt, Homo sapiens
ccuugcuguuuucaucuc

SEQ ID NO: 1114910 - RNA, 23 nt, Homo sapiens
ccuugcuguuuucaucucugcca

SEQ ID NO: 1114911 - RNA, 18 nt, Homo sapiens
ccuuguucugauaaugaa

SEQ ID NO: 1114912 - RNA, 18 nt, Homo sapiens
ccuuuagagccagcccau

SEQ ID NO: 1114913 - RNA, 20 nt, Homo sapiens
ccuuuauuaaaaacugagug

SEQ ID NO: 1114914 - RNA, 22 nt, Homo sapiens
ccuuuauuaaugaacugugaca

SEQ ID NO: 1114915 - RNA, 16 nt, Homo sapiens
ccuuucaaauuucaca

SEQ ID NO: 1114916 - RNA, 20 nt, Homo sapiens
ccuuucaccacaugugcaca

SEQ ID NO: 1114917 - RNA, 22 nt, Homo sapiens
ccuuuccaagcuccucgugaua

SEQ ID NO: 1114918 - RNA, 20 nt, Homo sapiens
ccuuuccagucauuucaaua

SEQ ID NO: 1114919 - RNA, 22 nt, Homo sapiens
ccuuucuuucuaacuccaguga

SEQ ID NO: 1114920 - RNA, 21 nt, Homo sapiens
ccuuuggcuaucuacugagac

SEQ ID NO: 1114921 - RNA, 11 nt, Homo sapiens
ccuuuguguaa

SEQ ID NO: 1114922 - RNA, 13 nt, Homo sapiens
ccuuuguguaaua

SEQ ID NO: 1114923 - RNA, 21 nt, Homo sapiens
ccuuuucuuuuucccuugaac

SEQ ID NO: 1114924 - RNA, 13 nt, Homo sapiens
cgaagucuuccau

SEQ ID NO: 1114925 - RNA, 15 nt, Homo sapiens
cgacccacucucaaa

SEQ ID NO: 1114926 - RNA, 19 nt, Homo sapiens
cgagaucacgccacugcac

SEQ ID NO: 1114927 - RNA, 21 nt, Homo sapiens
cgagauggcgcuauugcacuc

SEQ ID NO: 1114928 - RNA, 22 nt, Homo sapiens
cgaggcugcccacuauggucau

SEQ ID NO: 1114929 - RNA, 11 nt, Homo sapiens
cgaucuuggcu

SEQ ID NO: 1114930 - RNA, 15 nt, Homo sapiens
cgauucaaacugcuc

SEQ ID NO: 1114931 - RNA, 15 nt, Homo sapiens
cugacuguguucagu

SEQ ID NO: 1114932 - RNA, 13 nt, Homo sapiens
cugagaaacuucc

SEQ ID NO: 1114933 - RNA, 15 nt, Homo sapiens
cugagaaacuuccuu

SEQ ID NO: 1114934 - RNA, 14 nt, Homo sapiens
cugagaaucuagcc

SEQ ID NO: 1114935 - RNA, 16 nt, Homo sapiens
cugagagacccaagga

SEQ ID NO: 1114936 - RNA, 17 nt, Homo sapiens
cugagcaccuacuuaca

SEQ ID NO: 1114937 - RNA, 21 nt, Homo sapiens
cugagcaccuacuuacaugca

SEQ ID NO: 1114938 - RNA, 17 nt, Homo sapiens
cugagcucgguggaccc

SEQ ID NO: 1114939 - RNA, 13 nt, Homo sapiens
cugagcucugaga

SEQ ID NO: 1114940 - RNA, 13 nt, Homo sapiens
cugaggaccagcc

SEQ ID NO: 1114941 - RNA, 20 nt, Homo sapiens
cugaggagucugagguccug

SEQ ID NO: 1114942 - RNA, 18 nt, Homo sapiens
cugaggcaggaggauugc

SEQ ID NO: 1114943 - RNA, 22 nt, Homo sapiens
cugaggcaggaggauugcuuga

SEQ ID NO: 1114944 - RNA, 16 nt, Homo sapiens
cugaggcuuccagaga

SEQ ID NO: 1114945 - RNA, 19 nt, Homo sapiens
cugagugagccacagacca

SEQ ID NO: 1114946 - RNA, 15 nt, Homo sapiens
cugauaaacauuaaa

SEQ ID NO: 1114947 - RNA, 19 nt, Homo sapiens
cugauaaugaaaauuauga

SEQ ID NO: 1114948 - RNA, 16 nt, Homo sapiens
cugauaggacccauau

SEQ ID NO: 1114949 - RNA, 21 nt, Homo sapiens
cugaucauccacugugccaug

SEQ ID NO: 1114950 - RNA, 20 nt, Homo sapiens
cugaucgugcuaaauuuuca

SEQ ID NO: 1114951 - RNA, 17 nt, Homo sapiens
cugaugacaaacccagg

SEQ ID NO: 1114952 - RNA, 18 nt, Homo sapiens
cugaugagagagugcuga

SEQ ID NO: 1114953 - RNA, 12 nt, Homo sapiens
cugaugcuguug

SEQ ID NO: 1114954 - RNA, 16 nt, Homo sapiens
cugaugcuuuggugug

SEQ ID NO: 1114955 - RNA, 17 nt, Homo sapiens
cugauguuaaaauucca

SEQ ID NO: 1114956 - RNA, 18 nt, Homo sapiens
cugauguuaaaauuccau

SEQ ID NO: 1114957 - RNA, 17 nt, Homo sapiens
cugauuuccuaauguca

SEQ ID NO: 1114958 - RNA, 23 nt, Homo sapiens
cugauuuuaaaagguugacucaa

SEQ ID NO: 1114959 - RNA, 19 nt, Homo sapiens
cugcaaaggcgcagugcuu

SEQ ID NO: 1114960 - RNA, 16 nt, Homo sapiens
cugcaaauaaauucau

SEQ ID NO: 1114961 - RNA, 14 nt, Homo sapiens
cugcaagacuuaaa

SEQ ID NO: 1114962 - RNA, 17 nt, Homo sapiens
cugcaccgagagagaug

SEQ ID NO: 1114963 - RNA, 20 nt, Homo sapiens
cugcacuaauuugauguuua

SEQ ID NO: 1114964 - RNA, 17 nt, Homo sapiens
cugcagaaggccaagaa

SEQ ID NO: 1114965 - RNA, 20 nt, Homo sapiens
cugcagaguaggcagcugcc

SEQ ID NO: 1114966 - RNA, 15 nt, Homo sapiens
cugcagcggcacaaa

SEQ ID NO: 1114967 - RNA, 21 nt, Homo sapiens
cugcaguagucucugugcuuu

SEQ ID NO: 1114968 - RNA, 15 nt, Homo sapiens
cugcauaaauguggu

SEQ ID NO: 1114969 - RNA, 14 nt, Homo sapiens
cugcaugcucagga

SEQ ID NO: 1114970 - RNA, 14 nt, Homo sapiens
cugcauguucugcu

SEQ ID NO: 1114971 - RNA, 13 nt, Homo sapiens
cugccaagccacc

SEQ ID NO: 1114972 - RNA, 15 nt, Homo sapiens
cugccaagccuauug

SEQ ID NO: 1114973 - RNA, 16 nt, Homo sapiens
cugccagccuggcuuc

SEQ ID NO: 1114974 - RNA, 15 nt, Homo sapiens
cugcccagugcacuu

SEQ ID NO: 1114975 - RNA, 19 nt, Homo sapiens
cugccccacuucucuacuc

SEQ ID NO: 1114976 - RNA, 23 nt, Homo sapiens
cugccccacuucucuacucugga

SEQ ID NO: 1114977 - RNA, 16 nt, Homo sapiens
cugcccuagagcacac

SEQ ID NO: 1114978 - RNA, 15 nt, Homo sapiens
cugccucccuagcuu

SEQ ID NO: 1114979 - RNA, 15 nt, Homo sapiens
cugccuccucuucaa

SEQ ID NO: 1114980 - RNA, 15 nt, Homo sapiens
cugccucugacacac

SEQ ID NO: 1114981 - RNA, 20 nt, Homo sapiens
cugccuuccaggagcaauuu

SEQ ID NO: 1114982 - RNA, 21 nt, Homo sapiens
cugccuugccaugucuuguuc

SEQ ID NO: 1114983 - RNA, 23 nt, Homo sapiens
cugccuuuuaucugcccagaauu

SEQ ID NO: 1114984 - RNA, 19 nt, Homo sapiens
cugcgccggguaccaugga

SEQ ID NO: 1114985 - RNA, 16 nt, Homo sapiens
cugcgggacagaggac

SEQ ID NO: 1114986 - RNA, 17 nt, Homo sapiens
cugcuaaggcugccuca

SEQ ID NO: 1114987 - RNA, 16 nt, Homo sapiens
cugcuaccucacuggg

SEQ ID NO: 1114988 - RNA, 16 nt, Homo sapiens
cugcucaagaagacau

SEQ ID NO: 1114989 - RNA, 16 nt, Homo sapiens
cugcuccucccauucc

SEQ ID NO: 1114990 - RNA, 19 nt, Homo sapiens
cugcucggggugcacagga

SEQ ID NO: 1114991 - RNA, 18 nt, Homo sapiens
cugcucguccccaaguga

SEQ ID NO: 1114992 - RNA, 20 nt, Homo sapiens
cugcucgucuaucaccagga

SEQ ID NO: 1114993 - RNA, 18 nt, Homo sapiens
cugcucuggaaaauguga

SEQ ID NO: 1114994 - RNA, 13 nt, Homo sapiens
cugcugacagugu

SEQ ID NO: 1114995 - RNA, 17 nt, Homo sapiens
cugcuguguagcucugu

SEQ ID NO: 1114996 - RNA, 11 nt, Homo sapiens
cugcuucucag

SEQ ID NO: 1114997 - RNA, 16 nt, Homo sapiens
cuggaaaacucaggau

SEQ ID NO: 1114998 - RNA, 22 nt, Homo sapiens
cuggaaaacucaggauucucac

SEQ ID NO: 1114999 - RNA, 14 nt, Homo sapiens
cuggaaaagcacuu

SEQ ID NO: 1115000 - RNA, 15 nt, Homo sapiens
cuggaaaagcacuuu

SEQ ID NO: 1115001 - RNA, 12 nt, Homo sapiens
cuggaaguagaa

SEQ ID NO: 1115002 - RNA, 19 nt, Homo sapiens
cuggaauaagaagcaaaua

SEQ ID NO: 1115003 - RNA, 23 nt, Homo sapiens
cuggaauaagaagcaaauaaaua

SEQ ID NO: 1115004 - RNA, 14 nt, Homo sapiens
cuggaccagccugu

SEQ ID NO: 1115005 - RNA, 17 nt, Homo sapiens
cuggagcaucugacuca

SEQ ID NO: 1115006 - RNA, 16 nt, Homo sapiens
cuggaggucacauuca

SEQ ID NO: 1115007 - RNA, 13 nt, Homo sapiens
cuggagugcaguu

SEQ ID NO: 1115008 - RNA, 17 nt, Homo sapiens
cuggaucagcguggccu

SEQ ID NO: 1115009 - RNA, 16 nt, Homo sapiens
cuggaucucagccucu

SEQ ID NO: 1115010 - RNA, 14 nt, Homo sapiens
cuggaugucuccau

SEQ ID NO: 1115011 - RNA, 23 nt, Homo sapiens
cuggaugugcccacagggaccaa

SEQ ID NO: 1115012 - RNA, 15 nt, Homo sapiens
cuggauucgugacaa

SEQ ID NO: 1115013 - RNA, 21 nt, Homo sapiens
cuggccaaccaaagacacugu

SEQ ID NO: 1115014 - RNA, 16 nt, Homo sapiens
cuggccucaagcaauc

SEQ ID NO: 1115015 - RNA, 19 nt, Homo sapiens
cuggcugaccccaaagagc

SEQ ID NO: 1115016 - RNA, 22 nt, Homo sapiens
cugggaguucccugaacaucug

SEQ ID NO: 1115017 - RNA, 20 nt, Homo sapiens
cugggaucaagaaggggaca

SEQ ID NO: 1115018 - RNA, 15 nt, Homo sapiens
cugggauguuuugag

SEQ ID NO: 1115019 - RNA, 20 nt, Homo sapiens
cugggauuacaggugugaac

SEQ ID NO: 1115020 - RNA, 14 nt, Homo sapiens
cugggcagcauagc

SEQ ID NO: 1115021 - RNA, 22 nt, Homo sapiens
cugggcagcauagcaagacaca

SEQ ID NO: 1115022 - RNA, 18 nt, Homo sapiens
cuuuccagucauuucaau

SEQ ID NO: 1115023 - RNA, 16 nt, Homo sapiens
cuuuccgucucccuaa

SEQ ID NO: 1115024 - RNA, 20 nt, Homo sapiens
cuuucuacuuuuucuagcua

SEQ ID NO: 1115025 - RNA, 22 nt, Homo sapiens
cuuucuauugaaaaaucaccac

SEQ ID NO: 1115026 - RNA, 15 nt, Homo sapiens
cuuucuggaaaagag

SEQ ID NO: 1115027 - RNA, 21 nt, Homo sapiens
cuuucuguggagagugagaau

SEQ ID NO: 1115028 - RNA, 19 nt, Homo sapiens
cuuugccagaaagcauaaa

SEQ ID NO: 1115029 - RNA, 17 nt, Homo sapiens
cuuugccucugaaacuu

SEQ ID NO: 1115030 - RNA, 19 nt, Homo sapiens
cuuuguacuuugugcaaaa

SEQ ID NO: 1115031 - RNA, 22 nt, Homo sapiens
cuuugucagucugggugucuca

SEQ ID NO: 1115032 - RNA, 22 nt, Homo sapiens
cuuugucauucaagccugugaa

SEQ ID NO: 1115033 - RNA, 22 nt, Homo sapiens
cuuugugucgauuucaccaaga

SEQ ID NO: 1115034 - RNA, 16 nt, Homo sapiens
cuuugugugauugaau

SEQ ID NO: 1115035 - RNA, 14 nt, Homo sapiens
cuuuguucaguuga

SEQ ID NO: 1115036 - RNA, 20 nt, Homo sapiens
cuuuguuuccauucuugucc

SEQ ID NO: 1115037 - RNA, 15 nt, Homo sapiens
cuuuuaaaugcauaa

SEQ ID NO: 1115038 - RNA, 23 nt, Homo sapiens
cuuuuaaguugcugaugaacucu

SEQ ID NO: 1115039 - RNA, 22 nt, Homo sapiens
cuuuuaauguauuuguuugcaa

SEQ ID NO: 1115040 - RNA, 14 nt, Homo sapiens
cuuuuacaccaguu

SEQ ID NO: 1115041 - RNA, 20 nt, Homo sapiens
cuuuuaugagacccauuccu

SEQ ID NO: 1115042 - RNA, 17 nt, Homo sapiens
cuuuucaucuaauguga

SEQ ID NO: 1115043 - RNA, 18 nt, Homo sapiens
cuuuucugaccaaagaga

SEQ ID NO: 1115044 - RNA, 19 nt, Homo sapiens
cuuuucuggaauguaauca

SEQ ID NO: 1115045 - RNA, 15 nt, Homo sapiens
cuuuucuuuccucag

SEQ ID NO: 1115046 - RNA, 14 nt, Homo sapiens
cuuuuucacacuga

SEQ ID NO: 1115047 - RNA, 13 nt, Homo sapiens
cuuuuucuuugaa

SEQ ID NO: 1115048 - RNA, 18 nt, Homo sapiens
gaaaaaaaauaauagaaa

SEQ ID NO: 1115049 - RNA, 15 nt, Homo sapiens
gaaaaacuuccauga

SEQ ID NO: 1115050 - RNA, 20 nt, Homo sapiens
gaaaacauucauccaguugc

SEQ ID NO: 1115051 - RNA, 17 nt, Homo sapiens
gaaaaccauuaccugac

SEQ ID NO: 1115052 - RNA, 14 nt, Homo sapiens
gaaaaccuccagua

SEQ ID NO: 1115053 - RNA, 12 nt, Homo sapiens
gaaaacuggaaa

SEQ ID NO: 1115054 - RNA, 20 nt, Homo sapiens
gaaaagaaaccagagucaaa

SEQ ID NO: 1115055 - RNA, 19 nt, Homo sapiens
gaaaagaccaguccaugag

SEQ ID NO: 1115056 - RNA, 23 nt, Homo sapiens
gaaaagauucccacccaauucaa

SEQ ID NO: 1115057 - RNA, 13 nt, Homo sapiens
gaaaagcacuuua

SEQ ID NO: 1115058 - RNA, 13 nt, Homo sapiens
gaaaauaaagugu

SEQ ID NO: 1115059 - RNA, 18 nt, Homo sapiens
gaaaauacauaagaccau

SEQ ID NO: 1115060 - RNA, 16 nt, Homo sapiens
gaaaauagcucuuuca

SEQ ID NO: 1115061 - RNA, 19 nt, Homo sapiens
gaaaaucaaccagcaggaa

SEQ ID NO: 1115062 - RNA, 11 nt, Homo sapiens
gaaaaugucag

SEQ ID NO: 1115063 - RNA, 15 nt, Homo sapiens
gaaaaugugacccag

SEQ ID NO: 1115064 - RNA, 15 nt, Homo sapiens
gaaaaugugcaauau

SEQ ID NO: 1115065 - RNA, 15 nt, Homo sapiens
gaaaauuaacacugc

SEQ ID NO: 1115066 - RNA, 21 nt, Homo sapiens
gaaaauucuguagguucugug

SEQ ID NO: 1115067 - RNA, 18 nt, Homo sapiens
gaaacaaaaaaguguucc

SEQ ID NO: 1115068 - RNA, 20 nt, Homo sapiens
gaaacaaauaagaccauaaa

SEQ ID NO: 1115069 - RNA, 19 nt, Homo sapiens
gaaacagagaacccugugg

SEQ ID NO: 1115070 - RNA, 16 nt, Homo sapiens
gaaacauuuauggaau

SEQ ID NO: 1115071 - RNA, 15 nt, Homo sapiens
gaaaccagagucaaa

SEQ ID NO: 1115072 - RNA, 18 nt, Homo sapiens
gaaaccuccggugugaga

SEQ ID NO: 1115073 - RNA, 17 nt, Homo sapiens
gaaaccuuauuguaccu

SEQ ID NO: 1115074 - RNA, 14 nt, Homo sapiens
gaaacuaacacagc

SEQ ID NO: 1115075 - RNA, 19 nt, Homo sapiens
gaaacuaacacagccauca

SEQ ID NO: 1115076 - RNA, 18 nt, Homo sapiens
gaaacuggaugaggucau

SEQ ID NO: 1115077 - RNA, 16 nt, Homo sapiens
gaaacuuaauuacauc

SEQ ID NO: 1115078 - RNA, 22 nt, Homo sapiens
gaaacuuccuuugagaauugug

SEQ ID NO: 1115079 - RNA, 20 nt, Homo sapiens
gaaacuugcauacagagaca

SEQ ID NO: 1115080 - RNA, 18 nt, Homo sapiens
gaaagacagagcugggau

SEQ ID NO: 1115081 - RNA, 19 nt, Homo sapiens
gaaagcauuacauuuccaa

SEQ ID NO: 1115082 - RNA, 14 nt, Homo sapiens
gaaagccucacuga

SEQ ID NO: 1115083 - RNA, 22 nt, Homo sapiens
gaaagcuguggccagcuuguua

SEQ ID NO: 1115084 - RNA, 23 nt, Homo sapiens
gaaaggaccuuaccuguguuuca

SEQ ID NO: 1115085 - RNA, 22 nt, Homo sapiens
gaaaggagaacuauccaaaacu

SEQ ID NO: 1115086 - RNA, 18 nt, Homo sapiens
gaaagggauaguccaaag

SEQ ID NO: 1115087 - RNA, 14 nt, Homo sapiens
gaaaguaugugaua

SEQ ID NO: 1115088 - RNA, 19 nt, Homo sapiens
gaaauaaaguuggugacag

SEQ ID NO: 1115089 - RNA, 22 nt, Homo sapiens
gaaauaccagugaaccaaagag

SEQ ID NO: 1115090 - RNA, 16 nt, Homo sapiens
gaaauagacaguauau

SEQ ID NO: 1115091 - RNA, 20 nt, Homo sapiens
gaaauaugugguuuccacga

SEQ ID NO: 1115092 - RNA, 16 nt, Homo sapiens
gaaauccaguuuccca

SEQ ID NO: 1115093 - RNA, 12 nt, Homo sapiens
gaaaucugccaa

SEQ ID NO: 1115094 - RNA, 15 nt, Homo sapiens
gaaauguauccugau

SEQ ID NO: 1115095 - RNA, 18 nt, Homo sapiens
gaaauuauaucugugguc

SEQ ID NO: 1115096 - RNA, 14 nt, Homo sapiens
gaaauuauuauuca

SEQ ID NO: 1115097 - RNA, 20 nt, Homo sapiens
gaaauuugacucaugaacua

SEQ ID NO: 1115098 - RNA, 22 nt, Homo sapiens
gaacaacuaggcuucagcauau

SEQ ID NO: 1115099 - RNA, 19 nt, Homo sapiens
gaacaauggagauaucagu

SEQ ID NO: 1115100 - RNA, 14 nt, Homo sapiens
gaacacaaggucau

SEQ ID NO: 1115101 - RNA, 21 nt, Homo sapiens
gaacacccgacuccucaaaag

SEQ ID NO: 1115102 - RNA, 21 nt, Homo sapiens
gaacacuggcaacaacaaagc

SEQ ID NO: 1115103 - RNA, 20 nt, Homo sapiens
gaacacugggggaggggaca

SEQ ID NO: 1115104 - RNA, 13 nt, Homo sapiens
gaacagaaggaug

SEQ ID NO: 1115105 - RNA, 16 nt, Homo sapiens
gaacaguaacugccau

SEQ ID NO: 1115106 - RNA, 16 nt, Homo sapiens
gaacaugcacauuuau

SEQ ID NO: 1115107 - RNA, 19 nt, Homo sapiens
gaaccaauauuuguagaag

SEQ ID NO: 1115108 - RNA, 21 nt, Homo sapiens
gaacccauuuugagugacucg

SEQ ID NO: 1115109 - RNA, 21 nt, Homo sapiens
gaaccccaaaucccacagggc

SEQ ID NO: 1115110 - RNA, 22 nt, Homo sapiens
gaaccccuggccucaagcaauc

SEQ ID NO: 1115111 - RNA, 19 nt, Homo sapiens
gaacccugcuugcacuuug

SEQ ID NO: 1115112 - RNA, 16 nt, Homo sapiens
ucugacucacaagaag

SEQ ID NO: 1115113 - RNA, 14 nt, Homo sapiens
ucugacucuugccu

SEQ ID NO: 1115114 - RNA, 19 nt, Homo sapiens
ucugacucuugccuuucca

SEQ ID NO: 1115115 - RNA, 11 nt, Homo sapiens
ucugacugcug

SEQ ID NO: 1115116 - RNA, 22 nt, Homo sapiens
ucugagcuagugauuugccuca

SEQ ID NO: 1115117 - RNA, 21 nt, Homo sapiens
ucugaggaaggugcuugccug

SEQ ID NO: 1115118 - RNA, 13 nt, Homo sapiens
ucugauaccucaa

SEQ ID NO: 1115119 - RNA, 15 nt, Homo sapiens
ucugaugcaucagaa

SEQ ID NO: 1115120 - RNA, 21 nt, Homo sapiens
ucugcaaaggcgucugaaugu

SEQ ID NO: 1115121 - RNA, 18 nt, Homo sapiens
ucugcaaggucuuugguu

SEQ ID NO: 1115122 - RNA, 12 nt, Homo sapiens
ucugcacccagg

SEQ ID NO: 1115123 - RNA, 18 nt, Homo sapiens
ucugccagccagcagcca

SEQ ID NO: 1115124 - RNA, 18 nt, Homo sapiens
ucugcuccucuccaggca

SEQ ID NO: 1115125 - RNA, 23 nt, Homo sapiens
ucugcuuuucuucccagcaaagg

SEQ ID NO: 1115126 - RNA, 17 nt, Homo sapiens
ucuggaaaagcacuuua

SEQ ID NO: 1115127 - RNA, 16 nt, Homo sapiens
ucuggaauacaugaaa

SEQ ID NO: 1115128 - RNA, 22 nt, Homo sapiens
ucuggcagccacacuucucagg

SEQ ID NO: 1115129 - RNA, 14 nt, Homo sapiens
ucugggcauugagc

SEQ ID NO: 1115130 - RNA, 20 nt, Homo sapiens
ucugggcuuggggcuuccua

SEQ ID NO: 1115131 - RNA, 21 nt, Homo sapiens
ucuggggaagaccuuguccca

SEQ ID NO: 1115132 - RNA, 12 nt, Homo sapiens
ucuggucugucc

SEQ ID NO: 1115133 - RNA, 18 nt, Homo sapiens
ucuguaaggaacuggaac

SEQ ID NO: 1115134 - RNA, 12 nt, Homo sapiens
ucuguaaucuuc

SEQ ID NO: 1115135 - RNA, 18 nt, Homo sapiens
ucuguacgucugacaggc

SEQ ID NO: 1115136 - RNA, 16 nt, Homo sapiens
ucugucccucuuugcc

SEQ ID NO: 1115137 - RNA, 18 nt, Homo sapiens
ucuguccguuuacuccaa

SEQ ID NO: 1115138 - RNA, 17 nt, Homo sapiens
ucuguccuacucugugu

SEQ ID NO: 1115139 - RNA, 15 nt, Homo sapiens
ucugugucucuggaa

SEQ ID NO: 1115140 - RNA, 19 nt, Homo sapiens
ucuguucauuuccucaaaa

SEQ ID NO: 1115141 - RNA, 17 nt, Homo sapiens
ucuguuccccauggcca

SEQ ID NO: 1115142 - RNA, 20 nt, Homo sapiens
ucuguuggccagugugacaa

SEQ ID NO: 1115143 - RNA, 15 nt, Homo sapiens
ucuuaaaauucuugg

SEQ ID NO: 1115144 - RNA, 20 nt, Homo sapiens
ucuuaauucaacuaguacca

SEQ ID NO: 1115145 - RNA, 22 nt, Homo sapiens
ucuuaauucaacuaguaccaca

SEQ ID NO: 1115146 - RNA, 21 nt, Homo sapiens
ucuuacaauaauucuaugaga

SEQ ID NO: 1115147 - RNA, 22 nt, Homo sapiens
ucuuacaauaauucuaugagau

SEQ ID NO: 1115148 - RNA, 19 nt, Homo sapiens
ucuuaccuguaugucucca

SEQ ID NO: 1115149 - RNA, 20 nt, Homo sapiens
ucuuacuucccuaaugaagu

SEQ ID NO: 1115150 - RNA, 18 nt, Homo sapiens
ucuuagcugaacaaugaa

SEQ ID NO: 1115151 - RNA, 16 nt, Homo sapiens
ucuuaugaaaugggcu

SEQ ID NO: 1115152 - RNA, 19 nt, Homo sapiens
ucuuaugaaaugggcuuua

SEQ ID NO: 1115153 - RNA, 20 nt, Homo sapiens
ucuuaugaaaugggcuuuaa

SEQ ID NO: 1115154 - RNA, 22 nt, Homo sapiens
ucuuauuuaauuuuugcaauua

SEQ ID NO: 1115155 - RNA, 16 nt, Homo sapiens
ucuuauuuauauauga

SEQ ID NO: 1115156 - RNA, 14 nt, Homo sapiens
ucuuauuuccucaa

SEQ ID NO: 1115157 - RNA, 19 nt, Homo sapiens
ucuucaacuuuugugcucc

SEQ ID NO: 1115158 - RNA, 21 nt, Homo sapiens
ucuucagaauauggacaaaga

SEQ ID NO: 1115159 - RNA, 17 nt, Homo sapiens
ucuucaguuuuaggcuu

SEQ ID NO: 1115160 - RNA, 14 nt, Homo sapiens
ucuuccugccucag

SEQ ID NO: 1115161 - RNA, 23 nt, Homo sapiens
ucuucuccaggcuguaucccaug

SEQ ID NO: 1115162 - RNA, 14 nt, Homo sapiens
ucuucucucggggc

SEQ ID NO: 1115163 - RNA, 15 nt, Homo sapiens
ucuucugagcaccua

SEQ ID NO: 1115164 - RNA, 20 nt, Homo sapiens
ucuucugggaacuuccucag

SEQ ID NO: 1115165 - RNA, 21 nt, Homo sapiens
ucuugaaacauagagaucuau

SEQ ID NO: 1115166 - RNA, 14 nt, Homo sapiens
ucuugaagaauauu

SEQ ID NO: 1115167 - RNA, 23 nt, Homo sapiens
ucuugagguuuucugugcuuuga

SEQ ID NO: 1115168 - RNA, 13 nt, Homo sapiens
ucuugcucaaaaa

SEQ ID NO: 1115169 - RNA, 13 nt, Homo sapiens
ucuuggacacugu

SEQ ID NO: 1115170 - RNA, 19 nt, Homo sapiens
ucuuggaccucugcucuga

SEQ ID NO: 1115171 - RNA, 24 nt, Homo sapiens
ucuugggggguuuuuacuccagug

SEQ ID NO: 1115172 - RNA, 12 nt, Homo sapiens
ucuugucucaca

SEQ ID NO: 1115173 - RNA, 14 nt, Homo sapiens
ucuuuaaaucaaaa

SEQ ID NO: 1115174 - RNA, 18 nt, Homo sapiens
ucuuuaaauuucaucuca

SEQ ID NO: 1115175 - RNA, 13 nt, Homo sapiens
ucuuuaaguauug

SEQ ID NO: 1115176 - RNA, 17 nt, Homo sapiens
ucuuuaaugucacaggc

SEQ ID NO: 1115177 - RNA, 19 nt, Homo sapiens
ucuuuaucagugauggucu

SEQ ID NO: 1115178 - RNA, 14 nt, Homo sapiens
ucuuucugauaaca

SEQ ID NO: 1115179 - RNA, 17 nt, Homo sapiens
ucuuuggggucagccag

SEQ ID NO: 1115180 - RNA, 15 nt, Homo sapiens
ucuuuguccccaaau

SEQ ID NO: 1115181 - RNA, 14 nt, Homo sapiens
ucuuuuacuguaau

SEQ ID NO: 1115182 - RNA, 21 nt, Homo sapiens
ucuuuucuggaauguaaucaa

SEQ ID NO: 1115183 - RNA, 21 nt, Homo sapiens
ucuuuuuagagaaauuugcca

SEQ ID NO: 1115184 - RNA, 18 nt, Homo sapiens
ucuuuuuugucucaagau

SEQ ID NO: 1115185 - RNA, 22 nt, Homo sapiens
ugaaaaaaaauuuuauaguguc

SEQ ID NO: 1115186 - RNA, 19 nt, Homo sapiens
ugaaaaacagaaagcaucc

SEQ ID NO: 1115187 - RNA, 21 nt, Homo sapiens
ugaaaaaugguaauuguugcu

SEQ ID NO: 1115188 - RNA, 17 nt, Homo sapiens
ugaaaagacucaguguu

SEQ ID NO: 1115189 - RNA, 16 nt, Homo sapiens
ugaaaauaauguugua

SEQ ID NO: 1115190 - RNA, 16 nt, Homo sapiens
ugaaaaucacuauaac

SEQ ID NO: 1115191 - RNA, 17 nt, Homo sapiens
ugaaacaaauaaucaca

SEQ ID NO: 1115192 - RNA, 21 nt, Homo sapiens
ugaaacaagcaacagauggau

SEQ ID NO: 1115193 - RNA, 23 nt, Homo sapiens
ugaaaguaugugauaucugaaca

SEQ ID NO: 1115194 - RNA, 18 nt, Homo sapiens
ugaaagugaauaaacuuc

SEQ ID NO: 1115195 - RNA, 14 nt, Homo sapiens
ugaaauaaaagccu

SEQ ID NO: 1115196 - RNA, 19 nt, Homo sapiens
ugaaauaauuaaaaaccac

SEQ ID NO: 1115197 - RNA, 15 nt, Homo sapiens
ugaaauauuugcuua

SEQ ID NO: 1115198 - RNA, 15 nt, Homo sapiens
ugaaaucucagaauu

SEQ ID NO: 1115199 - RNA, 14 nt, Homo sapiens
ugaaaucugaggaa

SEQ ID NO: 1115200 - RNA, 20 nt, Homo sapiens
ugaaaucugaggaaggugcu

SEQ ID NO: 1115201 - RNA, 21 nt, Homo sapiens
ugaaaucugaggaaggugcuu

SEQ ID NO: 1115202 - RNA, 22 nt, Homo sapiens
ugcaugauuuuauacauaguca

SEQ ID NO: 1115203 - RNA, 17 nt, Homo sapiens
ugcaugcacuucuuaca

SEQ ID NO: 1115204 - RNA, 15 nt, Homo sapiens
ugcauguugccauga

SEQ ID NO: 1115205 - RNA, 19 nt, Homo sapiens
ugcauguuggcccagaccu

SEQ ID NO: 1115206 - RNA, 21 nt, Homo sapiens
ugcauuaaaaaugcauauacu

SEQ ID NO: 1115207 - RNA, 18 nt, Homo sapiens
ugcauuagaaacugaaaa

SEQ ID NO: 1115208 - RNA, 10 nt, Homo sapiens
ugcauuccau

SEQ ID NO: 1115209 - RNA, 14 nt, Homo sapiens
ugcauuugugucau

SEQ ID NO: 1115210 - RNA, 14 nt, Homo sapiens
ugccaaaacaaugc

SEQ ID NO: 1115211 - RNA, 13 nt, Homo sapiens
ugccaacauaccc

SEQ ID NO: 1115212 - RNA, 21 nt, Homo sapiens
ugccacuccugcuucucuggg

SEQ ID NO: 1115213 - RNA, 12 nt, Homo sapiens
ugccagacaugu

SEQ ID NO: 1115214 - RNA, 18 nt, Homo sapiens
ugccagggacugacaaaa

SEQ ID NO: 1115215 - RNA, 23 nt, Homo sapiens
ugccaguguuuagaagagccuga

SEQ ID NO: 1115216 - RNA, 18 nt, Homo sapiens
ugccauauucuguuggcc

SEQ ID NO: 1115217 - RNA, 23 nt, Homo sapiens
ugccaucaagaugagagaacugg

SEQ ID NO: 1115218 - RNA, 17 nt, Homo sapiens
ugccaucuccacccuga

SEQ ID NO: 1115219 - RNA, 23 nt, Homo sapiens
ugccaucuccacccugagccuga

SEQ ID NO: 1115220 - RNA, 13 nt, Homo sapiens
ugcccaccagauc

SEQ ID NO: 1115221 - RNA, 13 nt, Homo sapiens
ugcccacuauggc

SEQ ID NO: 1115222 - RNA, 16 nt, Homo sapiens
ugcccacuauggucau

SEQ ID NO: 1115223 - RNA, 21 nt, Homo sapiens
ugcccagccucgcaugccaga

SEQ ID NO: 1115224 - RNA, 14 nt, Homo sapiens
ugccccacugaauu

SEQ ID NO: 1115225 - RNA, 13 nt, Homo sapiens
ugccccucuuccc

SEQ ID NO: 1115226 - RNA, 17 nt, Homo sapiens
ugccccucuucccggga

SEQ ID NO: 1115227 - RNA, 19 nt, Homo sapiens
ugcccuuaaaauaaugauu

SEQ ID NO: 1115228 - RNA, 21 nt, Homo sapiens
ugccguaacaacuguggucaa

SEQ ID NO: 1115229 - RNA, 15 nt, Homo sapiens
ugccuagaggugcuc

SEQ ID NO: 1115230 - RNA, 22 nt, Homo sapiens
ugccucagccucccaaagugcu

SEQ ID NO: 1115231 - RNA, 18 nt, Homo sapiens
ugccucgaacuggcugca

SEQ ID NO: 1115232 - RNA, 20 nt, Homo sapiens
ugccucgcuccccacucugc

SEQ ID NO: 1115233 - RNA, 23 nt, Homo sapiens
ugccucugaggccagccuggccu

SEQ ID NO: 1115234 - RNA, 17 nt, Homo sapiens
ugccucugccucugaca

SEQ ID NO: 1115235 - RNA, 19 nt, Homo sapiens
ugccuggaaauuaaacccu

SEQ ID NO: 1115236 - RNA, 22 nt, Homo sapiens
ugccuggaucucacaagcacuu

SEQ ID NO: 1115237 - RNA, 15 nt, Homo sapiens
ugccuggccuggcac

SEQ ID NO: 1115238 - RNA, 18 nt, Homo sapiens
ugccugggaccaguggca

SEQ ID NO: 1115239 - RNA, 22 nt, Homo sapiens
ugccugugcacggccagcugca

SEQ ID NO: 1115240 - RNA, 16 nt, Homo sapiens
ugccuucacuuuacaa

SEQ ID NO: 1115241 - RNA, 16 nt, Homo sapiens
ugccuugccaugucuu

SEQ ID NO: 1115242 - RNA, 17 nt, Homo sapiens
ugccuuuuuaaugaaca

SEQ ID NO: 1115243 - RNA, 15 nt, Homo sapiens
ugcguggacucugca

SEQ ID NO: 1115244 - RNA, 16 nt, Homo sapiens
ugcguggacucugcac

SEQ ID NO: 1115245 - RNA, 13 nt, Homo sapiens
ugcguuacuaauu

SEQ ID NO: 1115246 - RNA, 21 nt, Homo sapiens
ugcguuuuagaguaugcaaga

SEQ ID NO: 1115247 - RNA, 13 nt, Homo sapiens
ugcuaaaugcaaa

SEQ ID NO: 1115248 - RNA, 23 nt, Homo sapiens
ugcuaaauggucgcccaggagac

SEQ ID NO: 1115249 - RNA, 22 nt, Homo sapiens
ugcuaagaagcgagcacugacc

SEQ ID NO: 1115250 - RNA, 16 nt, Homo sapiens
ugcuaaggaguucuca

SEQ ID NO: 1115251 - RNA, 20 nt, Homo sapiens
ugcuaaucuucuuaugcaau

SEQ ID NO: 1115252 - RNA, 16 nt, Homo sapiens
ugcuacaaacauauca

SEQ ID NO: 1115253 - RNA, 17 nt, Homo sapiens
ugcuacaaacauaucaa

SEQ ID NO: 1115254 - RNA, 19 nt, Homo sapiens
ugcuacaccuuagcagcuc

SEQ ID NO: 1115255 - RNA, 17 nt, Homo sapiens
ugcuaccucacuggggu

SEQ ID NO: 1115256 - RNA, 16 nt, Homo sapiens
ugcuagcugcaaguga

SEQ ID NO: 1115257 - RNA, 13 nt, Homo sapiens
ugcuagcuguaga

SEQ ID NO: 1115258 - RNA, 23 nt, Homo sapiens
ugcuauaggcuggagaagcucac

SEQ ID NO: 1115259 - RNA, 16 nt, Homo sapiens
ugcuaugaaugauacc

SEQ ID NO: 1115260 - RNA, 19 nt, Homo sapiens
ugcucaaggcaaccagagg

SEQ ID NO: 1115261 - RNA, 19 nt, Homo sapiens
ugcucacauaucugucauu

SEQ ID NO: 1115262 - RNA, 13 nt, Homo sapiens
ugcuccaguaugg

SEQ ID NO: 1115263 - RNA, 16 nt, Homo sapiens
ugcuccccagugcuac

SEQ ID NO: 1115264 - RNA, 20 nt, Homo sapiens
ugcuccguaugccaagagga

SEQ ID NO: 1115265 - RNA, 22 nt, Homo sapiens
ugcucgauuauucccuguacaa

SEQ ID NO: 1115266 - RNA, 21 nt, Homo sapiens
ugcucucucacucccccauga

SEQ ID NO: 1115267 - RNA, 11 nt, Homo sapiens
ugcucuugccu

SEQ ID NO: 1115268 - RNA, 15 nt, Homo sapiens
ugcucuuucuugacu

SEQ ID NO: 1115269 - RNA, 15 nt, Homo sapiens
ugcugagaaccuggc

SEQ ID NO: 1115270 - RNA, 22 nt, Homo sapiens
ugcugaggagaguggaacagaa

SEQ ID NO: 1115271 - RNA, 20 nt, Homo sapiens
ugcugaguauguuaagcucu

SEQ ID NO: 1115272 - RNA, 23 nt, Homo sapiens
ugcugagugcaccacuucaagug

SEQ ID NO: 1115273 - RNA, 12 nt, Homo sapiens
ugcugccaaaca

SEQ ID NO: 1115274 - RNA, 17 nt, Homo sapiens
ugcugccaaacacccau

SEQ ID NO: 1115275 - RNA, 19 nt, Homo sapiens
ugcugccaguccucugcau

SEQ ID NO: 1115276 - RNA, 21 nt, Homo sapiens
ugcugcggccagccugacuag

SEQ ID NO: 1115277 - RNA, 17 nt, Homo sapiens
ugcugcuggaaguagaa

SEQ ID NO: 1115278 - RNA, 14 nt, Homo sapiens
ugcuggagacacuc

SEQ ID NO: 1115279 - RNA, 21 nt, Homo sapiens
ugcuggggagucccugccaca

SEQ ID NO: 1115280 - RNA, 14 nt, Homo sapiens
ugcuuaguaucuca

SEQ ID NO: 1115281 - RNA, 18 nt, Homo sapiens
ugcuuaguaucucaucaa

SEQ ID NO: 1115282 - RNA, 12 nt, Homo sapiens
ugcuucacauaa

SEQ ID NO: 1115283 - RNA, 18 nt, Homo sapiens
ugcuugccaccaccagau

SEQ ID NO: 1115284 - RNA, 14 nt, Homo sapiens
ugcuugucaucugc

SEQ ID NO: 1115285 - RNA, 19 nt, Homo sapiens
ugcuuuaaaguaccuguag

SEQ ID NO: 1115286 - RNA, 20 nt, Homo sapiens
ugcuuucaacuuaaaucacu

SEQ ID NO: 1115287 - RNA, 21 nt, Homo sapiens
ugcuuuguuuccauucuuguc

SEQ ID NO: 1115288 - RNA, 14 nt, Homo sapiens
ugcuuuuaaaugca

SEQ ID NO: 1115289 - RNA, 16 nt, Homo sapiens
uggaaaaaaaggaaga

SEQ ID NO: 1115290 - RNA, 16 nt, Homo sapiens
uggaaaacucaggauu

SEQ ID NO: 1115291 - RNA, 13 nt, Homo sapiens
uggaaaagcacuu

SEQ ID NO: 1115292 - RNA, 18 nt, Homo sapiens
aaggucacauugugccuu

SEQ ID NO: 1115293 - RNA, 15 nt, Homo sapiens
aaggucuucagccau

SEQ ID NO: 1115294 - RNA, 22 nt, Homo sapiens
aaggucuugccugaauccauca

SEQ ID NO: 1115295 - RNA, 24 nt, Homo sapiens
aaggugugcucugaucauccacug

SEQ ID NO: 1115296 - RNA, 21 nt, Homo sapiens
aagguuaguaucaucagauag

SEQ ID NO: 1115297 - RNA, 14 nt, Homo sapiens
aaguagaauccuaa

SEQ ID NO: 1115298 - RNA, 18 nt, Homo sapiens
aaguagcucuggugaccu

SEQ ID NO: 1115299 - RNA, 14 nt, Homo sapiens
aaguauaaagugau

SEQ ID NO: 1115300 - RNA, 13 nt, Homo sapiens
aaguaugagggaa

SEQ ID NO: 1115301 - RNA, 18 nt, Homo sapiens
aaguauuauuuauuugaa

SEQ ID NO: 1115302 - RNA, 14 nt, Homo sapiens
aagucccagcauug

SEQ ID NO: 1115303 - RNA, 20 nt, Homo sapiens
aagucccugacucucuguga

SEQ ID NO: 1115304 - RNA, 14 nt, Homo sapiens
aagucuuccauaga

SEQ ID NO: 1115305 - RNA, 23 nt, Homo sapiens
aagucuuccauagagacuuugug

SEQ ID NO: 1115306 - RNA, 21 nt, Homo sapiens
aagugaagagggagaagggau

SEQ ID NO: 1115307 - RNA, 16 nt, Homo sapiens
aagugaaggagccagu

SEQ ID NO: 1115308 - RNA, 22 nt, Homo sapiens
aagugauaucccccagccucaa

SEQ ID NO: 1115309 - RNA, 16 nt, Homo sapiens
aagugcaaauuugaua

SEQ ID NO: 1115310 - RNA, 21 nt, Homo sapiens
aagugcugggauuacaggugu

SEQ ID NO: 1115311 - RNA, 22 nt, Homo sapiens
aagugcugggauuacaggugua

SEQ ID NO: 1115312 - RNA, 18 nt, Homo sapiens
aaguguugauuacauaau

SEQ ID NO: 1115313 - RNA, 16 nt, Homo sapiens
aaguuaaucuucaugg

SEQ ID NO: 1115314 - RNA, 18 nt, Homo sapiens
aaguuauacuguggcuau

SEQ ID NO: 1115315 - RNA, 21 nt, Homo sapiens
aaguuauaguauaucuggaca

SEQ ID NO: 1115316 - RNA, 22 nt, Homo sapiens
aaguuauccagaggguugugau

SEQ ID NO: 1115317 - RNA, 22 nt, Homo sapiens
aaguuccaguguucucucuuau

SEQ ID NO: 1115318 - RNA, 20 nt, Homo sapiens
aaguugaagcuaagauuuag

SEQ ID NO: 1115319 - RNA, 13 nt, Homo sapiens
aaguugagaacaa

SEQ ID NO: 1115320 - RNA, 19 nt, Homo sapiens
aaguuucuaguaucacaua

SEQ ID NO: 1115321 - RNA, 15 nt, Homo sapiens
aauaaaaacccugua

SEQ ID NO: 1115322 - RNA, 13 nt, Homo sapiens
aauaaaaauaccu

SEQ ID NO: 1115323 - RNA, 16 nt, Homo sapiens
aauaaaagccucuggu

SEQ ID NO: 1115324 - RNA, 15 nt, Homo sapiens
aauaaacccuuccug

SEQ ID NO: 1115325 - RNA, 20 nt, Homo sapiens
aauaaagacagaucauuuca

SEQ ID NO: 1115326 - RNA, 13 nt, Homo sapiens
aauaaagcccuug

SEQ ID NO: 1115327 - RNA, 20 nt, Homo sapiens
aauaaaguacccugugcuca

SEQ ID NO: 1115328 - RNA, 12 nt, Homo sapiens
aauaaaguguau

SEQ ID NO: 1115329 - RNA, 20 nt, Homo sapiens
aauaaaucaacuccagcucc

SEQ ID NO: 1115330 - RNA, 17 nt, Homo sapiens
aauaaaugaaucuuacu

SEQ ID NO: 1115331 - RNA, 20 nt, Homo sapiens
aauaaaugaaucuuacuccu

SEQ ID NO: 1115332 - RNA, 14 nt, Homo sapiens
aauaaaugugcuua

SEQ ID NO: 1115333 - RNA, 15 nt, Homo sapiens
aauaaauucauacau

SEQ ID NO: 1115334 - RNA, 14 nt, Homo sapiens
aauaagaaacacaa

SEQ ID NO: 1115335 - RNA, 15 nt, Homo sapiens
aauaagcccaacaga

SEQ ID NO: 1115336 - RNA, 19 nt, Homo sapiens
aauaaguacuguguacaga

SEQ ID NO: 1115337 - RNA, 14 nt, Homo sapiens
aauaauaccuaagc

SEQ ID NO: 1115338 - RNA, 18 nt, Homo sapiens
aauaauaugcugccaaau

SEQ ID NO: 1115339 - RNA, 13 nt, Homo sapiens
aauaaugauuuaa

SEQ ID NO: 1115340 - RNA, 15 nt, Homo sapiens
aauaauguauacaca

SEQ ID NO: 1115341 - RNA, 16 nt, Homo sapiens
aauaauguauacacau

SEQ ID NO: 1115342 - RNA, 14 nt, Homo sapiens
aauaauugauuuca

SEQ ID NO: 1115343 - RNA, 22 nt, Homo sapiens
aauaauugcauauaaaaugcuu

SEQ ID NO: 1115344 - RNA, 13 nt, Homo sapiens
aauaauuguguac

SEQ ID NO: 1115345 - RNA, 16 nt, Homo sapiens
aauaauuuaacuaauu

SEQ ID NO: 1115346 - RNA, 19 nt, Homo sapiens
aauacaauuaaagcuguua

SEQ ID NO: 1115347 - RNA, 17 nt, Homo sapiens
aauacagggcaugcauu

SEQ ID NO: 1115348 - RNA, 15 nt, Homo sapiens
aauacauaagaccau

SEQ ID NO: 1115349 - RNA, 21 nt, Homo sapiens
aauacauaccuacugacugau

SEQ ID NO: 1115350 - RNA, 20 nt, Homo sapiens
aauacauuuuauaucuggau

SEQ ID NO: 1115351 - RNA, 17 nt, Homo sapiens
aauaccagugaaccaaa

SEQ ID NO: 1115352 - RNA, 16 nt, Homo sapiens
aauacucaaaagagag

SEQ ID NO: 1115353 - RNA, 17 nt, Homo sapiens
aauacugcguguucuca

SEQ ID NO: 1115354 - RNA, 14 nt, Homo sapiens
aauacuuaacucaa

SEQ ID NO: 1115355 - RNA, 19 nt, Homo sapiens
aauaguaggaccaauguug

SEQ ID NO: 1115356 - RNA, 22 nt, Homo sapiens
aauaguguuggaaaaugugcaa

SEQ ID NO: 1115357 - RNA, 19 nt, Homo sapiens
aauaguuuuaaauaugaac

SEQ ID NO: 1115358 - RNA, 18 nt, Homo sapiens
aauaguuuugauccuaaa

SEQ ID NO: 1115359 - RNA, 16 nt, Homo sapiens
aauauaaaaguaaaua

SEQ ID NO: 1115360 - RNA, 12 nt, Homo sapiens
aauauaaugcaa

SEQ ID NO: 1115361 - RNA, 22 nt, Homo sapiens
aauaucacaucacuuaacugau

SEQ ID NO: 1115362 - RNA, 18 nt, Homo sapiens
aauaucugagaaguguau

SEQ ID NO: 1115363 - RNA, 15 nt, Homo sapiens
aauauuauuugcuaa

SEQ ID NO: 1115364 - RNA, 23 nt, Homo sapiens
aauauucaauaaagcugcugaga

SEQ ID NO: 1115365 - RNA, 17 nt, Homo sapiens
aauauuuaaguauauag

SEQ ID NO: 1115366 - RNA, 18 nt, Homo sapiens
aauauuugcaagacauag

SEQ ID NO: 1115367 - RNA, 18 nt, Homo sapiens
aauauuugcugacagcug

SEQ ID NO: 1115368 - RNA, 14 nt, Homo sapiens
aauauuuguagaag

SEQ ID NO: 1115369 - RNA, 15 nt, Homo sapiens
aauauuuuccaugaa

SEQ ID NO: 1115370 - RNA, 19 nt, Homo sapiens
aauauuuuuaugugcaaua

SEQ ID NO: 1115371 - RNA, 16 nt, Homo sapiens
aaucaagagugaguga

SEQ ID NO: 1115372 - RNA, 12 nt, Homo sapiens
aaucaauguuca

SEQ ID NO: 1115373 - RNA, 14 nt, Homo sapiens
aaucaccacaccaa

SEQ ID NO: 1115374 - RNA, 22 nt, Homo sapiens
aaucacuugcacuccggaggua

SEQ ID NO: 1115375 - RNA, 20 nt, Homo sapiens
aaucagauuauuaagggaau

SEQ ID NO: 1115376 - RNA, 16 nt, Homo sapiens
aaucauacuuagcaaa

SEQ ID NO: 1115377 - RNA, 19 nt, Homo sapiens
aaucauauaauaaauguac

SEQ ID NO: 1115378 - RNA, 18 nt, Homo sapiens
aaucauaugguugacagu

SEQ ID NO: 1115379 - RNA, 23 nt, Homo sapiens
aaucauaugguugacaguaugca

SEQ ID NO: 1115380 - RNA, 15 nt, Homo sapiens
aaucaucucucauca

SEQ ID NO: 1115381 - RNA, 16 nt, Homo sapiens
aaucauggcauucaca

SEQ ID NO: 1115382 - RNA, 16 nt, Homo sapiens
aauccagacccggcug

SEQ ID NO: 1115383 - RNA, 21 nt, Homo sapiens
auauucucaguguagggcaga

SEQ ID NO: 1115384 - RNA, 18 nt, Homo sapiens
auauuuaauugugucaua

SEQ ID NO: 1115385 - RNA, 16 nt, Homo sapiens
auauuuauaacucauc

SEQ ID NO: 1115386 - RNA, 21 nt, Homo sapiens
auauuuaugagaaaguucuca

SEQ ID NO: 1115387 - RNA, 14 nt, Homo sapiens
auauuucaauguua

SEQ ID NO: 1115388 - RNA, 14 nt, Homo sapiens
auauuuccauucau

SEQ ID NO: 1115389 - RNA, 18 nt, Homo sapiens
auauuugaagcaucacau

SEQ ID NO: 1115390 - RNA, 17 nt, Homo sapiens
auauuugcuaugaagcg

SEQ ID NO: 1115391 - RNA, 18 nt, Homo sapiens
auauuuuuaugugcaaua

SEQ ID NO: 1115392 - RNA, 14 nt, Homo sapiens
aucaaaacauauca

SEQ ID NO: 1115393 - RNA, 15 nt, Homo sapiens
aucaaaacauaucaa

SEQ ID NO: 1115394 - RNA, 19 nt, Homo sapiens
aucaaaacccaacaugacu

SEQ ID NO: 1115395 - RNA, 20 nt, Homo sapiens
aucaaaaucuuucagcacuc

SEQ ID NO: 1115396 - RNA, 21 nt, Homo sapiens
aucaaagacauggaauuaccu

SEQ ID NO: 1115397 - RNA, 18 nt, Homo sapiens
aucaaauauuaccaaaaa

SEQ ID NO: 1115398 - RNA, 17 nt, Homo sapiens
aucaaaucagucuugga

SEQ ID NO: 1115399 - RNA, 13 nt, Homo sapiens
aucaacacugcgc

SEQ ID NO: 1115400 - RNA, 22 nt, Homo sapiens
aucaacauucccccaacauuac

SEQ ID NO: 1115401 - RNA, 23 nt, Homo sapiens
aucaaccagcaggaaaguacaga

SEQ ID NO: 1115402 - RNA, 19 nt, Homo sapiens
aucaacuuauuauaugacu

SEQ ID NO: 1115403 - RNA, 11 nt, Homo sapiens
aucaaugucac

SEQ ID NO: 1115404 - RNA, 16 nt, Homo sapiens
aucaaugucacuuaaa

SEQ ID NO: 1115405 - RNA, 12 nt, Homo sapiens
aucaauguuucu

SEQ ID NO: 1115406 - RNA, 16 nt, Homo sapiens
aucaauuaaaggcaaa

SEQ ID NO: 1115407 - RNA, 17 nt, Homo sapiens
aucacaguguuugcaau

SEQ ID NO: 1115408 - RNA, 14 nt, Homo sapiens
aucacauacaauuu

SEQ ID NO: 1115409 - RNA, 17 nt, Homo sapiens
aucacauauucuagugu

SEQ ID NO: 1115410 - RNA, 15 nt, Homo sapiens
aucacauuaucaucu

SEQ ID NO: 1115411 - RNA, 18 nt, Homo sapiens
aucacauuaucaucugaa

SEQ ID NO: 1115412 - RNA, 19 nt, Homo sapiens
aucaccaggaucgcuuugu

SEQ ID NO: 1115413 - RNA, 15 nt, Homo sapiens
aucacccccuacccc

SEQ ID NO: 1115414 - RNA, 15 nt, Homo sapiens
aucaccuacucacac

SEQ ID NO: 1115415 - RNA, 15 nt, Homo sapiens
aucacgccacugcac

SEQ ID NO: 1115416 - RNA, 23 nt, Homo sapiens
aucacggcucacugcagccucaa

SEQ ID NO: 1115417 - RNA, 19 nt, Homo sapiens
aucacuaagggauggggca

SEQ ID NO: 1115418 - RNA, 17 nt, Homo sapiens
aucacuugcacuccgga

SEQ ID NO: 1115419 - RNA, 16 nt, Homo sapiens
aucacuuuucucugag

SEQ ID NO: 1115420 - RNA, 13 nt, Homo sapiens
aucagacuaguga

SEQ ID NO: 1115421 - RNA, 22 nt, Homo sapiens
aucagaguugcuuuucuaaucu

SEQ ID NO: 1115422 - RNA, 20 nt, Homo sapiens
aucaggccuggcacgguggc

SEQ ID NO: 1115423 - RNA, 16 nt, Homo sapiens
aucauacaugacucag

SEQ ID NO: 1115424 - RNA, 17 nt, Homo sapiens
aucauagcucacuguaa

SEQ ID NO: 1115425 - RNA, 19 nt, Homo sapiens
aucaucagcauaccuuuau

SEQ ID NO: 1115426 - RNA, 19 nt, Homo sapiens
aucauccacugugccaugu

SEQ ID NO: 1115427 - RNA, 22 nt, Homo sapiens
aucaucccagcugcucccaaau

SEQ ID NO: 1115428 - RNA, 18 nt, Homo sapiens
aucauccugccuucaugg

SEQ ID NO: 1115429 - RNA, 20 nt, Homo sapiens
aucaucucgaccacuuuuca

SEQ ID NO: 1115430 - RNA, 20 nt, Homo sapiens
aucaugccccuguacuccag

SEQ ID NO: 1115431 - RNA, 16 nt, Homo sapiens
aucaugcugucuuuac

SEQ ID NO: 1115432 - RNA, 13 nt, Homo sapiens
aucaugugccugg

SEQ ID NO: 1115433 - RNA, 14 nt, Homo sapiens
aucauuccuugaga

SEQ ID NO: 1115434 - RNA, 16 nt, Homo sapiens
auccaauuaugugaca

SEQ ID NO: 1115435 - RNA, 14 nt, Homo sapiens
auccacccaccuca

SEQ ID NO: 1115436 - RNA, 16 nt, Homo sapiens
auccagaaauaaugaa

SEQ ID NO: 1115437 - RNA, 16 nt, Homo sapiens
auccagaccucuacaa

SEQ ID NO: 1115438 - RNA, 17 nt, Homo sapiens
auccaggacucugucaa

SEQ ID NO: 1115439 - RNA, 16 nt, Homo sapiens
auccaguugcaauaaa

SEQ ID NO: 1115440 - RNA, 14 nt, Homo sapiens
aucccagcacuuug

SEQ ID NO: 1115441 - RNA, 19 nt, Homo sapiens
aucccaugggggugcugca

SEQ ID NO: 1115442 - RNA, 19 nt, Homo sapiens
aucccccagccucaagucu

SEQ ID NO: 1115443 - RNA, 22 nt, Homo sapiens
aucccgccucuucuucuucaga

SEQ ID NO: 1115444 - RNA, 16 nt, Homo sapiens
auccuaaauaauguua

SEQ ID NO: 1115445 - RNA, 19 nt, Homo sapiens
auccuauuaaaacacagcu

SEQ ID NO: 1115446 - RNA, 15 nt, Homo sapiens
auccucacaaccacc

SEQ ID NO: 1115447 - RNA, 22 nt, Homo sapiens
auccucugagugugaccaggca

SEQ ID NO: 1115448 - RNA, 22 nt, Homo sapiens
auccugauaaacauuaaacacu

SEQ ID NO: 1115449 - RNA, 21 nt, Homo sapiens
auccuggccaacauggugaaa

SEQ ID NO: 1115450 - RNA, 16 nt, Homo sapiens
auccuguuaggggaaa

SEQ ID NO: 1115451 - RNA, 16 nt, Homo sapiens
aucgagucuaccucuu

SEQ ID NO: 1115452 - RNA, 18 nt, Homo sapiens
aucgcugccuugccaugu

SEQ ID NO: 1115453 - RNA, 16 nt, Homo sapiens
aucggaagcagugccu

SEQ ID NO: 1115454 - RNA, 23 nt, Homo sapiens
aucggaucuggggcucugggaua

SEQ ID NO: 1115455 - RNA, 18 nt, Homo sapiens
aucuaagccuuuccauaa

SEQ ID NO: 1115456 - RNA, 14 nt, Homo sapiens
aucuaauacacuuu

SEQ ID NO: 1115457 - RNA, 16 nt, Homo sapiens
aucuaaugugaaguag

SEQ ID NO: 1115458 - RNA, 14 nt, Homo sapiens
aucuaauuuauaca

SEQ ID NO: 1115459 - RNA, 18 nt, Homo sapiens
aucuacaaaaaacaacaa

SEQ ID NO: 1115460 - RNA, 22 nt, Homo sapiens
aucuacacagcaguaugaauga

SEQ ID NO: 1115461 - RNA, 16 nt, Homo sapiens
aucuauuucugagaag

SEQ ID NO: 1115462 - RNA, 17 nt, Homo sapiens
aucucagagacaggugg

SEQ ID NO: 1115463 - RNA, 18 nt, Homo sapiens
aucucaggccucccucaa

SEQ ID NO: 1115464 - RNA, 17 nt, Homo sapiens
aucucauuuaagggaaa

SEQ ID NO: 1115465 - RNA, 20 nt, Homo sapiens
aucuccacccugagccugac

SEQ ID NO: 1115466 - RNA, 17 nt, Homo sapiens
aucuccauauguuacac

SEQ ID NO: 1115467 - RNA, 14 nt, Homo sapiens
aucucucuccugua

SEQ ID NO: 1115468 - RNA, 16 nt, Homo sapiens
aucucuuugaugucau

SEQ ID NO: 1115469 - RNA, 23 nt, Homo sapiens
aucugacucacaagaagaccaga

SEQ ID NO: 1115470 - RNA, 19 nt, Homo sapiens
aucugagaaaagcuuugaa

SEQ ID NO: 1115471 - RNA, 19 nt, Homo sapiens
aucugagagauuugaauag

SEQ ID NO: 1115472 - RNA, 16 nt, Homo sapiens
aucugaggaaggugcu

SEQ ID NO: 1115473 - RNA, 20 nt, Homo sapiens
aucugauuuccuaaugucag

SEQ ID NO: 1115474 - RNA, 18 nt, Homo sapiens
auuuaggaccaauaccuc

SEQ ID NO: 1115475 - RNA, 13 nt, Homo sapiens
auuuaguuucaua

SEQ ID NO: 1115476 - RNA, 12 nt, Homo sapiens
auuuaugaaggc

SEQ ID NO: 1115477 - RNA, 15 nt, Homo sapiens
auuuaugagcucuuc

SEQ ID NO: 1115478 - RNA, 23 nt, Homo sapiens
auuuaugaguuuuugauagcuuu

SEQ ID NO: 1115479 - RNA, 20 nt, Homo sapiens
auuuaugccucuguauuuaa

SEQ ID NO: 1115480 - RNA, 19 nt, Homo sapiens
auuuauggucaacacuuaa

SEQ ID NO: 1115481 - RNA, 24 nt, Homo sapiens
auuuauuaguuaggugugccaaac

SEQ ID NO: 1115482 - RNA, 13 nt, Homo sapiens
auuuauucugcuc

SEQ ID NO: 1115483 - RNA, 19 nt, Homo sapiens
auuuauucuucuuuuccaa

SEQ ID NO: 1115484 - RNA, 16 nt, Homo sapiens
auuuauuuaagcauca

SEQ ID NO: 1115485 - RNA, 15 nt, Homo sapiens
auuuauuuaagcuua

SEQ ID NO: 1115486 - RNA, 20 nt, Homo sapiens
auuuauuuuuuuacuuccuc

SEQ ID NO: 1115487 - RNA, 15 nt, Homo sapiens
auuucaacauaucau

SEQ ID NO: 1115488 - RNA, 22 nt, Homo sapiens
auuucagauaaacaacaaauaa

SEQ ID NO: 1115489 - RNA, 17 nt, Homo sapiens
auuucauguaaccaaga

SEQ ID NO: 1115490 - RNA, 22 nt, Homo sapiens
auuucauguaaccaagaguauu

SEQ ID NO: 1115491 - RNA, 17 nt, Homo sapiens
auuuccaaaugaaugac

SEQ ID NO: 1115492 - RNA, 15 nt, Homo sapiens
auuuccauaacucau

SEQ ID NO: 1115493 - RNA, 16 nt, Homo sapiens
auuucuauagccaaaa

SEQ ID NO: 1115494 - RNA, 21 nt, Homo sapiens
auuucugucucucucuguccu

SEQ ID NO: 1115495 - RNA, 16 nt, Homo sapiens
auuucuguuugaaugc

SEQ ID NO: 1115496 - RNA, 21 nt, Homo sapiens
auuucuuuuuuaaaugaagaa

SEQ ID NO: 1115497 - RNA, 18 nt, Homo sapiens
auuugaauuucaguaaac

SEQ ID NO: 1115498 - RNA, 14 nt, Homo sapiens
auuugagcaauuca

SEQ ID NO: 1115499 - RNA, 18 nt, Homo sapiens
auuugagugucuuugacu

SEQ ID NO: 1115500 - RNA, 19 nt, Homo sapiens
auuugcacccaugccauag

SEQ ID NO: 1115501 - RNA, 14 nt, Homo sapiens
auuugcagagacag

SEQ ID NO: 1115502 - RNA, 21 nt, Homo sapiens
auuuguuauagcaauguaaca

SEQ ID NO: 1115503 - RNA, 16 nt, Homo sapiens
auuuguuugcaauuuu

SEQ ID NO: 1115504 - RNA, 17 nt, Homo sapiens
auuuguuuggucacugc

SEQ ID NO: 1115505 - RNA, 14 nt, Homo sapiens
auuuuaauuugaua

SEQ ID NO: 1115506 - RNA, 21 nt, Homo sapiens
auuuuagcaaagauaucucau

SEQ ID NO: 1115507 - RNA, 20 nt, Homo sapiens
auuuuagcaggguacauauu

SEQ ID NO: 1115508 - RNA, 19 nt, Homo sapiens
auuuuaggagacagucuca

SEQ ID NO: 1115509 - RNA, 21 nt, Homo sapiens
auuuuagucugucauccagaa

SEQ ID NO: 1115510 - RNA, 21 nt, Homo sapiens
auuuuaugcugcuguuuacaa

SEQ ID NO: 1115511 - RNA, 19 nt, Homo sapiens
auuuuauucccaagcucua

SEQ ID NO: 1115512 - RNA, 21 nt, Homo sapiens
auuuucagagugacacccaag

SEQ ID NO: 1115513 - RNA, 12 nt, Homo sapiens
auuuucaguaua

SEQ ID NO: 1115514 - RNA, 14 nt, Homo sapiens
auuuucaguauaau

SEQ ID NO: 1115515 - RNA, 15 nt, Homo sapiens
auuuucauuuaacua

SEQ ID NO: 1115516 - RNA, 23 nt, Homo sapiens
auuuuccaaaucuuaauucaacu

SEQ ID NO: 1115517 - RNA, 20 nt, Homo sapiens
auuuuccaauaaaauuuuca

SEQ ID NO: 1115518 - RNA, 16 nt, Homo sapiens
auuuuccugaauauua

SEQ ID NO: 1115519 - RNA, 13 nt, Homo sapiens
auuuugcauuaga

SEQ ID NO: 1115520 - RNA, 23 nt, Homo sapiens
auuuugcauugugugagcuucua

SEQ ID NO: 1115521 - RNA, 18 nt, Homo sapiens
auuuugccauaaagucaa

SEQ ID NO: 1115522 - RNA, 20 nt, Homo sapiens
auuuugggguacccacugcu

SEQ ID NO: 1115523 - RNA, 19 nt, Homo sapiens
auuuuuacuaaagcagugu

SEQ ID NO: 1115524 - RNA, 15 nt, Homo sapiens
auuuuuauacauauc

SEQ ID NO: 1115525 - RNA, 16 nt, Homo sapiens
auuuuuaugugcaaua

SEQ ID NO: 1115526 - RNA, 23 nt, Homo sapiens
auuuuuccccaaaaagaauggga

SEQ ID NO: 1115527 - RNA, 13 nt, Homo sapiens
auuuuuggaagag

SEQ ID NO: 1115528 - RNA, 23 nt, Homo sapiens
auuuuuggaagaggacuccuuaa

SEQ ID NO: 1115529 - RNA, 21 nt, Homo sapiens
auuuuuuacagcugccugcag

SEQ ID NO: 1115530 - RNA, 20 nt, Homo sapiens
auuuuuuaguauaaguacau

SEQ ID NO: 1115531 - RNA, 15 nt, Homo sapiens
auuuuuuugagacag

SEQ ID NO: 1115532 - RNA, 20 nt, Homo sapiens
auuuuuuuuaacauuccaau

SEQ ID NO: 1115533 - RNA, 18 nt, Homo sapiens
caaaaaaguuguuaacua

SEQ ID NO: 1115534 - RNA, 13 nt, Homo sapiens
caaaaaauuugag

SEQ ID NO: 1115535 - RNA, 13 nt, Homo sapiens
caaaaagacauua

SEQ ID NO: 1115536 - RNA, 16 nt, Homo sapiens
caaaacagagauguga

SEQ ID NO: 1115537 - RNA, 12 nt, Homo sapiens
caaaacucuccu

SEQ ID NO: 1115538 - RNA, 13 nt, Homo sapiens
caaaagaagacaa

SEQ ID NO: 1115539 - RNA, 22 nt, Homo sapiens
caaaagaagacaacauuucuca

SEQ ID NO: 1115540 - RNA, 20 nt, Homo sapiens
caaaagcuuauucaucuguu

SEQ ID NO: 1115541 - RNA, 14 nt, Homo sapiens
caaaaguuacaugu

SEQ ID NO: 1115542 - RNA, 21 nt, Homo sapiens
caaaaguuucuuacucaagga

SEQ ID NO: 1115543 - RNA, 14 nt, Homo sapiens
caaaaucacaagca

SEQ ID NO: 1115544 - RNA, 17 nt, Homo sapiens
caaaaucccuauuuaau

SEQ ID NO: 1115545 - RNA, 13 nt, Homo sapiens
caaaccagagcag

SEQ ID NO: 1115546 - RNA, 12 nt, Homo sapiens
caaaccauuuaa

SEQ ID NO: 1115547 - RNA, 18 nt, Homo sapiens
caaacucacugcucaaga

SEQ ID NO: 1115548 - RNA, 21 nt, Homo sapiens
caaacuggggccucccugguc

SEQ ID NO: 1115549 - RNA, 19 nt, Homo sapiens
caaagagaauaaagacuuc

SEQ ID NO: 1115550 - RNA, 18 nt, Homo sapiens
caaagccaaacucugcca

SEQ ID NO: 1115551 - RNA, 23 nt, Homo sapiens
caaaggcacugaggcccagggag

SEQ ID NO: 1115552 - RNA, 14 nt, Homo sapiens
caaaggugugcaaa

SEQ ID NO: 1115553 - RNA, 19 nt, Homo sapiens
caaaguuacaaauucaagg

SEQ ID NO: 1115554 - RNA, 21 nt, Homo sapiens
caaauaaagaccugagaaccu

SEQ ID NO: 1115555 - RNA, 23 nt, Homo sapiens
caaauacauaccuacugacugau

SEQ ID NO: 1115556 - RNA, 15 nt, Homo sapiens
caaauaucucagagg

SEQ ID NO: 1115557 - RNA, 16 nt, Homo sapiens
caaaucccauugucac

SEQ ID NO: 1115558 - RNA, 14 nt, Homo sapiens
caaaugcacaucuc

SEQ ID NO: 1115559 - RNA, 20 nt, Homo sapiens
caaaugcacaucucauggca

SEQ ID NO: 1115560 - RNA, 16 nt, Homo sapiens
caaaugcuaaaugcaa

SEQ ID NO: 1115561 - RNA, 23 nt, Homo sapiens
caaauggagaaguucaggaaggu

SEQ ID NO: 1115562 - RNA, 21 nt, Homo sapiens
caaauucauggugcacugagc

SEQ ID NO: 1115563 - RNA, 19 nt, Homo sapiens
caaauuguaguucuugucu

SEQ ID NO: 1115564 - RNA, 15 nt, Homo sapiens
cagcuggaacccugg

SEQ ID NO: 1115565 - RNA, 11 nt, Homo sapiens
cagcugucauc

SEQ ID NO: 1115566 - RNA, 16 nt, Homo sapiens
cagcugucuguggcuu

SEQ ID NO: 1115567 - RNA, 15 nt, Homo sapiens
cagcuucaucaauuu

SEQ ID NO: 1115568 - RNA, 15 nt, Homo sapiens
caggaacagaaggau

SEQ ID NO: 1115569 - RNA, 15 nt, Homo sapiens
caggaacucccagca

SEQ ID NO: 1115570 - RNA, 18 nt, Homo sapiens
caggaagugucuagagga

SEQ ID NO: 1115571 - RNA, 14 nt, Homo sapiens
caggacacaggccu

SEQ ID NO: 1115572 - RNA, 18 nt, Homo sapiens
caggagaaucaauaaaaa

SEQ ID NO: 1115573 - RNA, 14 nt, Homo sapiens
caggagacaguuca

SEQ ID NO: 1115574 - RNA, 16 nt, Homo sapiens
caggagccgagccaau

SEQ ID NO: 1115575 - RNA, 14 nt, Homo sapiens
caggaggaucacag

SEQ ID NO: 1115576 - RNA, 18 nt, Homo sapiens
caggaguuugugugucuu

SEQ ID NO: 1115577 - RNA, 19 nt, Homo sapiens
caggauaccauauacagcu

SEQ ID NO: 1115578 - RNA, 15 nt, Homo sapiens
caggauacucuguca

SEQ ID NO: 1115579 - RNA, 23 nt, Homo sapiens
caggaucugaguuauuuugcuaa

SEQ ID NO: 1115580 - RNA, 18 nt, Homo sapiens
caggaugaguuacuugaa

SEQ ID NO: 1115581 - RNA, 19 nt, Homo sapiens
caggaugaguuacuugaaa

SEQ ID NO: 1115582 - RNA, 14 nt, Homo sapiens
caggcaaacuugca

SEQ ID NO: 1115583 - RNA, 14 nt, Homo sapiens
caggcaagugaaga

SEQ ID NO: 1115584 - RNA, 18 nt, Homo sapiens
caggccagagugcugcca

SEQ ID NO: 1115585 - RNA, 14 nt, Homo sapiens
caggccccugccac

SEQ ID NO: 1115586 - RNA, 20 nt, Homo sapiens
caggcugggcuucaguggca

SEQ ID NO: 1115587 - RNA, 17 nt, Homo sapiens
caggcuugucacuagca

SEQ ID NO: 1115588 - RNA, 13 nt, Homo sapiens
cagggaagccaaa

SEQ ID NO: 1115589 - RNA, 11 nt, Homo sapiens
cagggacccac

SEQ ID NO: 1115590 - RNA, 22 nt, Homo sapiens
cagggcucagccuggugggccu

SEQ ID NO: 1115591 - RNA, 22 nt, Homo sapiens
caggggccugcccagugcacuu

SEQ ID NO: 1115592 - RNA, 18 nt, Homo sapiens
caggggucgucaccaccu

SEQ ID NO: 1115593 - RNA, 21 nt, Homo sapiens
caggggucgucaccaccucuc

SEQ ID NO: 1115594 - RNA, 20 nt, Homo sapiens
caggguugaucacacucugg

SEQ ID NO: 1115595 - RNA, 20 nt, Homo sapiens
caggguuuugccauguuggc

SEQ ID NO: 1115596 - RNA, 13 nt, Homo sapiens
caggguuuuuaga

SEQ ID NO: 1115597 - RNA, 14 nt, Homo sapiens
caggucaacuucag

SEQ ID NO: 1115598 - RNA, 21 nt, Homo sapiens
caggugauccacccaccucag

SEQ ID NO: 1115599 - RNA, 20 nt, Homo sapiens
cagguguaagccaccgugcc

SEQ ID NO: 1115600 - RNA, 16 nt, Homo sapiens
caggugugaaccacca

SEQ ID NO: 1115601 - RNA, 14 nt, Homo sapiens
cagguguuuauaca

SEQ ID NO: 1115602 - RNA, 21 nt, Homo sapiens
caguaaacuuuggcuuauaaa

SEQ ID NO: 1115603 - RNA, 17 nt, Homo sapiens
caguaagcuaucuucaa

SEQ ID NO: 1115604 - RNA, 13 nt, Homo sapiens
caguagaguagaa

SEQ ID NO: 1115605 - RNA, 14 nt, Homo sapiens
cagucacacuguua

SEQ ID NO: 1115606 - RNA, 12 nt, Homo sapiens
cagucuuggaau

SEQ ID NO: 1115607 - RNA, 13 nt, Homo sapiens
cagucuuggaaua

SEQ ID NO: 1115608 - RNA, 17 nt, Homo sapiens
cagugaagaugccagug

SEQ ID NO: 1115609 - RNA, 15 nt, Homo sapiens
cagugagcucuggau

SEQ ID NO: 1115610 - RNA, 16 nt, Homo sapiens
cagugcauguugccau

SEQ ID NO: 1115611 - RNA, 18 nt, Homo sapiens
cagugcauguugccauga

SEQ ID NO: 1115612 - RNA, 20 nt, Homo sapiens
cagugcauguugccaugagg

SEQ ID NO: 1115613 - RNA, 22 nt, Homo sapiens
cagugcccacaggaucagucug

SEQ ID NO: 1115614 - RNA, 13 nt, Homo sapiens
cagugcuaccucu

SEQ ID NO: 1115615 - RNA, 15 nt, Homo sapiens
cagugcuguacuuga

SEQ ID NO: 1115616 - RNA, 22 nt, Homo sapiens
cagugcuguacuugaugacaga

SEQ ID NO: 1115617 - RNA, 20 nt, Homo sapiens
caguggcauucacaucucau

SEQ ID NO: 1115618 - RNA, 15 nt, Homo sapiens
cagugguaugaucac

SEQ ID NO: 1115619 - RNA, 19 nt, Homo sapiens
caguguaaagaauaaauga

SEQ ID NO: 1115620 - RNA, 16 nt, Homo sapiens
cagugucuuccauaau

SEQ ID NO: 1115621 - RNA, 17 nt, Homo sapiens
cagugucuuuccaccuu

SEQ ID NO: 1115622 - RNA, 16 nt, Homo sapiens
cagugugucacacuga

SEQ ID NO: 1115623 - RNA, 17 nt, Homo sapiens
caguguuauuaaugaca

SEQ ID NO: 1115624 - RNA, 20 nt, Homo sapiens
caguguuauuaaugacaaag

SEQ ID NO: 1115625 - RNA, 18 nt, Homo sapiens
caguguuuagaagagccu

SEQ ID NO: 1115626 - RNA, 22 nt, Homo sapiens
caguuaaggggagcaacagagg

SEQ ID NO: 1115627 - RNA, 23 nt, Homo sapiens
caguuacugguuucaguugacaa

SEQ ID NO: 1115628 - RNA, 16 nt, Homo sapiens
caguuagguagcuuua

SEQ ID NO: 1115629 - RNA, 21 nt, Homo sapiens
caguucaguggcauucacauc

SEQ ID NO: 1115630 - RNA, 16 nt, Homo sapiens
caguuccuuucaaugg

SEQ ID NO: 1115631 - RNA, 19 nt, Homo sapiens
caguucgcagccacccuga

SEQ ID NO: 1115632 - RNA, 23 nt, Homo sapiens
caguugacuuacuguuucuuacc

SEQ ID NO: 1115633 - RNA, 20 nt, Homo sapiens
caguuucuccuuuauugcuc

SEQ ID NO: 1115634 - RNA, 23 nt, Homo sapiens
caguuucuccuuuauugcuccug

SEQ ID NO: 1115635 - RNA, 15 nt, Homo sapiens
caguuugacuguggc

SEQ ID NO: 1115636 - RNA, 13 nt, Homo sapiens
caguuuucuugca

SEQ ID NO: 1115637 - RNA, 21 nt, Homo sapiens
cauaaacaacuuaauguucug

SEQ ID NO: 1115638 - RNA, 17 nt, Homo sapiens
cauaaacacccaugaau

SEQ ID NO: 1115639 - RNA, 22 nt, Homo sapiens
cauaaauuagaggucuccaaaa

SEQ ID NO: 1115640 - RNA, 18 nt, Homo sapiens
cauaagcaaagacuauga

SEQ ID NO: 1115641 - RNA, 21 nt, Homo sapiens
cauaauuuucuucaugcaaug

SEQ ID NO: 1115642 - RNA, 21 nt, Homo sapiens
cauacaccuaugucauuucau

SEQ ID NO: 1115643 - RNA, 12 nt, Homo sapiens
cauacaggccau

SEQ ID NO: 1115644 - RNA, 18 nt, Homo sapiens
cauacugcaugcucagga

SEQ ID NO: 1115645 - RNA, 22 nt, Homo sapiens
cauagagaucuauguacuguaa

SEQ ID NO: 1115646 - RNA, 19 nt, Homo sapiens
cauagcaagacacaucccu

SEQ ID NO: 1115647 - RNA, 15 nt, Homo sapiens
cauagcuuccaugag

SEQ ID NO: 1115648 - RNA, 16 nt, Homo sapiens
cauaguacauacaaaa

SEQ ID NO: 1115649 - RNA, 16 nt, Homo sapiens
cauauauuagcauuua

SEQ ID NO: 1115650 - RNA, 22 nt, Homo sapiens
cauauauuagcauuuaguccaa

SEQ ID NO: 1115651 - RNA, 16 nt, Homo sapiens
cauauggacucugcac

SEQ ID NO: 1115652 - RNA, 20 nt, Homo sapiens
cauauggacucugcacauga

SEQ ID NO: 1115653 - RNA, 15 nt, Homo sapiens
cauauucccacagca

SEQ ID NO: 1115654 - RNA, 19 nt, Homo sapiens
cauauucccacagcacuaa

SEQ ID NO: 1115655 - RNA, 15 nt, Homo sapiens
ccaggcacuguugcu

SEQ ID NO: 1115656 - RNA, 23 nt, Homo sapiens
ccaggcaggggugggagagccag

SEQ ID NO: 1115657 - RNA, 15 nt, Homo sapiens
ccaggccugccuguu

SEQ ID NO: 1115658 - RNA, 18 nt, Homo sapiens
ccaggcuggcgugcagug

SEQ ID NO: 1115659 - RNA, 20 nt, Homo sapiens
ccaggcuggcgugcaguggu

SEQ ID NO: 1115660 - RNA, 14 nt, Homo sapiens
ccagggacaagcag

SEQ ID NO: 1115661 - RNA, 20 nt, Homo sapiens
ccaggguccugaguggcuga

SEQ ID NO: 1115662 - RNA, 20 nt, Homo sapiens
ccagguuuuuggucugaccc

SEQ ID NO: 1115663 - RNA, 22 nt, Homo sapiens
ccagucacgagcccgcucugca

SEQ ID NO: 1115664 - RNA, 18 nt, Homo sapiens
ccagugaaaaacuauuaa

SEQ ID NO: 1115665 - RNA, 16 nt, Homo sapiens
ccagugagcuuaucau

SEQ ID NO: 1115666 - RNA, 19 nt, Homo sapiens
ccagugguaccagcucacu

SEQ ID NO: 1115667 - RNA, 23 nt, Homo sapiens
ccauaaacacccaugaaucaaag

SEQ ID NO: 1115668 - RNA, 13 nt, Homo sapiens
ccauaacagccaa

SEQ ID NO: 1115669 - RNA, 13 nt, Homo sapiens
ccauagcugguua

SEQ ID NO: 1115670 - RNA, 16 nt, Homo sapiens
ccauagcuuccaugag

SEQ ID NO: 1115671 - RNA, 19 nt, Homo sapiens
ccauauaucuuauguuaaa

SEQ ID NO: 1115672 - RNA, 19 nt, Homo sapiens
ccauauucccacagcacua

SEQ ID NO: 1115673 - RNA, 14 nt, Homo sapiens
ccaucaacaagucu

SEQ ID NO: 1115674 - RNA, 14 nt, Homo sapiens
ccaucaccuacuca

SEQ ID NO: 1115675 - RNA, 12 nt, Homo sapiens
ccaucaucccag

SEQ ID NO: 1115676 - RNA, 22 nt, Homo sapiens
ccauccuauuuaacuggcuuca

SEQ ID NO: 1115677 - RNA, 15 nt, Homo sapiens
ccaucuuuugugaga

SEQ ID NO: 1115678 - RNA, 23 nt, Homo sapiens
ccaucuuuugugagauguaauug

SEQ ID NO: 1115679 - RNA, 17 nt, Homo sapiens
ccaugaaaaugcaacaa

SEQ ID NO: 1115680 - RNA, 14 nt, Homo sapiens
ccaugaagaccaca

SEQ ID NO: 1115681 - RNA, 15 nt, Homo sapiens
ccaugaaucaaagac

SEQ ID NO: 1115682 - RNA, 16 nt, Homo sapiens
ccaugaaucaaagaca

SEQ ID NO: 1115683 - RNA, 15 nt, Homo sapiens
ccaugagaguuucaa

SEQ ID NO: 1115684 - RNA, 17 nt, Homo sapiens
ccaugaggcaaugucag

SEQ ID NO: 1115685 - RNA, 10 nt, Homo sapiens
ccaugccacc

SEQ ID NO: 1115686 - RNA, 20 nt, Homo sapiens
ccaugccacccuguuuucag

SEQ ID NO: 1115687 - RNA, 23 nt, Homo sapiens
ccaugccucuccaacaucuucaa

SEQ ID NO: 1115688 - RNA, 16 nt, Homo sapiens
ccaugcuagacaagcu

SEQ ID NO: 1115689 - RNA, 17 nt, Homo sapiens
ccaugcucaaccacugu

SEQ ID NO: 1115690 - RNA, 15 nt, Homo sapiens
ccaugcuucuugccc

SEQ ID NO: 1115691 - RNA, 16 nt, Homo sapiens
ccauguacaugaagaa

SEQ ID NO: 1115692 - RNA, 19 nt, Homo sapiens
ccaugucgccucugcauuc

SEQ ID NO: 1115693 - RNA, 14 nt, Homo sapiens
ccauucacagagcc

SEQ ID NO: 1115694 - RNA, 13 nt, Homo sapiens
ccauuuccugaga

SEQ ID NO: 1115695 - RNA, 14 nt, Homo sapiens
cccaaauccagugu

SEQ ID NO: 1115696 - RNA, 13 nt, Homo sapiens
cccaacaugacug

SEQ ID NO: 1115697 - RNA, 21 nt, Homo sapiens
cccaaggaaaauggacauauu

SEQ ID NO: 1115698 - RNA, 18 nt, Homo sapiens
cccaauaaaagugacucu

SEQ ID NO: 1115699 - RNA, 21 nt, Homo sapiens
cccaauacauaccacuuugaa

SEQ ID NO: 1115700 - RNA, 22 nt, Homo sapiens
cccaccuucuucagccaccucu

SEQ ID NO: 1115701 - RNA, 20 nt, Homo sapiens
cccacgugugcagacugugg

SEQ ID NO: 1115702 - RNA, 19 nt, Homo sapiens
cccacuucucuacucugga

SEQ ID NO: 1115703 - RNA, 20 nt, Homo sapiens
cccacuucucuacucuggaa

SEQ ID NO: 1115704 - RNA, 18 nt, Homo sapiens
cccagaaaaccuccagua

SEQ ID NO: 1115705 - RNA, 22 nt, Homo sapiens
cccagaccuuuuauccacuuac

SEQ ID NO: 1115706 - RNA, 14 nt, Homo sapiens
cccagacucagcuc

SEQ ID NO: 1115707 - RNA, 20 nt, Homo sapiens
cccagagaggguggugaccu

SEQ ID NO: 1115708 - RNA, 15 nt, Homo sapiens
cccagauacuuccca

SEQ ID NO: 1115709 - RNA, 21 nt, Homo sapiens
cccagauggccgggacaugca

SEQ ID NO: 1115710 - RNA, 12 nt, Homo sapiens
cccagcaaagag

SEQ ID NO: 1115711 - RNA, 20 nt, Homo sapiens
cccagcccacuucugccaua

SEQ ID NO: 1115712 - RNA, 23 nt, Homo sapiens
cccagccccuguggagggggugc

SEQ ID NO: 1115713 - RNA, 17 nt, Homo sapiens
cccagccucgcaugcca

SEQ ID NO: 1115714 - RNA, 17 nt, Homo sapiens
cccagcugucuguguca

SEQ ID NO: 1115715 - RNA, 23 nt, Homo sapiens
cccaggaggucgaccccaaagcc

SEQ ID NO: 1115716 - RNA, 21 nt, Homo sapiens
cccaggagguggcuauggcca

SEQ ID NO: 1115717 - RNA, 16 nt, Homo sapiens
cccaggcuggucuuga

SEQ ID NO: 1115718 - RNA, 19 nt, Homo sapiens
cccaguaacucaucuguca

SEQ ID NO: 1115719 - RNA, 12 nt, Homo sapiens
cccaguucugcu

SEQ ID NO: 1115720 - RNA, 17 nt, Homo sapiens
cccaguuugcuggguuu

SEQ ID NO: 1115721 - RNA, 19 nt, Homo sapiens
cccauagugcacacuugua

SEQ ID NO: 1115722 - RNA, 15 nt, Homo sapiens
cccaucaccuacuca

SEQ ID NO: 1115723 - RNA, 21 nt, Homo sapiens
cccaucugaaccacuuugccu

SEQ ID NO: 1115724 - RNA, 15 nt, Homo sapiens
cccaugaaucaaaga

SEQ ID NO: 1115725 - RNA, 21 nt, Homo sapiens
cccaugagaguagagggcacu

SEQ ID NO: 1115726 - RNA, 20 nt, Homo sapiens
cccaugcucaaccacugugg

SEQ ID NO: 1115727 - RNA, 12 nt, Homo sapiens
cccauucuugca

SEQ ID NO: 1115728 - RNA, 18 nt, Homo sapiens
cccauuuguaauguaucu

SEQ ID NO: 1115729 - RNA, 20 nt, Homo sapiens
ccccaccuugccaagcuuuc

SEQ ID NO: 1115730 - RNA, 12 nt, Homo sapiens
ccccacucuaua

SEQ ID NO: 1115731 - RNA, 15 nt, Homo sapiens
ccccagcgauucccu

SEQ ID NO: 1115732 - RNA, 13 nt, Homo sapiens
ccccagcuuugca

SEQ ID NO: 1115733 - RNA, 15 nt, Homo sapiens
ccccaguucugcucc

SEQ ID NO: 1115734 - RNA, 14 nt, Homo sapiens
ccccccagcuguca

SEQ ID NO: 1115735 - RNA, 21 nt, Homo sapiens
cccccucuaacccccagugcc

SEQ ID NO: 1115736 - RNA, 16 nt, Homo sapiens
cccccugcagcuugua

SEQ ID NO: 1115737 - RNA, 21 nt, Homo sapiens
cccccuuggaggagggcugua

SEQ ID NO: 1115738 - RNA, 15 nt, Homo sapiens
ccccuggccuuugag

SEQ ID NO: 1115739 - RNA, 16 nt, Homo sapiens
cccgacuccucaaaag

SEQ ID NO: 1115740 - RNA, 23 nt, Homo sapiens
cccgaucaucuuuccuguuccag

SEQ ID NO: 1115741 - RNA, 22 nt, Homo sapiens
cccgcaggcagccccacacccg

SEQ ID NO: 1115742 - RNA, 15 nt, Homo sapiens
cccggccccaucaga

SEQ ID NO: 1115743 - RNA, 19 nt, Homo sapiens
cccggcugucaaggggugu

SEQ ID NO: 1115744 - RNA, 16 nt, Homo sapiens
cccgucauguuccuca

SEQ ID NO: 1115745 - RNA, 14 nt, Homo sapiens
cccuaaaacaugug

SEQ ID NO: 1115746 - RNA, 13 nt, Homo sapiens
gagauauuuacau

SEQ ID NO: 1115747 - RNA, 17 nt, Homo sapiens
gagauccuuuaaauccu

SEQ ID NO: 1115748 - RNA, 14 nt, Homo sapiens
gagaucuugaucca

SEQ ID NO: 1115749 - RNA, 20 nt, Homo sapiens
gagauggcgcuauugcacuc

SEQ ID NO: 1115750 - RNA, 20 nt, Homo sapiens
gagauugcgccacugcacuc

SEQ ID NO: 1115751 - RNA, 15 nt, Homo sapiens
gagcaacagaggaca

SEQ ID NO: 1115752 - RNA, 14 nt, Homo sapiens
gagcaacagaguga

SEQ ID NO: 1115753 - RNA, 22 nt, Homo sapiens
gagcaagaucuugucuccacua

SEQ ID NO: 1115754 - RNA, 14 nt, Homo sapiens
gagcaauuugcaca

SEQ ID NO: 1115755 - RNA, 17 nt, Homo sapiens
gagcacuggagugcagg

SEQ ID NO: 1115756 - RNA, 22 nt, Homo sapiens
gagcagaugcaaucucuugucu

SEQ ID NO: 1115757 - RNA, 19 nt, Homo sapiens
gagcagcuuuggaaacagg

SEQ ID NO: 1115758 - RNA, 19 nt, Homo sapiens
gagcauuacgugagccagg

SEQ ID NO: 1115759 - RNA, 19 nt, Homo sapiens
gagcauuuauaaauggaca

SEQ ID NO: 1115760 - RNA, 16 nt, Homo sapiens
gagccacguauguuuu

SEQ ID NO: 1115761 - RNA, 21 nt, Homo sapiens
gagcccaugcucaaccacugu

SEQ ID NO: 1115762 - RNA, 17 nt, Homo sapiens
gagccccccacaaugau

SEQ ID NO: 1115763 - RNA, 16 nt, Homo sapiens
gagcccuggcaggaug

SEQ ID NO: 1115764 - RNA, 16 nt, Homo sapiens
gagccgagauugcacc

SEQ ID NO: 1115765 - RNA, 19 nt, Homo sapiens
gagccucgcaacccgugcc

SEQ ID NO: 1115766 - RNA, 14 nt, Homo sapiens
gagccugacugugu

SEQ ID NO: 1115767 - RNA, 12 nt, Homo sapiens
gagccugcaguu

SEQ ID NO: 1115768 - RNA, 12 nt, Homo sapiens
gagccuggagaa

SEQ ID NO: 1115769 - RNA, 22 nt, Homo sapiens
gagccuucacaaccagccacac

SEQ ID NO: 1115770 - RNA, 21 nt, Homo sapiens
gagcuaugauccacaaaaaca

SEQ ID NO: 1115771 - RNA, 21 nt, Homo sapiens
gagcucgguggacccagggau

SEQ ID NO: 1115772 - RNA, 22 nt, Homo sapiens
gagcugaacccauuuugaguga

SEQ ID NO: 1115773 - RNA, 16 nt, Homo sapiens
gagcugggauguuucu

SEQ ID NO: 1115774 - RNA, 23 nt, Homo sapiens
gagcuuccagugcauguugccau

SEQ ID NO: 1115775 - RNA, 24 nt, Homo sapiens
gagcuucugggaagacaacuagga

SEQ ID NO: 1115776 - RNA, 13 nt, Homo sapiens
gaggaaacuugca

SEQ ID NO: 1115777 - RNA, 13 nt, Homo sapiens
gaggaaccucaaa

SEQ ID NO: 1115778 - RNA, 16 nt, Homo sapiens
gaggaagaaaaccagc

SEQ ID NO: 1115779 - RNA, 17 nt, Homo sapiens
gaggaagaaaaccagcg

SEQ ID NO: 1115780 - RNA, 17 nt, Homo sapiens
gaggacacaguuucuau

SEQ ID NO: 1115781 - RNA, 19 nt, Homo sapiens
gaggagcuuccagugcaug

SEQ ID NO: 1115782 - RNA, 22 nt, Homo sapiens
gaggagggaugcugccugaguc

SEQ ID NO: 1115783 - RNA, 18 nt, Homo sapiens
gaggagggcgugacucac

SEQ ID NO: 1115784 - RNA, 22 nt, Homo sapiens
gaggagucugagguccugagca

SEQ ID NO: 1115785 - RNA, 14 nt, Homo sapiens
gaggaguuccuuga

SEQ ID NO: 1115786 - RNA, 22 nt, Homo sapiens
gaggcagccccauucugccugc

SEQ ID NO: 1115787 - RNA, 21 nt, Homo sapiens
gaggcaggaggaucacaguga

SEQ ID NO: 1115788 - RNA, 21 nt, Homo sapiens
gaggcauuugcagcugugcca

SEQ ID NO: 1115789 - RNA, 20 nt, Homo sapiens
gaggccuuuccccagugugg

SEQ ID NO: 1115790 - RNA, 13 nt, Homo sapiens
gaggcuagcaaag

SEQ ID NO: 1115791 - RNA, 16 nt, Homo sapiens
gaggcugcagaaggcc

SEQ ID NO: 1115792 - RNA, 20 nt, Homo sapiens
gaggcuugccccacccaaca

SEQ ID NO: 1115793 - RNA, 12 nt, Homo sapiens
gaggcuuggaaa

SEQ ID NO: 1115794 - RNA, 19 nt, Homo sapiens
gagggcgaguucagcaaag

SEQ ID NO: 1115795 - RNA, 21 nt, Homo sapiens
gagguaaaagugugagcagug

SEQ ID NO: 1115796 - RNA, 16 nt, Homo sapiens
gaggucccugccagug

SEQ ID NO: 1115797 - RNA, 16 nt, Homo sapiens
gagguccugagcacug

SEQ ID NO: 1115798 - RNA, 17 nt, Homo sapiens
gagguccugagcacugc

SEQ ID NO: 1115799 - RNA, 22 nt, Homo sapiens
gagguuccggugucuggaaaag

SEQ ID NO: 1115800 - RNA, 15 nt, Homo sapiens
gaguacaaacacagg

SEQ ID NO: 1115801 - RNA, 16 nt, Homo sapiens
gaguacagugagccaa

SEQ ID NO: 1115802 - RNA, 13 nt, Homo sapiens
gaguauacuaaaa

SEQ ID NO: 1115803 - RNA, 22 nt, Homo sapiens
gagucaauccccucauucagga

SEQ ID NO: 1115804 - RNA, 13 nt, Homo sapiens
gagucaccaggaa

SEQ ID NO: 1115805 - RNA, 23 nt, Homo sapiens
gagucacccaugaagacaggaca

SEQ ID NO: 1115806 - RNA, 13 nt, Homo sapiens
gagucacugaccc

SEQ ID NO: 1115807 - RNA, 14 nt, Homo sapiens
gagucgacuuugag

SEQ ID NO: 1115808 - RNA, 12 nt, Homo sapiens
gagucuaccucu

SEQ ID NO: 1115809 - RNA, 13 nt, Homo sapiens
gagucuaccucuu

SEQ ID NO: 1115810 - RNA, 22 nt, Homo sapiens
gagucuuaauauauauauccag

SEQ ID NO: 1115811 - RNA, 18 nt, Homo sapiens
gagugacucgaggguugg

SEQ ID NO: 1115812 - RNA, 18 nt, Homo sapiens
gagugagacuccgucuca

SEQ ID NO: 1115813 - RNA, 19 nt, Homo sapiens
gagugagacuccgucucaa

SEQ ID NO: 1115814 - RNA, 19 nt, Homo sapiens
gagugagacucugucucaa

SEQ ID NO: 1115815 - RNA, 14 nt, Homo sapiens
gagugauccuccaa

SEQ ID NO: 1115816 - RNA, 12 nt, Homo sapiens
gagugcugagaa

SEQ ID NO: 1115817 - RNA, 14 nt, Homo sapiens
gaguggcacguuua

SEQ ID NO: 1115818 - RNA, 21 nt, Homo sapiens
gaguggcugaaauaaaagccu

SEQ ID NO: 1115819 - RNA, 24 nt, Homo sapiens
gagugugugugaugggaucuguaa

SEQ ID NO: 1115820 - RNA, 18 nt, Homo sapiens
gaguucccugaacaucug

SEQ ID NO: 1115821 - RNA, 20 nt, Homo sapiens
gaguuccugugggugugucu

SEQ ID NO: 1115822 - RNA, 17 nt, Homo sapiens
gaguuuaagucucugac

SEQ ID NO: 1115823 - RNA, 18 nt, Homo sapiens
gauacaggaaaagcugcu

SEQ ID NO: 1115824 - RNA, 16 nt, Homo sapiens
gauacccagagcauua

SEQ ID NO: 1115825 - RNA, 21 nt, Homo sapiens
gauaccucaacccccauuucu

SEQ ID NO: 1115826 - RNA, 14 nt, Homo sapiens
gauacugcugccaa

SEQ ID NO: 1115827 - RNA, 23 nt, Homo sapiens
gauauauuuuccagggcaaucaa

SEQ ID NO: 1115828 - RNA, 21 nt, Homo sapiens
gauaucaugccccuguacucc

SEQ ID NO: 1115829 - RNA, 13 nt, Homo sapiens
gauauuaaaggag

SEQ ID NO: 1115830 - RNA, 16 nt, Homo sapiens
gaucaauagacuguac

SEQ ID NO: 1115831 - RNA, 17 nt, Homo sapiens
gaucacgccacugcacu

SEQ ID NO: 1115832 - RNA, 15 nt, Homo sapiens
gaucaguaugggaac

SEQ ID NO: 1115833 - RNA, 18 nt, Homo sapiens
gaucauccacugugccau

SEQ ID NO: 1115834 - RNA, 23 nt, Homo sapiens
gauccaaacagaaaagugcaaag

SEQ ID NO: 1115835 - RNA, 19 nt, Homo sapiens
gaucccuagcugugaccuc

SEQ ID NO: 1115836 - RNA, 19 nt, Homo sapiens
gcugacaaagaugaccugc

SEQ ID NO: 1115837 - RNA, 14 nt, Homo sapiens
gcugagaaggacac

SEQ ID NO: 1115838 - RNA, 14 nt, Homo sapiens
gcugagagacccaa

SEQ ID NO: 1115839 - RNA, 14 nt, Homo sapiens
gcugagauuccugg

SEQ ID NO: 1115840 - RNA, 23 nt, Homo sapiens
gcugaggcggguggaucaccuga

SEQ ID NO: 1115841 - RNA, 17 nt, Homo sapiens
gcugaggugcccaggag

SEQ ID NO: 1115842 - RNA, 16 nt, Homo sapiens
gcugcaggaaucaaaa

SEQ ID NO: 1115843 - RNA, 19 nt, Homo sapiens
gcugccccuggugcacugg

SEQ ID NO: 1115844 - RNA, 13 nt, Homo sapiens
gcugcuagcacuu

SEQ ID NO: 1115845 - RNA, 13 nt, Homo sapiens
gcugcucucugag

SEQ ID NO: 1115846 - RNA, 14 nt, Homo sapiens
gcugcucuggaaaa

SEQ ID NO: 1115847 - RNA, 15 nt, Homo sapiens
gcuggagugcaguga

SEQ ID NO: 1115848 - RNA, 20 nt, Homo sapiens
gcuggcuccuccaggcacgu

SEQ ID NO: 1115849 - RNA, 15 nt, Homo sapiens
gcugggcaccacagg

SEQ ID NO: 1115850 - RNA, 18 nt, Homo sapiens
gcugggcuucaguggcag

SEQ ID NO: 1115851 - RNA, 16 nt, Homo sapiens
gcugugugaauuccca

SEQ ID NO: 1115852 - RNA, 23 nt, Homo sapiens
gcuguucauguuacucaugacuc

SEQ ID NO: 1115853 - RNA, 22 nt, Homo sapiens
gcuuaauggcucaugaccugga

SEQ ID NO: 1115854 - RNA, 20 nt, Homo sapiens
gcuuagacuucgacucagga

SEQ ID NO: 1115855 - RNA, 14 nt, Homo sapiens
gcuuaguaucucau

SEQ ID NO: 1115856 - RNA, 21 nt, Homo sapiens
gcuuaguuaagucauccacag

SEQ ID NO: 1115857 - RNA, 20 nt, Homo sapiens
gcuuauucaucuguuuuucu

SEQ ID NO: 1115858 - RNA, 17 nt, Homo sapiens
gcuucagccucucccac

SEQ ID NO: 1115859 - RNA, 16 nt, Homo sapiens
gcuucaggauaccaua

SEQ ID NO: 1115860 - RNA, 16 nt, Homo sapiens
gcuucauuuccugugu

SEQ ID NO: 1115861 - RNA, 17 nt, Homo sapiens
gcuucauuuuugggaga

SEQ ID NO: 1115862 - RNA, 22 nt, Homo sapiens
gcuuccuucauuuccuccguca

SEQ ID NO: 1115863 - RNA, 15 nt, Homo sapiens
gcuugagcccaggag

SEQ ID NO: 1115864 - RNA, 19 nt, Homo sapiens
gcuugauccagaccucuac

SEQ ID NO: 1115865 - RNA, 14 nt, Homo sapiens
gcuugcaugccaaa

SEQ ID NO: 1115866 - RNA, 19 nt, Homo sapiens
gcuugggcccugcacagau

SEQ ID NO: 1115867 - RNA, 22 nt, Homo sapiens
gcuuguaacuccaccaacccau

SEQ ID NO: 1115868 - RNA, 13 nt, Homo sapiens
gcuuguagcagaa

SEQ ID NO: 1115869 - RNA, 23 nt, Homo sapiens
gcuuguagcagaaggcaagcacc

SEQ ID NO: 1115870 - RNA, 17 nt, Homo sapiens
gcuuuaaaucuaucuau

SEQ ID NO: 1115871 - RNA, 18 nt, Homo sapiens
gcuuuaacaaaacaagaa

SEQ ID NO: 1115872 - RNA, 13 nt, Homo sapiens
gcuuuaccuuuau

SEQ ID NO: 1115873 - RNA, 16 nt, Homo sapiens
gcuuucuacccagcga

SEQ ID NO: 1115874 - RNA, 18 nt, Homo sapiens
gcuuugcuucaaauccau

SEQ ID NO: 1115875 - RNA, 19 nt, Homo sapiens
gcuuuucuaaucuuguuaa

SEQ ID NO: 1115876 - RNA, 14 nt, Homo sapiens
ggaaaacucaggau

SEQ ID NO: 1115877 - RNA, 16 nt, Homo sapiens
ggaaaagaggaguuuc

SEQ ID NO: 1115878 - RNA, 17 nt, Homo sapiens
ggaaaaggccuggggug

SEQ ID NO: 1115879 - RNA, 12 nt, Homo sapiens
ggaaaaugagua

SEQ ID NO: 1115880 - RNA, 17 nt, Homo sapiens
ggaaaaugugacccaga

SEQ ID NO: 1115881 - RNA, 15 nt, Homo sapiens
ggaaaaugugcaaua

SEQ ID NO: 1115882 - RNA, 12 nt, Homo sapiens
ggaaacagagaa

SEQ ID NO: 1115883 - RNA, 13 nt, Homo sapiens
ggaaagcagccau

SEQ ID NO: 1115884 - RNA, 15 nt, Homo sapiens
ggaaagcagccguuu

SEQ ID NO: 1115885 - RNA, 17 nt, Homo sapiens
ggaaagggauaguccaa

SEQ ID NO: 1115886 - RNA, 22 nt, Homo sapiens
ggaaaguaaauauuucaggcau

SEQ ID NO: 1115887 - RNA, 18 nt, Homo sapiens
ggaacagacaacagaagu

SEQ ID NO: 1115888 - RNA, 20 nt, Homo sapiens
ggaacccugcuugcacuuug

SEQ ID NO: 1115889 - RNA, 21 nt, Homo sapiens
ggaacuagagggauacacuga

SEQ ID NO: 1115890 - RNA, 22 nt, Homo sapiens
ggaacuagagggauacacugaa

SEQ ID NO: 1115891 - RNA, 19 nt, Homo sapiens
ggaacugucucucaugaac

SEQ ID NO: 1115892 - RNA, 19 nt, Homo sapiens
ggaagagugugcuugucau

SEQ ID NO: 1115893 - RNA, 22 nt, Homo sapiens
ggaagauucccucuuccugcca

SEQ ID NO: 1115894 - RNA, 17 nt, Homo sapiens
ggaagcucugaagucac

SEQ ID NO: 1115895 - RNA, 19 nt, Homo sapiens
ggaagcucugaagucacau

SEQ ID NO: 1115896 - RNA, 22 nt, Homo sapiens
ggaagucguccuuacuccugug

SEQ ID NO: 1115897 - RNA, 12 nt, Homo sapiens
ggaaguuuucag

SEQ ID NO: 1115898 - RNA, 15 nt, Homo sapiens
ggaauugcaugccau

SEQ ID NO: 1115899 - RNA, 20 nt, Homo sapiens
ggacaccccuuauccaggac

SEQ ID NO: 1115900 - RNA, 12 nt, Homo sapiens
ggacacuuguau

SEQ ID NO: 1115901 - RNA, 21 nt, Homo sapiens
ggacagaccuucaacuuccaa

SEQ ID NO: 1115902 - RNA, 15 nt, Homo sapiens
ggacagggaggugac

SEQ ID NO: 1115903 - RNA, 21 nt, Homo sapiens
ggaccaacccuguuuccugag

SEQ ID NO: 1115904 - RNA, 15 nt, Homo sapiens
ggaccagccacugug

SEQ ID NO: 1115905 - RNA, 15 nt, Homo sapiens
ggaccgcuacaccac

SEQ ID NO: 1115906 - RNA, 19 nt, Homo sapiens
ggaccuuccugccaccagu

SEQ ID NO: 1115907 - RNA, 19 nt, Homo sapiens
ggacgagacccuacaggag

SEQ ID NO: 1115908 - RNA, 13 nt, Homo sapiens
ggacuacaggcac

SEQ ID NO: 1115909 - RNA, 10 nt, Homo sapiens
ggacuauuau

SEQ ID NO: 1115910 - RNA, 22 nt, Homo sapiens
ggacuauuauaauuuaaugcau

SEQ ID NO: 1115911 - RNA, 12 nt, Homo sapiens
ggacucaaugca

SEQ ID NO: 1115912 - RNA, 16 nt, Homo sapiens
ggagaaaacuucucac

SEQ ID NO: 1115913 - RNA, 17 nt, Homo sapiens
ggagaaaugacuuugaa

SEQ ID NO: 1115914 - RNA, 23 nt, Homo sapiens
ggagaaccucaggcuuccuuggc

SEQ ID NO: 1115915 - RNA, 23 nt, Homo sapiens
ggagacacuauuuaucugugcaa

SEQ ID NO: 1115916 - RNA, 17 nt, Homo sapiens
ggagaccagcucagagg

SEQ ID NO: 1115917 - RNA, 15 nt, Homo sapiens
ggagacugcaucuca

SEQ ID NO: 1115918 - RNA, 13 nt, Homo sapiens
ggagagaacugaa

SEQ ID NO: 1115919 - RNA, 14 nt, Homo sapiens
ggagagaaguuucu

SEQ ID NO: 1115920 - RNA, 13 nt, Homo sapiens
ggagagcccuuca

SEQ ID NO: 1115921 - RNA, 17 nt, Homo sapiens
ggagauaaucuagaaca

SEQ ID NO: 1115922 - RNA, 15 nt, Homo sapiens
ggagccagugcccac

SEQ ID NO: 1115923 - RNA, 23 nt, Homo sapiens
ggagccucgguggccaugcuucu

SEQ ID NO: 1115924 - RNA, 23 nt, Homo sapiens
ggagccucuccuugccuggugac

SEQ ID NO: 1115925 - RNA, 19 nt, Homo sapiens
ggagcugccuguucagcuc

SEQ ID NO: 1115926 - RNA, 13 nt, Homo sapiens
ggagcuuccagug

SEQ ID NO: 1115927 - RNA, 19 nt, Homo sapiens
gugcucggcuguaaacagc

SEQ ID NO: 1115928 - RNA, 16 nt, Homo sapiens
gugcucuucuguucuc

SEQ ID NO: 1115929 - RNA, 15 nt, Homo sapiens
gugcugcagccagga

SEQ ID NO: 1115930 - RNA, 23 nt, Homo sapiens
gugcugcauggagugagcaguag

SEQ ID NO: 1115931 - RNA, 21 nt, Homo sapiens
gugcugggauuacagguguga

SEQ ID NO: 1115932 - RNA, 17 nt, Homo sapiens
gugcuguggccugggca

SEQ ID NO: 1115933 - RNA, 14 nt, Homo sapiens
gugcuucuucacuu

SEQ ID NO: 1115934 - RNA, 19 nt, Homo sapiens
gugcuugccaccaccagau

SEQ ID NO: 1115935 - RNA, 19 nt, Homo sapiens
gugcuugccugggaccagu

SEQ ID NO: 1115936 - RNA, 13 nt, Homo sapiens
guggaacaaaagu

SEQ ID NO: 1115937 - RNA, 15 nt, Homo sapiens
guggaauugugcuga

SEQ ID NO: 1115938 - RNA, 20 nt, Homo sapiens
guggagaaauuccuugauuc

SEQ ID NO: 1115939 - RNA, 20 nt, Homo sapiens
guggagaacugggauuugaa

SEQ ID NO: 1115940 - RNA, 16 nt, Homo sapiens
guggagcuccugcugg

SEQ ID NO: 1115941 - RNA, 22 nt, Homo sapiens
guggcauucacaucucauguaa

SEQ ID NO: 1115942 - RNA, 14 nt, Homo sapiens
guggcccaagacaa

SEQ ID NO: 1115943 - RNA, 15 nt, Homo sapiens
guggccccaacacaa

SEQ ID NO: 1115944 - RNA, 18 nt, Homo sapiens
guggcuaauucaauuuau

SEQ ID NO: 1115945 - RNA, 21 nt, Homo sapiens
gugggaaggucccuuguuucc

SEQ ID NO: 1115946 - RNA, 18 nt, Homo sapiens
gugggacaaaccagagca

SEQ ID NO: 1115947 - RNA, 15 nt, Homo sapiens
gugggcagcagcuca

SEQ ID NO: 1115948 - RNA, 12 nt, Homo sapiens
gugggugccugu

SEQ ID NO: 1115949 - RNA, 11 nt, Homo sapiens
guggguggugg

SEQ ID NO: 1115950 - RNA, 14 nt, Homo sapiens
guggugauguugcc

SEQ ID NO: 1115951 - RNA, 18 nt, Homo sapiens
guguaaaauacguuugaa

SEQ ID NO: 1115952 - RNA, 15 nt, Homo sapiens
guguagcuuugcucu

SEQ ID NO: 1115953 - RNA, 13 nt, Homo sapiens
guguagugucugu

SEQ ID NO: 1115954 - RNA, 18 nt, Homo sapiens
guguauaaauaguaacuu

SEQ ID NO: 1115955 - RNA, 19 nt, Homo sapiens
guguaucgcugccuugcca

SEQ ID NO: 1115956 - RNA, 22 nt, Homo sapiens
gugucacuacucacagucucuu

SEQ ID NO: 1115957 - RNA, 19 nt, Homo sapiens
gugucccccuaugcuccag

SEQ ID NO: 1115958 - RNA, 23 nt, Homo sapiens
gugucugcacccaggggugggga

SEQ ID NO: 1115959 - RNA, 17 nt, Homo sapiens
gugucuggcaguuuaua

SEQ ID NO: 1115960 - RNA, 20 nt, Homo sapiens
gugucuguacacguguccug

SEQ ID NO: 1115961 - RNA, 16 nt, Homo sapiens
gugugaaggucuugcc

SEQ ID NO: 1115962 - RNA, 14 nt, Homo sapiens
guguguugauccca

SEQ ID NO: 1115963 - RNA, 17 nt, Homo sapiens
guguucucacacuggug

SEQ ID NO: 1115964 - RNA, 17 nt, Homo sapiens
guguugacaugugcuuu

SEQ ID NO: 1115965 - RNA, 14 nt, Homo sapiens
guguugaucccaag

SEQ ID NO: 1115966 - RNA, 21 nt, Homo sapiens
guguugggaauugcaugccau

SEQ ID NO: 1115967 - RNA, 20 nt, Homo sapiens
guguuucaucuguucauuca

SEQ ID NO: 1115968 - RNA, 13 nt, Homo sapiens
guguuuccuucag

SEQ ID NO: 1115969 - RNA, 16 nt, Homo sapiens
guguuucuggggacac

SEQ ID NO: 1115970 - RNA, 23 nt, Homo sapiens
guuaaacacgugucuauaaugga

SEQ ID NO: 1115971 - RNA, 14 nt, Homo sapiens
guuaaagugaauaa

SEQ ID NO: 1115972 - RNA, 16 nt, Homo sapiens
guuaaccucaguguca

SEQ ID NO: 1115973 - RNA, 16 nt, Homo sapiens
guuaagcagccuuucu

SEQ ID NO: 1115974 - RNA, 17 nt, Homo sapiens
guuaaucauguauuaaa

SEQ ID NO: 1115975 - RNA, 11 nt, Homo sapiens
guuaaugccau

SEQ ID NO: 1115976 - RNA, 18 nt, Homo sapiens
guuacccugcauguuggc

SEQ ID NO: 1115977 - RNA, 13 nt, Homo sapiens
guuacucaugacu

SEQ ID NO: 1115978 - RNA, 17 nt, Homo sapiens
guuacuugaaauaccag

SEQ ID NO: 1115979 - RNA, 17 nt, Homo sapiens
guuaggaaaauuucaca

SEQ ID NO: 1115980 - RNA, 15 nt, Homo sapiens
guuauagaaacugau

SEQ ID NO: 1115981 - RNA, 14 nt, Homo sapiens
guuauagacugcca

SEQ ID NO: 1115982 - RNA, 15 nt, Homo sapiens
guuaucaaccauaug

SEQ ID NO: 1115983 - RNA, 14 nt, Homo sapiens
guuaucaguuaaca

SEQ ID NO: 1115984 - RNA, 19 nt, Homo sapiens
guuauuuugcuauuugccu

SEQ ID NO: 1115985 - RNA, 23 nt, Homo sapiens
guucaauucucauuugucacaca

SEQ ID NO: 1115986 - RNA, 19 nt, Homo sapiens
guucagagaucguuccuau

SEQ ID NO: 1115987 - RNA, 13 nt, Homo sapiens
guucaguggcauu

SEQ ID NO: 1115988 - RNA, 21 nt, Homo sapiens
guucaucagacuccugugcaa

SEQ ID NO: 1115989 - RNA, 14 nt, Homo sapiens
guuccauguuaaaa

SEQ ID NO: 1115990 - RNA, 21 nt, Homo sapiens
guuccuauuuggggcuugcau

SEQ ID NO: 1115991 - RNA, 13 nt, Homo sapiens
guucgaagcuccg

SEQ ID NO: 1115992 - RNA, 20 nt, Homo sapiens
guucgagaccagccuggcca

SEQ ID NO: 1115993 - RNA, 14 nt, Homo sapiens
guucugaguguuuu

SEQ ID NO: 1115994 - RNA, 19 nt, Homo sapiens
guucuuagcugaacaauga

SEQ ID NO: 1115995 - RNA, 13 nt, Homo sapiens
guucuuaguguca

SEQ ID NO: 1115996 - RNA, 15 nt, Homo sapiens
guugcugaaacacac

SEQ ID NO: 1115997 - RNA, 21 nt, Homo sapiens
guugcuuuucuaaucuuguua

SEQ ID NO: 1115998 - RNA, 19 nt, Homo sapiens
guuggaugcggaacccaaa

SEQ ID NO: 1115999 - RNA, 18 nt, Homo sapiens
guuggccuaacacugggc

SEQ ID NO: 1116000 - RNA, 23 nt, Homo sapiens
guuguuaaaacugguuuagcaca

SEQ ID NO: 1116001 - RNA, 20 nt, Homo sapiens
guuuaauuguaggucaauga

SEQ ID NO: 1116002 - RNA, 17 nt, Homo sapiens
guuuauauaauuuugca

SEQ ID NO: 1116003 - RNA, 14 nt, Homo sapiens
guuucaaaccagga

SEQ ID NO: 1116004 - RNA, 18 nt, Homo sapiens
guuucaagcuaccuucau

SEQ ID NO: 1116005 - RNA, 19 nt, Homo sapiens
guuucaucuguucauucac

SEQ ID NO: 1116006 - RNA, 19 nt, Homo sapiens
guuuccaucagguuccauc

SEQ ID NO: 1116007 - RNA, 16 nt, Homo sapiens
guuuccucauuccuga

SEQ ID NO: 1116008 - RNA, 22 nt, Homo sapiens
guuucucuugaagaacugacua

SEQ ID NO: 1116009 - RNA, 13 nt, Homo sapiens
guuugagaccagc

SEQ ID NO: 1116010 - RNA, 19 nt, Homo sapiens
guuugagcgcagaguaaaa

SEQ ID NO: 1116011 - RNA, 22 nt, Homo sapiens
guuuguugaugugaaacauuau

SEQ ID NO: 1116012 - RNA, 22 nt, Homo sapiens
guuuuaagaggcagggucucac

SEQ ID NO: 1116013 - RNA, 15 nt, Homo sapiens
guuuuguaccaacac

SEQ ID NO: 1116014 - RNA, 11 nt, Homo sapiens
guuuuuacuaa

SEQ ID NO: 1116015 - RNA, 20 nt, Homo sapiens
guuuuuagauuaaacaaaca

SEQ ID NO: 1116016 - RNA, 22 nt, Homo sapiens
guuuuugaagaagggaaauuca

SEQ ID NO: 1116017 - RNA, 13 nt, Homo sapiens
guuuuuucacaua

SEQ ID NO: 1116018 - RNA, 14 nt, Homo sapiens
uacgcucucugucu

SEQ ID NO: 1116019 - RNA, 11 nt, Homo sapiens
uacgugcaaua

SEQ ID NO: 1116020 - RNA, 20 nt, Homo sapiens
uacguuuccugagaaguguc

SEQ ID NO: 1116021 - RNA, 14 nt, Homo sapiens
uacuacaugcacuu

SEQ ID NO: 1116022 - RNA, 12 nt, Homo sapiens
uacuauaugauu

SEQ ID NO: 1116023 - RNA, 20 nt, Homo sapiens
uacuauuauauuauguaguc

SEQ ID NO: 1116024 - RNA, 20 nt, Homo sapiens
uacuauucuguuaaaaucag

SEQ ID NO: 1116025 - RNA, 16 nt, Homo sapiens
uacuccaugcacauag

SEQ ID NO: 1116026 - RNA, 15 nt, Homo sapiens
uacuccuaccucagc

SEQ ID NO: 1116027 - RNA, 14 nt, Homo sapiens
uacucuccaaccug

SEQ ID NO: 1116028 - RNA, 21 nt, Homo sapiens
uacucugugccagagccuggg

SEQ ID NO: 1116029 - RNA, 17 nt, Homo sapiens
uacugcaugcucaggac

SEQ ID NO: 1116030 - RNA, 13 nt, Homo sapiens
uacugccuagaaa

SEQ ID NO: 1116031 - RNA, 22 nt, Homo sapiens
uacugcucaucauuccuugaga

SEQ ID NO: 1116032 - RNA, 22 nt, Homo sapiens
uacugcugucauuguccaugcc

SEQ ID NO: 1116033 - RNA, 13 nt, Homo sapiens
uacuguacuuaau

SEQ ID NO: 1116034 - RNA, 13 nt, Homo sapiens
uacuuaacugugu

SEQ ID NO: 1116035 - RNA, 20 nt, Homo sapiens
uacuuaacugugugaagaaa

SEQ ID NO: 1116036 - RNA, 14 nt, Homo sapiens
uacuuaagugcugc

SEQ ID NO: 1116037 - RNA, 23 nt, Homo sapiens
uacuuauuuucuggaucuaucug

SEQ ID NO: 1116038 - RNA, 15 nt, Homo sapiens
uacuucagucuugga

SEQ ID NO: 1116039 - RNA, 13 nt, Homo sapiens
uacuucaugagga

SEQ ID NO: 1116040 - RNA, 17 nt, Homo sapiens
uacuucggggcugggaa

SEQ ID NO: 1116041 - RNA, 18 nt, Homo sapiens
uacuucggggcugggaag

SEQ ID NO: 1116042 - RNA, 22 nt, Homo sapiens
uacuugaaauaccagugaacca

SEQ ID NO: 1116043 - RNA, 19 nt, Homo sapiens
uacuugggagaccuguaau

SEQ ID NO: 1116044 - RNA, 17 nt, Homo sapiens
uacuuguggacacagcu

SEQ ID NO: 1116045 - RNA, 20 nt, Homo sapiens
uacuuucaucuauucuuucc

SEQ ID NO: 1116046 - RNA, 17 nt, Homo sapiens
uacuuuuuauacuccau

SEQ ID NO: 1116047 - RNA, 12 nt, Homo sapiens
uagaaauaagcc

SEQ ID NO: 1116048 - RNA, 21 nt, Homo sapiens
uagaaauaagcccaacagaca

SEQ ID NO: 1116049 - RNA, 16 nt, Homo sapiens
uagaacuccaguacuc

SEQ ID NO: 1116050 - RNA, 14 nt, Homo sapiens
uagaagagccugac

SEQ ID NO: 1116051 - RNA, 19 nt, Homo sapiens
uagaagauuuuaugcugcu

SEQ ID NO: 1116052 - RNA, 18 nt, Homo sapiens
uagaagccugcagcggca

SEQ ID NO: 1116053 - RNA, 22 nt, Homo sapiens
uagaagccugcagcggcacaaa

SEQ ID NO: 1116054 - RNA, 17 nt, Homo sapiens
uagaaggccacauguca

SEQ ID NO: 1116055 - RNA, 12 nt, Homo sapiens
uagaagucacac

SEQ ID NO: 1116056 - RNA, 16 nt, Homo sapiens
uagaagucacacagua

SEQ ID NO: 1116057 - RNA, 23 nt, Homo sapiens
uagaaguguuaacuuagcuugaa

SEQ ID NO: 1116058 - RNA, 20 nt, Homo sapiens
uagaauauuuauuaccucug

SEQ ID NO: 1116059 - RNA, 23 nt, Homo sapiens
uagaauguuacuuuggaaugacu

SEQ ID NO: 1116060 - RNA, 23 nt, Homo sapiens
uagacugccaugcuagacaagcu

SEQ ID NO: 1116061 - RNA, 17 nt, Homo sapiens
uagagacuuugugaaaa

SEQ ID NO: 1116062 - RNA, 18 nt, Homo sapiens
uagagaucuauguacugu

SEQ ID NO: 1116063 - RNA, 14 nt, Homo sapiens
uagagcacacugua

SEQ ID NO: 1116064 - RNA, 16 nt, Homo sapiens
uagaggaagaaaacca

SEQ ID NO: 1116065 - RNA, 19 nt, Homo sapiens
uagaggaagaaaaccagcg

SEQ ID NO: 1116066 - RNA, 14 nt, Homo sapiens
uagauuaaacaaac

SEQ ID NO: 1116067 - RNA, 21 nt, Homo sapiens
uagcaaagauaucucaucucu

SEQ ID NO: 1116068 - RNA, 17 nt, Homo sapiens
uagcaagacacaucccu

SEQ ID NO: 1116069 - RNA, 14 nt, Homo sapiens
uagcacuauuuaca

SEQ ID NO: 1116070 - RNA, 19 nt, Homo sapiens
uagcagaaggcaagcacca

SEQ ID NO: 1116071 - RNA, 14 nt, Homo sapiens
uagcagacaguguu

SEQ ID NO: 1116072 - RNA, 23 nt, Homo sapiens
uagccagccggggcgaguggcac

SEQ ID NO: 1116073 - RNA, 16 nt, Homo sapiens
uagccgaaaugaucuu

SEQ ID NO: 1116074 - RNA, 17 nt, Homo sapiens
uagccgaccucagccuu

SEQ ID NO: 1116075 - RNA, 17 nt, Homo sapiens
uagccuuagaagucaca

SEQ ID NO: 1116076 - RNA, 17 nt, Homo sapiens
uagcuaccuucucuacc

SEQ ID NO: 1116077 - RNA, 13 nt, Homo sapiens
uagcucuguccac

SEQ ID NO: 1116078 - RNA, 17 nt, Homo sapiens
uagcugggacuacaggc

SEQ ID NO: 1116079 - RNA, 19 nt, Homo sapiens
uagcuguaaauacaugugu

SEQ ID NO: 1116080 - RNA, 16 nt, Homo sapiens
uagcugugaccugcug

SEQ ID NO: 1116081 - RNA, 21 nt, Homo sapiens
uagcuugauguuggaucucaa

SEQ ID NO: 1116082 - RNA, 15 nt, Homo sapiens
uagcuuggaaacugg

SEQ ID NO: 1116083 - RNA, 23 nt, Homo sapiens
uagcuuuaaaaccugugugccau

SEQ ID NO: 1116084 - RNA, 13 nt, Homo sapiens
uagcuuuacaaau

SEQ ID NO: 1116085 - RNA, 14 nt, Homo sapiens
uagcuuuuauucau

SEQ ID NO: 1116086 - RNA, 14 nt, Homo sapiens
uaggaaaauuucac

SEQ ID NO: 1116087 - RNA, 19 nt, Homo sapiens
uaggaaagaagagaaccau

SEQ ID NO: 1116088 - RNA, 16 nt, Homo sapiens
uaggaagaccaagaca

SEQ ID NO: 1116089 - RNA, 15 nt, Homo sapiens
uaggacaauucacuu

SEQ ID NO: 1116090 - RNA, 16 nt, Homo sapiens
uaggcuuaaaugcaau

SEQ ID NO: 1116091 - RNA, 18 nt, Homo sapiens
uagggcuuauccaugccu

SEQ ID NO: 1116092 - RNA, 19 nt, Homo sapiens
uaggucuguaauuuauuaa

SEQ ID NO: 1116093 - RNA, 19 nt, Homo sapiens
uagguuuccacugccaaaa

SEQ ID NO: 1116094 - RNA, 19 nt, Homo sapiens
uaguaaagugauaauuucu

SEQ ID NO: 1116095 - RNA, 13 nt, Homo sapiens
uaguagugucuuc

SEQ ID NO: 1116096 - RNA, 16 nt, Homo sapiens
uaguauauuuauacuc

SEQ ID NO: 1116097 - RNA, 17 nt, Homo sapiens
uaguauauuuauacucu

SEQ ID NO: 1116098 - RNA, 16 nt, Homo sapiens
uaguaucacauagaag

SEQ ID NO: 1116099 - RNA, 20 nt, Homo sapiens
uaguauuccagaccugaaga

SEQ ID NO: 1116100 - RNA, 13 nt, Homo sapiens
uaguauuuaugaa

SEQ ID NO: 1116101 - RNA, 16 nt, Homo sapiens
uagucaaggaggaaag

SEQ ID NO: 1116102 - RNA, 20 nt, Homo sapiens
uagucaaggaggaaagggau

SEQ ID NO: 1116103 - RNA, 13 nt, Homo sapiens
uagucacaaaaau

SEQ ID NO: 1116104 - RNA, 12 nt, Homo sapiens
uagucacauggc

SEQ ID NO: 1116105 - RNA, 23 nt, Homo sapiens
uagucacauggccuaugcacaua

SEQ ID NO: 1116106 - RNA, 21 nt, Homo sapiens
uaguccguuaacacuacuuaa

SEQ ID NO: 1116107 - RNA, 22 nt, Homo sapiens
uagugauuugccucaacaacgu

SEQ ID NO: 1116108 - RNA, 16 nt, Homo sapiens
uagugcacacuuguau

SEQ ID NO: 1116109 - RNA, 14 nt, Homo sapiens
uguuacuacaugca

SEQ ID NO: 1116110 - RNA, 20 nt, Homo sapiens
uguuacuugaaauaccagug

SEQ ID NO: 1116111 - RNA, 12 nt, Homo sapiens
uguucacauaua

SEQ ID NO: 1116112 - RNA, 18 nt, Homo sapiens
uguucacuuauugacuau

SEQ ID NO: 1116113 - RNA, 14 nt, Homo sapiens
uguucauucacugc

SEQ ID NO: 1116114 - RNA, 12 nt, Homo sapiens
uguucauuuccu

SEQ ID NO: 1116115 - RNA, 13 nt, Homo sapiens
uguuccaaaaaga

SEQ ID NO: 1116116 - RNA, 22 nt, Homo sapiens
uguucucaaaugcuaaaugcaa

SEQ ID NO: 1116117 - RNA, 13 nt, Homo sapiens
uguucucacuuau

SEQ ID NO: 1116118 - RNA, 23 nt, Homo sapiens
uguucugaauaauuucuuacuaa

SEQ ID NO: 1116119 - RNA, 13 nt, Homo sapiens
uguucuggcuuua

SEQ ID NO: 1116120 - RNA, 13 nt, Homo sapiens
uguucugggacac

SEQ ID NO: 1116121 - RNA, 15 nt, Homo sapiens
uguucugucaccaau

SEQ ID NO: 1116122 - RNA, 21 nt, Homo sapiens
uguucuguccaguuuccaaag

SEQ ID NO: 1116123 - RNA, 17 nt, Homo sapiens
uguugaaaauguucaga

SEQ ID NO: 1116124 - RNA, 20 nt, Homo sapiens
uguugauaaauuccacugga

SEQ ID NO: 1116125 - RNA, 22 nt, Homo sapiens
uguugcugagucugcagaugag

SEQ ID NO: 1116126 - RNA, 21 nt, Homo sapiens
uguugcuggacugucauagaa

SEQ ID NO: 1116127 - RNA, 15 nt, Homo sapiens
uguuggccaguguga

SEQ ID NO: 1116128 - RNA, 20 nt, Homo sapiens
uguuguguauagaugcaaga

SEQ ID NO: 1116129 - RNA, 13 nt, Homo sapiens
uguuuacccagua

SEQ ID NO: 1116130 - RNA, 14 nt, Homo sapiens
uguuucacuaugau

SEQ ID NO: 1116131 - RNA, 14 nt, Homo sapiens
uguuucuauucuaa

SEQ ID NO: 1116132 - RNA, 16 nt, Homo sapiens
uguuucugaaugacau

SEQ ID NO: 1116133 - RNA, 15 nt, Homo sapiens
uguuucuggggacac

SEQ ID NO: 1116134 - RNA, 12 nt, Homo sapiens
uguuucuuccaa

SEQ ID NO: 1116135 - RNA, 13 nt, Homo sapiens
uguuucuuccaaa

SEQ ID NO: 1116136 - RNA, 13 nt, Homo sapiens
uguuuuaaguuua

SEQ ID NO: 1116137 - RNA, 15 nt, Homo sapiens
uguuuuuugccuaaa

SEQ ID NO: 1116138 - RNA, 20 nt, Homo sapiens
uguuuuuugccuaaauccaa

SEQ ID NO: 1116139 - RNA, 19 nt, Homo sapiens
uuaaaaaauaaaaacugac

SEQ ID NO: 1116140 - RNA, 20 nt, Homo sapiens
uuaaaaauauuuucugaauu

SEQ ID NO: 1116141 - RNA, 17 nt, Homo sapiens
uuaaaagaagacuggaa

SEQ ID NO: 1116142 - RNA, 15 nt, Homo sapiens
uuaaaagauucacua

SEQ ID NO: 1116143 - RNA, 20 nt, Homo sapiens
uuaaaauguacacuggauau

SEQ ID NO: 1116144 - RNA, 19 nt, Homo sapiens
uuaaagcauuuacuuugaa

SEQ ID NO: 1116145 - RNA, 13 nt, Homo sapiens
uuaaagcuguuau

SEQ ID NO: 1116146 - RNA, 18 nt, Homo sapiens
uuaaaguaccuguaguga

SEQ ID NO: 1116147 - RNA, 15 nt, Homo sapiens
uuaaaugcauguccu

SEQ ID NO: 1116148 - RNA, 17 nt, Homo sapiens
uuaaaugcauguccuca

SEQ ID NO: 1116149 - RNA, 20 nt, Homo sapiens
uuaaaugcauguccucaaaa

SEQ ID NO: 1116150 - RNA, 16 nt, Homo sapiens
uuaaaugccuccuucu

SEQ ID NO: 1116151 - RNA, 14 nt, Homo sapiens
uuaaauuucuggau

SEQ ID NO: 1116152 - RNA, 14 nt, Homo sapiens
uuaacacauaacua

SEQ ID NO: 1116153 - RNA, 16 nt, Homo sapiens
uuaacaucaucaggcu

SEQ ID NO: 1116154 - RNA, 20 nt, Homo sapiens
uuaacaucuugaacugguug

SEQ ID NO: 1116155 - RNA, 10 nt, Homo sapiens
uuaacuauug

SEQ ID NO: 1116156 - RNA, 22 nt, Homo sapiens
uuaacuggcuucagccucccca

SEQ ID NO: 1116157 - RNA, 18 nt, Homo sapiens
uuaagauaguuuugccag

SEQ ID NO: 1116158 - RNA, 19 nt, Homo sapiens
uuaagcugggauaaucaca

SEQ ID NO: 1116159 - RNA, 23 nt, Homo sapiens
uuaagcugggauaaucacauuau

SEQ ID NO: 1116160 - RNA, 15 nt, Homo sapiens
uuaaggauugugaua

SEQ ID NO: 1116161 - RNA, 14 nt, Homo sapiens
uuaauaaauguaua

SEQ ID NO: 1116162 - RNA, 14 nt, Homo sapiens
uuaauaguauuuau

SEQ ID NO: 1116163 - RNA, 14 nt, Homo sapiens
uuaaucaugagaua

SEQ ID NO: 1116164 - RNA, 15 nt, Homo sapiens
uuaaucaugagauaa

SEQ ID NO: 1116165 - RNA, 19 nt, Homo sapiens
uuaaugaagacccagugua

SEQ ID NO: 1116166 - RNA, 12 nt, Homo sapiens
uuaauggugccu

SEQ ID NO: 1116167 - RNA, 21 nt, Homo sapiens
uuaauguauuuguuugcaauu

SEQ ID NO: 1116168 - RNA, 13 nt, Homo sapiens
uuaauuacaucca

SEQ ID NO: 1116169 - RNA, 18 nt, Homo sapiens
uuaauuugauaguauugu

SEQ ID NO: 1116170 - RNA, 15 nt, Homo sapiens
uuaauuuucaguaua

SEQ ID NO: 1116171 - RNA, 13 nt, Homo sapiens
uuacaugauucau

SEQ ID NO: 1116172 - RNA, 14 nt, Homo sapiens
uuacaugauucauu

SEQ ID NO: 1116173 - RNA, 13 nt, Homo sapiens
uuacaugcauuac

SEQ ID NO: 1116174 - RNA, 22 nt, Homo sapiens
uuacaugcauuacugcaugcac

SEQ ID NO: 1116175 - RNA, 21 nt, Homo sapiens
uuacauuuccaaaugaaugac

SEQ ID NO: 1116176 - RNA, 13 nt, Homo sapiens
uuaccaaagaaga

SEQ ID NO: 1116177 - RNA, 22 nt, Homo sapiens
uuacccagagaauauauacauu

SEQ ID NO: 1116178 - RNA, 16 nt, Homo sapiens
uuacccaguauuccau

SEQ ID NO: 1116179 - RNA, 14 nt, Homo sapiens
uuaccuaaacagau

SEQ ID NO: 1116180 - RNA, 21 nt, Homo sapiens
uuaccuagauuuacagccuca

SEQ ID NO: 1116181 - RNA, 22 nt, Homo sapiens
uuaccugggcauucuuguuuca

SEQ ID NO: 1116182 - RNA, 23 nt, Homo sapiens
uuaccuguguuucaagcuaccuu

SEQ ID NO: 1116183 - RNA, 23 nt, Homo sapiens
uuaccuuuauuaaugaacuguga

SEQ ID NO: 1116184 - RNA, 12 nt, Homo sapiens
uuacuaaagaca

SEQ ID NO: 1116185 - RNA, 22 nt, Homo sapiens
uuacuaacacgcauuguacacu

SEQ ID NO: 1116186 - RNA, 21 nt, Homo sapiens
uuacuauuuauugcugaauga

SEQ ID NO: 1116187 - RNA, 22 nt, Homo sapiens
uuacuauuuauugcugaaugac

SEQ ID NO: 1116188 - RNA, 18 nt, Homo sapiens
uuacuauuucacaacagc

SEQ ID NO: 1116189 - RNA, 22 nt, Homo sapiens
uuacuccuuugcauuccaugau

SEQ ID NO: 1116190 - RNA, 20 nt, Homo sapiens
uuacugagcuucucugugaa

SEQ ID NO: 1116191 - RNA, 21 nt, Homo sapiens
uuacugcuucuuuucacuuca

SEQ ID NO: 1116192 - RNA, 21 nt, Homo sapiens
uuacugguuucaguugacaaa

SEQ ID NO: 1116193 - RNA, 20 nt, Homo sapiens
uuacuguaauuggugacaau

SEQ ID NO: 1116194 - RNA, 17 nt, Homo sapiens
uuacuuauuuucuggau

SEQ ID NO: 1116195 - RNA, 21 nt, Homo sapiens
uuacuucacuuuaauucucau

SEQ ID NO: 1116196 - RNA, 20 nt, Homo sapiens
uuacuuccuaucaagccagu

SEQ ID NO: 1116197 - RNA, 14 nt, Homo sapiens
uuagaagucacaca

SEQ ID NO: 1116198 - RNA, 19 nt, Homo sapiens
uuagacaaaggcucuacac

SEQ ID NO: 1116199 - RNA, 17 nt, Homo sapiens
uuagacagagucucacu

SEQ ID NO: 1116200 - RNA, 17 nt, Homo sapiens
gugagacuccgucucaa

SEQ ID NO: 1116201 - RNA, 22 nt, Homo sapiens
gugagcagacugcaaaucugcc

SEQ ID NO: 1116202 - RNA, 15 nt, Homo sapiens
gugauuucagagagg

SEQ ID NO: 1116203 - RNA, 18 nt, Homo sapiens
gugcaccacuucaaguga

SEQ ID NO: 1116204 - RNA, 19 nt, Homo sapiens
gugcaccccuccccauuca

SEQ ID NO: 1116205 - RNA, 17 nt, Homo sapiens
gugcaguugacagcagg

SEQ ID NO: 1116206 - RNA, 22 nt, Homo sapiens
gugccuggaaauuaaacccugc

SEQ ID NO: 1116207 - RNA, 21 nt, Homo sapiens
gugcuaagaaagcaagccaau

SEQ ID NO: 1116208 - RNA, 18 nt, Homo sapiens
gugcuauaggcuggagaa

SEQ ID NO: 1116209 - RNA, 22 nt, Homo sapiens
gugcucauucauuuaacagagc

SEQ ID NO: 1116210 - RNA, 15 nt, Homo sapiens
gugcucuccuacccc

SEQ ID NO: 1116211 - RNA, 19 nt, Homo sapiens
gugcugggauuacaggugu

SEQ ID NO: 1116212 - RNA, 18 nt, Homo sapiens
gugcuguggccugggcaa

SEQ ID NO: 1116213 - RNA, 19 nt, Homo sapiens
guggaauagccucccugua

SEQ ID NO: 1116214 - RNA, 16 nt, Homo sapiens
ucuuggugucuguccu

SEQ ID NO: 1116215 - RNA, 17 nt, Homo sapiens
ucuugucauugccagcu

SEQ ID NO: 1116216 - RNA, 17 nt, Homo sapiens
ucuuucuuggugucugu

SEQ ID NO: 1116217 - RNA, 19 nt, Homo sapiens
ucuuugaauaaagucugag

SEQ ID NO: 1116218 - RNA, 17 nt, Homo sapiens
ucuuugagaacaaugga

SEQ ID NO: 1116219 - RNA, 21 nt, Homo sapiens
ucuuuguaagaguggaaccaa

SEQ ID NO: 1116220 - RNA, 19 nt, Homo sapiens
ucuuuguaaugucaccacc

SEQ ID NO: 1116221 - RNA, 14 nt, Homo sapiens
ucuuuuaaaccauu

SEQ ID NO: 1116222 - RNA, 15 nt, Homo sapiens
ucuuuuucacacuga

SEQ ID NO: 1116223 - RNA, 18 nt, Homo sapiens
ugaaaaacaaaaauaaca

SEQ ID NO: 1116224 - RNA, 22 nt, Homo sapiens
ugaaaaauucucagucaguaau

SEQ ID NO: 1116225 - RNA, 18 nt, Homo sapiens
ugaaaacucacuucaaug

SEQ ID NO: 1116226 - RNA, 11 nt, Homo sapiens
ugaaaauaacu

SEQ ID NO: 1116227 - RNA, 14 nt, Homo sapiens
ugaaaaucacuaua

SEQ ID NO: 1116228 - RNA, 20 nt, Homo sapiens
ugaaacaagauaacugagaa

SEQ ID NO: 1116229 - RNA, 23 nt, Homo sapiens
ugaaagaaccaaaagagaucaca

SEQ ID NO: 1116230 - RNA, 16 nt, Homo sapiens
ugaaagaaggagcaag

SEQ ID NO: 1116231 - RNA, 13 nt, Homo sapiens
ugaaagggcaaua

SEQ ID NO: 1116232 - RNA, 18 nt, Homo sapiens
ugaaauaaaagccucugg

SEQ ID NO: 1116233 - RNA, 22 nt, Homo sapiens
ugaaauaccagugaaccaaaga

SEQ ID NO: 1116234 - RNA, 23 nt, Homo sapiens
ugaaauaccagugaaccaaagag

SEQ ID NO: 1116235 - RNA, 22 nt, Homo sapiens
ugaaaucagaagccuacuuuga

SEQ ID NO: 1116236 - RNA, 14 nt, Homo sapiens
ugaaaugggcuuua

SEQ ID NO: 1116237 - RNA, 15 nt, Homo sapiens
ugaacaccacuuugu

SEQ ID NO: 1116238 - RNA, 19 nt, Homo sapiens
ugaacaccacuuugucucu

SEQ ID NO: 1116239 - RNA, 23 nt, Homo sapiens
ugaacaccacuuugucucugaga

SEQ ID NO: 1116240 - RNA, 19 nt, Homo sapiens
ugaacccaggacaagcaug

SEQ ID NO: 1116241 - RNA, 20 nt, Homo sapiens
ugaaccucaagcugcaucua

SEQ ID NO: 1116242 - RNA, 17 nt, Homo sapiens
ugaacugagccuagcua

SEQ ID NO: 1116243 - RNA, 14 nt, Homo sapiens
ugaacuucagggag

SEQ ID NO: 1116244 - RNA, 19 nt, Homo sapiens
ugaagaaaaaauacauuuu

SEQ ID NO: 1116245 - RNA, 22 nt, Homo sapiens
ugaagaacaguaacugccauca

SEQ ID NO: 1116246 - RNA, 20 nt, Homo sapiens
ugaagaagaguuugcaaaug

SEQ ID NO: 1116247 - RNA, 16 nt, Homo sapiens
ugaagacaacagcaua

SEQ ID NO: 1116248 - RNA, 15 nt, Homo sapiens
ugaagaccacaucca

SEQ ID NO: 1116249 - RNA, 22 nt, Homo sapiens
ugaagacccaguguaaagaaua

SEQ ID NO: 1116250 - RNA, 23 nt, Homo sapiens
ugaagacccaguguaaagaauaa

SEQ ID NO: 1116251 - RNA, 18 nt, Homo sapiens
ugaagagaccaagacucu

SEQ ID NO: 1116252 - RNA, 21 nt, Homo sapiens
ugaagagauuucaacauauca

SEQ ID NO: 1116253 - RNA, 18 nt, Homo sapiens
ugaagagggagaagggau

SEQ ID NO: 1116254 - RNA, 13 nt, Homo sapiens
ugaagagguguuu

SEQ ID NO: 1116255 - RNA, 19 nt, Homo sapiens
ugaagagugagagggcaug

SEQ ID NO: 1116256 - RNA, 21 nt, Homo sapiens
ugaagauggauguuugucaaa

SEQ ID NO: 1116257 - RNA, 16 nt, Homo sapiens
ugaaggagaaaaugca

SEQ ID NO: 1116258 - RNA, 23 nt, Homo sapiens
ugaaggaggugagggaugugaau

SEQ ID NO: 1116259 - RNA, 13 nt, Homo sapiens
ugaaggcuguaca

SEQ ID NO: 1116260 - RNA, 17 nt, Homo sapiens
ugaaggucuugccugaa

SEQ ID NO: 1116261 - RNA, 10 nt, Homo sapiens
ugaaggugcu

SEQ ID NO: 1116262 - RNA, 11 nt, Homo sapiens
ugaaggugcug

SEQ ID NO: 1116263 - RNA, 20 nt, Homo sapiens
ugaaguaaaggauugaucac

SEQ ID NO: 1116264 - RNA, 16 nt, Homo sapiens
ugaaguagaauccuaa

SEQ ID NO: 1116265 - RNA, 22 nt, Homo sapiens
ugaagugcaaauuugauacaua

SEQ ID NO: 1116266 - RNA, 16 nt, Homo sapiens
ugaaguguaauugaga

SEQ ID NO: 1116267 - RNA, 20 nt, Homo sapiens
ugaaguucuuuuacuguaau

SEQ ID NO: 1116268 - RNA, 15 nt, Homo sapiens
ugaauaaaaacccug

SEQ ID NO: 1116269 - RNA, 17 nt, Homo sapiens
ugaauaaaaacccugua

SEQ ID NO: 1116270 - RNA, 21 nt, Homo sapiens
ugaauaaaguuaguguguugu

SEQ ID NO: 1116271 - RNA, 16 nt, Homo sapiens
ugaauaaccacuuaaa

SEQ ID NO: 1116272 - RNA, 21 nt, Homo sapiens
ugaauccucucucuguguuac

SEQ ID NO: 1116273 - RNA, 15 nt, Homo sapiens
ugaaucuuacuccuu

SEQ ID NO: 1116274 - RNA, 18 nt, Homo sapiens
ugaaugcacacuagccuc

SEQ ID NO: 1116275 - RNA, 19 nt, Homo sapiens
ugaaugcuuaccugugaga

SEQ ID NO: 1116276 - RNA, 15 nt, Homo sapiens
ugaauggccugccuu

SEQ ID NO: 1116277 - RNA, 13 nt, Homo sapiens
ugaaugugucacu

SEQ ID NO: 1116278 - RNA, 18 nt, Homo sapiens
ugaaugugucacuacuca

SEQ ID NO: 1116279 - RNA, 14 nt, Homo sapiens
ugaauuuuguugcu

SEQ ID NO: 1116280 - RNA, 12 nt, Homo sapiens
ugacaaauugaa

SEQ ID NO: 1116281 - RNA, 19 nt, Homo sapiens
ugacaacauuucuauagcc

SEQ ID NO: 1116282 - RNA, 15 nt, Homo sapiens
ugacaauaauuucag

SEQ ID NO: 1116283 - RNA, 13 nt, Homo sapiens
ugacacauaugca

SEQ ID NO: 1116284 - RNA, 16 nt, Homo sapiens
ugacacauaugcaccu

SEQ ID NO: 1116285 - RNA, 14 nt, Homo sapiens
ugacaccucacuga

SEQ ID NO: 1116286 - RNA, 16 nt, Homo sapiens
ugacacugccagucac

SEQ ID NO: 1116287 - RNA, 17 nt, Homo sapiens
ugacacuuugccagaaa

SEQ ID NO: 1116288 - RNA, 14 nt, Homo sapiens
ugacagaaaugcaa

SEQ ID NO: 1116289 - RNA, 15 nt, Homo sapiens
ugacagaacacuguc

SEQ ID NO: 1116290 - RNA, 20 nt, Homo sapiens
ugacaguggaacuacauuag

SEQ ID NO: 1116291 - RNA, 12 nt, Homo sapiens
ugacaugugcuu

SEQ ID NO: 1116292 - RNA, 22 nt, Homo sapiens
ugacauucugauucgaaugaca

SEQ ID NO: 1116293 - RNA, 15 nt, Homo sapiens
ugacccaaagaccaa

SEQ ID NO: 1116294 - RNA, 16 nt, Homo sapiens
ugacuaucacauacaa

SEQ ID NO: 1116295 - RNA, 21 nt, Homo sapiens
ugacuaucacauacaauuugc

SEQ ID NO: 1116296 - RNA, 23 nt, Homo sapiens
ugacucacaagaagaccagacug

SEQ ID NO: 1116297 - RNA, 13 nt, Homo sapiens
ugacucaccuguu

SEQ ID NO: 1116298 - RNA, 16 nt, Homo sapiens
ugacucagcauaccug

SEQ ID NO: 1116299 - RNA, 18 nt, Homo sapiens
ugacucagcauaccugcu

SEQ ID NO: 1116300 - RNA, 16 nt, Homo sapiens
ugacuccuuucucuaa

SEQ ID NO: 1116301 - RNA, 11 nt, Homo sapiens
ugacugaugac

SEQ ID NO: 1116302 - RNA, 21 nt, Homo sapiens
ugacuguguucagugccuugg

SEQ ID NO: 1116303 - RNA, 19 nt, Homo sapiens
ugcaugaaucuguacccuu

SEQ ID NO: 1116304 - RNA, 16 nt, Homo sapiens
ugcaugcacuucuuac

SEQ ID NO: 1116305 - RNA, 14 nt, Homo sapiens
ugcauguccucaaa

SEQ ID NO: 1116306 - RNA, 15 nt, Homo sapiens
ugcauguccucaaaa

SEQ ID NO: 1116307 - RNA, 15 nt, Homo sapiens
ugcauuaaaaaugca

SEQ ID NO: 1116308 - RNA, 16 nt, Homo sapiens
ugcauucccagugguc

SEQ ID NO: 1116309 - RNA, 23 nt, Homo sapiens
ugcauuuauaaauguguggugcu

SEQ ID NO: 1116310 - RNA, 22 nt, Homo sapiens
ugcauuuauggucaacacuuaa

SEQ ID NO: 1116311 - RNA, 14 nt, Homo sapiens
ugcauuugcacuau

SEQ ID NO: 1116312 - RNA, 19 nt, Homo sapiens
ugcauuuucccagauacuu

SEQ ID NO: 1116313 - RNA, 21 nt, Homo sapiens
ugcauuuucccagauacuucc

SEQ ID NO: 1116314 - RNA, 17 nt, Homo sapiens
ugccaagccaccuucca

SEQ ID NO: 1116315 - RNA, 15 nt, Homo sapiens
ugccaauuagcaauu

SEQ ID NO: 1116316 - RNA, 14 nt, Homo sapiens
ugccacaucugugu

SEQ ID NO: 1116317 - RNA, 17 nt, Homo sapiens
ugccacuccugcuucuc

SEQ ID NO: 1116318 - RNA, 18 nt, Homo sapiens
ugccagaaagcauaaaau

SEQ ID NO: 1116319 - RNA, 17 nt, Homo sapiens
ugccagaugcaauacaa

SEQ ID NO: 1116320 - RNA, 17 nt, Homo sapiens
ugccagccgugaugcuc

SEQ ID NO: 1116321 - RNA, 22 nt, Homo sapiens
ugccagugccuuaccuccugcc

SEQ ID NO: 1116322 - RNA, 22 nt, Homo sapiens
ugccauccuaggcuuaaaugca

SEQ ID NO: 1116323 - RNA, 21 nt, Homo sapiens
ugcccaaccugcucuccucuu

SEQ ID NO: 1116324 - RNA, 22 nt, Homo sapiens
ugcccaauuagggccuagccuu

SEQ ID NO: 1116325 - RNA, 20 nt, Homo sapiens
ugcccacgcuggagugcagu

SEQ ID NO: 1116326 - RNA, 20 nt, Homo sapiens
ugcccaggcuggcgugcagu

SEQ ID NO: 1116327 - RNA, 20 nt, Homo sapiens
ugcccagggcucagccuggu

SEQ ID NO: 1116328 - RNA, 19 nt, Homo sapiens
ugccccaacuccuuccagc

SEQ ID NO: 1116329 - RNA, 19 nt, Homo sapiens
ugccccugcaguuggcaga

SEQ ID NO: 1116330 - RNA, 23 nt, Homo sapiens
ugcccugaguggaucuccaagga

SEQ ID NO: 1116331 - RNA, 17 nt, Homo sapiens
ugcccugcccaugggag

SEQ ID NO: 1116332 - RNA, 15 nt, Homo sapiens
ugcccuguccuccag

SEQ ID NO: 1116333 - RNA, 19 nt, Homo sapiens
ugccggguucuagucuccu

SEQ ID NO: 1116334 - RNA, 15 nt, Homo sapiens
ugccuacauucccug

SEQ ID NO: 1116335 - RNA, 16 nt, Homo sapiens
ugccuaggaggccuuc

SEQ ID NO: 1116336 - RNA, 17 nt, Homo sapiens
ugccucaaugugaccag

SEQ ID NO: 1116337 - RNA, 22 nt, Homo sapiens
ugccucagcugcucgcacagau

SEQ ID NO: 1116338 - RNA, 17 nt, Homo sapiens
ugccucugaaacuuaau

SEQ ID NO: 1116339 - RNA, 15 nt, Homo sapiens
ugccucuguauuuaa

SEQ ID NO: 1116340 - RNA, 15 nt, Homo sapiens
ugccugaagucacac

SEQ ID NO: 1116341 - RNA, 17 nt, Homo sapiens
ugccugaauccaucagg

SEQ ID NO: 1116342 - RNA, 16 nt, Homo sapiens
ugccuggccuggcaca

SEQ ID NO: 1116343 - RNA, 16 nt, Homo sapiens
ugccugguggcagcug

SEQ ID NO: 1116344 - RNA, 19 nt, Homo sapiens
ugccuggugggccacgugu

SEQ ID NO: 1116345 - RNA, 19 nt, Homo sapiens
ugccugugugagcaucucu

SEQ ID NO: 1116346 - RNA, 20 nt, Homo sapiens
ugccuucgguuuguauuuag

SEQ ID NO: 1116347 - RNA, 19 nt, Homo sapiens
ugcgcacaaggcugaccaa

SEQ ID NO: 1116348 - RNA, 20 nt, Homo sapiens
ugcggaaugaaccacaucuu

SEQ ID NO: 1116349 - RNA, 15 nt, Homo sapiens
ugcggugucacuggg

SEQ ID NO: 1116350 - RNA, 22 nt, Homo sapiens
ugcuaaauggucgcccaggaga

SEQ ID NO: 1116351 - RNA, 21 nt, Homo sapiens
ugcuaaucagggaggucauuu

SEQ ID NO: 1116352 - RNA, 13 nt, Homo sapiens
ugcuauauugccc

SEQ ID NO: 1116353 - RNA, 15 nt, Homo sapiens
ugcuaucgcaccacu

SEQ ID NO: 1116354 - RNA, 18 nt, Homo sapiens
ugcucagauagaaugaca

SEQ ID NO: 1116355 - RNA, 20 nt, Homo sapiens
ugcucaggcuugaaaugcau

SEQ ID NO: 1116356 - RNA, 21 nt, Homo sapiens
ugcucccagcagcccuaagga

SEQ ID NO: 1116357 - RNA, 18 nt, Homo sapiens
ugcuccccagugcuaccu

SEQ ID NO: 1116358 - RNA, 20 nt, Homo sapiens
ugcuccccagugcuaccucu

SEQ ID NO: 1116359 - RNA, 20 nt, Homo sapiens
ugcucgcacagauuacuuca

SEQ ID NO: 1116360 - RNA, 20 nt, Homo sapiens
ugcucggcuguaaacagcuc

SEQ ID NO: 1116361 - RNA, 21 nt, Homo sapiens
ugcucggcuguaaacagcucu

SEQ ID NO: 1116362 - RNA, 16 nt, Homo sapiens
ugcucggggugcacag

SEQ ID NO: 1116363 - RNA, 18 nt, Homo sapiens
ugcucuggaaaaugugac

SEQ ID NO: 1116364 - RNA, 21 nt, Homo sapiens
ugcucuuugauucaaagcacu

SEQ ID NO: 1116365 - RNA, 13 nt, Homo sapiens
ugcuggacuguca

SEQ ID NO: 1116366 - RNA, 19 nt, Homo sapiens
ugcuggcccauaaacaccc

SEQ ID NO: 1116367 - RNA, 23 nt, Homo sapiens
ugcugucauuguccaugccuaca

SEQ ID NO: 1116368 - RNA, 16 nt, Homo sapiens
ugcuguguagcucugu

SEQ ID NO: 1116369 - RNA, 17 nt, Homo sapiens
ugcuguugggaaaaccg

SEQ ID NO: 1116370 - RNA, 14 nt, Homo sapiens
ugcuuaaaauagca

SEQ ID NO: 1116371 - RNA, 13 nt, Homo sapiens
ugcuuaccuguga

SEQ ID NO: 1116372 - RNA, 12 nt, Homo sapiens
ugcuucagccug

SEQ ID NO: 1116373 - RNA, 15 nt, Homo sapiens
ugcuucaggauacca

SEQ ID NO: 1116374 - RNA, 18 nt, Homo sapiens
ugcuucaggauaccauau

SEQ ID NO: 1116375 - RNA, 19 nt, Homo sapiens
ugcuucaggauaccauaua

SEQ ID NO: 1116376 - RNA, 14 nt, Homo sapiens
ugcuucaugcucag

SEQ ID NO: 1116377 - RNA, 17 nt, Homo sapiens
ugcuugaaaccaaagau

SEQ ID NO: 1116378 - RNA, 15 nt, Homo sapiens
ugcuugacuaucaca

SEQ ID NO: 1116379 - RNA, 19 nt, Homo sapiens
uggaaaagcaaaacuguag

SEQ ID NO: 1116380 - RNA, 22 nt, Homo sapiens
uggaaaagcaaaacuguagggg

SEQ ID NO: 1116381 - RNA, 14 nt, Homo sapiens
uggaaaaugugacc

SEQ ID NO: 1116382 - RNA, 14 nt, Homo sapiens
uggaaaaugugcaa

SEQ ID NO: 1116383 - RNA, 16 nt, Homo sapiens
uggaaaaugugcaaua

SEQ ID NO: 1116384 - RNA, 14 nt, Homo sapiens
uggaaacaggacca

SEQ ID NO: 1116385 - RNA, 15 nt, Homo sapiens
uggaaacauuuacaa

SEQ ID NO: 1116386 - RNA, 21 nt, Homo sapiens
uggaaagcagguggcaucucu

SEQ ID NO: 1116387 - RNA, 18 nt, Homo sapiens
uggaaagcaucaccucag

SEQ ID NO: 1116388 - RNA, 15 nt, Homo sapiens
guuuaaaaaccaaau

SEQ ID NO: 1116389 - RNA, 20 nt, Homo sapiens
guuuaaacauaggaaagaag

SEQ ID NO: 1116390 - RNA, 21 nt, Homo sapiens
guuuacuucucaccauuugag

SEQ ID NO: 1116391 - RNA, 13 nt, Homo sapiens
guuuaugucauca

SEQ ID NO: 1116392 - RNA, 17 nt, Homo sapiens
guuucacacuagucaca

SEQ ID NO: 1116393 - RNA, 18 nt, Homo sapiens
guuucaguugacaaaaua

SEQ ID NO: 1116394 - RNA, 15 nt, Homo sapiens
guuucaucuguucau

SEQ ID NO: 1116395 - RNA, 17 nt, Homo sapiens
guuuccacugucuugcc

SEQ ID NO: 1116396 - RNA, 21 nt, Homo sapiens
guuucucuugaagaacugacu

SEQ ID NO: 1116397 - RNA, 11 nt, Homo sapiens
guuucuuccaa

SEQ ID NO: 1116398 - RNA, 14 nt, Homo sapiens
guuucuugccucau

SEQ ID NO: 1116399 - RNA, 21 nt, Homo sapiens
guuucuuggucucagcuucau

SEQ ID NO: 1116400 - RNA, 15 nt, Homo sapiens
guuucuugugggcua

SEQ ID NO: 1116401 - RNA, 13 nt, Homo sapiens
augcuugugauuu

SEQ ID NO: 1116402 - RNA, 22 nt, Homo sapiens
augcuugugauuuuugaacaau

SEQ ID NO: 1116403 - RNA, 21 nt, Homo sapiens
auggaagaggcaccuguccca

SEQ ID NO: 1116404 - RNA, 15 nt, Homo sapiens
auggaauaaagcccu

SEQ ID NO: 1116405 - RNA, 16 nt, Homo sapiens
auggaauaaagcccuu

SEQ ID NO: 1116406 - RNA, 20 nt, Homo sapiens
auggaauuuuucauugauau

SEQ ID NO: 1116407 - RNA, 21 nt, Homo sapiens
auggacauauucuuuuuggaa

SEQ ID NO: 1116408 - RNA, 15 nt, Homo sapiens
auggauguuugucaa

SEQ ID NO: 1116409 - RNA, 22 nt, Homo sapiens
auggcaccacugcacuccagcc

SEQ ID NO: 1116410 - RNA, 13 nt, Homo sapiens
auggcauccugca

SEQ ID NO: 1116411 - RNA, 17 nt, Homo sapiens
auggcaucuaccgaccu

SEQ ID NO: 1116412 - RNA, 20 nt, Homo sapiens
auggccagugugaucccaag

SEQ ID NO: 1116413 - RNA, 22 nt, Homo sapiens
auggccauagcuuuuauucauu

SEQ ID NO: 1116414 - RNA, 23 nt, Homo sapiens
augggaucuguaaggaacuggaa

SEQ ID NO: 1116415 - RNA, 12 nt, Homo sapiens
augggaugaaug

SEQ ID NO: 1116416 - RNA, 17 nt, Homo sapiens
augggauucagugcuuc

SEQ ID NO: 1116417 - RNA, 19 nt, Homo sapiens
augggcaaagcugugcacu

SEQ ID NO: 1116418 - RNA, 20 nt, Homo sapiens
augggcaaauuaaggcauaa

SEQ ID NO: 1116419 - RNA, 22 nt, Homo sapiens
augggucuggcugagcugaacc

SEQ ID NO: 1116420 - RNA, 18 nt, Homo sapiens
augguaaaaccccaucuc

SEQ ID NO: 1116421 - RNA, 15 nt, Homo sapiens
augguaagacuguaa

SEQ ID NO: 1116422 - RNA, 15 nt, Homo sapiens
auggucacaagcaca

SEQ ID NO: 1116423 - RNA, 21 nt, Homo sapiens
auggugagagauaagaucuau

SEQ ID NO: 1116424 - RNA, 20 nt, Homo sapiens
auggugcaaauccuacugaa

SEQ ID NO: 1116425 - RNA, 20 nt, Homo sapiens
augguggcgcgcaccuguaa

SEQ ID NO: 1116426 - RNA, 20 nt, Homo sapiens
augguguaaugcacaauuua

SEQ ID NO: 1116427 - RNA, 15 nt, Homo sapiens
augguuaaauaucac

SEQ ID NO: 1116428 - RNA, 14 nt, Homo sapiens
augguuuuacucau

SEQ ID NO: 1116429 - RNA, 19 nt, Homo sapiens
augguuuuacucaugugca

SEQ ID NO: 1116430 - RNA, 22 nt, Homo sapiens
auguaauaaaucugagccuaaa

SEQ ID NO: 1116431 - RNA, 23 nt, Homo sapiens
auguaaugcauaggaaguauggc

SEQ ID NO: 1116432 - RNA, 18 nt, Homo sapiens
auguacaugaagaagcua

SEQ ID NO: 1116433 - RNA, 16 nt, Homo sapiens
auguaccaguguacug

SEQ ID NO: 1116434 - RNA, 19 nt, Homo sapiens
auguaccaguguacugcuu

SEQ ID NO: 1116435 - RNA, 22 nt, Homo sapiens
auguauauauauauaguaacua

SEQ ID NO: 1116436 - RNA, 22 nt, Homo sapiens
auguauaucuauaucucuaaac

SEQ ID NO: 1116437 - RNA, 20 nt, Homo sapiens
auguaucccaacuccuauaa

SEQ ID NO: 1116438 - RNA, 16 nt, Homo sapiens
auguaucuaugcauuu

SEQ ID NO: 1116439 - RNA, 22 nt, Homo sapiens
auguauuuuccugcauaaucau

SEQ ID NO: 1116440 - RNA, 19 nt, Homo sapiens
augucagaguagaagauuu

SEQ ID NO: 1116441 - RNA, 21 nt, Homo sapiens
augucaucaaauauuaccaaa

SEQ ID NO: 1116442 - RNA, 23 nt, Homo sapiens
augucaucaaauauuaccaaaaa

SEQ ID NO: 1116443 - RNA, 16 nt, Homo sapiens
augucaucauacauga

SEQ ID NO: 1116444 - RNA, 22 nt, Homo sapiens
auguccagaagaauauucagga

SEQ ID NO: 1116445 - RNA, 22 nt, Homo sapiens
auguccaugauggaauauuccc

SEQ ID NO: 1116446 - RNA, 13 nt, Homo sapiens
auguccuauccaa

SEQ ID NO: 1116447 - RNA, 19 nt, Homo sapiens
auguccucuuguugcugag

SEQ ID NO: 1116448 - RNA, 17 nt, Homo sapiens
augucucagaccacuau

SEQ ID NO: 1116449 - RNA, 14 nt, Homo sapiens
augucuccaucucu

SEQ ID NO: 1116450 - RNA, 23 nt, Homo sapiens
augucuguuucaaugaccuguau

SEQ ID NO: 1116451 - RNA, 11 nt, Homo sapiens
augugcaauau

SEQ ID NO: 1116452 - RNA, 14 nt, Homo sapiens
augugcacaugcac

SEQ ID NO: 1116453 - RNA, 14 nt, Homo sapiens
auguggcauguuca

SEQ ID NO: 1116454 - RNA, 19 nt, Homo sapiens
augugugaaggucuugccu

SEQ ID NO: 1116455 - RNA, 16 nt, Homo sapiens
auugcauuucugcucu

SEQ ID NO: 1116456 - RNA, 18 nt, Homo sapiens
auugcuaccucuuuguca

SEQ ID NO: 1116457 - RNA, 22 nt, Homo sapiens
auugcuaugaaugauacccuga

SEQ ID NO: 1116458 - RNA, 13 nt, Homo sapiens
auugcugcucucu

SEQ ID NO: 1116459 - RNA, 19 nt, Homo sapiens
auuggagaguaaaaacuga

SEQ ID NO: 1116460 - RNA, 13 nt, Homo sapiens
auuggcagugugu

SEQ ID NO: 1116461 - RNA, 12 nt, Homo sapiens
auuguguucucu

SEQ ID NO: 1116462 - RNA, 16 nt, Homo sapiens
auuguuaaaauaacua

SEQ ID NO: 1116463 - RNA, 18 nt, Homo sapiens
auuguuacagguguacua

SEQ ID NO: 1116464 - RNA, 21 nt, Homo sapiens
auuguuacagguguacuaugg

SEQ ID NO: 1116465 - RNA, 15 nt, Homo sapiens
auuuaaaaucauuca

SEQ ID NO: 1116466 - RNA, 14 nt, Homo sapiens
auuuaaauauuaau

SEQ ID NO: 1116467 - RNA, 13 nt, Homo sapiens
auuuaacacuaaa

SEQ ID NO: 1116468 - RNA, 17 nt, Homo sapiens
auuuaaguaauuuugcc

SEQ ID NO: 1116469 - RNA, 19 nt, Homo sapiens
auuuaauaugggugaacac

SEQ ID NO: 1116470 - RNA, 18 nt, Homo sapiens
auuuacagccucacuuga

SEQ ID NO: 1116471 - RNA, 20 nt, Homo sapiens
auuuacagccucacuugaau

SEQ ID NO: 1116472 - RNA, 16 nt, Homo sapiens
auuuacgacugaagaa

SEQ ID NO: 1116473 - RNA, 11 nt, Homo sapiens
auuuacuuaac

SEQ ID NO: 1116474 - RNA, 19 nt, Homo sapiens
auuuacuuaacagaacagu

SEQ ID NO: 1116475 - RNA, 12 nt, Homo sapiens
auuuauauaugu

SEQ ID NO: 1116476 - RNA, 14 nt, Homo sapiens
auuuaucugaauau

SEQ ID NO: 1116477 - RNA, 19 nt, Homo sapiens
auuuaucugugcaaauccu

SEQ ID NO: 1116478 - RNA, 13 nt, Homo sapiens
auuuaugucucag

SEQ ID NO: 1116479 - RNA, 19 nt, Homo sapiens
auuucaaccgcuugccaua

SEQ ID NO: 1116480 - RNA, 20 nt, Homo sapiens
auuucaaccgcuugccauau

SEQ ID NO: 1116481 - RNA, 12 nt, Homo sapiens
auuucaggcaua

SEQ ID NO: 1116482 - RNA, 15 nt, Homo sapiens
auuucauaaacaacu

SEQ ID NO: 1116483 - RNA, 15 nt, Homo sapiens
auuucccccagggaa

SEQ ID NO: 1116484 - RNA, 22 nt, Homo sapiens
auuuccuaaugucagaguagaa

SEQ ID NO: 1116485 - RNA, 19 nt, Homo sapiens
auuuccuccgucaccucag

SEQ ID NO: 1116486 - RNA, 19 nt, Homo sapiens
auuuccuggugauucugau

SEQ ID NO: 1116487 - RNA, 18 nt, Homo sapiens
auuucuggaaaacugccu

SEQ ID NO: 1116488 - RNA, 15 nt, Homo sapiens
accacagugucugua

SEQ ID NO: 1116489 - RNA, 16 nt, Homo sapiens
accaccccuuccuguc

SEQ ID NO: 1116490 - RNA, 18 nt, Homo sapiens
accacuagaacucuccau

SEQ ID NO: 1116491 - RNA, 21 nt, Homo sapiens
accacucaggccaacaagcca

SEQ ID NO: 1116492 - RNA, 23 nt, Homo sapiens
accacucaggccaacaagccaac

SEQ ID NO: 1116493 - RNA, 16 nt, Homo sapiens
accacuuugccucuga

SEQ ID NO: 1116494 - RNA, 19 nt, Homo sapiens
accacuuugucucugagaa

SEQ ID NO: 1116495 - RNA, 13 nt, Homo sapiens
accagaaguggac

SEQ ID NO: 1116496 - RNA, 15 nt, Homo sapiens
accagagcaggaaag

SEQ ID NO: 1116497 - RNA, 17 nt, Homo sapiens
accagaggaaacuugca

SEQ ID NO: 1116498 - RNA, 17 nt, Homo sapiens
accagaggcugcagaag

SEQ ID NO: 1116499 - RNA, 22 nt, Homo sapiens
accagaggcugcagaaggccaa

SEQ ID NO: 1116500 - RNA, 20 nt, Homo sapiens
accagaugaaauaauguucu

SEQ ID NO: 1116501 - RNA, 13 nt, Homo sapiens
accagcaggaaag

SEQ ID NO: 1116502 - RNA, 17 nt, Homo sapiens
accagccuaagaagcuc

SEQ ID NO: 1116503 - RNA, 17 nt, Homo sapiens
accaggacuauagccca

SEQ ID NO: 1116504 - RNA, 14 nt, Homo sapiens
accaguguacugcu

SEQ ID NO: 1116505 - RNA, 15 nt, Homo sapiens
accaguguacugcuu

SEQ ID NO: 1116506 - RNA, 13 nt, Homo sapiens
accaguguagccu

SEQ ID NO: 1116507 - RNA, 21 nt, Homo sapiens
accaguguuauuaaugacaaa

SEQ ID NO: 1116508 - RNA, 17 nt, Homo sapiens
accauagcacaggcuaa

SEQ ID NO: 1116509 - RNA, 17 nt, Homo sapiens
accaugcgcugcucaac

SEQ ID NO: 1116510 - RNA, 12 nt, Homo sapiens
acccaaagacca

SEQ ID NO: 1116511 - RNA, 13 nt, Homo sapiens
acccaacaugacu

SEQ ID NO: 1116512 - RNA, 21 nt, Homo sapiens
acccacaugugacacauaugc

SEQ ID NO: 1116513 - RNA, 23 nt, Homo sapiens
acccacaugugacacauaugcac

SEQ ID NO: 1116514 - RNA, 14 nt, Homo sapiens
acccaccucagccu

SEQ ID NO: 1116515 - RNA, 14 nt, Homo sapiens
acccacuaacaaag

SEQ ID NO: 1116516 - RNA, 21 nt, Homo sapiens
acccacuucuaaauagcaauu

SEQ ID NO: 1116517 - RNA, 15 nt, Homo sapiens
acccagaaaucauuu

SEQ ID NO: 1116518 - RNA, 16 nt, Homo sapiens
acccagagccuucucc

SEQ ID NO: 1116519 - RNA, 13 nt, Homo sapiens
acccagaucucau

SEQ ID NO: 1116520 - RNA, 15 nt, Homo sapiens
acccagauuuccuaa

SEQ ID NO: 1116521 - RNA, 12 nt, Homo sapiens
acccaggaguuu

SEQ ID NO: 1116522 - RNA, 22 nt, Homo sapiens
acccaguaacucaucugucacc

SEQ ID NO: 1116523 - RNA, 16 nt, Homo sapiens
acccaugaaucaaaga

SEQ ID NO: 1116524 - RNA, 15 nt, Homo sapiens
acccaugaggcaaug

SEQ ID NO: 1116525 - RNA, 13 nt, Homo sapiens
acccaugccauag

SEQ ID NO: 1116526 - RNA, 15 nt, Homo sapiens
acccaugccauagaa

SEQ ID NO: 1116527 - RNA, 21 nt, Homo sapiens
acuucuaaaugaagugcaaau

SEQ ID NO: 1116528 - RNA, 19 nt, Homo sapiens
acuucuagagauaguacau

SEQ ID NO: 1116529 - RNA, 18 nt, Homo sapiens
acuucucaggacacaggc

SEQ ID NO: 1116530 - RNA, 23 nt, Homo sapiens
acuucucauuuuuuaaaaaagcu

SEQ ID NO: 1116531 - RNA, 15 nt, Homo sapiens
acuucucuuucuuau

SEQ ID NO: 1116532 - RNA, 17 nt, Homo sapiens
acuugaaauaccaguga

SEQ ID NO: 1116533 - RNA, 17 nt, Homo sapiens
acuugaaauuugccuug

SEQ ID NO: 1116534 - RNA, 17 nt, Homo sapiens
acuugacagaacacugu

SEQ ID NO: 1116535 - RNA, 17 nt, Homo sapiens
acuugcagauacauuca

SEQ ID NO: 1116536 - RNA, 17 nt, Homo sapiens
acuugcauacagagaca

SEQ ID NO: 1116537 - RNA, 23 nt, Homo sapiens
acuugcugcugagugcaccacuu

SEQ ID NO: 1116538 - RNA, 18 nt, Homo sapiens
acuuuaacccucucuucc

SEQ ID NO: 1116539 - RNA, 14 nt, Homo sapiens
acuuuaagauguuu

SEQ ID NO: 1116540 - RNA, 17 nt, Homo sapiens
acuuuaauucucuuacu

SEQ ID NO: 1116541 - RNA, 15 nt, Homo sapiens
acuuuaccacuaugc

SEQ ID NO: 1116542 - RNA, 17 nt, Homo sapiens
acuuuaccacuaugcaa

SEQ ID NO: 1116543 - RNA, 18 nt, Homo sapiens
acuuuaucuaauaccucu

SEQ ID NO: 1116544 - RNA, 18 nt, Homo sapiens
acuuuauguuacuacaug

SEQ ID NO: 1116545 - RNA, 23 nt, Homo sapiens
acuuuauguuacuacaugcacuu

SEQ ID NO: 1116546 - RNA, 18 nt, Homo sapiens
acuuucagguacuaaaua

SEQ ID NO: 1116547 - RNA, 12 nt, Homo sapiens
acuuugacaaau

SEQ ID NO: 1116548 - RNA, 17 nt, Homo sapiens
acuuugggaggccaagg

SEQ ID NO: 1116549 - RNA, 17 nt, Homo sapiens
acuuugguacauggcca

SEQ ID NO: 1116550 - RNA, 17 nt, Homo sapiens
acuuugucucugagaac

SEQ ID NO: 1116551 - RNA, 11 nt, Homo sapiens
acuuugugcaa

SEQ ID NO: 1116552 - RNA, 14 nt, Homo sapiens
acuuuguguucacc

SEQ ID NO: 1116553 - RNA, 18 nt, Homo sapiens
acuuuucaguucaguggc

SEQ ID NO: 1116554 - RNA, 22 nt, Homo sapiens
acuuuuucagaguugcuuuaaa

SEQ ID NO: 1116555 - RNA, 12 nt, Homo sapiens
agaaaaaagaga

SEQ ID NO: 1116556 - RNA, 19 nt, Homo sapiens
agaaaaccagcgcaaggaa

SEQ ID NO: 1116557 - RNA, 18 nt, Homo sapiens
agaaaagugaaugcucaa

SEQ ID NO: 1116558 - RNA, 12 nt, Homo sapiens
agaaaaugcauu

SEQ ID NO: 1116559 - RNA, 12 nt, Homo sapiens
agaaacccaagu

SEQ ID NO: 1116560 - RNA, 19 nt, Homo sapiens
agaaacugaggccauuauu

SEQ ID NO: 1116561 - RNA, 14 nt, Homo sapiens
agaaacuuaaacaa

SEQ ID NO: 1116562 - RNA, 12 nt, Homo sapiens
agaaacuuccuu

SEQ ID NO: 1116563 - RNA, 21 nt, Homo sapiens
agaaagcauccuaaauauauc

SEQ ID NO: 1116564 - RNA, 18 nt, Homo sapiens
agaaagccaggguccuga

SEQ ID NO: 1116565 - RNA, 19 nt, Homo sapiens
agaaagcucugcaugugug

SEQ ID NO: 1116566 - RNA, 22 nt, Homo sapiens
agaaaguacuucuccacccugc

SEQ ID NO: 1116567 - RNA, 18 nt, Homo sapiens
agaaauaaaaauaccucu

SEQ ID NO: 1116568 - RNA, 12 nt, Homo sapiens
agaaauaagccc

SEQ ID NO: 1116569 - RNA, 20 nt, Homo sapiens
agaaaucauggcauucacac

SEQ ID NO: 1116570 - RNA, 15 nt, Homo sapiens
agaaauguauccuga

SEQ ID NO: 1116571 - RNA, 19 nt, Homo sapiens
agaaauuccuguagcaucu

SEQ ID NO: 1116572 - RNA, 22 nt, Homo sapiens
agaaauuccuguagcaucuucu

SEQ ID NO: 1116573 - RNA, 19 nt, Homo sapiens
agaaauuugccaauuuacu

SEQ ID NO: 1116574 - RNA, 17 nt, Homo sapiens
ccgacuccucaaaagca

SEQ ID NO: 1116575 - RNA, 17 nt, Homo sapiens
ccgagagagauggaaua

SEQ ID NO: 1116576 - RNA, 22 nt, Homo sapiens
ccgggaagcggagguugcaggg

SEQ ID NO: 1116577 - RNA, 16 nt, Homo sapiens
ccggggcgaguggcac

SEQ ID NO: 1116578 - RNA, 22 nt, Homo sapiens
ccggugucuggaaaagcacuuu

SEQ ID NO: 1116579 - RNA, 12 nt, Homo sapiens
ccguacauucaa

SEQ ID NO: 1116580 - RNA, 19 nt, Homo sapiens
ccgucaaaagagucuuaau

SEQ ID NO: 1116581 - RNA, 23 nt, Homo sapiens
ccgucagccaaauguaauugaau

SEQ ID NO: 1116582 - RNA, 13 nt, Homo sapiens
ccguucaacuuuu

SEQ ID NO: 1116583 - RNA, 23 nt, Homo sapiens
ccguuuuucaagaaaacuggaaa

SEQ ID NO: 1116584 - RNA, 21 nt, Homo sapiens
ccuaaauguggacaucaugaa

SEQ ID NO: 1116585 - RNA, 22 nt, Homo sapiens
ccuaagcaacagaaauaaucug

SEQ ID NO: 1116586 - RNA, 22 nt, Homo sapiens
ccuaagcacguagagaugauuc

SEQ ID NO: 1116587 - RNA, 16 nt, Homo sapiens
ccuacaguggcuguca

SEQ ID NO: 1116588 - RNA, 15 nt, Homo sapiens
ccuaccacagugucu

SEQ ID NO: 1116589 - RNA, 17 nt, Homo sapiens
ccuacuuacaugcauua

SEQ ID NO: 1116590 - RNA, 19 nt, Homo sapiens
ccuacuuccugcacugacc

SEQ ID NO: 1116591 - RNA, 19 nt, Homo sapiens
ccuacuuuucuuuccucag

SEQ ID NO: 1116592 - RNA, 19 nt, Homo sapiens
ccuagccucgcucuuggca

SEQ ID NO: 1116593 - RNA, 21 nt, Homo sapiens
ccuagccuuagaagucacaca

SEQ ID NO: 1116594 - RNA, 16 nt, Homo sapiens
ccuagcugugaccucu

SEQ ID NO: 1116595 - RNA, 21 nt, Homo sapiens
ccuaggaauucccagcccaaa

SEQ ID NO: 1116596 - RNA, 15 nt, Homo sapiens
ccuauguccuaagga

SEQ ID NO: 1116597 - RNA, 17 nt, Homo sapiens
ccuauuaaaacacagcu

SEQ ID NO: 1116598 - RNA, 23 nt, Homo sapiens
ccucaaacuccuggacucaugca

SEQ ID NO: 1116599 - RNA, 21 nt, Homo sapiens
ccucaaauacauaccuacuga

SEQ ID NO: 1116600 - RNA, 20 nt, Homo sapiens
ccucaaaugacccaaagacc

SEQ ID NO: 1116601 - RNA, 22 nt, Homo sapiens
ccucaacaacguaaacuuccua

SEQ ID NO: 1116602 - RNA, 20 nt, Homo sapiens
ccucacccccagcuuugcua

SEQ ID NO: 1116603 - RNA, 21 nt, Homo sapiens
ccucacuaugacacugagcaa

SEQ ID NO: 1116604 - RNA, 12 nt, Homo sapiens
ccucacugaaaa

SEQ ID NO: 1116605 - RNA, 14 nt, Homo sapiens
ccucagccaugagg

SEQ ID NO: 1116606 - RNA, 19 nt, Homo sapiens
ccucaggccaggugcagug

SEQ ID NO: 1116607 - RNA, 13 nt, Homo sapiens
ccucaggugaucc

SEQ ID NO: 1116608 - RNA, 21 nt, Homo sapiens
ccucaguuuccugaccuauga

SEQ ID NO: 1116609 - RNA, 20 nt, Homo sapiens
ccucaguuuuaucauuuuca

SEQ ID NO: 1116610 - RNA, 17 nt, Homo sapiens
ccucauuuaucccucaa

SEQ ID NO: 1116611 - RNA, 13 nt, Homo sapiens
ccuccaaaugcca

SEQ ID NO: 1116612 - RNA, 17 nt, Homo sapiens
ccuccacaguagcauuu

SEQ ID NO: 1116613 - RNA, 15 nt, Homo sapiens
ccuccauucugacca

SEQ ID NO: 1116614 - RNA, 18 nt, Homo sapiens
ccucccaguuugcugggu

SEQ ID NO: 1116615 - RNA, 10 nt, Homo sapiens
ccucccugaa

SEQ ID NO: 1116616 - RNA, 16 nt, Homo sapiens
ccuccguguagugucu

SEQ ID NO: 1116617 - RNA, 15 nt, Homo sapiens
ccuccuaaauuucca

SEQ ID NO: 1116618 - RNA, 15 nt, Homo sapiens
ccuccugcaccgaga

SEQ ID NO: 1116619 - RNA, 14 nt, Homo sapiens
ccucuauuucucuc

SEQ ID NO: 1116620 - RNA, 17 nt, Homo sapiens
ccucuccuuugugacuu

SEQ ID NO: 1116621 - RNA, 17 nt, Homo sapiens
ccucugcagcacuuuaa

SEQ ID NO: 1116622 - RNA, 12 nt, Homo sapiens
ccucugccucaa

SEQ ID NO: 1116623 - RNA, 13 nt, Homo sapiens
ccucugcucugag

SEQ ID NO: 1116624 - RNA, 16 nt, Homo sapiens
ccucuggauucucugg

SEQ ID NO: 1116625 - RNA, 14 nt, Homo sapiens
ccucuguccaggca

SEQ ID NO: 1116626 - RNA, 16 nt, Homo sapiens
ccucuuccccuugccc

SEQ ID NO: 1116627 - RNA, 18 nt, Homo sapiens
ccucuuccccuugcccuu

SEQ ID NO: 1116628 - RNA, 20 nt, Homo sapiens
ccucuuuauuuuuugauuga

SEQ ID NO: 1116629 - RNA, 14 nt, Homo sapiens
ccugaaaaccaucc

SEQ ID NO: 1116630 - RNA, 17 nt, Homo sapiens
ccugaaccugggaacca

SEQ ID NO: 1116631 - RNA, 13 nt, Homo sapiens
ccugaaggugcug

SEQ ID NO: 1116632 - RNA, 21 nt, Homo sapiens
ccugaaggugcugacaaagau

SEQ ID NO: 1116633 - RNA, 14 nt, Homo sapiens
ccugaagucacaca

SEQ ID NO: 1116634 - RNA, 12 nt, Homo sapiens
ccugaccuguca

SEQ ID NO: 1116635 - RNA, 15 nt, Homo sapiens
ccugacuguguucag

SEQ ID NO: 1116636 - RNA, 19 nt, Homo sapiens
ccugagaaacccaccagcc

SEQ ID NO: 1116637 - RNA, 19 nt, Homo sapiens
ccugagcaacagagugaga

SEQ ID NO: 1116638 - RNA, 24 nt, Homo sapiens
ccugauaaacauuaaacacuguaa

SEQ ID NO: 1116639 - RNA, 16 nt, Homo sapiens
ccugauacuggguaca

SEQ ID NO: 1116640 - RNA, 20 nt, Homo sapiens
ccugcaaagcuaaaauugaa

SEQ ID NO: 1116641 - RNA, 20 nt, Homo sapiens
ccugcagccuccuccugacc

SEQ ID NO: 1116642 - RNA, 22 nt, Homo sapiens
ccugcagccuccuccugaccac

SEQ ID NO: 1116643 - RNA, 19 nt, Homo sapiens
ccugcaggccaagagcaga

SEQ ID NO: 1116644 - RNA, 18 nt, Homo sapiens
ccugccaccagucacugu

SEQ ID NO: 1116645 - RNA, 16 nt, Homo sapiens
ccugcccugcugccgc

SEQ ID NO: 1116646 - RNA, 13 nt, Homo sapiens
ccugccucaggcu

SEQ ID NO: 1116647 - RNA, 13 nt, Homo sapiens
ccugcuaaggagu

SEQ ID NO: 1116648 - RNA, 19 nt, Homo sapiens
ccugcucccagcagcccua

SEQ ID NO: 1116649 - RNA, 13 nt, Homo sapiens
ccugcugagcucu

SEQ ID NO: 1116650 - RNA, 15 nt, Homo sapiens
ccugcugagcucuga

SEQ ID NO: 1116651 - RNA, 16 nt, Homo sapiens
ccugcugagcucugag

SEQ ID NO: 1116652 - RNA, 12 nt, Homo sapiens
ccugcuucucag

SEQ ID NO: 1116653 - RNA, 13 nt, Homo sapiens
ccugcuucucugg

SEQ ID NO: 1116654 - RNA, 21 nt, Homo sapiens
ccuggaacugucucucaugaa

SEQ ID NO: 1116655 - RNA, 15 nt, Homo sapiens
ccuggaagagggcaa

SEQ ID NO: 1116656 - RNA, 20 nt, Homo sapiens
ccuggaaggcagccaggcug

SEQ ID NO: 1116657 - RNA, 18 nt, Homo sapiens
ccuggcaagugggugaaa

SEQ ID NO: 1116658 - RNA, 15 nt, Homo sapiens
ccuggcacacaucag

SEQ ID NO: 1116659 - RNA, 17 nt, Homo sapiens
ccuggccgccuccagga

SEQ ID NO: 1116660 - RNA, 16 nt, Homo sapiens
ccugggaaccaugaag

SEQ ID NO: 1116661 - RNA, 21 nt, Homo sapiens
ccugggaccaguggcagggac

SEQ ID NO: 1116662 - RNA, 14 nt, Homo sapiens
ccugggccuaugga

SEQ ID NO: 1116663 - RNA, 21 nt, Homo sapiens
uuuuaucuuuaaucuccucuu

SEQ ID NO: 1116664 - RNA, 23 nt, Homo sapiens
uuuuauuuuuagacagagucuca

SEQ ID NO: 1116665 - RNA, 21 nt, Homo sapiens
uuuucaaagauguguugcuau

SEQ ID NO: 1116666 - RNA, 14 nt, Homo sapiens
uuuucaacauaacu

SEQ ID NO: 1116667 - RNA, 22 nt, Homo sapiens
uuuucaauuuugcaugcucgau

SEQ ID NO: 1116668 - RNA, 16 nt, Homo sapiens
uuuucucugugcuuca

SEQ ID NO: 1116669 - RNA, 12 nt, Homo sapiens
uuuucugauuug

SEQ ID NO: 1116670 - RNA, 19 nt, Homo sapiens
uuuucuuauuuaacuuaac

SEQ ID NO: 1116671 - RNA, 14 nt, Homo sapiens
uuuugauagcuuua

SEQ ID NO: 1116672 - RNA, 22 nt, Homo sapiens
uuuuggaggguccuccacaaua

SEQ ID NO: 1116673 - RNA, 22 nt, Homo sapiens
uuuugggagaaaacuucucaca

SEQ ID NO: 1116674 - RNA, 13 nt, Homo sapiens
uuuuguuaccuuu

SEQ ID NO: 1116675 - RNA, 15 nt, Homo sapiens
uuuuuccccaaaguc

SEQ ID NO: 1116676 - RNA, 15 nt, Homo sapiens
uuuuucuugugcuga

SEQ ID NO: 1116677 - RNA, 19 nt, Homo sapiens
uuuuuuaaauaaaagcagc

SEQ ID NO: 1116678 - RNA, 21 nt, Homo sapiens
uuuuuuaggaagcaagcuuaa

SEQ ID NO: 1116679 - RNA, 15 nt, Homo sapiens
ucaucuuagcuuucc

SEQ ID NO: 1116680 - RNA, 15 nt, Homo sapiens
ucaugacagccagag

SEQ ID NO: 1116681 - RNA, 16 nt, Homo sapiens
ucaugauuucauuuca

SEQ ID NO: 1116682 - RNA, 15 nt, Homo sapiens
ucaugcaaucuuccu

SEQ ID NO: 1116683 - RNA, 13 nt, Homo sapiens
ucaugccucugag

SEQ ID NO: 1116684 - RNA, 20 nt, Homo sapiens
ucauggcagcuaagccacau

SEQ ID NO: 1116685 - RNA, 13 nt, Homo sapiens
ucauggcauucac

SEQ ID NO: 1116686 - RNA, 23 nt, Homo sapiens
ucauggccauagcuuuuauucau

SEQ ID NO: 1116687 - RNA, 15 nt, Homo sapiens
ucauggugcacugag

SEQ ID NO: 1116688 - RNA, 21 nt, Homo sapiens
ucauguaaaccuaagcacgua

SEQ ID NO: 1116689 - RNA, 12 nt, Homo sapiens
ucaugugccugg

SEQ ID NO: 1116690 - RNA, 20 nt, Homo sapiens
ucauguucuugcagucauca

SEQ ID NO: 1116691 - RNA, 14 nt, Homo sapiens
ucauuagcugugau

SEQ ID NO: 1116692 - RNA, 17 nt, Homo sapiens
ucauucaauaucugaca

SEQ ID NO: 1116693 - RNA, 19 nt, Homo sapiens
ucauucauuuaacagagcu

SEQ ID NO: 1116694 - RNA, 21 nt, Homo sapiens
ucauuccugaaagaaacaguu

SEQ ID NO: 1116695 - RNA, 22 nt, Homo sapiens
ucauuccugaaagaaacaguua

SEQ ID NO: 1116696 - RNA, 21 nt, Homo sapiens
ucauugaaguauuuuccucca

SEQ ID NO: 1116697 - RNA, 14 nt, Homo sapiens
ucauugacuaucaa

SEQ ID NO: 1116698 - RNA, 15 nt, Homo sapiens
ucauuuaucccucaa

SEQ ID NO: 1116699 - RNA, 17 nt, Homo sapiens
ucauuucagauaaacaa

SEQ ID NO: 1116700 - RNA, 13 nt, Homo sapiens
ucauuugaacaac

SEQ ID NO: 1116701 - RNA, 18 nt, Homo sapiens
ucauuuuaacaucugaga

SEQ ID NO: 1116702 - RNA, 19 nt, Homo sapiens
ucauuuuguuauagaaacu

SEQ ID NO: 1116703 - RNA, 21 nt, Homo sapiens
uccaaaacuaauuuccucuga

SEQ ID NO: 1116704 - RNA, 20 nt, Homo sapiens
uccaaagcacauugaaagag

SEQ ID NO: 1116705 - RNA, 16 nt, Homo sapiens
uccaaaggcccuacca

SEQ ID NO: 1116706 - RNA, 16 nt, Homo sapiens
uccaaccgaccagcuu

SEQ ID NO: 1116707 - RNA, 16 nt, Homo sapiens
uccaaccuaaccccuu

SEQ ID NO: 1116708 - RNA, 16 nt, Homo sapiens
uccaacuucccaguuc

SEQ ID NO: 1116709 - RNA, 16 nt, Homo sapiens
uccaauuaugugacaa

SEQ ID NO: 1116710 - RNA, 22 nt, Homo sapiens
uccaauuaugugacaaccuuug

SEQ ID NO: 1116711 - RNA, 14 nt, Homo sapiens
uccacuaaaugagc

SEQ ID NO: 1116712 - RNA, 15 nt, Homo sapiens
uccacugugccaugu

SEQ ID NO: 1116713 - RNA, 22 nt, Homo sapiens
uccacuuaccuagauucuacau

SEQ ID NO: 1116714 - RNA, 19 nt, Homo sapiens
uccagacgucaaccaggaa

SEQ ID NO: 1116715 - RNA, 16 nt, Homo sapiens
uccagaucagauucuu

SEQ ID NO: 1116716 - RNA, 22 nt, Homo sapiens
uccagccaauaaaucaacucca

SEQ ID NO: 1116717 - RNA, 15 nt, Homo sapiens
uccagcucaccagcc

SEQ ID NO: 1116718 - RNA, 21 nt, Homo sapiens
uccaggagcaauuugcacaug

SEQ ID NO: 1116719 - RNA, 17 nt, Homo sapiens
uccaguauccacuuugc

SEQ ID NO: 1116720 - RNA, 15 nt, Homo sapiens
uccagucauuucaau

SEQ ID NO: 1116721 - RNA, 22 nt, Homo sapiens
uccagugggaggugagaccacc

SEQ ID NO: 1116722 - RNA, 23 nt, Homo sapiens
uccagugguaccagcucacuccc

SEQ ID NO: 1116723 - RNA, 14 nt, Homo sapiens
uccaguucaucuau

SEQ ID NO: 1116724 - RNA, 15 nt, Homo sapiens
uccaguucaugagaa

SEQ ID NO: 1116725 - RNA, 18 nt, Homo sapiens
uccauaaacacccaugaa

SEQ ID NO: 1116726 - RNA, 21 nt, Homo sapiens
uccauaaacacccaugaauca

SEQ ID NO: 1116727 - RNA, 21 nt, Homo sapiens
uccauagggccuccuuagauc

SEQ ID NO: 1116728 - RNA, 12 nt, Homo sapiens
uccaucccgaaa

SEQ ID NO: 1116729 - RNA, 14 nt, Homo sapiens
uccaugaagaccac

SEQ ID NO: 1116730 - RNA, 21 nt, Homo sapiens
uccauggcagcuggucuuuau

SEQ ID NO: 1116731 - RNA, 16 nt, Homo sapiens
uccauucaacugaaaa

SEQ ID NO: 1116732 - RNA, 17 nt, Homo sapiens
ucccaaggaaaauggac

SEQ ID NO: 1116733 - RNA, 21 nt, Homo sapiens
ucccaauaaaagugacucuca

SEQ ID NO: 1116734 - RNA, 20 nt, Homo sapiens
ucccacccacaugugacaca

SEQ ID NO: 1116735 - RNA, 21 nt, Homo sapiens
ucccacccacaugugacacau

SEQ ID NO: 1116736 - RNA, 14 nt, Homo sapiens
ucccagagcccagg

SEQ ID NO: 1116737 - RNA, 18 nt, Homo sapiens
ucccagcaugcugagauu

SEQ ID NO: 1116738 - RNA, 20 nt, Homo sapiens
ucccagcaugcugagauuac

SEQ ID NO: 1116739 - RNA, 20 nt, Homo sapiens
ucccagcugcagaugccaca

SEQ ID NO: 1116740 - RNA, 14 nt, Homo sapiens
ucccaguggucaaa

SEQ ID NO: 1116741 - RNA, 14 nt, Homo sapiens
ucccauccaucagc

SEQ ID NO: 1116742 - RNA, 16 nt, Homo sapiens
uccccaaccacuucau

SEQ ID NO: 1116743 - RNA, 18 nt, Homo sapiens
uccccacagaacugcuua

SEQ ID NO: 1116744 - RNA, 22 nt, Homo sapiens
uccccagacuucucuuucuuau

SEQ ID NO: 1116745 - RNA, 18 nt, Homo sapiens
uccccagugcuaccucuc

SEQ ID NO: 1116746 - RNA, 14 nt, Homo sapiens
uccccaucauccca

SEQ ID NO: 1116747 - RNA, 20 nt, Homo sapiens
uccccauucacagagccuuu

SEQ ID NO: 1116748 - RNA, 17 nt, Homo sapiens
ucccccagccucaaguc

SEQ ID NO: 1116749 - RNA, 21 nt, Homo sapiens
uccccucgugugacucucuug

SEQ ID NO: 1116750 - RNA, 13 nt, Homo sapiens
uccccuuccugcc

SEQ ID NO: 1116751 - RNA, 19 nt, Homo sapiens
uccccuugcccuugcccug

SEQ ID NO: 1116752 - RNA, 19 nt, Homo sapiens
ucccucaugagcacagggu

SEQ ID NO: 1116753 - RNA, 20 nt, Homo sapiens
ucccucgcccccacacccca

SEQ ID NO: 1116754 - RNA, 19 nt, Homo sapiens
ucccugggggaagcccugg

SEQ ID NO: 1116755 - RNA, 16 nt, Homo sapiens
ucccuugcuguuuuca

SEQ ID NO: 1116756 - RNA, 16 nt, Homo sapiens
uccgacugcuagggag

SEQ ID NO: 1116757 - RNA, 16 nt, Homo sapiens
uccgcuuucaugaaca

SEQ ID NO: 1116758 - RNA, 23 nt, Homo sapiens
uccggguggaaaagaaucccugc

SEQ ID NO: 1116759 - RNA, 12 nt, Homo sapiens
uccguacauuca

SEQ ID NO: 1116760 - RNA, 15 nt, Homo sapiens
uuuaauacaggguag

SEQ ID NO: 1116761 - RNA, 19 nt, Homo sapiens
uuuaauacaggguagauaa

SEQ ID NO: 1116762 - RNA, 15 nt, Homo sapiens
uuuaauaucugagaa

SEQ ID NO: 1116763 - RNA, 15 nt, Homo sapiens
uuuaauuuugcagau

SEQ ID NO: 1116764 - RNA, 15 nt, Homo sapiens
uuuaauuuuugcaau

SEQ ID NO: 1116765 - RNA, 13 nt, Homo sapiens
uuuacagcugccu

SEQ ID NO: 1116766 - RNA, 15 nt, Homo sapiens
uuuacauucaucuca

SEQ ID NO: 1116767 - RNA, 14 nt, Homo sapiens
uuuaccacuaugca

SEQ ID NO: 1116768 - RNA, 13 nt, Homo sapiens
uuuacuuccucag

SEQ ID NO: 1116769 - RNA, 11 nt, Homo sapiens
uuuacuuuguu

SEQ ID NO: 1116770 - RNA, 13 nt, Homo sapiens
uuuagaagagccu

SEQ ID NO: 1116771 - RNA, 18 nt, Homo sapiens
uuuagauuaaacaaacaa

SEQ ID NO: 1116772 - RNA, 13 nt, Homo sapiens
uuuagauuguuaa

SEQ ID NO: 1116773 - RNA, 19 nt, Homo sapiens
uuuagcguagcuaagugaa

SEQ ID NO: 1116774 - RNA, 14 nt, Homo sapiens
uuuagcuaccucac

SEQ ID NO: 1116775 - RNA, 23 nt, Homo sapiens
uuuagcuaccucacuaugcugcu

SEQ ID NO: 1116776 - RNA, 13 nt, Homo sapiens
uuuaggcauuaaa

SEQ ID NO: 1116777 - RNA, 14 nt, Homo sapiens
uuuauacauaguca

SEQ ID NO: 1116778 - RNA, 22 nt, Homo sapiens
uuuauacucuagaacaugcaca

SEQ ID NO: 1116779 - RNA, 19 nt, Homo sapiens
uuuauauauuugaauauca

SEQ ID NO: 1116780 - RNA, 14 nt, Homo sapiens
uuuaucugugcaaa

SEQ ID NO: 1116781 - RNA, 22 nt, Homo sapiens
uuuaugagacccauuccuauuu

SEQ ID NO: 1116782 - RNA, 12 nt, Homo sapiens
uuuaugcugcug

SEQ ID NO: 1116783 - RNA, 13 nt, Homo sapiens
uuuaugugcaaua

SEQ ID NO: 1116784 - RNA, 18 nt, Homo sapiens
uuuauuaaugaacuguga

SEQ ID NO: 1116785 - RNA, 17 nt, Homo sapiens
uuuauuauuuucaccug

SEQ ID NO: 1116786 - RNA, 15 nt, Homo sapiens
uuuauugcugaauga

SEQ ID NO: 1116787 - RNA, 15 nt, Homo sapiens
uuuauugcuuaaucc

SEQ ID NO: 1116788 - RNA, 14 nt, Homo sapiens
uuuauugugaucua

SEQ ID NO: 1116789 - RNA, 18 nt, Homo sapiens
uuuauuuaagcaucaaau

SEQ ID NO: 1116790 - RNA, 16 nt, Homo sapiens
uuucaacauaucauuu

SEQ ID NO: 1116791 - RNA, 23 nt, Homo sapiens
uuucaagaccuucuccccauucu

SEQ ID NO: 1116792 - RNA, 15 nt, Homo sapiens
uuucaaugaccugua

SEQ ID NO: 1116793 - RNA, 19 nt, Homo sapiens
uuucacauacacucaaaca

SEQ ID NO: 1116794 - RNA, 17 nt, Homo sapiens
uuucaccacaugugcac

SEQ ID NO: 1116795 - RNA, 11 nt, Homo sapiens
uuucaccucau

SEQ ID NO: 1116796 - RNA, 22 nt, Homo sapiens
uuucaguauaauuuaacuucag

SEQ ID NO: 1116797 - RNA, 19 nt, Homo sapiens
uuucagugaaagcaucacu

SEQ ID NO: 1116798 - RNA, 17 nt, Homo sapiens
uuucaucauaacauaaa

SEQ ID NO: 1116799 - RNA, 23 nt, Homo sapiens
uuucauuagaggaagaaaaccag

SEQ ID NO: 1116800 - RNA, 19 nt, Homo sapiens
uuuccaaagggcaguaaag

SEQ ID NO: 1116801 - RNA, 16 nt, Homo sapiens
uuuccaauugaacuuu

SEQ ID NO: 1116802 - RNA, 15 nt, Homo sapiens
uuuccagucauuuca

SEQ ID NO: 1116803 - RNA, 16 nt, Homo sapiens
uuuccagucauuucaa

SEQ ID NO: 1116804 - RNA, 20 nt, Homo sapiens
uuuccaguucaucuauggca

SEQ ID NO: 1116805 - RNA, 15 nt, Homo sapiens
uuucccaauacauac

SEQ ID NO: 1116806 - RNA, 22 nt, Homo sapiens
uuucccaccaccuuggacuccu

SEQ ID NO: 1116807 - RNA, 17 nt, Homo sapiens
uuuccgucuuuguauca

SEQ ID NO: 1116808 - RNA, 19 nt, Homo sapiens
uuuccuaccuauauuacac

SEQ ID NO: 1116809 - RNA, 15 nt, Homo sapiens
uuuccuucagugcau

SEQ ID NO: 1116810 - RNA, 22 nt, Homo sapiens
uuucuaaagcucugaacaaaag

SEQ ID NO: 1116811 - RNA, 18 nt, Homo sapiens
uuucuaacuccagugaag

SEQ ID NO: 1116812 - RNA, 18 nt, Homo sapiens
uuucuaauuggcaugaag

SEQ ID NO: 1116813 - RNA, 15 nt, Homo sapiens
uuucuauagccaaaa

SEQ ID NO: 1116814 - RNA, 16 nt, Homo sapiens
uuucuaucacauauuu

SEQ ID NO: 1116815 - RNA, 17 nt, Homo sapiens
uuucuauucucuccuca

SEQ ID NO: 1116816 - RNA, 16 nt, Homo sapiens
uuucucuaaaacugcc

SEQ ID NO: 1116817 - RNA, 19 nt, Homo sapiens
uuucucuugaagaacugac

SEQ ID NO: 1116818 - RNA, 13 nt, Homo sapiens
uuucucuuugaga

SEQ ID NO: 1116819 - RNA, 17 nt, Homo sapiens
uuucuggaaaacugccu

SEQ ID NO: 1116820 - RNA, 15 nt, Homo sapiens
uuucuggcucuccca

SEQ ID NO: 1116821 - RNA, 17 nt, Homo sapiens
uuucuggggacaccagc

SEQ ID NO: 1116822 - RNA, 17 nt, Homo sapiens
uuucuguugccacaacc

SEQ ID NO: 1116823 - RNA, 19 nt, Homo sapiens
uuucuucuacaaccagagc

SEQ ID NO: 1116824 - RNA, 19 nt, Homo sapiens
uuucuuggucucagcuuca

SEQ ID NO: 1116825 - RNA, 17 nt, Homo sapiens
uuucuuucucacuaaau

SEQ ID NO: 1116826 - RNA, 13 nt, Homo sapiens
uuugaagcaaagc

SEQ ID NO: 1116827 - RNA, 23 nt, Homo sapiens
uuugacaaauugaagauggaugu

SEQ ID NO: 1116828 - RNA, 21 nt, Homo sapiens
uuugagaauaugaucauguaa

SEQ ID NO: 1116829 - RNA, 18 nt, Homo sapiens
uuugagcuggaaagcagc

SEQ ID NO: 1116830 - RNA, 18 nt, Homo sapiens
uuugauacuaagcauuga

SEQ ID NO: 1116831 - RNA, 20 nt, Homo sapiens
uuugauaguugguguucaaa

SEQ ID NO: 1116832 - RNA, 14 nt, Homo sapiens
uuugauucagacag

SEQ ID NO: 1116833 - RNA, 18 nt, Homo sapiens
uuugcaacaagacaaagc

SEQ ID NO: 1116834 - RNA, 13 nt, Homo sapiens
uuugcaagacaua

SEQ ID NO: 1116835 - RNA, 17 nt, Homo sapiens
uuugcuaucacacagug

SEQ ID NO: 1116836 - RNA, 20 nt, Homo sapiens
uuugcugccaaacacccaug

SEQ ID NO: 1116837 - RNA, 17 nt, Homo sapiens
uuuggaugaccagaaca

SEQ ID NO: 1116838 - RNA, 15 nt, Homo sapiens
uuuggggcaggagua

SEQ ID NO: 1116839 - RNA, 10 nt, Homo sapiens
uuuguaaaac

SEQ ID NO: 1116840 - RNA, 16 nt, Homo sapiens
uuuguaauaaacucuc

SEQ ID NO: 1116841 - RNA, 21 nt, Homo sapiens
uuugucagucugggugucuca

SEQ ID NO: 1116842 - RNA, 19 nt, Homo sapiens
uuuguucacuucgaugacu

SEQ ID NO: 1116843 - RNA, 15 nt, Homo sapiens
uuuguugcagccaaa

SEQ ID NO: 1116844 - RNA, 17 nt, Homo sapiens
uuuuaaaaaguugcaca

SEQ ID NO: 1116845 - RNA, 15 nt, Homo sapiens
uuuuaagugccuuua

SEQ ID NO: 1116846 - RNA, 11 nt, Homo sapiens
uuuuaauuucu

SEQ ID NO: 1116847 - RNA, 17 nt, Homo sapiens
uuuuacagugcuauuua

SEQ ID NO: 1116848 - RNA, 16 nt, Homo sapiens
uuuuacuacuguggaa

SEQ ID NO: 1116849 - RNA, 18 nt, Homo sapiens
uuuuaucauuaccauuaa

SEQ ID NO: 1116850 - RNA, 13 nt, Homo sapiens
ucacaaugaaaug

SEQ ID NO: 1116851 - RNA, 15 nt, Homo sapiens
ucacagguugaccaa

SEQ ID NO: 1116852 - RNA, 19 nt, Homo sapiens
ucacaguuagguagcuuua

SEQ ID NO: 1116853 - RNA, 21 nt, Homo sapiens
ucacauacaauuugcacuguu

SEQ ID NO: 1116854 - RNA, 15 nt, Homo sapiens
ucacauagcacagaa

SEQ ID NO: 1116855 - RNA, 20 nt, Homo sapiens
ucacauggccuaugcacaua

SEQ ID NO: 1116856 - RNA, 22 nt, Homo sapiens
ucacauggccuaugcacauaug

SEQ ID NO: 1116857 - RNA, 23 nt, Homo sapiens
ucacauggccuaugcacauaugg

SEQ ID NO: 1116858 - RNA, 16 nt, Homo sapiens
ucaccaauaacuucag

SEQ ID NO: 1116859 - RNA, 17 nt, Homo sapiens
ucaccacaccaaaccuc

SEQ ID NO: 1116860 - RNA, 16 nt, Homo sapiens
ucaccacaugugcaca

SEQ ID NO: 1116861 - RNA, 17 nt, Homo sapiens
ucaccacaugugcacau

SEQ ID NO: 1116862 - RNA, 18 nt, Homo sapiens
ucacccucauaccaucug

SEQ ID NO: 1116863 - RNA, 14 nt, Homo sapiens
ucaccgacaacaug

SEQ ID NO: 1116864 - RNA, 14 nt, Homo sapiens
ucaccggagcuuuc

SEQ ID NO: 1116865 - RNA, 21 nt, Homo sapiens
ucaccguggaccuuccugcca

SEQ ID NO: 1116866 - RNA, 17 nt, Homo sapiens
ucaccuguuacuugaaa

SEQ ID NO: 1116867 - RNA, 22 nt, Homo sapiens
ucacgacucuaccauguccaau

SEQ ID NO: 1116868 - RNA, 20 nt, Homo sapiens
ucacgucgucuucuguauac

SEQ ID NO: 1116869 - RNA, 23 nt, Homo sapiens
ucacgugucuuuagaacuccagu

SEQ ID NO: 1116870 - RNA, 13 nt, Homo sapiens
ucacuagcagcug

SEQ ID NO: 1116871 - RNA, 15 nt, Homo sapiens
ucacuaugacacuga

SEQ ID NO: 1116872 - RNA, 11 nt, Homo sapiens
ucacucaggcu

SEQ ID NO: 1116873 - RNA, 15 nt, Homo sapiens
ucacucuuaugaaau

SEQ ID NO: 1116874 - RNA, 14 nt, Homo sapiens
ucacugcaaccucc

SEQ ID NO: 1116875 - RNA, 17 nt, Homo sapiens
ucacuggaccacugggc

SEQ ID NO: 1116876 - RNA, 11 nt, Homo sapiens
ucacugggcua

SEQ ID NO: 1116877 - RNA, 15 nt, Homo sapiens
ucacugucccucaaa

SEQ ID NO: 1116878 - RNA, 17 nt, Homo sapiens
ucacugucccucaaaug

SEQ ID NO: 1116879 - RNA, 19 nt, Homo sapiens
ucacugucccucaaaugac

SEQ ID NO: 1116880 - RNA, 14 nt, Homo sapiens
ucacuuauuucaua

SEQ ID NO: 1116881 - RNA, 20 nt, Homo sapiens
ucacuuggaagauuuguaua

SEQ ID NO: 1116882 - RNA, 20 nt, Homo sapiens
ucacuugugcaguguugaca

SEQ ID NO: 1116883 - RNA, 14 nt, Homo sapiens
ucacuuguucuuaa

SEQ ID NO: 1116884 - RNA, 20 nt, Homo sapiens
ucacuuuacaaauucaagcc

SEQ ID NO: 1116885 - RNA, 19 nt, Homo sapiens
ucacuuuuuacagugcuau

SEQ ID NO: 1116886 - RNA, 23 nt, Homo sapiens
ucagaaagggagggcucugaggc

SEQ ID NO: 1116887 - RNA, 17 nt, Homo sapiens
ucagaauccacucuucu

SEQ ID NO: 1116888 - RNA, 16 nt, Homo sapiens
ucagaccaacucucuc

SEQ ID NO: 1116889 - RNA, 20 nt, Homo sapiens
ucagacccuaccccaccacg

SEQ ID NO: 1116890 - RNA, 17 nt, Homo sapiens
ucagacuccugugcaac

SEQ ID NO: 1116891 - RNA, 19 nt, Homo sapiens
ucagacuccugugcaacuu

SEQ ID NO: 1116892 - RNA, 14 nt, Homo sapiens
ucagagaagucagu

SEQ ID NO: 1116893 - RNA, 18 nt, Homo sapiens
ucagagggcguguuguuu

SEQ ID NO: 1116894 - RNA, 15 nt, Homo sapiens
ucagauagaaugaca

SEQ ID NO: 1116895 - RNA, 12 nt, Homo sapiens
ucagauggacaa

SEQ ID NO: 1116896 - RNA, 18 nt, Homo sapiens
ucagauggacaagauuac

SEQ ID NO: 1116897 - RNA, 14 nt, Homo sapiens
ucagcaaagagugg

SEQ ID NO: 1116898 - RNA, 17 nt, Homo sapiens
ucagcaauacuaaggga

SEQ ID NO: 1116899 - RNA, 14 nt, Homo sapiens
ucagcauaccugcu

SEQ ID NO: 1116900 - RNA, 12 nt, Homo sapiens
ucagccaugagg

SEQ ID NO: 1116901 - RNA, 14 nt, Homo sapiens
ucagccucccaaag

SEQ ID NO: 1116902 - RNA, 19 nt, Homo sapiens
ucagccucccgaauagcug

SEQ ID NO: 1116903 - RNA, 13 nt, Homo sapiens
ucagccucugauc

SEQ ID NO: 1116904 - RNA, 14 nt, Homo sapiens
ucagccugagucuc

SEQ ID NO: 1116905 - RNA, 19 nt, Homo sapiens
ucaggagagaguugaaccu

SEQ ID NO: 1116906 - RNA, 13 nt, Homo sapiens
ucaggagucccaa

SEQ ID NO: 1116907 - RNA, 17 nt, Homo sapiens
ucaggaguucgagacca

SEQ ID NO: 1116908 - RNA, 15 nt, Homo sapiens
ucaggauaccauaua

SEQ ID NO: 1116909 - RNA, 15 nt, Homo sapiens
ucaggaucaucugag

SEQ ID NO: 1116910 - RNA, 17 nt, Homo sapiens
ucaggcaaagugcugcu

SEQ ID NO: 1116911 - RNA, 18 nt, Homo sapiens
ucaggccaggugcagugg

SEQ ID NO: 1116912 - RNA, 15 nt, Homo sapiens
ucaggcuucugagua

SEQ ID NO: 1116913 - RNA, 21 nt, Homo sapiens
ucaggguccagacccugaaga

SEQ ID NO: 1116914 - RNA, 16 nt, Homo sapiens
ucagguggggcagcuu

SEQ ID NO: 1116915 - RNA, 22 nt, Homo sapiens
ucaggugucccugcacuugcag

SEQ ID NO: 1116916 - RNA, 18 nt, Homo sapiens
ucaguaaacaaugaauag

SEQ ID NO: 1116917 - RNA, 18 nt, Homo sapiens
ucaguauaauuuaacuuc

SEQ ID NO: 1116918 - RNA, 20 nt, Homo sapiens
ucagucgguguguaaucacg

SEQ ID NO: 1116919 - RNA, 19 nt, Homo sapiens
ucagucugggugggacuua

SEQ ID NO: 1116920 - RNA, 19 nt, Homo sapiens
ucaguggcauucacaucuc

SEQ ID NO: 1116921 - RNA, 22 nt, Homo sapiens
ucaguguagaaccuaauucaau

SEQ ID NO: 1116922 - RNA, 18 nt, Homo sapiens
ucaguuacucagcccugg

SEQ ID NO: 1116923 - RNA, 15 nt, Homo sapiens
ucauaaauauaaucu

SEQ ID NO: 1116924 - RNA, 16 nt, Homo sapiens
ucauaaccuuaccaga

SEQ ID NO: 1116925 - RNA, 21 nt, Homo sapiens
ucauaagaaugaauaauaauu

SEQ ID NO: 1116926 - RNA, 16 nt, Homo sapiens
ucauaaguuggaccag

SEQ ID NO: 1116927 - RNA, 15 nt, Homo sapiens
ucauacagauuugca

SEQ ID NO: 1116928 - RNA, 22 nt, Homo sapiens
ucauaugguugacaguaugcau

SEQ ID NO: 1116929 - RNA, 22 nt, Homo sapiens
ucauauuggacugauaaucucu

SEQ ID NO: 1116930 - RNA, 20 nt, Homo sapiens
ucaucaaauauuaccaaaaa

SEQ ID NO: 1116931 - RNA, 22 nt, Homo sapiens
ucaucaauuuuuauacauauca

SEQ ID NO: 1116932 - RNA, 20 nt, Homo sapiens
ucaucaccuguuaucugugu

SEQ ID NO: 1116933 - RNA, 20 nt, Homo sapiens
ggagguggagguugcaguga

SEQ ID NO: 1116934 - RNA, 22 nt, Homo sapiens
ggagguugcagugagcugagau

SEQ ID NO: 1116935 - RNA, 18 nt, Homo sapiens
gcuggcagccacccccuc

SEQ ID NO: 1116936 - RNA, 20 nt, Homo sapiens
gcuggcgugcaguggugcga

SEQ ID NO: 1116937 - RNA, 13 nt, Homo sapiens
gcuggcugcagug

SEQ ID NO: 1116938 - RNA, 20 nt, Homo sapiens
gccucaggggccucagggga

SEQ ID NO: 1116939 - RNA, 13 nt, Homo sapiens
gccucaucuucaa

SEQ ID NO: 1116940 - RNA, 18 nt, Homo sapiens
gccuccaaggggcuuugu

SEQ ID NO: 1116941 - RNA, 20 nt, Homo sapiens
gccuccauucugaccauuuc

SEQ ID NO: 1116942 - RNA, 19 nt, Homo sapiens
cggguguguacaccaaggu

SEQ ID NO: 1116943 - RNA, 12 nt, Homo sapiens
cguacauucaau

SEQ ID NO: 1116944 - RNA, 15 nt, Homo sapiens
cgucuccuuugacau

SEQ ID NO: 1116945 - RNA, 19 nt, Homo sapiens
cgucuucuguauacugugg

SEQ ID NO: 1116946 - RNA, 13 nt, Homo sapiens
cgugauaaugcag

SEQ ID NO: 1116947 - RNA, 14 nt, Homo sapiens
cgugccaguguccc

SEQ ID NO: 1116948 - RNA, 14 nt, Homo sapiens
cguggacucugcac

SEQ ID NO: 1116949 - RNA, 21 nt, Homo sapiens
cguggacucugcacaugucuu

SEQ ID NO: 1116950 - RNA, 18 nt, Homo sapiens
cguguagugucuguaaua

SEQ ID NO: 1116951 - RNA, 16 nt, Homo sapiens
cgugugcagacugugg

SEQ ID NO: 1116952 - RNA, 23 nt, Homo sapiens
cguuaguguauuuuauguguggc

SEQ ID NO: 1116953 - RNA, 19 nt, Homo sapiens
cguuccuuccgaugacagu

SEQ ID NO: 1116954 - RNA, 14 nt, Homo sapiens
cuaaaaaacagagg

SEQ ID NO: 1116955 - RNA, 18 nt, Homo sapiens
cuaaaaaacagaggccau

SEQ ID NO: 1116956 - RNA, 22 nt, Homo sapiens
cuaaaaaacagaggccauggca

SEQ ID NO: 1116957 - RNA, 13 nt, Homo sapiens
cuaaaaauacaaa

SEQ ID NO: 1116958 - RNA, 19 nt, Homo sapiens
cuaaaauaaaaaccagaau

SEQ ID NO: 1116959 - RNA, 17 nt, Homo sapiens
cuaaacaacuaccuccu

SEQ ID NO: 1116960 - RNA, 16 nt, Homo sapiens
cuaaagguuguauugc

SEQ ID NO: 1116961 - RNA, 19 nt, Homo sapiens
cuaaagguuguauugcaua

SEQ ID NO: 1116962 - RNA, 16 nt, Homo sapiens
cuaaauaccucaauca

SEQ ID NO: 1116963 - RNA, 14 nt, Homo sapiens
cuaaauaggagaua

SEQ ID NO: 1116964 - RNA, 13 nt, Homo sapiens
cuaaauccaaaga

SEQ ID NO: 1116965 - RNA, 18 nt, Homo sapiens
cuaaauccuuuacuguua

SEQ ID NO: 1116966 - RNA, 15 nt, Homo sapiens
cuaaaugaagugcaa

SEQ ID NO: 1116967 - RNA, 16 nt, Homo sapiens
cuaaaugaagugcaaa

SEQ ID NO: 1116968 - RNA, 18 nt, Homo sapiens
cuaaaugaauguuuacac

SEQ ID NO: 1116969 - RNA, 15 nt, Homo sapiens
cuaacacagccauca

SEQ ID NO: 1116970 - RNA, 17 nt, Homo sapiens
cuaaccagccuggucaa

SEQ ID NO: 1116971 - RNA, 13 nt, Homo sapiens
cuaacuagcuugg

SEQ ID NO: 1116972 - RNA, 19 nt, Homo sapiens
cuaacuguaugugucuuua

SEQ ID NO: 1116973 - RNA, 20 nt, Homo sapiens
cuaagaagcgagcacugacc

SEQ ID NO: 1116974 - RNA, 14 nt, Homo sapiens
cuaaggaucucuca

SEQ ID NO: 1116975 - RNA, 15 nt, Homo sapiens
cuaaugauuagcacu

SEQ ID NO: 1116976 - RNA, 19 nt, Homo sapiens
cuaaugauuagcacuuaau

SEQ ID NO: 1116977 - RNA, 22 nt, Homo sapiens
cuaauuaaaaaguuaaucuuca

SEQ ID NO: 1116978 - RNA, 19 nt, Homo sapiens
cuaauuggaagaaauuccu

SEQ ID NO: 1116979 - RNA, 18 nt, Homo sapiens
cuaauuggccucuuuaag

SEQ ID NO: 1116980 - RNA, 14 nt, Homo sapiens
cuacaaauuaucau

SEQ ID NO: 1116981 - RNA, 22 nt, Homo sapiens
cuacacaguaaaaacuuguacu

SEQ ID NO: 1116982 - RNA, 19 nt, Homo sapiens
cuacagauagucaaaccau

SEQ ID NO: 1116983 - RNA, 14 nt, Homo sapiens
cuacagauuuuaga

SEQ ID NO: 1116984 - RNA, 22 nt, Homo sapiens
cuacaguggcugucacgcagcc

SEQ ID NO: 1116985 - RNA, 13 nt, Homo sapiens
cuaccacaguguc

SEQ ID NO: 1116986 - RNA, 23 nt, Homo sapiens
cuacccugcuggggaaaguacaa

SEQ ID NO: 1116987 - RNA, 19 nt, Homo sapiens
cuacucaagaggcugaggc

SEQ ID NO: 1116988 - RNA, 17 nt, Homo sapiens
cuacugagacaugacua

SEQ ID NO: 1116989 - RNA, 17 nt, Homo sapiens
cuacuucuuuugcucuu

SEQ ID NO: 1116990 - RNA, 20 nt, Homo sapiens
cuacuugggaggcugaggca

SEQ ID NO: 1116991 - RNA, 15 nt, Homo sapiens
cuacuuguaaaggug

SEQ ID NO: 1116992 - RNA, 16 nt, Homo sapiens
cuacuuguaaaggugc

SEQ ID NO: 1116993 - RNA, 15 nt, Homo sapiens
cuacuuuuuauacuc

SEQ ID NO: 1116994 - RNA, 16 nt, Homo sapiens
cuacuuuuuauacucc

SEQ ID NO: 1116995 - RNA, 15 nt, Homo sapiens
cuagaaaucugccaa

SEQ ID NO: 1116996 - RNA, 12 nt, Homo sapiens
cuagaaggccac

SEQ ID NO: 1116997 - RNA, 23 nt, Homo sapiens
cuagagaagaggcuggugcugug

SEQ ID NO: 1116998 - RNA, 23 nt, Homo sapiens
cuagagauauggcagcgaaagga

SEQ ID NO: 1116999 - RNA, 14 nt, Homo sapiens
cuagagaugacuga

SEQ ID NO: 1117000 - RNA, 14 nt, Homo sapiens
cuagaucaauuaau

SEQ ID NO: 1117001 - RNA, 17 nt, Homo sapiens
cuagcaucucaugagug

SEQ ID NO: 1117002 - RNA, 21 nt, Homo sapiens
cuagcaucucaugagugccaa

SEQ ID NO: 1117003 - RNA, 14 nt, Homo sapiens
cuagccgaccucag

SEQ ID NO: 1117004 - RNA, 19 nt, Homo sapiens
cuaggagcugggaggaaaa

SEQ ID NO: 1117005 - RNA, 18 nt, Homo sapiens
cuaggccacaccaucucc

SEQ ID NO: 1117006 - RNA, 18 nt, Homo sapiens
cuaggggucaggcuccau

SEQ ID NO: 1117007 - RNA, 22 nt, Homo sapiens
cuagggucaggcggggugcugu

SEQ ID NO: 1117008 - RNA, 12 nt, Homo sapiens
cuaggucuguaa

SEQ ID NO: 1117009 - RNA, 21 nt, Homo sapiens
cuaguaccacagaaguucaau

SEQ ID NO: 1117010 - RNA, 13 nt, Homo sapiens
cuagucauaaccu

SEQ ID NO: 1117011 - RNA, 16 nt, Homo sapiens
cuauaaaaaaaugcau

SEQ ID NO: 1117012 - RNA, 14 nt, Homo sapiens
cuauaaaaugaaua

SEQ ID NO: 1117013 - RNA, 18 nt, Homo sapiens
cuauagccuaggugacag

SEQ ID NO: 1117014 - RNA, 23 nt, Homo sapiens
cuauagccuaggugacagaguga

SEQ ID NO: 1117015 - RNA, 12 nt, Homo sapiens
cuauagucccag

SEQ ID NO: 1117016 - RNA, 17 nt, Homo sapiens
cuauauacuauaugauu

SEQ ID NO: 1117017 - RNA, 21 nt, Homo sapiens
gcagucccagcuacucaggag

SEQ ID NO: 1117018 - RNA, 18 nt, Homo sapiens
gcagugacgugcaccugu

SEQ ID NO: 1117019 - RNA, 15 nt, Homo sapiens
gcagugacuuuagaa

SEQ ID NO: 1117020 - RNA, 21 nt, Homo sapiens
gcaguguuucccguauugaca

SEQ ID NO: 1117021 - RNA, 22 nt, Homo sapiens
gcaguugaaacaagaagccaca

SEQ ID NO: 1117022 - RNA, 21 nt, Homo sapiens
agguuggccuuacgaaauccu

SEQ ID NO: 1117023 - RNA, 20 nt, Homo sapiens
agguuucaccugaucauaua

SEQ ID NO: 1117024 - RNA, 22 nt, Homo sapiens
agguuuuuggucugacccacug

SEQ ID NO: 1117025 - RNA, 22 nt, Homo sapiens
aguaaguuugauuucauuaaua

SEQ ID NO: 1117026 - RNA, 14 nt, Homo sapiens
aguaauagggcccu

SEQ ID NO: 1117027 - RNA, 19 nt, Homo sapiens
aguaaucaaguuaaaaccu

SEQ ID NO: 1117028 - RNA, 20 nt, Homo sapiens
aguaauuuugugaaagaagg

SEQ ID NO: 1117029 - RNA, 18 nt, Homo sapiens
aguacaaacacaggauuu

SEQ ID NO: 1117030 - RNA, 12 nt, Homo sapiens
aguacaaccuga

SEQ ID NO: 1117031 - RNA, 13 nt, Homo sapiens
aguacagaugcag

SEQ ID NO: 1117032 - RNA, 18 nt, Homo sapiens
aguaccacagaaguucaa

SEQ ID NO: 1117033 - RNA, 15 nt, Homo sapiens
aguagaaauuguucc

SEQ ID NO: 1117034 - RNA, 18 nt, Homo sapiens
aguagacuauaagcagaa

SEQ ID NO: 1117035 - RNA, 18 nt, Homo sapiens
aguagagggcacuggguc

SEQ ID NO: 1117036 - RNA, 13 nt, Homo sapiens
aguagcugagcuc

SEQ ID NO: 1117037 - RNA, 14 nt, Homo sapiens
aguagcugggacua

SEQ ID NO: 1117038 - RNA, 20 nt, Homo sapiens
aguaucacauagaagcuguc

SEQ ID NO: 1117039 - RNA, 14 nt, Homo sapiens
aguaugagggaaaa

SEQ ID NO: 1117040 - RNA, 18 nt, Homo sapiens
aguauggcaugaacaucu

SEQ ID NO: 1117041 - RNA, 20 nt, Homo sapiens
aguauuuuaucugccuuaga

SEQ ID NO: 1117042 - RNA, 17 nt, Homo sapiens
agucaaaaggugccugu

SEQ ID NO: 1117043 - RNA, 12 nt, Homo sapiens
caaugauucaua

SEQ ID NO: 1117044 - RNA, 14 nt, Homo sapiens
caaugcauugcuaa

SEQ ID NO: 1117045 - RNA, 15 nt, Homo sapiens
caauguuagccucaa

SEQ ID NO: 1117046 - RNA, 23 nt, Homo sapiens
caauuaauucuuaauaggcuuua

SEQ ID NO: 1117047 - RNA, 23 nt, Homo sapiens
caauuauggagugucaccagcug

SEQ ID NO: 1117048 - RNA, 13 nt, Homo sapiens
caauuaugugaca

SEQ ID NO: 1117049 - RNA, 21 nt, Homo sapiens
caauucaaaacauugugccau

SEQ ID NO: 1117050 - RNA, 17 nt, Homo sapiens
caauucacuagaccaga

SEQ ID NO: 1117051 - RNA, 13 nt, Homo sapiens
caauuccucuggg

SEQ ID NO: 1117052 - RNA, 15 nt, Homo sapiens
caauuccucugggaa

SEQ ID NO: 1117053 - RNA, 20 nt, Homo sapiens
caauucuaacuuuuuugcua

SEQ ID NO: 1117054 - RNA, 16 nt, Homo sapiens
caauucuacccagagc

SEQ ID NO: 1117055 - RNA, 21 nt, Homo sapiens
caauugucauuuauaaaacca

SEQ ID NO: 1117056 - RNA, 13 nt, Homo sapiens
caauuugcugcca

SEQ ID NO: 1117057 - RNA, 15 nt, Homo sapiens
caauuuuuauacaua

SEQ ID NO: 1117058 - RNA, 18 nt, Homo sapiens
caauuuuuauacauauca

SEQ ID NO: 1117059 - RNA, 15 nt, Homo sapiens
cacaacacacacacu

SEQ ID NO: 1117060 - RNA, 17 nt, Homo sapiens
cacaaccagccacacag

SEQ ID NO: 1117061 - RNA, 16 nt, Homo sapiens
cacaacccuguuuuau

SEQ ID NO: 1117062 - RNA, 22 nt, Homo sapiens
cacaagaagaccagacugugga

SEQ ID NO: 1117063 - RNA, 20 nt, Homo sapiens
cacaauaaaggcugagcucu

SEQ ID NO: 1117064 - RNA, 19 nt, Homo sapiens
cacaauaauuuucuaccug

SEQ ID NO: 1117065 - RNA, 20 nt, Homo sapiens
cacaauagcaguugaaacaa

SEQ ID NO: 1117066 - RNA, 22 nt, Homo sapiens
cacaauuccauuuccaguucau

SEQ ID NO: 1117067 - RNA, 21 nt, Homo sapiens
cacacaccccucaaaaaaagc

SEQ ID NO: 1117068 - RNA, 13 nt, Homo sapiens
cacacagcacucu

SEQ ID NO: 1117069 - RNA, 16 nt, Homo sapiens
cacacagcacucucua

SEQ ID NO: 1117070 - RNA, 20 nt, Homo sapiens
cacaccccucaaaaaaagcc

SEQ ID NO: 1117071 - RNA, 17 nt, Homo sapiens
cacaccuagcaucucau

SEQ ID NO: 1117072 - RNA, 19 nt, Homo sapiens
cacaccucuccuuugugac

SEQ ID NO: 1117073 - RNA, 13 nt, Homo sapiens
cacacugagcugg

SEQ ID NO: 1117074 - RNA, 15 nt, Homo sapiens
cacacuggugacugc

SEQ ID NO: 1117075 - RNA, 12 nt, Homo sapiens
ugggaauugcau

SEQ ID NO: 1117076 - RNA, 13 nt, Homo sapiens
ugggaauugcaug

SEQ ID NO: 1117077 - RNA, 17 nt, Homo sapiens
ugggaauuuucuuccaa

SEQ ID NO: 1117078 - RNA, 12 nt, Homo sapiens
ugggacacaguu

SEQ ID NO: 1117079 - RNA, 23 nt, Homo sapiens
ugggaccucaguuuuaucauuuu

SEQ ID NO: 1117080 - RNA, 14 nt, Homo sapiens
ugggacuuauguau

SEQ ID NO: 1117081 - RNA, 12 nt, Homo sapiens
ugggagagccag

SEQ ID NO: 1117082 - RNA, 19 nt, Homo sapiens
ugggauuacaggugugaac

SEQ ID NO: 1117083 - RNA, 18 nt, Homo sapiens
ugggcaaagcugugcacu

SEQ ID NO: 1117084 - RNA, 18 nt, Homo sapiens
ugggcaacagagcaagau

SEQ ID NO: 1117085 - RNA, 15 nt, Homo sapiens
ugggcagcagcucag

SEQ ID NO: 1117086 - RNA, 21 nt, Homo sapiens
ugggcucgccacaucccauga

SEQ ID NO: 1117087 - RNA, 19 nt, Homo sapiens
ugggcugggcucgccacau

SEQ ID NO: 1117088 - RNA, 14 nt, Homo sapiens
ugggcuucugucca

SEQ ID NO: 1117089 - RNA, 18 nt, Homo sapiens
uggggaagaccuuguccc

SEQ ID NO: 1117090 - RNA, 14 nt, Homo sapiens
uggggaagacugug

SEQ ID NO: 1117091 - RNA, 10 nt, Homo sapiens
uggggcuccu

SEQ ID NO: 1117092 - RNA, 18 nt, Homo sapiens
uggggcuuuuacaccagu

SEQ ID NO: 1117093 - RNA, 19 nt, Homo sapiens
uggggucuugcuauauugc

SEQ ID NO: 1117094 - RNA, 16 nt, Homo sapiens
ugguaacugcacacau

SEQ ID NO: 1117095 - RNA, 19 nt, Homo sapiens
ugguaauaaguacugugua

SEQ ID NO: 1117096 - RNA, 19 nt, Homo sapiens
ugguaccacuggaaucgau

SEQ ID NO: 1117097 - RNA, 13 nt, Homo sapiens
ugguaccagcuca

SEQ ID NO: 1117098 - RNA, 12 nt, Homo sapiens
ugguaugaaggu

SEQ ID NO: 1117099 - RNA, 12 nt, Homo sapiens
ugguaugaucac

SEQ ID NO: 1117100 - RNA, 13 nt, Homo sapiens
ugguccagcucuu

SEQ ID NO: 1117101 - RNA, 14 nt, Homo sapiens
ugguccgaucuuug

SEQ ID NO: 1117102 - RNA, 23 nt, Homo sapiens
ugguccgccacgaggagcuucca

SEQ ID NO: 1117103 - RNA, 12 nt, Homo sapiens
uggucuuugaau

SEQ ID NO: 1117104 - RNA, 22 nt, Homo sapiens
uggugagaaucgaccucacugu

SEQ ID NO: 1117105 - RNA, 14 nt, Homo sapiens
ugguggaccacagg

SEQ ID NO: 1117106 - RNA, 15 nt, Homo sapiens
ugguggagaaccaca

SEQ ID NO: 1117107 - RNA, 17 nt, Homo sapiens
uggugggggcagggaug

SEQ ID NO: 1117108 - RNA, 22 nt, Homo sapiens
ugguguaaagccaacacccugu

SEQ ID NO: 1117109 - RNA, 11 nt, Homo sapiens
uggugucuguc

SEQ ID NO: 1117110 - RNA, 21 nt, Homo sapiens
ugguguggccagcacucugaa

SEQ ID NO: 1117111 - RNA, 17 nt, Homo sapiens
ugguguugacaugugcu

SEQ ID NO: 1117112 - RNA, 18 nt, Homo sapiens
ugguguuuacccaguauu

SEQ ID NO: 1117113 - RNA, 23 nt, Homo sapiens
ugguuacagcccagacuuuacca

SEQ ID NO: 1117114 - RNA, 14 nt, Homo sapiens
ugguucaggguugg

SEQ ID NO: 1117115 - RNA, 18 nt, Homo sapiens
uguaaaacuauauucuca

SEQ ID NO: 1117116 - RNA, 18 nt, Homo sapiens
uguaaaagagucaucugg

SEQ ID NO: 1117117 - RNA, 19 nt, Homo sapiens
uguaaaauaaguauuucca

SEQ ID NO: 1117118 - RNA, 19 nt, Homo sapiens
uguaaaauagaauguuacu

SEQ ID NO: 1117119 - RNA, 21 nt, Homo sapiens
uguaaaauauuuaugagaaag

SEQ ID NO: 1117120 - RNA, 23 nt, Homo sapiens
uguaaaaugucuguuaacuuaau

SEQ ID NO: 1117121 - RNA, 22 nt, Homo sapiens
uguaaaccaucgcgugcaauga

SEQ ID NO: 1117122 - RNA, 16 nt, Homo sapiens
uguaaacccucaaggg

SEQ ID NO: 1117123 - RNA, 17 nt, Homo sapiens
uguaacacugcaagaag

SEQ ID NO: 1117124 - RNA, 16 nt, Homo sapiens
uguaaggaacuggaac

SEQ ID NO: 1117125 - RNA, 15 nt, Homo sapiens
uguaagguaauuucu

SEQ ID NO: 1117126 - RNA, 16 nt, Homo sapiens
uguaauaaacucucua

SEQ ID NO: 1117127 - RNA, 19 nt, Homo sapiens
uguaauaaacucucuaggg

SEQ ID NO: 1117128 - RNA, 20 nt, Homo sapiens
uguaaucccagcacuuuggc

SEQ ID NO: 1117129 - RNA, 15 nt, Homo sapiens
uguacaaagauaugc

SEQ ID NO: 1117130 - RNA, 15 nt, Homo sapiens
uguacagacguaugc

SEQ ID NO: 1117131 - RNA, 22 nt, Homo sapiens
uguacauuccugauacugggua

SEQ ID NO: 1117132 - RNA, 17 nt, Homo sapiens
uguacauuugagugucu

SEQ ID NO: 1117133 - RNA, 14 nt, Homo sapiens
ugcuaaggcugccu

SEQ ID NO: 1117134 - RNA, 20 nt, Homo sapiens
ugcuacaaauacucuuagga

SEQ ID NO: 1117135 - RNA, 16 nt, Homo sapiens
ugcuaccucacugggg

SEQ ID NO: 1117136 - RNA, 20 nt, Homo sapiens
ugcuagacaagcuuguccau

SEQ ID NO: 1117137 - RNA, 19 nt, Homo sapiens
ugcuaugaagcguugaugg

SEQ ID NO: 1117138 - RNA, 23 nt, Homo sapiens
ugcuaugguuuucuccaagagcu

SEQ ID NO: 1117139 - RNA, 16 nt, Homo sapiens
ugcuauugacaaguca

SEQ ID NO: 1117140 - RNA, 16 nt, Homo sapiens
ugcucaaccacugugg

SEQ ID NO: 1117141 - RNA, 23 nt, Homo sapiens
ugcucaccaagcuguuccacuuc

SEQ ID NO: 1117142 - RNA, 20 nt, Homo sapiens
ugcucacugaccugccugua

SEQ ID NO: 1117143 - RNA, 21 nt, Homo sapiens
ugcucauucauuuaacagagc

SEQ ID NO: 1117144 - RNA, 21 nt, Homo sapiens
ugcuccccagugcuaccucuc

SEQ ID NO: 1117145 - RNA, 15 nt, Homo sapiens
ugcugagcauguacu

SEQ ID NO: 1117146 - RNA, 19 nt, Homo sapiens
ugcugcugagugcaccacu

SEQ ID NO: 1117147 - RNA, 23 nt, Homo sapiens
ugcugcugagugcaccacuucaa

SEQ ID NO: 1117148 - RNA, 22 nt, Homo sapiens
ugcuggaaguagaauuugucca

SEQ ID NO: 1117149 - RNA, 18 nt, Homo sapiens
ugcuggccuggaucuccc

SEQ ID NO: 1117150 - RNA, 18 nt, Homo sapiens
ugcugggcucuccaccuc

SEQ ID NO: 1117151 - RNA, 20 nt, Homo sapiens
ugcuggggacagguccucag

SEQ ID NO: 1117152 - RNA, 18 nt, Homo sapiens
ugcuguggacaccaccua

SEQ ID NO: 1117153 - RNA, 16 nt, Homo sapiens
ugcuuaccugugagau

SEQ ID NO: 1117154 - RNA, 16 nt, Homo sapiens
ugcuuaugacaucacu

SEQ ID NO: 1117155 - RNA, 13 nt, Homo sapiens
ugcuucagccucc

SEQ ID NO: 1117156 - RNA, 13 nt, Homo sapiens
ugcuugacuauca

SEQ ID NO: 1117157 - RNA, 13 nt, Homo sapiens
ugcuuugacucac

SEQ ID NO: 1117158 - RNA, 14 nt, Homo sapiens
ugcuuugaggacaa

SEQ ID NO: 1117159 - RNA, 13 nt, Homo sapiens
ugcuuugcaggaa

SEQ ID NO: 1117160 - RNA, 19 nt, Homo sapiens
ugcuuuucuaaucuuguua

SEQ ID NO: 1117161 - RNA, 23 nt, Homo sapiens
uggaaaaaagagaaaaaccaaug

SEQ ID NO: 1117162 - RNA, 17 nt, Homo sapiens
uggaaaaauacugccua

SEQ ID NO: 1117163 - RNA, 13 nt, Homo sapiens
uggaaaagcaaaa

SEQ ID NO: 1117164 - RNA, 21 nt, Homo sapiens
uggaaaagucacacagacaca

SEQ ID NO: 1117165 - RNA, 15 nt, Homo sapiens
uggaaaaugugcaau

SEQ ID NO: 1117166 - RNA, 20 nt, Homo sapiens
uggaaagccucugcugccau

SEQ ID NO: 1117167 - RNA, 17 nt, Homo sapiens
uggaacacacauguccu

SEQ ID NO: 1117168 - RNA, 19 nt, Homo sapiens
uggaacacucucugagaug

SEQ ID NO: 1117169 - RNA, 15 nt, Homo sapiens
uggaacucaaggaaa

SEQ ID NO: 1117170 - RNA, 18 nt, Homo sapiens
uggaacuugaacugauuc

SEQ ID NO: 1117171 - RNA, 12 nt, Homo sapiens
uggaagauuugu

SEQ ID NO: 1117172 - RNA, 15 nt, Homo sapiens
uggaagcacaugugu

SEQ ID NO: 1117173 - RNA, 17 nt, Homo sapiens
uggaagcucugaaguca

SEQ ID NO: 1117174 - RNA, 14 nt, Homo sapiens
uggaauaaagcccu

SEQ ID NO: 1117175 - RNA, 12 nt, Homo sapiens
uggacacagcuc

SEQ ID NO: 1117176 - RNA, 14 nt, Homo sapiens
uggacgaacagggg

SEQ ID NO: 1117177 - RNA, 18 nt, Homo sapiens
uggacgaacaggggccaa

SEQ ID NO: 1117178 - RNA, 16 nt, Homo sapiens
uggacugauaaucucu

SEQ ID NO: 1117179 - RNA, 22 nt, Homo sapiens
uggagaaauuccuugauucaca

SEQ ID NO: 1117180 - RNA, 14 nt, Homo sapiens
uggagaaggcccac

SEQ ID NO: 1117181 - RNA, 13 nt, Homo sapiens
uggagaaguucag

SEQ ID NO: 1117182 - RNA, 17 nt, Homo sapiens
uggagcaucugacucac

SEQ ID NO: 1117183 - RNA, 18 nt, Homo sapiens
uggagcuccugcuggaug

SEQ ID NO: 1117184 - RNA, 17 nt, Homo sapiens
uggaggagaaggacauu

SEQ ID NO: 1117185 - RNA, 12 nt, Homo sapiens
uggaggcugcuc

SEQ ID NO: 1117186 - RNA, 20 nt, Homo sapiens
uggaggucacauucaggaag

SEQ ID NO: 1117187 - RNA, 15 nt, Homo sapiens
uggaguugugaucau

SEQ ID NO: 1117188 - RNA, 15 nt, Homo sapiens
uggauaaaaugaggu

SEQ ID NO: 1117189 - RNA, 21 nt, Homo sapiens
uggauacagaaugaaucccau

SEQ ID NO: 1117190 - RNA, 17 nt, Homo sapiens
ugaacuauuagacauga

SEQ ID NO: 1117191 - RNA, 17 nt, Homo sapiens
ugaacuuucacauagca

SEQ ID NO: 1117192 - RNA, 11 nt, Homo sapiens
ugaacuuuguc

SEQ ID NO: 1117193 - RNA, 15 nt, Homo sapiens
ugaagaaaacuccuu

SEQ ID NO: 1117194 - RNA, 12 nt, Homo sapiens
ugaagaacugac

SEQ ID NO: 1117195 - RNA, 16 nt, Homo sapiens
ugaagacccaguguaa

SEQ ID NO: 1117196 - RNA, 12 nt, Homo sapiens
ugaagaucucag

SEQ ID NO: 1117197 - RNA, 12 nt, Homo sapiens
ugaagcuggaag

SEQ ID NO: 1117198 - RNA, 16 nt, Homo sapiens
ugaaggagaaggugcc

SEQ ID NO: 1117199 - RNA, 13 nt, Homo sapiens
ugaaggagccagu

SEQ ID NO: 1117200 - RNA, 17 nt, Homo sapiens
ugaaggaggugagggau

SEQ ID NO: 1117201 - RNA, 22 nt, Homo sapiens
ugaaggaggugagggaugugaa

SEQ ID NO: 1117202 - RNA, 20 nt, Homo sapiens
ugaaggugcugacaaagaug

SEQ ID NO: 1117203 - RNA, 17 nt, Homo sapiens
ugaaguucuuuuacugu

SEQ ID NO: 1117204 - RNA, 18 nt, Homo sapiens
ugaaguucuuuuacugua

SEQ ID NO: 1117205 - RNA, 21 nt, Homo sapiens
ugaaguuguguuaacaaugca

SEQ ID NO: 1117206 - RNA, 21 nt, Homo sapiens
ugaauaaagccugcuuuuuaa

SEQ ID NO: 1117207 - RNA, 20 nt, Homo sapiens
ugaauauaggaagcauaugc

SEQ ID NO: 1117208 - RNA, 21 nt, Homo sapiens
ugaaugaccuuguugcaugau

SEQ ID NO: 1117209 - RNA, 15 nt, Homo sapiens
ugaaugauacccuga

SEQ ID NO: 1117210 - RNA, 15 nt, Homo sapiens
ugaaugcaaaccaua

SEQ ID NO: 1117211 - RNA, 19 nt, Homo sapiens
ugaaugccucaaugugacc

SEQ ID NO: 1117212 - RNA, 11 nt, Homo sapiens
ugaaugcuauu

SEQ ID NO: 1117213 - RNA, 11 nt, Homo sapiens
ugaaugcucaa

SEQ ID NO: 1117214 - RNA, 22 nt, Homo sapiens
ugaauguuugaacugccaagaa

SEQ ID NO: 1117215 - RNA, 15 nt, Homo sapiens
ugaauuucuaaaaaa

SEQ ID NO: 1117216 - RNA, 23 nt, Homo sapiens
ugacaaauucuuuuucacacuga

SEQ ID NO: 1117217 - RNA, 14 nt, Homo sapiens
ugacacauaugcac

SEQ ID NO: 1117218 - RNA, 17 nt, Homo sapiens
ugacagcaggugggaaa

SEQ ID NO: 1117219 - RNA, 12 nt, Homo sapiens
ugacagccagag

SEQ ID NO: 1117220 - RNA, 22 nt, Homo sapiens
ugacagcugaccuuugucaucu

SEQ ID NO: 1117221 - RNA, 21 nt, Homo sapiens
ugacaggaagcccaaggcagu

SEQ ID NO: 1117222 - RNA, 14 nt, Homo sapiens
ugacaucacuugua

SEQ ID NO: 1117223 - RNA, 19 nt, Homo sapiens
ugacaucucuuugauguca

SEQ ID NO: 1117224 - RNA, 14 nt, Homo sapiens
ugaccaacaguucc

SEQ ID NO: 1117225 - RNA, 20 nt, Homo sapiens
ugaccaagagagaaagaagu

SEQ ID NO: 1117226 - RNA, 11 nt, Homo sapiens
ugaccaggaac

SEQ ID NO: 1117227 - RNA, 12 nt, Homo sapiens
ugacccaaagac

SEQ ID NO: 1117228 - RNA, 13 nt, Homo sapiens
ugacccaaagacc

SEQ ID NO: 1117229 - RNA, 14 nt, Homo sapiens
ugaccccaaagagc

SEQ ID NO: 1117230 - RNA, 21 nt, Homo sapiens
ugaccugucaccgugagcagc

SEQ ID NO: 1117231 - RNA, 14 nt, Homo sapiens
ugaccuuguagcua

SEQ ID NO: 1117232 - RNA, 20 nt, Homo sapiens
ugacggucccacacugguga

SEQ ID NO: 1117233 - RNA, 23 nt, Homo sapiens
ugacgugcaccuguacucaggag

SEQ ID NO: 1117234 - RNA, 12 nt, Homo sapiens
ugacuaaacaac

SEQ ID NO: 1117235 - RNA, 20 nt, Homo sapiens
ugacuagaccccacccugag

SEQ ID NO: 1117236 - RNA, 15 nt, Homo sapiens
ugacuaucacauaca

SEQ ID NO: 1117237 - RNA, 19 nt, Homo sapiens
ugacuauggcuaccaaaaa

SEQ ID NO: 1117238 - RNA, 22 nt, Homo sapiens
ugacuccuuucucuaaaacugc

SEQ ID NO: 1117239 - RNA, 23 nt, Homo sapiens
ugacuguaaacauagauagugcu

SEQ ID NO: 1117240 - RNA, 20 nt, Homo sapiens
ugacuuccucgccucuccca

SEQ ID NO: 1117241 - RNA, 21 nt, Homo sapiens
ugacuucuugcuuguacauau

SEQ ID NO: 1117242 - RNA, 19 nt, Homo sapiens
ugagaaaagcuuugaaccc

SEQ ID NO: 1117243 - RNA, 17 nt, Homo sapiens
ugagaaacccaccagcc

SEQ ID NO: 1117244 - RNA, 12 nt, Homo sapiens
ugagaaagccuu

SEQ ID NO: 1117245 - RNA, 14 nt, Homo sapiens
ugagaaaguucuca

SEQ ID NO: 1117246 - RNA, 22 nt, Homo sapiens
ugagaacagacguuaccaauua

SEQ ID NO: 1117247 - RNA, 15 nt, Homo sapiens
ugagaagaaaugaca

SEQ ID NO: 1117248 - RNA, 14 nt, Homo sapiens
ugagaagaaugacu

SEQ ID NO: 1117249 - RNA, 16 nt, Homo sapiens
ugagaauaauugugua

SEQ ID NO: 1117250 - RNA, 20 nt, Homo sapiens
ugagaaucgaccucacuguc

SEQ ID NO: 1117251 - RNA, 21 nt, Homo sapiens
ugagaaucgaccucacuguca

SEQ ID NO: 1117252 - RNA, 18 nt, Homo sapiens
ugagaccagccuggccaa

SEQ ID NO: 1117253 - RNA, 13 nt, Homo sapiens
ugagacuggaaau

SEQ ID NO: 1117254 - RNA, 19 nt, Homo sapiens
ugagagcugcucuggaaaa

SEQ ID NO: 1117255 - RNA, 20 nt, Homo sapiens
ugagaggaagggugggucug

SEQ ID NO: 1117256 - RNA, 15 nt, Homo sapiens
ugagauccuuuaaau

SEQ ID NO: 1117257 - RNA, 23 nt, Homo sapiens
ugagauccuuuaaauccuuccau

SEQ ID NO: 1117258 - RNA, 17 nt, Homo sapiens
ugagaucguuguuuaca

SEQ ID NO: 1117259 - RNA, 22 nt, Homo sapiens
ugagaugcaggauuucuucaca

SEQ ID NO: 1117260 - RNA, 16 nt, Homo sapiens
ugagcagucacacugu

SEQ ID NO: 1117261 - RNA, 12 nt, Homo sapiens
ugagccaaagag

SEQ ID NO: 1117262 - RNA, 12 nt, Homo sapiens
ugagccagguaa

SEQ ID NO: 1117263 - RNA, 21 nt, Homo sapiens
ugagcucuucauguuucagga

SEQ ID NO: 1117264 - RNA, 15 nt, Homo sapiens
ugaggacauguggaa

SEQ ID NO: 1117265 - RNA, 13 nt, Homo sapiens
ugaggauuucaag

SEQ ID NO: 1117266 - RNA, 16 nt, Homo sapiens
ugaggcauuuuuacua

SEQ ID NO: 1117267 - RNA, 20 nt, Homo sapiens
ugaggcauuuuuacuacuau

SEQ ID NO: 1117268 - RNA, 14 nt, Homo sapiens
ugaggcugcagcga

SEQ ID NO: 1117269 - RNA, 17 nt, Homo sapiens
ugagggaaaacauaaua

SEQ ID NO: 1117270 - RNA, 16 nt, Homo sapiens
ugaggggcuccuggaa

SEQ ID NO: 1117271 - RNA, 18 nt, Homo sapiens
ugagggucuuugcaagaa

SEQ ID NO: 1117272 - RNA, 22 nt, Homo sapiens
ugagguacagcagaaaggagaa

SEQ ID NO: 1117273 - RNA, 15 nt, Homo sapiens
ugagugagccacaga

SEQ ID NO: 1117274 - RNA, 18 nt, Homo sapiens
ugaguggaucuccaagga

SEQ ID NO: 1117275 - RNA, 13 nt, Homo sapiens
cagccaucaaggg

SEQ ID NO: 1117276 - RNA, 15 nt, Homo sapiens
cagcccagcuggugg

SEQ ID NO: 1117277 - RNA, 16 nt, Homo sapiens
cagccccgcccgccug

SEQ ID NO: 1117278 - RNA, 13 nt, Homo sapiens
cagcccuauggau

SEQ ID NO: 1117279 - RNA, 19 nt, Homo sapiens
cagcccuucccugcuuuga

SEQ ID NO: 1117280 - RNA, 14 nt, Homo sapiens
cagccggguaccuc

SEQ ID NO: 1117281 - RNA, 23 nt, Homo sapiens
cagccucacuugaaugugucacu

SEQ ID NO: 1117282 - RNA, 20 nt, Homo sapiens
cagccucccgaguagcuggg

SEQ ID NO: 1117283 - RNA, 20 nt, Homo sapiens
cagccucccucugaccugca

SEQ ID NO: 1117284 - RNA, 17 nt, Homo sapiens
cagccugcagacucacu

SEQ ID NO: 1117285 - RNA, 18 nt, Homo sapiens
cagccuggaagagggcaa

SEQ ID NO: 1117286 - RNA, 21 nt, Homo sapiens
cagccuggccaacauggugaa

SEQ ID NO: 1117287 - RNA, 18 nt, Homo sapiens
cagccugggcaacagagc

SEQ ID NO: 1117288 - RNA, 22 nt, Homo sapiens
cagccuggggggucguggcaga

SEQ ID NO: 1117289 - RNA, 21 nt, Homo sapiens
cagccuggucaacauggugaa

SEQ ID NO: 1117290 - RNA, 18 nt, Homo sapiens
cagcgaaugaaugcugua

SEQ ID NO: 1117291 - RNA, 23 nt, Homo sapiens
cagcgagaggcagagaaagaaga

SEQ ID NO: 1117292 - RNA, 14 nt, Homo sapiens
cagcgaugugucac

SEQ ID NO: 1117293 - RNA, 13 nt, Homo sapiens
cagcgccaccucu

SEQ ID NO: 1117294 - RNA, 21 nt, Homo sapiens
cagcuaagcccccuacugaga

SEQ ID NO: 1117295 - RNA, 19 nt, Homo sapiens
cagcuagggcuggacucug

SEQ ID NO: 1117296 - RNA, 21 nt, Homo sapiens
cagcuagugacccacaugcca

SEQ ID NO: 1117297 - RNA, 19 nt, Homo sapiens
cagcuauuuucaacauaac

SEQ ID NO: 1117298 - RNA, 23 nt, Homo sapiens
cagcuauuuucaacauaacugaa

SEQ ID NO: 1117299 - RNA, 20 nt, Homo sapiens
cagcucuguguuucugggga

SEQ ID NO: 1117300 - RNA, 14 nt, Homo sapiens
cagcugaacagcca

SEQ ID NO: 1117301 - RNA, 15 nt, Homo sapiens
cagcugaacagccaa

SEQ ID NO: 1117302 - RNA, 20 nt, Homo sapiens
cagcugaccuuugucaucuu

SEQ ID NO: 1117303 - RNA, 13 nt, Homo sapiens
cagcugcaccugc

SEQ ID NO: 1117304 - RNA, 15 nt, Homo sapiens
cagcugcaccugcca

SEQ ID NO: 1117305 - RNA, 20 nt, Homo sapiens
cagcugcagucaacaguuca

SEQ ID NO: 1117306 - RNA, 17 nt, Homo sapiens
cagcuucauuuccguga

SEQ ID NO: 1117307 - RNA, 21 nt, Homo sapiens
cagcuucauuuccgugaaggg

SEQ ID NO: 1117308 - RNA, 22 nt, Homo sapiens
cagcuuguaaauagcucaggug

SEQ ID NO: 1117309 - RNA, 19 nt, Homo sapiens
cagcuuguggcaagugaau

SEQ ID NO: 1117310 - RNA, 19 nt, Homo sapiens
caggaacacccgacuccuc

SEQ ID NO: 1117311 - RNA, 18 nt, Homo sapiens
caggaagcccaaggcagu

SEQ ID NO: 1117312 - RNA, 18 nt, Homo sapiens
caggaagggaaagccaga

SEQ ID NO: 1117313 - RNA, 21 nt, Homo sapiens
caggaagguagcccagcacug

SEQ ID NO: 1117314 - RNA, 22 nt, Homo sapiens
caggaagguagcccagcacugu

SEQ ID NO: 1117315 - RNA, 15 nt, Homo sapiens
caggacggaauauag

SEQ ID NO: 1117316 - RNA, 20 nt, Homo sapiens
caggacucacccucauacca

SEQ ID NO: 1117317 - RNA, 22 nt, Homo sapiens
caggacucugccuccucuucaa

SEQ ID NO: 1117318 - RNA, 17 nt, Homo sapiens
caggacuuggucugauu

SEQ ID NO: 1117319 - RNA, 23 nt, Homo sapiens
caggagcaaauguuucugcagua

SEQ ID NO: 1117320 - RNA, 17 nt, Homo sapiens
caggagcauggggauaa

SEQ ID NO: 1117321 - RNA, 21 nt, Homo sapiens
caggagcuaccuguguggaca

SEQ ID NO: 1117322 - RNA, 17 nt, Homo sapiens
caggagcugaagcccau

SEQ ID NO: 1117323 - RNA, 18 nt, Homo sapiens
caggaguagcugagcuca

SEQ ID NO: 1117324 - RNA, 19 nt, Homo sapiens
caggaguagcugagcucac

SEQ ID NO: 1117325 - RNA, 22 nt, Homo sapiens
caggaguuugaggcugcagcga

SEQ ID NO: 1117326 - RNA, 22 nt, Homo sapiens
caggauccuauucucaccagga

SEQ ID NO: 1117327 - RNA, 17 nt, Homo sapiens
caggcacccaccaucau

SEQ ID NO: 1117328 - RNA, 23 nt, Homo sapiens
caggcacgaacccaccugcugag

SEQ ID NO: 1117329 - RNA, 13 nt, Homo sapiens
caggcagccccac

SEQ ID NO: 1117330 - RNA, 19 nt, Homo sapiens
caggcaggcccugccuuca

SEQ ID NO: 1117331 - RNA, 17 nt, Homo sapiens
caggcaugcaccagugc

SEQ ID NO: 1117332 - RNA, 15 nt, Homo sapiens
caggcauguucucug

SEQ ID NO: 1117333 - RNA, 17 nt, Homo sapiens
caggccccgcuugucca

SEQ ID NO: 1117334 - RNA, 16 nt, Homo sapiens
caggcccugccuucag

SEQ ID NO: 1117335 - RNA, 18 nt, Homo sapiens
gaccuuucugagugacau

SEQ ID NO: 1117336 - RNA, 17 nt, Homo sapiens
gaccuuuuauccacuua

SEQ ID NO: 1117337 - RNA, 21 nt, Homo sapiens
gacggcugcucgaagaacaau

SEQ ID NO: 1117338 - RNA, 17 nt, Homo sapiens
gacuacaggcacccacc

SEQ ID NO: 1117339 - RNA, 19 nt, Homo sapiens
gacuagggcuuauccaugc

SEQ ID NO: 1117340 - RNA, 14 nt, Homo sapiens
gacuagugcuuuac

SEQ ID NO: 1117341 - RNA, 20 nt, Homo sapiens
gacuaucuuacuauuucaca

SEQ ID NO: 1117342 - RNA, 16 nt, Homo sapiens
gacuauuuaugaaggc

SEQ ID NO: 1117343 - RNA, 14 nt, Homo sapiens
gacucacaagaaga

SEQ ID NO: 1117344 - RNA, 21 nt, Homo sapiens
gacucacccucauaccaucug

SEQ ID NO: 1117345 - RNA, 15 nt, Homo sapiens
gacucugacuuugag

SEQ ID NO: 1117346 - RNA, 16 nt, Homo sapiens
gacucugcacaugucu

SEQ ID NO: 1117347 - RNA, 19 nt, Homo sapiens
gacugaugacaaacccagg

SEQ ID NO: 1117348 - RNA, 16 nt, Homo sapiens
gacugcaucucaaaaa

SEQ ID NO: 1117349 - RNA, 18 nt, Homo sapiens
gacugccaugcuagacaa

SEQ ID NO: 1117350 - RNA, 15 nt, Homo sapiens
gacugcucgucuauc

SEQ ID NO: 1117351 - RNA, 15 nt, Homo sapiens
gacuggaaccaggga

SEQ ID NO: 1117352 - RNA, 16 nt, Homo sapiens
gacuggaacuugaacu

SEQ ID NO: 1117353 - RNA, 19 nt, Homo sapiens
gacuggccucaaagcaagc

SEQ ID NO: 1117354 - RNA, 20 nt, Homo sapiens
gacugugaaaguaugugaua

SEQ ID NO: 1117355 - RNA, 16 nt, Homo sapiens
gacuguggccuguuaa

SEQ ID NO: 1117356 - RNA, 20 nt, Homo sapiens
gacuguggcugcuagcacuu

SEQ ID NO: 1117357 - RNA, 11 nt, Homo sapiens
gacuguguuca

SEQ ID NO: 1117358 - RNA, 14 nt, Homo sapiens
gacuguugcucaaa

SEQ ID NO: 1117359 - RNA, 22 nt, Homo sapiens
gacuuaaaauauuccugcauuu

SEQ ID NO: 1117360 - RNA, 20 nt, Homo sapiens
gacuugacagaacacugucu

SEQ ID NO: 1117361 - RNA, 16 nt, Homo sapiens
gacuugagcuuggcag

SEQ ID NO: 1117362 - RNA, 17 nt, Homo sapiens
gacuuuguauagaaggu

SEQ ID NO: 1117363 - RNA, 17 nt, Homo sapiens
gagaaaagaaaccagag

SEQ ID NO: 1117364 - RNA, 13 nt, Homo sapiens
gagaaacuuccuu

SEQ ID NO: 1117365 - RNA, 12 nt, Homo sapiens
gagaaagugacc

SEQ ID NO: 1117366 - RNA, 18 nt, Homo sapiens
gagaaauuccuugauuca

SEQ ID NO: 1117367 - RNA, 21 nt, Homo sapiens
gagaaccuggccuucagugua

SEQ ID NO: 1117368 - RNA, 22 nt, Homo sapiens
gagaagaagaaaaucaaccagc

SEQ ID NO: 1117369 - RNA, 15 nt, Homo sapiens
gaggcuuccagagag

SEQ ID NO: 1117370 - RNA, 16 nt, Homo sapiens
gagggcagcagccagc

SEQ ID NO: 1117371 - RNA, 15 nt, Homo sapiens
gaggggaagggccag

SEQ ID NO: 1117372 - RNA, 18 nt, Homo sapiens
gagggugggguaaccaaa

SEQ ID NO: 1117373 - RNA, 13 nt, Homo sapiens
gagguacacucuu

SEQ ID NO: 1117374 - RNA, 14 nt, Homo sapiens
gagguccugcauuu

SEQ ID NO: 1117375 - RNA, 21 nt, Homo sapiens
gagguggugggggcagggaug

SEQ ID NO: 1117376 - RNA, 16 nt, Homo sapiens
gaggugucuuaagccu

SEQ ID NO: 1117377 - RNA, 19 nt, Homo sapiens
gagguuuggggucugccac

SEQ ID NO: 1117378 - RNA, 19 nt, Homo sapiens
gaguaauucuagcuuucaa

SEQ ID NO: 1117379 - RNA, 19 nt, Homo sapiens
gaguauguuaagcucuuua

SEQ ID NO: 1117380 - RNA, 14 nt, Homo sapiens
gagucauuguuaca

SEQ ID NO: 1117381 - RNA, 20 nt, Homo sapiens
gaguccucguagccaucucu

SEQ ID NO: 1117382 - RNA, 17 nt, Homo sapiens
gagucgaggacagggag

SEQ ID NO: 1117383 - RNA, 17 nt, Homo sapiens
gagucucacuguugccc

SEQ ID NO: 1117384 - RNA, 22 nt, Homo sapiens
gagugagaauaauuguguacaa

SEQ ID NO: 1117385 - RNA, 18 nt, Homo sapiens
gagugagagacauuaacu

SEQ ID NO: 1117386 - RNA, 13 nt, Homo sapiens
gagugagcugguu

SEQ ID NO: 1117387 - RNA, 23 nt, Homo sapiens
gagugauugacacacagcacucu

SEQ ID NO: 1117388 - RNA, 21 nt, Homo sapiens
gagugccguaacaacuguggu

SEQ ID NO: 1117389 - RNA, 22 nt, Homo sapiens
gagugccguaacaacugugguc

SEQ ID NO: 1117390 - RNA, 18 nt, Homo sapiens
gagugggccgcuguguuu

SEQ ID NO: 1117391 - RNA, 13 nt, Homo sapiens
gaguuagugccau

SEQ ID NO: 1117392 - RNA, 20 nt, Homo sapiens
gaguucauacccuguuacca

SEQ ID NO: 1117393 - RNA, 22 nt, Homo sapiens
gaguucuugugccauagucaca

SEQ ID NO: 1117394 - RNA, 19 nt, Homo sapiens
gaguuuaugggaaugccuu

SEQ ID NO: 1117395 - RNA, 10 nt, Homo sapiens
gauaaacuaa

SEQ ID NO: 1117396 - RNA, 17 nt, Homo sapiens
gauaaacuaaaagcaua

SEQ ID NO: 1117397 - RNA, 19 nt, Homo sapiens
gauaaagaugucaaauauc

SEQ ID NO: 1117398 - RNA, 20 nt, Homo sapiens
gauaaguaaguuugauuuca

SEQ ID NO: 1117399 - RNA, 19 nt, Homo sapiens
gauaaugcuguugccucau

SEQ ID NO: 1117400 - RNA, 13 nt, Homo sapiens
gauacccagagca

SEQ ID NO: 1117401 - RNA, 12 nt, Homo sapiens
gauagcuuuauu

SEQ ID NO: 1117402 - RNA, 20 nt, Homo sapiens
gauaucaguuaucaauguua

SEQ ID NO: 1117403 - RNA, 17 nt, Homo sapiens
gauauguucaacuggag

SEQ ID NO: 1117404 - RNA, 19 nt, Homo sapiens
gauauuuauugagugccca

SEQ ID NO: 1117405 - RNA, 19 nt, Homo sapiens
gauauuugaagcaucacau

SEQ ID NO: 1117406 - RNA, 21 nt, Homo sapiens
gaucaagucaccggagcuuuc

SEQ ID NO: 1117407 - RNA, 15 nt, Homo sapiens
gaucacuuuguuaaa

SEQ ID NO: 1117408 - RNA, 19 nt, Homo sapiens
gaucacuuuguuaaaaaua

SEQ ID NO: 1117409 - RNA, 19 nt, Homo sapiens
gaucagaauuuuaccaaaa

SEQ ID NO: 1117410 - RNA, 23 nt, Homo sapiens
gaucagcaugggaaugugccucg

SEQ ID NO: 1117411 - RNA, 17 nt, Homo sapiens
gauccacaaaaacaacu

SEQ ID NO: 1117412 - RNA, 18 nt, Homo sapiens
gaucccaagacaaugaaa

SEQ ID NO: 1117413 - RNA, 13 nt, Homo sapiens
gaucccuagcugu

SEQ ID NO: 1117414 - RNA, 12 nt, Homo sapiens
gaucgcuuugua

SEQ ID NO: 1117415 - RNA, 19 nt, Homo sapiens
gaucucccugccgccucaa

SEQ ID NO: 1117416 - RNA, 12 nt, Homo sapiens
gaucuucagagc

SEQ ID NO: 1117417 - RNA, 17 nt, Homo sapiens
gaucuucuuggagcgag

SEQ ID NO: 1117418 - RNA, 17 nt, Homo sapiens
gaucuuguuaaugcauu

SEQ ID NO: 1117419 - RNA, 15 nt, Homo sapiens
gaucuuugacucuuu

SEQ ID NO: 1117420 - RNA, 21 nt, Homo sapiens
gaugaagcucuggccaaccaa

SEQ ID NO: 1117421 - RNA, 15 nt, Homo sapiens
gaugacaaacccagg

SEQ ID NO: 1117422 - RNA, 18 nt, Homo sapiens
gaugaccagaacaagguu

SEQ ID NO: 1117423 - RNA, 22 nt, Homo sapiens
gaugcaaucucuugucucacau

SEQ ID NO: 1117424 - RNA, 16 nt, Homo sapiens
gaugcaggauuucuuc

SEQ ID NO: 1117425 - RNA, 17 nt, Homo sapiens
gauggaauaaagcccuu

SEQ ID NO: 1117426 - RNA, 21 nt, Homo sapiens
gauggaauaaagcccuugaac

SEQ ID NO: 1117427 - RNA, 18 nt, Homo sapiens
gauggagaggggguacaa

SEQ ID NO: 1117428 - RNA, 19 nt, Homo sapiens
gauggagauauuuacauga

SEQ ID NO: 1117429 - RNA, 18 nt, Homo sapiens
gauggagccagcucugca

SEQ ID NO: 1117430 - RNA, 15 nt, Homo sapiens
gauggauguuuguca

SEQ ID NO: 1117431 - RNA, 16 nt, Homo sapiens
gauggcaccacugcac

SEQ ID NO: 1117432 - RNA, 18 nt, Homo sapiens
gauggcaccacugcacuc

SEQ ID NO: 1117433 - RNA, 21 nt, Homo sapiens
gauggcauuuuuugcaaguua

SEQ ID NO: 1117434 - RNA, 20 nt, Homo sapiens
gauggcgcuauugcacucca

SEQ ID NO: 1117435 - RNA, 19 nt, Homo sapiens
gauggcuuuuucuccuugg

SEQ ID NO: 1117436 - RNA, 13 nt, Homo sapiens
gaugggauuucau

SEQ ID NO: 1117437 - RNA, 18 nt, Homo sapiens
gaugguaacugcacacau

SEQ ID NO: 1117438 - RNA, 19 nt, Homo sapiens
gaugucacgucuugaaaag

SEQ ID NO: 1117439 - RNA, 13 nt, Homo sapiens
gaugugggguccc

SEQ ID NO: 1117440 - RNA, 21 nt, Homo sapiens
gauguguaaauggagcuugua

SEQ ID NO: 1117441 - RNA, 22 nt, Homo sapiens
gauguuuuaaguuuaucuuuca

SEQ ID NO: 1117442 - RNA, 14 nt, Homo sapiens
gauuaaacagacuu

SEQ ID NO: 1117443 - RNA, 13 nt, Homo sapiens
gauuauauaucau

SEQ ID NO: 1117444 - RNA, 14 nt, Homo sapiens
gauucacaucucau

SEQ ID NO: 1117445 - RNA, 20 nt, Homo sapiens
gauucacaucucauuuuucc

SEQ ID NO: 1117446 - RNA, 14 nt, Homo sapiens
gauucaugccaauu

SEQ ID NO: 1117447 - RNA, 15 nt, Homo sapiens
gauucccaccaaggu

SEQ ID NO: 1117448 - RNA, 13 nt, Homo sapiens
gauucccagagac

SEQ ID NO: 1117449 - RNA, 14 nt, Homo sapiens
gauucgaaugacac

SEQ ID NO: 1117450 - RNA, 13 nt, Homo sapiens
gauugauggugcu

SEQ ID NO: 1117451 - RNA, 18 nt, Homo sapiens
gauugcuuaaaauagcaa

SEQ ID NO: 1117452 - RNA, 19 nt, Homo sapiens
gauugugaccuccagaggu

SEQ ID NO: 1117453 - RNA, 19 nt, Homo sapiens
gauugugguacaaucucaa

SEQ ID NO: 1117454 - RNA, 15 nt, Homo sapiens
gauuuaacugugaac

SEQ ID NO: 1117455 - RNA, 21 nt, Homo sapiens
gauuuacgcucauuguagaaa

SEQ ID NO: 1117456 - RNA, 13 nt, Homo sapiens
gauuuauaucuau

SEQ ID NO: 1117457 - RNA, 16 nt, Homo sapiens
gauuuaugaucacuug

SEQ ID NO: 1117458 - RNA, 14 nt, Homo sapiens
cagugaaccaaaga

SEQ ID NO: 1117459 - RNA, 20 nt, Homo sapiens
cagugagccgagauggcgcu

SEQ ID NO: 1117460 - RNA, 21 nt, Homo sapiens
cagugagcucuggaugaagcu

SEQ ID NO: 1117461 - RNA, 20 nt, Homo sapiens
cagugagcugauaucaugcc

SEQ ID NO: 1117462 - RNA, 15 nt, Homo sapiens
cagugaucuccauau

SEQ ID NO: 1117463 - RNA, 14 nt, Homo sapiens
cagugcauguugcc

SEQ ID NO: 1117464 - RNA, 23 nt, Homo sapiens
cagugcucggcuguaaacagcuc

SEQ ID NO: 1117465 - RNA, 20 nt, Homo sapiens
caguggugaagaaaacuccu

SEQ ID NO: 1117466 - RNA, 20 nt, Homo sapiens
caguguaaagaauaaaugaa

SEQ ID NO: 1117467 - RNA, 13 nt, Homo sapiens
caguguacugcuu

SEQ ID NO: 1117468 - RNA, 16 nt, Homo sapiens
caguguauguacuaag

SEQ ID NO: 1117469 - RNA, 14 nt, Homo sapiens
caguguccucaggg

SEQ ID NO: 1117470 - RNA, 19 nt, Homo sapiens
caguguccucuugcucaaa

SEQ ID NO: 1117471 - RNA, 13 nt, Homo sapiens
cagugucuuccau

SEQ ID NO: 1117472 - RNA, 22 nt, Homo sapiens
caguguggcccagggaagccaa

SEQ ID NO: 1117473 - RNA, 22 nt, Homo sapiens
caguuaacuuuaagacugagca

SEQ ID NO: 1117474 - RNA, 13 nt, Homo sapiens
caguuaaggggag

SEQ ID NO: 1117475 - RNA, 16 nt, Homo sapiens
caguuauacauaccuc

SEQ ID NO: 1117476 - RNA, 17 nt, Homo sapiens
caguuauagaaaaucua

SEQ ID NO: 1117477 - RNA, 20 nt, Homo sapiens
caguuaugugaaugaucucu

SEQ ID NO: 1117478 - RNA, 14 nt, Homo sapiens
caguucugacacac

SEQ ID NO: 1117479 - RNA, 16 nt, Homo sapiens
caguugggagcacugg

SEQ ID NO: 1117480 - RNA, 20 nt, Homo sapiens
caguuucacaaaguuuguuc

SEQ ID NO: 1117481 - RNA, 20 nt, Homo sapiens
caguuucagguguuuaguug

SEQ ID NO: 1117482 - RNA, 21 nt, Homo sapiens
caguuuuaucuuuaaucuccu

SEQ ID NO: 1117483 - RNA, 20 nt, Homo sapiens
cauaaaugugguacaagcau

SEQ ID NO: 1117484 - RNA, 21 nt, Homo sapiens
cauaaaugugguacaagcauu

SEQ ID NO: 1117485 - RNA, 23 nt, Homo sapiens
cauaacauaaauuuaucaucucg

SEQ ID NO: 1117486 - RNA, 16 nt, Homo sapiens
cauaagaaaacuaaga

SEQ ID NO: 1117487 - RNA, 21 nt, Homo sapiens
cauaagccuaccaauguagac

SEQ ID NO: 1117488 - RNA, 16 nt, Homo sapiens
cauaauguuacauuau

SEQ ID NO: 1117489 - RNA, 18 nt, Homo sapiens
cauaauguuacauuauua

SEQ ID NO: 1117490 - RNA, 21 nt, Homo sapiens
cauaauguuacauuauuauca

SEQ ID NO: 1117491 - RNA, 19 nt, Homo sapiens
cauaauuuguacauaugua

SEQ ID NO: 1117492 - RNA, 22 nt, Homo sapiens
cauaauuuguacauauguaaaa

SEQ ID NO: 1117493 - RNA, 20 nt, Homo sapiens
cauacaccuaugucauuuca

SEQ ID NO: 1117494 - RNA, 17 nt, Homo sapiens
cauacacucaaacaauc

SEQ ID NO: 1117495 - RNA, 16 nt, Homo sapiens
cauacagagacagaua

SEQ ID NO: 1117496 - RNA, 19 nt, Homo sapiens
cauacagagacagauauac

SEQ ID NO: 1117497 - RNA, 14 nt, Homo sapiens
cauacauugccaau

SEQ ID NO: 1117498 - RNA, 15 nt, Homo sapiens
cauacccuguuacca

SEQ ID NO: 1117499 - RNA, 16 nt, Homo sapiens
cauacuucuucauuca

SEQ ID NO: 1117500 - RNA, 12 nt, Homo sapiens
cauagaaaaacu

SEQ ID NO: 1117501 - RNA, 19 nt, Homo sapiens
cauagaaauuacacccaaa

SEQ ID NO: 1117502 - RNA, 13 nt, Homo sapiens
cauagagacuuug

SEQ ID NO: 1117503 - RNA, 21 nt, Homo sapiens
cauagaggacagcaacuggug

SEQ ID NO: 1117504 - RNA, 16 nt, Homo sapiens
cauagaugaacuauua

SEQ ID NO: 1117505 - RNA, 21 nt, Homo sapiens
cauagaugaacuauuagacau

SEQ ID NO: 1117506 - RNA, 18 nt, Homo sapiens
cauaguggagagaacuga

SEQ ID NO: 1117507 - RNA, 13 nt, Homo sapiens
cauauaauguugu

SEQ ID NO: 1117508 - RNA, 12 nt, Homo sapiens
cauauacuuuaa

SEQ ID NO: 1117509 - RNA, 18 nt, Homo sapiens
cauauauaugucaggcaa

SEQ ID NO: 1117510 - RNA, 21 nt, Homo sapiens
cauaucaaacauauguauaca

SEQ ID NO: 1117511 - RNA, 14 nt, Homo sapiens
cauaugcuauguua

SEQ ID NO: 1117512 - RNA, 13 nt, Homo sapiens
cauauggaaaucc

SEQ ID NO: 1117513 - RNA, 17 nt, Homo sapiens
cauauguaccauguaca

SEQ ID NO: 1117514 - RNA, 14 nt, Homo sapiens
caucaaagcacugu

SEQ ID NO: 1117515 - RNA, 21 nt, Homo sapiens
caucaacaaagaaauauuauu

SEQ ID NO: 1117516 - RNA, 17 nt, Homo sapiens
caucaagagacugaguc

SEQ ID NO: 1117517 - RNA, 22 nt, Homo sapiens
caucaagaugagagaacuggag

SEQ ID NO: 1117518 - RNA, 12 nt, Homo sapiens
caucacaacauu

SEQ ID NO: 1117519 - RNA, 14 nt, Homo sapiens
caucagcauaccuu

SEQ ID NO: 1117520 - RNA, 11 nt, Homo sapiens
caucaucccag

SEQ ID NO: 1117521 - RNA, 21 nt, Homo sapiens
cauccaaggagaaacagagac

SEQ ID NO: 1117522 - RNA, 14 nt, Homo sapiens
cauccacugugcca

SEQ ID NO: 1117523 - RNA, 13 nt, Homo sapiens
cauccaucugugg

SEQ ID NO: 1117524 - RNA, 19 nt, Homo sapiens
caucccaucauggcugcug

SEQ ID NO: 1117525 - RNA, 13 nt, Homo sapiens
caucccaucuaag

SEQ ID NO: 1117526 - RNA, 15 nt, Homo sapiens
cauccccagccagaa

SEQ ID NO: 1117527 - RNA, 15 nt, Homo sapiens
cauccccuuuccucc

SEQ ID NO: 1117528 - RNA, 17 nt, Homo sapiens
caucgauucaaacugcu

SEQ ID NO: 1117529 - RNA, 12 nt, Homo sapiens
caucucagccua

SEQ ID NO: 1117530 - RNA, 19 nt, Homo sapiens
caucucaggccucccucaa

SEQ ID NO: 1117531 - RNA, 16 nt, Homo sapiens
caucucagugaagaau

SEQ ID NO: 1117532 - RNA, 12 nt, Homo sapiens
caucucuuugau

SEQ ID NO: 1117533 - RNA, 12 nt, Homo sapiens
caucugacucac

SEQ ID NO: 1117534 - RNA, 19 nt, Homo sapiens
caucugcuuguauuuucca

SEQ ID NO: 1117535 - RNA, 16 nt, Homo sapiens
caucugugucucugga

SEQ ID NO: 1117536 - RNA, 13 nt, Homo sapiens
caucuguucauuc

SEQ ID NO: 1117537 - RNA, 15 nt, Homo sapiens
caucuucuccaucug

SEQ ID NO: 1117538 - RNA, 17 nt, Homo sapiens
caucuuguugccaugga

SEQ ID NO: 1117539 - RNA, 16 nt, Homo sapiens
caucuuuccuguucca

SEQ ID NO: 1117540 - RNA, 19 nt, Homo sapiens
caugaaaauagcucuuuca

SEQ ID NO: 1117541 - RNA, 20 nt, Homo sapiens
caugaaccucaagcugcauc

SEQ ID NO: 1117542 - RNA, 22 nt, Homo sapiens
caugaaccucaagcugcaucua

SEQ ID NO: 1117543 - RNA, 22 nt, Homo sapiens
caugaacuauuuacauuuucca

SEQ ID NO: 1117544 - RNA, 20 nt, Homo sapiens
caugaagcuggaagcacugc

SEQ ID NO: 1117545 - RNA, 13 nt, Homo sapiens
caugaaugcacac

SEQ ID NO: 1117546 - RNA, 17 nt, Homo sapiens
caugacagccagagccu

SEQ ID NO: 1117547 - RNA, 13 nt, Homo sapiens
ugaacacuggggg

SEQ ID NO: 1117548 - RNA, 13 nt, Homo sapiens
ugaaccaaagaga

SEQ ID NO: 1117549 - RNA, 13 nt, Homo sapiens
ugaaccacuuugc

SEQ ID NO: 1117550 - RNA, 14 nt, Homo sapiens
ugaaccacuuugcc

SEQ ID NO: 1117551 - RNA, 23 nt, Homo sapiens
ugaaccccuggccucaagcaauc

SEQ ID NO: 1117552 - RNA, 13 nt, Homo sapiens
caucucugccaag

SEQ ID NO: 1117553 - RNA, 16 nt, Homo sapiens
caucucuuucugcaaa

SEQ ID NO: 1117554 - RNA, 14 nt, Homo sapiens
caucugaaccacuu

SEQ ID NO: 1117555 - RNA, 17 nt, Homo sapiens
caucugaaccacuuugc

SEQ ID NO: 1117556 - RNA, 22 nt, Homo sapiens
caucugaaccacuuugccucug

SEQ ID NO: 1117557 - RNA, 15 nt, Homo sapiens
caucugacucacaag

SEQ ID NO: 1117558 - RNA, 12 nt, Homo sapiens
caucugcuccuc

SEQ ID NO: 1117559 - RNA, 20 nt, Homo sapiens
caucuuagauagaugguacu

SEQ ID NO: 1117560 - RNA, 19 nt, Homo sapiens
caucuucaaagcuugaaga

SEQ ID NO: 1117561 - RNA, 22 nt, Homo sapiens
caucuugcucugcugacagaca

SEQ ID NO: 1117562 - RNA, 15 nt, Homo sapiens
caugaaacacuucuc

SEQ ID NO: 1117563 - RNA, 16 nt, Homo sapiens
caugaaaucugaggaa

SEQ ID NO: 1117564 - RNA, 23 nt, Homo sapiens
caugaacuauuuacauuuuccaa

SEQ ID NO: 1117565 - RNA, 22 nt, Homo sapiens
caugaaucccacccacauguga

SEQ ID NO: 1117566 - RNA, 19 nt, Homo sapiens
caugacucagcauaccugc

SEQ ID NO: 1117567 - RNA, 20 nt, Homo sapiens
caugacucagcauaccugcu

SEQ ID NO: 1117568 - RNA, 21 nt, Homo sapiens
caugaggccuuuccccagugu

SEQ ID NO: 1117569 - RNA, 23 nt, Homo sapiens
caugauggcaccacugcacucca

SEQ ID NO: 1117570 - RNA, 19 nt, Homo sapiens
caugauguuaaccagaaua

SEQ ID NO: 1117571 - RNA, 17 nt, Homo sapiens
caugauugugaccucca

SEQ ID NO: 1117572 - RNA, 20 nt, Homo sapiens
caugauuuuauacauaguca

SEQ ID NO: 1117573 - RNA, 15 nt, Homo sapiens
cagauuaccaaagaa

SEQ ID NO: 1117574 - RNA, 15 nt, Homo sapiens
cagcacaguuuuuaa

SEQ ID NO: 1117575 - RNA, 10 nt, Homo sapiens
cagcacuaac

SEQ ID NO: 1117576 - RNA, 15 nt, Homo sapiens
cagcacuaauucaac

SEQ ID NO: 1117577 - RNA, 20 nt, Homo sapiens
cagcacucugaaacugagaa

SEQ ID NO: 1117578 - RNA, 18 nt, Homo sapiens
cagcacuuguguugucug

SEQ ID NO: 1117579 - RNA, 23 nt, Homo sapiens
cagcagcccuaaggaucucucag

SEQ ID NO: 1117580 - RNA, 23 nt, Homo sapiens
cagcaggcauaaggcaccaguua

SEQ ID NO: 1117581 - RNA, 21 nt, Homo sapiens
cagcauaccugcuggugcaga

SEQ ID NO: 1117582 - RNA, 17 nt, Homo sapiens
cagcaugggaaugugcc

SEQ ID NO: 1117583 - RNA, 16 nt, Homo sapiens
cagccaaacagagccu

SEQ ID NO: 1117584 - RNA, 16 nt, Homo sapiens
cagccacacagagccu

SEQ ID NO: 1117585 - RNA, 20 nt, Homo sapiens
cagccagaggaggccgguga

SEQ ID NO: 1117586 - RNA, 18 nt, Homo sapiens
cagccaucaagagacuga

SEQ ID NO: 1117587 - RNA, 15 nt, Homo sapiens
cagccaucaagggaa

SEQ ID NO: 1117588 - RNA, 11 nt, Homo sapiens
cagcccauucu

SEQ ID NO: 1117589 - RNA, 19 nt, Homo sapiens
cagcccccaccuccgcccc

SEQ ID NO: 1117590 - RNA, 19 nt, Homo sapiens
cagccucccgaauagcugg

SEQ ID NO: 1117591 - RNA, 20 nt, Homo sapiens
cagccucccgaauagcuggg

SEQ ID NO: 1117592 - RNA, 19 nt, Homo sapiens
cagccucccgaguagcugg

SEQ ID NO: 1117593 - RNA, 16 nt, Homo sapiens
cagccuccuccugacc

SEQ ID NO: 1117594 - RNA, 17 nt, Homo sapiens
cagccucgcaugccaga

SEQ ID NO: 1117595 - RNA, 22 nt, Homo sapiens
cagccugagcaacagagugaga

SEQ ID NO: 1117596 - RNA, 18 nt, Homo sapiens
cagccugcagacucacug

SEQ ID NO: 1117597 - RNA, 20 nt, Homo sapiens
caaccuccccgcagagcucc

SEQ ID NO: 1117598 - RNA, 21 nt, Homo sapiens
caaccugcucuccucuugcca

SEQ ID NO: 1117599 - RNA, 23 nt, Homo sapiens
caaccuggucacaggacucugcc

SEQ ID NO: 1117600 - RNA, 21 nt, Homo sapiens
caaccuguucuuccuaccaaa

SEQ ID NO: 1117601 - RNA, 19 nt, Homo sapiens
caacuaggauacuuucuac

SEQ ID NO: 1117602 - RNA, 22 nt, Homo sapiens
caacucucuccuguauaaucuc

SEQ ID NO: 1117603 - RNA, 20 nt, Homo sapiens
caacugaaaagacucagugu

SEQ ID NO: 1117604 - RNA, 23 nt, Homo sapiens
caacugugcuacacuugcaccug

SEQ ID NO: 1117605 - RNA, 21 nt, Homo sapiens
caacuuaagcugggauaauca

SEQ ID NO: 1117606 - RNA, 21 nt, Homo sapiens
caacuugaaauuauaucugug

SEQ ID NO: 1117607 - RNA, 22 nt, Homo sapiens
caacuugaaauuauaucugugg

SEQ ID NO: 1117608 - RNA, 12 nt, Homo sapiens
caacuuugacaa

SEQ ID NO: 1117609 - RNA, 19 nt, Homo sapiens
caagaaauccaguuuccca

SEQ ID NO: 1117610 - RNA, 14 nt, Homo sapiens
caagaaggggacag

SEQ ID NO: 1117611 - RNA, 21 nt, Homo sapiens
caagaagucuugagaaaaaga

SEQ ID NO: 1117612 - RNA, 11 nt, Homo sapiens
caagaaugaga

SEQ ID NO: 1117613 - RNA, 21 nt, Homo sapiens
caagacagauuaccaaagaag

SEQ ID NO: 1117614 - RNA, 14 nt, Homo sapiens
caagacccuaugaa

SEQ ID NO: 1117615 - RNA, 14 nt, Homo sapiens
caagagacugaguc

SEQ ID NO: 1117616 - RNA, 11 nt, Homo sapiens
caagagccaug

SEQ ID NO: 1117617 - RNA, 13 nt, Homo sapiens
caagagcccuguc

SEQ ID NO: 1117618 - RNA, 20 nt, Homo sapiens
caagagugagugaacaacua

SEQ ID NO: 1117619 - RNA, 20 nt, Homo sapiens
caagaucgcgccacugcacu

SEQ ID NO: 1117620 - RNA, 16 nt, Homo sapiens
caagaucuuucaggaa

SEQ ID NO: 1117621 - RNA, 17 nt, Homo sapiens
caagaugaucacaugga

SEQ ID NO: 1117622 - RNA, 15 nt, Homo sapiens
caagcaacauaaaac

SEQ ID NO: 1117623 - RNA, 21 nt, Homo sapiens
caagcagagugauucaggggc

SEQ ID NO: 1117624 - RNA, 15 nt, Homo sapiens
caagccuauugugcc

SEQ ID NO: 1117625 - RNA, 16 nt, Homo sapiens
caagccugccuaggaa

SEQ ID NO: 1117626 - RNA, 19 nt, Homo sapiens
caagcuccuggucuugaga

SEQ ID NO: 1117627 - RNA, 21 nt, Homo sapiens
caagcuggucccacucagucc

SEQ ID NO: 1117628 - RNA, 21 nt, Homo sapiens
caaggaggucgggauggggcu

SEQ ID NO: 1117629 - RNA, 16 nt, Homo sapiens
caaggaugacacugcc

SEQ ID NO: 1117630 - RNA, 19 nt, Homo sapiens
caaggcuuuauauuuuuaa

SEQ ID NO: 1117631 - RNA, 23 nt, Homo sapiens
caaguauucauuuuuucuacccu

SEQ ID NO: 1117632 - RNA, 21 nt, Homo sapiens
caagucaggcccuuauuuuca

SEQ ID NO: 1117633 - RNA, 14 nt, Homo sapiens
caagugacaucucu

SEQ ID NO: 1117634 - RNA, 15 nt, Homo sapiens
caagugagacaauca

SEQ ID NO: 1117635 - RNA, 15 nt, Homo sapiens
caagugcacuugaac

SEQ ID NO: 1117636 - RNA, 23 nt, Homo sapiens
caaguuaaaaccugcaaagcuaa

SEQ ID NO: 1117637 - RNA, 23 nt, Homo sapiens
caaguuaaagugaauaaccacuu

SEQ ID NO: 1117638 - RNA, 16 nt, Homo sapiens
caaguuagcucaggag

SEQ ID NO: 1117639 - RNA, 21 nt, Homo sapiens
caaguugaaaucagaagccua

SEQ ID NO: 1117640 - RNA, 12 nt, Homo sapiens
caaguuuuuaca

SEQ ID NO: 1117641 - RNA, 15 nt, Homo sapiens
caauaaaacauuccu

SEQ ID NO: 1117642 - RNA, 15 nt, Homo sapiens
caauaaaucaacucc

SEQ ID NO: 1117643 - RNA, 19 nt, Homo sapiens
caauaauucuaugagauag

SEQ ID NO: 1117644 - RNA, 14 nt, Homo sapiens
caauaauuucaggu

SEQ ID NO: 1117645 - RNA, 23 nt, Homo sapiens
caauagacuguacuuauuuucca

SEQ ID NO: 1117646 - RNA, 17 nt, Homo sapiens
caauaucugacaguuac

SEQ ID NO: 1117647 - RNA, 16 nt, Homo sapiens
caauccccaagcuggc

SEQ ID NO: 1117648 - RNA, 13 nt, Homo sapiens
caaugaccuguau

SEQ ID NO: 1117649 - RNA, 15 nt, Homo sapiens
caaugccaaucuuca

SEQ ID NO: 1117650 - RNA, 16 nt, Homo sapiens
caauggcuuacuccag

SEQ ID NO: 1117651 - RNA, 15 nt, Homo sapiens
caauguuuaugcaag

SEQ ID NO: 1117652 - RNA, 21 nt, Homo sapiens
caauuagcaauugacugucac

SEQ ID NO: 1117653 - RNA, 14 nt, Homo sapiens
caauuaugugacaa

SEQ ID NO: 1117654 - RNA, 21 nt, Homo sapiens
caauuaugugacaaccuuugu

SEQ ID NO: 1117655 - RNA, 19 nt, Homo sapiens
caauucaaaacauugugcc

SEQ ID NO: 1117656 - RNA, 23 nt, Homo sapiens
caauucacuagaccagaagugga

SEQ ID NO: 1117657 - RNA, 13 nt, Homo sapiens
cacguuuguauca

SEQ ID NO: 1117658 - RNA, 16 nt, Homo sapiens
cacuaaggugugcucu

SEQ ID NO: 1117659 - RNA, 18 nt, Homo sapiens
cacuaauggggcggugag

SEQ ID NO: 1117660 - RNA, 22 nt, Homo sapiens
cacuaauuugauguuuacaggu

SEQ ID NO: 1117661 - RNA, 19 nt, Homo sapiens
cacuacacuccagccugag

SEQ ID NO: 1117662 - RNA, 17 nt, Homo sapiens
cacuagucacauucuug

SEQ ID NO: 1117663 - RNA, 15 nt, Homo sapiens
cacuauaaccaucag

SEQ ID NO: 1117664 - RNA, 19 nt, Homo sapiens
cacuauagccuaggugaca

SEQ ID NO: 1117665 - RNA, 21 nt, Homo sapiens
cacuauagccuaggugacaga

SEQ ID NO: 1117666 - RNA, 11 nt, Homo sapiens
cacuaucuuuc

SEQ ID NO: 1117667 - RNA, 14 nt, Homo sapiens
cacuauuuacauac

SEQ ID NO: 1117668 - RNA, 17 nt, Homo sapiens
cacucauuucaucucau

SEQ ID NO: 1117669 - RNA, 21 nt, Homo sapiens
cacucuacugcaagacuuaaa

SEQ ID NO: 1117670 - RNA, 16 nt, Homo sapiens
cacucucaaauccuga

SEQ ID NO: 1117671 - RNA, 23 nt, Homo sapiens
cacucuccccucccucuuccuuc

SEQ ID NO: 1117672 - RNA, 22 nt, Homo sapiens
cacucucuaaaucuuccuugug

SEQ ID NO: 1117673 - RNA, 13 nt, Homo sapiens
cacugaaaugcua

SEQ ID NO: 1117674 - RNA, 22 nt, Homo sapiens
cacugaaaugcuagcugcaagu

SEQ ID NO: 1117675 - RNA, 20 nt, Homo sapiens
cacugaaucuccccuccuca

SEQ ID NO: 1117676 - RNA, 20 nt, Homo sapiens
cacugaauuuuguguguacc

SEQ ID NO: 1117677 - RNA, 11 nt, Homo sapiens
cacugaucaau

SEQ ID NO: 1117678 - RNA, 23 nt, Homo sapiens
cacuggaaucgaucuguacugua

SEQ ID NO: 1117679 - RNA, 14 nt, Homo sapiens
cacuggaggucaca

SEQ ID NO: 1117680 - RNA, 21 nt, Homo sapiens
cacuggcauuaaagugcugua

SEQ ID NO: 1117681 - RNA, 20 nt, Homo sapiens
cacuguacaagguaccccuu

SEQ ID NO: 1117682 - RNA, 15 nt, Homo sapiens
cacuguauguuuacu

SEQ ID NO: 1117683 - RNA, 17 nt, Homo sapiens
aguaacucaucugucac

SEQ ID NO: 1117684 - RNA, 18 nt, Homo sapiens
aguaacucaucugucacc

SEQ ID NO: 1117685 - RNA, 20 nt, Homo sapiens
aguaacuuaaccagcacauu

SEQ ID NO: 1117686 - RNA, 15 nt, Homo sapiens
aguaaugagcaugau

SEQ ID NO: 1117687 - RNA, 17 nt, Homo sapiens
aguaauucuagcuuuca

SEQ ID NO: 1117688 - RNA, 13 nt, Homo sapiens
aguacaaccugaa

SEQ ID NO: 1117689 - RNA, 15 nt, Homo sapiens
aguaccacucaggcc

SEQ ID NO: 1117690 - RNA, 14 nt, Homo sapiens
aguaccuguaguga

SEQ ID NO: 1117691 - RNA, 15 nt, Homo sapiens
aguacuccugcaaaa

SEQ ID NO: 1117692 - RNA, 18 nt, Homo sapiens
aguagauaugaggcauuu

SEQ ID NO: 1117693 - RNA, 20 nt, Homo sapiens
aguagcugggacuacaggca

SEQ ID NO: 1117694 - RNA, 16 nt, Homo sapiens
aguagguuuacauuca

SEQ ID NO: 1117695 - RNA, 22 nt, Homo sapiens
aguagguuuacauucaucucau

SEQ ID NO: 1117696 - RNA, 18 nt, Homo sapiens
aguagugcccacuugagg

SEQ ID NO: 1117697 - RNA, 14 nt, Homo sapiens
aguagugucuuccu

SEQ ID NO: 1117698 - RNA, 16 nt, Homo sapiens
aguaguuuuucagcua

SEQ ID NO: 1117699 - RNA, 23 nt, Homo sapiens
aguauacaauaaagucuuaccuc

SEQ ID NO: 1117700 - RNA, 13 nt, Homo sapiens
aguaugugaauau

SEQ ID NO: 1117701 - RNA, 14 nt, Homo sapiens
aguauucauuuucc

SEQ ID NO: 1117702 - RNA, 16 nt, Homo sapiens
aguauuguccauauca

SEQ ID NO: 1117703 - RNA, 12 nt, Homo sapiens
aguauugugcau

SEQ ID NO: 1117704 - RNA, 15 nt, Homo sapiens
agucaaaacagagau

SEQ ID NO: 1117705 - RNA, 14 nt, Homo sapiens
agucaacaguucaa

SEQ ID NO: 1117706 - RNA, 14 nt, Homo sapiens
agucaauuuuacaa

SEQ ID NO: 1117707 - RNA, 20 nt, Homo sapiens
agucacacuguuacuccaca

SEQ ID NO: 1117708 - RNA, 22 nt, Homo sapiens
agucacauggccuaugcacaua

SEQ ID NO: 1117709 - RNA, 20 nt, Homo sapiens
agucauggcccaaauccagu

SEQ ID NO: 1117710 - RNA, 17 nt, Homo sapiens
aguccuacaagcuaaaa

SEQ ID NO: 1117711 - RNA, 12 nt, Homo sapiens
aguccucugcau

SEQ ID NO: 1117712 - RNA, 11 nt, Homo sapiens
aguccuggaag

SEQ ID NO: 1117713 - RNA, 19 nt, Homo sapiens
agucuaucaaccccagaca

SEQ ID NO: 1117714 - RNA, 22 nt, Homo sapiens
agucuaucaaccccagacacug

SEQ ID NO: 1117715 - RNA, 23 nt, Homo sapiens
agucuaucaaccccagacacugg

SEQ ID NO: 1117716 - RNA, 16 nt, Homo sapiens
agucucacuguugccc

SEQ ID NO: 1117717 - RNA, 12 nt, Homo sapiens
agucuccagugg

SEQ ID NO: 1117718 - RNA, 23 nt, Homo sapiens
agucuccucucugagacugcuaa

SEQ ID NO: 1117719 - RNA, 14 nt, Homo sapiens
agucucuaugaucu

SEQ ID NO: 1117720 - RNA, 18 nt, Homo sapiens
agucucugacucuugccu

SEQ ID NO: 1117721 - RNA, 11 nt, Homo sapiens
agucucugugc

SEQ ID NO: 1117722 - RNA, 22 nt, Homo sapiens
agucucuuuaaucuucaguuuu

SEQ ID NO: 1117723 - RNA, 17 nt, Homo sapiens
agucugauucccaagcu

SEQ ID NO: 1117724 - RNA, 15 nt, Homo sapiens
agucugggugucuca

SEQ ID NO: 1117725 - RNA, 16 nt, Homo sapiens
agucugucauccagaa

SEQ ID NO: 1117726 - RNA, 17 nt, Homo sapiens
agucuugaaacaagcaa

SEQ ID NO: 1117727 - RNA, 22 nt, Homo sapiens
auauuucagauaucagaaucau

SEQ ID NO: 1117728 - RNA, 13 nt, Homo sapiens
auauuucaggcau

SEQ ID NO: 1117729 - RNA, 18 nt, Homo sapiens
auauuucaggcauacuga

SEQ ID NO: 1117730 - RNA, 18 nt, Homo sapiens
auauuuccauucaugcca

SEQ ID NO: 1117731 - RNA, 15 nt, Homo sapiens
auauuuucacaugac

SEQ ID NO: 1117732 - RNA, 19 nt, Homo sapiens
auauuuucccucucuugcc

SEQ ID NO: 1117733 - RNA, 20 nt, Homo sapiens
auauuuucccucucuugccu

SEQ ID NO: 1117734 - RNA, 15 nt, Homo sapiens
auauuuuguguauaa

SEQ ID NO: 1117735 - RNA, 14 nt, Homo sapiens
auauuuuucaacca

SEQ ID NO: 1117736 - RNA, 19 nt, Homo sapiens
auauuuuugguugucaaua

SEQ ID NO: 1117737 - RNA, 17 nt, Homo sapiens
aucaaaaucacuaucuu

SEQ ID NO: 1117738 - RNA, 21 nt, Homo sapiens
aucaaaaucuuucagcacuca

SEQ ID NO: 1117739 - RNA, 19 nt, Homo sapiens
aucaaaguuccuguucacc

SEQ ID NO: 1117740 - RNA, 12 nt, Homo sapiens
aucaaauuucac

SEQ ID NO: 1117741 - RNA, 21 nt, Homo sapiens
aucaaccauaugaauuuacua

SEQ ID NO: 1117742 - RNA, 17 nt, Homo sapiens
aucaagcccuuuacuug

SEQ ID NO: 1117743 - RNA, 19 nt, Homo sapiens
aucaauucaacacauuacu

SEQ ID NO: 1117744 - RNA, 22 nt, Homo sapiens
aucaauucuauuacgugcaaua

SEQ ID NO: 1117745 - RNA, 23 nt, Homo sapiens
aucaauucuauuacgugcaauac

SEQ ID NO: 1117746 - RNA, 20 nt, Homo sapiens
aucaauuuuuauacauauca

SEQ ID NO: 1117747 - RNA, 11 nt, Homo sapiens
aucacaacauu

SEQ ID NO: 1117748 - RNA, 22 nt, Homo sapiens
aucacauagaagcuguccuuga

SEQ ID NO: 1117749 - RNA, 21 nt, Homo sapiens
aucaccuugauaaugggauga

SEQ ID NO: 1117750 - RNA, 21 nt, Homo sapiens
aucacgccacugcacuccagc

SEQ ID NO: 1117751 - RNA, 21 nt, Homo sapiens
aucacuaucuuucugauaaca

SEQ ID NO: 1117752 - RNA, 21 nt, Homo sapiens
aucacugaggcauuuuuacua

SEQ ID NO: 1117753 - RNA, 16 nt, Homo sapiens
aucacuuggagccagg

SEQ ID NO: 1117754 - RNA, 16 nt, Homo sapiens
aucagaaaugucauca

SEQ ID NO: 1117755 - RNA, 16 nt, Homo sapiens
aucagacuagugacaa

SEQ ID NO: 1117756 - RNA, 14 nt, Homo sapiens
aucagacucaucua

SEQ ID NO: 1117757 - RNA, 17 nt, Homo sapiens
aucagacuccugugcaa

SEQ ID NO: 1117758 - RNA, 14 nt, Homo sapiens
aucaguaugcuguu

SEQ ID NO: 1117759 - RNA, 17 nt, Homo sapiens
aucagugaagaugccag

SEQ ID NO: 1117760 - RNA, 21 nt, Homo sapiens
aucauacaugacucagcauac

SEQ ID NO: 1117761 - RNA, 23 nt, Homo sapiens
aucauauaauaaauguacauuaa

SEQ ID NO: 1117762 - RNA, 22 nt, Homo sapiens
aucauaugguugacaguaugca

SEQ ID NO: 1117763 - RNA, 19 nt, Homo sapiens
aucauccagaaguuccuca

SEQ ID NO: 1117764 - RNA, 12 nt, Homo sapiens
aucaucucucau

SEQ ID NO: 1117765 - RNA, 15 nt, Homo sapiens
aucauggcuaucugu

SEQ ID NO: 1117766 - RNA, 17 nt, Homo sapiens
aucauguaaaugauuau

SEQ ID NO: 1117767 - RNA, 13 nt, Homo sapiens
aucauguauuuau

SEQ ID NO: 1117768 - RNA, 16 nt, Homo sapiens
auccaagaaucaguga

SEQ ID NO: 1117769 - RNA, 20 nt, Homo sapiens
auccacucuucuagggauau

SEQ ID NO: 1117770 - RNA, 15 nt, Homo sapiens
auccacugugccaug

SEQ ID NO: 1117771 - RNA, 21 nt, Homo sapiens
auccagaccucuacaagcaaa

SEQ ID NO: 1117772 - RNA, 19 nt, Homo sapiens
auccaucaggacuugggaa

SEQ ID NO: 1117773 - RNA, 22 nt, Homo sapiens
auccaugccugggaaaugccac

SEQ ID NO: 1117774 - RNA, 20 nt, Homo sapiens
auccaugcuuggguguaaca

SEQ ID NO: 1117775 - RNA, 23 nt, Homo sapiens
auccauuccucagggacagagac

SEQ ID NO: 1117776 - RNA, 16 nt, Homo sapiens
auccauuuaugucuca

SEQ ID NO: 1117777 - RNA, 19 nt, Homo sapiens
auaaaucaaugucacuuaa

SEQ ID NO: 1117778 - RNA, 20 nt, Homo sapiens
auaaaugaggaaacuccaaa

SEQ ID NO: 1117779 - RNA, 17 nt, Homo sapiens
auaaauguguaaaugug

SEQ ID NO: 1117780 - RNA, 18 nt, Homo sapiens
auaaauguguggugcuaa

SEQ ID NO: 1117781 - RNA, 18 nt, Homo sapiens
auaaauugcuccuugaca

SEQ ID NO: 1117782 - RNA, 18 nt, Homo sapiens
auaaauuuaucaucucga

SEQ ID NO: 1117783 - RNA, 17 nt, Homo sapiens
auaaauuuuauaaucau

SEQ ID NO: 1117784 - RNA, 18 nt, Homo sapiens
auaacuaguguugcuugg

SEQ ID NO: 1117785 - RNA, 21 nt, Homo sapiens
auaacuuaaaaaaaugacaga

SEQ ID NO: 1117786 - RNA, 14 nt, Homo sapiens
auaagaaacacaaa

SEQ ID NO: 1117787 - RNA, 18 nt, Homo sapiens
auaagagugccguaacaa

SEQ ID NO: 1117788 - RNA, 19 nt, Homo sapiens
auaagcagaagcacauaug

SEQ ID NO: 1117789 - RNA, 21 nt, Homo sapiens
auaagcaucuguguaaccucc

SEQ ID NO: 1117790 - RNA, 23 nt, Homo sapiens
auaauagguuugugacuuuccua

SEQ ID NO: 1117791 - RNA, 22 nt, Homo sapiens
auaaucaaaacccaacaugacu

SEQ ID NO: 1117792 - RNA, 20 nt, Homo sapiens
auaaucacauuaucaucuga

SEQ ID NO: 1117793 - RNA, 18 nt, Homo sapiens
auaaucgagucuaccucu

SEQ ID NO: 1117794 - RNA, 18 nt, Homo sapiens
auaaugaaaauuaugaua

SEQ ID NO: 1117795 - RNA, 17 nt, Homo sapiens
auaauggaaacauuuac

SEQ ID NO: 1117796 - RNA, 23 nt, Homo sapiens
auaauuaggaucuaugcaauuuu

SEQ ID NO: 1117797 - RNA, 15 nt, Homo sapiens
auaauugacaugggc

SEQ ID NO: 1117798 - RNA, 23 nt, Homo sapiens
auaauuuucuaccuggucucucc

SEQ ID NO: 1117799 - RNA, 19 nt, Homo sapiens
auacaaauuguuucuggaa

SEQ ID NO: 1117800 - RNA, 16 nt, Homo sapiens
auacagcucagcuuuu

SEQ ID NO: 1117801 - RNA, 12 nt, Homo sapiens
auacagugucuu

SEQ ID NO: 1117802 - RNA, 13 nt, Homo sapiens
auacauaagacca

SEQ ID NO: 1117803 - RNA, 12 nt, Homo sapiens
auacauaccuac

SEQ ID NO: 1117804 - RNA, 16 nt, Homo sapiens
auacaugacucagcau

SEQ ID NO: 1117805 - RNA, 12 nt, Homo sapiens
auacauugccaa

SEQ ID NO: 1117806 - RNA, 17 nt, Homo sapiens
auaccauauacagcuca

SEQ ID NO: 1117807 - RNA, 15 nt, Homo sapiens
auacccacuaacaaa

SEQ ID NO: 1117808 - RNA, 23 nt, Homo sapiens
auacgugaaagaugcaagcaccu

SEQ ID NO: 1117809 - RNA, 18 nt, Homo sapiens
auacuaaaaaucaugaga

SEQ ID NO: 1117810 - RNA, 18 nt, Homo sapiens
auacuaagggaagaaaca

SEQ ID NO: 1117811 - RNA, 17 nt, Homo sapiens
auacucaaaagagagag

SEQ ID NO: 1117812 - RNA, 22 nt, Homo sapiens
auacuccauacauaacuugaua

SEQ ID NO: 1117813 - RNA, 19 nt, Homo sapiens
auacucuagaacaugcaca

SEQ ID NO: 1117814 - RNA, 18 nt, Homo sapiens
auacugaccuuguagcua

SEQ ID NO: 1117815 - RNA, 18 nt, Homo sapiens
auacugcaugcucaggac

SEQ ID NO: 1117816 - RNA, 19 nt, Homo sapiens
auacugcucaucauuccuu

SEQ ID NO: 1117817 - RNA, 16 nt, Homo sapiens
auagaaagcuguuuau

SEQ ID NO: 1117818 - RNA, 23 nt, Homo sapiens
auagaccucucaauuucuggaaa

SEQ ID NO: 1117819 - RNA, 23 nt, Homo sapiens
auagauauuccuauugugcaaug

SEQ ID NO: 1117820 - RNA, 19 nt, Homo sapiens
auagaugaacuauuagaca

SEQ ID NO: 1117821 - RNA, 21 nt, Homo sapiens
auagauuuucugcuacuuugc

SEQ ID NO: 1117822 - RNA, 15 nt, Homo sapiens
auagcaauguaacau

SEQ ID NO: 1117823 - RNA, 14 nt, Homo sapiens
auagcaauuucgcc

SEQ ID NO: 1117824 - RNA, 23 nt, Homo sapiens
auagccaacugcuguucauguua

SEQ ID NO: 1117825 - RNA, 12 nt, Homo sapiens
auagccacuuac

SEQ ID NO: 1117826 - RNA, 21 nt, Homo sapiens
auagcucacuguaaccucaaa

SEQ ID NO: 1117827 - RNA, 16 nt, Homo sapiens
auaggacccauauucc

SEQ ID NO: 1117828 - RNA, 22 nt, Homo sapiens
auaggcccuggaugugcccaca

SEQ ID NO: 1117829 - RNA, 12 nt, Homo sapiens
auagguuuccac

SEQ ID NO: 1117830 - RNA, 14 nt, Homo sapiens
auaguaaaugcuuu

SEQ ID NO: 1117831 - RNA, 16 nt, Homo sapiens
auaguauucauuuucc

SEQ ID NO: 1117832 - RNA, 15 nt, Homo sapiens
auagucacauggccu

SEQ ID NO: 1117833 - RNA, 16 nt, Homo sapiens
auaguggagagaacug

SEQ ID NO: 1117834 - RNA, 10 nt, Homo sapiens
auagugucuu

SEQ ID NO: 1117835 - RNA, 16 nt, Homo sapiens
auaguguuggaaaaug

SEQ ID NO: 1117836 - RNA, 15 nt, Homo sapiens
auauaaacacuauau

SEQ ID NO: 1117837 - RNA, 15 nt, Homo sapiens
auauaaugguuuacu

SEQ ID NO: 1117838 - RNA, 19 nt, Homo sapiens
auauaaugguuuacugcug

SEQ ID NO: 1117839 - RNA, 15 nt, Homo sapiens
auauacaauaacaua

SEQ ID NO: 1117840 - RNA, 17 nt, Homo sapiens
auauacaauaacauaau

SEQ ID NO: 1117841 - RNA, 13 nt, Homo sapiens
auauacauaugac

SEQ ID NO: 1117842 - RNA, 14 nt, Homo sapiens
auauacauaugaca

SEQ ID NO: 1117843 - RNA, 13 nt, Homo sapiens
auauaguuuacua

SEQ ID NO: 1117844 - RNA, 13 nt, Homo sapiens
auauaucaaggau

SEQ ID NO: 1117845 - RNA, 12 nt, Homo sapiens
auaucagaaaag

SEQ ID NO: 1117846 - RNA, 14 nt, Homo sapiens
auaucaucagcaua

SEQ ID NO: 1117847 - RNA, 21 nt, Homo sapiens
auaucaucagcauaccuuuau

SEQ ID NO: 1117848 - RNA, 17 nt, Homo sapiens
auauccagauggcaugu

SEQ ID NO: 1117849 - RNA, 23 nt, Homo sapiens
auauccagauggcauguguuuac

SEQ ID NO: 1117850 - RNA, 15 nt, Homo sapiens
auaucuguggucuuc

SEQ ID NO: 1117851 - RNA, 14 nt, Homo sapiens
auaucuuauguuaa

SEQ ID NO: 1117852 - RNA, 15 nt, Homo sapiens
auaugaaacauuuaa

SEQ ID NO: 1117853 - RNA, 18 nt, Homo sapiens
auaugaacuggaccugca

SEQ ID NO: 1117854 - RNA, 18 nt, Homo sapiens
auaugcaccuugugucug

SEQ ID NO: 1117855 - RNA, 14 nt, Homo sapiens
auaugcauuaugaa

SEQ ID NO: 1117856 - RNA, 14 nt, Homo sapiens
auaugcugccaaau

SEQ ID NO: 1117857 - RNA, 16 nt, Homo sapiens
auauggaaauccuguu

SEQ ID NO: 1117858 - RNA, 16 nt, Homo sapiens
auauggacucugcaca

SEQ ID NO: 1117859 - RNA, 16 nt, Homo sapiens
auauguguucauuaaa

SEQ ID NO: 1117860 - RNA, 21 nt, Homo sapiens
auauguuuuaagaggcagggu

SEQ ID NO: 1117861 - RNA, 13 nt, Homo sapiens
auauuccugcauu

SEQ ID NO: 1117862 - RNA, 21 nt, Homo sapiens
auauuccugcauuugugaaau

SEQ ID NO: 1117863 - RNA, 19 nt, Homo sapiens
auauugauaaaaccauaca

SEQ ID NO: 1117864 - RNA, 15 nt, Homo sapiens
auauuggacugauaa

SEQ ID NO: 1117865 - RNA, 19 nt, Homo sapiens
auauuuauagcaauccaug

SEQ ID NO: 1117866 - RNA, 19 nt, Homo sapiens
agcagguagugggugaaug

SEQ ID NO: 1117867 - RNA, 19 nt, Homo sapiens
agcaggugguccugagacc

SEQ ID NO: 1117868 - RNA, 18 nt, Homo sapiens
agcauaaguuucugggac

SEQ ID NO: 1117869 - RNA, 14 nt, Homo sapiens
agcaucaaagcacu

SEQ ID NO: 1117870 - RNA, 16 nt, Homo sapiens
agcaucaccucaggcc

SEQ ID NO: 1117871 - RNA, 21 nt, Homo sapiens
agcaucacuugggauuaauau

SEQ ID NO: 1117872 - RNA, 21 nt, Homo sapiens
agcauccuggccaacauggug

SEQ ID NO: 1117873 - RNA, 19 nt, Homo sapiens
agcaucugacucacaagaa

SEQ ID NO: 1117874 - RNA, 15 nt, Homo sapiens
agcaugaugagaguu

SEQ ID NO: 1117875 - RNA, 22 nt, Homo sapiens
agcauuacgugagccagguaau

SEQ ID NO: 1117876 - RNA, 18 nt, Homo sapiens
agcauuucccucccggga

SEQ ID NO: 1117877 - RNA, 21 nt, Homo sapiens
agcauuuuacuacuuguuacc

SEQ ID NO: 1117878 - RNA, 13 nt, Homo sapiens
agccaaacagagc

SEQ ID NO: 1117879 - RNA, 15 nt, Homo sapiens
agccaaacucugcca

SEQ ID NO: 1117880 - RNA, 13 nt, Homo sapiens
agccacacagagc

SEQ ID NO: 1117881 - RNA, 17 nt, Homo sapiens
agccacauuuugcauua

SEQ ID NO: 1117882 - RNA, 22 nt, Homo sapiens
agccagauggaguaccaugagg

SEQ ID NO: 1117883 - RNA, 14 nt, Homo sapiens
agccagcccugccu

SEQ ID NO: 1117884 - RNA, 22 nt, Homo sapiens
agccauaguggagagaacugaa

SEQ ID NO: 1117885 - RNA, 23 nt, Homo sapiens
agccaucaccuugauaaugggau

SEQ ID NO: 1117886 - RNA, 19 nt, Homo sapiens
agccaucaugugccuggaa

SEQ ID NO: 1117887 - RNA, 12 nt, Homo sapiens
agccauccauga

SEQ ID NO: 1117888 - RNA, 17 nt, Homo sapiens
agccauuuuuagcucug

SEQ ID NO: 1117889 - RNA, 19 nt, Homo sapiens
agccauuuuuuaaaugaca

SEQ ID NO: 1117890 - RNA, 20 nt, Homo sapiens
agcccaaauggcucugugaa

SEQ ID NO: 1117891 - RNA, 17 nt, Homo sapiens
agcccagaaaaccucca

SEQ ID NO: 1117892 - RNA, 15 nt, Homo sapiens
agcccauaaagcaag

SEQ ID NO: 1117893 - RNA, 14 nt, Homo sapiens
agcccauggcuuua

SEQ ID NO: 1117894 - RNA, 20 nt, Homo sapiens
agccccuuacuaugaucuca

SEQ ID NO: 1117895 - RNA, 21 nt, Homo sapiens
agccccuuacuaugaucucag

SEQ ID NO: 1117896 - RNA, 23 nt, Homo sapiens
agccccuuacuaugaucucagga

SEQ ID NO: 1117897 - RNA, 17 nt, Homo sapiens
agcccugcagccaaaca

SEQ ID NO: 1117898 - RNA, 16 nt, Homo sapiens
agcccugggaccgcua

SEQ ID NO: 1117899 - RNA, 16 nt, Homo sapiens
agcccuuagcagggaa

SEQ ID NO: 1117900 - RNA, 15 nt, Homo sapiens
agcccuuggaucagu

SEQ ID NO: 1117901 - RNA, 14 nt, Homo sapiens
agcccuuuacuuga

SEQ ID NO: 1117902 - RNA, 16 nt, Homo sapiens
agccgcugcacaucac

SEQ ID NO: 1117903 - RNA, 18 nt, Homo sapiens
agccggggcgaguggcac

SEQ ID NO: 1117904 - RNA, 18 nt, Homo sapiens
agccuaggugacagagug

SEQ ID NO: 1117905 - RNA, 18 nt, Homo sapiens
agccucccuguaacucca

SEQ ID NO: 1117906 - RNA, 19 nt, Homo sapiens
agccucgcaacccgugcca

SEQ ID NO: 1117907 - RNA, 14 nt, Homo sapiens
agccucuccaggaa

SEQ ID NO: 1117908 - RNA, 14 nt, Homo sapiens
agccucugaucagu

SEQ ID NO: 1117909 - RNA, 12 nt, Homo sapiens
agccucuguccc

SEQ ID NO: 1117910 - RNA, 16 nt, Homo sapiens
agccugagccaaagag

SEQ ID NO: 1117911 - RNA, 13 nt, Homo sapiens
aggcaaaggccag

SEQ ID NO: 1117912 - RNA, 19 nt, Homo sapiens
aggcaagaaccaguguuua

SEQ ID NO: 1117913 - RNA, 21 nt, Homo sapiens
aggcacaaaccuuacuaugga

SEQ ID NO: 1117914 - RNA, 22 nt, Homo sapiens
aggcaccaguuacccugcaugu

SEQ ID NO: 1117915 - RNA, 18 nt, Homo sapiens
aggcacguuuggcauuuc

SEQ ID NO: 1117916 - RNA, 23 nt, Homo sapiens
aggcagaauccuacaacuuccac

SEQ ID NO: 1117917 - RNA, 17 nt, Homo sapiens
aggcagagguggugggg

SEQ ID NO: 1117918 - RNA, 21 nt, Homo sapiens
aggcagggccuugcccagaga

SEQ ID NO: 1117919 - RNA, 14 nt, Homo sapiens
aggcagggucucac

SEQ ID NO: 1117920 - RNA, 13 nt, Homo sapiens
aggcaguguuccu

SEQ ID NO: 1117921 - RNA, 20 nt, Homo sapiens
aggcaguguuccucaccaau

SEQ ID NO: 1117922 - RNA, 19 nt, Homo sapiens
aggcauaagaaaacuaaga

SEQ ID NO: 1117923 - RNA, 16 nt, Homo sapiens
aggcaucuacacagcc

SEQ ID NO: 1117924 - RNA, 20 nt, Homo sapiens
aggcaugagaaucacuugaa

SEQ ID NO: 1117925 - RNA, 16 nt, Homo sapiens
aggccacaccaucucc

SEQ ID NO: 1117926 - RNA, 12 nt, Homo sapiens
aggccagcagca

SEQ ID NO: 1117927 - RNA, 20 nt, Homo sapiens
aggccaggugcaguggcuca

SEQ ID NO: 1117928 - RNA, 16 nt, Homo sapiens
aggccccaugaccucc

SEQ ID NO: 1117929 - RNA, 20 nt, Homo sapiens
aggcccugccuucagcccug

SEQ ID NO: 1117930 - RNA, 20 nt, Homo sapiens
aggccgggcgcgguggcuca

SEQ ID NO: 1117931 - RNA, 21 nt, Homo sapiens
aggccggugugggcugugucg

SEQ ID NO: 1117932 - RNA, 23 nt, Homo sapiens
aggccuggccagaugcaccagcc

SEQ ID NO: 1117933 - RNA, 19 nt, Homo sapiens
aggccuuuccccagugugg

SEQ ID NO: 1117934 - RNA, 20 nt, Homo sapiens
aggcgggagcaucucuugag

SEQ ID NO: 1117935 - RNA, 20 nt, Homo sapiens
aggcuauauuucugggauga

SEQ ID NO: 1117936 - RNA, 15 nt, Homo sapiens
aggcuauguauggaa

SEQ ID NO: 1117937 - RNA, 17 nt, Homo sapiens
aggcucaauauuccuga

SEQ ID NO: 1117938 - RNA, 19 nt, Homo sapiens
aggcugaggggaggaucac

SEQ ID NO: 1117939 - RNA, 16 nt, Homo sapiens
aggcuugucacuagca

SEQ ID NO: 1117940 - RNA, 14 nt, Homo sapiens
agggaaaaugagua

SEQ ID NO: 1117941 - RNA, 18 nt, Homo sapiens
agggaaauucacacugug

SEQ ID NO: 1117942 - RNA, 18 nt, Homo sapiens
agggaacgggguccuuca

SEQ ID NO: 1117943 - RNA, 13 nt, Homo sapiens
agggaagccaaaa

SEQ ID NO: 1117944 - RNA, 22 nt, Homo sapiens
agggaaggaacucuggcuucca

SEQ ID NO: 1117945 - RNA, 20 nt, Homo sapiens
agggaauggcacagcccaaa

SEQ ID NO: 1117946 - RNA, 14 nt, Homo sapiens
agggagaagggaug

SEQ ID NO: 1117947 - RNA, 18 nt, Homo sapiens
agggagacugcaucucaa

SEQ ID NO: 1117948 - RNA, 16 nt, Homo sapiens
agggagccgagaucac

SEQ ID NO: 1117949 - RNA, 19 nt, Homo sapiens
agggagccgcaccuuguca

SEQ ID NO: 1117950 - RNA, 22 nt, Homo sapiens
agggagggacacuuacccaagg

SEQ ID NO: 1117951 - RNA, 19 nt, Homo sapiens
agggaucuugcauucccag

SEQ ID NO: 1117952 - RNA, 17 nt, Homo sapiens
agggaugcugccugagu

SEQ ID NO: 1117953 - RNA, 19 nt, Homo sapiens
agggaugcugccugaguca

SEQ ID NO: 1117954 - RNA, 21 nt, Homo sapiens
agggcaagaaggaaauagcca

SEQ ID NO: 1117955 - RNA, 22 nt, Homo sapiens
agagaugauucggauuugacaa

SEQ ID NO: 1117956 - RNA, 23 nt, Homo sapiens
agagaugauucggauuugacaaa

SEQ ID NO: 1117957 - RNA, 15 nt, Homo sapiens
agagcacacuguagc

SEQ ID NO: 1117958 - RNA, 13 nt, Homo sapiens
agagcagaaccaa

SEQ ID NO: 1117959 - RNA, 15 nt, Homo sapiens
agagccagcucucuc

SEQ ID NO: 1117960 - RNA, 18 nt, Homo sapiens
agagccucuggcaucucu

SEQ ID NO: 1117961 - RNA, 23 nt, Homo sapiens
agagcugggauguuucugucaca

SEQ ID NO: 1117962 - RNA, 16 nt, Homo sapiens
agagcugggugucaag

SEQ ID NO: 1117963 - RNA, 13 nt, Homo sapiens
agaggagguuugg

SEQ ID NO: 1117964 - RNA, 16 nt, Homo sapiens
agaggcaccuguccca

SEQ ID NO: 1117965 - RNA, 14 nt, Homo sapiens
agaggccauggcag

SEQ ID NO: 1117966 - RNA, 22 nt, Homo sapiens
agaggcuauuauuuucacugua

SEQ ID NO: 1117967 - RNA, 19 nt, Homo sapiens
agaggcuuccuucauuucc

SEQ ID NO: 1117968 - RNA, 20 nt, Homo sapiens
agaggcuuccuucauuuccu

SEQ ID NO: 1117969 - RNA, 21 nt, Homo sapiens
agagggcugcgagcauuuccc

SEQ ID NO: 1117970 - RNA, 17 nt, Homo sapiens
agagggcuuucucagga

SEQ ID NO: 1117971 - RNA, 16 nt, Homo sapiens
agaggggaagggccag

SEQ ID NO: 1117972 - RNA, 19 nt, Homo sapiens
agaggugggcagcagcuca

SEQ ID NO: 1117973 - RNA, 16 nt, Homo sapiens
agaguaaaaacugaau

SEQ ID NO: 1117974 - RNA, 13 nt, Homo sapiens
agaguccucugga

SEQ ID NO: 1117975 - RNA, 18 nt, Homo sapiens
agaguccucuggauggca

SEQ ID NO: 1117976 - RNA, 16 nt, Homo sapiens
agagucuuaauauaua

SEQ ID NO: 1117977 - RNA, 20 nt, Homo sapiens
agagugagacucugucucaa

SEQ ID NO: 1117978 - RNA, 17 nt, Homo sapiens
agagugugaaacuuccu

SEQ ID NO: 1117979 - RNA, 22 nt, Homo sapiens
agagugugcuugucaucugcca

SEQ ID NO: 1117980 - RNA, 19 nt, Homo sapiens
agaguguuaucagucauaa

SEQ ID NO: 1117981 - RNA, 23 nt, Homo sapiens
agauaacaagaucuuucaggaaa

SEQ ID NO: 1117982 - RNA, 17 nt, Homo sapiens
agauaauaucugugagg

SEQ ID NO: 1117983 - RNA, 20 nt, Homo sapiens
agauaguacauaaagguggu

SEQ ID NO: 1117984 - RNA, 11 nt, Homo sapiens
agauaugauau

SEQ ID NO: 1117985 - RNA, 12 nt, Homo sapiens
agaucacgccac

SEQ ID NO: 1117986 - RNA, 23 nt, Homo sapiens
agaucccauccaucagcucccuu

SEQ ID NO: 1117987 - RNA, 19 nt, Homo sapiens
agaucgcgccacugcacuc

SEQ ID NO: 1117988 - RNA, 20 nt, Homo sapiens
agaucuaagccuuuccauaa

SEQ ID NO: 1117989 - RNA, 14 nt, Homo sapiens
agaucuauguacug

SEQ ID NO: 1117990 - RNA, 17 nt, Homo sapiens
agaucuauguacuguaa

SEQ ID NO: 1117991 - RNA, 10 nt, Homo sapiens
agaucuugau

SEQ ID NO: 1117992 - RNA, 19 nt, Homo sapiens
agaucuuuuaaaaaggcag

SEQ ID NO: 1117993 - RNA, 13 nt, Homo sapiens
agaugaccugcug

SEQ ID NO: 1117994 - RNA, 19 nt, Homo sapiens
agaugaucgugccuauaaa

SEQ ID NO: 1117995 - RNA, 19 nt, Homo sapiens
agaugauuaaacagacuuu

SEQ ID NO: 1117996 - RNA, 18 nt, Homo sapiens
agaugauucggauuugac

SEQ ID NO: 1117997 - RNA, 22 nt, Homo sapiens
agaugcaaucucuugucucaca

SEQ ID NO: 1117998 - RNA, 20 nt, Homo sapiens
agauggaguucuugugccau

SEQ ID NO: 1117999 - RNA, 16 nt, Homo sapiens
agauggcauguguuua

SEQ ID NO: 1118000 - RNA, 14 nt, Homo sapiens
aauccuuccaugaa

SEQ ID NO: 1118001 - RNA, 15 nt, Homo sapiens
aauccuuccaugaaa

SEQ ID NO: 1118002 - RNA, 18 nt, Homo sapiens
aauccuuuacuguuaguc

SEQ ID NO: 1118003 - RNA, 14 nt, Homo sapiens
aaucguagguguug

SEQ ID NO: 1118004 - RNA, 16 nt, Homo sapiens
aaucucaucucaguga

SEQ ID NO: 1118005 - RNA, 16 nt, Homo sapiens
aaucucuugucucaca

SEQ ID NO: 1118006 - RNA, 13 nt, Homo sapiens
aaucugcacugug

SEQ ID NO: 1118007 - RNA, 23 nt, Homo sapiens
aaucugccugauaggacccauau

SEQ ID NO: 1118008 - RNA, 19 nt, Homo sapiens
aaucuuaauucaacuagua

SEQ ID NO: 1118009 - RNA, 17 nt, Homo sapiens
aaucuucagaccuagaa

SEQ ID NO: 1118010 - RNA, 17 nt, Homo sapiens
aaucuuucagcacucag

SEQ ID NO: 1118011 - RNA, 19 nt, Homo sapiens
aaucuuucuuuaccugaga

SEQ ID NO: 1118012 - RNA, 14 nt, Homo sapiens
aaugaaagccaaau

SEQ ID NO: 1118013 - RNA, 16 nt, Homo sapiens
aaugaagacccagugu

SEQ ID NO: 1118014 - RNA, 23 nt, Homo sapiens
aaugaagacccaguguaaagaau

SEQ ID NO: 1118015 - RNA, 20 nt, Homo sapiens
aaugaaggaaaaccucacuu

SEQ ID NO: 1118016 - RNA, 14 nt, Homo sapiens
aaugaauacaauua

SEQ ID NO: 1118017 - RNA, 14 nt, Homo sapiens
aaugaauguuuaca

SEQ ID NO: 1118018 - RNA, 16 nt, Homo sapiens
aaugacagcggggaag

SEQ ID NO: 1118019 - RNA, 17 nt, Homo sapiens
aaugacccaaagaccaa

SEQ ID NO: 1118020 - RNA, 15 nt, Homo sapiens
aaugaugggacaaua

SEQ ID NO: 1118021 - RNA, 21 nt, Homo sapiens
aaugauguuuuagaaugauuc

SEQ ID NO: 1118022 - RNA, 14 nt, Homo sapiens
aaugauuagcacuu

SEQ ID NO: 1118023 - RNA, 19 nt, Homo sapiens
aaugauuuagguacgucaa

SEQ ID NO: 1118024 - RNA, 23 nt, Homo sapiens
aaugauuucaugcuaucucugug

SEQ ID NO: 1118025 - RNA, 22 nt, Homo sapiens
aaugcaaggugaacaccacuuu

SEQ ID NO: 1118026 - RNA, 18 nt, Homo sapiens
aaugcagaauucuugagu

SEQ ID NO: 1118027 - RNA, 19 nt, Homo sapiens
aaugcaguagccagcacgu

SEQ ID NO: 1118028 - RNA, 16 nt, Homo sapiens
aaugcauauacuuuaa

SEQ ID NO: 1118029 - RNA, 14 nt, Homo sapiens
aaugcauggugcag

SEQ ID NO: 1118030 - RNA, 14 nt, Homo sapiens
aaugcauguccuca

SEQ ID NO: 1118031 - RNA, 14 nt, Homo sapiens
aaugcauugcuaaa

SEQ ID NO: 1118032 - RNA, 21 nt, Homo sapiens
aaugcuagcugcaagugacau

SEQ ID NO: 1118033 - RNA, 21 nt, Homo sapiens
aauggagaaguucaggaaggu

SEQ ID NO: 1118034 - RNA, 16 nt, Homo sapiens
agaacacgaauugcuc

SEQ ID NO: 1118035 - RNA, 13 nt, Homo sapiens
agaacaguuugua

SEQ ID NO: 1118036 - RNA, 19 nt, Homo sapiens
agaacaugaccuccgugua

SEQ ID NO: 1118037 - RNA, 16 nt, Homo sapiens
agaacaugcacauuua

SEQ ID NO: 1118038 - RNA, 22 nt, Homo sapiens
agaacauuccucugcagcacuu

SEQ ID NO: 1118039 - RNA, 14 nt, Homo sapiens
agaaccaaaagaga

SEQ ID NO: 1118040 - RNA, 17 nt, Homo sapiens
agaacccagauuuccua

SEQ ID NO: 1118041 - RNA, 12 nt, Homo sapiens
agaaccucaggc

SEQ ID NO: 1118042 - RNA, 23 nt, Homo sapiens
agaacuggaaagacauagccaac

SEQ ID NO: 1118043 - RNA, 19 nt, Homo sapiens
agaagaaaacgaacuggga

SEQ ID NO: 1118044 - RNA, 19 nt, Homo sapiens
agaagaaaaucaaccagca

SEQ ID NO: 1118045 - RNA, 19 nt, Homo sapiens
agaagacaacauuucucaa

SEQ ID NO: 1118046 - RNA, 15 nt, Homo sapiens
agaagacacagggga

SEQ ID NO: 1118047 - RNA, 14 nt, Homo sapiens
agaagagacaggag

SEQ ID NO: 1118048 - RNA, 12 nt, Homo sapiens
agaagagccuga

SEQ ID NO: 1118049 - RNA, 16 nt, Homo sapiens
agaagcucuggcccca

SEQ ID NO: 1118050 - RNA, 14 nt, Homo sapiens
agaaggacaccucc

SEQ ID NO: 1118051 - RNA, 13 nt, Homo sapiens
agaaggcaaaaag

SEQ ID NO: 1118052 - RNA, 14 nt, Homo sapiens
agaaggcaagcacc

SEQ ID NO: 1118053 - RNA, 17 nt, Homo sapiens
agaaggccaagaaucaa

SEQ ID NO: 1118054 - RNA, 22 nt, Homo sapiens
agaaggguaccuugaacacugg

SEQ ID NO: 1118055 - RNA, 13 nt, Homo sapiens
agaaguaggcaug

SEQ ID NO: 1118056 - RNA, 16 nt, Homo sapiens
agaagucauggcccaa

SEQ ID NO: 1118057 - RNA, 18 nt, Homo sapiens
agaagucuugucucaaga

SEQ ID NO: 1118058 - RNA, 17 nt, Homo sapiens
agaaguuaagcagccuu

SEQ ID NO: 1118059 - RNA, 22 nt, Homo sapiens
agaaguucuggcugaacacugg

SEQ ID NO: 1118060 - RNA, 20 nt, Homo sapiens
agaauaaaugaaucuuacuc

SEQ ID NO: 1118061 - RNA, 22 nt, Homo sapiens
agaauaaaugaaucuuacuccu

SEQ ID NO: 1118062 - RNA, 14 nt, Homo sapiens
agaauacacuauca

SEQ ID NO: 1118063 - RNA, 18 nt, Homo sapiens
agaauacaguaagcugcu

SEQ ID NO: 1118064 - RNA, 12 nt, Homo sapiens
agaaucaauaaa

SEQ ID NO: 1118065 - RNA, 18 nt, Homo sapiens
agaaucauuaauacaaag

SEQ ID NO: 1118066 - RNA, 18 nt, Homo sapiens
agaaucauugaaguauuu

SEQ ID NO: 1118067 - RNA, 14 nt, Homo sapiens
agaaucgcuuaaac

SEQ ID NO: 1118068 - RNA, 14 nt, Homo sapiens
agaaucugcagcua

SEQ ID NO: 1118069 - RNA, 21 nt, Homo sapiens
agaaucugcagcuaacuuauu

SEQ ID NO: 1118070 - RNA, 23 nt, Homo sapiens
agaauuccuuuucuaacucuccc

SEQ ID NO: 1118071 - RNA, 23 nt, Homo sapiens
agaauucugcuaccucacugggg

SEQ ID NO: 1118072 - RNA, 14 nt, Homo sapiens
agaauuguaucauu

SEQ ID NO: 1118073 - RNA, 20 nt, Homo sapiens
agaauuucuuugucauucaa

SEQ ID NO: 1118074 - RNA, 15 nt, Homo sapiens
agacaaaacuagaga

SEQ ID NO: 1118075 - RNA, 19 nt, Homo sapiens
agacaaaaucuuaaaugcc

SEQ ID NO: 1118076 - RNA, 14 nt, Homo sapiens
agacaaagcaaagc

SEQ ID NO: 1118077 - RNA, 16 nt, Homo sapiens
agacaacagaagucau

SEQ ID NO: 1118078 - RNA, 14 nt, Homo sapiens
aauuuaucaucucg

SEQ ID NO: 1118079 - RNA, 20 nt, Homo sapiens
aauuuaucuugucucugggc

SEQ ID NO: 1118080 - RNA, 15 nt, Homo sapiens
aauuuccucugacau

SEQ ID NO: 1118081 - RNA, 19 nt, Homo sapiens
aauuucuaaaaaacagagg

SEQ ID NO: 1118082 - RNA, 14 nt, Homo sapiens
aauuucuuugucau

SEQ ID NO: 1118083 - RNA, 14 nt, Homo sapiens
aauuugaaauuuag

SEQ ID NO: 1118084 - RNA, 19 nt, Homo sapiens
aauuugacucaugaacuau

SEQ ID NO: 1118085 - RNA, 23 nt, Homo sapiens
aauuuggauuuacgacugaagaa

SEQ ID NO: 1118086 - RNA, 21 nt, Homo sapiens
aauuugguaaauuaguauuua

SEQ ID NO: 1118087 - RNA, 19 nt, Homo sapiens
aauuuuaaauuauaacuua

SEQ ID NO: 1118088 - RNA, 17 nt, Homo sapiens
aauuuucaagagaagaa

SEQ ID NO: 1118089 - RNA, 22 nt, Homo sapiens
aauuuuuauacauaucagaaaa

SEQ ID NO: 1118090 - RNA, 21 nt, Homo sapiens
aauuuuuuaguauaaguacau

SEQ ID NO: 1118091 - RNA, 14 nt, Homo sapiens
acaaaaaaaccaca

SEQ ID NO: 1118092 - RNA, 18 nt, Homo sapiens
acaaaaaacaacaaauaa

SEQ ID NO: 1118093 - RNA, 20 nt, Homo sapiens
acaaaaaauaaaaacacuua

SEQ ID NO: 1118094 - RNA, 15 nt, Homo sapiens
acaaaagcccaaugu

SEQ ID NO: 1118095 - RNA, 13 nt, Homo sapiens
acaaaauaauuua

SEQ ID NO: 1118096 - RNA, 14 nt, Homo sapiens
acaaacauauuugu

SEQ ID NO: 1118097 - RNA, 14 nt, Homo sapiens
acaaacaugugguu

SEQ ID NO: 1118098 - RNA, 16 nt, Homo sapiens
acaaaccuuacuaugg

SEQ ID NO: 1118099 - RNA, 18 nt, Homo sapiens
acaaaccuuacuauggaa

SEQ ID NO: 1118100 - RNA, 17 nt, Homo sapiens
acaaagaugaccugcug

SEQ ID NO: 1118101 - RNA, 23 nt, Homo sapiens
acaaagggaaggcugcuguguag

SEQ ID NO: 1118102 - RNA, 12 nt, Homo sapiens
acaaagugagac

SEQ ID NO: 1118103 - RNA, 22 nt, Homo sapiens
acaaauaauuuuuaaauauaag

SEQ ID NO: 1118104 - RNA, 16 nt, Homo sapiens
acaaauagucuaucaa

SEQ ID NO: 1118105 - RNA, 15 nt, Homo sapiens
acaaauaugucaguu

SEQ ID NO: 1118106 - RNA, 17 nt, Homo sapiens
acaaauuguacauuuga

SEQ ID NO: 1118107 - RNA, 19 nt, Homo sapiens
acaaauuuuuuucuuguuu

SEQ ID NO: 1118108 - RNA, 17 nt, Homo sapiens
acaacauguauaauauu

SEQ ID NO: 1118109 - RNA, 19 nt, Homo sapiens
acaacauuuacuuaacaga

SEQ ID NO: 1118110 - RNA, 19 nt, Homo sapiens
acaacauuucucaaaugca

SEQ ID NO: 1118111 - RNA, 22 nt, Homo sapiens
acaacauuucucaaaugcacau

SEQ ID NO: 1118112 - RNA, 14 nt, Homo sapiens
acaacauuuuauua

SEQ ID NO: 1118113 - RNA, 17 nt, Homo sapiens
acaacuguuuuugaaga

SEQ ID NO: 1118114 - RNA, 12 nt, Homo sapiens
acaagaagccac

SEQ ID NO: 1118115 - RNA, 22 nt, Homo sapiens
acaagaagccacagaccuagga

SEQ ID NO: 1118116 - RNA, 20 nt, Homo sapiens
acaagauuaccccaccuugc

SEQ ID NO: 1118117 - RNA, 22 nt, Homo sapiens
acaagcauucugucuugaaggg

SEQ ID NO: 1118118 - RNA, 20 nt, Homo sapiens
acaagcuuguauauacauau

SEQ ID NO: 1118119 - RNA, 15 nt, Homo sapiens
acaaggcugaccaag

SEQ ID NO: 1118120 - RNA, 18 nt, Homo sapiens
acaauaaggucaaugcca

SEQ ID NO: 1118121 - RNA, 18 nt, Homo sapiens
acaauaauuuucuaccug

SEQ ID NO: 1118122 - RNA, 20 nt, Homo sapiens
acaauaucuucauacaauga

SEQ ID NO: 1118123 - RNA, 12 nt, Homo sapiens
acaaucugggac

SEQ ID NO: 1118124 - RNA, 18 nt, Homo sapiens
acaaugcaguagccagca

SEQ ID NO: 1118125 - RNA, 18 nt, Homo sapiens
acaauggcuaauucccag

SEQ ID NO: 1118126 - RNA, 16 nt, Homo sapiens
acaauugaacuuaaau

SEQ ID NO: 1118127 - RNA, 20 nt, Homo sapiens
acaauuuagaaaacauucau

SEQ ID NO: 1118128 - RNA, 20 nt, Homo sapiens
acacaaaaugucacaauccu

SEQ ID NO: 1118129 - RNA, 19 nt, Homo sapiens
acacaagccacagaagcca

SEQ ID NO: 1118130 - RNA, 13 nt, Homo sapiens
acacacagcacuc

SEQ ID NO: 1118131 - RNA, 15 nt, Homo sapiens
acacagcaguaugaa

SEQ ID NO: 1118132 - RNA, 13 nt, Homo sapiens
acacaggccugug

SEQ ID NO: 1118133 - RNA, 11 nt, Homo sapiens
acacagugcug

SEQ ID NO: 1118134 - RNA, 13 nt, Homo sapiens
acacauaugcacc

SEQ ID NO: 1118135 - RNA, 22 nt, Homo sapiens
acacaugaaccauccuucccau

SEQ ID NO: 1118136 - RNA, 16 nt, Homo sapiens
acacauguaucuaugc

SEQ ID NO: 1118137 - RNA, 22 nt, Homo sapiens
acacccauagugcacacuugua

SEQ ID NO: 1118138 - RNA, 17 nt, Homo sapiens
acacccgacuccucaaa

SEQ ID NO: 1118139 - RNA, 23 nt, Homo sapiens
acacccuauauuuugcauaguac

SEQ ID NO: 1118140 - RNA, 20 nt, Homo sapiens
acaccugaaaauuaugaguc

SEQ ID NO: 1118141 - RNA, 14 nt, Homo sapiens
acacggaggcaucu

SEQ ID NO: 1118142 - RNA, 22 nt, Homo sapiens
acacguguggcgggcaguggga

SEQ ID NO: 1118143 - RNA, 15 nt, Homo sapiens
acacuaacauauaau

SEQ ID NO: 1118144 - RNA, 23 nt, Homo sapiens
acacuaacgauuuguuaaugaua

SEQ ID NO: 1118145 - RNA, 22 nt, Homo sapiens
acacuacaaguuuauaagccca

SEQ ID NO: 1118146 - RNA, 19 nt, Homo sapiens
acacuauaaagguugacaa

SEQ ID NO: 1118147 - RNA, 17 nt, Homo sapiens
acacucagaagccuggg

SEQ ID NO: 1118148 - RNA, 15 nt, Homo sapiens
acacugaaguuaaca

SEQ ID NO: 1118149 - RNA, 22 nt, Homo sapiens
acacugggcugcagagacugga

SEQ ID NO: 1118150 - RNA, 18 nt, Homo sapiens
acacugguggaggagcug

SEQ ID NO: 1118151 - RNA, 23 nt, Homo sapiens
acacugguggaggagcugggcuu

SEQ ID NO: 1118152 - RNA, 19 nt, Homo sapiens
acacuguccccacagcagg

SEQ ID NO: 1118153 - RNA, 14 nt, Homo sapiens
acagaacacugucu

SEQ ID NO: 1118154 - RNA, 13 nt, Homo sapiens
acagaacuaugga

SEQ ID NO: 1118155 - RNA, 23 nt, Homo sapiens
acagaagcuucugcccaccuacu

SEQ ID NO: 1118156 - RNA, 20 nt, Homo sapiens
acagaaggaaucugugcaga

SEQ ID NO: 1118157 - RNA, 17 nt, Homo sapiens
acagaaugaaucccaua

SEQ ID NO: 1118158 - RNA, 21 nt, Homo sapiens
acagacagggccuagcuuuca

SEQ ID NO: 1118159 - RNA, 17 nt, Homo sapiens
acagagacaggcccaag

SEQ ID NO: 1118160 - RNA, 18 nt, Homo sapiens
acagaggaagagcaggca

SEQ ID NO: 1118161 - RNA, 14 nt, Homo sapiens
acagaguucacuau

SEQ ID NO: 1118162 - RNA, 20 nt, Homo sapiens
acagaugcagccgugcagga

SEQ ID NO: 1118163 - RNA, 19 nt, Homo sapiens
acagauggauagucugucc

SEQ ID NO: 1118164 - RNA, 14 nt, Homo sapiens
acagcaaaacucca

SEQ ID NO: 1118165 - RNA, 19 nt, Homo sapiens
acagcaacaggaaucucag

SEQ ID NO: 1118166 - RNA, 13 nt, Homo sapiens
acagcaaccugua

SEQ ID NO: 1118167 - RNA, 21 nt, Homo sapiens
guauucacacaccccucaaaa

SEQ ID NO: 1118168 - RNA, 18 nt, Homo sapiens
guauugacaggaauacuu

SEQ ID NO: 1118169 - RNA, 22 nt, Homo sapiens
gucaaauaucucagaggcuaua

SEQ ID NO: 1118170 - RNA, 14 nt, Homo sapiens
gucaacaguucaaa

SEQ ID NO: 1118171 - RNA, 14 nt, Homo sapiens
gucaacuaugauau

SEQ ID NO: 1118172 - RNA, 18 nt, Homo sapiens
gucaauccccucauucag

SEQ ID NO: 1118173 - RNA, 18 nt, Homo sapiens
gucaauccgaaguaugag

SEQ ID NO: 1118174 - RNA, 21 nt, Homo sapiens
gucacaauccuaacacauuau

SEQ ID NO: 1118175 - RNA, 20 nt, Homo sapiens
gucacaauccugucccucac

SEQ ID NO: 1118176 - RNA, 18 nt, Homo sapiens
gucacacacuuuggcuau

SEQ ID NO: 1118177 - RNA, 17 nt, Homo sapiens
gucacauggccuaugca

SEQ ID NO: 1118178 - RNA, 17 nt, Homo sapiens
gucaccaauguacccac

SEQ ID NO: 1118179 - RNA, 17 nt, Homo sapiens
gucaccagcugccaaaa

SEQ ID NO: 1118180 - RNA, 13 nt, Homo sapiens
gucaccucagaga

SEQ ID NO: 1118181 - RNA, 17 nt, Homo sapiens
gucaccucagagacaua

SEQ ID NO: 1118182 - RNA, 19 nt, Homo sapiens
gucagaaacucgaugaaug

SEQ ID NO: 1118183 - RNA, 21 nt, Homo sapiens
gucaggaagggaaagccagaa

SEQ ID NO: 1118184 - RNA, 21 nt, Homo sapiens
gucaggcggggugcuguggug

SEQ ID NO: 1118185 - RNA, 16 nt, Homo sapiens
gucagucaugauggca

SEQ ID NO: 1118186 - RNA, 10 nt, Homo sapiens
gucauagaaa

SEQ ID NO: 1118187 - RNA, 19 nt, Homo sapiens
gucauucaagccugugaau

SEQ ID NO: 1118188 - RNA, 17 nt, Homo sapiens
gucauuguccaugccua

SEQ ID NO: 1118189 - RNA, 20 nt, Homo sapiens
guccaacaacuccaggaaaa

SEQ ID NO: 1118190 - RNA, 17 nt, Homo sapiens
guccaccugccuaucca

SEQ ID NO: 1118191 - RNA, 18 nt, Homo sapiens
guccacucugaauaccaa

SEQ ID NO: 1118192 - RNA, 18 nt, Homo sapiens
gucccaaccugaucccac

SEQ ID NO: 1118193 - RNA, 20 nt, Homo sapiens
guccccaaauugcuaccucu

SEQ ID NO: 1118194 - RNA, 23 nt, Homo sapiens
gucccccuaugcuccaguaugga

SEQ ID NO: 1118195 - RNA, 15 nt, Homo sapiens
guccccuccguagga

SEQ ID NO: 1118196 - RNA, 18 nt, Homo sapiens
gucccugccacacucagu

SEQ ID NO: 1118197 - RNA, 18 nt, Homo sapiens
gucccugucaccaagcuc

SEQ ID NO: 1118198 - RNA, 13 nt, Homo sapiens
gucccuuggagac

SEQ ID NO: 1118199 - RNA, 21 nt, Homo sapiens
guccgccuggccggcuccagu

SEQ ID NO: 1118200 - RNA, 18 nt, Homo sapiens
guccuauccaaaggaauc

SEQ ID NO: 1118201 - RNA, 19 nt, Homo sapiens
guccucuacuuaaugagau

SEQ ID NO: 1118202 - RNA, 15 nt, Homo sapiens
guccucuugcucaaa

SEQ ID NO: 1118203 - RNA, 23 nt, Homo sapiens
guccuguuaacgucaucucaggg

SEQ ID NO: 1118204 - RNA, 20 nt, Homo sapiens
guccuuuuauaaacauuggu

SEQ ID NO: 1118205 - RNA, 16 nt, Homo sapiens
guccuuuuguaccaug

SEQ ID NO: 1118206 - RNA, 17 nt, Homo sapiens
gucgucaaguugcagau

SEQ ID NO: 1118207 - RNA, 13 nt, Homo sapiens
gucuagacuuucu

SEQ ID NO: 1118208 - RNA, 21 nt, Homo sapiens
gucuauggucaguugaggaau

SEQ ID NO: 1118209 - RNA, 19 nt, Homo sapiens
gucuccacuaaaugagcuc

SEQ ID NO: 1118210 - RNA, 18 nt, Homo sapiens
gucuccuuugcacugagg

SEQ ID NO: 1118211 - RNA, 23 nt, Homo sapiens
gucuccuuugcacugagggccac

SEQ ID NO: 1118212 - RNA, 21 nt, Homo sapiens
gucucucaugaaccucaagcu

SEQ ID NO: 1118213 - RNA, 18 nt, Homo sapiens
gucucucuaaacccaaau

SEQ ID NO: 1118214 - RNA, 16 nt, Homo sapiens
gucucugcucuugccu

SEQ ID NO: 1118215 - RNA, 18 nt, Homo sapiens
gucugaaagcagguuaac

SEQ ID NO: 1118216 - RNA, 22 nt, Homo sapiens
gucugagcuucaguauaaaaga

SEQ ID NO: 1118217 - RNA, 21 nt, Homo sapiens
gucugagguccugagcacugc

SEQ ID NO: 1118218 - RNA, 18 nt, Homo sapiens
gucugccagccagcagcc

SEQ ID NO: 1118219 - RNA, 20 nt, Homo sapiens
gucugcuuaguaucucauca

SEQ ID NO: 1118220 - RNA, 19 nt, Homo sapiens
gucuggcugaggauuucaa

SEQ ID NO: 1118221 - RNA, 15 nt, Homo sapiens
gucuguacacguguc

SEQ ID NO: 1118222 - RNA, 12 nt, Homo sapiens
gucugucccaaa

SEQ ID NO: 1118223 - RNA, 12 nt, Homo sapiens
gucugugucugc

SEQ ID NO: 1118224 - RNA, 22 nt, Homo sapiens
gucuuaauauauauauccagau

SEQ ID NO: 1118225 - RNA, 17 nt, Homo sapiens
gucuuaaucaugagaua

SEQ ID NO: 1118226 - RNA, 23 nt, Homo sapiens
gucuucagccuagccgaccucag

SEQ ID NO: 1118227 - RNA, 12 nt, Homo sapiens
gucuuccauaau

SEQ ID NO: 1118228 - RNA, 21 nt, Homo sapiens
gucuuccuccuaaauuuccag

SEQ ID NO: 1118229 - RNA, 16 nt, Homo sapiens
gucuucuuacuuggaa

SEQ ID NO: 1118230 - RNA, 16 nt, Homo sapiens
gucuuuaucagugaug

SEQ ID NO: 1118231 - RNA, 13 nt, Homo sapiens
gucuuucugacau

SEQ ID NO: 1118232 - RNA, 21 nt, Homo sapiens
gugaaaccucaucucuacuaa

SEQ ID NO: 1118233 - RNA, 20 nt, Homo sapiens
gugaaagcaucacuugggau

SEQ ID NO: 1118234 - RNA, 18 nt, Homo sapiens
gugaauaaaaacccugua

SEQ ID NO: 1118235 - RNA, 18 nt, Homo sapiens
gugaauugccugcagaga

SEQ ID NO: 1118236 - RNA, 19 nt, Homo sapiens
gugacaacacuuguguuau

SEQ ID NO: 1118237 - RNA, 17 nt, Homo sapiens
gugacaugggugugcca

SEQ ID NO: 1118238 - RNA, 21 nt, Homo sapiens
gugaccucugccugaagucac

SEQ ID NO: 1118239 - RNA, 12 nt, Homo sapiens
gugacucucuug

SEQ ID NO: 1118240 - RNA, 20 nt, Homo sapiens
gugagaaucaaaacucuccu

SEQ ID NO: 1118241 - RNA, 13 nt, Homo sapiens
gugagaccaccuc

SEQ ID NO: 1118242 - RNA, 15 nt, Homo sapiens
gugagcacuaaggug

SEQ ID NO: 1118243 - RNA, 14 nt, Homo sapiens
gugagccacagacc

SEQ ID NO: 1118244 - RNA, 18 nt, Homo sapiens
gugaggugcugaugagug

SEQ ID NO: 1118245 - RNA, 15 nt, Homo sapiens
gugauaaugcagacu

SEQ ID NO: 1118246 - RNA, 23 nt, Homo sapiens
gugauacaacuucaagugcaugc

SEQ ID NO: 1118247 - RNA, 22 nt, Homo sapiens
gugaucagaccauaauguuaca

SEQ ID NO: 1118248 - RNA, 17 nt, Homo sapiens
gugaucaguaugcuguu

SEQ ID NO: 1118249 - RNA, 13 nt, Homo sapiens
gugaucaucccau

SEQ ID NO: 1118250 - RNA, 18 nt, Homo sapiens
gugauccucccaccucag

SEQ ID NO: 1118251 - RNA, 21 nt, Homo sapiens
gugaugaugaaaugaggucag

SEQ ID NO: 1118252 - RNA, 15 nt, Homo sapiens
gugauuuacgcucau

SEQ ID NO: 1118253 - RNA, 18 nt, Homo sapiens
gugcacguacacacacau

SEQ ID NO: 1118254 - RNA, 18 nt, Homo sapiens
gugcacuugcuggaagac

SEQ ID NO: 1118255 - RNA, 13 nt, Homo sapiens
guugggaauugca

SEQ ID NO: 1118256 - RNA, 23 nt, Homo sapiens
guugucucucuaaacccaaauaa

SEQ ID NO: 1118257 - RNA, 24 nt, Homo sapiens
guuguuuucagacucagacuccau

SEQ ID NO: 1118258 - RNA, 23 nt, Homo sapiens
guuuaaaaaccaaauaagcaucu

SEQ ID NO: 1118259 - RNA, 20 nt, Homo sapiens
guuuaagucucugacucuug

SEQ ID NO: 1118260 - RNA, 16 nt, Homo sapiens
guuuagaagagccuga

SEQ ID NO: 1118261 - RNA, 22 nt, Homo sapiens
guuuagaagagccugacugugu

SEQ ID NO: 1118262 - RNA, 17 nt, Homo sapiens
guuuaguugcagacuca

SEQ ID NO: 1118263 - RNA, 19 nt, Homo sapiens
guuuauuuaucagugacag

SEQ ID NO: 1118264 - RNA, 18 nt, Homo sapiens
guuucacacuagucacau

SEQ ID NO: 1118265 - RNA, 18 nt, Homo sapiens
guuucacagccuauaacc

SEQ ID NO: 1118266 - RNA, 17 nt, Homo sapiens
guuucccguauugacag

SEQ ID NO: 1118267 - RNA, 18 nt, Homo sapiens
guuucuggggacaccagc

SEQ ID NO: 1118268 - RNA, 17 nt, Homo sapiens
guuucuguuucuauucu

SEQ ID NO: 1118269 - RNA, 13 nt, Homo sapiens
guuucuugccuca

SEQ ID NO: 1118270 - RNA, 20 nt, Homo sapiens
guuugaaggaggugagggau

SEQ ID NO: 1118271 - RNA, 13 nt, Homo sapiens
guuugaguucaaa

SEQ ID NO: 1118272 - RNA, 23 nt, Homo sapiens
guuugaucccuguuacccagaga

SEQ ID NO: 1118273 - RNA, 18 nt, Homo sapiens
guuugcagaaaagcaccu

SEQ ID NO: 1118274 - RNA, 23 nt, Homo sapiens
guuuggccgggugcgguggcuca

SEQ ID NO: 1118275 - RNA, 15 nt, Homo sapiens
guuuggucacugcua

SEQ ID NO: 1118276 - RNA, 16 nt, Homo sapiens
guuugucagacuuuaa

SEQ ID NO: 1118277 - RNA, 12 nt, Homo sapiens
guuuguguggau

SEQ ID NO: 1118278 - RNA, 22 nt, Homo sapiens
guuuuacaaauuuaauuuugca

SEQ ID NO: 1118279 - RNA, 21 nt, Homo sapiens
guuuuagcggucaauuugccu

SEQ ID NO: 1118280 - RNA, 21 nt, Homo sapiens
guuuucccugaccucccucua

SEQ ID NO: 1118281 - RNA, 16 nt, Homo sapiens
guuuugaaaugcagaa

SEQ ID NO: 1118282 - RNA, 15 nt, Homo sapiens
guuuuuaagcuguuu

SEQ ID NO: 1118283 - RNA, 17 nt, Homo sapiens
guuuuuacuaaguaaaa

SEQ ID NO: 1118284 - RNA, 16 nt, Homo sapiens
uaaaaaaauacaguaa

SEQ ID NO: 1118285 - RNA, 20 nt, Homo sapiens
uaaaaauagaagaauacaaa

SEQ ID NO: 1118286 - RNA, 14 nt, Homo sapiens
uaaaaaugcaacuu

SEQ ID NO: 1118287 - RNA, 12 nt, Homo sapiens
uaaaaaugcaua

SEQ ID NO: 1118288 - RNA, 19 nt, Homo sapiens
uaaaaauggccauuugcuu

SEQ ID NO: 1118289 - RNA, 15 nt, Homo sapiens
uaaaacaaugaagga

SEQ ID NO: 1118290 - RNA, 23 nt, Homo sapiens
uaaaacagguggagaaauuccuu

SEQ ID NO: 1118291 - RNA, 22 nt, Homo sapiens
uaaaaccaucaaaaauauucca

SEQ ID NO: 1118292 - RNA, 17 nt, Homo sapiens
uaaaaccugugugccau

SEQ ID NO: 1118293 - RNA, 14 nt, Homo sapiens
uaaaaccuuacuua

SEQ ID NO: 1118294 - RNA, 17 nt, Homo sapiens
uaaaacuauauucucag

SEQ ID NO: 1118295 - RNA, 12 nt, Homo sapiens
uaaaagcacuua

SEQ ID NO: 1118296 - RNA, 19 nt, Homo sapiens
uaaaagcagcaucugcuaa

SEQ ID NO: 1118297 - RNA, 23 nt, Homo sapiens
uaaaauaaaguauauauagaauc

SEQ ID NO: 1118298 - RNA, 23 nt, Homo sapiens
uaaaauaauuuuaaaaguuggga

SEQ ID NO: 1118299 - RNA, 18 nt, Homo sapiens
uaaaauauauuucagaua

SEQ ID NO: 1118300 - RNA, 21 nt, Homo sapiens
uaaaauauuuuuaugugcaau

SEQ ID NO: 1118301 - RNA, 23 nt, Homo sapiens
uaaaauauuuuuaugugcaauaa

SEQ ID NO: 1118302 - RNA, 18 nt, Homo sapiens
uaaaaucauguacauuuc

SEQ ID NO: 1118303 - RNA, 19 nt, Homo sapiens
uaaaaugaaauuacuacaa

SEQ ID NO: 1118304 - RNA, 22 nt, Homo sapiens
uaaaaugagaucguuguuuaca

SEQ ID NO: 1118305 - RNA, 18 nt, Homo sapiens
uaaaauuaaaugcauguc

SEQ ID NO: 1118306 - RNA, 14 nt, Homo sapiens
uaaacaacuaccuc

SEQ ID NO: 1118307 - RNA, 17 nt, Homo sapiens
uaaacacccaugaauca

SEQ ID NO: 1118308 - RNA, 17 nt, Homo sapiens
uaaagaauaaaugaauc

SEQ ID NO: 1118309 - RNA, 18 nt, Homo sapiens
uaaagaauaaaugaaucu

SEQ ID NO: 1118310 - RNA, 21 nt, Homo sapiens
uaaagaauaaaugaaucuuac

SEQ ID NO: 1118311 - RNA, 22 nt, Homo sapiens
uaaagaugcccuaaguguugaa

SEQ ID NO: 1118312 - RNA, 21 nt, Homo sapiens
uaaagcaguguuuucaccuca

SEQ ID NO: 1118313 - RNA, 21 nt, Homo sapiens
uaaagccaacacccugucuaa

SEQ ID NO: 1118314 - RNA, 20 nt, Homo sapiens
uaaagcccaaccuccugacc

SEQ ID NO: 1118315 - RNA, 14 nt, Homo sapiens
uaaagcccuugaac

SEQ ID NO: 1118316 - RNA, 21 nt, Homo sapiens
uaaauaaauguaucuuauuca

SEQ ID NO: 1118317 - RNA, 18 nt, Homo sapiens
uaaauaauguauacacau

SEQ ID NO: 1118318 - RNA, 15 nt, Homo sapiens
uaaauagaccucuca

SEQ ID NO: 1118319 - RNA, 19 nt, Homo sapiens
uaaauagaccucucaauuu

SEQ ID NO: 1118320 - RNA, 18 nt, Homo sapiens
uaaauaucacaucacuua

SEQ ID NO: 1118321 - RNA, 20 nt, Homo sapiens
uaaauaucauccugccuuca

SEQ ID NO: 1118322 - RNA, 21 nt, Homo sapiens
uaaauaugccuaaaauacuua

SEQ ID NO: 1118323 - RNA, 17 nt, Homo sapiens
uaaauauuucaggcaua

SEQ ID NO: 1118324 - RNA, 19 nt, Homo sapiens
uaaaucaaugucacuuaaa

SEQ ID NO: 1118325 - RNA, 18 nt, Homo sapiens
uaaaugaaucuuacuccu

SEQ ID NO: 1118326 - RNA, 17 nt, Homo sapiens
uaaaugauguacuacau

SEQ ID NO: 1118327 - RNA, 18 nt, Homo sapiens
uaaaugauguacuacauu

SEQ ID NO: 1118328 - RNA, 15 nt, Homo sapiens
uaaaugauuaucucc

SEQ ID NO: 1118329 - RNA, 18 nt, Homo sapiens
uaaaugcaaacacugugu

SEQ ID NO: 1118330 - RNA, 16 nt, Homo sapiens
uaaaugcaauauguau

SEQ ID NO: 1118331 - RNA, 21 nt, Homo sapiens
uaaauguaaauauguacacaa

SEQ ID NO: 1118332 - RNA, 16 nt, Homo sapiens
uaaauguaucauagaa

SEQ ID NO: 1118333 - RNA, 11 nt, Homo sapiens
uaaaugugauu

SEQ ID NO: 1118334 - RNA, 19 nt, Homo sapiens
uaaaugugauuuacgcuca

SEQ ID NO: 1118335 - RNA, 22 nt, Homo sapiens
uaaaugugguacaagcauucug

SEQ ID NO: 1118336 - RNA, 17 nt, Homo sapiens
uaaauguguggugcuaa

SEQ ID NO: 1118337 - RNA, 20 nt, Homo sapiens
uaaauugaaauauaaugcaa

SEQ ID NO: 1118338 - RNA, 15 nt, Homo sapiens
uaaauugauguugcu

SEQ ID NO: 1118339 - RNA, 17 nt, Homo sapiens
uaaauuugguucuaggc

SEQ ID NO: 1118340 - RNA, 14 nt, Homo sapiens
uaaauuuguguucu

SEQ ID NO: 1118341 - RNA, 19 nt, Homo sapiens
uaaauuuucuaugcuuauu

SEQ ID NO: 1118342 - RNA, 20 nt, Homo sapiens
uaacaaaacuauacuuguac

SEQ ID NO: 1118343 - RNA, 21 nt, Homo sapiens
gagauggcgcuauugcacucc

SEQ ID NO: 1118344 - RNA, 19 nt, Homo sapiens
gagauggggucuugcuaua

SEQ ID NO: 1118345 - RNA, 12 nt, Homo sapiens
gagaugucuucu

SEQ ID NO: 1118346 - RNA, 21 nt, Homo sapiens
gagcaaauaaagaccugagaa

SEQ ID NO: 1118347 - RNA, 16 nt, Homo sapiens
gagcaauucauuucac

SEQ ID NO: 1118348 - RNA, 11 nt, Homo sapiens
gagcacacugu

SEQ ID NO: 1118349 - RNA, 18 nt, Homo sapiens
gagcacacuuaugggcca

SEQ ID NO: 1118350 - RNA, 21 nt, Homo sapiens
gagcacuggguugacuuucag

SEQ ID NO: 1118351 - RNA, 23 nt, Homo sapiens
gagcagugggaggguaccagcag

SEQ ID NO: 1118352 - RNA, 14 nt, Homo sapiens
gagcagugucuucc

SEQ ID NO: 1118353 - RNA, 19 nt, Homo sapiens
gagcaucucuugaggccag

SEQ ID NO: 1118354 - RNA, 18 nt, Homo sapiens
gagccacugcaccgggcc

SEQ ID NO: 1118355 - RNA, 14 nt, Homo sapiens
gagccccacacgga

SEQ ID NO: 1118356 - RNA, 21 nt, Homo sapiens
gagcccgcucugcacagggau

SEQ ID NO: 1118357 - RNA, 19 nt, Homo sapiens
gagccgcaccuugucaugu

SEQ ID NO: 1118358 - RNA, 15 nt, Homo sapiens
gagccugaccuuucu

SEQ ID NO: 1118359 - RNA, 18 nt, Homo sapiens
gagccugagccacaaaaa

SEQ ID NO: 1118360 - RNA, 17 nt, Homo sapiens
gagccuggggcauccca

SEQ ID NO: 1118361 - RNA, 17 nt, Homo sapiens
gagcuggcaaagguggc

SEQ ID NO: 1118362 - RNA, 20 nt, Homo sapiens
gagcugggcaccacaggcug

SEQ ID NO: 1118363 - RNA, 20 nt, Homo sapiens
gagcuguuuucccugaccuc

SEQ ID NO: 1118364 - RNA, 20 nt, Homo sapiens
gagcuuacaagacccuauga

SEQ ID NO: 1118365 - RNA, 16 nt, Homo sapiens
gagcuuccagugcaug

SEQ ID NO: 1118366 - RNA, 16 nt, Homo sapiens
gagcuugcaagaagca

SEQ ID NO: 1118367 - RNA, 16 nt, Homo sapiens
gagcuuggcagcugaa

SEQ ID NO: 1118368 - RNA, 22 nt, Homo sapiens
gaggacacaguuucuauuguaa

SEQ ID NO: 1118369 - RNA, 13 nt, Homo sapiens
gaggacuccuuaa

SEQ ID NO: 1118370 - RNA, 19 nt, Homo sapiens
gaggacuugugucucugug

SEQ ID NO: 1118371 - RNA, 20 nt, Homo sapiens
gaggcaagagaauugcuuga

SEQ ID NO: 1118372 - RNA, 20 nt, Homo sapiens
gaggcaggaggauugcuuga

SEQ ID NO: 1118373 - RNA, 19 nt, Homo sapiens
gaggcggagaguacaguga

SEQ ID NO: 1118374 - RNA, 14 nt, Homo sapiens
gaggcggcacauug

SEQ ID NO: 1118375 - RNA, 19 nt, Homo sapiens
gaggcgggcagaucaccag

SEQ ID NO: 1118376 - RNA, 12 nt, Homo sapiens
gaggcuauuaaa

SEQ ID NO: 1118377 - RNA, 18 nt, Homo sapiens
gaggcugaggcgggugga

SEQ ID NO: 1118378 - RNA, 14 nt, Homo sapiens
gagggaaaaugagu

SEQ ID NO: 1118379 - RNA, 20 nt, Homo sapiens
gagggaaaguaaauauuuca

SEQ ID NO: 1118380 - RNA, 19 nt, Homo sapiens
gagggacaaaggagccugu

SEQ ID NO: 1118381 - RNA, 14 nt, Homo sapiens
gagggagugacaga

SEQ ID NO: 1118382 - RNA, 14 nt, Homo sapiens
gagggcaaacccaa

SEQ ID NO: 1118383 - RNA, 14 nt, Homo sapiens
gagggcuguaggaa

SEQ ID NO: 1118384 - RNA, 21 nt, Homo sapiens
gaggggacuauuuaugaaggc

SEQ ID NO: 1118385 - RNA, 23 nt, Homo sapiens
gaggguuggguucaucugagcaa

SEQ ID NO: 1118386 - RNA, 20 nt, Homo sapiens
gagguagcucccagcacuca

SEQ ID NO: 1118387 - RNA, 18 nt, Homo sapiens
gaggucccugccaguguu

SEQ ID NO: 1118388 - RNA, 19 nt, Homo sapiens
gagguggagguugcaguga

SEQ ID NO: 1118389 - RNA, 20 nt, Homo sapiens
gagguggagguugcagugag

SEQ ID NO: 1118390 - RNA, 19 nt, Homo sapiens
gaggugggcagcagcucag

SEQ ID NO: 1118391 - RNA, 14 nt, Homo sapiens
gagguugcagggag

SEQ ID NO: 1118392 - RNA, 17 nt, Homo sapiens
gaguagaagucucuucc

SEQ ID NO: 1118393 - RNA, 18 nt, Homo sapiens
gaguagagggcacugggu

SEQ ID NO: 1118394 - RNA, 20 nt, Homo sapiens
gagucaggccuuaauuuuca

SEQ ID NO: 1118395 - RNA, 12 nt, Homo sapiens
gagugacaccca

SEQ ID NO: 1118396 - RNA, 15 nt, Homo sapiens
gagugacacccaaga

SEQ ID NO: 1118397 - RNA, 20 nt, Homo sapiens
gagugcaccacuucaaguga

SEQ ID NO: 1118398 - RNA, 19 nt, Homo sapiens
gaguggaacagaaggggug

SEQ ID NO: 1118399 - RNA, 18 nt, Homo sapiens
gaguguuuaaaguucaac

SEQ ID NO: 1118400 - RNA, 21 nt, Homo sapiens
gaguuaauauauagaagggua

SEQ ID NO: 1118401 - RNA, 15 nt, Homo sapiens
gaguucagcaaagag

SEQ ID NO: 1118402 - RNA, 13 nt, Homo sapiens
gaguugugaucau

SEQ ID NO: 1118403 - RNA, 14 nt, Homo sapiens
gaguuucgagguag

SEQ ID NO: 1118404 - RNA, 20 nt, Homo sapiens
gauaaaucaguuaugucaau

SEQ ID NO: 1118405 - RNA, 21 nt, Homo sapiens
gauaaaucaguuaugucaauu

SEQ ID NO: 1118406 - RNA, 23 nt, Homo sapiens
gauacacugaaguuaacagagac

SEQ ID NO: 1118407 - RNA, 17 nt, Homo sapiens
gauacccagagcauuac

SEQ ID NO: 1118408 - RNA, 21 nt, Homo sapiens
gauacccauagcuuccaugag

SEQ ID NO: 1118409 - RNA, 22 nt, Homo sapiens
gauacugcucaucauuccuuga

SEQ ID NO: 1118410 - RNA, 13 nt, Homo sapiens
gauagaaccugga

SEQ ID NO: 1118411 - RNA, 23 nt, Homo sapiens
gauagcaucuuauacgaguaaua

SEQ ID NO: 1118412 - RNA, 14 nt, Homo sapiens
gauaguccaaagac

SEQ ID NO: 1118413 - RNA, 12 nt, Homo sapiens
gauagucugucc

SEQ ID NO: 1118414 - RNA, 16 nt, Homo sapiens
gauauauacacaggau

SEQ ID NO: 1118415 - RNA, 19 nt, Homo sapiens
gauauaugacuuuuucuca

SEQ ID NO: 1118416 - RNA, 15 nt, Homo sapiens
gauaucaugccccug

SEQ ID NO: 1118417 - RNA, 14 nt, Homo sapiens
gauaucucaucucu

SEQ ID NO: 1118418 - RNA, 15 nt, Homo sapiens
gauauuuccauuucu

SEQ ID NO: 1118419 - RNA, 16 nt, Homo sapiens
gaucacuggcaaugaa

SEQ ID NO: 1118420 - RNA, 16 nt, Homo sapiens
gaucacuuggagccag

SEQ ID NO: 1118421 - RNA, 18 nt, Homo sapiens
gaucaguaugcuguuuua

SEQ ID NO: 1118422 - RNA, 16 nt, Homo sapiens
gaucaucuuuccuguu

SEQ ID NO: 1118423 - RNA, 20 nt, Homo sapiens
gaucaucuuuccuguuccag

SEQ ID NO: 1118424 - RNA, 21 nt, Homo sapiens
gaucauuuguuggaaugaauu

SEQ ID NO: 1118425 - RNA, 14 nt, Homo sapiens
gauccaagcugguc

SEQ ID NO: 1118426 - RNA, 14 nt, Homo sapiens
gggcucagccuggu

SEQ ID NO: 1118427 - RNA, 16 nt, Homo sapiens
gaaaacaugacuuuau

SEQ ID NO: 1118428 - RNA, 16 nt, Homo sapiens
gaaaaccucacuugaa

SEQ ID NO: 1118429 - RNA, 19 nt, Homo sapiens
gaaaacuggaaaucuggau

SEQ ID NO: 1118430 - RNA, 21 nt, Homo sapiens
gaaaagaaaccagagucaaau

SEQ ID NO: 1118431 - RNA, 20 nt, Homo sapiens
gaaaaguagaauuauaucua

SEQ ID NO: 1118432 - RNA, 13 nt, Homo sapiens
gaaaaguguuauu

SEQ ID NO: 1118433 - RNA, 16 nt, Homo sapiens
gaaaauaaaagcacuu

SEQ ID NO: 1118434 - RNA, 16 nt, Homo sapiens
gaaaauaaaguguaua

SEQ ID NO: 1118435 - RNA, 22 nt, Homo sapiens
gaaaaucgugacaacacuugug

SEQ ID NO: 1118436 - RNA, 20 nt, Homo sapiens
gaaaaugucagaaaccaguu

SEQ ID NO: 1118437 - RNA, 14 nt, Homo sapiens
gaaaauguccuccc

SEQ ID NO: 1118438 - RNA, 14 nt, Homo sapiens
gaaaaugugcaaua

SEQ ID NO: 1118439 - RNA, 23 nt, Homo sapiens
gaaaauuguauguuaaguuacuu

SEQ ID NO: 1118440 - RNA, 20 nt, Homo sapiens
gaaacaaaaaaguguucccu

SEQ ID NO: 1118441 - RNA, 18 nt, Homo sapiens
gaaacacacaggccauuu

SEQ ID NO: 1118442 - RNA, 17 nt, Homo sapiens
gaaacauuaugccuuaa

SEQ ID NO: 1118443 - RNA, 11 nt, Homo sapiens
gaaacauuuac

SEQ ID NO: 1118444 - RNA, 19 nt, Homo sapiens
gaaaccuaaggcaacauuu

SEQ ID NO: 1118445 - RNA, 20 nt, Homo sapiens
gaaaccuguccauaaaguaa

SEQ ID NO: 1118446 - RNA, 20 nt, Homo sapiens
gaaaccuuauuguaccucuc

SEQ ID NO: 1118447 - RNA, 17 nt, Homo sapiens
gaaacuugcauacagag

SEQ ID NO: 1118448 - RNA, 18 nt, Homo sapiens
gaaagaaagcaccuguuu

SEQ ID NO: 1118449 - RNA, 14 nt, Homo sapiens
gaaagaaaugccca

SEQ ID NO: 1118450 - RNA, 20 nt, Homo sapiens
gaaagacugaaagaauacau

SEQ ID NO: 1118451 - RNA, 18 nt, Homo sapiens
gaaagcaccgcagcaugu

SEQ ID NO: 1118452 - RNA, 18 nt, Homo sapiens
gaaagcaucaccucaggc

SEQ ID NO: 1118453 - RNA, 18 nt, Homo sapiens
gaaagcaucacuugggau

SEQ ID NO: 1118454 - RNA, 23 nt, Homo sapiens
gaaagcaucauuauuugcagaga

SEQ ID NO: 1118455 - RNA, 17 nt, Homo sapiens
gaaagccaggguccuga

SEQ ID NO: 1118456 - RNA, 18 nt, Homo sapiens
gaaagcuucaaacugcau

SEQ ID NO: 1118457 - RNA, 22 nt, Homo sapiens
gaaaguaaauauuucaggcaua

SEQ ID NO: 1118458 - RNA, 15 nt, Homo sapiens
gaaaguaugugauau

SEQ ID NO: 1118459 - RNA, 12 nt, Homo sapiens
gaaagugauauc

SEQ ID NO: 1118460 - RNA, 15 nt, Homo sapiens
gaaauaaaaauaccu

SEQ ID NO: 1118461 - RNA, 13 nt, Homo sapiens
gaaauaaaagccu

SEQ ID NO: 1118462 - RNA, 14 nt, Homo sapiens
gaaauaaacuuugg

SEQ ID NO: 1118463 - RNA, 18 nt, Homo sapiens
gaaauaaaguuggugaca

SEQ ID NO: 1118464 - RNA, 18 nt, Homo sapiens
gaaauaagcccaacagac

SEQ ID NO: 1118465 - RNA, 20 nt, Homo sapiens
gaaauaccagugaaccaaag

SEQ ID NO: 1118466 - RNA, 19 nt, Homo sapiens
gaaauauccagaacauacu

SEQ ID NO: 1118467 - RNA, 15 nt, Homo sapiens
gaaauaugaugccuu

SEQ ID NO: 1118468 - RNA, 18 nt, Homo sapiens
gaaaucagaagugcaaag

SEQ ID NO: 1118469 - RNA, 23 nt, Homo sapiens
gaaaucauuuuacccuuggcuca

SEQ ID NO: 1118470 - RNA, 13 nt, Homo sapiens
gaaaucugccaau

SEQ ID NO: 1118471 - RNA, 14 nt, Homo sapiens
gaaaugacuuugaa

SEQ ID NO: 1118472 - RNA, 19 nt, Homo sapiens
gaaaugucuggucugucca

SEQ ID NO: 1118473 - RNA, 22 nt, Homo sapiens
gaaaugugguagccucacuuuu

SEQ ID NO: 1118474 - RNA, 20 nt, Homo sapiens
gaaauucaaccugugucuua

SEQ ID NO: 1118475 - RNA, 22 nt, Homo sapiens
gaaauuuaaacuauaagcaaga

SEQ ID NO: 1118476 - RNA, 23 nt, Homo sapiens
gaaauuugccaauuuacuuuguu

SEQ ID NO: 1118477 - RNA, 15 nt, Homo sapiens
gaacacaaggucauu

SEQ ID NO: 1118478 - RNA, 22 nt, Homo sapiens
gaacacagccugggaccagggc

SEQ ID NO: 1118479 - RNA, 13 nt, Homo sapiens
gaacacagugccu

SEQ ID NO: 1118480 - RNA, 16 nt, Homo sapiens
gaacacgaauugcuca

SEQ ID NO: 1118481 - RNA, 18 nt, Homo sapiens
gaacacgaauugcucaau

SEQ ID NO: 1118482 - RNA, 12 nt, Homo sapiens
gaacacuggggg

SEQ ID NO: 1118483 - RNA, 19 nt, Homo sapiens
gaacagaaggaugaaugag

SEQ ID NO: 1118484 - RNA, 23 nt, Homo sapiens
gaacagccgcuccugucugccag

SEQ ID NO: 1118485 - RNA, 13 nt, Homo sapiens
gaacaggggccaa

SEQ ID NO: 1118486 - RNA, 12 nt, Homo sapiens
gaacaguuugua

SEQ ID NO: 1118487 - RNA, 21 nt, Homo sapiens
gaacauuccucugcagcacuu

SEQ ID NO: 1118488 - RNA, 18 nt, Homo sapiens
gaaccaugaaaaugggga

SEQ ID NO: 1118489 - RNA, 10 nt, Homo sapiens
gaacccagga

SEQ ID NO: 1118490 - RNA, 23 nt, Homo sapiens
gaacccugggacguggcuaguca

SEQ ID NO: 1118491 - RNA, 18 nt, Homo sapiens
gaaccucaaacuggguau

SEQ ID NO: 1118492 - RNA, 15 nt, Homo sapiens
gaaccucacugaaaa

SEQ ID NO: 1118493 - RNA, 16 nt, Homo sapiens
gaaccugaaggugcug

SEQ ID NO: 1118494 - RNA, 13 nt, Homo sapiens
gaaccuggagcca

SEQ ID NO: 1118495 - RNA, 15 nt, Homo sapiens
gaaccugggaaccau

SEQ ID NO: 1118496 - RNA, 17 nt, Homo sapiens
gaacuacauuaguacac

SEQ ID NO: 1118497 - RNA, 16 nt, Homo sapiens
gaacuaugaacuacaa

SEQ ID NO: 1118498 - RNA, 14 nt, Homo sapiens
gaacucucuccacc

SEQ ID NO: 1118499 - RNA, 22 nt, Homo sapiens
gaacucuggggagccugagcca

SEQ ID NO: 1118500 - RNA, 18 nt, Homo sapiens
gaacugauucacaucuca

SEQ ID NO: 1118501 - RNA, 17 nt, Homo sapiens
gaacugcgugccagugu

SEQ ID NO: 1118502 - RNA, 10 nt, Homo sapiens
gaacuuccuu

SEQ ID NO: 1118503 - RNA, 14 nt, Homo sapiens
gaagaaaaaauaca

SEQ ID NO: 1118504 - RNA, 14 nt, Homo sapiens
gaagaaaacaugac

SEQ ID NO: 1118505 - RNA, 15 nt, Homo sapiens
gaagaaaacaugacu

SEQ ID NO: 1118506 - RNA, 18 nt, Homo sapiens
gaagaaaaucaaccagca

SEQ ID NO: 1118507 - RNA, 20 nt, Homo sapiens
gacaauuugcugccaaacac

SEQ ID NO: 1118508 - RNA, 23 nt, Homo sapiens
gacaccagccaucaugugccugg

SEQ ID NO: 1118509 - RNA, 15 nt, Homo sapiens
gacacuuacccaagg

SEQ ID NO: 1118510 - RNA, 22 nt, Homo sapiens
gacacuucuaaaugaagugcaa

SEQ ID NO: 1118511 - RNA, 20 nt, Homo sapiens
gacacuugccuucuucaccc

SEQ ID NO: 1118512 - RNA, 14 nt, Homo sapiens
gacagagcugggau

SEQ ID NO: 1118513 - RNA, 22 nt, Homo sapiens
gacagaucccauccaucagcuc

SEQ ID NO: 1118514 - RNA, 16 nt, Homo sapiens
gacagcgccaccucuu

SEQ ID NO: 1118515 - RNA, 18 nt, Homo sapiens
cuucgacccuuucucuga

SEQ ID NO: 1118516 - RNA, 14 nt, Homo sapiens
cuucgacucaggau

SEQ ID NO: 1118517 - RNA, 15 nt, Homo sapiens
cuucuccccauucug

SEQ ID NO: 1118518 - RNA, 21 nt, Homo sapiens
cuucugagcaccuacuuacau

SEQ ID NO: 1118519 - RNA, 17 nt, Homo sapiens
cuucugagcgagcacac

SEQ ID NO: 1118520 - RNA, 16 nt, Homo sapiens
cuucuggagucuccag

SEQ ID NO: 1118521 - RNA, 15 nt, Homo sapiens
cuucuguccuacucu

SEQ ID NO: 1118522 - RNA, 14 nt, Homo sapiens
cuucuucuuagcac

SEQ ID NO: 1118523 - RNA, 17 nt, Homo sapiens
cuucuuuaggcauuaaa

SEQ ID NO: 1118524 - RNA, 16 nt, Homo sapiens
cuucuuuuaaaccauu

SEQ ID NO: 1118525 - RNA, 22 nt, Homo sapiens
cuugaaacaagcaacagaugga

SEQ ID NO: 1118526 - RNA, 23 nt, Homo sapiens
cuugaaauaccagugaaccaaag

SEQ ID NO: 1118527 - RNA, 17 nt, Homo sapiens
cuugaaccacaguucua

SEQ ID NO: 1118528 - RNA, 13 nt, Homo sapiens
cuugaacugauuc

SEQ ID NO: 1118529 - RNA, 17 nt, Homo sapiens
cuugaaucaaagcaguu

SEQ ID NO: 1118530 - RNA, 16 nt, Homo sapiens
cuugacuaucacauac

SEQ ID NO: 1118531 - RNA, 21 nt, Homo sapiens
cuugaggcggauggcugugac

SEQ ID NO: 1118532 - RNA, 23 nt, Homo sapiens
cuugaggggcccacagacagauc

SEQ ID NO: 1118533 - RNA, 19 nt, Homo sapiens
cuugagguuuucugugcuu

SEQ ID NO: 1118534 - RNA, 14 nt, Homo sapiens
cuugaguguguuac

SEQ ID NO: 1118535 - RNA, 18 nt, Homo sapiens
cuugaucuguauauacaa

SEQ ID NO: 1118536 - RNA, 17 nt, Homo sapiens
cuugauguuggaucuca

SEQ ID NO: 1118537 - RNA, 21 nt, Homo sapiens
cuugccugaauccaucaggac

SEQ ID NO: 1118538 - RNA, 18 nt, Homo sapiens
cuugccugggaccagugg

SEQ ID NO: 1118539 - RNA, 16 nt, Homo sapiens
cuugcugcugagugca

SEQ ID NO: 1118540 - RNA, 18 nt, Homo sapiens
cuuggacuuguucgugcc

SEQ ID NO: 1118541 - RNA, 13 nt, Homo sapiens
cuuggaggccacc

SEQ ID NO: 1118542 - RNA, 18 nt, Homo sapiens
cuugggagaccuguaauc

SEQ ID NO: 1118543 - RNA, 18 nt, Homo sapiens
cuugggcccugcacagau

SEQ ID NO: 1118544 - RNA, 21 nt, Homo sapiens
cuuggggggugaugagggcag

SEQ ID NO: 1118545 - RNA, 16 nt, Homo sapiens
cuuguauuuuccauac

SEQ ID NO: 1118546 - RNA, 13 nt, Homo sapiens
cuugucagaauuu

SEQ ID NO: 1118547 - RNA, 17 nt, Homo sapiens
cuugucaugugacaggu

SEQ ID NO: 1118548 - RNA, 15 nt, Homo sapiens
cuugucauugccagc

SEQ ID NO: 1118549 - RNA, 19 nt, Homo sapiens
cuugugguuuaugucauca

SEQ ID NO: 1118550 - RNA, 14 nt, Homo sapiens
cuuguguuuuuaac

SEQ ID NO: 1118551 - RNA, 20 nt, Homo sapiens
cuuuaaaaauaugcaccaaa

SEQ ID NO: 1118552 - RNA, 22 nt, Homo sapiens
cuuuaaaaauaugcaccaaauc

SEQ ID NO: 1118553 - RNA, 20 nt, Homo sapiens
cuuuaaagcguuugcacaga

SEQ ID NO: 1118554 - RNA, 22 nt, Homo sapiens
cuuuaauaguuuugauccuaaa

SEQ ID NO: 1118555 - RNA, 19 nt, Homo sapiens
cuuuaaucuucaguuuuau

SEQ ID NO: 1118556 - RNA, 13 nt, Homo sapiens
cuuuagaaugaga

SEQ ID NO: 1118557 - RNA, 22 nt, Homo sapiens
cuuuagagccagcccauggcuu

SEQ ID NO: 1118558 - RNA, 14 nt, Homo sapiens
cuuuaggcauuaaa

SEQ ID NO: 1118559 - RNA, 16 nt, Homo sapiens
cuuuaguuccuacuuu

SEQ ID NO: 1118560 - RNA, 14 nt, Homo sapiens
cuuuaucagugaug

SEQ ID NO: 1118561 - RNA, 20 nt, Homo sapiens
cuuuauguuacuacaugcac

SEQ ID NO: 1118562 - RNA, 14 nt, Homo sapiens
cuuuauugcuccug

SEQ ID NO: 1118563 - RNA, 18 nt, Homo sapiens
cuuucaugaacacagccu

SEQ ID NO: 1118564 - RNA, 14 nt, Homo sapiens
cuuuccccagugug

SEQ ID NO: 1118565 - RNA, 15 nt, Homo sapiens
cuuucccuuuaucag

SEQ ID NO: 1118566 - RNA, 22 nt, Homo sapiens
cuuuccugggggaugugcacgg

SEQ ID NO: 1118567 - RNA, 14 nt, Homo sapiens
cuuucuacccagcg

SEQ ID NO: 1118568 - RNA, 12 nt, Homo sapiens
cuuucucuaaaa

SEQ ID NO: 1118569 - RNA, 15 nt, Homo sapiens
cuuucuuauuuugua

SEQ ID NO: 1118570 - RNA, 13 nt, Homo sapiens
cuuucuugacucu

SEQ ID NO: 1118571 - RNA, 17 nt, Homo sapiens
cuuucuuuaccugagac

SEQ ID NO: 1118572 - RNA, 18 nt, Homo sapiens
cuuucuuucuaacuccag

SEQ ID NO: 1118573 - RNA, 18 nt, Homo sapiens
cuuugaugucauauggaa

SEQ ID NO: 1118574 - RNA, 13 nt, Homo sapiens
cuuugcauuccau

SEQ ID NO: 1118575 - RNA, 18 nt, Homo sapiens
cuuugcucuuucuugacu

SEQ ID NO: 1118576 - RNA, 20 nt, Homo sapiens
cuuuggaaacaggaccacaa

SEQ ID NO: 1118577 - RNA, 14 nt, Homo sapiens
cuuuguaccaucug

SEQ ID NO: 1118578 - RNA, 18 nt, Homo sapiens
cuuuguacuuugugcaaa

SEQ ID NO: 1118579 - RNA, 11 nt, Homo sapiens
cuuugucacaa

SEQ ID NO: 1118580 - RNA, 15 nt, Homo sapiens
cuuugucucugagaa

SEQ ID NO: 1118581 - RNA, 17 nt, Homo sapiens
cuuuuaaugaacaaaug

SEQ ID NO: 1118582 - RNA, 19 nt, Homo sapiens
cuuuuaaugccuuccacau

SEQ ID NO: 1118583 - RNA, 19 nt, Homo sapiens
cuuuuaauuaauauguuca

SEQ ID NO: 1118584 - RNA, 19 nt, Homo sapiens
cuuuuaguaaagucaagga

SEQ ID NO: 1118585 - RNA, 13 nt, Homo sapiens
cuuuuauaacuag

SEQ ID NO: 1118586 - RNA, 19 nt, Homo sapiens
cuuuuauccacuuaccuag

SEQ ID NO: 1118587 - RNA, 15 nt, Homo sapiens
cuuuuauugccauga

SEQ ID NO: 1118588 - RNA, 16 nt, Homo sapiens
cuuuucccacauucau

SEQ ID NO: 1118589 - RNA, 22 nt, Homo sapiens
cuuuugacaaauucuuuuucac

SEQ ID NO: 1118590 - RNA, 15 nt, Homo sapiens
cuuuugcaacaagac

SEQ ID NO: 1118591 - RNA, 12 nt, Homo sapiens
cuuuuguaccag

SEQ ID NO: 1118592 - RNA, 16 nt, Homo sapiens
cuuuugucauguggcu

SEQ ID NO: 1118593 - RNA, 14 nt, Homo sapiens
gaaaaaaugaacuu

SEQ ID NO: 1118594 - RNA, 16 nt, Homo sapiens
gaaaaacaagucuuua

SEQ ID NO: 1118595 - RNA, 13 nt, Homo sapiens
gaaaaaccaauga

SEQ ID NO: 1118596 - RNA, 15 nt, Homo sapiens
gaaaaaccaaugauu

SEQ ID NO: 1118597 - RNA, 12 nt, Homo sapiens
gaaaaacuauua

SEQ ID NO: 1118598 - RNA, 13 nt, Homo sapiens
gaaaaacuuccau

SEQ ID NO: 1118599 - RNA, 16 nt, Homo sapiens
gaaaaacuuuguuaua

SEQ ID NO: 1118600 - RNA, 20 nt, Homo sapiens
gaaaaaucaccacaccaaac

SEQ ID NO: 1118601 - RNA, 12 nt, Homo sapiens
gaaaacauaugc

SEQ ID NO: 1118602 - RNA, 15 nt, Homo sapiens
gaaaacauaugcauu

SEQ ID NO: 1118603 - RNA, 12 nt, Homo sapiens
gaaaacaugacu

SEQ ID NO: 1118604 - RNA, 13 nt, Homo sapiens
gaaaacaugacuu

SEQ ID NO: 1118605 - RNA, 16 nt, Homo sapiens
cuguaaggaacuggaa

SEQ ID NO: 1118606 - RNA, 20 nt, Homo sapiens
cuguaaucccagcacuuugg

SEQ ID NO: 1118607 - RNA, 17 nt, Homo sapiens
cuguaaucccagcaugc

SEQ ID NO: 1118608 - RNA, 21 nt, Homo sapiens
cuguacccaauuuaauuccau

SEQ ID NO: 1118609 - RNA, 22 nt, Homo sapiens
cuguagaaugauuucaugcuau

SEQ ID NO: 1118610 - RNA, 16 nt, Homo sapiens
cuguagagucacugac

SEQ ID NO: 1118611 - RNA, 17 nt, Homo sapiens
cuguagagucacugacc

SEQ ID NO: 1118612 - RNA, 16 nt, Homo sapiens
cuguaggaagauuccc

SEQ ID NO: 1118613 - RNA, 16 nt, Homo sapiens
cuguaggggcaaaaau

SEQ ID NO: 1118614 - RNA, 16 nt, Homo sapiens
cuguauauacaauaac

SEQ ID NO: 1118615 - RNA, 19 nt, Homo sapiens
cuguauucagaucguauua

SEQ ID NO: 1118616 - RNA, 12 nt, Homo sapiens
cugaugugccag

SEQ ID NO: 1118617 - RNA, 19 nt, Homo sapiens
cugcaaacucacugcucaa

SEQ ID NO: 1118618 - RNA, 22 nt, Homo sapiens
cugcaaaggcgucugaaugugu

SEQ ID NO: 1118619 - RNA, 17 nt, Homo sapiens
cugcaaaucugccugau

SEQ ID NO: 1118620 - RNA, 12 nt, Homo sapiens
cugcacagggau

SEQ ID NO: 1118621 - RNA, 18 nt, Homo sapiens
cugcacaugucuuguaca

SEQ ID NO: 1118622 - RNA, 23 nt, Homo sapiens
cugcacaugucuuguacaugugu

SEQ ID NO: 1118623 - RNA, 20 nt, Homo sapiens
cugcacccguacccccgugg

SEQ ID NO: 1118624 - RNA, 23 nt, Homo sapiens
cugcacuaauuugauguuuacag

SEQ ID NO: 1118625 - RNA, 14 nt, Homo sapiens
cugcagacucacug

SEQ ID NO: 1118626 - RNA, 19 nt, Homo sapiens
cugcagacucacuguggga

SEQ ID NO: 1118627 - RNA, 18 nt, Homo sapiens
cugcagagagaagccugu

SEQ ID NO: 1118628 - RNA, 13 nt, Homo sapiens
aaccgacuuuucu

SEQ ID NO: 1118629 - RNA, 14 nt, Homo sapiens
aaccgagcaauuuu

SEQ ID NO: 1118630 - RNA, 20 nt, Homo sapiens
aaccgcauggaacagugcag

SEQ ID NO: 1118631 - RNA, 14 nt, Homo sapiens
aaccgcuugccaua

SEQ ID NO: 1118632 - RNA, 16 nt, Homo sapiens
aaccguguccagcaca

SEQ ID NO: 1118633 - RNA, 20 nt, Homo sapiens
aaccuaccaccccuuccugu

SEQ ID NO: 1118634 - RNA, 12 nt, Homo sapiens
aaccucaucucu

SEQ ID NO: 1118635 - RNA, 21 nt, Homo sapiens
aaccuggagccacuucuaucu

SEQ ID NO: 1118636 - RNA, 18 nt, Homo sapiens
aaccuuauuguaccucuc

SEQ ID NO: 1118637 - RNA, 18 nt, Homo sapiens
aaccuugucucuaugcca

SEQ ID NO: 1118638 - RNA, 14 nt, Homo sapiens
aaccuuucccucac

SEQ ID NO: 1118639 - RNA, 16 nt, Homo sapiens
aacggagagugcuugg

SEQ ID NO: 1118640 - RNA, 18 nt, Homo sapiens
aacggcuccaggauuuua

SEQ ID NO: 1118641 - RNA, 14 nt, Homo sapiens
aacgucaucucagg

SEQ ID NO: 1118642 - RNA, 17 nt, Homo sapiens
aacguuuugaacuaaua

SEQ ID NO: 1118643 - RNA, 14 nt, Homo sapiens
aacuaaaagcauag

SEQ ID NO: 1118644 - RNA, 14 nt, Homo sapiens
aacuaaauaaagcu

SEQ ID NO: 1118645 - RNA, 13 nt, Homo sapiens
aacuaacacagcc

SEQ ID NO: 1118646 - RNA, 17 nt, Homo sapiens
aacuaauaaaagcauaa

SEQ ID NO: 1118647 - RNA, 17 nt, Homo sapiens
aacuacauuaguacaca

SEQ ID NO: 1118648 - RNA, 13 nt, Homo sapiens
aacuacugugauc

SEQ ID NO: 1118649 - RNA, 13 nt, Homo sapiens
aacuauauucuca

SEQ ID NO: 1118650 - RNA, 13 nt, Homo sapiens
aacuauccaaaac

SEQ ID NO: 1118651 - RNA, 16 nt, Homo sapiens
aacuauguacuuuaaa

SEQ ID NO: 1118652 - RNA, 17 nt, Homo sapiens
aacuauuguauaauggg

SEQ ID NO: 1118653 - RNA, 16 nt, Homo sapiens
aacuauuuauuucacc

SEQ ID NO: 1118654 - RNA, 21 nt, Homo sapiens
aacucaaggaaaucuguguca

SEQ ID NO: 1118655 - RNA, 14 nt, Homo sapiens
aacucaucuguuau

SEQ ID NO: 1118656 - RNA, 18 nt, Homo sapiens
aacuccaggaaaacuguu

SEQ ID NO: 1118657 - RNA, 12 nt, Homo sapiens
aacuccagugaa

SEQ ID NO: 1118658 - RNA, 19 nt, Homo sapiens
aacuccuuuagcagguggu

SEQ ID NO: 1118659 - RNA, 12 nt, Homo sapiens
aacucucuccac

SEQ ID NO: 1118660 - RNA, 18 nt, Homo sapiens
aacugauuuuuagcuuua

SEQ ID NO: 1118661 - RNA, 20 nt, Homo sapiens
aacuggaauccuuucagcaa

SEQ ID NO: 1118662 - RNA, 20 nt, Homo sapiens
aacuggaggaguuccuugau

SEQ ID NO: 1118663 - RNA, 21 nt, Homo sapiens
aacuggaggaguuccuugauc

SEQ ID NO: 1118664 - RNA, 14 nt, Homo sapiens
aacuuaaaagauuc

SEQ ID NO: 1118665 - RNA, 16 nt, Homo sapiens
aacuuaaaucacugag

SEQ ID NO: 1118666 - RNA, 16 nt, Homo sapiens
aacuuaauaguauuua

SEQ ID NO: 1118667 - RNA, 19 nt, Homo sapiens
aacuuauaucaucagcaua

SEQ ID NO: 1118668 - RNA, 17 nt, Homo sapiens
aacuucagcaccaugga

SEQ ID NO: 1118669 - RNA, 13 nt, Homo sapiens
aacuucauuugau

SEQ ID NO: 1118670 - RNA, 11 nt, Homo sapiens
aacuuccucag

SEQ ID NO: 1118671 - RNA, 23 nt, Homo sapiens
aacuuugacaaccaugagaccac

SEQ ID NO: 1118672 - RNA, 22 nt, Homo sapiens
aagaaaaguagguuuacauuca

SEQ ID NO: 1118673 - RNA, 13 nt, Homo sapiens
aagaaacccaagu

SEQ ID NO: 1118674 - RNA, 22 nt, Homo sapiens
aagaaauggaaucagcuuuuaa

SEQ ID NO: 1118675 - RNA, 12 nt, Homo sapiens
aagaaauuccug

SEQ ID NO: 1118676 - RNA, 19 nt, Homo sapiens
aagaacaaaucugggcauu

SEQ ID NO: 1118677 - RNA, 20 nt, Homo sapiens
aagaacaguaacugccauca

SEQ ID NO: 1118678 - RNA, 16 nt, Homo sapiens
aagaaccgagcaauuu

SEQ ID NO: 1118679 - RNA, 16 nt, Homo sapiens
aagaagacacauuccu

SEQ ID NO: 1118680 - RNA, 16 nt, Homo sapiens
aagaagacauggagac

SEQ ID NO: 1118681 - RNA, 15 nt, Homo sapiens
aagaaggacacuugu

SEQ ID NO: 1118682 - RNA, 16 nt, Homo sapiens
aagaauaaaugaaucu

SEQ ID NO: 1118683 - RNA, 13 nt, Homo sapiens
aagaauacagaaa

SEQ ID NO: 1118684 - RNA, 16 nt, Homo sapiens
aagaaucacuugaacc

SEQ ID NO: 1118685 - RNA, 13 nt, Homo sapiens
aagaaucuaauag

SEQ ID NO: 1118686 - RNA, 22 nt, Homo sapiens
aagaaucuucugccccagcuuu

SEQ ID NO: 1118687 - RNA, 18 nt, Homo sapiens
aagaauuacaaguagaau

SEQ ID NO: 1118688 - RNA, 17 nt, Homo sapiens
aagaauuccaaccgacc

SEQ ID NO: 1118689 - RNA, 16 nt, Homo sapiens
aagacaccaaauucca

SEQ ID NO: 1118690 - RNA, 12 nt, Homo sapiens
aagaccaagaca

SEQ ID NO: 1118691 - RNA, 13 nt, Homo sapiens
aagacccagugua

SEQ ID NO: 1118692 - RNA, 21 nt, Homo sapiens
aagacccaguguaaagaauaa

SEQ ID NO: 1118693 - RNA, 19 nt, Homo sapiens
aagaccuucugaagaucuc

SEQ ID NO: 1118694 - RNA, 18 nt, Homo sapiens
aagacguccuggaaugaa

SEQ ID NO: 1118695 - RNA, 22 nt, Homo sapiens
aagacuguggcugcuagcacuu

SEQ ID NO: 1118696 - RNA, 15 nt, Homo sapiens
aagacuguugcucaa

SEQ ID NO: 1118697 - RNA, 13 nt, Homo sapiens
aagacuugacagu

SEQ ID NO: 1118698 - RNA, 18 nt, Homo sapiens
aagagaccaagacucuga

SEQ ID NO: 1118699 - RNA, 17 nt, Homo sapiens
aagagaucacaauacuc

SEQ ID NO: 1118700 - RNA, 21 nt, Homo sapiens
aagagauuucaacauaucauu

SEQ ID NO: 1118701 - RNA, 14 nt, Homo sapiens
aagagccauguacc

SEQ ID NO: 1118702 - RNA, 15 nt, Homo sapiens
aagagcuuacaagac

SEQ ID NO: 1118703 - RNA, 16 nt, Homo sapiens
aagagcuuacaagacc

SEQ ID NO: 1118704 - RNA, 14 nt, Homo sapiens
aagaggcagggucu

SEQ ID NO: 1118705 - RNA, 16 nt, Homo sapiens
aagaggcgacuuccuc

SEQ ID NO: 1118706 - RNA, 16 nt, Homo sapiens
aagagggucugaggaa

SEQ ID NO: 1118707 - RNA, 21 nt, Homo sapiens
aagagugagacuccgucucaa

SEQ ID NO: 1118708 - RNA, 15 nt, Homo sapiens
aagagugagagggca

SEQ ID NO: 1118709 - RNA, 14 nt, Homo sapiens
aagaguggaaccaa

SEQ ID NO: 1118710 - RNA, 18 nt, Homo sapiens
aagaugagagaacuggag

SEQ ID NO: 1118711 - RNA, 23 nt, Homo sapiens
aaguuaaaaguguugauuacaua

SEQ ID NO: 1118712 - RNA, 14 nt, Homo sapiens
aaguuacuucacuu

SEQ ID NO: 1118713 - RNA, 22 nt, Homo sapiens
aaguuauacuguggcuaugcaa

SEQ ID NO: 1118714 - RNA, 20 nt, Homo sapiens
aaguuauuccccaucuucca

SEQ ID NO: 1118715 - RNA, 14 nt, Homo sapiens
aaguuauugauguu

SEQ ID NO: 1118716 - RNA, 16 nt, Homo sapiens
aaguucaauacucauu

SEQ ID NO: 1118717 - RNA, 18 nt, Homo sapiens
aaguuccaguguucucuc

SEQ ID NO: 1118718 - RNA, 22 nt, Homo sapiens
agauuccugguuaaauuugaau

SEQ ID NO: 1118719 - RNA, 23 nt, Homo sapiens
agauugcguggaccccgacaaag

SEQ ID NO: 1118720 - RNA, 22 nt, Homo sapiens
agauuguucuguccaguuucca

SEQ ID NO: 1118721 - RNA, 19 nt, Homo sapiens
agauuuauguaaugcuuua

SEQ ID NO: 1118722 - RNA, 18 nt, Homo sapiens
agauuuccaaaagacuug

SEQ ID NO: 1118723 - RNA, 15 nt, Homo sapiens
agauuuccuaacucu

SEQ ID NO: 1118724 - RNA, 23 nt, Homo sapiens
agauuuucauguucuugcaguca

SEQ ID NO: 1118725 - RNA, 13 nt, Homo sapiens
agauuuucuugca

SEQ ID NO: 1118726 - RNA, 20 nt, Homo sapiens
agcaaaaccacugagcuucu

SEQ ID NO: 1118727 - RNA, 22 nt, Homo sapiens
agcaaauggagaaguucaggaa

SEQ ID NO: 1118728 - RNA, 17 nt, Homo sapiens
agcaacaggaaucucag

SEQ ID NO: 1118729 - RNA, 13 nt, Homo sapiens
agcaacugcagaa

SEQ ID NO: 1118730 - RNA, 14 nt, Homo sapiens
agcaagacacaucc

SEQ ID NO: 1118731 - RNA, 17 nt, Homo sapiens
agcacacuuaugggcca

SEQ ID NO: 1118732 - RNA, 20 nt, Homo sapiens
agcacagcagccccugcaca

SEQ ID NO: 1118733 - RNA, 14 nt, Homo sapiens
agcacaucugggag

SEQ ID NO: 1118734 - RNA, 17 nt, Homo sapiens
agcaccuacuuacaugc

SEQ ID NO: 1118735 - RNA, 20 nt, Homo sapiens
agcaccuacuuacaugcauu

SEQ ID NO: 1118736 - RNA, 23 nt, Homo sapiens
agcacuaaggugugcucugauca

SEQ ID NO: 1118737 - RNA, 23 nt, Homo sapiens
agcacugcuguguccgcuuucau

SEQ ID NO: 1118738 - RNA, 17 nt, Homo sapiens
agcacuuaauaauugca

SEQ ID NO: 1118739 - RNA, 15 nt, Homo sapiens
agcagaagcacauau

SEQ ID NO: 1118740 - RNA, 20 nt, Homo sapiens
agcagaagcacauaugaacu

SEQ ID NO: 1118741 - RNA, 21 nt, Homo sapiens
agcagacucagcucugacauu

SEQ ID NO: 1118742 - RNA, 15 nt, Homo sapiens
agcagagaacuggaa

SEQ ID NO: 1118743 - RNA, 21 nt, Homo sapiens
agcagcccuaaggaucucuca

SEQ ID NO: 1118744 - RNA, 16 nt, Homo sapiens
agcagguaggaggcaa

SEQ ID NO: 1118745 - RNA, 19 nt, Homo sapiens
agcaguaagcuaucuucaa

SEQ ID NO: 1118746 - RNA, 17 nt, Homo sapiens
agcagugccuuccauaa

SEQ ID NO: 1118747 - RNA, 15 nt, Homo sapiens
agcagugucuuccau

SEQ ID NO: 1118748 - RNA, 17 nt, Homo sapiens
agcagugucuuccauaa

SEQ ID NO: 1118749 - RNA, 21 nt, Homo sapiens
agcagugugucaggugcugca

SEQ ID NO: 1118750 - RNA, 19 nt, Homo sapiens
agcaguguuuucaccucau

SEQ ID NO: 1118751 - RNA, 14 nt, Homo sapiens
agcaucaccucagg

SEQ ID NO: 1118752 - RNA, 13 nt, Homo sapiens
agcaucaugccuc

SEQ ID NO: 1118753 - RNA, 17 nt, Homo sapiens
agcaucuuauacgagua

SEQ ID NO: 1118754 - RNA, 20 nt, Homo sapiens
agcauggucacaagcacaaa

SEQ ID NO: 1118755 - RNA, 19 nt, Homo sapiens
agcauguggggaagcaaga

SEQ ID NO: 1118756 - RNA, 15 nt, Homo sapiens
agcauuacagugggu

SEQ ID NO: 1118757 - RNA, 18 nt, Homo sapiens
agcauuagcuacuuuuca

SEQ ID NO: 1118758 - RNA, 18 nt, Homo sapiens
agcauuaugauguggguc

SEQ ID NO: 1118759 - RNA, 16 nt, Homo sapiens
agcauucugucuugaa

SEQ ID NO: 1118760 - RNA, 17 nt, Homo sapiens
agcauugggcugggcuc

SEQ ID NO: 1118761 - RNA, 21 nt, Homo sapiens
agcauuucccucccgggagag

SEQ ID NO: 1118762 - RNA, 19 nt, Homo sapiens
agcauuucuugauguugcu

SEQ ID NO: 1118763 - RNA, 16 nt, Homo sapiens
agccaaacucugccag

SEQ ID NO: 1118764 - RNA, 16 nt, Homo sapiens
agccacacuucucagg

SEQ ID NO: 1118765 - RNA, 17 nt, Homo sapiens
agccacacuucucagga

SEQ ID NO: 1118766 - RNA, 16 nt, Homo sapiens
agccacagaccaccug

SEQ ID NO: 1118767 - RNA, 21 nt, Homo sapiens
agccacccaggggaaugaucu

SEQ ID NO: 1118768 - RNA, 22 nt, Homo sapiens
agccacccugaggagucugagg

SEQ ID NO: 1118769 - RNA, 22 nt, Homo sapiens
agccaccucuugggcaugcuca

SEQ ID NO: 1118770 - RNA, 14 nt, Homo sapiens
agccaccuuccagu

SEQ ID NO: 1118771 - RNA, 18 nt, Homo sapiens
agccacugguuucucaga

SEQ ID NO: 1118772 - RNA, 22 nt, Homo sapiens
agccagagagugagagacauua

SEQ ID NO: 1118773 - RNA, 20 nt, Homo sapiens
agccagaggaggccggugaa

SEQ ID NO: 1118774 - RNA, 19 nt, Homo sapiens
agccagcagccagcucuca

SEQ ID NO: 1118775 - RNA, 16 nt, Homo sapiens
agccagcucugcauua

SEQ ID NO: 1118776 - RNA, 23 nt, Homo sapiens
agccaggcugagugagccacaga

SEQ ID NO: 1118777 - RNA, 20 nt, Homo sapiens
agccaggguccugaguggcu

SEQ ID NO: 1118778 - RNA, 14 nt, Homo sapiens
agccagggucucac

SEQ ID NO: 1118779 - RNA, 20 nt, Homo sapiens
agccauguaccaguguacug

SEQ ID NO: 1118780 - RNA, 23 nt, Homo sapiens
agccauuuuuagcucugaucagc

SEQ ID NO: 1118781 - RNA, 17 nt, Homo sapiens
agcccaauguaaugcau

SEQ ID NO: 1118782 - RNA, 20 nt, Homo sapiens
agcccagaaaaccuccagua

SEQ ID NO: 1118783 - RNA, 16 nt, Homo sapiens
agcccagggcacuuca

SEQ ID NO: 1118784 - RNA, 19 nt, Homo sapiens
agcccaugcucaaccacug

SEQ ID NO: 1118785 - RNA, 22 nt, Homo sapiens
agcccaugcucaaccacugugg

SEQ ID NO: 1118786 - RNA, 13 nt, Homo sapiens
agcccaugcuuuc

SEQ ID NO: 1118787 - RNA, 23 nt, Homo sapiens
agcccauggcuuuagcuaccuca

SEQ ID NO: 1118788 - RNA, 22 nt, Homo sapiens
agcccauuggcucccaucugaa

SEQ ID NO: 1118789 - RNA, 17 nt, Homo sapiens
agccccagugacagcua

SEQ ID NO: 1118790 - RNA, 22 nt, Homo sapiens
agccccauucugccugcccagg

SEQ ID NO: 1118791 - RNA, 16 nt, Homo sapiens
agcccccuacugagaa

SEQ ID NO: 1118792 - RNA, 13 nt, Homo sapiens
agccccgacucca

SEQ ID NO: 1118793 - RNA, 16 nt, Homo sapiens
agccccgcccgccugg

SEQ ID NO: 1118794 - RNA, 13 nt, Homo sapiens
agcccugacuggu

SEQ ID NO: 1118795 - RNA, 21 nt, Homo sapiens
agcccuggcccagagcuggaa

SEQ ID NO: 1118796 - RNA, 12 nt, Homo sapiens
agccgaccucag

SEQ ID NO: 1118797 - RNA, 16 nt, Homo sapiens
agccgcuucugacugc

SEQ ID NO: 1118798 - RNA, 14 nt, Homo sapiens
agccgugaugcuca

SEQ ID NO: 1118799 - RNA, 16 nt, Homo sapiens
agccucaagaugaagg

SEQ ID NO: 1118800 - RNA, 15 nt, Homo sapiens
agccuccuccugacc

SEQ ID NO: 1118801 - RNA, 15 nt, Homo sapiens
agccuccucucucaa

SEQ ID NO: 1118802 - RNA, 21 nt, Homo sapiens
agccucuccuugccuggugac

SEQ ID NO: 1118803 - RNA, 18 nt, Homo sapiens
aaugcaugauuuuauaca

SEQ ID NO: 1118804 - RNA, 22 nt, Homo sapiens
aaugccagagacggaagccuuu

SEQ ID NO: 1118805 - RNA, 19 nt, Homo sapiens
aaugcuacaaacauaucaa

SEQ ID NO: 1118806 - RNA, 20 nt, Homo sapiens
aauggacauaagacagacag

SEQ ID NO: 1118807 - RNA, 17 nt, Homo sapiens
aauggagaaguucagga

SEQ ID NO: 1118808 - RNA, 20 nt, Homo sapiens
aauggagggaauaauaccua

SEQ ID NO: 1118809 - RNA, 20 nt, Homo sapiens
aauggcucaugaccuggaaa

SEQ ID NO: 1118810 - RNA, 13 nt, Homo sapiens
aauggcucuguga

SEQ ID NO: 1118811 - RNA, 21 nt, Homo sapiens
aauggcuuuaugcuaguuuga

SEQ ID NO: 1118812 - RNA, 21 nt, Homo sapiens
aauggguacaauguacauuau

SEQ ID NO: 1118813 - RNA, 17 nt, Homo sapiens
aauggucgcccaggaga

SEQ ID NO: 1118814 - RNA, 22 nt, Homo sapiens
aauggugcaaauccuacugaau

SEQ ID NO: 1118815 - RNA, 14 nt, Homo sapiens
aaugguuugaauau

SEQ ID NO: 1118816 - RNA, 16 nt, Homo sapiens
aauguaucauagaaau

SEQ ID NO: 1118817 - RNA, 15 nt, Homo sapiens
aauguaugauuacau

SEQ ID NO: 1118818 - RNA, 14 nt, Homo sapiens
aaugucaccaccuu

SEQ ID NO: 1118819 - RNA, 14 nt, Homo sapiens
aaugucacuuaaag

SEQ ID NO: 1118820 - RNA, 17 nt, Homo sapiens
aaugucaggaacagaag

SEQ ID NO: 1118821 - RNA, 12 nt, Homo sapiens
aaugucaucaaa

SEQ ID NO: 1118822 - RNA, 17 nt, Homo sapiens
aaugucuggucugucca

SEQ ID NO: 1118823 - RNA, 18 nt, Homo sapiens
aaugucuuuuuaagcuua

SEQ ID NO: 1118824 - RNA, 11 nt, Homo sapiens
aaugugcaaua

SEQ ID NO: 1118825 - RNA, 21 nt, Homo sapiens
aaugugccucggccuccaagg

SEQ ID NO: 1118826 - RNA, 15 nt, Homo sapiens
aaugugguacaagca

SEQ ID NO: 1118827 - RNA, 20 nt, Homo sapiens
aaugugugaaggucuugccu

SEQ ID NO: 1118828 - RNA, 23 nt, Homo sapiens
aauguuaagacuugacaguggaa

SEQ ID NO: 1118829 - RNA, 16 nt, Homo sapiens
aauguuacauuauuau

SEQ ID NO: 1118830 - RNA, 18 nt, Homo sapiens
aauguuacauuauuauca

SEQ ID NO: 1118831 - RNA, 22 nt, Homo sapiens
aauguuauuuuuuaauuauuau

SEQ ID NO: 1118832 - RNA, 12 nt, Homo sapiens
aauguuucacua

SEQ ID NO: 1118833 - RNA, 16 nt, Homo sapiens
aauguuucacuaugau

SEQ ID NO: 1118834 - RNA, 18 nt, Homo sapiens
aauguuucacuaugauuu

SEQ ID NO: 1118835 - RNA, 19 nt, Homo sapiens
aauuaaaaaguuaaucuuc

SEQ ID NO: 1118836 - RNA, 15 nt, Homo sapiens
aauuaaagcuguuau

SEQ ID NO: 1118837 - RNA, 14 nt, Homo sapiens
aauuaaaguauaca

SEQ ID NO: 1118838 - RNA, 14 nt, Homo sapiens
aauuaaaugcaugu

SEQ ID NO: 1118839 - RNA, 15 nt, Homo sapiens
aauuaaaugcauguc

SEQ ID NO: 1118840 - RNA, 19 nt, Homo sapiens
aauuaagagauacauuccc

SEQ ID NO: 1118841 - RNA, 12 nt, Homo sapiens
aauuagcaauug

SEQ ID NO: 1118842 - RNA, 23 nt, Homo sapiens
aauuagcaauugacugucacugu

SEQ ID NO: 1118843 - RNA, 19 nt, Homo sapiens
aauuagguuuuguacaauu

SEQ ID NO: 1118844 - RNA, 13 nt, Homo sapiens
aauuaguauuuau

SEQ ID NO: 1118845 - RNA, 20 nt, Homo sapiens
aauuaucggaagcagugccu

SEQ ID NO: 1118846 - RNA, 18 nt, Homo sapiens
aauuaucgggaacagugu

SEQ ID NO: 1118847 - RNA, 18 nt, Homo sapiens
aauuauuaugucucaaaa

SEQ ID NO: 1118848 - RNA, 21 nt, Homo sapiens
aauuauuaugucucaaaauaa

SEQ ID NO: 1118849 - RNA, 13 nt, Homo sapiens
aauucccagcugu

SEQ ID NO: 1118850 - RNA, 15 nt, Homo sapiens
aauucccagcugucu

SEQ ID NO: 1118851 - RNA, 21 nt, Homo sapiens
aauuccuaauaaguuugauca

SEQ ID NO: 1118852 - RNA, 21 nt, Homo sapiens
aauuccuagaaguugagagag

SEQ ID NO: 1118853 - RNA, 15 nt, Homo sapiens
aauucuaugagauag

SEQ ID NO: 1118854 - RNA, 21 nt, Homo sapiens
aauucuauuacgugcaauacu

SEQ ID NO: 1118855 - RNA, 17 nt, Homo sapiens
aauucugcucagauaga

SEQ ID NO: 1118856 - RNA, 21 nt, Homo sapiens
aauucuuuucuuuuccauuua

SEQ ID NO: 1118857 - RNA, 22 nt, Homo sapiens
aauugacugagacuggaaauau

SEQ ID NO: 1118858 - RNA, 12 nt, Homo sapiens
aauugauuucaa

SEQ ID NO: 1118859 - RNA, 15 nt, Homo sapiens
aauugcucaaugcau

SEQ ID NO: 1118860 - RNA, 19 nt, Homo sapiens
aauugcucaaugcaugaau

SEQ ID NO: 1118861 - RNA, 17 nt, Homo sapiens
aauugugaucagaccau

SEQ ID NO: 1118862 - RNA, 14 nt, Homo sapiens
aauugugugucuuc

SEQ ID NO: 1118863 - RNA, 12 nt, Homo sapiens
aauuuacuuugu

SEQ ID NO: 1118864 - RNA, 14 nt, Homo sapiens
aauuuaggaccaau

SEQ ID NO: 1118865 - RNA, 18 nt, Homo sapiens
aauuuaggaccaauaccu

SEQ ID NO: 1118866 - RNA, 18 nt, Homo sapiens
aauuuauucaauuccucu

SEQ ID NO: 1118867 - RNA, 17 nt, Homo sapiens
aauuucuggaaaacugc

SEQ ID NO: 1118868 - RNA, 19 nt, Homo sapiens
aauuucuggaaaacugccu

SEQ ID NO: 1118869 - RNA, 15 nt, Homo sapiens
aauuucuuacuaaac

SEQ ID NO: 1118870 - RNA, 19 nt, Homo sapiens
aauuugaaauuugacucau

SEQ ID NO: 1118871 - RNA, 14 nt, Homo sapiens
aauuugacucauga

SEQ ID NO: 1118872 - RNA, 18 nt, Homo sapiens
aauuuggccugcacuaau

SEQ ID NO: 1118873 - RNA, 21 nt, Homo sapiens
aauuugggggacuuacaugau

SEQ ID NO: 1118874 - RNA, 17 nt, Homo sapiens
aauuugguguggcugua

SEQ ID NO: 1118875 - RNA, 14 nt, Homo sapiens
aauuuguguucuca

SEQ ID NO: 1118876 - RNA, 15 nt, Homo sapiens
aauuuucuaugcuua

SEQ ID NO: 1118877 - RNA, 16 nt, Homo sapiens
aauuuucuaugcuuau

SEQ ID NO: 1118878 - RNA, 24 nt, Homo sapiens
aauuuucuucaugcaaugacaucu

SEQ ID NO: 1118879 - RNA, 13 nt, Homo sapiens
aauuuucuuccaa

SEQ ID NO: 1118880 - RNA, 21 nt, Homo sapiens
aauuuugccauaaagucaaau

SEQ ID NO: 1118881 - RNA, 23 nt, Homo sapiens
aauuuuguguguaccugugacua

SEQ ID NO: 1118882 - RNA, 19 nt, Homo sapiens
aauuuuguuuguugaugug

SEQ ID NO: 1118883 - RNA, 20 nt, Homo sapiens
aauuuuugaacaacuguugg

SEQ ID NO: 1118884 - RNA, 23 nt, Homo sapiens
aauuuuuuaguauaaguacauua

SEQ ID NO: 1118885 - RNA, 23 nt, Homo sapiens
acaaaaaaguguucccuuuucaa

SEQ ID NO: 1118886 - RNA, 21 nt, Homo sapiens
acaaaagcccaauguaaugca

SEQ ID NO: 1118887 - RNA, 16 nt, Homo sapiens
acaaaauaacauuuga

SEQ ID NO: 1118888 - RNA, 12 nt, Homo sapiens
acaaaauaauuu

SEQ ID NO: 1118889 - RNA, 15 nt, Homo sapiens
acaaaggagccugug

SEQ ID NO: 1118890 - RNA, 18 nt, Homo sapiens
acaaagggaaggcugcug

SEQ ID NO: 1118891 - RNA, 22 nt, Homo sapiens
acaaauaaucaaaacccaacau

SEQ ID NO: 1118892 - RNA, 17 nt, Homo sapiens
acaaauuauguuacauc

SEQ ID NO: 1118893 - RNA, 16 nt, Homo sapiens
agacaugaaaucugag

SEQ ID NO: 1118894 - RNA, 16 nt, Homo sapiens
agaccaaaauaugaaa

SEQ ID NO: 1118895 - RNA, 18 nt, Homo sapiens
agaccaccucucaauauu

SEQ ID NO: 1118896 - RNA, 21 nt, Homo sapiens
cggaugucccaucugcuccuc

SEQ ID NO: 1118897 - RNA, 16 nt, Homo sapiens
cggcacauuggcagug

SEQ ID NO: 1118898 - RNA, 21 nt, Homo sapiens
cggcaucgggccaucucagau

SEQ ID NO: 1118899 - RNA, 18 nt, Homo sapiens
cggccaagugaaggagcc

SEQ ID NO: 1118900 - RNA, 15 nt, Homo sapiens
cggccuugggaaauc

SEQ ID NO: 1118901 - RNA, 13 nt, Homo sapiens
cgggaacaguguu

SEQ ID NO: 1118902 - RNA, 15 nt, Homo sapiens
cgggaggcugagaca

SEQ ID NO: 1118903 - RNA, 20 nt, Homo sapiens
cgggaucucguaucuuuaaa

SEQ ID NO: 1118904 - RNA, 18 nt, Homo sapiens
cgggcugggagcucugca

SEQ ID NO: 1118905 - RNA, 15 nt, Homo sapiens
cggggugcuguggug

SEQ ID NO: 1118906 - RNA, 13 nt, Homo sapiens
cggguguguacac

SEQ ID NO: 1118907 - RNA, 17 nt, Homo sapiens
cggucccacacugguga

SEQ ID NO: 1118908 - RNA, 15 nt, Homo sapiens
cguaacaacuguggu

SEQ ID NO: 1118909 - RNA, 16 nt, Homo sapiens
cguaagggaucuuccu

SEQ ID NO: 1118910 - RNA, 17 nt, Homo sapiens
cgucaaagcaguaguca

SEQ ID NO: 1118911 - RNA, 20 nt, Homo sapiens
cgucucuacuaaaaauacaa

SEQ ID NO: 1118912 - RNA, 15 nt, Homo sapiens
cgucuucuguauacu

SEQ ID NO: 1118913 - RNA, 19 nt, Homo sapiens
cgugaacugcgugccagug

SEQ ID NO: 1118914 - RNA, 17 nt, Homo sapiens
cgugagcagcuuuggaa

SEQ ID NO: 1118915 - RNA, 16 nt, Homo sapiens
cguguccagcacagaa

SEQ ID NO: 1118916 - RNA, 14 nt, Homo sapiens
cguguccgacucuu

SEQ ID NO: 1118917 - RNA, 13 nt, Homo sapiens
cgugucucaggag

SEQ ID NO: 1118918 - RNA, 22 nt, Homo sapiens
cguuaagggaaggaacucuggc

SEQ ID NO: 1118919 - RNA, 19 nt, Homo sapiens
cguuggccuaacacugggc

SEQ ID NO: 1118920 - RNA, 14 nt, Homo sapiens
cguuuggcauuucu

SEQ ID NO: 1118921 - RNA, 14 nt, Homo sapiens
cuaguuugaccuca

SEQ ID NO: 1118922 - RNA, 15 nt, Homo sapiens
cuaguuugaccucau

SEQ ID NO: 1118923 - RNA, 23 nt, Homo sapiens
cuauauaguuuauugacaauaau

SEQ ID NO: 1118924 - RNA, 16 nt, Homo sapiens
cuauauggcagugucu

SEQ ID NO: 1118925 - RNA, 15 nt, Homo sapiens
cuauauguugcugaa

SEQ ID NO: 1118926 - RNA, 17 nt, Homo sapiens
cuauauucucaguguag

SEQ ID NO: 1118927 - RNA, 20 nt, Homo sapiens
cuauauucucaguguagggc

SEQ ID NO: 1118928 - RNA, 16 nt, Homo sapiens
cuaucaaaacauauca

SEQ ID NO: 1118929 - RNA, 17 nt, Homo sapiens
cuaucaaaacauaucaa

SEQ ID NO: 1118930 - RNA, 15 nt, Homo sapiens
cuaucauucugcucu

SEQ ID NO: 1118931 - RNA, 14 nt, Homo sapiens
cuaucgcaccacug

SEQ ID NO: 1118932 - RNA, 22 nt, Homo sapiens
cuaugaaggcuguacacugcac

SEQ ID NO: 1118933 - RNA, 15 nt, Homo sapiens
cuaugacacugagca

SEQ ID NO: 1118934 - RNA, 14 nt, Homo sapiens
cuauggucaguuga

SEQ ID NO: 1118935 - RNA, 22 nt, Homo sapiens
cuauguauggaauacaguguua

SEQ ID NO: 1118936 - RNA, 16 nt, Homo sapiens
cuauuacaccaaauaa

SEQ ID NO: 1118937 - RNA, 16 nt, Homo sapiens
cuauuacgugcaauac

SEQ ID NO: 1118938 - RNA, 21 nt, Homo sapiens
cuauuaugggaaugacucuga

SEQ ID NO: 1118939 - RNA, 19 nt, Homo sapiens
cuauugacaagucauuuua

SEQ ID NO: 1118940 - RNA, 16 nt, Homo sapiens
cuauuggaaugugguc

SEQ ID NO: 1118941 - RNA, 13 nt, Homo sapiens
cuauuuauuucac

SEQ ID NO: 1118942 - RNA, 15 nt, Homo sapiens
cuauuuuaaaaccau

SEQ ID NO: 1118943 - RNA, 21 nt, Homo sapiens
cuauuuucaacauaacugaag

SEQ ID NO: 1118944 - RNA, 16 nt, Homo sapiens
cucaaaaaaagggcaa

SEQ ID NO: 1118945 - RNA, 15 nt, Homo sapiens
ccggggaacuggcca

SEQ ID NO: 1118946 - RNA, 23 nt, Homo sapiens
ccggguaccgugcaugugcaguc

SEQ ID NO: 1118947 - RNA, 15 nt, Homo sapiens
ccggguccccagcuc

SEQ ID NO: 1118948 - RNA, 20 nt, Homo sapiens
ccguuuuuacuaaguaaaag

SEQ ID NO: 1118949 - RNA, 19 nt, Homo sapiens
ccuaaauaauguuaucugu

SEQ ID NO: 1118950 - RNA, 15 nt, Homo sapiens
ccuaaccucauuccc

SEQ ID NO: 1118951 - RNA, 18 nt, Homo sapiens
ccuaaggacacacuaauc

SEQ ID NO: 1118952 - RNA, 20 nt, Homo sapiens
ccuaaguauaaaugguuguc

SEQ ID NO: 1118953 - RNA, 14 nt, Homo sapiens
ccuaauaaacaauu

SEQ ID NO: 1118954 - RNA, 15 nt, Homo sapiens
ccuacagauagucaa

SEQ ID NO: 1118955 - RNA, 18 nt, Homo sapiens
ccuacaucccaucauggc

SEQ ID NO: 1118956 - RNA, 12 nt, Homo sapiens
ccuaccaaauau

SEQ ID NO: 1118957 - RNA, 20 nt, Homo sapiens
ccuacuuuucuuuccucaga

SEQ ID NO: 1118958 - RNA, 15 nt, Homo sapiens
ccuagagcacacugu

SEQ ID NO: 1118959 - RNA, 23 nt, Homo sapiens
ccuagcaggcacaggacaccugg

SEQ ID NO: 1118960 - RNA, 15 nt, Homo sapiens
ccuagccgaccucag

SEQ ID NO: 1118961 - RNA, 21 nt, Homo sapiens
ccuauaccuguguuucuugcc

SEQ ID NO: 1118962 - RNA, 20 nt, Homo sapiens
ccuauagucccagcuacuca

SEQ ID NO: 1118963 - RNA, 23 nt, Homo sapiens
ccuaugucaauuuguauaucaug

SEQ ID NO: 1118964 - RNA, 16 nt, Homo sapiens
ccuauuaaaacacagc

SEQ ID NO: 1118965 - RNA, 18 nt, Homo sapiens
ccuauuucuuauagucaa

SEQ ID NO: 1118966 - RNA, 16 nt, Homo sapiens
ccuauuuuuggaagag

SEQ ID NO: 1118967 - RNA, 17 nt, Homo sapiens
ccucaaaaaaagccuuu

SEQ ID NO: 1118968 - RNA, 22 nt, Homo sapiens
ccucaaaugacccaaagaccaa

SEQ ID NO: 1118969 - RNA, 18 nt, Homo sapiens
ccucaaccuccugggcua

SEQ ID NO: 1118970 - RNA, 13 nt, Homo sapiens
ccucaaugugacc

SEQ ID NO: 1118971 - RNA, 22 nt, Homo sapiens
ccucagccucccaaagugcugg

SEQ ID NO: 1118972 - RNA, 21 nt, Homo sapiens
ccucagccuugaaaaacaagu

SEQ ID NO: 1118973 - RNA, 18 nt, Homo sapiens
ccucagccuuuagggcuu

SEQ ID NO: 1118974 - RNA, 22 nt, Homo sapiens
ccucagggaucuugcauuccca

SEQ ID NO: 1118975 - RNA, 12 nt, Homo sapiens
ccucaggugcua

SEQ ID NO: 1118976 - RNA, 12 nt, Homo sapiens
ccucaguguccu

SEQ ID NO: 1118977 - RNA, 13 nt, Homo sapiens
ccucauuccugaa

SEQ ID NO: 1118978 - RNA, 14 nt, Homo sapiens
ccuccaaggggcuu

SEQ ID NO: 1118979 - RNA, 22 nt, Homo sapiens
ccuccaggaugaguuacuugaa

SEQ ID NO: 1118980 - RNA, 21 nt, Homo sapiens
ccuccaguaguggacaacagg

SEQ ID NO: 1118981 - RNA, 12 nt, Homo sapiens
ccuccauucuga

SEQ ID NO: 1118982 - RNA, 15 nt, Homo sapiens
ccucccaaccccagg

SEQ ID NO: 1118983 - RNA, 20 nt, Homo sapiens
ccucccccaccuucaagcac

SEQ ID NO: 1118984 - RNA, 14 nt, Homo sapiens
ccucccucauucca

SEQ ID NO: 1118985 - RNA, 17 nt, Homo sapiens
ccuccggugugagauau

SEQ ID NO: 1118986 - RNA, 14 nt, Homo sapiens
ccuccuccugacca

SEQ ID NO: 1118987 - RNA, 14 nt, Homo sapiens
ccuccuguccagca

SEQ ID NO: 1118988 - RNA, 15 nt, Homo sapiens
ccuccuuggugccug

SEQ ID NO: 1118989 - RNA, 13 nt, Homo sapiens
ccucuacaagcaa

SEQ ID NO: 1118990 - RNA, 13 nt, Homo sapiens
ccucuacugggaa

SEQ ID NO: 1118991 - RNA, 18 nt, Homo sapiens
ccucuacuuaaugagaua

SEQ ID NO: 1118992 - RNA, 17 nt, Homo sapiens
ccucucaucaguguccu

SEQ ID NO: 1118993 - RNA, 15 nt, Homo sapiens
ccucuccaauuguaa

SEQ ID NO: 1118994 - RNA, 20 nt, Homo sapiens
ccucuccaggaaugccuccu

SEQ ID NO: 1118995 - RNA, 12 nt, Homo sapiens
ccucucuccuuc

SEQ ID NO: 1118996 - RNA, 11 nt, Homo sapiens
ccucucuugcc

SEQ ID NO: 1118997 - RNA, 20 nt, Homo sapiens
ccucugagaauuccaaggag

SEQ ID NO: 1118998 - RNA, 14 nt, Homo sapiens
ccucugcugccaug

SEQ ID NO: 1118999 - RNA, 21 nt, Homo sapiens
ccucuuggaccucugcucuga

SEQ ID NO: 1119000 - RNA, 22 nt, Homo sapiens
ccucuuucuuucuuuuguguug

SEQ ID NO: 1119001 - RNA, 15 nt, Homo sapiens
ccugaaaauucugua

SEQ ID NO: 1119002 - RNA, 17 nt, Homo sapiens
ccugaauuuuguugcug

SEQ ID NO: 1119003 - RNA, 16 nt, Homo sapiens
ccugacgaacuccuug

SEQ ID NO: 1119004 - RNA, 20 nt, Homo sapiens
ccugacuccucuaagccacu

SEQ ID NO: 1119005 - RNA, 13 nt, Homo sapiens
ccugagaccaguu

SEQ ID NO: 1119006 - RNA, 15 nt, Homo sapiens
ccugagccacaaaaa

SEQ ID NO: 1119007 - RNA, 20 nt, Homo sapiens
ccugagcucgguggacccag

SEQ ID NO: 1119008 - RNA, 20 nt, Homo sapiens
ccugaggguggagacuaagc

SEQ ID NO: 1119009 - RNA, 19 nt, Homo sapiens
ccugaguuugggauugugg

SEQ ID NO: 1119010 - RNA, 21 nt, Homo sapiens
ccugaugacagagcgagauuc

SEQ ID NO: 1119011 - RNA, 23 nt, Homo sapiens
ccugcaccgagagagauggaaua

SEQ ID NO: 1119012 - RNA, 15 nt, Homo sapiens
ccugcaguuggcaga

SEQ ID NO: 1119013 - RNA, 12 nt, Homo sapiens
ccugccaagcca

SEQ ID NO: 1119014 - RNA, 23 nt, Homo sapiens
ccugccccacuucucuacucugg

SEQ ID NO: 1119015 - RNA, 18 nt, Homo sapiens
ccugccucaggcuucuga

SEQ ID NO: 1119016 - RNA, 18 nt, Homo sapiens
ccugcuaaggcugccuca

SEQ ID NO: 1119017 - RNA, 16 nt, Homo sapiens
ccugcuagcuguagaa

SEQ ID NO: 1119018 - RNA, 21 nt, Homo sapiens
ccugcugcuguguuuuugcua

SEQ ID NO: 1119019 - RNA, 15 nt, Homo sapiens
ccugcuuuuugacau

SEQ ID NO: 1119020 - RNA, 20 nt, Homo sapiens
ccuggaaauuaaacccugcc

SEQ ID NO: 1119021 - RNA, 19 nt, Homo sapiens
ccuggaagccggccggcug

SEQ ID NO: 1119022 - RNA, 20 nt, Homo sapiens
ccuggaaucaagaugucaga

SEQ ID NO: 1119023 - RNA, 17 nt, Homo sapiens
ccuggccccugggccug

SEQ ID NO: 1119024 - RNA, 19 nt, Homo sapiens
ccuggcuggcugagggcag

SEQ ID NO: 1119025 - RNA, 18 nt, Homo sapiens
ccugggaaccaugaagcu

SEQ ID NO: 1119026 - RNA, 19 nt, Homo sapiens
ccugggagaaccucaggcu

SEQ ID NO: 1119027 - RNA, 19 nt, Homo sapiens
ccugggaggcggagaguac

SEQ ID NO: 1119028 - RNA, 15 nt, Homo sapiens
ccugggauucaggaa

SEQ ID NO: 1119029 - RNA, 18 nt, Homo sapiens
ccugggccccaccaccua

SEQ ID NO: 1119030 - RNA, 18 nt, Homo sapiens
ccuggggaagcugugaaa

SEQ ID NO: 1119031 - RNA, 17 nt, Homo sapiens
ccugggggaugugcacg

SEQ ID NO: 1119032 - RNA, 16 nt, Homo sapiens
ccuggguggcuacucu

SEQ ID NO: 1119033 - RNA, 23 nt, Homo sapiens
ccuguaaucccagcuacauggga

SEQ ID NO: 1119034 - RNA, 17 nt, Homo sapiens
ccuguagagucacugac

SEQ ID NO: 1119035 - RNA, 22 nt, Homo sapiens
ccuguaucuacuaaaaauacaa

SEQ ID NO: 1119036 - RNA, 20 nt, Homo sapiens
ccuguauucuacagcagaua

SEQ ID NO: 1119037 - RNA, 15 nt, Homo sapiens
ccuguccagcaggua

SEQ ID NO: 1119038 - RNA, 23 nt, Homo sapiens
ccuguccagcagguaguggguga

SEQ ID NO: 1119039 - RNA, 15 nt, Homo sapiens
ccuguccauaaagua

SEQ ID NO: 1119040 - RNA, 17 nt, Homo sapiens
ccugucccccugagauc

SEQ ID NO: 1119041 - RNA, 18 nt, Homo sapiens
ccugugcaacuuucccaa

SEQ ID NO: 1119042 - RNA, 12 nt, Homo sapiens
ccugugugagca

SEQ ID NO: 1119043 - RNA, 20 nt, Homo sapiens
ccuguuuaaaaaaaguauau

SEQ ID NO: 1119044 - RNA, 19 nt, Homo sapiens
ccuguuuauauugguauaa

SEQ ID NO: 1119045 - RNA, 13 nt, Homo sapiens
ccuuaaacucagg

SEQ ID NO: 1119046 - RNA, 17 nt, Homo sapiens
ccuuaaggagguagcuc

SEQ ID NO: 1119047 - RNA, 18 nt, Homo sapiens
ccuuacuauggaaagcag

SEQ ID NO: 1119048 - RNA, 22 nt, Homo sapiens
ccuuagcuggcauuacagcugg

SEQ ID NO: 1119049 - RNA, 14 nt, Homo sapiens
ccuuauuguaccuc

SEQ ID NO: 1119050 - RNA, 17 nt, Homo sapiens
ccuucaccagagcccau

SEQ ID NO: 1119051 - RNA, 12 nt, Homo sapiens
ccuucacuuuac

SEQ ID NO: 1119052 - RNA, 12 nt, Homo sapiens
ccuucaugauga

SEQ ID NO: 1119053 - RNA, 21 nt, Homo sapiens
ccuucaugaugaauuacuucu

SEQ ID NO: 1119054 - RNA, 18 nt, Homo sapiens
ccuuccagcuagugaccc

SEQ ID NO: 1119055 - RNA, 17 nt, Homo sapiens
ccuuccccagacuucuc

SEQ ID NO: 1119056 - RNA, 14 nt, Homo sapiens
ccuuccgaugacag

SEQ ID NO: 1119057 - RNA, 18 nt, Homo sapiens
ccuuccucaguccuggaa

SEQ ID NO: 1119058 - RNA, 17 nt, Homo sapiens
ccuucgauauaugacuu

SEQ ID NO: 1119059 - RNA, 12 nt, Homo sapiens
ccuucuccaaau

SEQ ID NO: 1119060 - RNA, 20 nt, Homo sapiens
ccuucuucuuagcaccacaa

SEQ ID NO: 1119061 - RNA, 11 nt, Homo sapiens
ccuugaaccag

SEQ ID NO: 1119062 - RNA, 23 nt, Homo sapiens
ccuugacauuguagagcuucugg

SEQ ID NO: 1119063 - RNA, 11 nt, Homo sapiens
ccuugagaaac

SEQ ID NO: 1119064 - RNA, 16 nt, Homo sapiens
ccuugaguguguuacc

SEQ ID NO: 1119065 - RNA, 13 nt, Homo sapiens
ccuugcaccugca

SEQ ID NO: 1119066 - RNA, 15 nt, Homo sapiens
ccuugccagacaugu

SEQ ID NO: 1119067 - RNA, 14 nt, Homo sapiens
ccuugccaugucuu

SEQ ID NO: 1119068 - RNA, 13 nt, Homo sapiens
ccuugcccagaga

SEQ ID NO: 1119069 - RNA, 18 nt, Homo sapiens
ccuugcccugaccuccca

SEQ ID NO: 1119070 - RNA, 15 nt, Homo sapiens
ccuugggaugaucuu

SEQ ID NO: 1119071 - RNA, 16 nt, Homo sapiens
ccuuggggauucuucc

SEQ ID NO: 1119072 - RNA, 21 nt, Homo sapiens
ccuugguaggggacuaauuca

SEQ ID NO: 1119073 - RNA, 14 nt, Homo sapiens
ccuugugucuguac

SEQ ID NO: 1119074 - RNA, 15 nt, Homo sapiens
ccuuuauugcuccug

SEQ ID NO: 1119075 - RNA, 13 nt, Homo sapiens
ccuuuauugugau

SEQ ID NO: 1119076 - RNA, 18 nt, Homo sapiens
ccuuuccagucauuucaa

SEQ ID NO: 1119077 - RNA, 16 nt, Homo sapiens
ccuuuccauaaggaau

SEQ ID NO: 1119078 - RNA, 19 nt, Homo sapiens
ccuuucucuaaaacugccu

SEQ ID NO: 1119079 - RNA, 16 nt, Homo sapiens
ccuuugagacuauuga

SEQ ID NO: 1119080 - RNA, 18 nt, Homo sapiens
ccuuuggaugcacuuuau

SEQ ID NO: 1119081 - RNA, 18 nt, Homo sapiens
ccuuugggaggcugaggc

SEQ ID NO: 1119082 - RNA, 22 nt, Homo sapiens
ccuuuuauucauauuuucacau

SEQ ID NO: 1119083 - RNA, 16 nt, Homo sapiens
ccuuuuggcacugaga

SEQ ID NO: 1119084 - RNA, 16 nt, Homo sapiens
ccuuuuuuguuauuau

SEQ ID NO: 1119085 - RNA, 22 nt, Homo sapiens
cgacaaagccaaacucugccag

SEQ ID NO: 1119086 - RNA, 13 nt, Homo sapiens
cgaccagacaccu

SEQ ID NO: 1119087 - RNA, 20 nt, Homo sapiens
cgaggagcuuccagugcaug

SEQ ID NO: 1119088 - RNA, 22 nt, Homo sapiens
cgagucaauccccucauucagg

SEQ ID NO: 1119089 - RNA, 16 nt, Homo sapiens
cgaguuuacuucauga

SEQ ID NO: 1119090 - RNA, 12 nt, Homo sapiens
cgaucuggguuc

SEQ ID NO: 1119091 - RNA, 21 nt, Homo sapiens
cgccaccucuugucagugcuc

SEQ ID NO: 1119092 - RNA, 19 nt, Homo sapiens
cgcccagcugcaccugcca

SEQ ID NO: 1119093 - RNA, 22 nt, Homo sapiens
cgcuaaaugaaaaucgugacaa

SEQ ID NO: 1119094 - RNA, 18 nt, Homo sapiens
cgcuacccacuucuaaau

SEQ ID NO: 1119095 - RNA, 16 nt, Homo sapiens
cgcuggaccuugaacu

SEQ ID NO: 1119096 - RNA, 15 nt, Homo sapiens
cgcuggagugcagug

SEQ ID NO: 1119097 - RNA, 11 nt, Homo sapiens
cggacaaauca

SEQ ID NO: 1119098 - RNA, 17 nt, Homo sapiens
cggagccuccucucuca

SEQ ID NO: 1119099 - RNA, 16 nt, Homo sapiens
augcuuaccugugaga

SEQ ID NO: 1119100 - RNA, 19 nt, Homo sapiens
augcuuauuguacuuguua

SEQ ID NO: 1119101 - RNA, 17 nt, Homo sapiens
auggaaaaaaugaacuu

SEQ ID NO: 1119102 - RNA, 21 nt, Homo sapiens
auggaaauucugcucagauag

SEQ ID NO: 1119103 - RNA, 14 nt, Homo sapiens
auggaacagugcag

SEQ ID NO: 1119104 - RNA, 23 nt, Homo sapiens
auggaaguugcagugagcugaua

SEQ ID NO: 1119105 - RNA, 18 nt, Homo sapiens
auggacgaacaggggcca

SEQ ID NO: 1119106 - RNA, 15 nt, Homo sapiens
auggacucaguuuuc

SEQ ID NO: 1119107 - RNA, 21 nt, Homo sapiens
auggagauauuuacaugaauu

SEQ ID NO: 1119108 - RNA, 14 nt, Homo sapiens
auggauagucuguc

SEQ ID NO: 1119109 - RNA, 22 nt, Homo sapiens
auggcacagcccaaagaaggaa

SEQ ID NO: 1119110 - RNA, 22 nt, Homo sapiens
auggcggcccccccagcuguca

SEQ ID NO: 1119111 - RNA, 23 nt, Homo sapiens
auggcggcccccccagcugucau

SEQ ID NO: 1119112 - RNA, 15 nt, Homo sapiens
auggcucaugaccug

SEQ ID NO: 1119113 - RNA, 19 nt, Homo sapiens
auggcuuuagcuaccucac

SEQ ID NO: 1119114 - RNA, 15 nt, Homo sapiens
auggcuuuaugcuag

SEQ ID NO: 1119115 - RNA, 17 nt, Homo sapiens
augggaaccccuucauc

SEQ ID NO: 1119116 - RNA, 12 nt, Homo sapiens
augggaucugua

SEQ ID NO: 1119117 - RNA, 22 nt, Homo sapiens
augggauuucauguaaccaaga

SEQ ID NO: 1119118 - RNA, 20 nt, Homo sapiens
augguauggaacucucucca

SEQ ID NO: 1119119 - RNA, 22 nt, Homo sapiens
auggucacaagcacaaagcuca

SEQ ID NO: 1119120 - RNA, 19 nt, Homo sapiens
auggugaaaccucaucucu

SEQ ID NO: 1119121 - RNA, 19 nt, Homo sapiens
auggugcacugagcugcaa

SEQ ID NO: 1119122 - RNA, 16 nt, Homo sapiens
augguuacucuuguca

SEQ ID NO: 1119123 - RNA, 15 nt, Homo sapiens
augguucccaauaaa

SEQ ID NO: 1119124 - RNA, 14 nt, Homo sapiens
augguuuacugcug

SEQ ID NO: 1119125 - RNA, 21 nt, Homo sapiens
augguuuccaagggucuuccu

SEQ ID NO: 1119126 - RNA, 20 nt, Homo sapiens
auguaaacauaauucuugua

SEQ ID NO: 1119127 - RNA, 20 nt, Homo sapiens
auguaacauuaauucuacua

SEQ ID NO: 1119128 - RNA, 21 nt, Homo sapiens
auguaauugaauaaaguugaa

SEQ ID NO: 1119129 - RNA, 22 nt, Homo sapiens
auguaauuuagcaguccaaaga

SEQ ID NO: 1119130 - RNA, 12 nt, Homo sapiens
auguacaaauag

SEQ ID NO: 1119131 - RNA, 21 nt, Homo sapiens
auguacaugaagaagcuaaau

SEQ ID NO: 1119132 - RNA, 17 nt, Homo sapiens
auguauauguauaucua

SEQ ID NO: 1119133 - RNA, 14 nt, Homo sapiens
augucagacuggcu

SEQ ID NO: 1119134 - RNA, 13 nt, Homo sapiens
augucaucaaaua

SEQ ID NO: 1119135 - RNA, 17 nt, Homo sapiens
augucaucauacaugac

SEQ ID NO: 1119136 - RNA, 15 nt, Homo sapiens
augucucagaccacu

SEQ ID NO: 1119137 - RNA, 21 nt, Homo sapiens
augucucucagaauucuucag

SEQ ID NO: 1119138 - RNA, 19 nt, Homo sapiens
augucucuuuaaugucaca

SEQ ID NO: 1119139 - RNA, 16 nt, Homo sapiens
augucuguuaacuuaa

SEQ ID NO: 1119140 - RNA, 20 nt, Homo sapiens
augucuuaaucaugagauaa

SEQ ID NO: 1119141 - RNA, 20 nt, Homo sapiens
augucuuggacacuguacaa

SEQ ID NO: 1119142 - RNA, 14 nt, Homo sapiens
augugauaucugaa

SEQ ID NO: 1119143 - RNA, 15 nt, Homo sapiens
augugauccuuuuau

SEQ ID NO: 1119144 - RNA, 16 nt, Homo sapiens
augugcccacagggac

SEQ ID NO: 1119145 - RNA, 22 nt, Homo sapiens
auguggccuaaaaaugcaacuu

SEQ ID NO: 1119146 - RNA, 20 nt, Homo sapiens
augugggguccccaucaucc

SEQ ID NO: 1119147 - RNA, 19 nt, Homo sapiens
augugggucaaggaauuaa

SEQ ID NO: 1119148 - RNA, 15 nt, Homo sapiens
augugguagccucac

SEQ ID NO: 1119149 - RNA, 24 nt, Homo sapiens
augugguuaaugccauggacagaa

SEQ ID NO: 1119150 - RNA, 18 nt, Homo sapiens
auguguagccugugcaug

SEQ ID NO: 1119151 - RNA, 21 nt, Homo sapiens
augugucacuacucacagucu

SEQ ID NO: 1119152 - RNA, 11 nt, Homo sapiens
auguguugccu

SEQ ID NO: 1119153 - RNA, 15 nt, Homo sapiens
auguguugcuauccu

SEQ ID NO: 1119154 - RNA, 16 nt, Homo sapiens
auguuaaccucagugu

SEQ ID NO: 1119155 - RNA, 14 nt, Homo sapiens
auuaugacaguuau

SEQ ID NO: 1119156 - RNA, 18 nt, Homo sapiens
auuauggagugucaccag

SEQ ID NO: 1119157 - RNA, 22 nt, Homo sapiens
auuaugggaaugacucugacuu

SEQ ID NO: 1119158 - RNA, 11 nt, Homo sapiens
auuauggugaa

SEQ ID NO: 1119159 - RNA, 15 nt, Homo sapiens
auuauuaacacugaa

SEQ ID NO: 1119160 - RNA, 16 nt, Homo sapiens
auuauuuucacuguag

SEQ ID NO: 1119161 - RNA, 14 nt, Homo sapiens
auucaaccacugua

SEQ ID NO: 1119162 - RNA, 14 nt, Homo sapiens
auucaagccuguga

SEQ ID NO: 1119163 - RNA, 21 nt, Homo sapiens
auucaauaaagcugcugagaa

SEQ ID NO: 1119164 - RNA, 13 nt, Homo sapiens
auucacaucucau

SEQ ID NO: 1119165 - RNA, 23 nt, Homo sapiens
auucacuuauggcagaggaauau

SEQ ID NO: 1119166 - RNA, 12 nt, Homo sapiens
auucagacacuu

SEQ ID NO: 1119167 - RNA, 21 nt, Homo sapiens
auucaggacuuaacggcucca

SEQ ID NO: 1119168 - RNA, 14 nt, Homo sapiens
auucauguggaaua

SEQ ID NO: 1119169 - RNA, 16 nt, Homo sapiens
auucauuagcugugau

SEQ ID NO: 1119170 - RNA, 15 nt, Homo sapiens
auucauuuaacagag

SEQ ID NO: 1119171 - RNA, 19 nt, Homo sapiens
auuccaaggaguuccauga

SEQ ID NO: 1119172 - RNA, 17 nt, Homo sapiens
auuccaccugcaaucaa

SEQ ID NO: 1119173 - RNA, 18 nt, Homo sapiens
auucccacagcacuaauu

SEQ ID NO: 1119174 - RNA, 17 nt, Homo sapiens
auuccccucgugugacu

SEQ ID NO: 1119175 - RNA, 19 nt, Homo sapiens
auuccuauauaguuuauug

SEQ ID NO: 1119176 - RNA, 20 nt, Homo sapiens
auuccuauauaguuuauuga

SEQ ID NO: 1119177 - RNA, 16 nt, Homo sapiens
auucgaaugacacugu

SEQ ID NO: 1119178 - RNA, 17 nt, Homo sapiens
auucgugacaacaugcg

SEQ ID NO: 1119179 - RNA, 14 nt, Homo sapiens
auucuacacauaua

SEQ ID NO: 1119180 - RNA, 13 nt, Homo sapiens
auucuaguacuug

SEQ ID NO: 1119181 - RNA, 21 nt, Homo sapiens
auucucacuccaccacccaaa

SEQ ID NO: 1119182 - RNA, 21 nt, Homo sapiens
auucucaugugauccuuuuau

SEQ ID NO: 1119183 - RNA, 16 nt, Homo sapiens
auucucauuugucaca

SEQ ID NO: 1119184 - RNA, 14 nt, Homo sapiens
auucugaaugaaua

SEQ ID NO: 1119185 - RNA, 20 nt, Homo sapiens
auucugcuaccucacugggg

SEQ ID NO: 1119186 - RNA, 20 nt, Homo sapiens
auucuuauuuaaguuauuga

SEQ ID NO: 1119187 - RNA, 14 nt, Homo sapiens
auucuugaaugagg

SEQ ID NO: 1119188 - RNA, 11 nt, Homo sapiens
auucuuguccu

SEQ ID NO: 1119189 - RNA, 23 nt, Homo sapiens
auugaaauauaaugcaaaccaua

SEQ ID NO: 1119190 - RNA, 17 nt, Homo sapiens
auugaaaucaagcuuau

SEQ ID NO: 1119191 - RNA, 18 nt, Homo sapiens
auugaacuuucacauagc

SEQ ID NO: 1119192 - RNA, 22 nt, Homo sapiens
auugaacuuucacauagcacag

SEQ ID NO: 1119193 - RNA, 20 nt, Homo sapiens
auugacacacagcacucucu

SEQ ID NO: 1119194 - RNA, 21 nt, Homo sapiens
auugacacacagcacucucua

SEQ ID NO: 1119195 - RNA, 17 nt, Homo sapiens
auugacugucacuguuc

SEQ ID NO: 1119196 - RNA, 11 nt, Homo sapiens
auugauuucaa

SEQ ID NO: 1119197 - RNA, 21 nt, Homo sapiens
auugcacgggagaauauacaa

SEQ ID NO: 1119198 - RNA, 15 nt, Homo sapiens
auugcacuccagucu

SEQ ID NO: 1119199 - RNA, 14 nt, Homo sapiens
auugcaugccaucu

SEQ ID NO: 1119200 - RNA, 15 nt, Homo sapiens
auugccugcagagag

SEQ ID NO: 1119201 - RNA, 13 nt, Homo sapiens
auugcuaccucuu

SEQ ID NO: 1119202 - RNA, 14 nt, Homo sapiens
auugcuaugaauga

SEQ ID NO: 1119203 - RNA, 17 nt, Homo sapiens
auuggaccauccuauuu

SEQ ID NO: 1119204 - RNA, 14 nt, Homo sapiens
auuggcaugaaggu

SEQ ID NO: 1119205 - RNA, 23 nt, Homo sapiens
auugggagaagccgcagggacag

SEQ ID NO: 1119206 - RNA, 21 nt, Homo sapiens
auugguccgaucuuugacucu

SEQ ID NO: 1119207 - RNA, 15 nt, Homo sapiens
auuguaaugaauauc

SEQ ID NO: 1119208 - RNA, 15 nt, Homo sapiens
auuguacacuaucua

SEQ ID NO: 1119209 - RNA, 14 nt, Homo sapiens
auuguaguguucaa

SEQ ID NO: 1119210 - RNA, 16 nt, Homo sapiens
auuguaguguucaaaa

SEQ ID NO: 1119211 - RNA, 13 nt, Homo sapiens
auuguauaagauu

SEQ ID NO: 1119212 - RNA, 19 nt, Homo sapiens
auuugcugagcauguacug

SEQ ID NO: 1119213 - RNA, 21 nt, Homo sapiens
auuuguaauuccuuacuguaa

SEQ ID NO: 1119214 - RNA, 17 nt, Homo sapiens
auuuguauuuugcuuaa

SEQ ID NO: 1119215 - RNA, 20 nt, Homo sapiens
auuuguuaaugguuugaaua

SEQ ID NO: 1119216 - RNA, 20 nt, Homo sapiens
auuuguuuucuucuguaugu

SEQ ID NO: 1119217 - RNA, 17 nt, Homo sapiens
auuuuaacaucugagaa

SEQ ID NO: 1119218 - RNA, 19 nt, Homo sapiens
auuuuauacauagucacaa

SEQ ID NO: 1119219 - RNA, 19 nt, Homo sapiens
auuuuaucugccuuagaca

SEQ ID NO: 1119220 - RNA, 14 nt, Homo sapiens
auuuuaugcugcug

SEQ ID NO: 1119221 - RNA, 13 nt, Homo sapiens
auuuuauuauaau

SEQ ID NO: 1119222 - RNA, 18 nt, Homo sapiens
auuuuauucccuuucaca

SEQ ID NO: 1119223 - RNA, 22 nt, Homo sapiens
auuuucauguucuugcagucau

SEQ ID NO: 1119224 - RNA, 18 nt, Homo sapiens
auuuuccccuagcuuucc

SEQ ID NO: 1119225 - RNA, 21 nt, Homo sapiens
auuuucuauuauuaacacuga

SEQ ID NO: 1119226 - RNA, 14 nt, Homo sapiens
auuuugcagcagaa

SEQ ID NO: 1119227 - RNA, 20 nt, Homo sapiens
auuuugccauaaagucaaau

SEQ ID NO: 1119228 - RNA, 15 nt, Homo sapiens
auuuuggccaaagug

SEQ ID NO: 1119229 - RNA, 19 nt, Homo sapiens
auuuuguaacgaagacaca

SEQ ID NO: 1119230 - RNA, 17 nt, Homo sapiens
auuuuguaauaaacucu

SEQ ID NO: 1119231 - RNA, 21 nt, Homo sapiens
auuuugugaaagaaggagcaa

SEQ ID NO: 1119232 - RNA, 16 nt, Homo sapiens
auuuuguggucauuaa

SEQ ID NO: 1119233 - RNA, 21 nt, Homo sapiens
auuuuguguguaccugugacu

SEQ ID NO: 1119234 - RNA, 16 nt, Homo sapiens
auuuuuagacagaguc

SEQ ID NO: 1119235 - RNA, 15 nt, Homo sapiens
auuuuuaugugcaau

SEQ ID NO: 1119236 - RNA, 19 nt, Homo sapiens
auuuuugaauugacugaga

SEQ ID NO: 1119237 - RNA, 19 nt, Homo sapiens
auuuuuguagagccagggu

SEQ ID NO: 1119238 - RNA, 16 nt, Homo sapiens
auuuuuuauuuccaca

SEQ ID NO: 1119239 - RNA, 16 nt, Homo sapiens
auuuuuuuaacacaua

SEQ ID NO: 1119240 - RNA, 22 nt, Homo sapiens
caaaaagggauccguacauuca

SEQ ID NO: 1119241 - RNA, 18 nt, Homo sapiens
caaaaauacucacauggc

SEQ ID NO: 1119242 - RNA, 18 nt, Homo sapiens
caaaacagagaugugaua

SEQ ID NO: 1119243 - RNA, 18 nt, Homo sapiens
caaaacagauuguuugca

SEQ ID NO: 1119244 - RNA, 14 nt, Homo sapiens
caaaacauugugcc

SEQ ID NO: 1119245 - RNA, 18 nt, Homo sapiens
caaaaccugauguuaaaa

SEQ ID NO: 1119246 - RNA, 15 nt, Homo sapiens
caaaacuaauuuccu

SEQ ID NO: 1119247 - RNA, 23 nt, Homo sapiens
caaaagaagacaacauuucucaa

SEQ ID NO: 1119248 - RNA, 13 nt, Homo sapiens
caaaagcccaaug

SEQ ID NO: 1119249 - RNA, 20 nt, Homo sapiens
caaaagcugcuugacuauca

SEQ ID NO: 1119250 - RNA, 11 nt, Homo sapiens
caaaauaugaa

SEQ ID NO: 1119251 - RNA, 14 nt, Homo sapiens
caaaaucaugaaua

SEQ ID NO: 1119252 - RNA, 12 nt, Homo sapiens
caaaauuacuuc

SEQ ID NO: 1119253 - RNA, 15 nt, Homo sapiens
caaaauuuccaguac

SEQ ID NO: 1119254 - RNA, 12 nt, Homo sapiens
caaacagaacua

SEQ ID NO: 1119255 - RNA, 15 nt, Homo sapiens
caaacaugaagugug

SEQ ID NO: 1119256 - RNA, 16 nt, Homo sapiens
caaaccccgaccaccu

SEQ ID NO: 1119257 - RNA, 15 nt, Homo sapiens
caaaccuuacuaugg

SEQ ID NO: 1119258 - RNA, 19 nt, Homo sapiens
caaacgggcugcccugcca

SEQ ID NO: 1119259 - RNA, 17 nt, Homo sapiens
caaacucacugcucaag

SEQ ID NO: 1119260 - RNA, 12 nt, Homo sapiens
caaagaaaaagg

SEQ ID NO: 1119261 - RNA, 22 nt, Homo sapiens
caaagaaggcacagguguaaau

SEQ ID NO: 1119262 - RNA, 20 nt, Homo sapiens
caaagaauuuuuuuuaacau

SEQ ID NO: 1119263 - RNA, 18 nt, Homo sapiens
caaagagguuuuaugaaa

SEQ ID NO: 1119264 - RNA, 15 nt, Homo sapiens
caaagaugaccugcu

SEQ ID NO: 1119265 - RNA, 22 nt, Homo sapiens
caaagauuuuggaggagaagga

SEQ ID NO: 1119266 - RNA, 18 nt, Homo sapiens
caaagcacgaaauguuau

SEQ ID NO: 1119267 - RNA, 19 nt, Homo sapiens
caaagcacuguuucucuca

SEQ ID NO: 1119268 - RNA, 19 nt, Homo sapiens
caaagcaguagucaaggag

SEQ ID NO: 1119269 - RNA, 12 nt, Homo sapiens
caacauaucauu

SEQ ID NO: 1119270 - RNA, 13 nt, Homo sapiens
caacaugacuguu

SEQ ID NO: 1119271 - RNA, 23 nt, Homo sapiens
caacauggugaaaccucaucucu

SEQ ID NO: 1119272 - RNA, 21 nt, Homo sapiens
caacauuacuccauuacuaaa

SEQ ID NO: 1119273 - RNA, 12 nt, Homo sapiens
caaccacugugg

SEQ ID NO: 1119274 - RNA, 17 nt, Homo sapiens
caaccuaaccccuuucc

SEQ ID NO: 1119275 - RNA, 23 nt, Homo sapiens
caaccuccccgcagagcucccuu

SEQ ID NO: 1119276 - RNA, 23 nt, Homo sapiens
caaccuguucuuccuaccaaaua

SEQ ID NO: 1119277 - RNA, 14 nt, Homo sapiens
caaccuugcaucca

SEQ ID NO: 1119278 - RNA, 14 nt, Homo sapiens
caaccuuucccuca

SEQ ID NO: 1119279 - RNA, 12 nt, Homo sapiens
caacuccagcuc

SEQ ID NO: 1119280 - RNA, 15 nt, Homo sapiens
caacucgaugggcac

SEQ ID NO: 1119281 - RNA, 22 nt, Homo sapiens
caacuggugauuguuucagaga

SEQ ID NO: 1119282 - RNA, 12 nt, Homo sapiens
caacugugcuac

SEQ ID NO: 1119283 - RNA, 16 nt, Homo sapiens
caacuguggucaaucc

SEQ ID NO: 1119284 - RNA, 19 nt, Homo sapiens
caacuugaaauuauaucug

SEQ ID NO: 1119285 - RNA, 15 nt, Homo sapiens
caacuuuccuuaaaa

SEQ ID NO: 1119286 - RNA, 14 nt, Homo sapiens
caagaaaacuggaa

SEQ ID NO: 1119287 - RNA, 15 nt, Homo sapiens
caagaaaacuggaaa

SEQ ID NO: 1119288 - RNA, 13 nt, Homo sapiens
caagaaugagcug

SEQ ID NO: 1119289 - RNA, 22 nt, Homo sapiens
caagacaauucuucuucuucca

SEQ ID NO: 1119290 - RNA, 10 nt, Homo sapiens
caagacauag

SEQ ID NO: 1119291 - RNA, 16 nt, Homo sapiens
caagaccuucucccca

SEQ ID NO: 1119292 - RNA, 23 nt, Homo sapiens
caagagagaaagaaguaggcaug

SEQ ID NO: 1119293 - RNA, 16 nt, Homo sapiens
caagaggcuccugucc

SEQ ID NO: 1119294 - RNA, 18 nt, Homo sapiens
caagagugagacuccguc

SEQ ID NO: 1119295 - RNA, 20 nt, Homo sapiens
caagagugagacuccgucuc

SEQ ID NO: 1119296 - RNA, 12 nt, Homo sapiens
caagaugacagc

SEQ ID NO: 1119297 - RNA, 14 nt, Homo sapiens
caagcaaggccaaa

SEQ ID NO: 1119298 - RNA, 13 nt, Homo sapiens
caagcacaaagcu

SEQ ID NO: 1119299 - RNA, 17 nt, Homo sapiens
caagcacaaagcucaag

SEQ ID NO: 1119300 - RNA, 19 nt, Homo sapiens
caagcacaaagcucaagau

SEQ ID NO: 1119301 - RNA, 18 nt, Homo sapiens
caagcacuaaaaaguggc

SEQ ID NO: 1119302 - RNA, 17 nt, Homo sapiens
caagcagguaagagcug

SEQ ID NO: 1119303 - RNA, 13 nt, Homo sapiens
caagccaccuucc

SEQ ID NO: 1119304 - RNA, 18 nt, Homo sapiens
caagccaguacgugcuaa

SEQ ID NO: 1119305 - RNA, 16 nt, Homo sapiens
caagccccacuuauuc

SEQ ID NO: 1119306 - RNA, 22 nt, Homo sapiens
caagcuaaaauuagaugaacuc

SEQ ID NO: 1119307 - RNA, 22 nt, Homo sapiens
caagcuagaaggccacauguca

SEQ ID NO: 1119308 - RNA, 15 nt, Homo sapiens
caaggaaaauggaca

SEQ ID NO: 1119309 - RNA, 19 nt, Homo sapiens
caaggcaguguuccucacc

SEQ ID NO: 1119310 - RNA, 15 nt, Homo sapiens
caaguagcacccugg

SEQ ID NO: 1119311 - RNA, 21 nt, Homo sapiens
caaguauguugagaguugcug

SEQ ID NO: 1119312 - RNA, 12 nt, Homo sapiens
caagucuucccu

SEQ ID NO: 1119313 - RNA, 16 nt, Homo sapiens
caagugaaaucaaagg

SEQ ID NO: 1119314 - RNA, 21 nt, Homo sapiens
caaguuuuucagaaagcauua

SEQ ID NO: 1119315 - RNA, 16 nt, Homo sapiens
caauaaaguaucuaca

SEQ ID NO: 1119316 - RNA, 16 nt, Homo sapiens
caauaaaucaacucca

SEQ ID NO: 1119317 - RNA, 13 nt, Homo sapiens
caauaaauuauuc

SEQ ID NO: 1119318 - RNA, 22 nt, Homo sapiens
caauaacuucagagaagucagu

SEQ ID NO: 1119319 - RNA, 15 nt, Homo sapiens
caauacucaaaagag

SEQ ID NO: 1119320 - RNA, 18 nt, Homo sapiens
caauacucaaaagagaga

SEQ ID NO: 1119321 - RNA, 14 nt, Homo sapiens
caauaguaaaagau

SEQ ID NO: 1119322 - RNA, 10 nt, Homo sapiens
caauagucaa

SEQ ID NO: 1119323 - RNA, 21 nt, Homo sapiens
caaucaggguuuuuagauuaa

SEQ ID NO: 1119324 - RNA, 14 nt, Homo sapiens
caaugaaaugcucu

SEQ ID NO: 1119325 - RNA, 13 nt, Homo sapiens
caaugacacauag

SEQ ID NO: 1119326 - RNA, 16 nt, Homo sapiens
caaugauggcaauuuu

SEQ ID NO: 1119327 - RNA, 16 nt, Homo sapiens
aacaucauucuugaga

SEQ ID NO: 1119328 - RNA, 19 nt, Homo sapiens
aacauccuucaagaacucu

SEQ ID NO: 1119329 - RNA, 18 nt, Homo sapiens
aacaugagaaaugugaac

SEQ ID NO: 1119330 - RNA, 16 nt, Homo sapiens
aacaugguaaaacccc

SEQ ID NO: 1119331 - RNA, 22 nt, Homo sapiens
aacaugguaaaaccccaucucu

SEQ ID NO: 1119332 - RNA, 22 nt, Homo sapiens
aacauguuuugugcagcacagu

SEQ ID NO: 1119333 - RNA, 14 nt, Homo sapiens
aacauuaugccuua

SEQ ID NO: 1119334 - RNA, 16 nt, Homo sapiens
aacauuccaaugcauu

SEQ ID NO: 1119335 - RNA, 16 nt, Homo sapiens
aaccaaagagacugga

SEQ ID NO: 1119336 - RNA, 16 nt, Homo sapiens
aaccaaauaagcaucu

SEQ ID NO: 1119337 - RNA, 13 nt, Homo sapiens
aaccaaccucccc

SEQ ID NO: 1119338 - RNA, 19 nt, Homo sapiens
aaccaaguggcucccacac

SEQ ID NO: 1119339 - RNA, 15 nt, Homo sapiens
aaccaauagcuuuaa

SEQ ID NO: 1119340 - RNA, 13 nt, Homo sapiens
aaccacucaaauu

SEQ ID NO: 1119341 - RNA, 21 nt, Homo sapiens
aaccacuuaaaaaauguccau

SEQ ID NO: 1119342 - RNA, 15 nt, Homo sapiens
aaccagccacacaga

SEQ ID NO: 1119343 - RNA, 20 nt, Homo sapiens
agauuacuucagggcuggaa

SEQ ID NO: 1119344 - RNA, 19 nt, Homo sapiens
agauugcaccauugcgcuc

SEQ ID NO: 1119345 - RNA, 20 nt, Homo sapiens
agauugcaccauugcgcucu

SEQ ID NO: 1119346 - RNA, 20 nt, Homo sapiens
agauugcgccacugcacucc

SEQ ID NO: 1119347 - RNA, 24 nt, Homo sapiens
agauugcgccacugcacuccaguc

SEQ ID NO: 1119348 - RNA, 17 nt, Homo sapiens
agauuuaacaauuccaa

SEQ ID NO: 1119349 - RNA, 23 nt, Homo sapiens
agauuugaauagaaaaaguaauc

SEQ ID NO: 1119350 - RNA, 15 nt, Homo sapiens
agauuuuaugcugcu

SEQ ID NO: 1119351 - RNA, 16 nt, Homo sapiens
agauuuuaugcugcug

SEQ ID NO: 1119352 - RNA, 19 nt, Homo sapiens
agauuuucauguucuugca

SEQ ID NO: 1119353 - RNA, 17 nt, Homo sapiens
agcaaaacuccaucuca

SEQ ID NO: 1119354 - RNA, 14 nt, Homo sapiens
agcaaagagugggc

SEQ ID NO: 1119355 - RNA, 17 nt, Homo sapiens
agcaaagcuuaaaugcc

SEQ ID NO: 1119356 - RNA, 18 nt, Homo sapiens
agcaaagggagcacuggg

SEQ ID NO: 1119357 - RNA, 17 nt, Homo sapiens
agcaaauaaauaucauc

SEQ ID NO: 1119358 - RNA, 21 nt, Homo sapiens
agcaaauggagaaguucagga

SEQ ID NO: 1119359 - RNA, 24 nt, Homo sapiens
agcaacagauggauagucugucca

SEQ ID NO: 1119360 - RNA, 12 nt, Homo sapiens
agcaacauacca

SEQ ID NO: 1119361 - RNA, 18 nt, Homo sapiens
agcaagacucugucucaa

SEQ ID NO: 1119362 - RNA, 23 nt, Homo sapiens
agcaagacuucucuuugccucaa

SEQ ID NO: 1119363 - RNA, 17 nt, Homo sapiens
agcaagccaauuuggaa

SEQ ID NO: 1119364 - RNA, 16 nt, Homo sapiens
agcaauacuaagggaa

SEQ ID NO: 1119365 - RNA, 23 nt, Homo sapiens
agcaaucugagagauuugaauag

SEQ ID NO: 1119366 - RNA, 14 nt, Homo sapiens
agcaaugaugucca

SEQ ID NO: 1119367 - RNA, 15 nt, Homo sapiens
agcaauucauuucac

SEQ ID NO: 1119368 - RNA, 13 nt, Homo sapiens
agcacacuguagc

SEQ ID NO: 1119369 - RNA, 16 nt, Homo sapiens
agcacauagcacuggg

SEQ ID NO: 1119370 - RNA, 23 nt, Homo sapiens
agcacaugaaaaccauuaccuga

SEQ ID NO: 1119371 - RNA, 11 nt, Homo sapiens
agcacaugugu

SEQ ID NO: 1119372 - RNA, 17 nt, Homo sapiens
agcacuaaagcagugga

SEQ ID NO: 1119373 - RNA, 18 nt, Homo sapiens
agcacuaauucaacauau

SEQ ID NO: 1119374 - RNA, 21 nt, Homo sapiens
agcacuaauucaacauauacc

SEQ ID NO: 1119375 - RNA, 12 nt, Homo sapiens
agcacucaacca

SEQ ID NO: 1119376 - RNA, 16 nt, Homo sapiens
agcacucuacugcaag

SEQ ID NO: 1119377 - RNA, 12 nt, Homo sapiens
agcacucugaaa

SEQ ID NO: 1119378 - RNA, 15 nt, Homo sapiens
agcacugccaggagg

SEQ ID NO: 1119379 - RNA, 21 nt, Homo sapiens
agcacugccaggagggacaaa

SEQ ID NO: 1119380 - RNA, 16 nt, Homo sapiens
agcacuuaauaauugc

SEQ ID NO: 1119381 - RNA, 15 nt, Homo sapiens
agcagaggaguccag

SEQ ID NO: 1119382 - RNA, 14 nt, Homo sapiens
agcagauacuuugu

SEQ ID NO: 1119383 - RNA, 13 nt, Homo sapiens
agcagauuuaaca

SEQ ID NO: 1119384 - RNA, 17 nt, Homo sapiens
agcagcccagggcacuu

SEQ ID NO: 1119385 - RNA, 12 nt, Homo sapiens
agcagcugagca

SEQ ID NO: 1119386 - RNA, 16 nt, Homo sapiens
agcaggaaaguacaga

SEQ ID NO: 1119387 - RNA, 14 nt, Homo sapiens
agcagguggcagaa

SEQ ID NO: 1119388 - RNA, 16 nt, Homo sapiens
agcagugucuuccaua

SEQ ID NO: 1119389 - RNA, 21 nt, Homo sapiens
agcaguugaaacaagaagcca

SEQ ID NO: 1119390 - RNA, 14 nt, Homo sapiens
agcaucugacucac

SEQ ID NO: 1119391 - RNA, 16 nt, Homo sapiens
agcaucuguguaaccu

SEQ ID NO: 1119392 - RNA, 14 nt, Homo sapiens
agcaugauugugac

SEQ ID NO: 1119393 - RNA, 13 nt, Homo sapiens
agcauuucuugau

SEQ ID NO: 1119394 - RNA, 20 nt, Homo sapiens
agccaaacagagccuucaca

SEQ ID NO: 1119395 - RNA, 14 nt, Homo sapiens
agccaaacucugcc

SEQ ID NO: 1119396 - RNA, 21 nt, Homo sapiens
agccaaacucugccagccaca

SEQ ID NO: 1119397 - RNA, 15 nt, Homo sapiens
agccaaaugcauggu

SEQ ID NO: 1119398 - RNA, 13 nt, Homo sapiens
agccaaauguaau

SEQ ID NO: 1119399 - RNA, 19 nt, Homo sapiens
agccaauaaaucaacucca

SEQ ID NO: 1119400 - RNA, 15 nt, Homo sapiens
agccacagaagccag

SEQ ID NO: 1119401 - RNA, 19 nt, Homo sapiens
agccacaucccuuugaaac

SEQ ID NO: 1119402 - RNA, 17 nt, Homo sapiens
agccacccugaggaguc

SEQ ID NO: 1119403 - RNA, 16 nt, Homo sapiens
agccacugguuucuca

SEQ ID NO: 1119404 - RNA, 17 nt, Homo sapiens
agccacugguuucucag

SEQ ID NO: 1119405 - RNA, 13 nt, Homo sapiens
agccagauucaaa

SEQ ID NO: 1119406 - RNA, 16 nt, Homo sapiens
agccagcaaugauguc

SEQ ID NO: 1119407 - RNA, 18 nt, Homo sapiens
agccagcagccagcucuc

SEQ ID NO: 1119408 - RNA, 18 nt, Homo sapiens
agccaggcugagugagcc

SEQ ID NO: 1119409 - RNA, 23 nt, Homo sapiens
agccauaguggagagaacugaau

SEQ ID NO: 1119410 - RNA, 16 nt, Homo sapiens
agccaucaagagacug

SEQ ID NO: 1119411 - RNA, 19 nt, Homo sapiens
agccaugacgucaauagca

SEQ ID NO: 1119412 - RNA, 19 nt, Homo sapiens
agccauguaccaguguacu

SEQ ID NO: 1119413 - RNA, 21 nt, Homo sapiens
agcccacacaugaaccauccu

SEQ ID NO: 1119414 - RNA, 15 nt, Homo sapiens
agcccagcacuguga

SEQ ID NO: 1119415 - RNA, 16 nt, Homo sapiens
agcccaugcuuuccca

SEQ ID NO: 1119416 - RNA, 21 nt, Homo sapiens
agcccauuggcucccaucuga

SEQ ID NO: 1119417 - RNA, 18 nt, Homo sapiens
agcccccacuucucucca

SEQ ID NO: 1119418 - RNA, 19 nt, Homo sapiens
agccccccacaaugaugau

SEQ ID NO: 1119419 - RNA, 17 nt, Homo sapiens
agccccggacucaggcc

SEQ ID NO: 1119420 - RNA, 22 nt, Homo sapiens
agccccuuacuaugaucucagg

SEQ ID NO: 1119421 - RNA, 18 nt, Homo sapiens
agcccugucgagacacuu

SEQ ID NO: 1119422 - RNA, 20 nt, Homo sapiens
agcccuucaugcauuugcac

SEQ ID NO: 1119423 - RNA, 15 nt, Homo sapiens
agcccuugaaccagc

SEQ ID NO: 1119424 - RNA, 15 nt, Homo sapiens
agcccuuuacuugac

SEQ ID NO: 1119425 - RNA, 13 nt, Homo sapiens
agccgaccucagc

SEQ ID NO: 1119426 - RNA, 14 nt, Homo sapiens
agccggguaccuca

SEQ ID NO: 1119427 - RNA, 15 nt, Homo sapiens
agccgugaugcucag

SEQ ID NO: 1119428 - RNA, 16 nt, Homo sapiens
agccuagccgaccuca

SEQ ID NO: 1119429 - RNA, 17 nt, Homo sapiens
agccuagccgaccucag

SEQ ID NO: 1119430 - RNA, 18 nt, Homo sapiens
agccuagccgaccucagc

SEQ ID NO: 1119431 - RNA, 17 nt, Homo sapiens
agccucccucugaccug

SEQ ID NO: 1119432 - RNA, 19 nt, Homo sapiens
agccucuucgcugaccucg

SEQ ID NO: 1119433 - RNA, 23 nt, Homo sapiens
agccugcaguuauuaacacuaac

SEQ ID NO: 1119434 - RNA, 21 nt, Homo sapiens
agccugcucccccacccccuc

SEQ ID NO: 1119435 - RNA, 17 nt, Homo sapiens
agccuggcaacagagca

SEQ ID NO: 1119436 - RNA, 16 nt, Homo sapiens
agccuggccaacaugg

SEQ ID NO: 1119437 - RNA, 16 nt, Homo sapiens
agccuggccuccugcc

SEQ ID NO: 1119438 - RNA, 17 nt, Homo sapiens
agccuggccuccugccu

SEQ ID NO: 1119439 - RNA, 12 nt, Homo sapiens
agccuggugggc

SEQ ID NO: 1119440 - RNA, 21 nt, Homo sapiens
agccuguucauggcagaugua

SEQ ID NO: 1119441 - RNA, 14 nt, Homo sapiens
agccuuagaaguca

SEQ ID NO: 1119442 - RNA, 20 nt, Homo sapiens
agccuucucuguucauuucc

SEQ ID NO: 1119443 - RNA, 18 nt, Homo sapiens
agcgaugaauuuggagac

SEQ ID NO: 1119444 - RNA, 18 nt, Homo sapiens
agcgcaucaggccuggca

SEQ ID NO: 1119445 - RNA, 14 nt, Homo sapiens
agcgcuuucuggaa

SEQ ID NO: 1119446 - RNA, 21 nt, Homo sapiens
agcggacagaaugaugccaaa

SEQ ID NO: 1119447 - RNA, 19 nt, Homo sapiens
agcggcuggguggugaagg

SEQ ID NO: 1119448 - RNA, 13 nt, Homo sapiens
agcgugagccacu

SEQ ID NO: 1119449 - RNA, 16 nt, Homo sapiens
agcgugcucacugacc

SEQ ID NO: 1119450 - RNA, 18 nt, Homo sapiens
agcuaagccacauggcug

SEQ ID NO: 1119451 - RNA, 20 nt, Homo sapiens
agcuaccucacuaugcugcu

SEQ ID NO: 1119452 - RNA, 21 nt, Homo sapiens
agcuaccucacuaugcugcuu

SEQ ID NO: 1119453 - RNA, 19 nt, Homo sapiens
agcuacucagaagccugag

SEQ ID NO: 1119454 - RNA, 12 nt, Homo sapiens
agcuagaaggcc

SEQ ID NO: 1119455 - RNA, 15 nt, Homo sapiens
agcuagugauuugcc

SEQ ID NO: 1119456 - RNA, 21 nt, Homo sapiens
agcuaucauuucuuuuccaaa

SEQ ID NO: 1119457 - RNA, 18 nt, Homo sapiens
agcuaugaaggcuguaca

SEQ ID NO: 1119458 - RNA, 15 nt, Homo sapiens
agcucaagaugacag

SEQ ID NO: 1119459 - RNA, 19 nt, Homo sapiens
agcucaagucuucccugau

SEQ ID NO: 1119460 - RNA, 21 nt, Homo sapiens
agcucaagucuucccugauca

SEQ ID NO: 1119461 - RNA, 12 nt, Homo sapiens
agcucagguguc

SEQ ID NO: 1119462 - RNA, 17 nt, Homo sapiens
agcucagucccaucaga

SEQ ID NO: 1119463 - RNA, 18 nt, Homo sapiens
agcucccuaggagaccaa

SEQ ID NO: 1119464 - RNA, 14 nt, Homo sapiens
agcuccuugacucc

SEQ ID NO: 1119465 - RNA, 15 nt, Homo sapiens
agcucuaguucaaau

SEQ ID NO: 1119466 - RNA, 12 nt, Homo sapiens
agcucucucuac

SEQ ID NO: 1119467 - RNA, 13 nt, Homo sapiens
agcucugaaguca

SEQ ID NO: 1119468 - RNA, 22 nt, Homo sapiens
agcucuggccccaggcuuguca

SEQ ID NO: 1119469 - RNA, 14 nt, Homo sapiens
agcucuggugaccu

SEQ ID NO: 1119470 - RNA, 20 nt, Homo sapiens
agcugagauugcgccacugc

SEQ ID NO: 1119471 - RNA, 11 nt, Homo sapiens
agcugaucagu

SEQ ID NO: 1119472 - RNA, 14 nt, Homo sapiens
agcugcaacggaau

SEQ ID NO: 1119473 - RNA, 11 nt, Homo sapiens
agcugccaaaa

SEQ ID NO: 1119474 - RNA, 17 nt, Homo sapiens
agcugggauaaucacau

SEQ ID NO: 1119475 - RNA, 19 nt, Homo sapiens
agcuggugccccacugaau

SEQ ID NO: 1119476 - RNA, 20 nt, Homo sapiens
agcuggugccccacugaauu

SEQ ID NO: 1119477 - RNA, 17 nt, Homo sapiens
agcugucaggcugauua

SEQ ID NO: 1119478 - RNA, 20 nt, Homo sapiens
agcugugaccugcugagcuc

SEQ ID NO: 1119479 - RNA, 19 nt, Homo sapiens
agcuguggccagcuuguua

SEQ ID NO: 1119480 - RNA, 21 nt, Homo sapiens
agcuuaauggcucaugaccug

SEQ ID NO: 1119481 - RNA, 14 nt, Homo sapiens
agcuucaaacugca

SEQ ID NO: 1119482 - RNA, 14 nt, Homo sapiens
agcuuccagugcau

SEQ ID NO: 1119483 - RNA, 16 nt, Homo sapiens
agcuucuaucccagga

SEQ ID NO: 1119484 - RNA, 14 nt, Homo sapiens
agcuucucugugaa

SEQ ID NO: 1119485 - RNA, 18 nt, Homo sapiens
agcuucugcccaccuacu

SEQ ID NO: 1119486 - RNA, 13 nt, Homo sapiens
agcuugagccugu

SEQ ID NO: 1119487 - RNA, 14 nt, Homo sapiens
agcuugcaacaaaa

SEQ ID NO: 1119488 - RNA, 23 nt, Homo sapiens
agcuugcucuucagugggagaaa

SEQ ID NO: 1119489 - RNA, 22 nt, Homo sapiens
agcuuuauuuuuuaaguauuua

SEQ ID NO: 1119490 - RNA, 21 nt, Homo sapiens
agcuuucuucuacaaccagag

SEQ ID NO: 1119491 - RNA, 13 nt, Homo sapiens
agcuuugcaggau

SEQ ID NO: 1119492 - RNA, 20 nt, Homo sapiens
aggaaaaaccaauagcuuua

SEQ ID NO: 1119493 - RNA, 17 nt, Homo sapiens
aggaaaaucugcacugu

SEQ ID NO: 1119494 - RNA, 22 nt, Homo sapiens
aggaaacuugcauacagagaca

SEQ ID NO: 1119495 - RNA, 17 nt, Homo sapiens
aggaaagaugaugcaag

SEQ ID NO: 1119496 - RNA, 18 nt, Homo sapiens
aggaaagcaccgcagcau

SEQ ID NO: 1119497 - RNA, 19 nt, Homo sapiens
aggaaccucaaacugggua

SEQ ID NO: 1119498 - RNA, 12 nt, Homo sapiens
aggaagauuccc

SEQ ID NO: 1119499 - RNA, 21 nt, Homo sapiens
aggaaggaaagaaagaaggaa

SEQ ID NO: 1119500 - RNA, 17 nt, Homo sapiens
aggaagggaaagccaga

SEQ ID NO: 1119501 - RNA, 20 nt, Homo sapiens
aggaagguagcccagcacug

SEQ ID NO: 1119502 - RNA, 23 nt, Homo sapiens
aggaagguagcccagcacuguga

SEQ ID NO: 1119503 - RNA, 20 nt, Homo sapiens
aggaaggugcuugccuggga

SEQ ID NO: 1119504 - RNA, 21 nt, Homo sapiens
aggaauauuugcaagacauag

SEQ ID NO: 1119505 - RNA, 17 nt, Homo sapiens
aggaaucaaaaauugaa

SEQ ID NO: 1119506 - RNA, 16 nt, Homo sapiens
aggaauucuaggcauc

SEQ ID NO: 1119507 - RNA, 21 nt, Homo sapiens
aggacaaccauuccagacugc

SEQ ID NO: 1119508 - RNA, 20 nt, Homo sapiens
aggacauugcggacagccac

SEQ ID NO: 1119509 - RNA, 13 nt, Homo sapiens
aggaccagagcua

SEQ ID NO: 1119510 - RNA, 17 nt, Homo sapiens
aggacccauagaugaac

SEQ ID NO: 1119511 - RNA, 16 nt, Homo sapiens
aggaccccaaccccuc

SEQ ID NO: 1119512 - RNA, 15 nt, Homo sapiens
aggaccugagccugc

SEQ ID NO: 1119513 - RNA, 18 nt, Homo sapiens
aggacgguuaacuuguau

SEQ ID NO: 1119514 - RNA, 17 nt, Homo sapiens
aggacuauagcccaggu

SEQ ID NO: 1119515 - RNA, 22 nt, Homo sapiens
aggacucccucuaaguggaaua

SEQ ID NO: 1119516 - RNA, 19 nt, Homo sapiens
aggagacaagaaauccagu

SEQ ID NO: 1119517 - RNA, 14 nt, Homo sapiens
aggagaccagcuca

SEQ ID NO: 1119518 - RNA, 16 nt, Homo sapiens
aggagaccagcucaga

SEQ ID NO: 1119519 - RNA, 15 nt, Homo sapiens
aggagacccacaggu

SEQ ID NO: 1119520 - RNA, 18 nt, Homo sapiens
aggagacccacagguaug

SEQ ID NO: 1119521 - RNA, 16 nt, Homo sapiens
auaugaugccuuuucc

SEQ ID NO: 1119522 - RNA, 20 nt, Homo sapiens
auauggaaaaaaugaacuuu

SEQ ID NO: 1119523 - RNA, 16 nt, Homo sapiens
auauggaaauucugcu

SEQ ID NO: 1119524 - RNA, 12 nt, Homo sapiens
auauguauauau

SEQ ID NO: 1119525 - RNA, 20 nt, Homo sapiens
auaugucucaggucccugca

SEQ ID NO: 1119526 - RNA, 16 nt, Homo sapiens
auauguucaacuggag

SEQ ID NO: 1119527 - RNA, 15 nt, Homo sapiens
auauuaaagcaccaa

SEQ ID NO: 1119528 - RNA, 14 nt, Homo sapiens
auauuaccaaaaaa

SEQ ID NO: 1119529 - RNA, 17 nt, Homo sapiens
auauuauaauaauguuc

SEQ ID NO: 1119530 - RNA, 21 nt, Homo sapiens
auauucagagauguaccaugu

SEQ ID NO: 1119531 - RNA, 22 nt, Homo sapiens
auauuccauauauuagcauuua

SEQ ID NO: 1119532 - RNA, 18 nt, Homo sapiens
auauucugguuacugugg

SEQ ID NO: 1119533 - RNA, 20 nt, Homo sapiens
auauuucaggcauacugaca

SEQ ID NO: 1119534 - RNA, 20 nt, Homo sapiens
auauuucccaauacauacca

SEQ ID NO: 1119535 - RNA, 21 nt, Homo sapiens
auauuuguuaaauauuuacau

SEQ ID NO: 1119536 - RNA, 13 nt, Homo sapiens
auauuuucacaug

SEQ ID NO: 1119537 - RNA, 18 nt, Homo sapiens
auauuuuguaacuauuac

SEQ ID NO: 1119538 - RNA, 19 nt, Homo sapiens
aucaaaaauauuccaucca

SEQ ID NO: 1119539 - RNA, 13 nt, Homo sapiens
aucaaaacauauc

SEQ ID NO: 1119540 - RNA, 18 nt, Homo sapiens
aucaaccccagacacugg

SEQ ID NO: 1119541 - RNA, 20 nt, Homo sapiens
aucaacuuauuauaugacua

SEQ ID NO: 1119542 - RNA, 22 nt, Homo sapiens
aucaagagugagugaacaacua

SEQ ID NO: 1119543 - RNA, 14 nt, Homo sapiens
aucaaguccuacaa

SEQ ID NO: 1119544 - RNA, 23 nt, Homo sapiens
aucaauccuucuuauguuugcuu

SEQ ID NO: 1119545 - RNA, 15 nt, Homo sapiens
aucaaugucacuuaa

SEQ ID NO: 1119546 - RNA, 23 nt, Homo sapiens
aucaauguucacgcaacuugaaa

SEQ ID NO: 1119547 - RNA, 19 nt, Homo sapiens
aucaauuuuuauacauauc

SEQ ID NO: 1119548 - RNA, 19 nt, Homo sapiens
aucacaacauuuacuuaac

SEQ ID NO: 1119549 - RNA, 20 nt, Homo sapiens
aucacaguguuugcaauggu

SEQ ID NO: 1119550 - RNA, 21 nt, Homo sapiens
aucacauuauuugcauguuac

SEQ ID NO: 1119551 - RNA, 13 nt, Homo sapiens
aucaccagagguc

SEQ ID NO: 1119552 - RNA, 23 nt, Homo sapiens
aucaccuacucacacaggcauuu

SEQ ID NO: 1119553 - RNA, 15 nt, Homo sapiens
aucaccucaggccag

SEQ ID NO: 1119554 - RNA, 17 nt, Homo sapiens
aucacggcucacugcag

SEQ ID NO: 1119555 - RNA, 17 nt, Homo sapiens
aucacuauaaccaucag

SEQ ID NO: 1119556 - RNA, 17 nt, Homo sapiens
aucagaaucauugaagu

SEQ ID NO: 1119557 - RNA, 16 nt, Homo sapiens
aucagaccauaauguu

SEQ ID NO: 1119558 - RNA, 22 nt, Homo sapiens
aucagaccauaauguuacauua

SEQ ID NO: 1119559 - RNA, 18 nt, Homo sapiens
aucagacuccugugcaac

SEQ ID NO: 1119560 - RNA, 12 nt, Homo sapiens
aucagacuguag

SEQ ID NO: 1119561 - RNA, 23 nt, Homo sapiens
aucaggacuugggaaacagagaa

SEQ ID NO: 1119562 - RNA, 21 nt, Homo sapiens
aucaggcuauguauggaauac

SEQ ID NO: 1119563 - RNA, 17 nt, Homo sapiens
aucagggaggucauuuu

SEQ ID NO: 1119564 - RNA, 16 nt, Homo sapiens
aucagucauaacuaaa

SEQ ID NO: 1119565 - RNA, 21 nt, Homo sapiens
aucagucuuggaauacuugaa

SEQ ID NO: 1119566 - RNA, 23 nt, Homo sapiens
aucagugacagaguucacuauaa

SEQ ID NO: 1119567 - RNA, 20 nt, Homo sapiens
aucaguuuuuucaccuggaa

SEQ ID NO: 1119568 - RNA, 23 nt, Homo sapiens
aucauacuaccggcuacaucaaa

SEQ ID NO: 1119569 - RNA, 15 nt, Homo sapiens
aucaucuuuccuguu

SEQ ID NO: 1119570 - RNA, 18 nt, Homo sapiens
aucaugaaaagugcuguu

SEQ ID NO: 1119571 - RNA, 20 nt, Homo sapiens
aucaugaaaaugucuauuca

SEQ ID NO: 1119572 - RNA, 12 nt, Homo sapiens
aucaugagauaa

SEQ ID NO: 1119573 - RNA, 21 nt, Homo sapiens
auccaauucuuugaauuuccc

SEQ ID NO: 1119574 - RNA, 15 nt, Homo sapiens
auccagacccggcug

SEQ ID NO: 1119575 - RNA, 17 nt, Homo sapiens
auccagagauaauugcc

SEQ ID NO: 1119576 - RNA, 15 nt, Homo sapiens
augauuagcacuuaa

SEQ ID NO: 1119577 - RNA, 22 nt, Homo sapiens
augauucauuuuaacaucugag

SEQ ID NO: 1119578 - RNA, 21 nt, Homo sapiens
augauuccuugagcauuuuau

SEQ ID NO: 1119579 - RNA, 21 nt, Homo sapiens
augauuguuuuugcucaaggc

SEQ ID NO: 1119580 - RNA, 18 nt, Homo sapiens
augcaaaguagcaauuuc

SEQ ID NO: 1119581 - RNA, 22 nt, Homo sapiens
augcaaccuuuggaugcacuuu

SEQ ID NO: 1119582 - RNA, 21 nt, Homo sapiens
augcacauauggacucugcac

SEQ ID NO: 1119583 - RNA, 13 nt, Homo sapiens
augcacaucucau

SEQ ID NO: 1119584 - RNA, 19 nt, Homo sapiens
augcacuucuuacaauaau

SEQ ID NO: 1119585 - RNA, 20 nt, Homo sapiens
augcauaggaaguauggcau

SEQ ID NO: 1119586 - RNA, 13 nt, Homo sapiens
augccagagccug

SEQ ID NO: 1119587 - RNA, 22 nt, Homo sapiens
augccagcucagucccaucaga

SEQ ID NO: 1119588 - RNA, 16 nt, Homo sapiens
augccucuguauuuaa

SEQ ID NO: 1119589 - RNA, 22 nt, Homo sapiens
augccugauuuuaaaagguuga

SEQ ID NO: 1119590 - RNA, 14 nt, Homo sapiens
augcuaccaugccu

SEQ ID NO: 1119591 - RNA, 16 nt, Homo sapiens
augcuacucuaguauu

SEQ ID NO: 1119592 - RNA, 15 nt, Homo sapiens
augcuaucucugugu

SEQ ID NO: 1119593 - RNA, 22 nt, Homo sapiens
augcucagcccugacuggugcu

SEQ ID NO: 1119594 - RNA, 14 nt, Homo sapiens
augcuccaguaugg

SEQ ID NO: 1119595 - RNA, 15 nt, Homo sapiens
augcugccaaccagc

SEQ ID NO: 1119596 - RNA, 16 nt, Homo sapiens
augcuggcuguuggcu

SEQ ID NO: 1119597 - RNA, 20 nt, Homo sapiens
augcuguggacaccaccuau

SEQ ID NO: 1119598 - RNA, 22 nt, Homo sapiens
augcuuauuguacuuguuauca

SEQ ID NO: 1119599 - RNA, 20 nt, Homo sapiens
auggaaagaaucuaauagag

SEQ ID NO: 1119600 - RNA, 15 nt, Homo sapiens
auggacaagauuacc

SEQ ID NO: 1119601 - RNA, 18 nt, Homo sapiens
auggagccagcucugcau

SEQ ID NO: 1119602 - RNA, 18 nt, Homo sapiens
auggaggaaagugauauc

SEQ ID NO: 1119603 - RNA, 12 nt, Homo sapiens
auggaugaagga

SEQ ID NO: 1119604 - RNA, 14 nt, Homo sapiens
auggccaggccaga

SEQ ID NO: 1119605 - RNA, 15 nt, Homo sapiens
auggcccaaauccag

SEQ ID NO: 1119606 - RNA, 20 nt, Homo sapiens
auggcccugggagagccaga

SEQ ID NO: 1119607 - RNA, 22 nt, Homo sapiens
auggccuggggaagcugugaaa

SEQ ID NO: 1119608 - RNA, 16 nt, Homo sapiens
auggcuaccaaaaaga

SEQ ID NO: 1119609 - RNA, 15 nt, Homo sapiens
auggcucugugaaau

SEQ ID NO: 1119610 - RNA, 23 nt, Homo sapiens
auggggauaaaggagaaggcaug

SEQ ID NO: 1119611 - RNA, 20 nt, Homo sapiens
auggggguggggaggcaaga

SEQ ID NO: 1119612 - RNA, 21 nt, Homo sapiens
auggggguggggaggcaagaa

SEQ ID NO: 1119613 - RNA, 13 nt, Homo sapiens
auuccuugauuca

SEQ ID NO: 1119614 - RNA, 15 nt, Homo sapiens
auucgaaugacacug

SEQ ID NO: 1119615 - RNA, 18 nt, Homo sapiens
auucuaacuuuuuugcua

SEQ ID NO: 1119616 - RNA, 21 nt, Homo sapiens
auucuacacauauauguauau

SEQ ID NO: 1119617 - RNA, 18 nt, Homo sapiens
auucuacugaacacuuca

SEQ ID NO: 1119618 - RNA, 13 nt, Homo sapiens
auucuaggcaucc

SEQ ID NO: 1119619 - RNA, 12 nt, Homo sapiens
auucucaccagg

SEQ ID NO: 1119620 - RNA, 13 nt, Homo sapiens
auucucaccagga

SEQ ID NO: 1119621 - RNA, 14 nt, Homo sapiens
auucucaugugauc

SEQ ID NO: 1119622 - RNA, 15 nt, Homo sapiens
auucuccugccucag

SEQ ID NO: 1119623 - RNA, 22 nt, Homo sapiens
auucucuccucagacugcucaa

SEQ ID NO: 1119624 - RNA, 22 nt, Homo sapiens
auucucugugguauccaagaau

SEQ ID NO: 1119625 - RNA, 18 nt, Homo sapiens
auucuguuggccagugug

SEQ ID NO: 1119626 - RNA, 17 nt, Homo sapiens
auucuuaauaggcuuua

SEQ ID NO: 1119627 - RNA, 18 nt, Homo sapiens
auucuuaauaggcuuuau

SEQ ID NO: 1119628 - RNA, 20 nt, Homo sapiens
auucuuuaaauuucaucuca

SEQ ID NO: 1119629 - RNA, 22 nt, Homo sapiens
auugaaggagaaaaugcauuau

SEQ ID NO: 1119630 - RNA, 18 nt, Homo sapiens
auugaucacuuuguuaaa

SEQ ID NO: 1119631 - RNA, 12 nt, Homo sapiens
auugauguugcu

SEQ ID NO: 1119632 - RNA, 19 nt, Homo sapiens
auugauuauaagcauguau

SEQ ID NO: 1119633 - RNA, 10 nt, Homo sapiens
auugcacaau

SEQ ID NO: 1119634 - RNA, 14 nt, Homo sapiens
auugcacuccaguc

SEQ ID NO: 1119635 - RNA, 18 nt, Homo sapiens
auugcaugccaucuccac

SEQ ID NO: 1119636 - RNA, 17 nt, Homo sapiens
auugccuagaggugcuc

SEQ ID NO: 1119637 - RNA, 17 nt, Homo sapiens
auugcuaugaaugauac

SEQ ID NO: 1119638 - RNA, 18 nt, Homo sapiens
auuggagggaagacaggu

SEQ ID NO: 1119639 - RNA, 14 nt, Homo sapiens
auuguaccaugaaa

SEQ ID NO: 1119640 - RNA, 18 nt, Homo sapiens
auuguagaaaagcuauaa

SEQ ID NO: 1119641 - RNA, 22 nt, Homo sapiens
auuguauuuuagcaggguacau

SEQ ID NO: 1119642 - RNA, 14 nt, Homo sapiens
auuguccaugccua

SEQ ID NO: 1119643 - RNA, 20 nt, Homo sapiens
auuguuaaaaccuuacuuaa

SEQ ID NO: 1119644 - RNA, 15 nt, Homo sapiens
auuguuaaaauaacu

SEQ ID NO: 1119645 - RNA, 16 nt, Homo sapiens
auuuaaaaugagaucg

SEQ ID NO: 1119646 - RNA, 19 nt, Homo sapiens
auuuaaaauuaaaugcaug

SEQ ID NO: 1119647 - RNA, 13 nt, Homo sapiens
auuuaaguauaua

SEQ ID NO: 1119648 - RNA, 20 nt, Homo sapiens
auuuaaugaagacccagugu

SEQ ID NO: 1119649 - RNA, 22 nt, Homo sapiens
auuuaaugaagacccaguguaa

SEQ ID NO: 1119650 - RNA, 22 nt, Homo sapiens
auuuacuacuuuaaagagcuua

SEQ ID NO: 1119651 - RNA, 18 nt, Homo sapiens
auuuaguaacaguuguga

SEQ ID NO: 1119652 - RNA, 13 nt, Homo sapiens
auuuagugucuug

SEQ ID NO: 1119653 - RNA, 15 nt, Homo sapiens
auuuagugucuugaa

SEQ ID NO: 1119654 - RNA, 13 nt, Homo sapiens
auuuauaacucau

SEQ ID NO: 1119655 - RNA, 15 nt, Homo sapiens
auuuauaacucauca

SEQ ID NO: 1119656 - RNA, 14 nt, Homo sapiens
auuuaucagugaca

SEQ ID NO: 1119657 - RNA, 14 nt, Homo sapiens
auuuaucaucucga

SEQ ID NO: 1119658 - RNA, 13 nt, Homo sapiens
auuuaucccucaa

SEQ ID NO: 1119659 - RNA, 23 nt, Homo sapiens
auuuaucugugcaaauccuugau

SEQ ID NO: 1119660 - RNA, 19 nt, Homo sapiens
auuuaugagaaaguucuca

SEQ ID NO: 1119661 - RNA, 13 nt, Homo sapiens
auuuauguuuauu

SEQ ID NO: 1119662 - RNA, 14 nt, Homo sapiens
auuuauuaccucug

SEQ ID NO: 1119663 - RNA, 13 nt, Homo sapiens
auuucaaugauug

SEQ ID NO: 1119664 - RNA, 13 nt, Homo sapiens
auuucacauuaau

SEQ ID NO: 1119665 - RNA, 13 nt, Homo sapiens
caaaucucuauua

SEQ ID NO: 1119666 - RNA, 15 nt, Homo sapiens
caaaugcacaucuca

SEQ ID NO: 1119667 - RNA, 16 nt, Homo sapiens
caaaugcacaucucau

SEQ ID NO: 1119668 - RNA, 18 nt, Homo sapiens
caaaugcacaucucaugg

SEQ ID NO: 1119669 - RNA, 19 nt, Homo sapiens
caaauggacauaagacaga

SEQ ID NO: 1119670 - RNA, 20 nt, Homo sapiens
caaauggagaaguucaggaa

SEQ ID NO: 1119671 - RNA, 15 nt, Homo sapiens
caaauuaaguauguu

SEQ ID NO: 1119672 - RNA, 21 nt, Homo sapiens
caaauucuacugaacacuuca

SEQ ID NO: 1119673 - RNA, 20 nt, Homo sapiens
caaauucuuuuucacacuga

SEQ ID NO: 1119674 - RNA, 19 nt, Homo sapiens
caaauugcugggauuacag

SEQ ID NO: 1119675 - RNA, 21 nt, Homo sapiens
caacaaauuagguuuuguaca

SEQ ID NO: 1119676 - RNA, 23 nt, Homo sapiens
caacacaagcuggaagcacaugu

SEQ ID NO: 1119677 - RNA, 24 nt, Homo sapiens
caacacugcgccggguaccaugga

SEQ ID NO: 1119678 - RNA, 19 nt, Homo sapiens
caacacuucucacaucuua

SEQ ID NO: 1119679 - RNA, 16 nt, Homo sapiens
caacagcauaacuaaa

SEQ ID NO: 1119680 - RNA, 20 nt, Homo sapiens
caacaggaaucucagagaca

SEQ ID NO: 1119681 - RNA, 22 nt, Homo sapiens
caacagguggcaggaccaggac

SEQ ID NO: 1119682 - RNA, 12 nt, Homo sapiens
caacauaacuga

SEQ ID NO: 1119683 - RNA, 12 nt, Homo sapiens
caacaucuucaa

SEQ ID NO: 1119684 - RNA, 17 nt, Homo sapiens
caacaugcgaccgugac

SEQ ID NO: 1119685 - RNA, 16 nt, Homo sapiens
caaccagccacacaga

SEQ ID NO: 1119686 - RNA, 14 nt, Homo sapiens
caaccauaugaauu

SEQ ID NO: 1119687 - RNA, 14 nt, Homo sapiens
caaccccaccacuu

SEQ ID NO: 1119688 - RNA, 16 nt, Homo sapiens
caaccccagacacugg

SEQ ID NO: 1119689 - RNA, 17 nt, Homo sapiens
caaccccccaccugcca

SEQ ID NO: 1119690 - RNA, 13 nt, Homo sapiens
caaccuaugguau

SEQ ID NO: 1119691 - RNA, 20 nt, Homo sapiens
caaccugcucuccucuugcc

SEQ ID NO: 1119692 - RNA, 14 nt, Homo sapiens
caaccuuuguguaa

SEQ ID NO: 1119693 - RNA, 16 nt, Homo sapiens
caacggcuuagacuuc

SEQ ID NO: 1119694 - RNA, 17 nt, Homo sapiens
caacuaacguacauuca

SEQ ID NO: 1119695 - RNA, 17 nt, Homo sapiens
caacuaccuagacugga

SEQ ID NO: 1119696 - RNA, 15 nt, Homo sapiens
caacuacugugauca

SEQ ID NO: 1119697 - RNA, 10 nt, Homo sapiens
caacugacca

SEQ ID NO: 1119698 - RNA, 15 nt, Homo sapiens
caacuggagcacuga

SEQ ID NO: 1119699 - RNA, 22 nt, Homo sapiens
caacuuaaaucacugaggcauu

SEQ ID NO: 1119700 - RNA, 21 nt, Homo sapiens
caacuucauuugaugcuaaau

SEQ ID NO: 1119701 - RNA, 22 nt, Homo sapiens
caacuuccaaauuggauacugc

SEQ ID NO: 1119702 - RNA, 18 nt, Homo sapiens
caacuuuuccuuugaauc

SEQ ID NO: 1119703 - RNA, 12 nt, Homo sapiens
caagaaccugcu

SEQ ID NO: 1119704 - RNA, 21 nt, Homo sapiens
caagaaccugcuaaggcugcc

SEQ ID NO: 1119705 - RNA, 22 nt, Homo sapiens
caagaagaaaacgaacugggaa

SEQ ID NO: 1119706 - RNA, 18 nt, Homo sapiens
ccauagugcacacuugua

SEQ ID NO: 1119707 - RNA, 23 nt, Homo sapiens
ccauaguggagagaacugaauaa

SEQ ID NO: 1119708 - RNA, 15 nt, Homo sapiens
ccaucaccuacucac

SEQ ID NO: 1119709 - RNA, 16 nt, Homo sapiens
ccaucaguuacugguu

SEQ ID NO: 1119710 - RNA, 22 nt, Homo sapiens
ccauccagccgcugcacaucac

SEQ ID NO: 1119711 - RNA, 14 nt, Homo sapiens
ccauccauauacuu

SEQ ID NO: 1119712 - RNA, 20 nt, Homo sapiens
ccauccaugagaguuucaaa

SEQ ID NO: 1119713 - RNA, 21 nt, Homo sapiens
ccauccuaggcuuaaaugcaa

SEQ ID NO: 1119714 - RNA, 15 nt, Homo sapiens
ccaucuaagcugcag

SEQ ID NO: 1119715 - RNA, 18 nt, Homo sapiens
ccaucugaaccacuuugc

SEQ ID NO: 1119716 - RNA, 10 nt, Homo sapiens
ccaucugauu

SEQ ID NO: 1119717 - RNA, 13 nt, Homo sapiens
ccaucugcuccuc

SEQ ID NO: 1119718 - RNA, 15 nt, Homo sapiens
ccaugaaaaugcaac

SEQ ID NO: 1119719 - RNA, 13 nt, Homo sapiens
ccaugaagcugga

SEQ ID NO: 1119720 - RNA, 23 nt, Homo sapiens
ccaugaggccuuuccccagugug

SEQ ID NO: 1119721 - RNA, 15 nt, Homo sapiens
ccaugcucaaccacu

SEQ ID NO: 1119722 - RNA, 18 nt, Homo sapiens
ccauguaccaguguacug

SEQ ID NO: 1119723 - RNA, 13 nt, Homo sapiens
ccauuaccugacu

SEQ ID NO: 1119724 - RNA, 23 nt, Homo sapiens
ccauuauuucaaccgcuugccau

SEQ ID NO: 1119725 - RNA, 17 nt, Homo sapiens
ccauuccagacugcuuc

SEQ ID NO: 1119726 - RNA, 13 nt, Homo sapiens
ccauucugaccau

SEQ ID NO: 1119727 - RNA, 21 nt, Homo sapiens
ccauugucaccuaacucugaa

SEQ ID NO: 1119728 - RNA, 22 nt, Homo sapiens
cccaaggaaaauggacauauuc

SEQ ID NO: 1119729 - RNA, 17 nt, Homo sapiens
cccaaggcaguguuccu

SEQ ID NO: 1119730 - RNA, 15 nt, Homo sapiens
cccacagcacuaauu

SEQ ID NO: 1119731 - RNA, 17 nt, Homo sapiens
cccacccaacaagccau

SEQ ID NO: 1119732 - RNA, 16 nt, Homo sapiens
cccacccccucuuugu

SEQ ID NO: 1119733 - RNA, 19 nt, Homo sapiens
cccacgcuggagugcagug

SEQ ID NO: 1119734 - RNA, 16 nt, Homo sapiens
cccacugcucugguua

SEQ ID NO: 1119735 - RNA, 10 nt, Homo sapiens
cccagaacac

SEQ ID NO: 1119736 - RNA, 12 nt, Homo sapiens
cccagaaggcag

SEQ ID NO: 1119737 - RNA, 23 nt, Homo sapiens
cccagagaccccuuccuuuccuc

SEQ ID NO: 1119738 - RNA, 18 nt, Homo sapiens
cccagagcaaaauaauuu

SEQ ID NO: 1119739 - RNA, 21 nt, Homo sapiens
cccagagugugaaacuuccua

SEQ ID NO: 1119740 - RNA, 12 nt, Homo sapiens
cccagauccuca

SEQ ID NO: 1119741 - RNA, 12 nt, Homo sapiens
cccagauuuccu

SEQ ID NO: 1119742 - RNA, 13 nt, Homo sapiens
cccagcacuguga

SEQ ID NO: 1119743 - RNA, 12 nt, Homo sapiens
cccagcacuuug

SEQ ID NO: 1119744 - RNA, 13 nt, Homo sapiens
cccagcacuuugg

SEQ ID NO: 1119745 - RNA, 15 nt, Homo sapiens
cccagccacucggga

SEQ ID NO: 1119746 - RNA, 18 nt, Homo sapiens
cccagccccgcccgccug

SEQ ID NO: 1119747 - RNA, 22 nt, Homo sapiens
cccaggacgccacucauuucau

SEQ ID NO: 1119748 - RNA, 14 nt, Homo sapiens
cccaggaguuugag

SEQ ID NO: 1119749 - RNA, 19 nt, Homo sapiens
cccaggcuggcgugcagug

SEQ ID NO: 1119750 - RNA, 13 nt, Homo sapiens
cccagggcacuuc

SEQ ID NO: 1119751 - RNA, 19 nt, Homo sapiens
cccaggucucuccacugcu

SEQ ID NO: 1119752 - RNA, 12 nt, Homo sapiens
cccaguguaaag

SEQ ID NO: 1119753 - RNA, 14 nt, Homo sapiens
cccaguguaaagaa

SEQ ID NO: 1119754 - RNA, 21 nt, Homo sapiens
cccaguguaaagaauaaauga

SEQ ID NO: 1119755 - RNA, 19 nt, Homo sapiens
cccaucuaagcugcagcuu

SEQ ID NO: 1119756 - RNA, 18 nt, Homo sapiens
cccaugagguacagcaga

SEQ ID NO: 1119757 - RNA, 23 nt, Homo sapiens
cccaugaguagugcccacuugag

SEQ ID NO: 1119758 - RNA, 14 nt, Homo sapiens
cccaugcccagcug

SEQ ID NO: 1119759 - RNA, 13 nt, Homo sapiens
cccauggccacuu

SEQ ID NO: 1119760 - RNA, 17 nt, Homo sapiens
cccauucagacacuuca

SEQ ID NO: 1119761 - RNA, 22 nt, Homo sapiens
cccauugaaacaaaacauugau

SEQ ID NO: 1119762 - RNA, 15 nt, Homo sapiens
cccauuucuauuuau

SEQ ID NO: 1119763 - RNA, 17 nt, Homo sapiens
ccccaaauugcuaccuc

SEQ ID NO: 1119764 - RNA, 16 nt, Homo sapiens
ccccaacauugagaug

SEQ ID NO: 1119765 - RNA, 14 nt, Homo sapiens
ccccaagugaccua

SEQ ID NO: 1119766 - RNA, 16 nt, Homo sapiens
ccccacuucucuacuc

SEQ ID NO: 1119767 - RNA, 16 nt, Homo sapiens
ccccagcccacaggug

SEQ ID NO: 1119768 - RNA, 22 nt, Homo sapiens
ccccagcucuggcuuccagaaa

SEQ ID NO: 1119769 - RNA, 10 nt, Homo sapiens
ccccagcugu

SEQ ID NO: 1119770 - RNA, 23 nt, Homo sapiens
ccccaggucucuccacugcucuc

SEQ ID NO: 1119771 - RNA, 13 nt, Homo sapiens
cccccacugccac

SEQ ID NO: 1119772 - RNA, 11 nt, Homo sapiens
cccccagugug

SEQ ID NO: 1119773 - RNA, 20 nt, Homo sapiens
cccccugacauuaucuugga

SEQ ID NO: 1119774 - RNA, 16 nt, Homo sapiens
ccccguggucuuugaa

SEQ ID NO: 1119775 - RNA, 14 nt, Homo sapiens
ccccuaugcuccag

SEQ ID NO: 1119776 - RNA, 13 nt, Homo sapiens
ccccucagugcuc

SEQ ID NO: 1119777 - RNA, 21 nt, Homo sapiens
ccccugaccucaccuuugcaa

SEQ ID NO: 1119778 - RNA, 21 nt, Homo sapiens
ccccuggccuuugaggcaaag

SEQ ID NO: 1119779 - RNA, 23 nt, Homo sapiens
ccccuuauccaggacucugucaa

SEQ ID NO: 1119780 - RNA, 12 nt, Homo sapiens
cccgcucugcac

SEQ ID NO: 1119781 - RNA, 22 nt, Homo sapiens
cccgggagaggagaucagggcg

SEQ ID NO: 1119782 - RNA, 20 nt, Homo sapiens
cccgucauguuccucaaaag

SEQ ID NO: 1119783 - RNA, 17 nt, Homo sapiens
cccgugccaaguccagg

SEQ ID NO: 1119784 - RNA, 18 nt, Homo sapiens
cccuaucaaaacauauca

SEQ ID NO: 1119785 - RNA, 13 nt, Homo sapiens
cccuccccauuca

SEQ ID NO: 1119786 - RNA, 16 nt, Homo sapiens
cccucucuugccuuuc

SEQ ID NO: 1119787 - RNA, 15 nt, Homo sapiens
cccucuuccugccaa

SEQ ID NO: 1119788 - RNA, 11 nt, Homo sapiens
cccugaccucc

SEQ ID NO: 1119789 - RNA, 13 nt, Homo sapiens
cccugagguccug

SEQ ID NO: 1119790 - RNA, 15 nt, Homo sapiens
cccugagguccugca

SEQ ID NO: 1119791 - RNA, 14 nt, Homo sapiens
cccugaucaaguca

SEQ ID NO: 1119792 - RNA, 17 nt, Homo sapiens
cccugcagccaaacaga

SEQ ID NO: 1119793 - RNA, 15 nt, Homo sapiens
cccugccccugccuu

SEQ ID NO: 1119794 - RNA, 19 nt, Homo sapiens
cccugcuugcacuuuguaa

SEQ ID NO: 1119795 - RNA, 17 nt, Homo sapiens
cccuggccucacgccca

SEQ ID NO: 1119796 - RNA, 19 nt, Homo sapiens
cccuguuucucuugaagaa

SEQ ID NO: 1119797 - RNA, 14 nt, Homo sapiens
ccuguaaauaguuu

SEQ ID NO: 1119798 - RNA, 12 nt, Homo sapiens
ccuguaacacaa

SEQ ID NO: 1119799 - RNA, 21 nt, Homo sapiens
ccuguaaucccagcuacaugg

SEQ ID NO: 1119800 - RNA, 20 nt, Homo sapiens
ccuguaccccagcacuugug

SEQ ID NO: 1119801 - RNA, 17 nt, Homo sapiens
ccugucgauuagacugg

SEQ ID NO: 1119802 - RNA, 22 nt, Homo sapiens
ccugucugccagccagcagcca

SEQ ID NO: 1119803 - RNA, 17 nt, Homo sapiens
ccugugucacucagcag

SEQ ID NO: 1119804 - RNA, 17 nt, Homo sapiens
ccugugugccauuuuaa

SEQ ID NO: 1119805 - RNA, 16 nt, Homo sapiens
ccuguguuucaagcua

SEQ ID NO: 1119806 - RNA, 22 nt, Homo sapiens
ccuguuacuugaaauaccagug

SEQ ID NO: 1119807 - RNA, 20 nt, Homo sapiens
ccuguuaggggaaaauagua

SEQ ID NO: 1119808 - RNA, 20 nt, Homo sapiens
ccuguucaccuuauguauua

SEQ ID NO: 1119809 - RNA, 19 nt, Homo sapiens
ccuguucuuccuaccaaau

SEQ ID NO: 1119810 - RNA, 16 nt, Homo sapiens
ccuuagauuagcucug

SEQ ID NO: 1119811 - RNA, 20 nt, Homo sapiens
ccuuagcagggaaacagcua

SEQ ID NO: 1119812 - RNA, 18 nt, Homo sapiens
ccuuagcuuagaccucag

SEQ ID NO: 1119813 - RNA, 12 nt, Homo sapiens
ccuuauaguguu

SEQ ID NO: 1119814 - RNA, 16 nt, Homo sapiens
ccuuauuguaccucuc

SEQ ID NO: 1119815 - RNA, 20 nt, Homo sapiens
ccuucaaguuagcucaggag

SEQ ID NO: 1119816 - RNA, 23 nt, Homo sapiens
ccuucauuuccuccgucaccuca

SEQ ID NO: 1119817 - RNA, 19 nt, Homo sapiens
ccuuccacggauccaugua

SEQ ID NO: 1119818 - RNA, 18 nt, Homo sapiens
ccuuccugccaccaguca

SEQ ID NO: 1119819 - RNA, 19 nt, Homo sapiens
ccuuccugucccaccucuu

SEQ ID NO: 1119820 - RNA, 13 nt, Homo sapiens
ccuucgcagcuuu

SEQ ID NO: 1119821 - RNA, 19 nt, Homo sapiens
ccuucuccugccuacauuc

SEQ ID NO: 1119822 - RNA, 16 nt, Homo sapiens
ccuucugaagaucuca

SEQ ID NO: 1119823 - RNA, 19 nt, Homo sapiens
ccuucugguacaauccuuu

SEQ ID NO: 1119824 - RNA, 15 nt, Homo sapiens
ccuugagcuguccua

SEQ ID NO: 1119825 - RNA, 20 nt, Homo sapiens
ccuugagcuguccuauggaa

SEQ ID NO: 1119826 - RNA, 14 nt, Homo sapiens
ccuugauucacaau

SEQ ID NO: 1119827 - RNA, 20 nt, Homo sapiens
ccuugcauccaucugggcua

SEQ ID NO: 1119828 - RNA, 21 nt, Homo sapiens
ccuugcuguuuucaucucugc

SEQ ID NO: 1119829 - RNA, 14 nt, Homo sapiens
ccuuggugugaccc

SEQ ID NO: 1119830 - RNA, 19 nt, Homo sapiens
ccuuguaauucuaaaugaa

SEQ ID NO: 1119831 - RNA, 17 nt, Homo sapiens
ccuugugguuuauguca

SEQ ID NO: 1119832 - RNA, 21 nt, Homo sapiens
ccuuguuuggggcaggaguag

SEQ ID NO: 1119833 - RNA, 21 nt, Homo sapiens
ccuuuaaaaauaugcaccaaa

SEQ ID NO: 1119834 - RNA, 16 nt, Homo sapiens
ccuuuaaaauuuacca

SEQ ID NO: 1119835 - RNA, 20 nt, Homo sapiens
cuacacaguaaaaacuugua

SEQ ID NO: 1119836 - RNA, 22 nt, Homo sapiens
cuacaccacucuggcagccaca

SEQ ID NO: 1119837 - RNA, 22 nt, Homo sapiens
cuacaccuuagcagcucuuccc

SEQ ID NO: 1119838 - RNA, 16 nt, Homo sapiens
cuacaguggcugucac

SEQ ID NO: 1119839 - RNA, 21 nt, Homo sapiens
cuacauauucuuuaaauuuca

SEQ ID NO: 1119840 - RNA, 12 nt, Homo sapiens
cuacaugcacuu

SEQ ID NO: 1119841 - RNA, 23 nt, Homo sapiens
cuacauuaguacacagcaccaga

SEQ ID NO: 1119842 - RNA, 21 nt, Homo sapiens
cuaccaaagcaccuuagcugg

SEQ ID NO: 1119843 - RNA, 14 nt, Homo sapiens
cuaccaauguagac

SEQ ID NO: 1119844 - RNA, 13 nt, Homo sapiens
cuacuauucuguu

SEQ ID NO: 1119845 - RNA, 23 nt, Homo sapiens
cuacucaggaggcugaggcagaa

SEQ ID NO: 1119846 - RNA, 16 nt, Homo sapiens
cuacuuacaugcauua

SEQ ID NO: 1119847 - RNA, 12 nt, Homo sapiens
cuacuugccaca

SEQ ID NO: 1119848 - RNA, 20 nt, Homo sapiens
cuacuuguaaaggugcugca

SEQ ID NO: 1119849 - RNA, 18 nt, Homo sapiens
cuacuuuucuuuccucag

SEQ ID NO: 1119850 - RNA, 19 nt, Homo sapiens
cuagaacaugcacauuuau

SEQ ID NO: 1119851 - RNA, 14 nt, Homo sapiens
cuagaacucuccau

SEQ ID NO: 1119852 - RNA, 19 nt, Homo sapiens
cuagaacucuccaucuuau

SEQ ID NO: 1119853 - RNA, 14 nt, Homo sapiens
cuagagaacaugcc

SEQ ID NO: 1119854 - RNA, 15 nt, Homo sapiens
cuagagaacaugccc

SEQ ID NO: 1119855 - RNA, 21 nt, Homo sapiens
cuagaggcuuccuucauuucc

SEQ ID NO: 1119856 - RNA, 15 nt, Homo sapiens
cuagcagcugcaguc

SEQ ID NO: 1119857 - RNA, 12 nt, Homo sapiens
cuagcaucucau

SEQ ID NO: 1119858 - RNA, 16 nt, Homo sapiens
cuagcucuaguucaaa

SEQ ID NO: 1119859 - RNA, 17 nt, Homo sapiens
cuagcugcaagugacau

SEQ ID NO: 1119860 - RNA, 14 nt, Homo sapiens
cuaggaaugcuuuu

SEQ ID NO: 1119861 - RNA, 15 nt, Homo sapiens
cuaggaggaaaaaga

SEQ ID NO: 1119862 - RNA, 17 nt, Homo sapiens
cuaggcuuaaaugcaau

SEQ ID NO: 1119863 - RNA, 23 nt, Homo sapiens
cuagucuauggucaguugaggaa

SEQ ID NO: 1119864 - RNA, 19 nt, Homo sapiens
cuagucuccuuugcacuga

SEQ ID NO: 1119865 - RNA, 15 nt, Homo sapiens
cuagucugcuagcca

SEQ ID NO: 1119866 - RNA, 14 nt, Homo sapiens
cuagugauuugccu

SEQ ID NO: 1119867 - RNA, 22 nt, Homo sapiens
cuagugauuugccucaacaacg

SEQ ID NO: 1119868 - RNA, 14 nt, Homo sapiens
cuaguguugcuugg

SEQ ID NO: 1119869 - RNA, 22 nt, Homo sapiens
cuaguugaacaucucacuuugc

SEQ ID NO: 1119870 - RNA, 20 nt, Homo sapiens
cuauaaagguugacaauaaa

SEQ ID NO: 1119871 - RNA, 16 nt, Homo sapiens
cuauaagcaugaucuu

SEQ ID NO: 1119872 - RNA, 17 nt, Homo sapiens
cuauauuguacacaccu

SEQ ID NO: 1119873 - RNA, 18 nt, Homo sapiens
cuauauuuagauuguuaa

SEQ ID NO: 1119874 - RNA, 12 nt, Homo sapiens
cuaucacauaca

SEQ ID NO: 1119875 - RNA, 21 nt, Homo sapiens
cuaucacauacaauuugcacu

SEQ ID NO: 1119876 - RNA, 22 nt, Homo sapiens
cuaucauuucuuuuccaaaauu

SEQ ID NO: 1119877 - RNA, 19 nt, Homo sapiens
cuauccaaaacuaauuucc

SEQ ID NO: 1119878 - RNA, 15 nt, Homo sapiens
cuaucgcaccacugu

SEQ ID NO: 1119879 - RNA, 20 nt, Homo sapiens
cuaucugauuuccuaauguc

SEQ ID NO: 1119880 - RNA, 15 nt, Homo sapiens
cuaugacuugggcac

SEQ ID NO: 1119881 - RNA, 13 nt, Homo sapiens
cuaugaucuuggc

SEQ ID NO: 1119882 - RNA, 22 nt, Homo sapiens
cuaugcaacagcucucaccuac

SEQ ID NO: 1119883 - RNA, 23 nt, Homo sapiens
cuaugcacauauggacucugcac

SEQ ID NO: 1119884 - RNA, 19 nt, Homo sapiens
cuauggcagccauccauga

SEQ ID NO: 1119885 - RNA, 17 nt, Homo sapiens
cuauggcugccugcauc

SEQ ID NO: 1119886 - RNA, 11 nt, Homo sapiens
cuaugggacuc

SEQ ID NO: 1119887 - RNA, 15 nt, Homo sapiens
cuauguacuguaaua

SEQ ID NO: 1119888 - RNA, 13 nt, Homo sapiens
cuauguacuuuaa

SEQ ID NO: 1119889 - RNA, 23 nt, Homo sapiens
gacauacaccuaugucauuucau

SEQ ID NO: 1119890 - RNA, 16 nt, Homo sapiens
gacaugcagcucugau

SEQ ID NO: 1119891 - RNA, 16 nt, Homo sapiens
gacauggaauuaccuu

SEQ ID NO: 1119892 - RNA, 17 nt, Homo sapiens
gacauggaauuaccuua

SEQ ID NO: 1119893 - RNA, 19 nt, Homo sapiens
gacauggguagcaauucua

SEQ ID NO: 1119894 - RNA, 16 nt, Homo sapiens
gacauucaaggcauuu

SEQ ID NO: 1119895 - RNA, 20 nt, Homo sapiens
gacauucuggaaaagcaaaa

SEQ ID NO: 1119896 - RNA, 20 nt, Homo sapiens
gacauuucccuccugggaga

SEQ ID NO: 1119897 - RNA, 18 nt, Homo sapiens
gaccaacaccccucccac

SEQ ID NO: 1119898 - RNA, 19 nt, Homo sapiens
gaccaccucucaauauuca

SEQ ID NO: 1119899 - RNA, 17 nt, Homo sapiens
gaccacugggcaaugau

SEQ ID NO: 1119900 - RNA, 24 nt, Homo sapiens
gaccacugggcaaugauggcaauu

SEQ ID NO: 1119901 - RNA, 23 nt, Homo sapiens
gaccagccugggcaacaaaguga

SEQ ID NO: 1119902 - RNA, 15 nt, Homo sapiens
gaccauaaagggaaa

SEQ ID NO: 1119903 - RNA, 18 nt, Homo sapiens
gacccagggaugacaugu

SEQ ID NO: 1119904 - RNA, 12 nt, Homo sapiens
gaccccaaagag

SEQ ID NO: 1119905 - RNA, 24 nt, Homo sapiens
gaccccagggcacaggagcuaccu

SEQ ID NO: 1119906 - RNA, 14 nt, Homo sapiens
gacccuccugucca

SEQ ID NO: 1119907 - RNA, 17 nt, Homo sapiens
gaccuaaccuaagcaaa

SEQ ID NO: 1119908 - RNA, 15 nt, Homo sapiens
gaccuacuaaaaaua

SEQ ID NO: 1119909 - RNA, 17 nt, Homo sapiens
gaccucaggugcuaggg

SEQ ID NO: 1119910 - RNA, 16 nt, Homo sapiens
gaccucauuccuggga

SEQ ID NO: 1119911 - RNA, 19 nt, Homo sapiens
gaccuccagcuuuccugua

SEQ ID NO: 1119912 - RNA, 16 nt, Homo sapiens
gaccucccagcccuau

SEQ ID NO: 1119913 - RNA, 19 nt, Homo sapiens
gaccuccuccugcccuccc

SEQ ID NO: 1119914 - RNA, 18 nt, Homo sapiens
auccagaggguugugauu

SEQ ID NO: 1119915 - RNA, 19 nt, Homo sapiens
auccagaggguugugauuu

SEQ ID NO: 1119916 - RNA, 21 nt, Homo sapiens
auccaguuucccaccaccuug

SEQ ID NO: 1119917 - RNA, 20 nt, Homo sapiens
auccaucugggcuaccccac

SEQ ID NO: 1119918 - RNA, 17 nt, Homo sapiens
aucccaucuaagcugca

SEQ ID NO: 1119919 - RNA, 15 nt, Homo sapiens
aucccaugagccuca

SEQ ID NO: 1119920 - RNA, 17 nt, Homo sapiens
aucccgaaaaucucucg

SEQ ID NO: 1119921 - RNA, 21 nt, Homo sapiens
aucccggcugucaaggggugu

SEQ ID NO: 1119922 - RNA, 15 nt, Homo sapiens
auccgaggcaggguc

SEQ ID NO: 1119923 - RNA, 22 nt, Homo sapiens
auccgaggcagggucaggagag

SEQ ID NO: 1119924 - RNA, 20 nt, Homo sapiens
auccguacauucaauguuua

SEQ ID NO: 1119925 - RNA, 21 nt, Homo sapiens
auccuacaacuuccacuccaa

SEQ ID NO: 1119926 - RNA, 22 nt, Homo sapiens
auccuaggcuuaaaugcaauau

SEQ ID NO: 1119927 - RNA, 21 nt, Homo sapiens
auccugaugcuguugggaaaa

SEQ ID NO: 1119928 - RNA, 16 nt, Homo sapiens
auccugcuagcuguag

SEQ ID NO: 1119929 - RNA, 15 nt, Homo sapiens
auccuuucuauugaa

SEQ ID NO: 1119930 - RNA, 23 nt, Homo sapiens
auccuuugaguuauaguuugcuu

SEQ ID NO: 1119931 - RNA, 20 nt, Homo sapiens
aucgaucuguacuguaauuu

SEQ ID NO: 1119932 - RNA, 20 nt, Homo sapiens
aucgcugccuugccaugucu

SEQ ID NO: 1119933 - RNA, 16 nt, Homo sapiens
aucgggccaucucaga

SEQ ID NO: 1119934 - RNA, 17 nt, Homo sapiens
aucguuguuuacagugu

SEQ ID NO: 1119935 - RNA, 22 nt, Homo sapiens
aucuacaaaaaacaacaaauaa

SEQ ID NO: 1119936 - RNA, 23 nt, Homo sapiens
aucuagaggcuuccuucauuucc

SEQ ID NO: 1119937 - RNA, 17 nt, Homo sapiens
aucuaucaauagucaag

SEQ ID NO: 1119938 - RNA, 13 nt, Homo sapiens
aucuaugcaauuu

SEQ ID NO: 1119939 - RNA, 17 nt, Homo sapiens
aucuauuauaaaaccau

SEQ ID NO: 1119940 - RNA, 16 nt, Homo sapiens
aucuauuuccuuucca

SEQ ID NO: 1119941 - RNA, 20 nt, Homo sapiens
aucucaugagugccaagcaa

SEQ ID NO: 1119942 - RNA, 16 nt, Homo sapiens
aucucauggcagcuaa

SEQ ID NO: 1119943 - RNA, 12 nt, Homo sapiens
aucuccaaggac

SEQ ID NO: 1119944 - RNA, 23 nt, Homo sapiens
aucucccuagccugcuuuugucc

SEQ ID NO: 1119945 - RNA, 23 nt, Homo sapiens
aucucuaauuggaagaaauuccu

SEQ ID NO: 1119946 - RNA, 13 nt, Homo sapiens
aucucugucucaa

SEQ ID NO: 1119947 - RNA, 19 nt, Homo sapiens
aucucuucuuuuaaaccau

SEQ ID NO: 1119948 - RNA, 21 nt, Homo sapiens
gagcugaauuaccuuucacuu

SEQ ID NO: 1119949 - RNA, 18 nt, Homo sapiens
gagcuucaguauaaaaga

SEQ ID NO: 1119950 - RNA, 23 nt, Homo sapiens
gaggaagggcaaaaccacuagaa

SEQ ID NO: 1119951 - RNA, 18 nt, Homo sapiens
gaggacacuaaccacgcu

SEQ ID NO: 1119952 - RNA, 22 nt, Homo sapiens
gaggacauucuggaaaagcaaa

SEQ ID NO: 1119953 - RNA, 17 nt, Homo sapiens
gaggacuuuucuuugug

SEQ ID NO: 1119954 - RNA, 14 nt, Homo sapiens
gaggagaucagggc

SEQ ID NO: 1119955 - RNA, 13 nt, Homo sapiens
gaggaucacugga

SEQ ID NO: 1119956 - RNA, 15 nt, Homo sapiens
gaggaugcaacaaau

SEQ ID NO: 1119957 - RNA, 15 nt, Homo sapiens
gaggcaaaggccagc

SEQ ID NO: 1119958 - RNA, 14 nt, Homo sapiens
gaggcaagaaccag

SEQ ID NO: 1119959 - RNA, 15 nt, Homo sapiens
gaggcaagaaccagu

SEQ ID NO: 1119960 - RNA, 18 nt, Homo sapiens
gaggcagacagcagcuca

SEQ ID NO: 1119961 - RNA, 19 nt, Homo sapiens
gaggcggguggaucacuug

SEQ ID NO: 1119962 - RNA, 16 nt, Homo sapiens
gaggcugaggcaagag

SEQ ID NO: 1119963 - RNA, 16 nt, Homo sapiens
gagggaggagaaugag

SEQ ID NO: 1119964 - RNA, 20 nt, Homo sapiens
gagggcaaacccaaaaccuc

SEQ ID NO: 1119965 - RNA, 16 nt, Homo sapiens
gagggcaggugcccuc

SEQ ID NO: 1119966 - RNA, 15 nt, Homo sapiens
gagggcugccugaaa

SEQ ID NO: 1119967 - RNA, 12 nt, Homo sapiens
gaggguugcuau

SEQ ID NO: 1119968 - RNA, 16 nt, Homo sapiens
gaggucacauucagga

SEQ ID NO: 1119969 - RNA, 17 nt, Homo sapiens
gaggucgggauggggcu

SEQ ID NO: 1119970 - RNA, 16 nt, Homo sapiens
gaggugagaccaccuc

SEQ ID NO: 1119971 - RNA, 18 nt, Homo sapiens
gaggugggcagcagcuca

SEQ ID NO: 1119972 - RNA, 20 nt, Homo sapiens
gagguggggcuggaugucuc

SEQ ID NO: 1119973 - RNA, 15 nt, Homo sapiens
gaguaauaugccugc

SEQ ID NO: 1119974 - RNA, 22 nt, Homo sapiens
gaguaccaugaggguugcuauu

SEQ ID NO: 1119975 - RNA, 11 nt, Homo sapiens
gagucacugac

SEQ ID NO: 1119976 - RNA, 18 nt, Homo sapiens
gagucuccucucugagac

SEQ ID NO: 1119977 - RNA, 22 nt, Homo sapiens
gagugacggucccacacuggug

SEQ ID NO: 1119978 - RNA, 19 nt, Homo sapiens
gagugcaguuuccaauccc

SEQ ID NO: 1119979 - RNA, 14 nt, Homo sapiens
gaguggaucuccaa

SEQ ID NO: 1119980 - RNA, 20 nt, Homo sapiens
gagugucaccagcugccaaa

SEQ ID NO: 1119981 - RNA, 20 nt, Homo sapiens
gaguguggcuuaguaauaga

SEQ ID NO: 1119982 - RNA, 17 nt, Homo sapiens
gaguuacuuccuaucaa

SEQ ID NO: 1119983 - RNA, 17 nt, Homo sapiens
gaguucagcaaagagug

SEQ ID NO: 1119984 - RNA, 23 nt, Homo sapiens
gaguuccaugaagaccacaucca

SEQ ID NO: 1119985 - RNA, 19 nt, Homo sapiens
gaguucgaggcugcaguca

SEQ ID NO: 1119986 - RNA, 22 nt, Homo sapiens
gaguugagucuccucucugaga

SEQ ID NO: 1119987 - RNA, 17 nt, Homo sapiens
gaguugugaucauccca

SEQ ID NO: 1119988 - RNA, 18 nt, Homo sapiens
gaguuguggaaagccucu

SEQ ID NO: 1119989 - RNA, 23 nt, Homo sapiens
gaguuugaaggaggugagggaug

SEQ ID NO: 1119990 - RNA, 19 nt, Homo sapiens
gauaaacacagagguuuua

SEQ ID NO: 1119991 - RNA, 16 nt, Homo sapiens
gauaaauuccacugga

SEQ ID NO: 1119992 - RNA, 22 nt, Homo sapiens
gauaacaaaaucacaagcaaua

SEQ ID NO: 1119993 - RNA, 15 nt, Homo sapiens
gauaacugagaauuu

SEQ ID NO: 1119994 - RNA, 15 nt, Homo sapiens
gauaaucagccucuu

SEQ ID NO: 1119995 - RNA, 19 nt, Homo sapiens
gauaaucgagucuaccucu

SEQ ID NO: 1119996 - RNA, 20 nt, Homo sapiens
gauaaucgagucuaccucuu

SEQ ID NO: 1119997 - RNA, 21 nt, Homo sapiens
gauaaucucuuuaaauggcuu

SEQ ID NO: 1119998 - RNA, 16 nt, Homo sapiens
gauacagaaugaaucc

SEQ ID NO: 1119999 - RNA, 19 nt, Homo sapiens
gauacaggaaaagcugcug

SEQ ID NO: 1120000 - RNA, 20 nt, Homo sapiens
gauacccaaguuauugggau

SEQ ID NO: 1120001 - RNA, 15 nt, Homo sapiens
gauaguccaaagacu

SEQ ID NO: 1120002 - RNA, 13 nt, Homo sapiens
gauaguuuugcca

SEQ ID NO: 1120003 - RNA, 20 nt, Homo sapiens
gauauaugacuuuuucucag

SEQ ID NO: 1120004 - RNA, 18 nt, Homo sapiens
gauauauuucauucucuu

SEQ ID NO: 1120005 - RNA, 17 nt, Homo sapiens
gauaucugaacacauac

SEQ ID NO: 1120006 - RNA, 22 nt, Homo sapiens
gauaucugaacacauacuagaa

SEQ ID NO: 1120007 - RNA, 22 nt, Homo sapiens
gauauuucccaauacauaccac

SEQ ID NO: 1120008 - RNA, 23 nt, Homo sapiens
gaucacagggccccagaaggcag

SEQ ID NO: 1120009 - RNA, 19 nt, Homo sapiens
gauccacaaaaacaacuua

SEQ ID NO: 1120010 - RNA, 14 nt, Homo sapiens
gauccacugugcag

SEQ ID NO: 1120011 - RNA, 16 nt, Homo sapiens
gauccucccaccucag

SEQ ID NO: 1120012 - RNA, 20 nt, Homo sapiens
gaucgcgccacugcacuccg

SEQ ID NO: 1120013 - RNA, 20 nt, Homo sapiens
gaucguauuaauuaucugau

SEQ ID NO: 1120014 - RNA, 16 nt, Homo sapiens
gcauaaguuucuggga

SEQ ID NO: 1120015 - RNA, 21 nt, Homo sapiens
gcauaaguuucugggaccuca

SEQ ID NO: 1120016 - RNA, 14 nt, Homo sapiens
gcauaccugcuggu

SEQ ID NO: 1120017 - RNA, 12 nt, Homo sapiens
gcauaccuuuau

SEQ ID NO: 1120018 - RNA, 16 nt, Homo sapiens
gcauagcaagacacau

SEQ ID NO: 1120019 - RNA, 15 nt, Homo sapiens
gcauauauacauaua

SEQ ID NO: 1120020 - RNA, 14 nt, Homo sapiens
gcauccugcagugg

SEQ ID NO: 1120021 - RNA, 14 nt, Homo sapiens
gcaucuacacagcc

SEQ ID NO: 1120022 - RNA, 23 nt, Homo sapiens
gcaucugggauucccaccaaggu

SEQ ID NO: 1120023 - RNA, 17 nt, Homo sapiens
gcaugagaaucacuuga

SEQ ID NO: 1120024 - RNA, 15 nt, Homo sapiens
gcaugcucagcccuu

SEQ ID NO: 1120025 - RNA, 21 nt, Homo sapiens
gcaugcuuaaauauugaauaa

SEQ ID NO: 1120026 - RNA, 24 nt, Homo sapiens
gcauguaugucuuggacacuguac

SEQ ID NO: 1120027 - RNA, 12 nt, Homo sapiens
gcauguccucaa

SEQ ID NO: 1120028 - RNA, 18 nt, Homo sapiens
gcaugucucaauaguaaa

SEQ ID NO: 1120029 - RNA, 15 nt, Homo sapiens
gcauguugccaugag

SEQ ID NO: 1120030 - RNA, 17 nt, Homo sapiens
gcauuaaauuuuagcaa

SEQ ID NO: 1120031 - RNA, 13 nt, Homo sapiens
gcauuagcuacuu

SEQ ID NO: 1120032 - RNA, 15 nt, Homo sapiens
gcauucacaucucau

SEQ ID NO: 1120033 - RNA, 22 nt, Homo sapiens
gcauuuauggucaacacuuaag

SEQ ID NO: 1120034 - RNA, 15 nt, Homo sapiens
gcauuucugucucuc

SEQ ID NO: 1120035 - RNA, 13 nt, Homo sapiens
gcauuuuacuacu

SEQ ID NO: 1120036 - RNA, 15 nt, Homo sapiens
gcauuuuuaaauaca

SEQ ID NO: 1120037 - RNA, 15 nt, Homo sapiens
gcauuuuuugcaagu

SEQ ID NO: 1120038 - RNA, 14 nt, Homo sapiens
gccaacauggugaa

SEQ ID NO: 1120039 - RNA, 16 nt, Homo sapiens
gccaagagaauauccg

SEQ ID NO: 1120040 - RNA, 23 nt, Homo sapiens
gccaaggugggguauuuaccaca

SEQ ID NO: 1120041 - RNA, 18 nt, Homo sapiens
gccaaucuucaguauuuu

SEQ ID NO: 1120042 - RNA, 12 nt, Homo sapiens
gccaauuuacuu

SEQ ID NO: 1120043 - RNA, 14 nt, Homo sapiens
gccacacacuguuc

SEQ ID NO: 1120044 - RNA, 19 nt, Homo sapiens
gccacacccuccccauuca

SEQ ID NO: 1120045 - RNA, 12 nt, Homo sapiens
gccacaccuguc

SEQ ID NO: 1120046 - RNA, 21 nt, Homo sapiens
gccacagcuggugguaucuga

SEQ ID NO: 1120047 - RNA, 16 nt, Homo sapiens
gccacaucccuuugaa

SEQ ID NO: 1120048 - RNA, 17 nt, Homo sapiens
gccacauggcugggauu

SEQ ID NO: 1120049 - RNA, 22 nt, Homo sapiens
gccaccacccuacuucauuuuc

SEQ ID NO: 1120050 - RNA, 15 nt, Homo sapiens
gccaccauccugcag

SEQ ID NO: 1120051 - RNA, 24 nt, Homo sapiens
gccaccgggacagaccuggacacu

SEQ ID NO: 1120052 - RNA, 14 nt, Homo sapiens
gccagaaaacauau

SEQ ID NO: 1120053 - RNA, 19 nt, Homo sapiens
gccagaaaacauaugcauu

SEQ ID NO: 1120054 - RNA, 21 nt, Homo sapiens
gccagagccuggggcauccca

SEQ ID NO: 1120055 - RNA, 22 nt, Homo sapiens
gccagauuuuuuaaaauuuaua

SEQ ID NO: 1120056 - RNA, 21 nt, Homo sapiens
gccaggacaugcagcccagaa

SEQ ID NO: 1120057 - RNA, 15 nt, Homo sapiens
gccaggccaccagga

SEQ ID NO: 1120058 - RNA, 22 nt, Homo sapiens
gccauauucuguuggccagugu

SEQ ID NO: 1120059 - RNA, 14 nt, Homo sapiens
gccaucaugugccu

SEQ ID NO: 1120060 - RNA, 19 nt, Homo sapiens
gccauguaccaguguacug

SEQ ID NO: 1120061 - RNA, 13 nt, Homo sapiens
gccauuuguacug

SEQ ID NO: 1120062 - RNA, 13 nt, Homo sapiens
gcccaaacauaaa

SEQ ID NO: 1120063 - RNA, 15 nt, Homo sapiens
gcccaaauccagugu

SEQ ID NO: 1120064 - RNA, 17 nt, Homo sapiens
gcccaaggcaguguucc

SEQ ID NO: 1120065 - RNA, 16 nt, Homo sapiens
gcccacagggaccaag

SEQ ID NO: 1120066 - RNA, 19 nt, Homo sapiens
gcccacgugugcagacugu

SEQ ID NO: 1120067 - RNA, 14 nt, Homo sapiens
gcccacuacgugcc

SEQ ID NO: 1120068 - RNA, 16 nt, Homo sapiens
gcccacuucugccaua

SEQ ID NO: 1120069 - RNA, 19 nt, Homo sapiens
gcccagaauucccagcugu

SEQ ID NO: 1120070 - RNA, 19 nt, Homo sapiens
gcccagaauugcauucuga

SEQ ID NO: 1120071 - RNA, 11 nt, Homo sapiens
gcccagcacug

SEQ ID NO: 1120072 - RNA, 21 nt, Homo sapiens
gcccagccuccaagcuccauc

SEQ ID NO: 1120073 - RNA, 14 nt, Homo sapiens
gcccagcugcaccu

SEQ ID NO: 1120074 - RNA, 16 nt, Homo sapiens
gcccagcugcaccugc

SEQ ID NO: 1120075 - RNA, 17 nt, Homo sapiens
gcccaggcaggucuuga

SEQ ID NO: 1120076 - RNA, 20 nt, Homo sapiens
gcccaggcuggcgugcagug

SEQ ID NO: 1120077 - RNA, 17 nt, Homo sapiens
gcccaggcuggucuuga

SEQ ID NO: 1120078 - RNA, 14 nt, Homo sapiens
gcccagugcacuug

SEQ ID NO: 1120079 - RNA, 18 nt, Homo sapiens
gcccaguuggguggaugc

SEQ ID NO: 1120080 - RNA, 22 nt, Homo sapiens
gccccacuucucuacucuggaa

SEQ ID NO: 1120081 - RNA, 18 nt, Homo sapiens
gccccagaaggcagggaa

SEQ ID NO: 1120082 - RNA, 17 nt, Homo sapiens
gcccccaccuggcucac

SEQ ID NO: 1120083 - RNA, 16 nt, Homo sapiens
gccccugcacaaagcc

SEQ ID NO: 1120084 - RNA, 22 nt, Homo sapiens
gccccuuacuaugaucucagga

SEQ ID NO: 1120085 - RNA, 18 nt, Homo sapiens
gccccuucuccucugggg

SEQ ID NO: 1120086 - RNA, 18 nt, Homo sapiens
gcccgacaggcaugcacc

SEQ ID NO: 1120087 - RNA, 20 nt, Homo sapiens
gcccgucauguuccucaaaa

SEQ ID NO: 1120088 - RNA, 16 nt, Homo sapiens
gcccucauccauuuau

SEQ ID NO: 1120089 - RNA, 11 nt, Homo sapiens
gcccugaccuc

SEQ ID NO: 1120090 - RNA, 13 nt, Homo sapiens
gcccugcacagau

SEQ ID NO: 1120091 - RNA, 14 nt, Homo sapiens
gcccuggauccauc

SEQ ID NO: 1120092 - RNA, 15 nt, Homo sapiens
gcccuucccacugga

SEQ ID NO: 1120093 - RNA, 21 nt, Homo sapiens
gcccuucccacuggaggucac

SEQ ID NO: 1120094 - RNA, 17 nt, Homo sapiens
gcccuucuuucuacccu

SEQ ID NO: 1120095 - RNA, 21 nt, Homo sapiens
gcccuugcccugaccucccag

SEQ ID NO: 1120096 - RNA, 22 nt, Homo sapiens
gccggcaaccccaguucugcuc

SEQ ID NO: 1120097 - RNA, 23 nt, Homo sapiens
gccggcaaccccaguucugcucc

SEQ ID NO: 1120098 - RNA, 23 nt, Homo sapiens
gccuagauccacacacagaggaa

SEQ ID NO: 1120099 - RNA, 19 nt, Homo sapiens
gccuagcaggcacaggaca

SEQ ID NO: 1120100 - RNA, 12 nt, Homo sapiens
gccuaggguaca

SEQ ID NO: 1120101 - RNA, 19 nt, Homo sapiens
gccucaacaacguaaacuu

SEQ ID NO: 1120102 - RNA, 19 nt, Homo sapiens
gccucaagaugaaggcaaa

SEQ ID NO: 1120103 - RNA, 14 nt, Homo sapiens
uacaagcgugagcc

SEQ ID NO: 1120104 - RNA, 23 nt, Homo sapiens
uacaauaacauaauuuguacaua

SEQ ID NO: 1120105 - RNA, 16 nt, Homo sapiens
uacaaucucaaauucu

SEQ ID NO: 1120106 - RNA, 20 nt, Homo sapiens
uacaaugacaaguaugauga

SEQ ID NO: 1120107 - RNA, 14 nt, Homo sapiens
uacacauguaucua

SEQ ID NO: 1120108 - RNA, 18 nt, Homo sapiens
uacacauguaucuaugca

SEQ ID NO: 1120109 - RNA, 20 nt, Homo sapiens
uacaccugaggcugaggcag

SEQ ID NO: 1120110 - RNA, 16 nt, Homo sapiens
uacacucaaacaauca

SEQ ID NO: 1120111 - RNA, 13 nt, Homo sapiens
uacagaacaaaga

SEQ ID NO: 1120112 - RNA, 15 nt, Homo sapiens
uacagagaaucugaa

SEQ ID NO: 1120113 - RNA, 18 nt, Homo sapiens
uacagauagucaaaccau

SEQ ID NO: 1120114 - RNA, 13 nt, Homo sapiens
uacagaugcagcc

SEQ ID NO: 1120115 - RNA, 20 nt, Homo sapiens
uacagcagaaaggagaacua

SEQ ID NO: 1120116 - RNA, 19 nt, Homo sapiens
uacaggccauacuuuacaa

SEQ ID NO: 1120117 - RNA, 17 nt, Homo sapiens
uacaggugugagucacc

SEQ ID NO: 1120118 - RNA, 15 nt, Homo sapiens
uacauaacuugauau

SEQ ID NO: 1120119 - RNA, 20 nt, Homo sapiens
uacauacaggccauacuuua

SEQ ID NO: 1120120 - RNA, 15 nt, Homo sapiens
uacauaguacauaca

SEQ ID NO: 1120121 - RNA, 16 nt, Homo sapiens
uacauaguacauacaa

SEQ ID NO: 1120122 - RNA, 15 nt, Homo sapiens
uacauaugugaauau

SEQ ID NO: 1120123 - RNA, 21 nt, Homo sapiens
uacauauuucuuugccuuuau

SEQ ID NO: 1120124 - RNA, 17 nt, Homo sapiens
uacauccagaaagaagg

SEQ ID NO: 1120125 - RNA, 20 nt, Homo sapiens
uacaugcauuacugcaugca

SEQ ID NO: 1120126 - RNA, 24 nt, Homo sapiens
uacauucccuaucaaaacauauca

SEQ ID NO: 1120127 - RNA, 19 nt, Homo sapiens
uacauucuuuaucuugaca

SEQ ID NO: 1120128 - RNA, 15 nt, Homo sapiens
uacauuuuccaaauc

SEQ ID NO: 1120129 - RNA, 16 nt, Homo sapiens
uaccaaaaaaguauuu

SEQ ID NO: 1120130 - RNA, 10 nt, Homo sapiens
uaccaaauau

SEQ ID NO: 1120131 - RNA, 18 nt, Homo sapiens
uaccaaguguguugggaa

SEQ ID NO: 1120132 - RNA, 12 nt, Homo sapiens
uaccacaguguc

SEQ ID NO: 1120133 - RNA, 18 nt, Homo sapiens
uaccacagugucuguauc

SEQ ID NO: 1120134 - RNA, 15 nt, Homo sapiens
uaccacuaugcaaua

SEQ ID NO: 1120135 - RNA, 12 nt, Homo sapiens
uaccagcucacu

SEQ ID NO: 1120136 - RNA, 19 nt, Homo sapiens
uacccauagcuuccaugag

SEQ ID NO: 1120137 - RNA, 17 nt, Homo sapiens
uaccccaccucaugccu

SEQ ID NO: 1120138 - RNA, 21 nt, Homo sapiens
uacccuucuuuaaaucaaaag

SEQ ID NO: 1120139 - RNA, 14 nt, Homo sapiens
uaccucacuggggu

SEQ ID NO: 1120140 - RNA, 16 nt, Homo sapiens
uaccucuucaguaggu

SEQ ID NO: 1120141 - RNA, 22 nt, Homo sapiens
uaccuucaauaaaguaucuaca

SEQ ID NO: 1120142 - RNA, 16 nt, Homo sapiens
uacuaaaaauacagaa

SEQ ID NO: 1120143 - RNA, 17 nt, Homo sapiens
uacuaaaaaucaugaga

SEQ ID NO: 1120144 - RNA, 23 nt, Homo sapiens
uacucaaggaauuugcauuuagu

SEQ ID NO: 1120145 - RNA, 18 nt, Homo sapiens
uacugacugaugacaaac

SEQ ID NO: 1120146 - RNA, 20 nt, Homo sapiens
uacugagacaugacuaggaa

SEQ ID NO: 1120147 - RNA, 17 nt, Homo sapiens
uacugaugauguagaua

SEQ ID NO: 1120148 - RNA, 14 nt, Homo sapiens
uacugcuguaaaua

SEQ ID NO: 1120149 - RNA, 18 nt, Homo sapiens
uacuguaauagugugauu

SEQ ID NO: 1120150 - RNA, 16 nt, Homo sapiens
uacuguuccaaaaaga

SEQ ID NO: 1120151 - RNA, 19 nt, Homo sapiens
uacuuaauggguacaaugu

SEQ ID NO: 1120152 - RNA, 22 nt, Homo sapiens
uacuucaacacuucauguauug

SEQ ID NO: 1120153 - RNA, 14 nt, Homo sapiens
uacuuguggacaca

SEQ ID NO: 1120154 - RNA, 12 nt, Homo sapiens
uacuuuaccucc

SEQ ID NO: 1120155 - RNA, 22 nt, Homo sapiens
uagaaacugaggccauuauuuc

SEQ ID NO: 1120156 - RNA, 19 nt, Homo sapiens
uagaaauguauccugauaa

SEQ ID NO: 1120157 - RNA, 18 nt, Homo sapiens
uagaaauuggcuggaugu

SEQ ID NO: 1120158 - RNA, 17 nt, Homo sapiens
uagaagaaagggcaaga

SEQ ID NO: 1120159 - RNA, 19 nt, Homo sapiens
uagaagagccugacugugu

SEQ ID NO: 1120160 - RNA, 21 nt, Homo sapiens
uagaagagccugacuguguuc

SEQ ID NO: 1120161 - RNA, 23 nt, Homo sapiens
uagaagagccugacuguguucag

SEQ ID NO: 1120162 - RNA, 15 nt, Homo sapiens
uagaagcaucacagg

SEQ ID NO: 1120163 - RNA, 20 nt, Homo sapiens
uagaaggguaccuugaacac

SEQ ID NO: 1120164 - RNA, 15 nt, Homo sapiens
uagaagucucuucca

SEQ ID NO: 1120165 - RNA, 17 nt, Homo sapiens
uagaauauuuauuaccu

SEQ ID NO: 1120166 - RNA, 23 nt, Homo sapiens
uagaauauuuauuaccucugaua

SEQ ID NO: 1120167 - RNA, 14 nt, Homo sapiens
uagaaugauucccu

SEQ ID NO: 1120168 - RNA, 13 nt, Homo sapiens
uagacuagugcuu

SEQ ID NO: 1120169 - RNA, 23 nt, Homo sapiens
uagacuauaagcagaagcacaua

SEQ ID NO: 1120170 - RNA, 19 nt, Homo sapiens
uagagaaauuugccaauuu

SEQ ID NO: 1120171 - RNA, 14 nt, Homo sapiens
uagagacucaaaga

SEQ ID NO: 1120172 - RNA, 21 nt, Homo sapiens
uagagccagcccauggcuuua

SEQ ID NO: 1120173 - RNA, 13 nt, Homo sapiens
uagaguguuauca

SEQ ID NO: 1120174 - RNA, 23 nt, Homo sapiens
uagauaaccuguacuucaaguua

SEQ ID NO: 1120175 - RNA, 15 nt, Homo sapiens
uagauuaaacaaaca

SEQ ID NO: 1120176 - RNA, 13 nt, Homo sapiens
uagcaaaagaaga

SEQ ID NO: 1120177 - RNA, 16 nt, Homo sapiens
uagcaaagauaucuca

SEQ ID NO: 1120178 - RNA, 20 nt, Homo sapiens
uagcaauguaacauuaauuc

SEQ ID NO: 1120179 - RNA, 17 nt, Homo sapiens
uagcacuauuuacauac

SEQ ID NO: 1120180 - RNA, 13 nt, Homo sapiens
uagcacugggaac

SEQ ID NO: 1120181 - RNA, 23 nt, Homo sapiens
uagcagaaguauaaagugaucag

SEQ ID NO: 1120182 - RNA, 15 nt, Homo sapiens
uagcaucucaugagu

SEQ ID NO: 1120183 - RNA, 18 nt, Homo sapiens
uagccaucucucuacucc

SEQ ID NO: 1120184 - RNA, 14 nt, Homo sapiens
uagcccagcacugu

SEQ ID NO: 1120185 - RNA, 22 nt, Homo sapiens
uagccucgccgucugugaauug

SEQ ID NO: 1120186 - RNA, 18 nt, Homo sapiens
uagcuaccucacuaugcu

SEQ ID NO: 1120187 - RNA, 22 nt, Homo sapiens
uagcuaccucacuaugcugcuu

SEQ ID NO: 1120188 - RNA, 17 nt, Homo sapiens
uagcuagaagugggcca

SEQ ID NO: 1120189 - RNA, 17 nt, Homo sapiens
uagcucuggaccagccu

SEQ ID NO: 1120190 - RNA, 17 nt, Homo sapiens
uagcucuggugaccuug

SEQ ID NO: 1120191 - RNA, 18 nt, Homo sapiens
uagcucuguccacucuga

SEQ ID NO: 1120192 - RNA, 23 nt, Homo sapiens
uaacacauuaucgggagcagugu

SEQ ID NO: 1120193 - RNA, 17 nt, Homo sapiens
uaacacucagaagccug

SEQ ID NO: 1120194 - RNA, 15 nt, Homo sapiens
uaacagaccacugua

SEQ ID NO: 1120195 - RNA, 18 nt, Homo sapiens
uaacaggucuccucuuaa

SEQ ID NO: 1120196 - RNA, 15 nt, Homo sapiens
uaacccucucuuccc

SEQ ID NO: 1120197 - RNA, 17 nt, Homo sapiens
uaaccguuuuucaagaa

SEQ ID NO: 1120198 - RNA, 19 nt, Homo sapiens
uaacuacuuuuuauacucc

SEQ ID NO: 1120199 - RNA, 13 nt, Homo sapiens
uaacuagaucucc

SEQ ID NO: 1120200 - RNA, 11 nt, Homo sapiens
uaacuauucaa

SEQ ID NO: 1120201 - RNA, 16 nt, Homo sapiens
uaacucaucugucacc

SEQ ID NO: 1120202 - RNA, 22 nt, Homo sapiens
uaacuguagauaaagugguuug

SEQ ID NO: 1120203 - RNA, 13 nt, Homo sapiens
uaacuuauaucau

SEQ ID NO: 1120204 - RNA, 22 nt, Homo sapiens
uaagaaaucauggcauucacac

SEQ ID NO: 1120205 - RNA, 23 nt, Homo sapiens
uaagaacuugauauauuucauuc

SEQ ID NO: 1120206 - RNA, 20 nt, Homo sapiens
uaagaagaaugcuuaaucag

SEQ ID NO: 1120207 - RNA, 18 nt, Homo sapiens
uaagaccauaacagccaa

SEQ ID NO: 1120208 - RNA, 16 nt, Homo sapiens
uaagacgaaugauuua

SEQ ID NO: 1120209 - RNA, 13 nt, Homo sapiens
uaagaguuacuua

SEQ ID NO: 1120210 - RNA, 15 nt, Homo sapiens
uaagaguuguaugaa

SEQ ID NO: 1120211 - RNA, 22 nt, Homo sapiens
uaagcaucaaauauuugugcaa

SEQ ID NO: 1120212 - RNA, 15 nt, Homo sapiens
uaagcaucuguguaa

SEQ ID NO: 1120213 - RNA, 19 nt, Homo sapiens
uaagccacguuaaguccaa

SEQ ID NO: 1120214 - RNA, 19 nt, Homo sapiens
uaagcccccuacugagaaa

SEQ ID NO: 1120215 - RNA, 17 nt, Homo sapiens
uaagccuuuugcucaca

SEQ ID NO: 1120216 - RNA, 21 nt, Homo sapiens
uaagcuaucuucaaaugucua

SEQ ID NO: 1120217 - RNA, 17 nt, Homo sapiens
uaagcucuuuaugacug

SEQ ID NO: 1120218 - RNA, 15 nt, Homo sapiens
uaaggauugugauau

SEQ ID NO: 1120219 - RNA, 20 nt, Homo sapiens
uaagggaaggaacucuggcu

SEQ ID NO: 1120220 - RNA, 20 nt, Homo sapiens
uaaggucacauugugccuuu

SEQ ID NO: 1120221 - RNA, 21 nt, Homo sapiens
uaaguaauugcauuucugcuc

SEQ ID NO: 1120222 - RNA, 14 nt, Homo sapiens
uaaguaauuuugcc

SEQ ID NO: 1120223 - RNA, 15 nt, Homo sapiens
uaaguauguuugaau

SEQ ID NO: 1120224 - RNA, 20 nt, Homo sapiens
uaagugggguugcaaccacu

SEQ ID NO: 1120225 - RNA, 18 nt, Homo sapiens
uaagugguauauacauau

SEQ ID NO: 1120226 - RNA, 13 nt, Homo sapiens
uaauaaacauccu

SEQ ID NO: 1120227 - RNA, 17 nt, Homo sapiens
uaauaaacauccuucaa

SEQ ID NO: 1120228 - RNA, 13 nt, Homo sapiens
uaauaaaucugag

SEQ ID NO: 1120229 - RNA, 14 nt, Homo sapiens
uaauaaguacugug

SEQ ID NO: 1120230 - RNA, 17 nt, Homo sapiens
uaauaauuaugugccau

SEQ ID NO: 1120231 - RNA, 13 nt, Homo sapiens
uaauaauuuuccu

SEQ ID NO: 1120232 - RNA, 21 nt, Homo sapiens
uaauaucugagaaguguauau

SEQ ID NO: 1120233 - RNA, 22 nt, Homo sapiens
uaaucagggaggucauuuuggu

SEQ ID NO: 1120234 - RNA, 20 nt, Homo sapiens
uaauccagagauaauugcca

SEQ ID NO: 1120235 - RNA, 17 nt, Homo sapiens
uaaucgagucuaccucu

SEQ ID NO: 1120236 - RNA, 18 nt, Homo sapiens
uaaucgagucuaccucuu

SEQ ID NO: 1120237 - RNA, 15 nt, Homo sapiens
uaaucuaauacacuu

SEQ ID NO: 1120238 - RNA, 14 nt, Homo sapiens
uaaucuccacuguu

SEQ ID NO: 1120239 - RNA, 16 nt, Homo sapiens
uaaucuggacuccucu

SEQ ID NO: 1120240 - RNA, 13 nt, Homo sapiens
uaaucuguagggc

SEQ ID NO: 1120241 - RNA, 21 nt, Homo sapiens
uaaucuuaaauuuauuagaua

SEQ ID NO: 1120242 - RNA, 15 nt, Homo sapiens
uaaugaaaaugucag

SEQ ID NO: 1120243 - RNA, 14 nt, Homo sapiens
uaaugaaacaaaga

SEQ ID NO: 1120244 - RNA, 14 nt, Homo sapiens
uaaugaacauguga

SEQ ID NO: 1120245 - RNA, 15 nt, Homo sapiens
uaaugaacugugaca

SEQ ID NO: 1120246 - RNA, 16 nt, Homo sapiens
uaaugaagacccagug

SEQ ID NO: 1120247 - RNA, 17 nt, Homo sapiens
uaaugaagacccagugu

SEQ ID NO: 1120248 - RNA, 18 nt, Homo sapiens
uaaugacaaaggcacuga

SEQ ID NO: 1120249 - RNA, 21 nt, Homo sapiens
uaaugagccguugugcuccag

SEQ ID NO: 1120250 - RNA, 11 nt, Homo sapiens
uaaugagggac

SEQ ID NO: 1120251 - RNA, 21 nt, Homo sapiens
uaaugcuuuccucccuggcau

SEQ ID NO: 1120252 - RNA, 21 nt, Homo sapiens
uaauggaaacauuuacaauaa

SEQ ID NO: 1120253 - RNA, 21 nt, Homo sapiens
uaauguauuuguuugcaauuu

SEQ ID NO: 1120254 - RNA, 21 nt, Homo sapiens
uaauuaaaaaguuaaucuuca

SEQ ID NO: 1120255 - RNA, 21 nt, Homo sapiens
uaauuaaacaagugcacuuga

SEQ ID NO: 1120256 - RNA, 23 nt, Homo sapiens
uaauuaaacaagugcacuugaac

SEQ ID NO: 1120257 - RNA, 15 nt, Homo sapiens
uaauuaaacaugauc

SEQ ID NO: 1120258 - RNA, 21 nt, Homo sapiens
uaauuacauccagaaagaagg

SEQ ID NO: 1120259 - RNA, 22 nt, Homo sapiens
uaauuacauccagaaagaagga

SEQ ID NO: 1120260 - RNA, 17 nt, Homo sapiens
uaauuagaacaauagcu

SEQ ID NO: 1120261 - RNA, 15 nt, Homo sapiens
uaauuaggaucuaug

SEQ ID NO: 1120262 - RNA, 17 nt, Homo sapiens
uaauuaggaucuaugca

SEQ ID NO: 1120263 - RNA, 20 nt, Homo sapiens
uaauuaucgggaacaguguu

SEQ ID NO: 1120264 - RNA, 18 nt, Homo sapiens
uaauucaacauauaccuu

SEQ ID NO: 1120265 - RNA, 16 nt, Homo sapiens
uaauucucaugugauc

SEQ ID NO: 1120266 - RNA, 15 nt, Homo sapiens
uaauugaacuaacaa

SEQ ID NO: 1120267 - RNA, 13 nt, Homo sapiens
uaauugauuucaa

SEQ ID NO: 1120268 - RNA, 21 nt, Homo sapiens
uaauuggaagaaauuccugua

SEQ ID NO: 1120269 - RNA, 13 nt, Homo sapiens
uaauuguguacaa

SEQ ID NO: 1120270 - RNA, 14 nt, Homo sapiens
uaauuuaaugcaug

SEQ ID NO: 1120271 - RNA, 21 nt, Homo sapiens
uaauuuaucuugucucugggc

SEQ ID NO: 1120272 - RNA, 17 nt, Homo sapiens
uagcugagcgugguggc

SEQ ID NO: 1120273 - RNA, 23 nt, Homo sapiens
uagcugcuuuaaaucuaucuaua

SEQ ID NO: 1120274 - RNA, 15 nt, Homo sapiens
uagcugggacuacag

SEQ ID NO: 1120275 - RNA, 16 nt, Homo sapiens
uagcugggacuacagg

SEQ ID NO: 1120276 - RNA, 17 nt, Homo sapiens
uagcugggacuacaggu

SEQ ID NO: 1120277 - RNA, 18 nt, Homo sapiens
uagcugggacuacaggug

SEQ ID NO: 1120278 - RNA, 18 nt, Homo sapiens
uagcugguucacacugac

SEQ ID NO: 1120279 - RNA, 16 nt, Homo sapiens
uagcuuuagggcaaua

SEQ ID NO: 1120280 - RNA, 21 nt, Homo sapiens
uaggagacagucucaagcacu

SEQ ID NO: 1120281 - RNA, 23 nt, Homo sapiens
uaggagacagucucaagcacuaa

SEQ ID NO: 1120282 - RNA, 15 nt, Homo sapiens
uaggagacuaaugga

SEQ ID NO: 1120283 - RNA, 16 nt, Homo sapiens
uaggagcaauacuauu

SEQ ID NO: 1120284 - RNA, 13 nt, Homo sapiens
uaggggcaaaaau

SEQ ID NO: 1120285 - RNA, 20 nt, Homo sapiens
uagguuuacauucaucucau

SEQ ID NO: 1120286 - RNA, 14 nt, Homo sapiens
uaguaacauagaca

SEQ ID NO: 1120287 - RNA, 19 nt, Homo sapiens
uaguaacuuuccauagggc

SEQ ID NO: 1120288 - RNA, 18 nt, Homo sapiens
uaguagcagagucauugu

SEQ ID NO: 1120289 - RNA, 21 nt, Homo sapiens
uagucacauggccuaugcaca

SEQ ID NO: 1120290 - RNA, 18 nt, Homo sapiens
uaguccuauucuauugca

SEQ ID NO: 1120291 - RNA, 23 nt, Homo sapiens
uagugaaguucuuuuacuguaau

SEQ ID NO: 1120292 - RNA, 20 nt, Homo sapiens
uagugcuuuaccuuuauuaa

SEQ ID NO: 1120293 - RNA, 16 nt, Homo sapiens
uaguguccgaagaccg

SEQ ID NO: 1120294 - RNA, 19 nt, Homo sapiens
uaguguuggaaaaugugca

SEQ ID NO: 1120295 - RNA, 13 nt, Homo sapiens
uaguuaaaguaau

SEQ ID NO: 1120296 - RNA, 14 nt, Homo sapiens
uaguuaaaguaaug

SEQ ID NO: 1120297 - RNA, 18 nt, Homo sapiens
uaguuuuaagacugaaga

SEQ ID NO: 1120298 - RNA, 16 nt, Homo sapiens
uaguuuuaguugcaga

SEQ ID NO: 1120299 - RNA, 23 nt, Homo sapiens
uaguuuugauccuaaaucugccu

SEQ ID NO: 1120300 - RNA, 22 nt, Homo sapiens
uaguuuuuaccuaccacagugu

SEQ ID NO: 1120301 - RNA, 15 nt, Homo sapiens
uauaaaaacaaaaac

SEQ ID NO: 1120302 - RNA, 13 nt, Homo sapiens
uauaaacauuggu

SEQ ID NO: 1120303 - RNA, 23 nt, Homo sapiens
uauaaacauugguauauuuccau

SEQ ID NO: 1120304 - RNA, 18 nt, Homo sapiens
uauaaauuuguguucuca

SEQ ID NO: 1120305 - RNA, 19 nt, Homo sapiens
uauaaauuuguguucucaa

SEQ ID NO: 1120306 - RNA, 17 nt, Homo sapiens
uauaagcagaagcacau

SEQ ID NO: 1120307 - RNA, 14 nt, Homo sapiens
uauaaugguugacu

SEQ ID NO: 1120308 - RNA, 21 nt, Homo sapiens
uauacaaauuguuucuggaau

SEQ ID NO: 1120309 - RNA, 23 nt, Homo sapiens
uauacaauaaagucuuaccucag

SEQ ID NO: 1120310 - RNA, 14 nt, Homo sapiens
uauacagcucagcu

SEQ ID NO: 1120311 - RNA, 18 nt, Homo sapiens
uauacauaugacauauau

SEQ ID NO: 1120312 - RNA, 18 nt, Homo sapiens
uauacauguauagugagu

SEQ ID NO: 1120313 - RNA, 21 nt, Homo sapiens
uauagaaggguaccuugaaca

SEQ ID NO: 1120314 - RNA, 15 nt, Homo sapiens
uauagacaaauaaua

SEQ ID NO: 1120315 - RNA, 14 nt, Homo sapiens
uauagacucuagga

SEQ ID NO: 1120316 - RNA, 13 nt, Homo sapiens
uauagcugggaac

SEQ ID NO: 1120317 - RNA, 14 nt, Homo sapiens
uauagguuuccacu

SEQ ID NO: 1120318 - RNA, 20 nt, Homo sapiens
uauauaaugguuuacugcug

SEQ ID NO: 1120319 - RNA, 13 nt, Homo sapiens
uauauauauagua

SEQ ID NO: 1120320 - RNA, 17 nt, Homo sapiens
uauaucuauaguaguca

SEQ ID NO: 1120321 - RNA, 16 nt, Homo sapiens
uauauguacaguuaua

SEQ ID NO: 1120322 - RNA, 15 nt, Homo sapiens
uauauucucagugua

SEQ ID NO: 1120323 - RNA, 19 nt, Homo sapiens
uauauuuuugguugucaau

SEQ ID NO: 1120324 - RNA, 16 nt, Homo sapiens
uaucaaaacauaucaa

SEQ ID NO: 1120325 - RNA, 20 nt, Homo sapiens
uaucaaaacauaucaauuca

SEQ ID NO: 1120326 - RNA, 16 nt, Homo sapiens
uaucaaaaucacuauc

SEQ ID NO: 1120327 - RNA, 20 nt, Homo sapiens
uaucagacuguaggauuuga

SEQ ID NO: 1120328 - RNA, 14 nt, Homo sapiens
uaucagucauaacu

SEQ ID NO: 1120329 - RNA, 20 nt, Homo sapiens
uaucauccugccuucaugga

SEQ ID NO: 1120330 - RNA, 19 nt, Homo sapiens
uaucaugaaacacuucuca

SEQ ID NO: 1120331 - RNA, 22 nt, Homo sapiens
uaucauuuuuuuaacacauaac

SEQ ID NO: 1120332 - RNA, 17 nt, Homo sapiens
uauccacuuaccuagau

SEQ ID NO: 1120333 - RNA, 24 nt, Homo sapiens
uauccacuuaccuagauucuacau

SEQ ID NO: 1120334 - RNA, 16 nt, Homo sapiens
uauccugcuagcugua

SEQ ID NO: 1120335 - RNA, 20 nt, Homo sapiens
uauccugcuagcuguagaaa

SEQ ID NO: 1120336 - RNA, 12 nt, Homo sapiens
uaucucaucucu

SEQ ID NO: 1120337 - RNA, 14 nt, Homo sapiens
uaucugauuuccua

SEQ ID NO: 1120338 - RNA, 14 nt, Homo sapiens
uaucuucauacaau

SEQ ID NO: 1120339 - RNA, 13 nt, Homo sapiens
uaugaacuugagg

SEQ ID NO: 1120340 - RNA, 22 nt, Homo sapiens
uaugaaggcuguacacugcacg

SEQ ID NO: 1120341 - RNA, 19 nt, Homo sapiens
uaugacacugagcaagauc

SEQ ID NO: 1120342 - RNA, 16 nt, Homo sapiens
uaugacaucacuugua

SEQ ID NO: 1120343 - RNA, 22 nt, Homo sapiens
uaugacuguuuuuguaguggua

SEQ ID NO: 1120344 - RNA, 12 nt, Homo sapiens
uaugagggaaaa

SEQ ID NO: 1120345 - RNA, 18 nt, Homo sapiens
uaugauauugcauaugca

SEQ ID NO: 1120346 - RNA, 13 nt, Homo sapiens
uaugaucauguaa

SEQ ID NO: 1120347 - RNA, 21 nt, Homo sapiens
uaugcaauuuuuaaacuagua

SEQ ID NO: 1120348 - RNA, 18 nt, Homo sapiens
uaugccauagcaagauug

SEQ ID NO: 1120349 - RNA, 15 nt, Homo sapiens
uaugccucuguauuu

SEQ ID NO: 1120350 - RNA, 14 nt, Homo sapiens
uaugccuucacuuu

SEQ ID NO: 1120351 - RNA, 14 nt, Homo sapiens
uaugcuaacuguag

SEQ ID NO: 1120352 - RNA, 18 nt, Homo sapiens
uaugcuccaguauggaag

SEQ ID NO: 1120353 - RNA, 18 nt, Homo sapiens
uauggaaaaaaugaacuu

SEQ ID NO: 1120354 - RNA, 22 nt, Homo sapiens
uauggaaauccuguuacuuaaa

SEQ ID NO: 1120355 - RNA, 14 nt, Homo sapiens
ucaaggaauuugca

SEQ ID NO: 1120356 - RNA, 18 nt, Homo sapiens
ucaaucccagcuacucaa

SEQ ID NO: 1120357 - RNA, 16 nt, Homo sapiens
ucaauccgaaguauga

SEQ ID NO: 1120358 - RNA, 15 nt, Homo sapiens
ucaauccucuaagcu

SEQ ID NO: 1120359 - RNA, 17 nt, Homo sapiens
ucaauucagugcuguac

SEQ ID NO: 1120360 - RNA, 15 nt, Homo sapiens
ucaauuuaaauaacc

SEQ ID NO: 1120361 - RNA, 19 nt, Homo sapiens
ucaauuuucacuugcuuaa

SEQ ID NO: 1120362 - RNA, 17 nt, Homo sapiens
ucacaacauuuacuuaa

SEQ ID NO: 1120363 - RNA, 18 nt, Homo sapiens
ucacaagaagaccagacu

SEQ ID NO: 1120364 - RNA, 18 nt, Homo sapiens
ucacaauacucaaaagag

SEQ ID NO: 1120365 - RNA, 21 nt, Homo sapiens
ucacaauuccauuuccaguuc

SEQ ID NO: 1120366 - RNA, 17 nt, Homo sapiens
ucacacaccccucaaaa

SEQ ID NO: 1120367 - RNA, 21 nt, Homo sapiens
ucacacuauggcagccaucca

SEQ ID NO: 1120368 - RNA, 15 nt, Homo sapiens
ucacaguuccucgcc

SEQ ID NO: 1120369 - RNA, 18 nt, Homo sapiens
ucacauuuauucugcuca

SEQ ID NO: 1120370 - RNA, 19 nt, Homo sapiens
ucaccaggaucgcuuugua

SEQ ID NO: 1120371 - RNA, 22 nt, Homo sapiens
ucaccggagcuuucaaagaagg

SEQ ID NO: 1120372 - RNA, 16 nt, Homo sapiens
ucaccucauaugcuau

SEQ ID NO: 1120373 - RNA, 14 nt, Homo sapiens
ucacgccacugcac

SEQ ID NO: 1120374 - RNA, 14 nt, Homo sapiens
ucacguggucaagg

SEQ ID NO: 1120375 - RNA, 16 nt, Homo sapiens
ucacuauaaccaucag

SEQ ID NO: 1120376 - RNA, 19 nt, Homo sapiens
ucacuccacaacccaagaa

SEQ ID NO: 1120377 - RNA, 20 nt, Homo sapiens
ucacuuauuucauaaacaac

SEQ ID NO: 1120378 - RNA, 14 nt, Homo sapiens
ucacuucgaugacu

SEQ ID NO: 1120379 - RNA, 15 nt, Homo sapiens
ucacuuggagccagg

SEQ ID NO: 1120380 - RNA, 23 nt, Homo sapiens
ucacuuggagccaggaguuugag

SEQ ID NO: 1120381 - RNA, 18 nt, Homo sapiens
ucacuuuaaagucuuucc

SEQ ID NO: 1120382 - RNA, 22 nt, Homo sapiens
ucagaagaaagaaucuuuccau

SEQ ID NO: 1120383 - RNA, 15 nt, Homo sapiens
ucagaagacacugca

SEQ ID NO: 1120384 - RNA, 17 nt, Homo sapiens
ucagaagccuacuuuga

SEQ ID NO: 1120385 - RNA, 18 nt, Homo sapiens
ucagaaggauggcauuuu

SEQ ID NO: 1120386 - RNA, 14 nt, Homo sapiens
ucagacucaucuac

SEQ ID NO: 1120387 - RNA, 21 nt, Homo sapiens
ucagacuccugugcaacuuuc

SEQ ID NO: 1120388 - RNA, 21 nt, Homo sapiens
ucagacugcugggacuggcca

SEQ ID NO: 1120389 - RNA, 23 nt, Homo sapiens
ucagagacauacaccuaugucau

SEQ ID NO: 1120390 - RNA, 13 nt, Homo sapiens
ucagauaugauau

SEQ ID NO: 1120391 - RNA, 15 nt, Homo sapiens
ucagcagcccuccuc

SEQ ID NO: 1120392 - RNA, 20 nt, Homo sapiens
ucagccuagccgaccucagc

SEQ ID NO: 1120393 - RNA, 19 nt, Homo sapiens
ucagcuccagaauaccuuc

SEQ ID NO: 1120394 - RNA, 22 nt, Homo sapiens
ucagcuuuuaauaaaauugaca

SEQ ID NO: 1120395 - RNA, 14 nt, Homo sapiens
ucaggaaaacugac

SEQ ID NO: 1120396 - RNA, 19 nt, Homo sapiens
ucaggaagggaaagccaga

SEQ ID NO: 1120397 - RNA, 18 nt, Homo sapiens
ucaggcaaagugcugcug

SEQ ID NO: 1120398 - RNA, 18 nt, Homo sapiens
ucaggccaacaagccaac

SEQ ID NO: 1120399 - RNA, 17 nt, Homo sapiens
ucaggggccucagggga

SEQ ID NO: 1120400 - RNA, 19 nt, Homo sapiens
ucaggggccugcccagugc

SEQ ID NO: 1120401 - RNA, 19 nt, Homo sapiens
ucaggguccagacccugaa

SEQ ID NO: 1120402 - RNA, 21 nt, Homo sapiens
ucaggguuuuuagauuaaaca

SEQ ID NO: 1120403 - RNA, 15 nt, Homo sapiens
ucagugaaagccaga

SEQ ID NO: 1120404 - RNA, 20 nt, Homo sapiens
ucagugaagaugccagugaa

SEQ ID NO: 1120405 - RNA, 20 nt, Homo sapiens
ucaguggcauucacaucuca

SEQ ID NO: 1120406 - RNA, 20 nt, Homo sapiens
ucaguuucaauucagugcug

SEQ ID NO: 1120407 - RNA, 21 nt, Homo sapiens
ucauaacaauguaugugaaag

SEQ ID NO: 1120408 - RNA, 14 nt, Homo sapiens
ucauacaaugacaa

SEQ ID NO: 1120409 - RNA, 16 nt, Homo sapiens
ucauagcucacuguaa

SEQ ID NO: 1120410 - RNA, 15 nt, Homo sapiens
ucauagcugagauuc

SEQ ID NO: 1120411 - RNA, 22 nt, Homo sapiens
ucauaguggcuuaaaacaacac

SEQ ID NO: 1120412 - RNA, 14 nt, Homo sapiens
ucauauuggacuga

SEQ ID NO: 1120413 - RNA, 22 nt, Homo sapiens
ucaucaacuuauuauaugacua

SEQ ID NO: 1120414 - RNA, 20 nt, Homo sapiens
ucaucaauuuaaaaucauuc

SEQ ID NO: 1120415 - RNA, 18 nt, Homo sapiens
ucaucaauuuucacuugc

SEQ ID NO: 1120416 - RNA, 15 nt, Homo sapiens
ucaucagcauaccuu

SEQ ID NO: 1120417 - RNA, 16 nt, Homo sapiens
ucaucaggcuuggaau

SEQ ID NO: 1120418 - RNA, 19 nt, Homo sapiens
ucaucauauuguauguaag

SEQ ID NO: 1120419 - RNA, 16 nt, Homo sapiens
ucauccacugugccau

SEQ ID NO: 1120420 - RNA, 15 nt, Homo sapiens
ucaucccuaugggau

SEQ ID NO: 1120421 - RNA, 19 nt, Homo sapiens
ucauccugccuucauggaa

SEQ ID NO: 1120422 - RNA, 11 nt, Homo sapiens
ucaucucugcc

SEQ ID NO: 1120423 - RNA, 22 nt, Homo sapiens
ucaucucuucuuuuaaaccauu

SEQ ID NO: 1120424 - RNA, 16 nt, Homo sapiens
ucaucugaaaaucugg

SEQ ID NO: 1120425 - RNA, 21 nt, Homo sapiens
ucaucuuguugccauggaguu

SEQ ID NO: 1120426 - RNA, 12 nt, Homo sapiens
ucaugacaaagu

SEQ ID NO: 1120427 - RNA, 14 nt, Homo sapiens
ucaugacagccaga

SEQ ID NO: 1120428 - RNA, 18 nt, Homo sapiens
ucaugacccuccugucca

SEQ ID NO: 1120429 - RNA, 16 nt, Homo sapiens
ucaugagcacaggguc

SEQ ID NO: 1120430 - RNA, 23 nt, Homo sapiens
ucaugauuucaaugauuguuuaa

SEQ ID NO: 1120431 - RNA, 13 nt, Homo sapiens
ucaugcauuugca

SEQ ID NO: 1120432 - RNA, 14 nt, Homo sapiens
ucaugccucugagg

SEQ ID NO: 1120433 - RNA, 17 nt, Homo sapiens
ucauggcagcuaagcca

SEQ ID NO: 1120434 - RNA, 14 nt, Homo sapiens
ucauguaccaucaa

SEQ ID NO: 1120435 - RNA, 21 nt, Homo sapiens
ucauuaaaaaugaaagccaaa

SEQ ID NO: 1120436 - RNA, 13 nt, Homo sapiens
ucauuagcuguga

SEQ ID NO: 1120437 - RNA, 16 nt, Homo sapiens
ucauuagcugugauuu

SEQ ID NO: 1120438 - RNA, 16 nt, Homo sapiens
ucauucaagccuguga

SEQ ID NO: 1120439 - RNA, 13 nt, Homo sapiens
ucauuccaccuuc

SEQ ID NO: 1120440 - RNA, 14 nt, Homo sapiens
uccucuugccacug

SEQ ID NO: 1120441 - RNA, 14 nt, Homo sapiens
uccucuugcucaaa

SEQ ID NO: 1120442 - RNA, 18 nt, Homo sapiens
uccugaguggcugaaaua

SEQ ID NO: 1120443 - RNA, 14 nt, Homo sapiens
uccugauaaacauu

SEQ ID NO: 1120444 - RNA, 23 nt, Homo sapiens
uccugauaaacauuaaacacugu

SEQ ID NO: 1120445 - RNA, 23 nt, Homo sapiens
uccugcaccgagagagauggaau

SEQ ID NO: 1120446 - RNA, 21 nt, Homo sapiens
uccugcagccuccuccugacc

SEQ ID NO: 1120447 - RNA, 19 nt, Homo sapiens
uccugcaggugucuaucca

SEQ ID NO: 1120448 - RNA, 15 nt, Homo sapiens
uccugccucuacugg

SEQ ID NO: 1120449 - RNA, 18 nt, Homo sapiens
uccugccucuacugggaa

SEQ ID NO: 1120450 - RNA, 15 nt, Homo sapiens
uccugccuucaugga

SEQ ID NO: 1120451 - RNA, 12 nt, Homo sapiens
uccuggaaccaa

SEQ ID NO: 1120452 - RNA, 13 nt, Homo sapiens
uccuggaaccaau

SEQ ID NO: 1120453 - RNA, 22 nt, Homo sapiens
uccuggccccagcccccaccuc

SEQ ID NO: 1120454 - RNA, 19 nt, Homo sapiens
uccuggcuuugacaugaaa

SEQ ID NO: 1120455 - RNA, 18 nt, Homo sapiens
uccugggagaaccucagg

SEQ ID NO: 1120456 - RNA, 20 nt, Homo sapiens
uccugggagaaccucaggcu

SEQ ID NO: 1120457 - RNA, 17 nt, Homo sapiens
uccugguauuauuuaca

SEQ ID NO: 1120458 - RNA, 16 nt, Homo sapiens
uccuggugauucugau

SEQ ID NO: 1120459 - RNA, 17 nt, Homo sapiens
uccuguacgaaccccuc

SEQ ID NO: 1120460 - RNA, 15 nt, Homo sapiens
uccuucaagaacucu

SEQ ID NO: 1120461 - RNA, 20 nt, Homo sapiens
uccuuguauuuaaauauuaa

SEQ ID NO: 1120462 - RNA, 18 nt, Homo sapiens
uccuugugguuuauguca

SEQ ID NO: 1120463 - RNA, 20 nt, Homo sapiens
uccuuuaaauccuuccauga

SEQ ID NO: 1120464 - RNA, 17 nt, Homo sapiens
uccuuucagcaagacuu

SEQ ID NO: 1120465 - RNA, 16 nt, Homo sapiens
uccuuucuccagccag

SEQ ID NO: 1120466 - RNA, 23 nt, Homo sapiens
uccuuugaguuauaguuugcuuu

SEQ ID NO: 1120467 - RNA, 18 nt, Homo sapiens
uccuuugcauuccaugau

SEQ ID NO: 1120468 - RNA, 15 nt, Homo sapiens
uccuuuuguguacag

SEQ ID NO: 1120469 - RNA, 22 nt, Homo sapiens
ucgauauaugacuuuuucucag

SEQ ID NO: 1120470 - RNA, 21 nt, Homo sapiens
ucgaugccacuccugcuucuc

SEQ ID NO: 1120471 - RNA, 19 nt, Homo sapiens
ucgauuauucccuguacaa

SEQ ID NO: 1120472 - RNA, 16 nt, Homo sapiens
ucgauucaaacugcuc

SEQ ID NO: 1120473 - RNA, 16 nt, Homo sapiens
ucgcagccacccugag

SEQ ID NO: 1120474 - RNA, 18 nt, Homo sapiens
ucgcagcuuuuagaccaa

SEQ ID NO: 1120475 - RNA, 23 nt, Homo sapiens
ucggcaucgggccaucucagaua

SEQ ID NO: 1120476 - RNA, 14 nt, Homo sapiens
ucgggaacaguguu

SEQ ID NO: 1120477 - RNA, 15 nt, Homo sapiens
ucggggaacuccugg

SEQ ID NO: 1120478 - RNA, 18 nt, Homo sapiens
ucgguggccaugcuucuu

SEQ ID NO: 1120479 - RNA, 15 nt, Homo sapiens
ucgugacaacacuug

SEQ ID NO: 1120480 - RNA, 21 nt, Homo sapiens
ucguggguguguguagccaag

SEQ ID NO: 1120481 - RNA, 14 nt, Homo sapiens
ucuaaaauagccac

SEQ ID NO: 1120482 - RNA, 17 nt, Homo sapiens
ucuaaaugaagugcaaa

SEQ ID NO: 1120483 - RNA, 19 nt, Homo sapiens
ucuaaaugaagugcaaauu

SEQ ID NO: 1120484 - RNA, 12 nt, Homo sapiens
ucuaacucuccc

SEQ ID NO: 1120485 - RNA, 20 nt, Homo sapiens
ucuaagguaguaacuuucca

SEQ ID NO: 1120486 - RNA, 18 nt, Homo sapiens
ucuaagugguauauacau

SEQ ID NO: 1120487 - RNA, 15 nt, Homo sapiens
ucuaagugugcugca

SEQ ID NO: 1120488 - RNA, 15 nt, Homo sapiens
ucuaauuggcaugaa

SEQ ID NO: 1120489 - RNA, 19 nt, Homo sapiens
ucuacaaacucccacuugu

SEQ ID NO: 1120490 - RNA, 13 nt, Homo sapiens
ucuacacauauau

SEQ ID NO: 1120491 - RNA, 14 nt, Homo sapiens
ucuacagaggccau

SEQ ID NO: 1120492 - RNA, 22 nt, Homo sapiens
ucuacgcucuccuuucuuucua

SEQ ID NO: 1120493 - RNA, 17 nt, Homo sapiens
ucuacuccaugcacaua

SEQ ID NO: 1120494 - RNA, 18 nt, Homo sapiens
ucuacugcaagacuuaaa

SEQ ID NO: 1120495 - RNA, 15 nt, Homo sapiens
ucuagaacacaggca

SEQ ID NO: 1120496 - RNA, 22 nt, Homo sapiens
ucuagaacacaggcaaaauccu

SEQ ID NO: 1120497 - RNA, 15 nt, Homo sapiens
ucuagaacaugcaca

SEQ ID NO: 1120498 - RNA, 20 nt, Homo sapiens
ucuagaagcgguuuccaggc

SEQ ID NO: 1120499 - RNA, 19 nt, Homo sapiens
ucuagccugggcaacaaca

SEQ ID NO: 1120500 - RNA, 17 nt, Homo sapiens
ucuagcucuaguucaaa

SEQ ID NO: 1120501 - RNA, 18 nt, Homo sapiens
ucuaggcaucccagggga

SEQ ID NO: 1120502 - RNA, 22 nt, Homo sapiens
ucuaguccuauucuauugcagu

SEQ ID NO: 1120503 - RNA, 20 nt, Homo sapiens
ucuaguuucuugugggcuaa

SEQ ID NO: 1120504 - RNA, 13 nt, Homo sapiens
ucuauaaauaacc

SEQ ID NO: 1120505 - RNA, 21 nt, Homo sapiens
ucuauaauggaaacauuuaca

SEQ ID NO: 1120506 - RNA, 14 nt, Homo sapiens
ucuaucaauaguca

SEQ ID NO: 1120507 - RNA, 17 nt, Homo sapiens
ucuaucaauagucaaga

SEQ ID NO: 1120508 - RNA, 14 nt, Homo sapiens
ucuaugaucuuggc

SEQ ID NO: 1120509 - RNA, 12 nt, Homo sapiens
ucuaugcuuauu

SEQ ID NO: 1120510 - RNA, 16 nt, Homo sapiens
ucuauuacgugcaaua

SEQ ID NO: 1120511 - RNA, 14 nt, Homo sapiens
ucuauuauagccac

SEQ ID NO: 1120512 - RNA, 13 nt, Homo sapiens
ucuauucuaagua

SEQ ID NO: 1120513 - RNA, 13 nt, Homo sapiens
ucuauugcugcuc

SEQ ID NO: 1120514 - RNA, 16 nt, Homo sapiens
ucuauuuccuuuccag

SEQ ID NO: 1120515 - RNA, 16 nt, Homo sapiens
ucucaaaaaaagggca

SEQ ID NO: 1120516 - RNA, 18 nt, Homo sapiens
ucucaaaugcacaucuca

SEQ ID NO: 1120517 - RNA, 19 nt, Homo sapiens
ucucaaaugcacaucucau

SEQ ID NO: 1120518 - RNA, 22 nt, Homo sapiens
ucucaaauucauggugcacuga

SEQ ID NO: 1120519 - RNA, 21 nt, Homo sapiens
ucucaaauucucaaccuacca

SEQ ID NO: 1120520 - RNA, 14 nt, Homo sapiens
ucucaauaguaaaa

SEQ ID NO: 1120521 - RNA, 17 nt, Homo sapiens
ucucacuaaaauggaua

SEQ ID NO: 1120522 - RNA, 20 nt, Homo sapiens
ucucacucugucgcccaguc

SEQ ID NO: 1120523 - RNA, 16 nt, Homo sapiens
ucucacuguugcccag

SEQ ID NO: 1120524 - RNA, 23 nt, Homo sapiens
ucucacuuugccccaguuacaaa

SEQ ID NO: 1120525 - RNA, 15 nt, Homo sapiens
ucucaugagugccaa

SEQ ID NO: 1120526 - RNA, 18 nt, Homo sapiens
ucucauuuaaaaugagau

SEQ ID NO: 1120527 - RNA, 15 nt, Homo sapiens
ucucauuugucacac

SEQ ID NO: 1120528 - RNA, 18 nt, Homo sapiens
ucuccaagaauacagaaa

SEQ ID NO: 1120529 - RNA, 21 nt, Homo sapiens
ucuccccacucuaggggucag

SEQ ID NO: 1120530 - RNA, 15 nt, Homo sapiens
ucuccuggcuuccca

SEQ ID NO: 1120531 - RNA, 13 nt, Homo sapiens
ucuccuuuggcca

SEQ ID NO: 1120532 - RNA, 19 nt, Homo sapiens
ucucgcauuuucucuagcu

SEQ ID NO: 1120533 - RNA, 15 nt, Homo sapiens
ucucuaaaauagcca

SEQ ID NO: 1120534 - RNA, 23 nt, Homo sapiens
ucucuaaaauagccacuuaccuu

SEQ ID NO: 1120535 - RNA, 18 nt, Homo sapiens
ucucuaaacugcuguuaa

SEQ ID NO: 1120536 - RNA, 22 nt, Homo sapiens
ucucuaauuggaagaaauuccu

SEQ ID NO: 1120537 - RNA, 23 nt, Homo sapiens
ucucuacaaacucccacuuguca

SEQ ID NO: 1120538 - RNA, 21 nt, Homo sapiens
ucucuacuaaaaacacaaaag

SEQ ID NO: 1120539 - RNA, 20 nt, Homo sapiens
ucucuagcugaucagaauuu

SEQ ID NO: 1120540 - RNA, 14 nt, Homo sapiens
ucucugagaacaga

SEQ ID NO: 1120541 - RNA, 17 nt, Homo sapiens
ucucugaggacacuaac

SEQ ID NO: 1120542 - RNA, 23 nt, Homo sapiens
ucucugcccccagccucuguccc

SEQ ID NO: 1120543 - RNA, 16 nt, Homo sapiens
ucucugcugcauuugu

SEQ ID NO: 1120544 - RNA, 13 nt, Homo sapiens
ucucugucucaaa

SEQ ID NO: 1120545 - RNA, 16 nt, Homo sapiens
ucucuuauagaauauu

SEQ ID NO: 1120546 - RNA, 18 nt, Homo sapiens
ucucuucagaaaacccuu

SEQ ID NO: 1120547 - RNA, 21 nt, Homo sapiens
ucucuuuaaauggcuuuaugc

SEQ ID NO: 1120548 - RNA, 14 nt, Homo sapiens
ucucuuucugcaaa

SEQ ID NO: 1120549 - RNA, 18 nt, Homo sapiens
ucugaaaauuaacacugc

SEQ ID NO: 1120550 - RNA, 13 nt, Homo sapiens
ucugaagaucuca

SEQ ID NO: 1120551 - RNA, 19 nt, Homo sapiens
ucugaaggucccaccucca

SEQ ID NO: 1120552 - RNA, 15 nt, Homo sapiens
ucugacacuaccuua

SEQ ID NO: 1120553 - RNA, 20 nt, Homo sapiens
ucugacucacaagaagacca

SEQ ID NO: 1120554 - RNA, 19 nt, Homo sapiens
ucugagcaccuacuuacau

SEQ ID NO: 1120555 - RNA, 24 nt, Homo sapiens
ucugagcaccuacuuacaugcauu

SEQ ID NO: 1120556 - RNA, 16 nt, Homo sapiens
ucugagcuagugauuu

SEQ ID NO: 1120557 - RNA, 15 nt, Homo sapiens
ucugauaacagaauu

SEQ ID NO: 1120558 - RNA, 16 nt, Homo sapiens
ucugcagcuaacuuau

SEQ ID NO: 1120559 - RNA, 15 nt, Homo sapiens
ucugcaguagucucu

SEQ ID NO: 1120560 - RNA, 13 nt, Homo sapiens
ucugcccaccuac

SEQ ID NO: 1120561 - RNA, 20 nt, Homo sapiens
ucugccccagcucuggcuuc

SEQ ID NO: 1120562 - RNA, 16 nt, Homo sapiens
ucugccucccuagcuu

SEQ ID NO: 1120563 - RNA, 16 nt, Homo sapiens
ucugccugaagucaca

SEQ ID NO: 1120564 - RNA, 17 nt, Homo sapiens
ucugccuuagacaaagg

SEQ ID NO: 1120565 - RNA, 18 nt, Homo sapiens
ucugcuaccucacugggg

SEQ ID NO: 1120566 - RNA, 20 nt, Homo sapiens
ucugcucacauaucugucau

SEQ ID NO: 1120567 - RNA, 23 nt, Homo sapiens
ucugcuccccagugcuaccucuc

SEQ ID NO: 1120568 - RNA, 22 nt, Homo sapiens
ucugcucugaggcuuccagaga

SEQ ID NO: 1120569 - RNA, 15 nt, Homo sapiens
ucuggaccagccugu

SEQ ID NO: 1120570 - RNA, 17 nt, Homo sapiens
ucuggaccagccuguug

SEQ ID NO: 1120571 - RNA, 17 nt, Homo sapiens
ucuggaucuaucuguau

SEQ ID NO: 1120572 - RNA, 20 nt, Homo sapiens
ucuggccaaccaaagacacu

SEQ ID NO: 1120573 - RNA, 16 nt, Homo sapiens
ucuggcccuucuugcc

SEQ ID NO: 1120574 - RNA, 18 nt, Homo sapiens
ucuggcugaggauuucaa

SEQ ID NO: 1120575 - RNA, 17 nt, Homo sapiens
ucuggcuuuacauuuua

SEQ ID NO: 1120576 - RNA, 18 nt, Homo sapiens
ucuggcuuuacauuuuau

SEQ ID NO: 1120577 - RNA, 18 nt, Homo sapiens
ucugggauucccaccaag

SEQ ID NO: 1120578 - RNA, 17 nt, Homo sapiens
ucugggccaaguuccuc

SEQ ID NO: 1120579 - RNA, 16 nt, Homo sapiens
ucugucaccaagccuu

SEQ ID NO: 1120580 - RNA, 14 nt, Homo sapiens
ucuguccacucuga

SEQ ID NO: 1120581 - RNA, 15 nt, Homo sapiens
ucugugaggugcuga

SEQ ID NO: 1120582 - RNA, 22 nt, Homo sapiens
ucugugcaaauccuugauacug

SEQ ID NO: 1120583 - RNA, 11 nt, Homo sapiens
ucugugcagcu

SEQ ID NO: 1120584 - RNA, 23 nt, Homo sapiens
ucugugcuuugacucaccuguua

SEQ ID NO: 1120585 - RNA, 18 nt, Homo sapiens
ucuguguaaccuccacag

SEQ ID NO: 1120586 - RNA, 15 nt, Homo sapiens
ucuguuaaucaugua

SEQ ID NO: 1120587 - RNA, 13 nt, Homo sapiens
ucuguucacuuuu

SEQ ID NO: 1120588 - RNA, 18 nt, Homo sapiens
ucuguucauucacugcac

SEQ ID NO: 1120589 - RNA, 18 nt, Homo sapiens
ucuguuuuuaaaaaucau

SEQ ID NO: 1120590 - RNA, 18 nt, Homo sapiens
ucuuaaaacacuuuucaa

SEQ ID NO: 1120591 - RNA, 14 nt, Homo sapiens
ucuuaacuauucaa

SEQ ID NO: 1120592 - RNA, 16 nt, Homo sapiens
ucuuagaaguggacca

SEQ ID NO: 1120593 - RNA, 13 nt, Homo sapiens
ucuuagugucacu

SEQ ID NO: 1120594 - RNA, 16 nt, Homo sapiens
ucuuauuuaacuuaac

SEQ ID NO: 1120595 - RNA, 16 nt, Homo sapiens
ucuucagaagacacug

SEQ ID NO: 1120596 - RNA, 12 nt, Homo sapiens
ucuucagccuag

SEQ ID NO: 1120597 - RNA, 21 nt, Homo sapiens
ucuucaggguguuaaggcagu

SEQ ID NO: 1120598 - RNA, 22 nt, Homo sapiens
ucuucaggguguuaaggcagug

SEQ ID NO: 1120599 - RNA, 14 nt, Homo sapiens
ucuuccuaccaaau

SEQ ID NO: 1120600 - RNA, 23 nt, Homo sapiens
ucuucugccccagcuuugcagga

SEQ ID NO: 1120601 - RNA, 15 nt, Homo sapiens
ucuucuuagcaccac

SEQ ID NO: 1120602 - RNA, 14 nt, Homo sapiens
ucuugaaacaagca

SEQ ID NO: 1120603 - RNA, 21 nt, Homo sapiens
ucuugaacugguugugaauaa

SEQ ID NO: 1120604 - RNA, 21 nt, Homo sapiens
ucuugaagggcaggugcuuca

SEQ ID NO: 1120605 - RNA, 12 nt, Homo sapiens
ucuugacauuca

SEQ ID NO: 1120606 - RNA, 20 nt, Homo sapiens
ucuugacauucaaggcauuu

SEQ ID NO: 1120607 - RNA, 15 nt, Homo sapiens
ucuugaggccaggag

SEQ ID NO: 1120608 - RNA, 22 nt, Homo sapiens
ucuugaguucuggaagggacuu

SEQ ID NO: 1120609 - RNA, 13 nt, Homo sapiens
ucuugcagaucaa

SEQ ID NO: 1120610 - RNA, 19 nt, Homo sapiens
uuucuuuaccugagaccag

SEQ ID NO: 1120611 - RNA, 13 nt, Homo sapiens
uuucuuuccucag

SEQ ID NO: 1120612 - RNA, 16 nt, Homo sapiens
uuucuuuuaucacgau

SEQ ID NO: 1120613 - RNA, 18 nt, Homo sapiens
uuugaagcaucacauaaa

SEQ ID NO: 1120614 - RNA, 21 nt, Homo sapiens
uuugaaugaguuuauauggaa

SEQ ID NO: 1120615 - RNA, 13 nt, Homo sapiens
uuugaauggugca

SEQ ID NO: 1120616 - RNA, 17 nt, Homo sapiens
uuugaauugacugagac

SEQ ID NO: 1120617 - RNA, 22 nt, Homo sapiens
uuugacucaugaacuauuuaca

SEQ ID NO: 1120618 - RNA, 18 nt, Homo sapiens
uuugagaauaugaucaug

SEQ ID NO: 1120619 - RNA, 21 nt, Homo sapiens
uuugagacgguguaccagcag

SEQ ID NO: 1120620 - RNA, 17 nt, Homo sapiens
uuugagauaaugucaaa

SEQ ID NO: 1120621 - RNA, 16 nt, Homo sapiens
uuugaguaauucuagc

SEQ ID NO: 1120622 - RNA, 14 nt, Homo sapiens
uuugcagacaggca

SEQ ID NO: 1120623 - RNA, 17 nt, Homo sapiens
uuugcagcugugccaua

SEQ ID NO: 1120624 - RNA, 15 nt, Homo sapiens
uuugcauuccaugau

SEQ ID NO: 1120625 - RNA, 15 nt, Homo sapiens
uuugcauugugugag

SEQ ID NO: 1120626 - RNA, 18 nt, Homo sapiens
uuugccauccuaggcuua

SEQ ID NO: 1120627 - RNA, 16 nt, Homo sapiens
uuugcccaccagauca

SEQ ID NO: 1120628 - RNA, 23 nt, Homo sapiens
uuugcgcugguggaccacaggca

SEQ ID NO: 1120629 - RNA, 14 nt, Homo sapiens
uuugcuaucaaaau

SEQ ID NO: 1120630 - RNA, 22 nt, Homo sapiens
uuugcucuuagcugucugcuca

SEQ ID NO: 1120631 - RNA, 14 nt, Homo sapiens
uuugcugccaaaca

SEQ ID NO: 1120632 - RNA, 19 nt, Homo sapiens
uuuggaagaggacuccuua

SEQ ID NO: 1120633 - RNA, 20 nt, Homo sapiens
uuuggagacggccaagugaa

SEQ ID NO: 1120634 - RNA, 19 nt, Homo sapiens
uuuggggacuuguagggau

SEQ ID NO: 1120635 - RNA, 15 nt, Homo sapiens
uuuggguaacuucaa

SEQ ID NO: 1120636 - RNA, 18 nt, Homo sapiens
uuugguaggcuuaucaaa

SEQ ID NO: 1120637 - RNA, 17 nt, Homo sapiens
uuugguuaccaauuuaa

SEQ ID NO: 1120638 - RNA, 19 nt, Homo sapiens
uuugguucucuccaggaag

SEQ ID NO: 1120639 - RNA, 14 nt, Homo sapiens
uucuuauuugcaau

SEQ ID NO: 1120640 - RNA, 13 nt, Homo sapiens
uucuuccaucuga

SEQ ID NO: 1120641 - RNA, 13 nt, Homo sapiens
uucuucuauucca

SEQ ID NO: 1120642 - RNA, 16 nt, Homo sapiens
uucuucuuagcaccac

SEQ ID NO: 1120643 - RNA, 22 nt, Homo sapiens
uucuucuucagaagacacugca

SEQ ID NO: 1120644 - RNA, 15 nt, Homo sapiens
uucuuuaucuugaca

SEQ ID NO: 1120645 - RNA, 23 nt, Homo sapiens
uucuuuccucuuccccuugcccu

SEQ ID NO: 1120646 - RNA, 15 nt, Homo sapiens
uucuuuuaaaccauu

SEQ ID NO: 1120647 - RNA, 16 nt, Homo sapiens
uugaaaacucacagaa

SEQ ID NO: 1120648 - RNA, 14 nt, Homo sapiens
uugaaaauguucag

SEQ ID NO: 1120649 - RNA, 16 nt, Homo sapiens
uugaaauaccagugaa

SEQ ID NO: 1120650 - RNA, 18 nt, Homo sapiens
uugaaauuugccuugagu

SEQ ID NO: 1120651 - RNA, 20 nt, Homo sapiens
uugaacugauucacaucuca

SEQ ID NO: 1120652 - RNA, 12 nt, Homo sapiens
uugaacuuggaa

SEQ ID NO: 1120653 - RNA, 21 nt, Homo sapiens
uugaagagauuucaacauauc

SEQ ID NO: 1120654 - RNA, 22 nt, Homo sapiens
uugaagagauuucaacauauca

SEQ ID NO: 1120655 - RNA, 17 nt, Homo sapiens
uugaagaucccuauuau

SEQ ID NO: 1120656 - RNA, 21 nt, Homo sapiens
uugaagaucccuauuauggga

SEQ ID NO: 1120657 - RNA, 23 nt, Homo sapiens
uugaagauggauguuugucaaaa

SEQ ID NO: 1120658 - RNA, 19 nt, Homo sapiens
uugaaguaggacuuuccua

SEQ ID NO: 1120659 - RNA, 16 nt, Homo sapiens
uugaauauaaacacua

SEQ ID NO: 1120660 - RNA, 17 nt, Homo sapiens
uugaaugacguguccua

SEQ ID NO: 1120661 - RNA, 19 nt, Homo sapiens
uugacaaagaaacccaagu

SEQ ID NO: 1120662 - RNA, 17 nt, Homo sapiens
uugacaaccaugagacc

SEQ ID NO: 1120663 - RNA, 16 nt, Homo sapiens
uugacugcuuggaacu

SEQ ID NO: 1120664 - RNA, 23 nt, Homo sapiens
uugacugucacuguuccuuguca

SEQ ID NO: 1120665 - RNA, 17 nt, Homo sapiens
uugagaaagccuucaua

SEQ ID NO: 1120666 - RNA, 23 nt, Homo sapiens
uugagaguauauuauguauuuau

SEQ ID NO: 1120667 - RNA, 15 nt, Homo sapiens
uugagcuccccaaaa

SEQ ID NO: 1120668 - RNA, 17 nt, Homo sapiens
uugaggacacaugucca

SEQ ID NO: 1120669 - RNA, 17 nt, Homo sapiens
uugaggauuuugaucca

SEQ ID NO: 1120670 - RNA, 15 nt, Homo sapiens
uugagggguggaccc

SEQ ID NO: 1120671 - RNA, 18 nt, Homo sapiens
uugagguuuucugugcuu

SEQ ID NO: 1120672 - RNA, 18 nt, Homo sapiens
uugaguaauucuagcuuu

SEQ ID NO: 1120673 - RNA, 16 nt, Homo sapiens
uugauaguauugugca

SEQ ID NO: 1120674 - RNA, 12 nt, Homo sapiens
uugauauacuuu

SEQ ID NO: 1120675 - RNA, 15 nt, Homo sapiens
uugauuucauuaaua

SEQ ID NO: 1120676 - RNA, 20 nt, Homo sapiens
uugcaacaagacaaagcaaa

SEQ ID NO: 1120677 - RNA, 19 nt, Homo sapiens
uugcaagauuuaacacuaa

SEQ ID NO: 1120678 - RNA, 14 nt, Homo sapiens
uugcaauggcagcc

SEQ ID NO: 1120679 - RNA, 20 nt, Homo sapiens
uugcacaagcuuguauauac

SEQ ID NO: 1120680 - RNA, 19 nt, Homo sapiens
uugcauauaaaaugcuuua

SEQ ID NO: 1120681 - RNA, 19 nt, Homo sapiens
uugccauuaaacuuaccug

SEQ ID NO: 1120682 - RNA, 19 nt, Homo sapiens
uugccuaauaaacauccuu

SEQ ID NO: 1120683 - RNA, 13 nt, Homo sapiens
uugcggacagcca

SEQ ID NO: 1120684 - RNA, 17 nt, Homo sapiens
uugcguggacucugcac

SEQ ID NO: 1120685 - RNA, 14 nt, Homo sapiens
uugcuaugaagcgu

SEQ ID NO: 1120686 - RNA, 14 nt, Homo sapiens
uugcuccuugacau

SEQ ID NO: 1120687 - RNA, 15 nt, Homo sapiens
uuggaaaaugugcaa

SEQ ID NO: 1120688 - RNA, 23 nt, Homo sapiens
uuggaaaugcuacaaacauauca

SEQ ID NO: 1120689 - RNA, 14 nt, Homo sapiens
uuggaauacuaaaa

SEQ ID NO: 1120690 - RNA, 16 nt, Homo sapiens
uuggacauuuucuuca

SEQ ID NO: 1120691 - RNA, 21 nt, Homo sapiens
uuggacugauaaucucuuuaa

SEQ ID NO: 1120692 - RNA, 11 nt, Homo sapiens
uuggagccagg

SEQ ID NO: 1120693 - RNA, 24 nt, Homo sapiens
uuggagccaggaguuugagaccag

SEQ ID NO: 1120694 - RNA, 17 nt, Homo sapiens
uuggagggugucccaaa

SEQ ID NO: 1120695 - RNA, 15 nt, Homo sapiens
uuggcacugagauau

SEQ ID NO: 1120696 - RNA, 21 nt, Homo sapiens
uuggcagugugucacacugag

SEQ ID NO: 1120697 - RNA, 21 nt, Homo sapiens
uuggccgugguccagcucuug

SEQ ID NO: 1120698 - RNA, 17 nt, Homo sapiens
uuggcgggcagcccagc

SEQ ID NO: 1120699 - RNA, 20 nt, Homo sapiens
uuaguauuauuguugcauua

SEQ ID NO: 1120700 - RNA, 22 nt, Homo sapiens
uuaguauuauuguugcauuaaa

SEQ ID NO: 1120701 - RNA, 15 nt, Homo sapiens
uuaguuuuuuccaca

SEQ ID NO: 1120702 - RNA, 14 nt, Homo sapiens
uuauaauauacuau

SEQ ID NO: 1120703 - RNA, 16 nt, Homo sapiens
uuauacuccauacaua

SEQ ID NO: 1120704 - RNA, 19 nt, Homo sapiens
uuauacuguggcuaugcaa

SEQ ID NO: 1120705 - RNA, 17 nt, Homo sapiens
uuauagguuuccacugc

SEQ ID NO: 1120706 - RNA, 19 nt, Homo sapiens
uuauauauuaugucauuca

SEQ ID NO: 1120707 - RNA, 14 nt, Homo sapiens
uuauaucagccuga

SEQ ID NO: 1120708 - RNA, 20 nt, Homo sapiens
uuauaucaucagcauaccuu

SEQ ID NO: 1120709 - RNA, 18 nt, Homo sapiens
uuauaucuguggucuuca

SEQ ID NO: 1120710 - RNA, 20 nt, Homo sapiens
uuauaugaaauguuucacua

SEQ ID NO: 1120711 - RNA, 16 nt, Homo sapiens
uuauauuacacuacac

SEQ ID NO: 1120712 - RNA, 15 nt, Homo sapiens
uuaucuuggacugac

SEQ ID NO: 1120713 - RNA, 15 nt, Homo sapiens
uuaucuugucucugg

SEQ ID NO: 1120714 - RNA, 14 nt, Homo sapiens
uuaugaaaaagaag

SEQ ID NO: 1120715 - RNA, 22 nt, Homo sapiens
uuaugacuguuuuuguaguggu

SEQ ID NO: 1120716 - RNA, 17 nt, Homo sapiens
uuaugccuucacuuuac

SEQ ID NO: 1120717 - RNA, 23 nt, Homo sapiens
uuauguauuugaaaacucacaga

SEQ ID NO: 1120718 - RNA, 22 nt, Homo sapiens
uuaugucaucauacaugacuca

SEQ ID NO: 1120719 - RNA, 12 nt, Homo sapiens
uuaugugcaaua

SEQ ID NO: 1120720 - RNA, 14 nt, Homo sapiens
uuauguuagcauug

SEQ ID NO: 1120721 - RNA, 18 nt, Homo sapiens
uuauuaauuaaacaagug

SEQ ID NO: 1120722 - RNA, 18 nt, Homo sapiens
uuauugguguuuacccag

SEQ ID NO: 1120723 - RNA, 14 nt, Homo sapiens
uuauuguugcauua

SEQ ID NO: 1120724 - RNA, 14 nt, Homo sapiens
uuauuuauauauga

SEQ ID NO: 1120725 - RNA, 21 nt, Homo sapiens
uucaaaaauacucacauggcu

SEQ ID NO: 1120726 - RNA, 14 nt, Homo sapiens
uucaaaacauugug

SEQ ID NO: 1120727 - RNA, 22 nt, Homo sapiens
uucaaaacauugugccauguca

SEQ ID NO: 1120728 - RNA, 18 nt, Homo sapiens
uucaaaguuaauuuuccc

SEQ ID NO: 1120729 - RNA, 15 nt, Homo sapiens
uucgugacaacaugc

SEQ ID NO: 1120730 - RNA, 23 nt, Homo sapiens
uucuaaaugaauguuuacacucu

SEQ ID NO: 1120731 - RNA, 21 nt, Homo sapiens
uucuaacuagaaaucugccaa

SEQ ID NO: 1120732 - RNA, 16 nt, Homo sapiens
uucuaacuccagugaa

SEQ ID NO: 1120733 - RNA, 21 nt, Homo sapiens
uucuaaguggaaaaaguauua

SEQ ID NO: 1120734 - RNA, 21 nt, Homo sapiens
uucuaauauuuuuagcucugu

SEQ ID NO: 1120735 - RNA, 22 nt, Homo sapiens
uucuacacaguaaaaacuugua

SEQ ID NO: 1120736 - RNA, 11 nt, Homo sapiens
uucuaggcauc

SEQ ID NO: 1120737 - RNA, 15 nt, Homo sapiens
uucuaggucuguaau

SEQ ID NO: 1120738 - RNA, 16 nt, Homo sapiens
uucucacacuauggca

SEQ ID NO: 1120739 - RNA, 16 nt, Homo sapiens
uucucaccauuugagu

SEQ ID NO: 1120740 - RNA, 22 nt, Homo sapiens
uucucaguaaauauuaaccuga

SEQ ID NO: 1120741 - RNA, 14 nt, Homo sapiens
uucuccaaaugaga

SEQ ID NO: 1120742 - RNA, 22 nt, Homo sapiens
uucuccuguugcaaugacacau

SEQ ID NO: 1120743 - RNA, 15 nt, Homo sapiens
uucucuauugcugcu

SEQ ID NO: 1120744 - RNA, 16 nt, Homo sapiens
uucucuauugcugcuc

SEQ ID NO: 1120745 - RNA, 13 nt, Homo sapiens
uucucucucuggu

SEQ ID NO: 1120746 - RNA, 18 nt, Homo sapiens
uucugaaacuucauaaau

SEQ ID NO: 1120747 - RNA, 14 nt, Homo sapiens
uucugaagaucuca

SEQ ID NO: 1120748 - RNA, 22 nt, Homo sapiens
uucugauuugaagguauaaccu

SEQ ID NO: 1120749 - RNA, 21 nt, Homo sapiens
uucugccuccauucugaccau

SEQ ID NO: 1120750 - RNA, 13 nt, Homo sapiens
uucugcucacaua

SEQ ID NO: 1120751 - RNA, 16 nt, Homo sapiens
uucuggaaaagcaaaa

SEQ ID NO: 1120752 - RNA, 12 nt, Homo sapiens
uucuggcuuuac

SEQ ID NO: 1120753 - RNA, 13 nt, Homo sapiens
uucugggacacag

SEQ ID NO: 1120754 - RNA, 16 nt, Homo sapiens
uucugggacacaguuc

SEQ ID NO: 1120755 - RNA, 15 nt, Homo sapiens
uucuguucaucuuaa

SEQ ID NO: 1120756 - RNA, 22 nt, Homo sapiens
uucuguuugaaugcggaaccau

SEQ ID NO: 1120757 - RNA, 21 nt, Homo sapiens
uucuuaaacaaauguaugauu

SEQ ID NO: 1120758 - RNA, 15 nt, Homo sapiens
uuuaaaaaacuaaaa

SEQ ID NO: 1120759 - RNA, 15 nt, Homo sapiens
uuuaaaaccaugcag

SEQ ID NO: 1120760 - RNA, 14 nt, Homo sapiens
uuuaaaauagcaaa

SEQ ID NO: 1120761 - RNA, 24 nt, Homo sapiens
uuuaaaauuaaaugcauguccuca

SEQ ID NO: 1120762 - RNA, 12 nt, Homo sapiens
uuuaaacaguga

SEQ ID NO: 1120763 - RNA, 16 nt, Homo sapiens
uuuaaacuauaagcaa

SEQ ID NO: 1120764 - RNA, 16 nt, Homo sapiens
uuuaacauuuaucuaa

SEQ ID NO: 1120765 - RNA, 16 nt, Homo sapiens
uuuaacccucucuucc

SEQ ID NO: 1120766 - RNA, 22 nt, Homo sapiens
uuuaagaagaaauacccacuaa

SEQ ID NO: 1120767 - RNA, 15 nt, Homo sapiens
uuuaaguauauagua

SEQ ID NO: 1120768 - RNA, 17 nt, Homo sapiens
uuuaaguauauaguaua

SEQ ID NO: 1120769 - RNA, 20 nt, Homo sapiens
uuuaagucucugacucuugc

SEQ ID NO: 1120770 - RNA, 14 nt, Homo sapiens
uuuaauagcaaaga

SEQ ID NO: 1120771 - RNA, 22 nt, Homo sapiens
uuuaaugaagacccaguguaaa

SEQ ID NO: 1120772 - RNA, 17 nt, Homo sapiens
uuuaaugccuuccacau

SEQ ID NO: 1120773 - RNA, 12 nt, Homo sapiens
uuuacaaaguau

SEQ ID NO: 1120774 - RNA, 17 nt, Homo sapiens
uuuacaaaguauuugcu

SEQ ID NO: 1120775 - RNA, 10 nt, Homo sapiens
uuuacauuca

SEQ ID NO: 1120776 - RNA, 11 nt, Homo sapiens
uuuacauucau

SEQ ID NO: 1120777 - RNA, 17 nt, Homo sapiens
uuuaccugagaccaguu

SEQ ID NO: 1120778 - RNA, 15 nt, Homo sapiens
uuuacgacugaagaa

SEQ ID NO: 1120779 - RNA, 20 nt, Homo sapiens
uuuacuaauccaacccauga

SEQ ID NO: 1120780 - RNA, 16 nt, Homo sapiens
uuuacugaugauguag

SEQ ID NO: 1120781 - RNA, 21 nt, Homo sapiens
uuuagaagagccugacugugu

SEQ ID NO: 1120782 - RNA, 15 nt, Homo sapiens
uuuagaguaugcaag

SEQ ID NO: 1120783 - RNA, 22 nt, Homo sapiens
uuuagaguaugcaagaagaaua

SEQ ID NO: 1120784 - RNA, 13 nt, Homo sapiens
uuuaggaagcaag

SEQ ID NO: 1120785 - RNA, 19 nt, Homo sapiens
uuuaggaagcaagcuuaau

SEQ ID NO: 1120786 - RNA, 16 nt, Homo sapiens
uuuauaaauggacaaa

SEQ ID NO: 1120787 - RNA, 17 nt, Homo sapiens
uuuauacauaucagaaa

SEQ ID NO: 1120788 - RNA, 15 nt, Homo sapiens
uuuauauauuauguc

SEQ ID NO: 1120789 - RNA, 15 nt, Homo sapiens
uuuauaucuauagua

SEQ ID NO: 1120790 - RNA, 12 nt, Homo sapiens
uuuaucaucucg

SEQ ID NO: 1120791 - RNA, 17 nt, Homo sapiens
uuuaucuugucucuggg

SEQ ID NO: 1120792 - RNA, 21 nt, Homo sapiens
uuuaugucaucauacaugacu

SEQ ID NO: 1120793 - RNA, 18 nt, Homo sapiens
uuuaugugcucuccaaau

SEQ ID NO: 1120794 - RNA, 13 nt, Homo sapiens
uuuauugccauga

SEQ ID NO: 1120795 - RNA, 15 nt, Homo sapiens
uuuauugugaucuau

SEQ ID NO: 1120796 - RNA, 23 nt, Homo sapiens
uuucaaagaaggaauucuaggca

SEQ ID NO: 1120797 - RNA, 19 nt, Homo sapiens
uuucaaagauguguugcua

SEQ ID NO: 1120798 - RNA, 17 nt, Homo sapiens
uuucacauaaacacaua

SEQ ID NO: 1120799 - RNA, 14 nt, Homo sapiens
uuucacuaugauuu

SEQ ID NO: 1120800 - RNA, 17 nt, Homo sapiens
uuucagauaaacaacaa

SEQ ID NO: 1120801 - RNA, 18 nt, Homo sapiens
uuucaguauaauuuaacu

SEQ ID NO: 1120802 - RNA, 17 nt, Homo sapiens
uuucaguugacaaaaua

SEQ ID NO: 1120803 - RNA, 15 nt, Homo sapiens
uuucaucuaauguga

SEQ ID NO: 1120804 - RNA, 15 nt, Homo sapiens
uuucauugauaugaa

SEQ ID NO: 1120805 - RNA, 18 nt, Homo sapiens
uuucauuguguucucuau

SEQ ID NO: 1120806 - RNA, 17 nt, Homo sapiens
uuuccaagggucuuccu

SEQ ID NO: 1120807 - RNA, 22 nt, Homo sapiens
uuuccacaagauucccagagac

SEQ ID NO: 1120808 - RNA, 18 nt, Homo sapiens
uuuccaggggccucccaa

SEQ ID NO: 1120809 - RNA, 14 nt, Homo sapiens
uuuccauagucaca

SEQ ID NO: 1120810 - RNA, 17 nt, Homo sapiens
uuuccauuuaguaacag

SEQ ID NO: 1120811 - RNA, 14 nt, Homo sapiens
uuuccccagugugg

SEQ ID NO: 1120812 - RNA, 18 nt, Homo sapiens
uuuccuuuguaaguuccu

SEQ ID NO: 1120813 - RNA, 19 nt, Homo sapiens
uuucuaaagcucugaacaa

SEQ ID NO: 1120814 - RNA, 12 nt, Homo sapiens
uuucuacccagc

SEQ ID NO: 1120815 - RNA, 16 nt, Homo sapiens
uuucuucaugcaauga

SEQ ID NO: 1120816 - RNA, 12 nt, Homo sapiens
uuucuugccuca

SEQ ID NO: 1120817 - RNA, 13 nt, Homo sapiens
uuucuugccucau

SEQ ID NO: 1120818 - RNA, 22 nt, Homo sapiens
uuucuuuaauaguuuugauccu

SEQ ID NO: 1120819 - RNA, 22 nt, Homo sapiens
acaggguuuugccauguuggcc

SEQ ID NO: 1120820 - RNA, 13 nt, Homo sapiens
acaggugugaacc

SEQ ID NO: 1120821 - RNA, 16 nt, Homo sapiens
acaguaaaaacuugua

SEQ ID NO: 1120822 - RNA, 17 nt, Homo sapiens
acaguaacugccaucaa

SEQ ID NO: 1120823 - RNA, 22 nt, Homo sapiens
acaguccugggagaaccucagg

SEQ ID NO: 1120824 - RNA, 14 nt, Homo sapiens
acagucucugggag

SEQ ID NO: 1120825 - RNA, 19 nt, Homo sapiens
acaguguugaaaauguuca

SEQ ID NO: 1120826 - RNA, 16 nt, Homo sapiens
acaguuaacuuucaga

SEQ ID NO: 1120827 - RNA, 16 nt, Homo sapiens
acaguuccuucagcuu

SEQ ID NO: 1120828 - RNA, 15 nt, Homo sapiens
acauaaacacauaca

SEQ ID NO: 1120829 - RNA, 22 nt, Homo sapiens
acauaacacuauaaagguugac

SEQ ID NO: 1120830 - RNA, 12 nt, Homo sapiens
acauaagacaga

SEQ ID NO: 1120831 - RNA, 21 nt, Homo sapiens
acauaagacagacagcaguuu

SEQ ID NO: 1120832 - RNA, 22 nt, Homo sapiens
acauacaccuaugucauuucau

SEQ ID NO: 1120833 - RNA, 19 nt, Homo sapiens
acauacaggccauacuuua

SEQ ID NO: 1120834 - RNA, 22 nt, Homo sapiens
acauaccucucucuauauauac

SEQ ID NO: 1120835 - RNA, 19 nt, Homo sapiens
acauaucaauucaacacau

SEQ ID NO: 1120836 - RNA, 14 nt, Homo sapiens
acauaugacauaua

SEQ ID NO: 1120837 - RNA, 23 nt, Homo sapiens
acauauucuaguguaacacugca

SEQ ID NO: 1120838 - RNA, 16 nt, Homo sapiens
acaucacaacauuuac

SEQ ID NO: 1120839 - RNA, 20 nt, Homo sapiens
acaucacuuguacaaaauaa

SEQ ID NO: 1120840 - RNA, 21 nt, Homo sapiens
acauccaaccccccaccugcc

SEQ ID NO: 1120841 - RNA, 18 nt, Homo sapiens
acaucugugucucuggaa

SEQ ID NO: 1120842 - RNA, 19 nt, Homo sapiens
acaugaacagaaacaauaa

SEQ ID NO: 1120843 - RNA, 23 nt, Homo sapiens
acaugaauugcauuuuacuuuaa

SEQ ID NO: 1120844 - RNA, 17 nt, Homo sapiens
acaugcagcucugauga

SEQ ID NO: 1120845 - RNA, 17 nt, Homo sapiens
acaugcauuacugcaug

SEQ ID NO: 1120846 - RNA, 14 nt, Homo sapiens
acauggccuaugca

SEQ ID NO: 1120847 - RNA, 16 nt, Homo sapiens
acauggccuaugcaca

SEQ ID NO: 1120848 - RNA, 21 nt, Homo sapiens
acauggccuaugcacauaugg

SEQ ID NO: 1120849 - RNA, 20 nt, Homo sapiens
acaugggugugccaggcuag

SEQ ID NO: 1120850 - RNA, 18 nt, Homo sapiens
acaugugacacauaugca

SEQ ID NO: 1120851 - RNA, 19 nt, Homo sapiens
acauguguagccugugcau

SEQ ID NO: 1120852 - RNA, 16 nt, Homo sapiens
acauuaaacacuguaa

SEQ ID NO: 1120853 - RNA, 16 nt, Homo sapiens
acauuaauucuacuaa

SEQ ID NO: 1120854 - RNA, 14 nt, Homo sapiens
acauuaucaucuga

SEQ ID NO: 1120855 - RNA, 22 nt, Homo sapiens
acauuaucaucugaaaaucugg

SEQ ID NO: 1120856 - RNA, 21 nt, Homo sapiens
acauucaaggcauuucuauca

SEQ ID NO: 1120857 - RNA, 20 nt, Homo sapiens
acauuccaaugcauugcuaa

SEQ ID NO: 1120858 - RNA, 15 nt, Homo sapiens
acauuccacagugcc

SEQ ID NO: 1120859 - RNA, 17 nt, Homo sapiens
acauucccuaucaaaac

SEQ ID NO: 1120860 - RNA, 13 nt, Homo sapiens
acauugguauauu

SEQ ID NO: 1120861 - RNA, 20 nt, Homo sapiens
acauuguuugucugucuuca

SEQ ID NO: 1120862 - RNA, 20 nt, Homo sapiens
acauuucccuccugggagag

SEQ ID NO: 1120863 - RNA, 21 nt, Homo sapiens
acauuucuuaaaauguuucau

SEQ ID NO: 1120864 - RNA, 22 nt, Homo sapiens
acauuugguauauuaccucaaa

SEQ ID NO: 1120865 - RNA, 23 nt, Homo sapiens
acauuuugcauuagacagaugac

SEQ ID NO: 1120866 - RNA, 22 nt, Homo sapiens
accaaaaguuacauguuugcac

SEQ ID NO: 1120867 - RNA, 15 nt, Homo sapiens
accaaagagacugga

SEQ ID NO: 1120868 - RNA, 17 nt, Homo sapiens
accaacaguuccuucag

SEQ ID NO: 1120869 - RNA, 18 nt, Homo sapiens
accaacccuguuuccuga

SEQ ID NO: 1120870 - RNA, 21 nt, Homo sapiens
accaaccuccccgcagagcuc

SEQ ID NO: 1120871 - RNA, 22 nt, Homo sapiens
accaaguguguugggaauugca

SEQ ID NO: 1120872 - RNA, 23 nt, Homo sapiens
accaaguuauaaaucaaugucac

SEQ ID NO: 1120873 - RNA, 13 nt, Homo sapiens
accaauagcuuua

SEQ ID NO: 1120874 - RNA, 13 nt, Homo sapiens
accaauauucaaa

SEQ ID NO: 1120875 - RNA, 12 nt, Homo sapiens
accaauguagaa

SEQ ID NO: 1120876 - RNA, 15 nt, Homo sapiens
accacaccaaaccuc

SEQ ID NO: 1120877 - RNA, 16 nt, Homo sapiens
accacaccucccugaa

SEQ ID NO: 1120878 - RNA, 14 nt, Homo sapiens
accacaggcaucua

SEQ ID NO: 1120879 - RNA, 15 nt, Homo sapiens
accacauaacauaaa

SEQ ID NO: 1120880 - RNA, 18 nt, Homo sapiens
accacaucuugcucugcu

SEQ ID NO: 1120881 - RNA, 18 nt, Homo sapiens
accacaugugcacaugca

SEQ ID NO: 1120882 - RNA, 17 nt, Homo sapiens
accacuagaacucucca

SEQ ID NO: 1120883 - RNA, 12 nt, Homo sapiens
accagaggucag

SEQ ID NO: 1120884 - RNA, 14 nt, Homo sapiens
accagcaugucacu

SEQ ID NO: 1120885 - RNA, 19 nt, Homo sapiens
accagcuuguuugugaaac

SEQ ID NO: 1120886 - RNA, 15 nt, Homo sapiens
accaggucaaaauag

SEQ ID NO: 1120887 - RNA, 13 nt, Homo sapiens
accaguccaugag

SEQ ID NO: 1120888 - RNA, 17 nt, Homo sapiens
accagugaaccaaagag

SEQ ID NO: 1120889 - RNA, 20 nt, Homo sapiens
accauaaaaauccuucucac

SEQ ID NO: 1120890 - RNA, 14 nt, Homo sapiens
accauaauguuaca

SEQ ID NO: 1120891 - RNA, 13 nt, Homo sapiens
accauauacagcu

SEQ ID NO: 1120892 - RNA, 21 nt, Homo sapiens
accauaugaauuuacuacuuu

SEQ ID NO: 1120893 - RNA, 16 nt, Homo sapiens
accauaugcuguggac

SEQ ID NO: 1120894 - RNA, 16 nt, Homo sapiens
accaucaguuacuggu

SEQ ID NO: 1120895 - RNA, 16 nt, Homo sapiens
accaucugucuugcca

SEQ ID NO: 1120896 - RNA, 21 nt, Homo sapiens
accaugagaccacuguuauca

SEQ ID NO: 1120897 - RNA, 24 nt, Homo sapiens
accaugccucuccaacaucuucaa

SEQ ID NO: 1120898 - RNA, 16 nt, Homo sapiens
accaugcgcugcucaa

SEQ ID NO: 1120899 - RNA, 14 nt, Homo sapiens
accauuucagagag

SEQ ID NO: 1120900 - RNA, 14 nt, Homo sapiens
acccacuccucacu

SEQ ID NO: 1120901 - RNA, 15 nt, Homo sapiens
acccagggugcauua

SEQ ID NO: 1120902 - RNA, 14 nt, Homo sapiens
acccaguauuccau

SEQ ID NO: 1120903 - RNA, 13 nt, Homo sapiens
acccaguguaaag

SEQ ID NO: 1120904 - RNA, 21 nt, Homo sapiens
acccauagugcacacuuguau

SEQ ID NO: 1120905 - RNA, 17 nt, Homo sapiens
acccaugaaucaaagac

SEQ ID NO: 1120906 - RNA, 15 nt, Homo sapiens
accccaaaucccaca

SEQ ID NO: 1120907 - RNA, 15 nt, Homo sapiens
accccagacacuggu

SEQ ID NO: 1120908 - RNA, 11 nt, Homo sapiens
accccaucucu

SEQ ID NO: 1120909 - RNA, 13 nt, Homo sapiens
accccuacaugaa

SEQ ID NO: 1120910 - RNA, 14 nt, Homo sapiens
acucacaugccgcc

SEQ ID NO: 1120911 - RNA, 19 nt, Homo sapiens
acucacccucauaccaucu

SEQ ID NO: 1120912 - RNA, 20 nt, Homo sapiens
acucacuccacaacccaaga

SEQ ID NO: 1120913 - RNA, 14 nt, Homo sapiens
acucacugcucaag

SEQ ID NO: 1120914 - RNA, 11 nt, Homo sapiens
acucacugugg

SEQ ID NO: 1120915 - RNA, 14 nt, Homo sapiens
acucacugugggaa

SEQ ID NO: 1120916 - RNA, 19 nt, Homo sapiens
acucagaaaagaaaaccau

SEQ ID NO: 1120917 - RNA, 16 nt, Homo sapiens
acucagaagacacuga

SEQ ID NO: 1120918 - RNA, 22 nt, Homo sapiens
acucaguuugucagacuuuaaa

SEQ ID NO: 1120919 - RNA, 15 nt, Homo sapiens
acucaucuguuaucc

SEQ ID NO: 1120920 - RNA, 20 nt, Homo sapiens
acuccagauuuuuuacagcu

SEQ ID NO: 1120921 - RNA, 18 nt, Homo sapiens
acuccuaagacuuaugua

SEQ ID NO: 1120922 - RNA, 12 nt, Homo sapiens
acuccugcaaaa

SEQ ID NO: 1120923 - RNA, 23 nt, Homo sapiens
acuccuuccagcuagugacccac

SEQ ID NO: 1120924 - RNA, 20 nt, Homo sapiens
acucgaagcccuuccagugg

SEQ ID NO: 1120925 - RNA, 20 nt, Homo sapiens
acucuaggggucaggcucca

SEQ ID NO: 1120926 - RNA, 21 nt, Homo sapiens
acucuaggggucaggcuccau

SEQ ID NO: 1120927 - RNA, 14 nt, Homo sapiens
acucugacuuugag

SEQ ID NO: 1120928 - RNA, 15 nt, Homo sapiens
acucugcacaugucu

SEQ ID NO: 1120929 - RNA, 21 nt, Homo sapiens
acucuggaaguccccgggagc

SEQ ID NO: 1120930 - RNA, 22 nt, Homo sapiens
acucuggguuuauuacauggca

SEQ ID NO: 1120931 - RNA, 12 nt, Homo sapiens
acucugugucag

SEQ ID NO: 1120932 - RNA, 16 nt, Homo sapiens
acucuuccaaaggcau

SEQ ID NO: 1120933 - RNA, 14 nt, Homo sapiens
acugaaaugcuagc

SEQ ID NO: 1120934 - RNA, 19 nt, Homo sapiens
acugaaggagaaggugccc

SEQ ID NO: 1120935 - RNA, 18 nt, Homo sapiens
acugaauguaaacaaagg

SEQ ID NO: 1120936 - RNA, 13 nt, Homo sapiens
acugacuccuuag

SEQ ID NO: 1120937 - RNA, 23 nt, Homo sapiens
acugaggcccagggaggugaccc

SEQ ID NO: 1120938 - RNA, 12 nt, Homo sapiens
acugagggccac

SEQ ID NO: 1120939 - RNA, 16 nt, Homo sapiens
acugagugacucuaua

SEQ ID NO: 1120940 - RNA, 13 nt, Homo sapiens
acugauaaucucu

SEQ ID NO: 1120941 - RNA, 20 nt, Homo sapiens
acugcaccgggccacagaga

SEQ ID NO: 1120942 - RNA, 20 nt, Homo sapiens
acugcacuccagccugggca

SEQ ID NO: 1120943 - RNA, 20 nt, Homo sapiens
acugcagggacugccagucc

SEQ ID NO: 1120944 - RNA, 14 nt, Homo sapiens
acugcagugagaau

SEQ ID NO: 1120945 - RNA, 15 nt, Homo sapiens
acugcaucucaaaaa

SEQ ID NO: 1120946 - RNA, 15 nt, Homo sapiens
acugcaugcacuucu

SEQ ID NO: 1120947 - RNA, 19 nt, Homo sapiens
acugcauuuuuaaauacaa

SEQ ID NO: 1120948 - RNA, 20 nt, Homo sapiens
acugccaugcuagacaagcu

SEQ ID NO: 1120949 - RNA, 20 nt, Homo sapiens
acugccucuuccucccucau

SEQ ID NO: 1120950 - RNA, 18 nt, Homo sapiens
acugccuuccacaauuca

SEQ ID NO: 1120951 - RNA, 20 nt, Homo sapiens
acugcuaggcgagugccagg

SEQ ID NO: 1120952 - RNA, 22 nt, Homo sapiens
acugcucaagagaagcacauga

SEQ ID NO: 1120953 - RNA, 20 nt, Homo sapiens
acugcucgucuaucaccagg

SEQ ID NO: 1120954 - RNA, 19 nt, Homo sapiens
acugcugcccagccuccaa

SEQ ID NO: 1120955 - RNA, 15 nt, Homo sapiens
acugcuuuuggucug

SEQ ID NO: 1120956 - RNA, 17 nt, Homo sapiens
acuggaaagacauagcc

SEQ ID NO: 1120957 - RNA, 21 nt, Homo sapiens
acuggagacuuggaagaguug

SEQ ID NO: 1120958 - RNA, 22 nt, Homo sapiens
acuggagcacugaucaauccuu

SEQ ID NO: 1120959 - RNA, 15 nt, Homo sapiens
acuggagcaucugac

SEQ ID NO: 1120960 - RNA, 19 nt, Homo sapiens
acuggagcaucugacucac

SEQ ID NO: 1120961 - RNA, 12 nt, Homo sapiens
acuggcauuaaa

SEQ ID NO: 1120962 - RNA, 22 nt, Homo sapiens
acugguagaacguaaccacgga

SEQ ID NO: 1120963 - RNA, 21 nt, Homo sapiens
acuggucuuguggaauuggga

SEQ ID NO: 1120964 - RNA, 14 nt, Homo sapiens
acugucauagaaau

SEQ ID NO: 1120965 - RNA, 14 nt, Homo sapiens
acuguccuacccac

SEQ ID NO: 1120966 - RNA, 15 nt, Homo sapiens
acugucucucaugaa

SEQ ID NO: 1120967 - RNA, 21 nt, Homo sapiens
acugucuugaagacaauggcu

SEQ ID NO: 1120968 - RNA, 22 nt, Homo sapiens
acugucuugaagacaauggcuu

SEQ ID NO: 1120969 - RNA, 19 nt, Homo sapiens
acuguggagguacacucuu

SEQ ID NO: 1120970 - RNA, 21 nt, Homo sapiens
acuguggccuguuaacuggua

SEQ ID NO: 1120971 - RNA, 20 nt, Homo sapiens
acuguggcugcuagcacuug

SEQ ID NO: 1120972 - RNA, 22 nt, Homo sapiens
acuguggcugcuagcacuugga

SEQ ID NO: 1120973 - RNA, 19 nt, Homo sapiens
acugugugaagaaauggaa

SEQ ID NO: 1120974 - RNA, 14 nt, Homo sapiens
acuguguucagugc

SEQ ID NO: 1120975 - RNA, 22 nt, Homo sapiens
acuguuauucuauuauaucaga

SEQ ID NO: 1120976 - RNA, 20 nt, Homo sapiens
acuuaaaaaauguccaugau

SEQ ID NO: 1120977 - RNA, 22 nt, Homo sapiens
acuuaagcugggauaaucacau

SEQ ID NO: 1120978 - RNA, 19 nt, Homo sapiens
acuuaaggauggagccagc

SEQ ID NO: 1120979 - RNA, 15 nt, Homo sapiens
acuuauaucaucagc

SEQ ID NO: 1120980 - RNA, 16 nt, Homo sapiens
acuuauaucaucagca

SEQ ID NO: 1120981 - RNA, 20 nt, Homo sapiens
acuuauguauuuaugaccuu

SEQ ID NO: 1120982 - RNA, 20 nt, Homo sapiens
acuucaaguuaaagugaaua

SEQ ID NO: 1120983 - RNA, 16 nt, Homo sapiens
acuucacuaccaaaug

SEQ ID NO: 1120984 - RNA, 17 nt, Homo sapiens
acuucaguugcuuugca

SEQ ID NO: 1120985 - RNA, 18 nt, Homo sapiens
acuucauuugaugcuaaa

SEQ ID NO: 1120986 - RNA, 13 nt, Homo sapiens
acuuccuuugaga

SEQ ID NO: 1120987 - RNA, 18 nt, Homo sapiens
acuucgacucaggaucca

SEQ ID NO: 1120988 - RNA, 19 nt, Homo sapiens
acuucguguccgacucuuc

SEQ ID NO: 1120989 - RNA, 13 nt, Homo sapiens
acuucucuagaga

SEQ ID NO: 1120990 - RNA, 12 nt, Homo sapiens
acuucucuccag

SEQ ID NO: 1120991 - RNA, 21 nt, Homo sapiens
acuucuuacuucccuaaugaa

SEQ ID NO: 1120992 - RNA, 23 nt, Homo sapiens
acuugaaauaccagugaaccaaa

SEQ ID NO: 1120993 - RNA, 16 nt, Homo sapiens
acuugccacacacugu

SEQ ID NO: 1120994 - RNA, 23 nt, Homo sapiens
acuuggggagauggaguucuugu

SEQ ID NO: 1120995 - RNA, 22 nt, Homo sapiens
acuugggggaggaggaacaaau

SEQ ID NO: 1120996 - RNA, 21 nt, Homo sapiens
acuuguaauuucuaacuccuu

SEQ ID NO: 1120997 - RNA, 13 nt, Homo sapiens
acuuguacuaugu

SEQ ID NO: 1120998 - RNA, 16 nt, Homo sapiens
acuuguggacacagcu

SEQ ID NO: 1120999 - RNA, 18 nt, Homo sapiens
acuuguggacacagcucu

SEQ ID NO: 1121000 - RNA, 20 nt, Homo sapiens
agcaauugacugucacuguu

SEQ ID NO: 1121001 - RNA, 11 nt, Homo sapiens
agcacacugua

SEQ ID NO: 1121002 - RNA, 20 nt, Homo sapiens
agcacagaaggaaucugugc

SEQ ID NO: 1121003 - RNA, 15 nt, Homo sapiens
agcacagcagcaucu

SEQ ID NO: 1121004 - RNA, 19 nt, Homo sapiens
agcacuaaggugugcucug

SEQ ID NO: 1121005 - RNA, 19 nt, Homo sapiens
agcacuauuauggaugaag

SEQ ID NO: 1121006 - RNA, 22 nt, Homo sapiens
agcacucagaaaagaaaaccau

SEQ ID NO: 1121007 - RNA, 20 nt, Homo sapiens
agcacugccaggagggacaa

SEQ ID NO: 1121008 - RNA, 16 nt, Homo sapiens
agcacuguuucucuca

SEQ ID NO: 1121009 - RNA, 23 nt, Homo sapiens
agcacuuuaacccucucuucccu

SEQ ID NO: 1121010 - RNA, 12 nt, Homo sapiens
agcagaaagcca

SEQ ID NO: 1121011 - RNA, 13 nt, Homo sapiens
agcagaaccaaag

SEQ ID NO: 1121012 - RNA, 14 nt, Homo sapiens
agcagaagccaaau

SEQ ID NO: 1121013 - RNA, 20 nt, Homo sapiens
agcagagacgggguuucacc

SEQ ID NO: 1121014 - RNA, 15 nt, Homo sapiens
agcagaugcaaucuc

SEQ ID NO: 1121015 - RNA, 15 nt, Homo sapiens
agcagcaucuucaaa

SEQ ID NO: 1121016 - RNA, 19 nt, Homo sapiens
agcagggaauugauccacu

SEQ ID NO: 1121017 - RNA, 16 nt, Homo sapiens
agcagguggcaucucu

SEQ ID NO: 1121018 - RNA, 19 nt, Homo sapiens
agcagguggcaucucuaau

SEQ ID NO: 1121019 - RNA, 13 nt, Homo sapiens
agcaguaagcuau

SEQ ID NO: 1121020 - RNA, 22 nt, Homo sapiens
agcagucacacuguuacuccac

SEQ ID NO: 1121021 - RNA, 16 nt, Homo sapiens
agcagugccuuccaua

SEQ ID NO: 1121022 - RNA, 22 nt, Homo sapiens
agcagugucuuccauaauguau

SEQ ID NO: 1121023 - RNA, 19 nt, Homo sapiens
agcauaauucggaagggaa

SEQ ID NO: 1121024 - RNA, 17 nt, Homo sapiens
agcaucaccucaggcca

SEQ ID NO: 1121025 - RNA, 18 nt, Homo sapiens
agcaucucuguguaccca

SEQ ID NO: 1121026 - RNA, 13 nt, Homo sapiens
agcaucugacuca

SEQ ID NO: 1121027 - RNA, 11 nt, Homo sapiens
agcauggaaaa

SEQ ID NO: 1121028 - RNA, 20 nt, Homo sapiens
agcaugucucaauaguaaaa

SEQ ID NO: 1121029 - RNA, 14 nt, Homo sapiens
agcauguggggaag

SEQ ID NO: 1121030 - RNA, 14 nt, Homo sapiens
agcauuacaguggg

SEQ ID NO: 1121031 - RNA, 17 nt, Homo sapiens
agcauuucccccaggga

SEQ ID NO: 1121032 - RNA, 14 nt, Homo sapiens
agccaaacccauga

SEQ ID NO: 1121033 - RNA, 17 nt, Homo sapiens
agccaacacccugucua

SEQ ID NO: 1121034 - RNA, 20 nt, Homo sapiens
agccaacacccugucuaaaa

SEQ ID NO: 1121035 - RNA, 21 nt, Homo sapiens
agccaacucacucuuaugaaa

SEQ ID NO: 1121036 - RNA, 20 nt, Homo sapiens
agccaagaucgcgccacugc

SEQ ID NO: 1121037 - RNA, 14 nt, Homo sapiens
agccacagaccacc

SEQ ID NO: 1121038 - RNA, 13 nt, Homo sapiens
agccacucuucca

SEQ ID NO: 1121039 - RNA, 19 nt, Homo sapiens
agccagagccugucuuuca

SEQ ID NO: 1121040 - RNA, 15 nt, Homo sapiens
agccagcagccagcu

SEQ ID NO: 1121041 - RNA, 16 nt, Homo sapiens
agccagccggugccug

SEQ ID NO: 1121042 - RNA, 13 nt, Homo sapiens
agccaggagcaaa

SEQ ID NO: 1121043 - RNA, 19 nt, Homo sapiens
agccaucaagagacugagu

SEQ ID NO: 1121044 - RNA, 20 nt, Homo sapiens
agccaucaagagacugaguc

SEQ ID NO: 1121045 - RNA, 22 nt, Homo sapiens
agccauuuguuggggcaguggu

SEQ ID NO: 1121046 - RNA, 20 nt, Homo sapiens
agcccaacagacaccaucuu

SEQ ID NO: 1121047 - RNA, 16 nt, Homo sapiens
agcccaccuuggcuca

SEQ ID NO: 1121048 - RNA, 18 nt, Homo sapiens
agcccagaauagcuuuga

SEQ ID NO: 1121049 - RNA, 14 nt, Homo sapiens
agcccagccauuac

SEQ ID NO: 1121050 - RNA, 21 nt, Homo sapiens
agcccugggccccaccaccua

SEQ ID NO: 1121051 - RNA, 16 nt, Homo sapiens
agcccuuccuagaaga

SEQ ID NO: 1121052 - RNA, 21 nt, Homo sapiens
agccgagaucacgccacugca

SEQ ID NO: 1121053 - RNA, 23 nt, Homo sapiens
agccgagauggcgcuauugcacu

SEQ ID NO: 1121054 - RNA, 14 nt, Homo sapiens
agccgagauugcac

SEQ ID NO: 1121055 - RNA, 14 nt, Homo sapiens
agccggccggcugg

SEQ ID NO: 1121056 - RNA, 17 nt, Homo sapiens
agccgugaugcucaggc

SEQ ID NO: 1121057 - RNA, 16 nt, Homo sapiens
agccuaccaauguaga

SEQ ID NO: 1121058 - RNA, 20 nt, Homo sapiens
agccuagaaacuaacacagc

SEQ ID NO: 1121059 - RNA, 16 nt, Homo sapiens
agccuaggugacagag

SEQ ID NO: 1121060 - RNA, 17 nt, Homo sapiens
agccuauugugccucug

SEQ ID NO: 1121061 - RNA, 12 nt, Homo sapiens
agccucaagucu

SEQ ID NO: 1121062 - RNA, 23 nt, Homo sapiens
agccucaagucuuauuuccucaa

SEQ ID NO: 1121063 - RNA, 19 nt, Homo sapiens
agccuccccaccuucuuca

SEQ ID NO: 1121064 - RNA, 19 nt, Homo sapiens
agccuccuuuugcuugaaa

SEQ ID NO: 1121065 - RNA, 19 nt, Homo sapiens
agccucgguggccaugcuu

SEQ ID NO: 1121066 - RNA, 19 nt, Homo sapiens
agccucugaucaguuucac

SEQ ID NO: 1121067 - RNA, 14 nt, Homo sapiens
agccucugcugcca

SEQ ID NO: 1121068 - RNA, 23 nt, Homo sapiens
agccugaccuuucugagugacau

SEQ ID NO: 1121069 - RNA, 15 nt, Homo sapiens
agccugacuguguuc

SEQ ID NO: 1121070 - RNA, 23 nt, Homo sapiens
agccugcaaacucacugcucaag

SEQ ID NO: 1121071 - RNA, 16 nt, Homo sapiens
agccugcagacucacu

SEQ ID NO: 1121072 - RNA, 20 nt, Homo sapiens
agccugcagacucacugugg

SEQ ID NO: 1121073 - RNA, 13 nt, Homo sapiens
agccugggaccag

SEQ ID NO: 1121074 - RNA, 15 nt, Homo sapiens
agccugggcaacaaa

SEQ ID NO: 1121075 - RNA, 21 nt, Homo sapiens
agccugggcagcauagcaaga

SEQ ID NO: 1121076 - RNA, 18 nt, Homo sapiens
agccuggggcaucccaga

SEQ ID NO: 1121077 - RNA, 19 nt, Homo sapiens
agccuuagaagucacacag

SEQ ID NO: 1121078 - RNA, 19 nt, Homo sapiens
agccuuggggauucuucca

SEQ ID NO: 1121079 - RNA, 13 nt, Homo sapiens
agcgaacaugccu

SEQ ID NO: 1121080 - RNA, 18 nt, Homo sapiens
agcggaggagaccagcuc

SEQ ID NO: 1121081 - RNA, 16 nt, Homo sapiens
agcgugagccacugca

SEQ ID NO: 1121082 - RNA, 14 nt, Homo sapiens
agcgugcucacuga

SEQ ID NO: 1121083 - RNA, 16 nt, Homo sapiens
agcuaacuuauuuucc

SEQ ID NO: 1121084 - RNA, 13 nt, Homo sapiens
agcuaagccacau

SEQ ID NO: 1121085 - RNA, 21 nt, Homo sapiens
agcuagaagugggccaggaca

SEQ ID NO: 1121086 - RNA, 18 nt, Homo sapiens
agcuaggccuggccagau

SEQ ID NO: 1121087 - RNA, 20 nt, Homo sapiens
agcuauuagcaacugugcua

SEQ ID NO: 1121088 - RNA, 22 nt, Homo sapiens
agcuauuuucaacauaacugaa

SEQ ID NO: 1121089 - RNA, 19 nt, Homo sapiens
agcucagaggcccaggaau

SEQ ID NO: 1121090 - RNA, 14 nt, Homo sapiens
agcucagccucccc

SEQ ID NO: 1121091 - RNA, 15 nt, Homo sapiens
agcucaggcacacuu

SEQ ID NO: 1121092 - RNA, 22 nt, Homo sapiens
agcuccccaggacucacccuca

SEQ ID NO: 1121093 - RNA, 18 nt, Homo sapiens
agcuccgcuuucuaccca

SEQ ID NO: 1121094 - RNA, 13 nt, Homo sapiens
agcuccuugacuc

SEQ ID NO: 1121095 - RNA, 16 nt, Homo sapiens
agcucugacauucuga

SEQ ID NO: 1121096 - RNA, 12 nt, Homo sapiens
agcucugaucag

SEQ ID NO: 1121097 - RNA, 14 nt, Homo sapiens
agcucuggaccagc

SEQ ID NO: 1121098 - RNA, 15 nt, Homo sapiens
agcucuggcuuccag

SEQ ID NO: 1121099 - RNA, 12 nt, Homo sapiens
agcucuguccac

SEQ ID NO: 1121100 - RNA, 19 nt, Homo sapiens
agcucuguuuuacaauaaa

SEQ ID NO: 1121101 - RNA, 20 nt, Homo sapiens
agcugaacagccaaaugcau

SEQ ID NO: 1121102 - RNA, 23 nt, Homo sapiens
agcugagauugcgccacugcacu

SEQ ID NO: 1121103 - RNA, 15 nt, Homo sapiens
agcugcaccugccag

SEQ ID NO: 1121104 - RNA, 22 nt, Homo sapiens
agcugcagucaacaguucaaag

SEQ ID NO: 1121105 - RNA, 13 nt, Homo sapiens
agcugcaucuacu

SEQ ID NO: 1121106 - RNA, 23 nt, Homo sapiens
agcugcaugggugccugcugcug

SEQ ID NO: 1121107 - RNA, 21 nt, Homo sapiens
agcugcuugacuaucacauac

SEQ ID NO: 1121108 - RNA, 14 nt, Homo sapiens
agcuggaacccugg

SEQ ID NO: 1121109 - RNA, 23 nt, Homo sapiens
agcuggaauuuaaggagggacaa

SEQ ID NO: 1121110 - RNA, 14 nt, Homo sapiens
agcuggcaaaggug

SEQ ID NO: 1121111 - RNA, 18 nt, Homo sapiens
agcugggacuacaggcac

SEQ ID NO: 1121112 - RNA, 17 nt, Homo sapiens
agcugggcuucugucca

SEQ ID NO: 1121113 - RNA, 21 nt, Homo sapiens
agcuguccuugagcuguccua

SEQ ID NO: 1121114 - RNA, 12 nt, Homo sapiens
agcugucugcuc

SEQ ID NO: 1121115 - RNA, 13 nt, Homo sapiens
agcugucugcuca

SEQ ID NO: 1121116 - RNA, 14 nt, Homo sapiens
agcuguuuccauag

SEQ ID NO: 1121117 - RNA, 14 nt, Homo sapiens
agcuuaugucagac

SEQ ID NO: 1121118 - RNA, 12 nt, Homo sapiens
agcuuccaugag

SEQ ID NO: 1121119 - RNA, 15 nt, Homo sapiens
agcuuccugucaaca

SEQ ID NO: 1121120 - RNA, 21 nt, Homo sapiens
agcuuccugucaacacuucuc

SEQ ID NO: 1121121 - RNA, 17 nt, Homo sapiens
agcuugcucuucagugg

SEQ ID NO: 1121122 - RNA, 17 nt, Homo sapiens
agcuuguaaauagcuca

SEQ ID NO: 1121123 - RNA, 23 nt, Homo sapiens
agcuuguccaacaacuccaggaa

SEQ ID NO: 1121124 - RNA, 20 nt, Homo sapiens
agcuugucugaucguucaaa

SEQ ID NO: 1121125 - RNA, 19 nt, Homo sapiens
agcuuucuucuacaaccag

SEQ ID NO: 1121126 - RNA, 12 nt, Homo sapiens
agcuuugcucuu

SEQ ID NO: 1121127 - RNA, 20 nt, Homo sapiens
aggaaaacugaggcccuugg

SEQ ID NO: 1121128 - RNA, 20 nt, Homo sapiens
aggaaaaucuuaaaauucuu

SEQ ID NO: 1121129 - RNA, 23 nt, Homo sapiens
aggaaagggauaguccaaagacu

SEQ ID NO: 1121130 - RNA, 22 nt, Homo sapiens
aggaacugggccaacucaccug

SEQ ID NO: 1121131 - RNA, 11 nt, Homo sapiens
aggaagcaagc

SEQ ID NO: 1121132 - RNA, 13 nt, Homo sapiens
aggaauauuugca

SEQ ID NO: 1121133 - RNA, 22 nt, Homo sapiens
aggaaucggagcgaagcagaga

SEQ ID NO: 1121134 - RNA, 18 nt, Homo sapiens
aggaaucugugcagauga

SEQ ID NO: 1121135 - RNA, 16 nt, Homo sapiens
aggaauuugcauuuag

SEQ ID NO: 1121136 - RNA, 18 nt, Homo sapiens
aggacaaccauuccagac

SEQ ID NO: 1121137 - RNA, 12 nt, Homo sapiens
aggacaagcaug

SEQ ID NO: 1121138 - RNA, 18 nt, Homo sapiens
aggacauuuuacugcagu

SEQ ID NO: 1121139 - RNA, 11 nt, Homo sapiens
aggacccauag

SEQ ID NO: 1121140 - RNA, 22 nt, Homo sapiens
aggacuaacacucagaagccug

SEQ ID NO: 1121141 - RNA, 13 nt, Homo sapiens
aggacuccuuaaa

SEQ ID NO: 1121142 - RNA, 19 nt, Homo sapiens
aggacuugugucucugugc

SEQ ID NO: 1121143 - RNA, 17 nt, Homo sapiens
aggagaaucacuugcac

SEQ ID NO: 1121144 - RNA, 22 nt, Homo sapiens
aggagacucaccucugccucaa

SEQ ID NO: 1121145 - RNA, 13 nt, Homo sapiens
aggagcugggcuu

SEQ ID NO: 1121146 - RNA, 18 nt, Homo sapiens
aggagcuugcaagaagca

SEQ ID NO: 1121147 - RNA, 18 nt, Homo sapiens
aggagggagagaacuuaa

SEQ ID NO: 1121148 - RNA, 22 nt, Homo sapiens
aggagggggucguggagagcua

SEQ ID NO: 1121149 - RNA, 21 nt, Homo sapiens
aggagguagcucccagcacuc

SEQ ID NO: 1121150 - RNA, 22 nt, Homo sapiens
aggagguuuggggucugccacc

SEQ ID NO: 1121151 - RNA, 17 nt, Homo sapiens
aggaugaguuacuugaa

SEQ ID NO: 1121152 - RNA, 18 nt, Homo sapiens
aggaugauaaaagcacuu

SEQ ID NO: 1121153 - RNA, 16 nt, Homo sapiens
aggauguuuuucauga

SEQ ID NO: 1121154 - RNA, 14 nt, Homo sapiens
aggauugcuacugu

SEQ ID NO: 1121155 - RNA, 19 nt, Homo sapiens
aggcaaagugcugcuggaa

SEQ ID NO: 1121156 - RNA, 16 nt, Homo sapiens
aggcaaauaucuugaa

SEQ ID NO: 1121157 - RNA, 23 nt, Homo sapiens
aggcaacugaggcagacagcagc

SEQ ID NO: 1121158 - RNA, 19 nt, Homo sapiens
aggcacgcaccaccaugcc

SEQ ID NO: 1121159 - RNA, 17 nt, Homo sapiens
aggcaggaggaucacuu

SEQ ID NO: 1121160 - RNA, 20 nt, Homo sapiens
aggcaggaggauugcuugag

SEQ ID NO: 1121161 - RNA, 20 nt, Homo sapiens
aggcagggucucacucuguc

SEQ ID NO: 1121162 - RNA, 22 nt, Homo sapiens
aggcauaagacccuaagccucc

SEQ ID NO: 1121163 - RNA, 15 nt, Homo sapiens
aggcauacugacacu

SEQ ID NO: 1121164 - RNA, 22 nt, Homo sapiens
aggcaugagggaucacagggcc

SEQ ID NO: 1121165 - RNA, 19 nt, Homo sapiens
aggccaagggccaagagaa

SEQ ID NO: 1121166 - RNA, 21 nt, Homo sapiens
aggccacacacucugcauccg

SEQ ID NO: 1121167 - RNA, 14 nt, Homo sapiens
aggccacaugucac

SEQ ID NO: 1121168 - RNA, 20 nt, Homo sapiens
aggccacuugaugaccccca

SEQ ID NO: 1121169 - RNA, 23 nt, Homo sapiens
aggccagaaaacauaugcauuau

SEQ ID NO: 1121170 - RNA, 17 nt, Homo sapiens
aggccagagugcugcca

SEQ ID NO: 1121171 - RNA, 21 nt, Homo sapiens
aggccauggcagaauaaucuu

SEQ ID NO: 1121172 - RNA, 17 nt, Homo sapiens
aggcccgagcagcugag

SEQ ID NO: 1121173 - RNA, 19 nt, Homo sapiens
aggcccuuauuuucaagaa

SEQ ID NO: 1121174 - RNA, 16 nt, Homo sapiens
aggcccuugggcaccu

SEQ ID NO: 1121175 - RNA, 15 nt, Homo sapiens
aggccuguguagcug

SEQ ID NO: 1121176 - RNA, 16 nt, Homo sapiens
aggcggaagaaucacu

SEQ ID NO: 1121177 - RNA, 22 nt, Homo sapiens
aggcggcacauuggcagugugu

SEQ ID NO: 1121178 - RNA, 18 nt, Homo sapiens
aggcggguggaucaccug

SEQ ID NO: 1121179 - RNA, 17 nt, Homo sapiens
aggcuauagcugggaac

SEQ ID NO: 1121180 - RNA, 14 nt, Homo sapiens
aggcugaggacuua

SEQ ID NO: 1121181 - RNA, 22 nt, Homo sapiens
cuagaggcuuccuucauuuccu

SEQ ID NO: 1121182 - RNA, 20 nt, Homo sapiens
cuagagugcgguggcgcgau

SEQ ID NO: 1121183 - RNA, 20 nt, Homo sapiens
cuagaucaaggagcccagaa

SEQ ID NO: 1121184 - RNA, 15 nt, Homo sapiens
cuagauuagaagugu

SEQ ID NO: 1121185 - RNA, 13 nt, Homo sapiens
cuagcaaagcuua

SEQ ID NO: 1121186 - RNA, 17 nt, Homo sapiens
cuagcaggcacaggaca

SEQ ID NO: 1121187 - RNA, 18 nt, Homo sapiens
cuagcccucucacauuua

SEQ ID NO: 1121188 - RNA, 14 nt, Homo sapiens
cuagcugcaaguga

SEQ ID NO: 1121189 - RNA, 21 nt, Homo sapiens
cuaggagguuccggugucugg

SEQ ID NO: 1121190 - RNA, 18 nt, Homo sapiens
cuagggccuuuuguggau

SEQ ID NO: 1121191 - RNA, 20 nt, Homo sapiens
cuagguucuaaaaauuguga

SEQ ID NO: 1121192 - RNA, 23 nt, Homo sapiens
cuaguaucacauagaagcugucc

SEQ ID NO: 1121193 - RNA, 15 nt, Homo sapiens
cuagucauaaccuua

SEQ ID NO: 1121194 - RNA, 19 nt, Homo sapiens
cuagucugcuagccaggau

SEQ ID NO: 1121195 - RNA, 16 nt, Homo sapiens
cuagugacaagcuccu

SEQ ID NO: 1121196 - RNA, 22 nt, Homo sapiens
cuauaaccaucaguuacugguu

SEQ ID NO: 1121197 - RNA, 13 nt, Homo sapiens
cuauaaugagccg

SEQ ID NO: 1121198 - RNA, 15 nt, Homo sapiens
cuauaggucagagau

SEQ ID NO: 1121199 - RNA, 21 nt, Homo sapiens
cuauagucccagcuacucaga

SEQ ID NO: 1121200 - RNA, 21 nt, Homo sapiens
cuaucaaccuaagcaacagaa

SEQ ID NO: 1121201 - RNA, 14 nt, Homo sapiens
cuaucaauagucaa

SEQ ID NO: 1121202 - RNA, 11 nt, Homo sapiens
cuauccagcua

SEQ ID NO: 1121203 - RNA, 23 nt, Homo sapiens
cuauccuaaaggcccacuggcau

SEQ ID NO: 1121204 - RNA, 20 nt, Homo sapiens
cuaucuacugagacaugacu

SEQ ID NO: 1121205 - RNA, 15 nt, Homo sapiens
cuaucuguauuuuca

SEQ ID NO: 1121206 - RNA, 17 nt, Homo sapiens
cuaucuuuuaguuuuag

SEQ ID NO: 1121207 - RNA, 21 nt, Homo sapiens
cuaugagaauugggauuacau

SEQ ID NO: 1121208 - RNA, 16 nt, Homo sapiens
cuaugauccacaaaaa

SEQ ID NO: 1121209 - RNA, 19 nt, Homo sapiens
cuaugcaacagcucucacc

SEQ ID NO: 1121210 - RNA, 15 nt, Homo sapiens
cuauggaaggguaau

SEQ ID NO: 1121211 - RNA, 19 nt, Homo sapiens
cuauggaaggguaauuuga

SEQ ID NO: 1121212 - RNA, 10 nt, Homo sapiens
cuauggaugu

SEQ ID NO: 1121213 - RNA, 13 nt, Homo sapiens
cuauguacuguaa

SEQ ID NO: 1121214 - RNA, 19 nt, Homo sapiens
cuaugucauuucauuuccu

SEQ ID NO: 1121215 - RNA, 19 nt, Homo sapiens
cuauguugcccaggcaggu

SEQ ID NO: 1121216 - RNA, 19 nt, Homo sapiens
cuauuaccuguuaguauua

SEQ ID NO: 1121217 - RNA, 15 nt, Homo sapiens
cuauuacgugcaaua

SEQ ID NO: 1121218 - RNA, 21 nt, Homo sapiens
cuauuagacaugaaaucugag

SEQ ID NO: 1121219 - RNA, 16 nt, Homo sapiens
cuauuauuaacacuga

SEQ ID NO: 1121220 - RNA, 16 nt, Homo sapiens
cuauuuccuuuccagu

SEQ ID NO: 1121221 - RNA, 13 nt, Homo sapiens
cuauuugaagugu

SEQ ID NO: 1121222 - RNA, 19 nt, Homo sapiens
cuauuugcacuguagccuc

SEQ ID NO: 1121223 - RNA, 21 nt, Homo sapiens
cuauuuggggcuugcaugcca

SEQ ID NO: 1121224 - RNA, 15 nt, Homo sapiens
cuauuuuuguagaag

SEQ ID NO: 1121225 - RNA, 21 nt, Homo sapiens
cucaaaagaaaaaaaaaagca

SEQ ID NO: 1121226 - RNA, 23 nt, Homo sapiens
cucaaacuccugaccuugugauu

SEQ ID NO: 1121227 - RNA, 20 nt, Homo sapiens
cucaaacucuugaccucagg

SEQ ID NO: 1121228 - RNA, 16 nt, Homo sapiens
cucaaaugacccaaag

SEQ ID NO: 1121229 - RNA, 14 nt, Homo sapiens
cucaaaugcuaaau

SEQ ID NO: 1121230 - RNA, 22 nt, Homo sapiens
cucaaccuccugggcuaaguga

SEQ ID NO: 1121231 - RNA, 22 nt, Homo sapiens
cucaagugauucuccugccuca

SEQ ID NO: 1121232 - RNA, 18 nt, Homo sapiens
cucacaaaccaugcaaau

SEQ ID NO: 1121233 - RNA, 19 nt, Homo sapiens
cucacaagaagaccagacu

SEQ ID NO: 1121234 - RNA, 15 nt, Homo sapiens
cucacauaucuguca

SEQ ID NO: 1121235 - RNA, 14 nt, Homo sapiens
cucacuaugcugcu

SEQ ID NO: 1121236 - RNA, 21 nt, Homo sapiens
cucacucuuaugaaaugggcu

SEQ ID NO: 1121237 - RNA, 21 nt, Homo sapiens
cucacugggccuccaaccaug

SEQ ID NO: 1121238 - RNA, 14 nt, Homo sapiens
cucagagacauaca

SEQ ID NO: 1121239 - RNA, 12 nt, Homo sapiens
cucagcauaccu

SEQ ID NO: 1121240 - RNA, 13 nt, Homo sapiens
cucagcauaccug

SEQ ID NO: 1121241 - RNA, 14 nt, Homo sapiens
cucagcauaccugc

SEQ ID NO: 1121242 - RNA, 21 nt, Homo sapiens
cucagcauaccugcuggugca

SEQ ID NO: 1121243 - RNA, 23 nt, Homo sapiens
cucagcccugggccccaccaccu

SEQ ID NO: 1121244 - RNA, 18 nt, Homo sapiens
cucagccucccaaagugc

SEQ ID NO: 1121245 - RNA, 19 nt, Homo sapiens
cucagccuuuagggcuuau

SEQ ID NO: 1121246 - RNA, 20 nt, Homo sapiens
cucagcuccagaauaccuuc

SEQ ID NO: 1121247 - RNA, 18 nt, Homo sapiens
cucagcugcucgcacaga

SEQ ID NO: 1121248 - RNA, 19 nt, Homo sapiens
cucagcuucauuuccguga

SEQ ID NO: 1121249 - RNA, 22 nt, Homo sapiens
cucaggauccagucccuuacac

SEQ ID NO: 1121250 - RNA, 14 nt, Homo sapiens
cucaggucccugca

SEQ ID NO: 1121251 - RNA, 14 nt, Homo sapiens
cucagucucaggag

SEQ ID NO: 1121252 - RNA, 21 nt, Homo sapiens
cucagugggacaaaccagagc

SEQ ID NO: 1121253 - RNA, 22 nt, Homo sapiens
cucauaaguuggaccagaggaa

SEQ ID NO: 1121254 - RNA, 14 nt, Homo sapiens
cucaugaaccucaa

SEQ ID NO: 1121255 - RNA, 22 nt, Homo sapiens
cucaugaacuauuuacauuuuc

SEQ ID NO: 1121256 - RNA, 19 nt, Homo sapiens
cucaugagugccaagcaaa

SEQ ID NO: 1121257 - RNA, 18 nt, Homo sapiens
cucauuccccaaccacuu

SEQ ID NO: 1121258 - RNA, 13 nt, Homo sapiens
cucauuucaucuc

SEQ ID NO: 1121259 - RNA, 14 nt, Homo sapiens
cucauuucaucuca

SEQ ID NO: 1121260 - RNA, 13 nt, Homo sapiens
cuccaacuggauu

SEQ ID NO: 1121261 - RNA, 12 nt, Homo sapiens
cuccacccugag

SEQ ID NO: 1121262 - RNA, 16 nt, Homo sapiens
cuccagccagcaauga

SEQ ID NO: 1121263 - RNA, 22 nt, Homo sapiens
cuccagccagcaaugaugucca

SEQ ID NO: 1121264 - RNA, 20 nt, Homo sapiens
cuccaggaugaguuacuuga

SEQ ID NO: 1121265 - RNA, 15 nt, Homo sapiens
cuccaguuuccccau

SEQ ID NO: 1121266 - RNA, 17 nt, Homo sapiens
cuccauacauaacuuga

SEQ ID NO: 1121267 - RNA, 17 nt, Homo sapiens
cuccaucuccacuccag

SEQ ID NO: 1121268 - RNA, 18 nt, Homo sapiens
cuccaucuuagauagaug

SEQ ID NO: 1121269 - RNA, 19 nt, Homo sapiens
cuccaugcugccuccagaa

SEQ ID NO: 1121270 - RNA, 15 nt, Homo sapiens
cucccaaggcucuga

SEQ ID NO: 1121271 - RNA, 20 nt, Homo sapiens
cugggccaaguuccucuagu

SEQ ID NO: 1121272 - RNA, 18 nt, Homo sapiens
cugggcuucuguccaagg

SEQ ID NO: 1121273 - RNA, 17 nt, Homo sapiens
cuggggaacuagaggga

SEQ ID NO: 1121274 - RNA, 13 nt, Homo sapiens
cuggggacaccag

SEQ ID NO: 1121275 - RNA, 14 nt, Homo sapiens
cuggggacaccagc

SEQ ID NO: 1121276 - RNA, 21 nt, Homo sapiens
cuggggacagguccucagugu

SEQ ID NO: 1121277 - RNA, 18 nt, Homo sapiens
cugggggcagauauuucc

SEQ ID NO: 1121278 - RNA, 22 nt, Homo sapiens
cugggucuuucugacaucagca

SEQ ID NO: 1121279 - RNA, 15 nt, Homo sapiens
cuggguggugaagga

SEQ ID NO: 1121280 - RNA, 15 nt, Homo sapiens
cugguaacauagguu

SEQ ID NO: 1121281 - RNA, 14 nt, Homo sapiens
cugguacaauccuu

SEQ ID NO: 1121282 - RNA, 15 nt, Homo sapiens
cuggucugcucagga

SEQ ID NO: 1121283 - RNA, 13 nt, Homo sapiens
cuggucuugugga

SEQ ID NO: 1121284 - RNA, 16 nt, Homo sapiens
cuggugaccuacuaaa

SEQ ID NO: 1121285 - RNA, 18 nt, Homo sapiens
cuggugguggcaccaucu

SEQ ID NO: 1121286 - RNA, 17 nt, Homo sapiens
cuguaaauacaugugug

SEQ ID NO: 1121287 - RNA, 17 nt, Homo sapiens
cuguaaggaacuggaac

SEQ ID NO: 1121288 - RNA, 19 nt, Homo sapiens
cuguaaggaacuggaacac

SEQ ID NO: 1121289 - RNA, 12 nt, Homo sapiens
cuguaauagugu

SEQ ID NO: 1121290 - RNA, 18 nt, Homo sapiens
cuguaaucccagcacuuu

SEQ ID NO: 1121291 - RNA, 23 nt, Homo sapiens
cuguaaucccagcacuuugggag

SEQ ID NO: 1121292 - RNA, 18 nt, Homo sapiens
cuguaaucccagcuacuu

SEQ ID NO: 1121293 - RNA, 22 nt, Homo sapiens
cuguacuccagccugggugaca

SEQ ID NO: 1121294 - RNA, 16 nt, Homo sapiens
cuguagaaauguaucc

SEQ ID NO: 1121295 - RNA, 18 nt, Homo sapiens
cuguagccccagugacag

SEQ ID NO: 1121296 - RNA, 13 nt, Homo sapiens
cuguagcucuccu

SEQ ID NO: 1121297 - RNA, 15 nt, Homo sapiens
cuguagguucuugau

SEQ ID NO: 1121298 - RNA, 21 nt, Homo sapiens
cuguagucccagccacucggg

SEQ ID NO: 1121299 - RNA, 20 nt, Homo sapiens
cuguauaaccccaccuugcc

SEQ ID NO: 1121300 - RNA, 19 nt, Homo sapiens
cuguauauacaauaacaua

SEQ ID NO: 1121301 - RNA, 18 nt, Homo sapiens
cuguaucggagacaguga

SEQ ID NO: 1121302 - RNA, 16 nt, Homo sapiens
cuguaugauuccuuga

SEQ ID NO: 1121303 - RNA, 21 nt, Homo sapiens
cuguccaaggcacaaaccuua

SEQ ID NO: 1121304 - RNA, 12 nt, Homo sapiens
cugucccaaaga

SEQ ID NO: 1121305 - RNA, 16 nt, Homo sapiens
cuguccccacacugac

SEQ ID NO: 1121306 - RNA, 12 nt, Homo sapiens
cuguccuaggcc

SEQ ID NO: 1121307 - RNA, 22 nt, Homo sapiens
cuguccucgucucucugcaagg

SEQ ID NO: 1121308 - RNA, 17 nt, Homo sapiens
cugucuuucagcauuca

SEQ ID NO: 1121309 - RNA, 15 nt, Homo sapiens
cugugaccugcugag

SEQ ID NO: 1121310 - RNA, 18 nt, Homo sapiens
cugugcaaauccuugaua

SEQ ID NO: 1121311 - RNA, 21 nt, Homo sapiens
cugugcacggccagcugcauc

SEQ ID NO: 1121312 - RNA, 22 nt, Homo sapiens
cuguggagaaauaaaaauaccu

SEQ ID NO: 1121313 - RNA, 22 nt, Homo sapiens
cuguguaaaacuauauucucag

SEQ ID NO: 1121314 - RNA, 22 nt, Homo sapiens
cuguguacagaauucugcuacc

SEQ ID NO: 1121315 - RNA, 17 nt, Homo sapiens
cuguguacccacuccuc

SEQ ID NO: 1121316 - RNA, 19 nt, Homo sapiens
cugugucaguggaugcugc

SEQ ID NO: 1121317 - RNA, 23 nt, Homo sapiens
cugugucuuauagguuuccacug

SEQ ID NO: 1121318 - RNA, 20 nt, Homo sapiens
cugugucuuuuuucacuaca

SEQ ID NO: 1121319 - RNA, 13 nt, Homo sapiens
cuguguugucucu

SEQ ID NO: 1121320 - RNA, 22 nt, Homo sapiens
cuguuaaaauguacacuggaua

SEQ ID NO: 1121321 - RNA, 15 nt, Homo sapiens
cuguuacacaugaca

SEQ ID NO: 1121322 - RNA, 20 nt, Homo sapiens
cuguuacuuuuuagucuuuu

SEQ ID NO: 1121323 - RNA, 19 nt, Homo sapiens
cuguucuuccuaccaaaua

SEQ ID NO: 1121324 - RNA, 12 nt, Homo sapiens
cuguugcucaaa

SEQ ID NO: 1121325 - RNA, 16 nt, Homo sapiens
cuguuggccaguguga

SEQ ID NO: 1121326 - RNA, 19 nt, Homo sapiens
cuguuggccagugugacaa

SEQ ID NO: 1121327 - RNA, 21 nt, Homo sapiens
cuguuggccagugugacaagg

SEQ ID NO: 1121328 - RNA, 18 nt, Homo sapiens
cuguuguaacugcccaag

SEQ ID NO: 1121329 - RNA, 18 nt, Homo sapiens
cuguuucucucacugggc

SEQ ID NO: 1121330 - RNA, 15 nt, Homo sapiens
cuguuuuaauaauua

SEQ ID NO: 1121331 - RNA, 17 nt, Homo sapiens
cuguuuuucggacaguu

SEQ ID NO: 1121332 - RNA, 19 nt, Homo sapiens
cuuaaaagauucacuaaag

SEQ ID NO: 1121333 - RNA, 23 nt, Homo sapiens
cuuaaagcuuguuuguucuaguu

SEQ ID NO: 1121334 - RNA, 22 nt, Homo sapiens
cuuaaaugccuccuucucugcc

SEQ ID NO: 1121335 - RNA, 19 nt, Homo sapiens
cuuaaccagcacauuucuc

SEQ ID NO: 1121336 - RNA, 16 nt, Homo sapiens
cuuaagccuuuugcuc

SEQ ID NO: 1121337 - RNA, 16 nt, Homo sapiens
cuuaauaauugcauau

SEQ ID NO: 1121338 - RNA, 14 nt, Homo sapiens
cuuaauaggcuuua

SEQ ID NO: 1121339 - RNA, 14 nt, Homo sapiens
cuuacaaacaugug

SEQ ID NO: 1121340 - RNA, 14 nt, Homo sapiens
cuuacaugauucau

SEQ ID NO: 1121341 - RNA, 19 nt, Homo sapiens
cuuaccuuaaaaaguaauu

SEQ ID NO: 1121342 - RNA, 13 nt, Homo sapiens
cuuacuacuugcc

SEQ ID NO: 1121343 - RNA, 21 nt, Homo sapiens
cuuacuucccuaaugaaguua

SEQ ID NO: 1121344 - RNA, 21 nt, Homo sapiens
cuuagacuaguugaacaucuc

SEQ ID NO: 1121345 - RNA, 23 nt, Homo sapiens
cuuagauaaucgagucuaccucu

SEQ ID NO: 1121346 - RNA, 15 nt, Homo sapiens
cuuagccuacagaug

SEQ ID NO: 1121347 - RNA, 15 nt, Homo sapiens
cuuagcuuuccacag

SEQ ID NO: 1121348 - RNA, 20 nt, Homo sapiens
cuuaggacuuuccacuccug

SEQ ID NO: 1121349 - RNA, 21 nt, Homo sapiens
cuuaggugcuucuucacuuca

SEQ ID NO: 1121350 - RNA, 16 nt, Homo sapiens
cuuauagaaaguucaa

SEQ ID NO: 1121351 - RNA, 18 nt, Homo sapiens
cuuauagaaaguucaaaa

SEQ ID NO: 1121352 - RNA, 15 nt, Homo sapiens
cuuauagguuuccac

SEQ ID NO: 1121353 - RNA, 21 nt, Homo sapiens
cuuauagguuuccacugccaa

SEQ ID NO: 1121354 - RNA, 21 nt, Homo sapiens
cuuauaucaucagcauaccuu

SEQ ID NO: 1121355 - RNA, 22 nt, Homo sapiens
cuuaugggguauuuuaagcauu

SEQ ID NO: 1121356 - RNA, 16 nt, Homo sapiens
cuuauuuaacuuaaca

SEQ ID NO: 1121357 - RNA, 21 nt, Homo sapiens
cuucaacugaccagccuccau

SEQ ID NO: 1121358 - RNA, 18 nt, Homo sapiens
cuucaagagccucuggca

SEQ ID NO: 1121359 - RNA, 17 nt, Homo sapiens
cuucaagcacccuguuc

SEQ ID NO: 1121360 - RNA, 19 nt, Homo sapiens
cuucaaguuaaagugaaua

SEQ ID NO: 1121361 - RNA, 23 nt, Homo sapiens
ucacugaggcauuuuuacuacua

SEQ ID NO: 1121362 - RNA, 18 nt, Homo sapiens
ucacugauauauuuucca

SEQ ID NO: 1121363 - RNA, 15 nt, Homo sapiens
ucacugcagccucaa

SEQ ID NO: 1121364 - RNA, 14 nt, Homo sapiens
ucacugcucaagaa

SEQ ID NO: 1121365 - RNA, 23 nt, Homo sapiens
ucacuguagaaugauuucaugcu

SEQ ID NO: 1121366 - RNA, 13 nt, Homo sapiens
ucacuucaguugc

SEQ ID NO: 1121367 - RNA, 16 nt, Homo sapiens
ucacuugaacucggga

SEQ ID NO: 1121368 - RNA, 20 nt, Homo sapiens
ucagaaacaggugcaucugg

SEQ ID NO: 1121369 - RNA, 21 nt, Homo sapiens
ucagaaagggagggcucugag

SEQ ID NO: 1121370 - RNA, 22 nt, Homo sapiens
ucagaagacacugaugggcaac

SEQ ID NO: 1121371 - RNA, 13 nt, Homo sapiens
ucagaagccugag

SEQ ID NO: 1121372 - RNA, 22 nt, Homo sapiens
ucagaaucauugaaguauuuuc

SEQ ID NO: 1121373 - RNA, 22 nt, Homo sapiens
ucagaauuucuuugucauucaa

SEQ ID NO: 1121374 - RNA, 21 nt, Homo sapiens
ucagaccaacucucuccugua

SEQ ID NO: 1121375 - RNA, 16 nt, Homo sapiens
ucagacuccugugcaa

SEQ ID NO: 1121376 - RNA, 13 nt, Homo sapiens
ucagagacauaca

SEQ ID NO: 1121377 - RNA, 14 nt, Homo sapiens
ucagagcacagcag

SEQ ID NO: 1121378 - RNA, 17 nt, Homo sapiens
ucagaggcccaggaauc

SEQ ID NO: 1121379 - RNA, 20 nt, Homo sapiens
ucagauauuuuuucagaaau

SEQ ID NO: 1121380 - RNA, 21 nt, Homo sapiens
ucagauauuuuuucagaaaua

SEQ ID NO: 1121381 - RNA, 18 nt, Homo sapiens
ucagauggagacauugga

SEQ ID NO: 1121382 - RNA, 16 nt, Homo sapiens
ucagauucuucucuua

SEQ ID NO: 1121383 - RNA, 22 nt, Homo sapiens
ucagcaagacuucucuuugccu

SEQ ID NO: 1121384 - RNA, 15 nt, Homo sapiens
ucagcagagaacugg

SEQ ID NO: 1121385 - RNA, 18 nt, Homo sapiens
ucagccuagccgaccuca

SEQ ID NO: 1121386 - RNA, 21 nt, Homo sapiens
ucagccuccccccgcugggga

SEQ ID NO: 1121387 - RNA, 19 nt, Homo sapiens
ucagcuuguaaauagcuca

SEQ ID NO: 1121388 - RNA, 21 nt, Homo sapiens
ucaggacacuaauacaccagg

SEQ ID NO: 1121389 - RNA, 17 nt, Homo sapiens
ucaggagcuugcaagaa

SEQ ID NO: 1121390 - RNA, 13 nt, Homo sapiens
ucaggauaccaua

SEQ ID NO: 1121391 - RNA, 16 nt, Homo sapiens
ucaggauacucuguca

SEQ ID NO: 1121392 - RNA, 17 nt, Homo sapiens
ucaggccaacaagccaa

SEQ ID NO: 1121393 - RNA, 16 nt, Homo sapiens
ucaggcggggugcugu

SEQ ID NO: 1121394 - RNA, 21 nt, Homo sapiens
ucagggcuggaaaagucacac

SEQ ID NO: 1121395 - RNA, 14 nt, Homo sapiens
ucaguaaacaauga

SEQ ID NO: 1121396 - RNA, 20 nt, Homo sapiens
ucaguaaauauuaaccugaa

SEQ ID NO: 1121397 - RNA, 24 nt, Homo sapiens
ucaguaaauuguuuuuacugauga

SEQ ID NO: 1121398 - RNA, 16 nt, Homo sapiens
ucagucccccaccaca

SEQ ID NO: 1121399 - RNA, 13 nt, Homo sapiens
ucaguccuggaag

SEQ ID NO: 1121400 - RNA, 21 nt, Homo sapiens
ucagugaagaauacuucucau

SEQ ID NO: 1121401 - RNA, 22 nt, Homo sapiens
ucagugacagaguucacuauaa

SEQ ID NO: 1121402 - RNA, 23 nt, Homo sapiens
ucagugacagaguucacuauaaa

SEQ ID NO: 1121403 - RNA, 19 nt, Homo sapiens
ucaguguccucuugcucaa

SEQ ID NO: 1121404 - RNA, 16 nt, Homo sapiens
ucaguugacaaaauau

SEQ ID NO: 1121405 - RNA, 14 nt, Homo sapiens
ucaguuggagaaaa

SEQ ID NO: 1121406 - RNA, 18 nt, Homo sapiens
ucaguuguguuuggcagg

SEQ ID NO: 1121407 - RNA, 23 nt, Homo sapiens
ucauaagccuaccaauguagaca

SEQ ID NO: 1121408 - RNA, 19 nt, Homo sapiens
ucaucaacuuauuauauga

SEQ ID NO: 1121409 - RNA, 20 nt, Homo sapiens
ucaucaggcuuggaaugaau

SEQ ID NO: 1121410 - RNA, 22 nt, Homo sapiens
ucaucaggcuuggaaugaauuc

SEQ ID NO: 1121411 - RNA, 20 nt, Homo sapiens
ucaucucauuccaacuuccc

SEQ ID NO: 1121412 - RNA, 13 nt, Homo sapiens
ucaucucuacuaa

SEQ ID NO: 1121413 - RNA, 17 nt, Homo sapiens
ucaucuuagcuuuccac

SEQ ID NO: 1121414 - RNA, 13 nt, Homo sapiens
ucaugaaccucaa

SEQ ID NO: 1121415 - RNA, 23 nt, Homo sapiens
ucaugaacuauuuacauuuucca

SEQ ID NO: 1121416 - RNA, 19 nt, Homo sapiens
ucaugacccuccuguccag

SEQ ID NO: 1121417 - RNA, 14 nt, Homo sapiens
ucaugcauuugcac

SEQ ID NO: 1121418 - RNA, 12 nt, Homo sapiens
ucauggaacuca

SEQ ID NO: 1121419 - RNA, 13 nt, Homo sapiens
ucauguaaccaag

SEQ ID NO: 1121420 - RNA, 14 nt, Homo sapiens
ucauguaaccaaga

SEQ ID NO: 1121421 - RNA, 19 nt, Homo sapiens
ucauguaaccaagaguauu

SEQ ID NO: 1121422 - RNA, 15 nt, Homo sapiens
ucaugugauccuuuu

SEQ ID NO: 1121423 - RNA, 14 nt, Homo sapiens
ucauguuccucaaa

SEQ ID NO: 1121424 - RNA, 15 nt, Homo sapiens
ucauguuccucaaaa

SEQ ID NO: 1121425 - RNA, 13 nt, Homo sapiens
ucauguucuugca

SEQ ID NO: 1121426 - RNA, 20 nt, Homo sapiens
ucauuauaaacgugaugauc

SEQ ID NO: 1121427 - RNA, 14 nt, Homo sapiens
ucauuguguucucu

SEQ ID NO: 1121428 - RNA, 20 nt, Homo sapiens
ucauuguuuauuaacaaauu

SEQ ID NO: 1121429 - RNA, 17 nt, Homo sapiens
ucauuuaauuugaaauu

SEQ ID NO: 1121430 - RNA, 13 nt, Homo sapiens
ucauuuaccauaa

SEQ ID NO: 1121431 - RNA, 17 nt, Homo sapiens
ucauuuauaaaaccauc

SEQ ID NO: 1121432 - RNA, 13 nt, Homo sapiens
ucauuucaucuca

SEQ ID NO: 1121433 - RNA, 21 nt, Homo sapiens
ucauuuccuccgucaccucag

SEQ ID NO: 1121434 - RNA, 23 nt, Homo sapiens
ucauuuuaacuuuaucacauuau

SEQ ID NO: 1121435 - RNA, 18 nt, Homo sapiens
uccaaacagaaaagugca

SEQ ID NO: 1121436 - RNA, 17 nt, Homo sapiens
uccaaaggaaucuccag

SEQ ID NO: 1121437 - RNA, 14 nt, Homo sapiens
uccaaaguuaucca

SEQ ID NO: 1121438 - RNA, 19 nt, Homo sapiens
uccaaaugauuuucaucaa

SEQ ID NO: 1121439 - RNA, 13 nt, Homo sapiens
uccaaaugccaac

SEQ ID NO: 1121440 - RNA, 16 nt, Homo sapiens
uccaagaauacagaaa

SEQ ID NO: 1121441 - RNA, 23 nt, Homo sapiens
uccaaggaggucgggauggggcu

SEQ ID NO: 1121442 - RNA, 19 nt, Homo sapiens
uccaauggaauacugaaaa

SEQ ID NO: 1121443 - RNA, 12 nt, Homo sapiens
uccaauugaacu

SEQ ID NO: 1121444 - RNA, 20 nt, Homo sapiens
uccaauugaacuuucacaua

SEQ ID NO: 1121445 - RNA, 19 nt, Homo sapiens
uccacaaaaacaacuuauu

SEQ ID NO: 1121446 - RNA, 16 nt, Homo sapiens
uccacaauaaggucaa

SEQ ID NO: 1121447 - RNA, 14 nt, Homo sapiens
uccacagaaauaca

SEQ ID NO: 1121448 - RNA, 18 nt, Homo sapiens
uccacagaaauacaugaa

SEQ ID NO: 1121449 - RNA, 15 nt, Homo sapiens
uccacccagcaaaga

SEQ ID NO: 1121450 - RNA, 17 nt, Homo sapiens
uccacccugagccugac

SEQ ID NO: 1121451 - RNA, 22 nt, Homo sapiens
uccuuuacuaauccaacccaug

SEQ ID NO: 1121452 - RNA, 14 nt, Homo sapiens
uccuuucaccacau

SEQ ID NO: 1121453 - RNA, 23 nt, Homo sapiens
uccuuuccaagcuccucgugaua

SEQ ID NO: 1121454 - RNA, 22 nt, Homo sapiens
uccuuugacuuauuguccccac

SEQ ID NO: 1121455 - RNA, 19 nt, Homo sapiens
ucgaaaugaauuuaucuga

SEQ ID NO: 1121456 - RNA, 14 nt, Homo sapiens
ucgaagcuccguga

SEQ ID NO: 1121457 - RNA, 13 nt, Homo sapiens
ucgagguggauca

SEQ ID NO: 1121458 - RNA, 14 nt, Homo sapiens
ucgagucuaccucu

SEQ ID NO: 1121459 - RNA, 14 nt, Homo sapiens
ucgaguuuacuuca

SEQ ID NO: 1121460 - RNA, 20 nt, Homo sapiens
ucgaguuuacuucaugagga

SEQ ID NO: 1121461 - RNA, 13 nt, Homo sapiens
ucgauauaugacu

SEQ ID NO: 1121462 - RNA, 18 nt, Homo sapiens
ucgaugagaaauugaacu

SEQ ID NO: 1121463 - RNA, 14 nt, Homo sapiens
ucgauuagacugga

SEQ ID NO: 1121464 - RNA, 22 nt, Homo sapiens
ucgauuucaccaagaaguggag

SEQ ID NO: 1121465 - RNA, 17 nt, Homo sapiens
ucgcccaggagacaucc

SEQ ID NO: 1121466 - RNA, 16 nt, Homo sapiens
ucgcuccccacucugc

SEQ ID NO: 1121467 - RNA, 22 nt, Homo sapiens
ucggggaacuccuggaaauauc

SEQ ID NO: 1121468 - RNA, 20 nt, Homo sapiens
ucgguagaggauuucuaguu

SEQ ID NO: 1121469 - RNA, 10 nt, Homo sapiens
ucguagccaa

SEQ ID NO: 1121470 - RNA, 14 nt, Homo sapiens
ucguagccaucucu

SEQ ID NO: 1121471 - RNA, 20 nt, Homo sapiens
ucguggguguguguagccaa

SEQ ID NO: 1121472 - RNA, 12 nt, Homo sapiens
ucuaaaacugcc

SEQ ID NO: 1121473 - RNA, 17 nt, Homo sapiens
ucuaaaaucccuuucaa

SEQ ID NO: 1121474 - RNA, 14 nt, Homo sapiens
ucuaaacccaaaua

SEQ ID NO: 1121475 - RNA, 12 nt, Homo sapiens
ucuaaaugaagu

SEQ ID NO: 1121476 - RNA, 23 nt, Homo sapiens
ucuaacaccaacauaagguacua

SEQ ID NO: 1121477 - RNA, 17 nt, Homo sapiens
ucuaacccccagugcca

SEQ ID NO: 1121478 - RNA, 22 nt, Homo sapiens
ucuaagcugcagcuuccuguca

SEQ ID NO: 1121479 - RNA, 19 nt, Homo sapiens
ucuaagguaguaacuuucc

SEQ ID NO: 1121480 - RNA, 20 nt, Homo sapiens
ucuaaguggaaaaaguauua

SEQ ID NO: 1121481 - RNA, 22 nt, Homo sapiens
ucuaaucuuuuaauguauuugu

SEQ ID NO: 1121482 - RNA, 20 nt, Homo sapiens
ucuacaaaaaauaaaaacac

SEQ ID NO: 1121483 - RNA, 21 nt, Homo sapiens
ucuacaaacucccacuuguca

SEQ ID NO: 1121484 - RNA, 13 nt, Homo sapiens
ucuacaaccagag

SEQ ID NO: 1121485 - RNA, 23 nt, Homo sapiens
ucuacacagcaguaugaaugaug

SEQ ID NO: 1121486 - RNA, 15 nt, Homo sapiens
ucuacccuauacaac

SEQ ID NO: 1121487 - RNA, 13 nt, Homo sapiens
ucuaccgaccugu

SEQ ID NO: 1121488 - RNA, 16 nt, Homo sapiens
ucuaccuggucucucc

SEQ ID NO: 1121489 - RNA, 23 nt, Homo sapiens
ucuaccuuuaaaauuuaccacag

SEQ ID NO: 1121490 - RNA, 20 nt, Homo sapiens
ucuacguauaaauaugaaau

SEQ ID NO: 1121491 - RNA, 16 nt, Homo sapiens
ucuacuccaugcacau

SEQ ID NO: 1121492 - RNA, 17 nt, Homo sapiens
ucuacuccuaccucagc

SEQ ID NO: 1121493 - RNA, 22 nt, Homo sapiens
ucuacugugacugauguuacau

SEQ ID NO: 1121494 - RNA, 19 nt, Homo sapiens
ucuagccuggcaacagagc

SEQ ID NO: 1121495 - RNA, 13 nt, Homo sapiens
ucuaguaucacau

SEQ ID NO: 1121496 - RNA, 15 nt, Homo sapiens
ucuauaguagucaau

SEQ ID NO: 1121497 - RNA, 18 nt, Homo sapiens
ucuaugggacucaaugca

SEQ ID NO: 1121498 - RNA, 13 nt, Homo sapiens
ucuauguacugua

SEQ ID NO: 1121499 - RNA, 15 nt, Homo sapiens
ucuauucuuucccua

SEQ ID NO: 1121500 - RNA, 20 nt, Homo sapiens
ucucaaauccugaugcuguu

SEQ ID NO: 1121501 - RNA, 14 nt, Homo sapiens
ucucaaaugcacau

SEQ ID NO: 1121502 - RNA, 18 nt, Homo sapiens
ucucacuauguugcccag

SEQ ID NO: 1121503 - RNA, 14 nt, Homo sapiens
ucucacuugucuca

SEQ ID NO: 1121504 - RNA, 16 nt, Homo sapiens
ucucagccuaccauga

SEQ ID NO: 1121505 - RNA, 19 nt, Homo sapiens
ucucaggagcuugcaagaa

SEQ ID NO: 1121506 - RNA, 20 nt, Homo sapiens
ucucagucaguaauugccaa

SEQ ID NO: 1121507 - RNA, 16 nt, Homo sapiens
ucucagugcucuccua

SEQ ID NO: 1121508 - RNA, 19 nt, Homo sapiens
ucucauuuaaaaugagauc

SEQ ID NO: 1121509 - RNA, 17 nt, Homo sapiens
ucuccaaaugagaucua

SEQ ID NO: 1121510 - RNA, 22 nt, Homo sapiens
ucuccagccagcaaugaugucc

SEQ ID NO: 1121511 - RNA, 24 nt, Homo sapiens
ucuccagccagcaaugauguccag

SEQ ID NO: 1121512 - RNA, 22 nt, Homo sapiens
ucuccagccaucaagagacuga

SEQ ID NO: 1121513 - RNA, 22 nt, Homo sapiens
ucuccagugguugcuguugaug

SEQ ID NO: 1121514 - RNA, 14 nt, Homo sapiens
ucuccucagaagaa

SEQ ID NO: 1121515 - RNA, 17 nt, Homo sapiens
ucuccuuugcacugagg

SEQ ID NO: 1121516 - RNA, 18 nt, Homo sapiens
ucuccuuuggccauucca

SEQ ID NO: 1121517 - RNA, 18 nt, Homo sapiens
ucucguaacugguuucau

SEQ ID NO: 1121518 - RNA, 20 nt, Homo sapiens
ucucuacccggcccagagac

SEQ ID NO: 1121519 - RNA, 13 nt, Homo sapiens
ucucuaugaucuu

SEQ ID NO: 1121520 - RNA, 23 nt, Homo sapiens
ucucuaugccagcucagucccau

SEQ ID NO: 1121521 - RNA, 15 nt, Homo sapiens
ucucuauugcugcuc

SEQ ID NO: 1121522 - RNA, 20 nt, Homo sapiens
ucucuccucagacugcucaa

SEQ ID NO: 1121523 - RNA, 23 nt, Homo sapiens
ucucucuaaaaauaaaaugaugu

SEQ ID NO: 1121524 - RNA, 14 nt, Homo sapiens
ucucucucuguccu

SEQ ID NO: 1121525 - RNA, 10 nt, Homo sapiens
ucucucugca

SEQ ID NO: 1121526 - RNA, 16 nt, Homo sapiens
ucucugacucuugccu

SEQ ID NO: 1121527 - RNA, 18 nt, Homo sapiens
ucucugagaacagacguu

SEQ ID NO: 1121528 - RNA, 14 nt, Homo sapiens
ucucugcucuugcc

SEQ ID NO: 1121529 - RNA, 15 nt, Homo sapiens
ucucugcucuugccu

SEQ ID NO: 1121530 - RNA, 20 nt, Homo sapiens
ucucuggaacccaggaccuc

SEQ ID NO: 1121531 - RNA, 15 nt, Homo sapiens
ucucugggagacuuu

SEQ ID NO: 1121532 - RNA, 15 nt, Homo sapiens
ucucugucucaaauu

SEQ ID NO: 1121533 - RNA, 16 nt, Homo sapiens
ucucugugugcacaaa

SEQ ID NO: 1121534 - RNA, 17 nt, Homo sapiens
ucucuuauauaguauuc

SEQ ID NO: 1121535 - RNA, 13 nt, Homo sapiens
ucucuuugagaga

SEQ ID NO: 1121536 - RNA, 22 nt, Homo sapiens
ucucuuuuguuccuggcuuuga

SEQ ID NO: 1121537 - RNA, 20 nt, Homo sapiens
ucugaaauuuuaauugaacu

SEQ ID NO: 1121538 - RNA, 13 nt, Homo sapiens
ucugaagucacau

SEQ ID NO: 1121539 - RNA, 23 nt, Homo sapiens
ucugaagucacaucacaggacac

SEQ ID NO: 1121540 - RNA, 14 nt, Homo sapiens
ucugacacacagcu

SEQ ID NO: 1121541 - RNA, 13 nt, Homo sapiens
ucugaccauuuca

SEQ ID NO: 1121542 - RNA, 15 nt, Homo sapiens
ugaaauuauaucugu

SEQ ID NO: 1121543 - RNA, 12 nt, Homo sapiens
ugaacacugggg

SEQ ID NO: 1121544 - RNA, 11 nt, Homo sapiens
ugaacagccaa

SEQ ID NO: 1121545 - RNA, 17 nt, Homo sapiens
ugaacaucucacuuugc

SEQ ID NO: 1121546 - RNA, 21 nt, Homo sapiens
ugaacaucuuuaggagacuaa

SEQ ID NO: 1121547 - RNA, 18 nt, Homo sapiens
ugaaccuaaacauagaaa

SEQ ID NO: 1121548 - RNA, 19 nt, Homo sapiens
ugaaccugggaaccaugaa

SEQ ID NO: 1121549 - RNA, 19 nt, Homo sapiens
ugaacuauuagacaugaaa

SEQ ID NO: 1121550 - RNA, 21 nt, Homo sapiens
ugaacuccuggccucaaguga

SEQ ID NO: 1121551 - RNA, 21 nt, Homo sapiens
ugaacuuggaaagaaaugccc

SEQ ID NO: 1121552 - RNA, 24 nt, Homo sapiens
ugaacuuggaaagaaaugcccauc

SEQ ID NO: 1121553 - RNA, 18 nt, Homo sapiens
ugaacuuucacauagcac

SEQ ID NO: 1121554 - RNA, 15 nt, Homo sapiens
ugaagaaaagcacuu

SEQ ID NO: 1121555 - RNA, 13 nt, Homo sapiens
ugaagacccagug

SEQ ID NO: 1121556 - RNA, 14 nt, Homo sapiens
ugaagagagauaua

SEQ ID NO: 1121557 - RNA, 22 nt, Homo sapiens
ugaagaggaagggcaaaaccac

SEQ ID NO: 1121558 - RNA, 17 nt, Homo sapiens
ugaagauguaaggaauu

SEQ ID NO: 1121559 - RNA, 13 nt, Homo sapiens
ugaagccacugaa

SEQ ID NO: 1121560 - RNA, 22 nt, Homo sapiens
ugaagccagcugcaggaaucaa

SEQ ID NO: 1121561 - RNA, 14 nt, Homo sapiens
ugaagcucuggcca

SEQ ID NO: 1121562 - RNA, 20 nt, Homo sapiens
ugaaggacgugucucaggag

SEQ ID NO: 1121563 - RNA, 16 nt, Homo sapiens
ugaaggguaaagaagu

SEQ ID NO: 1121564 - RNA, 16 nt, Homo sapiens
ugaaggucacucuucc

SEQ ID NO: 1121565 - RNA, 12 nt, Homo sapiens
ugaaggugcuga

SEQ ID NO: 1121566 - RNA, 18 nt, Homo sapiens
ugaaggugcugacaaaga

SEQ ID NO: 1121567 - RNA, 15 nt, Homo sapiens
ugaagucacacagug

SEQ ID NO: 1121568 - RNA, 16 nt, Homo sapiens
ugaagucacacaguga

SEQ ID NO: 1121569 - RNA, 23 nt, Homo sapiens
ugaagucaguuucuaucauucug

SEQ ID NO: 1121570 - RNA, 12 nt, Homo sapiens
ugaagugcaaau

SEQ ID NO: 1121571 - RNA, 20 nt, Homo sapiens
ugaaguuaagaaccugaaua

SEQ ID NO: 1121572 - RNA, 22 nt, Homo sapiens
ugaaguuguguuaacaaugcag

SEQ ID NO: 1121573 - RNA, 22 nt, Homo sapiens
ugaauaacauuugugugguggg

SEQ ID NO: 1121574 - RNA, 13 nt, Homo sapiens
ugaauaaccacuu

SEQ ID NO: 1121575 - RNA, 17 nt, Homo sapiens
ugaauaaguauucuuca

SEQ ID NO: 1121576 - RNA, 13 nt, Homo sapiens
ugaaugacguguc

SEQ ID NO: 1121577 - RNA, 14 nt, Homo sapiens
ugaaugcaaaguag

SEQ ID NO: 1121578 - RNA, 14 nt, Homo sapiens
ugaaugcuauugaa

SEQ ID NO: 1121579 - RNA, 22 nt, Homo sapiens
ugaaugguccaggguugaucac

SEQ ID NO: 1121580 - RNA, 16 nt, Homo sapiens
ugaaugguuccaugcc

SEQ ID NO: 1121581 - RNA, 17 nt, Homo sapiens
ugaauuggaccauccua

SEQ ID NO: 1121582 - RNA, 14 nt, Homo sapiens
ugaauuucaguaaa

SEQ ID NO: 1121583 - RNA, 18 nt, Homo sapiens
ugacaaaauaacauuuga

SEQ ID NO: 1121584 - RNA, 16 nt, Homo sapiens
ugacaaaauuggccag

SEQ ID NO: 1121585 - RNA, 21 nt, Homo sapiens
ugacaaagaugaccugcugcu

SEQ ID NO: 1121586 - RNA, 14 nt, Homo sapiens
ugacaagcacugcu

SEQ ID NO: 1121587 - RNA, 12 nt, Homo sapiens
ugacacacagcu

SEQ ID NO: 1121588 - RNA, 15 nt, Homo sapiens
ugacacauaugcacc

SEQ ID NO: 1121589 - RNA, 14 nt, Homo sapiens
ugacagaacacugu

SEQ ID NO: 1121590 - RNA, 16 nt, Homo sapiens
ugacagacacaggccc

SEQ ID NO: 1121591 - RNA, 16 nt, Homo sapiens
ugacagagacccagau

SEQ ID NO: 1121592 - RNA, 19 nt, Homo sapiens
ugacagaguucacuauaaa

SEQ ID NO: 1121593 - RNA, 17 nt, Homo sapiens
ugacagccagagccugu

SEQ ID NO: 1121594 - RNA, 23 nt, Homo sapiens
ugacagccagagccugucuuuca

SEQ ID NO: 1121595 - RNA, 14 nt, Homo sapiens
ugacaggcaaugcu

SEQ ID NO: 1121596 - RNA, 15 nt, Homo sapiens
ugacaguaugcauua

SEQ ID NO: 1121597 - RNA, 17 nt, Homo sapiens
ugacaugggugugccag

SEQ ID NO: 1121598 - RNA, 18 nt, Homo sapiens
ugacaugggugugccagg

SEQ ID NO: 1121599 - RNA, 14 nt, Homo sapiens
ugacaugugcuuug

SEQ ID NO: 1121600 - RNA, 24 nt, Homo sapiens
ugaccaaguuauaaaucaauguca

SEQ ID NO: 1121601 - RNA, 22 nt, Homo sapiens
ugaccaggcauccuccacaaua

SEQ ID NO: 1121602 - RNA, 16 nt, Homo sapiens
ugaccauuucaggggu

SEQ ID NO: 1121603 - RNA, 19 nt, Homo sapiens
ugaccuaaccuaagcaaaa

SEQ ID NO: 1121604 - RNA, 14 nt, Homo sapiens
ugaccucaggugau

SEQ ID NO: 1121605 - RNA, 18 nt, Homo sapiens
ugaccucauuuguaaaau

SEQ ID NO: 1121606 - RNA, 19 nt, Homo sapiens
ugaccuuucugagugacau

SEQ ID NO: 1121607 - RNA, 22 nt, Homo sapiens
ugacggcugcucgaagaacaau

SEQ ID NO: 1121608 - RNA, 22 nt, Homo sapiens
ugacguuggccuaacacugggc

SEQ ID NO: 1121609 - RNA, 20 nt, Homo sapiens
ugacuaaacaacuaccuccu

SEQ ID NO: 1121610 - RNA, 22 nt, Homo sapiens
ugacuaaacaacuaccuccuca

SEQ ID NO: 1121611 - RNA, 17 nt, Homo sapiens
ugacuaucacauacaau

SEQ ID NO: 1121612 - RNA, 17 nt, Homo sapiens
ugacuauggcuaccaaa

SEQ ID NO: 1121613 - RNA, 21 nt, Homo sapiens
ugacucaugaacuauuuacau

SEQ ID NO: 1121614 - RNA, 14 nt, Homo sapiens
ugacucugacuuug

SEQ ID NO: 1121615 - RNA, 18 nt, Homo sapiens
ugacugauguuacaucac

SEQ ID NO: 1121616 - RNA, 18 nt, Homo sapiens
ugacuguguucagugccu

SEQ ID NO: 1121617 - RNA, 15 nt, Homo sapiens
ugacuuccacaccua

SEQ ID NO: 1121618 - RNA, 19 nt, Homo sapiens
ugacuugacagaacacugu

SEQ ID NO: 1121619 - RNA, 23 nt, Homo sapiens
ugagaaaccuuauuguaccucuc

SEQ ID NO: 1121620 - RNA, 16 nt, Homo sapiens
ugagaaacugauuuau

SEQ ID NO: 1121621 - RNA, 18 nt, Homo sapiens
ugagaaauuuaaacuaua

SEQ ID NO: 1121622 - RNA, 18 nt, Homo sapiens
ugagaaucacuugaacuc

SEQ ID NO: 1121623 - RNA, 19 nt, Homo sapiens
ugagaaugagggccaagaa

SEQ ID NO: 1121624 - RNA, 12 nt, Homo sapiens
ugagacaaucac

SEQ ID NO: 1121625 - RNA, 16 nt, Homo sapiens
ugagacccccaucucu

SEQ ID NO: 1121626 - RNA, 17 nt, Homo sapiens
ugagacucugucucaaa

SEQ ID NO: 1121627 - RNA, 21 nt, Homo sapiens
ugagagggauuuggguguuua

SEQ ID NO: 1121628 - RNA, 18 nt, Homo sapiens
ugagaggggaacagacug

SEQ ID NO: 1121629 - RNA, 18 nt, Homo sapiens
ugagauaaccacaaccag

SEQ ID NO: 1121630 - RNA, 13 nt, Homo sapiens
ugagauuacaggu

SEQ ID NO: 1121631 - RNA, 16 nt, Homo sapiens
ugagcaagcuaugagg

SEQ ID NO: 1121632 - RNA, 23 nt, Homo sapiens
ugagcaccuacuuacaugcauua

SEQ ID NO: 1121633 - RNA, 17 nt, Homo sapiens
uggaaaaugugacccag

SEQ ID NO: 1121634 - RNA, 13 nt, Homo sapiens
uggaaacuggcca

SEQ ID NO: 1121635 - RNA, 17 nt, Homo sapiens
uggaaagacauagccaa

SEQ ID NO: 1121636 - RNA, 19 nt, Homo sapiens
uggaaauaaaauacuucua

SEQ ID NO: 1121637 - RNA, 12 nt, Homo sapiens
uggaacagugca

SEQ ID NO: 1121638 - RNA, 23 nt, Homo sapiens
uggaaccaacacuaacauauaau

SEQ ID NO: 1121639 - RNA, 16 nt, Homo sapiens
uggaacccccagaaua

SEQ ID NO: 1121640 - RNA, 16 nt, Homo sapiens
uggaacucaaggaaau

SEQ ID NO: 1121641 - RNA, 14 nt, Homo sapiens
uggaagaaauuccu

SEQ ID NO: 1121642 - RNA, 20 nt, Homo sapiens
uggaagaggcaccuguccca

SEQ ID NO: 1121643 - RNA, 15 nt, Homo sapiens
uggaagcacagcuuc

SEQ ID NO: 1121644 - RNA, 19 nt, Homo sapiens
uggaagcauuuguuucuac

SEQ ID NO: 1121645 - RNA, 22 nt, Homo sapiens
uggaagcucugaagucacauca

SEQ ID NO: 1121646 - RNA, 13 nt, Homo sapiens
uggaauguaauca

SEQ ID NO: 1121647 - RNA, 13 nt, Homo sapiens
uggaauugugcug

SEQ ID NO: 1121648 - RNA, 19 nt, Homo sapiens
uggacaccccugcuauaua

SEQ ID NO: 1121649 - RNA, 13 nt, Homo sapiens
uggaccacaggca

SEQ ID NO: 1121650 - RNA, 13 nt, Homo sapiens
uggaccagccugu

SEQ ID NO: 1121651 - RNA, 17 nt, Homo sapiens
uggaccugcaccaaagc

SEQ ID NO: 1121652 - RNA, 19 nt, Homo sapiens
uggacucaguuuucuugca

SEQ ID NO: 1121653 - RNA, 14 nt, Homo sapiens
uggacucugcacau

SEQ ID NO: 1121654 - RNA, 15 nt, Homo sapiens
uggacucugcacaug

SEQ ID NO: 1121655 - RNA, 19 nt, Homo sapiens
uggagacggccaagugaag

SEQ ID NO: 1121656 - RNA, 22 nt, Homo sapiens
uggagagaucauagcucacugu

SEQ ID NO: 1121657 - RNA, 23 nt, Homo sapiens
uggagcccaggaguuugaggcug

SEQ ID NO: 1121658 - RNA, 23 nt, Homo sapiens
uggaggacagugggaacuggagg

SEQ ID NO: 1121659 - RNA, 23 nt, Homo sapiens
uggaggagcugggcuucugucca

SEQ ID NO: 1121660 - RNA, 19 nt, Homo sapiens
uggagggucgccacacccg

SEQ ID NO: 1121661 - RNA, 17 nt, Homo sapiens
uggaguucuugugccau

SEQ ID NO: 1121662 - RNA, 16 nt, Homo sapiens
uggauguggggucccc

SEQ ID NO: 1121663 - RNA, 15 nt, Homo sapiens
uggauucgugacaac

SEQ ID NO: 1121664 - RNA, 15 nt, Homo sapiens
uggcaaccuguucuu

SEQ ID NO: 1121665 - RNA, 21 nt, Homo sapiens
uggcaagugaauuugccugua

SEQ ID NO: 1121666 - RNA, 17 nt, Homo sapiens
uggcagcaaagugucag

SEQ ID NO: 1121667 - RNA, 20 nt, Homo sapiens
uggcagcgccucaucuucaa

SEQ ID NO: 1121668 - RNA, 14 nt, Homo sapiens
uggcaggaccagga

SEQ ID NO: 1121669 - RNA, 13 nt, Homo sapiens
uggcagggacccc

SEQ ID NO: 1121670 - RNA, 17 nt, Homo sapiens
uggcaguccagccagcu

SEQ ID NO: 1121671 - RNA, 16 nt, Homo sapiens
uggcauucacaucuca

SEQ ID NO: 1121672 - RNA, 20 nt, Homo sapiens
uggccaaccaaagacacugu

SEQ ID NO: 1121673 - RNA, 18 nt, Homo sapiens
uggccaugcuucuugccc

SEQ ID NO: 1121674 - RNA, 17 nt, Homo sapiens
uggcccagggaagccaa

SEQ ID NO: 1121675 - RNA, 19 nt, Homo sapiens
uggcccagggaagccaaaa

SEQ ID NO: 1121676 - RNA, 22 nt, Homo sapiens
uggccgggugcgguggcucacg

SEQ ID NO: 1121677 - RNA, 19 nt, Homo sapiens
uggccuaaaaaugcaacuu

SEQ ID NO: 1121678 - RNA, 13 nt, Homo sapiens
uggccuggcacac

SEQ ID NO: 1121679 - RNA, 21 nt, Homo sapiens
uggccuggggaagcugugaaa

SEQ ID NO: 1121680 - RNA, 12 nt, Homo sapiens
uggcuagucaua

SEQ ID NO: 1121681 - RNA, 16 nt, Homo sapiens
uggcuagucauaaccu

SEQ ID NO: 1121682 - RNA, 19 nt, Homo sapiens
uggcuaucugcauuuauaa

SEQ ID NO: 1121683 - RNA, 16 nt, Homo sapiens
uggcucacgccuguaa

SEQ ID NO: 1121684 - RNA, 12 nt, Homo sapiens
uggcucugccag

SEQ ID NO: 1121685 - RNA, 13 nt, Homo sapiens
uggcucugugaaa

SEQ ID NO: 1121686 - RNA, 15 nt, Homo sapiens
uggcugaccccaaag

SEQ ID NO: 1121687 - RNA, 17 nt, Homo sapiens
uggcugaccccaaagag

SEQ ID NO: 1121688 - RNA, 15 nt, Homo sapiens
uggcugcuagcacuu

SEQ ID NO: 1121689 - RNA, 19 nt, Homo sapiens
uggcugggggccucagugc

SEQ ID NO: 1121690 - RNA, 11 nt, Homo sapiens
uggcuucuuac

SEQ ID NO: 1121691 - RNA, 19 nt, Homo sapiens
ugggaauugcaugccaucu

SEQ ID NO: 1121692 - RNA, 22 nt, Homo sapiens
ugggaauugcaugccaucucca

SEQ ID NO: 1121693 - RNA, 16 nt, Homo sapiens
ugggacagcaaccugu

SEQ ID NO: 1121694 - RNA, 13 nt, Homo sapiens
ugggagagccaga

SEQ ID NO: 1121695 - RNA, 15 nt, Homo sapiens
ugggaggaaccugaa

SEQ ID NO: 1121696 - RNA, 14 nt, Homo sapiens
ugggauaaucacau

SEQ ID NO: 1121697 - RNA, 11 nt, Homo sapiens
ugggaugcuac

SEQ ID NO: 1121698 - RNA, 16 nt, Homo sapiens
ugggauugugguacaa

SEQ ID NO: 1121699 - RNA, 14 nt, Homo sapiens
ugggcagaaagugg

SEQ ID NO: 1121700 - RNA, 18 nt, Homo sapiens
ugggcagcauagcaagac

SEQ ID NO: 1121701 - RNA, 18 nt, Homo sapiens
ugggcauucuuguuucaa

SEQ ID NO: 1121702 - RNA, 16 nt, Homo sapiens
ugggccccaccaccua

SEQ ID NO: 1121703 - RNA, 16 nt, Homo sapiens
ugggcgaagcuaaaag

SEQ ID NO: 1121704 - RNA, 19 nt, Homo sapiens
ugggcuggugucaccugaa

SEQ ID NO: 1121705 - RNA, 16 nt, Homo sapiens
uggggagaaaguacuu

SEQ ID NO: 1121706 - RNA, 19 nt, Homo sapiens
uggggagggagagccauca

SEQ ID NO: 1121707 - RNA, 24 nt, Homo sapiens
ugggggaggcggcacauuggcagu

SEQ ID NO: 1121708 - RNA, 21 nt, Homo sapiens
ugggggccucuuucugugcuu

SEQ ID NO: 1121709 - RNA, 16 nt, Homo sapiens
ugggggcuagcagaag

SEQ ID NO: 1121710 - RNA, 18 nt, Homo sapiens
ugggguacccacugcucu

SEQ ID NO: 1121711 - RNA, 21 nt, Homo sapiens
ugggguacccacugcucuggu

SEQ ID NO: 1121712 - RNA, 16 nt, Homo sapiens
ugggguauggcaucua

SEQ ID NO: 1121713 - RNA, 18 nt, Homo sapiens
uggguacuuguggacaca

SEQ ID NO: 1121714 - RNA, 15 nt, Homo sapiens
ugggucuucccugua

SEQ ID NO: 1121715 - RNA, 21 nt, Homo sapiens
ugggugaacaccaacuuuuau

SEQ ID NO: 1121716 - RNA, 20 nt, Homo sapiens
uggguggggcugcuccucca

SEQ ID NO: 1121717 - RNA, 18 nt, Homo sapiens
ugguaaaaccccaucucu

SEQ ID NO: 1121718 - RNA, 21 nt, Homo sapiens
ugguagguuugaaugacgugu

SEQ ID NO: 1121719 - RNA, 20 nt, Homo sapiens
ugguaugaacuugaggacac

SEQ ID NO: 1121720 - RNA, 15 nt, Homo sapiens
uggucaacacuuaag

SEQ ID NO: 1121721 - RNA, 19 nt, Homo sapiens
uggucaauccgaaguauga

SEQ ID NO: 1121722 - RNA, 18 nt, Homo sapiens
ugguccgaagucuuccau

SEQ ID NO: 1121723 - RNA, 13 nt, Homo sapiens
uggucugacccac

SEQ ID NO: 1121724 - RNA, 18 nt, Homo sapiens
ugugucccccucugucca

SEQ ID NO: 1121725 - RNA, 12 nt, Homo sapiens
uguuauucuugu

SEQ ID NO: 1121726 - RNA, 16 nt, Homo sapiens
uguucccccugugcag

SEQ ID NO: 1121727 - RNA, 19 nt, Homo sapiens
uguuggauaaagaccuucc

SEQ ID NO: 1121728 - RNA, 20 nt, Homo sapiens
uguuucaauugcaucuccca

SEQ ID NO: 1121729 - RNA, 11 nt, Homo sapiens
uguuugucagc

SEQ ID NO: 1121730 - RNA, 15 nt, Homo sapiens
uguuugucagcaucu

SEQ ID NO: 1121731 - RNA, 15 nt, Homo sapiens
uguuuugcacugaca

SEQ ID NO: 1121732 - RNA, 18 nt, Homo sapiens
uuaaaacguguaaaugaa

SEQ ID NO: 1121733 - RNA, 16 nt, Homo sapiens
uuaaaaucaugauccu

SEQ ID NO: 1121734 - RNA, 16 nt, Homo sapiens
uuaaauaaagucucuc

SEQ ID NO: 1121735 - RNA, 17 nt, Homo sapiens
uuaaauacagucuucca

SEQ ID NO: 1121736 - RNA, 21 nt, Homo sapiens
uuaaaucaacgaguacuucaa

SEQ ID NO: 1121737 - RNA, 13 nt, Homo sapiens
uuaauuauugcuu

SEQ ID NO: 1121738 - RNA, 21 nt, Homo sapiens
uuacagaaucacagcccucau

SEQ ID NO: 1121739 - RNA, 12 nt, Homo sapiens
uuaccucugaua

SEQ ID NO: 1121740 - RNA, 15 nt, Homo sapiens
uuacgauuaguauau

SEQ ID NO: 1121741 - RNA, 18 nt, Homo sapiens
uuagaugggaggaugaau

SEQ ID NO: 1121742 - RNA, 23 nt, Homo sapiens
uuagauguucuaagucuuuccau

SEQ ID NO: 1121743 - RNA, 21 nt, Homo sapiens
uuaguaaauaaacaagucaaa

SEQ ID NO: 1121744 - RNA, 21 nt, Homo sapiens
uuauacuucucuauuaucuca

SEQ ID NO: 1121745 - RNA, 21 nt, Homo sapiens
uuaucuauuccugaaauuucu

SEQ ID NO: 1121746 - RNA, 14 nt, Homo sapiens
uuauguuacuguau

SEQ ID NO: 1121747 - RNA, 13 nt, Homo sapiens
uuauuaacuaaga

SEQ ID NO: 1121748 - RNA, 15 nt, Homo sapiens
uuauuaccucugaua

SEQ ID NO: 1121749 - RNA, 21 nt, Homo sapiens
uuauuaccucugauaccucaa

SEQ ID NO: 1121750 - RNA, 19 nt, Homo sapiens
uuauuagagugucuuucca

SEQ ID NO: 1121751 - RNA, 20 nt, Homo sapiens
uucacuucuaccuacauauu

SEQ ID NO: 1121752 - RNA, 15 nt, Homo sapiens
uucacuuuugacaaa

SEQ ID NO: 1121753 - RNA, 15 nt, Homo sapiens
uucaugaucaucaca

SEQ ID NO: 1121754 - RNA, 19 nt, Homo sapiens
uucauguaauaaacagguu

SEQ ID NO: 1121755 - RNA, 19 nt, Homo sapiens
uucauguaauagcaaugca

SEQ ID NO: 1121756 - RNA, 22 nt, Homo sapiens
uuccauugaagccgacucuggc

SEQ ID NO: 1121757 - RNA, 18 nt, Homo sapiens
uucccugaccucccucua

SEQ ID NO: 1121758 - RNA, 20 nt, Homo sapiens
uuccugacacucaauaaaca

SEQ ID NO: 1121759 - RNA, 23 nt, Homo sapiens
uucuaaauaugaaugaaugggau

SEQ ID NO: 1121760 - RNA, 17 nt, Homo sapiens
uucucccaccaccucac

SEQ ID NO: 1121761 - RNA, 16 nt, Homo sapiens
uucucugggcugaaug

SEQ ID NO: 1121762 - RNA, 20 nt, Homo sapiens
uugcaccuguccccacccuc

SEQ ID NO: 1121763 - RNA, 18 nt, Homo sapiens
uugcauuuugauauugcu

SEQ ID NO: 1121764 - RNA, 16 nt, Homo sapiens
uugccacuacccccuc

SEQ ID NO: 1121765 - RNA, 19 nt, Homo sapiens
uugccucccagcuucuuau

SEQ ID NO: 1121766 - RNA, 21 nt, Homo sapiens
uugccucugaagccuauguau

SEQ ID NO: 1121767 - RNA, 18 nt, Homo sapiens
uugcugauaccauaugaa

SEQ ID NO: 1121768 - RNA, 23 nt, Homo sapiens
uugcuggggcucgugcccugcau

SEQ ID NO: 1121769 - RNA, 21 nt, Homo sapiens
uuggaacuuuuauuacugggg

SEQ ID NO: 1121770 - RNA, 15 nt, Homo sapiens
uuggaagaugcagaa

SEQ ID NO: 1121771 - RNA, 13 nt, Homo sapiens
uuggcaaugccau

SEQ ID NO: 1121772 - RNA, 18 nt, Homo sapiens
uuggcauucuuugcaaua

SEQ ID NO: 1121773 - RNA, 18 nt, Homo sapiens
uuggcuuguuuggagcau

SEQ ID NO: 1121774 - RNA, 22 nt, Homo sapiens
uugggaggcugaggcaagagaa

SEQ ID NO: 1121775 - RNA, 20 nt, Homo sapiens
uugggauucuaggaaaccca

SEQ ID NO: 1121776 - RNA, 22 nt, Homo sapiens
uugguguggguucauuggcauu

SEQ ID NO: 1121777 - RNA, 17 nt, Homo sapiens
uuguaauaugucugcca

SEQ ID NO: 1121778 - RNA, 19 nt, Homo sapiens
uuguauauagaguggaauc

SEQ ID NO: 1121779 - RNA, 20 nt, Homo sapiens
uuguauguuuuucuguauaa

SEQ ID NO: 1121780 - RNA, 22 nt, Homo sapiens
uugucuagaggugagaccaaag

SEQ ID NO: 1121781 - RNA, 16 nt, Homo sapiens
uuguuuagagagccug

SEQ ID NO: 1121782 - RNA, 23 nt, Homo sapiens
uuuaaauacagucuuccauuugc

SEQ ID NO: 1121783 - RNA, 12 nt, Homo sapiens
uuuaaaucugag

SEQ ID NO: 1121784 - RNA, 21 nt, Homo sapiens
uuuaacuagaauuuauucaau

SEQ ID NO: 1121785 - RNA, 23 nt, Homo sapiens
uuuacagaaucaaaugcaauuuu

SEQ ID NO: 1121786 - RNA, 23 nt, Homo sapiens
uuuacauguauuuaaaguagcau

SEQ ID NO: 1121787 - RNA, 13 nt, Homo sapiens
uuuauuaccucug

SEQ ID NO: 1121788 - RNA, 13 nt, Homo sapiens
uuuauugcaaugc

SEQ ID NO: 1121789 - RNA, 16 nt, Homo sapiens
uuucaaaaccuuuuga

SEQ ID NO: 1121790 - RNA, 18 nt, Homo sapiens
uuucaaauuggagcuuca

SEQ ID NO: 1121791 - RNA, 19 nt, Homo sapiens
uuucaauuuaucaaucucu

SEQ ID NO: 1121792 - RNA, 18 nt, Homo sapiens
uuucagguuccaaucaga

SEQ ID NO: 1121793 - RNA, 14 nt, Homo sapiens
uuuccucugcagca

SEQ ID NO: 1121794 - RNA, 20 nt, Homo sapiens
uuucuauuuuuaugaugaca

SEQ ID NO: 1121795 - RNA, 19 nt, Homo sapiens
uuugguuuugacagguuuu

SEQ ID NO: 1121796 - RNA, 23 nt, Homo sapiens
uuuucaauguuagccacagugua

SEQ ID NO: 1121797 - RNA, 15 nt, Homo sapiens
ucugagcacccccuc

SEQ ID NO: 1121798 - RNA, 16 nt, Homo sapiens
ucuucaguuuuucacu

SEQ ID NO: 1121799 - RNA, 17 nt, Homo sapiens
ucuucaugccugaugaa

SEQ ID NO: 1121800 - RNA, 17 nt, Homo sapiens
ucuuccauuugcaaggg

SEQ ID NO: 1121801 - RNA, 13 nt, Homo sapiens
ucuugaaagcugu

SEQ ID NO: 1121802 - RNA, 15 nt, Homo sapiens
ucuugcucagugaag

SEQ ID NO: 1121803 - RNA, 15 nt, Homo sapiens
ucuuggaugcagcuu

SEQ ID NO: 1121804 - RNA, 14 nt, Homo sapiens
ucuuucccaauuca

SEQ ID NO: 1121805 - RNA, 17 nt, Homo sapiens
ugaaaacacugugcaca

SEQ ID NO: 1121806 - RNA, 23 nt, Homo sapiens
ugaaaauuuauuuuuagugauaa

SEQ ID NO: 1121807 - RNA, 11 nt, Homo sapiens
ugaaacuaaga

SEQ ID NO: 1121808 - RNA, 15 nt, Homo sapiens
ugaaauuaagcauuu

SEQ ID NO: 1121809 - RNA, 17 nt, Homo sapiens
ugaaauucacaguaaua

SEQ ID NO: 1121810 - RNA, 16 nt, Homo sapiens
ugaacauaacuucuca

SEQ ID NO: 1121811 - RNA, 11 nt, Homo sapiens
ugaacauuuca

SEQ ID NO: 1121812 - RNA, 23 nt, Homo sapiens
ugaagacaccaucuccaugugac

SEQ ID NO: 1121813 - RNA, 12 nt, Homo sapiens
ugaaucuaugaa

SEQ ID NO: 1121814 - RNA, 22 nt, Homo sapiens
ugacaacucauuuucauauugu

SEQ ID NO: 1121815 - RNA, 14 nt, Homo sapiens
ugacauuauaugca

SEQ ID NO: 1121816 - RNA, 15 nt, Homo sapiens
ugaccuucugggaca

SEQ ID NO: 1121817 - RNA, 15 nt, Homo sapiens
ugagacagacauuca

SEQ ID NO: 1121818 - RNA, 22 nt, Homo sapiens
ugagcauagagaacaaaguaaa

SEQ ID NO: 1121819 - RNA, 13 nt, Homo sapiens
ugaggagcccagg

SEQ ID NO: 1121820 - RNA, 14 nt, Homo sapiens
ugagucugugccac

SEQ ID NO: 1121821 - RNA, 22 nt, Homo sapiens
ugaguuuuguuucacuuugaca

SEQ ID NO: 1121822 - RNA, 22 nt, Homo sapiens
ugauaagcaggaaggauggcaa

SEQ ID NO: 1121823 - RNA, 14 nt, Homo sapiens
ugauauauugcugu

SEQ ID NO: 1121824 - RNA, 20 nt, Homo sapiens
ugaugucagcugcuguugaa

SEQ ID NO: 1121825 - RNA, 22 nt, Homo sapiens
ugcaacugggucugacaugaac

SEQ ID NO: 1121826 - RNA, 14 nt, Homo sapiens
ugcaauacugcuua

SEQ ID NO: 1121827 - RNA, 19 nt, Homo sapiens
ugcaauugacauaggcaau

SEQ ID NO: 1121828 - RNA, 18 nt, Homo sapiens
ugcacagggggaggccau

SEQ ID NO: 1121829 - RNA, 23 nt, Homo sapiens
ugcacagggggaggccauaaaga

SEQ ID NO: 1121830 - RNA, 14 nt, Homo sapiens
ugcacugacaagau

SEQ ID NO: 1121831 - RNA, 17 nt, Homo sapiens
ugcacugacaagaugga

SEQ ID NO: 1121832 - RNA, 21 nt, Homo sapiens
ugcacuguucccccugugcag

SEQ ID NO: 1121833 - RNA, 15 nt, Homo sapiens
ugcagagcaugaccu

SEQ ID NO: 1121834 - RNA, 14 nt, Homo sapiens
ugcagcaccuccag

SEQ ID NO: 1121835 - RNA, 15 nt, Homo sapiens
ugcagcuuauauuca

SEQ ID NO: 1121836 - RNA, 20 nt, Homo sapiens
ugcaguaggggcuacuguga

SEQ ID NO: 1121837 - RNA, 21 nt, Homo sapiens
ugcaguaggggcuacugugac

SEQ ID NO: 1121838 - RNA, 13 nt, Homo sapiens
ugcauuuauagca

SEQ ID NO: 1121839 - RNA, 17 nt, Homo sapiens
ugccaaucuguacaaaa

SEQ ID NO: 1121840 - RNA, 23 nt, Homo sapiens
ugccacagccuccccugccaggg

SEQ ID NO: 1121841 - RNA, 15 nt, Homo sapiens
ugccaugccucaaga

SEQ ID NO: 1121842 - RNA, 20 nt, Homo sapiens
ugccauuaagcucacaauaa

SEQ ID NO: 1121843 - RNA, 13 nt, Homo sapiens
ugcccaucagggc

SEQ ID NO: 1121844 - RNA, 15 nt, Homo sapiens
ugccuggacugacca

SEQ ID NO: 1121845 - RNA, 21 nt, Homo sapiens
ugccuugaaggggcagcugug

SEQ ID NO: 1121846 - RNA, 23 nt, Homo sapiens
ugcgccgggggaccuggggacuc

SEQ ID NO: 1121847 - RNA, 14 nt, Homo sapiens
ugcggaagccaaag

SEQ ID NO: 1121848 - RNA, 16 nt, Homo sapiens
ugcggaagccaaaggc

SEQ ID NO: 1121849 - RNA, 17 nt, Homo sapiens
ugcggccucugagacau

SEQ ID NO: 1121850 - RNA, 19 nt, Homo sapiens
ugcuauagagccuaccugu

SEQ ID NO: 1121851 - RNA, 14 nt, Homo sapiens
ugcuaugacaugca

SEQ ID NO: 1121852 - RNA, 17 nt, Homo sapiens
ugcugauaccauaugaa

SEQ ID NO: 1121853 - RNA, 14 nt, Homo sapiens
ugcugggagugugg

SEQ ID NO: 1121854 - RNA, 14 nt, Homo sapiens
ugcuuaaucuugcu

SEQ ID NO: 1121855 - RNA, 14 nt, Homo sapiens
ugcuuaauugcuga

SEQ ID NO: 1121856 - RNA, 15 nt, Homo sapiens
ugcuucugcacacaa

SEQ ID NO: 1121857 - RNA, 16 nt, Homo sapiens
uggaaggcuuccacua

SEQ ID NO: 1121858 - RNA, 14 nt, Homo sapiens
uggacaaaauggaa

SEQ ID NO: 1121859 - RNA, 23 nt, Homo sapiens
uggacaaagggaaauacucuuaa

SEQ ID NO: 1121860 - RNA, 12 nt, Homo sapiens
uggacugaccaa

SEQ ID NO: 1121861 - RNA, 15 nt, Homo sapiens
uggacugaccaaaga

SEQ ID NO: 1121862 - RNA, 15 nt, Homo sapiens
uggagaauacugcca

SEQ ID NO: 1121863 - RNA, 20 nt, Homo sapiens
uggagaauacugccaaaaca

SEQ ID NO: 1121864 - RNA, 20 nt, Homo sapiens
uggaggcugcuguggggacc

SEQ ID NO: 1121865 - RNA, 17 nt, Homo sapiens
uggauaagggaauaaua

SEQ ID NO: 1121866 - RNA, 13 nt, Homo sapiens
uggauacuaagca

SEQ ID NO: 1121867 - RNA, 22 nt, Homo sapiens
uggaugacgugaagccacagga

SEQ ID NO: 1121868 - RNA, 13 nt, Homo sapiens
uggaugaucucaa

SEQ ID NO: 1121869 - RNA, 21 nt, Homo sapiens
uggcauucuuugcaauacugc

SEQ ID NO: 1121870 - RNA, 14 nt, Homo sapiens
uaaccuuucuaacc

SEQ ID NO: 1121871 - RNA, 17 nt, Homo sapiens
uaagaguaaaauuccuc

SEQ ID NO: 1121872 - RNA, 16 nt, Homo sapiens
uaagcacaaagcccau

SEQ ID NO: 1121873 - RNA, 20 nt, Homo sapiens
uaagcaccaggacgcccucg

SEQ ID NO: 1121874 - RNA, 16 nt, Homo sapiens
uaagcagaccacugau

SEQ ID NO: 1121875 - RNA, 19 nt, Homo sapiens
uaagugaugugcugaauuu

SEQ ID NO: 1121876 - RNA, 20 nt, Homo sapiens
uaauaagauauuuaguaaua

SEQ ID NO: 1121877 - RNA, 15 nt, Homo sapiens
uaauauuuaggcaag

SEQ ID NO: 1121878 - RNA, 22 nt, Homo sapiens
uaaucaguaugcaaagcaaucu

SEQ ID NO: 1121879 - RNA, 14 nt, Homo sapiens
uaaugcuaaaugug

SEQ ID NO: 1121880 - RNA, 14 nt, Homo sapiens
uaauggaaugaagg

SEQ ID NO: 1121881 - RNA, 17 nt, Homo sapiens
uaauggacaaagggaaa

SEQ ID NO: 1121882 - RNA, 12 nt, Homo sapiens
uaauuauugcuu

SEQ ID NO: 1121883 - RNA, 24 nt, Homo sapiens
uaauuuaguaaauaaacaagucaa

SEQ ID NO: 1121884 - RNA, 16 nt, Homo sapiens
uacaaggacaaugccu

SEQ ID NO: 1121885 - RNA, 19 nt, Homo sapiens
uacagaaucaaaugcaauu

SEQ ID NO: 1121886 - RNA, 20 nt, Homo sapiens
uacagaaucaaaugcaauuu

SEQ ID NO: 1121887 - RNA, 23 nt, Homo sapiens
uacagaaucacagcccucaugau

SEQ ID NO: 1121888 - RNA, 13 nt, Homo sapiens
uacagacugggga

SEQ ID NO: 1121889 - RNA, 21 nt, Homo sapiens
uacagauagaaaauaugauau

SEQ ID NO: 1121890 - RNA, 18 nt, Homo sapiens
uacagauguaaaugccac

SEQ ID NO: 1121891 - RNA, 22 nt, Homo sapiens
uacaguaggagcccagcucuga

SEQ ID NO: 1121892 - RNA, 18 nt, Homo sapiens
uacagucuuccauuugca

SEQ ID NO: 1121893 - RNA, 16 nt, Homo sapiens
uacauauuuguauguu

SEQ ID NO: 1121894 - RNA, 23 nt, Homo sapiens
uacauuguuugucugucuucaua

SEQ ID NO: 1121895 - RNA, 14 nt, Homo sapiens
uaccaccuacugau

SEQ ID NO: 1121896 - RNA, 16 nt, Homo sapiens
uacccggcccagagac

SEQ ID NO: 1121897 - RNA, 15 nt, Homo sapiens
uaccgcccucggggc

SEQ ID NO: 1121898 - RNA, 19 nt, Homo sapiens
uaccgugggucaaccuggg

SEQ ID NO: 1121899 - RNA, 17 nt, Homo sapiens
uaccugcccccaucaua

SEQ ID NO: 1121900 - RNA, 20 nt, Homo sapiens
uacguucagaggugcagcug

SEQ ID NO: 1121901 - RNA, 14 nt, Homo sapiens
uacuggaaggcuuc

SEQ ID NO: 1121902 - RNA, 14 nt, Homo sapiens
uacuggcaauuugu

SEQ ID NO: 1121903 - RNA, 18 nt, Homo sapiens
uacugggaaucaagacaa

SEQ ID NO: 1121904 - RNA, 21 nt, Homo sapiens
uacugggguuuuucuaagaaa

SEQ ID NO: 1121905 - RNA, 15 nt, Homo sapiens
uacugugaccaugga

SEQ ID NO: 1121906 - RNA, 16 nt, Homo sapiens
uacuucaagaucugaa

SEQ ID NO: 1121907 - RNA, 15 nt, Homo sapiens
uacuugcuucucuag

SEQ ID NO: 1121908 - RNA, 21 nt, Homo sapiens
uacuuugaagucauaccaaug

SEQ ID NO: 1121909 - RNA, 22 nt, Homo sapiens
uagaagccacuauuacugggac

SEQ ID NO: 1121910 - RNA, 17 nt, Homo sapiens
uagaauauuuauuaccu

SEQ ID NO: 1121911 - RNA, 19 nt, Homo sapiens
uagacuuggagaauacugc

SEQ ID NO: 1121912 - RNA, 11 nt, Homo sapiens
uagagccugug

SEQ ID NO: 1121913 - RNA, 11 nt, Homo sapiens
uagaguggaau

SEQ ID NO: 1121914 - RNA, 15 nt, Homo sapiens
uagauccauuuggac

SEQ ID NO: 1121915 - RNA, 20 nt, Homo sapiens
uagauccugguuaccacucu

SEQ ID NO: 1121916 - RNA, 20 nt, Homo sapiens
uagcaaaauacaugacauuu

SEQ ID NO: 1121917 - RNA, 18 nt, Homo sapiens
uagcacugggcucugaug

SEQ ID NO: 1121918 - RNA, 13 nt, Homo sapiens
uagcauacgguau

SEQ ID NO: 1121919 - RNA, 17 nt, Homo sapiens
uagcauuuugcuaucuu

SEQ ID NO: 1121920 - RNA, 13 nt, Homo sapiens
uagccugugcacg

SEQ ID NO: 1121921 - RNA, 18 nt, Homo sapiens
uaggaaaaaaauaguaaa

SEQ ID NO: 1121922 - RNA, 17 nt, Homo sapiens
uaggaagugaacccaua

SEQ ID NO: 1121923 - RNA, 14 nt, Homo sapiens
uagggaucccucau

SEQ ID NO: 1121924 - RNA, 15 nt, Homo sapiens
uaggguccaccagga

SEQ ID NO: 1121925 - RNA, 12 nt, Homo sapiens
uaguaacaugug

SEQ ID NO: 1121926 - RNA, 20 nt, Homo sapiens
uagucaagugcguccacgag

SEQ ID NO: 1121927 - RNA, 18 nt, Homo sapiens
uauaaaugccagagccaa

SEQ ID NO: 1121928 - RNA, 17 nt, Homo sapiens
uauagagccuaccugua

SEQ ID NO: 1121929 - RNA, 14 nt, Homo sapiens
uauagcauuuugcu

SEQ ID NO: 1121930 - RNA, 22 nt, Homo sapiens
uauagucgaacaauucauauau

SEQ ID NO: 1121931 - RNA, 18 nt, Homo sapiens
uauauaaaugugauugca

SEQ ID NO: 1121932 - RNA, 21 nt, Homo sapiens
uauauaaaugugauugcagcu

SEQ ID NO: 1121933 - RNA, 18 nt, Homo sapiens
uauauauuuuugugcaca

SEQ ID NO: 1121934 - RNA, 18 nt, Homo sapiens
uauaucagcuuuugccuu

SEQ ID NO: 1121935 - RNA, 17 nt, Homo sapiens
uaucaccgugggcuccc

SEQ ID NO: 1121936 - RNA, 21 nt, Homo sapiens
uaucaguugauuuuucuuauu

SEQ ID NO: 1121937 - RNA, 15 nt, Homo sapiens
uauccacccucugca

SEQ ID NO: 1121938 - RNA, 16 nt, Homo sapiens
uaucucaaacuacugg

SEQ ID NO: 1121939 - RNA, 16 nt, Homo sapiens
uaucuuugcuguuauu

SEQ ID NO: 1121940 - RNA, 16 nt, Homo sapiens
uaugauauauugcugu

SEQ ID NO: 1121941 - RNA, 22 nt, Homo sapiens
uaugauuagagggaugagacag

SEQ ID NO: 1121942 - RNA, 13 nt, Homo sapiens
uauguaacaugua

SEQ ID NO: 1121943 - RNA, 22 nt, Homo sapiens
uauguagcaaaauacaugacau

SEQ ID NO: 1121944 - RNA, 15 nt, Homo sapiens
uauugcagcuuauau

SEQ ID NO: 1121945 - RNA, 20 nt, Homo sapiens
uauuuuuugaaucuaugaac

SEQ ID NO: 1121946 - RNA, 14 nt, Homo sapiens
ucaaacuacuggca

SEQ ID NO: 1121947 - RNA, 10 nt, Homo sapiens
ucaaagccag

SEQ ID NO: 1121948 - RNA, 22 nt, Homo sapiens
ucaacagcauuuucaagcaguu

SEQ ID NO: 1121949 - RNA, 15 nt, Homo sapiens
ucaagggaaaggcaa

SEQ ID NO: 1121950 - RNA, 13 nt, Homo sapiens
ucaauguacauag

SEQ ID NO: 1121951 - RNA, 15 nt, Homo sapiens
ucaauguacauagac

SEQ ID NO: 1121952 - RNA, 18 nt, Homo sapiens
ucacagcccucaugauca

SEQ ID NO: 1121953 - RNA, 14 nt, Homo sapiens
ucaccuuccagugu

SEQ ID NO: 1121954 - RNA, 21 nt, Homo sapiens
ucagaaaguaacaaucuaugg

SEQ ID NO: 1121955 - RNA, 16 nt, Homo sapiens
ucagauaggagugaau

SEQ ID NO: 1121956 - RNA, 22 nt, Homo sapiens
ucagauugauagggaguuuuaa

SEQ ID NO: 1121957 - RNA, 18 nt, Homo sapiens
ucagcaucugaccaucug

SEQ ID NO: 1121958 - RNA, 23 nt, Homo sapiens
ucagcaucugaccaucugugacu

SEQ ID NO: 1121959 - RNA, 15 nt, Homo sapiens
ucagcuuuugccuuu

SEQ ID NO: 1121960 - RNA, 18 nt, Homo sapiens
ucaggaguuccuaaccag

SEQ ID NO: 1121961 - RNA, 18 nt, Homo sapiens
ucagugaauaaaccauca

SEQ ID NO: 1121962 - RNA, 20 nt, Homo sapiens
ucaguguugccucuugcaau

SEQ ID NO: 1121963 - RNA, 21 nt, Homo sapiens
ucaguguugccucuugcaaug

SEQ ID NO: 1121964 - RNA, 15 nt, Homo sapiens
ucaguuuuucacuuc

SEQ ID NO: 1121965 - RNA, 15 nt, Homo sapiens
ucauaagggcacuga

SEQ ID NO: 1121966 - RNA, 21 nt, Homo sapiens
ucauaaguagcauucauguaa

SEQ ID NO: 1121967 - RNA, 23 nt, Homo sapiens
ucauguguguccacgacugucuc

SEQ ID NO: 1121968 - RNA, 19 nt, Homo sapiens
ucauuaucuuugcuguuau

SEQ ID NO: 1121969 - RNA, 20 nt, Homo sapiens
ucauuggcauucuuugcaau

SEQ ID NO: 1121970 - RNA, 16 nt, Homo sapiens
uccagcacgucugugu

SEQ ID NO: 1121971 - RNA, 16 nt, Homo sapiens
uccaggagaaggccaa

SEQ ID NO: 1121972 - RNA, 13 nt, Homo sapiens
uccaggguggaug

SEQ ID NO: 1121973 - RNA, 15 nt, Homo sapiens
uccaggguggaugau

SEQ ID NO: 1121974 - RNA, 21 nt, Homo sapiens
uccaggugguaagcaccagga

SEQ ID NO: 1121975 - RNA, 18 nt, Homo sapiens
uccaguuucccaccaccu

SEQ ID NO: 1121976 - RNA, 16 nt, Homo sapiens
uccaguuugcaccugu

SEQ ID NO: 1121977 - RNA, 19 nt, Homo sapiens
uccauacguucagaggugc

SEQ ID NO: 1121978 - RNA, 23 nt, Homo sapiens
uccauacguucagaggugcagcu

SEQ ID NO: 1121979 - RNA, 24 nt, Homo sapiens
uccauacguucagaggugcagcug

SEQ ID NO: 1121980 - RNA, 17 nt, Homo sapiens
cagucuuccauuugcaa

SEQ ID NO: 1121981 - RNA, 15 nt, Homo sapiens
cagugccagcaccug

SEQ ID NO: 1121982 - RNA, 18 nt, Homo sapiens
cagugccagcaccugccc

SEQ ID NO: 1121983 - RNA, 20 nt, Homo sapiens
caguguugccucuugcaaug

SEQ ID NO: 1121984 - RNA, 14 nt, Homo sapiens
caguugcugugaac

SEQ ID NO: 1121985 - RNA, 22 nt, Homo sapiens
caguuuucggaaacacugacuu

SEQ ID NO: 1121986 - RNA, 14 nt, Homo sapiens
cauaaaccugugcu

SEQ ID NO: 1121987 - RNA, 14 nt, Homo sapiens
cauaagggcacuga

SEQ ID NO: 1121988 - RNA, 12 nt, Homo sapiens
cauacagacugg

SEQ ID NO: 1121989 - RNA, 22 nt, Homo sapiens
cauaccaaugaaaaaauguaua

SEQ ID NO: 1121990 - RNA, 20 nt, Homo sapiens
cauagagauagcuacagugu

SEQ ID NO: 1121991 - RNA, 19 nt, Homo sapiens
cauagcacugggcucugau

SEQ ID NO: 1121992 - RNA, 19 nt, Homo sapiens
cauaggcgcaggugcacag

SEQ ID NO: 1121993 - RNA, 17 nt, Homo sapiens
caucaucuccugccuuc

SEQ ID NO: 1121994 - RNA, 17 nt, Homo sapiens
caucauucucugucuca

SEQ ID NO: 1121995 - RNA, 16 nt, Homo sapiens
cauccaucaucaugug

SEQ ID NO: 1121996 - RNA, 15 nt, Homo sapiens
cauccccuuuccucc

SEQ ID NO: 1121997 - RNA, 14 nt, Homo sapiens
caucuccaugugac

SEQ ID NO: 1121998 - RNA, 21 nt, Homo sapiens
caucucccagauaaugugaaa

SEQ ID NO: 1121999 - RNA, 13 nt, Homo sapiens
caucugaccaucu

SEQ ID NO: 1122000 - RNA, 20 nt, Homo sapiens
caucugaccaucugugacua

SEQ ID NO: 1122001 - RNA, 23 nt, Homo sapiens
caucuggcuuuuucugccacuga

SEQ ID NO: 1122002 - RNA, 13 nt, Homo sapiens
caucugugcagua

SEQ ID NO: 1122003 - RNA, 21 nt, Homo sapiens
caucuguugacaaaugacaga

SEQ ID NO: 1122004 - RNA, 13 nt, Homo sapiens
caugaaaaaccau

SEQ ID NO: 1122005 - RNA, 15 nt, Homo sapiens
caugaggaccaggug

SEQ ID NO: 1122006 - RNA, 16 nt, Homo sapiens
caugccugaugaaagc

SEQ ID NO: 1122007 - RNA, 15 nt, Homo sapiens
cauggcagaagucaa

SEQ ID NO: 1122008 - RNA, 24 nt, Homo sapiens
cauggcaucuucaauaugaaucua

SEQ ID NO: 1122009 - RNA, 17 nt, Homo sapiens
caugguggguccauggg

SEQ ID NO: 1122010 - RNA, 17 nt, Homo sapiens
cauguaaacugugcacc

SEQ ID NO: 1122011 - RNA, 17 nt, Homo sapiens
cauuauucaagaaugaa

SEQ ID NO: 1122012 - RNA, 14 nt, Homo sapiens
cauugaucugggau

SEQ ID NO: 1122013 - RNA, 15 nt, Homo sapiens
cauugccuggacuga

SEQ ID NO: 1122014 - RNA, 22 nt, Homo sapiens
cauugcuuuugggagacuggaa

SEQ ID NO: 1122015 - RNA, 14 nt, Homo sapiens
cauuuaugacaagc

SEQ ID NO: 1122016 - RNA, 21 nt, Homo sapiens
cauuucuauuuauuuacugag

SEQ ID NO: 1122017 - RNA, 16 nt, Homo sapiens
cauuuggcaaugccau

SEQ ID NO: 1122018 - RNA, 13 nt, Homo sapiens
cauuugugcaaga

SEQ ID NO: 1122019 - RNA, 18 nt, Homo sapiens
ccaaaaucggaucugggg

SEQ ID NO: 1122020 - RNA, 15 nt, Homo sapiens
ccaaagcaaugugag

SEQ ID NO: 1122021 - RNA, 15 nt, Homo sapiens
ccaacuuuuucauag

SEQ ID NO: 1122022 - RNA, 13 nt, Homo sapiens
ccaagccugacca

SEQ ID NO: 1122023 - RNA, 22 nt, Homo sapiens
ccaauggaaaauauaaugauca

SEQ ID NO: 1122024 - RNA, 23 nt, Homo sapiens
cuccuguguucuagaccucuggg

SEQ ID NO: 1122025 - RNA, 17 nt, Homo sapiens
cucuaaccaaggcugug

SEQ ID NO: 1122026 - RNA, 23 nt, Homo sapiens
cucuaggccucuccaguuugcac

SEQ ID NO: 1122027 - RNA, 13 nt, Homo sapiens
cucucccagauuu

SEQ ID NO: 1122028 - RNA, 14 nt, Homo sapiens
cucucccuuguaca

SEQ ID NO: 1122029 - RNA, 17 nt, Homo sapiens
cucugaaaccaguguua

SEQ ID NO: 1122030 - RNA, 18 nt, Homo sapiens
cucugacucagggcuccu

SEQ ID NO: 1122031 - RNA, 21 nt, Homo sapiens
cucugagguuuccgaaaucag

SEQ ID NO: 1122032 - RNA, 15 nt, Homo sapiens
cucugcagcacuuua

SEQ ID NO: 1122033 - RNA, 13 nt, Homo sapiens
cucuggauugaga

SEQ ID NO: 1122034 - RNA, 21 nt, Homo sapiens
cucugugaacgauuuagaaag

SEQ ID NO: 1122035 - RNA, 14 nt, Homo sapiens
cucugugaccaaug

SEQ ID NO: 1122036 - RNA, 21 nt, Homo sapiens
cucuucccuucccagaccagg

SEQ ID NO: 1122037 - RNA, 13 nt, Homo sapiens
cucuuucuuguuu

SEQ ID NO: 1122038 - RNA, 14 nt, Homo sapiens
cugacaagauggaa

SEQ ID NO: 1122039 - RNA, 22 nt, Homo sapiens
cugagcagugaaugauucagug

SEQ ID NO: 1122040 - RNA, 12 nt, Homo sapiens
cugauaccucaa

SEQ ID NO: 1122041 - RNA, 16 nt, Homo sapiens
cugauggcugcuccac

SEQ ID NO: 1122042 - RNA, 16 nt, Homo sapiens
cugcagccugguagaa

SEQ ID NO: 1122043 - RNA, 12 nt, Homo sapiens
cugcagcugucu

SEQ ID NO: 1122044 - RNA, 18 nt, Homo sapiens
cugccaaaacauuuauga

SEQ ID NO: 1122045 - RNA, 21 nt, Homo sapiens
cugccaguugucuuaugugaa

SEQ ID NO: 1122046 - RNA, 16 nt, Homo sapiens
cugcccccaauccaug

SEQ ID NO: 1122047 - RNA, 21 nt, Homo sapiens
cugccuucaccuccucuuuca

SEQ ID NO: 1122048 - RNA, 19 nt, Homo sapiens
cugcggaagccaaaggcag

SEQ ID NO: 1122049 - RNA, 15 nt, Homo sapiens
cugcuguugaacuuu

SEQ ID NO: 1122050 - RNA, 13 nt, Homo sapiens
cuggacucucagu

SEQ ID NO: 1122051 - RNA, 13 nt, Homo sapiens
cuggacugaccaa

SEQ ID NO: 1122052 - RNA, 16 nt, Homo sapiens
cuggauacuaagcaca

SEQ ID NO: 1122053 - RNA, 17 nt, Homo sapiens
cuggauacuaagcacaa

SEQ ID NO: 1122054 - RNA, 15 nt, Homo sapiens
cuggcucucagagga

SEQ ID NO: 1122055 - RNA, 17 nt, Homo sapiens
cugggcggccucuugcu

SEQ ID NO: 1122056 - RNA, 23 nt, Homo sapiens
cugggcuguaacguggcacuggu

SEQ ID NO: 1122057 - RNA, 15 nt, Homo sapiens
cuggucuucacugcc

SEQ ID NO: 1122058 - RNA, 14 nt, Homo sapiens
cuguaaccucuuca

SEQ ID NO: 1122059 - RNA, 21 nt, Homo sapiens
cuguaauaguuuuauauuguu

SEQ ID NO: 1122060 - RNA, 21 nt, Homo sapiens
cuguaaucccagcacuuuggg

SEQ ID NO: 1122061 - RNA, 22 nt, Homo sapiens
cugugacuauaaagcuguuauu

SEQ ID NO: 1122062 - RNA, 16 nt, Homo sapiens
cugugauuacugcaau

SEQ ID NO: 1122063 - RNA, 13 nt, Homo sapiens
cuguuauucuugu

SEQ ID NO: 1122064 - RNA, 15 nt, Homo sapiens
cuguugacaaaugac

SEQ ID NO: 1122065 - RNA, 19 nt, Homo sapiens
cuguuuccauagggugaca

SEQ ID NO: 1122066 - RNA, 17 nt, Homo sapiens
cuuaaaagguacuggua

SEQ ID NO: 1122067 - RNA, 22 nt, Homo sapiens
cuuaauaagauauuuaguaaua

SEQ ID NO: 1122068 - RNA, 22 nt, Homo sapiens
cuuaauuuaacuuuccagucuu

SEQ ID NO: 1122069 - RNA, 14 nt, Homo sapiens
cuuauuguaccucu

SEQ ID NO: 1122070 - RNA, 11 nt, Homo sapiens
cuucaccugcg

SEQ ID NO: 1122071 - RNA, 20 nt, Homo sapiens
cuucacgauuaacugugaaa

SEQ ID NO: 1122072 - RNA, 11 nt, Homo sapiens
cuucacugaca

SEQ ID NO: 1122073 - RNA, 18 nt, Homo sapiens
cuucacugccaugccuca

SEQ ID NO: 1122074 - RNA, 18 nt, Homo sapiens
cuucaguccaacugucaa

SEQ ID NO: 1122075 - RNA, 23 nt, Homo sapiens
cuucaguuuuucacuucuaccua

SEQ ID NO: 1122076 - RNA, 13 nt, Homo sapiens
cuuccagcuccug

SEQ ID NO: 1122077 - RNA, 11 nt, Homo sapiens
cuuccauuugc

SEQ ID NO: 1122078 - RNA, 13 nt, Homo sapiens
cuucccagaccag

SEQ ID NO: 1122079 - RNA, 21 nt, Homo sapiens
cuucccaguaacccuaaggaa

SEQ ID NO: 1122080 - RNA, 17 nt, Homo sapiens
cuucccugccacuucaa

SEQ ID NO: 1122081 - RNA, 19 nt, Homo sapiens
cuucgaggcuuuacagugu

SEQ ID NO: 1122082 - RNA, 14 nt, Homo sapiens
cuucggcaucuucu

SEQ ID NO: 1122083 - RNA, 12 nt, Homo sapiens
cuucucauuucu

SEQ ID NO: 1122084 - RNA, 19 nt, Homo sapiens
cuucucuuccuagaucugc

SEQ ID NO: 1122085 - RNA, 13 nt, Homo sapiens
cuucugcacacaa

SEQ ID NO: 1122086 - RNA, 21 nt, Homo sapiens
cuucugccucccacuccauac

SEQ ID NO: 1122087 - RNA, 16 nt, Homo sapiens
cuucuucaccauuugg

SEQ ID NO: 1122088 - RNA, 19 nt, Homo sapiens
cuugagccucccccaaagc

SEQ ID NO: 1122089 - RNA, 17 nt, Homo sapiens
cuuuauaaaagcaaaag

SEQ ID NO: 1122090 - RNA, 16 nt, Homo sapiens
cuuucaaccucaguga

SEQ ID NO: 1122091 - RNA, 15 nt, Homo sapiens
cuuuuauuacugggg

SEQ ID NO: 1122092 - RNA, 20 nt, Homo sapiens
gagaaaccuuauuguaccuc

SEQ ID NO: 1122093 - RNA, 16 nt, Homo sapiens
gagaacaaugugcuau

SEQ ID NO: 1122094 - RNA, 17 nt, Homo sapiens
gagacuuggggaccaga

SEQ ID NO: 1122095 - RNA, 17 nt, Homo sapiens
gagagggacucaaggga

SEQ ID NO: 1122096 - RNA, 19 nt, Homo sapiens
gagagggacucaagggaaa

SEQ ID NO: 1122097 - RNA, 19 nt, Homo sapiens
gagauuuugucgggacaga

SEQ ID NO: 1122098 - RNA, 20 nt, Homo sapiens
gagauuuugucgggacagag

SEQ ID NO: 1122099 - RNA, 13 nt, Homo sapiens
gagcaugaccuga

SEQ ID NO: 1122100 - RNA, 20 nt, Homo sapiens
gagccuggagggaugccacc

SEQ ID NO: 1122101 - RNA, 14 nt, Homo sapiens
gaggaaaaauggga

SEQ ID NO: 1122102 - RNA, 14 nt, Homo sapiens
gagggacucaaggg

SEQ ID NO: 1122103 - RNA, 23 nt, Homo sapiens
gagggaggaacguggucaacuca

SEQ ID NO: 1122104 - RNA, 21 nt, Homo sapiens
gagggauucuggucuucacug

SEQ ID NO: 1122105 - RNA, 16 nt, Homo sapiens
gagggcagucgauaga

SEQ ID NO: 1122106 - RNA, 23 nt, Homo sapiens
gaggucauuaaaauuacauugag

SEQ ID NO: 1122107 - RNA, 21 nt, Homo sapiens
gaggucugguccgagucucag

SEQ ID NO: 1122108 - RNA, 20 nt, Homo sapiens
gagucaauagcuugucuucg

SEQ ID NO: 1122109 - RNA, 21 nt, Homo sapiens
gagugccagucagcagucaug

SEQ ID NO: 1122110 - RNA, 17 nt, Homo sapiens
gaguggaaucucuugga

SEQ ID NO: 1122111 - RNA, 22 nt, Homo sapiens
gauaaagaccuuccagcuccug

SEQ ID NO: 1122112 - RNA, 15 nt, Homo sapiens
gauacagaacucuuu

SEQ ID NO: 1122113 - RNA, 18 nt, Homo sapiens
gauagauccauuuggaca

SEQ ID NO: 1122114 - RNA, 15 nt, Homo sapiens
gauagcucauauuau

SEQ ID NO: 1122115 - RNA, 13 nt, Homo sapiens
gauauugcagcuu

SEQ ID NO: 1122116 - RNA, 16 nt, Homo sapiens
gauauuuaguaauauu

SEQ ID NO: 1122117 - RNA, 14 nt, Homo sapiens
gaugaaacuucuca

SEQ ID NO: 1122118 - RNA, 18 nt, Homo sapiens
gaugaauugucacaucua

SEQ ID NO: 1122119 - RNA, 17 nt, Homo sapiens
gaugagacagacauuca

SEQ ID NO: 1122120 - RNA, 15 nt, Homo sapiens
gaugcagcuucaaga

SEQ ID NO: 1122121 - RNA, 14 nt, Homo sapiens
gauggguccucacg

SEQ ID NO: 1122122 - RNA, 14 nt, Homo sapiens
gauguaaaugccac

SEQ ID NO: 1122123 - RNA, 16 nt, Homo sapiens
gauguaaaugccacaa

SEQ ID NO: 1122124 - RNA, 13 nt, Homo sapiens
gauuauaaacuga

SEQ ID NO: 1122125 - RNA, 14 nt, Homo sapiens
gauuauaaacugac

SEQ ID NO: 1122126 - RNA, 14 nt, Homo sapiens
gauucaguguuaaa

SEQ ID NO: 1122127 - RNA, 17 nt, Homo sapiens
gcaauaauaagugaugu

SEQ ID NO: 1122128 - RNA, 21 nt, Homo sapiens
gcaauugcgaccuuaauuuaa

SEQ ID NO: 1122129 - RNA, 20 nt, Homo sapiens
gcacaauuuaaaacaauccu

SEQ ID NO: 1122130 - RNA, 18 nt, Homo sapiens
gcacagggggaggccaua

SEQ ID NO: 1122131 - RNA, 18 nt, Homo sapiens
gcacauuuaaggcgccau

SEQ ID NO: 1122132 - RNA, 16 nt, Homo sapiens
gcaccaucacacaugc

SEQ ID NO: 1122133 - RNA, 14 nt, Homo sapiens
gcagaccacugaua

SEQ ID NO: 1122134 - RNA, 15 nt, Homo sapiens
gcagccucacuucua

SEQ ID NO: 1122135 - RNA, 21 nt, Homo sapiens
gcagugagcugauaucaugcc

SEQ ID NO: 1122136 - RNA, 23 nt, Homo sapiens
gcauacagacuggggacccugga

SEQ ID NO: 1122137 - RNA, 15 nt, Homo sapiens
gcaucucaagcccca

SEQ ID NO: 1122138 - RNA, 19 nt, Homo sapiens
gcaucugaccaucugugac

SEQ ID NO: 1122139 - RNA, 14 nt, Homo sapiens
gcauugccuggacu

SEQ ID NO: 1122140 - RNA, 17 nt, Homo sapiens
gcauuuucaagcaguua

SEQ ID NO: 1122141 - RNA, 14 nt, Homo sapiens
gccacccagcaaca

SEQ ID NO: 1122142 - RNA, 15 nt, Homo sapiens
gccagcucucucuac

SEQ ID NO: 1122143 - RNA, 16 nt, Homo sapiens
gccagucagcagucau

SEQ ID NO: 1122144 - RNA, 17 nt, Homo sapiens
gccagugccagcaccug

SEQ ID NO: 1122145 - RNA, 22 nt, Homo sapiens
gccauaugaaugucaguaguuu

SEQ ID NO: 1122146 - RNA, 14 nt, Homo sapiens
gcccacugccugcc

SEQ ID NO: 1122147 - RNA, 16 nt, Homo sapiens
gcccagcuaaagcaau

SEQ ID NO: 1122148 - RNA, 16 nt, Homo sapiens
gcccauagcacugggc

SEQ ID NO: 1122149 - RNA, 19 nt, Homo sapiens
gcccucaugaucauucuca

SEQ ID NO: 1122150 - RNA, 22 nt, Homo sapiens
gcccuuacuugcuucucuagcu

SEQ ID NO: 1122151 - RNA, 21 nt, Homo sapiens
gcccuucccacaggacauuuc

SEQ ID NO: 1122152 - RNA, 20 nt, Homo sapiens
gccuccauggcagaagucaa

SEQ ID NO: 1122153 - RNA, 14 nt, Homo sapiens
gccucuugcaaugc

SEQ ID NO: 1122154 - RNA, 13 nt, Homo sapiens
gccugacaacuca

SEQ ID NO: 1122155 - RNA, 14 nt, Homo sapiens
gccuggacugacca

SEQ ID NO: 1122156 - RNA, 21 nt, Homo sapiens
gccuggggcgagcacugugag

SEQ ID NO: 1122157 - RNA, 17 nt, Homo sapiens
gccugguagaauuggga

SEQ ID NO: 1122158 - RNA, 20 nt, Homo sapiens
gccuguaaucccagcacuuu

SEQ ID NO: 1122159 - RNA, 16 nt, Homo sapiens
gcgccgggggaccugg

SEQ ID NO: 1122160 - RNA, 12 nt, Homo sapiens
gcggaagccaaa

SEQ ID NO: 1122161 - RNA, 13 nt, Homo sapiens
gcggccucuugcu

SEQ ID NO: 1122162 - RNA, 12 nt, Homo sapiens
aaaaacaauuaa

SEQ ID NO: 1122163 - RNA, 18 nt, Homo sapiens
aaaaaugucucaugucaa

SEQ ID NO: 1122164 - RNA, 16 nt, Homo sapiens
aaaacaagcauucaca

SEQ ID NO: 1122165 - RNA, 21 nt, Homo sapiens
aaaacaaugguguggugaaug

SEQ ID NO: 1122166 - RNA, 11 nt, Homo sapiens
aaaacacugug

SEQ ID NO: 1122167 - RNA, 13 nt, Homo sapiens
aaaagauggaaug

SEQ ID NO: 1122168 - RNA, 17 nt, Homo sapiens
aaaagcaaaagcucugu

SEQ ID NO: 1122169 - RNA, 23 nt, Homo sapiens
aaaaguaaagaugcuacuuccca

SEQ ID NO: 1122170 - RNA, 20 nt, Homo sapiens
ugcagccucacuucuaccug

SEQ ID NO: 1122171 - RNA, 17 nt, Homo sapiens
ugcaucaucagccuauu

SEQ ID NO: 1122172 - RNA, 20 nt, Homo sapiens
ugcaucccacguucuguuaa

SEQ ID NO: 1122173 - RNA, 22 nt, Homo sapiens
ugcauccccuuggcccaucugu

SEQ ID NO: 1122174 - RNA, 23 nt, Homo sapiens
ugcccagccugugcgccggggga

SEQ ID NO: 1122175 - RNA, 21 nt, Homo sapiens
ugcccucugaaauaaugggau

SEQ ID NO: 1122176 - RNA, 14 nt, Homo sapiens
ugccuccagcacuc

SEQ ID NO: 1122177 - RNA, 15 nt, Homo sapiens
ugccuccagcacucc

SEQ ID NO: 1122178 - RNA, 18 nt, Homo sapiens
ugccucuaaauagcacuu

SEQ ID NO: 1122179 - RNA, 13 nt, Homo sapiens
ugccugacauuug

SEQ ID NO: 1122180 - RNA, 21 nt, Homo sapiens
ugccuguuaaggaaacuuuau

SEQ ID NO: 1122181 - RNA, 21 nt, Homo sapiens
ugcuauaaaugccagagccaa

SEQ ID NO: 1122182 - RNA, 19 nt, Homo sapiens
ugcuccacuggguuacaga

SEQ ID NO: 1122183 - RNA, 21 nt, Homo sapiens
uggaacuuuuauuacuggggu

SEQ ID NO: 1122184 - RNA, 19 nt, Homo sapiens
uggacagguguuguauaua

SEQ ID NO: 1122185 - RNA, 12 nt, Homo sapiens
uggacugaccac

SEQ ID NO: 1122186 - RNA, 19 nt, Homo sapiens
uggagaaaagggauggagc

SEQ ID NO: 1122187 - RNA, 12 nt, Homo sapiens
uggagagccacc

SEQ ID NO: 1122188 - RNA, 19 nt, Homo sapiens
uggaggcuggaugugcauu

SEQ ID NO: 1122189 - RNA, 16 nt, Homo sapiens
uggaugcagcuucaag

SEQ ID NO: 1122190 - RNA, 15 nt, Homo sapiens
uggcaaggugacauu

SEQ ID NO: 1122191 - RNA, 14 nt, Homo sapiens
uggcccaucugugc

SEQ ID NO: 1122192 - RNA, 23 nt, Homo sapiens
uggcgacugcagcugcaccauca

SEQ ID NO: 1122193 - RNA, 16 nt, Homo sapiens
uggcugggaacaacuu

SEQ ID NO: 1122194 - RNA, 15 nt, Homo sapiens
ugggagacuggaaaa

SEQ ID NO: 1122195 - RNA, 16 nt, Homo sapiens
ugggagaucagccacg

SEQ ID NO: 1122196 - RNA, 18 nt, Homo sapiens
ugggagaucagccacgga

SEQ ID NO: 1122197 - RNA, 13 nt, Homo sapiens
ugggcagagccca

SEQ ID NO: 1122198 - RNA, 16 nt, Homo sapiens
ugggcccuuugagugc

SEQ ID NO: 1122199 - RNA, 22 nt, Homo sapiens
ugggcugugauuacugcaauca

SEQ ID NO: 1122200 - RNA, 16 nt, Homo sapiens
uggggugggcacauug

SEQ ID NO: 1122201 - RNA, 21 nt, Homo sapiens
ugguauaaacguccuacugua

SEQ ID NO: 1122202 - RNA, 13 nt, Homo sapiens
ugguuuacuucaa

SEQ ID NO: 1122203 - RNA, 14 nt, Homo sapiens
uguaccugugcacg

SEQ ID NO: 1122204 - RNA, 15 nt, Homo sapiens
uguaccugugcacgu

SEQ ID NO: 1122205 - RNA, 18 nt, Homo sapiens
uguacuugccuuauuaga

SEQ ID NO: 1122206 - RNA, 22 nt, Homo sapiens
uguagagccaauuagacuugaa

SEQ ID NO: 1122207 - RNA, 18 nt, Homo sapiens
uguaucaaaugugacauu

SEQ ID NO: 1122208 - RNA, 16 nt, Homo sapiens
uguccuucuccaucua

SEQ ID NO: 1122209 - RNA, 23 nt, Homo sapiens
ugucucaugucaaugaccauuca

SEQ ID NO: 1122210 - RNA, 20 nt, Homo sapiens
ugugaaauucacaguaauau

SEQ ID NO: 1122211 - RNA, 20 nt, Homo sapiens
ugugaccaaugucuugaugc

SEQ ID NO: 1122212 - RNA, 16 nt, Homo sapiens
ugugaccgaacacugc

SEQ ID NO: 1122213 - RNA, 12 nt, Homo sapiens
ugugagcaccug

SEQ ID NO: 1122214 - RNA, 23 nt, Homo sapiens
ugugauuacugcaaucacugugc

SEQ ID NO: 1122215 - RNA, 22 nt, Homo sapiens
ugugcaagaccguuuguccacu

SEQ ID NO: 1122216 - RNA, 17 nt, Homo sapiens
ugugcgccgggggaccu

SEQ ID NO: 1122217 - RNA, 15 nt, Homo sapiens
ugugggcuccaugua

SEQ ID NO: 1122218 - RNA, 19 nt, Homo sapiens
ugugucccccucuguccag

SEQ ID NO: 1122219 - RNA, 20 nt, Homo sapiens
uguguucuagaccucugggg

SEQ ID NO: 1122220 - RNA, 20 nt, Homo sapiens
uguguuucuagaaucacagc

SEQ ID NO: 1122221 - RNA, 20 nt, Homo sapiens
uguuaccugaaaacacugug

SEQ ID NO: 1122222 - RNA, 23 nt, Homo sapiens
uguugcuauagagccuaccugua

SEQ ID NO: 1122223 - RNA, 13 nt, Homo sapiens
uguuuuuaagcug

SEQ ID NO: 1122224 - RNA, 18 nt, Homo sapiens
uuaaaaucugucacguag

SEQ ID NO: 1122225 - RNA, 17 nt, Homo sapiens
uuaaguuuuacugauaa

SEQ ID NO: 1122226 - RNA, 20 nt, Homo sapiens
uuaauauuuuuccacuuaaa

SEQ ID NO: 1122227 - RNA, 20 nt, Homo sapiens
uuacugagcuucucugugaa

SEQ ID NO: 1122228 - RNA, 15 nt, Homo sapiens
uuagacccugcauuu

SEQ ID NO: 1122229 - RNA, 13 nt, Homo sapiens
uuaggcaugccua

SEQ ID NO: 1122230 - RNA, 12 nt, Homo sapiens
uuagggcacugg

SEQ ID NO: 1122231 - RNA, 13 nt, Homo sapiens
uuauauucaucca

SEQ ID NO: 1122232 - RNA, 16 nt, Homo sapiens
uuaugaaaaguacuaa

SEQ ID NO: 1122233 - RNA, 12 nt, Homo sapiens
uuauuaccucug

SEQ ID NO: 1122234 - RNA, 12 nt, Homo sapiens
uuauugcaaugc

SEQ ID NO: 1122235 - RNA, 23 nt, Homo sapiens
uuauuuaccugaaauaaaauuca

SEQ ID NO: 1122236 - RNA, 16 nt, Homo sapiens
uucacaucuaaccuca

SEQ ID NO: 1122237 - RNA, 16 nt, Homo sapiens
uucacauuuguauuaa

SEQ ID NO: 1122238 - RNA, 20 nt, Homo sapiens
uucaccuuccagugucucgg

SEQ ID NO: 1122239 - RNA, 18 nt, Homo sapiens
uucacgauuaacugugaa

SEQ ID NO: 1122240 - RNA, 21 nt, Homo sapiens
uucacugaguuuuguuucacu

SEQ ID NO: 1122241 - RNA, 15 nt, Homo sapiens
uucacugccaugccu

SEQ ID NO: 1122242 - RNA, 21 nt, Homo sapiens
uucagaaaucaaacugcuuau

SEQ ID NO: 1122243 - RNA, 15 nt, Homo sapiens
uucauguaauaaaca

SEQ ID NO: 1122244 - RNA, 21 nt, Homo sapiens
uuccaaauugcccuaugcugu

SEQ ID NO: 1122245 - RNA, 20 nt, Homo sapiens
uuccauaguguuaacuguca

SEQ ID NO: 1122246 - RNA, 15 nt, Homo sapiens
uuccauuccaagccu

SEQ ID NO: 1122247 - RNA, 14 nt, Homo sapiens
uucccaaauguauu

SEQ ID NO: 1122248 - RNA, 16 nt, Homo sapiens
uucccacaggacauuu

SEQ ID NO: 1122249 - RNA, 16 nt, Homo sapiens
uucccaggcuggauac

SEQ ID NO: 1122250 - RNA, 16 nt, Homo sapiens
uuccccuuccacugag

SEQ ID NO: 1122251 - RNA, 14 nt, Homo sapiens
uucccgaugaacaa

SEQ ID NO: 1122252 - RNA, 14 nt, Homo sapiens
gugauuacugcaau

SEQ ID NO: 1122253 - RNA, 21 nt, Homo sapiens
gugauuacugcaaucacugug

SEQ ID NO: 1122254 - RNA, 23 nt, Homo sapiens
gugcaguaagccuguuggauaaa

SEQ ID NO: 1122255 - RNA, 20 nt, Homo sapiens
gugggcucccugacugggag

SEQ ID NO: 1122256 - RNA, 17 nt, Homo sapiens
gugguccuuugggguga

SEQ ID NO: 1122257 - RNA, 14 nt, Homo sapiens
guguuaaaugugau

SEQ ID NO: 1122258 - RNA, 15 nt, Homo sapiens
guguucuagaccucu

SEQ ID NO: 1122259 - RNA, 19 nt, Homo sapiens
guguugccucuugcaaugc

SEQ ID NO: 1122260 - RNA, 21 nt, Homo sapiens
guuaccugaaaacacugugca

SEQ ID NO: 1122261 - RNA, 22 nt, Homo sapiens
guuagauaaugaaugauaagca

SEQ ID NO: 1122262 - RNA, 14 nt, Homo sapiens
guuaguuccuucau

SEQ ID NO: 1122263 - RNA, 15 nt, Homo sapiens
guuauucuuguuaua

SEQ ID NO: 1122264 - RNA, 21 nt, Homo sapiens
guuauuggacuccaggccuga

SEQ ID NO: 1122265 - RNA, 22 nt, Homo sapiens
guucaagaaguaaucaguaugc

SEQ ID NO: 1122266 - RNA, 21 nt, Homo sapiens
guuccaguaccgcccucgggg

SEQ ID NO: 1122267 - RNA, 14 nt, Homo sapiens
guucccaaaacaau

SEQ ID NO: 1122268 - RNA, 14 nt, Homo sapiens
guucccccugugca

SEQ ID NO: 1122269 - RNA, 17 nt, Homo sapiens
guucuaaauaugaauga

SEQ ID NO: 1122270 - RNA, 19 nt, Homo sapiens
guucucccaccaccucacc

SEQ ID NO: 1122271 - RNA, 14 nt, Homo sapiens
guugaauaaaugaa

SEQ ID NO: 1122272 - RNA, 17 nt, Homo sapiens
guugccucuugcaaugc

SEQ ID NO: 1122273 - RNA, 19 nt, Homo sapiens
uaaaaaaugucucauguca

SEQ ID NO: 1122274 - RNA, 13 nt, Homo sapiens
uaaaacagucauc

SEQ ID NO: 1122275 - RNA, 19 nt, Homo sapiens
uaaaacauugaaugaaacu

SEQ ID NO: 1122276 - RNA, 14 nt, Homo sapiens
uaaaaguaaauuca

SEQ ID NO: 1122277 - RNA, 20 nt, Homo sapiens
uaaacaagucaaagacuugu

SEQ ID NO: 1122278 - RNA, 19 nt, Homo sapiens
uaaagaaauuuuaguaguu

SEQ ID NO: 1122279 - RNA, 18 nt, Homo sapiens
uaaagcaauaugcauuua

SEQ ID NO: 1122280 - RNA, 23 nt, Homo sapiens
uaaaguagcaggacucggaauuc

SEQ ID NO: 1122281 - RNA, 16 nt, Homo sapiens
uaaauaaaaauaugua

SEQ ID NO: 1122282 - RNA, 21 nt, Homo sapiens
uaaauaaauguaucuuauuca

SEQ ID NO: 1122283 - RNA, 16 nt, Homo sapiens
uaaauaccauucacua

SEQ ID NO: 1122284 - RNA, 23 nt, Homo sapiens
uaaauagugucauauaaacucau

SEQ ID NO: 1122285 - RNA, 23 nt, Homo sapiens
uaaauauucccugacgacacuga

SEQ ID NO: 1122286 - RNA, 17 nt, Homo sapiens
uaaauuugguucuaggc

SEQ ID NO: 1122287 - RNA, 14 nt, Homo sapiens
uaacaaacucugag

SEQ ID NO: 1122288 - RNA, 17 nt, Homo sapiens
uaaccagcucaguguuu

SEQ ID NO: 1122289 - RNA, 14 nt, Homo sapiens
uaacguggcacugg

SEQ ID NO: 1122290 - RNA, 22 nt, Homo sapiens
uaacuacaaggacaaugccuug

SEQ ID NO: 1122291 - RNA, 17 nt, Homo sapiens
uaacuagaauuuauuca

SEQ ID NO: 1122292 - RNA, 18 nt, Homo sapiens
uaacugcccucugaaaua

SEQ ID NO: 1122293 - RNA, 15 nt, Homo sapiens
uaacuguacugaaua

SEQ ID NO: 1122294 - RNA, 23 nt, Homo sapiens
uaacuuaaaaaacugcaucccac

SEQ ID NO: 1122295 - RNA, 15 nt, Homo sapiens
uaagagaacaaugug

SEQ ID NO: 1122296 - RNA, 18 nt, Homo sapiens
uaagaguaaaauuccucu

SEQ ID NO: 1122297 - RNA, 17 nt, Homo sapiens
uaagagucauccagcuc

SEQ ID NO: 1122298 - RNA, 17 nt, Homo sapiens
uaagauauuuaguaaua

SEQ ID NO: 1122299 - RNA, 21 nt, Homo sapiens
uaagcaaaaugcuucugcaca

SEQ ID NO: 1122300 - RNA, 22 nt, Homo sapiens
uaaguaaaauccccuucgcuga

SEQ ID NO: 1122301 - RNA, 14 nt, Homo sapiens
uaaucaguaugcaa

SEQ ID NO: 1122302 - RNA, 20 nt, Homo sapiens
uaaucccagcuacuugggag

SEQ ID NO: 1122303 - RNA, 15 nt, Homo sapiens
uaauuuaacuuucca

SEQ ID NO: 1122304 - RNA, 19 nt, Homo sapiens
uaauuuucgaaaacuuccc

SEQ ID NO: 1122305 - RNA, 11 nt, Homo sapiens
uacaaacucau

SEQ ID NO: 1122306 - RNA, 19 nt, Homo sapiens
uacaaucaaggccacugcu

SEQ ID NO: 1122307 - RNA, 14 nt, Homo sapiens
uacagaacucuuuc

SEQ ID NO: 1122308 - RNA, 19 nt, Homo sapiens
uacagauguaaaugccaca

SEQ ID NO: 1122309 - RNA, 19 nt, Homo sapiens
uacaguauguuuuacaugu

SEQ ID NO: 1122310 - RNA, 20 nt, Homo sapiens
uacaguucugggguacaugu

SEQ ID NO: 1122311 - RNA, 21 nt, Homo sapiens
uaccaguauaauugaguuuuc

SEQ ID NO: 1122312 - RNA, 15 nt, Homo sapiens
uaccucaagacucac

SEQ ID NO: 1122313 - RNA, 20 nt, Homo sapiens
uaccugaaauaaaauucauu

SEQ ID NO: 1122314 - RNA, 14 nt, Homo sapiens
uaccugacacuccc

SEQ ID NO: 1122315 - RNA, 23 nt, Homo sapiens
uaccugcccccaucauaagggca

SEQ ID NO: 1122316 - RNA, 21 nt, Homo sapiens
uacugaugguuacauauacua

SEQ ID NO: 1122317 - RNA, 21 nt, Homo sapiens
uacuuuugcccuuugauuaaa

SEQ ID NO: 1122318 - RNA, 13 nt, Homo sapiens
uagaauuuauuca

SEQ ID NO: 1122319 - RNA, 15 nt, Homo sapiens
uagacuccucaggag

SEQ ID NO: 1122320 - RNA, 18 nt, Homo sapiens
uagagauuaccuccugag

SEQ ID NO: 1122321 - RNA, 18 nt, Homo sapiens
uagaggcauaaaccugug

SEQ ID NO: 1122322 - RNA, 15 nt, Homo sapiens
uagaguggaaucucu

SEQ ID NO: 1122323 - RNA, 18 nt, Homo sapiens
uagcauacgguaugauau

SEQ ID NO: 1122324 - RNA, 19 nt, Homo sapiens
uagcggugaagaguacaga

SEQ ID NO: 1122325 - RNA, 21 nt, Homo sapiens
uagcuaacguguccgaaacca

SEQ ID NO: 1122326 - RNA, 22 nt, Homo sapiens
uagcuccauaaaguacaaauga

SEQ ID NO: 1122327 - RNA, 16 nt, Homo sapiens
uaggcgcaggugcaca

SEQ ID NO: 1122328 - RNA, 17 nt, Homo sapiens
uaggcgcaggugcacag

SEQ ID NO: 1122329 - RNA, 21 nt, Homo sapiens
uagugacauuuaaugccaucu

SEQ ID NO: 1122330 - RNA, 21 nt, Homo sapiens
uagugauguccuuaaaaugug

SEQ ID NO: 1122331 - RNA, 14 nt, Homo sapiens
uauaaagcuguuau

SEQ ID NO: 1122332 - RNA, 23 nt, Homo sapiens
cauuaguuguuagugauggagcu

SEQ ID NO: 1122333 - RNA, 22 nt, Homo sapiens
auugcugccccaucagugcucc

SEQ ID NO: 1122334 - RNA, 22 nt, Homo sapiens
auugggaagcugggggaagggu

SEQ ID NO: 1122335 - RNA, 22 nt, Homo sapiens
auuuaguaaauaaacaagucaa

SEQ ID NO: 1122336 - RNA, 14 nt, Homo sapiens
cauuauaugcacua

SEQ ID NO: 1122337 - RNA, 20 nt, Homo sapiens
cauuauaugcacuagcaaua

SEQ ID NO: 1122338 - RNA, 18 nt, Homo sapiens
cauuaucuuugcuguuau

SEQ ID NO: 1122339 - RNA, 22 nt, Homo sapiens
cauuccccucgugugacucucu

SEQ ID NO: 1122340 - RNA, 18 nt, Homo sapiens
cauugccuggacugacca

SEQ ID NO: 1122341 - RNA, 18 nt, Homo sapiens
cauuggugagaguccaac

SEQ ID NO: 1122342 - RNA, 13 nt, Homo sapiens
cauuuauagcaua

SEQ ID NO: 1122343 - RNA, 17 nt, Homo sapiens
cauuuccaugcauaaau

SEQ ID NO: 1122344 - RNA, 20 nt, Homo sapiens
cauuuucccccacuacugca

SEQ ID NO: 1122345 - RNA, 13 nt, Homo sapiens
ccaaauguauucu

SEQ ID NO: 1122346 - RNA, 21 nt, Homo sapiens
ccaacagaagcuuccauucca

SEQ ID NO: 1122347 - RNA, 22 nt, Homo sapiens
ccaagcaggaaaugaaaauguc

SEQ ID NO: 1122348 - RNA, 13 nt, Homo sapiens
ccaauuagacuug

SEQ ID NO: 1122349 - RNA, 19 nt, Homo sapiens
ccacaaucugggacuuuca

SEQ ID NO: 1122350 - RNA, 21 nt, Homo sapiens
ccacauccuccacguucugcu

SEQ ID NO: 1122351 - RNA, 17 nt, Homo sapiens
ccaccaccucaccaguu

SEQ ID NO: 1122352 - RNA, 15 nt, Homo sapiens
ccaccacgugcucaa

SEQ ID NO: 1122353 - RNA, 22 nt, Homo sapiens
ccacgagcuguuuacuagggau

SEQ ID NO: 1122354 - RNA, 12 nt, Homo sapiens
ccacuacugcag

SEQ ID NO: 1122355 - RNA, 22 nt, Homo sapiens
ccacuaggguccaccaggaguu

SEQ ID NO: 1122356 - RNA, 23 nt, Homo sapiens
ccacugaggagacagaaagccuc

SEQ ID NO: 1122357 - RNA, 16 nt, Homo sapiens
ccacuggguuacagaa

SEQ ID NO: 1122358 - RNA, 23 nt, Homo sapiens
ccagagccaaccuggacuuccug

SEQ ID NO: 1122359 - RNA, 15 nt, Homo sapiens
ccagagggcacucug

SEQ ID NO: 1122360 - RNA, 19 nt, Homo sapiens
ccagaguuuuuaaagccuu

SEQ ID NO: 1122361 - RNA, 15 nt, Homo sapiens
ccaggcugagccaug

SEQ ID NO: 1122362 - RNA, 20 nt, Homo sapiens
ccagggaagaagaucaacgc

SEQ ID NO: 1122363 - RNA, 22 nt, Homo sapiens
ccauacguucagaggugcagcu

SEQ ID NO: 1122364 - RNA, 14 nt, Homo sapiens
ccaucagugcuccc

SEQ ID NO: 1122365 - RNA, 15 nt, Homo sapiens
ccauccaacacugga

SEQ ID NO: 1122366 - RNA, 15 nt, Homo sapiens
ccaugcccagccugu

SEQ ID NO: 1122367 - RNA, 21 nt, Homo sapiens
ccauguacuucccucuugaaa

SEQ ID NO: 1122368 - RNA, 15 nt, Homo sapiens
ccaugugcaccugcc

SEQ ID NO: 1122369 - RNA, 21 nt, Homo sapiens
ccauuuggcaaugccaucauc

SEQ ID NO: 1122370 - RNA, 16 nt, Homo sapiens
cccaauucacaucuaa

SEQ ID NO: 1122371 - RNA, 13 nt, Homo sapiens
cccacagccauag

SEQ ID NO: 1122372 - RNA, 14 nt, Homo sapiens
cccaccagugccuu

SEQ ID NO: 1122373 - RNA, 19 nt, Homo sapiens
cccacccacagccauagac

SEQ ID NO: 1122374 - RNA, 14 nt, Homo sapiens
cccagacucagcuc

SEQ ID NO: 1122375 - RNA, 14 nt, Homo sapiens
cccagagaccccuu

SEQ ID NO: 1122376 - RNA, 20 nt, Homo sapiens
cccaggcccgagaugugacc

SEQ ID NO: 1122377 - RNA, 21 nt, Homo sapiens
cccauagcacugggcucugau

SEQ ID NO: 1122378 - RNA, 15 nt, Homo sapiens
cccauuucuauuuau

SEQ ID NO: 1122379 - RNA, 14 nt, Homo sapiens
ccccaauccaugaa

SEQ ID NO: 1122380 - RNA, 13 nt, Homo sapiens
cccuaagugccca

SEQ ID NO: 1122381 - RNA, 15 nt, Homo sapiens
cccuacucaccugag

SEQ ID NO: 1122382 - RNA, 22 nt, Homo sapiens
cccugaccuucugggacauggu

SEQ ID NO: 1122383 - RNA, 21 nt, Homo sapiens
cccugacugggaguugaucgc

SEQ ID NO: 1122384 - RNA, 23 nt, Homo sapiens
cccugccuguuaaggaaacuuua

SEQ ID NO: 1122385 - RNA, 17 nt, Homo sapiens
cccuuaagagucaucca

SEQ ID NO: 1122386 - RNA, 11 nt, Homo sapiens
ccgacucuggc

SEQ ID NO: 1122387 - RNA, 16 nt, Homo sapiens
ccgcaacagccaagug

SEQ ID NO: 1122388 - RNA, 13 nt, Homo sapiens
ccggccaccagau

SEQ ID NO: 1122389 - RNA, 20 nt, Homo sapiens
ccgggaagagggugauugcu

SEQ ID NO: 1122390 - RNA, 18 nt, Homo sapiens
ccuaaaaguucucaaugu

SEQ ID NO: 1122391 - RNA, 15 nt, Homo sapiens
ccuaaccucauuccc

SEQ ID NO: 1122392 - RNA, 18 nt, Homo sapiens
ccuacaaaauggagggag

SEQ ID NO: 1122393 - RNA, 12 nt, Homo sapiens
ccuagaacuucc

SEQ ID NO: 1122394 - RNA, 22 nt, Homo sapiens
ccuaggcuaccucaagacucac

SEQ ID NO: 1122395 - RNA, 20 nt, Homo sapiens
ccucauuccccaaccacuuc

SEQ ID NO: 1122396 - RNA, 15 nt, Homo sapiens
ccucccagcuucuua

SEQ ID NO: 1122397 - RNA, 19 nt, Homo sapiens
ccuccugccuccagcacuc

SEQ ID NO: 1122398 - RNA, 15 nt, Homo sapiens
ccucgcuggacucuc

SEQ ID NO: 1122399 - RNA, 20 nt, Homo sapiens
ccucgggaagccccauccaa

SEQ ID NO: 1122400 - RNA, 16 nt, Homo sapiens
ccucuccaguuugcac

SEQ ID NO: 1122401 - RNA, 17 nt, Homo sapiens
ccucucuagacaguaga

SEQ ID NO: 1122402 - RNA, 14 nt, Homo sapiens
ccucugcagcacuu

SEQ ID NO: 1122403 - RNA, 20 nt, Homo sapiens
ccugagguuugccagcauuu

SEQ ID NO: 1122404 - RNA, 22 nt, Homo sapiens
ccugagguuugccagcauuuag

SEQ ID NO: 1122405 - RNA, 17 nt, Homo sapiens
ccugcaaaaggacucuc

SEQ ID NO: 1122406 - RNA, 16 nt, Homo sapiens
ccugccuccagcacuc

SEQ ID NO: 1122407 - RNA, 19 nt, Homo sapiens
ccuggggagucugggcaca

SEQ ID NO: 1122408 - RNA, 17 nt, Homo sapiens
ccuggucaacaugguga

SEQ ID NO: 1122409 - RNA, 21 nt, Homo sapiens
ccugucaccagagcuucucug

SEQ ID NO: 1122410 - RNA, 22 nt, Homo sapiens
ccuuaaaauguggucugccaau

SEQ ID NO: 1122411 - RNA, 20 nt, Homo sapiens
ccuuauuagagugucuuucc

SEQ ID NO: 1122412 - RNA, 16 nt, Homo sapiens
ccuuauuguaccucuc

SEQ ID NO: 1122413 - RNA, 21 nt, Homo sapiens
ccuuauuguaccucucuuaua

SEQ ID NO: 1122414 - RNA, 17 nt, Homo sapiens
ccuucaugaucaucaca

SEQ ID NO: 1122415 - RNA, 12 nt, Homo sapiens
ccuuccacugag

SEQ ID NO: 1122416 - RNA, 19 nt, Homo sapiens
ccuucuccauccacauggg

SEQ ID NO: 1122417 - RNA, 15 nt, Homo sapiens
ccuucugggacaugg

SEQ ID NO: 1122418 - RNA, 20 nt, Homo sapiens
ccuucugguucuaacugcug

SEQ ID NO: 1122419 - RNA, 21 nt, Homo sapiens
ccuucugguucuaacugcugu

SEQ ID NO: 1122420 - RNA, 11 nt, Homo sapiens
ccuugagaaac

SEQ ID NO: 1122421 - RNA, 19 nt, Homo sapiens
ccuuuccuccccaccuucc

SEQ ID NO: 1122422 - RNA, 21 nt, Homo sapiens
ccuuuggggugaacuaccuug

SEQ ID NO: 1122423 - RNA, 19 nt, Homo sapiens
ccuuuuggccuccugcaaa

SEQ ID NO: 1122424 - RNA, 12 nt, Homo sapiens
ccuuuuucauaa

SEQ ID NO: 1122425 - RNA, 21 nt, Homo sapiens
cgaaaccaguuaagaauggaa

SEQ ID NO: 1122426 - RNA, 19 nt, Homo sapiens
cgaaccauggugaacucca

SEQ ID NO: 1122427 - RNA, 13 nt, Homo sapiens
cgagcacugugag

SEQ ID NO: 1122428 - RNA, 22 nt, Homo sapiens
cgcugagcgaggagaugcuccu

SEQ ID NO: 1122429 - RNA, 14 nt, Homo sapiens
cggaagccaaaggc

SEQ ID NO: 1122430 - RNA, 23 nt, Homo sapiens
cggccuggggcgagcacugugag

SEQ ID NO: 1122431 - RNA, 19 nt, Homo sapiens
cgggacaguaaacacucca

SEQ ID NO: 1122432 - RNA, 13 nt, Homo sapiens
cguccuacuguau

SEQ ID NO: 1122433 - RNA, 13 nt, Homo sapiens
cgugggcucccug

SEQ ID NO: 1122434 - RNA, 15 nt, Homo sapiens
cguucagaggugcag

SEQ ID NO: 1122435 - RNA, 23 nt, Homo sapiens
cuaaauaaaaauauguaauuuca

SEQ ID NO: 1122436 - RNA, 20 nt, Homo sapiens
cuaaauguguaauaauguaa

SEQ ID NO: 1122437 - RNA, 18 nt, Homo sapiens
cuaaccaaggcuguguuu

SEQ ID NO: 1122438 - RNA, 16 nt, Homo sapiens
cuaaccagccugguca

SEQ ID NO: 1122439 - RNA, 22 nt, Homo sapiens
cuaaccuucacgauuaacugug

SEQ ID NO: 1122440 - RNA, 16 nt, Homo sapiens
cuaagagaacaaugug

SEQ ID NO: 1122441 - RNA, 15 nt, Homo sapiens
cuaagugcccaaagu

SEQ ID NO: 1122442 - RNA, 23 nt, Homo sapiens
cuaauguuugaacaaagcucaaa

SEQ ID NO: 1122443 - RNA, 13 nt, Homo sapiens
cuaccuacauauu

SEQ ID NO: 1122444 - RNA, 22 nt, Homo sapiens
cuaccucaagacucaccucauc

SEQ ID NO: 1122445 - RNA, 22 nt, Homo sapiens
aaagggaaauacucuuaauuca

SEQ ID NO: 1122446 - RNA, 14 nt, Homo sapiens
aaauaaacaaguca

SEQ ID NO: 1122447 - RNA, 17 nt, Homo sapiens
aaauagagccugaggga

SEQ ID NO: 1122448 - RNA, 17 nt, Homo sapiens
aaauaucauaaagcauu

SEQ ID NO: 1122449 - RNA, 16 nt, Homo sapiens
aaaucugguuagauaa

SEQ ID NO: 1122450 - RNA, 18 nt, Homo sapiens
aaaucuguguaacuguaa

SEQ ID NO: 1122451 - RNA, 14 nt, Homo sapiens
aaaugcuucugcac

SEQ ID NO: 1122452 - RNA, 21 nt, Homo sapiens
aaauggagggagccaucccuu

SEQ ID NO: 1122453 - RNA, 22 nt, Homo sapiens
aaaugguccaggagaaggccaa

SEQ ID NO: 1122454 - RNA, 12 nt, Homo sapiens
aaauguguaaua

SEQ ID NO: 1122455 - RNA, 12 nt, Homo sapiens
aaauuaagcauu

SEQ ID NO: 1122456 - RNA, 18 nt, Homo sapiens
aaauuacuggaaggcuuc

SEQ ID NO: 1122457 - RNA, 21 nt, Homo sapiens
aaauucauuaguuguuaguga

SEQ ID NO: 1122458 - RNA, 14 nt, Homo sapiens
aaauuguauuauca

SEQ ID NO: 1122459 - RNA, 21 nt, Homo sapiens
aaauuuuaguaguuacuaaaa

SEQ ID NO: 1122460 - RNA, 22 nt, Homo sapiens
aacaagagaaaaaacuagagcc

SEQ ID NO: 1122461 - RNA, 21 nt, Homo sapiens
aacaccuuuguuuugcacuga

SEQ ID NO: 1122462 - RNA, 15 nt, Homo sapiens
aacagucacuggaaa

SEQ ID NO: 1122463 - RNA, 18 nt, Homo sapiens
aaccacuucauucuugaa

SEQ ID NO: 1122464 - RNA, 18 nt, Homo sapiens
aaccuuauuguaccucuc

SEQ ID NO: 1122465 - RNA, 21 nt, Homo sapiens
aacuaagaaaauucuauguua

SEQ ID NO: 1122466 - RNA, 17 nt, Homo sapiens
aacuagaauuuauucaa

SEQ ID NO: 1122467 - RNA, 15 nt, Homo sapiens
aacucacaccugccu

SEQ ID NO: 1122468 - RNA, 20 nt, Homo sapiens
aacuguaaauugagauuuaa

SEQ ID NO: 1122469 - RNA, 20 nt, Homo sapiens
aacuucaguccaacugucaa

SEQ ID NO: 1122470 - RNA, 18 nt, Homo sapiens
aagaaauccaguuuccca

SEQ ID NO: 1122471 - RNA, 15 nt, Homo sapiens
aagaauaauaauuaa

SEQ ID NO: 1122472 - RNA, 13 nt, Homo sapiens
aagaauggaagaa

SEQ ID NO: 1122473 - RNA, 18 nt, Homo sapiens
aagacuggauuugcagaa

SEQ ID NO: 1122474 - RNA, 19 nt, Homo sapiens
aagacuguugccacuuaac

SEQ ID NO: 1122475 - RNA, 18 nt, Homo sapiens
aagauaaaaugauguuau

SEQ ID NO: 1122476 - RNA, 19 nt, Homo sapiens
aagaucaacgccucacuga

SEQ ID NO: 1122477 - RNA, 23 nt, Homo sapiens
aagauggaaugcuugcagagcau

SEQ ID NO: 1122478 - RNA, 12 nt, Homo sapiens
aagcaccaggac

SEQ ID NO: 1122479 - RNA, 12 nt, Homo sapiens
aagcacuugugg

SEQ ID NO: 1122480 - RNA, 19 nt, Homo sapiens
aagcauucacaacuuguuu

SEQ ID NO: 1122481 - RNA, 15 nt, Homo sapiens
aagcccaauauuaua

SEQ ID NO: 1122482 - RNA, 16 nt, Homo sapiens
aagcuugaggccaaga

SEQ ID NO: 1122483 - RNA, 13 nt, Homo sapiens
aaggacaaugccu

SEQ ID NO: 1122484 - RNA, 16 nt, Homo sapiens
aaggagccccauuccu

SEQ ID NO: 1122485 - RNA, 13 nt, Homo sapiens
aaggccucugugg

SEQ ID NO: 1122486 - RNA, 14 nt, Homo sapiens
aagggauggagcug

SEQ ID NO: 1122487 - RNA, 22 nt, Homo sapiens
aaguauaaucagcacuuugcca

SEQ ID NO: 1122488 - RNA, 18 nt, Homo sapiens
aaguccuaaaaguucuca

SEQ ID NO: 1122489 - RNA, 14 nt, Homo sapiens
aauaaaauaucaua

SEQ ID NO: 1122490 - RNA, 18 nt, Homo sapiens
aauaaacaagucaaagac

SEQ ID NO: 1122491 - RNA, 20 nt, Homo sapiens
aauaaaccaucaucuugcca

SEQ ID NO: 1122492 - RNA, 21 nt, Homo sapiens
aauaagauauuuaguaauauu

SEQ ID NO: 1122493 - RNA, 20 nt, Homo sapiens
aauacugccaaaacauuuau

SEQ ID NO: 1122494 - RNA, 20 nt, Homo sapiens
aauagauuugggucauuuag

SEQ ID NO: 1122495 - RNA, 11 nt, Homo sapiens
aauaugaauga

SEQ ID NO: 1122496 - RNA, 20 nt, Homo sapiens
aauauuuauuauuuucaccu

SEQ ID NO: 1122497 - RNA, 18 nt, Homo sapiens
aauauuuuuccacuuaaa

SEQ ID NO: 1122498 - RNA, 13 nt, Homo sapiens
aaucaaacugcuu

SEQ ID NO: 1122499 - RNA, 16 nt, Homo sapiens
aaucaugaguaccuca

SEQ ID NO: 1122500 - RNA, 16 nt, Homo sapiens
aaucaugcccugccuu

SEQ ID NO: 1122501 - RNA, 12 nt, Homo sapiens
aaucuguacaaa

SEQ ID NO: 1122502 - RNA, 17 nt, Homo sapiens
aaucuguguaacuguaa

SEQ ID NO: 1122503 - RNA, 13 nt, Homo sapiens
aaugaaacuuuaa

SEQ ID NO: 1122504 - RNA, 12 nt, Homo sapiens
aaugacagaucu

SEQ ID NO: 1122505 - RNA, 23 nt, Homo sapiens
aaugauuaacaguuaugugguca

SEQ ID NO: 1122506 - RNA, 20 nt, Homo sapiens
aaugcauauuugccacaaaa

SEQ ID NO: 1122507 - RNA, 17 nt, Homo sapiens
aaugcucccaccugaau

SEQ ID NO: 1122508 - RNA, 22 nt, Homo sapiens
aaugcugauagcucauauuaua

SEQ ID NO: 1122509 - RNA, 19 nt, Homo sapiens
aauggagugggagaucagc

SEQ ID NO: 1122510 - RNA, 22 nt, Homo sapiens
aaugucucaugucaaugaccau

SEQ ID NO: 1122511 - RNA, 20 nt, Homo sapiens
aaugugacauuauaugcacu

SEQ ID NO: 1122512 - RNA, 12 nt, Homo sapiens
aaugugauugca

SEQ ID NO: 1122513 - RNA, 19 nt, Homo sapiens
aauuaaaauccucaaucca

SEQ ID NO: 1122514 - RNA, 14 nt, Homo sapiens
aauuaauauaucau

SEQ ID NO: 1122515 - RNA, 22 nt, Homo sapiens
aauuauuugcauaacaauuccu

SEQ ID NO: 1122516 - RNA, 19 nt, Homo sapiens
aauucccaaauguauucua

SEQ ID NO: 1122517 - RNA, 13 nt, Homo sapiens
aauuccucuggga

SEQ ID NO: 1122518 - RNA, 16 nt, Homo sapiens
aauuccucuuacugua

SEQ ID NO: 1122519 - RNA, 17 nt, Homo sapiens
aauucucauaaguagca

SEQ ID NO: 1122520 - RNA, 21 nt, Homo sapiens
aauucucauaaguagcauuca

SEQ ID NO: 1122521 - RNA, 12 nt, Homo sapiens
aauuugaacuuu

SEQ ID NO: 1122522 - RNA, 20 nt, Homo sapiens
aauuuguauaugacugcauu

SEQ ID NO: 1122523 - RNA, 18 nt, Homo sapiens
aauuuuauuacauaugau

SEQ ID NO: 1122524 - RNA, 21 nt, Homo sapiens
acaaagcccauagcacugggc

SEQ ID NO: 1122525 - RNA, 16 nt, Homo sapiens
acaaagggaaauacuc

SEQ ID NO: 1122526 - RNA, 20 nt, Homo sapiens
acaaauauaaaacuauaagu

SEQ ID NO: 1122527 - RNA, 19 nt, Homo sapiens
acaagaaggccacugguag

SEQ ID NO: 1122528 - RNA, 19 nt, Homo sapiens
acaaucaucaucauucuca

SEQ ID NO: 1122529 - RNA, 12 nt, Homo sapiens
acaaucugggac

SEQ ID NO: 1122530 - RNA, 18 nt, Homo sapiens
acaaucugggacuuucac

SEQ ID NO: 1122531 - RNA, 15 nt, Homo sapiens
acacaaaacucucug

SEQ ID NO: 1122532 - RNA, 15 nt, Homo sapiens
acacccacagaagga

SEQ ID NO: 1122533 - RNA, 12 nt, Homo sapiens
acagaagguccu

SEQ ID NO: 1122534 - RNA, 17 nt, Homo sapiens
acagauguaaaugccac

SEQ ID NO: 1122535 - RNA, 20 nt, Homo sapiens
acagauguaaaugccacaaa

SEQ ID NO: 1122536 - RNA, 21 nt, Homo sapiens
acagcccucaugaucauucuc

SEQ ID NO: 1122537 - RNA, 22 nt, Homo sapiens
acagcccucaugaucauucuca

SEQ ID NO: 1122538 - RNA, 12 nt, Homo sapiens
acagcuggacag

SEQ ID NO: 1122539 - RNA, 16 nt, Homo sapiens
acaguaaacacuccac

SEQ ID NO: 1122540 - RNA, 13 nt, Homo sapiens
acagucacuggaa

SEQ ID NO: 1122541 - RNA, 16 nt, Homo sapiens
acagucacuggaaaga

SEQ ID NO: 1122542 - RNA, 15 nt, Homo sapiens
acaucugugucuugu

SEQ ID NO: 1122543 - RNA, 14 nt, Homo sapiens
acauggaacuuuag

SEQ ID NO: 1122544 - RNA, 13 nt, Homo sapiens
acaugguggacag

SEQ ID NO: 1122545 - RNA, 13 nt, Homo sapiens
acauuuccaugca

SEQ ID NO: 1122546 - RNA, 17 nt, Homo sapiens
accaagcagagcucaca

SEQ ID NO: 1122547 - RNA, 13 nt, Homo sapiens
accaaugucuuga

SEQ ID NO: 1122548 - RNA, 14 nt, Homo sapiens
accacacugauccu

SEQ ID NO: 1122549 - RNA, 17 nt, Homo sapiens
accacugauaaaaccau

SEQ ID NO: 1122550 - RNA, 20 nt, Homo sapiens
accagaugucgcccuacuca

SEQ ID NO: 1122551 - RNA, 22 nt, Homo sapiens
accagccuggucaacaugguga

SEQ ID NO: 1122552 - RNA, 14 nt, Homo sapiens
accauaugaaugaa

SEQ ID NO: 1122553 - RNA, 14 nt, Homo sapiens
accaucugugacua

SEQ ID NO: 1122554 - RNA, 18 nt, Homo sapiens
acccagcaacacagagcu

SEQ ID NO: 1122555 - RNA, 12 nt, Homo sapiens
ccaggaccaguc

SEQ ID NO: 1122556 - RNA, 19 nt, Homo sapiens
ccaggacgcccucacugca

SEQ ID NO: 1122557 - RNA, 13 nt, Homo sapiens
ccaggccugacca

SEQ ID NO: 1122558 - RNA, 15 nt, Homo sapiens
ccaggccugaccagg

SEQ ID NO: 1122559 - RNA, 19 nt, Homo sapiens
ccaggcugcccaucagggc

SEQ ID NO: 1122560 - RNA, 19 nt, Homo sapiens
ccaggguggaugaucucaa

SEQ ID NO: 1122561 - RNA, 20 nt, Homo sapiens
ccaguuugcaccugucccca

SEQ ID NO: 1122562 - RNA, 23 nt, Homo sapiens
ccauacguucagaggugcagcug

SEQ ID NO: 1122563 - RNA, 17 nt, Homo sapiens
ccauauuugauaguaua

SEQ ID NO: 1122564 - RNA, 15 nt, Homo sapiens
ccaucacacaugcau

SEQ ID NO: 1122565 - RNA, 23 nt, Homo sapiens
ccaucagugcucccucacauguc

SEQ ID NO: 1122566 - RNA, 15 nt, Homo sapiens
ccaucugugacuaua

SEQ ID NO: 1122567 - RNA, 13 nt, Homo sapiens
ccaucugugcagu

SEQ ID NO: 1122568 - RNA, 16 nt, Homo sapiens
ccauuaggcaugccua

SEQ ID NO: 1122569 - RNA, 13 nt, Homo sapiens
cccaaauguauuc

SEQ ID NO: 1122570 - RNA, 23 nt, Homo sapiens
cccacuuuccuacaaaauggagg

SEQ ID NO: 1122571 - RNA, 14 nt, Homo sapiens
cccagcaacacaga

SEQ ID NO: 1122572 - RNA, 11 nt, Homo sapiens
cccagcacugc

SEQ ID NO: 1122573 - RNA, 15 nt, Homo sapiens
cccagccuucacuga

SEQ ID NO: 1122574 - RNA, 13 nt, Homo sapiens
cccaggaggucug

SEQ ID NO: 1122575 - RNA, 20 nt, Homo sapiens
cccauagcacugggcucuga

SEQ ID NO: 1122576 - RNA, 19 nt, Homo sapiens
cccaucagggcccagggag

SEQ ID NO: 1122577 - RNA, 23 nt, Homo sapiens
cccauccauuaggccagcaacgc

SEQ ID NO: 1122578 - RNA, 16 nt, Homo sapiens
cccauccccuuuccuc

SEQ ID NO: 1122579 - RNA, 16 nt, Homo sapiens
ccccaaagcaauguga

SEQ ID NO: 1122580 - RNA, 12 nt, Homo sapiens
ccccaauccauc

SEQ ID NO: 1122581 - RNA, 15 nt, Homo sapiens
ccccauuccugggaa

SEQ ID NO: 1122582 - RNA, 14 nt, Homo sapiens
cccccagaggacuu

SEQ ID NO: 1122583 - RNA, 17 nt, Homo sapiens
cccccaucauaagggca

SEQ ID NO: 1122584 - RNA, 16 nt, Homo sapiens
cccgugggcaucucaa

SEQ ID NO: 1122585 - RNA, 14 nt, Homo sapiens
cccucaugaucauu

SEQ ID NO: 1122586 - RNA, 15 nt, Homo sapiens
cccuccaccuuccau

SEQ ID NO: 1122587 - RNA, 20 nt, Homo sapiens
cccuggggagucugggcaca

SEQ ID NO: 1122588 - RNA, 13 nt, Homo sapiens
cccuggugucaca

SEQ ID NO: 1122589 - RNA, 14 nt, Homo sapiens
cccuuauacagugg

SEQ ID NO: 1122590 - RNA, 22 nt, Homo sapiens
cccuuggcccaucugugcagua

SEQ ID NO: 1122591 - RNA, 16 nt, Homo sapiens
ccgaugaacaaguuua

SEQ ID NO: 1122592 - RNA, 21 nt, Homo sapiens
ccgcugcuuccuggcugggaa

SEQ ID NO: 1122593 - RNA, 17 nt, Homo sapiens
ccggaugaaacuucuca

SEQ ID NO: 1122594 - RNA, 15 nt, Homo sapiens
ccuaacaaaugcucc

SEQ ID NO: 1122595 - RNA, 18 nt, Homo sapiens
ccuaagcagaccacugau

SEQ ID NO: 1122596 - RNA, 15 nt, Homo sapiens
ccuacaaaauggagg

SEQ ID NO: 1122597 - RNA, 17 nt, Homo sapiens
ccucaugaucauucuca

SEQ ID NO: 1122598 - RNA, 22 nt, Homo sapiens
ccucaugaucauucucagugag

SEQ ID NO: 1122599 - RNA, 16 nt, Homo sapiens
ccuccagaauggagcu

SEQ ID NO: 1122600 - RNA, 14 nt, Homo sapiens
ccucgcugccagcu

SEQ ID NO: 1122601 - RNA, 12 nt, Homo sapiens
ccucucugcucu

SEQ ID NO: 1122602 - RNA, 16 nt, Homo sapiens
ccucucuuauagaaua

SEQ ID NO: 1122603 - RNA, 16 nt, Homo sapiens
ccugacacucaauaaa

SEQ ID NO: 1122604 - RNA, 16 nt, Homo sapiens
ccugaccuucugggac

SEQ ID NO: 1122605 - RNA, 15 nt, Homo sapiens
ccugagguuugccag

SEQ ID NO: 1122606 - RNA, 14 nt, Homo sapiens
ccuggacugaccac

SEQ ID NO: 1122607 - RNA, 19 nt, Homo sapiens
ccuggggcgagcacuguga

SEQ ID NO: 1122608 - RNA, 19 nt, Homo sapiens
ccuggucaacauggugaaa

SEQ ID NO: 1122609 - RNA, 16 nt, Homo sapiens
ccuguaccugugcacg

SEQ ID NO: 1122610 - RNA, 21 nt, Homo sapiens
ccuucacgauuaacugugaaa

SEQ ID NO: 1122611 - RNA, 22 nt, Homo sapiens
ccuucaugaucaucacaaucau

SEQ ID NO: 1122612 - RNA, 13 nt, Homo sapiens
ccuuccaaagacu

SEQ ID NO: 1122613 - RNA, 19 nt, Homo sapiens
ccuugguucccccacugau

SEQ ID NO: 1122614 - RNA, 14 nt, Homo sapiens
cgaacaauucauau

SEQ ID NO: 1122615 - RNA, 16 nt, Homo sapiens
cgaacaauucauauau

SEQ ID NO: 1122616 - RNA, 20 nt, Homo sapiens
cgcgcaccuguaaucccagc

SEQ ID NO: 1122617 - RNA, 21 nt, Homo sapiens
cggaucuggggcucugggaua

SEQ ID NO: 1122618 - RNA, 14 nt, Homo sapiens
cggcuucaccugcg

SEQ ID NO: 1122619 - RNA, 19 nt, Homo sapiens
cguauuaaaaaacaauuaa

SEQ ID NO: 1122620 - RNA, 18 nt, Homo sapiens
cuaaaaguucucaaugua

SEQ ID NO: 1122621 - RNA, 15 nt, Homo sapiens
cuaaagcaauaugca

SEQ ID NO: 1122622 - RNA, 15 nt, Homo sapiens
cuaaauuugguucua

SEQ ID NO: 1122623 - RNA, 14 nt, Homo sapiens
cuacagaaugcggc

SEQ ID NO: 1122624 - RNA, 23 nt, Homo sapiens
cuacccggcccagagaccccuuc

SEQ ID NO: 1122625 - RNA, 18 nt, Homo sapiens
cuacugcagcaccuccag

SEQ ID NO: 1122626 - RNA, 21 nt, Homo sapiens
cuacuguuaucaguaaugcua

SEQ ID NO: 1122627 - RNA, 19 nt, Homo sapiens
cuacuugggaggcugaggc

SEQ ID NO: 1122628 - RNA, 20 nt, Homo sapiens
cuacuugggaggcugaggca

SEQ ID NO: 1122629 - RNA, 15 nt, Homo sapiens
cuagacuccucagga

SEQ ID NO: 1122630 - RNA, 17 nt, Homo sapiens
cuagagccgaggggaga

SEQ ID NO: 1122631 - RNA, 16 nt, Homo sapiens
cuagggccaagcccag

SEQ ID NO: 1122632 - RNA, 19 nt, Homo sapiens
cuaggguccaccaggaguu

SEQ ID NO: 1122633 - RNA, 18 nt, Homo sapiens
cuaugcauuaagaguaaa

SEQ ID NO: 1122634 - RNA, 14 nt, Homo sapiens
cuauguaacaugua

SEQ ID NO: 1122635 - RNA, 12 nt, Homo sapiens
cuauuaucucaa

SEQ ID NO: 1122636 - RNA, 15 nt, Homo sapiens
cucaauaaacaguca

SEQ ID NO: 1122637 - RNA, 16 nt, Homo sapiens
cucaauaaacagucac

SEQ ID NO: 1122638 - RNA, 19 nt, Homo sapiens
cucaauccauccauguacu

SEQ ID NO: 1122639 - RNA, 23 nt, Homo sapiens
cucaaucucccgugggcaucuca

SEQ ID NO: 1122640 - RNA, 14 nt, Homo sapiens
cucacgcagacaca

SEQ ID NO: 1122641 - RNA, 18 nt, Homo sapiens
cucagucucugagcagug

SEQ ID NO: 1122642 - RNA, 19 nt, Homo sapiens
cucagugagggcucuggau

SEQ ID NO: 1122643 - RNA, 16 nt, Homo sapiens
cuccaggccugaccag

SEQ ID NO: 1122644 - RNA, 19 nt, Homo sapiens
cuccauguagaagccacua

SEQ ID NO: 1122645 - RNA, 18 nt, Homo sapiens
cucccgugggcaucucaa

SEQ ID NO: 1122646 - RNA, 15 nt, Homo sapiens
cucccucccagagaa

SEQ ID NO: 1122647 - RNA, 14 nt, Homo sapiens
cuccgcaacagcca

SEQ ID NO: 1122648 - RNA, 24 nt, Homo sapiens
cucgguggcauacagacuggggac

SEQ ID NO: 1122649 - RNA, 20 nt, Homo sapiens
cucuacuaaaaauacaaaaa

SEQ ID NO: 1122650 - RNA, 20 nt, Homo sapiens
cucucuacccggcccagaga

SEQ ID NO: 1122651 - RNA, 17 nt, Homo sapiens
cucugauggcugcucca

SEQ ID NO: 1122652 - RNA, 14 nt, Homo sapiens
cucugcagcacuuu

SEQ ID NO: 1122653 - RNA, 14 nt, Homo sapiens
cucuugcucaguga

SEQ ID NO: 1122654 - RNA, 22 nt, Homo sapiens
cucuuggaugcagcuucaagaa

SEQ ID NO: 1122655 - RNA, 15 nt, Homo sapiens
cugaccuuccaaaga

SEQ ID NO: 1122656 - RNA, 21 nt, Homo sapiens
cugaccuuccaaagacuaaga

SEQ ID NO: 1122657 - RNA, 13 nt, Homo sapiens
cugagaaacacua

SEQ ID NO: 1122658 - RNA, 14 nt, Homo sapiens
cugagauaccagcg

SEQ ID NO: 1122659 - RNA, 19 nt, Homo sapiens
cugagguuugccagcauuu

SEQ ID NO: 1122660 - RNA, 13 nt, Homo sapiens
cugcagcacuuua

SEQ ID NO: 1122661 - RNA, 16 nt, Homo sapiens
cugcccuugucacugg

SEQ ID NO: 1122662 - RNA, 21 nt, Homo sapiens
cugcuguggggaccacacuga

SEQ ID NO: 1122663 - RNA, 22 nt, Homo sapiens
cugcuguggggaccacacugau

SEQ ID NO: 1122664 - RNA, 16 nt, Homo sapiens
cugcuguugaacuuuu

SEQ ID NO: 1122665 - RNA, 17 nt, Homo sapiens
ggggcgagcacugugag

SEQ ID NO: 1122666 - RNA, 14 nt, Homo sapiens
ggggcuacugugac

SEQ ID NO: 1122667 - RNA, 12 nt, Homo sapiens
ggguccaccagg

SEQ ID NO: 1122668 - RNA, 13 nt, Homo sapiens
ggguggaugaucu

SEQ ID NO: 1122669 - RNA, 14 nt, Homo sapiens
gguaagcaccagga

SEQ ID NO: 1122670 - RNA, 15 nt, Homo sapiens
gguagguugggacac

SEQ ID NO: 1122671 - RNA, 12 nt, Homo sapiens
ggucacaugaug

SEQ ID NO: 1122672 - RNA, 12 nt, Homo sapiens
ggucugccaauc

SEQ ID NO: 1122673 - RNA, 12 nt, Homo sapiens
ggugaacuccac

SEQ ID NO: 1122674 - RNA, 14 nt, Homo sapiens
ggugacagagcaag

SEQ ID NO: 1122675 - RNA, 15 nt, Homo sapiens
ggugagaccaaagga

SEQ ID NO: 1122676 - RNA, 15 nt, Homo sapiens
gguggcgcgcaccug

SEQ ID NO: 1122677 - RNA, 13 nt, Homo sapiens
guaaaacagucau

SEQ ID NO: 1122678 - RNA, 21 nt, Homo sapiens
guaaagaaauauauaugauau

SEQ ID NO: 1122679 - RNA, 16 nt, Homo sapiens
guaaaugccacaaaga

SEQ ID NO: 1122680 - RNA, 21 nt, Homo sapiens
guacaguauguuuuacaugua

SEQ ID NO: 1122681 - RNA, 23 nt, Homo sapiens
guacaguucugggguacauguua

SEQ ID NO: 1122682 - RNA, 18 nt, Homo sapiens
guacucuguccaguuccu

SEQ ID NO: 1122683 - RNA, 15 nt, Homo sapiens
guaucaggacccaga

SEQ ID NO: 1122684 - RNA, 17 nt, Homo sapiens
guauucuacuuguucua

SEQ ID NO: 1122685 - RNA, 17 nt, Homo sapiens
guauuuuucagaaauca

SEQ ID NO: 1122686 - RNA, 15 nt, Homo sapiens
gucaaugaccauuca

SEQ ID NO: 1122687 - RNA, 14 nt, Homo sapiens
gucagcaucugacc

SEQ ID NO: 1122688 - RNA, 14 nt, Homo sapiens
gucagcccaugugc

SEQ ID NO: 1122689 - RNA, 22 nt, Homo sapiens
gucaggauucuucaaggagaau

SEQ ID NO: 1122690 - RNA, 13 nt, Homo sapiens
guccaacugucaa

SEQ ID NO: 1122691 - RNA, 20 nt, Homo sapiens
guccaacugucaaccuagaa

SEQ ID NO: 1122692 - RNA, 21 nt, Homo sapiens
guccaggguggaugaucucaa

SEQ ID NO: 1122693 - RNA, 21 nt, Homo sapiens
gucuagacuuucucaguggga

SEQ ID NO: 1122694 - RNA, 20 nt, Homo sapiens
gucuagaggugagaccaaag

SEQ ID NO: 1122695 - RNA, 22 nt, Homo sapiens
gucucuuguaauccgaaucucu

SEQ ID NO: 1122696 - RNA, 14 nt, Homo sapiens
gucugcccuuguca

SEQ ID NO: 1122697 - RNA, 16 nt, Homo sapiens
gucugggcacagucag

SEQ ID NO: 1122698 - RNA, 15 nt, Homo sapiens
gugaauaaaccauca

SEQ ID NO: 1122699 - RNA, 16 nt, Homo sapiens
gugcacaucugugucu

SEQ ID NO: 1122700 - RNA, 15 nt, Homo sapiens
gugccagcaccugcc

SEQ ID NO: 1122701 - RNA, 16 nt, Homo sapiens
gugcgcgaugugacag

SEQ ID NO: 1122702 - RNA, 22 nt, Homo sapiens
gugcuauaaaugccagagccaa

SEQ ID NO: 1122703 - RNA, 22 nt, Homo sapiens
guggaaucucuuggaugcagcu

SEQ ID NO: 1122704 - RNA, 18 nt, Homo sapiens
guggcccaagggugguga

SEQ ID NO: 1122705 - RNA, 14 nt, Homo sapiens
guggcgacucuaua

SEQ ID NO: 1122706 - RNA, 12 nt, Homo sapiens
guggcuccugug

SEQ ID NO: 1122707 - RNA, 12 nt, Homo sapiens
gugggcaucuca

SEQ ID NO: 1122708 - RNA, 13 nt, Homo sapiens
gugggcaucucaa

SEQ ID NO: 1122709 - RNA, 14 nt, Homo sapiens
guguuuucagcaaa

SEQ ID NO: 1122710 - RNA, 20 nt, Homo sapiens
guuaaccuuucuaaccuuca

SEQ ID NO: 1122711 - RNA, 11 nt, Homo sapiens
guuacauauac

SEQ ID NO: 1122712 - RNA, 15 nt, Homo sapiens
guuauugacagcgau

SEQ ID NO: 1122713 - RNA, 20 nt, Homo sapiens
guucaagaaguaaucaguau

SEQ ID NO: 1122714 - RNA, 17 nt, Homo sapiens
guucagaggugcagcug

SEQ ID NO: 1122715 - RNA, 14 nt, Homo sapiens
guucccccacugau

SEQ ID NO: 1122716 - RNA, 16 nt, Homo sapiens
guucuguagagccaau

SEQ ID NO: 1122717 - RNA, 22 nt, Homo sapiens
guugggggaggggccuagacaa

SEQ ID NO: 1122718 - RNA, 21 nt, Homo sapiens
guuuucccugaccucccucua

SEQ ID NO: 1122719 - RNA, 16 nt, Homo sapiens
guuuuuaaaacccagu

SEQ ID NO: 1122720 - RNA, 15 nt, Homo sapiens
guuuuuaagcuguuu

SEQ ID NO: 1122721 - RNA, 15 nt, Homo sapiens
uaaaagguacuggua

SEQ ID NO: 1122722 - RNA, 23 nt, Homo sapiens
uaaaauguggucugccaaucugu

SEQ ID NO: 1122723 - RNA, 18 nt, Homo sapiens
uaaaauguuauauaauaa

SEQ ID NO: 1122724 - RNA, 16 nt, Homo sapiens
uaaaauugaguuugua

SEQ ID NO: 1122725 - RNA, 17 nt, Homo sapiens
uaaaccaucaucuugcc

SEQ ID NO: 1122726 - RNA, 17 nt, Homo sapiens
uaaagaagugcaugaaa

SEQ ID NO: 1122727 - RNA, 18 nt, Homo sapiens
uaaagcuguuauucuugu

SEQ ID NO: 1122728 - RNA, 23 nt, Homo sapiens
uaaagcuguuauucuuguuauac

SEQ ID NO: 1122729 - RNA, 14 nt, Homo sapiens
uaaauuauugcugu

SEQ ID NO: 1122730 - RNA, 12 nt, Homo sapiens
uaacuagaauuu

SEQ ID NO: 1122731 - RNA, 22 nt, Homo sapiens
uaacugaggacuguuugcaauu

SEQ ID NO: 1122732 - RNA, 19 nt, Homo sapiens
uaagauauucagaaguaua

SEQ ID NO: 1122733 - RNA, 20 nt, Homo sapiens
uaagauauucagaaguauau

SEQ ID NO: 1122734 - RNA, 22 nt, Homo sapiens
uaagccuguuggauaaagaccu

SEQ ID NO: 1122735 - RNA, 17 nt, Homo sapiens
uaagucaaccugccuga

SEQ ID NO: 1122736 - RNA, 22 nt, Homo sapiens
uaagucaaccugccugacauuu

SEQ ID NO: 1122737 - RNA, 14 nt, Homo sapiens
uaagugugccaaau

SEQ ID NO: 1122738 - RNA, 15 nt, Homo sapiens
uaaugagacaugaau

SEQ ID NO: 1122739 - RNA, 16 nt, Homo sapiens
uaauuaguaacaugug

SEQ ID NO: 1122740 - RNA, 21 nt, Homo sapiens
uaauuuaucuugucucugggc

SEQ ID NO: 1122741 - RNA, 14 nt, Homo sapiens
uaauuugaacuuug

SEQ ID NO: 1122742 - RNA, 22 nt, Homo sapiens
uacacugcggaagccaaaggca

SEQ ID NO: 1122743 - RNA, 17 nt, Homo sapiens
uacagauguaaaugcca

SEQ ID NO: 1122744 - RNA, 17 nt, Homo sapiens
uacaucucccagacucu

SEQ ID NO: 1122745 - RNA, 11 nt, Homo sapiens
uacauguuaag

SEQ ID NO: 1122746 - RNA, 16 nt, Homo sapiens
uaccauucacuacuca

SEQ ID NO: 1122747 - RNA, 14 nt, Homo sapiens
uaccuccugagaaa

SEQ ID NO: 1122748 - RNA, 17 nt, Homo sapiens
uaccucugauaccucaa

SEQ ID NO: 1122749 - RNA, 20 nt, Homo sapiens
uacuaacuaaauaccauuca

SEQ ID NO: 1122750 - RNA, 16 nt, Homo sapiens
uacugcaaucacugug

SEQ ID NO: 1122751 - RNA, 18 nt, Homo sapiens
uacugccaaaacauuuau

SEQ ID NO: 1122752 - RNA, 17 nt, Homo sapiens
uacugggacugugcuca

SEQ ID NO: 1122753 - RNA, 21 nt, Homo sapiens
uacuuacauguucccaaaaca

SEQ ID NO: 1122754 - RNA, 15 nt, Homo sapiens
uacuucccacuguau

SEQ ID NO: 1122755 - RNA, 21 nt, Homo sapiens
uagaagccacuauuacuggga

SEQ ID NO: 1122756 - RNA, 20 nt, Homo sapiens
uagaauauuuauuaccucug

SEQ ID NO: 1122757 - RNA, 23 nt, Homo sapiens
uagaauauuuauuaccucugaua

SEQ ID NO: 1122758 - RNA, 20 nt, Homo sapiens
uagaauucacugaguuuugu

SEQ ID NO: 1122759 - RNA, 12 nt, Homo sapiens
uagaauugggaa

SEQ ID NO: 1122760 - RNA, 21 nt, Homo sapiens
uagacccugcauuuauagcau

SEQ ID NO: 1122761 - RNA, 23 nt, Homo sapiens
uagagagccugucaccagagcuu

SEQ ID NO: 1122762 - RNA, 20 nt, Homo sapiens
uagauaaugaaugauaagca

SEQ ID NO: 1122763 - RNA, 19 nt, Homo sapiens
uagcuccauaaaguacaaa

SEQ ID NO: 1122764 - RNA, 13 nt, Homo sapiens
uaggaaguaggaa

SEQ ID NO: 1122765 - RNA, 17 nt, Homo sapiens
uaggcuaccucaagacu

SEQ ID NO: 1122766 - RNA, 15 nt, Homo sapiens
uagucaccuucauga

SEQ ID NO: 1122767 - RNA, 17 nt, Homo sapiens
uagucgaacaauucaua

SEQ ID NO: 1122768 - RNA, 13 nt, Homo sapiens
uagugacauuuaa

SEQ ID NO: 1122769 - RNA, 19 nt, Homo sapiens
uagugacauuuaaugccau

SEQ ID NO: 1122770 - RNA, 18 nt, Homo sapiens
uauagcauuuugcuaucu

SEQ ID NO: 1122771 - RNA, 22 nt, Homo sapiens
uaucauuaucuuugcuguuauu

SEQ ID NO: 1122772 - RNA, 23 nt, Homo sapiens
uaucucaaacuacuggcaauuug

SEQ ID NO: 1122773 - RNA, 19 nt, Homo sapiens
uauuaauuuuugaaaccca

SEQ ID NO: 1122774 - RNA, 20 nt, Homo sapiens
uauuacugggacugugcuca

SEQ ID NO: 1122775 - RNA, 20 nt, Homo sapiens
aaaaauguauaugcacuuau

SEQ ID NO: 1122776 - RNA, 14 nt, Homo sapiens
aaaacacugugcac

SEQ ID NO: 1122777 - RNA, 11 nt, Homo sapiens
aaaacagucau

SEQ ID NO: 1122778 - RNA, 21 nt, Homo sapiens
aaaacagucaucuagaauuca

SEQ ID NO: 1122779 - RNA, 21 nt, Homo sapiens
aaaacucucugguuuacuuca

SEQ ID NO: 1122780 - RNA, 13 nt, Homo sapiens
aaaauacaugaca

SEQ ID NO: 1122781 - RNA, 18 nt, Homo sapiens
aaaauacaugacauuuau

SEQ ID NO: 1122782 - RNA, 18 nt, Homo sapiens
aaaauagagccugaggga

SEQ ID NO: 1122783 - RNA, 16 nt, Homo sapiens
aaaauaguaaagccaa

SEQ ID NO: 1122784 - RNA, 16 nt, Homo sapiens
aaaaucuguguaacug

SEQ ID NO: 1122785 - RNA, 18 nt, Homo sapiens
aaaauuccucuuacugua

SEQ ID NO: 1122786 - RNA, 17 nt, Homo sapiens
aaacaaauguauuucaa

SEQ ID NO: 1122787 - RNA, 12 nt, Homo sapiens
aaacacuccaca

SEQ ID NO: 1122788 - RNA, 14 nt, Homo sapiens
aaacaugauauauc

SEQ ID NO: 1122789 - RNA, 18 nt, Homo sapiens
aaacaugggcugugauua

SEQ ID NO: 1122790 - RNA, 20 nt, Homo sapiens
aaacaugguggguccauggg

SEQ ID NO: 1122791 - RNA, 17 nt, Homo sapiens
aaacauuuuaucauuaa

SEQ ID NO: 1122792 - RNA, 23 nt, Homo sapiens
aaaccaagauagauccauuugga

SEQ ID NO: 1122793 - RNA, 20 nt, Homo sapiens
aaacucucugguuuacuuca

SEQ ID NO: 1122794 - RNA, 14 nt, Homo sapiens
aaacugucuugccc

SEQ ID NO: 1122795 - RNA, 12 nt, Homo sapiens
aaacugugcacc

SEQ ID NO: 1122796 - RNA, 15 nt, Homo sapiens
aaacuguuacugaaa

SEQ ID NO: 1122797 - RNA, 17 nt, Homo sapiens
aaagcucaaaguaugca

SEQ ID NO: 1122798 - RNA, 23 nt, Homo sapiens
aaagcuuucauguaaacugugca

SEQ ID NO: 1122799 - RNA, 14 nt, Homo sapiens
aaaucaaacugcuu

SEQ ID NO: 1122800 - RNA, 13 nt, Homo sapiens
aaaugacagaucu

SEQ ID NO: 1122801 - RNA, 14 nt, Homo sapiens
aaaugccacaaaga

SEQ ID NO: 1122802 - RNA, 15 nt, Homo sapiens
aaaugccacaaagaa

SEQ ID NO: 1122803 - RNA, 16 nt, Homo sapiens
aaaugccuccauggca

SEQ ID NO: 1122804 - RNA, 17 nt, Homo sapiens
aaaugcuucugcacaca

SEQ ID NO: 1122805 - RNA, 13 nt, Homo sapiens
aaaugguccuauu

SEQ ID NO: 1122806 - RNA, 17 nt, Homo sapiens
aaauuauguuacuguau

SEQ ID NO: 1122807 - RNA, 19 nt, Homo sapiens
aaauuauugcuguauguaa

SEQ ID NO: 1122808 - RNA, 20 nt, Homo sapiens
aaauuguaucaaaugugaca

SEQ ID NO: 1122809 - RNA, 22 nt, Homo sapiens
aaauuguauuaucaacagcauu

SEQ ID NO: 1122810 - RNA, 21 nt, Homo sapiens
aaauuuuucuucucuuuucaa

SEQ ID NO: 1122811 - RNA, 16 nt, Homo sapiens
aacaaauguauuucaa

SEQ ID NO: 1122812 - RNA, 23 nt, Homo sapiens
aaccucagugauuggcucugugg

SEQ ID NO: 1122813 - RNA, 15 nt, Homo sapiens
aaccucauuccccaa

SEQ ID NO: 1122814 - RNA, 12 nt, Homo sapiens
aaccugggaugu

SEQ ID NO: 1122815 - RNA, 15 nt, Homo sapiens
aacucacucugggcu

SEQ ID NO: 1122816 - RNA, 20 nt, Homo sapiens
aacugcaucccacguucugu

SEQ ID NO: 1122817 - RNA, 13 nt, Homo sapiens
aacuguacugaau

SEQ ID NO: 1122818 - RNA, 18 nt, Homo sapiens
aagaaaauuugccaaucu

SEQ ID NO: 1122819 - RNA, 14 nt, Homo sapiens
aagaaagccuaaaa

SEQ ID NO: 1122820 - RNA, 21 nt, Homo sapiens
aagacaggucuagacuuucuc

SEQ ID NO: 1122821 - RNA, 22 nt, Homo sapiens
aagagugccagucagcagucau

SEQ ID NO: 1122822 - RNA, 15 nt, Homo sapiens
aagauaauuuacuua

SEQ ID NO: 1122823 - RNA, 20 nt, Homo sapiens
aagauacgguugucuagagg

SEQ ID NO: 1122824 - RNA, 14 nt, Homo sapiens
aagcaaaaugcuuc

SEQ ID NO: 1122825 - RNA, 15 nt, Homo sapiens
aagcagaccacugau

SEQ ID NO: 1122826 - RNA, 14 nt, Homo sapiens
aagcagagcucaca

SEQ ID NO: 1122827 - RNA, 22 nt, Homo sapiens
aagcauugccuggacugaccac

SEQ ID NO: 1122828 - RNA, 13 nt, Homo sapiens
aagccacaggagc

SEQ ID NO: 1122829 - RNA, 17 nt, Homo sapiens
aagcccauagcacuggg

SEQ ID NO: 1122830 - RNA, 18 nt, Homo sapiens
aagcccauagcacugggc

SEQ ID NO: 1122831 - RNA, 19 nt, Homo sapiens
aagcccauagcacugggcu

SEQ ID NO: 1122832 - RNA, 16 nt, Homo sapiens
aagccggccugagaaa

SEQ ID NO: 1122833 - RNA, 18 nt, Homo sapiens
aagccuauguaugccaug

SEQ ID NO: 1122834 - RNA, 16 nt, Homo sapiens
aagccuccgcugggcu

SEQ ID NO: 1122835 - RNA, 20 nt, Homo sapiens
aagcugggcaugaacgcacu

SEQ ID NO: 1122836 - RNA, 18 nt, Homo sapiens
aagcuguaucacugccuu

SEQ ID NO: 1122837 - RNA, 11 nt, Homo sapiens
aagcuguuauu

SEQ ID NO: 1122838 - RNA, 21 nt, Homo sapiens
aagcuguuauucuuguuauac

SEQ ID NO: 1122839 - RNA, 18 nt, Homo sapiens
aaggauccagagacuugg

SEQ ID NO: 1122840 - RNA, 20 nt, Homo sapiens
aagggaauucggugugcacc

SEQ ID NO: 1122841 - RNA, 12 nt, Homo sapiens
aaggugaacuuu

SEQ ID NO: 1122842 - RNA, 19 nt, Homo sapiens
aaguauaaucagcacuuug

SEQ ID NO: 1122843 - RNA, 14 nt, Homo sapiens
aagucaaccugccu

SEQ ID NO: 1122844 - RNA, 16 nt, Homo sapiens
aaguuuaaaaaaccau

SEQ ID NO: 1122845 - RNA, 16 nt, Homo sapiens
aauaaaaucauguagu

SEQ ID NO: 1122846 - RNA, 13 nt, Homo sapiens
aauaaccaauccu

SEQ ID NO: 1122847 - RNA, 15 nt, Homo sapiens
aauaagauauuuagu

SEQ ID NO: 1122848 - RNA, 15 nt, Homo sapiens
aauaauaagugaugu

SEQ ID NO: 1122849 - RNA, 20 nt, Homo sapiens
aauaugucugccacagagag

SEQ ID NO: 1122850 - RNA, 21 nt, Homo sapiens
aauauucccugacgacacuga

SEQ ID NO: 1122851 - RNA, 18 nt, Homo sapiens
aauauuuaggcaagagaa

SEQ ID NO: 1122852 - RNA, 20 nt, Homo sapiens
aauauuuauuaccucugaua

SEQ ID NO: 1122853 - RNA, 20 nt, Homo sapiens
gaagcauugccuggacugac

SEQ ID NO: 1122854 - RNA, 22 nt, Homo sapiens
gaagcauugccuggacugacca

SEQ ID NO: 1122855 - RNA, 14 nt, Homo sapiens
gaaggcaaacccau

SEQ ID NO: 1122856 - RNA, 16 nt, Homo sapiens
gaaggugaacuuugug

SEQ ID NO: 1122857 - RNA, 13 nt, Homo sapiens
gaagguugcaccu

SEQ ID NO: 1122858 - RNA, 19 nt, Homo sapiens
gaaguaaaacagucaucua

SEQ ID NO: 1122859 - RNA, 20 nt, Homo sapiens
gaaguugcagugagcugaua

SEQ ID NO: 1122860 - RNA, 17 nt, Homo sapiens
gaaguugccaugggaaa

SEQ ID NO: 1122861 - RNA, 18 nt, Homo sapiens
gaauaaauaaauguaucu

SEQ ID NO: 1122862 - RNA, 13 nt, Homo sapiens
gcugcccaucagg

SEQ ID NO: 1122863 - RNA, 16 nt, Homo sapiens
gcugccucuaccugac

SEQ ID NO: 1122864 - RNA, 15 nt, Homo sapiens
gcugcuccacugggu

SEQ ID NO: 1122865 - RNA, 13 nt, Homo sapiens
gcuggacugacca

SEQ ID NO: 1122866 - RNA, 17 nt, Homo sapiens
gcuucaaggacauuggu

SEQ ID NO: 1122867 - RNA, 15 nt, Homo sapiens
gcuucccugacucau

SEQ ID NO: 1122868 - RNA, 12 nt, Homo sapiens
gcuuccuaacug

SEQ ID NO: 1122869 - RNA, 14 nt, Homo sapiens
gcuuccuaacugcu

SEQ ID NO: 1122870 - RNA, 18 nt, Homo sapiens
gcuugcagagcaugaccu

SEQ ID NO: 1122871 - RNA, 19 nt, Homo sapiens
ggaaaauaaauuauauuaa

SEQ ID NO: 1122872 - RNA, 22 nt, Homo sapiens
ggaaaauaggaagugaacccau

SEQ ID NO: 1122873 - RNA, 18 nt, Homo sapiens
ggaccaagcagagcucac

SEQ ID NO: 1122874 - RNA, 14 nt, Homo sapiens
ggaccagaggugac

SEQ ID NO: 1122875 - RNA, 19 nt, Homo sapiens
ggacugaccaaagacugca

SEQ ID NO: 1122876 - RNA, 20 nt, Homo sapiens
ggacuuguuuagagagccug

SEQ ID NO: 1122877 - RNA, 14 nt, Homo sapiens
ggagaagugauaug

SEQ ID NO: 1122878 - RNA, 19 nt, Homo sapiens
ggagaaugaauacugggaa

SEQ ID NO: 1122879 - RNA, 15 nt, Homo sapiens
ggagauugaacuuuc

SEQ ID NO: 1122880 - RNA, 16 nt, Homo sapiens
ggagcuggcccucucc

SEQ ID NO: 1122881 - RNA, 23 nt, Homo sapiens
ggaguccaggguggaugaucuca

SEQ ID NO: 1122882 - RNA, 17 nt, Homo sapiens
ggaguguggcuccugug

SEQ ID NO: 1122883 - RNA, 17 nt, Homo sapiens
ggaugcagcuucaagaa

SEQ ID NO: 1122884 - RNA, 17 nt, Homo sapiens
ggauggguccucacgca

SEQ ID NO: 1122885 - RNA, 17 nt, Homo sapiens
ggcauacagacugggga

SEQ ID NO: 1122886 - RNA, 18 nt, Homo sapiens
ggccauaaagaucaaaca

SEQ ID NO: 1122887 - RNA, 14 nt, Homo sapiens
ggcccgaacaggga

SEQ ID NO: 1122888 - RNA, 23 nt, Homo sapiens
ggcccuucccacaggacauuucu

SEQ ID NO: 1122889 - RNA, 18 nt, Homo sapiens
ggccucuccaguuugcac

SEQ ID NO: 1122890 - RNA, 13 nt, Homo sapiens
ggccuucauccuc

SEQ ID NO: 1122891 - RNA, 14 nt, Homo sapiens
ggcggccucuugcu

SEQ ID NO: 1122892 - RNA, 20 nt, Homo sapiens
ggcugguguaugcacagggu

SEQ ID NO: 1122893 - RNA, 21 nt, Homo sapiens
gggaagcugggggaagggugg

SEQ ID NO: 1122894 - RNA, 12 nt, Homo sapiens
gggagacuggaa

SEQ ID NO: 1122895 - RNA, 24 nt, Homo sapiens
gggaguccaggguggaugaucuca

SEQ ID NO: 1122896 - RNA, 16 nt, Homo sapiens
gggauaagggagucca

SEQ ID NO: 1122897 - RNA, 18 nt, Homo sapiens
gggaugccacccagcaac

SEQ ID NO: 1122898 - RNA, 22 nt, Homo sapiens
gggcaggcaagguuuacacugc

SEQ ID NO: 1122899 - RNA, 14 nt, Homo sapiens
gggcagucauuauc

SEQ ID NO: 1122900 - RNA, 13 nt, Homo sapiens
gggcaucucaagc

SEQ ID NO: 1122901 - RNA, 16 nt, Homo sapiens
gggcccgaacagggac

SEQ ID NO: 1122902 - RNA, 17 nt, Homo sapiens
gggcuacugugaccaug

SEQ ID NO: 1122903 - RNA, 17 nt, Homo sapiens
ggggcccgaacagggac

SEQ ID NO: 1122904 - RNA, 16 nt, Homo sapiens
ggggcgagcacuguga

SEQ ID NO: 1122905 - RNA, 10 nt, Homo sapiens
ggggcuuccu

SEQ ID NO: 1122906 - RNA, 12 nt, Homo sapiens
gggggaccuggg

SEQ ID NO: 1122907 - RNA, 21 nt, Homo sapiens
ggucugacaugaacacuuuuu

SEQ ID NO: 1122908 - RNA, 18 nt, Homo sapiens
gguggcauacagacuggg

SEQ ID NO: 1122909 - RNA, 17 nt, Homo sapiens
gguggcucacgccugua

SEQ ID NO: 1122910 - RNA, 16 nt, Homo sapiens
ggugguaagcaccagg

SEQ ID NO: 1122911 - RNA, 18 nt, Homo sapiens
gguguaugcacagggugu

SEQ ID NO: 1122912 - RNA, 15 nt, Homo sapiens
gguuagauaaugaau

SEQ ID NO: 1122913 - RNA, 21 nt, Homo sapiens
gguucaauuucagaaguaaug

SEQ ID NO: 1122914 - RNA, 13 nt, Homo sapiens
guaaacugugcac

SEQ ID NO: 1122915 - RNA, 16 nt, Homo sapiens
guaaauaaacaaguca

SEQ ID NO: 1122916 - RNA, 16 nt, Homo sapiens
guaacauccaagccag

SEQ ID NO: 1122917 - RNA, 21 nt, Homo sapiens
guaagccuguuggauaaagac

SEQ ID NO: 1122918 - RNA, 19 nt, Homo sapiens
guacaaaaauuaugcaauu

SEQ ID NO: 1122919 - RNA, 21 nt, Homo sapiens
guacaguucugggguacaugu

SEQ ID NO: 1122920 - RNA, 14 nt, Homo sapiens
guaccucucuuaua

SEQ ID NO: 1122921 - RNA, 17 nt, Homo sapiens
guagaagccacuauuac

SEQ ID NO: 1122922 - RNA, 16 nt, Homo sapiens
guaggggcuacuguga

SEQ ID NO: 1122923 - RNA, 18 nt, Homo sapiens
gucaagaaacagccagca

SEQ ID NO: 1122924 - RNA, 20 nt, Homo sapiens
gucacuggaaagagugccag

SEQ ID NO: 1122925 - RNA, 13 nt, Homo sapiens
gucagcaucugac

SEQ ID NO: 1122926 - RNA, 19 nt, Homo sapiens
gucagcaucugaccaucug

SEQ ID NO: 1122927 - RNA, 20 nt, Homo sapiens
gucagcccaugugcaccugc

SEQ ID NO: 1122928 - RNA, 15 nt, Homo sapiens
gucaucuagaauuca

SEQ ID NO: 1122929 - RNA, 14 nt, Homo sapiens
gucauuugugcaag

SEQ ID NO: 1122930 - RNA, 20 nt, Homo sapiens
guccaacagacacaauuuau

SEQ ID NO: 1122931 - RNA, 16 nt, Homo sapiens
guccaggcacugagau

SEQ ID NO: 1122932 - RNA, 19 nt, Homo sapiens
guccaggguggaugaucuc

SEQ ID NO: 1122933 - RNA, 17 nt, Homo sapiens
guccauuguccaauccu

SEQ ID NO: 1122934 - RNA, 17 nt, Homo sapiens
guccccacccuccacuc

SEQ ID NO: 1122935 - RNA, 21 nt, Homo sapiens
guccuugugaguccaucuaac

SEQ ID NO: 1122936 - RNA, 16 nt, Homo sapiens
gucgaacaauucauau

SEQ ID NO: 1122937 - RNA, 13 nt, Homo sapiens
gucuagacuuucu

SEQ ID NO: 1122938 - RNA, 18 nt, Homo sapiens
gugacuauaaagcuguua

SEQ ID NO: 1122939 - RNA, 19 nt, Homo sapiens
gugcacagggggaggccau

SEQ ID NO: 1122940 - RNA, 19 nt, Homo sapiens
gugcccugcaucccucucc

SEQ ID NO: 1122941 - RNA, 19 nt, Homo sapiens
gugcgaagacugagccaga

SEQ ID NO: 1122942 - RNA, 18 nt, Homo sapiens
guggaaaaaacauuuuaa

SEQ ID NO: 1122943 - RNA, 23 nt, Homo sapiens
guggauuccugggcaagaaccua

SEQ ID NO: 1122944 - RNA, 19 nt, Homo sapiens
guggccuaggcuaccucaa

SEQ ID NO: 1122945 - RNA, 18 nt, Homo sapiens
gugggacaaaccagagca

SEQ ID NO: 1122946 - RNA, 14 nt, Homo sapiens
guuaagaauggaag

SEQ ID NO: 1122947 - RNA, 23 nt, Homo sapiens
guuaagcaaaaugcuucugcaca

SEQ ID NO: 1122948 - RNA, 18 nt, Homo sapiens
guuaauuacaacugcuau

SEQ ID NO: 1122949 - RNA, 16 nt, Homo sapiens
guuauacaucaauaug

SEQ ID NO: 1122950 - RNA, 22 nt, Homo sapiens
guuaucaguaaugcuaaaugug

SEQ ID NO: 1122951 - RNA, 12 nt, Homo sapiens
guucaaagccag

SEQ ID NO: 1122952 - RNA, 14 nt, Homo sapiens
guuccaguaccgcc

SEQ ID NO: 1122953 - RNA, 17 nt, Homo sapiens
guucuaacugcuguuaa

SEQ ID NO: 1122954 - RNA, 11 nt, Homo sapiens
guuguguuccu

SEQ ID NO: 1122955 - RNA, 17 nt, Homo sapiens
guuugauuauucagugu

SEQ ID NO: 1122956 - RNA, 15 nt, Homo sapiens
guuuuguauucucug

SEQ ID NO: 1122957 - RNA, 23 nt, Homo sapiens
uaaaaaacaauuaacugcccucu

SEQ ID NO: 1122958 - RNA, 16 nt, Homo sapiens
uaaaacaaucugucca

SEQ ID NO: 1122959 - RNA, 20 nt, Homo sapiens
aaucucccgugggcaucuca

SEQ ID NO: 1122960 - RNA, 16 nt, Homo sapiens
aaugaauacugggaau

SEQ ID NO: 1122961 - RNA, 21 nt, Homo sapiens
aaugauaagcaggaaggaugg

SEQ ID NO: 1122962 - RNA, 14 nt, Homo sapiens
aaugcuggacugga

SEQ ID NO: 1122963 - RNA, 17 nt, Homo sapiens
aaugcuucauuauucaa

SEQ ID NO: 1122964 - RNA, 15 nt, Homo sapiens
aaugcuucugcacac

SEQ ID NO: 1122965 - RNA, 13 nt, Homo sapiens
aauggaagguugg

SEQ ID NO: 1122966 - RNA, 20 nt, Homo sapiens
aauguaguuagcuccauaaa

SEQ ID NO: 1122967 - RNA, 19 nt, Homo sapiens
aaugucuugaugcaugcac

SEQ ID NO: 1122968 - RNA, 22 nt, Homo sapiens
aaugugaaaaugguccaggaga

SEQ ID NO: 1122969 - RNA, 15 nt, Homo sapiens
aauuaguaacaugug

SEQ ID NO: 1122970 - RNA, 19 nt, Homo sapiens
aauuauuaugacucaauaa

SEQ ID NO: 1122971 - RNA, 18 nt, Homo sapiens
aauuguaucaaaugugac

SEQ ID NO: 1122972 - RNA, 18 nt, Homo sapiens
aauuuauucaauuccucu

SEQ ID NO: 1122973 - RNA, 14 nt, Homo sapiens
aauuucuacuuuga

SEQ ID NO: 1122974 - RNA, 17 nt, Homo sapiens
aauuuuauuacauauga

SEQ ID NO: 1122975 - RNA, 18 nt, Homo sapiens
aauuuucgaaaacuuccc

SEQ ID NO: 1122976 - RNA, 19 nt, Homo sapiens
acaaaauggagggagccau

SEQ ID NO: 1122977 - RNA, 18 nt, Homo sapiens
acaaauauaaaacuauaa

SEQ ID NO: 1122978 - RNA, 21 nt, Homo sapiens
acaagaaaauguauccaagga

SEQ ID NO: 1122979 - RNA, 17 nt, Homo sapiens
acaaugccuugggagag

SEQ ID NO: 1122980 - RNA, 20 nt, Homo sapiens
acagaaugcggccucugaga

SEQ ID NO: 1122981 - RNA, 14 nt, Homo sapiens
acagacacaauuua

SEQ ID NO: 1122982 - RNA, 17 nt, Homo sapiens
acagcccucaugaucau

SEQ ID NO: 1122983 - RNA, 20 nt, Homo sapiens
acagcucgggcccucuguga

SEQ ID NO: 1122984 - RNA, 20 nt, Homo sapiens
acaggcacauuaacuguugc

SEQ ID NO: 1122985 - RNA, 21 nt, Homo sapiens
acagucaucuagaauucacug

SEQ ID NO: 1122986 - RNA, 22 nt, Homo sapiens
acaguuguguuccugacacuca

SEQ ID NO: 1122987 - RNA, 21 nt, Homo sapiens
acaguuuccaaauugcccuau

SEQ ID NO: 1122988 - RNA, 10 nt, Homo sapiens
acaugggagc

SEQ ID NO: 1122989 - RNA, 23 nt, Homo sapiens
acaugggcugugauuacugcaau

SEQ ID NO: 1122990 - RNA, 13 nt, Homo sapiens
acauugagguucc

SEQ ID NO: 1122991 - RNA, 20 nt, Homo sapiens
acauuguuugucugucuuca

SEQ ID NO: 1122992 - RNA, 15 nt, Homo sapiens
acccuccacucagcu

SEQ ID NO: 1122993 - RNA, 19 nt, Homo sapiens
acccuccacucagcugucc

SEQ ID NO: 1122994 - RNA, 21 nt, Homo sapiens
acccuccacucagcuguccug

SEQ ID NO: 1122995 - RNA, 19 nt, Homo sapiens
accggagaaccccaggacg

SEQ ID NO: 1122996 - RNA, 17 nt, Homo sapiens
accucgcuggacucuca

SEQ ID NO: 1122997 - RNA, 18 nt, Homo sapiens
accugaaauaaaauucau

SEQ ID NO: 1122998 - RNA, 17 nt, Homo sapiens
accuggggacucgggug

SEQ ID NO: 1122999 - RNA, 17 nt, Homo sapiens
accuuauuguaccucuc

SEQ ID NO: 1123000 - RNA, 23 nt, Homo sapiens
accuucacgauuaacugugaaau

SEQ ID NO: 1123001 - RNA, 14 nt, Homo sapiens
acgcacacauggac

SEQ ID NO: 1123002 - RNA, 21 nt, Homo sapiens
acgccuguaaucccagcacuu

SEQ ID NO: 1123003 - RNA, 16 nt, Homo sapiens
acgcgcgcgugcacac

SEQ ID NO: 1123004 - RNA, 20 nt, Homo sapiens
acgcuuguagaacucacucu

SEQ ID NO: 1123005 - RNA, 19 nt, Homo sapiens
acgugaagccacaggagcc

SEQ ID NO: 1123006 - RNA, 16 nt, Homo sapiens
acgugcgcgaugugac

SEQ ID NO: 1123007 - RNA, 13 nt, Homo sapiens
acguggcacuggu

SEQ ID NO: 1123008 - RNA, 16 nt, Homo sapiens
acuaaaaauacaaaaa

SEQ ID NO: 1123009 - RNA, 15 nt, Homo sapiens
acuauguaacaugua

SEQ ID NO: 1123010 - RNA, 23 nt, Homo sapiens
acuccacccuccaccuuccauuu

SEQ ID NO: 1123011 - RNA, 20 nt, Homo sapiens
acuccgagagcaugcuuaau

SEQ ID NO: 1123012 - RNA, 21 nt, Homo sapiens
acucuacuucccaguaacccu

SEQ ID NO: 1123013 - RNA, 18 nt, Homo sapiens
acucucugguuuacuuca

SEQ ID NO: 1123014 - RNA, 23 nt, Homo sapiens
acucugggcuguaacguggcacu

SEQ ID NO: 1123015 - RNA, 14 nt, Homo sapiens
acugaauaauauca

SEQ ID NO: 1123016 - RNA, 19 nt, Homo sapiens
acugaccaaagacugcaga

SEQ ID NO: 1123017 - RNA, 21 nt, Homo sapiens
acugauccuggagaaaaggga

SEQ ID NO: 1123018 - RNA, 12 nt, Homo sapiens
acugaugguuca

SEQ ID NO: 1123019 - RNA, 16 nt, Homo sapiens
acugcaugaaugaaac

SEQ ID NO: 1123020 - RNA, 20 nt, Homo sapiens
acugccaugccucaagaaca

SEQ ID NO: 1123021 - RNA, 17 nt, Homo sapiens
acugcuacaaucaaggc

SEQ ID NO: 1123022 - RNA, 14 nt, Homo sapiens
acugcuugaggaaa

SEQ ID NO: 1123023 - RNA, 17 nt, Homo sapiens
acugguagguugggaca

SEQ ID NO: 1123024 - RNA, 15 nt, Homo sapiens
acuuauuaacuaaga

SEQ ID NO: 1123025 - RNA, 17 nt, Homo sapiens
acuucucuauuaucuca

SEQ ID NO: 1123026 - RNA, 20 nt, Homo sapiens
acuuguugcugauucaagaa

SEQ ID NO: 1123027 - RNA, 13 nt, Homo sapiens
acuuuaacccucu

SEQ ID NO: 1123028 - RNA, 22 nt, Homo sapiens
acuuuauucggaccaagcagag

SEQ ID NO: 1123029 - RNA, 12 nt, Homo sapiens
acuuucauguca

SEQ ID NO: 1123030 - RNA, 19 nt, Homo sapiens
agaaacacuauuugugacu

SEQ ID NO: 1123031 - RNA, 17 nt, Homo sapiens
agaaagcuggacugacc

SEQ ID NO: 1123032 - RNA, 15 nt, Homo sapiens
agaaaucaaacugcu

SEQ ID NO: 1123033 - RNA, 17 nt, Homo sapiens
agaagaaaauuugccaa

SEQ ID NO: 1123034 - RNA, 14 nt, Homo sapiens
agaagucaacgccu

SEQ ID NO: 1123035 - RNA, 23 nt, Homo sapiens
agaagugauauggugaagggaag

SEQ ID NO: 1123036 - RNA, 19 nt, Homo sapiens
agaaguuuaaaaaaccaug

SEQ ID NO: 1123037 - RNA, 21 nt, Homo sapiens
agaaugaauacugggaaucaa

SEQ ID NO: 1123038 - RNA, 11 nt, Homo sapiens
agaauggagcu

SEQ ID NO: 1123039 - RNA, 16 nt, Homo sapiens
agaauucacaccuuag

SEQ ID NO: 1123040 - RNA, 14 nt, Homo sapiens
agacagaaagccuc

SEQ ID NO: 1123041 - RNA, 18 nt, Homo sapiens
agacaggucuagacuuuc

SEQ ID NO: 1123042 - RNA, 19 nt, Homo sapiens
agacaggucuagacuuucu

SEQ ID NO: 1123043 - RNA, 11 nt, Homo sapiens
agaccuuccag

SEQ ID NO: 1123044 - RNA, 13 nt, Homo sapiens
agacuaaggccau

SEQ ID NO: 1123045 - RNA, 20 nt, Homo sapiens
agacuggggacccuggacau

SEQ ID NO: 1123046 - RNA, 15 nt, Homo sapiens
agagaacaggggcuu

SEQ ID NO: 1123047 - RNA, 21 nt, Homo sapiens
agagacuuggggaccagaggu

SEQ ID NO: 1123048 - RNA, 23 nt, Homo sapiens
agagauuuugucgggacagagag

SEQ ID NO: 1123049 - RNA, 19 nt, Homo sapiens
agagccugugcuaaagaag

SEQ ID NO: 1123050 - RNA, 20 nt, Homo sapiens
agagccugugcuaaagaagc

SEQ ID NO: 1123051 - RNA, 14 nt, Homo sapiens
agaggaaaaugccu

SEQ ID NO: 1123052 - RNA, 15 nt, Homo sapiens
agagggaugagacag

SEQ ID NO: 1123053 - RNA, 15 nt, Homo sapiens
agaggugcagcugga

SEQ ID NO: 1123054 - RNA, 13 nt, Homo sapiens
agaguacagaugu

SEQ ID NO: 1123055 - RNA, 13 nt, Homo sapiens
agagugucuuucc

SEQ ID NO: 1123056 - RNA, 16 nt, Homo sapiens
agauagcuacagugua

SEQ ID NO: 1123057 - RNA, 18 nt, Homo sapiens
agauauucagaaguauau

SEQ ID NO: 1123058 - RNA, 21 nt, Homo sapiens
agaugcuacuucccacuguau

SEQ ID NO: 1123059 - RNA, 23 nt, Homo sapiens
agaugucgcccuacucaccugag

SEQ ID NO: 1123060 - RNA, 16 nt, Homo sapiens
agauuauaaacugacu

SEQ ID NO: 1123061 - RNA, 18 nt, Homo sapiens
agauuuugucgggacaga

SEQ ID NO: 1123062 - RNA, 17 nt, Homo sapiens
cuuuugacaaaggcaag

SEQ ID NO: 1123063 - RNA, 14 nt, Homo sapiens
cuuuugccuuucaa

SEQ ID NO: 1123064 - RNA, 17 nt, Homo sapiens
gaaaaguacuaauagaa

SEQ ID NO: 1123065 - RNA, 20 nt, Homo sapiens
gaaaauaggaagugaaccca

SEQ ID NO: 1123066 - RNA, 14 nt, Homo sapiens
gaaaauuauuugca

SEQ ID NO: 1123067 - RNA, 23 nt, Homo sapiens
gaaacaacaauuucuacuuugaa

SEQ ID NO: 1123068 - RNA, 20 nt, Homo sapiens
gaaacacuauuugugacuuu

SEQ ID NO: 1123069 - RNA, 16 nt, Homo sapiens
gaaacccauuaggcau

SEQ ID NO: 1123070 - RNA, 14 nt, Homo sapiens
gaaaucaaacugcu

SEQ ID NO: 1123071 - RNA, 15 nt, Homo sapiens
gaaaucaaacugcuu

SEQ ID NO: 1123072 - RNA, 23 nt, Homo sapiens
gaagaaacgcuuggagugcuucu

SEQ ID NO: 1123073 - RNA, 15 nt, Homo sapiens
gaagccccauccaac

SEQ ID NO: 1123074 - RNA, 21 nt, Homo sapiens
gaaggacacuagccugugcac

SEQ ID NO: 1123075 - RNA, 20 nt, Homo sapiens
gaaguuccauuuaagggcaa

SEQ ID NO: 1123076 - RNA, 15 nt, Homo sapiens
gaauaauggacaaag

SEQ ID NO: 1123077 - RNA, 16 nt, Homo sapiens
gaauacugccaaaaca

SEQ ID NO: 1123078 - RNA, 18 nt, Homo sapiens
gaauauuuauuaccucug

SEQ ID NO: 1123079 - RNA, 15 nt, Homo sapiens
gaaucaagacaagac

SEQ ID NO: 1123080 - RNA, 19 nt, Homo sapiens
gaaucucuuggaugcagcu

SEQ ID NO: 1123081 - RNA, 16 nt, Homo sapiens
gaaugaagguaauauu

SEQ ID NO: 1123082 - RNA, 17 nt, Homo sapiens
gaauggagcuggcccuc

SEQ ID NO: 1123083 - RNA, 16 nt, Homo sapiens
gaauuuaaucuuugag

SEQ ID NO: 1123084 - RNA, 17 nt, Homo sapiens
gaauuuauucaauuccu

SEQ ID NO: 1123085 - RNA, 12 nt, Homo sapiens
gaauuugagugc

SEQ ID NO: 1123086 - RNA, 20 nt, Homo sapiens
gaauuuuugcuaugcuguaa

SEQ ID NO: 1123087 - RNA, 14 nt, Homo sapiens
gacaaaccagagca

SEQ ID NO: 1123088 - RNA, 24 nt, Homo sapiens
gacaacucauuuucauauuguaau

SEQ ID NO: 1123089 - RNA, 16 nt, Homo sapiens
gacagcuuccuuuccu

SEQ ID NO: 1123090 - RNA, 14 nt, Homo sapiens
gacaguaaacacuc

SEQ ID NO: 1123091 - RNA, 16 nt, Homo sapiens
gacaguaaacacucca

SEQ ID NO: 1123092 - RNA, 21 nt, Homo sapiens
gaccacgcuuucuagcuguug

SEQ ID NO: 1123093 - RNA, 15 nt, Homo sapiens
gaccauggaggccag

SEQ ID NO: 1123094 - RNA, 17 nt, Homo sapiens
gaccccaauauauguau

SEQ ID NO: 1123095 - RNA, 17 nt, Homo sapiens
gaccuggugcugccucu

SEQ ID NO: 1123096 - RNA, 15 nt, Homo sapiens
gacuaagcauugagc

SEQ ID NO: 1123097 - RNA, 16 nt, Homo sapiens
gacuauaaagcuguua

SEQ ID NO: 1123098 - RNA, 22 nt, Homo sapiens
gacucugcuagacuccucagga

SEQ ID NO: 1123099 - RNA, 22 nt, Homo sapiens
gacucugggcugucagcccaug

SEQ ID NO: 1123100 - RNA, 17 nt, Homo sapiens
gacuuggagaauacugc

SEQ ID NO: 1123101 - RNA, 14 nt, Homo sapiens
gagaaaagggaugg

SEQ ID NO: 1123102 - RNA, 14 nt, Homo sapiens
ggcgagcacuguga

SEQ ID NO: 1123103 - RNA, 21 nt, Homo sapiens
ggcgagcacugugagcaccug

SEQ ID NO: 1123104 - RNA, 20 nt, Homo sapiens
ggcuccaggccccaccuccu

SEQ ID NO: 1123105 - RNA, 21 nt, Homo sapiens
ggcuccccuccucggcuuccu

SEQ ID NO: 1123106 - RNA, 18 nt, Homo sapiens
ggcugcuguggggaccac

SEQ ID NO: 1123107 - RNA, 22 nt, Homo sapiens
ggcugucaggauucuucaagga

SEQ ID NO: 1123108 - RNA, 20 nt, Homo sapiens
ggcuuuacaguguaaacugu

SEQ ID NO: 1123109 - RNA, 14 nt, Homo sapiens
gggacucgggugcu

SEQ ID NO: 1123110 - RNA, 15 nt, Homo sapiens
gggagaagugauaug

SEQ ID NO: 1123111 - RNA, 19 nt, Homo sapiens
gggcacugagcccuuccca

SEQ ID NO: 1123112 - RNA, 15 nt, Homo sapiens
gggcuccauguagaa

SEQ ID NO: 1123113 - RNA, 19 nt, Homo sapiens
ggggaaguaaaacagucau

SEQ ID NO: 1123114 - RNA, 17 nt, Homo sapiens
ggggagauugaacuuuc

SEQ ID NO: 1123115 - RNA, 23 nt, Homo sapiens
ggguuuuuguucuggaagccaua

SEQ ID NO: 1123116 - RNA, 18 nt, Homo sapiens
gguaauuaguaacaugug

SEQ ID NO: 1123117 - RNA, 14 nt, Homo sapiens
gguaugauauugca

SEQ ID NO: 1123118 - RNA, 15 nt, Homo sapiens
gguggaugaucucaa

SEQ ID NO: 1123119 - RNA, 15 nt, Homo sapiens
gguuccccaauccau

SEQ ID NO: 1123120 - RNA, 18 nt, Homo sapiens
gguucuaacugcuguuaa

SEQ ID NO: 1123121 - RNA, 20 nt, Homo sapiens
guacuccagccugggugaca

SEQ ID NO: 1123122 - RNA, 22 nt, Homo sapiens
guagaaaauuuguuauuuugca

SEQ ID NO: 1123123 - RNA, 14 nt, Homo sapiens
guauaugacugcau

SEQ ID NO: 1123124 - RNA, 14 nt, Homo sapiens
guaucaaaugugac

SEQ ID NO: 1123125 - RNA, 15 nt, Homo sapiens
guaucaaaugugaca

SEQ ID NO: 1123126 - RNA, 21 nt, Homo sapiens
guaucaaaugugacauuauau

SEQ ID NO: 1123127 - RNA, 13 nt, Homo sapiens
guaugcacagggu

SEQ ID NO: 1123128 - RNA, 21 nt, Homo sapiens
guauuaaaaaacaauuaacug

SEQ ID NO: 1123129 - RNA, 19 nt, Homo sapiens
gucaaccugccugacauuu

SEQ ID NO: 1123130 - RNA, 15 nt, Homo sapiens
gucaacucacaccug

SEQ ID NO: 1123131 - RNA, 16 nt, Homo sapiens
gucaacucacaccugc

SEQ ID NO: 1123132 - RNA, 19 nt, Homo sapiens
gucagcugcuguugaacuu

SEQ ID NO: 1123133 - RNA, 24 nt, Homo sapiens
guccacgagcuguuuacuagggau

SEQ ID NO: 1123134 - RNA, 12 nt, Homo sapiens
guccgagucuca

SEQ ID NO: 1123135 - RNA, 21 nt, Homo sapiens
guccuaaaaguucucaaugua

SEQ ID NO: 1123136 - RNA, 19 nt, Homo sapiens
guccucacgcagacacacc

SEQ ID NO: 1123137 - RNA, 14 nt, Homo sapiens
gucuagaggugaga

SEQ ID NO: 1123138 - RNA, 15 nt, Homo sapiens
gucuuuacagaauca

SEQ ID NO: 1123139 - RNA, 14 nt, Homo sapiens
gugaacuccaccuc

SEQ ID NO: 1123140 - RNA, 16 nt, Homo sapiens
gugaauaaaccaucau

SEQ ID NO: 1123141 - RNA, 19 nt, Homo sapiens
gugacauuuccaugcauaa

SEQ ID NO: 1123142 - RNA, 23 nt, Homo sapiens
gugaccauggaggccagugccag

SEQ ID NO: 1123143 - RNA, 19 nt, Homo sapiens
gugacuauaaagcuguuau

SEQ ID NO: 1123144 - RNA, 12 nt, Homo sapiens
gugacucucuug

SEQ ID NO: 1123145 - RNA, 12 nt, Homo sapiens
gugagacccagc

SEQ ID NO: 1123146 - RNA, 13 nt, Homo sapiens
gugagcacgcuga

SEQ ID NO: 1123147 - RNA, 19 nt, Homo sapiens
gugauauggugaagggaag

SEQ ID NO: 1123148 - RNA, 14 nt, Homo sapiens
guggaugaucucaa

SEQ ID NO: 1123149 - RNA, 15 nt, Homo sapiens
guguaugcacagggu

SEQ ID NO: 1123150 - RNA, 15 nt, Homo sapiens
gugucaccugugcuu

SEQ ID NO: 1123151 - RNA, 18 nt, Homo sapiens
guguugccucuugcaaug

SEQ ID NO: 1123152 - RNA, 22 nt, Homo sapiens
guuaccugaaaacacugugcac

SEQ ID NO: 1123153 - RNA, 15 nt, Homo sapiens
guuagugacauuuaa

SEQ ID NO: 1123154 - RNA, 15 nt, Homo sapiens
guuagugauggagcu

SEQ ID NO: 1123155 - RNA, 16 nt, Homo sapiens
guucagaggugcagcu

SEQ ID NO: 1123156 - RNA, 14 nt, Homo sapiens
guuccugacacuca

SEQ ID NO: 1123157 - RNA, 19 nt, Homo sapiens
guuguauauagaguggaau

SEQ ID NO: 1123158 - RNA, 21 nt, Homo sapiens
guuuacuucaaauuaacucua

SEQ ID NO: 1123159 - RNA, 15 nt, Homo sapiens
guuuagagagccugu

SEQ ID NO: 1123160 - RNA, 18 nt, Homo sapiens
guuugucagcaucugacc

SEQ ID NO: 1123161 - RNA, 16 nt, Homo sapiens
uaaaauaaugaacacu

SEQ ID NO: 1123162 - RNA, 12 nt, Homo sapiens
uaaaaugauguu

SEQ ID NO: 1123163 - RNA, 21 nt, Homo sapiens
uaaaauguggucugccaaucu

SEQ ID NO: 1123164 - RNA, 17 nt, Homo sapiens
uaaacaagucaaagacu

SEQ ID NO: 1123165 - RNA, 17 nt, Homo sapiens
uaaacacuccacauucu

SEQ ID NO: 1123166 - RNA, 20 nt, Homo sapiens
uaaacagguuuuuaguuugu

SEQ ID NO: 1123167 - RNA, 13 nt, Homo sapiens
uaaacugugcacc

SEQ ID NO: 1123168 - RNA, 13 nt, Homo sapiens
uaaauaacauguu

SEQ ID NO: 1123169 - RNA, 15 nt, Homo sapiens
uaaauacagucuucc

SEQ ID NO: 1123170 - RNA, 14 nt, Homo sapiens
uaaaugccacaaag

SEQ ID NO: 1123171 - RNA, 19 nt, Homo sapiens
uaaauguaucuuauucaca

SEQ ID NO: 1123172 - RNA, 20 nt, Homo sapiens
uaaauguaucuuauucacau

SEQ ID NO: 1123173 - RNA, 21 nt, Homo sapiens
uauaaaugugauugcagcuuu

SEQ ID NO: 1123174 - RNA, 22 nt, Homo sapiens
uauaacuaaacaugauauauca

SEQ ID NO: 1123175 - RNA, 16 nt, Homo sapiens
uauaauugaguuuuca

SEQ ID NO: 1123176 - RNA, 20 nt, Homo sapiens
uauacuucucuauuaucuca

SEQ ID NO: 1123177 - RNA, 14 nt, Homo sapiens
uauagacucuagga

SEQ ID NO: 1123178 - RNA, 20 nt, Homo sapiens
uauauauuuuugugcacauu

SEQ ID NO: 1123179 - RNA, 21 nt, Homo sapiens
uauauauuuuugugcacauuu

SEQ ID NO: 1123180 - RNA, 18 nt, Homo sapiens
uauaugaucaaacuucca

SEQ ID NO: 1123181 - RNA, 19 nt, Homo sapiens
uauauuugaaguggagcca

SEQ ID NO: 1123182 - RNA, 21 nt, Homo sapiens
uaucauuaucuuugcuguuau

SEQ ID NO: 1123183 - RNA, 17 nt, Homo sapiens
uaugcaauucaguguuc

SEQ ID NO: 1123184 - RNA, 23 nt, Homo sapiens
uaugcauuaagaguaaaauuccu

SEQ ID NO: 1123185 - RNA, 21 nt, Homo sapiens
uaugcugaucuuuuaaaauca

SEQ ID NO: 1123186 - RNA, 21 nt, Homo sapiens
uaugggggagauugaacuuuc

SEQ ID NO: 1123187 - RNA, 20 nt, Homo sapiens
uauguuacuguauuuuucag

SEQ ID NO: 1123188 - RNA, 14 nt, Homo sapiens
uauuacauaugauu

SEQ ID NO: 1123189 - RNA, 16 nt, Homo sapiens
uauuguuucaauugca

SEQ ID NO: 1123190 - RNA, 12 nt, Homo sapiens
uauuuaccugaa

SEQ ID NO: 1123191 - RNA, 14 nt, Homo sapiens
uauuuuugugcaca

SEQ ID NO: 1123192 - RNA, 20 nt, Homo sapiens
ucaacagaaacuaaaugaac

SEQ ID NO: 1123193 - RNA, 15 nt, Homo sapiens
ucaacucacaccugc

SEQ ID NO: 1123194 - RNA, 15 nt, Homo sapiens
ucaagacucaccuca

SEQ ID NO: 1123195 - RNA, 15 nt, Homo sapiens
ucaauaaaagaauuc

SEQ ID NO: 1123196 - RNA, 14 nt, Homo sapiens
ucaauaaacaguca

SEQ ID NO: 1123197 - RNA, 20 nt, Homo sapiens
ucaaucaugaguaccucaaa

SEQ ID NO: 1123198 - RNA, 21 nt, Homo sapiens
ucacaaucaucaucauucuca

SEQ ID NO: 1123199 - RNA, 15 nt, Homo sapiens
ucacagcccucauga

SEQ ID NO: 1123200 - RNA, 12 nt, Homo sapiens
ucacaguugugu

SEQ ID NO: 1123201 - RNA, 20 nt, Homo sapiens
uuuauagucgaacaauucau

SEQ ID NO: 1123202 - RNA, 24 nt, Homo sapiens
uuuauuacgauuaguauaugauca

SEQ ID NO: 1123203 - RNA, 17 nt, Homo sapiens
uuuauuauuuucaccug

SEQ ID NO: 1123204 - RNA, 13 nt, Homo sapiens
uuucaauuuauca

SEQ ID NO: 1123205 - RNA, 13 nt, Homo sapiens
uuucaccauuuga

SEQ ID NO: 1123206 - RNA, 20 nt, Homo sapiens
uuucagaauuuaaucuuuga

SEQ ID NO: 1123207 - RNA, 19 nt, Homo sapiens
uuucagguuccaaucagaa

SEQ ID NO: 1123208 - RNA, 12 nt, Homo sapiens
uuucccaccacc

SEQ ID NO: 1123209 - RNA, 19 nt, Homo sapiens
uuucccuguagauguauca

SEQ ID NO: 1123210 - RNA, 23 nt, Homo sapiens
uuucccuguagauguaucaaaau

SEQ ID NO: 1123211 - RNA, 22 nt, Homo sapiens
uuucuaaaaagaaaaagagaua

SEQ ID NO: 1123212 - RNA, 22 nt, Homo sapiens
uuucuacuuugaagucauacca

SEQ ID NO: 1123213 - RNA, 23 nt, Homo sapiens
uuugaaaaaugagagcuguaacu

SEQ ID NO: 1123214 - RNA, 18 nt, Homo sapiens
uuugaaauuaaccucuca

SEQ ID NO: 1123215 - RNA, 20 nt, Homo sapiens
uuugaugauuaauucaccuu

SEQ ID NO: 1123216 - RNA, 20 nt, Homo sapiens
uuugcaagggaaaagucucu

SEQ ID NO: 1123217 - RNA, 21 nt, Homo sapiens
uuugcauuuugauauugcugu

SEQ ID NO: 1123218 - RNA, 16 nt, Homo sapiens
uuuggggccucaagaa

SEQ ID NO: 1123219 - RNA, 22 nt, Homo sapiens
uuuuaaacgauuagugaugucc

SEQ ID NO: 1123220 - RNA, 15 nt, Homo sapiens
uuuuaaugggcacaa

SEQ ID NO: 1123221 - RNA, 12 nt, Homo sapiens
uuuucacuugua

SEQ ID NO: 1123222 - RNA, 17 nt, Homo sapiens
uuuugaaauuaaccucu

SEQ ID NO: 1123223 - RNA, 23 nt, Homo sapiens
uuuuucacuucuaccuacauauu

SEQ ID NO: 1123224 - RNA, 13 nt, Homo sapiens
uuuuugacauuua

SEQ ID NO: 1123225 - RNA, 21 nt, Homo sapiens
uuuuuucccccuaucaguuga

SEQ ID NO: 1123226 - RNA, 18 nt, Homo sapiens
acccaugauacuccacuc

SEQ ID NO: 1123227 - RNA, 22 nt, Homo sapiens
accccaggacgcccucacugca

SEQ ID NO: 1123228 - RNA, 16 nt, Homo sapiens
accucaccaguuucca

SEQ ID NO: 1123229 - RNA, 22 nt, Homo sapiens
accugaaauaaaauucauuagu

SEQ ID NO: 1123230 - RNA, 17 nt, Homo sapiens
accuguccccacccucc

SEQ ID NO: 1123231 - RNA, 19 nt, Homo sapiens
accuguuuuuaagcuguuu

SEQ ID NO: 1123232 - RNA, 19 nt, Homo sapiens
accuuaauuuaacuuucca

SEQ ID NO: 1123233 - RNA, 20 nt, Homo sapiens
accuucacgauuaacuguga

SEQ ID NO: 1123234 - RNA, 18 nt, Homo sapiens
accuucugggacauggug

SEQ ID NO: 1123235 - RNA, 20 nt, Homo sapiens
acggagccacuccucugacu

SEQ ID NO: 1123236 - RNA, 23 nt, Homo sapiens
acuaccuugguucccccacugau

SEQ ID NO: 1123237 - RNA, 15 nt, Homo sapiens
acuagggaucccuca

SEQ ID NO: 1123238 - RNA, 11 nt, Homo sapiens
acuagggccaa

SEQ ID NO: 1123239 - RNA, 16 nt, Homo sapiens
acuauaaagcuguuau

SEQ ID NO: 1123240 - RNA, 15 nt, Homo sapiens
acuauuuugugcucc

SEQ ID NO: 1123241 - RNA, 17 nt, Homo sapiens
acucaauaaacagucac

SEQ ID NO: 1123242 - RNA, 15 nt, Homo sapiens
acucccaacccuggc

SEQ ID NO: 1123243 - RNA, 20 nt, Homo sapiens
acucucugguuuacuucaaa

SEQ ID NO: 1123244 - RNA, 18 nt, Homo sapiens
acugaguucuauauucug

SEQ ID NO: 1123245 - RNA, 13 nt, Homo sapiens
acugauccuggag

SEQ ID NO: 1123246 - RNA, 13 nt, Homo sapiens
acugcagcugucu

SEQ ID NO: 1123247 - RNA, 23 nt, Homo sapiens
acugcagggaaaauuauuugcau

SEQ ID NO: 1123248 - RNA, 18 nt, Homo sapiens
acugccaugccucaagaa

SEQ ID NO: 1123249 - RNA, 17 nt, Homo sapiens
acuggaaagagugccag

SEQ ID NO: 1123250 - RNA, 18 nt, Homo sapiens
acuguaugugggaauuua

SEQ ID NO: 1123251 - RNA, 13 nt, Homo sapiens
acugucuccaugg

SEQ ID NO: 1123252 - RNA, 18 nt, Homo sapiens
acuguucccccugugcag

SEQ ID NO: 1123253 - RNA, 16 nt, Homo sapiens
acuucuaccuacauau

SEQ ID NO: 1123254 - RNA, 22 nt, Homo sapiens
acuucugaagagaccacucaau

SEQ ID NO: 1123255 - RNA, 14 nt, Homo sapiens
acuuguggaaaaua

SEQ ID NO: 1123256 - RNA, 20 nt, Homo sapiens
agaaaccuuauuguaccucu

SEQ ID NO: 1123257 - RNA, 22 nt, Homo sapiens
agaaauauacucucccagauuu

SEQ ID NO: 1123258 - RNA, 21 nt, Homo sapiens
agaacaccuuuguuuugcacu

SEQ ID NO: 1123259 - RNA, 20 nt, Homo sapiens
agaaccccaggacgcccuca

SEQ ID NO: 1123260 - RNA, 15 nt, Homo sapiens
agaacucacucuggg

SEQ ID NO: 1123261 - RNA, 22 nt, Homo sapiens
agaagcauugccuggacugacc

SEQ ID NO: 1123262 - RNA, 22 nt, Homo sapiens
agaaggacacuagccugugcac

SEQ ID NO: 1123263 - RNA, 16 nt, Homo sapiens
agaagggggugggggg

SEQ ID NO: 1123264 - RNA, 18 nt, Homo sapiens
agaauacugccaaaacau

SEQ ID NO: 1123265 - RNA, 12 nt, Homo sapiens
agaauauuuacu

SEQ ID NO: 1123266 - RNA, 19 nt, Homo sapiens
agaauauuuauuaccucug

SEQ ID NO: 1123267 - RNA, 13 nt, Homo sapiens
agaaucaaaugca

SEQ ID NO: 1123268 - RNA, 21 nt, Homo sapiens
agaauuuauucaauuccucug

SEQ ID NO: 1123269 - RNA, 20 nt, Homo sapiens
agaccccucucccagcuauu

SEQ ID NO: 1123270 - RNA, 23 nt, Homo sapiens
agaccucugggggauaagggagu

SEQ ID NO: 1123271 - RNA, 19 nt, Homo sapiens
agacgugcgcgaugugaca

SEQ ID NO: 1123272 - RNA, 22 nt, Homo sapiens
agacucaccucauccuuaccgc

SEQ ID NO: 1123273 - RNA, 18 nt, Homo sapiens
agacucugggcugucagc

SEQ ID NO: 1123274 - RNA, 17 nt, Homo sapiens
agacuguugccacuuaa

SEQ ID NO: 1123275 - RNA, 18 nt, Homo sapiens
agacuguugccacuuaac

SEQ ID NO: 1123276 - RNA, 18 nt, Homo sapiens
agacuuggggaccagagg

SEQ ID NO: 1123277 - RNA, 17 nt, Homo sapiens
agagaaagaguuugaaa

SEQ ID NO: 1123278 - RNA, 17 nt, Homo sapiens
agagaaagcacaauuua

SEQ ID NO: 1123279 - RNA, 22 nt, Homo sapiens
agagaacaaugugcuaugugaa

SEQ ID NO: 1123280 - RNA, 18 nt, Homo sapiens
agagaacaggggcuucuu

SEQ ID NO: 1123281 - RNA, 20 nt, Homo sapiens
agagcaagacucugucucaa

SEQ ID NO: 1123282 - RNA, 16 nt, Homo sapiens
agagcaauuccaggcu

SEQ ID NO: 1123283 - RNA, 20 nt, Homo sapiens
agagccaauuagacuugaaa

SEQ ID NO: 1123284 - RNA, 15 nt, Homo sapiens
agagccagcucucuc

SEQ ID NO: 1123285 - RNA, 17 nt, Homo sapiens
agagcuucucugggcug

SEQ ID NO: 1123286 - RNA, 21 nt, Homo sapiens
agagggcagcccccacuuucc

SEQ ID NO: 1123287 - RNA, 17 nt, Homo sapiens
agaggugacaguggaug

SEQ ID NO: 1123288 - RNA, 14 nt, Homo sapiens
agagucuucccuac

SEQ ID NO: 1123289 - RNA, 20 nt, Homo sapiens
agauaaagaauaauaauuaa

SEQ ID NO: 1123290 - RNA, 12 nt, Homo sapiens
agauugaacuuu

SEQ ID NO: 1123291 - RNA, 22 nt, Homo sapiens
agcaauuccaggcugagccaug

SEQ ID NO: 1123292 - RNA, 16 nt, Homo sapiens
agcacugggcucugau

SEQ ID NO: 1123293 - RNA, 17 nt, Homo sapiens
agcacugggcucugaug

SEQ ID NO: 1123294 - RNA, 11 nt, Homo sapiens
agcacugugag

SEQ ID NO: 1123295 - RNA, 20 nt, Homo sapiens
agcagugaaugauucagugu

SEQ ID NO: 1123296 - RNA, 18 nt, Homo sapiens
agcauacgguaugauauu

SEQ ID NO: 1123297 - RNA, 12 nt, Homo sapiens
agcaucugacca

SEQ ID NO: 1123298 - RNA, 20 nt, Homo sapiens
agcauugccuggacugacca

SEQ ID NO: 1123299 - RNA, 17 nt, Homo sapiens
agcauuuagacccugca

SEQ ID NO: 1123300 - RNA, 19 nt, Homo sapiens
agcccaugugcaccugccc

SEQ ID NO: 1123301 - RNA, 15 nt, Homo sapiens
agccggccugagaaa

SEQ ID NO: 1123302 - RNA, 18 nt, Homo sapiens
agccucccccaaagcaau

SEQ ID NO: 1123303 - RNA, 20 nt, Homo sapiens
agccugcucuagugggacag

SEQ ID NO: 1123304 - RNA, 15 nt, Homo sapiens
agccuggagggaugc

SEQ ID NO: 1123305 - RNA, 21 nt, Homo sapiens
agccugugcgccgggggaccu

SEQ ID NO: 1123306 - RNA, 13 nt, Homo sapiens
agccuugcaugac

SEQ ID NO: 1123307 - RNA, 11 nt, Homo sapiens
agcuacagugu

SEQ ID NO: 1123308 - RNA, 12 nt, Homo sapiens
agcucucucuac

SEQ ID NO: 1123309 - RNA, 15 nt, Homo sapiens
agcugaggccuugcc

SEQ ID NO: 1123310 - RNA, 14 nt, Homo sapiens
agcuggacugacca

SEQ ID NO: 1123311 - RNA, 21 nt, Homo sapiens
agcuucucugggcugaaugua

SEQ ID NO: 1123312 - RNA, 17 nt, Homo sapiens
aggaaaauaaacugaca

SEQ ID NO: 1123313 - RNA, 13 nt, Homo sapiens
aggaaaaugccuc

SEQ ID NO: 1123314 - RNA, 20 nt, Homo sapiens
aggagaaugaauacugggaa

SEQ ID NO: 1123315 - RNA, 15 nt, Homo sapiens
aggauggcaagcacg

SEQ ID NO: 1123316 - RNA, 19 nt, Homo sapiens
aggcaagcuugaggccaag

SEQ ID NO: 1123317 - RNA, 23 nt, Homo sapiens
aggcaggggugggagagccagcu

SEQ ID NO: 1123318 - RNA, 19 nt, Homo sapiens
aggccagugccagcaccug

SEQ ID NO: 1123319 - RNA, 22 nt, Homo sapiens
aggccagugccagcaccugccc

SEQ ID NO: 1123320 - RNA, 20 nt, Homo sapiens
aggccgggcgcgguggcuca

SEQ ID NO: 1123321 - RNA, 19 nt, Homo sapiens
aggccucuccaguuugcac

SEQ ID NO: 1123322 - RNA, 15 nt, Homo sapiens
aggccucuguggcac

SEQ ID NO: 1123323 - RNA, 13 nt, Homo sapiens
aggcuaccucaag

SEQ ID NO: 1123324 - RNA, 15 nt, Homo sapiens
aggcuaccucaagac

SEQ ID NO: 1123325 - RNA, 16 nt, Homo sapiens
aggcuuggcuggugua

SEQ ID NO: 1123326 - RNA, 16 nt, Homo sapiens
agggacgccugggggu

SEQ ID NO: 1123327 - RNA, 15 nt, Homo sapiens
agggauggagcugaa

SEQ ID NO: 1123328 - RNA, 15 nt, Homo sapiens
agggcaagaucucag

SEQ ID NO: 1123329 - RNA, 14 nt, Homo sapiens
agggccacauggga

SEQ ID NO: 1123330 - RNA, 18 nt, Homo sapiens
agggugacugaugauaca

SEQ ID NO: 1123331 - RNA, 22 nt, Homo sapiens
agguuuacacugcggaagccaa

SEQ ID NO: 1123332 - RNA, 23 nt, Homo sapiens
agguuuuuaguuuguucuucaga

SEQ ID NO: 1123333 - RNA, 19 nt, Homo sapiens
aguaaauaaacaagucaaa

SEQ ID NO: 1123334 - RNA, 11 nt, Homo sapiens
aguaacaugug

SEQ ID NO: 1123335 - RNA, 19 nt, Homo sapiens
aguaacgggacaguaaaca

SEQ ID NO: 1123336 - RNA, 22 nt, Homo sapiens
cugcuugaggaaaacaagcauu

SEQ ID NO: 1123337 - RNA, 16 nt, Homo sapiens
cuggaaggcuuccacu

SEQ ID NO: 1123338 - RNA, 12 nt, Homo sapiens
cuggacugacca

SEQ ID NO: 1123339 - RNA, 17 nt, Homo sapiens
cuggaucccguucagaa

SEQ ID NO: 1123340 - RNA, 18 nt, Homo sapiens
cuggauccucaguucuca

SEQ ID NO: 1123341 - RNA, 16 nt, Homo sapiens
cuggcagaagcauugc

SEQ ID NO: 1123342 - RNA, 20 nt, Homo sapiens
cuggcugggaacaacuucag

SEQ ID NO: 1123343 - RNA, 22 nt, Homo sapiens
cugggaagcuugagccuccccc

SEQ ID NO: 1123344 - RNA, 15 nt, Homo sapiens
cugggaaucaagaca

SEQ ID NO: 1123345 - RNA, 16 nt, Homo sapiens
cugggaaucaagacaa

SEQ ID NO: 1123346 - RNA, 22 nt, Homo sapiens
cugggcccucucugcucugcgu

SEQ ID NO: 1123347 - RNA, 13 nt, Homo sapiens
cugggcuguaacg

SEQ ID NO: 1123348 - RNA, 22 nt, Homo sapiens
cuggguuuuguauucucugagc

SEQ ID NO: 1123349 - RNA, 20 nt, Homo sapiens
cugguguaaucucaaugcaa

SEQ ID NO: 1123350 - RNA, 18 nt, Homo sapiens
cugguguaugcacagggu

SEQ ID NO: 1123351 - RNA, 16 nt, Homo sapiens
cugguucuaacugcug

SEQ ID NO: 1123352 - RNA, 17 nt, Homo sapiens
cuguaaucccagcacuu

SEQ ID NO: 1123353 - RNA, 22 nt, Homo sapiens
cuguacuccagccugggugaca

SEQ ID NO: 1123354 - RNA, 22 nt, Homo sapiens
cuguauguaaacuguuacugaa

SEQ ID NO: 1123355 - RNA, 22 nt, Homo sapiens
cuguaugucaauaaacaacagc

SEQ ID NO: 1123356 - RNA, 16 nt, Homo sapiens
cuguauuaagccacuu

SEQ ID NO: 1123357 - RNA, 15 nt, Homo sapiens
cugucaccagagcuu

SEQ ID NO: 1123358 - RNA, 19 nt, Homo sapiens
cugucacguagaacuugga

SEQ ID NO: 1123359 - RNA, 13 nt, Homo sapiens
cugucuccauggc

SEQ ID NO: 1123360 - RNA, 18 nt, Homo sapiens
cugugaaauucacaguaa

SEQ ID NO: 1123361 - RNA, 20 nt, Homo sapiens
cugugaaauucacaguaaua

SEQ ID NO: 1123362 - RNA, 17 nt, Homo sapiens
cugugagccuugcauga

SEQ ID NO: 1123363 - RNA, 22 nt, Homo sapiens
cugugcacgcgcgcgugcacac

SEQ ID NO: 1123364 - RNA, 20 nt, Homo sapiens
cugugcgccgggggaccugg

SEQ ID NO: 1123365 - RNA, 23 nt, Homo sapiens
cuguguaacuguaaaacauugaa

SEQ ID NO: 1123366 - RNA, 21 nt, Homo sapiens
cuguugacaaaugacagaucu

SEQ ID NO: 1123367 - RNA, 23 nt, Homo sapiens
cuguugcacuuuugaauguccaa

SEQ ID NO: 1123368 - RNA, 17 nt, Homo sapiens
cuguuggcaaggugaca

SEQ ID NO: 1123369 - RNA, 13 nt, Homo sapiens
cuuauuucuauga

SEQ ID NO: 1123370 - RNA, 19 nt, Homo sapiens
cuucacgauuaacugugaa

SEQ ID NO: 1123371 - RNA, 12 nt, Homo sapiens
cuucacugacag

SEQ ID NO: 1123372 - RNA, 21 nt, Homo sapiens
cuuccauauuugccuugggaa

SEQ ID NO: 1123373 - RNA, 18 nt, Homo sapiens
cuuccauuugcaagggaa

SEQ ID NO: 1123374 - RNA, 18 nt, Homo sapiens
cuucccuguccaccucac

SEQ ID NO: 1123375 - RNA, 13 nt, Homo sapiens
cuucccuucccag

SEQ ID NO: 1123376 - RNA, 18 nt, Homo sapiens
cuuccuuccucucugcaa

SEQ ID NO: 1123377 - RNA, 18 nt, Homo sapiens
cuugacuaccuacuggug

SEQ ID NO: 1123378 - RNA, 20 nt, Homo sapiens
cuugaggccaagauggcugc

SEQ ID NO: 1123379 - RNA, 13 nt, Homo sapiens
cuuggacuccucc

SEQ ID NO: 1123380 - RNA, 18 nt, Homo sapiens
cuuggagaauacugccaa

SEQ ID NO: 1123381 - RNA, 20 nt, Homo sapiens
cuuguuuagagagccuguca

SEQ ID NO: 1123382 - RNA, 14 nt, Homo sapiens
cuuuauuaaguaaa

SEQ ID NO: 1123383 - RNA, 14 nt, Homo sapiens
cuuuauugcaaugc

SEQ ID NO: 1123384 - RNA, 11 nt, Homo sapiens
cuuucauguca

SEQ ID NO: 1123385 - RNA, 14 nt, Homo sapiens
cuuucuuauccaac

SEQ ID NO: 1123386 - RNA, 23 nt, Homo sapiens
cuuucuuguuugucagcaucuga

SEQ ID NO: 1123387 - RNA, 19 nt, Homo sapiens
gaaaaaacuagagccugug

SEQ ID NO: 1123388 - RNA, 22 nt, Homo sapiens
gaaaaaacuagagccugugcua

SEQ ID NO: 1123389 - RNA, 14 nt, Homo sapiens
gaaaaagauggaau

SEQ ID NO: 1123390 - RNA, 22 nt, Homo sapiens
gaaaaauauaauguugauaaua

SEQ ID NO: 1123391 - RNA, 15 nt, Homo sapiens
gaaaacacugugcac

SEQ ID NO: 1123392 - RNA, 16 nt, Homo sapiens
gaaaacacugugcaca

SEQ ID NO: 1123393 - RNA, 14 nt, Homo sapiens
gaaaauaaaccaag

SEQ ID NO: 1123394 - RNA, 22 nt, Homo sapiens
gaaacaaauaauuugaacuuug

SEQ ID NO: 1123395 - RNA, 22 nt, Homo sapiens
gaaacaacaauuucuacuuuga

SEQ ID NO: 1123396 - RNA, 18 nt, Homo sapiens
gaaacaugggcugugauu

SEQ ID NO: 1123397 - RNA, 17 nt, Homo sapiens
gaaaccuuauuguaccu

SEQ ID NO: 1123398 - RNA, 19 nt, Homo sapiens
gaaagggccacccaugaua

SEQ ID NO: 1123399 - RNA, 16 nt, Homo sapiens
gaaauccaguuuccca

SEQ ID NO: 1123400 - RNA, 15 nt, Homo sapiens
gaaaugaacuuuguc

SEQ ID NO: 1123401 - RNA, 15 nt, Homo sapiens
gaacauaacuucuca

SEQ ID NO: 1123402 - RNA, 18 nt, Homo sapiens
gaaccauggugaacucca

SEQ ID NO: 1123403 - RNA, 15 nt, Homo sapiens
gaacuucccuuaaga

SEQ ID NO: 1123404 - RNA, 19 nt, Homo sapiens
gaagaaguuuaaaaaacca

SEQ ID NO: 1123405 - RNA, 15 nt, Homo sapiens
gaaggugaacuuugu

SEQ ID NO: 1123406 - RNA, 22 nt, Homo sapiens
gaagugauauggugaagggaag

SEQ ID NO: 1123407 - RNA, 16 nt, Homo sapiens
gaaguuuaaaaaacca

SEQ ID NO: 1123408 - RNA, 18 nt, Homo sapiens
gaauaaauggagauucag

SEQ ID NO: 1123409 - RNA, 15 nt, Homo sapiens
gaauaccuucuucgc

SEQ ID NO: 1123410 - RNA, 21 nt, Homo sapiens
gaauauuuauuaccucugaua

SEQ ID NO: 1123411 - RNA, 21 nt, Homo sapiens
gaaucucaauguacauagacc

SEQ ID NO: 1123412 - RNA, 13 nt, Homo sapiens
gaaugaaacugau

SEQ ID NO: 1123413 - RNA, 16 nt, Homo sapiens
gaaugaauacugggaa

SEQ ID NO: 1123414 - RNA, 22 nt, Homo sapiens
gaauuuaaucuuugaggaaaag

SEQ ID NO: 1123415 - RNA, 21 nt, Homo sapiens
gacaaaccagagcagagagca

SEQ ID NO: 1123416 - RNA, 18 nt, Homo sapiens
gacaagaaggccacuggu

SEQ ID NO: 1123417 - RNA, 13 nt, Homo sapiens
gacaaggcuccag

SEQ ID NO: 1123418 - RNA, 19 nt, Homo sapiens
gacaugaagacaccaucuc

SEQ ID NO: 1123419 - RNA, 19 nt, Homo sapiens
gaccaaugucuugaugcau

SEQ ID NO: 1123420 - RNA, 13 nt, Homo sapiens
gaccaucugugac

SEQ ID NO: 1123421 - RNA, 15 nt, Homo sapiens
gacugaguucuauau

SEQ ID NO: 1123422 - RNA, 16 nt, Homo sapiens
gacuguugccacuuaa

SEQ ID NO: 1123423 - RNA, 23 nt, Homo sapiens
gacuuguuuagagagccugucac

SEQ ID NO: 1123424 - RNA, 22 nt, Homo sapiens
gagaaaccuuauuguaccucuc

SEQ ID NO: 1123425 - RNA, 15 nt, Homo sapiens
gagacuuggggacca

SEQ ID NO: 1123426 - RNA, 20 nt, Homo sapiens
gagauggaaguugcagugag

SEQ ID NO: 1123427 - RNA, 17 nt, Homo sapiens
gagauuaccuccugaga

SEQ ID NO: 1123428 - RNA, 22 nt, Homo sapiens
gagcaagacucugucucaaaaa

SEQ ID NO: 1123429 - RNA, 17 nt, Homo sapiens
gagccugugcuaaagaa

SEQ ID NO: 1123430 - RNA, 11 nt, Homo sapiens
gagcugugcag

SEQ ID NO: 1123431 - RNA, 21 nt, Homo sapiens
gagcuucccugacucauucug

SEQ ID NO: 1123432 - RNA, 20 nt, Homo sapiens
gaggaacguggucaacucac

SEQ ID NO: 1123433 - RNA, 20 nt, Homo sapiens
gaggaaugcuggacuggagg

SEQ ID NO: 1123434 - RNA, 19 nt, Homo sapiens
gaggcggguggaucacuug

SEQ ID NO: 1123435 - RNA, 18 nt, Homo sapiens
gaggcugaggcgggugga

SEQ ID NO: 1123436 - RNA, 21 nt, Homo sapiens
gaggugcagcuggaggcugcu

SEQ ID NO: 1123437 - RNA, 21 nt, Homo sapiens
gaguacagauguaaaugccac

SEQ ID NO: 1123438 - RNA, 23 nt, Homo sapiens
gaguacagauguaaaugccacaa

SEQ ID NO: 1123439 - RNA, 16 nt, Homo sapiens
gaguauuugaacacag

SEQ ID NO: 1123440 - RNA, 19 nt, Homo sapiens
gagucauccagcucuugcu

SEQ ID NO: 1123441 - RNA, 21 nt, Homo sapiens
gaguccaggguggaugaucuc

SEQ ID NO: 1123442 - RNA, 21 nt, Homo sapiens
gagucucagcccugaccuucu

SEQ ID NO: 1123443 - RNA, 16 nt, Homo sapiens
gaguuuuuaaagccuu

SEQ ID NO: 1123444 - RNA, 14 nt, Homo sapiens
gauaccauaugaau

SEQ ID NO: 1123445 - RNA, 22 nt, Homo sapiens
ugaauagguuccccaauccauc

SEQ ID NO: 1123446 - RNA, 19 nt, Homo sapiens
ugaauauacagaaguucca

SEQ ID NO: 1123447 - RNA, 21 nt, Homo sapiens
ugacagcccugaacgugagca

SEQ ID NO: 1123448 - RNA, 20 nt, Homo sapiens
ugacaguuuuugacauuuau

SEQ ID NO: 1123449 - RNA, 22 nt, Homo sapiens
ugacaucaugaggccggaugaa

SEQ ID NO: 1123450 - RNA, 14 nt, Homo sapiens
ugaccaucugugac

SEQ ID NO: 1123451 - RNA, 18 nt, Homo sapiens
ugacugaaggcugucagg

SEQ ID NO: 1123452 - RNA, 16 nt, Homo sapiens
ugagacagacauucac

SEQ ID NO: 1123453 - RNA, 20 nt, Homo sapiens
ugaggagggaggaacguggu

SEQ ID NO: 1123454 - RNA, 14 nt, Homo sapiens
ugaguuuucagugg

SEQ ID NO: 1123455 - RNA, 17 nt, Homo sapiens
ugauauauaaaugugau

SEQ ID NO: 1123456 - RNA, 12 nt, Homo sapiens
ugauauugcagc

SEQ ID NO: 1123457 - RNA, 13 nt, Homo sapiens
ugauauugcagcu

SEQ ID NO: 1123458 - RNA, 20 nt, Homo sapiens
ugaucagcgccgcaccagcc

SEQ ID NO: 1123459 - RNA, 16 nt, Homo sapiens
ugcaaaaggacucuca

SEQ ID NO: 1123460 - RNA, 13 nt, Homo sapiens
ugcacacuuugcc

SEQ ID NO: 1123461 - RNA, 19 nt, Homo sapiens
ugcacagggggaggccaua

SEQ ID NO: 1123462 - RNA, 21 nt, Homo sapiens
ugcaccucuggcuagagccga

SEQ ID NO: 1123463 - RNA, 19 nt, Homo sapiens
ugcacgcgcgcgugcacac

SEQ ID NO: 1123464 - RNA, 16 nt, Homo sapiens
ugcagcaaacacucca

SEQ ID NO: 1123465 - RNA, 22 nt, Homo sapiens
ugcauaaaugcgauccacagaa

SEQ ID NO: 1123466 - RNA, 11 nt, Homo sapiens
ugccacaaaga

SEQ ID NO: 1123467 - RNA, 12 nt, Homo sapiens
ugccagagccaa

SEQ ID NO: 1123468 - RNA, 21 nt, Homo sapiens
ugccagcauuuagacccugca

SEQ ID NO: 1123469 - RNA, 13 nt, Homo sapiens
ugccaugccucaa

SEQ ID NO: 1123470 - RNA, 14 nt, Homo sapiens
ugcccaugggcuau

SEQ ID NO: 1123471 - RNA, 15 nt, Homo sapiens
ugccuucaccuccuc

SEQ ID NO: 1123472 - RNA, 20 nt, Homo sapiens
ugcuacaaauacucuuagga

SEQ ID NO: 1123473 - RNA, 18 nt, Homo sapiens
ugcuagacuccucaggag

SEQ ID NO: 1123474 - RNA, 18 nt, Homo sapiens
ugcuaucuuuuuuagugu

SEQ ID NO: 1123475 - RNA, 19 nt, Homo sapiens
ugcuccuugggcccuuuga

SEQ ID NO: 1123476 - RNA, 16 nt, Homo sapiens
ugcuguggggaccaca

SEQ ID NO: 1123477 - RNA, 20 nt, Homo sapiens
ugcuguggggaccacacuga

SEQ ID NO: 1123478 - RNA, 18 nt, Homo sapiens
ugcuucucuagcucucua

SEQ ID NO: 1123479 - RNA, 13 nt, Homo sapiens
ugcuucugcacac

SEQ ID NO: 1123480 - RNA, 18 nt, Homo sapiens
ugcuucugcacacaaaac

SEQ ID NO: 1123481 - RNA, 14 nt, Homo sapiens
ugcuuguuauuaga

SEQ ID NO: 1123482 - RNA, 19 nt, Homo sapiens
uggaagaugcagaagcaau

SEQ ID NO: 1123483 - RNA, 21 nt, Homo sapiens
uggaauauuguccauugucca

SEQ ID NO: 1123484 - RNA, 15 nt, Homo sapiens
uggacaaaauggaag

SEQ ID NO: 1123485 - RNA, 20 nt, Homo sapiens
uggagaaaagggauggagcu

SEQ ID NO: 1123486 - RNA, 23 nt, Homo sapiens
uggagaaaagggauggagcugaa

SEQ ID NO: 1123487 - RNA, 14 nt, Homo sapiens
uggagggagccauc

SEQ ID NO: 1123488 - RNA, 24 nt, Homo sapiens
uggcugggaacaacuucaguccaa

SEQ ID NO: 1123489 - RNA, 15 nt, Homo sapiens
uggcugugaaauuca

SEQ ID NO: 1123490 - RNA, 15 nt, Homo sapiens
ugggagaucagccac

SEQ ID NO: 1123491 - RNA, 23 nt, Homo sapiens
ugggcuguaacguggcacuggua

SEQ ID NO: 1123492 - RNA, 18 nt, Homo sapiens
uggggcgagcacugugag

SEQ ID NO: 1123493 - RNA, 19 nt, Homo sapiens
uggucauaaaauagaauaa

SEQ ID NO: 1123494 - RNA, 14 nt, Homo sapiens
ugguccgagucuca

SEQ ID NO: 1123495 - RNA, 15 nt, Homo sapiens
ugguggagggccaca

SEQ ID NO: 1123496 - RNA, 19 nt, Homo sapiens
ugguucccccacugaucac

SEQ ID NO: 1123497 - RNA, 19 nt, Homo sapiens
ugguucuaacugcuguuaa

SEQ ID NO: 1123498 - RNA, 13 nt, Homo sapiens
uguaaaugccaca

SEQ ID NO: 1123499 - RNA, 18 nt, Homo sapiens
uguaaaugccacaaagaa

SEQ ID NO: 1123500 - RNA, 21 nt, Homo sapiens
uguauucucugagcugugcag

SEQ ID NO: 1123501 - RNA, 16 nt, Homo sapiens
ugucagcaucugacca

SEQ ID NO: 1123502 - RNA, 17 nt, Homo sapiens
ugucagcaucugaccau

SEQ ID NO: 1123503 - RNA, 16 nt, Homo sapiens
ugucaggauucuucaa

SEQ ID NO: 1123504 - RNA, 15 nt, Homo sapiens
uguccacaaauauaa

SEQ ID NO: 1123505 - RNA, 13 nt, Homo sapiens
uguccacuucauu

SEQ ID NO: 1123506 - RNA, 21 nt, Homo sapiens
ugucucggagggauuccccua

SEQ ID NO: 1123507 - RNA, 17 nt, Homo sapiens
ugugaaacaguugcugu

SEQ ID NO: 1123508 - RNA, 12 nt, Homo sapiens
ugugacuauaaa

SEQ ID NO: 1123509 - RNA, 11 nt, Homo sapiens
ugugcacauuu

SEQ ID NO: 1123510 - RNA, 23 nt, Homo sapiens
ugugcacgcgcgcgugcacacac

SEQ ID NO: 1123511 - RNA, 18 nt, Homo sapiens
ugugcucagagaccccuc

SEQ ID NO: 1123512 - RNA, 18 nt, Homo sapiens
uguggggugggcacauug

SEQ ID NO: 1123513 - RNA, 17 nt, Homo sapiens
uguguggggugggcaca

SEQ ID NO: 1123514 - RNA, 13 nt, Homo sapiens
uguguguacucug

SEQ ID NO: 1123515 - RNA, 16 nt, Homo sapiens
uguucuggaagccaua

SEQ ID NO: 1123516 - RNA, 20 nt, Homo sapiens
uguuuuuguucaaagccagc

SEQ ID NO: 1123517 - RNA, 13 nt, Homo sapiens
uuaaaaaacugca

SEQ ID NO: 1123518 - RNA, 16 nt, Homo sapiens
uuaaaauaaugaacac

SEQ ID NO: 1123519 - RNA, 22 nt, Homo sapiens
uuaaaauaaugaacacuacaga

SEQ ID NO: 1123520 - RNA, 13 nt, Homo sapiens
uuaaaaucuguca

SEQ ID NO: 1123521 - RNA, 19 nt, Homo sapiens
uuaaacgauuagugauguc

SEQ ID NO: 1123522 - RNA, 21 nt, Homo sapiens
uuaaauaaagucucucugacu

SEQ ID NO: 1123523 - RNA, 17 nt, Homo sapiens
uuaauuacaacugcuau

SEQ ID NO: 1123524 - RNA, 12 nt, Homo sapiens
uuacacugcgga

SEQ ID NO: 1123525 - RNA, 23 nt, Homo sapiens
uuacaguaggagcccagcucuga

SEQ ID NO: 1123526 - RNA, 22 nt, Homo sapiens
uuaccugaaauaaaauucauua

SEQ ID NO: 1123527 - RNA, 20 nt, Homo sapiens
uuagcuccauaaaguacaaa

SEQ ID NO: 1123528 - RNA, 15 nt, Homo sapiens
uuagugauggagcuu

SEQ ID NO: 1123529 - RNA, 21 nt, Homo sapiens
uuauagaauauuuauuaccuc

SEQ ID NO: 1123530 - RNA, 18 nt, Homo sapiens
uuaucaccgugggcuccc

SEQ ID NO: 1123531 - RNA, 15 nt, Homo sapiens
uuaucuugucucugg

SEQ ID NO: 1123532 - RNA, 16 nt, Homo sapiens
uuaucuuugcuguuau

SEQ ID NO: 1123533 - RNA, 13 nt, Homo sapiens
uuauuaaguaaaa

SEQ ID NO: 1123534 - RNA, 14 nt, Homo sapiens
uuauuguaccucuc

SEQ ID NO: 1123535 - RNA, 13 nt, Homo sapiens
uucaccuguauau

SEQ ID NO: 1123536 - RNA, 19 nt, Homo sapiens
uucagaaaucaaacugcuu

SEQ ID NO: 1123537 - RNA, 20 nt, Homo sapiens
uucagguuagugacauuuaa

SEQ ID NO: 1123538 - RNA, 16 nt, Homo sapiens
uucauaaguauuucaa

SEQ ID NO: 1123539 - RNA, 22 nt, Homo sapiens
uucaugaauaaaaacuuugcag

SEQ ID NO: 1123540 - RNA, 10 nt, Homo sapiens
uuccacugag

SEQ ID NO: 1123541 - RNA, 17 nt, Homo sapiens
uuccaggcugagccaug

SEQ ID NO: 1123542 - RNA, 23 nt, Homo sapiens
uuccauugaagccgacucuggcc

SEQ ID NO: 1123543 - RNA, 16 nt, Homo sapiens
uuccauuugcaaggga

SEQ ID NO: 1123544 - RNA, 17 nt, Homo sapiens
uucccacaggacauuuc

SEQ ID NO: 1123545 - RNA, 17 nt, Homo sapiens
uucccuucccagaccag

SEQ ID NO: 1123546 - RNA, 21 nt, Homo sapiens
uuccugggcaagaaccuaaag

SEQ ID NO: 1123547 - RNA, 21 nt, Homo sapiens
uuccuucaugaucaucacaau

SEQ ID NO: 1123548 - RNA, 22 nt, Homo sapiens
uucucccaccaccucaccaguu

SEQ ID NO: 1123549 - RNA, 13 nt, Homo sapiens
uucuccuccaugg

SEQ ID NO: 1123550 - RNA, 22 nt, Homo sapiens
uucuuauaccacguuccacgga

SEQ ID NO: 1123551 - RNA, 22 nt, Homo sapiens
uucuuguuugucagcaucugac

SEQ ID NO: 1123552 - RNA, 19 nt, Homo sapiens
uucuuuaggggaaguaaaa

SEQ ID NO: 1123553 - RNA, 21 nt, Homo sapiens
uugacaguuuuugacauuuau

SEQ ID NO: 1123554 - RNA, 21 nt, Homo sapiens
uugacauaggcaauaauaagu

SEQ ID NO: 1123555 - RNA, 22 nt, Homo sapiens
cuaccuugguucccccacugau

SEQ ID NO: 1123556 - RNA, 19 nt, Homo sapiens
cuagagccugugcuaaaga

SEQ ID NO: 1123557 - RNA, 13 nt, Homo sapiens
cuagccugugcac

SEQ ID NO: 1123558 - RNA, 21 nt, Homo sapiens
cuaggccucuccaguuugcac

SEQ ID NO: 1123559 - RNA, 14 nt, Homo sapiens
cuaggcuaccucaa

SEQ ID NO: 1123560 - RNA, 20 nt, Homo sapiens
cuaggcuaccucaagacuca

SEQ ID NO: 1123561 - RNA, 17 nt, Homo sapiens
cuauaccuuauccauag

SEQ ID NO: 1123562 - RNA, 14 nt, Homo sapiens
cuaugcugugcucc

SEQ ID NO: 1123563 - RNA, 14 nt, Homo sapiens
cuauugucuguaau

SEQ ID NO: 1123564 - RNA, 16 nt, Homo sapiens
cucaagacucaccuca

SEQ ID NO: 1123565 - RNA, 20 nt, Homo sapiens
cucaauccauccauguacuu

SEQ ID NO: 1123566 - RNA, 20 nt, Homo sapiens
cucagcuccagaauaccuuc

SEQ ID NO: 1123567 - RNA, 15 nt, Homo sapiens
cucaguaaaaguaaa

SEQ ID NO: 1123568 - RNA, 13 nt, Homo sapiens
cucagugggacaa

SEQ ID NO: 1123569 - RNA, 20 nt, Homo sapiens
cucauccucuuuuaauggca

SEQ ID NO: 1123570 - RNA, 17 nt, Homo sapiens
cucauccuuaccgcaca

SEQ ID NO: 1123571 - RNA, 15 nt, Homo sapiens
cuccagcacucccuc

SEQ ID NO: 1123572 - RNA, 15 nt, Homo sapiens
cuccauacguucaga

SEQ ID NO: 1123573 - RNA, 21 nt, Homo sapiens
cuccauguagaagccacuauu

SEQ ID NO: 1123574 - RNA, 17 nt, Homo sapiens
cucccagauaaugugaa

SEQ ID NO: 1123575 - RNA, 15 nt, Homo sapiens
cucccagcagcucaa

SEQ ID NO: 1123576 - RNA, 20 nt, Homo sapiens
cucccaggcccgagauguga

SEQ ID NO: 1123577 - RNA, 13 nt, Homo sapiens
cuccgcaacagcc

SEQ ID NO: 1123578 - RNA, 15 nt, Homo sapiens
cuccgcaacagccaa

SEQ ID NO: 1123579 - RNA, 22 nt, Homo sapiens
cuccucuuucaaccucagugau

SEQ ID NO: 1123580 - RNA, 14 nt, Homo sapiens
cuccugaagccaca

SEQ ID NO: 1123581 - RNA, 20 nt, Homo sapiens
cucgggaagccccauccaac

SEQ ID NO: 1123582 - RNA, 15 nt, Homo sapiens
cucuaaauagcacuu

SEQ ID NO: 1123583 - RNA, 14 nt, Homo sapiens
cucuagugggacag

SEQ ID NO: 1123584 - RNA, 13 nt, Homo sapiens
cucuauuaucuca

SEQ ID NO: 1123585 - RNA, 17 nt, Homo sapiens
cucucacuauaccagua

SEQ ID NO: 1123586 - RNA, 21 nt, Homo sapiens
cucucagucucugagcaguga

SEQ ID NO: 1123587 - RNA, 18 nt, Homo sapiens
cucucugguuuacuucaa

SEQ ID NO: 1123588 - RNA, 15 nt, Homo sapiens
cucugaaaccagugu

SEQ ID NO: 1123589 - RNA, 15 nt, Homo sapiens
cucugagcugugcag

SEQ ID NO: 1123590 - RNA, 18 nt, Homo sapiens
cucugcuuugucaugcca

SEQ ID NO: 1123591 - RNA, 10 nt, Homo sapiens
cucuguccag

SEQ ID NO: 1123592 - RNA, 13 nt, Homo sapiens
cucuuggaugcag

SEQ ID NO: 1123593 - RNA, 16 nt, Homo sapiens
cugaaaaagauggaau

SEQ ID NO: 1123594 - RNA, 19 nt, Homo sapiens
cugaaggagccccauuccu

SEQ ID NO: 1123595 - RNA, 13 nt, Homo sapiens
cugaauaauauca

SEQ ID NO: 1123596 - RNA, 16 nt, Homo sapiens
cugaccaucugugacu

SEQ ID NO: 1123597 - RNA, 13 nt, Homo sapiens
cugagcugugcag

SEQ ID NO: 1123598 - RNA, 22 nt, Homo sapiens
cugaggcaagagaauugcuuga

SEQ ID NO: 1123599 - RNA, 19 nt, Homo sapiens
cugaguuuuguuucacuuu

SEQ ID NO: 1123600 - RNA, 21 nt, Homo sapiens
cugaguuuuguuucacuuuga

SEQ ID NO: 1123601 - RNA, 15 nt, Homo sapiens
cugaugauacaugca

SEQ ID NO: 1123602 - RNA, 13 nt, Homo sapiens
cugcagcaaacac

SEQ ID NO: 1123603 - RNA, 22 nt, Homo sapiens
cugcauuuauagcauacgguau

SEQ ID NO: 1123604 - RNA, 14 nt, Homo sapiens
cugcuccacugggu

SEQ ID NO: 1123605 - RNA, 21 nt, Homo sapiens
cugcucuagugggacagccca

SEQ ID NO: 1123606 - RNA, 14 nt, Homo sapiens
cuggaaaagggaag

SEQ ID NO: 1123607 - RNA, 22 nt, Homo sapiens
cuggagaaaagggauggagcug

SEQ ID NO: 1123608 - RNA, 19 nt, Homo sapiens
cugggacugugcucagaga

SEQ ID NO: 1123609 - RNA, 14 nt, Homo sapiens
cugggcuucauucc

SEQ ID NO: 1123610 - RNA, 16 nt, Homo sapiens
cuggucuucacugcca

SEQ ID NO: 1123611 - RNA, 12 nt, Homo sapiens
cugguucuaacu

SEQ ID NO: 1123612 - RNA, 14 nt, Homo sapiens
cugguuuacuucaa

SEQ ID NO: 1123613 - RNA, 16 nt, Homo sapiens
cuguaccugugcacgu

SEQ ID NO: 1123614 - RNA, 20 nt, Homo sapiens
cugucugaccuuccaaagac

SEQ ID NO: 1123615 - RNA, 22 nt, Homo sapiens
cugugcagguggggagacuggg

SEQ ID NO: 1123616 - RNA, 15 nt, Homo sapiens
cugugcaguaagccu

SEQ ID NO: 1123617 - RNA, 17 nt, Homo sapiens
cugugcaguaagccugu

SEQ ID NO: 1123618 - RNA, 22 nt, Homo sapiens
cugugcugaacauaacuucuca

SEQ ID NO: 1123619 - RNA, 23 nt, Homo sapiens
cuguggugugucccccucugucc

SEQ ID NO: 1123620 - RNA, 19 nt, Homo sapiens
cuguuacugaaauugguau

SEQ ID NO: 1123621 - RNA, 15 nt, Homo sapiens
cuguuauucuuguua

SEQ ID NO: 1123622 - RNA, 14 nt, Homo sapiens
cuguuauugacagc

SEQ ID NO: 1123623 - RNA, 20 nt, Homo sapiens
cuuauaagacucacaguaua

SEQ ID NO: 1123624 - RNA, 18 nt, Homo sapiens
cuuauauucauccaugcc

SEQ ID NO: 1123625 - RNA, 23 nt, Homo sapiens
cuuauccauaggcgcaggugcac

SEQ ID NO: 1123626 - RNA, 22 nt, Homo sapiens
cuucaacaaccggccaccagau

SEQ ID NO: 1123627 - RNA, 10 nt, Homo sapiens
cuucacugac

SEQ ID NO: 1123628 - RNA, 14 nt, Homo sapiens
cuucauacuuugaa

SEQ ID NO: 1123629 - RNA, 19 nt, Homo sapiens
cuucauuuuguauaaucac

SEQ ID NO: 1123630 - RNA, 14 nt, Homo sapiens
cuuccacugagggc

SEQ ID NO: 1123631 - RNA, 13 nt, Homo sapiens
cuucugcuucuca

SEQ ID NO: 1123632 - RNA, 21 nt, Homo sapiens
cuugagaaaccuuauuguacc

SEQ ID NO: 1123633 - RNA, 18 nt, Homo sapiens
cuugaggaaaacaagcau

SEQ ID NO: 1123634 - RNA, 19 nt, Homo sapiens
cuugcagagcaugaccuga

SEQ ID NO: 1123635 - RNA, 13 nt, Homo sapiens
cuugggcucccug

SEQ ID NO: 1123636 - RNA, 20 nt, Homo sapiens
cuugucccucucacucccca

SEQ ID NO: 1123637 - RNA, 17 nt, Homo sapiens
cuuguuugucagcaucu

SEQ ID NO: 1123638 - RNA, 20 nt, Homo sapiens
cuuguuugucagcaucugac

SEQ ID NO: 1123639 - RNA, 21 nt, Homo sapiens
cuuugagucaauagcuugucu

SEQ ID NO: 1123640 - RNA, 16 nt, Homo sapiens
cuuugagugacugggu

SEQ ID NO: 1123641 - RNA, 14 nt, Homo sapiens
cuuugucaguguug

SEQ ID NO: 1123642 - RNA, 16 nt, Homo sapiens
cuuuguuuugcacuga

SEQ ID NO: 1123643 - RNA, 13 nt, Homo sapiens
gaaaaaauggaug

SEQ ID NO: 1123644 - RNA, 14 nt, Homo sapiens
gaaaacacugugca

SEQ ID NO: 1123645 - RNA, 19 nt, Homo sapiens
gaaaacacugugcacaucu

SEQ ID NO: 1123646 - RNA, 14 nt, Homo sapiens
gaaaaccacuuuau

SEQ ID NO: 1123647 - RNA, 21 nt, Homo sapiens
gaaaaccacuuuauugcaaug

SEQ ID NO: 1123648 - RNA, 16 nt, Homo sapiens
gaaaagggauggagcu

SEQ ID NO: 1123649 - RNA, 13 nt, Homo sapiens
gaaacaacucuuu

SEQ ID NO: 1123650 - RNA, 20 nt, Homo sapiens
gaaaccaguuaagaauggaa

SEQ ID NO: 1123651 - RNA, 20 nt, Homo sapiens
gaaacccauuaggcaugccu

SEQ ID NO: 1123652 - RNA, 20 nt, Homo sapiens
gaaaccuuauuguaccucuc

SEQ ID NO: 1123653 - RNA, 17 nt, Homo sapiens
gaaagcuggacugacca

SEQ ID NO: 1123654 - RNA, 18 nt, Homo sapiens
gaaagcuggacugaccaa

SEQ ID NO: 1123655 - RNA, 22 nt, Homo sapiens
gaaagcuguggccagcuuguua

SEQ ID NO: 1123656 - RNA, 11 nt, Homo sapiens
gaaaugaacuu

SEQ ID NO: 1123657 - RNA, 21 nt, Homo sapiens
gaaauuacuggaaggcuucca

SEQ ID NO: 1123658 - RNA, 21 nt, Homo sapiens
gaacaccuuuguuuugcacug

SEQ ID NO: 1123659 - RNA, 22 nt, Homo sapiens
gaacgcacuuuauaaaagcaaa

SEQ ID NO: 1123660 - RNA, 19 nt, Homo sapiens
gaacucagcugaggccuug

SEQ ID NO: 1123661 - RNA, 20 nt, Homo sapiens
gaagaaguuuaaaaaaccau

SEQ ID NO: 1123662 - RNA, 21 nt, Homo sapiens
gaagaaguuuaaaaaaccaug

SEQ ID NO: 1123663 - RNA, 21 nt, Homo sapiens
gaagaauugauguaugccucu

SEQ ID NO: 1123664 - RNA, 21 nt, Homo sapiens
gaagaucaacgccucacugaa

SEQ ID NO: 1123665 - RNA, 20 nt, Homo sapiens
agauuuugucgggacagaga

SEQ ID NO: 1123666 - RNA, 17 nt, Homo sapiens
agcaaaaugcuucugca

SEQ ID NO: 1123667 - RNA, 20 nt, Homo sapiens
agcaaugcaagcagccuagc

SEQ ID NO: 1123668 - RNA, 15 nt, Homo sapiens
agcacuuugccaugc

SEQ ID NO: 1123669 - RNA, 15 nt, Homo sapiens
agcagugaaguauaa

SEQ ID NO: 1123670 - RNA, 20 nt, Homo sapiens
agcaguuaguuccuucauga

SEQ ID NO: 1123671 - RNA, 14 nt, Homo sapiens
auuuauuaccucug

SEQ ID NO: 1123672 - RNA, 17 nt, Homo sapiens
auuuauuaccucugaua

SEQ ID NO: 1123673 - RNA, 21 nt, Homo sapiens
auuuuaaugaagaaaguggaa

SEQ ID NO: 1123674 - RNA, 22 nt, Homo sapiens
auuuucccccacuacugcagca

SEQ ID NO: 1123675 - RNA, 14 nt, Homo sapiens
caaaaccuguauua

SEQ ID NO: 1123676 - RNA, 17 nt, Homo sapiens
caaaaugcuucugcaca

SEQ ID NO: 1123677 - RNA, 19 nt, Homo sapiens
caaaaugcuucugcacaca

SEQ ID NO: 1123678 - RNA, 18 nt, Homo sapiens
caaagcccauagcacugg

SEQ ID NO: 1123679 - RNA, 14 nt, Homo sapiens
caaaguacucuuua

SEQ ID NO: 1123680 - RNA, 17 nt, Homo sapiens
caaauaauuugaacuuu

SEQ ID NO: 1123681 - RNA, 17 nt, Homo sapiens
caaccaggccuucaucc

SEQ ID NO: 1123682 - RNA, 20 nt, Homo sapiens
caaccucgcuggacucucag

SEQ ID NO: 1123683 - RNA, 20 nt, Homo sapiens
caaccugggauguagcggug

SEQ ID NO: 1123684 - RNA, 14 nt, Homo sapiens
caacgaguacuuca

SEQ ID NO: 1123685 - RNA, 18 nt, Homo sapiens
caacgccucacugaaaca

SEQ ID NO: 1123686 - RNA, 12 nt, Homo sapiens
caagaaacagaa

SEQ ID NO: 1123687 - RNA, 16 nt, Homo sapiens
caagacuauaccuuau

SEQ ID NO: 1123688 - RNA, 17 nt, Homo sapiens
caagacuauaccuuauc

SEQ ID NO: 1123689 - RNA, 23 nt, Homo sapiens
caagcaguuaguuccuucaugau

SEQ ID NO: 1123690 - RNA, 18 nt, Homo sapiens
caagcuguaucacugccu

SEQ ID NO: 1123691 - RNA, 16 nt, Homo sapiens
caagcuugaggccaag

SEQ ID NO: 1123692 - RNA, 14 nt, Homo sapiens
caagggaaaggcaa

SEQ ID NO: 1123693 - RNA, 21 nt, Homo sapiens
caagggaauucggugugcacc

SEQ ID NO: 1123694 - RNA, 21 nt, Homo sapiens
caaguauguuuguacaguaug

SEQ ID NO: 1123695 - RNA, 12 nt, Homo sapiens
caauaugcauuu

SEQ ID NO: 1123696 - RNA, 19 nt, Homo sapiens
caaucaucaucauucucau

SEQ ID NO: 1123697 - RNA, 16 nt, Homo sapiens
caauccagcuauguua

SEQ ID NO: 1123698 - RNA, 13 nt, Homo sapiens
caauccuauguuu

SEQ ID NO: 1123699 - RNA, 22 nt, Homo sapiens
caaucucccgugggcaucucaa

SEQ ID NO: 1123700 - RNA, 15 nt, Homo sapiens
caaucuguccacaaa

SEQ ID NO: 1123701 - RNA, 14 nt, Homo sapiens
caaugugaguccca

SEQ ID NO: 1123702 - RNA, 14 nt, Homo sapiens
caauuaacugcccu

SEQ ID NO: 1123703 - RNA, 15 nt, Homo sapiens
caauuagacuugaaa

SEQ ID NO: 1123704 - RNA, 15 nt, Homo sapiens
caauuaguggucaua

SEQ ID NO: 1123705 - RNA, 18 nt, Homo sapiens
cacaaaauaaccaauccu

SEQ ID NO: 1123706 - RNA, 19 nt, Homo sapiens
cacaaagaagaaguuuaaa

SEQ ID NO: 1123707 - RNA, 20 nt, Homo sapiens
cacaaagcccauagcacugg

SEQ ID NO: 1123708 - RNA, 14 nt, Homo sapiens
cacacauguuuaca

SEQ ID NO: 1123709 - RNA, 17 nt, Homo sapiens
cacagaagguccuggug

SEQ ID NO: 1123710 - RNA, 23 nt, Homo sapiens
cacagcccucaugaucauucuca

SEQ ID NO: 1123711 - RNA, 15 nt, Homo sapiens
cacaguuguguuccu

SEQ ID NO: 1123712 - RNA, 16 nt, Homo sapiens
cacaucuaaccucauc

SEQ ID NO: 1123713 - RNA, 15 nt, Homo sapiens
cacauggacacagac

SEQ ID NO: 1123714 - RNA, 17 nt, Homo sapiens
cacaugucaguaccuuc

SEQ ID NO: 1123715 - RNA, 23 nt, Homo sapiens
cacauucuucaguuuuucacuuc

SEQ ID NO: 1123716 - RNA, 13 nt, Homo sapiens
caccucauccuua

SEQ ID NO: 1123717 - RNA, 13 nt, Homo sapiens
caccugagcauga

SEQ ID NO: 1123718 - RNA, 14 nt, Homo sapiens
caccuguaauccca

SEQ ID NO: 1123719 - RNA, 16 nt, Homo sapiens
cacuaacaaacucuga

SEQ ID NO: 1123720 - RNA, 12 nt, Homo sapiens
cacuagccugug

SEQ ID NO: 1123721 - RNA, 13 nt, Homo sapiens
cacucaauccauc

SEQ ID NO: 1123722 - RNA, 13 nt, Homo sapiens
cacucagcugucc

SEQ ID NO: 1123723 - RNA, 21 nt, Homo sapiens
cacugagcccuucccaggcug

SEQ ID NO: 1123724 - RNA, 15 nt, Homo sapiens
cacugauaaaaccau

SEQ ID NO: 1123725 - RNA, 16 nt, Homo sapiens
cacugcggaagccaaa

SEQ ID NO: 1123726 - RNA, 21 nt, Homo sapiens
cacugcggaagccaaaggcag

SEQ ID NO: 1123727 - RNA, 19 nt, Homo sapiens
cacugggcucugauggcug

SEQ ID NO: 1123728 - RNA, 17 nt, Homo sapiens
cacuucuaccuacauau

SEQ ID NO: 1123729 - RNA, 18 nt, Homo sapiens
cagaacuguuguuuacuu

SEQ ID NO: 1123730 - RNA, 15 nt, Homo sapiens
cagagcccaagggaa

SEQ ID NO: 1123731 - RNA, 14 nt, Homo sapiens
cagaggugcagcug

SEQ ID NO: 1123732 - RNA, 16 nt, Homo sapiens
cagaggugcagcugga

SEQ ID NO: 1123733 - RNA, 22 nt, Homo sapiens
cagagugagacccagcccucau

SEQ ID NO: 1123734 - RNA, 13 nt, Homo sapiens
cagauaaugugaa

SEQ ID NO: 1123735 - RNA, 15 nt, Homo sapiens
cagauguaaaugcca

SEQ ID NO: 1123736 - RNA, 16 nt, Homo sapiens
cagauuggccaauuaa

SEQ ID NO: 1123737 - RNA, 12 nt, Homo sapiens
cagcaucugacc

SEQ ID NO: 1123738 - RNA, 14 nt, Homo sapiens
cagcaucugaccau

SEQ ID NO: 1123739 - RNA, 14 nt, Homo sapiens
cagcccaugugcac

SEQ ID NO: 1123740 - RNA, 15 nt, Homo sapiens
cagcccaugugcacc

SEQ ID NO: 1123741 - RNA, 20 nt, Homo sapiens
cagcccaugugcaccugccc

SEQ ID NO: 1123742 - RNA, 19 nt, Homo sapiens
cagccugggugacagagca

SEQ ID NO: 1123743 - RNA, 21 nt, Homo sapiens
cagccuggucaacauggugaa

SEQ ID NO: 1123744 - RNA, 18 nt, Homo sapiens
cagccuucuucucuuaau

SEQ ID NO: 1123745 - RNA, 20 nt, Homo sapiens
cagcguggguguugaaucca

SEQ ID NO: 1123746 - RNA, 19 nt, Homo sapiens
cagcucgggcccucuguga

SEQ ID NO: 1123747 - RNA, 20 nt, Homo sapiens
cagcugaggccuugccuuga

SEQ ID NO: 1123748 - RNA, 14 nt, Homo sapiens
cagcuuuugccuuu

SEQ ID NO: 1123749 - RNA, 15 nt, Homo sapiens
caggaguaagacaag

SEQ ID NO: 1123750 - RNA, 20 nt, Homo sapiens
cagggggcccgaacagggac

SEQ ID NO: 1123751 - RNA, 20 nt, Homo sapiens
caggggugcuaugacaugca

SEQ ID NO: 1123752 - RNA, 17 nt, Homo sapiens
caggguggaugaucuca

SEQ ID NO: 1123753 - RNA, 15 nt, Homo sapiens
caggucuagacuuuc

SEQ ID NO: 1123754 - RNA, 15 nt, Homo sapiens
caguaauggaaugaa

SEQ ID NO: 1123755 - RNA, 19 nt, Homo sapiens
caguaggggcuacugugac

SEQ ID NO: 1123756 - RNA, 13 nt, Homo sapiens
cagucaaccuggg

SEQ ID NO: 1123757 - RNA, 14 nt, Homo sapiens
cagucaccuaucca

SEQ ID NO: 1123758 - RNA, 14 nt, Homo sapiens
cagucuuccauuug

SEQ ID NO: 1123759 - RNA, 17 nt, Homo sapiens
caguuguguuccugaca

SEQ ID NO: 1123760 - RNA, 15 nt, Homo sapiens
caguuugcaccuguc

SEQ ID NO: 1123761 - RNA, 21 nt, Homo sapiens
caguuuucggaaacacugacu

SEQ ID NO: 1123762 - RNA, 12 nt, Homo sapiens
cauaaagaucaa

SEQ ID NO: 1123763 - RNA, 12 nt, Homo sapiens
cauaaagcauuu

SEQ ID NO: 1123764 - RNA, 22 nt, Homo sapiens
cauaaauuagaggucuccaaaa

SEQ ID NO: 1123765 - RNA, 15 nt, Homo sapiens
cauaacuucucaugu

SEQ ID NO: 1123766 - RNA, 17 nt, Homo sapiens
cauaggcgcaggugcac

SEQ ID NO: 1123767 - RNA, 18 nt, Homo sapiens
cauaggcgcaggugcaca

SEQ ID NO: 1123768 - RNA, 19 nt, Homo sapiens
cauaguguuaacugucagu

SEQ ID NO: 1123769 - RNA, 13 nt, Homo sapiens
cauauuugccuug

SEQ ID NO: 1123770 - RNA, 13 nt, Homo sapiens
caucagggcccag

SEQ ID NO: 1123771 - RNA, 19 nt, Homo sapiens
caucaucuccugccuuccu

SEQ ID NO: 1123772 - RNA, 15 nt, Homo sapiens
cauccaacacuggau

SEQ ID NO: 1123773 - RNA, 17 nt, Homo sapiens
caucucaagccccaaau

SEQ ID NO: 1123774 - RNA, 17 nt, Homo sapiens
caucugaccaucuguga

SEQ ID NO: 1123775 - RNA, 18 nt, Homo sapiens
caucugaccaucugugac

SEQ ID NO: 1123776 - RNA, 16 nt, Homo sapiens
caugcauaaaugcgau

SEQ ID NO: 1123777 - RNA, 13 nt, Homo sapiens
caugccugaugaa

SEQ ID NO: 1123778 - RNA, 21 nt, Homo sapiens
cauggcagaaggcaaacccau

SEQ ID NO: 1123779 - RNA, 19 nt, Homo sapiens
caugugaccgaacacugca

SEQ ID NO: 1123780 - RNA, 17 nt, Homo sapiens
cauguucccaaaacaau

SEQ ID NO: 1123781 - RNA, 13 nt, Homo sapiens
ccuuuuucauaau

SEQ ID NO: 1123782 - RNA, 13 nt, Homo sapiens
cgaacagggacuu

SEQ ID NO: 1123783 - RNA, 13 nt, Homo sapiens
cgcacacauggac

SEQ ID NO: 1123784 - RNA, 18 nt, Homo sapiens
cgccucacugaaacaugg

SEQ ID NO: 1123785 - RNA, 22 nt, Homo sapiens
cgcugcagcuguguguccuucu

SEQ ID NO: 1123786 - RNA, 22 nt, Homo sapiens
cggccuggggcgagcacuguga

SEQ ID NO: 1123787 - RNA, 20 nt, Homo sapiens
cgucucuacuaaaaauacaa

SEQ ID NO: 1123788 - RNA, 23 nt, Homo sapiens
cgugcaguaggggcuacugugac

SEQ ID NO: 1123789 - RNA, 18 nt, Homo sapiens
cguucagaggugcagcug

SEQ ID NO: 1123790 - RNA, 13 nt, Homo sapiens
cuaaaaguucuca

SEQ ID NO: 1123791 - RNA, 17 nt, Homo sapiens
cuaaaaguucucaaugu

SEQ ID NO: 1123792 - RNA, 19 nt, Homo sapiens
cuaaaaguucucaauguag

SEQ ID NO: 1123793 - RNA, 20 nt, Homo sapiens
cuaaaauuauguuacuguau

SEQ ID NO: 1123794 - RNA, 17 nt, Homo sapiens
cuaaauaaaaauaugua

SEQ ID NO: 1123795 - RNA, 13 nt, Homo sapiens
cuaaauagcacuu

SEQ ID NO: 1123796 - RNA, 17 nt, Homo sapiens
cuaaccagccuggucaa

SEQ ID NO: 1123797 - RNA, 23 nt, Homo sapiens
cuaaccuucacgauuaacuguga

SEQ ID NO: 1123798 - RNA, 13 nt, Homo sapiens
cuaacugcuguua

SEQ ID NO: 1123799 - RNA, 15 nt, Homo sapiens
cuaagcagaccacug

SEQ ID NO: 1123800 - RNA, 17 nt, Homo sapiens
cuaauagaacuuguuaa

SEQ ID NO: 1123801 - RNA, 20 nt, Homo sapiens
cuaaugugaaaauguauucu

SEQ ID NO: 1123802 - RNA, 16 nt, Homo sapiens
cuaauuguaagugaaa

SEQ ID NO: 1123803 - RNA, 13 nt, Homo sapiens
cuacaaaauggag

SEQ ID NO: 1123804 - RNA, 16 nt, Homo sapiens
cuaccucaagacucac

SEQ ID NO: 1123805 - RNA, 17 nt, Homo sapiens
cuagacuccucaggaga

SEQ ID NO: 1123806 - RNA, 18 nt, Homo sapiens
cuagaggugagaccaaag

SEQ ID NO: 1123807 - RNA, 22 nt, Homo sapiens
cuaggaaacccaaggaacaaga

SEQ ID NO: 1123808 - RNA, 14 nt, Homo sapiens
cuagggaucccuca

SEQ ID NO: 1123809 - RNA, 15 nt, Homo sapiens
cuagggaucccucau

SEQ ID NO: 1123810 - RNA, 13 nt, Homo sapiens
cuauauagacuug

SEQ ID NO: 1123811 - RNA, 20 nt, Homo sapiens
cuauauucuggugaguuaau

SEQ ID NO: 1123812 - RNA, 15 nt, Homo sapiens
cuaugaaccugaaaa

SEQ ID NO: 1123813 - RNA, 22 nt, Homo sapiens
cuauguuuuuguucaaagccag

SEQ ID NO: 1123814 - RNA, 15 nt, Homo sapiens
cuauugucuguaaua

SEQ ID NO: 1123815 - RNA, 11 nt, Homo sapiens
cucaagggaaa

SEQ ID NO: 1123816 - RNA, 23 nt, Homo sapiens
cucacgcagacacacccacagaa

SEQ ID NO: 1123817 - RNA, 22 nt, Homo sapiens
cucacucugggcuguaacgugg

SEQ ID NO: 1123818 - RNA, 19 nt, Homo sapiens
cucagcuguccugcagcaa

SEQ ID NO: 1123819 - RNA, 17 nt, Homo sapiens
cucaucccgagcaccuc

SEQ ID NO: 1123820 - RNA, 20 nt, Homo sapiens
cucccacccacagccauaga

SEQ ID NO: 1123821 - RNA, 16 nt, Homo sapiens
cuccgcaacagccaag

SEQ ID NO: 1123822 - RNA, 15 nt, Homo sapiens
cuccugaagccacag

SEQ ID NO: 1123823 - RNA, 14 nt, Homo sapiens
uuccucuuacugua

SEQ ID NO: 1123824 - RNA, 13 nt, Homo sapiens
uuccugacacuca

SEQ ID NO: 1123825 - RNA, 16 nt, Homo sapiens
uucuaaauaugaauga

SEQ ID NO: 1123826 - RNA, 15 nt, Homo sapiens
uucuaugcauuaaga

SEQ ID NO: 1123827 - RNA, 20 nt, Homo sapiens
uucucauuucuguagccuga

SEQ ID NO: 1123828 - RNA, 19 nt, Homo sapiens
uucuccgcaacagccaagu

SEQ ID NO: 1123829 - RNA, 23 nt, Homo sapiens
uucucugggcugaauguauguca

SEQ ID NO: 1123830 - RNA, 15 nt, Homo sapiens
uucuguacucaaaug

SEQ ID NO: 1123831 - RNA, 13 nt, Homo sapiens
uucuuuuauguga

SEQ ID NO: 1123832 - RNA, 19 nt, Homo sapiens
uugaaaaaugagagcugua

SEQ ID NO: 1123833 - RNA, 17 nt, Homo sapiens
uugaaaugaacuuuguc

SEQ ID NO: 1123834 - RNA, 13 nt, Homo sapiens
uugaaguguuccc

SEQ ID NO: 1123835 - RNA, 13 nt, Homo sapiens
uugaaucuaugaa

SEQ ID NO: 1123836 - RNA, 18 nt, Homo sapiens
uugacaaaugacagaucu

SEQ ID NO: 1123837 - RNA, 13 nt, Homo sapiens
uugcaaggcauuu

SEQ ID NO: 1123838 - RNA, 20 nt, Homo sapiens
uugcagcuuauauucaucca

SEQ ID NO: 1123839 - RNA, 15 nt, Homo sapiens
uugcuauagagccua

SEQ ID NO: 1123840 - RNA, 21 nt, Homo sapiens
uugcugauaccauaugaauga

SEQ ID NO: 1123841 - RNA, 16 nt, Homo sapiens
uuggaugcagcuucaa

SEQ ID NO: 1123842 - RNA, 15 nt, Homo sapiens
uugucagcaucugac

SEQ ID NO: 1123843 - RNA, 12 nt, Homo sapiens
uugugauugccu

SEQ ID NO: 1123844 - RNA, 16 nt, Homo sapiens
uugugcuccaaacaaa

SEQ ID NO: 1123845 - RNA, 18 nt, Homo sapiens
uuguguuguuguugcugc

SEQ ID NO: 1123846 - RNA, 23 nt, Homo sapiens
uuguuggucuguguaacauccaa

SEQ ID NO: 1123847 - RNA, 22 nt, Homo sapiens
uuuaaagccuucuggauccaug

SEQ ID NO: 1123848 - RNA, 22 nt, Homo sapiens
uuuaaaucaacgaguacuucaa

SEQ ID NO: 1123849 - RNA, 21 nt, Homo sapiens
uuuaguaauauuuuacuuuga

SEQ ID NO: 1123850 - RNA, 17 nt, Homo sapiens
uuuaguaguuacuaaaa

SEQ ID NO: 1123851 - RNA, 19 nt, Homo sapiens
ucaccagagcuucucuggg

SEQ ID NO: 1123852 - RNA, 22 nt, Homo sapiens
ucacugugcuaucggcagauga

SEQ ID NO: 1123853 - RNA, 23 nt, Homo sapiens
ucagaaaaccacuuuauugcaau

SEQ ID NO: 1123854 - RNA, 20 nt, Homo sapiens
ucagaauaaauuauugcugu

SEQ ID NO: 1123855 - RNA, 18 nt, Homo sapiens
ucagaggugcagcuggag

SEQ ID NO: 1123856 - RNA, 18 nt, Homo sapiens
ucagauaccgacuggggc

SEQ ID NO: 1123857 - RNA, 16 nt, Homo sapiens
ucagcagugaaguaua

SEQ ID NO: 1123858 - RNA, 15 nt, Homo sapiens
ucagcaucugaccau

SEQ ID NO: 1123859 - RNA, 21 nt, Homo sapiens
ucagcaucugaccaucuguga

SEQ ID NO: 1123860 - RNA, 22 nt, Homo sapiens
ucagcaucugaccaucugugac

SEQ ID NO: 1123861 - RNA, 19 nt, Homo sapiens
ucaguaaauagugucauau

SEQ ID NO: 1123862 - RNA, 16 nt, Homo sapiens
ucaguucucaaaugug

SEQ ID NO: 1123863 - RNA, 23 nt, Homo sapiens
ucaguugauuuuucuuauuuaca

SEQ ID NO: 1123864 - RNA, 16 nt, Homo sapiens
ucaguuugacuacucu

SEQ ID NO: 1123865 - RNA, 14 nt, Homo sapiens
ucauaaguagcauu

SEQ ID NO: 1123866 - RNA, 23 nt, Homo sapiens
ucauaauguggugauggcccuaa

SEQ ID NO: 1123867 - RNA, 23 nt, Homo sapiens
ucauaguaagugcgaagacugag

SEQ ID NO: 1123868 - RNA, 15 nt, Homo sapiens
ucauccuuaccgcac

SEQ ID NO: 1123869 - RNA, 16 nt, Homo sapiens
ucaucucggaguucca

SEQ ID NO: 1123870 - RNA, 20 nt, Homo sapiens
ucaugaauaaaaacuuugca

SEQ ID NO: 1123871 - RNA, 18 nt, Homo sapiens
ucaugaggccggaugaaa

SEQ ID NO: 1123872 - RNA, 21 nt, Homo sapiens
ucauucucugucucauccauc

SEQ ID NO: 1123873 - RNA, 18 nt, Homo sapiens
ucauuuucauauuguaau

SEQ ID NO: 1123874 - RNA, 12 nt, Homo sapiens
uccaaucagaac

SEQ ID NO: 1123875 - RNA, 12 nt, Homo sapiens
uccaccuuccau

SEQ ID NO: 1123876 - RNA, 16 nt, Homo sapiens
uccacgcacacaugga

SEQ ID NO: 1123877 - RNA, 19 nt, Homo sapiens
uccagcccaucuccgggga

SEQ ID NO: 1123878 - RNA, 17 nt, Homo sapiens
uccaggccccaccuccu

SEQ ID NO: 1123879 - RNA, 18 nt, Homo sapiens
uccaggguggaugaucuc

SEQ ID NO: 1123880 - RNA, 20 nt, Homo sapiens
uccaggguggaugaucucaa

SEQ ID NO: 1123881 - RNA, 15 nt, Homo sapiens
uccauaaaguacaaa

SEQ ID NO: 1123882 - RNA, 21 nt, Homo sapiens
uccauaggcgcaggugcacag

SEQ ID NO: 1123883 - RNA, 14 nt, Homo sapiens
uccauauuugccuu

SEQ ID NO: 1123884 - RNA, 13 nt, Homo sapiens
uccaucuguugac

SEQ ID NO: 1123885 - RNA, 15 nt, Homo sapiens
uccaucuguugacaa

SEQ ID NO: 1123886 - RNA, 21 nt, Homo sapiens
uccaugugaccgaacacugca

SEQ ID NO: 1123887 - RNA, 19 nt, Homo sapiens
uccauugguggacagccuu

SEQ ID NO: 1123888 - RNA, 14 nt, Homo sapiens
uccauuuggacaaa

SEQ ID NO: 1123889 - RNA, 17 nt, Homo sapiens
ucccacguucuguuaau

SEQ ID NO: 1123890 - RNA, 15 nt, Homo sapiens
ucccagcuacuuggg

SEQ ID NO: 1123891 - RNA, 16 nt, Homo sapiens
uccccaaccacuucau

SEQ ID NO: 1123892 - RNA, 15 nt, Homo sapiens
uccccuuccacugag

SEQ ID NO: 1123893 - RNA, 22 nt, Homo sapiens
uccccuuggcccaucugugcag

SEQ ID NO: 1123894 - RNA, 20 nt, Homo sapiens
ucccucccagagaacagggg

SEQ ID NO: 1123895 - RNA, 23 nt, Homo sapiens
uccggguggaaaagaaucccugc

SEQ ID NO: 1123896 - RNA, 13 nt, Homo sapiens
uccucugacucag

SEQ ID NO: 1123897 - RNA, 22 nt, Homo sapiens
uccugaaggaaaauaaacugac

SEQ ID NO: 1123898 - RNA, 22 nt, Homo sapiens
uccugcaaagucuccagaagaa

SEQ ID NO: 1123899 - RNA, 14 nt, Homo sapiens
uccuggcugggaac

SEQ ID NO: 1123900 - RNA, 14 nt, Homo sapiens
uccuguguucuaga

SEQ ID NO: 1123901 - RNA, 13 nt, Homo sapiens
uccuuaccgcaca

SEQ ID NO: 1123902 - RNA, 16 nt, Homo sapiens
uccuucccccaucccc

SEQ ID NO: 1123903 - RNA, 15 nt, Homo sapiens
ucgaacaauucauau

SEQ ID NO: 1123904 - RNA, 16 nt, Homo sapiens
ucuaaauaugaaugaa

SEQ ID NO: 1123905 - RNA, 15 nt, Homo sapiens
ucuaagaaagaaauu

SEQ ID NO: 1123906 - RNA, 20 nt, Homo sapiens
ucuaagagaacaaugugcua

SEQ ID NO: 1123907 - RNA, 14 nt, Homo sapiens
ucuaagucuuucca

SEQ ID NO: 1123908 - RNA, 17 nt, Homo sapiens
ucuaccugcccccauca

SEQ ID NO: 1123909 - RNA, 18 nt, Homo sapiens
ucuagauuauaaacugac

SEQ ID NO: 1123910 - RNA, 17 nt, Homo sapiens
ucuaggaaacccaagga

SEQ ID NO: 1123911 - RNA, 16 nt, Homo sapiens
ucuauuuaaauaaagu

SEQ ID NO: 1123912 - RNA, 11 nt, Homo sapiens
ucucaaucucc

SEQ ID NO: 1123913 - RNA, 14 nt, Homo sapiens
ucucaauguacaua

SEQ ID NO: 1123914 - RNA, 18 nt, Homo sapiens
ucucagcccugaccuucu

SEQ ID NO: 1123915 - RNA, 19 nt, Homo sapiens
ucucaggaccaaagcuuuc

SEQ ID NO: 1123916 - RNA, 13 nt, Homo sapiens
ucucauccaucau

SEQ ID NO: 1123917 - RNA, 16 nt, Homo sapiens
ucucccaccaccucac

SEQ ID NO: 1123918 - RNA, 16 nt, Homo sapiens
ucucuaggccucucca

SEQ ID NO: 1123919 - RNA, 19 nt, Homo sapiens
ucucugagcagugaaugau

SEQ ID NO: 1123920 - RNA, 16 nt, Homo sapiens
ucucugguuuacuuca

SEQ ID NO: 1123921 - RNA, 16 nt, Homo sapiens
ucucuuggaugcagcu

SEQ ID NO: 1123922 - RNA, 16 nt, Homo sapiens
ucucuuugagucaaua

SEQ ID NO: 1123923 - RNA, 19 nt, Homo sapiens
ucugaccaucugugacuau

SEQ ID NO: 1123924 - RNA, 19 nt, Homo sapiens
ucugagcagugaaugauuc

SEQ ID NO: 1123925 - RNA, 23 nt, Homo sapiens
ucugagcagugaaugauucagug

SEQ ID NO: 1123926 - RNA, 21 nt, Homo sapiens
ucugauggcugcuccacuggg

SEQ ID NO: 1123927 - RNA, 16 nt, Homo sapiens
ucugcacacaaaacuc

SEQ ID NO: 1123928 - RNA, 19 nt, Homo sapiens
ucugcuagacuccucagga

SEQ ID NO: 1123929 - RNA, 14 nt, Homo sapiens
ucugggcugucagc

SEQ ID NO: 1123930 - RNA, 18 nt, Homo sapiens
ucugggggauaagggagu

SEQ ID NO: 1123931 - RNA, 16 nt, Homo sapiens
ucugguuuacuucaaa

SEQ ID NO: 1123932 - RNA, 12 nt, Homo sapiens
aaaaaacugcau

SEQ ID NO: 1123933 - RNA, 15 nt, Homo sapiens
aaaaaucagugaaua

SEQ ID NO: 1123934 - RNA, 16 nt, Homo sapiens
aaaaaugggagccagg

SEQ ID NO: 1123935 - RNA, 13 nt, Homo sapiens
aaaacacugugca

SEQ ID NO: 1123936 - RNA, 15 nt, Homo sapiens
aaaacacugugcaca

SEQ ID NO: 1123937 - RNA, 21 nt, Homo sapiens
aaaacggugcauccacgcaca

SEQ ID NO: 1123938 - RNA, 14 nt, Homo sapiens
aaaacguguaaaug

SEQ ID NO: 1123939 - RNA, 11 nt, Homo sapiens
aaaacucucug

SEQ ID NO: 1123940 - RNA, 18 nt, Homo sapiens
aaaaguaaauucauguaa

SEQ ID NO: 1123941 - RNA, 23 nt, Homo sapiens
aaaauaaaauguuucauuaugca

SEQ ID NO: 1123942 - RNA, 19 nt, Homo sapiens
aaaauggaagguuggagac

SEQ ID NO: 1123943 - RNA, 13 nt, Homo sapiens
aaacaaacaugac

SEQ ID NO: 1123944 - RNA, 22 nt, Homo sapiens
uccauaggcgcaggugcacagg

SEQ ID NO: 1123945 - RNA, 13 nt, Homo sapiens
uccauccauguac

SEQ ID NO: 1123946 - RNA, 21 nt, Homo sapiens
uccauggggggagaagugaua

SEQ ID NO: 1123947 - RNA, 19 nt, Homo sapiens
uccauuuggacaaaaugga

SEQ ID NO: 1123948 - RNA, 17 nt, Homo sapiens
ucccacaaucugggacu

SEQ ID NO: 1123949 - RNA, 16 nt, Homo sapiens
ucccacguucuguuaa

SEQ ID NO: 1123950 - RNA, 19 nt, Homo sapiens
ucccagcuauuccuacucu

SEQ ID NO: 1123951 - RNA, 19 nt, Homo sapiens
ucccaggcccgagauguga

SEQ ID NO: 1123952 - RNA, 21 nt, Homo sapiens
ucccaggcccgagaugugacc

SEQ ID NO: 1123953 - RNA, 18 nt, Homo sapiens
ucccaggcuggauacuaa

SEQ ID NO: 1123954 - RNA, 20 nt, Homo sapiens
uccccaccuuccccagacuc

SEQ ID NO: 1123955 - RNA, 12 nt, Homo sapiens
ucccccacugau

SEQ ID NO: 1123956 - RNA, 21 nt, Homo sapiens
uccccucgugugacucucuug

SEQ ID NO: 1123957 - RNA, 21 nt, Homo sapiens
uccccuggggagucugggcac

SEQ ID NO: 1123958 - RNA, 19 nt, Homo sapiens
ucccucuaauuuaucuugu

SEQ ID NO: 1123959 - RNA, 14 nt, Homo sapiens
ucccuguaaccucu

SEQ ID NO: 1123960 - RNA, 14 nt, Homo sapiens
uccucaauccagcu

SEQ ID NO: 1123961 - RNA, 22 nt, Homo sapiens
uccucacgcagacacacccaca

SEQ ID NO: 1123962 - RNA, 19 nt, Homo sapiens
uccucaguucucaaaugug

SEQ ID NO: 1123963 - RNA, 14 nt, Homo sapiens
uccuccaugggaga

SEQ ID NO: 1123964 - RNA, 16 nt, Homo sapiens
uccucugugaccaaug

SEQ ID NO: 1123965 - RNA, 16 nt, Homo sapiens
uccucuuucaaccuca

SEQ ID NO: 1123966 - RNA, 16 nt, Homo sapiens
uccugaacucagcuga

SEQ ID NO: 1123967 - RNA, 13 nt, Homo sapiens
uccugggcccucu

SEQ ID NO: 1123968 - RNA, 18 nt, Homo sapiens
ucgcccuacucaccugag

SEQ ID NO: 1123969 - RNA, 23 nt, Homo sapiens
ucggggagcguucuaaauaugaa

SEQ ID NO: 1123970 - RNA, 12 nt, Homo sapiens
ucggugugcacc

SEQ ID NO: 1123971 - RNA, 15 nt, Homo sapiens
ucguaaauauucccu

SEQ ID NO: 1123972 - RNA, 18 nt, Homo sapiens
ucuaaaacaaucugucca

SEQ ID NO: 1123973 - RNA, 16 nt, Homo sapiens
ucuaacuacaaggaca

SEQ ID NO: 1123974 - RNA, 16 nt, Homo sapiens
ucuaacugcuguuaaa

SEQ ID NO: 1123975 - RNA, 13 nt, Homo sapiens
ucuauuaucucaa

SEQ ID NO: 1123976 - RNA, 16 nt, Homo sapiens
ucucaaacuacuggca

SEQ ID NO: 1123977 - RNA, 16 nt, Homo sapiens
ucucaauguacauaga

SEQ ID NO: 1123978 - RNA, 10 nt, Homo sapiens
ucucauguca

SEQ ID NO: 1123979 - RNA, 20 nt, Homo sapiens
ucucuacccggcccagagac

SEQ ID NO: 1123980 - RNA, 21 nt, Homo sapiens
ucucuuaaucacaagauuauu

SEQ ID NO: 1123981 - RNA, 15 nt, Homo sapiens
caagcagagcucaca

SEQ ID NO: 1123982 - RNA, 13 nt, Homo sapiens
caaggaagucaaa

SEQ ID NO: 1123983 - RNA, 21 nt, Homo sapiens
caagggcuuuguuuugcacac

SEQ ID NO: 1123984 - RNA, 20 nt, Homo sapiens
caagucuuuacagaaucaaa

SEQ ID NO: 1123985 - RNA, 17 nt, Homo sapiens
caaucuguccacaaaua

SEQ ID NO: 1123986 - RNA, 21 nt, Homo sapiens
caauggagugggagaucagcc

SEQ ID NO: 1123987 - RNA, 11 nt, Homo sapiens
caauuaacugc

SEQ ID NO: 1123988 - RNA, 15 nt, Homo sapiens
caauuccucugggaa

SEQ ID NO: 1123989 - RNA, 17 nt, Homo sapiens
cacaaucugggacuuuc

SEQ ID NO: 1123990 - RNA, 19 nt, Homo sapiens
cacacccacagaaggacac

SEQ ID NO: 1123991 - RNA, 12 nt, Homo sapiens
cacacuuugcca

SEQ ID NO: 1123992 - RNA, 21 nt, Homo sapiens
cacagacccacacauguuuac

SEQ ID NO: 1123993 - RNA, 22 nt, Homo sapiens
cacagacccacacauguuuaca

SEQ ID NO: 1123994 - RNA, 11 nt, Homo sapiens
cacagccauag

SEQ ID NO: 1123995 - RNA, 17 nt, Homo sapiens
cacagcccucaugauca

SEQ ID NO: 1123996 - RNA, 22 nt, Homo sapiens
cacagcccucaugaucauucuc

SEQ ID NO: 1123997 - RNA, 17 nt, Homo sapiens
cacagccuccccugcca

SEQ ID NO: 1123998 - RNA, 15 nt, Homo sapiens
cacagcuggacaggu

SEQ ID NO: 1123999 - RNA, 17 nt, Homo sapiens
cacaugcaucaucagcc

SEQ ID NO: 1124000 - RNA, 14 nt, Homo sapiens
cacauggaacuuua

SEQ ID NO: 1124001 - RNA, 14 nt, Homo sapiens
cacauggacacaga

SEQ ID NO: 1124002 - RNA, 13 nt, Homo sapiens
cacauucuucagu

SEQ ID NO: 1124003 - RNA, 16 nt, Homo sapiens
cacgauuaacugugaa

SEQ ID NO: 1124004 - RNA, 21 nt, Homo sapiens
cacgcugaaggcuuacuucag

SEQ ID NO: 1124005 - RNA, 18 nt, Homo sapiens
cacucuccccucccucuu

SEQ ID NO: 1124006 - RNA, 21 nt, Homo sapiens
cacucucccuuguacagccuu

SEQ ID NO: 1124007 - RNA, 19 nt, Homo sapiens
cacugauccuggagaaaag

SEQ ID NO: 1124008 - RNA, 17 nt, Homo sapiens
cacugcggaagccaaag

SEQ ID NO: 1124009 - RNA, 15 nt, Homo sapiens
cacugcuugaggaaa

SEQ ID NO: 1124010 - RNA, 23 nt, Homo sapiens
cacugcuugaggaaaacaagcau

SEQ ID NO: 1124011 - RNA, 15 nt, Homo sapiens
cacuuaaccauucca

SEQ ID NO: 1124012 - RNA, 18 nt, Homo sapiens
cacuucaacccccagcua

SEQ ID NO: 1124013 - RNA, 15 nt, Homo sapiens
cacuuuauugcaaug

SEQ ID NO: 1124014 - RNA, 19 nt, Homo sapiens
cacuuugggaggcugaggc

SEQ ID NO: 1124015 - RNA, 17 nt, Homo sapiens
cagaaaucaaacugcuu

SEQ ID NO: 1124016 - RNA, 20 nt, Homo sapiens
cagaagaaaauuugccaauc

SEQ ID NO: 1124017 - RNA, 19 nt, Homo sapiens
cagaagcauugccuggacu

SEQ ID NO: 1124018 - RNA, 23 nt, Homo sapiens
cagaaggacacuagccugugcac

SEQ ID NO: 1124019 - RNA, 16 nt, Homo sapiens
cagaaggcaaacccau

SEQ ID NO: 1124020 - RNA, 19 nt, Homo sapiens
cagaaugcggccucugaga

SEQ ID NO: 1124021 - RNA, 22 nt, Homo sapiens
cagaaugcggccucugagacau

SEQ ID NO: 1124022 - RNA, 12 nt, Homo sapiens
cagaauggagcu

SEQ ID NO: 1124023 - RNA, 20 nt, Homo sapiens
cagaccacugauaaaaccau

SEQ ID NO: 1124024 - RNA, 22 nt, Homo sapiens
cagagcaauuccaggcugagcc

SEQ ID NO: 1124025 - RNA, 19 nt, Homo sapiens
cagaggacuuuauucggac

SEQ ID NO: 1124026 - RNA, 18 nt, Homo sapiens
cagaguuuuuaaagccuu

SEQ ID NO: 1124027 - RNA, 21 nt, Homo sapiens
cagauguaaaugccacaaaga

SEQ ID NO: 1124028 - RNA, 20 nt, Homo sapiens
cagcacucccucccagagaa

SEQ ID NO: 1124029 - RNA, 10 nt, Homo sapiens
cagcaucuga

SEQ ID NO: 1124030 - RNA, 21 nt, Homo sapiens
cagcauuuagacccugcauuu

SEQ ID NO: 1124031 - RNA, 21 nt, Homo sapiens
cagccucacuucuaccugccc

SEQ ID NO: 1124032 - RNA, 20 nt, Homo sapiens
cagccugcucuagugggaca

SEQ ID NO: 1124033 - RNA, 13 nt, Homo sapiens
cagcuaaagcaau

SEQ ID NO: 1124034 - RNA, 16 nt, Homo sapiens
cagcuggaggcugcug

SEQ ID NO: 1124035 - RNA, 16 nt, Homo sapiens
cagcuguccugcagca

SEQ ID NO: 1124036 - RNA, 17 nt, Homo sapiens
cagcuuauauucaucca

SEQ ID NO: 1124037 - RNA, 14 nt, Homo sapiens
caggacgcccucac

SEQ ID NO: 1124038 - RNA, 12 nt, Homo sapiens
caggcacugaga

SEQ ID NO: 1124039 - RNA, 18 nt, Homo sapiens
cagggagcccccagagga

SEQ ID NO: 1124040 - RNA, 14 nt, Homo sapiens
caggucuagacuuu

SEQ ID NO: 1124041 - RNA, 20 nt, Homo sapiens
cagguucucuuugagucaau

SEQ ID NO: 1124042 - RNA, 15 nt, Homo sapiens
caguaaacacuccac

SEQ ID NO: 1124043 - RNA, 15 nt, Homo sapiens
cagucagcagucaug

SEQ ID NO: 1124044 - RNA, 22 nt, Homo sapiens
cagucaucuagaauucacugag

SEQ ID NO: 1124045 - RNA, 22 nt, Homo sapiens
cagucucuucgaggcuuuacag

SEQ ID NO: 1124046 - RNA, 23 nt, Homo sapiens
aauauuuuuguauuucucuauuu

SEQ ID NO: 1124047 - RNA, 18 nt, Homo sapiens
aaucaguaaauaguguca

SEQ ID NO: 1124048 - RNA, 21 nt, Homo sapiens
aaucaguaugcaaagcaaucu

SEQ ID NO: 1124049 - RNA, 23 nt, Homo sapiens
aauccaucguauuaaaaaacaau

SEQ ID NO: 1124050 - RNA, 12 nt, Homo sapiens
aauccaugaacc

SEQ ID NO: 1124051 - RNA, 21 nt, Homo sapiens
aauccccacaggcacauuaac

SEQ ID NO: 1124052 - RNA, 16 nt, Homo sapiens
aaucuaacuacaagga

SEQ ID NO: 1124053 - RNA, 19 nt, Homo sapiens
aaucuaacuacaaggacaa

SEQ ID NO: 1124054 - RNA, 21 nt, Homo sapiens
aaucuuuuauacaauaauuga

SEQ ID NO: 1124055 - RNA, 13 nt, Homo sapiens
aaugaacuuuguc

SEQ ID NO: 1124056 - RNA, 16 nt, Homo sapiens
aaugggcacaaaaugg

SEQ ID NO: 1124057 - RNA, 14 nt, Homo sapiens
aaugucucauguca

SEQ ID NO: 1124058 - RNA, 15 nt, Homo sapiens
aaugucucaugucaa

SEQ ID NO: 1124059 - RNA, 15 nt, Homo sapiens
aauguucacuuuuga

SEQ ID NO: 1124060 - RNA, 18 nt, Homo sapiens
aauuauugcuguauguaa

SEQ ID NO: 1124061 - RNA, 15 nt, Homo sapiens
aauucggugugcacc

SEQ ID NO: 1124062 - RNA, 21 nt, Homo sapiens
aauugauucuuagacauugca

SEQ ID NO: 1124063 - RNA, 20 nt, Homo sapiens
aauuuaucuugucucugggc

SEQ ID NO: 1124064 - RNA, 15 nt, Homo sapiens
aauuuuauuacauau

SEQ ID NO: 1124065 - RNA, 19 nt, Homo sapiens
aauuuuugcuaugcuguaa

SEQ ID NO: 1124066 - RNA, 20 nt, Homo sapiens
acaaaauaaccaauccugga

SEQ ID NO: 1124067 - RNA, 13 nt, Homo sapiens
acaaauauacauu

SEQ ID NO: 1124068 - RNA, 21 nt, Homo sapiens
acaacuucaguccaacuguca

SEQ ID NO: 1124069 - RNA, 16 nt, Homo sapiens
acaaucaaggccacug

SEQ ID NO: 1124070 - RNA, 20 nt, Homo sapiens
acaccugccucuuccugcag

SEQ ID NO: 1124071 - RNA, 18 nt, Homo sapiens
acacugcggaagccaaag

SEQ ID NO: 1124072 - RNA, 19 nt, Homo sapiens
acagaaggugaacuuugug

SEQ ID NO: 1124073 - RNA, 16 nt, Homo sapiens
acagagcuucccugac

SEQ ID NO: 1124074 - RNA, 18 nt, Homo sapiens
acagagcuucccugacuc

SEQ ID NO: 1124075 - RNA, 15 nt, Homo sapiens
acagauguaaaugcc

SEQ ID NO: 1124076 - RNA, 22 nt, Homo sapiens
acagggugugguaugagggggu

SEQ ID NO: 1124077 - RNA, 18 nt, Homo sapiens
acaguuuuugacauuuau

SEQ ID NO: 1124078 - RNA, 15 nt, Homo sapiens
acauccaagccagag

SEQ ID NO: 1124079 - RNA, 18 nt, Homo sapiens
acaugaagacaccaucuc

SEQ ID NO: 1124080 - RNA, 21 nt, Homo sapiens
acauucuucaguuuuucacuu

SEQ ID NO: 1124081 - RNA, 16 nt, Homo sapiens
acauuuuaucauuaaa

SEQ ID NO: 1124082 - RNA, 13 nt, Homo sapiens
accaaagacugca

SEQ ID NO: 1124083 - RNA, 23 nt, Homo sapiens
accaagauagauccauuuggaca

SEQ ID NO: 1124084 - RNA, 13 nt, Homo sapiens
accaccucaccag

SEQ ID NO: 1124085 - RNA, 17 nt, Homo sapiens
accaucuccaugugacc

SEQ ID NO: 1124086 - RNA, 19 nt, Homo sapiens
accaucugugacuauaaag

SEQ ID NO: 1124087 - RNA, 21 nt, Homo sapiens
acccaauggaaaauauaauga

SEQ ID NO: 1124088 - RNA, 16 nt, Homo sapiens
acccuaaaucuugacu

SEQ ID NO: 1124089 - RNA, 14 nt, Homo sapiens
acccucucuucccu

SEQ ID NO: 1124090 - RNA, 20 nt, Homo sapiens
acccucuuucuuguuuguca

SEQ ID NO: 1124091 - RNA, 16 nt, Homo sapiens
accuaaauuugguucu

SEQ ID NO: 1124092 - RNA, 20 nt, Homo sapiens
accucugggggauaagggag

SEQ ID NO: 1124093 - RNA, 14 nt, Homo sapiens
aggggcuacuguga

SEQ ID NO: 1124094 - RNA, 15 nt, Homo sapiens
aggggcuacugugac

SEQ ID NO: 1124095 - RNA, 22 nt, Homo sapiens
aggggugggagagccagcucuc

SEQ ID NO: 1124096 - RNA, 17 nt, Homo sapiens
aggucauuaaaauuaca

SEQ ID NO: 1124097 - RNA, 13 nt, Homo sapiens
aggucuccaaaau

SEQ ID NO: 1124098 - RNA, 15 nt, Homo sapiens
aggugacugaaggcu

SEQ ID NO: 1124099 - RNA, 14 nt, Homo sapiens
aguaaaacagucau

SEQ ID NO: 1124100 - RNA, 19 nt, Homo sapiens
aguacagauguaaaugcca

SEQ ID NO: 1124101 - RNA, 20 nt, Homo sapiens
aguacuugacuaccuacugg

SEQ ID NO: 1124102 - RNA, 17 nt, Homo sapiens
aguaggggcuacuguga

SEQ ID NO: 1124103 - RNA, 18 nt, Homo sapiens
aguaggggcuacugugac

SEQ ID NO: 1124104 - RNA, 23 nt, Homo sapiens
agucaccuauccacccucugcau

SEQ ID NO: 1124105 - RNA, 13 nt, Homo sapiens
agucagcagucau

SEQ ID NO: 1124106 - RNA, 14 nt, Homo sapiens
agucagcagucaug

SEQ ID NO: 1124107 - RNA, 21 nt, Homo sapiens
aguccaggguggaugaucuca

SEQ ID NO: 1124108 - RNA, 15 nt, Homo sapiens
agugagcugauauca

SEQ ID NO: 1124109 - RNA, 12 nt, Homo sapiens
agugauggagcu

SEQ ID NO: 1124110 - RNA, 12 nt, Homo sapiens
agugauguaauc

SEQ ID NO: 1124111 - RNA, 19 nt, Homo sapiens
agugcuauaaaugccagag

SEQ ID NO: 1124112 - RNA, 19 nt, Homo sapiens
aguguuccaagucucugug

SEQ ID NO: 1124113 - RNA, 23 nt, Homo sapiens
aguugcuaacuuaaaaaacugca

SEQ ID NO: 1124114 - RNA, 15 nt, Homo sapiens
aguuuauacuucucu

SEQ ID NO: 1124115 - RNA, 17 nt, Homo sapiens
auaaaaacuuugcagaa

SEQ ID NO: 1124116 - RNA, 16 nt, Homo sapiens
auaaaauucauuaguu

SEQ ID NO: 1124117 - RNA, 14 nt, Homo sapiens
auaaagaccuucca

SEQ ID NO: 1124118 - RNA, 22 nt, Homo sapiens
auaaagaucaaacaugcaugga

SEQ ID NO: 1124119 - RNA, 14 nt, Homo sapiens
auaaauuugguucu

SEQ ID NO: 1124120 - RNA, 19 nt, Homo sapiens
auaaguagcauucauguaa

SEQ ID NO: 1124121 - RNA, 16 nt, Homo sapiens
auaaucacaguugugu

SEQ ID NO: 1124122 - RNA, 15 nt, Homo sapiens
auaaugaucagcaaa

SEQ ID NO: 1124123 - RNA, 15 nt, Homo sapiens
auacagaaguuccau

SEQ ID NO: 1124124 - RNA, 17 nt, Homo sapiens
auaccauucacuacuca

SEQ ID NO: 1124125 - RNA, 14 nt, Homo sapiens
auacgguaugauau

SEQ ID NO: 1124126 - RNA, 16 nt, Homo sapiens
auacuacuacuguuau

SEQ ID NO: 1124127 - RNA, 13 nt, Homo sapiens
auaggcaauaaua

SEQ ID NO: 1124128 - RNA, 21 nt, Homo sapiens
auauaaaugugauugcagcuu

SEQ ID NO: 1124129 - RNA, 14 nt, Homo sapiens
auauagaguggaau

SEQ ID NO: 1124130 - RNA, 23 nt, Homo sapiens
auauaugauauauaaaugugauu

SEQ ID NO: 1124131 - RNA, 16 nt, Homo sapiens
auauuuuuuuaacugu

SEQ ID NO: 1124132 - RNA, 19 nt, Homo sapiens
auauuuuuuuaacugugau

SEQ ID NO: 1124133 - RNA, 17 nt, Homo sapiens
aucacaguuguguuccu

SEQ ID NO: 1124134 - RNA, 16 nt, Homo sapiens
aucauaagggcacuga

SEQ ID NO: 1124135 - RNA, 17 nt, Homo sapiens
aucauaagggcacugag

SEQ ID NO: 1124136 - RNA, 16 nt, Homo sapiens
aucaucaucauucuca

SEQ ID NO: 1124137 - RNA, 18 nt, Homo sapiens
aucaucuccugccuuccu

SEQ ID NO: 1124138 - RNA, 14 nt, Homo sapiens
aucaugcccugccu

SEQ ID NO: 1124139 - RNA, 17 nt, Homo sapiens
aucauucucugucucau

SEQ ID NO: 1124140 - RNA, 17 nt, Homo sapiens
auccacgcacacaugga

SEQ ID NO: 1124141 - RNA, 22 nt, Homo sapiens
auccauaggcgcaggugcacag

SEQ ID NO: 1124142 - RNA, 23 nt, Homo sapiens
auccauaggcgcaggugcacagg

SEQ ID NO: 1124143 - RNA, 20 nt, Homo sapiens
auccauuuggacaaaaugga

SEQ ID NO: 1124144 - RNA, 21 nt, Homo sapiens
auccauuuggacaaaauggaa

SEQ ID NO: 1124145 - RNA, 13 nt, Homo sapiens
aucccaacuuccu

SEQ ID NO: 1124146 - RNA, 14 nt, Homo sapiens
aucccuucccuguc

SEQ ID NO: 1124147 - RNA, 21 nt, Homo sapiens
aucucaaacuacuggcaauuu

SEQ ID NO: 1124148 - RNA, 19 nt, Homo sapiens
aucucccgugggcaucuca

SEQ ID NO: 1124149 - RNA, 16 nt, Homo sapiens
aucuucuucaccauuu

SEQ ID NO: 1124150 - RNA, 13 nt, Homo sapiens
aucuuugcuguua

SEQ ID NO: 1124151 - RNA, 16 nt, Homo sapiens
augaacacuacagaua

SEQ ID NO: 1124152 - RNA, 14 nt, Homo sapiens
augaagguaauauu

SEQ ID NO: 1124153 - RNA, 16 nt, Homo sapiens
augagacagacauuca

SEQ ID NO: 1124154 - RNA, 12 nt, Homo sapiens
augaucagcaaa

SEQ ID NO: 1124155 - RNA, 16 nt, Homo sapiens
augauccuuguguuca

SEQ ID NO: 1124156 - RNA, 14 nt, Homo sapiens
augcauaaaugcga

SEQ ID NO: 1124157 - RNA, 18 nt, Homo sapiens
auggcugcuccacugggu

SEQ ID NO: 1124158 - RNA, 20 nt, Homo sapiens
uggcccacgcccucccucuc

SEQ ID NO: 1124159 - RNA, 20 nt, Homo sapiens
uggccuaggcuaccucaaga

SEQ ID NO: 1124160 - RNA, 14 nt, Homo sapiens
uggcucucagagga

SEQ ID NO: 1124161 - RNA, 17 nt, Homo sapiens
uggcugcuccacugggu

SEQ ID NO: 1124162 - RNA, 17 nt, Homo sapiens
uggcuguguuugcagcc

SEQ ID NO: 1124163 - RNA, 20 nt, Homo sapiens
ugggagacuggaaaagggaa

SEQ ID NO: 1124164 - RNA, 14 nt, Homo sapiens
ugggagaucagcca

SEQ ID NO: 1124165 - RNA, 21 nt, Homo sapiens
ugggauuuggggccucaagaa

SEQ ID NO: 1124166 - RNA, 14 nt, Homo sapiens
ugggcagagcccaa

SEQ ID NO: 1124167 - RNA, 18 nt, Homo sapiens
ugggcaucucaagcccca

SEQ ID NO: 1124168 - RNA, 21 nt, Homo sapiens
ugggcugucagcccaugugca

SEQ ID NO: 1124169 - RNA, 22 nt, Homo sapiens
ugggcuucauuccggacuggca

SEQ ID NO: 1124170 - RNA, 17 nt, Homo sapiens
ugggggauaagggaguc

SEQ ID NO: 1124171 - RNA, 22 nt, Homo sapiens
ugguauaaacguccuacuguau

SEQ ID NO: 1124172 - RNA, 21 nt, Homo sapiens
uggucuucacugccaugccuc

SEQ ID NO: 1124173 - RNA, 17 nt, Homo sapiens
uggugaaugugugagaa

SEQ ID NO: 1124174 - RNA, 12 nt, Homo sapiens
ugguuuugacag

SEQ ID NO: 1124175 - RNA, 15 nt, Homo sapiens
uguaaacugugcacc

SEQ ID NO: 1124176 - RNA, 11 nt, Homo sapiens
uguacauagac

SEQ ID NO: 1124177 - RNA, 15 nt, Homo sapiens
uguacuugccuuauu

SEQ ID NO: 1124178 - RNA, 17 nt, Homo sapiens
uguagaagccacuauua

SEQ ID NO: 1124179 - RNA, 21 nt, Homo sapiens
uguagcggugaagaguacaga

SEQ ID NO: 1124180 - RNA, 18 nt, Homo sapiens
uguauauagaguggaauc

SEQ ID NO: 1124181 - RNA, 21 nt, Homo sapiens
uguauauagaguggaaucucu

SEQ ID NO: 1124182 - RNA, 15 nt, Homo sapiens
uguaucaaaugugac

SEQ ID NO: 1124183 - RNA, 16 nt, Homo sapiens
uguaucaaaugugaca

SEQ ID NO: 1124184 - RNA, 20 nt, Homo sapiens
uguauccccgugaaaucugg

SEQ ID NO: 1124185 - RNA, 16 nt, Homo sapiens
uguaucuuauucacau

SEQ ID NO: 1124186 - RNA, 16 nt, Homo sapiens
ugucagcugcuguuga

SEQ ID NO: 1124187 - RNA, 17 nt, Homo sapiens
uguccaggcacugagau

SEQ ID NO: 1124188 - RNA, 12 nt, Homo sapiens
ugucugccacag

SEQ ID NO: 1124189 - RNA, 21 nt, Homo sapiens
ugugaaauguacgucauuugu

SEQ ID NO: 1124190 - RNA, 22 nt, Homo sapiens
ugugacauuauaugcacuagca

SEQ ID NO: 1124191 - RNA, 21 nt, Homo sapiens
ugugacuauaaagcuguuauu

SEQ ID NO: 1124192 - RNA, 23 nt, Homo sapiens
ugugagacugaguucuauauucu

SEQ ID NO: 1124193 - RNA, 22 nt, Homo sapiens
ugugcuucaaggacauugguga

SEQ ID NO: 1124194 - RNA, 20 nt, Homo sapiens
aaucacagcccucaugauca

SEQ ID NO: 1124195 - RNA, 23 nt, Homo sapiens
aaucacagcccucaugaucauuc

SEQ ID NO: 1124196 - RNA, 17 nt, Homo sapiens
aaucagaacuguuggca

SEQ ID NO: 1124197 - RNA, 14 nt, Homo sapiens
aaucccagcacuuu

SEQ ID NO: 1124198 - RNA, 19 nt, Homo sapiens
aaucgauucugcagcaccg

SEQ ID NO: 1124199 - RNA, 23 nt, Homo sapiens
aaucgauucugcagcaccggccu

SEQ ID NO: 1124200 - RNA, 17 nt, Homo sapiens
aaucuaacuacaaggac

SEQ ID NO: 1124201 - RNA, 18 nt, Homo sapiens
uaacugaggacuguuugc

SEQ ID NO: 1124202 - RNA, 18 nt, Homo sapiens
uaagauauuuaguaauau

SEQ ID NO: 1124203 - RNA, 21 nt, Homo sapiens
uaagcacaaagcccauagcac

SEQ ID NO: 1124204 - RNA, 21 nt, Homo sapiens
uaagggcacugagcccuuccc

SEQ ID NO: 1124205 - RNA, 16 nt, Homo sapiens
uaauacuacuacuguu

SEQ ID NO: 1124206 - RNA, 22 nt, Homo sapiens
uaauauugauaagcuauugucu

SEQ ID NO: 1124207 - RNA, 19 nt, Homo sapiens
uaauauuuuuccacuuaaa

SEQ ID NO: 1124208 - RNA, 20 nt, Homo sapiens
uaauauuuuuguauuucucu

SEQ ID NO: 1124209 - RNA, 15 nt, Homo sapiens
uaaucccagcacuuu

SEQ ID NO: 1124210 - RNA, 19 nt, Homo sapiens
uaauuacucuacuucccag

SEQ ID NO: 1124211 - RNA, 19 nt, Homo sapiens
uaauuguuuaaaaugccuc

SEQ ID NO: 1124212 - RNA, 17 nt, Homo sapiens
uaauuuuauuacauaug

SEQ ID NO: 1124213 - RNA, 14 nt, Homo sapiens
uacaaggacaaugc

SEQ ID NO: 1124214 - RNA, 19 nt, Homo sapiens
uacacugcggaagccaaag

SEQ ID NO: 1124215 - RNA, 12 nt, Homo sapiens
uacauaugcuga

SEQ ID NO: 1124216 - RNA, 13 nt, Homo sapiens
uacaugacauuua

SEQ ID NO: 1124217 - RNA, 12 nt, Homo sapiens
uaccuacuggug

SEQ ID NO: 1124218 - RNA, 21 nt, Homo sapiens
uaccugaaaacacugugcaca

SEQ ID NO: 1124219 - RNA, 21 nt, Homo sapiens
uaccugcccccaauccaugaa

SEQ ID NO: 1124220 - RNA, 21 nt, Homo sapiens
uaccuugguucccccacugau

SEQ ID NO: 1124221 - RNA, 16 nt, Homo sapiens
uacgucauuugugcaa

SEQ ID NO: 1124222 - RNA, 17 nt, Homo sapiens
uacugaugguuacauau

SEQ ID NO: 1124223 - RNA, 16 nt, Homo sapiens
uacugcagcaccucca

SEQ ID NO: 1124224 - RNA, 21 nt, Homo sapiens
uacugggacugugcucagaga

SEQ ID NO: 1124225 - RNA, 22 nt, Homo sapiens
uagaaagcuggacugaccaaag

SEQ ID NO: 1124226 - RNA, 20 nt, Homo sapiens
uagaacuuuauuaaguaaaa

SEQ ID NO: 1124227 - RNA, 16 nt, Homo sapiens
uagacaguagauacca

SEQ ID NO: 1124228 - RNA, 14 nt, Homo sapiens
uagacuaaggccau

SEQ ID NO: 1124229 - RNA, 18 nt, Homo sapiens
uagagauagcuacagugu

SEQ ID NO: 1124230 - RNA, 20 nt, Homo sapiens
uagagauagcuacaguguaa

SEQ ID NO: 1124231 - RNA, 18 nt, Homo sapiens
uagaggauagggagaaua

SEQ ID NO: 1124232 - RNA, 22 nt, Homo sapiens
uagauccauuuggacaaaaugg

SEQ ID NO: 1124233 - RNA, 17 nt, Homo sapiens
uagauggauaagggaau

SEQ ID NO: 1124234 - RNA, 22 nt, Homo sapiens
uagauguaucaaaauacuacca

SEQ ID NO: 1124235 - RNA, 17 nt, Homo sapiens
uagcugaggcugagaaa

SEQ ID NO: 1124236 - RNA, 16 nt, Homo sapiens
uaggaagagaaaccag

SEQ ID NO: 1124237 - RNA, 23 nt, Homo sapiens
uaggccacagaaggugaacuuug

SEQ ID NO: 1124238 - RNA, 13 nt, Homo sapiens
uaguauacuuugu

SEQ ID NO: 1124239 - RNA, 14 nt, Homo sapiens
uagugauggagcuu

SEQ ID NO: 1124240 - RNA, 23 nt, Homo sapiens
uauaaagauacagaacucuuuca

SEQ ID NO: 1124241 - RNA, 14 nt, Homo sapiens
uauaaaugccagag

SEQ ID NO: 1124242 - RNA, 13 nt, Homo sapiens
uauaaaugugauu

SEQ ID NO: 1124243 - RNA, 17 nt, Homo sapiens
uauaauacuacuacugu

SEQ ID NO: 1124244 - RNA, 23 nt, Homo sapiens
uauacaauaauugaaguguuccc

SEQ ID NO: 1124245 - RNA, 14 nt, Homo sapiens
uauagaguggaauc

SEQ ID NO: 1124246 - RNA, 16 nt, Homo sapiens
uauauucauccaugcc

SEQ ID NO: 1124247 - RNA, 15 nt, Homo sapiens
uauauuuuugugcac

SEQ ID NO: 1124248 - RNA, 14 nt, Homo sapiens
uaucaacagcauuu

SEQ ID NO: 1124249 - RNA, 15 nt, Homo sapiens
uaugauauugcagcu

SEQ ID NO: 1124250 - RNA, 21 nt, Homo sapiens
uaugccauggaggcacuaaca

SEQ ID NO: 1124251 - RNA, 15 nt, Homo sapiens
uauuaagccacuuaa

SEQ ID NO: 1124252 - RNA, 19 nt, Homo sapiens
uauugcagcuuauauucau

SEQ ID NO: 1124253 - RNA, 19 nt, Homo sapiens
uauuggacuccaggccuga

SEQ ID NO: 1124254 - RNA, 21 nt, Homo sapiens
uauuuacugagcuucucugug

SEQ ID NO: 1124255 - RNA, 12 nt, Homo sapiens
uauuuauagucg

SEQ ID NO: 1124256 - RNA, 13 nt, Homo sapiens
uauuuauuuacug

SEQ ID NO: 1124257 - RNA, 10 nt, Homo sapiens
ucaaacugcu

SEQ ID NO: 1124258 - RNA, 22 nt, Homo sapiens
ucaaacuuccauauuugccuug

SEQ ID NO: 1124259 - RNA, 18 nt, Homo sapiens
ucaaaugugacauuauau

SEQ ID NO: 1124260 - RNA, 16 nt, Homo sapiens
ucaaauuggagcuuca

SEQ ID NO: 1124261 - RNA, 20 nt, Homo sapiens
ucacaaucuuggggcugaug

SEQ ID NO: 1124262 - RNA, 21 nt, Homo sapiens
ucacaucuauccacacuguca

SEQ ID NO: 1124263 - RNA, 17 nt, Homo sapiens
ucacaugucaguaccuu

SEQ ID NO: 1124264 - RNA, 19 nt, Homo sapiens
ucaccauuuggcaaugcca

SEQ ID NO: 1124265 - RNA, 18 nt, Homo sapiens
ucacuucuaccuacauau

SEQ ID NO: 1124266 - RNA, 15 nt, Homo sapiens
ucaguguuaaaugug

SEQ ID NO: 1124267 - RNA, 18 nt, Homo sapiens
ucaucauucucugucuca

SEQ ID NO: 1124268 - RNA, 17 nt, Homo sapiens
ucaugaggccggaugaa

SEQ ID NO: 1124269 - RNA, 19 nt, Homo sapiens
ucaugaguaccucaaagga

SEQ ID NO: 1124270 - RNA, 23 nt, Homo sapiens
ucaugcccugccuugucccucuc

SEQ ID NO: 1124271 - RNA, 14 nt, Homo sapiens
ucaugccugaugaa

SEQ ID NO: 1124272 - RNA, 13 nt, Homo sapiens
ucauucucaguga

SEQ ID NO: 1124273 - RNA, 14 nt, Homo sapiens
ucauucucagugag

SEQ ID NO: 1124274 - RNA, 15 nt, Homo sapiens
ucauucucauucuca

SEQ ID NO: 1124275 - RNA, 21 nt, Homo sapiens
ucauugacuuccugaacaacc

SEQ ID NO: 1124276 - RNA, 23 nt, Homo sapiens
uccaagccugaccacgcuuucua

SEQ ID NO: 1124277 - RNA, 19 nt, Homo sapiens
uccacuaggguccaccagg

SEQ ID NO: 1124278 - RNA, 21 nt, Homo sapiens
uccagcacucccucccagaga

SEQ ID NO: 1124279 - RNA, 16 nt, Homo sapiens
ucccacccacagccau

SEQ ID NO: 1124280 - RNA, 18 nt, Homo sapiens
ucccccaaagcaauguga

SEQ ID NO: 1124281 - RNA, 22 nt, Homo sapiens
ucccccaaagcaaugugagucc

SEQ ID NO: 1124282 - RNA, 19 nt, Homo sapiens
uccgagucucagcccugac

SEQ ID NO: 1124283 - RNA, 16 nt, Homo sapiens
uccuacaaaauggagg

SEQ ID NO: 1124284 - RNA, 18 nt, Homo sapiens
uccuccagaauggagcug

SEQ ID NO: 1124285 - RNA, 19 nt, Homo sapiens
uccucugugaccaaugucu

SEQ ID NO: 1124286 - RNA, 19 nt, Homo sapiens
uccugcagcaaacacucca

SEQ ID NO: 1124287 - RNA, 19 nt, Homo sapiens
uccugccuccagcacuccc

SEQ ID NO: 1124288 - RNA, 20 nt, Homo sapiens
uccuguguguacucugucca

SEQ ID NO: 1124289 - RNA, 18 nt, Homo sapiens
uccuucaugaucaucaca

SEQ ID NO: 1124290 - RNA, 19 nt, Homo sapiens
ucggaccaagcagagcuca

SEQ ID NO: 1124291 - RNA, 23 nt, Homo sapiens
ucggccaguuuucggaaacacug

SEQ ID NO: 1124292 - RNA, 16 nt, Homo sapiens
ucuaaauagcacuuuu

SEQ ID NO: 1124293 - RNA, 21 nt, Homo sapiens
ucuaacuacaaggacaaugcc

SEQ ID NO: 1124294 - RNA, 16 nt, Homo sapiens
gaaucaaaugcaauuu

SEQ ID NO: 1124295 - RNA, 16 nt, Homo sapiens
gaaucacagcccucau

SEQ ID NO: 1124296 - RNA, 22 nt, Homo sapiens
gaaucacagcccucaugaucau

SEQ ID NO: 1124297 - RNA, 20 nt, Homo sapiens
gaaucucuuuuugcuuucga

SEQ ID NO: 1124298 - RNA, 17 nt, Homo sapiens
gaaugaauacugggaau

SEQ ID NO: 1124299 - RNA, 19 nt, Homo sapiens
gaaugcggccucugagaca

SEQ ID NO: 1124300 - RNA, 13 nt, Homo sapiens
gaauucacugagu

SEQ ID NO: 1124301 - RNA, 13 nt, Homo sapiens
gacaaaccagagc

SEQ ID NO: 1124302 - RNA, 17 nt, Homo sapiens
gacaguuuuugacauuu

SEQ ID NO: 1124303 - RNA, 17 nt, Homo sapiens
gaccaaagacugcagaa

SEQ ID NO: 1124304 - RNA, 15 nt, Homo sapiens
gaccacucaauccau

SEQ ID NO: 1124305 - RNA, 13 nt, Homo sapiens
gacccacacaugu

SEQ ID NO: 1124306 - RNA, 15 nt, Homo sapiens
gaccuggcucucaga

SEQ ID NO: 1124307 - RNA, 18 nt, Homo sapiens
gaccuggcucucagagga

SEQ ID NO: 1124308 - RNA, 13 nt, Homo sapiens
gacucaagggaaa

SEQ ID NO: 1124309 - RNA, 19 nt, Homo sapiens
gacucaccucauccuuacc

SEQ ID NO: 1124310 - RNA, 13 nt, Homo sapiens
gacuccaguuaaa

SEQ ID NO: 1124311 - RNA, 16 nt, Homo sapiens
gacuucauacuuugaa

SEQ ID NO: 1124312 - RNA, 17 nt, Homo sapiens
gacuuggggaccagagg

SEQ ID NO: 1124313 - RNA, 18 nt, Homo sapiens
gacuuuauucggaccaag

SEQ ID NO: 1124314 - RNA, 18 nt, Homo sapiens
gagaaaagggauggagcu

SEQ ID NO: 1124315 - RNA, 17 nt, Homo sapiens
gagaagggggcagaguc

SEQ ID NO: 1124316 - RNA, 22 nt, Homo sapiens
gagaagugauauggugaaggga

SEQ ID NO: 1124317 - RNA, 20 nt, Homo sapiens
gagacuuggggaccagaggu

SEQ ID NO: 1124318 - RNA, 14 nt, Homo sapiens
gagagcaggacagg

SEQ ID NO: 1124319 - RNA, 16 nt, Homo sapiens
gagagccaccaagagg

SEQ ID NO: 1124320 - RNA, 13 nt, Homo sapiens
gagauaaagaaua

SEQ ID NO: 1124321 - RNA, 12 nt, Homo sapiens
gagcacugugag

SEQ ID NO: 1124322 - RNA, 23 nt, Homo sapiens
gagccagcucucucuacccggcc

SEQ ID NO: 1124323 - RNA, 13 nt, Homo sapiens
gagccauaugaau

SEQ ID NO: 1124324 - RNA, 21 nt, Homo sapiens
gagcccgcuuuuguucuuccc

SEQ ID NO: 1124325 - RNA, 17 nt, Homo sapiens
gagccgggucugccucu

SEQ ID NO: 1124326 - RNA, 15 nt, Homo sapiens
gagcucacagcugga

SEQ ID NO: 1124327 - RNA, 17 nt, Homo sapiens
gagcucacagcuggaca

SEQ ID NO: 1124328 - RNA, 23 nt, Homo sapiens
gaggacuuuauucggaccaagca

SEQ ID NO: 1124329 - RNA, 15 nt, Homo sapiens
gaggagagaaggggg

SEQ ID NO: 1124330 - RNA, 20 nt, Homo sapiens
gaggcaagagaauugcuuga

SEQ ID NO: 1124331 - RNA, 19 nt, Homo sapiens
gaggccccuggagccagau

SEQ ID NO: 1124332 - RNA, 14 nt, Homo sapiens
gaggugagaccaaa

SEQ ID NO: 1124333 - RNA, 15 nt, Homo sapiens
gaggugcagcuggag

SEQ ID NO: 1124334 - RNA, 21 nt, Homo sapiens
gaguguuccccuuccacugag

SEQ ID NO: 1124335 - RNA, 22 nt, Homo sapiens
gaguguuccccuuccacugagg

SEQ ID NO: 1124336 - RNA, 17 nt, Homo sapiens
gaguugccagggaagaa

SEQ ID NO: 1124337 - RNA, 21 nt, Homo sapiens
gauaccucaacccccauuucu

SEQ ID NO: 1124338 - RNA, 23 nt, Homo sapiens
gauacuuacauguucccaaaaca

SEQ ID NO: 1124339 - RNA, 21 nt, Homo sapiens
gauaucaugccccuguacucc

SEQ ID NO: 1124340 - RNA, 17 nt, Homo sapiens
gauauggugaagggaag

SEQ ID NO: 1124341 - RNA, 23 nt, Homo sapiens
gauccccccacagccccugguca

SEQ ID NO: 1124342 - RNA, 22 nt, Homo sapiens
gaugaauugucacaucuaucca

SEQ ID NO: 1124343 - RNA, 20 nt, Homo sapiens
gaugacgugaagccacagga

SEQ ID NO: 1124344 - RNA, 16 nt, Homo sapiens
gaugugacagcccuga

SEQ ID NO: 1124345 - RNA, 22 nt, Homo sapiens
gauuaagauauucagaaguaua

SEQ ID NO: 1124346 - RNA, 21 nt, Homo sapiens
gauuccugggcaagaaccuaa

SEQ ID NO: 1124347 - RNA, 15 nt, Homo sapiens
gauucugcagcaccg

SEQ ID NO: 1124348 - RNA, 23 nt, Homo sapiens
gauugccucugaagccuauguau

SEQ ID NO: 1124349 - RNA, 19 nt, Homo sapiens
gcaaaauacaugacauuua

SEQ ID NO: 1124350 - RNA, 13 nt, Homo sapiens
gcaaggugacauu

SEQ ID NO: 1124351 - RNA, 23 nt, Homo sapiens
gcaauacugcuuaauugcugaua

SEQ ID NO: 1124352 - RNA, 16 nt, Homo sapiens
gcacaaagcccauagc

SEQ ID NO: 1124353 - RNA, 22 nt, Homo sapiens
gcacacgucuggccuacagaau

SEQ ID NO: 1124354 - RNA, 12 nt, Homo sapiens
gcacauuaacug

SEQ ID NO: 1124355 - RNA, 18 nt, Homo sapiens
gcacucccucccagagaa

SEQ ID NO: 1124356 - RNA, 20 nt, Homo sapiens
gcacuguucccccugugcag

SEQ ID NO: 1124357 - RNA, 13 nt, Homo sapiens
gcagaccacugau

SEQ ID NO: 1124358 - RNA, 18 nt, Homo sapiens
gcagagcaugaccugagg

SEQ ID NO: 1124359 - RNA, 9 nt, Homo sapiens
gcagcacuu

SEQ ID NO: 1124360 - RNA, 10 nt, Homo sapiens
gcagccucac

SEQ ID NO: 1124361 - RNA, 18 nt, Homo sapiens
gcaggaagccuacuauuu

SEQ ID NO: 1124362 - RNA, 20 nt, Homo sapiens
gcagguggggagacugggcu

SEQ ID NO: 1124363 - RNA, 13 nt, Homo sapiens
gcagugaaguaua

SEQ ID NO: 1124364 - RNA, 16 nt, Homo sapiens
gcaucaucagccuauu

SEQ ID NO: 1124365 - RNA, 18 nt, Homo sapiens
gcaucugaccaucuguga

SEQ ID NO: 1124366 - RNA, 18 nt, Homo sapiens
gcauggauggguccucac

SEQ ID NO: 1124367 - RNA, 21 nt, Homo sapiens
gcauucuuugcaauacugcuu

SEQ ID NO: 1124368 - RNA, 11 nt, Homo sapiens
gccacaaagaa

SEQ ID NO: 1124369 - RNA, 18 nt, Homo sapiens
gccacagaaggugaacuu

SEQ ID NO: 1124370 - RNA, 19 nt, Homo sapiens
gccacccagcaacacagag

SEQ ID NO: 1124371 - RNA, 19 nt, Homo sapiens
gccagcaccugcccagugg

SEQ ID NO: 1124372 - RNA, 19 nt, Homo sapiens
gccaggcugcccaucaggg

SEQ ID NO: 1124373 - RNA, 18 nt, Homo sapiens
gccagugccagcaccugc

SEQ ID NO: 1124374 - RNA, 19 nt, Homo sapiens
gccauagaccuacagaccu

SEQ ID NO: 1124375 - RNA, 16 nt, Homo sapiens
gcccaugugcaccugc

SEQ ID NO: 1124376 - RNA, 16 nt, Homo sapiens
gccccaggcauugcca

SEQ ID NO: 1124377 - RNA, 20 nt, Homo sapiens
gccccauccaacacuggaug

SEQ ID NO: 1124378 - RNA, 18 nt, Homo sapiens
gcccgagaugugacccac

SEQ ID NO: 1124379 - RNA, 18 nt, Homo sapiens
gcccugaccuucugggac

SEQ ID NO: 1124380 - RNA, 14 nt, Homo sapiens
gcccuugucacugg

SEQ ID NO: 1124381 - RNA, 23 nt, Homo sapiens
gccgaggggagagagggacucaa

SEQ ID NO: 1124382 - RNA, 19 nt, Homo sapiens
gccucacugaaacauggcu

SEQ ID NO: 1124383 - RNA, 18 nt, Homo sapiens
gccucccagcuucuuaua

SEQ ID NO: 1124384 - RNA, 14 nt, Homo sapiens
gccucccccaaagc

SEQ ID NO: 1124385 - RNA, 21 nt, Homo sapiens
gccuccgcugggcuucauucc

SEQ ID NO: 1124386 - RNA, 20 nt, Homo sapiens
gccuccuccagaauggagcu

SEQ ID NO: 1124387 - RNA, 17 nt, Homo sapiens
gccucuccaguuugcac

SEQ ID NO: 1124388 - RNA, 14 nt, Homo sapiens
gccucugaagccua

SEQ ID NO: 1124389 - RNA, 22 nt, Homo sapiens
gccugaucagcgccgcaccagc

SEQ ID NO: 1124390 - RNA, 18 nt, Homo sapiens
gccugguagaauugggaa

SEQ ID NO: 1124391 - RNA, 15 nt, Homo sapiens
gccuuaaccaugagg

SEQ ID NO: 1124392 - RNA, 14 nt, Homo sapiens
gccuucacugacag

SEQ ID NO: 1124393 - RNA, 20 nt, Homo sapiens
gcgagcacugugagcaccug

SEQ ID NO: 1124394 - RNA, 18 nt, Homo sapiens
ucuacccggcccagagac

SEQ ID NO: 1124395 - RNA, 15 nt, Homo sapiens
ucuacuaacaaucag

SEQ ID NO: 1124396 - RNA, 15 nt, Homo sapiens
ucuauccacacuguc

SEQ ID NO: 1124397 - RNA, 11 nt, Homo sapiens
ucuauguuaau

SEQ ID NO: 1124398 - RNA, 19 nt, Homo sapiens
ucuauuucuccuccauggg

SEQ ID NO: 1124399 - RNA, 15 nt, Homo sapiens
ucucacuauaccagu

SEQ ID NO: 1124400 - RNA, 14 nt, Homo sapiens
ucucaggaccaaag

SEQ ID NO: 1124401 - RNA, 20 nt, Homo sapiens
ucucaggaccaaagcuuuca

SEQ ID NO: 1124402 - RNA, 10 nt, Homo sapiens
ucucauuucu

SEQ ID NO: 1124403 - RNA, 20 nt, Homo sapiens
ucuccucuucauggcaucuu

SEQ ID NO: 1124404 - RNA, 14 nt, Homo sapiens
ucucugagcaguga

SEQ ID NO: 1124405 - RNA, 15 nt, Homo sapiens
ucucugagcagugaa

SEQ ID NO: 1124406 - RNA, 12 nt, Homo sapiens
ucucugcucugc

SEQ ID NO: 1124407 - RNA, 15 nt, Homo sapiens
ucucuuaaucacaag

SEQ ID NO: 1124408 - RNA, 14 nt, Homo sapiens
ucucuuugagucaa

SEQ ID NO: 1124409 - RNA, 14 nt, Homo sapiens
ucugagcugugcag

SEQ ID NO: 1124410 - RNA, 20 nt, Homo sapiens
ucugcgugucaccugugcuu

SEQ ID NO: 1124411 - RNA, 18 nt, Homo sapiens
ucugcucaucauucucug

SEQ ID NO: 1124412 - RNA, 22 nt, Homo sapiens
ucugggcugucagcccaugugc

SEQ ID NO: 1124413 - RNA, 23 nt, Homo sapiens
ucuggucuucacugccaugccuc

SEQ ID NO: 1124414 - RNA, 18 nt, Homo sapiens
ucuggugaguuaaugggg

SEQ ID NO: 1124415 - RNA, 18 nt, Homo sapiens
ucugugcaguaagccugu

SEQ ID NO: 1124416 - RNA, 17 nt, Homo sapiens
ucuguggcacucagaua

SEQ ID NO: 1124417 - RNA, 19 nt, Homo sapiens
ucugugggcuccauguaga

SEQ ID NO: 1124418 - RNA, 18 nt, Homo sapiens
ucuucaaggagaaugaau

SEQ ID NO: 1124419 - RNA, 19 nt, Homo sapiens
ucuucaauaugaaucuaua

SEQ ID NO: 1124420 - RNA, 12 nt, Homo sapiens
ucuucacugcca

SEQ ID NO: 1124421 - RNA, 22 nt, Homo sapiens
ucuuccagcccaucuccgggga

SEQ ID NO: 1124422 - RNA, 18 nt, Homo sapiens
ucuuguuugucagcaucu

SEQ ID NO: 1124423 - RNA, 16 nt, Homo sapiens
ugaaaacacugugcac

SEQ ID NO: 1124424 - RNA, 21 nt, Homo sapiens
ugaaacauggcuguguuugca

SEQ ID NO: 1124425 - RNA, 16 nt, Homo sapiens
ugaaggcuuacuucag

SEQ ID NO: 1124426 - RNA, 17 nt, Homo sapiens
ugaaggcuuacuucaga

SEQ ID NO: 1124427 - RNA, 17 nt, Homo sapiens
ugaaucuauaaguagua

SEQ ID NO: 1124428 - RNA, 20 nt, Homo sapiens
ugacacucccuugggcuccc

SEQ ID NO: 1124429 - RNA, 17 nt, Homo sapiens
ugacauaggcaauaaua

SEQ ID NO: 1124430 - RNA, 15 nt, Homo sapiens
ugacauuauaugcac

SEQ ID NO: 1124431 - RNA, 17 nt, Homo sapiens
ugacauuauaugcacua

SEQ ID NO: 1124432 - RNA, 15 nt, Homo sapiens
ugaccaucugugacu

SEQ ID NO: 1124433 - RNA, 22 nt, Homo sapiens
ugaccauggaggccagugccag

SEQ ID NO: 1124434 - RNA, 15 nt, Homo sapiens
ugaccgaacacugca

SEQ ID NO: 1124435 - RNA, 16 nt, Homo sapiens
ugaccuuccaaagacu

SEQ ID NO: 1124436 - RNA, 18 nt, Homo sapiens
ugacuauaaagcuguuau

SEQ ID NO: 1124437 - RNA, 21 nt, Homo sapiens
ugacuuccugaacaaccagcu

SEQ ID NO: 1124438 - RNA, 22 nt, Homo sapiens
ugacuuccugaacaaccagcug

SEQ ID NO: 1124439 - RNA, 18 nt, Homo sapiens
ugagaagcugggcaugaa

SEQ ID NO: 1124440 - RNA, 19 nt, Homo sapiens
ugagacagacauucaccug

SEQ ID NO: 1124441 - RNA, 12 nt, Homo sapiens
ugagcugugcag

SEQ ID NO: 1124442 - RNA, 15 nt, Homo sapiens
ugaggaacccuuaca

SEQ ID NO: 1124443 - RNA, 21 nt, Homo sapiens
ugaggcggguggaucacuuga

SEQ ID NO: 1124444 - RNA, 19 nt, Homo sapiens
ugagggagccuggccccau

SEQ ID NO: 1124445 - RNA, 16 nt, Homo sapiens
ugaguaccucaaagga

SEQ ID NO: 1124446 - RNA, 18 nt, Homo sapiens
ugaguccaucuaacauca

SEQ ID NO: 1124447 - RNA, 18 nt, Homo sapiens
ugaguuuuguuucacuuu

SEQ ID NO: 1124448 - RNA, 22 nt, Homo sapiens
ugauaagcuauugucuguaaua

SEQ ID NO: 1124449 - RNA, 17 nt, Homo sapiens
ugauaccauaugaauga

SEQ ID NO: 1124450 - RNA, 19 nt, Homo sapiens
ugauaccauaugaaugaaa

SEQ ID NO: 1124451 - RNA, 15 nt, Homo sapiens
ugauauugcagcuua

SEQ ID NO: 1124452 - RNA, 17 nt, Homo sapiens
ugaugauuaauucaccu

SEQ ID NO: 1124453 - RNA, 22 nt, Homo sapiens
ugauggcccuaaguuaagcaaa

SEQ ID NO: 1124454 - RNA, 22 nt, Homo sapiens
ugauuagagggaugagacagac

SEQ ID NO: 1124455 - RNA, 18 nt, Homo sapiens
ugcaccaucacacaugca

SEQ ID NO: 1124456 - RNA, 21 nt, Homo sapiens
ugcagcaaacacuccacccuc

SEQ ID NO: 1124457 - RNA, 16 nt, Homo sapiens
ugcagcggcagagcaa

SEQ ID NO: 1124458 - RNA, 13 nt, Homo sapiens
ugcagcugucuga

SEQ ID NO: 1124459 - RNA, 19 nt, Homo sapiens
ugcagcuuauauucaucca

SEQ ID NO: 1124460 - RNA, 22 nt, Homo sapiens
ugcaguaggggcuacugugacc

SEQ ID NO: 1124461 - RNA, 22 nt, Homo sapiens
ugcauccacgcacacauggaca

SEQ ID NO: 1124462 - RNA, 23 nt, Homo sapiens
ugcauuuaaauacagucuuccau

SEQ ID NO: 1124463 - RNA, 15 nt, Homo sapiens
ugccaugcucagaaa

SEQ ID NO: 1124464 - RNA, 20 nt, Homo sapiens
ugcccaucagggcccaggga

SEQ ID NO: 1124465 - RNA, 17 nt, Homo sapiens
ugcccccaauccaugaa

SEQ ID NO: 1124466 - RNA, 19 nt, Homo sapiens
ugcccuguaccugugcacg

SEQ ID NO: 1124467 - RNA, 14 nt, Homo sapiens
ugcgccgggggacc

SEQ ID NO: 1124468 - RNA, 20 nt, Homo sapiens
ugcuaacuuaaaaaacugca

SEQ ID NO: 1124469 - RNA, 22 nt, Homo sapiens
ugcuguuaaaauuaauauauca

SEQ ID NO: 1124470 - RNA, 19 nt, Homo sapiens
ugcuuuugggagacuggaa

SEQ ID NO: 1124471 - RNA, 20 nt, Homo sapiens
uggaagaugcagaagcaaua

SEQ ID NO: 1124472 - RNA, 16 nt, Homo sapiens
uggaaugaagguaaua

SEQ ID NO: 1124473 - RNA, 17 nt, Homo sapiens
uggaaugaagguaauau

SEQ ID NO: 1124474 - RNA, 21 nt, Homo sapiens
uggaggcugcuguggggacca

SEQ ID NO: 1124475 - RNA, 14 nt, Homo sapiens
uggagggaugccac

SEQ ID NO: 1124476 - RNA, 17 nt, Homo sapiens
uggauaaagaccuucca

SEQ ID NO: 1124477 - RNA, 14 nt, Homo sapiens
uggauguucacugc

SEQ ID NO: 1124478 - RNA, 18 nt, Homo sapiens
uggcagaagcauugccug

SEQ ID NO: 1124479 - RNA, 13 nt, Homo sapiens
uggcagaagucaa

SEQ ID NO: 1124480 - RNA, 13 nt, Homo sapiens
uggcucucagagg

SEQ ID NO: 1124481 - RNA, 24 nt, Homo sapiens
uggcuuauuucuaugacaaauuca

SEQ ID NO: 1124482 - RNA, 23 nt, Homo sapiens
uggcuucagguuagugacauuua

SEQ ID NO: 1124483 - RNA, 20 nt, Homo sapiens
ugggaaacaaauaauuugaa

SEQ ID NO: 1124484 - RNA, 13 nt, Homo sapiens
ugggagacuggaa

SEQ ID NO: 1124485 - RNA, 16 nt, Homo sapiens
uggggaccacacugau

SEQ ID NO: 1124486 - RNA, 16 nt, Homo sapiens
uggguguacaaacuca

SEQ ID NO: 1124487 - RNA, 14 nt, Homo sapiens
ugguaagcaccagg

SEQ ID NO: 1124488 - RNA, 23 nt, Homo sapiens
uggucacaugaugugcauagaga

SEQ ID NO: 1124489 - RNA, 14 nt, Homo sapiens
uggugaacuccacc

SEQ ID NO: 1124490 - RNA, 22 nt, Homo sapiens
ugguucaauuucagaaguaaug

SEQ ID NO: 1124491 - RNA, 18 nt, Homo sapiens
ugguugggggaggggccu

SEQ ID NO: 1124492 - RNA, 21 nt, Homo sapiens
uguaaauugagauuuaauucc

SEQ ID NO: 1124493 - RNA, 16 nt, Homo sapiens
uguaacguggcacugg

SEQ ID NO: 1124494 - RNA, 19 nt, Homo sapiens
uguaacuguaaaacauuga

SEQ ID NO: 1124495 - RNA, 19 nt, Homo sapiens
uguaaucccagcacuuugg

SEQ ID NO: 1124496 - RNA, 19 nt, Homo sapiens
uguaaucccagcuacuugg

SEQ ID NO: 1124497 - RNA, 17 nt, Homo sapiens
uguaaucucaaugcaag

SEQ ID NO: 1124498 - RNA, 19 nt, Homo sapiens
uguauguuuuucuguauaa

SEQ ID NO: 1124499 - RNA, 13 nt, Homo sapiens
ugucagcaucuga

SEQ ID NO: 1124500 - RNA, 20 nt, Homo sapiens
ugucagcaucugaccaucug

SEQ ID NO: 1124501 - RNA, 17 nt, Homo sapiens
ugucagcccaugugcac

SEQ ID NO: 1124502 - RNA, 17 nt, Homo sapiens
ugucagcugcuguugaa

SEQ ID NO: 1124503 - RNA, 17 nt, Homo sapiens
uucaauugcaucuccca

SEQ ID NO: 1124504 - RNA, 19 nt, Homo sapiens
uucacaguaauaugguucc

SEQ ID NO: 1124505 - RNA, 18 nt, Homo sapiens
uucagaaaucaaacugcu

SEQ ID NO: 1124506 - RNA, 19 nt, Homo sapiens
uucagcuucuaugcauuaa

SEQ ID NO: 1124507 - RNA, 17 nt, Homo sapiens
uucagguuagugacauu

SEQ ID NO: 1124508 - RNA, 16 nt, Homo sapiens
uucaguuuuucacuuc

SEQ ID NO: 1124509 - RNA, 12 nt, Homo sapiens
uucauacuuuga

SEQ ID NO: 1124510 - RNA, 19 nt, Homo sapiens
uuccagcccaucuccgggg

SEQ ID NO: 1124511 - RNA, 20 nt, Homo sapiens
uuccaggcugagccaugagg

SEQ ID NO: 1124512 - RNA, 22 nt, Homo sapiens
uucccaaauguauucuacuugu

SEQ ID NO: 1124513 - RNA, 19 nt, Homo sapiens
uucccccacuacugcagca

SEQ ID NO: 1124514 - RNA, 13 nt, Homo sapiens
uucccccacugau

SEQ ID NO: 1124515 - RNA, 15 nt, Homo sapiens
uuccuacaaaaugga

SEQ ID NO: 1124516 - RNA, 16 nt, Homo sapiens
uucuaacugcuguuaa

SEQ ID NO: 1124517 - RNA, 15 nt, Homo sapiens
uucuauuuauuuacu

SEQ ID NO: 1124518 - RNA, 19 nt, Homo sapiens
uucugggguugcuccgggg

SEQ ID NO: 1124519 - RNA, 23 nt, Homo sapiens
uucuggucuucacugccaugccu

SEQ ID NO: 1124520 - RNA, 16 nt, Homo sapiens
uucuguauaacagccu

SEQ ID NO: 1124521 - RNA, 21 nt, Homo sapiens
uucuuguuugucagcaucuga

SEQ ID NO: 1124522 - RNA, 18 nt, Homo sapiens
uugaaacccauuaggcau

SEQ ID NO: 1124523 - RNA, 16 nt, Homo sapiens
uugaaaccugauguca

SEQ ID NO: 1124524 - RNA, 15 nt, Homo sapiens
uugaacccaggagau

SEQ ID NO: 1124525 - RNA, 20 nt, Homo sapiens
uugagauucugaaguaugaa

SEQ ID NO: 1124526 - RNA, 14 nt, Homo sapiens
uugcaaccucgcug

SEQ ID NO: 1124527 - RNA, 22 nt, Homo sapiens
uugcaaccucgcuggacucuca

SEQ ID NO: 1124528 - RNA, 13 nt, Homo sapiens
uugcaauacugcu

SEQ ID NO: 1124529 - RNA, 21 nt, Homo sapiens
uugcagcuuauauucauccau

SEQ ID NO: 1124530 - RNA, 14 nt, Homo sapiens
uugcuucucuagcu

SEQ ID NO: 1124531 - RNA, 19 nt, Homo sapiens
uuggaacaggguuggcauu

SEQ ID NO: 1124532 - RNA, 21 nt, Homo sapiens
uuggacuccaggccugaccag

SEQ ID NO: 1124533 - RNA, 15 nt, Homo sapiens
uugggcccuuugagu

SEQ ID NO: 1124534 - RNA, 20 nt, Homo sapiens
uuguaucaaaugugacauua

SEQ ID NO: 1124535 - RNA, 16 nt, Homo sapiens
uugucgggacagagag

SEQ ID NO: 1124536 - RNA, 23 nt, Homo sapiens
uuguuauuuucgcacaaugggaa

SEQ ID NO: 1124537 - RNA, 21 nt, Homo sapiens
uuguuucaaaugaaacuuuaa

SEQ ID NO: 1124538 - RNA, 16 nt, Homo sapiens
uuuacagaacuguugu

SEQ ID NO: 1124539 - RNA, 21 nt, Homo sapiens
uuuaccugaaauaaaauucau

SEQ ID NO: 1124540 - RNA, 18 nt, Homo sapiens
uuuagacccugcauuuau

SEQ ID NO: 1124541 - RNA, 15 nt, Homo sapiens
uuuaguaaauaaaca

SEQ ID NO: 1124542 - RNA, 21 nt, Homo sapiens
uuuauauuuuuuuaacuguga

SEQ ID NO: 1124543 - RNA, 14 nt, Homo sapiens
uuuauuacauauga

SEQ ID NO: 1124544 - RNA, 15 nt, Homo sapiens
uuuccgaaaucagaa

SEQ ID NO: 1124545 - RNA, 13 nt, Homo sapiens
uuuccuccccacc

SEQ ID NO: 1124546 - RNA, 18 nt, Homo sapiens
uuugaaacaaaguacucu

SEQ ID NO: 1124547 - RNA, 17 nt, Homo sapiens
uuugauuaaagacucca

SEQ ID NO: 1124548 - RNA, 13 nt, Homo sapiens
uuugcacugacaa

SEQ ID NO: 1124549 - RNA, 15 nt, Homo sapiens
uuuggggccucaaga

SEQ ID NO: 1124550 - RNA, 12 nt, Homo sapiens
uuugugcaagac

SEQ ID NO: 1124551 - RNA, 15 nt, Homo sapiens
uuuguuuugcacuga

SEQ ID NO: 1124552 - RNA, 18 nt, Homo sapiens
uuuuaguuuguucuucag

SEQ ID NO: 1124553 - RNA, 18 nt, Homo sapiens
cacuaggguccaccagga

SEQ ID NO: 1124554 - RNA, 14 nt, Homo sapiens
cacuauuacuggga

SEQ ID NO: 1124555 - RNA, 14 nt, Homo sapiens
cacugccaugccuc

SEQ ID NO: 1124556 - RNA, 22 nt, Homo sapiens
cacuucuaccugcccccaucau

SEQ ID NO: 1124557 - RNA, 14 nt, Homo sapiens
cagaacucuuucaa

SEQ ID NO: 1124558 - RNA, 16 nt, Homo sapiens
cagaacuguuguuuac

SEQ ID NO: 1124559 - RNA, 23 nt, Homo sapiens
cagaagcauugccuggacugacc

SEQ ID NO: 1124560 - RNA, 18 nt, Homo sapiens
cagaaucacagcccucau

SEQ ID NO: 1124561 - RNA, 20 nt, Homo sapiens
cagagcaagacucugucuca

SEQ ID NO: 1124562 - RNA, 17 nt, Homo sapiens
cagagcucacagcugga

SEQ ID NO: 1124563 - RNA, 15 nt, Homo sapiens
cagagcuucccugac

SEQ ID NO: 1124564 - RNA, 23 nt, Homo sapiens
cagagugagacccagcccucauc

SEQ ID NO: 1124565 - RNA, 17 nt, Homo sapiens
cagauaacuucuuuagg

SEQ ID NO: 1124566 - RNA, 17 nt, Homo sapiens
cagaugaugcuuuggaa

SEQ ID NO: 1124567 - RNA, 17 nt, Homo sapiens
cagauguaaaugccaca

SEQ ID NO: 1124568 - RNA, 13 nt, Homo sapiens
cagcagucaugca

SEQ ID NO: 1124569 - RNA, 16 nt, Homo sapiens
cagcaucugaccaucu

SEQ ID NO: 1124570 - RNA, 17 nt, Homo sapiens
cagccaaaaaggacuuu

SEQ ID NO: 1124571 - RNA, 17 nt, Homo sapiens
cagccugcucuaguggg

SEQ ID NO: 1124572 - RNA, 13 nt, Homo sapiens
cagcuggacaggu

SEQ ID NO: 1124573 - RNA, 23 nt, Homo sapiens
cagcuguggccuaggcuaccuca

SEQ ID NO: 1124574 - RNA, 23 nt, Homo sapiens
caggaggucugguccgagucuca

SEQ ID NO: 1124575 - RNA, 23 nt, Homo sapiens
caggaguucucccaccaccucac

SEQ ID NO: 1124576 - RNA, 13 nt, Homo sapiens
caggcauugccaa

SEQ ID NO: 1124577 - RNA, 13 nt, Homo sapiens
cagggaagaaggu

SEQ ID NO: 1124578 - RNA, 21 nt, Homo sapiens
caggggcuucuuucuuuucga

SEQ ID NO: 1124579 - RNA, 18 nt, Homo sapiens
caggguggaugaucucaa

SEQ ID NO: 1124580 - RNA, 19 nt, Homo sapiens
caggugguaagcaccagga

SEQ ID NO: 1124581 - RNA, 19 nt, Homo sapiens
cagguucucuuugagucaa

SEQ ID NO: 1124582 - RNA, 16 nt, Homo sapiens
caguaaacacuccaca

SEQ ID NO: 1124583 - RNA, 17 nt, Homo sapiens
caguaaauagugucaua

SEQ ID NO: 1124584 - RNA, 16 nt, Homo sapiens
caguaugcaaagcaau

SEQ ID NO: 1124585 - RNA, 13 nt, Homo sapiens
cagucacuggaaa

SEQ ID NO: 1124586 - RNA, 22 nt, Homo sapiens
cagucuuccauuugcaagggaa

SEQ ID NO: 1124587 - RNA, 20 nt, Homo sapiens
cagugagcugauaucaugcc

SEQ ID NO: 1124588 - RNA, 17 nt, Homo sapiens
cagugagggcucuggau

SEQ ID NO: 1124589 - RNA, 16 nt, Homo sapiens
cagugcccaugggcua

SEQ ID NO: 1124590 - RNA, 20 nt, Homo sapiens
caguguuaaaugugaugaau

SEQ ID NO: 1124591 - RNA, 22 nt, Homo sapiens
caguuguguuccugacacucaa

SEQ ID NO: 1124592 - RNA, 14 nt, Homo sapiens
caguuuuucacuuc

SEQ ID NO: 1124593 - RNA, 13 nt, Homo sapiens
cauaaagcauuuu

SEQ ID NO: 1124594 - RNA, 23 nt, Homo sapiens
cauaagggcacugagcccuuccc

SEQ ID NO: 1124595 - RNA, 13 nt, Homo sapiens
cauaaguagcauu

SEQ ID NO: 1124596 - RNA, 17 nt, Homo sapiens
cauaauuacucuacuuc

SEQ ID NO: 1124597 - RNA, 22 nt, Homo sapiens
cauacgguaugauauugcagcu

SEQ ID NO: 1124598 - RNA, 13 nt, Homo sapiens
cauauaaacucau

SEQ ID NO: 1124599 - RNA, 14 nt, Homo sapiens
cauauacuagggaa

SEQ ID NO: 1124600 - RNA, 17 nt, Homo sapiens
caucagugcucccucac

SEQ ID NO: 1124601 - RNA, 12 nt, Homo sapiens
cauccaacacug

SEQ ID NO: 1124602 - RNA, 13 nt, Homo sapiens
cauccaacacugg

SEQ ID NO: 1124603 - RNA, 22 nt, Homo sapiens
caucuaaccucaucuucuucac

SEQ ID NO: 1124604 - RNA, 14 nt, Homo sapiens
caucuagaauucac

SEQ ID NO: 1124605 - RNA, 17 nt, Homo sapiens
caucuagaauucacuga

SEQ ID NO: 1124606 - RNA, 16 nt, Homo sapiens
caugaagauucuuucc

SEQ ID NO: 1124607 - RNA, 18 nt, Homo sapiens
caugaucaucacaaucau

SEQ ID NO: 1124608 - RNA, 14 nt, Homo sapiens
caugcaagugagaa

SEQ ID NO: 1124609 - RNA, 21 nt, Homo sapiens
caugcauggauggguccucac

SEQ ID NO: 1124610 - RNA, 17 nt, Homo sapiens
caugcccuguaccugug

SEQ ID NO: 1124611 - RNA, 14 nt, Homo sapiens
cauggaggccagug

SEQ ID NO: 1124612 - RNA, 20 nt, Homo sapiens
cauggcagaagucaacgccu

SEQ ID NO: 1124613 - RNA, 17 nt, Homo sapiens
cauggcuguguuugcag

SEQ ID NO: 1124614 - RNA, 21 nt, Homo sapiens
cauguacaaaaauuaugcaau

SEQ ID NO: 1124615 - RNA, 13 nt, Homo sapiens
caugugcaccugc

SEQ ID NO: 1124616 - RNA, 14 nt, Homo sapiens
caugugcaccugcc

SEQ ID NO: 1124617 - RNA, 15 nt, Homo sapiens
cauguucccaaaaca

SEQ ID NO: 1124618 - RNA, 17 nt, Homo sapiens
cauucaauuagugguca

SEQ ID NO: 1124619 - RNA, 23 nt, Homo sapiens
cauucucagugagggcucuggau

SEQ ID NO: 1124620 - RNA, 14 nt, Homo sapiens
cauucuuugcaaua

SEQ ID NO: 1124621 - RNA, 19 nt, Homo sapiens
cauugaagccgacucuggc

SEQ ID NO: 1124622 - RNA, 22 nt, Homo sapiens
cauuuaguuugauuauucagug

SEQ ID NO: 1124623 - RNA, 15 nt, Homo sapiens
cauuuccaugcauaa

SEQ ID NO: 1124624 - RNA, 17 nt, Homo sapiens
ccaaagcuuucauguaa

SEQ ID NO: 1124625 - RNA, 17 nt, Homo sapiens
ccaauaaaagcucuucu

SEQ ID NO: 1124626 - RNA, 21 nt, Homo sapiens
ccacagaaggugaacuuugug

SEQ ID NO: 1124627 - RNA, 23 nt, Homo sapiens
ccacauccuccacguucugcuca

SEQ ID NO: 1124628 - RNA, 16 nt, Homo sapiens
ccaccaccucaccagu

SEQ ID NO: 1124629 - RNA, 16 nt, Homo sapiens
ccacuccucugacuca

SEQ ID NO: 1124630 - RNA, 16 nt, Homo sapiens
ccacuuuauugcaaug

SEQ ID NO: 1124631 - RNA, 17 nt, Homo sapiens
ccacuuuauugcaaugc

SEQ ID NO: 1124632 - RNA, 20 nt, Homo sapiens
ccagagcggcuucaccugcg

SEQ ID NO: 1124633 - RNA, 21 nt, Homo sapiens
ccaggagauggaaguugcagu

SEQ ID NO: 1124634 - RNA, 23 nt, Homo sapiens
ccaggcaggggugggagagccag

SEQ ID NO: 1124635 - RNA, 18 nt, Homo sapiens
ccaggcccgagaugugac

SEQ ID NO: 1124636 - RNA, 14 nt, Homo sapiens
ccaggccugaccag

SEQ ID NO: 1124637 - RNA, 17 nt, Homo sapiens
ccaggcugcccaucagg

SEQ ID NO: 1124638 - RNA, 13 nt, Homo sapiens
ccaggcuggauac

SEQ ID NO: 1124639 - RNA, 18 nt, Homo sapiens
ccaggguggaugaucuca

SEQ ID NO: 1124640 - RNA, 18 nt, Homo sapiens
ccagguuucuacaccccc

SEQ ID NO: 1124641 - RNA, 14 nt, Homo sapiens
ccauaaaguacaaa

SEQ ID NO: 1124642 - RNA, 20 nt, Homo sapiens
ccauauuuucaccauuugau

SEQ ID NO: 1124643 - RNA, 23 nt, Homo sapiens
ccaucguauuaaaaaacaauuaa

SEQ ID NO: 1124644 - RNA, 21 nt, Homo sapiens
ccaucuggcuuuuucugccac

SEQ ID NO: 1124645 - RNA, 19 nt, Homo sapiens
ccaugaaccaagaccauug

SEQ ID NO: 1124646 - RNA, 15 nt, Homo sapiens
ccaugccucaagaac

SEQ ID NO: 1124647 - RNA, 16 nt, Homo sapiens
ccauggugugaucguc

SEQ ID NO: 1124648 - RNA, 15 nt, Homo sapiens
ccauuaggcaugccu

SEQ ID NO: 1124649 - RNA, 18 nt, Homo sapiens
ccauuaggcaugccuaau

SEQ ID NO: 1124650 - RNA, 14 nt, Homo sapiens
ccauucacuacuca

SEQ ID NO: 1124651 - RNA, 14 nt, Homo sapiens
cccaaauguauucu

SEQ ID NO: 1124652 - RNA, 13 nt, Homo sapiens
cccacaauggagu

SEQ ID NO: 1124653 - RNA, 20 nt, Homo sapiens
cccaccacgugcucaaucau

SEQ ID NO: 1124654 - RNA, 19 nt, Homo sapiens
cccagcucuucucuuccua

SEQ ID NO: 1124655 - RNA, 22 nt, Homo sapiens
cccaggcuggauacuaagcaca

SEQ ID NO: 1124656 - RNA, 18 nt, Homo sapiens
cccauagcacugggcucu

SEQ ID NO: 1124657 - RNA, 23 nt, Homo sapiens
ccccacaauuccauuacuaagaa

SEQ ID NO: 1124658 - RNA, 12 nt, Homo sapiens
cccccugugcag

SEQ ID NO: 1124659 - RNA, 23 nt, Homo sapiens
cccgccaaggaaaggcauguaca

SEQ ID NO: 1124660 - RNA, 13 nt, Homo sapiens
cccucccagagaa

SEQ ID NO: 1124661 - RNA, 18 nt, Homo sapiens
cccugacgacacugaaga

SEQ ID NO: 1124662 - RNA, 12 nt, Homo sapiens
auaugacugcau

SEQ ID NO: 1124663 - RNA, 20 nt, Homo sapiens
auaugauauauaaaugugau

SEQ ID NO: 1124664 - RNA, 17 nt, Homo sapiens
auaugaucaaacuucca

SEQ ID NO: 1124665 - RNA, 17 nt, Homo sapiens
auauguauuucuauaua

SEQ ID NO: 1124666 - RNA, 12 nt, Homo sapiens
auauucccugac

SEQ ID NO: 1124667 - RNA, 19 nt, Homo sapiens
auauuuuaaaaucugucac

SEQ ID NO: 1124668 - RNA, 19 nt, Homo sapiens
auauuuugaaaugaacuuu

SEQ ID NO: 1124669 - RNA, 17 nt, Homo sapiens
auauuuuuccacuuaaa

SEQ ID NO: 1124670 - RNA, 15 nt, Homo sapiens
auauuuuugugcaca

SEQ ID NO: 1124671 - RNA, 17 nt, Homo sapiens
auauuuuugugcacauu

SEQ ID NO: 1124672 - RNA, 23 nt, Homo sapiens
aucaaacaugcauggaugggucc

SEQ ID NO: 1124673 - RNA, 22 nt, Homo sapiens
aucaaaugugacauuauaugca

SEQ ID NO: 1124674 - RNA, 16 nt, Homo sapiens
aucagaacuguuggca

SEQ ID NO: 1124675 - RNA, 15 nt, Homo sapiens
aucagagggugacug

SEQ ID NO: 1124676 - RNA, 13 nt, Homo sapiens
aucagccacggag

SEQ ID NO: 1124677 - RNA, 19 nt, Homo sapiens
aucauaagggcacugagcc

SEQ ID NO: 1124678 - RNA, 20 nt, Homo sapiens
aucaugauccuuguguucag

SEQ ID NO: 1124679 - RNA, 15 nt, Homo sapiens
aucauguguguccac

SEQ ID NO: 1124680 - RNA, 13 nt, Homo sapiens
auccaacacugga

SEQ ID NO: 1124681 - RNA, 19 nt, Homo sapiens
auccaacacuggaugguca

SEQ ID NO: 1124682 - RNA, 16 nt, Homo sapiens
auccaagccagaguuu

SEQ ID NO: 1124683 - RNA, 14 nt, Homo sapiens
auccacaugggagc

SEQ ID NO: 1124684 - RNA, 20 nt, Homo sapiens
auccagcucuugcucaguga

SEQ ID NO: 1124685 - RNA, 17 nt, Homo sapiens
auccaugaaccaagacc

SEQ ID NO: 1124686 - RNA, 22 nt, Homo sapiens
auccccuaagcagaccacugau

SEQ ID NO: 1124687 - RNA, 16 nt, Homo sapiens
aucccugccuguuaag

SEQ ID NO: 1124688 - RNA, 22 nt, Homo sapiens
aucccuucccuguccaccucac

SEQ ID NO: 1124689 - RNA, 23 nt, Homo sapiens
aucggaucuggggcucugggaua

SEQ ID NO: 1124690 - RNA, 17 nt, Homo sapiens
aucucaauguacauaga

SEQ ID NO: 1124691 - RNA, 12 nt, Homo sapiens
aucugaccaucu

SEQ ID NO: 1124692 - RNA, 13 nt, Homo sapiens
aucugaccaucug

SEQ ID NO: 1124693 - RNA, 19 nt, Homo sapiens
aucuucuuuggacuucuga

SEQ ID NO: 1124694 - RNA, 20 nt, Homo sapiens
aucuugcuucugcuucucau

SEQ ID NO: 1124695 - RNA, 13 nt, Homo sapiens
augaacacuuuuu

SEQ ID NO: 1124696 - RNA, 21 nt, Homo sapiens
augaagaucuuuauauuucaa

SEQ ID NO: 1124697 - RNA, 13 nt, Homo sapiens
augaagguaauau

SEQ ID NO: 1124698 - RNA, 12 nt, Homo sapiens
augaaugaaacu

SEQ ID NO: 1124699 - RNA, 22 nt, Homo sapiens
augagaauuugagugcucugau

SEQ ID NO: 1124700 - RNA, 13 nt, Homo sapiens
augagacagacau

SEQ ID NO: 1124701 - RNA, 15 nt, Homo sapiens
augaucaaacuucca

SEQ ID NO: 1124702 - RNA, 16 nt, Homo sapiens
augaucaaacuuccau

SEQ ID NO: 1124703 - RNA, 13 nt, Homo sapiens
augcaagugagaa

SEQ ID NO: 1124704 - RNA, 22 nt, Homo sapiens
augcacuguucccccugugcag

SEQ ID NO: 1124705 - RNA, 13 nt, Homo sapiens
augcaucaucagc

SEQ ID NO: 1124706 - RNA, 19 nt, Homo sapiens
augccuaauauuuaggcaa

SEQ ID NO: 1124707 - RNA, 18 nt, Homo sapiens
augcggccucugagacau

SEQ ID NO: 1124708 - RNA, 18 nt, Homo sapiens
auggagggagccaucccu

SEQ ID NO: 1124709 - RNA, 17 nt, Homo sapiens
auggcccugcaaaagga

SEQ ID NO: 1124710 - RNA, 16 nt, Homo sapiens
augggauauuuugaaa

SEQ ID NO: 1124711 - RNA, 19 nt, Homo sapiens
augguaauagcuuuaguga

SEQ ID NO: 1124712 - RNA, 13 nt, Homo sapiens
auggugaacucca

SEQ ID NO: 1124713 - RNA, 14 nt, Homo sapiens
auggugaagggaag

SEQ ID NO: 1124714 - RNA, 14 nt, Homo sapiens
auguaaacugugca

SEQ ID NO: 1124715 - RNA, 16 nt, Homo sapiens
auguaaacugugcacc

SEQ ID NO: 1124716 - RNA, 16 nt, Homo sapiens
auguaaaugccacaaa

SEQ ID NO: 1124717 - RNA, 23 nt, Homo sapiens
auguaacauguaggaaguaggaa

SEQ ID NO: 1124718 - RNA, 14 nt, Homo sapiens
auguauucuaugaa

SEQ ID NO: 1124719 - RNA, 17 nt, Homo sapiens
augugaaaauguauucu

SEQ ID NO: 1124720 - RNA, 18 nt, Homo sapiens
auguuagccacaguguau

SEQ ID NO: 1124721 - RNA, 17 nt, Homo sapiens
auuaccucugauaccuc

SEQ ID NO: 1124722 - RNA, 20 nt, Homo sapiens
auuacuggaaggcuuccacu

SEQ ID NO: 1124723 - RNA, 22 nt, Homo sapiens
auuauuugcuauggcaggauaa

SEQ ID NO: 1124724 - RNA, 14 nt, Homo sapiens
auucacaguaauau

SEQ ID NO: 1124725 - RNA, 22 nt, Homo sapiens
auucaccuuccagugucucgga

SEQ ID NO: 1124726 - RNA, 12 nt, Homo sapiens
auucaguguuaa

SEQ ID NO: 1124727 - RNA, 17 nt, Homo sapiens
auuccccucgugugacu

SEQ ID NO: 1124728 - RNA, 19 nt, Homo sapiens
auucucugucucauccauc

SEQ ID NO: 1124729 - RNA, 17 nt, Homo sapiens
auucuggucuucacugc

SEQ ID NO: 1124730 - RNA, 19 nt, Homo sapiens
auucuggucuucacugcca

SEQ ID NO: 1124731 - RNA, 12 nt, Homo sapiens
auugaaugaaac

SEQ ID NO: 1124732 - RNA, 18 nt, Homo sapiens
auuuagacccugcauuua

SEQ ID NO: 1124733 - RNA, 22 nt, Homo sapiens
auuuaguuugauuauucagugu

SEQ ID NO: 1124734 - RNA, 16 nt, Homo sapiens
auuuggcaaugccauc

SEQ ID NO: 1124735 - RNA, 16 nt, Homo sapiens
auuuguauaugacugc

SEQ ID NO: 1124736 - RNA, 16 nt, Homo sapiens
auuuuaaaauuaggaa

SEQ ID NO: 1124737 - RNA, 17 nt, Homo sapiens
auuuugaaaugaacuuu

SEQ ID NO: 1124738 - RNA, 14 nt, Homo sapiens
auuuuuccacuuaa

SEQ ID NO: 1124739 - RNA, 22 nt, Homo sapiens
auuuuugaaacccauuaggcau

SEQ ID NO: 1124740 - RNA, 14 nt, Homo sapiens
auuuuugugcacau

SEQ ID NO: 1124741 - RNA, 22 nt, Homo sapiens
caaaaaucuguguaacuguaaa

SEQ ID NO: 1124742 - RNA, 23 nt, Homo sapiens
caaaaugcuucugcacacaaaac

SEQ ID NO: 1124743 - RNA, 22 nt, Homo sapiens
caaaauggagggagccaucccu

SEQ ID NO: 1124744 - RNA, 17 nt, Homo sapiens
caaacacuccacccucc

SEQ ID NO: 1124745 - RNA, 13 nt, Homo sapiens
caaaccagagcag

SEQ ID NO: 1124746 - RNA, 18 nt, Homo sapiens
caaacucauccucuuuua

SEQ ID NO: 1124747 - RNA, 17 nt, Homo sapiens
caaagcuuucauguaaa

SEQ ID NO: 1124748 - RNA, 14 nt, Homo sapiens
caaauaaaauauca

SEQ ID NO: 1124749 - RNA, 14 nt, Homo sapiens
caaaugaaacuuua

SEQ ID NO: 1124750 - RNA, 21 nt, Homo sapiens
caaccgaaucucaauguacau

SEQ ID NO: 1124751 - RNA, 12 nt, Homo sapiens
caaccucaguga

SEQ ID NO: 1124752 - RNA, 18 nt, Homo sapiens
caaccugccugacauuug

SEQ ID NO: 1124753 - RNA, 13 nt, Homo sapiens
caaccugggaugu

SEQ ID NO: 1124754 - RNA, 22 nt, Homo sapiens
caaccugggauguagcggugaa

SEQ ID NO: 1124755 - RNA, 16 nt, Homo sapiens
caacucauuuucauau

SEQ ID NO: 1124756 - RNA, 15 nt, Homo sapiens
caacucuuugagaaa

SEQ ID NO: 1124757 - RNA, 17 nt, Homo sapiens
caagaaguaaucaguau

SEQ ID NO: 1124758 - RNA, 19 nt, Homo sapiens
caagacucugucucaaaaa

SEQ ID NO: 1124759 - RNA, 14 nt, Homo sapiens
caagaucugaauuu

SEQ ID NO: 1124760 - RNA, 17 nt, Homo sapiens
caaucaugaguaccuca

SEQ ID NO: 1124761 - RNA, 18 nt, Homo sapiens
caauccagcuauguuaua

SEQ ID NO: 1124762 - RNA, 13 nt, Homo sapiens
caaucuuuuauac

SEQ ID NO: 1124763 - RNA, 19 nt, Homo sapiens
caauguacauagacccucu

SEQ ID NO: 1124764 - RNA, 13 nt, Homo sapiens
caauuccucuggg

SEQ ID NO: 1124765 - RNA, 17 nt, Homo sapiens
caauuuuaaaucugaga

SEQ ID NO: 1124766 - RNA, 20 nt, Homo sapiens
cacaaagaagaaguuuaaaa

SEQ ID NO: 1124767 - RNA, 22 nt, Homo sapiens
cacauacgggcuuuaauaguca

SEQ ID NO: 1124768 - RNA, 15 nt, Homo sapiens
cacaugaugugcaua

SEQ ID NO: 1124769 - RNA, 19 nt, Homo sapiens
cacccccaugcagccucuu

SEQ ID NO: 1124770 - RNA, 22 nt, Homo sapiens
cacgccuguaaucccagcacuu

SEQ ID NO: 1124771 - RNA, 16 nt, Homo sapiens
cacuagccugugcacg

SEQ ID NO: 1124772 - RNA, 19 nt, Homo sapiens
agaauugcuugaacccagg

SEQ ID NO: 1124773 - RNA, 20 nt, Homo sapiens
agacaagaaggccacuggua

SEQ ID NO: 1124774 - RNA, 13 nt, Homo sapiens
agacagacauuca

SEQ ID NO: 1124775 - RNA, 19 nt, Homo sapiens
agaccaaaggauccagaga

SEQ ID NO: 1124776 - RNA, 14 nt, Homo sapiens
agaccuggcucuca

SEQ ID NO: 1124777 - RNA, 12 nt, Homo sapiens
agacucaccuca

SEQ ID NO: 1124778 - RNA, 13 nt, Homo sapiens
agacucugucuca

SEQ ID NO: 1124779 - RNA, 17 nt, Homo sapiens
agacuggggacccugga

SEQ ID NO: 1124780 - RNA, 15 nt, Homo sapiens
agacuuggggaccag

SEQ ID NO: 1124781 - RNA, 12 nt, Homo sapiens
agagagggacuc

SEQ ID NO: 1124782 - RNA, 14 nt, Homo sapiens
agagccagcucucu

SEQ ID NO: 1124783 - RNA, 14 nt, Homo sapiens
agagcuucccugac

SEQ ID NO: 1124784 - RNA, 21 nt, Homo sapiens
agagugccagucagcagucau

SEQ ID NO: 1124785 - RNA, 22 nt, Homo sapiens
agaguggaaucucuuggaugca

SEQ ID NO: 1124786 - RNA, 20 nt, Homo sapiens
agauaaaaugauguuauaca

SEQ ID NO: 1124787 - RNA, 15 nt, Homo sapiens
agauagcuacagugu

SEQ ID NO: 1124788 - RNA, 20 nt, Homo sapiens
agaucaaacaugcauggaug

SEQ ID NO: 1124789 - RNA, 14 nt, Homo sapiens
agauguaaaugcca

SEQ ID NO: 1124790 - RNA, 15 nt, Homo sapiens
agauguaaaugccac

SEQ ID NO: 1124791 - RNA, 17 nt, Homo sapiens
agauguaaaugccacaa

SEQ ID NO: 1124792 - RNA, 21 nt, Homo sapiens
agaugugacccaccagugccu

SEQ ID NO: 1124793 - RNA, 19 nt, Homo sapiens
agauguucuaagucuuucc

SEQ ID NO: 1124794 - RNA, 15 nt, Homo sapiens
agauugaacuuuccc

SEQ ID NO: 1124795 - RNA, 15 nt, Homo sapiens
agauuuaauucccaa

SEQ ID NO: 1124796 - RNA, 17 nt, Homo sapiens
agauuuugucgggacag

SEQ ID NO: 1124797 - RNA, 16 nt, Homo sapiens
agcaaaaagacuggau

SEQ ID NO: 1124798 - RNA, 20 nt, Homo sapiens
agcaaaauacaugacauuua

SEQ ID NO: 1124799 - RNA, 18 nt, Homo sapiens
agcaagacucugucucaa

SEQ ID NO: 1124800 - RNA, 15 nt, Homo sapiens
agcaauaaaaugcua

SEQ ID NO: 1124801 - RNA, 16 nt, Homo sapiens
agcaauaugcauuuaa

SEQ ID NO: 1124802 - RNA, 23 nt, Homo sapiens
agcaauuccaggcugagccauga

SEQ ID NO: 1124803 - RNA, 15 nt, Homo sapiens
agcacaaagcccaua

SEQ ID NO: 1124804 - RNA, 22 nt, Homo sapiens
agcacaaagcccauagcacugg

SEQ ID NO: 1124805 - RNA, 14 nt, Homo sapiens
agcacgcugaaggc

SEQ ID NO: 1124806 - RNA, 22 nt, Homo sapiens
agcacuuuaacccucucuuccc

SEQ ID NO: 1124807 - RNA, 23 nt, Homo sapiens
agcacuuuaacccucucuucccu

SEQ ID NO: 1124808 - RNA, 21 nt, Homo sapiens
agcauacgguaugauauugca

SEQ ID NO: 1124809 - RNA, 16 nt, Homo sapiens
agcaucugaccaucug

SEQ ID NO: 1124810 - RNA, 20 nt, Homo sapiens
agcaucugaccaucugugac

SEQ ID NO: 1124811 - RNA, 18 nt, Homo sapiens
agccaggaguaagacaag

SEQ ID NO: 1124812 - RNA, 17 nt, Homo sapiens
agccauaugaaugucag

SEQ ID NO: 1124813 - RNA, 19 nt, Homo sapiens
agccauauuugauaguaua

SEQ ID NO: 1124814 - RNA, 17 nt, Homo sapiens
agcccauagcacugggc

SEQ ID NO: 1124815 - RNA, 16 nt, Homo sapiens
agccccauccaacacu

SEQ ID NO: 1124816 - RNA, 15 nt, Homo sapiens
agcccucaugaucau

SEQ ID NO: 1124817 - RNA, 15 nt, Homo sapiens
agcccugaacgugag

SEQ ID NO: 1124818 - RNA, 13 nt, Homo sapiens
agccgacucuggc

SEQ ID NO: 1124819 - RNA, 19 nt, Homo sapiens
agccugcucuagugggaca

SEQ ID NO: 1124820 - RNA, 22 nt, Homo sapiens
agccuggagggaugccacccag

SEQ ID NO: 1124821 - RNA, 21 nt, Homo sapiens
agccuggcugcccaucaugug

SEQ ID NO: 1124822 - RNA, 22 nt, Homo sapiens
agccugucaccagagcuucucu

SEQ ID NO: 1124823 - RNA, 19 nt, Homo sapiens
agcgaggaggcuccagagg

SEQ ID NO: 1124824 - RNA, 18 nt, Homo sapiens
agcugaaaaagauggaau

SEQ ID NO: 1124825 - RNA, 15 nt, Homo sapiens
agcugggcaugaacg

SEQ ID NO: 1124826 - RNA, 19 nt, Homo sapiens
agcuguggccagcuuguua

SEQ ID NO: 1124827 - RNA, 18 nt, Homo sapiens
agcuuagacuaaggccau

SEQ ID NO: 1124828 - RNA, 14 nt, Homo sapiens
agcuucucugugaa

SEQ ID NO: 1124829 - RNA, 13 nt, Homo sapiens
agcuugaggccaa

SEQ ID NO: 1124830 - RNA, 15 nt, Homo sapiens
aggaaaaaugggagc

SEQ ID NO: 1124831 - RNA, 11 nt, Homo sapiens
aggacaaugcc

SEQ ID NO: 1124832 - RNA, 22 nt, Homo sapiens
aggaggggcccacaauggagug

SEQ ID NO: 1124833 - RNA, 12 nt, Homo sapiens
aggcaagcacuu

SEQ ID NO: 1124834 - RNA, 23 nt, Homo sapiens
aggcaauaauaagugaugugcug

SEQ ID NO: 1124835 - RNA, 15 nt, Homo sapiens
aggcagcagugugag

SEQ ID NO: 1124836 - RNA, 14 nt, Homo sapiens
aggcauguacaaaa

SEQ ID NO: 1124837 - RNA, 12 nt, Homo sapiens
aggcccucgcug

SEQ ID NO: 1124838 - RNA, 17 nt, Homo sapiens
aggccucgccccaacac

SEQ ID NO: 1124839 - RNA, 22 nt, Homo sapiens
aggccucuccaguuugcaccug

SEQ ID NO: 1124840 - RNA, 23 nt, Homo sapiens
aggcugucaggauucuucaagga

SEQ ID NO: 1124841 - RNA, 12 nt, Homo sapiens
aggcuuacuuca

SEQ ID NO: 1124842 - RNA, 16 nt, Homo sapiens
agggagcccccagagg

SEQ ID NO: 1124843 - RNA, 14 nt, Homo sapiens
agggcacugggcug

SEQ ID NO: 1124844 - RNA, 16 nt, Homo sapiens
agggccacaugggagg

SEQ ID NO: 1124845 - RNA, 21 nt, Homo sapiens
aggggccuuagggcacugggc

SEQ ID NO: 1124846 - RNA, 16 nt, Homo sapiens
agguccuggugguauu

SEQ ID NO: 1124847 - RNA, 20 nt, Homo sapiens
aggucugguccgagucucag

SEQ ID NO: 1124848 - RNA, 21 nt, Homo sapiens
aggugacugaaggcugucagg

SEQ ID NO: 1124849 - RNA, 17 nt, Homo sapiens
aggugagaccaaaggau

SEQ ID NO: 1124850 - RNA, 20 nt, Homo sapiens
aggugguaagcaccaggacg

SEQ ID NO: 1124851 - RNA, 21 nt, Homo sapiens
agguguuguauauagagugga

SEQ ID NO: 1124852 - RNA, 17 nt, Homo sapiens
agguuagugacauuuaa

SEQ ID NO: 1124853 - RNA, 20 nt, Homo sapiens
aguacagauguaaaugccac

SEQ ID NO: 1124854 - RNA, 20 nt, Homo sapiens
aguaccgcccucggggcccg

SEQ ID NO: 1124855 - RNA, 21 nt, Homo sapiens
agucaaccugccugacauuug

SEQ ID NO: 1124856 - RNA, 22 nt, Homo sapiens
agucaccuauccacccucugca

SEQ ID NO: 1124857 - RNA, 15 nt, Homo sapiens
aguccaggguggaug

SEQ ID NO: 1124858 - RNA, 17 nt, Homo sapiens
aguccuaaaaguucuca

SEQ ID NO: 1124859 - RNA, 20 nt, Homo sapiens
aguccuuugggauucuagga

SEQ ID NO: 1124860 - RNA, 23 nt, Homo sapiens
aguguaaaaaaugucucauguca

SEQ ID NO: 1124861 - RNA, 20 nt, Homo sapiens
aguguccccuuauacagugg

SEQ ID NO: 1124862 - RNA, 16 nt, Homo sapiens
aguguuccccuuccac

SEQ ID NO: 1124863 - RNA, 22 nt, Homo sapiens
aguuaagaauggaagaaaacgg

SEQ ID NO: 1124864 - RNA, 16 nt, Homo sapiens
aguucauaauguggug

SEQ ID NO: 1124865 - RNA, 16 nt, Homo sapiens
aguuuucggaaacacu

SEQ ID NO: 1124866 - RNA, 20 nt, Homo sapiens
auaaaauguuucauuaugca

SEQ ID NO: 1124867 - RNA, 16 nt, Homo sapiens
auaaacagucacugga

SEQ ID NO: 1124868 - RNA, 17 nt, Homo sapiens
auaaaccagauuccaga

SEQ ID NO: 1124869 - RNA, 16 nt, Homo sapiens
auaaacucauuuaucu

SEQ ID NO: 1124870 - RNA, 18 nt, Homo sapiens
auaaacugacuaaacuua

SEQ ID NO: 1124871 - RNA, 14 nt, Homo sapiens
auaaguagcauuca

SEQ ID NO: 1124872 - RNA, 16 nt, Homo sapiens
auacaucaauauguau

SEQ ID NO: 1124873 - RNA, 21 nt, Homo sapiens
auaccucaacccccauuucua

SEQ ID NO: 1124874 - RNA, 17 nt, Homo sapiens
auacugggaaucaagac

SEQ ID NO: 1124875 - RNA, 12 nt, Homo sapiens
auagaguggaau

SEQ ID NO: 1124876 - RNA, 21 nt, Homo sapiens
auagauccauuuggacaaaau

SEQ ID NO: 1124877 - RNA, 17 nt, Homo sapiens
auagcuacaguguaaua

SEQ ID NO: 1124878 - RNA, 22 nt, Homo sapiens
auagcuugucuucguccaucug

SEQ ID NO: 1124879 - RNA, 16 nt, Homo sapiens
auaguguuaacuguca

SEQ ID NO: 1124880 - RNA, 23 nt, Homo sapiens
auaucaugccccuguacuccagc

SEQ ID NO: 1124881 - RNA, 16 nt, Homo sapiens
aauaaugaacacuaca

SEQ ID NO: 1124882 - RNA, 21 nt, Homo sapiens
aauacagucuuccauuugcaa

SEQ ID NO: 1124883 - RNA, 20 nt, Homo sapiens
aauauauauuaagugugcca

SEQ ID NO: 1124884 - RNA, 20 nt, Homo sapiens
aauaucaaauaaaauaucau

SEQ ID NO: 1124885 - RNA, 17 nt, Homo sapiens
aauaucauaaagcauuu

SEQ ID NO: 1124886 - RNA, 19 nt, Homo sapiens
aauaugucugccacagaga

SEQ ID NO: 1124887 - RNA, 23 nt, Homo sapiens
aauauuuacuaacuaaauaccau

SEQ ID NO: 1124888 - RNA, 14 nt, Homo sapiens
aauauuuaggcaag

SEQ ID NO: 1124889 - RNA, 14 nt, Homo sapiens
aaucaaaugcaauu

SEQ ID NO: 1124890 - RNA, 21 nt, Homo sapiens
aaucacagcccucaugaucau

SEQ ID NO: 1124891 - RNA, 17 nt, Homo sapiens
aaucacaguuguguucc

SEQ ID NO: 1124892 - RNA, 20 nt, Homo sapiens
aaucaugauccuuguguuca

SEQ ID NO: 1124893 - RNA, 19 nt, Homo sapiens
aaucauuucuagauuauaa

SEQ ID NO: 1124894 - RNA, 20 nt, Homo sapiens
aauccaugaaccaagaccau

SEQ ID NO: 1124895 - RNA, 15 nt, Homo sapiens
aaucccagcuacuug

SEQ ID NO: 1124896 - RNA, 19 nt, Homo sapiens
aaucucuuggaugcagcuu

SEQ ID NO: 1124897 - RNA, 19 nt, Homo sapiens
aaugccccuguucauguuu

SEQ ID NO: 1124898 - RNA, 15 nt, Homo sapiens
aaugugauugcagcu

SEQ ID NO: 1124899 - RNA, 12 nt, Homo sapiens
aauuaagcauuu

SEQ ID NO: 1124900 - RNA, 16 nt, Homo sapiens
aauuauguuacuguau

SEQ ID NO: 1124901 - RNA, 19 nt, Homo sapiens
acaaagcccauagcacugg

SEQ ID NO: 1124902 - RNA, 19 nt, Homo sapiens
acaaagcucaaaguaugca

SEQ ID NO: 1124903 - RNA, 18 nt, Homo sapiens
acaagaaggccacuggua

SEQ ID NO: 1124904 - RNA, 19 nt, Homo sapiens
acaagcuguaucacugccu

SEQ ID NO: 1124905 - RNA, 14 nt, Homo sapiens
acaaucagcuccuu

SEQ ID NO: 1124906 - RNA, 17 nt, Homo sapiens
acaauggagugggagau

SEQ ID NO: 1124907 - RNA, 15 nt, Homo sapiens
acaauuaacugcccu

SEQ ID NO: 1124908 - RNA, 23 nt, Homo sapiens
uugauaagcuauugucuguaaua

SEQ ID NO: 1124909 - RNA, 19 nt, Homo sapiens
uugaugauuaauucaccuu

SEQ ID NO: 1124910 - RNA, 14 nt, Homo sapiens
uugaugcaugcacu

SEQ ID NO: 1124911 - RNA, 12 nt, Homo sapiens
uugccacuuaac

SEQ ID NO: 1124912 - RNA, 16 nt, Homo sapiens
uugccucuugcaaugc

SEQ ID NO: 1124913 - RNA, 20 nt, Homo sapiens
uugggauugagucugugcca

SEQ ID NO: 1124914 - RNA, 19 nt, Homo sapiens
uuguaauaugucugccaca

SEQ ID NO: 1124915 - RNA, 17 nt, Homo sapiens
uuguauuaucaacagca

SEQ ID NO: 1124916 - RNA, 12 nt, Homo sapiens
uuguuuugcacu

SEQ ID NO: 1124917 - RNA, 14 nt, Homo sapiens
uuuaaaaaaccaug

SEQ ID NO: 1124918 - RNA, 14 nt, Homo sapiens
uuuaaaaucuguca

SEQ ID NO: 1124919 - RNA, 17 nt, Homo sapiens
uuuaaagaagugcauga

SEQ ID NO: 1124920 - RNA, 16 nt, Homo sapiens
uuuaacccucucuucc

SEQ ID NO: 1124921 - RNA, 17 nt, Homo sapiens
uuuaauuuuaaugcugu

SEQ ID NO: 1124922 - RNA, 13 nt, Homo sapiens
uuuagagagccug

SEQ ID NO: 1124923 - RNA, 21 nt, Homo sapiens
uuuauaauacuacuacuguua

SEQ ID NO: 1124924 - RNA, 17 nt, Homo sapiens
uuuaucuugucucuggg

SEQ ID NO: 1124925 - RNA, 16 nt, Homo sapiens
uuuauuaccucugaua

SEQ ID NO: 1124926 - RNA, 12 nt, Homo sapiens
uuucaauugcau

SEQ ID NO: 1124927 - RNA, 21 nt, Homo sapiens
uuucaccuguuuuuaagcugu

SEQ ID NO: 1124928 - RNA, 22 nt, Homo sapiens
uuucccaccaccuuggacuccu

SEQ ID NO: 1124929 - RNA, 21 nt, Homo sapiens
uuucgcacaaugggaaucucu

SEQ ID NO: 1124930 - RNA, 13 nt, Homo sapiens
uuucuaaccuuca

SEQ ID NO: 1124931 - RNA, 18 nt, Homo sapiens
uuucuauuuuuaugauga

SEQ ID NO: 1124932 - RNA, 16 nt, Homo sapiens
uuugaacaaagcucaa

SEQ ID NO: 1124933 - RNA, 15 nt, Homo sapiens
uuugauuauucagug

SEQ ID NO: 1124934 - RNA, 23 nt, Homo sapiens
uuugccauauuuucaccauuuga

SEQ ID NO: 1124935 - RNA, 17 nt, Homo sapiens
uuuggaauauuguccau

SEQ ID NO: 1124936 - RNA, 18 nt, Homo sapiens
uuuggagauagauggaua

SEQ ID NO: 1124937 - RNA, 15 nt, Homo sapiens
uuuggccuccuccag

SEQ ID NO: 1124938 - RNA, 15 nt, Homo sapiens
uuugggguucaagaa

SEQ ID NO: 1124939 - RNA, 20 nt, Homo sapiens
uuugucagcaucugaccauc

SEQ ID NO: 1124940 - RNA, 20 nt, Homo sapiens
uuugucaugccauuaagcuc

SEQ ID NO: 1124941 - RNA, 16 nt, Homo sapiens
uuuguuuugcacugac

SEQ ID NO: 1124942 - RNA, 16 nt, Homo sapiens
uuuucacaaucuuggg

SEQ ID NO: 1124943 - RNA, 21 nt, Homo sapiens
uuuucuaagaaagaaauugua

SEQ ID NO: 1124944 - RNA, 18 nt, Homo sapiens
uuuugcacacuuugccau

SEQ ID NO: 1124945 - RNA, 13 nt, Homo sapiens
uuuugcacugaca

SEQ ID NO: 1124946 - RNA, 13 nt, Homo sapiens
uuuugugauugcc

SEQ ID NO: 1124947 - RNA, 20 nt, Homo sapiens
uuuuucuucaugccugauga

SEQ ID NO: 1124948 - RNA, 19 nt, Homo sapiens
aguauguuuguacaguaug

SEQ ID NO: 1124949 - RNA, 18 nt, Homo sapiens
aguccaucuaacaucaua

SEQ ID NO: 1124950 - RNA, 15 nt, Homo sapiens
agucgaacaauucau

SEQ ID NO: 1124951 - RNA, 19 nt, Homo sapiens
agucucagcccugaccuuc

SEQ ID NO: 1124952 - RNA, 19 nt, Homo sapiens
agugaauaaaccaucaucu

SEQ ID NO: 1124953 - RNA, 21 nt, Homo sapiens
aguggaugacgugaagccaca

SEQ ID NO: 1124954 - RNA, 11 nt, Homo sapiens
aguguggcucc

SEQ ID NO: 1124955 - RNA, 20 nt, Homo sapiens
aguguuccccuuccacugag

SEQ ID NO: 1124956 - RNA, 23 nt, Homo sapiens
aguguuccccuuccacugagggc

SEQ ID NO: 1124957 - RNA, 23 nt, Homo sapiens
aguugcugugaacuuucauguca

SEQ ID NO: 1124958 - RNA, 15 nt, Homo sapiens
aguuuaaaaaaccau

SEQ ID NO: 1124959 - RNA, 17 nt, Homo sapiens
auaaacguccuacugua

SEQ ID NO: 1124960 - RNA, 20 nt, Homo sapiens
auaaacugacuaaacuuaca

SEQ ID NO: 1124961 - RNA, 17 nt, Homo sapiens
auaaaugccagagccaa

SEQ ID NO: 1124962 - RNA, 15 nt, Homo sapiens
auaaauggagauuca

SEQ ID NO: 1124963 - RNA, 17 nt, Homo sapiens
auaacagauaaguccau

SEQ ID NO: 1124964 - RNA, 18 nt, Homo sapiens
auaagacucacaguauaa

SEQ ID NO: 1124965 - RNA, 19 nt, Homo sapiens
auaagauauuuaguaauau

SEQ ID NO: 1124966 - RNA, 13 nt, Homo sapiens
auacguucagagg

SEQ ID NO: 1124967 - RNA, 19 nt, Homo sapiens
auacugccaaaacauuuau

SEQ ID NO: 1124968 - RNA, 19 nt, Homo sapiens
auacuucucuauuaucuca

SEQ ID NO: 1124969 - RNA, 21 nt, Homo sapiens
auagagauagcuacaguguaa

SEQ ID NO: 1124970 - RNA, 13 nt, Homo sapiens
auagagccugagg

SEQ ID NO: 1124971 - RNA, 12 nt, Homo sapiens
auagcacugggc

SEQ ID NO: 1124972 - RNA, 18 nt, Homo sapiens
auaggcgcaggugcacag

SEQ ID NO: 1124973 - RNA, 15 nt, Homo sapiens
auauagaguggaauc

SEQ ID NO: 1124974 - RNA, 20 nt, Homo sapiens
auauauuuuugugcacauuu

SEQ ID NO: 1124975 - RNA, 17 nt, Homo sapiens
auaugaaugucaguagu

SEQ ID NO: 1124976 - RNA, 16 nt, Homo sapiens
auauggugaagggaag

SEQ ID NO: 1124977 - RNA, 24 nt, Homo sapiens
auauggugaagggaaguggggagu

SEQ ID NO: 1124978 - RNA, 22 nt, Homo sapiens
auauguaauuucaaaauacauu

SEQ ID NO: 1124979 - RNA, 19 nt, Homo sapiens
auauugcagcuuauauuca

SEQ ID NO: 1124980 - RNA, 12 nt, Homo sapiens
aucaaacuucca

SEQ ID NO: 1124981 - RNA, 15 nt, Homo sapiens
aucaggacccagagg

SEQ ID NO: 1124982 - RNA, 19 nt, Homo sapiens
aucagugaauaaaccauca

SEQ ID NO: 1124983 - RNA, 14 nt, Homo sapiens
aucaucauucucau

SEQ ID NO: 1124984 - RNA, 20 nt, Homo sapiens
aucaugccccuguacuccag

SEQ ID NO: 1124985 - RNA, 16 nt, Homo sapiens
aucauucucauucuca

SEQ ID NO: 1124986 - RNA, 12 nt, Homo sapiens
auccacauggga

SEQ ID NO: 1124987 - RNA, 22 nt, Homo sapiens
auccagcucuugcucagugaag

SEQ ID NO: 1124988 - RNA, 19 nt, Homo sapiens
auccagguaauccaagaua

SEQ ID NO: 1124989 - RNA, 18 nt, Homo sapiens
aucuaacuacaaggacaa

SEQ ID NO: 1124990 - RNA, 14 nt, Homo sapiens
aucucaauguacau

SEQ ID NO: 1124991 - RNA, 20 nt, Homo sapiens
aucucauuggacccuuccau

SEQ ID NO: 1124992 - RNA, 22 nt, Homo sapiens
aucucauuggacccuuccaugg

SEQ ID NO: 1124993 - RNA, 23 nt, Homo sapiens
aucucccgugggcaucucaagcc

SEQ ID NO: 1124994 - RNA, 16 nt, Homo sapiens
aucugaccaucuguga

SEQ ID NO: 1124995 - RNA, 17 nt, Homo sapiens
aucuucuuuggggcccu

SEQ ID NO: 1124996 - RNA, 21 nt, Homo sapiens
augaaaauuuauuuuuaguga

SEQ ID NO: 1124997 - RNA, 12 nt, Homo sapiens
augaaacuaaga

SEQ ID NO: 1124998 - RNA, 17 nt, Homo sapiens
augagacagacauucac

SEQ ID NO: 1124999 - RNA, 12 nt, Homo sapiens
augaguuugaca

SEQ ID NO: 1125000 - RNA, 22 nt, Homo sapiens
augauacuccacucccagcagc

SEQ ID NO: 1125001 - RNA, 22 nt, Homo sapiens
augaucaucacaaucaucauca

SEQ ID NO: 1125002 - RNA, 16 nt, Homo sapiens
augcauaaaugcgauc

SEQ ID NO: 1125003 - RNA, 19 nt, Homo sapiens
augcccuguaccugugcac

SEQ ID NO: 1125004 - RNA, 15 nt, Homo sapiens
augcuucugcacaca

SEQ ID NO: 1125005 - RNA, 22 nt, Homo sapiens
auggaaugcuugcagagcauga

SEQ ID NO: 1125006 - RNA, 13 nt, Homo sapiens
auggcaucuucaa

SEQ ID NO: 1125007 - RNA, 16 nt, Homo sapiens
auggcuguguuugcag

SEQ ID NO: 1125008 - RNA, 12 nt, Homo sapiens
augggagccagg

SEQ ID NO: 1125009 - RNA, 19 nt, Homo sapiens
augggcagagcccaaggga

SEQ ID NO: 1125010 - RNA, 23 nt, Homo sapiens
augguggagggccacaugggagg

SEQ ID NO: 1125011 - RNA, 20 nt, Homo sapiens
augguggcgcgcaccuguaa

SEQ ID NO: 1125012 - RNA, 15 nt, Homo sapiens
auguaaacugugcac

SEQ ID NO: 1125013 - RNA, 13 nt, Homo sapiens
augucucauguca

SEQ ID NO: 1125014 - RNA, 17 nt, Homo sapiens
augucugccacagagag

SEQ ID NO: 1125015 - RNA, 16 nt, Homo sapiens
auuaagcucacaauaa

SEQ ID NO: 1125016 - RNA, 18 nt, Homo sapiens
auuagagggaugagacag

SEQ ID NO: 1125017 - RNA, 18 nt, Homo sapiens
auuagaggucuccaaaau

SEQ ID NO: 1125018 - RNA, 18 nt, Homo sapiens
auuagccgggcauggugg

SEQ ID NO: 1125019 - RNA, 16 nt, Homo sapiens
auucaaaucacaugga

SEQ ID NO: 1125020 - RNA, 19 nt, Homo sapiens
auucaagaaacagaaguag

SEQ ID NO: 1125021 - RNA, 17 nt, Homo sapiens
auucaauuaguggucau

SEQ ID NO: 1125022 - RNA, 21 nt, Homo sapiens
auucacaguaauaugguuccc

SEQ ID NO: 1125023 - RNA, 19 nt, Homo sapiens
auuccaggcugagccauga

SEQ ID NO: 1125024 - RNA, 20 nt, Homo sapiens
auuccugggcaagaaccuaa

SEQ ID NO: 1125025 - RNA, 21 nt, Homo sapiens
auucucagugagggcucugga

SEQ ID NO: 1125026 - RNA, 17 nt, Homo sapiens
auucucugucucaucca

SEQ ID NO: 1125027 - RNA, 20 nt, Homo sapiens
auucuuucccaauucacauc

SEQ ID NO: 1125028 - RNA, 15 nt, Homo sapiens
auuggacuccaggcc

SEQ ID NO: 1125029 - RNA, 22 nt, Homo sapiens
auuggacuccaggccugaccag

SEQ ID NO: 1125030 - RNA, 19 nt, Homo sapiens
auuguaucaaaugugacau

SEQ ID NO: 1125031 - RNA, 20 nt, Homo sapiens
auuguaucaaaugugacauu

SEQ ID NO: 1125032 - RNA, 12 nt, Homo sapiens
auuuaacuuucc

SEQ ID NO: 1125033 - RNA, 19 nt, Homo sapiens
auuuaggcaagagaaaaua

SEQ ID NO: 1125034 - RNA, 19 nt, Homo sapiens
auuucuccuccaugggaga

SEQ ID NO: 1125035 - RNA, 19 nt, Homo sapiens
auuugcauaacaauuccuc

SEQ ID NO: 1125036 - RNA, 12 nt, Homo sapiens
auuuggacaaaa

SEQ ID NO: 1125037 - RNA, 19 nt, Homo sapiens
auuuucagaauuuaaucuu

SEQ ID NO: 1125038 - RNA, 23 nt, Homo sapiens
caaaacucucugguuuacuucaa

SEQ ID NO: 1125039 - RNA, 18 nt, Homo sapiens
caaaauggaagguuggag

SEQ ID NO: 1125040 - RNA, 21 nt, Homo sapiens
caaacuacuggcaauuuguaa

SEQ ID NO: 1125041 - RNA, 17 nt, Homo sapiens
caaagaagaaguuuaaa

SEQ ID NO: 1125042 - RNA, 20 nt, Homo sapiens
caaagggaaauacucuuaau

SEQ ID NO: 1125043 - RNA, 21 nt, Homo sapiens
caaauaauuugaacuuuggaa

SEQ ID NO: 1125044 - RNA, 13 nt, Homo sapiens
caaaugugacauu

SEQ ID NO: 1125045 - RNA, 20 nt, Homo sapiens
caaauuaaaacaaauauaca

SEQ ID NO: 1125046 - RNA, 22 nt, Homo sapiens
caacaaccggccaccagauguc

SEQ ID NO: 1125047 - RNA, 18 nt, Homo sapiens
caacagaagcuuccauuc

SEQ ID NO: 1125048 - RNA, 14 nt, Homo sapiens
caaccaggccuuca

SEQ ID NO: 1125049 - RNA, 16 nt, Homo sapiens
caacucacaccugccu

SEQ ID NO: 1125050 - RNA, 19 nt, Homo sapiens
caacugggucugacaugaa

SEQ ID NO: 1125051 - RNA, 19 nt, Homo sapiens
caagaaauccaguuuccca

SEQ ID NO: 1125052 - RNA, 12 nt, Homo sapiens
caagaaauuacu

SEQ ID NO: 1125053 - RNA, 20 nt, Homo sapiens
caagacaagacuauaccuua

SEQ ID NO: 1125054 - RNA, 15 nt, Homo sapiens
caagcauucuguuua

SEQ ID NO: 1125055 - RNA, 22 nt, Homo sapiens
caaggagaaugaauacugggaa

SEQ ID NO: 1125056 - RNA, 15 nt, Homo sapiens
caagggaaaggcaag

SEQ ID NO: 1125057 - RNA, 20 nt, Homo sapiens
gauacuaagcacaaagccca

SEQ ID NO: 1125058 - RNA, 14 nt, Homo sapiens
gauagcuacagugu

SEQ ID NO: 1125059 - RNA, 22 nt, Homo sapiens
gauauaauuuuauuacauauga

SEQ ID NO: 1125060 - RNA, 15 nt, Homo sapiens
gauaucaugccccug

SEQ ID NO: 1125061 - RNA, 18 nt, Homo sapiens
gaucaacgccucacugaa

SEQ ID NO: 1125062 - RNA, 18 nt, Homo sapiens
gaugagacagacauucac

SEQ ID NO: 1125063 - RNA, 18 nt, Homo sapiens
gauggaaguugcagugag

SEQ ID NO: 1125064 - RNA, 22 nt, Homo sapiens
gaugucgcccuacucaccugag

SEQ ID NO: 1125065 - RNA, 13 nt, Homo sapiens
gauuauucagugu

SEQ ID NO: 1125066 - RNA, 18 nt, Homo sapiens
gauuccugggcaagaacc

SEQ ID NO: 1125067 - RNA, 17 nt, Homo sapiens
gauucuuucccaauuca

SEQ ID NO: 1125068 - RNA, 17 nt, Homo sapiens
gcaaaagcucuguguaa

SEQ ID NO: 1125069 - RNA, 16 nt, Homo sapiens
gcaaggaaacuaugua

SEQ ID NO: 1125070 - RNA, 17 nt, Homo sapiens
gcaauaauaaaguacuu

SEQ ID NO: 1125071 - RNA, 21 nt, Homo sapiens
gcacaaagcccauagcacugg

SEQ ID NO: 1125072 - RNA, 21 nt, Homo sapiens
gcacauuuaaggcgccauugc

SEQ ID NO: 1125073 - RNA, 17 nt, Homo sapiens
gcacucccucccagaga

SEQ ID NO: 1125074 - RNA, 16 nt, Homo sapiens
gcacugugagcaccug

SEQ ID NO: 1125075 - RNA, 17 nt, Homo sapiens
gcacugugagcaccuga

SEQ ID NO: 1125076 - RNA, 19 nt, Homo sapiens
gcacuuuauaaaagcaaaa

SEQ ID NO: 1125077 - RNA, 22 nt, Homo sapiens
gcagaagucaacgccucggugg

SEQ ID NO: 1125078 - RNA, 16 nt, Homo sapiens
gcagagcaugaccuga

SEQ ID NO: 1125079 - RNA, 16 nt, Homo sapiens
gcagcuggaggcugcu

SEQ ID NO: 1125080 - RNA, 20 nt, Homo sapiens
gcagcuuagacuaaggccau

SEQ ID NO: 1125081 - RNA, 21 nt, Homo sapiens
gcaggcaagguuuacacugcg

SEQ ID NO: 1125082 - RNA, 13 nt, Homo sapiens
gcaguaagccugu

SEQ ID NO: 1125083 - RNA, 19 nt, Homo sapiens
gcaguaggggcuacuguga

SEQ ID NO: 1125084 - RNA, 20 nt, Homo sapiens
gcaguaggggcuacugugac

SEQ ID NO: 1125085 - RNA, 15 nt, Homo sapiens
gcaucugaccaucug

SEQ ID NO: 1125086 - RNA, 15 nt, Homo sapiens
gcauucuuugcaaua

SEQ ID NO: 1125087 - RNA, 16 nt, Homo sapiens
gccaaucuguacaaaa

SEQ ID NO: 1125088 - RNA, 18 nt, Homo sapiens
gccacaaagaagaaguuu

SEQ ID NO: 1125089 - RNA, 22 nt, Homo sapiens
gccaucagggugggccacucuc

SEQ ID NO: 1125090 - RNA, 10 nt, Homo sapiens
gccaugccuc

SEQ ID NO: 1125091 - RNA, 17 nt, Homo sapiens
gccaugccucaagaaca

SEQ ID NO: 1125092 - RNA, 15 nt, Homo sapiens
gcccagagccuggcu

SEQ ID NO: 1125093 - RNA, 21 nt, Homo sapiens
gcccaucagggcccagggagc

SEQ ID NO: 1125094 - RNA, 17 nt, Homo sapiens
gcccaugugcaccugcc

SEQ ID NO: 1125095 - RNA, 19 nt, Homo sapiens
gccccaggcauugccaagg

SEQ ID NO: 1125096 - RNA, 22 nt, Homo sapiens
gccccccagccuucacugacag

SEQ ID NO: 1125097 - RNA, 14 nt, Homo sapiens
gccuccugcaaagu

SEQ ID NO: 1125098 - RNA, 14 nt, Homo sapiens
gccucuguggcacu

SEQ ID NO: 1125099 - RNA, 17 nt, Homo sapiens
gccucuuccugcagccu

SEQ ID NO: 1125100 - RNA, 20 nt, Homo sapiens
gccucuuccugcagccucac

SEQ ID NO: 1125101 - RNA, 13 nt, Homo sapiens
gccucuugcaaug

SEQ ID NO: 1125102 - RNA, 17 nt, Homo sapiens
gccugagguuugccagc

SEQ ID NO: 1125103 - RNA, 21 nt, Homo sapiens
gccugagguuugccagcauuu

SEQ ID NO: 1125104 - RNA, 24 nt, Homo sapiens
gccuggacugaccacaccaaccag

SEQ ID NO: 1125105 - RNA, 20 nt, Homo sapiens
gccuguuggauaaagaccuu

SEQ ID NO: 1125106 - RNA, 16 nt, Homo sapiens
gccuuagggcacuggg

SEQ ID NO: 1125107 - RNA, 13 nt, Homo sapiens
gccuucacugaca

SEQ ID NO: 1125108 - RNA, 19 nt, Homo sapiens
gccuuucuccgcaacagcc

SEQ ID NO: 1125109 - RNA, 16 nt, Homo sapiens
gcuauugucuguaaua

SEQ ID NO: 1125110 - RNA, 20 nt, Homo sapiens
gcuccauguagaagccacua

SEQ ID NO: 1125111 - RNA, 20 nt, Homo sapiens
gcuccccuccucggcuuccu

SEQ ID NO: 1125112 - RNA, 16 nt, Homo sapiens
gcucugauggcugcuc

SEQ ID NO: 1125113 - RNA, 23 nt, Homo sapiens
gcugaauguaugucagugcuaua

SEQ ID NO: 1125114 - RNA, 16 nt, Homo sapiens
gcugaggcaagagaau

SEQ ID NO: 1125115 - RNA, 12 nt, Homo sapiens
gcugcagcugug

SEQ ID NO: 1125116 - RNA, 19 nt, Homo sapiens
gcugccucuaccugacacu

SEQ ID NO: 1125117 - RNA, 22 nt, Homo sapiens
gcuggacugaccaaagacugca

SEQ ID NO: 1125118 - RNA, 22 nt, Homo sapiens
gcugucagcccaugugcaccug

SEQ ID NO: 1125119 - RNA, 23 nt, Homo sapiens
gcuguggggaccacacugauccu

SEQ ID NO: 1125120 - RNA, 23 nt, Homo sapiens
gcuguguuugcagccugcucuag

SEQ ID NO: 1125121 - RNA, 15 nt, Homo sapiens
gcuguuguuccauug

SEQ ID NO: 1125122 - RNA, 22 nt, Homo sapiens
gcuucagguuagugacauuuaa

SEQ ID NO: 1125123 - RNA, 21 nt, Homo sapiens
gcuuucauguaaacugugcac

SEQ ID NO: 1125124 - RNA, 21 nt, Homo sapiens
ggaaaaaaauaguaaagccaa

SEQ ID NO: 1125125 - RNA, 24 nt, Homo sapiens
ggaaaauaaacugacacuuauuaa

SEQ ID NO: 1125126 - RNA, 21 nt, Homo sapiens
ggaaucucuuggaugcagcuu

SEQ ID NO: 1125127 - RNA, 23 nt, Homo sapiens
ggacaaaauggaagguuggagac

SEQ ID NO: 1125128 - RNA, 19 nt, Homo sapiens
ggacaaugccuugggagag

SEQ ID NO: 1125129 - RNA, 14 nt, Homo sapiens
ggacagucaccuau

SEQ ID NO: 1125130 - RNA, 17 nt, Homo sapiens
ggacaugaagauucuuu

SEQ ID NO: 1125131 - RNA, 16 nt, Homo sapiens
ggaccaagcagagcuc

SEQ ID NO: 1125132 - RNA, 20 nt, Homo sapiens
ggaccuggggacucgggugc

SEQ ID NO: 1125133 - RNA, 23 nt, Homo sapiens
ggacucugcuagacuccucagga

SEQ ID NO: 1125134 - RNA, 14 nt, Homo sapiens
ggacuuccugucau

SEQ ID NO: 1125135 - RNA, 20 nt, Homo sapiens
ggagaaaagggauggagcug

SEQ ID NO: 1125136 - RNA, 21 nt, Homo sapiens
ggagaaaagggauggagcuga

SEQ ID NO: 1125137 - RNA, 12 nt, Homo sapiens
ggagacuggaaa

SEQ ID NO: 1125138 - RNA, 20 nt, Homo sapiens
ggagcugaaaaagauggaau

SEQ ID NO: 1125139 - RNA, 20 nt, Homo sapiens
ggaggccagugccagcaccu

SEQ ID NO: 1125140 - RNA, 18 nt, Homo sapiens
ggaguucucccaccaccu

SEQ ID NO: 1125141 - RNA, 22 nt, Homo sapiens
ggauauuuugaaaugaacuuug

SEQ ID NO: 1125142 - RNA, 15 nt, Homo sapiens
ggcaaagccuaguga

SEQ ID NO: 1125143 - RNA, 21 nt, Homo sapiens
ggcagagcaauuccaggcuga

SEQ ID NO: 1125144 - RNA, 21 nt, Homo sapiens
ggccacagaaggugaacuuug

SEQ ID NO: 1125145 - RNA, 18 nt, Homo sapiens
ggccagugccagcaccug

SEQ ID NO: 1125146 - RNA, 19 nt, Homo sapiens
ggcccuaaguuaagcaaaa

SEQ ID NO: 1125147 - RNA, 24 nt, Homo sapiens
ggccuaggcuaccucaagacucac

SEQ ID NO: 1125148 - RNA, 16 nt, Homo sapiens
ggccugaccagggggc

SEQ ID NO: 1125149 - RNA, 21 nt, Homo sapiens
ggccuggggcgagcacuguga

SEQ ID NO: 1125150 - RNA, 15 nt, Homo sapiens
ggcgagcacugugag

SEQ ID NO: 1125151 - RNA, 15 nt, Homo sapiens
ggcgcaggugcacag

SEQ ID NO: 1125152 - RNA, 16 nt, Homo sapiens
ggcuaucaacuuaaua

SEQ ID NO: 1125153 - RNA, 22 nt, Homo sapiens
ggcugggaacaacuucagucca

SEQ ID NO: 1125154 - RNA, 12 nt, Homo sapiens
ggcugguguaug

SEQ ID NO: 1125155 - RNA, 20 nt, Homo sapiens
ggcuuuaauagucaccuuca

SEQ ID NO: 1125156 - RNA, 19 nt, Homo sapiens
gggaaacaaauaauuugaa

SEQ ID NO: 1125157 - RNA, 12 nt, Homo sapiens
gggagucugggc

SEQ ID NO: 1125158 - RNA, 15 nt, Homo sapiens
gggaguguggcuccu

SEQ ID NO: 1125159 - RNA, 21 nt, Homo sapiens
gggaucuggugggcagucgaa

SEQ ID NO: 1125160 - RNA, 19 nt, Homo sapiens
gggauucuaggaaacccaa

SEQ ID NO: 1125161 - RNA, 22 nt, Homo sapiens
gggcacugagcccuucccaggc

SEQ ID NO: 1125162 - RNA, 21 nt, Homo sapiens
gggcaggcaagguuuacacug

SEQ ID NO: 1125163 - RNA, 12 nt, Homo sapiens
gggcgcgguggc

SEQ ID NO: 1125164 - RNA, 21 nt, Homo sapiens
gggcugugauuacugcaauca

SEQ ID NO: 1125165 - RNA, 19 nt, Homo sapiens
aaaaguacuaauagaacuu

SEQ ID NO: 1125166 - RNA, 17 nt, Homo sapiens
aaaauauguaauuucaa

SEQ ID NO: 1125167 - RNA, 16 nt, Homo sapiens
aaaaugccuccauggc

SEQ ID NO: 1125168 - RNA, 21 nt, Homo sapiens
aaaauuagccgggcauggugg

SEQ ID NO: 1125169 - RNA, 18 nt, Homo sapiens
aaaauuauuugcauaaca

SEQ ID NO: 1125170 - RNA, 20 nt, Homo sapiens
aaaauucuauguuaauuaca

SEQ ID NO: 1125171 - RNA, 18 nt, Homo sapiens
aaacaaaaaucuguguaa

SEQ ID NO: 1125172 - RNA, 16 nt, Homo sapiens
aaacagucaucuagaa

SEQ ID NO: 1125173 - RNA, 17 nt, Homo sapiens
aaaccaagauagaucca

SEQ ID NO: 1125174 - RNA, 21 nt, Homo sapiens
aaacgauuagugauguccuua

SEQ ID NO: 1125175 - RNA, 17 nt, Homo sapiens
aaacuauguaacaugua

SEQ ID NO: 1125176 - RNA, 18 nt, Homo sapiens
aaacuauguaacauguag

SEQ ID NO: 1125177 - RNA, 18 nt, Homo sapiens
aaacugacuaaacuuaca

SEQ ID NO: 1125178 - RNA, 23 nt, Homo sapiens
aaacugcuuaugaaaaguacuaa

SEQ ID NO: 1125179 - RNA, 10 nt, Homo sapiens
aaacuucuca

SEQ ID NO: 1125180 - RNA, 18 nt, Homo sapiens
aaagaaauuguauuauca

SEQ ID NO: 1125181 - RNA, 17 nt, Homo sapiens
aaagacuggauuugcag

SEQ ID NO: 1125182 - RNA, 15 nt, Homo sapiens
aaagagaaguuccca

SEQ ID NO: 1125183 - RNA, 19 nt, Homo sapiens
aaagagaauccaacuuuau

SEQ ID NO: 1125184 - RNA, 18 nt, Homo sapiens
aaagccuccgcugggcuu

SEQ ID NO: 1125185 - RNA, 17 nt, Homo sapiens
aaagcuggacugaccaa

SEQ ID NO: 1125186 - RNA, 19 nt, Homo sapiens
aaagcuggacugaccaaag

SEQ ID NO: 1125187 - RNA, 21 nt, Homo sapiens
aaagggaaggugacugaaggc

SEQ ID NO: 1125188 - RNA, 17 nt, Homo sapiens
aaaguaaauucauguaa

SEQ ID NO: 1125189 - RNA, 14 nt, Homo sapiens
aaaguacuaauaga

SEQ ID NO: 1125190 - RNA, 12 nt, Homo sapiens
aaauauucccug

SEQ ID NO: 1125191 - RNA, 23 nt, Homo sapiens
aaaucggaucuggggcucuggga

SEQ ID NO: 1125192 - RNA, 19 nt, Homo sapiens
aaaucuaacuacaaggaca

SEQ ID NO: 1125193 - RNA, 15 nt, Homo sapiens
aaaugucucauguca

SEQ ID NO: 1125194 - RNA, 13 nt, Homo sapiens
aaaugugaugaau

SEQ ID NO: 1125195 - RNA, 18 nt, Homo sapiens
aaauuccucuuacuguaa

SEQ ID NO: 1125196 - RNA, 22 nt, Homo sapiens
aaauuguaucaaaugugacauu

SEQ ID NO: 1125197 - RNA, 15 nt, Homo sapiens
aaauuguauuaucaa

SEQ ID NO: 1125198 - RNA, 23 nt, Homo sapiens
aacaaaaaucuguguaacuguaa

SEQ ID NO: 1125199 - RNA, 20 nt, Homo sapiens
aacaaaaauuaaaauccuca

SEQ ID NO: 1125200 - RNA, 15 nt, Homo sapiens
aacaaauguauuuca

SEQ ID NO: 1125201 - RNA, 20 nt, Homo sapiens
aacaaucuauggcuuauuuc

SEQ ID NO: 1125202 - RNA, 14 nt, Homo sapiens
aacagaagcuucca

SEQ ID NO: 1125203 - RNA, 14 nt, Homo sapiens
aacauaacuucuca

SEQ ID NO: 1125204 - RNA, 16 nt, Homo sapiens
aaccaucaucuugcca

SEQ ID NO: 1125205 - RNA, 19 nt, Homo sapiens
aaccauggugaacuccacc

SEQ ID NO: 1125206 - RNA, 20 nt, Homo sapiens
aacccaggagauggaaguug

SEQ ID NO: 1125207 - RNA, 21 nt, Homo sapiens
aacccauuaggcaugccuaau

SEQ ID NO: 1125208 - RNA, 15 nt, Homo sapiens
aacccucucuucccu

SEQ ID NO: 1125209 - RNA, 19 nt, Homo sapiens
aaccuacccugguccaguc

SEQ ID NO: 1125210 - RNA, 21 nt, Homo sapiens
aaccucauuccccaaccacuu

SEQ ID NO: 1125211 - RNA, 12 nt, Homo sapiens
aacuaacuugau

SEQ ID NO: 1125212 - RNA, 16 nt, Homo sapiens
aacuauguaacaugua

SEQ ID NO: 1125213 - RNA, 16 nt, Homo sapiens
aacucacucugggcug

SEQ ID NO: 1125214 - RNA, 20 nt, Homo sapiens
aacucucugguuuacuucaa

SEQ ID NO: 1125215 - RNA, 21 nt, Homo sapiens
aacucucugguuuacuucaaa

SEQ ID NO: 1125216 - RNA, 13 nt, Homo sapiens
aacugucaaccua

SEQ ID NO: 1125217 - RNA, 20 nt, Homo sapiens
aacugugaaauguacgucau

SEQ ID NO: 1125218 - RNA, 21 nt, Homo sapiens
aacuguuggcaaggugacauu

SEQ ID NO: 1125219 - RNA, 14 nt, Homo sapiens
aacuguuguuuacu

SEQ ID NO: 1125220 - RNA, 22 nt, Homo sapiens
aacuucccuuaagagucaucca

SEQ ID NO: 1125221 - RNA, 16 nt, Homo sapiens
aacuuuuauuacuggg

SEQ ID NO: 1125222 - RNA, 23 nt, Homo sapiens
aacuuuuuaaagaagugcaugaa

SEQ ID NO: 1125223 - RNA, 15 nt, Homo sapiens
aagaaggccacuggu

SEQ ID NO: 1125224 - RNA, 12 nt, Homo sapiens
aagaccuuccag

SEQ ID NO: 1125225 - RNA, 21 nt, Homo sapiens
aagacucaccucauccuuacc

SEQ ID NO: 1125226 - RNA, 20 nt, Homo sapiens
aagagggugauugcuggggc

SEQ ID NO: 1125227 - RNA, 12 nt, Homo sapiens
aagagucaucca

SEQ ID NO: 1125228 - RNA, 15 nt, Homo sapiens
aagcaguuaguuccu

SEQ ID NO: 1125229 - RNA, 23 nt, Homo sapiens
aagccuccgcugggcuucauucc

SEQ ID NO: 1125230 - RNA, 13 nt, Homo sapiens
aagcucuguguaa

SEQ ID NO: 1125231 - RNA, 22 nt, Homo sapiens
aagcuuccauuccaagccugac

SEQ ID NO: 1125232 - RNA, 21 nt, Homo sapiens
aaggacacuagccugugcacg

SEQ ID NO: 1125233 - RNA, 11 nt, Homo sapiens
aaggacucuca

SEQ ID NO: 1125234 - RNA, 18 nt, Homo sapiens
aaggauuguugggcuugg

SEQ ID NO: 1125235 - RNA, 14 nt, Homo sapiens
aaggcauguacaaa

SEQ ID NO: 1125236 - RNA, 19 nt, Homo sapiens
aaggccacugcuacaucuc

SEQ ID NO: 1125237 - RNA, 15 nt, Homo sapiens
aaguaaaacagucau

SEQ ID NO: 1125238 - RNA, 16 nt, Homo sapiens
aaguaaucaguaugca

SEQ ID NO: 1125239 - RNA, 13 nt, Homo sapiens
aaguaaugauuaa

SEQ ID NO: 1125240 - RNA, 20 nt, Homo sapiens
aaguagcaucccaucccaac

SEQ ID NO: 1125241 - RNA, 19 nt, Homo sapiens
aaguguaaaaaaugucuca

SEQ ID NO: 1125242 - RNA, 23 nt, Homo sapiens
aaguugcuaacuuaaaaaacugc

SEQ ID NO: 1125243 - RNA, 12 nt, Homo sapiens
aauaaacaguca

SEQ ID NO: 1125244 - RNA, 14 nt, Homo sapiens
aauaaacagucacu

SEQ ID NO: 1125245 - RNA, 18 nt, Homo sapiens
aauaaaguucuguacuca

SEQ ID NO: 1125246 - RNA, 20 nt, Homo sapiens
aauaacauguuucucuauaa

SEQ ID NO: 1125247 - RNA, 23 nt, Homo sapiens
acacagacccacacauguuuaca

SEQ ID NO: 1125248 - RNA, 16 nt, Homo sapiens
acaccuuuguuuugca

SEQ ID NO: 1125249 - RNA, 23 nt, Homo sapiens
acacggccuggggcgagcacugu

SEQ ID NO: 1125250 - RNA, 17 nt, Homo sapiens
acacuagccugugcacg

SEQ ID NO: 1125251 - RNA, 19 nt, Homo sapiens
acacucaauaaacagucac

SEQ ID NO: 1125252 - RNA, 16 nt, Homo sapiens
acacugcagcugucug

SEQ ID NO: 1125253 - RNA, 17 nt, Homo sapiens
acacugcggaagccaaa

SEQ ID NO: 1125254 - RNA, 15 nt, Homo sapiens
acacuggauggucau

SEQ ID NO: 1125255 - RNA, 23 nt, Homo sapiens
acagaaugcggccucugagacau

SEQ ID NO: 1125256 - RNA, 18 nt, Homo sapiens
acagacauucaccuguau

SEQ ID NO: 1125257 - RNA, 18 nt, Homo sapiens
acagagaggaguugccag

SEQ ID NO: 1125258 - RNA, 20 nt, Homo sapiens
acagagcaagacucugucuc

SEQ ID NO: 1125259 - RNA, 19 nt, Homo sapiens
acagagcuucccugacuca

SEQ ID NO: 1125260 - RNA, 15 nt, Homo sapiens
acagcccagagccug

SEQ ID NO: 1125261 - RNA, 23 nt, Homo sapiens
acagcucgggcccucugugagau

SEQ ID NO: 1125262 - RNA, 14 nt, Homo sapiens
acaggaggggccca

SEQ ID NO: 1125263 - RNA, 22 nt, Homo sapiens
acaggaggggcccacaauggag

SEQ ID NO: 1125264 - RNA, 15 nt, Homo sapiens
acaguaaacacucca

SEQ ID NO: 1125265 - RNA, 18 nt, Homo sapiens
acagucuuccauuugcaa

SEQ ID NO: 1125266 - RNA, 19 nt, Homo sapiens
acaucaaauaaacugacuu

SEQ ID NO: 1125267 - RNA, 19 nt, Homo sapiens
acaugaacacuuuuuauca

SEQ ID NO: 1125268 - RNA, 18 nt, Homo sapiens
acauggcuguguuugcag

SEQ ID NO: 1125269 - RNA, 16 nt, Homo sapiens
accaaagacugcagaa

SEQ ID NO: 1125270 - RNA, 22 nt, Homo sapiens
accacaccaaccaggccuucau

SEQ ID NO: 1125271 - RNA, 15 nt, Homo sapiens
accaccucaccaguu

SEQ ID NO: 1125272 - RNA, 22 nt, Homo sapiens
accagagcuucucugggcugaa

SEQ ID NO: 1125273 - RNA, 14 nt, Homo sapiens
accagaggugacag

SEQ ID NO: 1125274 - RNA, 20 nt, Homo sapiens
accaggguugaccccagagg

SEQ ID NO: 1125275 - RNA, 13 nt, Homo sapiens
accauaugaauga

SEQ ID NO: 1125276 - RNA, 13 nt, Homo sapiens
accaucugugacu

SEQ ID NO: 1125277 - RNA, 15 nt, Homo sapiens
accauggugaacucc

SEQ ID NO: 1125278 - RNA, 14 nt, Homo sapiens
acccacagccauag

SEQ ID NO: 1125279 - RNA, 15 nt, Homo sapiens
acccccgccaggcug

SEQ ID NO: 1125280 - RNA, 23 nt, Homo sapiens
accgaaucucaauguacauagac

SEQ ID NO: 1125281 - RNA, 17 nt, Homo sapiens
accgugggcucccugac

SEQ ID NO: 1125282 - RNA, 14 nt, Homo sapiens
accuccguggaaua

SEQ ID NO: 1125283 - RNA, 12 nt, Homo sapiens
accugagcauga

SEQ ID NO: 1125284 - RNA, 19 nt, Homo sapiens
accugccccccagccuuca

SEQ ID NO: 1125285 - RNA, 21 nt, Homo sapiens
accugugcacguuggaacuuu

SEQ ID NO: 1125286 - RNA, 16 nt, Homo sapiens
accugugcugaacaua

SEQ ID NO: 1125287 - RNA, 23 nt, Homo sapiens
accuuauccauaggcgcaggugc

SEQ ID NO: 1125288 - RNA, 15 nt, Homo sapiens
accuuggacuccucc

SEQ ID NO: 1125289 - RNA, 18 nt, Homo sapiens
accuuggacuccucccac

SEQ ID NO: 1125290 - RNA, 12 nt, Homo sapiens
accuugugagag

SEQ ID NO: 1125291 - RNA, 17 nt, Homo sapiens
acgacugucuccauggc

SEQ ID NO: 1125292 - RNA, 15 nt, Homo sapiens
acgauuaacugugaa

SEQ ID NO: 1125293 - RNA, 22 nt, Homo sapiens
acgccucgguggcauacagacu

SEQ ID NO: 1125294 - RNA, 18 nt, Homo sapiens
acgcugaaggcuuacuuc

SEQ ID NO: 1125295 - RNA, 11 nt, Homo sapiens
acgucauuugu

SEQ ID NO: 1125296 - RNA, 16 nt, Homo sapiens
acgucauuugugcaag

SEQ ID NO: 1125297 - RNA, 16 nt, Homo sapiens
acgugaagccacagga

SEQ ID NO: 1125298 - RNA, 17 nt, Homo sapiens
acgugaagccacaggag

SEQ ID NO: 1125299 - RNA, 22 nt, Homo sapiens
acuaaaauuguaucaaauguga

SEQ ID NO: 1125300 - RNA, 13 nt, Homo sapiens
acuaaaugaacau

SEQ ID NO: 1125301 - RNA, 15 nt, Homo sapiens
acuacuggcaauuug

SEQ ID NO: 1125302 - RNA, 15 nt, Homo sapiens
acuauuuuaccugaa

SEQ ID NO: 1125303 - RNA, 16 nt, Homo sapiens
acucaagggaaaggca

SEQ ID NO: 1125304 - RNA, 22 nt, Homo sapiens
acucuccccucccucuuccuuc

SEQ ID NO: 1125305 - RNA, 17 nt, Homo sapiens
acucugcuagacuccuc

SEQ ID NO: 1125306 - RNA, 14 nt, Homo sapiens
acugaggagacaga

SEQ ID NO: 1125307 - RNA, 20 nt, Homo sapiens
acugaguuuuguuucacuuu

SEQ ID NO: 1125308 - RNA, 16 nt, Homo sapiens
acugcagcaccuccag

SEQ ID NO: 1125309 - RNA, 19 nt, Homo sapiens
acuguuggcaaggugacau

SEQ ID NO: 1125310 - RNA, 15 nt, Homo sapiens
acuucccuuaagagu

SEQ ID NO: 1125311 - RNA, 13 nt, Homo sapiens
acuucuaccugcc

SEQ ID NO: 1125312 - RNA, 18 nt, Homo sapiens
acuucucuauuaucucaa

SEQ ID NO: 1125313 - RNA, 16 nt, Homo sapiens
acuugcuucucuagcu

SEQ ID NO: 1125314 - RNA, 19 nt, Homo sapiens
acuuggagaauacugccaa

SEQ ID NO: 1125315 - RNA, 13 nt, Homo sapiens
acuuggggaccag

SEQ ID NO: 1125316 - RNA, 19 nt, Homo sapiens
acuuguugcugauucaaga

SEQ ID NO: 1125317 - RNA, 17 nt, Homo sapiens
acuuuaacccucucuuc

SEQ ID NO: 1125318 - RNA, 18 nt, Homo sapiens
acuuuaacccucucuucc

SEQ ID NO: 1125319 - RNA, 12 nt, Homo sapiens
agaaaagggaug

SEQ ID NO: 1125320 - RNA, 17 nt, Homo sapiens
agaaaauguaguuagcu

SEQ ID NO: 1125321 - RNA, 21 nt, Homo sapiens
agaaaccuuauuguaccucuc

SEQ ID NO: 1125322 - RNA, 22 nt, Homo sapiens
agaaagcuggacugaccaaaga

SEQ ID NO: 1125323 - RNA, 15 nt, Homo sapiens
agaaccuaaaguagc

SEQ ID NO: 1125324 - RNA, 16 nt, Homo sapiens
agaagaaaauuugcca

SEQ ID NO: 1125325 - RNA, 15 nt, Homo sapiens
agaaguaaucaguau

SEQ ID NO: 1125326 - RNA, 20 nt, Homo sapiens
agaaguuuaaaaaaccaugc

SEQ ID NO: 1125327 - RNA, 15 nt, Homo sapiens
agaaucccugccugu

SEQ ID NO: 1125328 - RNA, 12 nt, Homo sapiens
agaauggagcug

SEQ ID NO: 1125329 - RNA, 14 nt, Homo sapiens
agaauucacugagu

SEQ ID NO: 1125330 - RNA, 17 nt, Homo sapiens
cccuguaccugugcacg

SEQ ID NO: 1125331 - RNA, 16 nt, Homo sapiens
cccuuggcccaucugu

SEQ ID NO: 1125332 - RNA, 13 nt, Homo sapiens
ccgaaaucagaag

SEQ ID NO: 1125333 - RNA, 14 nt, Homo sapiens
ccgugggcaucuca

SEQ ID NO: 1125334 - RNA, 16 nt, Homo sapiens
ccguucagaaaaccac

SEQ ID NO: 1125335 - RNA, 20 nt, Homo sapiens
ccuacagaccuggcucucag

SEQ ID NO: 1125336 - RNA, 18 nt, Homo sapiens
ccuacugguguaaucuca

SEQ ID NO: 1125337 - RNA, 14 nt, Homo sapiens
ccuauccacccucu

SEQ ID NO: 1125338 - RNA, 14 nt, Homo sapiens
ccuauguaugccau

SEQ ID NO: 1125339 - RNA, 23 nt, Homo sapiens
ccuauguuuuuguucaaagccag

SEQ ID NO: 1125340 - RNA, 17 nt, Homo sapiens
ccucaagacucaccuca

SEQ ID NO: 1125341 - RNA, 12 nt, Homo sapiens
ccucaguucuca

SEQ ID NO: 1125342 - RNA, 23 nt, Homo sapiens
ccuccagcacucccucccagaga

SEQ ID NO: 1125343 - RNA, 16 nt, Homo sapiens
ccuccugggcccucuc

SEQ ID NO: 1125344 - RNA, 17 nt, Homo sapiens
ccucuaaauagcacuuu

SEQ ID NO: 1125345 - RNA, 14 nt, Homo sapiens
ccucugagacauga

SEQ ID NO: 1125346 - RNA, 17 nt, Homo sapiens
ccucugcagcacuuuaa

SEQ ID NO: 1125347 - RNA, 12 nt, Homo sapiens
ccucuuugccuc

SEQ ID NO: 1125348 - RNA, 20 nt, Homo sapiens
ccugaaggaaaauaaacuga

SEQ ID NO: 1125349 - RNA, 15 nt, Homo sapiens
ccugacgacacugaa

SEQ ID NO: 1125350 - RNA, 18 nt, Homo sapiens
ccugacgacacugaagaa

SEQ ID NO: 1125351 - RNA, 21 nt, Homo sapiens
ccugaucagagccgugguccu

SEQ ID NO: 1125352 - RNA, 18 nt, Homo sapiens
ccugcagcaaacacucca

SEQ ID NO: 1125353 - RNA, 21 nt, Homo sapiens
ccugcguguccccgugcagua

SEQ ID NO: 1125354 - RNA, 19 nt, Homo sapiens
ccuggauccucaguucuca

SEQ ID NO: 1125355 - RNA, 15 nt, Homo sapiens
ccugggaggagagaa

SEQ ID NO: 1125356 - RNA, 14 nt, Homo sapiens
ccugggcaaagccu

SEQ ID NO: 1125357 - RNA, 20 nt, Homo sapiens
ccuggggcgagcacugugag

SEQ ID NO: 1125358 - RNA, 21 nt, Homo sapiens
ccuguuggauaaagaccuucc

SEQ ID NO: 1125359 - RNA, 13 nt, Homo sapiens
ccuuaagagucau

SEQ ID NO: 1125360 - RNA, 14 nt, Homo sapiens
ccuuacaguaggag

SEQ ID NO: 1125361 - RNA, 14 nt, Homo sapiens
ccuuauuguaccuc

SEQ ID NO: 1125362 - RNA, 18 nt, Homo sapiens
ccuuucuaaccuucacga

SEQ ID NO: 1125363 - RNA, 17 nt, Homo sapiens
ccuuuuuccauaguguu

SEQ ID NO: 1125364 - RNA, 21 nt, Homo sapiens
cgaacaauucauauauuugaa

SEQ ID NO: 1125365 - RNA, 14 nt, Homo sapiens
cgagcacugugagc

SEQ ID NO: 1125366 - RNA, 15 nt, Homo sapiens
cgagcacugugagca

SEQ ID NO: 1125367 - RNA, 10 nt, Homo sapiens
cgaguacuuc

SEQ ID NO: 1125368 - RNA, 21 nt, Homo sapiens
cgauauaauuuuauuacauau

SEQ ID NO: 1125369 - RNA, 20 nt, Homo sapiens
cgcagacacacccacagaag

SEQ ID NO: 1125370 - RNA, 19 nt, Homo sapiens
cgcccucacugcaggcucc

SEQ ID NO: 1125371 - RNA, 12 nt, Homo sapiens
cgcccucggggc

SEQ ID NO: 1125372 - RNA, 13 nt, Homo sapiens
cgugggcaucuca

SEQ ID NO: 1125373 - RNA, 21 nt, Homo sapiens
cgugggcaucucaagccccaa

SEQ ID NO: 1125374 - RNA, 19 nt, Homo sapiens
cuaaaauuauguuacugua

SEQ ID NO: 1125375 - RNA, 22 nt, Homo sapiens
cuaaaauuguaucaaaugugac

SEQ ID NO: 1125376 - RNA, 18 nt, Homo sapiens
cuaacuaaauaccauuca

SEQ ID NO: 1125377 - RNA, 22 nt, Homo sapiens
cuaacuacaaggacaaugccuu

SEQ ID NO: 1125378 - RNA, 17 nt, Homo sapiens
cuaagauaauuuacuua

SEQ ID NO: 1125379 - RNA, 17 nt, Homo sapiens
cuaagcacaaagcccau

SEQ ID NO: 1125380 - RNA, 17 nt, Homo sapiens
cuaagcagaccacugau

SEQ ID NO: 1125381 - RNA, 19 nt, Homo sapiens
cuaaugugaaaauguauuc

SEQ ID NO: 1125382 - RNA, 23 nt, Homo sapiens
cuacagaccuggcucucagagga

SEQ ID NO: 1125383 - RNA, 22 nt, Homo sapiens
cuacagagcuucccugacucau

SEQ ID NO: 1125384 - RNA, 14 nt, Homo sapiens
cuacagauagaaaa

SEQ ID NO: 1125385 - RNA, 16 nt, Homo sapiens
cuacugaugguuacau

SEQ ID NO: 1125386 - RNA, 19 nt, Homo sapiens
cuacugaugguuacauaua

SEQ ID NO: 1125387 - RNA, 17 nt, Homo sapiens
cuacugcagcaccucca

SEQ ID NO: 1125388 - RNA, 19 nt, Homo sapiens
cuacuucccaguaacccua

SEQ ID NO: 1125389 - RNA, 16 nt, Homo sapiens
cuaucuucuuuggacu

SEQ ID NO: 1125390 - RNA, 13 nt, Homo sapiens
cuaugacaugcaa

SEQ ID NO: 1125391 - RNA, 14 nt, Homo sapiens
cuauguuauauuga

SEQ ID NO: 1125392 - RNA, 13 nt, Homo sapiens
cucaagacucacc

SEQ ID NO: 1125393 - RNA, 22 nt, Homo sapiens
cucaauaaacagucacuggaaa

SEQ ID NO: 1125394 - RNA, 20 nt, Homo sapiens
cucaaucaugaguaccucaa

SEQ ID NO: 1125395 - RNA, 15 nt, Homo sapiens
cucacugaaacaugg

SEQ ID NO: 1125396 - RNA, 15 nt, Homo sapiens
cucagcuguccugca

SEQ ID NO: 1125397 - RNA, 18 nt, Homo sapiens
cucagcuguccugcagca

SEQ ID NO: 1125398 - RNA, 21 nt, Homo sapiens
cucagugggacaaaccagagc

SEQ ID NO: 1125399 - RNA, 18 nt, Homo sapiens
cucauuccccaaccacuu

SEQ ID NO: 1125400 - RNA, 21 nt, Homo sapiens
cucauuggacccuuccauggu

SEQ ID NO: 1125401 - RNA, 18 nt, Homo sapiens
cuccauaaaguacaaaug

SEQ ID NO: 1125402 - RNA, 18 nt, Homo sapiens
cuccauacguucagaggu

SEQ ID NO: 1125403 - RNA, 19 nt, Homo sapiens
cucccaccaccucaccagu

SEQ ID NO: 1125404 - RNA, 17 nt, Homo sapiens
cucccgugggcaucuca

SEQ ID NO: 1125405 - RNA, 12 nt, Homo sapiens
cucuagcucucu

SEQ ID NO: 1125406 - RNA, 17 nt, Homo sapiens
cucuauaaaguauggua

SEQ ID NO: 1125407 - RNA, 21 nt, Homo sapiens
cucuauagacucuaggacaua

SEQ ID NO: 1125408 - RNA, 14 nt, Homo sapiens
cucugaaaccagug

SEQ ID NO: 1125409 - RNA, 12 nt, Homo sapiens
cucugauaccuc

SEQ ID NO: 1125410 - RNA, 13 nt, Homo sapiens
cucugaucccucu

SEQ ID NO: 1125411 - RNA, 18 nt, Homo sapiens
cucugugggcuccaugua

SEQ ID NO: 1125412 - RNA, 16 nt, Homo sapiens
cucuuggaugcagcuu

SEQ ID NO: 1125413 - RNA, 19 nt, Homo sapiens
cugaaaacacugugcacau

SEQ ID NO: 1125414 - RNA, 17 nt, Homo sapiens
cugaaauaaaauucauu

SEQ ID NO: 1125415 - RNA, 23 nt, Homo sapiens
cugaauagcagaagguugcaccu

SEQ ID NO: 1125416 - RNA, 21 nt, Homo sapiens
cugaauauacagaaguuccau

SEQ ID NO: 1125417 - RNA, 22 nt, Homo sapiens
cugacacucaauaaacagucac

SEQ ID NO: 1125418 - RNA, 14 nt, Homo sapiens
cugacgacacugaa

SEQ ID NO: 1125419 - RNA, 16 nt, Homo sapiens
cugacgacacugaaga

SEQ ID NO: 1125420 - RNA, 15 nt, Homo sapiens
cugauccuggagaaa

SEQ ID NO: 1125421 - RNA, 13 nt, Homo sapiens
cugauucaagaaa

SEQ ID NO: 1125422 - RNA, 16 nt, Homo sapiens
cugcaaucacugugcu

SEQ ID NO: 1125423 - RNA, 14 nt, Homo sapiens
cugcagcacuuuaa

SEQ ID NO: 1125424 - RNA, 12 nt, Homo sapiens
cugcagccucac

SEQ ID NO: 1125425 - RNA, 14 nt, Homo sapiens
cugcgacagaacuu

SEQ ID NO: 1125426 - RNA, 16 nt, Homo sapiens
cugcuguggggaccac

SEQ ID NO: 1125427 - RNA, 13 nt, Homo sapiens
cuggaaggcuucc

SEQ ID NO: 1125428 - RNA, 16 nt, Homo sapiens
cuggacugaccaaaga

SEQ ID NO: 1125429 - RNA, 16 nt, Homo sapiens
cuggauggucaucucg

SEQ ID NO: 1125430 - RNA, 14 nt, Homo sapiens
cuggauuugcagaa

SEQ ID NO: 1125431 - RNA, 23 nt, Homo sapiens
cuggcuuggggucaagaaacagc

SEQ ID NO: 1125432 - RNA, 21 nt, Homo sapiens
cugggaacaacuucaguccaa

SEQ ID NO: 1125433 - RNA, 22 nt, Homo sapiens
cugggaacaacuucaguccaac

SEQ ID NO: 1125434 - RNA, 15 nt, Homo sapiens
cugggacauggugga

SEQ ID NO: 1125435 - RNA, 13 nt, Homo sapiens
cugggacuuucac

SEQ ID NO: 1125436 - RNA, 14 nt, Homo sapiens
cugggcacagucag

SEQ ID NO: 1125437 - RNA, 19 nt, Homo sapiens
cuggguuacagaaucacag

SEQ ID NO: 1125438 - RNA, 17 nt, Homo sapiens
cugguagguugggacac

SEQ ID NO: 1125439 - RNA, 23 nt, Homo sapiens
cuggucagucugcccuugucacu

SEQ ID NO: 1125440 - RNA, 9 nt, Homo sapiens
gauggagcu

SEQ ID NO: 1125441 - RNA, 13 nt, Homo sapiens
gauugaacuuucc

SEQ ID NO: 1125442 - RNA, 14 nt, Homo sapiens
gauuguauuaacua

SEQ ID NO: 1125443 - RNA, 17 nt, Homo sapiens
gauuuggggccucaaga

SEQ ID NO: 1125444 - RNA, 14 nt, Homo sapiens
gcaaaagcucugug

SEQ ID NO: 1125445 - RNA, 18 nt, Homo sapiens
gcaaaauacaugacauuu

SEQ ID NO: 1125446 - RNA, 17 nt, Homo sapiens
gcaacagccaaguggaa

SEQ ID NO: 1125447 - RNA, 23 nt, Homo sapiens
gcaacugggucugacaugaacac

SEQ ID NO: 1125448 - RNA, 18 nt, Homo sapiens
gcaagagaaaauaaacca

SEQ ID NO: 1125449 - RNA, 23 nt, Homo sapiens
gcaaggaaacuauguaacaugua

SEQ ID NO: 1125450 - RNA, 15 nt, Homo sapiens
gcaccggccucggga

SEQ ID NO: 1125451 - RNA, 20 nt, Homo sapiens
gcacucccucccagagaaca

SEQ ID NO: 1125452 - RNA, 22 nt, Homo sapiens
gcacugggcucugauggcugcu

SEQ ID NO: 1125453 - RNA, 22 nt, Homo sapiens
gcacuuuaacccucucuucccu

SEQ ID NO: 1125454 - RNA, 21 nt, Homo sapiens
gcagaccacugauaaaaccau

SEQ ID NO: 1125455 - RNA, 15 nt, Homo sapiens
gcagagcaugaccug

SEQ ID NO: 1125456 - RNA, 19 nt, Homo sapiens
gcagagcaugaccugagga

SEQ ID NO: 1125457 - RNA, 22 nt, Homo sapiens
gcagcacuuuaacccucucuuc

SEQ ID NO: 1125458 - RNA, 18 nt, Homo sapiens
gcaggaaaugaaaauguc

SEQ ID NO: 1125459 - RNA, 20 nt, Homo sapiens
gcauacgguaugauauugca

SEQ ID NO: 1125460 - RNA, 23 nt, Homo sapiens
gcauacgguaugauauugcagcu

SEQ ID NO: 1125461 - RNA, 12 nt, Homo sapiens
gcaucugaccau

SEQ ID NO: 1125462 - RNA, 20 nt, Homo sapiens
gcauuuagacccugcauuua

SEQ ID NO: 1125463 - RNA, 14 nt, Homo sapiens
gccaaaacauuuau

SEQ ID NO: 1125464 - RNA, 13 nt, Homo sapiens
gccaaccuggacu

SEQ ID NO: 1125465 - RNA, 11 nt, Homo sapiens
gccacauggga

SEQ ID NO: 1125466 - RNA, 16 nt, Homo sapiens
gccacuauuacuggga

SEQ ID NO: 1125467 - RNA, 19 nt, Homo sapiens
gccaugaggagcguggacu

SEQ ID NO: 1125468 - RNA, 14 nt, Homo sapiens
gcccacaauggagu

SEQ ID NO: 1125469 - RNA, 13 nt, Homo sapiens
gcccuacucaccu

SEQ ID NO: 1125470 - RNA, 16 nt, Homo sapiens
gcccuacucaccugag

SEQ ID NO: 1125471 - RNA, 16 nt, Homo sapiens
gcccugaccuucuggg

SEQ ID NO: 1125472 - RNA, 12 nt, Homo sapiens
gccucaagaaca

SEQ ID NO: 1125473 - RNA, 17 nt, Homo sapiens
gccucaguagcaucuca

SEQ ID NO: 1125474 - RNA, 13 nt, Homo sapiens
gccuccagcacuc

SEQ ID NO: 1125475 - RNA, 17 nt, Homo sapiens
gccuccgcugggcuuca

SEQ ID NO: 1125476 - RNA, 15 nt, Homo sapiens
gccugcuuugcuuua

SEQ ID NO: 1125477 - RNA, 20 nt, Homo sapiens
gccugugcgccgggggaccu

SEQ ID NO: 1125478 - RNA, 14 nt, Homo sapiens
gccugugcuaaaga

SEQ ID NO: 1125479 - RNA, 17 nt, Homo sapiens
gcgaaaaaaucagugaa

SEQ ID NO: 1125480 - RNA, 13 nt, Homo sapiens
gcgagcacuguga

SEQ ID NO: 1125481 - RNA, 14 nt, Homo sapiens
gcgcgcgugcacac

SEQ ID NO: 1125482 - RNA, 19 nt, Homo sapiens
gcucaaucaugaguaccuc

SEQ ID NO: 1125483 - RNA, 13 nt, Homo sapiens
gcucaucauucuc

SEQ ID NO: 1125484 - RNA, 13 nt, Homo sapiens
gcuccggggccag

SEQ ID NO: 1125485 - RNA, 19 nt, Homo sapiens
gcuccuguguucuagaccu

SEQ ID NO: 1125486 - RNA, 16 nt, Homo sapiens
gcucgcuuugagugac

SEQ ID NO: 1125487 - RNA, 22 nt, Homo sapiens
gcucugauggcugcuccacugg

SEQ ID NO: 1125488 - RNA, 17 nt, Homo sapiens
gcucugggauagcugac

SEQ ID NO: 1125489 - RNA, 22 nt, Homo sapiens
gcucuugcucagugaagaggaa

SEQ ID NO: 1125490 - RNA, 18 nt, Homo sapiens
gcugaacauaacuucuca

SEQ ID NO: 1125491 - RNA, 18 nt, Homo sapiens
gcugaaggcuuacuucag

SEQ ID NO: 1125492 - RNA, 22 nt, Homo sapiens
gcugcuuccuggcugggaacaa

SEQ ID NO: 1125493 - RNA, 14 nt, Homo sapiens
gcuggccgcggugg

SEQ ID NO: 1125494 - RNA, 16 nt, Homo sapiens
gcuguggggaccacac

SEQ ID NO: 1125495 - RNA, 20 nt, Homo sapiens
gcuguuuccauagggugaca

SEQ ID NO: 1125496 - RNA, 21 nt, Homo sapiens
gcuuagacuaaggccauuauu

SEQ ID NO: 1125497 - RNA, 14 nt, Homo sapiens
gcuucugcacacaa

SEQ ID NO: 1125498 - RNA, 19 nt, Homo sapiens
gcuugucuucguccaucug

SEQ ID NO: 1125499 - RNA, 15 nt, Homo sapiens
gcuuuacugcaugaa

SEQ ID NO: 1125500 - RNA, 15 nt, Homo sapiens
ggaaaacaagcauuc

SEQ ID NO: 1125501 - RNA, 19 nt, Homo sapiens
ggaacuuuuauuacugggg

SEQ ID NO: 1125502 - RNA, 17 nt, Homo sapiens
ggaagagggugauugcu

SEQ ID NO: 1125503 - RNA, 12 nt, Homo sapiens
ggaagccaaagg

SEQ ID NO: 1125504 - RNA, 12 nt, Homo sapiens
ggacaaaaugga

SEQ ID NO: 1125505 - RNA, 16 nt, Homo sapiens
ggacaguaaacacucc

SEQ ID NO: 1125506 - RNA, 18 nt, Homo sapiens
ggacuuccugucauuuuc

SEQ ID NO: 1125507 - RNA, 21 nt, Homo sapiens
ggaggcuccagagggcacucu

SEQ ID NO: 1125508 - RNA, 13 nt, Homo sapiens
ggaggcugcugug

SEQ ID NO: 1125509 - RNA, 21 nt, Homo sapiens
ggaggucugguccgagucuca

SEQ ID NO: 1125510 - RNA, 21 nt, Homo sapiens
ggauaagggaguccagggugg

SEQ ID NO: 1125511 - RNA, 19 nt, Homo sapiens
ggauccccccacagccccu

SEQ ID NO: 1125512 - RNA, 16 nt, Homo sapiens
ggauccucaguucuca

SEQ ID NO: 1125513 - RNA, 15 nt, Homo sapiens
ggauggguccucacg

SEQ ID NO: 1125514 - RNA, 17 nt, Homo sapiens
ggaugguggagggccac

SEQ ID NO: 1125515 - RNA, 20 nt, Homo sapiens
ggcauucuuugcaauacugc

SEQ ID NO: 1125516 - RNA, 20 nt, Homo sapiens
ggccaggcaggggugggaga

SEQ ID NO: 1125517 - RNA, 14 nt, Homo sapiens
ggccuuaaccauga

SEQ ID NO: 1125518 - RNA, 23 nt, Homo sapiens
ggcuaccgugggucaaccuggga

SEQ ID NO: 1125519 - RNA, 22 nt, Homo sapiens
ggcuaccucaagacucaccuca

SEQ ID NO: 1125520 - RNA, 22 nt, Homo sapiens
ggcugguguaugcacagggugu

SEQ ID NO: 1125521 - RNA, 13 nt, Homo sapiens
ggcugucagccca

SEQ ID NO: 1125522 - RNA, 21 nt, Homo sapiens
ggcuucagguuagugacauuu

SEQ ID NO: 1125523 - RNA, 19 nt, Homo sapiens
gggagacugggcugaggga

SEQ ID NO: 1125524 - RNA, 15 nt, Homo sapiens
gggaguccagggugg

SEQ ID NO: 1125525 - RNA, 19 nt, Homo sapiens
gggauuggagggaagacag

SEQ ID NO: 1125526 - RNA, 18 nt, Homo sapiens
gggcaagaaccuaaagua

SEQ ID NO: 1125527 - RNA, 11 nt, Homo sapiens
gggcaucucaa

SEQ ID NO: 1125528 - RNA, 23 nt, Homo sapiens
gggcccacaauggagugggagau

SEQ ID NO: 1125529 - RNA, 14 nt, Homo sapiens
gggcucgugcccug

SEQ ID NO: 1125530 - RNA, 17 nt, Homo sapiens
gggcucugauggcugcu

SEQ ID NO: 1125531 - RNA, 14 nt, Homo sapiens
ggggcgagcacugu

SEQ ID NO: 1125532 - RNA, 18 nt, Homo sapiens
ggggcgagcacugugagc

SEQ ID NO: 1125533 - RNA, 16 nt, Homo sapiens
gggucaaccugggaug

SEQ ID NO: 1125534 - RNA, 20 nt, Homo sapiens
gggucuuguuucacauuugu

SEQ ID NO: 1125535 - RNA, 15 nt, Homo sapiens
ggguggaugaucuca

SEQ ID NO: 1125536 - RNA, 16 nt, Homo sapiens
gggugggccacucucc

SEQ ID NO: 1125537 - RNA, 19 nt, Homo sapiens
ggguggucugagcaccccc

SEQ ID NO: 1125538 - RNA, 18 nt, Homo sapiens
ggguggugagaaccggag

SEQ ID NO: 1125539 - RNA, 15 nt, Homo sapiens
ggucaagaaacagcc

SEQ ID NO: 1125540 - RNA, 23 nt, Homo sapiens
ggugcuacacccuuuuccagcug

SEQ ID NO: 1125541 - RNA, 13 nt, Homo sapiens
gguggagggccac

SEQ ID NO: 1125542 - RNA, 14 nt, Homo sapiens
gguggaugaucuca

SEQ ID NO: 1125543 - RNA, 22 nt, Homo sapiens
gguggauuccugggcaagaacc

SEQ ID NO: 1125544 - RNA, 24 nt, Homo sapiens
gguucuguagagccaauuagacuu

SEQ ID NO: 1125545 - RNA, 23 nt, Homo sapiens
guaaaacagucaucuagaauuca

SEQ ID NO: 1125546 - RNA, 14 nt, Homo sapiens
guaaacugugcacc

SEQ ID NO: 1125547 - RNA, 14 nt, Homo sapiens
guaaaugccacaaa

SEQ ID NO: 1125548 - RNA, 16 nt, Homo sapiens
guaauaaauuguuauu

SEQ ID NO: 1125549 - RNA, 18 nt, Homo sapiens
guaauauuuuacuuugag

SEQ ID NO: 1125550 - RNA, 14 nt, Homo sapiens
cuggucuucacugc

SEQ ID NO: 1125551 - RNA, 23 nt, Homo sapiens
cuguaaucccagcacuuugggag

SEQ ID NO: 1125552 - RNA, 18 nt, Homo sapiens
cuguaaucccagcuacuu

SEQ ID NO: 1125553 - RNA, 21 nt, Homo sapiens
cuguaaucccagcuacuuggg

SEQ ID NO: 1125554 - RNA, 18 nt, Homo sapiens
cuguaccugugcacguug

SEQ ID NO: 1125555 - RNA, 15 nt, Homo sapiens
cuguaucacugccuu

SEQ ID NO: 1125556 - RNA, 23 nt, Homo sapiens
cuguaugggggagauugaacuuu

SEQ ID NO: 1125557 - RNA, 18 nt, Homo sapiens
cugucaggauucuucaag

SEQ ID NO: 1125558 - RNA, 22 nt, Homo sapiens
cuguccugcagcaaacacucca

SEQ ID NO: 1125559 - RNA, 18 nt, Homo sapiens
cugugaacuuucauguca

SEQ ID NO: 1125560 - RNA, 13 nt, Homo sapiens
cugugacuauaaa

SEQ ID NO: 1125561 - RNA, 21 nt, Homo sapiens
cugugagccuugcaugacauc

SEQ ID NO: 1125562 - RNA, 13 nt, Homo sapiens
cuguugacaaaug

SEQ ID NO: 1125563 - RNA, 20 nt, Homo sapiens
cuguuggauaaagaccuucc

SEQ ID NO: 1125564 - RNA, 14 nt, Homo sapiens
cuuauauucaucca

SEQ ID NO: 1125565 - RNA, 14 nt, Homo sapiens
cuuauuuacagaua

SEQ ID NO: 1125566 - RNA, 17 nt, Homo sapiens
cuucaagaaauuacugg

SEQ ID NO: 1125567 - RNA, 21 nt, Homo sapiens
cuucaugaucaucacaaucau

SEQ ID NO: 1125568 - RNA, 22 nt, Homo sapiens
cuuccauuuucccccacuacug

SEQ ID NO: 1125569 - RNA, 17 nt, Homo sapiens
cuuccccagacucagcu

SEQ ID NO: 1125570 - RNA, 15 nt, Homo sapiens
cuuccucucugcaau

SEQ ID NO: 1125571 - RNA, 19 nt, Homo sapiens
cuuccugaacaaccagcug

SEQ ID NO: 1125572 - RNA, 16 nt, Homo sapiens
cuucuaccugccccca

SEQ ID NO: 1125573 - RNA, 18 nt, Homo sapiens
cuucuccauccacauggg

SEQ ID NO: 1125574 - RNA, 14 nt, Homo sapiens
cuucugcacacaaa

SEQ ID NO: 1125575 - RNA, 19 nt, Homo sapiens
cuucugguucuaacugcug

SEQ ID NO: 1125576 - RNA, 14 nt, Homo sapiens
cuugcagagcauga

SEQ ID NO: 1125577 - RNA, 19 nt, Homo sapiens
cuugcuucucuagcucucu

SEQ ID NO: 1125578 - RNA, 19 nt, Homo sapiens
cuuggagaauacugccaaa

SEQ ID NO: 1125579 - RNA, 16 nt, Homo sapiens
cuuggagugcuucuga

SEQ ID NO: 1125580 - RNA, 16 nt, Homo sapiens
cuuggcuucagguuag

SEQ ID NO: 1125581 - RNA, 17 nt, Homo sapiens
cuuuguuuugcacugac

SEQ ID NO: 1125582 - RNA, 15 nt, Homo sapiens
cuuuuauacaauaau

SEQ ID NO: 1125583 - RNA, 19 nt, Homo sapiens
cuuuucaauguuagccaca

SEQ ID NO: 1125584 - RNA, 21 nt, Homo sapiens
cuuuuuaaagaagugcaugaa

SEQ ID NO: 1125585 - RNA, 22 nt, Homo sapiens
cuuuuuaaagaagugcaugaaa

SEQ ID NO: 1125586 - RNA, 15 nt, Homo sapiens
cuuuuugugucucca

SEQ ID NO: 1125587 - RNA, 14 nt, Homo sapiens
gaaaauaaacugac

SEQ ID NO: 1125588 - RNA, 20 nt, Homo sapiens
gaaacaaauaauuugaacuu

SEQ ID NO: 1125589 - RNA, 19 nt, Homo sapiens
gaaacuuuaaaagacugaa

SEQ ID NO: 1125590 - RNA, 14 nt, Homo sapiens
gaaagcuggacuga

SEQ ID NO: 1125591 - RNA, 21 nt, Homo sapiens
gaaagcuggacugaccaaaga

SEQ ID NO: 1125592 - RNA, 19 nt, Homo sapiens
gaagaagaucaacgccuca

SEQ ID NO: 1125593 - RNA, 23 nt, Homo sapiens
gaagcauugccuggacugaccac

SEQ ID NO: 1125594 - RNA, 14 nt, Homo sapiens
gaagccacaggagc

SEQ ID NO: 1125595 - RNA, 20 nt, Homo sapiens
gaagccacuauuacugggac

SEQ ID NO: 1125596 - RNA, 17 nt, Homo sapiens
gaagccuauguaugcca

SEQ ID NO: 1125597 - RNA, 15 nt, Homo sapiens
gaagcuuccauucca

SEQ ID NO: 1125598 - RNA, 17 nt, Homo sapiens
gaaggacacuagccugu

SEQ ID NO: 1125599 - RNA, 13 nt, Homo sapiens
gaaggccacuggu

SEQ ID NO: 1125600 - RNA, 15 nt, Homo sapiens
gaagucugagggaaa

SEQ ID NO: 1125601 - RNA, 17 nt, Homo sapiens
gaauaaaaacuuugcag

SEQ ID NO: 1125602 - RNA, 21 nt, Homo sapiens
gaauaaaccaucaucuugcca

SEQ ID NO: 1125603 - RNA, 21 nt, Homo sapiens
gaauacugggaaucaagacaa

SEQ ID NO: 1125604 - RNA, 13 nt, Homo sapiens
gaaucucuuggau

SEQ ID NO: 1125605 - RNA, 20 nt, Homo sapiens
gaaucucuuggaugcagcuu

SEQ ID NO: 1125606 - RNA, 15 nt, Homo sapiens
gaaugauaagcagga

SEQ ID NO: 1125607 - RNA, 14 nt, Homo sapiens
gaaugauucagugu

SEQ ID NO: 1125608 - RNA, 15 nt, Homo sapiens
gaauucacaccuuag

SEQ ID NO: 1125609 - RNA, 15 nt, Homo sapiens
gacacuagccugugc

SEQ ID NO: 1125610 - RNA, 18 nt, Homo sapiens
gacacuagccugugcacg

SEQ ID NO: 1125611 - RNA, 21 nt, Homo sapiens
gacacuagccugugcacgcgc

SEQ ID NO: 1125612 - RNA, 17 nt, Homo sapiens
gacagucaccuauccac

SEQ ID NO: 1125613 - RNA, 19 nt, Homo sapiens
gacaguuuuugacauuuau

SEQ ID NO: 1125614 - RNA, 18 nt, Homo sapiens
gaccacaccaaccaggcc

SEQ ID NO: 1125615 - RNA, 19 nt, Homo sapiens
gaccccagaggauugcugc

SEQ ID NO: 1125616 - RNA, 14 nt, Homo sapiens
gaccgaacacugca

SEQ ID NO: 1125617 - RNA, 18 nt, Homo sapiens
gaccuuccagcuccugug

SEQ ID NO: 1125618 - RNA, 18 nt, Homo sapiens
gacuauaaagcuguuauu

SEQ ID NO: 1125619 - RNA, 20 nt, Homo sapiens
gacuggguuuugugauugcc

SEQ ID NO: 1125620 - RNA, 17 nt, Homo sapiens
gacuguugccacuuaac

SEQ ID NO: 1125621 - RNA, 14 nt, Homo sapiens
gagaaacacuauuu

SEQ ID NO: 1125622 - RNA, 23 nt, Homo sapiens
gagaaaccagggagccccuuuga

SEQ ID NO: 1125623 - RNA, 22 nt, Homo sapiens
gagaccaaaggauccagagacu

SEQ ID NO: 1125624 - RNA, 20 nt, Homo sapiens
gagaccccuuccuuuccucu

SEQ ID NO: 1125625 - RNA, 20 nt, Homo sapiens
gagagccugucaccagagcu

SEQ ID NO: 1125626 - RNA, 22 nt, Homo sapiens
gagagcucgcuuugagugacug

SEQ ID NO: 1125627 - RNA, 18 nt, Homo sapiens
gagcacccccucauuccc

SEQ ID NO: 1125628 - RNA, 11 nt, Homo sapiens
gagcacuguga

SEQ ID NO: 1125629 - RNA, 21 nt, Homo sapiens
gagcagugaaugauucagugu

SEQ ID NO: 1125630 - RNA, 12 nt, Homo sapiens
gagcaugaccug

SEQ ID NO: 1125631 - RNA, 14 nt, Homo sapiens
gagcaugaccugag

SEQ ID NO: 1125632 - RNA, 20 nt, Homo sapiens
gagcuguuuucccugaccuc

SEQ ID NO: 1125633 - RNA, 12 nt, Homo sapiens
gaggcugagaaa

SEQ ID NO: 1125634 - RNA, 16 nt, Homo sapiens
gaggcugaggcaagag

SEQ ID NO: 1125635 - RNA, 19 nt, Homo sapiens
gaggcugcuguggggacca

SEQ ID NO: 1125636 - RNA, 15 nt, Homo sapiens
gaggcuuuacagugu

SEQ ID NO: 1125637 - RNA, 21 nt, Homo sapiens
gagggaugccacccagcaaca

SEQ ID NO: 1125638 - RNA, 17 nt, Homo sapiens
gagggccacaugggagg

SEQ ID NO: 1125639 - RNA, 20 nt, Homo sapiens
gaggucugguccgagucuca

SEQ ID NO: 1125640 - RNA, 12 nt, Homo sapiens
gaggugcagcug

SEQ ID NO: 1125641 - RNA, 14 nt, Homo sapiens
gaggugcagcugga

SEQ ID NO: 1125642 - RNA, 17 nt, Homo sapiens
gagguuugccagcauuu

SEQ ID NO: 1125643 - RNA, 17 nt, Homo sapiens
gaguccaggguggauga

SEQ ID NO: 1125644 - RNA, 22 nt, Homo sapiens
gaguccaggguggaugaucuca

SEQ ID NO: 1125645 - RNA, 14 nt, Homo sapiens
gagugaggagccca

SEQ ID NO: 1125646 - RNA, 23 nt, Homo sapiens
gagugucuuuccacggagccacu

SEQ ID NO: 1125647 - RNA, 13 nt, Homo sapiens
gaguuuucagugg

SEQ ID NO: 1125648 - RNA, 17 nt, Homo sapiens
gauacuaagcacaaagc

SEQ ID NO: 1125649 - RNA, 20 nt, Homo sapiens
gauauaauuuuauuacauau

SEQ ID NO: 1125650 - RNA, 21 nt, Homo sapiens
gauauaauuuuauuacauaug

SEQ ID NO: 1125651 - RNA, 16 nt, Homo sapiens
gauauucagaaguaua

SEQ ID NO: 1125652 - RNA, 15 nt, Homo sapiens
gaucauucucaguga

SEQ ID NO: 1125653 - RNA, 21 nt, Homo sapiens
gaucccguucagaaaaccacu

SEQ ID NO: 1125654 - RNA, 21 nt, Homo sapiens
gauccgucuuuggccuccucc

SEQ ID NO: 1125655 - RNA, 20 nt, Homo sapiens
gaucucagcagugaaguaua

SEQ ID NO: 1125656 - RNA, 13 nt, Homo sapiens
gaugaguuugaca

SEQ ID NO: 1125657 - RNA, 24 nt, Homo sapiens
gaugccacccagcaacacagagcu

SEQ ID NO: 1125658 - RNA, 20 nt, Homo sapiens
gauggaaugcuugcagagca

SEQ ID NO: 1125659 - RNA, 16 nt, Homo sapiens
guaaucccagcacuuu

SEQ ID NO: 1125660 - RNA, 20 nt, Homo sapiens
guaaucccagcuacuuggga

SEQ ID NO: 1125661 - RNA, 20 nt, Homo sapiens
guacaguauguuuuacaugu

SEQ ID NO: 1125662 - RNA, 18 nt, Homo sapiens
guaccugcccccaaucca

SEQ ID NO: 1125663 - RNA, 13 nt, Homo sapiens
guaccugugcacg

SEQ ID NO: 1125664 - RNA, 21 nt, Homo sapiens
guaccuucaaacuagggccaa

SEQ ID NO: 1125665 - RNA, 17 nt, Homo sapiens
guacucuuuaacauaca

SEQ ID NO: 1125666 - RNA, 22 nt, Homo sapiens
guagaacucacucugggcugua

SEQ ID NO: 1125667 - RNA, 13 nt, Homo sapiens
guagaacuuggau

SEQ ID NO: 1125668 - RNA, 19 nt, Homo sapiens
guauauuacccaauggaaa

SEQ ID NO: 1125669 - RNA, 18 nt, Homo sapiens
guauuuuuucacuuguac

SEQ ID NO: 1125670 - RNA, 18 nt, Homo sapiens
gucaauaaacaacagcug

SEQ ID NO: 1125671 - RNA, 17 nt, Homo sapiens
gucagcccaugugcacc

SEQ ID NO: 1125672 - RNA, 15 nt, Homo sapiens
gucaggauucuucaa

SEQ ID NO: 1125673 - RNA, 22 nt, Homo sapiens
gucaguguugccucuugcaaug

SEQ ID NO: 1125674 - RNA, 20 nt, Homo sapiens
guccaggguggaugaucuca

SEQ ID NO: 1125675 - RNA, 21 nt, Homo sapiens
guccccacccuccacucagcu

SEQ ID NO: 1125676 - RNA, 19 nt, Homo sapiens
guccgagucucagcccuga

SEQ ID NO: 1125677 - RNA, 18 nt, Homo sapiens
guccucacgcagacacac

SEQ ID NO: 1125678 - RNA, 20 nt, Homo sapiens
guccugcagcaaacacucca

SEQ ID NO: 1125679 - RNA, 15 nt, Homo sapiens
gucgcccuacucacc

SEQ ID NO: 1125680 - RNA, 17 nt, Homo sapiens
gugaaauuaagcauuuu

SEQ ID NO: 1125681 - RNA, 19 nt, Homo sapiens
gugaagaggaaaaugccuc

SEQ ID NO: 1125682 - RNA, 23 nt, Homo sapiens
gugaauaaaccaucaucuugcca

SEQ ID NO: 1125683 - RNA, 16 nt, Homo sapiens
gugaaugauucagugu

SEQ ID NO: 1125684 - RNA, 16 nt, Homo sapiens
gugacauuuccaugca

SEQ ID NO: 1125685 - RNA, 17 nt, Homo sapiens
gugacauuuccaugcau

SEQ ID NO: 1125686 - RNA, 14 nt, Homo sapiens
gugagaccaaagga

SEQ ID NO: 1125687 - RNA, 17 nt, Homo sapiens
gugagcaccugagcaug

SEQ ID NO: 1125688 - RNA, 18 nt, Homo sapiens
uuuucacuucuaccuaca

SEQ ID NO: 1125689 - RNA, 14 nt, Homo sapiens
uuuucccccuauca

SEQ ID NO: 1125690 - RNA, 17 nt, Homo sapiens
uuuuucacuucuaccua

SEQ ID NO: 1125691 - RNA, 15 nt, Homo sapiens
uuuuugaaucuauga

SEQ ID NO: 1125692 - RNA, 18 nt, Homo sapiens
uuuuuguucaaagccagc

SEQ ID NO: 1125693 - RNA, 18 nt, Homo sapiens
accugaaaacacugugca

SEQ ID NO: 1125694 - RNA, 19 nt, Homo sapiens
accugaaaacacugugcac

SEQ ID NO: 1125695 - RNA, 20 nt, Homo sapiens
accugaaaacacugugcaca

SEQ ID NO: 1125696 - RNA, 13 nt, Homo sapiens
accugccucuucc

SEQ ID NO: 1125697 - RNA, 15 nt, Homo sapiens
accugggcaaagccu

SEQ ID NO: 1125698 - RNA, 15 nt, Homo sapiens
accuguaaucccagc

SEQ ID NO: 1125699 - RNA, 14 nt, Homo sapiens
acgauuaacuguga

SEQ ID NO: 1125700 - RNA, 21 nt, Homo sapiens
acgccucacugaaacauggcu

SEQ ID NO: 1125701 - RNA, 22 nt, Homo sapiens
acggagccacuccucugacuca

SEQ ID NO: 1125702 - RNA, 17 nt, Homo sapiens
acgucauuugugcaaga

SEQ ID NO: 1125703 - RNA, 19 nt, Homo sapiens
acguucagaggugcagcug

SEQ ID NO: 1125704 - RNA, 21 nt, Homo sapiens
acguucagaggugcagcugga

SEQ ID NO: 1125705 - RNA, 19 nt, Homo sapiens
acuaccuacugguguaauc

SEQ ID NO: 1125706 - RNA, 17 nt, Homo sapiens
acuagagccugugcuaa

SEQ ID NO: 1125707 - RNA, 16 nt, Homo sapiens
acuagccugugcacgc

SEQ ID NO: 1125708 - RNA, 17 nt, Homo sapiens
acuauaaagcuguuauu

SEQ ID NO: 1125709 - RNA, 13 nt, Homo sapiens
acuauaccuuauc

SEQ ID NO: 1125710 - RNA, 12 nt, Homo sapiens
acuauuacuggg

SEQ ID NO: 1125711 - RNA, 12 nt, Homo sapiens
acucaagggaaa

SEQ ID NO: 1125712 - RNA, 17 nt, Homo sapiens
acucagcuguccugcag

SEQ ID NO: 1125713 - RNA, 13 nt, Homo sapiens
acucagggcuccu

SEQ ID NO: 1125714 - RNA, 15 nt, Homo sapiens
acucauuuaucuccu

SEQ ID NO: 1125715 - RNA, 15 nt, Homo sapiens
acuccacucccagca

SEQ ID NO: 1125716 - RNA, 20 nt, Homo sapiens
acucucccuuguacagccuu

SEQ ID NO: 1125717 - RNA, 20 nt, Homo sapiens
acucucuguuuuaguguuua

SEQ ID NO: 1125718 - RNA, 21 nt, Homo sapiens
acugaggacuguuugcaauug

SEQ ID NO: 1125719 - RNA, 22 nt, Homo sapiens
acugcagggaaaauuauuugca

SEQ ID NO: 1125720 - RNA, 17 nt, Homo sapiens
acugccaaaacauuuau

SEQ ID NO: 1125721 - RNA, 13 nt, Homo sapiens
acugccaugccuc

SEQ ID NO: 1125722 - RNA, 15 nt, Homo sapiens
acugccaugccucaa

SEQ ID NO: 1125723 - RNA, 17 nt, Homo sapiens
acuggauggucaucucg

SEQ ID NO: 1125724 - RNA, 14 nt, Homo sapiens
acugggaaucaaga

SEQ ID NO: 1125725 - RNA, 17 nt, Homo sapiens
acugggucugacaugaa

SEQ ID NO: 1125726 - RNA, 15 nt, Homo sapiens
acuuaaaaaacugca

SEQ ID NO: 1125727 - RNA, 19 nt, Homo sapiens
acuucaagaucugaauuug

SEQ ID NO: 1125728 - RNA, 17 nt, Homo sapiens
acuucuaccuacauauu

SEQ ID NO: 1125729 - RNA, 14 nt, Homo sapiens
acuucuaccugccc

SEQ ID NO: 1125730 - RNA, 16 nt, Homo sapiens
acuuuaaaagacugaa

SEQ ID NO: 1125731 - RNA, 17 nt, Homo sapiens
agaaaaaacuagagccu

SEQ ID NO: 1125732 - RNA, 13 nt, Homo sapiens
agaaagcuggacu

SEQ ID NO: 1125733 - RNA, 19 nt, Homo sapiens
agaacuucagcauuguaau

SEQ ID NO: 1125734 - RNA, 21 nt, Homo sapiens
agaagaaguuuaaaaaaccau

SEQ ID NO: 1125735 - RNA, 15 nt, Homo sapiens
agaagucaacgccuc

SEQ ID NO: 1125736 - RNA, 18 nt, Homo sapiens
agaauuugagugcucuga

SEQ ID NO: 1125737 - RNA, 14 nt, Homo sapiens
agaccacugauaaa

SEQ ID NO: 1125738 - RNA, 18 nt, Homo sapiens
agacgugcgcgaugugac

SEQ ID NO: 1125739 - RNA, 18 nt, Homo sapiens
agacucagcuccagaaua

SEQ ID NO: 1125740 - RNA, 21 nt, Homo sapiens
agacugcccagcuaaagcaau

SEQ ID NO: 1125741 - RNA, 16 nt, Homo sapiens
agacugggcugaggga

SEQ ID NO: 1125742 - RNA, 16 nt, Homo sapiens
agacuuggggaccaga

SEQ ID NO: 1125743 - RNA, 16 nt, Homo sapiens
agagaccccuuccuuu

SEQ ID NO: 1125744 - RNA, 14 nt, Homo sapiens
agagauaaaugagc

SEQ ID NO: 1125745 - RNA, 19 nt, Homo sapiens
agagcaagacucugucuca

SEQ ID NO: 1125746 - RNA, 15 nt, Homo sapiens
agagcaugaccugag

SEQ ID NO: 1125747 - RNA, 16 nt, Homo sapiens
agagcucacagcugga

SEQ ID NO: 1125748 - RNA, 19 nt, Homo sapiens
agaggugacaguggaugac

SEQ ID NO: 1125749 - RNA, 14 nt, Homo sapiens
agaggugagaccaa

SEQ ID NO: 1125750 - RNA, 22 nt, Homo sapiens
agaggugcagcuggaggcugcu

SEQ ID NO: 1125751 - RNA, 22 nt, Homo sapiens
agauagauccauuuggacaaaa

SEQ ID NO: 1125752 - RNA, 17 nt, Homo sapiens
agauauucagaaguaua

SEQ ID NO: 1125753 - RNA, 19 nt, Homo sapiens
agcaaaaugcuucugcaca

SEQ ID NO: 1125754 - RNA, 13 nt, Homo sapiens
agcaacacagagc

SEQ ID NO: 1125755 - RNA, 15 nt, Homo sapiens
agcaccggccucggg

SEQ ID NO: 1125756 - RNA, 14 nt, Homo sapiens
aaacaagucaaaga

SEQ ID NO: 1125757 - RNA, 12 nt, Homo sapiens
aaacacuccacc

SEQ ID NO: 1125758 - RNA, 13 nt, Homo sapiens
aaacuaacuugau

SEQ ID NO: 1125759 - RNA, 18 nt, Homo sapiens
aaagaccuuccagcuccu

SEQ ID NO: 1125760 - RNA, 16 nt, Homo sapiens
aaagcaaaagcucugu

SEQ ID NO: 1125761 - RNA, 20 nt, Homo sapiens
aaagcuggacugaccaaaga

SEQ ID NO: 1125762 - RNA, 13 nt, Homo sapiens
aaaguacuugacu

SEQ ID NO: 1125763 - RNA, 15 nt, Homo sapiens
aaauacagucuucca

SEQ ID NO: 1125764 - RNA, 21 nt, Homo sapiens
aaauacagucuuccauuugca

SEQ ID NO: 1125765 - RNA, 15 nt, Homo sapiens
aaauauauaugauau

SEQ ID NO: 1125766 - RNA, 15 nt, Homo sapiens
aaauccaguuuccca

SEQ ID NO: 1125767 - RNA, 15 nt, Homo sapiens
aaaucuugacuacag

SEQ ID NO: 1125768 - RNA, 17 nt, Homo sapiens
aaaugaaaaugucuugu

SEQ ID NO: 1125769 - RNA, 14 nt, Homo sapiens
aaaugaacauuuca

SEQ ID NO: 1125770 - RNA, 15 nt, Homo sapiens
aaaugcuucugcaca

SEQ ID NO: 1125771 - RNA, 21 nt, Homo sapiens
aaauuaauauaucauuaucuu

SEQ ID NO: 1125772 - RNA, 15 nt, Homo sapiens
aacaacuucagucca

SEQ ID NO: 1125773 - RNA, 16 nt, Homo sapiens
aacagaagcuuccauu

SEQ ID NO: 1125774 - RNA, 14 nt, Homo sapiens
aacagauaagucca

SEQ ID NO: 1125775 - RNA, 19 nt, Homo sapiens
aacagccaaaaaggacuuu

SEQ ID NO: 1125776 - RNA, 15 nt, Homo sapiens
aacaugggcugugau

SEQ ID NO: 1125777 - RNA, 18 nt, Homo sapiens
aaccaguuaagaauggaa

SEQ ID NO: 1125778 - RNA, 19 nt, Homo sapiens
aacccaaggaacaagagaa

SEQ ID NO: 1125779 - RNA, 13 nt, Homo sapiens
aaccugugcugaa

SEQ ID NO: 1125780 - RNA, 17 nt, Homo sapiens
aacgaaucgauucugca

SEQ ID NO: 1125781 - RNA, 14 nt, Homo sapiens
aacguggcacuggu

SEQ ID NO: 1125782 - RNA, 15 nt, Homo sapiens
aacguggcacuggua

SEQ ID NO: 1125783 - RNA, 15 nt, Homo sapiens
aacuacuggcaauuu

SEQ ID NO: 1125784 - RNA, 23 nt, Homo sapiens
aacugaggacuguuugcaauuga

SEQ ID NO: 1125785 - RNA, 19 nt, Homo sapiens
aacuuggauguaccugccc

SEQ ID NO: 1125786 - RNA, 16 nt, Homo sapiens
aacuuuggaacagggu

SEQ ID NO: 1125787 - RNA, 19 nt, Homo sapiens
aacuuuuugcaaggcauuu

SEQ ID NO: 1125788 - RNA, 16 nt, Homo sapiens
aagaaccuaaaguagc

SEQ ID NO: 1125789 - RNA, 21 nt, Homo sapiens
aagaagacuguugccacuuaa

SEQ ID NO: 1125790 - RNA, 20 nt, Homo sapiens
aagaagcccugcugggccca

SEQ ID NO: 1125791 - RNA, 14 nt, Homo sapiens
aagacuauaccuua

SEQ ID NO: 1125792 - RNA, 13 nt, Homo sapiens
aagacucaccuca

SEQ ID NO: 1125793 - RNA, 19 nt, Homo sapiens
aagagaaaauaaaccaaga

SEQ ID NO: 1125794 - RNA, 21 nt, Homo sapiens
aagaggaaggccucuguggca

SEQ ID NO: 1125795 - RNA, 17 nt, Homo sapiens
aagauacagaacucuuu

SEQ ID NO: 1125796 - RNA, 13 nt, Homo sapiens
aagcagagcucac

SEQ ID NO: 1125797 - RNA, 20 nt, Homo sapiens
aagcaggaaaugaaaauguc

SEQ ID NO: 1125798 - RNA, 11 nt, Homo sapiens
aagccaaaggc

SEQ ID NO: 1125799 - RNA, 20 nt, Homo sapiens
aagccccauccaacacugga

SEQ ID NO: 1125800 - RNA, 18 nt, Homo sapiens
aagcuauugucuguaaua

SEQ ID NO: 1125801 - RNA, 12 nt, Homo sapiens
aagcucacaaua

SEQ ID NO: 1125802 - RNA, 19 nt, Homo sapiens
aagcuguuuccauagggug

SEQ ID NO: 1125803 - RNA, 22 nt, Homo sapiens
aagcuuucauguaaacugugca

SEQ ID NO: 1125804 - RNA, 17 nt, Homo sapiens
aagguacugguacuaua

SEQ ID NO: 1125805 - RNA, 14 nt, Homo sapiens
aaguaaaacaguca

SEQ ID NO: 1125806 - RNA, 16 nt, Homo sapiens
aaguaaaacagucauc

SEQ ID NO: 1125807 - RNA, 16 nt, Homo sapiens
aagucauaccaaugaa

SEQ ID NO: 1125808 - RNA, 13 nt, Homo sapiens
aauaaacagucac

SEQ ID NO: 1125809 - RNA, 21 nt, Homo sapiens
aauaaaccaagauagauccau

SEQ ID NO: 1125810 - RNA, 12 nt, Homo sapiens
aauaacauguuu

SEQ ID NO: 1125811 - RNA, 20 nt, Homo sapiens
aauacagucuuccauuugca

SEQ ID NO: 1125812 - RNA, 17 nt, Homo sapiens
aauacuacuacuguuau

SEQ ID NO: 1125813 - RNA, 23 nt, Homo sapiens
aauauauauuaagugugccaaau

SEQ ID NO: 1125814 - RNA, 22 nt, Homo sapiens
aauauguaauuucaaaauacau

SEQ ID NO: 1125815 - RNA, 23 nt, Homo sapiens
aauauuguccauuguccaauccu

SEQ ID NO: 1125816 - RNA, 17 nt, Homo sapiens
aauauuuauuaccucug

SEQ ID NO: 1125817 - RNA, 20 nt, Homo sapiens
agcacugggcucugauggcu

SEQ ID NO: 1125818 - RNA, 17 nt, Homo sapiens
agcacugugagcaccug

SEQ ID NO: 1125819 - RNA, 21 nt, Homo sapiens
agcacuuuuugggguucaaga

SEQ ID NO: 1125820 - RNA, 21 nt, Homo sapiens
agcagcgccccucccaagagg

SEQ ID NO: 1125821 - RNA, 13 nt, Homo sapiens
agcaucugaccau

SEQ ID NO: 1125822 - RNA, 19 nt, Homo sapiens
agcaucugaccaucuguga

SEQ ID NO: 1125823 - RNA, 23 nt, Homo sapiens
agcauuuugaaacaaaguacucu

SEQ ID NO: 1125824 - RNA, 14 nt, Homo sapiens
agccaaccuggacu

SEQ ID NO: 1125825 - RNA, 15 nt, Homo sapiens
agccaccaagaggga

SEQ ID NO: 1125826 - RNA, 21 nt, Homo sapiens
agccagaguuuuuaaagccuu

SEQ ID NO: 1125827 - RNA, 13 nt, Homo sapiens
agccauaugaaug

SEQ ID NO: 1125828 - RNA, 14 nt, Homo sapiens
agcccaugugcacc

SEQ ID NO: 1125829 - RNA, 19 nt, Homo sapiens
agcccuucccaggcuggau

SEQ ID NO: 1125830 - RNA, 23 nt, Homo sapiens
agccuauguaugccauggaggca

SEQ ID NO: 1125831 - RNA, 20 nt, Homo sapiens
agccugcuuugcuuuacugc

SEQ ID NO: 1125832 - RNA, 18 nt, Homo sapiens
agcgaggaggcuccagag

SEQ ID NO: 1125833 - RNA, 20 nt, Homo sapiens
agcguucuaaauaugaauga

SEQ ID NO: 1125834 - RNA, 18 nt, Homo sapiens
agcuccuguguucuagac

SEQ ID NO: 1125835 - RNA, 20 nt, Homo sapiens
agcucgggcccucugugaga

SEQ ID NO: 1125836 - RNA, 20 nt, Homo sapiens
agcucugaaaccaguguuag

SEQ ID NO: 1125837 - RNA, 23 nt, Homo sapiens
agcucugaaaccaguguuaggga

SEQ ID NO: 1125838 - RNA, 18 nt, Homo sapiens
agcuggaaaaaguguccu

SEQ ID NO: 1125839 - RNA, 15 nt, Homo sapiens
agcuggacugaccaa

SEQ ID NO: 1125840 - RNA, 22 nt, Homo sapiens
agcuuuagugaauuaaauuuag

SEQ ID NO: 1125841 - RNA, 22 nt, Homo sapiens
agcuuucauguaaacugugcac

SEQ ID NO: 1125842 - RNA, 15 nt, Homo sapiens
aggaacaagagaaaa

SEQ ID NO: 1125843 - RNA, 19 nt, Homo sapiens
aggaacguggucaacucac

SEQ ID NO: 1125844 - RNA, 15 nt, Homo sapiens
aggaagaaugaaacu

SEQ ID NO: 1125845 - RNA, 19 nt, Homo sapiens
aggaaggauggcaagcacg

SEQ ID NO: 1125846 - RNA, 13 nt, Homo sapiens
aggcaagagaaaa

SEQ ID NO: 1125847 - RNA, 13 nt, Homo sapiens
aggcauguacaaa

SEQ ID NO: 1125848 - RNA, 14 nt, Homo sapiens
aggccagugccagc

SEQ ID NO: 1125849 - RNA, 16 nt, Homo sapiens
aggcgcaggugcacag

SEQ ID NO: 1125850 - RNA, 20 nt, Homo sapiens
aggcggguggaucacuugag

SEQ ID NO: 1125851 - RNA, 17 nt, Homo sapiens
aggcucguugacuggcu

SEQ ID NO: 1125852 - RNA, 22 nt, Homo sapiens
aggcuggauacuaagcacaaag

SEQ ID NO: 1125853 - RNA, 14 nt, Homo sapiens
aggcuuuacagugu

SEQ ID NO: 1125854 - RNA, 15 nt, Homo sapiens
agggacaagggauuc

SEQ ID NO: 1125855 - RNA, 23 nt, Homo sapiens
agggagccaucccuucccugucc

SEQ ID NO: 1125856 - RNA, 20 nt, Homo sapiens
agggagcccccagaggacuu

SEQ ID NO: 1125857 - RNA, 15 nt, Homo sapiens
agggaguccagggug

SEQ ID NO: 1125858 - RNA, 22 nt, Homo sapiens
agggaugccacccagcaacaca

SEQ ID NO: 1125859 - RNA, 19 nt, Homo sapiens
agggauggagcugaaaaag

SEQ ID NO: 1125860 - RNA, 16 nt, Homo sapiens
agggauuccccuaacc

SEQ ID NO: 1125861 - RNA, 20 nt, Homo sapiens
aggggccuuagggcacuggg

SEQ ID NO: 1125862 - RNA, 17 nt, Homo sapiens
augggcuaucaacuuaa

SEQ ID NO: 1125863 - RNA, 22 nt, Homo sapiens
auguagcggugaagaguacaga

SEQ ID NO: 1125864 - RNA, 14 nt, Homo sapiens
auguauaugcacuu

SEQ ID NO: 1125865 - RNA, 19 nt, Homo sapiens
augugacauuauaugcacu

SEQ ID NO: 1125866 - RNA, 19 nt, Homo sapiens
augugaccgaacacugcag

SEQ ID NO: 1125867 - RNA, 14 nt, Homo sapiens
augugauugcagcu

SEQ ID NO: 1125868 - RNA, 22 nt, Homo sapiens
auguucacuuuugacaaaggca

SEQ ID NO: 1125869 - RNA, 19 nt, Homo sapiens
auguucccaaaacaauggu

SEQ ID NO: 1125870 - RNA, 13 nt, Homo sapiens
auuaggcaugccu

SEQ ID NO: 1125871 - RNA, 14 nt, Homo sapiens
auuaggcaugccua

SEQ ID NO: 1125872 - RNA, 21 nt, Homo sapiens
auuauagaauucuguacuuga

SEQ ID NO: 1125873 - RNA, 16 nt, Homo sapiens
auuauaugcacuagca

SEQ ID NO: 1125874 - RNA, 16 nt, Homo sapiens
auuaucuuugcuguua

SEQ ID NO: 1125875 - RNA, 21 nt, Homo sapiens
auucaauuaguggucauaaaa

SEQ ID NO: 1125876 - RNA, 22 nt, Homo sapiens
auuccauuacuaagaaacacau

SEQ ID NO: 1125877 - RNA, 22 nt, Homo sapiens
auuccccucgugugacucucuu

SEQ ID NO: 1125878 - RNA, 14 nt, Homo sapiens
auucggaccaagca

SEQ ID NO: 1125879 - RNA, 20 nt, Homo sapiens
auucucauaaguagcauuca

SEQ ID NO: 1125880 - RNA, 13 nt, Homo sapiens
auucucauucuca

SEQ ID NO: 1125881 - RNA, 12 nt, Homo sapiens
auugaacuuucc

SEQ ID NO: 1125882 - RNA, 17 nt, Homo sapiens
auugagauuuaauuccc

SEQ ID NO: 1125883 - RNA, 16 nt, Homo sapiens
auugaguuuucagugg

SEQ ID NO: 1125884 - RNA, 12 nt, Homo sapiens
auuggacuccag

SEQ ID NO: 1125885 - RNA, 18 nt, Homo sapiens
auuggagggaagacaggu

SEQ ID NO: 1125886 - RNA, 14 nt, Homo sapiens
auugucacaucuau

SEQ ID NO: 1125887 - RNA, 13 nt, Homo sapiens
auuuaacuuucca

SEQ ID NO: 1125888 - RNA, 13 nt, Homo sapiens
auuuaucaaucuc

SEQ ID NO: 1125889 - RNA, 16 nt, Homo sapiens
auuucuccuccauggg

SEQ ID NO: 1125890 - RNA, 13 nt, Homo sapiens
auuugagugcucu

SEQ ID NO: 1125891 - RNA, 21 nt, Homo sapiens
auuugcaagggaaaagucucu

SEQ ID NO: 1125892 - RNA, 16 nt, Homo sapiens
auuuugaaaaaugaga

SEQ ID NO: 1125893 - RNA, 15 nt, Homo sapiens
auuuuuccacuuaaa

SEQ ID NO: 1125894 - RNA, 13 nt, Homo sapiens
auuuuugugcaca

SEQ ID NO: 1125895 - RNA, 20 nt, Homo sapiens
caaaaaucuguguaacugua

SEQ ID NO: 1125896 - RNA, 17 nt, Homo sapiens
caaaaauugucccuuaa

SEQ ID NO: 1125897 - RNA, 15 nt, Homo sapiens
caaaaggacucucag

SEQ ID NO: 1125898 - RNA, 18 nt, Homo sapiens
caaaaugggcccuugccu

SEQ ID NO: 1125899 - RNA, 23 nt, Homo sapiens
caaagcaaggaaacuauguaaca

SEQ ID NO: 1125900 - RNA, 22 nt, Homo sapiens
caaagcuuucauguaaacugug

SEQ ID NO: 1125901 - RNA, 13 nt, Homo sapiens
caaaugcaauuuu

SEQ ID NO: 1125902 - RNA, 13 nt, Homo sapiens
caaauguauuuca

SEQ ID NO: 1125903 - RNA, 11 nt, Homo sapiens
caacagcauuu

SEQ ID NO: 1125904 - RNA, 15 nt, Homo sapiens
caacagcauuuucaa

SEQ ID NO: 1125905 - RNA, 22 nt, Homo sapiens
caagaauaaauuuuucuucucu

SEQ ID NO: 1125906 - RNA, 16 nt, Homo sapiens
caagacucaccucauc

SEQ ID NO: 1125907 - RNA, 21 nt, Homo sapiens
gcgagcacugugagcaccuga

SEQ ID NO: 1125908 - RNA, 14 nt, Homo sapiens
gcgcgugcacacac

SEQ ID NO: 1125909 - RNA, 18 nt, Homo sapiens
gcggcagguucucuuuga

SEQ ID NO: 1125910 - RNA, 17 nt, Homo sapiens
gcggcuucaccugcgug

SEQ ID NO: 1125911 - RNA, 14 nt, Homo sapiens
gcuacgaccugguc

SEQ ID NO: 1125912 - RNA, 22 nt, Homo sapiens
gcuaugugaagaguaagucaac

SEQ ID NO: 1125913 - RNA, 15 nt, Homo sapiens
gcucaucauucucug

SEQ ID NO: 1125914 - RNA, 20 nt, Homo sapiens
gcuccuguguucuagaccuc

SEQ ID NO: 1125915 - RNA, 14 nt, Homo sapiens
gcugaggcugagaa

SEQ ID NO: 1125916 - RNA, 19 nt, Homo sapiens
gcugauaccauaugaauga

SEQ ID NO: 1125917 - RNA, 16 nt, Homo sapiens
gcugauucaagaaaca

SEQ ID NO: 1125918 - RNA, 19 nt, Homo sapiens
gcugauucaagaaacagaa

SEQ ID NO: 1125919 - RNA, 18 nt, Homo sapiens
gcugccagcucuguauca

SEQ ID NO: 1125920 - RNA, 12 nt, Homo sapiens
uaaaacagucau

SEQ ID NO: 1125921 - RNA, 17 nt, Homo sapiens
uaaaacuauaaguaaua

SEQ ID NO: 1125922 - RNA, 19 nt, Homo sapiens
uaaaaguaaauucauguaa

SEQ ID NO: 1125923 - RNA, 12 nt, Homo sapiens
uaaaaguucuca

SEQ ID NO: 1125924 - RNA, 20 nt, Homo sapiens
uaaaauuacauugagguucc

SEQ ID NO: 1125925 - RNA, 20 nt, Homo sapiens
uaaaauuccucuuacuguaa

SEQ ID NO: 1125926 - RNA, 17 nt, Homo sapiens
uaaacugacuuuuuccc

SEQ ID NO: 1125927 - RNA, 20 nt, Homo sapiens
uaaagaaauauauaugauau

SEQ ID NO: 1125928 - RNA, 14 nt, Homo sapiens
uaaagaccuuccag

SEQ ID NO: 1125929 - RNA, 16 nt, Homo sapiens
uaaagagaaguuccca

SEQ ID NO: 1125930 - RNA, 16 nt, Homo sapiens
uaaagucucucugacu

SEQ ID NO: 1125931 - RNA, 14 nt, Homo sapiens
uaaauguaucuuau

SEQ ID NO: 1125932 - RNA, 21 nt, Homo sapiens
uaaauucucauaaguagcauu

SEQ ID NO: 1125933 - RNA, 13 nt, Homo sapiens
uaacccucucuuc

SEQ ID NO: 1125934 - RNA, 15 nt, Homo sapiens
uaacccucucuuccc

SEQ ID NO: 1125935 - RNA, 12 nt, Homo sapiens
uaacccuuuuuc

SEQ ID NO: 1125936 - RNA, 18 nt, Homo sapiens
ugucuucauagcagauuu

SEQ ID NO: 1125937 - RNA, 21 nt, Homo sapiens
ugugaccaaugucuugaugca

SEQ ID NO: 1125938 - RNA, 20 nt, Homo sapiens
ugugacuauaaagcuguuau

SEQ ID NO: 1125939 - RNA, 22 nt, Homo sapiens
uguguaacuguaaaacauugaa

SEQ ID NO: 1125940 - RNA, 15 nt, Homo sapiens
uguguuuucagcaaa

SEQ ID NO: 1125941 - RNA, 23 nt, Homo sapiens
uguuaccugaaaacacugugcac

SEQ ID NO: 1125942 - RNA, 18 nt, Homo sapiens
uguuccccuuccacugag

SEQ ID NO: 1125943 - RNA, 22 nt, Homo sapiens
uguucuaagucuuuccauugga

SEQ ID NO: 1125944 - RNA, 23 nt, Homo sapiens
uuaacugugaaauguacgucauu

SEQ ID NO: 1125945 - RNA, 18 nt, Homo sapiens
uuaagcauuuugaaacaa

SEQ ID NO: 1125946 - RNA, 18 nt, Homo sapiens
uuaaugaagaaaguggaa

SEQ ID NO: 1125947 - RNA, 15 nt, Homo sapiens
uuaaugagacaugaa

SEQ ID NO: 1125948 - RNA, 21 nt, Homo sapiens
uuacuaacuaaauaccauuca

SEQ ID NO: 1125949 - RNA, 17 nt, Homo sapiens
uuagagugucuuuccac

SEQ ID NO: 1125950 - RNA, 22 nt, Homo sapiens
uuaucaccgugggcucccugac

SEQ ID NO: 1125951 - RNA, 19 nt, Homo sapiens
uuaucauuaaaaauuaccu

SEQ ID NO: 1125952 - RNA, 17 nt, Homo sapiens
uuaugaaaaguacuaau

SEQ ID NO: 1125953 - RNA, 20 nt, Homo sapiens
uucaaagauuuuuauuuuga

SEQ ID NO: 1125954 - RNA, 22 nt, Homo sapiens
uucaaaucacauggaacuuuag

SEQ ID NO: 1125955 - RNA, 12 nt, Homo sapiens
uucaaaugaaac

SEQ ID NO: 1125956 - RNA, 20 nt, Homo sapiens
uucaacaaccggccaccaga

SEQ ID NO: 1125957 - RNA, 20 nt, Homo sapiens
ccaauuaaaaacgaaaaccu

SEQ ID NO: 1125958 - RNA, 19 nt, Homo sapiens
ccaccaccucaccaguuuc

SEQ ID NO: 1125959 - RNA, 19 nt, Homo sapiens
ccagaugucgcccuacuca

SEQ ID NO: 1125960 - RNA, 12 nt, Homo sapiens
ccagcaccugcc

SEQ ID NO: 1125961 - RNA, 18 nt, Homo sapiens
ccaggccuguugcuauag

SEQ ID NO: 1125962 - RNA, 23 nt, Homo sapiens
ccaggcuggauacuaagcacaaa

SEQ ID NO: 1125963 - RNA, 23 nt, Homo sapiens
ccaguaauggaaugaagguaaua

SEQ ID NO: 1125964 - RNA, 15 nt, Homo sapiens
ccagugccagcaccu

SEQ ID NO: 1125965 - RNA, 19 nt, Homo sapiens
ccagugccuucugucugcu

SEQ ID NO: 1125966 - RNA, 11 nt, Homo sapiens
ccaguuugcac

SEQ ID NO: 1125967 - RNA, 12 nt, Homo sapiens
ccauagcacugg

SEQ ID NO: 1125968 - RNA, 12 nt, Homo sapiens
ccauauuuucac

SEQ ID NO: 1125969 - RNA, 20 nt, Homo sapiens
ccaucguauuaaaaaacaau

SEQ ID NO: 1125970 - RNA, 14 nt, Homo sapiens
ccaucugugacuau

SEQ ID NO: 1125971 - RNA, 14 nt, Homo sapiens
ccaucugugcagua

SEQ ID NO: 1125972 - RNA, 12 nt, Homo sapiens
ccaugccucaag

SEQ ID NO: 1125973 - RNA, 21 nt, Homo sapiens
ccauggaggccagugccagca

SEQ ID NO: 1125974 - RNA, 22 nt, Homo sapiens
ccaugugaccgaacacugcagc

SEQ ID NO: 1125975 - RNA, 13 nt, Homo sapiens
cccaacccuggcu

SEQ ID NO: 1125976 - RNA, 23 nt, Homo sapiens
cccagagaccccuuccuuuccuc

SEQ ID NO: 1125977 - RNA, 21 nt, Homo sapiens
cccagggagcccccagaggac

SEQ ID NO: 1125978 - RNA, 13 nt, Homo sapiens
cccauagcacugg

SEQ ID NO: 1125979 - RNA, 14 nt, Homo sapiens
cccauagcacuggg

SEQ ID NO: 1125980 - RNA, 15 nt, Homo sapiens
cccaucugugcagua

SEQ ID NO: 1125981 - RNA, 22 nt, Homo sapiens
cccaucugugcaguaagccugu

SEQ ID NO: 1125982 - RNA, 22 nt, Homo sapiens
cccaugggcuaucaacuuaaua

SEQ ID NO: 1125983 - RNA, 23 nt, Homo sapiens
ccccaacacuguccuucccugcc

SEQ ID NO: 1125984 - RNA, 15 nt, Homo sapiens
ccccaggcauugcca

SEQ ID NO: 1125985 - RNA, 20 nt, Homo sapiens
ccccaucauaagggcacuga

SEQ ID NO: 1125986 - RNA, 17 nt, Homo sapiens
ccccauccaacacugga

SEQ ID NO: 1125987 - RNA, 22 nt, Homo sapiens
cccgugggcaucucaagcccca

SEQ ID NO: 1125988 - RNA, 17 nt, Homo sapiens
cccuaaaucuugacuac

SEQ ID NO: 1125989 - RNA, 18 nt, Homo sapiens
cccuaagcagaccacuga

SEQ ID NO: 1125990 - RNA, 18 nt, Homo sapiens
cccucaugaucauucuca

SEQ ID NO: 1125991 - RNA, 12 nt, Homo sapiens
cccugcauuuau

SEQ ID NO: 1125992 - RNA, 21 nt, Homo sapiens
cccugggaggagagaaggggg

SEQ ID NO: 1125993 - RNA, 19 nt, Homo sapiens
cccuuugaugauuaauuca

SEQ ID NO: 1125994 - RNA, 19 nt, Homo sapiens
ccgcaaaagacaagucuuu

SEQ ID NO: 1125995 - RNA, 14 nt, Homo sapiens
ccuaaaaguucuca

SEQ ID NO: 1125996 - RNA, 15 nt, Homo sapiens
ccuaggcuaccucaa

SEQ ID NO: 1125997 - RNA, 22 nt, Homo sapiens
ccuauuuccugaacucagcuga

SEQ ID NO: 1125998 - RNA, 18 nt, Homo sapiens
ccucaucccgagcaccuc

SEQ ID NO: 1125999 - RNA, 19 nt, Homo sapiens
ccuccauggcagaagucaa

SEQ ID NO: 1126000 - RNA, 18 nt, Homo sapiens
ccuccugaagccacagca

SEQ ID NO: 1126001 - RNA, 16 nt, Homo sapiens
ccuccugccuccagca

SEQ ID NO: 1126002 - RNA, 12 nt, Homo sapiens
ccucugacucag

SEQ ID NO: 1126003 - RNA, 15 nt, Homo sapiens
ccucugcagcacuuu

SEQ ID NO: 1126004 - RNA, 18 nt, Homo sapiens
ccucuguccaggcacuga

SEQ ID NO: 1126005 - RNA, 17 nt, Homo sapiens
ccucuugcaaugccuca

SEQ ID NO: 1126006 - RNA, 23 nt, Homo sapiens
ccugacacucaauaaacagucac

SEQ ID NO: 1126007 - RNA, 18 nt, Homo sapiens
ccugcagccucacuucua

SEQ ID NO: 1126008 - RNA, 13 nt, Homo sapiens
ccugccacuucaa

SEQ ID NO: 1126009 - RNA, 22 nt, Homo sapiens
ccugccucuuccugcagccuca

SEQ ID NO: 1126010 - RNA, 20 nt, Homo sapiens
ccugggauguagcggugaag

SEQ ID NO: 1126011 - RNA, 17 nt, Homo sapiens
ccuggggcgagcacugu

SEQ ID NO: 1126012 - RNA, 16 nt, Homo sapiens
ccugggggugccagga

SEQ ID NO: 1126013 - RNA, 11 nt, Homo sapiens
ccuggucaguc

SEQ ID NO: 1126014 - RNA, 16 nt, Homo sapiens
ccuguccccacccucc

SEQ ID NO: 1126015 - RNA, 22 nt, Homo sapiens
ccugugcacgcgcgcgugcaca

SEQ ID NO: 1126016 - RNA, 14 nt, Homo sapiens
ccugugcuaaagaa

SEQ ID NO: 1126017 - RNA, 19 nt, Homo sapiens
ccuuaagagucauccagcu

SEQ ID NO: 1126018 - RNA, 22 nt, Homo sapiens
ccuuagauguucuaagucuuuc

SEQ ID NO: 1126019 - RNA, 23 nt, Homo sapiens
ccuuagauguucuaagucuuucc

SEQ ID NO: 1126020 - RNA, 16 nt, Homo sapiens
ccuucuggauccaugg

SEQ ID NO: 1126021 - RNA, 22 nt, Homo sapiens
ccuuuccucugcagcacuuuaa

SEQ ID NO: 1126022 - RNA, 18 nt, Homo sapiens
ccuuucuucagacacuga

SEQ ID NO: 1126023 - RNA, 13 nt, Homo sapiens
gcuccauguagaa

SEQ ID NO: 1126024 - RNA, 23 nt, Homo sapiens
gcuccuguguucuagaccucugg

SEQ ID NO: 1126025 - RNA, 14 nt, Homo sapiens
gcugauucaagaaa

SEQ ID NO: 1126026 - RNA, 16 nt, Homo sapiens
gcugcuguggggacca

SEQ ID NO: 1126027 - RNA, 22 nt, Homo sapiens
gcugcuguggggaccacacuga

SEQ ID NO: 1126028 - RNA, 16 nt, Homo sapiens
gcuggacugaccaaag

SEQ ID NO: 1126029 - RNA, 23 nt, Homo sapiens
gcuggaggcugcuguggggacca

SEQ ID NO: 1126030 - RNA, 20 nt, Homo sapiens
gcuguaacguggcacuggua

SEQ ID NO: 1126031 - RNA, 16 nt, Homo sapiens
gcuguauguaaacugu

SEQ ID NO: 1126032 - RNA, 14 nt, Homo sapiens
gcuguccugcagca

SEQ ID NO: 1126033 - RNA, 13 nt, Homo sapiens
gcuguguuugcag

SEQ ID NO: 1126034 - RNA, 19 nt, Homo sapiens
gcuguuauucuuguuauac

SEQ ID NO: 1126035 - RNA, 12 nt, Homo sapiens
gcuuauauucau

SEQ ID NO: 1126036 - RNA, 19 nt, Homo sapiens
gcuugcagagcaugaccug

SEQ ID NO: 1126037 - RNA, 20 nt, Homo sapiens
gcuugucuuaaaauaaugaa

SEQ ID NO: 1126038 - RNA, 20 nt, Homo sapiens
gcuuucauguaaacugugca

SEQ ID NO: 1126039 - RNA, 20 nt, Homo sapiens
ggaaaagaaucccugcagcc

SEQ ID NO: 1126040 - RNA, 19 nt, Homo sapiens
ggaaaaugccuccauggca

SEQ ID NO: 1126041 - RNA, 21 nt, Homo sapiens
ggaagacgugcgcgaugugac

SEQ ID NO: 1126042 - RNA, 22 nt, Homo sapiens
ggaagccccauccaacacugga

SEQ ID NO: 1126043 - RNA, 11 nt, Homo sapiens
ggacacagacc

SEQ ID NO: 1126044 - RNA, 23 nt, Homo sapiens
ggaccacacugauccuggagaaa

SEQ ID NO: 1126045 - RNA, 11 nt, Homo sapiens
ggacucaaggg

SEQ ID NO: 1126046 - RNA, 14 nt, Homo sapiens
ggacucaagggaaa

SEQ ID NO: 1126047 - RNA, 19 nt, Homo sapiens
ggacuccaggccugaccag

SEQ ID NO: 1126048 - RNA, 18 nt, Homo sapiens
ggacugaccaaagacugc

SEQ ID NO: 1126049 - RNA, 19 nt, Homo sapiens
ggagaauacugccaaaaca

SEQ ID NO: 1126050 - RNA, 16 nt, Homo sapiens
ggagacagaaagccuc

SEQ ID NO: 1126051 - RNA, 22 nt, Homo sapiens
ggagcguucuaaauaugaauga

SEQ ID NO: 1126052 - RNA, 15 nt, Homo sapiens
ggaggcugaggcaag

SEQ ID NO: 1126053 - RNA, 20 nt, Homo sapiens
ggauauuuugaaaugaacuu

SEQ ID NO: 1126054 - RNA, 21 nt, Homo sapiens
ggaugacgugaagccacagga

SEQ ID NO: 1126055 - RNA, 13 nt, Homo sapiens
ggaugccacccag

SEQ ID NO: 1126056 - RNA, 21 nt, Homo sapiens
ggcaagguuuacacugcggaa

SEQ ID NO: 1126057 - RNA, 9 nt, Homo sapiens
ggcacauug

SEQ ID NO: 1126058 - RNA, 14 nt, Homo sapiens
ggcacugagcccuu

SEQ ID NO: 1126059 - RNA, 23 nt, Homo sapiens
ggcaggggugggagagccagcuc

SEQ ID NO: 1126060 - RNA, 16 nt, Homo sapiens
ggcauacagacugggg

SEQ ID NO: 1126061 - RNA, 15 nt, Homo sapiens
ggccauaaagaucaa

SEQ ID NO: 1126062 - RNA, 15 nt, Homo sapiens
ucuucgcugcuagag

SEQ ID NO: 1126063 - RNA, 17 nt, Homo sapiens
ucuugaugcaugcacug

SEQ ID NO: 1126064 - RNA, 16 nt, Homo sapiens
ucuuguguuaccugaa

SEQ ID NO: 1126065 - RNA, 16 nt, Homo sapiens
ucuuuuaaaaucauga

SEQ ID NO: 1126066 - RNA, 17 nt, Homo sapiens
ucuuuucgaauguggcu

SEQ ID NO: 1126067 - RNA, 20 nt, Homo sapiens
ugaaacuauuuuaccugaac

SEQ ID NO: 1126068 - RNA, 23 nt, Homo sapiens
ugaagaaggggguggggggaguu

SEQ ID NO: 1126069 - RNA, 18 nt, Homo sapiens
ugaagccuauguaugcca

SEQ ID NO: 1126070 - RNA, 15 nt, Homo sapiens
ugaaggcuuacuuca

SEQ ID NO: 1126071 - RNA, 19 nt, Homo sapiens
ugaagggaaguggggagua

SEQ ID NO: 1126072 - RNA, 22 nt, Homo sapiens
ugaauaaaccaucaucuugcca

SEQ ID NO: 1126073 - RNA, 12 nt, Homo sapiens
ugaauauacaga

SEQ ID NO: 1126074 - RNA, 15 nt, Homo sapiens
ugacaagauggaaaa

SEQ ID NO: 1126075 - RNA, 22 nt, Homo sapiens
ugacagguuuuccaaaaguaaa

SEQ ID NO: 1126076 - RNA, 16 nt, Homo sapiens
ugaccaucugugacua

SEQ ID NO: 1126077 - RNA, 17 nt, Homo sapiens
ugacuucauacuuugaa

SEQ ID NO: 1126078 - RNA, 23 nt, Homo sapiens
ugagaaaccuuauuguaccucuc

SEQ ID NO: 1126079 - RNA, 15 nt, Homo sapiens
ugagacugaguucua

SEQ ID NO: 1126080 - RNA, 22 nt, Homo sapiens
ugagauggguguacaaacucau

SEQ ID NO: 1126081 - RNA, 18 nt, Homo sapiens
ugagcacccccucauucc

SEQ ID NO: 1126082 - RNA, 21 nt, Homo sapiens
ugauauauaaaugugauugca

SEQ ID NO: 1126083 - RNA, 22 nt, Homo sapiens
ugcaaaaggacucucaggacca

SEQ ID NO: 1126084 - RNA, 14 nt, Homo sapiens
ugcacacuuugcca

SEQ ID NO: 1126085 - RNA, 16 nt, Homo sapiens
ugcaccaagcaggaaa

SEQ ID NO: 1126086 - RNA, 21 nt, Homo sapiens
ugcaccuguccccacccucca

SEQ ID NO: 1126087 - RNA, 21 nt, Homo sapiens
ugcacuuuuagaaaugcauau

SEQ ID NO: 1126088 - RNA, 19 nt, Homo sapiens
ugcagcaccggccucggga

SEQ ID NO: 1126089 - RNA, 14 nt, Homo sapiens
agcaucucaguggu

SEQ ID NO: 1126090 - RNA, 14 nt, Homo sapiens
agcauugagcauaa

SEQ ID NO: 1126091 - RNA, 23 nt, Homo sapiens
agcccgcuuuuguucuuccccac

SEQ ID NO: 1126092 - RNA, 13 nt, Homo sapiens
agcccucaucccg

SEQ ID NO: 1126093 - RNA, 20 nt, Homo sapiens
agcccucaugaucauucuca

SEQ ID NO: 1126094 - RNA, 21 nt, Homo sapiens
agccuauguaugccauggagg

SEQ ID NO: 1126095 - RNA, 21 nt, Homo sapiens
agccuggauccucaguucuca

SEQ ID NO: 1126096 - RNA, 16 nt, Homo sapiens
agccugugcuaaagaa

SEQ ID NO: 1126097 - RNA, 12 nt, Homo sapiens
agcucucuaggc

SEQ ID NO: 1126098 - RNA, 17 nt, Homo sapiens
agcugcuguugaacuuu

SEQ ID NO: 1126099 - RNA, 23 nt, Homo sapiens
agcuguccugcagcaaacacucc

SEQ ID NO: 1126100 - RNA, 21 nt, Homo sapiens
agcuguggccuaggcuaccuc

SEQ ID NO: 1126101 - RNA, 22 nt, Homo sapiens
agcuguggccuaggcuaccuca

SEQ ID NO: 1126102 - RNA, 14 nt, Homo sapiens
agcuguuuccauag

SEQ ID NO: 1126103 - RNA, 16 nt, Homo sapiens
agcuguuuucccugac

SEQ ID NO: 1126104 - RNA, 19 nt, Homo sapiens
aggagacaagaaauccagu

SEQ ID NO: 1126105 - RNA, 20 nt, Homo sapiens
aggagauggaaguugcagug

SEQ ID NO: 1126106 - RNA, 19 nt, Homo sapiens
aggcaagguuuacacugcg

SEQ ID NO: 1126107 - RNA, 23 nt, Homo sapiens
aggcauguacaaaaauuaugcaa

SEQ ID NO: 1126108 - RNA, 22 nt, Homo sapiens
aggcuccagagggcacucugcu

SEQ ID NO: 1126109 - RNA, 15 nt, Homo sapiens
aggcuuuacagugua

SEQ ID NO: 1126110 - RNA, 18 nt, Homo sapiens
agggaaaauuauuugcau

SEQ ID NO: 1126111 - RNA, 22 nt, Homo sapiens
agggaaguggggaguauuugaa

SEQ ID NO: 1126112 - RNA, 18 nt, Homo sapiens
agggagcccccagaggac

SEQ ID NO: 1126113 - RNA, 14 nt, Homo sapiens
agggagcuggaaaa

SEQ ID NO: 1126114 - RNA, 15 nt, Homo sapiens
agggaggcccuggga

SEQ ID NO: 1126115 - RNA, 21 nt, Homo sapiens
agggcacugagcccuucccag

SEQ ID NO: 1126116 - RNA, 23 nt, Homo sapiens
aggggugcuaugacaugcaagug

SEQ ID NO: 1126117 - RNA, 17 nt, Homo sapiens
aggguggaugaucucaa

SEQ ID NO: 1126118 - RNA, 11 nt, Homo sapiens
aggugcacagg

SEQ ID NO: 1126119 - RNA, 15 nt, Homo sapiens
agguuugccagcauu

SEQ ID NO: 1126120 - RNA, 16 nt, Homo sapiens
agguuugccagcauuu

SEQ ID NO: 1126121 - RNA, 15 nt, Homo sapiens
aguaaauagugucau

SEQ ID NO: 1126122 - RNA, 15 nt, Homo sapiens
aguaacauguguuaa

SEQ ID NO: 1126123 - RNA, 16 nt, Homo sapiens
agucaacgccucggug

SEQ ID NO: 1126124 - RNA, 16 nt, Homo sapiens
agucaauagcuugucu

SEQ ID NO: 1126125 - RNA, 14 nt, Homo sapiens
aguccaacugucaa

SEQ ID NO: 1126126 - RNA, 20 nt, Homo sapiens
aguccaggguggaugaucuc

SEQ ID NO: 1126127 - RNA, 23 nt, Homo sapiens
agucgaaccauggugaacuccac

SEQ ID NO: 1126128 - RNA, 16 nt, Homo sapiens
agugauuggcucugug

SEQ ID NO: 1126129 - RNA, 20 nt, Homo sapiens
aguuguguuccugacacuca

SEQ ID NO: 1126130 - RNA, 19 nt, Homo sapiens
aguuuauacuucucuauua

SEQ ID NO: 1126131 - RNA, 18 nt, Homo sapiens
aguuugauuauucagugu

SEQ ID NO: 1126132 - RNA, 14 nt, Homo sapiens
auaaaauguuucau

SEQ ID NO: 1126133 - RNA, 14 nt, Homo sapiens
auaaagucucucug

SEQ ID NO: 1126134 - RNA, 15 nt, Homo sapiens
auaaagucucucuga

SEQ ID NO: 1126135 - RNA, 12 nt, Homo sapiens
auaccuuaucca

SEQ ID NO: 1126136 - RNA, 23 nt, Homo sapiens
auacuccacucccagcagcucaa

SEQ ID NO: 1126137 - RNA, 15 nt, Homo sapiens
auaggagugaauaca

SEQ ID NO: 1126138 - RNA, 14 nt, Homo sapiens
auauaaaacuauaa

SEQ ID NO: 1126139 - RNA, 19 nt, Homo sapiens
auauauauuuuugugcaca

SEQ ID NO: 1126140 - RNA, 20 nt, Homo sapiens
auauauauuuuugugcacau

SEQ ID NO: 1126141 - RNA, 18 nt, Homo sapiens
auaugaucaaacuuccau

SEQ ID NO: 1126142 - RNA, 16 nt, Homo sapiens
auauguauauauguau

SEQ ID NO: 1126143 - RNA, 20 nt, Homo sapiens
auauugcagcuuauauucau

SEQ ID NO: 1126144 - RNA, 15 nt, Homo sapiens
auauuuucaccauuu

SEQ ID NO: 1126145 - RNA, 16 nt, Homo sapiens
auauuuuuccacuuaa

SEQ ID NO: 1126146 - RNA, 13 nt, Homo sapiens
aucaacagcauuu

SEQ ID NO: 1126147 - RNA, 16 nt, Homo sapiens
aucaacgaguacuuca

SEQ ID NO: 1126148 - RNA, 20 nt, Homo sapiens
aucaacgccucacugaaaca

SEQ ID NO: 1126149 - RNA, 20 nt, Homo sapiens
aucaccgugggcucccugac

SEQ ID NO: 1126150 - RNA, 18 nt, Homo sapiens
aucagcgccgcaccagcc

SEQ ID NO: 1126151 - RNA, 10 nt, Homo sapiens
aucaguugau

SEQ ID NO: 1126152 - RNA, 13 nt, Homo sapiens
aucaucauucuca

SEQ ID NO: 1126153 - RNA, 20 nt, Homo sapiens
aucaugaguaccucaaagga

SEQ ID NO: 1126154 - RNA, 22 nt, Homo sapiens
aucauuucuauuucuccuccau

SEQ ID NO: 1126155 - RNA, 19 nt, Homo sapiens
auccacgcacacauggaca

SEQ ID NO: 1126156 - RNA, 21 nt, Homo sapiens
auccaguuucccaccaccuug

SEQ ID NO: 1126157 - RNA, 20 nt, Homo sapiens
aucccugcagccugguagaa

SEQ ID NO: 1126158 - RNA, 14 nt, Homo sapiens
auccucaguucuca

SEQ ID NO: 1126159 - RNA, 17 nt, Homo sapiens
aucuagaauucacugag

SEQ ID NO: 1126160 - RNA, 15 nt, Homo sapiens
aucucaaacuacugg

SEQ ID NO: 1126161 - RNA, 22 nt, Homo sapiens
aucucaaacuacuggcaauuug

SEQ ID NO: 1126162 - RNA, 12 nt, Homo sapiens
aucucaaucucc

SEQ ID NO: 1126163 - RNA, 23 nt, Homo sapiens
aucucauuggacccuuccauggu

SEQ ID NO: 1126164 - RNA, 12 nt, Homo sapiens
aucugugcagua

SEQ ID NO: 1126165 - RNA, 16 nt, Homo sapiens
aucuuggggcugauga

SEQ ID NO: 1126166 - RNA, 19 nt, Homo sapiens
augaaacuauuuuaccuga

SEQ ID NO: 1126167 - RNA, 16 nt, Homo sapiens
augaaagggcaaagac

SEQ ID NO: 1126168 - RNA, 15 nt, Homo sapiens
augaucucaaucucc

SEQ ID NO: 1126169 - RNA, 14 nt, Homo sapiens
augauuagagggau

SEQ ID NO: 1126170 - RNA, 19 nt, Homo sapiens
augcaagccccaacuuucu

SEQ ID NO: 1126171 - RNA, 13 nt, Homo sapiens
augccucaagaac

SEQ ID NO: 1126172 - RNA, 23 nt, Homo sapiens
auggaaguugcagugagcugaua

SEQ ID NO: 1126173 - RNA, 20 nt, Homo sapiens
auggaaugcuugcagagcau

SEQ ID NO: 1126174 - RNA, 22 nt, Homo sapiens
auggaggccagugccagcaccu

SEQ ID NO: 1126175 - RNA, 22 nt, Homo sapiens
auggcuuauuucuaugacaaau

SEQ ID NO: 1126176 - RNA, 19 nt, Homo sapiens
augugacccaccagugccu

SEQ ID NO: 1126177 - RNA, 18 nt, Homo sapiens
augugaccgaacacugca

SEQ ID NO: 1126178 - RNA, 11 nt, Homo sapiens
augugaugaau

SEQ ID NO: 1126179 - RNA, 20 nt, Homo sapiens
auguuuuucuguauaacagc

SEQ ID NO: 1126180 - RNA, 13 nt, Homo sapiens
auuaacugugaaa

SEQ ID NO: 1126181 - RNA, 12 nt, Homo sapiens
auuaauucaccu

SEQ ID NO: 1126182 - RNA, 16 nt, Homo sapiens
auuaccuccugagaaa

SEQ ID NO: 1126183 - RNA, 16 nt, Homo sapiens
auuaggcaugccuaau

SEQ ID NO: 1126184 - RNA, 17 nt, Homo sapiens
auuauaugcacuagcaa

SEQ ID NO: 1126185 - RNA, 13 nt, Homo sapiens
auuaucaacagca

SEQ ID NO: 1126186 - RNA, 16 nt, Homo sapiens
auuaucaacagcauuu

SEQ ID NO: 1126187 - RNA, 20 nt, Homo sapiens
auuauguaaauaacucuaac

SEQ ID NO: 1126188 - RNA, 23 nt, Homo sapiens
auucucagugagggcucuggauu

SEQ ID NO: 1126189 - RNA, 18 nt, Homo sapiens
auucucugagcugugcag

SEQ ID NO: 1126190 - RNA, 14 nt, Homo sapiens
auucuuguuauacc

SEQ ID NO: 1126191 - RNA, 19 nt, Homo sapiens
auucuuugcaauacugcuu

SEQ ID NO: 1126192 - RNA, 13 nt, Homo sapiens
auugaacuuuccc

SEQ ID NO: 1126193 - RNA, 15 nt, Homo sapiens
auugagauuuaauuc

SEQ ID NO: 1126194 - RNA, 17 nt, Homo sapiens
auugccuggacugacca

SEQ ID NO: 1126195 - RNA, 20 nt, Homo sapiens
aaaaggacucucaggaccaa

SEQ ID NO: 1126196 - RNA, 11 nt, Homo sapiens
aaaaguucuca

SEQ ID NO: 1126197 - RNA, 18 nt, Homo sapiens
aaaaugagagcuguaacu

SEQ ID NO: 1126198 - RNA, 18 nt, Homo sapiens
aaaaugcuucugcacaca

SEQ ID NO: 1126199 - RNA, 22 nt, Homo sapiens
aaaauggagggagccaucccuu

SEQ ID NO: 1126200 - RNA, 13 nt, Homo sapiens
aaaauuauuugcu

SEQ ID NO: 1126201 - RNA, 12 nt, Homo sapiens
aaacaacucuuu

SEQ ID NO: 1126202 - RNA, 13 nt, Homo sapiens
aaacacuauuugu

SEQ ID NO: 1126203 - RNA, 19 nt, Homo sapiens
aaacagguuuuuaguuugu

SEQ ID NO: 1126204 - RNA, 16 nt, Homo sapiens
aaacguccuacuguau

SEQ ID NO: 1126205 - RNA, 17 nt, Homo sapiens
aaacucuuaaguccuaa

SEQ ID NO: 1126206 - RNA, 21 nt, Homo sapiens
aaacuucccucucuagacagu

SEQ ID NO: 1126207 - RNA, 22 nt, Homo sapiens
aaagagguggauuccugggcaa

SEQ ID NO: 1126208 - RNA, 17 nt, Homo sapiens
caaggugacauuuccau

SEQ ID NO: 1126209 - RNA, 13 nt, Homo sapiens
caagucaaagacu

SEQ ID NO: 1126210 - RNA, 17 nt, Homo sapiens
caauaaacagucacugg

SEQ ID NO: 1126211 - RNA, 18 nt, Homo sapiens
caauaaacagucacugga

SEQ ID NO: 1126212 - RNA, 20 nt, Homo sapiens
caauaauaaaguacuugacu

SEQ ID NO: 1126213 - RNA, 19 nt, Homo sapiens
caauaauugaaguguuccc

SEQ ID NO: 1126214 - RNA, 17 nt, Homo sapiens
caaucaaggccacugcu

SEQ ID NO: 1126215 - RNA, 14 nt, Homo sapiens
caaucacugugcua

SEQ ID NO: 1126216 - RNA, 12 nt, Homo sapiens
caaucucuuaaa

SEQ ID NO: 1126217 - RNA, 19 nt, Homo sapiens
caaucuuuccuacuuucua

SEQ ID NO: 1126218 - RNA, 14 nt, Homo sapiens
caauguuagccaca

SEQ ID NO: 1126219 - RNA, 20 nt, Homo sapiens
caauuaacugcccucugaaa

SEQ ID NO: 1126220 - RNA, 22 nt, Homo sapiens
caauucauauauuugaagugga

SEQ ID NO: 1126221 - RNA, 21 nt, Homo sapiens
caauuccaggcugagccauga

SEQ ID NO: 1126222 - RNA, 18 nt, Homo sapiens
caauugacauaggcaaua

SEQ ID NO: 1126223 - RNA, 14 nt, Homo sapiens
caauuuaaaacaau

SEQ ID NO: 1126224 - RNA, 19 nt, Homo sapiens
cacaauaaggaagaaauaa

SEQ ID NO: 1126225 - RNA, 17 nt, Homo sapiens
cacagaaggugaacuuu

SEQ ID NO: 1126226 - RNA, 18 nt, Homo sapiens
cacaggcacauuaacugu

SEQ ID NO: 1126227 - RNA, 17 nt, Homo sapiens
cacaguuguguuccuga

SEQ ID NO: 1126228 - RNA, 22 nt, Homo sapiens
caccugcguguccccgugcagu

SEQ ID NO: 1126229 - RNA, 14 nt, Homo sapiens
cacgauuaacugug

SEQ ID NO: 1126230 - RNA, 16 nt, Homo sapiens
cacgccuguaauccca

SEQ ID NO: 1126231 - RNA, 13 nt, Homo sapiens
cacgcugaaggcu

SEQ ID NO: 1126232 - RNA, 15 nt, Homo sapiens
cacgcugaaggcuua

SEQ ID NO: 1126233 - RNA, 15 nt, Homo sapiens
cacguucugcucauc

SEQ ID NO: 1126234 - RNA, 21 nt, Homo sapiens
cacuagcaauaaaaugcuaau

SEQ ID NO: 1126235 - RNA, 23 nt, Homo sapiens
cacucuccccucccucuuccuuc

SEQ ID NO: 1126236 - RNA, 17 nt, Homo sapiens
cacucugggcuguaacg

SEQ ID NO: 1126237 - RNA, 22 nt, Homo sapiens
cacugaggagacagaaagccuc

SEQ ID NO: 1126238 - RNA, 20 nt, Homo sapiens
cacuggguuacagaaucaca

SEQ ID NO: 1126239 - RNA, 15 nt, Homo sapiens
cacugugagcaccug

SEQ ID NO: 1126240 - RNA, 16 nt, Homo sapiens
cacugugagcaccuga

SEQ ID NO: 1126241 - RNA, 13 nt, Homo sapiens
cacuuuccuacaa

SEQ ID NO: 1126242 - RNA, 14 nt, Homo sapiens
cagaaaaccacuuu

SEQ ID NO: 1126243 - RNA, 19 nt, Homo sapiens
cagaacuucagcauuguaa

SEQ ID NO: 1126244 - RNA, 17 nt, Homo sapiens
cagaaucaaaugcaauu

SEQ ID NO: 1126245 - RNA, 16 nt, Homo sapiens
cagaauuuuuaacugu

SEQ ID NO: 1126246 - RNA, 19 nt, Homo sapiens
cagaauuuuuaacuguacu

SEQ ID NO: 1126247 - RNA, 14 nt, Homo sapiens
cagacacacccaca

SEQ ID NO: 1126248 - RNA, 18 nt, Homo sapiens
cagacacacccacagaag

SEQ ID NO: 1126249 - RNA, 12 nt, Homo sapiens
cagaccacugau

SEQ ID NO: 1126250 - RNA, 17 nt, Homo sapiens
cagagacuuggggacca

SEQ ID NO: 1126251 - RNA, 17 nt, Homo sapiens
cagcaccggccucggga

SEQ ID NO: 1126252 - RNA, 15 nt, Homo sapiens
cagccauagaccuac

SEQ ID NO: 1126253 - RNA, 14 nt, Homo sapiens
cagcccccacuuuc

SEQ ID NO: 1126254 - RNA, 20 nt, Homo sapiens
cagcuccagaauaccuucuu

SEQ ID NO: 1126255 - RNA, 13 nt, Homo sapiens
cagcuuauauuca

SEQ ID NO: 1126256 - RNA, 17 nt, Homo sapiens
caggaggucugguccga

SEQ ID NO: 1126257 - RNA, 24 nt, Homo sapiens
caggaggucugguccgagucucag

SEQ ID NO: 1126258 - RNA, 15 nt, Homo sapiens
caggccccaccuccu

SEQ ID NO: 1126259 - RNA, 23 nt, Homo sapiens
caggcuggauacuaagcacaaag

SEQ ID NO: 1126260 - RNA, 19 nt, Homo sapiens
cagggaaaauuauuugcau

SEQ ID NO: 1126261 - RNA, 16 nt, Homo sapiens
caggguggaugaucuc

SEQ ID NO: 1126262 - RNA, 22 nt, Homo sapiens
caggguggaugaucucaaucuc

SEQ ID NO: 1126263 - RNA, 17 nt, Homo sapiens
caggucuagacuuucuc

SEQ ID NO: 1126264 - RNA, 16 nt, Homo sapiens
cagguuccaaucagaa

SEQ ID NO: 1126265 - RNA, 14 nt, Homo sapiens
caguaaacacucca

SEQ ID NO: 1126266 - RNA, 14 nt, Homo sapiens
caguaauggaauga

SEQ ID NO: 1126267 - RNA, 21 nt, Homo sapiens
cagugaaugauucaguguuaa

SEQ ID NO: 1126268 - RNA, 16 nt, Homo sapiens
cagugccagcaccugc

SEQ ID NO: 1126269 - RNA, 17 nt, Homo sapiens
cagugccagcaccugcc

SEQ ID NO: 1126270 - RNA, 12 nt, Homo sapiens
cagugcucccuc

SEQ ID NO: 1126271 - RNA, 23 nt, Homo sapiens
caguggugugugaaguuuggaga

SEQ ID NO: 1126272 - RNA, 21 nt, Homo sapiens
cauaaagauauucuuuagugg

SEQ ID NO: 1126273 - RNA, 13 nt, Homo sapiens
cauaacaauuccu

SEQ ID NO: 1126274 - RNA, 13 nt, Homo sapiens
cauagcacugggc

SEQ ID NO: 1126275 - RNA, 23 nt, Homo sapiens
cauauauuugaaguggagccaua

SEQ ID NO: 1126276 - RNA, 14 nt, Homo sapiens
caucauaagggcac

SEQ ID NO: 1126277 - RNA, 17 nt, Homo sapiens
cauccaagccagaguuu

SEQ ID NO: 1126278 - RNA, 11 nt, Homo sapiens
caucugaccau

SEQ ID NO: 1126279 - RNA, 14 nt, Homo sapiens
caucugaccaucug

SEQ ID NO: 1126280 - RNA, 18 nt, Homo sapiens
caucuggcuuuuucugcc

SEQ ID NO: 1126281 - RNA, 20 nt, Homo sapiens
caucugugcaguaagccugu

SEQ ID NO: 1126282 - RNA, 15 nt, Homo sapiens
caugaacgcacuuua

SEQ ID NO: 1126283 - RNA, 14 nt, Homo sapiens
caugaucaucacaa

SEQ ID NO: 1126284 - RNA, 17 nt, Homo sapiens
caugaucaucacaauca

SEQ ID NO: 1126285 - RNA, 14 nt, Homo sapiens
caugaucauucuca

SEQ ID NO: 1126286 - RNA, 13 nt, Homo sapiens
caugcagccucuu

SEQ ID NO: 1126287 - RNA, 13 nt, Homo sapiens
cauggacacagac

SEQ ID NO: 1126288 - RNA, 16 nt, Homo sapiens
cauguaaacugugcac

SEQ ID NO: 1126289 - RNA, 15 nt, Homo sapiens
cauuaagcucacaau

SEQ ID NO: 1126290 - RNA, 15 nt, Homo sapiens
cauuaggcaugccua

SEQ ID NO: 1126291 - RNA, 23 nt, Homo sapiens
cauuaucuuugcuguuauugaca

SEQ ID NO: 1126292 - RNA, 9 nt, Homo sapiens
cauucaguc

SEQ ID NO: 1126293 - RNA, 12 nt, Homo sapiens
cauucucugucu

SEQ ID NO: 1126294 - RNA, 20 nt, Homo sapiens
cauucuuugcaauacugcuu

SEQ ID NO: 1126295 - RNA, 23 nt, Homo sapiens
cauugcuuuugggagacuggaaa

SEQ ID NO: 1126296 - RNA, 12 nt, Homo sapiens
cauuuccaugca

SEQ ID NO: 1126297 - RNA, 22 nt, Homo sapiens
cauuucuauuucuccuccaugg

SEQ ID NO: 1126298 - RNA, 14 nt, Homo sapiens
ccaagcagagcuca

SEQ ID NO: 1126299 - RNA, 15 nt, Homo sapiens
ccaagcagagcucac

SEQ ID NO: 1126300 - RNA, 21 nt, Homo sapiens
ccaaggaaaggcauguacaaa

SEQ ID NO: 1126301 - RNA, 22 nt, Homo sapiens
ccaaggaaaggcauguacaaaa

SEQ ID NO: 1126302 - RNA, 13 nt, Homo sapiens
ccaaggaacaaga

SEQ ID NO: 1126303 - RNA, 17 nt, Homo sapiens
ccaauccuggacaugaa

SEQ ID NO: 1126304 - RNA, 15 nt, Homo sapiens
ccaaucuguacaaaa

SEQ ID NO: 1126305 - RNA, 14 nt, Homo sapiens
ccaaucuuuccuac

SEQ ID NO: 1126306 - RNA, 18 nt, Homo sapiens
ccacaaucugggacuuuc

SEQ ID NO: 1126307 - RNA, 17 nt, Homo sapiens
ccacaauggagugggag

SEQ ID NO: 1126308 - RNA, 19 nt, Homo sapiens
ccacacugauccuggagaa

SEQ ID NO: 1126309 - RNA, 14 nt, Homo sapiens
ccacaggacauuuc

SEQ ID NO: 1126310 - RNA, 16 nt, Homo sapiens
ccaccuccuccuccau

SEQ ID NO: 1126311 - RNA, 14 nt, Homo sapiens
ccacuacugcagca

SEQ ID NO: 1126312 - RNA, 20 nt, Homo sapiens
ccacuaggguccaccaggag

SEQ ID NO: 1126313 - RNA, 15 nt, Homo sapiens
ccagacucagcucca

SEQ ID NO: 1126314 - RNA, 21 nt, Homo sapiens
ccagagacuuggggaccagag

SEQ ID NO: 1126315 - RNA, 20 nt, Homo sapiens
ccagaggauugcugccccau

SEQ ID NO: 1126316 - RNA, 13 nt, Homo sapiens
ccagcaacacaga

SEQ ID NO: 1126317 - RNA, 20 nt, Homo sapiens
ccagccugggugacagagca

SEQ ID NO: 1126318 - RNA, 23 nt, Homo sapiens
ccagccugugcgccgggggaccu

SEQ ID NO: 1126319 - RNA, 19 nt, Homo sapiens
uauugacagcgauauaauu

SEQ ID NO: 1126320 - RNA, 23 nt, Homo sapiens
uauuuaaauaaagucucucugac

SEQ ID NO: 1126321 - RNA, 22 nt, Homo sapiens
uauuuacagauaacuucuuuag

SEQ ID NO: 1126322 - RNA, 21 nt, Homo sapiens
uauuuauagucgaacaauuca

SEQ ID NO: 1126323 - RNA, 14 nt, Homo sapiens
uauuugcauaacaa

SEQ ID NO: 1126324 - RNA, 18 nt, Homo sapiens
ucaaccugggcaaagccu

SEQ ID NO: 1126325 - RNA, 20 nt, Homo sapiens
ucaagaaacagccagcaaga

SEQ ID NO: 1126326 - RNA, 17 nt, Homo sapiens
ucaauaaacaacagcug

SEQ ID NO: 1126327 - RNA, 22 nt, Homo sapiens
ucaauaaacaacagcugaagca

SEQ ID NO: 1126328 - RNA, 12 nt, Homo sapiens
ucaauccagcua

SEQ ID NO: 1126329 - RNA, 22 nt, Homo sapiens
ucaaucucuuaaagagaaucca

SEQ ID NO: 1126330 - RNA, 22 nt, Homo sapiens
ucacaaucaucaucauucucau

SEQ ID NO: 1126331 - RNA, 17 nt, Homo sapiens
ucacagcccucaugauc

SEQ ID NO: 1126332 - RNA, 22 nt, Homo sapiens
ucaccaggggugcuaugacaug

SEQ ID NO: 1126333 - RNA, 16 nt, Homo sapiens
ucaccaguuuccaggu

SEQ ID NO: 1126334 - RNA, 20 nt, Homo sapiens
ucaccauuuggcaaugccau

SEQ ID NO: 1126335 - RNA, 23 nt, Homo sapiens
ucaccauuuggcaaugccaucau

SEQ ID NO: 1126336 - RNA, 16 nt, Homo sapiens
ucacccuguauguuag

SEQ ID NO: 1126337 - RNA, 22 nt, Homo sapiens
ucacugaguuuuguuucacuuu

SEQ ID NO: 1126338 - RNA, 14 nt, Homo sapiens
ucacuucuaccugc

SEQ ID NO: 1126339 - RNA, 14 nt, Homo sapiens
ucagcaucugacca

SEQ ID NO: 1126340 - RNA, 19 nt, Homo sapiens
ucagcuccagaauaccuuc

SEQ ID NO: 1126341 - RNA, 20 nt, Homo sapiens
ucagcugcuguugaacuuuu

SEQ ID NO: 1126342 - RNA, 14 nt, Homo sapiens
ucaggauucuucaa

SEQ ID NO: 1126343 - RNA, 13 nt, Homo sapiens
ucagucucugagc

SEQ ID NO: 1126344 - RNA, 19 nt, Homo sapiens
ucagucucugagcagugaa

SEQ ID NO: 1126345 - RNA, 21 nt, Homo sapiens
ucagugcucccucacauguca

SEQ ID NO: 1126346 - RNA, 16 nt, Homo sapiens
ucauaagggcacugag

SEQ ID NO: 1126347 - RNA, 19 nt, Homo sapiens
ucauauuauaaauuucuaa

SEQ ID NO: 1126348 - RNA, 18 nt, Homo sapiens
ucauauuguaaucuaugu

SEQ ID NO: 1126349 - RNA, 16 nt, Homo sapiens
ucaucaugugugucca

SEQ ID NO: 1126350 - RNA, 21 nt, Homo sapiens
ucaucccgagcaccuccacau

SEQ ID NO: 1126351 - RNA, 12 nt, Homo sapiens
ucaucuugccac

SEQ ID NO: 1126352 - RNA, 18 nt, Homo sapiens
ucaugaguaccucaaagg

SEQ ID NO: 1126353 - RNA, 14 nt, Homo sapiens
ucaugaucaucaca

SEQ ID NO: 1126354 - RNA, 12 nt, Homo sapiens
ucaugaucauuc

SEQ ID NO: 1126355 - RNA, 16 nt, Homo sapiens
ucaugaucauucucag

SEQ ID NO: 1126356 - RNA, 17 nt, Homo sapiens
ucauguaaacugugcac

SEQ ID NO: 1126357 - RNA, 15 nt, Homo sapiens
uccacgcacacaugg

SEQ ID NO: 1126358 - RNA, 23 nt, Homo sapiens
uccacggagccacuccucugacu

SEQ ID NO: 1126359 - RNA, 19 nt, Homo sapiens
uccacguucugcucaucau

SEQ ID NO: 1126360 - RNA, 20 nt, Homo sapiens
uccacuaggguccaccagga

SEQ ID NO: 1126361 - RNA, 21 nt, Homo sapiens
uccacuaggguccaccaggag

SEQ ID NO: 1126362 - RNA, 22 nt, Homo sapiens
uccacucagcuguccugcagca

SEQ ID NO: 1126363 - RNA, 19 nt, Homo sapiens
uccaguuucccaccaccuu

SEQ ID NO: 1126364 - RNA, 15 nt, Homo sapiens
uccauauuugccuug

SEQ ID NO: 1126365 - RNA, 21 nt, Homo sapiens
uccaucuguugacaaaugaca

SEQ ID NO: 1126366 - RNA, 13 nt, Homo sapiens
ucccacaggacau

SEQ ID NO: 1126367 - RNA, 18 nt, Homo sapiens
ucccacccacagccauag

SEQ ID NO: 1126368 - RNA, 13 nt, Homo sapiens
ucccagaccagga

SEQ ID NO: 1126369 - RNA, 20 nt, Homo sapiens
uccccuggggagucugggca

SEQ ID NO: 1126370 - RNA, 22 nt, Homo sapiens
uccccuggggagucugggcaca

SEQ ID NO: 1126371 - RNA, 17 nt, Homo sapiens
ucccgugggcaucucaa

SEQ ID NO: 1126372 - RNA, 15 nt, Homo sapiens
ucccucaucuguccc

SEQ ID NO: 1126373 - RNA, 19 nt, Homo sapiens
ucccuuaagagucauccag

SEQ ID NO: 1126374 - RNA, 23 nt, Homo sapiens
ucccuucccuguccaccucacca

SEQ ID NO: 1126375 - RNA, 18 nt, Homo sapiens
uccuacuguaugugggaa

SEQ ID NO: 1126376 - RNA, 15 nt, Homo sapiens
uccugacacucaaua

SEQ ID NO: 1126377 - RNA, 18 nt, Homo sapiens
uccugccuccagcacucc

SEQ ID NO: 1126378 - RNA, 18 nt, Homo sapiens
uccuggagaaaagggaug

SEQ ID NO: 1126379 - RNA, 17 nt, Homo sapiens
uccuguguguacucugu

SEQ ID NO: 1126380 - RNA, 11 nt, Homo sapiens
uccuuccucuc

SEQ ID NO: 1126381 - RNA, 12 nt, Homo sapiens
ucggcaucuucu

SEQ ID NO: 1126382 - RNA, 22 nt, Homo sapiens
ucgggaaauuauuaugacucaa

SEQ ID NO: 1126383 - RNA, 20 nt, Homo sapiens
ucuaaaaagaaaaagagaua

SEQ ID NO: 1126384 - RNA, 14 nt, Homo sapiens
ucuaaauagcacuu

SEQ ID NO: 1126385 - RNA, 14 nt, Homo sapiens
ucuaacugcuguua

SEQ ID NO: 1126386 - RNA, 15 nt, Homo sapiens
ucuaacugcuguuaa

SEQ ID NO: 1126387 - RNA, 19 nt, Homo sapiens
ucuacagagcuucccugac

SEQ ID NO: 1126388 - RNA, 20 nt, Homo sapiens
ucuacccggcccagagaccc

SEQ ID NO: 1126389 - RNA, 21 nt, Homo sapiens
ucuacuaacaaucagcuccuu

SEQ ID NO: 1126390 - RNA, 14 nt, Homo sapiens
ucuacuuguucuaa

SEQ ID NO: 1126391 - RNA, 19 nt, Homo sapiens
ucucauaaguagcauucau

SEQ ID NO: 1126392 - RNA, 18 nt, Homo sapiens
ucuccaguuugcaccugu

SEQ ID NO: 1126393 - RNA, 22 nt, Homo sapiens
ucuccgcaacagccaaguggaa

SEQ ID NO: 1126394 - RNA, 16 nt, Homo sapiens
ucucuuauagaauauu

SEQ ID NO: 1126395 - RNA, 21 nt, Homo sapiens
ucugaaggagccccauuccug

SEQ ID NO: 1126396 - RNA, 16 nt, Homo sapiens
ucugaccaucugugac

SEQ ID NO: 1126397 - RNA, 17 nt, Homo sapiens
ucugacucagggcuccu

SEQ ID NO: 1126398 - RNA, 13 nt, Homo sapiens
ucugagcugugca

SEQ ID NO: 1126399 - RNA, 13 nt, Homo sapiens
ucugaggucauua

SEQ ID NO: 1126400 - RNA, 13 nt, Homo sapiens
ucugauaccucaa

SEQ ID NO: 1126401 - RNA, 18 nt, Homo sapiens
ucugccaaucuguacaaa

SEQ ID NO: 1126402 - RNA, 14 nt, Homo sapiens
ucugcucaucauuc

SEQ ID NO: 1126403 - RNA, 20 nt, Homo sapiens
ucugggcuuggggcuuccua

SEQ ID NO: 1126404 - RNA, 17 nt, Homo sapiens
ucugggggauaagggag

SEQ ID NO: 1126405 - RNA, 17 nt, Homo sapiens
ucugguccgagucucag

SEQ ID NO: 1126406 - RNA, 24 nt, Homo sapiens
ucuguguaaaucuaacuacaagga

SEQ ID NO: 1126407 - RNA, 14 nt, Homo sapiens
ucuucaccauuugg

SEQ ID NO: 1126408 - RNA, 24 nt, Homo sapiens
ucuucaccauuuggcaaugccauc

SEQ ID NO: 1126409 - RNA, 13 nt, Homo sapiens
ucuuccagcccau

SEQ ID NO: 1126410 - RNA, 19 nt, Homo sapiens
ucuugacuacagucaggaa

SEQ ID NO: 1126411 - RNA, 22 nt, Homo sapiens
ucuugguugaggaaacaaacau

SEQ ID NO: 1126412 - RNA, 17 nt, Homo sapiens
ucuuucccaauucacau

SEQ ID NO: 1126413 - RNA, 17 nt, Homo sapiens
ucuuucuuguuugucag

SEQ ID NO: 1126414 - RNA, 16 nt, Homo sapiens
ugaaaaagauggaaug

SEQ ID NO: 1126415 - RNA, 19 nt, Homo sapiens
ugaaaaugguccaggagaa

SEQ ID NO: 1126416 - RNA, 16 nt, Homo sapiens
ugaaacauggcugugu

SEQ ID NO: 1126417 - RNA, 21 nt, Homo sapiens
ugaaaucugguuagauaauga

SEQ ID NO: 1126418 - RNA, 14 nt, Homo sapiens
ugaaaugaacuuug

SEQ ID NO: 1126419 - RNA, 15 nt, Homo sapiens
ugaaaugaacuuugu

SEQ ID NO: 1126420 - RNA, 22 nt, Homo sapiens
ugaaccaagaccauugaauucu

SEQ ID NO: 1126421 - RNA, 10 nt, Homo sapiens
ugaacuuugg

SEQ ID NO: 1126422 - RNA, 12 nt, Homo sapiens
ugaagaguacag

SEQ ID NO: 1126423 - RNA, 13 nt, Homo sapiens
ugaagccacagca

SEQ ID NO: 1126424 - RNA, 23 nt, Homo sapiens
ugaaggcugucaggauucuucaa

SEQ ID NO: 1126425 - RNA, 15 nt, Homo sapiens
ugaagggaagugggg

SEQ ID NO: 1126426 - RNA, 16 nt, Homo sapiens
ugaauaaaaacuuugc

SEQ ID NO: 1126427 - RNA, 13 nt, Homo sapiens
ugaauacugggaa

SEQ ID NO: 1126428 - RNA, 17 nt, Homo sapiens
ugaauacugggaaucaa

SEQ ID NO: 1126429 - RNA, 19 nt, Homo sapiens
gcauuuguuccaugccugc

SEQ ID NO: 1126430 - RNA, 18 nt, Homo sapiens
gccaaagugacacagagc

SEQ ID NO: 1126431 - RNA, 20 nt, Homo sapiens
gccagcuguacugaguucuc

SEQ ID NO: 1126432 - RNA, 20 nt, Homo sapiens
gccaggaucccccucuuugc

SEQ ID NO: 1126433 - RNA, 15 nt, Homo sapiens
gcccaagaggacuga

SEQ ID NO: 1126434 - RNA, 15 nt, Homo sapiens
gcccagugaccugac

SEQ ID NO: 1126435 - RNA, 23 nt, Homo sapiens
gcccccucccuggaugacauuaa

SEQ ID NO: 1126436 - RNA, 14 nt, Homo sapiens
gcccucaguuuuca

SEQ ID NO: 1126437 - RNA, 20 nt, Homo sapiens
gcccuugggguaagccagag

SEQ ID NO: 1126438 - RNA, 14 nt, Homo sapiens
gccgcauggcacuc

SEQ ID NO: 1126439 - RNA, 13 nt, Homo sapiens
gccucugcuuguu

SEQ ID NO: 1126440 - RNA, 14 nt, Homo sapiens
gccuggagacauau

SEQ ID NO: 1126441 - RNA, 20 nt, Homo sapiens
gccuguaaucccagcuacuu

SEQ ID NO: 1126442 - RNA, 17 nt, Homo sapiens
gcgaaaggaaagccaaa

SEQ ID NO: 1126443 - RNA, 20 nt, Homo sapiens
gcggucauucuacacugagg

SEQ ID NO: 1126444 - RNA, 17 nt, Homo sapiens
gcuaacuccagucuccu

SEQ ID NO: 1126445 - RNA, 19 nt, Homo sapiens
gcuagagugcaguggugca

SEQ ID NO: 1126446 - RNA, 23 nt, Homo sapiens
gcuauaccugggcauacuaauaa

SEQ ID NO: 1126447 - RNA, 20 nt, Homo sapiens
gcuauugaacugagccaaac

SEQ ID NO: 1126448 - RNA, 14 nt, Homo sapiens
gcucaaaaccucca

SEQ ID NO: 1126449 - RNA, 16 nt, Homo sapiens
gcucagacuugccagg

SEQ ID NO: 1126450 - RNA, 19 nt, Homo sapiens
gcugacccagaguggaguc

SEQ ID NO: 1126451 - RNA, 23 nt, Homo sapiens
gcuguaaacuauaaacuacugua

SEQ ID NO: 1126452 - RNA, 16 nt, Homo sapiens
gcugugcuagugccug

SEQ ID NO: 1126453 - RNA, 19 nt, Homo sapiens
gcuuauccccucagaaucc

SEQ ID NO: 1126454 - RNA, 18 nt, Homo sapiens
gcuuccagggagcccuuu

SEQ ID NO: 1126455 - RNA, 21 nt, Homo sapiens
gcuuccgugugucaucagggu

SEQ ID NO: 1126456 - RNA, 17 nt, Homo sapiens
gcuucucuuucucugag

SEQ ID NO: 1126457 - RNA, 18 nt, Homo sapiens
ggaaaaguuuaaccuaaa

SEQ ID NO: 1126458 - RNA, 21 nt, Homo sapiens
ggaaccacaccaaugcaacau

SEQ ID NO: 1126459 - RNA, 13 nt, Homo sapiens
ggaagacuugaag

SEQ ID NO: 1126460 - RNA, 18 nt, Homo sapiens
ggaagcaagaaagccgua

SEQ ID NO: 1126461 - RNA, 15 nt, Homo sapiens
ggaauaugcuaguga

SEQ ID NO: 1126462 - RNA, 17 nt, Homo sapiens
ggacaaagaaauagcaa

SEQ ID NO: 1126463 - RNA, 16 nt, Homo sapiens
ggacacuguccaugaa

SEQ ID NO: 1126464 - RNA, 22 nt, Homo sapiens
ggacacuguccaugaagcacug

SEQ ID NO: 1126465 - RNA, 14 nt, Homo sapiens
ggacaugugcuauu

SEQ ID NO: 1126466 - RNA, 16 nt, Homo sapiens
ggacuaugaaaagcua

SEQ ID NO: 1126467 - RNA, 13 nt, Homo sapiens
ggacuccugucug

SEQ ID NO: 1126468 - RNA, 21 nt, Homo sapiens
ggaggcacaacgcaccagaca

SEQ ID NO: 1126469 - RNA, 23 nt, Homo sapiens
ggauggcacuccggccaccuccu

SEQ ID NO: 1126470 - RNA, 20 nt, Homo sapiens
ggauuacagguguaagccac

SEQ ID NO: 1126471 - RNA, 18 nt, Homo sapiens
ggcaacccucacuguguu

SEQ ID NO: 1126472 - RNA, 20 nt, Homo sapiens
ggcaggaaggggaaacacag

SEQ ID NO: 1126473 - RNA, 13 nt, Homo sapiens
ggcauccugugug

SEQ ID NO: 1126474 - RNA, 20 nt, Homo sapiens
ggcuaaacaagggcagugag

SEQ ID NO: 1126475 - RNA, 18 nt, Homo sapiens
ggcuuccccucugucaaa

SEQ ID NO: 1126476 - RNA, 15 nt, Homo sapiens
gggaauacuggccau

SEQ ID NO: 1126477 - RNA, 13 nt, Homo sapiens
gggacucugagaa

SEQ ID NO: 1126478 - RNA, 13 nt, Homo sapiens
ggguaacacugau

SEQ ID NO: 1126479 - RNA, 16 nt, Homo sapiens
gggucuguguggugcc

SEQ ID NO: 1126480 - RNA, 15 nt, Homo sapiens
gggugcaaugauaau

SEQ ID NO: 1126481 - RNA, 23 nt, Homo sapiens
ggguguguuucaggacagcugcu

SEQ ID NO: 1126482 - RNA, 20 nt, Homo sapiens
ggguugcuaggaaaagaaau

SEQ ID NO: 1126483 - RNA, 17 nt, Homo sapiens
gguagcaucauugaucu

SEQ ID NO: 1126484 - RNA, 17 nt, Homo sapiens
gguccuguucccuaccc

SEQ ID NO: 1126485 - RNA, 19 nt, Homo sapiens
ggugggauccacacugaga

SEQ ID NO: 1126486 - RNA, 13 nt, Homo sapiens
ggugugaggucca

SEQ ID NO: 1126487 - RNA, 15 nt, Homo sapiens
gguucaaaagcaauc

SEQ ID NO: 1126488 - RNA, 17 nt, Homo sapiens
guaaaaccugagccauu

SEQ ID NO: 1126489 - RNA, 19 nt, Homo sapiens
guaaacuauaaacuacugu

SEQ ID NO: 1126490 - RNA, 17 nt, Homo sapiens
guaauagauguuugaua

SEQ ID NO: 1126491 - RNA, 16 nt, Homo sapiens
guaauuaagugcaauu

SEQ ID NO: 1126492 - RNA, 23 nt, Homo sapiens
guacugaguucucauccacagag

SEQ ID NO: 1126493 - RNA, 17 nt, Homo sapiens
guaugugaaacacacau

SEQ ID NO: 1126494 - RNA, 19 nt, Homo sapiens
gucaacaucaccccagugg

SEQ ID NO: 1126495 - RNA, 20 nt, Homo sapiens
guccaaucacauucaggcau

SEQ ID NO: 1126496 - RNA, 19 nt, Homo sapiens
gucucuuggcuuugucacu

SEQ ID NO: 1126497 - RNA, 18 nt, Homo sapiens
gucugaauaacacuggau

SEQ ID NO: 1126498 - RNA, 23 nt, Homo sapiens
gugaaucuuugucagcaguuccc

SEQ ID NO: 1126499 - RNA, 14 nt, Homo sapiens
gugagccaaggagg

SEQ ID NO: 1126500 - RNA, 14 nt, Homo sapiens
gugcuggacacugu

SEQ ID NO: 1126501 - RNA, 18 nt, Homo sapiens
gugggauccacacugaga

SEQ ID NO: 1126502 - RNA, 23 nt, Homo sapiens
gugggguacagagaugaaagagg

SEQ ID NO: 1126503 - RNA, 14 nt, Homo sapiens
gugggguacauuuc

SEQ ID NO: 1126504 - RNA, 17 nt, Homo sapiens
gugucuggcaguuuaua

SEQ ID NO: 1126505 - RNA, 10 nt, Homo sapiens
guguguuuca

SEQ ID NO: 1126506 - RNA, 19 nt, Homo sapiens
guguuauuugugggguaca

SEQ ID NO: 1126507 - RNA, 18 nt, Homo sapiens
guguugugaaacuguaaa

SEQ ID NO: 1126508 - RNA, 13 nt, Homo sapiens
guuauaacugugg

SEQ ID NO: 1126509 - RNA, 21 nt, Homo sapiens
guugauauuaaagaaucaaaa

SEQ ID NO: 1126510 - RNA, 16 nt, Homo sapiens
guugcuuauugggagu

SEQ ID NO: 1126511 - RNA, 16 nt, Homo sapiens
guuggaggauggcacu

SEQ ID NO: 1126512 - RNA, 16 nt, Homo sapiens
guugggaccugugauc

SEQ ID NO: 1126513 - RNA, 21 nt, Homo sapiens
guuugucaggauggaauccua

SEQ ID NO: 1126514 - RNA, 18 nt, Homo sapiens
uaaaaauccacuauuucc

SEQ ID NO: 1126515 - RNA, 21 nt, Homo sapiens
uaaaaugauuguaguaaucug

SEQ ID NO: 1126516 - RNA, 17 nt, Homo sapiens
uaaacaagggcagugag

SEQ ID NO: 1126517 - RNA, 19 nt, Homo sapiens
uaaacaagggcagugagaa

SEQ ID NO: 1126518 - RNA, 17 nt, Homo sapiens
uaaacccuuaaccuaaa

SEQ ID NO: 1126519 - RNA, 18 nt, Homo sapiens
uaaacuuuccaaaaccuu

SEQ ID NO: 1126520 - RNA, 22 nt, Homo sapiens
uaaagauuuuuuaauaauuuag

SEQ ID NO: 1126521 - RNA, 15 nt, Homo sapiens
uaaaguugauaaaga

SEQ ID NO: 1126522 - RNA, 23 nt, Homo sapiens
uaaauauuuuuuaaaaccauaaa

SEQ ID NO: 1126523 - RNA, 20 nt, Homo sapiens
uaaccaggggcugacaaugc

SEQ ID NO: 1126524 - RNA, 20 nt, Homo sapiens
uaacuccagucuccugacau

SEQ ID NO: 1126525 - RNA, 18 nt, Homo sapiens
uaagauguucugccuuau

SEQ ID NO: 1126526 - RNA, 16 nt, Homo sapiens
uaaguguucaguguug

SEQ ID NO: 1126527 - RNA, 19 nt, Homo sapiens
uaaguguucaguguugaca

SEQ ID NO: 1126528 - RNA, 16 nt, Homo sapiens
uaauacuaaagugucu

SEQ ID NO: 1126529 - RNA, 23 nt, Homo sapiens
uaauucuagagucucuguuacug

SEQ ID NO: 1126530 - RNA, 17 nt, Homo sapiens
uaauuuucuacaaccua

SEQ ID NO: 1126531 - RNA, 18 nt, Homo sapiens
uaauuuucuacaaccuaa

SEQ ID NO: 1126532 - RNA, 19 nt, Homo sapiens
uaauuuucuacaaccuaag

SEQ ID NO: 1126533 - RNA, 15 nt, Homo sapiens
uacacagcccaagag

SEQ ID NO: 1126534 - RNA, 21 nt, Homo sapiens
uaccagcuaacuccagucucc

SEQ ID NO: 1126535 - RNA, 21 nt, Homo sapiens
uaccugacggacguccugcug

SEQ ID NO: 1126536 - RNA, 14 nt, Homo sapiens
uacuaaagugucua

SEQ ID NO: 1126537 - RNA, 14 nt, Homo sapiens
uacuuucauacuga

SEQ ID NO: 1126538 - RNA, 17 nt, Homo sapiens
uagaaaaaucucauucc

SEQ ID NO: 1126539 - RNA, 16 nt, Homo sapiens
uagaauggaugugcuc

SEQ ID NO: 1126540 - RNA, 16 nt, Homo sapiens
uagagucucuguuacu

SEQ ID NO: 1126541 - RNA, 13 nt, Homo sapiens
uagcaacuacagu

SEQ ID NO: 1126542 - RNA, 23 nt, Homo sapiens
uagcaccgcuuauccccucagaa

SEQ ID NO: 1126543 - RNA, 23 nt, Homo sapiens
uagccucccaaagugcugggauu

SEQ ID NO: 1126544 - RNA, 11 nt, Homo sapiens
uaggauuccau

SEQ ID NO: 1126545 - RNA, 11 nt, Homo sapiens
uaggggaugag

SEQ ID NO: 1126546 - RNA, 23 nt, Homo sapiens
uaguaguuaauucugucacucac

SEQ ID NO: 1126547 - RNA, 20 nt, Homo sapiens
uagugccugaauuuguucuc

SEQ ID NO: 1126548 - RNA, 23 nt, Homo sapiens
uagugccugaauuuguucucuuu

SEQ ID NO: 1126549 - RNA, 21 nt, Homo sapiens
uaguggcuuccccucugucaa

SEQ ID NO: 1126550 - RNA, 20 nt, Homo sapiens
uaguucuguggccaucugcu

SEQ ID NO: 1126551 - RNA, 15 nt, Homo sapiens
ugauuuuuaauaguu

SEQ ID NO: 1126552 - RNA, 18 nt, Homo sapiens
ugcaaaccauagcacagg

SEQ ID NO: 1126553 - RNA, 16 nt, Homo sapiens
ugcacucccuaagaaa

SEQ ID NO: 1126554 - RNA, 14 nt, Homo sapiens
ugcagugagccaag

SEQ ID NO: 1126555 - RNA, 21 nt, Homo sapiens
ugcauaacagcagaugccaaa

SEQ ID NO: 1126556 - RNA, 19 nt, Homo sapiens
ugcauguaucuucuaagaa

SEQ ID NO: 1126557 - RNA, 22 nt, Homo sapiens
ugccagcucucugauuccccaa

SEQ ID NO: 1126558 - RNA, 22 nt, Homo sapiens
ugccaggacucucuuucuucca

SEQ ID NO: 1126559 - RNA, 16 nt, Homo sapiens
ugccauugguuccuug

SEQ ID NO: 1126560 - RNA, 22 nt, Homo sapiens
ugcccacguaugugaaacacac

SEQ ID NO: 1126561 - RNA, 20 nt, Homo sapiens
ugcccuugggguaagccaga

SEQ ID NO: 1126562 - RNA, 15 nt, Homo sapiens
ugccugagaugcacg

SEQ ID NO: 1126563 - RNA, 21 nt, Homo sapiens
ugccugccucaugcucucuau

SEQ ID NO: 1126564 - RNA, 16 nt, Homo sapiens
ugccugcuccaagaaa

SEQ ID NO: 1126565 - RNA, 22 nt, Homo sapiens
ugcgcaacaacaaggacccugu

SEQ ID NO: 1126566 - RNA, 21 nt, Homo sapiens
ugcuagugccugagaugcacg

SEQ ID NO: 1126567 - RNA, 19 nt, Homo sapiens
ugcuccaucaugcuugauu

SEQ ID NO: 1126568 - RNA, 16 nt, Homo sapiens
ugcuccugugugcugg

SEQ ID NO: 1126569 - RNA, 21 nt, Homo sapiens
ugcuccuugauaaaguauuau

SEQ ID NO: 1126570 - RNA, 12 nt, Homo sapiens
ugcucuguggcu

SEQ ID NO: 1126571 - RNA, 20 nt, Homo sapiens
ugcugugcuagugccugaga

SEQ ID NO: 1126572 - RNA, 23 nt, Homo sapiens
ugcuuaguagagcuuuuugcaug

SEQ ID NO: 1126573 - RNA, 20 nt, Homo sapiens
ugcuuauguaugccuauuca

SEQ ID NO: 1126574 - RNA, 20 nt, Homo sapiens
ugcuuuaauuuucacucugg

SEQ ID NO: 1126575 - RNA, 23 nt, Homo sapiens
uggaaagauuuuguccagaagaa

SEQ ID NO: 1126576 - RNA, 13 nt, Homo sapiens
uggaaaugaccag

SEQ ID NO: 1126577 - RNA, 17 nt, Homo sapiens
uggaaaugaccaggcca

SEQ ID NO: 1126578 - RNA, 18 nt, Homo sapiens
uggaaaugaccaggccaa

SEQ ID NO: 1126579 - RNA, 21 nt, Homo sapiens
uggaaccaaaaaucacuguca

SEQ ID NO: 1126580 - RNA, 17 nt, Homo sapiens
uggaagacuaucuuacu

SEQ ID NO: 1126581 - RNA, 24 nt, Homo sapiens
uggacacuguccaugaagcacuga

SEQ ID NO: 1126582 - RNA, 19 nt, Homo sapiens
uggacccccuggaagcuga

SEQ ID NO: 1126583 - RNA, 14 nt, Homo sapiens
uggagggaauuuga

SEQ ID NO: 1126584 - RNA, 14 nt, Homo sapiens
uggagggacaggga

SEQ ID NO: 1126585 - RNA, 13 nt, Homo sapiens
uggaugacauuaa

SEQ ID NO: 1126586 - RNA, 21 nt, Homo sapiens
uggaugacauuaaagaagggu

SEQ ID NO: 1126587 - RNA, 20 nt, Homo sapiens
uggauuggggauggggacaa

SEQ ID NO: 1126588 - RNA, 16 nt, Homo sapiens
uggcacagaugcccac

SEQ ID NO: 1126589 - RNA, 21 nt, Homo sapiens
uggcaccucagacaauccacu

SEQ ID NO: 1126590 - RNA, 18 nt, Homo sapiens
uggcccacauuuuccuua

SEQ ID NO: 1126591 - RNA, 21 nt, Homo sapiens
uggcccccucccuggaugaca

SEQ ID NO: 1126592 - RNA, 13 nt, Homo sapiens
uggccugagacaa

SEQ ID NO: 1126593 - RNA, 17 nt, Homo sapiens
uggcugaaccaaagaaa

SEQ ID NO: 1126594 - RNA, 16 nt, Homo sapiens
uggcugagcccauuuu

SEQ ID NO: 1126595 - RNA, 14 nt, Homo sapiens
uggcuugacuggau

SEQ ID NO: 1126596 - RNA, 19 nt, Homo sapiens
ugggaagaaagaaugcaag

SEQ ID NO: 1126597 - RNA, 21 nt, Homo sapiens
ugggagccugacagugcccag

SEQ ID NO: 1126598 - RNA, 21 nt, Homo sapiens
ugggauguccaccacaguaaa

SEQ ID NO: 1126599 - RNA, 18 nt, Homo sapiens
ugggcagcugucauggaa

SEQ ID NO: 1126600 - RNA, 18 nt, Homo sapiens
ugggcccuggccuggauu

SEQ ID NO: 1126601 - RNA, 22 nt, Homo sapiens
uggggaauacuggccaugccug

SEQ ID NO: 1126602 - RNA, 22 nt, Homo sapiens
uggguaaccagucccaggugaa

SEQ ID NO: 1126603 - RNA, 18 nt, Homo sapiens
ugguccaggcuugggcuc

SEQ ID NO: 1126604 - RNA, 19 nt, Homo sapiens
uguaaacuauaaacuacug

SEQ ID NO: 1126605 - RNA, 20 nt, Homo sapiens
uguaauuuuguccucucugu

SEQ ID NO: 1126606 - RNA, 16 nt, Homo sapiens
uguagugugucagagu

SEQ ID NO: 1126607 - RNA, 13 nt, Homo sapiens
uguaugccuauuc

SEQ ID NO: 1126608 - RNA, 15 nt, Homo sapiens
ugucaaaagcacaaa

SEQ ID NO: 1126609 - RNA, 16 nt, Homo sapiens
uguccucucugugucc

SEQ ID NO: 1126610 - RNA, 21 nt, Homo sapiens
uguccuggggaauacuggcca

SEQ ID NO: 1126611 - RNA, 17 nt, Homo sapiens
ugucuauguugugaucc

SEQ ID NO: 1126612 - RNA, 13 nt, Homo sapiens
ugucucaguuuac

SEQ ID NO: 1126613 - RNA, 20 nt, Homo sapiens
ugugaggaugaaaggaguga

SEQ ID NO: 1126614 - RNA, 17 nt, Homo sapiens
ugugcuauugaacugag

SEQ ID NO: 1126615 - RNA, 16 nt, Homo sapiens
ugugcuggacacuguc

SEQ ID NO: 1126616 - RNA, 18 nt, Homo sapiens
ugugcuugcccaccacag

SEQ ID NO: 1126617 - RNA, 14 nt, Homo sapiens
uguggccaucugcu

SEQ ID NO: 1126618 - RNA, 16 nt, Homo sapiens
uguguccccaccucag

SEQ ID NO: 1126619 - RNA, 12 nt, Homo sapiens
uguguccugggg

SEQ ID NO: 1126620 - RNA, 16 nt, Homo sapiens
uguucaguguugacau

SEQ ID NO: 1126621 - RNA, 21 nt, Homo sapiens
uguucaguguugacauagccu

SEQ ID NO: 1126622 - RNA, 12 nt, Homo sapiens
uguugacauagc

SEQ ID NO: 1126623 - RNA, 16 nt, Homo sapiens
uguuuauuugcacuau

SEQ ID NO: 1126624 - RNA, 18 nt, Homo sapiens
uuaaaguggacuuauuaa

SEQ ID NO: 1126625 - RNA, 14 nt, Homo sapiens
uuaagacacaccuc

SEQ ID NO: 1126626 - RNA, 21 nt, Homo sapiens
uuaauccucacaccuacugua

SEQ ID NO: 1126627 - RNA, 15 nt, Homo sapiens
uuaauuuauguaucu

SEQ ID NO: 1126628 - RNA, 20 nt, Homo sapiens
uuagacuaguuucuuauuaa

SEQ ID NO: 1126629 - RNA, 22 nt, Homo sapiens
aauacaguauaccgcaguggcu

SEQ ID NO: 1126630 - RNA, 13 nt, Homo sapiens
aauacuaguauua

SEQ ID NO: 1126631 - RNA, 13 nt, Homo sapiens
aauacuggccaug

SEQ ID NO: 1126632 - RNA, 17 nt, Homo sapiens
aauagcuaaauaccuca

SEQ ID NO: 1126633 - RNA, 19 nt, Homo sapiens
aauaguuguugaguauucc

SEQ ID NO: 1126634 - RNA, 20 nt, Homo sapiens
aauauucauuuuaaagugga

SEQ ID NO: 1126635 - RNA, 20 nt, Homo sapiens
aauccacaacuuguaccaag

SEQ ID NO: 1126636 - RNA, 16 nt, Homo sapiens
aauccacuauuuccau

SEQ ID NO: 1126637 - RNA, 16 nt, Homo sapiens
aaucucagaacccaga

SEQ ID NO: 1126638 - RNA, 21 nt, Homo sapiens
aaucuccuucuuuccuggacu

SEQ ID NO: 1126639 - RNA, 16 nt, Homo sapiens
aaucugccugcaacuu

SEQ ID NO: 1126640 - RNA, 23 nt, Homo sapiens
aaucuggucugaauaacacugga

SEQ ID NO: 1126641 - RNA, 18 nt, Homo sapiens
aaugaccaguaauuguga

SEQ ID NO: 1126642 - RNA, 23 nt, Homo sapiens
aaugcaaaucaauaaauucccaa

SEQ ID NO: 1126643 - RNA, 19 nt, Homo sapiens
aaugccucugcugugggcu

SEQ ID NO: 1126644 - RNA, 16 nt, Homo sapiens
aaugcuuuuugaucug

SEQ ID NO: 1126645 - RNA, 15 nt, Homo sapiens
aaugggaaaagagau

SEQ ID NO: 1126646 - RNA, 12 nt, Homo sapiens
aauguccagcca

SEQ ID NO: 1126647 - RNA, 15 nt, Homo sapiens
aauuagaaacauaaa

SEQ ID NO: 1126648 - RNA, 17 nt, Homo sapiens
aauuauuuuaguagugu

SEQ ID NO: 1126649 - RNA, 16 nt, Homo sapiens
aauuucucugaggaca

SEQ ID NO: 1126650 - RNA, 15 nt, Homo sapiens
acaaaggcccagcag

SEQ ID NO: 1126651 - RNA, 15 nt, Homo sapiens
acaacugccagcucu

SEQ ID NO: 1126652 - RNA, 20 nt, Homo sapiens
acaagcaagggcugugcuga

SEQ ID NO: 1126653 - RNA, 14 nt, Homo sapiens
acaauccacucuca

SEQ ID NO: 1126654 - RNA, 12 nt, Homo sapiens
acacacuguaaa

SEQ ID NO: 1126655 - RNA, 20 nt, Homo sapiens
acacagcugaugaacugugg

SEQ ID NO: 1126656 - RNA, 18 nt, Homo sapiens
acacagggugcaugugag

SEQ ID NO: 1126657 - RNA, 14 nt, Homo sapiens
acacagguguagac

SEQ ID NO: 1126658 - RNA, 18 nt, Homo sapiens
gacuuaggaaccuaccag

SEQ ID NO: 1126659 - RNA, 16 nt, Homo sapiens
gacuugaagcacagag

SEQ ID NO: 1126660 - RNA, 23 nt, Homo sapiens
gagacaaaucuaugccacucaga

SEQ ID NO: 1126661 - RNA, 14 nt, Homo sapiens
gagagcgaaggggg

SEQ ID NO: 1126662 - RNA, 18 nt, Homo sapiens
gagcccagcauucagggg

SEQ ID NO: 1126663 - RNA, 17 nt, Homo sapiens
gagccuccugacccugu

SEQ ID NO: 1126664 - RNA, 16 nt, Homo sapiens
gagccuggaagccaaa

SEQ ID NO: 1126665 - RNA, 14 nt, Homo sapiens
gagcucagccgugc

SEQ ID NO: 1126666 - RNA, 19 nt, Homo sapiens
gaggcacaacgcaccagac

SEQ ID NO: 1126667 - RNA, 17 nt, Homo sapiens
gaggcucagccacacag

SEQ ID NO: 1126668 - RNA, 14 nt, Homo sapiens
gaggggaccaaagc

SEQ ID NO: 1126669 - RNA, 12 nt, Homo sapiens
gagguggcugcu

SEQ ID NO: 1126670 - RNA, 20 nt, Homo sapiens
gaggugggguacauuucucu

SEQ ID NO: 1126671 - RNA, 21 nt, Homo sapiens
gaguccccagaaccagcugca

SEQ ID NO: 1126672 - RNA, 15 nt, Homo sapiens
gaguucaagccugug

SEQ ID NO: 1126673 - RNA, 22 nt, Homo sapiens
gaucuccacaccaaagucaggg

SEQ ID NO: 1126674 - RNA, 16 nt, Homo sapiens
gaugaacuguggugcc

SEQ ID NO: 1126675 - RNA, 17 nt, Homo sapiens
gaugacauuaaagaagg

SEQ ID NO: 1126676 - RNA, 16 nt, Homo sapiens
gaugagaaacaacaga

SEQ ID NO: 1126677 - RNA, 20 nt, Homo sapiens
gaugccaaccagacaccucc

SEQ ID NO: 1126678 - RNA, 21 nt, Homo sapiens
gauggucaucgugacagcagc

SEQ ID NO: 1126679 - RNA, 18 nt, Homo sapiens
gauuauaagaguaauaua

SEQ ID NO: 1126680 - RNA, 12 nt, Homo sapiens
gauugagugcuc

SEQ ID NO: 1126681 - RNA, 21 nt, Homo sapiens
gauugagugcuccugugugcu

SEQ ID NO: 1126682 - RNA, 15 nt, Homo sapiens
gauuugccaaaguga

SEQ ID NO: 1126683 - RNA, 23 nt, Homo sapiens
gcaaaacaaggacuagagcucag

SEQ ID NO: 1126684 - RNA, 15 nt, Homo sapiens
gcaagggcugugcug

SEQ ID NO: 1126685 - RNA, 18 nt, Homo sapiens
guaagguuauaacugugg

SEQ ID NO: 1126686 - RNA, 14 nt, Homo sapiens
guagaacucacaga

SEQ ID NO: 1126687 - RNA, 17 nt, Homo sapiens
guagcagccugcguuaa

SEQ ID NO: 1126688 - RNA, 22 nt, Homo sapiens
guaucacugguccaccuccuga

SEQ ID NO: 1126689 - RNA, 14 nt, Homo sapiens
guaugccuauucag

SEQ ID NO: 1126690 - RNA, 17 nt, Homo sapiens
guauuaauuuauguauc

SEQ ID NO: 1126691 - RNA, 15 nt, Homo sapiens
guauuaccuauucaa

SEQ ID NO: 1126692 - RNA, 14 nt, Homo sapiens
guauuuaaacaaca

SEQ ID NO: 1126693 - RNA, 21 nt, Homo sapiens
gucaccgggaugaaccuaucc

SEQ ID NO: 1126694 - RNA, 21 nt, Homo sapiens
gucacuaaccaagccagaaac

SEQ ID NO: 1126695 - RNA, 19 nt, Homo sapiens
gucaugcacucaggcagac

SEQ ID NO: 1126696 - RNA, 15 nt, Homo sapiens
gucauucuacacuga

SEQ ID NO: 1126697 - RNA, 17 nt, Homo sapiens
gucauucuacacugagg

SEQ ID NO: 1126698 - RNA, 16 nt, Homo sapiens
guccaaucacauucag

SEQ ID NO: 1126699 - RNA, 17 nt, Homo sapiens
guccagagucuaggcaa

SEQ ID NO: 1126700 - RNA, 18 nt, Homo sapiens
guccaugaagcacugagc

SEQ ID NO: 1126701 - RNA, 17 nt, Homo sapiens
gucccaagcccagggac

SEQ ID NO: 1126702 - RNA, 18 nt, Homo sapiens
gucccagccacaguguua

SEQ ID NO: 1126703 - RNA, 14 nt, Homo sapiens
guccucaucugcaa

SEQ ID NO: 1126704 - RNA, 23 nt, Homo sapiens
guccugggaauaugcuagugaug

SEQ ID NO: 1126705 - RNA, 19 nt, Homo sapiens
guccuuaggugugaggucc

SEQ ID NO: 1126706 - RNA, 19 nt, Homo sapiens
gucucucuauuacacugga

SEQ ID NO: 1126707 - RNA, 21 nt, Homo sapiens
gucucugccugcggcccagaa

SEQ ID NO: 1126708 - RNA, 12 nt, Homo sapiens
gucuguguuauu

SEQ ID NO: 1126709 - RNA, 20 nt, Homo sapiens
gucuuagccucccaaagugc

SEQ ID NO: 1126710 - RNA, 15 nt, Homo sapiens
ugggauccacacuga

SEQ ID NO: 1126711 - RNA, 12 nt, Homo sapiens
uggggccagugc

SEQ ID NO: 1126712 - RNA, 14 nt, Homo sapiens
uggggucaaagacu

SEQ ID NO: 1126713 - RNA, 19 nt, Homo sapiens
uggucacagccaugaaguc

SEQ ID NO: 1126714 - RNA, 19 nt, Homo sapiens
uggucgcggagguccugcu

SEQ ID NO: 1126715 - RNA, 19 nt, Homo sapiens
uguaaucccagcuacuugg

SEQ ID NO: 1126716 - RNA, 19 nt, Homo sapiens
uguaccagggcucuguauu

SEQ ID NO: 1126717 - RNA, 18 nt, Homo sapiens
uguaucagagggcuuuga

SEQ ID NO: 1126718 - RNA, 14 nt, Homo sapiens
uguauuaccuauuc

SEQ ID NO: 1126719 - RNA, 20 nt, Homo sapiens
uguauuauaugcagaauuac

SEQ ID NO: 1126720 - RNA, 18 nt, Homo sapiens
uguauuuuccaacuuguu

SEQ ID NO: 1126721 - RNA, 14 nt, Homo sapiens
ugucagcaguuccc

SEQ ID NO: 1126722 - RNA, 15 nt, Homo sapiens
uguccaaucacauuc

SEQ ID NO: 1126723 - RNA, 19 nt, Homo sapiens
uguccaugaagcacugagc

SEQ ID NO: 1126724 - RNA, 22 nt, Homo sapiens
uguccccucuccccucauggag

SEQ ID NO: 1126725 - RNA, 13 nt, Homo sapiens
uguccucucugug

SEQ ID NO: 1126726 - RNA, 22 nt, Homo sapiens
ugugauuccuuugaagaggaaa

SEQ ID NO: 1126727 - RNA, 23 nt, Homo sapiens
ugugcccuugggguaagccagag

SEQ ID NO: 1126728 - RNA, 16 nt, Homo sapiens
ugugccgugacagggc

SEQ ID NO: 1126729 - RNA, 14 nt, Homo sapiens
ugugcucacugggg

SEQ ID NO: 1126730 - RNA, 15 nt, Homo sapiens
ugugcuggacacugu

SEQ ID NO: 1126731 - RNA, 22 nt, Homo sapiens
aaccuccaaggaccucucucaa

SEQ ID NO: 1126732 - RNA, 16 nt, Homo sapiens
aaccuuccucuuccag

SEQ ID NO: 1126733 - RNA, 17 nt, Homo sapiens
aacgcaccagacacuca

SEQ ID NO: 1126734 - RNA, 13 nt, Homo sapiens
aacuauaagcaag

SEQ ID NO: 1126735 - RNA, 21 nt, Homo sapiens
aacuccagccacccagccagg

SEQ ID NO: 1126736 - RNA, 11 nt, Homo sapiens
aacuggcuguu

SEQ ID NO: 1126737 - RNA, 23 nt, Homo sapiens
aagaaagugaaaaaaacaaccua

SEQ ID NO: 1126738 - RNA, 11 nt, Homo sapiens
aagaaggguug

SEQ ID NO: 1126739 - RNA, 17 nt, Homo sapiens
aagacacaccucuggau

SEQ ID NO: 1126740 - RNA, 13 nt, Homo sapiens
aagagagaucaaa

SEQ ID NO: 1126741 - RNA, 14 nt, Homo sapiens
aagaggucugagcc

SEQ ID NO: 1126742 - RNA, 15 nt, Homo sapiens
aagaguggacugaau

SEQ ID NO: 1126743 - RNA, 19 nt, Homo sapiens
aagaugcagcaaaauguga

SEQ ID NO: 1126744 - RNA, 21 nt, Homo sapiens
aagcagucaauuuucacauca

SEQ ID NO: 1126745 - RNA, 13 nt, Homo sapiens
aagcaguccuccu

SEQ ID NO: 1126746 - RNA, 14 nt, Homo sapiens
aagcauaaagcaau

SEQ ID NO: 1126747 - RNA, 23 nt, Homo sapiens
aagcaucuuucuguuacugaugu

SEQ ID NO: 1126748 - RNA, 16 nt, Homo sapiens
aagcccagugaccuga

SEQ ID NO: 1126749 - RNA, 20 nt, Homo sapiens
aagccuccccaguucuacug

SEQ ID NO: 1126750 - RNA, 23 nt, Homo sapiens
aagccuuuccuuuuagugauaaa

SEQ ID NO: 1126751 - RNA, 15 nt, Homo sapiens
aagcguuugcacaga

SEQ ID NO: 1126752 - RNA, 20 nt, Homo sapiens
aaggaccucucucaaugcca

SEQ ID NO: 1126753 - RNA, 15 nt, Homo sapiens
aaggcauccaugaaa

SEQ ID NO: 1126754 - RNA, 13 nt, Homo sapiens
aaggcugugagcc

SEQ ID NO: 1126755 - RNA, 14 nt, Homo sapiens
aagggcagugagaa

SEQ ID NO: 1126756 - RNA, 13 nt, Homo sapiens
aagggcugugcug

SEQ ID NO: 1126757 - RNA, 19 nt, Homo sapiens
aaggggaaacacagcugau

SEQ ID NO: 1126758 - RNA, 13 nt, Homo sapiens
aaggguugagcug

SEQ ID NO: 1126759 - RNA, 15 nt, Homo sapiens
aaggucagagucaaa

SEQ ID NO: 1126760 - RNA, 15 nt, Homo sapiens
aagguuauaacugug

SEQ ID NO: 1126761 - RNA, 13 nt, Homo sapiens
aagugaucugucc

SEQ ID NO: 1126762 - RNA, 24 nt, Homo sapiens
aagugcaauuuccccucugugucc

SEQ ID NO: 1126763 - RNA, 14 nt, Homo sapiens
aaguugcagucuca

SEQ ID NO: 1126764 - RNA, 22 nt, Homo sapiens
aaguugcagucucagaaagccu

SEQ ID NO: 1126765 - RNA, 22 nt, Homo sapiens
aauaaaagaauaguugccaagg

SEQ ID NO: 1126766 - RNA, 15 nt, Homo sapiens
aauaagguacaagaa

SEQ ID NO: 1126767 - RNA, 18 nt, Homo sapiens
aauaagugcucugucaaa

SEQ ID NO: 1126768 - RNA, 22 nt, Homo sapiens
aauaauuuagacuucaagcaug

SEQ ID NO: 1126769 - RNA, 14 nt, Homo sapiens
aauacuaguauuaa

SEQ ID NO: 1126770 - RNA, 17 nt, Homo sapiens
aauauccuaaacaucau

SEQ ID NO: 1126771 - RNA, 16 nt, Homo sapiens
aaucaccaaaugcuuu

SEQ ID NO: 1126772 - RNA, 11 nt, Homo sapiens
aauccccagac

SEQ ID NO: 1126773 - RNA, 15 nt, Homo sapiens
aaucuaugccacuca

SEQ ID NO: 1126774 - RNA, 16 nt, Homo sapiens
aaucucaucucaguga

SEQ ID NO: 1126775 - RNA, 17 nt, Homo sapiens
aaucuccuucuuuccug

SEQ ID NO: 1126776 - RNA, 20 nt, Homo sapiens
aaugaccaggccaagacuca

SEQ ID NO: 1126777 - RNA, 21 nt, Homo sapiens
aaugauggaaccaaaaaucac

SEQ ID NO: 1126778 - RNA, 17 nt, Homo sapiens
aaugcuuuuugaucugu

SEQ ID NO: 1126779 - RNA, 19 nt, Homo sapiens
aauggaugugcucacuggg

SEQ ID NO: 1126780 - RNA, 23 nt, Homo sapiens
aauggcuguaaacuauaaacuac

SEQ ID NO: 1126781 - RNA, 15 nt, Homo sapiens
aaugggacucugaga

SEQ ID NO: 1126782 - RNA, 13 nt, Homo sapiens
aauuaagugcaau

SEQ ID NO: 1126783 - RNA, 21 nt, Homo sapiens
aauucacauaacuucucugag

SEQ ID NO: 1126784 - RNA, 22 nt, Homo sapiens
aauucugucacucaccacuaca

SEQ ID NO: 1126785 - RNA, 15 nt, Homo sapiens
aauugagcaccuacu

SEQ ID NO: 1126786 - RNA, 15 nt, Homo sapiens
aauuucaaaagugau

SEQ ID NO: 1126787 - RNA, 16 nt, Homo sapiens
aauuuuguugcuacau

SEQ ID NO: 1126788 - RNA, 21 nt, Homo sapiens
acaaaucuaugccacucagaa

SEQ ID NO: 1126789 - RNA, 17 nt, Homo sapiens
acaaaugggucccucag

SEQ ID NO: 1126790 - RNA, 19 nt, Homo sapiens
acaacgcaccagacacuca

SEQ ID NO: 1126791 - RNA, 20 nt, Homo sapiens
acaacugccagcucucugau

SEQ ID NO: 1126792 - RNA, 16 nt, Homo sapiens
acaagcauuuguucca

SEQ ID NO: 1126793 - RNA, 12 nt, Homo sapiens
acaaugccucuc

SEQ ID NO: 1126794 - RNA, 23 nt, Homo sapiens
acaaugcgaggucgcaacugaga

SEQ ID NO: 1126795 - RNA, 22 nt, Homo sapiens
acacacuaacaaaagcaugaaa

SEQ ID NO: 1126796 - RNA, 15 nt, Homo sapiens
acacagagcaauggu

SEQ ID NO: 1126797 - RNA, 12 nt, Homo sapiens
acacuguccaug

SEQ ID NO: 1126798 - RNA, 21 nt, Homo sapiens
acacuguccaugaagcacuga

SEQ ID NO: 1126799 - RNA, 23 nt, Homo sapiens
acacuguccaugaagcacugagc

SEQ ID NO: 1126800 - RNA, 14 nt, Homo sapiens
acagaaauaaagag

SEQ ID NO: 1126801 - RNA, 15 nt, Homo sapiens
acagagaugaaagag

SEQ ID NO: 1126802 - RNA, 21 nt, Homo sapiens
acagagcaaugguagcaaaac

SEQ ID NO: 1126803 - RNA, 24 nt, Homo sapiens
acagagguggcugcugugcuagug

SEQ ID NO: 1126804 - RNA, 17 nt, Homo sapiens
acagggcucccgaguca

SEQ ID NO: 1126805 - RNA, 24 nt, Homo sapiens
acagggcucccgagucaugcacuc

SEQ ID NO: 1126806 - RNA, 12 nt, Homo sapiens
acagggugcaug

SEQ ID NO: 1126807 - RNA, 13 nt, Homo sapiens
acaguugugagau

SEQ ID NO: 1126808 - RNA, 15 nt, Homo sapiens
acauagacagaagaa

SEQ ID NO: 1126809 - RNA, 22 nt, Homo sapiens
acaucaaagacagcaucuaaga

SEQ ID NO: 1126810 - RNA, 13 nt, Homo sapiens
acaucacuugaga

SEQ ID NO: 1126811 - RNA, 22 nt, Homo sapiens
acaugcuagugauaucuagaaa

SEQ ID NO: 1126812 - RNA, 16 nt, Homo sapiens
acaugugcuauugaac

SEQ ID NO: 1126813 - RNA, 20 nt, Homo sapiens
acauugaauuagaaacauaa

SEQ ID NO: 1126814 - RNA, 20 nt, Homo sapiens
acauuuacugaccauguacu

SEQ ID NO: 1126815 - RNA, 18 nt, Homo sapiens
acauuugacuucuagaaa

SEQ ID NO: 1126816 - RNA, 20 nt, Homo sapiens
accaccgaagaggaagcaag

SEQ ID NO: 1126817 - RNA, 13 nt, Homo sapiens
accagacacucac

SEQ ID NO: 1126818 - RNA, 16 nt, Homo sapiens
accaggggcugacaau

SEQ ID NO: 1126819 - RNA, 14 nt, Homo sapiens
accaguaauuguga

SEQ ID NO: 1126820 - RNA, 15 nt, Homo sapiens
accaguaauugugaa

SEQ ID NO: 1126821 - RNA, 22 nt, Homo sapiens
accauccuuguagacucagaaa

SEQ ID NO: 1126822 - RNA, 20 nt, Homo sapiens
acccagaugccaaccagaca

SEQ ID NO: 1126823 - RNA, 18 nt, Homo sapiens
acccaguaaaaauccacu

SEQ ID NO: 1126824 - RNA, 17 nt, Homo sapiens
accccauuuguggucac

SEQ ID NO: 1126825 - RNA, 15 nt, Homo sapiens
acccccaggcaucug

SEQ ID NO: 1126826 - RNA, 14 nt, Homo sapiens
acccuuaaccuaaa

SEQ ID NO: 1126827 - RNA, 17 nt, Homo sapiens
accucacugacacaggg

SEQ ID NO: 1126828 - RNA, 19 nt, Homo sapiens
accuccuucuuccuagcca

SEQ ID NO: 1126829 - RNA, 15 nt, Homo sapiens
accuuccacacaggg

SEQ ID NO: 1126830 - RNA, 16 nt, Homo sapiens
acgugccagcucuagu

SEQ ID NO: 1126831 - RNA, 21 nt, Homo sapiens
acuacacacuguguacugcag

SEQ ID NO: 1126832 - RNA, 14 nt, Homo sapiens
acuacaucacuuga

SEQ ID NO: 1126833 - RNA, 16 nt, Homo sapiens
acuauaaacuacugua

SEQ ID NO: 1126834 - RNA, 16 nt, Homo sapiens
acuauugagugaaaca

SEQ ID NO: 1126835 - RNA, 13 nt, Homo sapiens
acuauuuccauug

SEQ ID NO: 1126836 - RNA, 22 nt, Homo sapiens
acucccacagaggagagaggcu

SEQ ID NO: 1126837 - RNA, 13 nt, Homo sapiens
acuccucugacug

SEQ ID NO: 1126838 - RNA, 15 nt, Homo sapiens
acuccugucuguccu

SEQ ID NO: 1126839 - RNA, 18 nt, Homo sapiens
acucugagaacuccucau

SEQ ID NO: 1126840 - RNA, 17 nt, Homo sapiens
acucugggcuccucaac

SEQ ID NO: 1126841 - RNA, 23 nt, Homo sapiens
acucuguccuggaggcacuggga

SEQ ID NO: 1126842 - RNA, 16 nt, Homo sapiens
acucuuagccccagac

SEQ ID NO: 1126843 - RNA, 18 nt, Homo sapiens
acugcccuggccuuugca

SEQ ID NO: 1126844 - RNA, 17 nt, Homo sapiens
acuggacccccuggaag

SEQ ID NO: 1126845 - RNA, 23 nt, Homo sapiens
acuggcuucucuuucucugagug

SEQ ID NO: 1126846 - RNA, 12 nt, Homo sapiens
acuguccaugaa

SEQ ID NO: 1126847 - RNA, 15 nt, Homo sapiens
acugucgagucccca

SEQ ID NO: 1126848 - RNA, 18 nt, Homo sapiens
acugucuauguugugauc

SEQ ID NO: 1126849 - RNA, 17 nt, Homo sapiens
acuguguugacuuugcu

SEQ ID NO: 1126850 - RNA, 19 nt, Homo sapiens
acuguuuauuugcacuaug

SEQ ID NO: 1126851 - RNA, 23 nt, Homo sapiens
acuuuaauuuccuugacuguaaa

SEQ ID NO: 1126852 - RNA, 13 nt, Homo sapiens
agaaaaacaaaua

SEQ ID NO: 1126853 - RNA, 17 nt, Homo sapiens
agaaaacacagccugug

SEQ ID NO: 1126854 - RNA, 15 nt, Homo sapiens
agaaaauaagugcuc

SEQ ID NO: 1126855 - RNA, 18 nt, Homo sapiens
agaaagccguacugucua

SEQ ID NO: 1126856 - RNA, 13 nt, Homo sapiens
agaaaggccugag

SEQ ID NO: 1126857 - RNA, 16 nt, Homo sapiens
agaacucacagaaaua

SEQ ID NO: 1126858 - RNA, 16 nt, Homo sapiens
agaacuguuuucucaa

SEQ ID NO: 1126859 - RNA, 21 nt, Homo sapiens
agaagcaacacuuugugaucu

SEQ ID NO: 1126860 - RNA, 22 nt, Homo sapiens
agaauggaugugcucacugggg

SEQ ID NO: 1126861 - RNA, 18 nt, Homo sapiens
agacaacccucagauuug

SEQ ID NO: 1126862 - RNA, 13 nt, Homo sapiens
agacacaggugua

SEQ ID NO: 1126863 - RNA, 15 nt, Homo sapiens
agacauaucacucaa

SEQ ID NO: 1126864 - RNA, 22 nt, Homo sapiens
agaccuugaugcuuggccuccc

SEQ ID NO: 1126865 - RNA, 21 nt, Homo sapiens
agagaaaucaccaaaugcuuu

SEQ ID NO: 1126866 - RNA, 19 nt, Homo sapiens
agagaaggcugugagccaa

SEQ ID NO: 1126867 - RNA, 22 nt, Homo sapiens
agagaaggcugugagccaagga

SEQ ID NO: 1126868 - RNA, 15 nt, Homo sapiens
agagaucugucauau

SEQ ID NO: 1126869 - RNA, 15 nt, Homo sapiens
agagcuuuuugcaug

SEQ ID NO: 1126870 - RNA, 13 nt, Homo sapiens
agaggcagugaga

SEQ ID NO: 1126871 - RNA, 15 nt, Homo sapiens
agaggccaggcaugg

SEQ ID NO: 1126872 - RNA, 11 nt, Homo sapiens
agaggcucagc

SEQ ID NO: 1126873 - RNA, 22 nt, Homo sapiens
agaggggugggauccacacuga

SEQ ID NO: 1126874 - RNA, 14 nt, Homo sapiens
agagugacaugugc

SEQ ID NO: 1126875 - RNA, 17 nt, Homo sapiens
agaguggagagugacau

SEQ ID NO: 1126876 - RNA, 21 nt, Homo sapiens
agaguggccaaucccugugug

SEQ ID NO: 1126877 - RNA, 23 nt, Homo sapiens
agauagauauuccuauugugcaa

SEQ ID NO: 1126878 - RNA, 14 nt, Homo sapiens
agaucaaauggaaa

SEQ ID NO: 1126879 - RNA, 21 nt, Homo sapiens
agaucgauccuggauucacuc

SEQ ID NO: 1126880 - RNA, 23 nt, Homo sapiens
agaugaagaccaggacuacagcu

SEQ ID NO: 1126881 - RNA, 20 nt, Homo sapiens
agcaacacuuugugaucuca

SEQ ID NO: 1126882 - RNA, 21 nt, Homo sapiens
agcaaugcuucuaucaaauac

SEQ ID NO: 1126883 - RNA, 21 nt, Homo sapiens
agcaauugugaaauacaguau

SEQ ID NO: 1126884 - RNA, 20 nt, Homo sapiens
agcacugccucuuccagggc

SEQ ID NO: 1126885 - RNA, 20 nt, Homo sapiens
agcagagacgggguuucacc

SEQ ID NO: 1126886 - RNA, 13 nt, Homo sapiens
agcagauggagua

SEQ ID NO: 1126887 - RNA, 14 nt, Homo sapiens
agcaugaggcaaaa

SEQ ID NO: 1126888 - RNA, 14 nt, Homo sapiens
agccaaacaaaggc

SEQ ID NO: 1126889 - RNA, 23 nt, Homo sapiens
agccaaggagggagggucuuccu

SEQ ID NO: 1126890 - RNA, 14 nt, Homo sapiens
agccacaacugcca

SEQ ID NO: 1126891 - RNA, 13 nt, Homo sapiens
agccaccaagaca

SEQ ID NO: 1126892 - RNA, 17 nt, Homo sapiens
agccacuauuaacauuu

SEQ ID NO: 1126893 - RNA, 16 nt, Homo sapiens
agcccaagaggacuga

SEQ ID NO: 1126894 - RNA, 18 nt, Homo sapiens
agccccucaauccuauca

SEQ ID NO: 1126895 - RNA, 24 nt, Homo sapiens
agcccuauggaagucucaagguca

SEQ ID NO: 1126896 - RNA, 16 nt, Homo sapiens
agccgcauggcacucu

SEQ ID NO: 1126897 - RNA, 22 nt, Homo sapiens
agcggucauucuacacugagga

SEQ ID NO: 1126898 - RNA, 23 nt, Homo sapiens
agcuacguauuuaauagcaaaga

SEQ ID NO: 1126899 - RNA, 20 nt, Homo sapiens
agcuagagugcaguggugca

SEQ ID NO: 1126900 - RNA, 18 nt, Homo sapiens
agcucagccgugcacucc

SEQ ID NO: 1126901 - RNA, 13 nt, Homo sapiens
agcuguacuguaa

SEQ ID NO: 1126902 - RNA, 15 nt, Homo sapiens
aggaaaaugaauaau

SEQ ID NO: 1126903 - RNA, 12 nt, Homo sapiens
aggaaccuacca

SEQ ID NO: 1126904 - RNA, 17 nt, Homo sapiens
aggaaggggaaacacag

SEQ ID NO: 1126905 - RNA, 20 nt, Homo sapiens
aggaauauuuucuucugcac

SEQ ID NO: 1126906 - RNA, 23 nt, Homo sapiens
aggacacagauaggauggggugu

SEQ ID NO: 1126907 - RNA, 21 nt, Homo sapiens
aggacgaaaaacacagugcac

SEQ ID NO: 1126908 - RNA, 23 nt, Homo sapiens
aggaggcgcagcccgaagcccag

SEQ ID NO: 1126909 - RNA, 15 nt, Homo sapiens
aggaggggcugucca

SEQ ID NO: 1126910 - RNA, 16 nt, Homo sapiens
aggauaucgggucacu

SEQ ID NO: 1126911 - RNA, 18 nt, Homo sapiens
aggaugcuucugcucaca

SEQ ID NO: 1126912 - RNA, 19 nt, Homo sapiens
aggcaggcuuuuccuccaa

SEQ ID NO: 1126913 - RNA, 20 nt, Homo sapiens
aggccaggcgcgguggcuca

SEQ ID NO: 1126914 - RNA, 22 nt, Homo sapiens
aggcccagaaagaggcagugau

SEQ ID NO: 1126915 - RNA, 19 nt, Homo sapiens
aggcugggauggagcacuu

SEQ ID NO: 1126916 - RNA, 14 nt, Homo sapiens
agggccucugggag

SEQ ID NO: 1126917 - RNA, 21 nt, Homo sapiens
aggggacacugaaccuuguug

SEQ ID NO: 1126918 - RNA, 16 nt, Homo sapiens
agggggcuauucccug

SEQ ID NO: 1126919 - RNA, 18 nt, Homo sapiens
aggggugauucugaaacc

SEQ ID NO: 1126920 - RNA, 22 nt, Homo sapiens
aggggugggauccacacugaga

SEQ ID NO: 1126921 - RNA, 15 nt, Homo sapiens
agguccugcuaccca

SEQ ID NO: 1126922 - RNA, 16 nt, Homo sapiens
agguguagaccagagu

SEQ ID NO: 1126923 - RNA, 14 nt, Homo sapiens
aguaauugcaagag

SEQ ID NO: 1126924 - RNA, 13 nt, Homo sapiens
aguaauugugaaa

SEQ ID NO: 1126925 - RNA, 19 nt, Homo sapiens
aguaauuuugcuccuugau

SEQ ID NO: 1126926 - RNA, 22 nt, Homo sapiens
aguauuuauuuuuucaaaaaca

SEQ ID NO: 1126927 - RNA, 21 nt, Homo sapiens
agucagaggagaagagacaug

SEQ ID NO: 1126928 - RNA, 14 nt, Homo sapiens
agucaugcacucag

SEQ ID NO: 1126929 - RNA, 15 nt, Homo sapiens
agucaugcacucagg

SEQ ID NO: 1126930 - RNA, 22 nt, Homo sapiens
aguccuccagacaacccucaga

SEQ ID NO: 1126931 - RNA, 21 nt, Homo sapiens
aguccugcaaguccauagcug

SEQ ID NO: 1126932 - RNA, 24 nt, Homo sapiens
aguccugggaauaugcuagugaug

SEQ ID NO: 1126933 - RNA, 22 nt, Homo sapiens
agucuggcaaugggacucugag

SEQ ID NO: 1126934 - RNA, 14 nt, Homo sapiens
agucuuggcucacu

SEQ ID NO: 1126935 - RNA, 18 nt, Homo sapiens
agugaaaaaaacaaccua

SEQ ID NO: 1126936 - RNA, 16 nt, Homo sapiens
agugaaacauugaacu

SEQ ID NO: 1126937 - RNA, 21 nt, Homo sapiens
agugacaugugcuggacacug

SEQ ID NO: 1126938 - RNA, 18 nt, Homo sapiens
agugaucuguguucaaaa

SEQ ID NO: 1126939 - RNA, 16 nt, Homo sapiens
agugauguacgagcug

SEQ ID NO: 1126940 - RNA, 17 nt, Homo sapiens
agugauuugggggugca

SEQ ID NO: 1126941 - RNA, 20 nt, Homo sapiens
agugcaauuuccccucugug

SEQ ID NO: 1126942 - RNA, 16 nt, Homo sapiens
agugcuccugugugcu

SEQ ID NO: 1126943 - RNA, 17 nt, Homo sapiens
aguguucaguguugaca

SEQ ID NO: 1126944 - RNA, 18 nt, Homo sapiens
aguguugacauagccuuu

SEQ ID NO: 1126945 - RNA, 17 nt, Homo sapiens
aguguugugaaacugua

SEQ ID NO: 1126946 - RNA, 14 nt, Homo sapiens
aguucucauccaca

SEQ ID NO: 1126947 - RNA, 17 nt, Homo sapiens
aguucucauccacagag

SEQ ID NO: 1126948 - RNA, 19 nt, Homo sapiens
aguugcugcauuccuaaac

SEQ ID NO: 1126949 - RNA, 18 nt, Homo sapiens
aguuggccaugaugucuu

SEQ ID NO: 1126950 - RNA, 13 nt, Homo sapiens
aguuuaaccuaaa

SEQ ID NO: 1126951 - RNA, 16 nt, Homo sapiens
auaaaaaugcaacgcu

SEQ ID NO: 1126952 - RNA, 19 nt, Homo sapiens
auaaaacaaaaccaacuca

SEQ ID NO: 1126953 - RNA, 14 nt, Homo sapiens
auaaacuacuguaa

SEQ ID NO: 1126954 - RNA, 17 nt, Homo sapiens
auaauaaugccuagugg

SEQ ID NO: 1126955 - RNA, 14 nt, Homo sapiens
auaauauacuguac

SEQ ID NO: 1126956 - RNA, 20 nt, Homo sapiens
auaauuuucuacaaccuaag

SEQ ID NO: 1126957 - RNA, 12 nt, Homo sapiens
auagauaaguca

SEQ ID NO: 1126958 - RNA, 15 nt, Homo sapiens
auagauaagucaaua

SEQ ID NO: 1126959 - RNA, 15 nt, Homo sapiens
auagauuucuauaaa

SEQ ID NO: 1126960 - RNA, 18 nt, Homo sapiens
auagguucaaaagcaauc

SEQ ID NO: 1126961 - RNA, 18 nt, Homo sapiens
auaguuguugaguauucc

SEQ ID NO: 1126962 - RNA, 12 nt, Homo sapiens
auauacuaauau

SEQ ID NO: 1126963 - RNA, 16 nt, Homo sapiens
auauaugcaggaaaga

SEQ ID NO: 1126964 - RNA, 15 nt, Homo sapiens
aucacagucuacuga

SEQ ID NO: 1126965 - RNA, 17 nt, Homo sapiens
aucacauucaggcaugc

SEQ ID NO: 1126966 - RNA, 23 nt, Homo sapiens
aucagaguggccaaucccugugu

SEQ ID NO: 1126967 - RNA, 18 nt, Homo sapiens
auccacaacuuguaccaa

SEQ ID NO: 1126968 - RNA, 19 nt, Homo sapiens
auccgccucugagccagga

SEQ ID NO: 1126969 - RNA, 21 nt, Homo sapiens
auccuaucacagucuacugac

SEQ ID NO: 1126970 - RNA, 16 nt, Homo sapiens
aucuaugccacucaga

SEQ ID NO: 1126971 - RNA, 17 nt, Homo sapiens
aucuccacaccaaaguc

SEQ ID NO: 1126972 - RNA, 20 nt, Homo sapiens
aucucuggccauauccugcc

SEQ ID NO: 1126973 - RNA, 22 nt, Homo sapiens
aucuggucugaauaacacugga

SEQ ID NO: 1126974 - RNA, 23 nt, Homo sapiens
aucuguugauauuaaagaaucaa

SEQ ID NO: 1126975 - RNA, 18 nt, Homo sapiens
augaaguaaggagaggga

SEQ ID NO: 1126976 - RNA, 16 nt, Homo sapiens
augaauaauacauuga

SEQ ID NO: 1126977 - RNA, 15 nt, Homo sapiens
augaaugacaugacc

SEQ ID NO: 1126978 - RNA, 19 nt, Homo sapiens
augccaauaaagugaucug

SEQ ID NO: 1126979 - RNA, 17 nt, Homo sapiens
augccacucagaaucuc

SEQ ID NO: 1126980 - RNA, 20 nt, Homo sapiens
augccagcuguacugaguuc

SEQ ID NO: 1126981 - RNA, 12 nt, Homo sapiens
augcuagugaua

SEQ ID NO: 1126982 - RNA, 18 nt, Homo sapiens
auggagaaauaggaccuu

SEQ ID NO: 1126983 - RNA, 17 nt, Homo sapiens
auggcacauggcuggca

SEQ ID NO: 1126984 - RNA, 16 nt, Homo sapiens
auggcuggcacugagc

SEQ ID NO: 1126985 - RNA, 15 nt, Homo sapiens
auggguaacacugau

SEQ ID NO: 1126986 - RNA, 16 nt, Homo sapiens
augggucccucagucu

SEQ ID NO: 1126987 - RNA, 21 nt, Homo sapiens
auggucacgagguccagaccc

SEQ ID NO: 1126988 - RNA, 21 nt, Homo sapiens
augguccuugucccaagccca

SEQ ID NO: 1126989 - RNA, 21 nt, Homo sapiens
auggugagagauaagaucuau

SEQ ID NO: 1126990 - RNA, 19 nt, Homo sapiens
auguagccuggcccuggaa

SEQ ID NO: 1126991 - RNA, 17 nt, Homo sapiens
auguauaaagacaccuu

SEQ ID NO: 1126992 - RNA, 21 nt, Homo sapiens
augucuuuaagguagcaucau

SEQ ID NO: 1126993 - RNA, 17 nt, Homo sapiens
augugcuggacacuguc

SEQ ID NO: 1126994 - RNA, 23 nt, Homo sapiens
augugcuggacacuguccaugaa

SEQ ID NO: 1126995 - RNA, 18 nt, Homo sapiens
auguggccaagggcucca

SEQ ID NO: 1126996 - RNA, 22 nt, Homo sapiens
augugucccagccacaguguua

SEQ ID NO: 1126997 - RNA, 21 nt, Homo sapiens
auguuccuuucgaaagcaaug

SEQ ID NO: 1126998 - RNA, 22 nt, Homo sapiens
auuaaaauuggaugcuagagaa

SEQ ID NO: 1126999 - RNA, 13 nt, Homo sapiens
auuaccuauucaa

SEQ ID NO: 1127000 - RNA, 15 nt, Homo sapiens
auuccaugugaaaau

SEQ ID NO: 1127001 - RNA, 18 nt, Homo sapiens
auucccccaucuagccau

SEQ ID NO: 1127002 - RNA, 18 nt, Homo sapiens
auucccccuaagaggcag

SEQ ID NO: 1127003 - RNA, 18 nt, Homo sapiens
auucuuaauagguucaaa

SEQ ID NO: 1127004 - RNA, 17 nt, Homo sapiens
auugaaguccuccagac

SEQ ID NO: 1127005 - RNA, 20 nt, Homo sapiens
auugagugcuccugugugcu

SEQ ID NO: 1127006 - RNA, 23 nt, Homo sapiens
auugcuuauguaugccuauucag

SEQ ID NO: 1127007 - RNA, 13 nt, Homo sapiens
auuuaguuucaua

SEQ ID NO: 1127008 - RNA, 13 nt, Homo sapiens
auuugccaaagug

SEQ ID NO: 1127009 - RNA, 15 nt, Homo sapiens
auuuucacucugggc

SEQ ID NO: 1127010 - RNA, 22 nt, Homo sapiens
caaaauuucaaaagugaucugu

SEQ ID NO: 1127011 - RNA, 14 nt, Homo sapiens
caaaccgcaggcaa

SEQ ID NO: 1127012 - RNA, 23 nt, Homo sapiens
caaagccccuacaacuccagcca

SEQ ID NO: 1127013 - RNA, 16 nt, Homo sapiens
caaaggaagacuugaa

SEQ ID NO: 1127014 - RNA, 13 nt, Homo sapiens
caaagggugggca

SEQ ID NO: 1127015 - RNA, 20 nt, Homo sapiens
caaauaguucugaacauuuu

SEQ ID NO: 1127016 - RNA, 21 nt, Homo sapiens
caaaucuaguuuccuauggaa

SEQ ID NO: 1127017 - RNA, 21 nt, Homo sapiens
caaaucuugguugaugccaaa

SEQ ID NO: 1127018 - RNA, 16 nt, Homo sapiens
caaaugggucccucag

SEQ ID NO: 1127019 - RNA, 20 nt, Homo sapiens
caacagccugacaacauuuc

SEQ ID NO: 1127020 - RNA, 14 nt, Homo sapiens
caacccucacugug

SEQ ID NO: 1127021 - RNA, 20 nt, Homo sapiens
caacccucagauuugaugau

SEQ ID NO: 1127022 - RNA, 17 nt, Homo sapiens
caacuccagccacccag

SEQ ID NO: 1127023 - RNA, 12 nt, Homo sapiens
caacugagaucu

SEQ ID NO: 1127024 - RNA, 16 nt, Homo sapiens
caagaggacugagacu

SEQ ID NO: 1127025 - RNA, 16 nt, Homo sapiens
caaggcauccaugaaa

SEQ ID NO: 1127026 - RNA, 24 nt, Homo sapiens
caaguccugggaauaugcuaguga

SEQ ID NO: 1127027 - RNA, 19 nt, Homo sapiens
caagugauuugggggugca

SEQ ID NO: 1127028 - RNA, 18 nt, Homo sapiens
caauuucucugaggacac

SEQ ID NO: 1127029 - RNA, 18 nt, Homo sapiens
cacaccaaagucagggag

SEQ ID NO: 1127030 - RNA, 10 nt, Homo sapiens
cacaccucau

SEQ ID NO: 1127031 - RNA, 20 nt, Homo sapiens
cacacuguaaauauccacag

SEQ ID NO: 1127032 - RNA, 19 nt, Homo sapiens
cacauaacuucucugaguc

SEQ ID NO: 1127033 - RNA, 16 nt, Homo sapiens
caccaaugcaacauuu

SEQ ID NO: 1127034 - RNA, 19 nt, Homo sapiens
caccucagacaauccacuc

SEQ ID NO: 1127035 - RNA, 18 nt, Homo sapiens
cacgcuuuuugaaaaagc

SEQ ID NO: 1127036 - RNA, 14 nt, Homo sapiens
cacuauuuccauug

SEQ ID NO: 1127037 - RNA, 15 nt, Homo sapiens
cacucaauuucucug

SEQ ID NO: 1127038 - RNA, 17 nt, Homo sapiens
cacucggcuuccaggga

SEQ ID NO: 1127039 - RNA, 17 nt, Homo sapiens
cacucuucccaccucag

SEQ ID NO: 1127040 - RNA, 22 nt, Homo sapiens
cacuguguuggaggauggcacu

SEQ ID NO: 1127041 - RNA, 23 nt, Homo sapiens
cacuuugugaucucauggcuuug

SEQ ID NO: 1127042 - RNA, 14 nt, Homo sapiens
cagaaacucuggaa

SEQ ID NO: 1127043 - RNA, 21 nt, Homo sapiens
cagaauaaauggguaacacug

SEQ ID NO: 1127044 - RNA, 21 nt, Homo sapiens
cagacuugccaggcucccuuu

SEQ ID NO: 1127045 - RNA, 18 nt, Homo sapiens
cagagaagccccuaggca

SEQ ID NO: 1127046 - RNA, 23 nt, Homo sapiens
cagagucgcuuuugccuuuucaa

SEQ ID NO: 1127047 - RNA, 14 nt, Homo sapiens
cagagucugucucu

SEQ ID NO: 1127048 - RNA, 15 nt, Homo sapiens
cagauaggauggggu

SEQ ID NO: 1127049 - RNA, 23 nt, Homo sapiens
cagaugccaaccagacaccuccu

SEQ ID NO: 1127050 - RNA, 13 nt, Homo sapiens
cagcaaaauguga

SEQ ID NO: 1127051 - RNA, 19 nt, Homo sapiens
cagcaaggauggagcugaa

SEQ ID NO: 1127052 - RNA, 20 nt, Homo sapiens
cagcauaccuuggacugacu

SEQ ID NO: 1127053 - RNA, 14 nt, Homo sapiens
cagcauucaggggu

SEQ ID NO: 1127054 - RNA, 17 nt, Homo sapiens
cagccacaguguuaugc

SEQ ID NO: 1127055 - RNA, 19 nt, Homo sapiens
cagccagcgccucccucca

SEQ ID NO: 1127056 - RNA, 21 nt, Homo sapiens
cagcccaagaggacugagacu

SEQ ID NO: 1127057 - RNA, 14 nt, Homo sapiens
cagccuuacaauac

SEQ ID NO: 1127058 - RNA, 20 nt, Homo sapiens
cagcucaaguuagcauuuca

SEQ ID NO: 1127059 - RNA, 16 nt, Homo sapiens
cagcugaugaacugug

SEQ ID NO: 1127060 - RNA, 18 nt, Homo sapiens
cagcugcuucugugcauu

SEQ ID NO: 1127061 - RNA, 19 nt, Homo sapiens
cagcuguacugaguucuca

SEQ ID NO: 1127062 - RNA, 20 nt, Homo sapiens
caggaaagaauagaagugau

SEQ ID NO: 1127063 - RNA, 18 nt, Homo sapiens
caggaggggcuguccaau

SEQ ID NO: 1127064 - RNA, 17 nt, Homo sapiens
caggcugggauggagca

SEQ ID NO: 1127065 - RNA, 13 nt, Homo sapiens
cagggagcccuuu

SEQ ID NO: 1127066 - RNA, 23 nt, Homo sapiens
cagggccuggccugguccaggcu

SEQ ID NO: 1127067 - RNA, 17 nt, Homo sapiens
caggggacacugaaccu

SEQ ID NO: 1127068 - RNA, 19 nt, Homo sapiens
cagguguaagccaccgugc

SEQ ID NO: 1127069 - RNA, 13 nt, Homo sapiens
caguaaaaaucca

SEQ ID NO: 1127070 - RNA, 17 nt, Homo sapiens
caguaaaaauccacuau

SEQ ID NO: 1127071 - RNA, 16 nt, Homo sapiens
caguccaagaccccaa

SEQ ID NO: 1127072 - RNA, 16 nt, Homo sapiens
cagucucagaaagccu

SEQ ID NO: 1127073 - RNA, 16 nt, Homo sapiens
cagucuuggcucacua

SEQ ID NO: 1127074 - RNA, 22 nt, Homo sapiens
cagucuuggcucacuacagccu

SEQ ID NO: 1127075 - RNA, 18 nt, Homo sapiens
cagugagaagacuggcag

SEQ ID NO: 1127076 - RNA, 23 nt, Homo sapiens
caguguugacauagccuuugugc

SEQ ID NO: 1127077 - RNA, 15 nt, Homo sapiens
caguucuacugaccu

SEQ ID NO: 1127078 - RNA, 17 nt, Homo sapiens
caguuuuugacuucaua

SEQ ID NO: 1127079 - RNA, 21 nt, Homo sapiens
cauaacuucucugagucugaa

SEQ ID NO: 1127080 - RNA, 11 nt, Homo sapiens
cauagcacugc

SEQ ID NO: 1127081 - RNA, 20 nt, Homo sapiens
cauaucuccuuccccuacac

SEQ ID NO: 1127082 - RNA, 15 nt, Homo sapiens
cauccugugugcuga

SEQ ID NO: 1127083 - RNA, 17 nt, Homo sapiens
caugaaagauaagcuuu

SEQ ID NO: 1127084 - RNA, 16 nt, Homo sapiens
caugaggacaaagugu

SEQ ID NO: 1127085 - RNA, 14 nt, Homo sapiens
caugcacucaggca

SEQ ID NO: 1127086 - RNA, 23 nt, Homo sapiens
caugccuggagacauaucacuca

SEQ ID NO: 1127087 - RNA, 15 nt, Homo sapiens
cauggagaaacaucc

SEQ ID NO: 1127088 - RNA, 17 nt, Homo sapiens
caugugcuggacacugu

SEQ ID NO: 1127089 - RNA, 20 nt, Homo sapiens
caugugcuggacacugucca

SEQ ID NO: 1127090 - RNA, 22 nt, Homo sapiens
cauucaguggcccacauuuucc

SEQ ID NO: 1127091 - RNA, 17 nt, Homo sapiens
cauucccucucauccag

SEQ ID NO: 1127092 - RNA, 19 nt, Homo sapiens
cauuccuucacucauccag

SEQ ID NO: 1127093 - RNA, 21 nt, Homo sapiens
cauuucaucucauuuaaggga

SEQ ID NO: 1127094 - RNA, 19 nt, Homo sapiens
ccaaaaccuuccucuucca

SEQ ID NO: 1127095 - RNA, 15 nt, Homo sapiens
ccaaagccaccaaga

SEQ ID NO: 1127096 - RNA, 15 nt, Homo sapiens
ccaaagugacacaga

SEQ ID NO: 1127097 - RNA, 20 nt, Homo sapiens
ccaaaugcuuuuugaucugu

SEQ ID NO: 1127098 - RNA, 14 nt, Homo sapiens
ccaacccuauccca

SEQ ID NO: 1127099 - RNA, 22 nt, Homo sapiens
ccaagaccccaaaucaccacaa

SEQ ID NO: 1127100 - RNA, 24 nt, Homo sapiens
ccaaguccugggaauaugcuagug

SEQ ID NO: 1127101 - RNA, 19 nt, Homo sapiens
ccaauaaagugaucugugu

SEQ ID NO: 1127102 - RNA, 14 nt, Homo sapiens
ccacaaugccucuc

SEQ ID NO: 1127103 - RNA, 13 nt, Homo sapiens
ccacacagggugc

SEQ ID NO: 1127104 - RNA, 16 nt, Homo sapiens
ccacacagggugcaug

SEQ ID NO: 1127105 - RNA, 12 nt, Homo sapiens
ccacagcacuau

SEQ ID NO: 1127106 - RNA, 21 nt, Homo sapiens
ccaccuaaaaacauuuacuga

SEQ ID NO: 1127107 - RNA, 15 nt, Homo sapiens
ccaccuccaaggacu

SEQ ID NO: 1127108 - RNA, 16 nt, Homo sapiens
ccacgaugucaaggac

SEQ ID NO: 1127109 - RNA, 17 nt, Homo sapiens
ccacucauuucaucuca

SEQ ID NO: 1127110 - RNA, 16 nt, Homo sapiens
ccagcucuaguuuuca

SEQ ID NO: 1127111 - RNA, 20 nt, Homo sapiens
ccaggacucucuuucuucca

SEQ ID NO: 1127112 - RNA, 20 nt, Homo sapiens
ccaguaaaaauccacuauuu

SEQ ID NO: 1127113 - RNA, 20 nt, Homo sapiens
ccauaaggcacuuaucccug

SEQ ID NO: 1127114 - RNA, 15 nt, Homo sapiens
ccauacuacccucau

SEQ ID NO: 1127115 - RNA, 17 nt, Homo sapiens
ccaucaugcuugauuga

SEQ ID NO: 1127116 - RNA, 14 nt, Homo sapiens
ccaucuagccauuu

SEQ ID NO: 1127117 - RNA, 18 nt, Homo sapiens
ccaucugcuugguuggcu

SEQ ID NO: 1127118 - RNA, 12 nt, Homo sapiens
ccaugugaaaau

SEQ ID NO: 1127119 - RNA, 21 nt, Homo sapiens
ccauugauucuucagaacuuu

SEQ ID NO: 1127120 - RNA, 12 nt, Homo sapiens
cccaaaucugca

SEQ ID NO: 1127121 - RNA, 22 nt, Homo sapiens
cccaagaggacugagacuggca

SEQ ID NO: 1127122 - RNA, 15 nt, Homo sapiens
cccaauccccagacu

SEQ ID NO: 1127123 - RNA, 16 nt, Homo sapiens
cccaauccccagacuc

SEQ ID NO: 1127124 - RNA, 20 nt, Homo sapiens
cccacagcacuacgaugugu

SEQ ID NO: 1127125 - RNA, 15 nt, Homo sapiens
cccacaugaucuuga

SEQ ID NO: 1127126 - RNA, 18 nt, Homo sapiens
cccagcccucaguuuuca

SEQ ID NO: 1127127 - RNA, 14 nt, Homo sapiens
cccaguccaagacc

SEQ ID NO: 1127128 - RNA, 18 nt, Homo sapiens
cccaugaggacaaagugu

SEQ ID NO: 1127129 - RNA, 21 nt, Homo sapiens
ccccagacucuucauucagug

SEQ ID NO: 1127130 - RNA, 22 nt, Homo sapiens
ccccaggcaucuguuagcagag

SEQ ID NO: 1127131 - RNA, 18 nt, Homo sapiens
ccccaguucuacugaccu

SEQ ID NO: 1127132 - RNA, 22 nt, Homo sapiens
cccccuggaagcugauucacua

SEQ ID NO: 1127133 - RNA, 16 nt, Homo sapiens
ccccuaagaggcagug

SEQ ID NO: 1127134 - RNA, 21 nt, Homo sapiens
ccccucccuggaugacauuaa

SEQ ID NO: 1127135 - RNA, 16 nt, Homo sapiens
cccuacaacuccagcc

SEQ ID NO: 1127136 - RNA, 17 nt, Homo sapiens
cccuaggauacccagau

SEQ ID NO: 1127137 - RNA, 16 nt, Homo sapiens
cccuauggaagucuca

SEQ ID NO: 1127138 - RNA, 18 nt, Homo sapiens
cccuccugaggucuggau

SEQ ID NO: 1127139 - RNA, 22 nt, Homo sapiens
cccucuucuucucccugugugg

SEQ ID NO: 1127140 - RNA, 15 nt, Homo sapiens
cccuggaugacauua

SEQ ID NO: 1127141 - RNA, 23 nt, Homo sapiens
cccuuuagggaaauucaaagcag

SEQ ID NO: 1127142 - RNA, 18 nt, Homo sapiens
ccgagcuagagugcagug

SEQ ID NO: 1127143 - RNA, 17 nt, Homo sapiens
ccgucuccucuccagcc

SEQ ID NO: 1127144 - RNA, 17 nt, Homo sapiens
ccuaaacaucauucauu

SEQ ID NO: 1127145 - RNA, 22 nt, Homo sapiens
ccuagagaaggcugugagccaa

SEQ ID NO: 1127146 - RNA, 20 nt, Homo sapiens
ccuagccaggcuaucuggcc

SEQ ID NO: 1127147 - RNA, 20 nt, Homo sapiens
ccuaggauacccagaugcca

SEQ ID NO: 1127148 - RNA, 18 nt, Homo sapiens
ccuauaaggagaguucaa

SEQ ID NO: 1127149 - RNA, 14 nt, Homo sapiens
ccuauuguaguaaa

SEQ ID NO: 1127150 - RNA, 17 nt, Homo sapiens
ccucaauccuaucacag

SEQ ID NO: 1127151 - RNA, 19 nt, Homo sapiens
ccucagacaauccacucuc

SEQ ID NO: 1127152 - RNA, 22 nt, Homo sapiens
ccucaucugcaaagcauggaga

SEQ ID NO: 1127153 - RNA, 16 nt, Homo sapiens
ccucccaaucuugccc

SEQ ID NO: 1127154 - RNA, 18 nt, Homo sapiens
ccuccccaguucuacuga

SEQ ID NO: 1127155 - RNA, 22 nt, Homo sapiens
ccucccucgcauccgccucuga

SEQ ID NO: 1127156 - RNA, 23 nt, Homo sapiens
ccucgggggaaagcacaccucau

SEQ ID NO: 1127157 - RNA, 21 nt, Homo sapiens
ccucucccgcgggccuggaca

SEQ ID NO: 1127158 - RNA, 18 nt, Homo sapiens
ccucuuuccugugccagg

SEQ ID NO: 1127159 - RNA, 20 nt, Homo sapiens
ccugacacaggggacacuga

SEQ ID NO: 1127160 - RNA, 21 nt, Homo sapiens
ccugacauuaagacacaccuc

SEQ ID NO: 1127161 - RNA, 17 nt, Homo sapiens
ccugagccccucaaucc

SEQ ID NO: 1127162 - RNA, 19 nt, Homo sapiens
ccugagccccucaauccua

SEQ ID NO: 1127163 - RNA, 15 nt, Homo sapiens
ccugcggcccagaag

SEQ ID NO: 1127164 - RNA, 22 nt, Homo sapiens
ccugcugugcccucccauagca

SEQ ID NO: 1127165 - RNA, 14 nt, Homo sapiens
ccugcuuaccugac

SEQ ID NO: 1127166 - RNA, 12 nt, Homo sapiens
ccuggaugacau

SEQ ID NO: 1127167 - RNA, 20 nt, Homo sapiens
ccuggguggggcagggccug

SEQ ID NO: 1127168 - RNA, 14 nt, Homo sapiens
ccugugggaguaga

SEQ ID NO: 1127169 - RNA, 17 nt, Homo sapiens
ccuucccucuucuucuc

SEQ ID NO: 1127170 - RNA, 18 nt, Homo sapiens
ccuucucuucuauccugc

SEQ ID NO: 1127171 - RNA, 21 nt, Homo sapiens
ccuuggaaaugaccaggccaa

SEQ ID NO: 1127172 - RNA, 19 nt, Homo sapiens
ccuugggagguuuuauucu

SEQ ID NO: 1127173 - RNA, 12 nt, Homo sapiens
ccuugugucugu

SEQ ID NO: 1127174 - RNA, 15 nt, Homo sapiens
ccuuucccuagagaa

SEQ ID NO: 1127175 - RNA, 21 nt, Homo sapiens
ccuuuucaaaaccuaaaaaca

SEQ ID NO: 1127176 - RNA, 15 nt, Homo sapiens
cgcaccagacacuca

SEQ ID NO: 1127177 - RNA, 14 nt, Homo sapiens
cgcagcgggugguc

SEQ ID NO: 1127178 - RNA, 13 nt, Homo sapiens
cgcggagguccug

SEQ ID NO: 1127179 - RNA, 16 nt, Homo sapiens
cggagguccugcuacc

SEQ ID NO: 1127180 - RNA, 17 nt, Homo sapiens
cggcccagaaguuuccc

SEQ ID NO: 1127181 - RNA, 20 nt, Homo sapiens
cgugccagcucuaguuuuca

SEQ ID NO: 1127182 - RNA, 20 nt, Homo sapiens
cguggccgagggcuucccua

SEQ ID NO: 1127183 - RNA, 18 nt, Homo sapiens
cuaaacaagggcagugag

SEQ ID NO: 1127184 - RNA, 17 nt, Homo sapiens
cuaaacuuuccaaaacc

SEQ ID NO: 1127185 - RNA, 16 nt, Homo sapiens
cuaaauaccucaauca

SEQ ID NO: 1127186 - RNA, 15 nt, Homo sapiens
cuaacuccagucucc

SEQ ID NO: 1127187 - RNA, 15 nt, Homo sapiens
cuaacuuauccuaaa

SEQ ID NO: 1127188 - RNA, 21 nt, Homo sapiens
cuaaguguugugaaacuguaa

SEQ ID NO: 1127189 - RNA, 23 nt, Homo sapiens
cuaaucagaguggccaaucccug

SEQ ID NO: 1127190 - RNA, 19 nt, Homo sapiens
cuacagccuccucggggga

SEQ ID NO: 1127191 - RNA, 16 nt, Homo sapiens
cuacuuucauacugaa

SEQ ID NO: 1127192 - RNA, 21 nt, Homo sapiens
cuagagaaggcugugagccaa

SEQ ID NO: 1127193 - RNA, 14 nt, Homo sapiens
cuagagcucaggcc

SEQ ID NO: 1127194 - RNA, 20 nt, Homo sapiens
cuagagugcgguggcgcgau

SEQ ID NO: 1127195 - RNA, 21 nt, Homo sapiens
cuagugccugagaugcacgau

SEQ ID NO: 1127196 - RNA, 13 nt, Homo sapiens
cuaucaguucccu

SEQ ID NO: 1127197 - RNA, 22 nt, Homo sapiens
cuauuaguaguuaauucuguca

SEQ ID NO: 1127198 - RNA, 18 nt, Homo sapiens
cuauuaguuuucuuugua

SEQ ID NO: 1127199 - RNA, 11 nt, Homo sapiens
cuauuuccauu

SEQ ID NO: 1127200 - RNA, 14 nt, Homo sapiens
cucaauccuaucac

SEQ ID NO: 1127201 - RNA, 21 nt, Homo sapiens
cucaauuucucugaggacaca

SEQ ID NO: 1127202 - RNA, 22 nt, Homo sapiens
cucacagcaaggauggagcuga

SEQ ID NO: 1127203 - RNA, 15 nt, Homo sapiens
cucacucggcuucca

SEQ ID NO: 1127204 - RNA, 19 nt, Homo sapiens
cucacuggggucugugugg

SEQ ID NO: 1127205 - RNA, 23 nt, Homo sapiens
cucagccgugcacucccuaagaa

SEQ ID NO: 1127206 - RNA, 17 nt, Homo sapiens
cucaggggugauucuga

SEQ ID NO: 1127207 - RNA, 17 nt, Homo sapiens
cucauggcuuugauuga

SEQ ID NO: 1127208 - RNA, 16 nt, Homo sapiens
cucauuccuucacuca

SEQ ID NO: 1127209 - RNA, 14 nt, Homo sapiens
cucccacagaggag

SEQ ID NO: 1127210 - RNA, 15 nt, Homo sapiens
cucccgaauccugag

SEQ ID NO: 1127211 - RNA, 17 nt, Homo sapiens
cucccucuccauaucuc

SEQ ID NO: 1127212 - RNA, 16 nt, Homo sapiens
cucccuggaugacauu

SEQ ID NO: 1127213 - RNA, 20 nt, Homo sapiens
cucccuguagcucugccucc

SEQ ID NO: 1127214 - RNA, 19 nt, Homo sapiens
cucccuguguggcugcuga

SEQ ID NO: 1127215 - RNA, 18 nt, Homo sapiens
cuccuccaucucuggcca

SEQ ID NO: 1127216 - RNA, 19 nt, Homo sapiens
cuccugagccccucaaucc

SEQ ID NO: 1127217 - RNA, 14 nt, Homo sapiens
cuccugugugcugg

SEQ ID NO: 1127218 - RNA, 12 nt, Homo sapiens
cuccuugauaaa

SEQ ID NO: 1127219 - RNA, 17 nt, Homo sapiens
cucucaagcuagccaga

SEQ ID NO: 1127220 - RNA, 18 nt, Homo sapiens
cucucuauaaguguucag

SEQ ID NO: 1127221 - RNA, 23 nt, Homo sapiens
cucucuauaaguguucaguguug

SEQ ID NO: 1127222 - RNA, 20 nt, Homo sapiens
cucugagaacuccucauucc

SEQ ID NO: 1127223 - RNA, 15 nt, Homo sapiens
cucugaggacacaga

SEQ ID NO: 1127224 - RNA, 16 nt, Homo sapiens
cucugggcagcuguca

SEQ ID NO: 1127225 - RNA, 14 nt, Homo sapiens
cugaauaacacugg

SEQ ID NO: 1127226 - RNA, 16 nt, Homo sapiens
cugacacaggggacac

SEQ ID NO: 1127227 - RNA, 17 nt, Homo sapiens
cugaccucgugauccac

SEQ ID NO: 1127228 - RNA, 13 nt, Homo sapiens
cugacuaccagcu

SEQ ID NO: 1127229 - RNA, 14 nt, Homo sapiens
cugacuaccagcua

SEQ ID NO: 1127230 - RNA, 23 nt, Homo sapiens
cugagagaguggagagugacaug

SEQ ID NO: 1127231 - RNA, 21 nt, Homo sapiens
cugagaucuccaugacugugu

SEQ ID NO: 1127232 - RNA, 20 nt, Homo sapiens
cugagcagaagcuggaggca

SEQ ID NO: 1127233 - RNA, 19 nt, Homo sapiens
cugagccaaacacacugua

SEQ ID NO: 1127234 - RNA, 22 nt, Homo sapiens
cugagccaaacacacuguaaau

SEQ ID NO: 1127235 - RNA, 23 nt, Homo sapiens
cugagccccucaauccuaucaca

SEQ ID NO: 1127236 - RNA, 21 nt, Homo sapiens
cugaggcccagaaagaggcag

SEQ ID NO: 1127237 - RNA, 20 nt, Homo sapiens
cugaggggauaucccuaugu

SEQ ID NO: 1127238 - RNA, 19 nt, Homo sapiens
cugcagagcugacccagag

SEQ ID NO: 1127239 - RNA, 19 nt, Homo sapiens
cugcccccaucccacauga

SEQ ID NO: 1127240 - RNA, 16 nt, Homo sapiens
cugccugcggcccaga

SEQ ID NO: 1127241 - RNA, 22 nt, Homo sapiens
cugcuacccaguaaaaauccac

SEQ ID NO: 1127242 - RNA, 16 nt, Homo sapiens
cugcugaggacaaugu

SEQ ID NO: 1127243 - RNA, 22 nt, Homo sapiens
cugcugugcccucccauagcac

SEQ ID NO: 1127244 - RNA, 18 nt, Homo sapiens
cugcuucugugcauuugu

SEQ ID NO: 1127245 - RNA, 15 nt, Homo sapiens
cuggaauuauuuuag

SEQ ID NO: 1127246 - RNA, 14 nt, Homo sapiens
cuggaugacauuaa

SEQ ID NO: 1127247 - RNA, 11 nt, Homo sapiens
cuggcacugag

SEQ ID NO: 1127248 - RNA, 18 nt, Homo sapiens
cuggcacuuagcccaaga

SEQ ID NO: 1127249 - RNA, 19 nt, Homo sapiens
cuggcacuuagcccaagag

SEQ ID NO: 1127250 - RNA, 22 nt, Homo sapiens
cuggccaugccuggagacauau

SEQ ID NO: 1127251 - RNA, 17 nt, Homo sapiens
cuggccugauugcagag

SEQ ID NO: 1127252 - RNA, 23 nt, Homo sapiens
cuggcugaaccaaagaaacaauu

SEQ ID NO: 1127253 - RNA, 12 nt, Homo sapiens
cugggaagacaa

SEQ ID NO: 1127254 - RNA, 13 nt, Homo sapiens
cugggauggggca

SEQ ID NO: 1127255 - RNA, 23 nt, Homo sapiens
cugggauuacagguguaagccac

SEQ ID NO: 1127256 - RNA, 24 nt, Homo sapiens
cugggcgcugucuugugucuccua

SEQ ID NO: 1127257 - RNA, 17 nt, Homo sapiens
cuggggaauacuggcca

SEQ ID NO: 1127258 - RNA, 21 nt, Homo sapiens
cugggugguguacaagcauuu

SEQ ID NO: 1127259 - RNA, 23 nt, Homo sapiens
cuguaaacuauaaacuacuguaa

SEQ ID NO: 1127260 - RNA, 16 nt, Homo sapiens
cuguaauuaagugcaa

SEQ ID NO: 1127261 - RNA, 14 nt, Homo sapiens
cugucauauuauga

SEQ ID NO: 1127262 - RNA, 19 nt, Homo sapiens
cugucauggaaaagcccag

SEQ ID NO: 1127263 - RNA, 20 nt, Homo sapiens
cuguccaugaagcacugagc

SEQ ID NO: 1127264 - RNA, 13 nt, Homo sapiens
cugugaugccuga

SEQ ID NO: 1127265 - RNA, 13 nt, Homo sapiens
cuuaaauaagucu

SEQ ID NO: 1127266 - RNA, 18 nt, Homo sapiens
cuuagccucccaaagugc

SEQ ID NO: 1127267 - RNA, 16 nt, Homo sapiens
cuuaggaaccuaccag

SEQ ID NO: 1127268 - RNA, 23 nt, Homo sapiens
cuuaggugugagguccaggguug

SEQ ID NO: 1127269 - RNA, 18 nt, Homo sapiens
cuuauccccucagaaucc

SEQ ID NO: 1127270 - RNA, 20 nt, Homo sapiens
cuucagaacuuucugcaguu

SEQ ID NO: 1127271 - RNA, 20 nt, Homo sapiens
cuucaucgaacaaacugaug

SEQ ID NO: 1127272 - RNA, 20 nt, Homo sapiens
cuuccuaaacuuuccaaaac

SEQ ID NO: 1127273 - RNA, 22 nt, Homo sapiens
cuuccucucaagcuagccagag

SEQ ID NO: 1127274 - RNA, 14 nt, Homo sapiens
cuucuagaaaacau

SEQ ID NO: 1127275 - RNA, 16 nt, Homo sapiens
cuucuauccugcaauu

SEQ ID NO: 1127276 - RNA, 16 nt, Homo sapiens
cuucucuucuauccug

SEQ ID NO: 1127277 - RNA, 14 nt, Homo sapiens
cuucugacaagcaa

SEQ ID NO: 1127278 - RNA, 16 nt, Homo sapiens
cuucugcgcuguuguu

SEQ ID NO: 1127279 - RNA, 18 nt, Homo sapiens
cuuuagcuguacuguaau

SEQ ID NO: 1127280 - RNA, 14 nt, Homo sapiens
cuuuccaaaaccuu

SEQ ID NO: 1127281 - RNA, 16 nt, Homo sapiens
cuuuccaaaaccuucc

SEQ ID NO: 1127282 - RNA, 16 nt, Homo sapiens
cuuucuucaccaaauc

SEQ ID NO: 1127283 - RNA, 15 nt, Homo sapiens
cuuugaaaacauaca

SEQ ID NO: 1127284 - RNA, 14 nt, Homo sapiens
cuuugcagcaauga

SEQ ID NO: 1127285 - RNA, 20 nt, Homo sapiens
cuuugcauccuaaggacgaa

SEQ ID NO: 1127286 - RNA, 20 nt, Homo sapiens
cuuuuccuccaaccuguggc

SEQ ID NO: 1127287 - RNA, 18 nt, Homo sapiens
gaaaaaguugcagucuca

SEQ ID NO: 1127288 - RNA, 20 nt, Homo sapiens
gaaaagaaaucagcagacac

SEQ ID NO: 1127289 - RNA, 11 nt, Homo sapiens
gaaaauuacag

SEQ ID NO: 1127290 - RNA, 15 nt, Homo sapiens
gaaagcacaccucau

SEQ ID NO: 1127291 - RNA, 13 nt, Homo sapiens
gaaagccuuccau

SEQ ID NO: 1127292 - RNA, 19 nt, Homo sapiens
gaaauaaagagcuguuaua

SEQ ID NO: 1127293 - RNA, 23 nt, Homo sapiens
gaaauaaagagcuguuauacugu

SEQ ID NO: 1127294 - RNA, 19 nt, Homo sapiens
gaaauaaguuuuuguuuca

SEQ ID NO: 1127295 - RNA, 22 nt, Homo sapiens
gaaauacaguauaccgcagugg

SEQ ID NO: 1127296 - RNA, 20 nt, Homo sapiens
gaaaugaccaggccaagacu

SEQ ID NO: 1127297 - RNA, 17 nt, Homo sapiens
gaacccagaaauagcca

SEQ ID NO: 1127298 - RNA, 13 nt, Homo sapiens
gaacucacagaaa

SEQ ID NO: 1127299 - RNA, 23 nt, Homo sapiens
gaacugagccaaacacacuguaa

SEQ ID NO: 1127300 - RNA, 19 nt, Homo sapiens
gaacuguggugccacauga

SEQ ID NO: 1127301 - RNA, 15 nt, Homo sapiens
gaagaauggccauuu

SEQ ID NO: 1127302 - RNA, 19 nt, Homo sapiens
gaagacccacgugcuaggg

SEQ ID NO: 1127303 - RNA, 18 nt, Homo sapiens
gaagacuugaagcacaga

SEQ ID NO: 1127304 - RNA, 14 nt, Homo sapiens
gaagaggaagcaag

SEQ ID NO: 1127305 - RNA, 19 nt, Homo sapiens
gaagcacagagggcuaggg

SEQ ID NO: 1127306 - RNA, 16 nt, Homo sapiens
gaagcauaaagcaauu

SEQ ID NO: 1127307 - RNA, 15 nt, Homo sapiens
gaagcugggagcuac

SEQ ID NO: 1127308 - RNA, 19 nt, Homo sapiens
gaagcugggagcuacaggg

SEQ ID NO: 1127309 - RNA, 17 nt, Homo sapiens
gaaggcugugagccaag

SEQ ID NO: 1127310 - RNA, 19 nt, Homo sapiens
gaaucuuugucagcaguuc

SEQ ID NO: 1127311 - RNA, 21 nt, Homo sapiens
gaaucuuugucagcaguuccc

SEQ ID NO: 1127312 - RNA, 17 nt, Homo sapiens
gaaugcaaaccauagca

SEQ ID NO: 1127313 - RNA, 24 nt, Homo sapiens
gaaugcuuaccaaguccugggaau

SEQ ID NO: 1127314 - RNA, 22 nt, Homo sapiens
gaauguuccuuucgaaagcaau

SEQ ID NO: 1127315 - RNA, 19 nt, Homo sapiens
gacaagcaagggcugugcu

SEQ ID NO: 1127316 - RNA, 22 nt, Homo sapiens
gacaagcaagggcugugcugag

SEQ ID NO: 1127317 - RNA, 16 nt, Homo sapiens
gacacugaaccuuguu

SEQ ID NO: 1127318 - RNA, 21 nt, Homo sapiens
gacagcugcuucugugcauuu

SEQ ID NO: 1127319 - RNA, 22 nt, Homo sapiens
gaccaggccaagacucaagccu

SEQ ID NO: 1127320 - RNA, 22 nt, Homo sapiens
gaccccaaaucaccacaaagga

SEQ ID NO: 1127321 - RNA, 16 nt, Homo sapiens
gaccuuccacacaggg

SEQ ID NO: 1127322 - RNA, 21 nt, Homo sapiens
gaccuuuuuuaggaagcaagc

SEQ ID NO: 1127323 - RNA, 14 nt, Homo sapiens
gacuaugaaaagcu

SEQ ID NO: 1127324 - RNA, 18 nt, Homo sapiens
gagaagacccacgugcua

SEQ ID NO: 1127325 - RNA, 19 nt, Homo sapiens
gagaauaaggaugaaauaa

SEQ ID NO: 1127326 - RNA, 19 nt, Homo sapiens
gagacauguaccuugacca

SEQ ID NO: 1127327 - RNA, 14 nt, Homo sapiens
gagauggccugaga

SEQ ID NO: 1127328 - RNA, 23 nt, Homo sapiens
gagcaacaguuaugggacacuga

SEQ ID NO: 1127329 - RNA, 19 nt, Homo sapiens
gagcauccccagccacaac

SEQ ID NO: 1127330 - RNA, 22 nt, Homo sapiens
gagccaggagccuccugacccu

SEQ ID NO: 1127331 - RNA, 18 nt, Homo sapiens
cagcucaaguuagcauuu

SEQ ID NO: 1127332 - RNA, 20 nt, Homo sapiens
cagcugaugaacuguggugc

SEQ ID NO: 1127333 - RNA, 16 nt, Homo sapiens
caggaaggacuaugaa

SEQ ID NO: 1127334 - RNA, 13 nt, Homo sapiens
caggagacccaga

SEQ ID NO: 1127335 - RNA, 14 nt, Homo sapiens
caggcuggagccca

SEQ ID NO: 1127336 - RNA, 20 nt, Homo sapiens
caggcugggauggagcacuu

SEQ ID NO: 1127337 - RNA, 15 nt, Homo sapiens
cagggagcagggcag

SEQ ID NO: 1127338 - RNA, 23 nt, Homo sapiens
cagggagcagggcagaaaacaca

SEQ ID NO: 1127339 - RNA, 18 nt, Homo sapiens
cagggcaggaaggggaaa

SEQ ID NO: 1127340 - RNA, 20 nt, Homo sapiens
cagggccucugggagccuga

SEQ ID NO: 1127341 - RNA, 20 nt, Homo sapiens
cagggcucuguauucugcaa

SEQ ID NO: 1127342 - RNA, 17 nt, Homo sapiens
caggggcugacaaugcg

SEQ ID NO: 1127343 - RNA, 14 nt, Homo sapiens
cagggugcauguga

SEQ ID NO: 1127344 - RNA, 19 nt, Homo sapiens
caguaaaaauccacuauuu

SEQ ID NO: 1127345 - RNA, 16 nt, Homo sapiens
caguguugacauagcc

SEQ ID NO: 1127346 - RNA, 22 nt, Homo sapiens
caguucuuuucaaccuacuuuc

SEQ ID NO: 1127347 - RNA, 12 nt, Homo sapiens
cauaaagcaauu

SEQ ID NO: 1127348 - RNA, 14 nt, Homo sapiens
cauaacuucucuga

SEQ ID NO: 1127349 - RNA, 16 nt, Homo sapiens
caucacgucaagcuuu

SEQ ID NO: 1127350 - RNA, 13 nt, Homo sapiens
caucauugaucuu

SEQ ID NO: 1127351 - RNA, 16 nt, Homo sapiens
caucucagugaagaau

SEQ ID NO: 1127352 - RNA, 15 nt, Homo sapiens
caugaagcacugagc

SEQ ID NO: 1127353 - RNA, 23 nt, Homo sapiens
caugacccuuguggcacagaugc

SEQ ID NO: 1127354 - RNA, 15 nt, Homo sapiens
caugcacucaggcag

SEQ ID NO: 1127355 - RNA, 17 nt, Homo sapiens
cauggaaaagcccagug

SEQ ID NO: 1127356 - RNA, 21 nt, Homo sapiens
caugugaaaauaaaauaugag

SEQ ID NO: 1127357 - RNA, 18 nt, Homo sapiens
caugugcuggacacuguc

SEQ ID NO: 1127358 - RNA, 23 nt, Homo sapiens
cauucagaagaaaaagaagcaac

SEQ ID NO: 1127359 - RNA, 12 nt, Homo sapiens
cauuucaucuca

SEQ ID NO: 1127360 - RNA, 12 nt, Homo sapiens
cauuuuccuuag

SEQ ID NO: 1127361 - RNA, 11 nt, Homo sapiens
ccaaaaccuuc

SEQ ID NO: 1127362 - RNA, 16 nt, Homo sapiens
ccaaacacacuguaaa

SEQ ID NO: 1127363 - RNA, 21 nt, Homo sapiens
ccaaacacuguuucuaacuca

SEQ ID NO: 1127364 - RNA, 22 nt, Homo sapiens
ccaaagccaccaagacaggcuc

SEQ ID NO: 1127365 - RNA, 16 nt, Homo sapiens
ccaaagcucagacuug

SEQ ID NO: 1127366 - RNA, 16 nt, Homo sapiens
ccaaagugacacagag

SEQ ID NO: 1127367 - RNA, 22 nt, Homo sapiens
ccaaggaaucagcaggaugugu

SEQ ID NO: 1127368 - RNA, 16 nt, Homo sapiens
ccaaggaccucucuca

SEQ ID NO: 1127369 - RNA, 16 nt, Homo sapiens
ccaauccccagacuca

SEQ ID NO: 1127370 - RNA, 17 nt, Homo sapiens
ccaauccccagacucaa

SEQ ID NO: 1127371 - RNA, 12 nt, Homo sapiens
ccaaucuugccc

SEQ ID NO: 1127372 - RNA, 20 nt, Homo sapiens
ccacaccaaugcaacauuug

SEQ ID NO: 1127373 - RNA, 20 nt, Homo sapiens
ccacacugagagaguggaga

SEQ ID NO: 1127374 - RNA, 14 nt, Homo sapiens
ccacagacucccuc

SEQ ID NO: 1127375 - RNA, 12 nt, Homo sapiens
ccacggagcuga

SEQ ID NO: 1127376 - RNA, 14 nt, Homo sapiens
ccacucccaaagcu

SEQ ID NO: 1127377 - RNA, 15 nt, Homo sapiens
ccacucuguccugga

SEQ ID NO: 1127378 - RNA, 16 nt, Homo sapiens
ccagaaagaggcagug

SEQ ID NO: 1127379 - RNA, 17 nt, Homo sapiens
ccagaacuguuuucuca

SEQ ID NO: 1127380 - RNA, 11 nt, Homo sapiens
ccagagucaga

SEQ ID NO: 1127381 - RNA, 17 nt, Homo sapiens
ccagcccucaguuuuca

SEQ ID NO: 1127382 - RNA, 20 nt, Homo sapiens
ccagcuguacugaguucuca

SEQ ID NO: 1127383 - RNA, 24 nt, Homo sapiens
ccaguaagguuauaacuguggcua

SEQ ID NO: 1127384 - RNA, 17 nt, Homo sapiens
ccaguccaagaccccaa

SEQ ID NO: 1127385 - RNA, 23 nt, Homo sapiens
ccagugugcuugcccaccacagc

SEQ ID NO: 1127386 - RNA, 19 nt, Homo sapiens
ccaucagcuggguggugua

SEQ ID NO: 1127387 - RNA, 16 nt, Homo sapiens
ccauugcccugugagg

SEQ ID NO: 1127388 - RNA, 22 nt, Homo sapiens
cccaggacgccacucauuucau

SEQ ID NO: 1127389 - RNA, 16 nt, Homo sapiens
cccaguaaaaauccac

SEQ ID NO: 1127390 - RNA, 17 nt, Homo sapiens
cccaguaaaaauccacu

SEQ ID NO: 1127391 - RNA, 23 nt, Homo sapiens
cccaguccaagaccccaaaucac

SEQ ID NO: 1127392 - RNA, 14 nt, Homo sapiens
cccauguacauaau

SEQ ID NO: 1127393 - RNA, 15 nt, Homo sapiens
cccauuuguguuuca

SEQ ID NO: 1127394 - RNA, 11 nt, Homo sapiens
ccccaccucag

SEQ ID NO: 1127395 - RNA, 15 nt, Homo sapiens
ccccagacucaagau

SEQ ID NO: 1127396 - RNA, 15 nt, Homo sapiens
ccccaguucuacuga

SEQ ID NO: 1127397 - RNA, 14 nt, Homo sapiens
ccccucccuggaug

SEQ ID NO: 1127398 - RNA, 14 nt, Homo sapiens
cccucccauagcac

SEQ ID NO: 1127399 - RNA, 15 nt, Homo sapiens
cccucccuggaugac

SEQ ID NO: 1127400 - RNA, 20 nt, Homo sapiens
cccucugggcagcugucaug

SEQ ID NO: 1127401 - RNA, 16 nt, Homo sapiens
cccugacucuuagccc

SEQ ID NO: 1127402 - RNA, 21 nt, Homo sapiens
cccuggaugacauuaaagaag

SEQ ID NO: 1127403 - RNA, 22 nt, Homo sapiens
cccuuguggcacagaugcccac

SEQ ID NO: 1127404 - RNA, 12 nt, Homo sapiens
ccgaagcccagu

SEQ ID NO: 1127405 - RNA, 13 nt, Homo sapiens
ccuaaacuuucca

SEQ ID NO: 1127406 - RNA, 15 nt, Homo sapiens
ccuaagaaaccccag

SEQ ID NO: 1127407 - RNA, 16 nt, Homo sapiens
ccuacuguaggagaua

SEQ ID NO: 1127408 - RNA, 12 nt, Homo sapiens
ccucccaaagug

SEQ ID NO: 1127409 - RNA, 18 nt, Homo sapiens
ccucuaaguguugugaaa

SEQ ID NO: 1127410 - RNA, 18 nt, Homo sapiens
ccucuuccagcaacugaa

SEQ ID NO: 1127411 - RNA, 22 nt, Homo sapiens
ccucuuccagggccucugggag

SEQ ID NO: 1127412 - RNA, 18 nt, Homo sapiens
ccugacggacguccugcu

SEQ ID NO: 1127413 - RNA, 12 nt, Homo sapiens
ccugagccauug

SEQ ID NO: 1127414 - RNA, 15 nt, Homo sapiens
ccugcccucugggag

SEQ ID NO: 1127415 - RNA, 14 nt, Homo sapiens
ccugcuacccagua

SEQ ID NO: 1127416 - RNA, 16 nt, Homo sapiens
ccugcuggcaccucag

SEQ ID NO: 1127417 - RNA, 18 nt, Homo sapiens
ccuggaagccaaacaaag

SEQ ID NO: 1127418 - RNA, 18 nt, Homo sapiens
ccuggaugacauuaaaga

SEQ ID NO: 1127419 - RNA, 22 nt, Homo sapiens
ccugugugcugacaggagaccc

SEQ ID NO: 1127420 - RNA, 15 nt, Homo sapiens
ccuuaaaagagccau

SEQ ID NO: 1127421 - RNA, 14 nt, Homo sapiens
ccuuaggugugagg

SEQ ID NO: 1127422 - RNA, 18 nt, Homo sapiens
ccuuugucauuauuaguc

SEQ ID NO: 1127423 - RNA, 19 nt, Homo sapiens
cgaacaaacugaugcgaaa

SEQ ID NO: 1127424 - RNA, 14 nt, Homo sapiens
cgagucaugcacuc

SEQ ID NO: 1127425 - RNA, 19 nt, Homo sapiens
cgaugcuggggucaaagac

SEQ ID NO: 1127426 - RNA, 17 nt, Homo sapiens
cgcaccagacacucaca

SEQ ID NO: 1127427 - RNA, 17 nt, Homo sapiens
cgcagcccgaagcccag

SEQ ID NO: 1127428 - RNA, 13 nt, Homo sapiens
cgccucugagcca

SEQ ID NO: 1127429 - RNA, 15 nt, Homo sapiens
cggagguccugcuac

SEQ ID NO: 1127430 - RNA, 13 nt, Homo sapiens
cguccuuccucuc

SEQ ID NO: 1127431 - RNA, 14 nt, Homo sapiens
cgucuccucuccag

SEQ ID NO: 1127432 - RNA, 21 nt, Homo sapiens
cuaaaagggggcuauucccug

SEQ ID NO: 1127433 - RNA, 23 nt, Homo sapiens
cuaaaggacugguuaaaucaauu

SEQ ID NO: 1127434 - RNA, 15 nt, Homo sapiens
cuacccaguaaaaau

SEQ ID NO: 1127435 - RNA, 14 nt, Homo sapiens
cuacugacuuuucc

SEQ ID NO: 1127436 - RNA, 14 nt, Homo sapiens
cuagagugcagugg

SEQ ID NO: 1127437 - RNA, 22 nt, Homo sapiens
cuagggcuggagggacagggag

SEQ ID NO: 1127438 - RNA, 23 nt, Homo sapiens
cuauaaguguucaguguugacau

SEQ ID NO: 1127439 - RNA, 23 nt, Homo sapiens
cucaaccccuccccuccaucccu

SEQ ID NO: 1127440 - RNA, 13 nt, Homo sapiens
cucacauucccuc

SEQ ID NO: 1127441 - RNA, 22 nt, Homo sapiens
cucagccgugcacucccuaaga

SEQ ID NO: 1127442 - RNA, 17 nt, Homo sapiens
cucaugcucucuauaga

SEQ ID NO: 1127443 - RNA, 15 nt, Homo sapiens
cucccaaagcucaga

SEQ ID NO: 1127444 - RNA, 19 nt, Homo sapiens
cucccaaagugcugggauu

SEQ ID NO: 1127445 - RNA, 15 nt, Homo sapiens
cucccauagcacugc

SEQ ID NO: 1127446 - RNA, 21 nt, Homo sapiens
cuccccacaccucccuacucc

SEQ ID NO: 1127447 - RNA, 14 nt, Homo sapiens
cuccccucauggag

SEQ ID NO: 1127448 - RNA, 17 nt, Homo sapiens
cuccccuccaucccugg

SEQ ID NO: 1127449 - RNA, 14 nt, Homo sapiens
cucccuggaugaca

SEQ ID NO: 1127450 - RNA, 18 nt, Homo sapiens
cucccuggaugacauuaa

SEQ ID NO: 1127451 - RNA, 18 nt, Homo sapiens
cucccuguguggcugcug

SEQ ID NO: 1127452 - RNA, 22 nt, Homo sapiens
cuccucaaccccuccccuccau

SEQ ID NO: 1127453 - RNA, 22 nt, Homo sapiens
aaaaagugcuuauuaugugcaa

SEQ ID NO: 1127454 - RNA, 19 nt, Homo sapiens
aaaacaaaaaaagcaucuc

SEQ ID NO: 1127455 - RNA, 13 nt, Homo sapiens
aaaauagcaaaag

SEQ ID NO: 1127456 - RNA, 11 nt, Homo sapiens
aaaauccacua

SEQ ID NO: 1127457 - RNA, 15 nt, Homo sapiens
aaaauucucuuaaac

SEQ ID NO: 1127458 - RNA, 20 nt, Homo sapiens
aaaauucucuuaaaccacag

SEQ ID NO: 1127459 - RNA, 14 nt, Homo sapiens
aaacaaguauuugu

SEQ ID NO: 1127460 - RNA, 14 nt, Homo sapiens
aaacacacuguaaa

SEQ ID NO: 1127461 - RNA, 16 nt, Homo sapiens
aaacacagccugugua

SEQ ID NO: 1127462 - RNA, 15 nt, Homo sapiens
aaaccaaugucauaa

SEQ ID NO: 1127463 - RNA, 22 nt, Homo sapiens
aaacuguuuauuugcacuauga

SEQ ID NO: 1127464 - RNA, 18 nt, Homo sapiens
aaacuuucaggcacugga

SEQ ID NO: 1127465 - RNA, 19 nt, Homo sapiens
aaagagcuguuauacugug

SEQ ID NO: 1127466 - RNA, 19 nt, Homo sapiens
aaagucagggagccuggaa

SEQ ID NO: 1127467 - RNA, 14 nt, Homo sapiens
aaauagcaaaagaa

SEQ ID NO: 1127468 - RNA, 15 nt, Homo sapiens
aaaucaauaaauucc

SEQ ID NO: 1127469 - RNA, 23 nt, Homo sapiens
aaauggagaaauaggaccuucca

SEQ ID NO: 1127470 - RNA, 20 nt, Homo sapiens
aaauuuuuaaaacacagaaa

SEQ ID NO: 1127471 - RNA, 15 nt, Homo sapiens
aacaaaaccaacuca

SEQ ID NO: 1127472 - RNA, 12 nt, Homo sapiens
aacacacuguaa

SEQ ID NO: 1127473 - RNA, 16 nt, Homo sapiens
aacagccugacaacau

SEQ ID NO: 1127474 - RNA, 12 nt, Homo sapiens
aacauagacaga

SEQ ID NO: 1127475 - RNA, 22 nt, Homo sapiens
aacauccuaagugggaagugaa

SEQ ID NO: 1127476 - RNA, 18 nt, Homo sapiens
aacauugaacucauaucu

SEQ ID NO: 1127477 - RNA, 14 nt, Homo sapiens
aaccagacaccucc

SEQ ID NO: 1127478 - RNA, 17 nt, Homo sapiens
aaccccuccccuccauc

SEQ ID NO: 1127479 - RNA, 13 nt, Homo sapiens
aacccucacugug

SEQ ID NO: 1127480 - RNA, 19 nt, Homo sapiens
aacgcaccagacacucaca

SEQ ID NO: 1127481 - RNA, 16 nt, Homo sapiens
aacuguggugccacau

SEQ ID NO: 1127482 - RNA, 22 nt, Homo sapiens
aacuuaccaggcaccaaaagaa

SEQ ID NO: 1127483 - RNA, 12 nt, Homo sapiens
aacuucucugag

SEQ ID NO: 1127484 - RNA, 17 nt, Homo sapiens
aacuuucugcaguuuuu

SEQ ID NO: 1127485 - RNA, 23 nt, Homo sapiens
aagaaaaccuuucuucaccaaau

SEQ ID NO: 1127486 - RNA, 15 nt, Homo sapiens
auaaaauacagagaa

SEQ ID NO: 1127487 - RNA, 11 nt, Homo sapiens
auaaaugggcc

SEQ ID NO: 1127488 - RNA, 17 nt, Homo sapiens
auaaguguucaguguug

SEQ ID NO: 1127489 - RNA, 17 nt, Homo sapiens
auaaucuucaggugaaa

SEQ ID NO: 1127490 - RNA, 18 nt, Homo sapiens
auagaggaggauggucau

SEQ ID NO: 1127491 - RNA, 14 nt, Homo sapiens
auagccacuauuaa

SEQ ID NO: 1127492 - RNA, 21 nt, Homo sapiens
auauaauacuaaagugucuau

SEQ ID NO: 1127493 - RNA, 19 nt, Homo sapiens
aucacucauucuaugaaca

SEQ ID NO: 1127494 - RNA, 13 nt, Homo sapiens
aucaguggcugcc

SEQ ID NO: 1127495 - RNA, 12 nt, Homo sapiens
aucauugaucuu

SEQ ID NO: 1127496 - RNA, 12 nt, Homo sapiens
auccacacugag

SEQ ID NO: 1127497 - RNA, 13 nt, Homo sapiens
auccacacugaga

SEQ ID NO: 1127498 - RNA, 15 nt, Homo sapiens
auccacacugagaga

SEQ ID NO: 1127499 - RNA, 13 nt, Homo sapiens
auccccagacuca

SEQ ID NO: 1127500 - RNA, 20 nt, Homo sapiens
auccccagccacaacugcca

SEQ ID NO: 1127501 - RNA, 17 nt, Homo sapiens
aucccugguuccuagca

SEQ ID NO: 1127502 - RNA, 20 nt, Homo sapiens
auccuaucacagucuacuga

SEQ ID NO: 1127503 - RNA, 23 nt, Homo sapiens
aucucauucccagagucagagga

SEQ ID NO: 1127504 - RNA, 18 nt, Homo sapiens
aucugguuaaugacauac

SEQ ID NO: 1127505 - RNA, 14 nt, Homo sapiens
aucuucuauucuag

SEQ ID NO: 1127506 - RNA, 17 nt, Homo sapiens
aucuuguucaaugaaga

SEQ ID NO: 1127507 - RNA, 14 nt, Homo sapiens
aucuuucuguuacu

SEQ ID NO: 1127508 - RNA, 19 nt, Homo sapiens
augaacuguggugccacau

SEQ ID NO: 1127509 - RNA, 18 nt, Homo sapiens
augaauaauacauugaau

SEQ ID NO: 1127510 - RNA, 14 nt, Homo sapiens
augaaugacaugac

SEQ ID NO: 1127511 - RNA, 14 nt, Homo sapiens
augagaagccaaag

SEQ ID NO: 1127512 - RNA, 14 nt, Homo sapiens
augagcauccccag

SEQ ID NO: 1127513 - RNA, 17 nt, Homo sapiens
augauuuccuaguagaa

SEQ ID NO: 1127514 - RNA, 16 nt, Homo sapiens
augcagcaaaauguga

SEQ ID NO: 1127515 - RNA, 16 nt, Homo sapiens
augccagcuguacuga

SEQ ID NO: 1127516 - RNA, 22 nt, Homo sapiens
augcuuaccaaguccugggaau

SEQ ID NO: 1127517 - RNA, 23 nt, Homo sapiens
auggaaaagcccagugaccugac

SEQ ID NO: 1127518 - RNA, 17 nt, Homo sapiens
auggaugugcucacugg

SEQ ID NO: 1127519 - RNA, 14 nt, Homo sapiens
aggccugagggcug

SEQ ID NO: 1127520 - RNA, 19 nt, Homo sapiens
aggcucagccacacaggaa

SEQ ID NO: 1127521 - RNA, 13 nt, Homo sapiens
agggccucuggga

SEQ ID NO: 1127522 - RNA, 20 nt, Homo sapiens
aggggugggauccacacuga

SEQ ID NO: 1127523 - RNA, 23 nt, Homo sapiens
agggucacuaaccaagccagaaa

SEQ ID NO: 1127524 - RNA, 13 nt, Homo sapiens
aggguugagcugg

SEQ ID NO: 1127525 - RNA, 16 nt, Homo sapiens
aggucccugcuuaccu

SEQ ID NO: 1127526 - RNA, 14 nt, Homo sapiens
agguccugcuaccc

SEQ ID NO: 1127527 - RNA, 22 nt, Homo sapiens
aguaaaaauccacuauuuccau

SEQ ID NO: 1127528 - RNA, 21 nt, Homo sapiens
aguaagguuauaacuguggcu

SEQ ID NO: 1127529 - RNA, 11 nt, Homo sapiens
aguaauuuugc

SEQ ID NO: 1127530 - RNA, 14 nt, Homo sapiens
aguaccagugugcu

SEQ ID NO: 1127531 - RNA, 17 nt, Homo sapiens
aguaggaguugcuccua

SEQ ID NO: 1127532 - RNA, 22 nt, Homo sapiens
aguauugccacaaugccucucc

SEQ ID NO: 1127533 - RNA, 14 nt, Homo sapiens
agucaccgggauga

SEQ ID NO: 1127534 - RNA, 19 nt, Homo sapiens
aguccagagucuaggcaau

SEQ ID NO: 1127535 - RNA, 22 nt, Homo sapiens
agucugucucuuggcuuuguca

SEQ ID NO: 1127536 - RNA, 15 nt, Homo sapiens
agugaaaaaaacaac

SEQ ID NO: 1127537 - RNA, 20 nt, Homo sapiens
agugauuugggggugcaaug

SEQ ID NO: 1127538 - RNA, 15 nt, Homo sapiens
agugcccagcaugaa

SEQ ID NO: 1127539 - RNA, 16 nt, Homo sapiens
agugcccagcaugaag

SEQ ID NO: 1127540 - RNA, 14 nt, Homo sapiens
agugccugagaugc

SEQ ID NO: 1127541 - RNA, 21 nt, Homo sapiens
aguggaaacaaagggugggca

SEQ ID NO: 1127542 - RNA, 15 nt, Homo sapiens
aguggagagugacau

SEQ ID NO: 1127543 - RNA, 20 nt, Homo sapiens
aguguucaguguugacauag

SEQ ID NO: 1127544 - RNA, 13 nt, Homo sapiens
aguguugacauag

SEQ ID NO: 1127545 - RNA, 23 nt, Homo sapiens
aguucuuuucaaccuacuuucau

SEQ ID NO: 1127546 - RNA, 17 nt, Homo sapiens
auaaauuuuuauaagga

SEQ ID NO: 1127547 - RNA, 15 nt, Homo sapiens
auaacuucucugagu

SEQ ID NO: 1127548 - RNA, 14 nt, Homo sapiens
auaaguguucagug

SEQ ID NO: 1127549 - RNA, 21 nt, Homo sapiens
auaaguguucaguguugacau

SEQ ID NO: 1127550 - RNA, 23 nt, Homo sapiens
auaauacauugaauuagaaacau

SEQ ID NO: 1127551 - RNA, 18 nt, Homo sapiens
auaaugaagaauggccau

SEQ ID NO: 1127552 - RNA, 18 nt, Homo sapiens
auaauuuuguugcuacau

SEQ ID NO: 1127553 - RNA, 19 nt, Homo sapiens
auacuuucccacagcacua

SEQ ID NO: 1127554 - RNA, 23 nt, Homo sapiens
auagauauuccuauugugcaaug

SEQ ID NO: 1127555 - RNA, 21 nt, Homo sapiens
auagauuuucugcuacuuugc

SEQ ID NO: 1127556 - RNA, 19 nt, Homo sapiens
auaggaccuuccacacagg

SEQ ID NO: 1127557 - RNA, 12 nt, Homo sapiens
auauccacagac

SEQ ID NO: 1127558 - RNA, 15 nt, Homo sapiens
auauccacagacucc

SEQ ID NO: 1127559 - RNA, 16 nt, Homo sapiens
auaucgggucacuguc

SEQ ID NO: 1127560 - RNA, 21 nt, Homo sapiens
auaucuaaauuuaaacaguau

SEQ ID NO: 1127561 - RNA, 14 nt, Homo sapiens
aucaaauacuagua

SEQ ID NO: 1127562 - RNA, 14 nt, Homo sapiens
aucagaguggccaa

SEQ ID NO: 1127563 - RNA, 21 nt, Homo sapiens
aucagcuguuaaccauuugca

SEQ ID NO: 1127564 - RNA, 15 nt, Homo sapiens
auccacaacuuguac

SEQ ID NO: 1127565 - RNA, 16 nt, Homo sapiens
auccacggagcugaag

SEQ ID NO: 1127566 - RNA, 17 nt, Homo sapiens
aucccccucuuugcaca

SEQ ID NO: 1127567 - RNA, 21 nt, Homo sapiens
aucccuggguucaacucugcu

SEQ ID NO: 1127568 - RNA, 21 nt, Homo sapiens
auccuaaacccuuaaccuaaa

SEQ ID NO: 1127569 - RNA, 17 nt, Homo sapiens
aucucauuuaagggaaa

SEQ ID NO: 1127570 - RNA, 22 nt, Homo sapiens
aucuguuacugaaaugaggaga

SEQ ID NO: 1127571 - RNA, 14 nt, Homo sapiens
augaagcacugagc

SEQ ID NO: 1127572 - RNA, 14 nt, Homo sapiens
augcaacgcuguaa

SEQ ID NO: 1127573 - RNA, 18 nt, Homo sapiens
augcaagaguggacugaa

SEQ ID NO: 1127574 - RNA, 17 nt, Homo sapiens
augcagcaaaaugugaa

SEQ ID NO: 1127575 - RNA, 18 nt, Homo sapiens
augcccacguaugugaaa

SEQ ID NO: 1127576 - RNA, 22 nt, Homo sapiens
augccuuuucccaaaauguuga

SEQ ID NO: 1127577 - RNA, 17 nt, Homo sapiens
augcugagcgcuguguu

SEQ ID NO: 1127578 - RNA, 17 nt, Homo sapiens
auggaaaggagaggaaa

SEQ ID NO: 1127579 - RNA, 23 nt, Homo sapiens
auggacaugugucccagccacag

SEQ ID NO: 1127580 - RNA, 21 nt, Homo sapiens
auggcacauggcuggcacuga

SEQ ID NO: 1127581 - RNA, 21 nt, Homo sapiens
auggcacucuucccaccucag

SEQ ID NO: 1127582 - RNA, 17 nt, Homo sapiens
auggcuuugauugauuu

SEQ ID NO: 1127583 - RNA, 22 nt, Homo sapiens
augggacucugagaacuccuca

SEQ ID NO: 1127584 - RNA, 18 nt, Homo sapiens
auggggugucuguguuau

SEQ ID NO: 1127585 - RNA, 15 nt, Homo sapiens
augguagcaaaacaa

SEQ ID NO: 1127586 - RNA, 22 nt, Homo sapiens
auguagugugucagaguaacau

SEQ ID NO: 1127587 - RNA, 23 nt, Homo sapiens
augugcuauugaacugagccaaa

SEQ ID NO: 1127588 - RNA, 17 nt, Homo sapiens
auguggcuuuuggauuu

SEQ ID NO: 1127589 - RNA, 17 nt, Homo sapiens
augugucccagccacag

SEQ ID NO: 1127590 - RNA, 11 nt, Homo sapiens
auuacacugga

SEQ ID NO: 1127591 - RNA, 20 nt, Homo sapiens
auuaugauuaaucugauuau

SEQ ID NO: 1127592 - RNA, 14 nt, Homo sapiens
auuaugugcaacau

SEQ ID NO: 1127593 - RNA, 21 nt, Homo sapiens
auucacauaacuucucugagu

SEQ ID NO: 1127594 - RNA, 22 nt, Homo sapiens
auucacuauggggggaggugua

SEQ ID NO: 1127595 - RNA, 13 nt, Homo sapiens
auuccuucacuca

SEQ ID NO: 1127596 - RNA, 18 nt, Homo sapiens
auucuaugaacagugaca

SEQ ID NO: 1127597 - RNA, 15 nt, Homo sapiens
auugaauuagaaaca

SEQ ID NO: 1127598 - RNA, 21 nt, Homo sapiens
auugagugcuccugugugcug

SEQ ID NO: 1127599 - RNA, 21 nt, Homo sapiens
auuguguugggaccugugauc

SEQ ID NO: 1127600 - RNA, 16 nt, Homo sapiens
auuugaaugacaagau

SEQ ID NO: 1127601 - RNA, 22 nt, Homo sapiens
auuugccuaaggucacagcuaa

SEQ ID NO: 1127602 - RNA, 16 nt, Homo sapiens
auuuucacaucaaaga

SEQ ID NO: 1127603 - RNA, 15 nt, Homo sapiens
auuuucuacaaccua

SEQ ID NO: 1127604 - RNA, 17 nt, Homo sapiens
auuuucuacaaccuaag

SEQ ID NO: 1127605 - RNA, 17 nt, Homo sapiens
auuuuuucaugaaagau

SEQ ID NO: 1127606 - RNA, 22 nt, Homo sapiens
caaaaaaagcaucucacugcaa

SEQ ID NO: 1127607 - RNA, 17 nt, Homo sapiens
caaaaauguccagccac

SEQ ID NO: 1127608 - RNA, 14 nt, Homo sapiens
caaaagugaucugu

SEQ ID NO: 1127609 - RNA, 13 nt, Homo sapiens
caaacacacugua

SEQ ID NO: 1127610 - RNA, 15 nt, Homo sapiens
caaacacacuguaaa

SEQ ID NO: 1127611 - RNA, 18 nt, Homo sapiens
caaacaugaauccuguga

SEQ ID NO: 1127612 - RNA, 21 nt, Homo sapiens
cccacguaugugaaacacaca

SEQ ID NO: 1127613 - RNA, 14 nt, Homo sapiens
cccagaaagaggca

SEQ ID NO: 1127614 - RNA, 13 nt, Homo sapiens
cccagugaccuga

SEQ ID NO: 1127615 - RNA, 24 nt, Homo sapiens
ccccagaaccagcugcagauggag

SEQ ID NO: 1127616 - RNA, 19 nt, Homo sapiens
cccccuaagaggcagugag

SEQ ID NO: 1127617 - RNA, 13 nt, Homo sapiens
cccccucccugga

SEQ ID NO: 1127618 - RNA, 19 nt, Homo sapiens
ccccuaagaggcagugaga

SEQ ID NO: 1127619 - RNA, 21 nt, Homo sapiens
ccccucuuugcacagcaugag

SEQ ID NO: 1127620 - RNA, 19 nt, Homo sapiens
cccgagcuagagugcagug

SEQ ID NO: 1127621 - RNA, 17 nt, Homo sapiens
cccuaagaggcagugag

SEQ ID NO: 1127622 - RNA, 15 nt, Homo sapiens
cccuaugucccagcc

SEQ ID NO: 1127623 - RNA, 16 nt, Homo sapiens
cccucauuaugacucu

SEQ ID NO: 1127624 - RNA, 15 nt, Homo sapiens
cccuccccuccaucc

SEQ ID NO: 1127625 - RNA, 20 nt, Homo sapiens
cccucccuggaugacauuaa

SEQ ID NO: 1127626 - RNA, 13 nt, Homo sapiens
cccuggaagcuga

SEQ ID NO: 1127627 - RNA, 17 nt, Homo sapiens
cccuucucccaguccaa

SEQ ID NO: 1127628 - RNA, 16 nt, Homo sapiens
ccgaucuccacuguug

SEQ ID NO: 1127629 - RNA, 15 nt, Homo sapiens
ccuaggauacccaga

SEQ ID NO: 1127630 - RNA, 14 nt, Homo sapiens
ccuaguagaacuca

SEQ ID NO: 1127631 - RNA, 19 nt, Homo sapiens
ccuaucccagagaccuuga

SEQ ID NO: 1127632 - RNA, 20 nt, Homo sapiens
ccucagacaauccacucuca

SEQ ID NO: 1127633 - RNA, 13 nt, Homo sapiens
ccucagucuggca

SEQ ID NO: 1127634 - RNA, 17 nt, Homo sapiens
ccucaugcucucuauag

SEQ ID NO: 1127635 - RNA, 22 nt, Homo sapiens
cuuuccuucucgucuuccucuc

SEQ ID NO: 1127636 - RNA, 15 nt, Homo sapiens
cuuucgaaagcaaug

SEQ ID NO: 1127637 - RNA, 13 nt, Homo sapiens
cuuucuuccacua

SEQ ID NO: 1127638 - RNA, 21 nt, Homo sapiens
cuuugucauuauuagucuuca

SEQ ID NO: 1127639 - RNA, 14 nt, Homo sapiens
cuuuguugcugucu

SEQ ID NO: 1127640 - RNA, 16 nt, Homo sapiens
gaaaaaauucucuuaa

SEQ ID NO: 1127641 - RNA, 16 nt, Homo sapiens
gaaaacauacacugag

SEQ ID NO: 1127642 - RNA, 14 nt, Homo sapiens
gaaaagcccaguga

SEQ ID NO: 1127643 - RNA, 19 nt, Homo sapiens
gaaaauuauugacagcaau

SEQ ID NO: 1127644 - RNA, 21 nt, Homo sapiens
gaaacacagcugaugaacugu

SEQ ID NO: 1127645 - RNA, 15 nt, Homo sapiens
gaaaugucaguugcu

SEQ ID NO: 1127646 - RNA, 17 nt, Homo sapiens
gaagacccacgugcuag

SEQ ID NO: 1127647 - RNA, 16 nt, Homo sapiens
gaagcacagagggcua

SEQ ID NO: 1127648 - RNA, 13 nt, Homo sapiens
gaagcacugagca

SEQ ID NO: 1127649 - RNA, 18 nt, Homo sapiens
gaagccaaacaaaggccc

SEQ ID NO: 1127650 - RNA, 24 nt, Homo sapiens
gaagcuggaggcacaacgcaccag

SEQ ID NO: 1127651 - RNA, 16 nt, Homo sapiens
gaaguaauuugccuaa

SEQ ID NO: 1127652 - RNA, 15 nt, Homo sapiens
gaaguccuccagaca

SEQ ID NO: 1127653 - RNA, 21 nt, Homo sapiens
gaagugauugaauauuguuaa

SEQ ID NO: 1127654 - RNA, 13 nt, Homo sapiens
gaauacuggccau

SEQ ID NO: 1127655 - RNA, 14 nt, Homo sapiens
gaauagugccugaa

SEQ ID NO: 1127656 - RNA, 16 nt, Homo sapiens
gaauauaaacacauaa

SEQ ID NO: 1127657 - RNA, 13 nt, Homo sapiens
gaauaugacauac

SEQ ID NO: 1127658 - RNA, 18 nt, Homo sapiens
gaauaugcuagugaugua

SEQ ID NO: 1127659 - RNA, 20 nt, Homo sapiens
gaauauuaucaguggcugcc

SEQ ID NO: 1127660 - RNA, 15 nt, Homo sapiens
gaaugaaugacauga

SEQ ID NO: 1127661 - RNA, 23 nt, Homo sapiens
gaaugagccguauacaaggaaua

SEQ ID NO: 1127662 - RNA, 16 nt, Homo sapiens
gaauuuuuaaacaagu

SEQ ID NO: 1127663 - RNA, 18 nt, Homo sapiens
gacaacauuucuauagcc

SEQ ID NO: 1127664 - RNA, 19 nt, Homo sapiens
gacacucacagcaaggaug

SEQ ID NO: 1127665 - RNA, 19 nt, Homo sapiens
gacacuguccaugaagcac

SEQ ID NO: 1127666 - RNA, 20 nt, Homo sapiens
gacagcugcuucugugcauu

SEQ ID NO: 1127667 - RNA, 19 nt, Homo sapiens
gacauacuuggagagcaaa

SEQ ID NO: 1127668 - RNA, 18 nt, Homo sapiens
gaccaaagccaccaagac

SEQ ID NO: 1127669 - RNA, 18 nt, Homo sapiens
gacccagagagcuagggc

SEQ ID NO: 1127670 - RNA, 18 nt, Homo sapiens
gaccugaccggcaccugc

SEQ ID NO: 1127671 - RNA, 22 nt, Homo sapiens
gaccuuuuuuaggaagcaagcu

SEQ ID NO: 1127672 - RNA, 14 nt, Homo sapiens
gacggccacucugu

SEQ ID NO: 1127673 - RNA, 16 nt, Homo sapiens
gacggccacucuguug

SEQ ID NO: 1127674 - RNA, 14 nt, Homo sapiens
gacuaucaguuccc

SEQ ID NO: 1127675 - RNA, 17 nt, Homo sapiens
gacucuuaacauuagag

SEQ ID NO: 1127676 - RNA, 18 nt, Homo sapiens
gacuggacccccuggaag

SEQ ID NO: 1127677 - RNA, 15 nt, Homo sapiens
gacuguauuuuccaa

SEQ ID NO: 1127678 - RNA, 15 nt, Homo sapiens
gagaacuccucauuc

SEQ ID NO: 1127679 - RNA, 17 nt, Homo sapiens
gagaacuccucauuccc

SEQ ID NO: 1127680 - RNA, 14 nt, Homo sapiens
gagaaggcugugag

SEQ ID NO: 1127681 - RNA, 16 nt, Homo sapiens
gagacauaucacucaa

SEQ ID NO: 1127682 - RNA, 21 nt, Homo sapiens
gagaccuccccauguacauaa

SEQ ID NO: 1127683 - RNA, 19 nt, Homo sapiens
gagagaggcucagccacac

SEQ ID NO: 1127684 - RNA, 18 nt, Homo sapiens
gagauaagaucuauagcc

SEQ ID NO: 1127685 - RNA, 15 nt, Homo sapiens
gagcaccuacugugu

SEQ ID NO: 1127686 - RNA, 15 nt, Homo sapiens
gagcagaagcuggag

SEQ ID NO: 1127687 - RNA, 15 nt, Homo sapiens
gagcagucagggugg

SEQ ID NO: 1127688 - RNA, 19 nt, Homo sapiens
gagccaaacacacuguaaa

SEQ ID NO: 1127689 - RNA, 23 nt, Homo sapiens
gagccaaggagggagggucuucc

SEQ ID NO: 1127690 - RNA, 19 nt, Homo sapiens
gagccuggaagccaaacaa

SEQ ID NO: 1127691 - RNA, 18 nt, Homo sapiens
gagcucagccgugcacuc

SEQ ID NO: 1127692 - RNA, 13 nt, Homo sapiens
gaggacaaagugu

SEQ ID NO: 1127693 - RNA, 22 nt, Homo sapiens
gaggaggauggucaucgugaca

SEQ ID NO: 1127694 - RNA, 21 nt, Homo sapiens
gaggcgcagcccgaagcccag

SEQ ID NO: 1127695 - RNA, 15 nt, Homo sapiens
gaggcucagccacac

SEQ ID NO: 1127696 - RNA, 19 nt, Homo sapiens
gagguccugcuacccagua

SEQ ID NO: 1127697 - RNA, 19 nt, Homo sapiens
gaguaacaugccagcuucc

SEQ ID NO: 1127698 - RNA, 23 nt, Homo sapiens
gauaggauggggugucuguguua

SEQ ID NO: 1127699 - RNA, 14 nt, Homo sapiens
gauccacacugaga

SEQ ID NO: 1127700 - RNA, 22 nt, Homo sapiens
gaugauuuccuaguagaacuca

SEQ ID NO: 1127701 - RNA, 17 nt, Homo sapiens
gaugccaaaaacaaaaa

SEQ ID NO: 1127702 - RNA, 23 nt, Homo sapiens
gaugucaaggacuccugucuguc

SEQ ID NO: 1127703 - RNA, 12 nt, Homo sapiens
gauguggcuuuu

SEQ ID NO: 1127704 - RNA, 16 nt, Homo sapiens
gauuacuuuugggagg

SEQ ID NO: 1127705 - RNA, 17 nt, Homo sapiens
gauuugggggugcaaug

SEQ ID NO: 1127706 - RNA, 16 nt, Homo sapiens
gcaaagcuggcuuccu

SEQ ID NO: 1127707 - RNA, 13 nt, Homo sapiens
gcaaagugcugaa

SEQ ID NO: 1127708 - RNA, 17 nt, Homo sapiens
gcaacccucacuguguu

SEQ ID NO: 1127709 - RNA, 20 nt, Homo sapiens
gcaagauuuugucaaaaacu

SEQ ID NO: 1127710 - RNA, 15 nt, Homo sapiens
gcaaucuggucugaa

SEQ ID NO: 1127711 - RNA, 11 nt, Homo sapiens
gcacaccucau

SEQ ID NO: 1127712 - RNA, 21 nt, Homo sapiens
gcacuucccauuuguguuuca

SEQ ID NO: 1127713 - RNA, 18 nt, Homo sapiens
gcagaagcuggaggcaca

SEQ ID NO: 1127714 - RNA, 15 nt, Homo sapiens
gcagcccgaagccca

SEQ ID NO: 1127715 - RNA, 21 nt, Homo sapiens
gcagcugucauggaaaagccc

SEQ ID NO: 1127716 - RNA, 19 nt, Homo sapiens
gcaguauugccacaaugcc

SEQ ID NO: 1127717 - RNA, 22 nt, Homo sapiens
gcagucagggugggaagaaaga

SEQ ID NO: 1127718 - RNA, 14 nt, Homo sapiens
gcauaccuuggacu

SEQ ID NO: 1127719 - RNA, 16 nt, Homo sapiens
gcauccugugugcuga

SEQ ID NO: 1127720 - RNA, 22 nt, Homo sapiens
gcauccuuuucaaaaccuaaaa

SEQ ID NO: 1127721 - RNA, 19 nt, Homo sapiens
gcauuacugggaagacaau

SEQ ID NO: 1127722 - RNA, 18 nt, Homo sapiens
gcauuuguuccaugccug

SEQ ID NO: 1127723 - RNA, 14 nt, Homo sapiens
gccaaacacacugu

SEQ ID NO: 1127724 - RNA, 17 nt, Homo sapiens
gccaaacacacuguaaa

SEQ ID NO: 1127725 - RNA, 13 nt, Homo sapiens
gccaccaagacag

SEQ ID NO: 1127726 - RNA, 21 nt, Homo sapiens
gccacccccaggcaucuguua

SEQ ID NO: 1127727 - RNA, 17 nt, Homo sapiens
gccacuauuaacauuuc

SEQ ID NO: 1127728 - RNA, 21 nt, Homo sapiens
gccaggcuaucuggccugaga

SEQ ID NO: 1127729 - RNA, 23 nt, Homo sapiens
gccaugccuggagacauaucacu

SEQ ID NO: 1127730 - RNA, 18 nt, Homo sapiens
gccauuucggaagacacc

SEQ ID NO: 1127731 - RNA, 16 nt, Homo sapiens
gcccaagaggacugag

SEQ ID NO: 1127732 - RNA, 17 nt, Homo sapiens
gcccgaucuccacuguu

SEQ ID NO: 1127733 - RNA, 11 nt, Homo sapiens
gcccucuggga

SEQ ID NO: 1127734 - RNA, 19 nt, Homo sapiens
gcccugguguguuuccaga

SEQ ID NO: 1127735 - RNA, 14 nt, Homo sapiens
uaauguugaugaau

SEQ ID NO: 1127736 - RNA, 14 nt, Homo sapiens
uaauuaaguacaaa

SEQ ID NO: 1127737 - RNA, 14 nt, Homo sapiens
uaauucuagagucu

SEQ ID NO: 1127738 - RNA, 20 nt, Homo sapiens
uaauugugaaaauuacaguu

SEQ ID NO: 1127739 - RNA, 13 nt, Homo sapiens
uaccagugugcuu

SEQ ID NO: 1127740 - RNA, 20 nt, Homo sapiens
uacuggcuuucauagcuuuu

SEQ ID NO: 1127741 - RNA, 11 nt, Homo sapiens
uagacuaguuu

SEQ ID NO: 1127742 - RNA, 13 nt, Homo sapiens
uagcaaaagaaga

SEQ ID NO: 1127743 - RNA, 14 nt, Homo sapiens
uagcagauggagua

SEQ ID NO: 1127744 - RNA, 17 nt, Homo sapiens
uagccaggcuaucuggc

SEQ ID NO: 1127745 - RNA, 16 nt, Homo sapiens
uagcugggacuacagg

SEQ ID NO: 1127746 - RNA, 18 nt, Homo sapiens
uagcugguucacacugac

SEQ ID NO: 1127747 - RNA, 16 nt, Homo sapiens
uaggcuggaauguucc

SEQ ID NO: 1127748 - RNA, 17 nt, Homo sapiens
uagguucaaaagcaauc

SEQ ID NO: 1127749 - RNA, 21 nt, Homo sapiens
uauaaguguucaguguugaca

SEQ ID NO: 1127750 - RNA, 19 nt, Homo sapiens
uauauaguuaguaucuuua

SEQ ID NO: 1127751 - RNA, 15 nt, Homo sapiens
uggagcugaaaacau

SEQ ID NO: 1127752 - RNA, 22 nt, Homo sapiens
uggaggcacaacgcaccagaca

SEQ ID NO: 1127753 - RNA, 14 nt, Homo sapiens
uggcaaugggacuc

SEQ ID NO: 1127754 - RNA, 20 nt, Homo sapiens
uggcacauggcuggcacuga

SEQ ID NO: 1127755 - RNA, 15 nt, Homo sapiens
uggcaccucagacaa

SEQ ID NO: 1127756 - RNA, 16 nt, Homo sapiens
uggcaugcugccuuaa

SEQ ID NO: 1127757 - RNA, 19 nt, Homo sapiens
uggcauguguacaaugaaa

SEQ ID NO: 1127758 - RNA, 14 nt, Homo sapiens
uggcugcugugcua

SEQ ID NO: 1127759 - RNA, 15 nt, Homo sapiens
uggcuggcacugagc

SEQ ID NO: 1127760 - RNA, 12 nt, Homo sapiens
ugggacacugaa

SEQ ID NO: 1127761 - RNA, 15 nt, Homo sapiens
ugggcaucuccgugu

SEQ ID NO: 1127762 - RNA, 18 nt, Homo sapiens
uggggacagcauaccuug

SEQ ID NO: 1127763 - RNA, 19 nt, Homo sapiens
uggggcuggguguguuuca

SEQ ID NO: 1127764 - RNA, 19 nt, Homo sapiens
ugggggucagucacuugaa

SEQ ID NO: 1127765 - RNA, 15 nt, Homo sapiens
ugguccaccuccuga

SEQ ID NO: 1127766 - RNA, 21 nt, Homo sapiens
ugguuaaaucaauucugauac

SEQ ID NO: 1127767 - RNA, 16 nt, Homo sapiens
ugguugaugccaaaaa

SEQ ID NO: 1127768 - RNA, 18 nt, Homo sapiens
ugguuucccaagagcuac

SEQ ID NO: 1127769 - RNA, 23 nt, Homo sapiens
uguaaacuauaaacuacuguaau

SEQ ID NO: 1127770 - RNA, 23 nt, Homo sapiens
uguauaauuuucuacaaccuaag

SEQ ID NO: 1127771 - RNA, 19 nt, Homo sapiens
uguauucugcaacagccug

SEQ ID NO: 1127772 - RNA, 19 nt, Homo sapiens
ugucacucaccacuacauc

SEQ ID NO: 1127773 - RNA, 20 nt, Homo sapiens
ugucauggaaaagcccagug

SEQ ID NO: 1127774 - RNA, 16 nt, Homo sapiens
uguccaugaagcacug

SEQ ID NO: 1127775 - RNA, 14 nt, Homo sapiens
uguccccaccucag

SEQ ID NO: 1127776 - RNA, 19 nt, Homo sapiens
ugucgccaggcuagagugc

SEQ ID NO: 1127777 - RNA, 12 nt, Homo sapiens
ugucucugccug

SEQ ID NO: 1127778 - RNA, 21 nt, Homo sapiens
ugugaaacuguaaauuucaua

SEQ ID NO: 1127779 - RNA, 20 nt, Homo sapiens
ugugucagaguaacaugcca

SEQ ID NO: 1127780 - RNA, 19 nt, Homo sapiens
uguguccccaccucaggcu

SEQ ID NO: 1127781 - RNA, 13 nt, Homo sapiens
uguguugggaccu

SEQ ID NO: 1127782 - RNA, 17 nt, Homo sapiens
uguguugggaccuguga

SEQ ID NO: 1127783 - RNA, 16 nt, Homo sapiens
uguguuucaggacagc

SEQ ID NO: 1127784 - RNA, 17 nt, Homo sapiens
uguguuuggaagacuau

SEQ ID NO: 1127785 - RNA, 15 nt, Homo sapiens
uguuaaccauuugca

SEQ ID NO: 1127786 - RNA, 19 nt, Homo sapiens
uguuacacagcccaagagg

SEQ ID NO: 1127787 - RNA, 17 nt, Homo sapiens
uguucaguguugacaua

SEQ ID NO: 1127788 - RNA, 19 nt, Homo sapiens
uguucaguguugacauagc

SEQ ID NO: 1127789 - RNA, 20 nt, Homo sapiens
uguucaguguugacauagcc

SEQ ID NO: 1127790 - RNA, 17 nt, Homo sapiens
uguugugaaacuguaaa

SEQ ID NO: 1127791 - RNA, 13 nt, Homo sapiens
uguuucuaacuca

SEQ ID NO: 1127792 - RNA, 17 nt, Homo sapiens
uuaaaaaaauaagaaga

SEQ ID NO: 1127793 - RNA, 14 nt, Homo sapiens
uuaaaauagcaaaa

SEQ ID NO: 1127794 - RNA, 14 nt, Homo sapiens
uuaaacaacagcuc

SEQ ID NO: 1127795 - RNA, 18 nt, Homo sapiens
uuaaacuauaagcaagaa

SEQ ID NO: 1127796 - RNA, 21 nt, Homo sapiens
uuaaagaaguaaauuugucca

SEQ ID NO: 1127797 - RNA, 16 nt, Homo sapiens
uuaacuuauugcauaa

SEQ ID NO: 1127798 - RNA, 15 nt, Homo sapiens
uuacaaauaguucug

SEQ ID NO: 1127799 - RNA, 20 nt, Homo sapiens
uuaccaggcaccaaaagaag

SEQ ID NO: 1127800 - RNA, 12 nt, Homo sapiens
uuagaaugccuc

SEQ ID NO: 1127801 - RNA, 19 nt, Homo sapiens
uuauaccaccauccuugua

SEQ ID NO: 1127802 - RNA, 20 nt, Homo sapiens
uuaucaauguucuaguucug

SEQ ID NO: 1127803 - RNA, 18 nt, Homo sapiens
uuaugauuaaucugauua

SEQ ID NO: 1127804 - RNA, 16 nt, Homo sapiens
uuauguaucugguuaa

SEQ ID NO: 1127805 - RNA, 19 nt, Homo sapiens
uuauuaauuuuuauuauga

SEQ ID NO: 1127806 - RNA, 14 nt, Homo sapiens
uuauuagucuucaa

SEQ ID NO: 1127807 - RNA, 16 nt, Homo sapiens
uuauuugugggguaca

SEQ ID NO: 1127808 - RNA, 13 nt, Homo sapiens
uucaaaagcaauc

SEQ ID NO: 1127809 - RNA, 15 nt, Homo sapiens
uucaaccuacuuuca

SEQ ID NO: 1127810 - RNA, 21 nt, Homo sapiens
uuccacacagggugcauguga

SEQ ID NO: 1127811 - RNA, 18 nt, Homo sapiens
uuccccucuguguccucu

SEQ ID NO: 1127812 - RNA, 12 nt, Homo sapiens
uuccuucacuca

SEQ ID NO: 1127813 - RNA, 15 nt, Homo sapiens
uuccuugacuguaaa

SEQ ID NO: 1127814 - RNA, 16 nt, Homo sapiens
uuccuuugucauuauu

SEQ ID NO: 1127815 - RNA, 12 nt, Homo sapiens
uucuacaaccua

SEQ ID NO: 1127816 - RNA, 18 nt, Homo sapiens
uucuaucaaauacuagua

SEQ ID NO: 1127817 - RNA, 17 nt, Homo sapiens
uucugucacucaccacu

SEQ ID NO: 1127818 - RNA, 15 nt, Homo sapiens
uucuuaaauaagaaa

SEQ ID NO: 1127819 - RNA, 19 nt, Homo sapiens
uugaaguccuccagacaac

SEQ ID NO: 1127820 - RNA, 14 nt, Homo sapiens
uugcccaccacagc

SEQ ID NO: 1127821 - RNA, 15 nt, Homo sapiens
uugccuucuuucaua

SEQ ID NO: 1127822 - RNA, 14 nt, Homo sapiens
uugcuucuauuauu

SEQ ID NO: 1127823 - RNA, 16 nt, Homo sapiens
uuggaccguaucacug

SEQ ID NO: 1127824 - RNA, 18 nt, Homo sapiens
uuggacugacuaccagcu

SEQ ID NO: 1127825 - RNA, 10 nt, Homo sapiens
uugggcucca

SEQ ID NO: 1127826 - RNA, 19 nt, Homo sapiens
uuguauauaguuaguaucu

SEQ ID NO: 1127827 - RNA, 15 nt, Homo sapiens
uugugaaauacagua

SEQ ID NO: 1127828 - RNA, 17 nt, Homo sapiens
uugugucuggcaguuua

SEQ ID NO: 1127829 - RNA, 16 nt, Homo sapiens
uuuaaacuauaagcaa

SEQ ID NO: 1127830 - RNA, 12 nt, Homo sapiens
uuuaaauucucu

SEQ ID NO: 1127831 - RNA, 23 nt, Homo sapiens
uuuaagguagcaucauugaucuu

SEQ ID NO: 1127832 - RNA, 13 nt, Homo sapiens
uuuaggaagcaag

SEQ ID NO: 1127833 - RNA, 18 nt, Homo sapiens
uuuaucuguuuuguacuu

SEQ ID NO: 1127834 - RNA, 16 nt, Homo sapiens
uuucaaaaacagcuac

SEQ ID NO: 1127835 - RNA, 14 nt, Homo sapiens
uuucauacauuuga

SEQ ID NO: 1127836 - RNA, 16 nt, Homo sapiens
uuucauacauuugacu

SEQ ID NO: 1127837 - RNA, 20 nt, Homo sapiens
uuuccuggacuuaacucuaa

SEQ ID NO: 1127838 - RNA, 21 nt, Homo sapiens
uuucucugagcagucagggug

SEQ ID NO: 1127839 - RNA, 15 nt, Homo sapiens
uuucuguaacacacu

SEQ ID NO: 1127840 - RNA, 14 nt, Homo sapiens
uuucuucaccaaau

SEQ ID NO: 1127841 - RNA, 23 nt, Homo sapiens
uuucuuuguaaaggucagaguca

SEQ ID NO: 1127842 - RNA, 15 nt, Homo sapiens
uuugaaaacauacac

SEQ ID NO: 1127843 - RNA, 14 nt, Homo sapiens
uuuggaauuugaca

SEQ ID NO: 1127844 - RNA, 20 nt, Homo sapiens
uuuggguuugucaggaugga

SEQ ID NO: 1127845 - RNA, 13 nt, Homo sapiens
uuuguaaagguca

SEQ ID NO: 1127846 - RNA, 15 nt, Homo sapiens
uuuguccucucugug

SEQ ID NO: 1127847 - RNA, 12 nt, Homo sapiens
uuuuaaaacaca

SEQ ID NO: 1127848 - RNA, 12 nt, Homo sapiens
uuuuauaugauu

SEQ ID NO: 1127849 - RNA, 15 nt, Homo sapiens
uuuugauaaguaucu

SEQ ID NO: 1127850 - RNA, 22 nt, Homo sapiens
uuuuucaaaaacagcuacuuaa

SEQ ID NO: 1127851 - RNA, 18 nt, Homo sapiens
uuuuuuaaaaaagcuuaa

SEQ ID NO: 1127852 - RNA, 11 nt, Homo sapiens
cacauucccuc

SEQ ID NO: 1127853 - RNA, 15 nt, Homo sapiens
caccaaagucaggga

SEQ ID NO: 1127854 - RNA, 20 nt, Homo sapiens
cacccgagcuagagugcagu

SEQ ID NO: 1127855 - RNA, 15 nt, Homo sapiens
cacgaugucaaggac

SEQ ID NO: 1127856 - RNA, 12 nt, Homo sapiens
cacuauuuccau

SEQ ID NO: 1127857 - RNA, 17 nt, Homo sapiens
cacucagaaucuccuuc

SEQ ID NO: 1127858 - RNA, 18 nt, Homo sapiens
cacucauuccuucacuca

SEQ ID NO: 1127859 - RNA, 17 nt, Homo sapiens
cacucauuucaucucau

SEQ ID NO: 1127860 - RNA, 12 nt, Homo sapiens
cacucccaaagc

SEQ ID NO: 1127861 - RNA, 21 nt, Homo sapiens
cacugaaccuuguugaugcca

SEQ ID NO: 1127862 - RNA, 23 nt, Homo sapiens
cacuguccaugaagcacugagca

SEQ ID NO: 1127863 - RNA, 16 nt, Homo sapiens
cacuuagcccaagagg

SEQ ID NO: 1127864 - RNA, 16 nt, Homo sapiens
cagaaaacacagccug

SEQ ID NO: 1127865 - RNA, 12 nt, Homo sapiens
cagaaaugugua

SEQ ID NO: 1127866 - RNA, 23 nt, Homo sapiens
cagaagaaaaaguugcagucuca

SEQ ID NO: 1127867 - RNA, 15 nt, Homo sapiens
cagaauaaaugggua

SEQ ID NO: 1127868 - RNA, 14 nt, Homo sapiens
cagacacaggugua

SEQ ID NO: 1127869 - RNA, 20 nt, Homo sapiens
cagacaccuccuucuuccua

SEQ ID NO: 1127870 - RNA, 18 nt, Homo sapiens
cagagcugcugaggacaa

SEQ ID NO: 1127871 - RNA, 23 nt, Homo sapiens
cagagguggcugcugugcuagug

SEQ ID NO: 1127872 - RNA, 19 nt, Homo sapiens
cagaguaacaugccagcuu

SEQ ID NO: 1127873 - RNA, 22 nt, Homo sapiens
cagaucgauccuggauucacuc

SEQ ID NO: 1127874 - RNA, 20 nt, Homo sapiens
cagcaaaaugugaaugggaa

SEQ ID NO: 1127875 - RNA, 16 nt, Homo sapiens
cagcaaggauggagcu

SEQ ID NO: 1127876 - RNA, 13 nt, Homo sapiens
cagcagaugccaa

SEQ ID NO: 1127877 - RNA, 12 nt, Homo sapiens
cagccacagugu

SEQ ID NO: 1127878 - RNA, 22 nt, Homo sapiens
cagccacaguguuaugcucugu

SEQ ID NO: 1127879 - RNA, 15 nt, Homo sapiens
cagccaggaggggcu

SEQ ID NO: 1127880 - RNA, 14 nt, Homo sapiens
cagcgauccacgga

SEQ ID NO: 1127881 - RNA, 18 nt, Homo sapiens
cagcuaacuccagucucc

SEQ ID NO: 1127882 - RNA, 13 nt, Homo sapiens
cagcugcuucugu

SEQ ID NO: 1127883 - RNA, 21 nt, Homo sapiens
cagcugggugguguacaagca

SEQ ID NO: 1127884 - RNA, 19 nt, Homo sapiens
caggaaggggaaacacagc

SEQ ID NO: 1127885 - RNA, 13 nt, Homo sapiens
caggaauguauca

SEQ ID NO: 1127886 - RNA, 14 nt, Homo sapiens
caggacuacagcuu

SEQ ID NO: 1127887 - RNA, 22 nt, Homo sapiens
caggagaagcucaguagccuuu

SEQ ID NO: 1127888 - RNA, 22 nt, Homo sapiens
caggcuuuuccuccaaccugug

SEQ ID NO: 1127889 - RNA, 23 nt, Homo sapiens
cagggcaggaaggggaaacacag

SEQ ID NO: 1127890 - RNA, 23 nt, Homo sapiens
cagggugugagggauggggagca

SEQ ID NO: 1127891 - RNA, 15 nt, Homo sapiens
caggguucugaggca

SEQ ID NO: 1127892 - RNA, 21 nt, Homo sapiens
caggguucugaggcaaauggc

SEQ ID NO: 1127893 - RNA, 14 nt, Homo sapiens
cagguccuuccuuu

SEQ ID NO: 1127894 - RNA, 20 nt, Homo sapiens
cagguguaagccaccgugcc

SEQ ID NO: 1127895 - RNA, 14 nt, Homo sapiens
caguaaaaauccac

SEQ ID NO: 1127896 - RNA, 22 nt, Homo sapiens
caguaaaaauccacuauuucca

SEQ ID NO: 1127897 - RNA, 15 nt, Homo sapiens
cagugcccacagcca

SEQ ID NO: 1127898 - RNA, 21 nt, Homo sapiens
cagugcuggggguuucuguag

SEQ ID NO: 1127899 - RNA, 15 nt, Homo sapiens
caguguugacauagc

SEQ ID NO: 1127900 - RNA, 19 nt, Homo sapiens
caguguugacauagccuuu

SEQ ID NO: 1127901 - RNA, 18 nt, Homo sapiens
cauaauugcuuauguaug

SEQ ID NO: 1127902 - RNA, 21 nt, Homo sapiens
cauacugaagaugcagcaaaa

SEQ ID NO: 1127903 - RNA, 19 nt, Homo sapiens
cauacuuucccacagcacu

SEQ ID NO: 1127904 - RNA, 24 nt, Homo sapiens
cauagcugagcuggaaaggaugcu

SEQ ID NO: 1127905 - RNA, 13 nt, Homo sapiens
cauaucacucaau

SEQ ID NO: 1127906 - RNA, 22 nt, Homo sapiens
caucccacaugaucuugagauu

SEQ ID NO: 1127907 - RNA, 19 nt, Homo sapiens
caugaaacauuacaggaaa

SEQ ID NO: 1127908 - RNA, 13 nt, Homo sapiens
caugaagcacuga

SEQ ID NO: 1127909 - RNA, 15 nt, Homo sapiens
caugccuggagacau

SEQ ID NO: 1127910 - RNA, 18 nt, Homo sapiens
cauuaaagaaggguugag

SEQ ID NO: 1127911 - RNA, 17 nt, Homo sapiens
cauuuacuuuaauuucc

SEQ ID NO: 1127912 - RNA, 22 nt, Homo sapiens
cauuuguggucacagccaugaa

SEQ ID NO: 1127913 - RNA, 13 nt, Homo sapiens
cauuugugucugc

SEQ ID NO: 1127914 - RNA, 17 nt, Homo sapiens
ccaaacacacuguaaau

SEQ ID NO: 1127915 - RNA, 22 nt, Homo sapiens
ccaaaccgcaggcaaacggguc

SEQ ID NO: 1127916 - RNA, 14 nt, Homo sapiens
ccaaaucaccacaa

SEQ ID NO: 1127917 - RNA, 20 nt, Homo sapiens
ccaaaucugcauccuuuuca

SEQ ID NO: 1127918 - RNA, 19 nt, Homo sapiens
ccaagaggacugagacugg

SEQ ID NO: 1127919 - RNA, 20 nt, Homo sapiens
ccaagggcuccagggccagg

SEQ ID NO: 1127920 - RNA, 14 nt, Homo sapiens
ccaauggcuguaaa

SEQ ID NO: 1127921 - RNA, 13 nt, Homo sapiens
ccacaccaaaguc

SEQ ID NO: 1127922 - RNA, 23 nt, Homo sapiens
ccacagccaagguagggucacua

SEQ ID NO: 1127923 - RNA, 16 nt, Homo sapiens
ccaccucaggcugcca

SEQ ID NO: 1127924 - RNA, 20 nt, Homo sapiens
ccacguaugugaaacacaca

SEQ ID NO: 1127925 - RNA, 17 nt, Homo sapiens
ccacucccaaagcucag

SEQ ID NO: 1127926 - RNA, 21 nt, Homo sapiens
ccagaaacguaacugugugca

SEQ ID NO: 1127927 - RNA, 19 nt, Homo sapiens
ccagaaagaggcagugauu

SEQ ID NO: 1127928 - RNA, 20 nt, Homo sapiens
ccagaaauagccacuauuaa

SEQ ID NO: 1127929 - RNA, 18 nt, Homo sapiens
ccagaucgauccuggauu

SEQ ID NO: 1127930 - RNA, 23 nt, Homo sapiens
ccagcaugaagguggggccagug

SEQ ID NO: 1127931 - RNA, 13 nt, Homo sapiens
ccagccacagugu

SEQ ID NO: 1127932 - RNA, 21 nt, Homo sapiens
ccaggaggggcuguccaauca

SEQ ID NO: 1127933 - RNA, 23 nt, Homo sapiens
ccaggcuugggcuccauucccau

SEQ ID NO: 1127934 - RNA, 17 nt, Homo sapiens
ccagggcucuguauucu

SEQ ID NO: 1127935 - RNA, 15 nt, Homo sapiens
ccaguaaaaauccac

SEQ ID NO: 1127936 - RNA, 16 nt, Homo sapiens
ccaguaaaaauccacu

SEQ ID NO: 1127937 - RNA, 19 nt, Homo sapiens
ccauacuuucccacagcac

SEQ ID NO: 1127938 - RNA, 22 nt, Homo sapiens
ccaucguccuuccucucaagcu

SEQ ID NO: 1127939 - RNA, 19 nt, Homo sapiens
ccaugaagcacugagcaga

SEQ ID NO: 1127940 - RNA, 17 nt, Homo sapiens
ccaugaggacaaagugu

SEQ ID NO: 1127941 - RNA, 16 nt, Homo sapiens
ccaugugacuguauua

SEQ ID NO: 1127942 - RNA, 16 nt, Homo sapiens
ccauugauucuucaga

SEQ ID NO: 1127943 - RNA, 23 nt, Homo sapiens
ccauuguguugggaccugugauc

SEQ ID NO: 1127944 - RNA, 20 nt, Homo sapiens
cccaaagcucagacuugcca

SEQ ID NO: 1127945 - RNA, 23 nt, Homo sapiens
cccaaguguugaggggaccaaag

SEQ ID NO: 1127946 - RNA, 15 nt, Homo sapiens
cccacauuuuccuua

SEQ ID NO: 1127947 - RNA, 20 nt, Homo sapiens
aaaaacacagugcacucaga

SEQ ID NO: 1127948 - RNA, 15 nt, Homo sapiens
aaaaauguccagcca

SEQ ID NO: 1127949 - RNA, 17 nt, Homo sapiens
aaaagaauaguugccaa

SEQ ID NO: 1127950 - RNA, 20 nt, Homo sapiens
aaaauagcuaaauaccucaa

SEQ ID NO: 1127951 - RNA, 17 nt, Homo sapiens
aaaaugcaacgcuguaa

SEQ ID NO: 1127952 - RNA, 23 nt, Homo sapiens
aaaauuauuuaaaccgcuaaaag

SEQ ID NO: 1127953 - RNA, 19 nt, Homo sapiens
aaaauuucaaaagugaucu

SEQ ID NO: 1127954 - RNA, 19 nt, Homo sapiens
aaacaaaaccaacucagac

SEQ ID NO: 1127955 - RNA, 12 nt, Homo sapiens
aaacaacagcuc

SEQ ID NO: 1127956 - RNA, 17 nt, Homo sapiens
aaaccuuccucuuccag

SEQ ID NO: 1127957 - RNA, 19 nt, Homo sapiens
aaacuuggaaccuuggaaa

SEQ ID NO: 1127958 - RNA, 14 nt, Homo sapiens
aaagagcuguuaua

SEQ ID NO: 1127959 - RNA, 20 nt, Homo sapiens
aaagcaagcauucagaagaa

SEQ ID NO: 1127960 - RNA, 15 nt, Homo sapiens
aaagcaauugugaaa

SEQ ID NO: 1127961 - RNA, 14 nt, Homo sapiens
aaagcacaccucau

SEQ ID NO: 1127962 - RNA, 21 nt, Homo sapiens
aaagcuguguguuuggaagac

SEQ ID NO: 1127963 - RNA, 16 nt, Homo sapiens
aaaggaagacuugaag

SEQ ID NO: 1127964 - RNA, 15 nt, Homo sapiens
aaaguugcagucuca

SEQ ID NO: 1127965 - RNA, 15 nt, Homo sapiens
aaaguuuaaccuaaa

SEQ ID NO: 1127966 - RNA, 17 nt, Homo sapiens
aaauagcaaaagaagaa

SEQ ID NO: 1127967 - RNA, 15 nt, Homo sapiens
aaauagccacuauua

SEQ ID NO: 1127968 - RNA, 21 nt, Homo sapiens
aaauuaucuauaaucucagaa

SEQ ID NO: 1127969 - RNA, 14 nt, Homo sapiens
aaauuuguccaaug

SEQ ID NO: 1127970 - RNA, 21 nt, Homo sapiens
aaauuuguccaauggcuguaa

SEQ ID NO: 1127971 - RNA, 18 nt, Homo sapiens
aacaaaaaaagcaucuca

SEQ ID NO: 1127972 - RNA, 21 nt, Homo sapiens
aacaaggacccuguuuuccac

SEQ ID NO: 1127973 - RNA, 19 nt, Homo sapiens
aacacagaaacuauaugca

SEQ ID NO: 1127974 - RNA, 21 nt, Homo sapiens
aacacauaauugcuuauguau

SEQ ID NO: 1127975 - RNA, 16 nt, Homo sapiens
aacaucauucuugaga

SEQ ID NO: 1127976 - RNA, 16 nt, Homo sapiens
aacaugguaugaaggu

SEQ ID NO: 1127977 - RNA, 15 nt, Homo sapiens
aaccuauccuuccag

SEQ ID NO: 1127978 - RNA, 23 nt, Homo sapiens
aaccucaguaauuuagaaaucau

SEQ ID NO: 1127979 - RNA, 14 nt, Homo sapiens
aaccuuucccucac

SEQ ID NO: 1127980 - RNA, 14 nt, Homo sapiens
aacgcaccagacac

SEQ ID NO: 1127981 - RNA, 14 nt, Homo sapiens
aacuauaagcaaga

SEQ ID NO: 1127982 - RNA, 14 nt, Homo sapiens
aacugagaucucca

SEQ ID NO: 1127983 - RNA, 15 nt, Homo sapiens
aacugagccaaacac

SEQ ID NO: 1127984 - RNA, 22 nt, Homo sapiens
aacugaugcgaaaacuugaauc

SEQ ID NO: 1127985 - RNA, 15 nt, Homo sapiens
aacuguggugccaca

SEQ ID NO: 1127986 - RNA, 21 nt, Homo sapiens
aacuuauugcauaacagcaga

SEQ ID NO: 1127987 - RNA, 14 nt, Homo sapiens
aacuucucugaguc

SEQ ID NO: 1127988 - RNA, 17 nt, Homo sapiens
aagaaaaaguugcaguc

SEQ ID NO: 1127989 - RNA, 20 nt, Homo sapiens
aagaaaaaguugcagucuca

SEQ ID NO: 1127990 - RNA, 18 nt, Homo sapiens
aagaaauguuuauacaau

SEQ ID NO: 1127991 - RNA, 20 nt, Homo sapiens
aagaagcagucaauuuucac

SEQ ID NO: 1127992 - RNA, 14 nt, Homo sapiens
aagaggacugagac

SEQ ID NO: 1127993 - RNA, 13 nt, Homo sapiens
aagaggcagugag

SEQ ID NO: 1127994 - RNA, 20 nt, Homo sapiens
aagaucgugccauugcacuc

SEQ ID NO: 1127995 - RNA, 15 nt, Homo sapiens
aagaugcagcaaaau

SEQ ID NO: 1127996 - RNA, 20 nt, Homo sapiens
aagcaacacuuugugaucuc

SEQ ID NO: 1127997 - RNA, 15 nt, Homo sapiens
aagcucagacuugcc

SEQ ID NO: 1127998 - RNA, 15 nt, Homo sapiens
aagcugauucacuau

SEQ ID NO: 1127999 - RNA, 13 nt, Homo sapiens
aagcuggaggcac

SEQ ID NO: 1128000 - RNA, 13 nt, Homo sapiens
aagcuggcuuccu

SEQ ID NO: 1128001 - RNA, 20 nt, Homo sapiens
aaggauaucgggucacuguc

SEQ ID NO: 1128002 - RNA, 18 nt, Homo sapiens
aaggggcauuacugggaa

SEQ ID NO: 1128003 - RNA, 19 nt, Homo sapiens
aagugaaaaaaacaaccua

SEQ ID NO: 1128004 - RNA, 14 nt, Homo sapiens
aagugaucuguccc

SEQ ID NO: 1128005 - RNA, 18 nt, Homo sapiens
aaguguucaguguugaca

SEQ ID NO: 1128006 - RNA, 13 nt, Homo sapiens
aaguuagcauuuc

SEQ ID NO: 1128007 - RNA, 22 nt, Homo sapiens
aaguuucccuucucccagucca

SEQ ID NO: 1128008 - RNA, 23 nt, Homo sapiens
aaguuucccuucucccaguccaa

SEQ ID NO: 1128009 - RNA, 20 nt, Homo sapiens
aauaaaauuuaucuuguuca

SEQ ID NO: 1128010 - RNA, 18 nt, Homo sapiens
aauaaacuuaacaaagag

SEQ ID NO: 1128011 - RNA, 18 nt, Homo sapiens
aauaaugccuaguggcuu

SEQ ID NO: 1128012 - RNA, 23 nt, Homo sapiens
aauacaauaguaugcagcuaaaa

SEQ ID NO: 1128013 - RNA, 19 nt, Homo sapiens
aauagguucaaaagcaauc

SEQ ID NO: 1128014 - RNA, 18 nt, Homo sapiens
aauauuuuuuaaaaccau

SEQ ID NO: 1128015 - RNA, 14 nt, Homo sapiens
aaucucauucccag

SEQ ID NO: 1128016 - RNA, 23 nt, Homo sapiens
aaucugcauccuuuucaaaaccu

SEQ ID NO: 1128017 - RNA, 18 nt, Homo sapiens
aaugguguaauuuugucc

SEQ ID NO: 1128018 - RNA, 22 nt, Homo sapiens
aaugguuucccgggcccagaaa

SEQ ID NO: 1128019 - RNA, 12 nt, Homo sapiens
aauuaagugcaa

SEQ ID NO: 1128020 - RNA, 17 nt, Homo sapiens
aauucucucucuugcag

SEQ ID NO: 1128021 - RNA, 18 nt, Homo sapiens
aauugagcaccuacugug

SEQ ID NO: 1128022 - RNA, 16 nt, Homo sapiens
aauuuucuacaaccua

SEQ ID NO: 1128023 - RNA, 20 nt, Homo sapiens
ccucuccagcccuauggaag

SEQ ID NO: 1128024 - RNA, 15 nt, Homo sapiens
ccucugggagccuga

SEQ ID NO: 1128025 - RNA, 22 nt, Homo sapiens
ccugacauuaagacacaccucu

SEQ ID NO: 1128026 - RNA, 21 nt, Homo sapiens
ccugacccugugaugccugac

SEQ ID NO: 1128027 - RNA, 23 nt, Homo sapiens
ccugagaagagagaucaaaugga

SEQ ID NO: 1128028 - RNA, 19 nt, Homo sapiens
ccugcgagaggucccugcu

SEQ ID NO: 1128029 - RNA, 14 nt, Homo sapiens
ccugcugugcccuc

SEQ ID NO: 1128030 - RNA, 23 nt, Homo sapiens
ccuggaacuagaaacagaggugg

SEQ ID NO: 1128031 - RNA, 22 nt, Homo sapiens
ccuggaggugggagacaaggaa

SEQ ID NO: 1128032 - RNA, 22 nt, Homo sapiens
ccugggcauacuaauaaaguau

SEQ ID NO: 1128033 - RNA, 22 nt, Homo sapiens
ccuggggcuggguguguuucag

SEQ ID NO: 1128034 - RNA, 20 nt, Homo sapiens
ccuguaaucccagcuacuug

SEQ ID NO: 1128035 - RNA, 23 nt, Homo sapiens
ccugucuuagccucccaaagugc

SEQ ID NO: 1128036 - RNA, 12 nt, Homo sapiens
ccugugaucucc

SEQ ID NO: 1128037 - RNA, 18 nt, Homo sapiens
ccuguuuuccacaccauc

SEQ ID NO: 1128038 - RNA, 16 nt, Homo sapiens
ccuuccacacagggug

SEQ ID NO: 1128039 - RNA, 21 nt, Homo sapiens
ccuuccuuuaggucugguugu

SEQ ID NO: 1128040 - RNA, 14 nt, Homo sapiens
cgaacaaacugaug

SEQ ID NO: 1128041 - RNA, 18 nt, Homo sapiens
cgauccuggauucacuca

SEQ ID NO: 1128042 - RNA, 15 nt, Homo sapiens
cgcaacaacaaggac

SEQ ID NO: 1128043 - RNA, 13 nt, Homo sapiens
cggcuuccaggga

SEQ ID NO: 1128044 - RNA, 20 nt, Homo sapiens
cgggggaaagcacaccucau

SEQ ID NO: 1128045 - RNA, 13 nt, Homo sapiens
cgugcacucccua

SEQ ID NO: 1128046 - RNA, 22 nt, Homo sapiens
cuaaacuguuuauuugcacuau

SEQ ID NO: 1128047 - RNA, 18 nt, Homo sapiens
cuaaacuuuccaaaaccu

SEQ ID NO: 1128048 - RNA, 13 nt, Homo sapiens
cuaaagugucuau

SEQ ID NO: 1128049 - RNA, 15 nt, Homo sapiens
cuaagaggcagugag

SEQ ID NO: 1128050 - RNA, 15 nt, Homo sapiens
cuacauuuacuuuaa

SEQ ID NO: 1128051 - RNA, 17 nt, Homo sapiens
cuaccaguuggccauga

SEQ ID NO: 1128052 - RNA, 21 nt, Homo sapiens
cuacccaguaaaaauccacua

SEQ ID NO: 1128053 - RNA, 16 nt, Homo sapiens
cuagagaaggcuguga

SEQ ID NO: 1128054 - RNA, 18 nt, Homo sapiens
cuagagugcaguggugca

SEQ ID NO: 1128055 - RNA, 18 nt, Homo sapiens
cuaggcaaagacuggccu

SEQ ID NO: 1128056 - RNA, 21 nt, Homo sapiens
cuaggcaaagacuggccugau

SEQ ID NO: 1128057 - RNA, 21 nt, Homo sapiens
cuaguagaacucacagaaaua

SEQ ID NO: 1128058 - RNA, 15 nt, Homo sapiens
cuaguuuuacuuuga

SEQ ID NO: 1128059 - RNA, 19 nt, Homo sapiens
cuauaaguguucaguguug

SEQ ID NO: 1128060 - RNA, 14 nt, Homo sapiens
cuauaaucucagaa

SEQ ID NO: 1128061 - RNA, 14 nt, Homo sapiens
cuaucacagucuac

SEQ ID NO: 1128062 - RNA, 19 nt, Homo sapiens
cuauccugcaauuucuccc

SEQ ID NO: 1128063 - RNA, 22 nt, Homo sapiens
cuauugaacugagccaaacaca

SEQ ID NO: 1128064 - RNA, 15 nt, Homo sapiens
cucaaccugggacuu

SEQ ID NO: 1128065 - RNA, 16 nt, Homo sapiens
cucaauccuaucacag

SEQ ID NO: 1128066 - RNA, 14 nt, Homo sapiens
cucacuacagccuc

SEQ ID NO: 1128067 - RNA, 15 nt, Homo sapiens
cucagccgugcacuc

SEQ ID NO: 1128068 - RNA, 15 nt, Homo sapiens
cucauuuaagggaaa

SEQ ID NO: 1128069 - RNA, 13 nt, Homo sapiens
cucauuucaucuc

SEQ ID NO: 1128070 - RNA, 15 nt, Homo sapiens
cucauuucaucucau

SEQ ID NO: 1128071 - RNA, 18 nt, Homo sapiens
cuccaaggaccucucuca

SEQ ID NO: 1128072 - RNA, 22 nt, Homo sapiens
cuccaaggaccucucucaaugc

SEQ ID NO: 1128073 - RNA, 21 nt, Homo sapiens
cuccacaccaaagucagggag

SEQ ID NO: 1128074 - RNA, 22 nt, Homo sapiens
cuccagucuccugacauuaaga

SEQ ID NO: 1128075 - RNA, 15 nt, Homo sapiens
cuccaucaugcuuga

SEQ ID NO: 1128076 - RNA, 17 nt, Homo sapiens
cuccaucaugcuugauu

SEQ ID NO: 1128077 - RNA, 15 nt, Homo sapiens
cucccaguccaagac

SEQ ID NO: 1128078 - RNA, 23 nt, Homo sapiens
cuccccuccaucccuggcccccu

SEQ ID NO: 1128079 - RNA, 19 nt, Homo sapiens
cuccccucugcccuguaua

SEQ ID NO: 1128080 - RNA, 12 nt, Homo sapiens
cuccccuguauu

SEQ ID NO: 1128081 - RNA, 16 nt, Homo sapiens
cuccugacccugugau

SEQ ID NO: 1128082 - RNA, 17 nt, Homo sapiens
cuccugaggucuggauu

SEQ ID NO: 1128083 - RNA, 22 nt, Homo sapiens
cucgggggaaagcacaccucau

SEQ ID NO: 1128084 - RNA, 21 nt, Homo sapiens
cucgucuuccucucucucacc

SEQ ID NO: 1128085 - RNA, 15 nt, Homo sapiens
cucuaaaagggggcu

SEQ ID NO: 1128086 - RNA, 16 nt, Homo sapiens
cucucaccuacuuccu

SEQ ID NO: 1128087 - RNA, 21 nt, Homo sapiens
cucugggcagcugucauggaa

SEQ ID NO: 1128088 - RNA, 15 nt, Homo sapiens
cucuucccaccucag

SEQ ID NO: 1128089 - RNA, 19 nt, Homo sapiens
cucuuuuugggugauuaaa

SEQ ID NO: 1128090 - RNA, 21 nt, Homo sapiens
cugaacuggcugaaguucaag

SEQ ID NO: 1128091 - RNA, 18 nt, Homo sapiens
cugaaugugccuaaugga

SEQ ID NO: 1128092 - RNA, 19 nt, Homo sapiens
cugagaugcacgaugcugg

SEQ ID NO: 1128093 - RNA, 22 nt, Homo sapiens
cugagcagaagcuggaggcaca

SEQ ID NO: 1128094 - RNA, 14 nt, Homo sapiens
cugagcaguaccag

SEQ ID NO: 1128095 - RNA, 16 nt, Homo sapiens
cugagcaguaccagug

SEQ ID NO: 1128096 - RNA, 15 nt, Homo sapiens
cugagcgcuguguua

SEQ ID NO: 1128097 - RNA, 18 nt, Homo sapiens
cugaguucucauccacag

SEQ ID NO: 1128098 - RNA, 24 nt, Homo sapiens
cugauacagccuuacaauacaaua

SEQ ID NO: 1128099 - RNA, 18 nt, Homo sapiens
cugcaguuuuugacuuca

SEQ ID NO: 1128100 - RNA, 15 nt, Homo sapiens
cugccagcucucuga

SEQ ID NO: 1128101 - RNA, 23 nt, Homo sapiens
cugcccguaaaaccugagccauu

SEQ ID NO: 1128102 - RNA, 18 nt, Homo sapiens
cugccuacaaaauggaga

SEQ ID NO: 1128103 - RNA, 20 nt, Homo sapiens
cugccuauuaguaguuaauu

SEQ ID NO: 1128104 - RNA, 17 nt, Homo sapiens
cugccucaugcucucua

SEQ ID NO: 1128105 - RNA, 13 nt, Homo sapiens
cugcuacccagua

SEQ ID NO: 1128106 - RNA, 16 nt, Homo sapiens
cugcucacauucccuc

SEQ ID NO: 1128107 - RNA, 14 nt, Homo sapiens
cugcugaggacaau

SEQ ID NO: 1128108 - RNA, 19 nt, Homo sapiens
cuggaaaggaugcuucugc

SEQ ID NO: 1128109 - RNA, 15 nt, Homo sapiens
cuggaagcugauuca

SEQ ID NO: 1128110 - RNA, 23 nt, Homo sapiens
cuggacacuguccaugaagcacu

SEQ ID NO: 1128111 - RNA, 15 nt, Homo sapiens
cuggagggacaggga

SEQ ID NO: 1128112 - RNA, 15 nt, Homo sapiens
cuggauucacucacu

SEQ ID NO: 1128113 - RNA, 20 nt, Homo sapiens
cuggauuuguuucugugauc

SEQ ID NO: 1128114 - RNA, 20 nt, Homo sapiens
cuggcacuuagcccaagagg

SEQ ID NO: 1128115 - RNA, 22 nt, Homo sapiens
cugggauggggcauguggccaa

SEQ ID NO: 1128116 - RNA, 20 nt, Homo sapiens
cugggcagcugucauggaaa

SEQ ID NO: 1128117 - RNA, 19 nt, Homo sapiens
cuggggucuguguggugcc

SEQ ID NO: 1128118 - RNA, 14 nt, Homo sapiens
cuggguguguuuca

SEQ ID NO: 1128119 - RNA, 16 nt, Homo sapiens
cuguaacacacuaaca

SEQ ID NO: 1128120 - RNA, 16 nt, Homo sapiens
cuguacuguaauuucu

SEQ ID NO: 1128121 - RNA, 21 nt, Homo sapiens
cuguauucccccaucuagcca

SEQ ID NO: 1128122 - RNA, 15 nt, Homo sapiens
cuguauucugcaaca

SEQ ID NO: 1128123 - RNA, 18 nt, Homo sapiens
cugucauggaaaagccca

SEQ ID NO: 1128124 - RNA, 21 nt, Homo sapiens
cuguccaugaagcacugagca

SEQ ID NO: 1128125 - RNA, 22 nt, Homo sapiens
cuguccaugaagcacugagcag

SEQ ID NO: 1128126 - RNA, 23 nt, Homo sapiens
cuguccccucuccccucauggag

SEQ ID NO: 1128127 - RNA, 22 nt, Homo sapiens
cuguuacugcuugggcuauacc

SEQ ID NO: 1128128 - RNA, 17 nt, Homo sapiens
cuuaaaacaaagccaug

SEQ ID NO: 1128129 - RNA, 11 nt, Homo sapiens
cuuaacaaaga

SEQ ID NO: 1128130 - RNA, 20 nt, Homo sapiens
cuuacuucgugcgcaacaac

SEQ ID NO: 1128131 - RNA, 18 nt, Homo sapiens
cuuagcccaagaggucug

SEQ ID NO: 1128132 - RNA, 15 nt, Homo sapiens
cuuagccccagacuc

SEQ ID NO: 1128133 - RNA, 17 nt, Homo sapiens
cuuagccucccaaagug

SEQ ID NO: 1128134 - RNA, 15 nt, Homo sapiens
cuuccacacagggug

SEQ ID NO: 1128135 - RNA, 15 nt, Homo sapiens
cuuccccagguccuu

SEQ ID NO: 1128136 - RNA, 17 nt, Homo sapiens
cuuccucuuccagcaac

SEQ ID NO: 1128137 - RNA, 14 nt, Homo sapiens
cuuccuggguccug

SEQ ID NO: 1128138 - RNA, 21 nt, Homo sapiens
cuuccuggguccuguucccua

SEQ ID NO: 1128139 - RNA, 15 nt, Homo sapiens
cuucugcucacauuc

SEQ ID NO: 1128140 - RNA, 21 nt, Homo sapiens
cuucuuccuuauuucacugaa

SEQ ID NO: 1128141 - RNA, 13 nt, Homo sapiens
cuugaaucuguua

SEQ ID NO: 1128142 - RNA, 14 nt, Homo sapiens
uacuuaagugcugc

SEQ ID NO: 1128143 - RNA, 18 nt, Homo sapiens
uacuuucccacagcacua

SEQ ID NO: 1128144 - RNA, 15 nt, Homo sapiens
uagaagugcaagaaa

SEQ ID NO: 1128145 - RNA, 18 nt, Homo sapiens
uagaauggaugugcucac

SEQ ID NO: 1128146 - RNA, 18 nt, Homo sapiens
uagagaaggcugugagcc

SEQ ID NO: 1128147 - RNA, 18 nt, Homo sapiens
uagagcucaggccugcug

SEQ ID NO: 1128148 - RNA, 17 nt, Homo sapiens
uagagugcaguggugca

SEQ ID NO: 1128149 - RNA, 15 nt, Homo sapiens
uagauaagucaauau

SEQ ID NO: 1128150 - RNA, 19 nt, Homo sapiens
uagccuuuggggacggcca

SEQ ID NO: 1128151 - RNA, 15 nt, Homo sapiens
uagcuguacuguaau

SEQ ID NO: 1128152 - RNA, 19 nt, Homo sapiens
uaggcauccugugugcuga

SEQ ID NO: 1128153 - RNA, 20 nt, Homo sapiens
uagggcuggagggacaggga

SEQ ID NO: 1128154 - RNA, 20 nt, Homo sapiens
uaguaguuaauucugucacu

SEQ ID NO: 1128155 - RNA, 20 nt, Homo sapiens
uaguauuaauuuauguaucu

SEQ ID NO: 1128156 - RNA, 16 nt, Homo sapiens
uagugauaucuagaaa

SEQ ID NO: 1128157 - RNA, 15 nt, Homo sapiens
uaguuuucagccuug

SEQ ID NO: 1128158 - RNA, 14 nt, Homo sapiens
uauaaacacauaau

SEQ ID NO: 1128159 - RNA, 21 nt, Homo sapiens
uauaaccagacacauacucau

SEQ ID NO: 1128160 - RNA, 14 nt, Homo sapiens
uauaagaguaauau

SEQ ID NO: 1128161 - RNA, 19 nt, Homo sapiens
uauaaguguucaguguuga

SEQ ID NO: 1128162 - RNA, 18 nt, Homo sapiens
uauaccugggcauacuaa

SEQ ID NO: 1128163 - RNA, 20 nt, Homo sapiens
uauaccugggcauacuaaua

SEQ ID NO: 1128164 - RNA, 23 nt, Homo sapiens
uauagauuucuauaaaagcaaga

SEQ ID NO: 1128165 - RNA, 12 nt, Homo sapiens
uauauacuaaua

SEQ ID NO: 1128166 - RNA, 19 nt, Homo sapiens
uaucaaauacuaguauuaa

SEQ ID NO: 1128167 - RNA, 15 nt, Homo sapiens
uaucccugguuccua

SEQ ID NO: 1128168 - RNA, 13 nt, Homo sapiens
uaucgggucacug

SEQ ID NO: 1128169 - RNA, 22 nt, Homo sapiens
uaugaggaaaaguuuaaccuaa

SEQ ID NO: 1128170 - RNA, 23 nt, Homo sapiens
uauguauauauuuuucugauuau

SEQ ID NO: 1128171 - RNA, 20 nt, Homo sapiens
uauucccccaucuagccauu

SEQ ID NO: 1128172 - RNA, 16 nt, Homo sapiens
uauuuaaacaacagcu

SEQ ID NO: 1128173 - RNA, 14 nt, Homo sapiens
uauuuuacauagau

SEQ ID NO: 1128174 - RNA, 18 nt, Homo sapiens
ucaaaagugaucuguccc

SEQ ID NO: 1128175 - RNA, 17 nt, Homo sapiens
ucaaagcccacauacug

SEQ ID NO: 1128176 - RNA, 22 nt, Homo sapiens
ucaaccccuccccuccaucccu

SEQ ID NO: 1128177 - RNA, 23 nt, Homo sapiens
ucaagccuccccaguucuacuga

SEQ ID NO: 1128178 - RNA, 19 nt, Homo sapiens
ucaauucugauacagccuu

SEQ ID NO: 1128179 - RNA, 14 nt, Homo sapiens
ucaauuucucugag

SEQ ID NO: 1128180 - RNA, 14 nt, Homo sapiens
ucacagucuacuga

SEQ ID NO: 1128181 - RNA, 16 nt, Homo sapiens
ucaccacaaaggaccc

SEQ ID NO: 1128182 - RNA, 13 nt, Homo sapiens
ucacuacagccuc

SEQ ID NO: 1128183 - RNA, 20 nt, Homo sapiens
ucacucaauuucucugagga

SEQ ID NO: 1128184 - RNA, 22 nt, Homo sapiens
ucacucaauuucucugaggaca

SEQ ID NO: 1128185 - RNA, 20 nt, Homo sapiens
ucacugcaagucacauaaaa

SEQ ID NO: 1128186 - RNA, 14 nt, Homo sapiens
ucagaacccagaaa

SEQ ID NO: 1128187 - RNA, 15 nt, Homo sapiens
ucagaauccacaacu

SEQ ID NO: 1128188 - RNA, 22 nt, Homo sapiens
ucagacaauccacucucaggag

SEQ ID NO: 1128189 - RNA, 22 nt, Homo sapiens
ucagaguggccaaucccugugu

SEQ ID NO: 1128190 - RNA, 15 nt, Homo sapiens
ucagcagacacaggu

SEQ ID NO: 1128191 - RNA, 16 nt, Homo sapiens
ucagggagccuggaag

SEQ ID NO: 1128192 - RNA, 13 nt, Homo sapiens
ucagucacuugaa

SEQ ID NO: 1128193 - RNA, 14 nt, Homo sapiens
ucaguguugacaua

SEQ ID NO: 1128194 - RNA, 17 nt, Homo sapiens
ucaguguugacauagcc

SEQ ID NO: 1128195 - RNA, 15 nt, Homo sapiens
ucaugcacucaggca

SEQ ID NO: 1128196 - RNA, 16 nt, Homo sapiens
ucauggaaaagcccag

SEQ ID NO: 1128197 - RNA, 15 nt, Homo sapiens
ucauucuucuggcaa

SEQ ID NO: 1128198 - RNA, 17 nt, Homo sapiens
uccaaaaccuuccucuu

SEQ ID NO: 1128199 - RNA, 18 nt, Homo sapiens
uccaaaccgcaggcaaac

SEQ ID NO: 1128200 - RNA, 23 nt, Homo sapiens
uccaaggaccucucucaaugcca

SEQ ID NO: 1128201 - RNA, 13 nt, Homo sapiens
uccaauggcugua

SEQ ID NO: 1128202 - RNA, 14 nt, Homo sapiens
uccaccacaguaaa

SEQ ID NO: 1128203 - RNA, 10 nt, Homo sapiens
uccacuauuu

SEQ ID NO: 1128204 - RNA, 15 nt, Homo sapiens
uccaugaagcacuga

SEQ ID NO: 1128205 - RNA, 16 nt, Homo sapiens
uccaugaagcacugag

SEQ ID NO: 1128206 - RNA, 17 nt, Homo sapiens
uccauucccaucacugc

SEQ ID NO: 1128207 - RNA, 17 nt, Homo sapiens
ucccagccacaguguua

SEQ ID NO: 1128208 - RNA, 19 nt, Homo sapiens
ucccaguaaagauaccaug

SEQ ID NO: 1128209 - RNA, 14 nt, Homo sapiens
ucccauagcacugc

SEQ ID NO: 1128210 - RNA, 16 nt, Homo sapiens
ucccauucagcuguga

SEQ ID NO: 1128211 - RNA, 16 nt, Homo sapiens
ucccauuuguguuuca

SEQ ID NO: 1128212 - RNA, 21 nt, Homo sapiens
ucccccagcccucaguuuuca

SEQ ID NO: 1128213 - RNA, 13 nt, Homo sapiens
ucccgaauccuga

SEQ ID NO: 1128214 - RNA, 15 nt, Homo sapiens
ucccgggcccagaaa

SEQ ID NO: 1128215 - RNA, 13 nt, Homo sapiens
ucccuauguccca

SEQ ID NO: 1128216 - RNA, 23 nt, Homo sapiens
ucccugacucuuagccccagacu

SEQ ID NO: 1128217 - RNA, 12 nt, Homo sapiens
ucccuggaugac

SEQ ID NO: 1128218 - RNA, 17 nt, Homo sapiens
ucccuggaugacauuaa

SEQ ID NO: 1128219 - RNA, 23 nt, Homo sapiens
ucccuggcccccucccuggauga

SEQ ID NO: 1128220 - RNA, 16 nt, Homo sapiens
ucccuguguggcugcu

SEQ ID NO: 1128221 - RNA, 17 nt, Homo sapiens
ucccuucucccagucca

SEQ ID NO: 1128222 - RNA, 14 nt, Homo sapiens
uccggggugcaaug

SEQ ID NO: 1128223 - RNA, 21 nt, Homo sapiens
uccuaaacuguuuauuugcac

SEQ ID NO: 1128224 - RNA, 17 nt, Homo sapiens
uccuagaauggaugugc

SEQ ID NO: 1128225 - RNA, 21 nt, Homo sapiens
uccuagaauggaugugcucac

SEQ ID NO: 1128226 - RNA, 23 nt, Homo sapiens
uccuagaauggaugugcucacug

SEQ ID NO: 1128227 - RNA, 19 nt, Homo sapiens
uccucucaagcuagccaga

SEQ ID NO: 1128228 - RNA, 16 nt, Homo sapiens
uccuggaggugggaga

SEQ ID NO: 1128229 - RNA, 14 nt, Homo sapiens
uccuugacuguaaa

SEQ ID NO: 1128230 - RNA, 22 nt, Homo sapiens
uccuuggaccguaucacugguc

SEQ ID NO: 1128231 - RNA, 23 nt, Homo sapiens
uccuuugucauuauuagucuuca

SEQ ID NO: 1128232 - RNA, 19 nt, Homo sapiens
ucgaagaaaggcagaagaa

SEQ ID NO: 1128233 - RNA, 20 nt, Homo sapiens
ucgauccuggauucacucac

SEQ ID NO: 1128234 - RNA, 21 nt, Homo sapiens
ucuaaaagggggcuauucccu

SEQ ID NO: 1128235 - RNA, 14 nt, Homo sapiens
ucuaacucaggggu

SEQ ID NO: 1128236 - RNA, 23 nt, Homo sapiens
ucuauaaguguucaguguugaca

SEQ ID NO: 1128237 - RNA, 13 nt, Homo sapiens
ucucacugcaagu

SEQ ID NO: 1128238 - RNA, 14 nt, Homo sapiens
ucucauccacagag

SEQ ID NO: 1128239 - RNA, 17 nt, Homo sapiens
ucucugauuccccaaau

SEQ ID NO: 1128240 - RNA, 23 nt, Homo sapiens
ucucugauuccccaaaucugcau

SEQ ID NO: 1128241 - RNA, 21 nt, Homo sapiens
ucucuuaaaccacagcacuau

SEQ ID NO: 1128242 - RNA, 16 nt, Homo sapiens
ucucuuugguguuaca

SEQ ID NO: 1128243 - RNA, 15 nt, Homo sapiens
ucugagaacuccuca

SEQ ID NO: 1128244 - RNA, 22 nt, Homo sapiens
ucugagaacuccucauucccug

SEQ ID NO: 1128245 - RNA, 14 nt, Homo sapiens
ucugauacagccuu

SEQ ID NO: 1128246 - RNA, 19 nt, Homo sapiens
ucugaucaguuuccuccaa

SEQ ID NO: 1128247 - RNA, 19 nt, Homo sapiens
ucugauuauacaccauuuu

SEQ ID NO: 1128248 - RNA, 14 nt, Homo sapiens
ucugggagccugac

SEQ ID NO: 1128249 - RNA, 21 nt, Homo sapiens
ucuguccuggaggcacuggga

SEQ ID NO: 1128250 - RNA, 22 nt, Homo sapiens
ucugucuguagagccgcauggc

SEQ ID NO: 1128251 - RNA, 19 nt, Homo sapiens
ucuuaaaccacagcacuau

SEQ ID NO: 1128252 - RNA, 19 nt, Homo sapiens
ucuuagccucccaaagugc

SEQ ID NO: 1128253 - RNA, 21 nt, Homo sapiens
ucuucccaccucagugcccac

SEQ ID NO: 1128254 - RNA, 14 nt, Homo sapiens
ucuucucccugugu

SEQ ID NO: 1128255 - RNA, 23 nt, Homo sapiens
ucuuuccuggacuuaacucuaau

SEQ ID NO: 1128256 - RNA, 13 nt, Homo sapiens
ugaagcacugagc

SEQ ID NO: 1128257 - RNA, 16 nt, Homo sapiens
ugaagccccuuguccu

SEQ ID NO: 1128258 - RNA, 17 nt, Homo sapiens
ugaaguaauuugccuaa

SEQ ID NO: 1128259 - RNA, 18 nt, Homo sapiens
ugaagucaccgggaugaa

SEQ ID NO: 1128260 - RNA, 15 nt, Homo sapiens
ugaauaacacuggau

SEQ ID NO: 1128261 - RNA, 17 nt, Homo sapiens
ugaaucuguuacugaaa

SEQ ID NO: 1128262 - RNA, 17 nt, Homo sapiens
aaaaagaagcaaccuca

SEQ ID NO: 1128263 - RNA, 21 nt, Homo sapiens
aaaacaaagccaugccaauaa

SEQ ID NO: 1128264 - RNA, 14 nt, Homo sapiens
aaaaccugagccau

SEQ ID NO: 1128265 - RNA, 16 nt, Homo sapiens
aaaagaagcaaccuca

SEQ ID NO: 1128266 - RNA, 19 nt, Homo sapiens
aaaagagauggccugagaa

SEQ ID NO: 1128267 - RNA, 20 nt, Homo sapiens
aaaagcaagauuuugucaaa

SEQ ID NO: 1128268 - RNA, 18 nt, Homo sapiens
aaaagcaucucacugcaa

SEQ ID NO: 1128269 - RNA, 22 nt, Homo sapiens
aaaagugaucuguccccucucc

SEQ ID NO: 1128270 - RNA, 18 nt, Homo sapiens
aaaauauugaauaaugcg

SEQ ID NO: 1128271 - RNA, 19 nt, Homo sapiens
aaaaugaauaauacauuga

SEQ ID NO: 1128272 - RNA, 14 nt, Homo sapiens
aaaaugcaacgcug

SEQ ID NO: 1128273 - RNA, 19 nt, Homo sapiens
aaaauuuuuaaaacacaga

SEQ ID NO: 1128274 - RNA, 20 nt, Homo sapiens
aaacaaaaaaagcaucucac

SEQ ID NO: 1128275 - RNA, 11 nt, Homo sapiens
aaacaaccuac

SEQ ID NO: 1128276 - RNA, 11 nt, Homo sapiens
aaacacagccu

SEQ ID NO: 1128277 - RNA, 17 nt, Homo sapiens
aaacauuuuuguggcuu

SEQ ID NO: 1128278 - RNA, 13 nt, Homo sapiens
aaaccuguuggcu

SEQ ID NO: 1128279 - RNA, 17 nt, Homo sapiens
aaacuggcuguuugaua

SEQ ID NO: 1128280 - RNA, 18 nt, Homo sapiens
aaagaacucagugcugcc

SEQ ID NO: 1128281 - RNA, 14 nt, Homo sapiens
aaagaaguaaaagc

SEQ ID NO: 1128282 - RNA, 14 nt, Homo sapiens
aaagacuggccuga

SEQ ID NO: 1128283 - RNA, 23 nt, Homo sapiens
aaagcaucucacugcaagucaca

SEQ ID NO: 1128284 - RNA, 18 nt, Homo sapiens
aaagggggcuauucccug

SEQ ID NO: 1128285 - RNA, 18 nt, Homo sapiens
aaaggucuaguauccaaa

SEQ ID NO: 1128286 - RNA, 19 nt, Homo sapiens
aaauauccacagacucccu

SEQ ID NO: 1128287 - RNA, 20 nt, Homo sapiens
aaaucagcagacacaggugu

SEQ ID NO: 1128288 - RNA, 16 nt, Homo sapiens
aaauccacuauuucca

SEQ ID NO: 1128289 - RNA, 21 nt, Homo sapiens
aaaugcgcgugugcacgugug

SEQ ID NO: 1128290 - RNA, 18 nt, Homo sapiens
aaauucucucucuugcag

SEQ ID NO: 1128291 - RNA, 19 nt, Homo sapiens
aaauuggaugcuagagaau

SEQ ID NO: 1128292 - RNA, 13 nt, Homo sapiens
aacaaaaccaacu

SEQ ID NO: 1128293 - RNA, 16 nt, Homo sapiens
aacaagggcagugaga

SEQ ID NO: 1128294 - RNA, 21 nt, Homo sapiens
aacaaguauuuguuaauuuag

SEQ ID NO: 1128295 - RNA, 14 nt, Homo sapiens
aacacagcugauga

SEQ ID NO: 1128296 - RNA, 20 nt, Homo sapiens
aacagaacauagacagaaga

SEQ ID NO: 1128297 - RNA, 19 nt, Homo sapiens
aacauacacugagcugcuu

SEQ ID NO: 1128298 - RNA, 16 nt, Homo sapiens
aacauagacagaagaa

SEQ ID NO: 1128299 - RNA, 20 nt, Homo sapiens
aacauuucuauagccaaaaa

SEQ ID NO: 1128300 - RNA, 20 nt, Homo sapiens
aaccaggggcugacaaugcg

SEQ ID NO: 1128301 - RNA, 14 nt, Homo sapiens
aaccauagcacagg

SEQ ID NO: 1128302 - RNA, 16 nt, Homo sapiens
aaccccuccccuccau

SEQ ID NO: 1128303 - RNA, 20 nt, Homo sapiens
aaccuacuuucauacugaag

SEQ ID NO: 1128304 - RNA, 21 nt, Homo sapiens
aagaaaauaagugcucuguca

SEQ ID NO: 1128305 - RNA, 23 nt, Homo sapiens
aagaagcaaccucaguaauuuag

SEQ ID NO: 1128306 - RNA, 19 nt, Homo sapiens
aagacaauggccauugugu

SEQ ID NO: 1128307 - RNA, 22 nt, Homo sapiens
aagacuuguguccccaccucag

SEQ ID NO: 1128308 - RNA, 12 nt, Homo sapiens
aagagcuguuau

SEQ ID NO: 1128309 - RNA, 16 nt, Homo sapiens
aagcaagauuuuguca

SEQ ID NO: 1128310 - RNA, 17 nt, Homo sapiens
aagcagucaauuuucac

SEQ ID NO: 1128311 - RNA, 20 nt, Homo sapiens
aagccagaaacguaacugug

SEQ ID NO: 1128312 - RNA, 16 nt, Homo sapiens
aagccauuauucacua

SEQ ID NO: 1128313 - RNA, 10 nt, Homo sapiens
aagcccaguu

SEQ ID NO: 1128314 - RNA, 19 nt, Homo sapiens
aagcuuuugguaauauuca

SEQ ID NO: 1128315 - RNA, 12 nt, Homo sapiens
aaggaaagccaa

SEQ ID NO: 1128316 - RNA, 21 nt, Homo sapiens
aaggaacugaggcccagaaag

SEQ ID NO: 1128317 - RNA, 14 nt, Homo sapiens
aaggaagacuugaa

SEQ ID NO: 1128318 - RNA, 14 nt, Homo sapiens
aaggacaugugcua

SEQ ID NO: 1128319 - RNA, 16 nt, Homo sapiens
aaggacuaugaaaagc

SEQ ID NO: 1128320 - RNA, 19 nt, Homo sapiens
aaggacuccugucuguccu

SEQ ID NO: 1128321 - RNA, 13 nt, Homo sapiens
aagggcagugaga

SEQ ID NO: 1128322 - RNA, 17 nt, Homo sapiens
aagggggcuauucccug

SEQ ID NO: 1128323 - RNA, 18 nt, Homo sapiens
aaguaaauuuguccaaug

SEQ ID NO: 1128324 - RNA, 20 nt, Homo sapiens
aaguaauuuugcuccuugau

SEQ ID NO: 1128325 - RNA, 18 nt, Homo sapiens
aagucacauaaaaaugca

SEQ ID NO: 1128326 - RNA, 21 nt, Homo sapiens
aagucucucuauuacacugga

SEQ ID NO: 1128327 - RNA, 18 nt, Homo sapiens
aagugaagccccuugucc

SEQ ID NO: 1128328 - RNA, 22 nt, Homo sapiens
aagugcugggauuacaggugua

SEQ ID NO: 1128329 - RNA, 23 nt, Homo sapiens
aagugcugggauuacaguuguga

SEQ ID NO: 1128330 - RNA, 14 nt, Homo sapiens
aaguuuaaccuaaa

SEQ ID NO: 1128331 - RNA, 14 nt, Homo sapiens
aaucagcaggaugu

SEQ ID NO: 1128332 - RNA, 15 nt, Homo sapiens
aauccacuauuucca

SEQ ID NO: 1128333 - RNA, 21 nt, Homo sapiens
aauccuaucacagucuacuga

SEQ ID NO: 1128334 - RNA, 21 nt, Homo sapiens
aauccugaggggauaucccua

SEQ ID NO: 1128335 - RNA, 16 nt, Homo sapiens
aaugaagaauggccau

SEQ ID NO: 1128336 - RNA, 12 nt, Homo sapiens
aaugaaugacau

SEQ ID NO: 1128337 - RNA, 14 nt, Homo sapiens
aaugaccaggccaa

SEQ ID NO: 1128338 - RNA, 18 nt, Homo sapiens
aauggaugugcucacugg

SEQ ID NO: 1128339 - RNA, 19 nt, Homo sapiens
aauggccauuguguuggga

SEQ ID NO: 1128340 - RNA, 15 nt, Homo sapiens
aaugugaaugggaaa

SEQ ID NO: 1128341 - RNA, 19 nt, Homo sapiens
aauguguauuuuauaugau

SEQ ID NO: 1128342 - RNA, 22 nt, Homo sapiens
aauguuccuuucgaaagcaaug

SEQ ID NO: 1128343 - RNA, 14 nt, Homo sapiens
aauuaagugcaauu

SEQ ID NO: 1128344 - RNA, 21 nt, Homo sapiens
aauucuagagucucuguuacu

SEQ ID NO: 1128345 - RNA, 12 nt, Homo sapiens
aauuuccuugac

SEQ ID NO: 1128346 - RNA, 18 nt, Homo sapiens
aauuuucuacaaccuaag

SEQ ID NO: 1128347 - RNA, 13 nt, Homo sapiens
aauuuugcuccuu

SEQ ID NO: 1128348 - RNA, 14 nt, Homo sapiens
acaaagaaauagca

SEQ ID NO: 1128349 - RNA, 14 nt, Homo sapiens
acaaagccaugcca

SEQ ID NO: 1128350 - RNA, 19 nt, Homo sapiens
acaaaggacccaaucccca

SEQ ID NO: 1128351 - RNA, 12 nt, Homo sapiens
acaaccuugucc

SEQ ID NO: 1128352 - RNA, 21 nt, Homo sapiens
acaaggacuagagcucaggcc

SEQ ID NO: 1128353 - RNA, 13 nt, Homo sapiens
acaauaguaugca

SEQ ID NO: 1128354 - RNA, 21 nt, Homo sapiens
acacacuaacaaaagcaugaa

SEQ ID NO: 1128355 - RNA, 14 nt, Homo sapiens
acacagggugcaug

SEQ ID NO: 1128356 - RNA, 17 nt, Homo sapiens
acacagggugcauguga

SEQ ID NO: 1128357 - RNA, 15 nt, Homo sapiens
acaccucccuacucc

SEQ ID NO: 1128358 - RNA, 20 nt, Homo sapiens
acacuaacaaaagcaugaaa

SEQ ID NO: 1128359 - RNA, 16 nt, Homo sapiens
acacuuugugaucuca

SEQ ID NO: 1128360 - RNA, 21 nt, Homo sapiens
acagaaauaaagagcuguuau

SEQ ID NO: 1128361 - RNA, 15 nt, Homo sapiens
acagagguggcugcu

SEQ ID NO: 1128362 - RNA, 20 nt, Homo sapiens
acagcugcuucugugcauuu

SEQ ID NO: 1128363 - RNA, 17 nt, Homo sapiens
acaggagacccagagag

SEQ ID NO: 1128364 - RNA, 22 nt, Homo sapiens
acaucacuugagacaaaucuau

SEQ ID NO: 1128365 - RNA, 18 nt, Homo sapiens
acauggcuggcacugagc

SEQ ID NO: 1128366 - RNA, 15 nt, Homo sapiens
acaugguaugaaggu

SEQ ID NO: 1128367 - RNA, 21 nt, Homo sapiens
acaugugucccagccacagug

SEQ ID NO: 1128368 - RNA, 17 nt, Homo sapiens
acauucaggcaugcgaa

SEQ ID NO: 1128369 - RNA, 17 nt, Homo sapiens
acauucccucucaucca

SEQ ID NO: 1128370 - RNA, 23 nt, Homo sapiens
acauuuacuuuaauuuccuugac

SEQ ID NO: 1128371 - RNA, 19 nt, Homo sapiens
accaaaugcuuuuugaucu

SEQ ID NO: 1128372 - RNA, 20 nt, Homo sapiens
accaaaugcuuuuugaucug

SEQ ID NO: 1128373 - RNA, 14 nt, Homo sapiens
accaaugucauaac

SEQ ID NO: 1128374 - RNA, 14 nt, Homo sapiens
accacagcacuauu

SEQ ID NO: 1128375 - RNA, 20 nt, Homo sapiens
accagcuaacuccagucucc

SEQ ID NO: 1128376 - RNA, 18 nt, Homo sapiens
accagugaaucuuuguca

SEQ ID NO: 1128377 - RNA, 21 nt, Homo sapiens
acccaguaaaaauccacuauu

SEQ ID NO: 1128378 - RNA, 15 nt, Homo sapiens
acccucacuguguug

SEQ ID NO: 1128379 - RNA, 12 nt, Homo sapiens
accuacuuccuc

SEQ ID NO: 1128380 - RNA, 17 nt, Homo sapiens
accuacuuucauacuga

SEQ ID NO: 1128381 - RNA, 19 nt, Homo sapiens
accucagacaauccacucu

SEQ ID NO: 1128382 - RNA, 18 nt, Homo sapiens
accugaccggcaccugcg

SEQ ID NO: 1128383 - RNA, 17 nt, Homo sapiens
accuuggaaaugaccag

SEQ ID NO: 1128384 - RNA, 22 nt, Homo sapiens
accuuggaaaugaccaggccaa

SEQ ID NO: 1128385 - RNA, 18 nt, Homo sapiens
acgaugucaaggacuccu

SEQ ID NO: 1128386 - RNA, 21 nt, Homo sapiens
acggagcugaagcugggagcu

SEQ ID NO: 1128387 - RNA, 13 nt, Homo sapiens
agaauuacauaaa

SEQ ID NO: 1128388 - RNA, 16 nt, Homo sapiens
agacaaccuuguccca

SEQ ID NO: 1128389 - RNA, 17 nt, Homo sapiens
agacaauccacucucag

SEQ ID NO: 1128390 - RNA, 19 nt, Homo sapiens
agacaauccacucucagga

SEQ ID NO: 1128391 - RNA, 18 nt, Homo sapiens
agacaccuccuucuuccu

SEQ ID NO: 1128392 - RNA, 18 nt, Homo sapiens
agacacucacagcaagga

SEQ ID NO: 1128393 - RNA, 16 nt, Homo sapiens
agacauaucacucaau

SEQ ID NO: 1128394 - RNA, 22 nt, Homo sapiens
agacccacgugcuaggggauga

SEQ ID NO: 1128395 - RNA, 17 nt, Homo sapiens
agaccuccccauguaca

SEQ ID NO: 1128396 - RNA, 15 nt, Homo sapiens
agacuaucaguuccc

SEQ ID NO: 1128397 - RNA, 21 nt, Homo sapiens
agacuaucuuacuauuucaca

SEQ ID NO: 1128398 - RNA, 12 nt, Homo sapiens
agagacaggguc

SEQ ID NO: 1128399 - RNA, 16 nt, Homo sapiens
agagauggccugagaa

SEQ ID NO: 1128400 - RNA, 17 nt, Homo sapiens
agagcuguuauacugug

SEQ ID NO: 1128401 - RNA, 21 nt, Homo sapiens
agaggagaagagacauguacc

SEQ ID NO: 1128402 - RNA, 13 nt, Homo sapiens
agaggcagugauu

SEQ ID NO: 1128403 - RNA, 13 nt, Homo sapiens
agaggucugagcc

SEQ ID NO: 1128404 - RNA, 21 nt, Homo sapiens
agagguggcugcugugcuagu

SEQ ID NO: 1128405 - RNA, 20 nt, Homo sapiens
agaucgauccuggauucacu

SEQ ID NO: 1128406 - RNA, 13 nt, Homo sapiens
agcaaaacaagga

SEQ ID NO: 1128407 - RNA, 22 nt, Homo sapiens
agcaacaguuaugggacacuga

SEQ ID NO: 1128408 - RNA, 15 nt, Homo sapiens
agcaaggauggagcu

SEQ ID NO: 1128409 - RNA, 15 nt, Homo sapiens
agcaagggcugugcu

SEQ ID NO: 1128410 - RNA, 18 nt, Homo sapiens
agcaagggcugugcugag

SEQ ID NO: 1128411 - RNA, 12 nt, Homo sapiens
agcacaccucau

SEQ ID NO: 1128412 - RNA, 14 nt, Homo sapiens
agcacugagcagaa

SEQ ID NO: 1128413 - RNA, 22 nt, Homo sapiens
agcagacacagguguagaccag

SEQ ID NO: 1128414 - RNA, 22 nt, Homo sapiens
agcaggcuggagcccagcauuc

SEQ ID NO: 1128415 - RNA, 20 nt, Homo sapiens
agcaguccagagucuaggca

SEQ ID NO: 1128416 - RNA, 14 nt, Homo sapiens
agcauaaagcaauu

SEQ ID NO: 1128417 - RNA, 20 nt, Homo sapiens
agcaugaagguggggccagu

SEQ ID NO: 1128418 - RNA, 23 nt, Homo sapiens
agccaaacacuguuucuaacuca

SEQ ID NO: 1128419 - RNA, 23 nt, Homo sapiens
agccaagguagggucacuaacca

SEQ ID NO: 1128420 - RNA, 18 nt, Homo sapiens
agccacuauuaacauuuc

SEQ ID NO: 1128421 - RNA, 16 nt, Homo sapiens
agcccacauacuggau

SEQ ID NO: 1128422 - RNA, 14 nt, Homo sapiens
agcccgaagcccag

SEQ ID NO: 1128423 - RNA, 19 nt, Homo sapiens
agcccucaguuuucaguca

SEQ ID NO: 1128424 - RNA, 13 nt, Homo sapiens
agccuagagaagg

SEQ ID NO: 1128425 - RNA, 14 nt, Homo sapiens
agccucccaaagug

SEQ ID NO: 1128426 - RNA, 18 nt, Homo sapiens
agccuggaagccaaacaa

SEQ ID NO: 1128427 - RNA, 22 nt, Homo sapiens
agccuuuccuuuuagugauaaa

SEQ ID NO: 1128428 - RNA, 11 nt, Homo sapiens
agccuuugugc

SEQ ID NO: 1128429 - RNA, 23 nt, Homo sapiens
agcgcuguguuaggcacaggcug

SEQ ID NO: 1128430 - RNA, 21 nt, Homo sapiens
agcggucauucuacacugagg

SEQ ID NO: 1128431 - RNA, 23 nt, Homo sapiens
agcucugccucccucuccauauc

SEQ ID NO: 1128432 - RNA, 12 nt, Homo sapiens
agcugauucacu

SEQ ID NO: 1128433 - RNA, 15 nt, Homo sapiens
agcugauucacuaug

SEQ ID NO: 1128434 - RNA, 16 nt, Homo sapiens
agcugcugaggacaau

SEQ ID NO: 1128435 - RNA, 14 nt, Homo sapiens
agcuggaggcacaa

SEQ ID NO: 1128436 - RNA, 14 nt, Homo sapiens
agcuggguggugua

SEQ ID NO: 1128437 - RNA, 17 nt, Homo sapiens
aggaaaaacaugagcau

SEQ ID NO: 1128438 - RNA, 14 nt, Homo sapiens
aggaaaaagugcuu

SEQ ID NO: 1128439 - RNA, 20 nt, Homo sapiens
aggaagacuugaagcacaga

SEQ ID NO: 1128440 - RNA, 11 nt, Homo sapiens
aggaagcaagc

SEQ ID NO: 1128441 - RNA, 21 nt, Homo sapiens
aggacucucuuucuuccacua

SEQ ID NO: 1128442 - RNA, 13 nt, Homo sapiens
aggauacccagau

SEQ ID NO: 1128443 - RNA, 17 nt, Homo sapiens
aggauacccagaugcca

SEQ ID NO: 1128444 - RNA, 19 nt, Homo sapiens
aggcacgcaccaccaugcc

SEQ ID NO: 1128445 - RNA, 18 nt, Homo sapiens
aggcccagaaagaggcag

SEQ ID NO: 1128446 - RNA, 17 nt, Homo sapiens
agggaaagcuuccuccu

SEQ ID NO: 1128447 - RNA, 20 nt, Homo sapiens
agggcucccgagucaugcac

SEQ ID NO: 1128448 - RNA, 19 nt, Homo sapiens
agggcuggagggacaggga

SEQ ID NO: 1128449 - RNA, 13 nt, Homo sapiens
agggcugugcuga

SEQ ID NO: 1128450 - RNA, 18 nt, Homo sapiens
aggucccugcuuaccuga

SEQ ID NO: 1128451 - RNA, 13 nt, Homo sapiens
agguccugcuacc

SEQ ID NO: 1128452 - RNA, 13 nt, Homo sapiens
aguaaaaauccac

SEQ ID NO: 1128453 - RNA, 16 nt, Homo sapiens
aguaaaaggcuuauua

SEQ ID NO: 1128454 - RNA, 20 nt, Homo sapiens
aguaagguuauaacuguggc

SEQ ID NO: 1128455 - RNA, 12 nt, Homo sapiens
aguacaaaaaca

SEQ ID NO: 1128456 - RNA, 13 nt, Homo sapiens
aguaccagugugc

SEQ ID NO: 1128457 - RNA, 11 nt, Homo sapiens
aguagaacuca

SEQ ID NO: 1128458 - RNA, 14 nt, Homo sapiens
agucaauauuguau

SEQ ID NO: 1128459 - RNA, 13 nt, Homo sapiens
agucaugcacuca

SEQ ID NO: 1128460 - RNA, 19 nt, Homo sapiens
agugaaacauugaacucau

SEQ ID NO: 1128461 - RNA, 16 nt, Homo sapiens
agugacaugugcugga

SEQ ID NO: 1128462 - RNA, 18 nt, Homo sapiens
agugauuugggggugcaa

SEQ ID NO: 1128463 - RNA, 20 nt, Homo sapiens
agugcccaacccuaucccag

SEQ ID NO: 1128464 - RNA, 13 nt, Homo sapiens
aguggaaacaaag

SEQ ID NO: 1128465 - RNA, 14 nt, Homo sapiens
aguggcacagcuaa

SEQ ID NO: 1128466 - RNA, 14 nt, Homo sapiens
aguguugacauagc

SEQ ID NO: 1128467 - RNA, 16 nt, Homo sapiens
aguguugacauagccu

SEQ ID NO: 1128468 - RNA, 17 nt, Homo sapiens
aguguugacauagccuu

SEQ ID NO: 1128469 - RNA, 17 nt, Homo sapiens
aguuaguaucuuuauua

SEQ ID NO: 1128470 - RNA, 15 nt, Homo sapiens
aguucugaacauuuu

SEQ ID NO: 1128471 - RNA, 15 nt, Homo sapiens
aguuguaucacuuaa

SEQ ID NO: 1128472 - RNA, 21 nt, Homo sapiens
aguuucccuucucccagucca

SEQ ID NO: 1128473 - RNA, 15 nt, Homo sapiens
aguuuuuguuucaca

SEQ ID NO: 1128474 - RNA, 19 nt, Homo sapiens
cuggcaaugggacucugag

SEQ ID NO: 1128475 - RNA, 24 nt, Homo sapiens
cuggccaugccuggagacauauca

SEQ ID NO: 1128476 - RNA, 21 nt, Homo sapiens
cuggcccccucccuggaugac

SEQ ID NO: 1128477 - RNA, 14 nt, Homo sapiens
cuggcuuccuagaa

SEQ ID NO: 1128478 - RNA, 19 nt, Homo sapiens
cugggugguguacaagcau

SEQ ID NO: 1128479 - RNA, 21 nt, Homo sapiens
cuggguucaacucugcuccca

SEQ ID NO: 1128480 - RNA, 17 nt, Homo sapiens
cuguaaacuauaaacua

SEQ ID NO: 1128481 - RNA, 17 nt, Homo sapiens
cuguauauaauacuaaa

SEQ ID NO: 1128482 - RNA, 16 nt, Homo sapiens
cuguauuaccuauuca

SEQ ID NO: 1128483 - RNA, 17 nt, Homo sapiens
cugucaaaucuaguuuc

SEQ ID NO: 1128484 - RNA, 14 nt, Homo sapiens
cuguccuggaggca

SEQ ID NO: 1128485 - RNA, 14 nt, Homo sapiens
cugucucacuggca

SEQ ID NO: 1128486 - RNA, 17 nt, Homo sapiens
cugucuugugucuccua

SEQ ID NO: 1128487 - RNA, 22 nt, Homo sapiens
cugugggcuuuggguuugucag

SEQ ID NO: 1128488 - RNA, 15 nt, Homo sapiens
cuguguggugcccau

SEQ ID NO: 1128489 - RNA, 22 nt, Homo sapiens
cuuaauagguucaaaagcaauc

SEQ ID NO: 1128490 - RNA, 18 nt, Homo sapiens
cuuacaauacaauaguau

SEQ ID NO: 1128491 - RNA, 17 nt, Homo sapiens
cuuaccaggcaccaaaa

SEQ ID NO: 1128492 - RNA, 21 nt, Homo sapiens
cuucaggaagcauaaagcaau

SEQ ID NO: 1128493 - RNA, 22 nt, Homo sapiens
cuucaggaagcauaaagcaauu

SEQ ID NO: 1128494 - RNA, 15 nt, Homo sapiens
cuuccauuaaaacaa

SEQ ID NO: 1128495 - RNA, 13 nt, Homo sapiens
cuucccaccucag

SEQ ID NO: 1128496 - RNA, 22 nt, Homo sapiens
cuuccgugugucaucaggguug

SEQ ID NO: 1128497 - RNA, 23 nt, Homo sapiens
cuuccuggguccuguucccuacc

SEQ ID NO: 1128498 - RNA, 13 nt, Homo sapiens
cuucucccugugu

SEQ ID NO: 1128499 - RNA, 15 nt, Homo sapiens
cuucucuuucucuga

SEQ ID NO: 1128500 - RNA, 12 nt, Homo sapiens
cuucugguccuu

SEQ ID NO: 1128501 - RNA, 13 nt, Homo sapiens
cuugaagcacaga

SEQ ID NO: 1128502 - RNA, 19 nt, Homo sapiens
cuugagacaaaucuaugcc

SEQ ID NO: 1128503 - RNA, 20 nt, Homo sapiens
cuugauugagugcuccugug

SEQ ID NO: 1128504 - RNA, 13 nt, Homo sapiens
cuugccaggcucc

SEQ ID NO: 1128505 - RNA, 17 nt, Homo sapiens
cuuggccucccaaucuu

SEQ ID NO: 1128506 - RNA, 17 nt, Homo sapiens
cuugggguaagccagag

SEQ ID NO: 1128507 - RNA, 15 nt, Homo sapiens
cuuguagacucagaa

SEQ ID NO: 1128508 - RNA, 15 nt, Homo sapiens
cuuguugaugccagc

SEQ ID NO: 1128509 - RNA, 22 nt, Homo sapiens
cuuuaauuuccuugacuguaaa

SEQ ID NO: 1128510 - RNA, 16 nt, Homo sapiens
cuuucacgcugaaaca

SEQ ID NO: 1128511 - RNA, 13 nt, Homo sapiens
cuuuccaaaaccu

SEQ ID NO: 1128512 - RNA, 13 nt, Homo sapiens
cuuuggcauggga

SEQ ID NO: 1128513 - RNA, 20 nt, Homo sapiens
cuuuguggggcucaaaaccu

SEQ ID NO: 1128514 - RNA, 13 nt, Homo sapiens
cuuuucaaaaccu

SEQ ID NO: 1128515 - RNA, 21 nt, Homo sapiens
cuuuucuuucuacagaccaua

SEQ ID NO: 1128516 - RNA, 12 nt, Homo sapiens
cuuuuugaucug

SEQ ID NO: 1128517 - RNA, 20 nt, Homo sapiens
cuuuuuggcuuuaagccauu

SEQ ID NO: 1128518 - RNA, 22 nt, Homo sapiens
cuuuuugggugauuaaaaaacu

SEQ ID NO: 1128519 - RNA, 15 nt, Homo sapiens
gaaaaacacagugca

SEQ ID NO: 1128520 - RNA, 16 nt, Homo sapiens
gaaaaagugcuuauua

SEQ ID NO: 1128521 - RNA, 15 nt, Homo sapiens
gaaaaaguugcaguc

SEQ ID NO: 1128522 - RNA, 21 nt, Homo sapiens
gaaaacauaacccacucuguc

SEQ ID NO: 1128523 - RNA, 11 nt, Homo sapiens
gaaaacauaca

SEQ ID NO: 1128524 - RNA, 20 nt, Homo sapiens
gaaaagagauggccugagaa

SEQ ID NO: 1128525 - RNA, 16 nt, Homo sapiens
gaaaaguuuaaccuaa

SEQ ID NO: 1128526 - RNA, 16 nt, Homo sapiens
gaaaauaagugcucug

SEQ ID NO: 1128527 - RNA, 16 nt, Homo sapiens
gaaaauugaaugcaaa

SEQ ID NO: 1128528 - RNA, 15 nt, Homo sapiens
gaaacaagguuuuca

SEQ ID NO: 1128529 - RNA, 23 nt, Homo sapiens
gaaacagagguggcugcugugcu

SEQ ID NO: 1128530 - RNA, 23 nt, Homo sapiens
gaaacuuuccuuugucauuauua

SEQ ID NO: 1128531 - RNA, 15 nt, Homo sapiens
gaaagaggcagugau

SEQ ID NO: 1128532 - RNA, 23 nt, Homo sapiens
gaaaggaaagccaaacacuguuu

SEQ ID NO: 1128533 - RNA, 14 nt, Homo sapiens
gaaaucagcagaca

SEQ ID NO: 1128534 - RNA, 16 nt, Homo sapiens
gaaaugaccaggccaa

SEQ ID NO: 1128535 - RNA, 22 nt, Homo sapiens
gaaauuuaaacuauaagcaaga

SEQ ID NO: 1128536 - RNA, 18 nt, Homo sapiens
gaaccucgccauaaggca

SEQ ID NO: 1128537 - RNA, 16 nt, Homo sapiens
gaacucauaucuguaa

SEQ ID NO: 1128538 - RNA, 16 nt, Homo sapiens
gaagacccacgugcua

SEQ ID NO: 1128539 - RNA, 22 nt, Homo sapiens
gaagcagucaauuuucacauca

SEQ ID NO: 1128540 - RNA, 16 nt, Homo sapiens
gaaggggaaacacagc

SEQ ID NO: 1128541 - RNA, 19 nt, Homo sapiens
gaagggggucaaaggaaga

SEQ ID NO: 1128542 - RNA, 14 nt, Homo sapiens
gaaguaaaagcaaa

SEQ ID NO: 1128543 - RNA, 23 nt, Homo sapiens
gaagucucucuauuacacuggag

SEQ ID NO: 1128544 - RNA, 11 nt, Homo sapiens
gaaguuucauc

SEQ ID NO: 1128545 - RNA, 17 nt, Homo sapiens
gaauacuggccaugccu

SEQ ID NO: 1128546 - RNA, 24 nt, Homo sapiens
gaauacuggccaugccuggagaca

SEQ ID NO: 1128547 - RNA, 23 nt, Homo sapiens
gaauguuccuuucgaaagcaaug

SEQ ID NO: 1128548 - RNA, 22 nt, Homo sapiens
gacaaaucuaugccacucagaa

SEQ ID NO: 1128549 - RNA, 23 nt, Homo sapiens
gacaacaaaugggucccucaguc

SEQ ID NO: 1128550 - RNA, 20 nt, Homo sapiens
gacaagcaagggcugugcug

SEQ ID NO: 1128551 - RNA, 21 nt, Homo sapiens
gacaagcaagggcugugcuga

SEQ ID NO: 1128552 - RNA, 20 nt, Homo sapiens
gacaugugcuggacacuguc

SEQ ID NO: 1128553 - RNA, 22 nt, Homo sapiens
gacaugugcuggacacugucca

SEQ ID NO: 1128554 - RNA, 18 nt, Homo sapiens
gaccaggccaagacucaa

SEQ ID NO: 1128555 - RNA, 16 nt, Homo sapiens
gaccugaccggcaccu

SEQ ID NO: 1128556 - RNA, 21 nt, Homo sapiens
gacgccacucauuucaucuca

SEQ ID NO: 1128557 - RNA, 20 nt, Homo sapiens
gacuaccagcuaacuccagu

SEQ ID NO: 1128558 - RNA, 15 nt, Homo sapiens
gacuagagcucaggc

SEQ ID NO: 1128559 - RNA, 16 nt, Homo sapiens
gacuaguuucuuauua

SEQ ID NO: 1128560 - RNA, 18 nt, Homo sapiens
gacucagcggucauucua

SEQ ID NO: 1128561 - RNA, 20 nt, Homo sapiens
gacuccugucuguccuggag

SEQ ID NO: 1128562 - RNA, 18 nt, Homo sapiens
gacucugagaacuccuca

SEQ ID NO: 1128563 - RNA, 22 nt, Homo sapiens
gacugaaugugccuaauggaga

SEQ ID NO: 1128564 - RNA, 13 nt, Homo sapiens
gacuuaacucuaa

SEQ ID NO: 1128565 - RNA, 17 nt, Homo sapiens
uccaggcuugggcucca

SEQ ID NO: 1128566 - RNA, 14 nt, Homo sapiens
ucccaaucuugccc

SEQ ID NO: 1128567 - RNA, 18 nt, Homo sapiens
ucccacgaugucaaggac

SEQ ID NO: 1128568 - RNA, 15 nt, Homo sapiens
uccccacaccucccu

SEQ ID NO: 1128569 - RNA, 20 nt, Homo sapiens
uccccacaccucccuacucc

SEQ ID NO: 1128570 - RNA, 18 nt, Homo sapiens
ucccccaucuagccauuu

SEQ ID NO: 1128571 - RNA, 20 nt, Homo sapiens
ucccccuaagaggcagugag

SEQ ID NO: 1128572 - RNA, 14 nt, Homo sapiens
ucccccucuuugca

SEQ ID NO: 1128573 - RNA, 21 nt, Homo sapiens
ucccgagucaugcacucaggc

SEQ ID NO: 1128574 - RNA, 22 nt, Homo sapiens
ucccucaaaugcgcgugugcac

SEQ ID NO: 1128575 - RNA, 16 nt, Homo sapiens
ucccucaugucuuuaa

SEQ ID NO: 1128576 - RNA, 22 nt, Homo sapiens
ucccucuucuucucccugugug

SEQ ID NO: 1128577 - RNA, 16 nt, Homo sapiens
ucccuggaugacauua

SEQ ID NO: 1128578 - RNA, 18 nt, Homo sapiens
ucccuggaugacauuaaa

SEQ ID NO: 1128579 - RNA, 23 nt, Homo sapiens
ucccuggaugacauuaaagaagg

SEQ ID NO: 1128580 - RNA, 20 nt, Homo sapiens
ucccuuuuaaaugcaaauca

SEQ ID NO: 1128581 - RNA, 12 nt, Homo sapiens
uccggcugccuc

SEQ ID NO: 1128582 - RNA, 15 nt, Homo sapiens
uccuaaacuuuccaa

SEQ ID NO: 1128583 - RNA, 12 nt, Homo sapiens
uccuacagccuc

SEQ ID NO: 1128584 - RNA, 22 nt, Homo sapiens
uccuagccaggcuaucuggccu

SEQ ID NO: 1128585 - RNA, 18 nt, Homo sapiens
uccucgggggaaagcaca

SEQ ID NO: 1128586 - RNA, 19 nt, Homo sapiens
uccuggaggcacugggaag

SEQ ID NO: 1128587 - RNA, 23 nt, Homo sapiens
uccuggaggugggagacaaggaa

SEQ ID NO: 1128588 - RNA, 20 nt, Homo sapiens
ucuauaaguguucaguguug

SEQ ID NO: 1128589 - RNA, 15 nt, Homo sapiens
ucucauuuaagggaa

SEQ ID NO: 1128590 - RNA, 13 nt, Homo sapiens
ucuccuacccuga

SEQ ID NO: 1128591 - RNA, 23 nt, Homo sapiens
ucucuauaaguguucaguguuga

SEQ ID NO: 1128592 - RNA, 14 nt, Homo sapiens
ucugcaacagccug

SEQ ID NO: 1128593 - RNA, 23 nt, Homo sapiens
ucuggcaaugggacucugagaac

SEQ ID NO: 1128594 - RNA, 15 nt, Homo sapiens
ucugggcagcuguca

SEQ ID NO: 1128595 - RNA, 14 nt, Homo sapiens
ucugucucuuggcu

SEQ ID NO: 1128596 - RNA, 13 nt, Homo sapiens
ucuguguggugcc

SEQ ID NO: 1128597 - RNA, 17 nt, Homo sapiens
ucuuagccccagacucu

SEQ ID NO: 1128598 - RNA, 20 nt, Homo sapiens
ucuuagccccagacucuuca

SEQ ID NO: 1128599 - RNA, 15 nt, Homo sapiens
ucuuagccucccaaa

SEQ ID NO: 1128600 - RNA, 14 nt, Homo sapiens
ucuucccaccucag

SEQ ID NO: 1128601 - RNA, 20 nt, Homo sapiens
ucuuggcucacuacagccuc

SEQ ID NO: 1128602 - RNA, 17 nt, Homo sapiens
ucuuuagagguaugauu

SEQ ID NO: 1128603 - RNA, 15 nt, Homo sapiens
ucuuuucaaccuacu

SEQ ID NO: 1128604 - RNA, 21 nt, Homo sapiens
ugaaaaaggcaagccacagaa

SEQ ID NO: 1128605 - RNA, 22 nt, Homo sapiens
ugaaaacauaacccacucuguc

SEQ ID NO: 1128606 - RNA, 12 nt, Homo sapiens
ugaaaacauaca

SEQ ID NO: 1128607 - RNA, 15 nt, Homo sapiens
ugaaacacacaugga

SEQ ID NO: 1128608 - RNA, 22 nt, Homo sapiens
ugaaagaggggugggauccaca

SEQ ID NO: 1128609 - RNA, 16 nt, Homo sapiens
ugaagaaaggaacuga

SEQ ID NO: 1128610 - RNA, 17 nt, Homo sapiens
ugaagaaaggaacugag

SEQ ID NO: 1128611 - RNA, 19 nt, Homo sapiens
ugacaacauuucuauagcc

SEQ ID NO: 1128612 - RNA, 13 nt, Homo sapiens
ugacauuaagaca

SEQ ID NO: 1128613 - RNA, 16 nt, Homo sapiens
ugaccaguaauuguga

SEQ ID NO: 1128614 - RNA, 12 nt, Homo sapiens
ugacccugugau

SEQ ID NO: 1128615 - RNA, 15 nt, Homo sapiens
ugacccuuguggcac

SEQ ID NO: 1128616 - RNA, 15 nt, Homo sapiens
ugaccuuuguccuua

SEQ ID NO: 1128617 - RNA, 22 nt, Homo sapiens
ugacuguauuuuccaacuuguu

SEQ ID NO: 1128618 - RNA, 23 nt, Homo sapiens
ugacuucauagauuaugcuuuaa

SEQ ID NO: 1128619 - RNA, 18 nt, Homo sapiens
ugagacaacaaauggguc

SEQ ID NO: 1128620 - RNA, 23 nt, Homo sapiens
ugagauguagccuggcccuggaa

SEQ ID NO: 1128621 - RNA, 15 nt, Homo sapiens
ugagcaccuacugug

SEQ ID NO: 1128622 - RNA, 22 nt, Homo sapiens
ugagcagaagcuggaggcacaa

SEQ ID NO: 1128623 - RNA, 20 nt, Homo sapiens
ugagccaaacacacuguaaa

SEQ ID NO: 1128624 - RNA, 14 nt, Homo sapiens
ugagcgcuguguua

SEQ ID NO: 1128625 - RNA, 12 nt, Homo sapiens
ugaggacaaugu

SEQ ID NO: 1128626 - RNA, 20 nt, Homo sapiens
ugaggagagaaggacaugug

SEQ ID NO: 1128627 - RNA, 12 nt, Homo sapiens
ugagggcucacu

SEQ ID NO: 1128628 - RNA, 16 nt, Homo sapiens
ugaguucaagucaaau

SEQ ID NO: 1128629 - RNA, 19 nt, Homo sapiens
ugauggcaugcugccuuaa

SEQ ID NO: 1128630 - RNA, 19 nt, Homo sapiens
aaaaacaugagcaucccca

SEQ ID NO: 1128631 - RNA, 16 nt, Homo sapiens
aaaaguugcagucuca

SEQ ID NO: 1128632 - RNA, 13 nt, Homo sapiens
aaacacacaugga

SEQ ID NO: 1128633 - RNA, 22 nt, Homo sapiens
aaacacuguuucuaacucaggg

SEQ ID NO: 1128634 - RNA, 21 nt, Homo sapiens
aaacaugagcauccccagcca

SEQ ID NO: 1128635 - RNA, 23 nt, Homo sapiens
aaaccuccaaggaccucucucaa

SEQ ID NO: 1128636 - RNA, 23 nt, Homo sapiens
aaagacuuguguccccaccucag

SEQ ID NO: 1128637 - RNA, 17 nt, Homo sapiens
aaagauaccauguauaa

SEQ ID NO: 1128638 - RNA, 19 nt, Homo sapiens
aaagcccuuuuauaccucc

SEQ ID NO: 1128639 - RNA, 13 nt, Homo sapiens
aaaggagugaaug

SEQ ID NO: 1128640 - RNA, 18 nt, Homo sapiens
aaagguuuaugaaaaaga

SEQ ID NO: 1128641 - RNA, 17 nt, Homo sapiens
aaaguaugguauugaaa

SEQ ID NO: 1128642 - RNA, 19 nt, Homo sapiens
aaaguugcagucucagaaa

SEQ ID NO: 1128643 - RNA, 21 nt, Homo sapiens
aaaguuuaggcaugcucagaa

SEQ ID NO: 1128644 - RNA, 16 nt, Homo sapiens
aaauaagugcucuguc

SEQ ID NO: 1128645 - RNA, 13 nt, Homo sapiens
aaauaauuguaug

SEQ ID NO: 1128646 - RNA, 19 nt, Homo sapiens
aaauacagagaaaucacca

SEQ ID NO: 1128647 - RNA, 19 nt, Homo sapiens
aaaucugcauccuuuucaa

SEQ ID NO: 1128648 - RNA, 22 nt, Homo sapiens
aaaucuugguugaugccaaaaa

SEQ ID NO: 1128649 - RNA, 14 nt, Homo sapiens
aaauuugaaugaca

SEQ ID NO: 1128650 - RNA, 15 nt, Homo sapiens
aaauuugaaugacaa

SEQ ID NO: 1128651 - RNA, 22 nt, Homo sapiens
aaauuuguccaauggcuguaaa

SEQ ID NO: 1128652 - RNA, 19 nt, Homo sapiens
aacaaaaagaaaaacaaau

SEQ ID NO: 1128653 - RNA, 17 nt, Homo sapiens
aacaaaugggucccuca

SEQ ID NO: 1128654 - RNA, 14 nt, Homo sapiens
aacaagggcaguga

SEQ ID NO: 1128655 - RNA, 14 nt, Homo sapiens
aacacagccugugu

SEQ ID NO: 1128656 - RNA, 17 nt, Homo sapiens
aacacuuugugaucuca

SEQ ID NO: 1128657 - RNA, 17 nt, Homo sapiens
aacaucuggaguccuau

SEQ ID NO: 1128658 - RNA, 14 nt, Homo sapiens
aaccacagcacuau

SEQ ID NO: 1128659 - RNA, 22 nt, Homo sapiens
aaccaguaagguuauaacugug

SEQ ID NO: 1128660 - RNA, 15 nt, Homo sapiens
aacccauacuacccu

SEQ ID NO: 1128661 - RNA, 14 nt, Homo sapiens
aacccucacugugu

SEQ ID NO: 1128662 - RNA, 18 nt, Homo sapiens
aacccucacuguguugga

SEQ ID NO: 1128663 - RNA, 19 nt, Homo sapiens
aaccuacuuucauacugaa

SEQ ID NO: 1128664 - RNA, 13 nt, Homo sapiens
aacuccagucucc

SEQ ID NO: 1128665 - RNA, 18 nt, Homo sapiens
aacuccugguucagccau

SEQ ID NO: 1128666 - RNA, 15 nt, Homo sapiens
aacuuuccaaaaccu

SEQ ID NO: 1128667 - RNA, 16 nt, Homo sapiens
aagaaaggaacugagg

SEQ ID NO: 1128668 - RNA, 14 nt, Homo sapiens
aagaagaaucucau

SEQ ID NO: 1128669 - RNA, 19 nt, Homo sapiens
aagaaguuuuguucugucc

SEQ ID NO: 1128670 - RNA, 15 nt, Homo sapiens
aagaauacuucucau

SEQ ID NO: 1128671 - RNA, 22 nt, Homo sapiens
aagacacaccucuggaucccug

SEQ ID NO: 1128672 - RNA, 14 nt, Homo sapiens
aagaggcagugaga

SEQ ID NO: 1128673 - RNA, 13 nt, Homo sapiens
aagaggcagugau

SEQ ID NO: 1128674 - RNA, 17 nt, Homo sapiens
aagauguucugccuuau

SEQ ID NO: 1128675 - RNA, 13 nt, Homo sapiens
aagcacaccucau

SEQ ID NO: 1128676 - RNA, 13 nt, Homo sapiens
aaggaagacuuga

SEQ ID NO: 1128677 - RNA, 19 nt, Homo sapiens
aaggacccaauccccagac

SEQ ID NO: 1128678 - RNA, 16 nt, Homo sapiens
aaggacuagagcucag

SEQ ID NO: 1128679 - RNA, 16 nt, Homo sapiens
aaggagagggacugga

SEQ ID NO: 1128680 - RNA, 21 nt, Homo sapiens
aaggcugugagccaaggaggg

SEQ ID NO: 1128681 - RNA, 18 nt, Homo sapiens
aaggcuuauuaaagugga

SEQ ID NO: 1128682 - RNA, 22 nt, Homo sapiens
aaguaaauuuguccaauggcug

SEQ ID NO: 1128683 - RNA, 20 nt, Homo sapiens
aaguagcuuugaacuaguuu

SEQ ID NO: 1128684 - RNA, 21 nt, Homo sapiens
aaguccuccagacaacccuca

SEQ ID NO: 1128685 - RNA, 13 nt, Homo sapiens
aaguguucagugu

SEQ ID NO: 1128686 - RNA, 22 nt, Homo sapiens
aaguguucaguguugacauagc

SEQ ID NO: 1128687 - RNA, 23 nt, Homo sapiens
aauaaaaauuaucuauaaucuca

SEQ ID NO: 1128688 - RNA, 13 nt, Homo sapiens
aauaaagugaucu

SEQ ID NO: 1128689 - RNA, 19 nt, Homo sapiens
aauaaauggguaacacuga

SEQ ID NO: 1128690 - RNA, 12 nt, Homo sapiens
aauaacacugga

SEQ ID NO: 1128691 - RNA, 12 nt, Homo sapiens
aauacaguauac

SEQ ID NO: 1128692 - RNA, 22 nt, Homo sapiens
gcaagggcugugcugaggucac

SEQ ID NO: 1128693 - RNA, 22 nt, Homo sapiens
gcaauaacguuuaagccaaaac

SEQ ID NO: 1128694 - RNA, 18 nt, Homo sapiens
gcacaacgcaccagacac

SEQ ID NO: 1128695 - RNA, 18 nt, Homo sapiens
gcacagaugcccacguau

SEQ ID NO: 1128696 - RNA, 23 nt, Homo sapiens
gcacucagagcugcugaggacaa

SEQ ID NO: 1128697 - RNA, 16 nt, Homo sapiens
gcagacacagguguag

SEQ ID NO: 1128698 - RNA, 15 nt, Homo sapiens
gcagaucuuggaaug

SEQ ID NO: 1128699 - RNA, 22 nt, Homo sapiens
gcagaucuuggaaugaaugaca

SEQ ID NO: 1128700 - RNA, 11 nt, Homo sapiens
gcagcaaugag

SEQ ID NO: 1128701 - RNA, 19 nt, Homo sapiens
gcagcucaaguuagcauuu

SEQ ID NO: 1128702 - RNA, 21 nt, Homo sapiens
gcaggcaaacgggucgugaug

SEQ ID NO: 1128703 - RNA, 17 nt, Homo sapiens
gcagucaauuuucacau

SEQ ID NO: 1128704 - RNA, 21 nt, Homo sapiens
gcagugagccaagaucgugcc

SEQ ID NO: 1128705 - RNA, 22 nt, Homo sapiens
gcaucaaagaugagaagccaaa

SEQ ID NO: 1128706 - RNA, 18 nt, Homo sapiens
gcauccugugugcugaca

SEQ ID NO: 1128707 - RNA, 13 nt, Homo sapiens
gcaugcgcagcgg

SEQ ID NO: 1128708 - RNA, 20 nt, Homo sapiens
gcaugggauggggaugaagu

SEQ ID NO: 1128709 - RNA, 16 nt, Homo sapiens
gcauguggagacacuc

SEQ ID NO: 1128710 - RNA, 23 nt, Homo sapiens
gcauucccccuaagaggcaguga

SEQ ID NO: 1128711 - RNA, 14 nt, Homo sapiens
gcauuugugucugc

SEQ ID NO: 1128712 - RNA, 21 nt, Homo sapiens
gccaaacaaaggcccagcagc

SEQ ID NO: 1128713 - RNA, 14 nt, Homo sapiens
gccacaaugccucu

SEQ ID NO: 1128714 - RNA, 23 nt, Homo sapiens
gccaggauggcgugugugccgug

SEQ ID NO: 1128715 - RNA, 18 nt, Homo sapiens
gcccagaaagaggcagug

SEQ ID NO: 1128716 - RNA, 20 nt, Homo sapiens
gcccagaaagaggcagugau

SEQ ID NO: 1128717 - RNA, 14 nt, Homo sapiens
gcccagugaccuga

SEQ ID NO: 1128718 - RNA, 13 nt, Homo sapiens
gccccgacuccag

SEQ ID NO: 1128719 - RNA, 16 nt, Homo sapiens
gcccugcugugggaga

SEQ ID NO: 1128720 - RNA, 20 nt, Homo sapiens
gcccugugagggcucacucg

SEQ ID NO: 1128721 - RNA, 13 nt, Homo sapiens
gccguacugucua

SEQ ID NO: 1128722 - RNA, 17 nt, Homo sapiens
gccucccaaagugcugg

SEQ ID NO: 1128723 - RNA, 14 nt, Homo sapiens
gccucuuccagggc

SEQ ID NO: 1128724 - RNA, 17 nt, Homo sapiens
gccuugcacauaggaaa

SEQ ID NO: 1128725 - RNA, 20 nt, Homo sapiens
gcgcagcccgaagcccaguu

SEQ ID NO: 1128726 - RNA, 22 nt, Homo sapiens
gcgguccugggauggggcaugu

SEQ ID NO: 1128727 - RNA, 19 nt, Homo sapiens
gcguccugcccucugggag

SEQ ID NO: 1128728 - RNA, 16 nt, Homo sapiens
gcuaacuccagucucc

SEQ ID NO: 1128729 - RNA, 14 nt, Homo sapiens
gcuagagugcagug

SEQ ID NO: 1128730 - RNA, 21 nt, Homo sapiens
gcuaucuggccugagacaaca

SEQ ID NO: 1128731 - RNA, 23 nt, Homo sapiens
gcuaugguuuucuccaagagcua

SEQ ID NO: 1128732 - RNA, 17 nt, Homo sapiens
gcugaaaacauaaccca

SEQ ID NO: 1128733 - RNA, 22 nt, Homo sapiens
gcugacccaaguguugagggga

SEQ ID NO: 1128734 - RNA, 19 nt, Homo sapiens
gcugaguuccggggugcaa

SEQ ID NO: 1128735 - RNA, 21 nt, Homo sapiens
gcugaguuccggggugcaaug

SEQ ID NO: 1128736 - RNA, 14 nt, Homo sapiens
gcugggcacugggc

SEQ ID NO: 1128737 - RNA, 13 nt, Homo sapiens
gcuggguggugua

SEQ ID NO: 1128738 - RNA, 10 nt, Homo sapiens
gcuguuauac

SEQ ID NO: 1128739 - RNA, 13 nt, Homo sapiens
gcuguuauacugu

SEQ ID NO: 1128740 - RNA, 23 nt, Homo sapiens
gcuuaguagagcuuuuugcaugu

SEQ ID NO: 1128741 - RNA, 19 nt, Homo sapiens
gcuucugcucacauucccu

SEQ ID NO: 1128742 - RNA, 15 nt, Homo sapiens
gcuuguuggcuuccg

SEQ ID NO: 1128743 - RNA, 16 nt, Homo sapiens
gcuuuacuccaggaaa

SEQ ID NO: 1128744 - RNA, 16 nt, Homo sapiens
gcuuugaaaacauaca

SEQ ID NO: 1128745 - RNA, 18 nt, Homo sapiens
ggaaaaugaauaauacau

SEQ ID NO: 1128746 - RNA, 13 nt, Homo sapiens
ggaagccaaacaa

SEQ ID NO: 1128747 - RNA, 13 nt, Homo sapiens
ggaauacuggcca

SEQ ID NO: 1128748 - RNA, 18 nt, Homo sapiens
ggacgccacucauuucau

SEQ ID NO: 1128749 - RNA, 16 nt, Homo sapiens
ggagauagguacuguu

SEQ ID NO: 1128750 - RNA, 18 nt, Homo sapiens
ggagccaucagcugggug

SEQ ID NO: 1128751 - RNA, 13 nt, Homo sapiens
ggaggcacuggga

SEQ ID NO: 1128752 - RNA, 16 nt, Homo sapiens
ggaggugggagacaag

SEQ ID NO: 1128753 - RNA, 19 nt, Homo sapiens
ggaggugggguacauuucu

SEQ ID NO: 1128754 - RNA, 18 nt, Homo sapiens
ggaguagaaaaaucucau

SEQ ID NO: 1128755 - RNA, 15 nt, Homo sapiens
ggauccacacugaga

SEQ ID NO: 1128756 - RNA, 21 nt, Homo sapiens
ggauggaauccuacagccucc

SEQ ID NO: 1128757 - RNA, 23 nt, Homo sapiens
ggcaagauaaaccaaugucauaa

SEQ ID NO: 1128758 - RNA, 16 nt, Homo sapiens
ggcacauggcuggcac

SEQ ID NO: 1128759 - RNA, 17 nt, Homo sapiens
ggcacauggcuggcacu

SEQ ID NO: 1128760 - RNA, 19 nt, Homo sapiens
ggcacucuucccaccucag

SEQ ID NO: 1128761 - RNA, 16 nt, Homo sapiens
ggcagcugucauggaa

SEQ ID NO: 1128762 - RNA, 12 nt, Homo sapiens
ggcauacuaaua

SEQ ID NO: 1128763 - RNA, 22 nt, Homo sapiens
ggccugagaagagagaucaaau

SEQ ID NO: 1128764 - RNA, 19 nt, Homo sapiens
ggcuaaacaagggcaguga

SEQ ID NO: 1128765 - RNA, 16 nt, Homo sapiens
ggcucuguauucugca

SEQ ID NO: 1128766 - RNA, 17 nt, Homo sapiens
ggcugccaggauggcgu

SEQ ID NO: 1128767 - RNA, 13 nt, Homo sapiens
ggcugugcugagg

SEQ ID NO: 1128768 - RNA, 14 nt, Homo sapiens
gggacagcauaccu

SEQ ID NO: 1128769 - RNA, 13 nt, Homo sapiens
gggaccugugauc

SEQ ID NO: 1128770 - RNA, 12 nt, Homo sapiens
gggcuagggagg

SEQ ID NO: 1128771 - RNA, 12 nt, Homo sapiens
ggggagguguau

SEQ ID NO: 1128772 - RNA, 16 nt, Homo sapiens
ggggcauguggccaag

SEQ ID NO: 1128773 - RNA, 13 nt, Homo sapiens
ggggcuguccaau

SEQ ID NO: 1128774 - RNA, 18 nt, Homo sapiens
gggugggccagauccaaa

SEQ ID NO: 1128775 - RNA, 19 nt, Homo sapiens
gguccaggguugcuaggaa

SEQ ID NO: 1128776 - RNA, 12 nt, Homo sapiens
gguccugucuaa

SEQ ID NO: 1128777 - RNA, 20 nt, Homo sapiens
gguccuugucccaagcccag

SEQ ID NO: 1128778 - RNA, 18 nt, Homo sapiens
ggucugaauaacacugga

SEQ ID NO: 1128779 - RNA, 18 nt, Homo sapiens
ggucugguuguugcacca

SEQ ID NO: 1128780 - RNA, 17 nt, Homo sapiens
gguggagguugcaguga

SEQ ID NO: 1128781 - RNA, 12 nt, Homo sapiens
guaaaaccugag

SEQ ID NO: 1128782 - RNA, 22 nt, Homo sapiens
guaaacuauaaacuacuguaau

SEQ ID NO: 1128783 - RNA, 18 nt, Homo sapiens
guaaauauccacagacuc

SEQ ID NO: 1128784 - RNA, 22 nt, Homo sapiens
guaaccaggggcugacaaugcg

SEQ ID NO: 1128785 - RNA, 10 nt, Homo sapiens
guaacugugu

SEQ ID NO: 1128786 - RNA, 19 nt, Homo sapiens
uccuggggaauacuggcca

SEQ ID NO: 1128787 - RNA, 15 nt, Homo sapiens
uccuuaggaaaaaca

SEQ ID NO: 1128788 - RNA, 13 nt, Homo sapiens
uccuucuuccuag

SEQ ID NO: 1128789 - RNA, 17 nt, Homo sapiens
uccuugauaaaguauua

SEQ ID NO: 1128790 - RNA, 16 nt, Homo sapiens
uccuuggaccguauca

SEQ ID NO: 1128791 - RNA, 23 nt, Homo sapiens
uccuugucccaagcccagggacu

SEQ ID NO: 1128792 - RNA, 18 nt, Homo sapiens
uccuuuggcaugggaugg

SEQ ID NO: 1128793 - RNA, 12 nt, Homo sapiens
ucgaaagcaaug

SEQ ID NO: 1128794 - RNA, 15 nt, Homo sapiens
ucgaguccccagaac

SEQ ID NO: 1128795 - RNA, 21 nt, Homo sapiens
ucuacugacuuuucccauuca

SEQ ID NO: 1128796 - RNA, 19 nt, Homo sapiens
ucuauaaguguucaguguu

SEQ ID NO: 1128797 - RNA, 21 nt, Homo sapiens
ucuaucaaauacuaguauuaa

SEQ ID NO: 1128798 - RNA, 22 nt, Homo sapiens
ucucaaggucacgggaccccua

SEQ ID NO: 1128799 - RNA, 13 nt, Homo sapiens
ucucauccacaga

SEQ ID NO: 1128800 - RNA, 14 nt, Homo sapiens
ucucccaguccaag

SEQ ID NO: 1128801 - RNA, 15 nt, Homo sapiens
ucucucuugcaggaa

SEQ ID NO: 1128802 - RNA, 22 nt, Homo sapiens
ucucuuaaaccacagcacuauu

SEQ ID NO: 1128803 - RNA, 15 nt, Homo sapiens
ucugaggacacagau

SEQ ID NO: 1128804 - RNA, 21 nt, Homo sapiens
ucugcccuguauauaauacua

SEQ ID NO: 1128805 - RNA, 22 nt, Homo sapiens
ucugccugccucaugcucucua

SEQ ID NO: 1128806 - RNA, 23 nt, Homo sapiens
ucugggagguuacugucugguag

SEQ ID NO: 1128807 - RNA, 22 nt, Homo sapiens
ucuguaggucccacucccacag

SEQ ID NO: 1128808 - RNA, 21 nt, Homo sapiens
ucuguggaaguagcuuugaac

SEQ ID NO: 1128809 - RNA, 22 nt, Homo sapiens
ucuucuaagaauuuuaucuguu

SEQ ID NO: 1128810 - RNA, 16 nt, Homo sapiens
ucuuggaaugaaugac

SEQ ID NO: 1128811 - RNA, 21 nt, Homo sapiens
ucuuuaagguagcaucauuga

SEQ ID NO: 1128812 - RNA, 22 nt, Homo sapiens
ucuuuaagguagcaucauugau

SEQ ID NO: 1128813 - RNA, 19 nt, Homo sapiens
ucuuugucagcaguucccu

SEQ ID NO: 1128814 - RNA, 13 nt, Homo sapiens
ugaaaacauacac

SEQ ID NO: 1128815 - RNA, 16 nt, Homo sapiens
ugaaacacacauggac

SEQ ID NO: 1128816 - RNA, 18 nt, Homo sapiens
ugaaacacacauggacau

SEQ ID NO: 1128817 - RNA, 13 nt, Homo sapiens
ugaaccacaccau

SEQ ID NO: 1128818 - RNA, 19 nt, Homo sapiens
ugaaccaugugacuguauu

SEQ ID NO: 1128819 - RNA, 18 nt, Homo sapiens
ugaacuguggugccacau

SEQ ID NO: 1128820 - RNA, 21 nt, Homo sapiens
ugaacuguggugccacaugac

SEQ ID NO: 1128821 - RNA, 22 nt, Homo sapiens
ugaacuguggugccacaugacc

SEQ ID NO: 1128822 - RNA, 18 nt, Homo sapiens
ugaagccccuuguccucu

SEQ ID NO: 1128823 - RNA, 17 nt, Homo sapiens
ugaagguggggccagug

SEQ ID NO: 1128824 - RNA, 14 nt, Homo sapiens
ugaauccugugaua

SEQ ID NO: 1128825 - RNA, 18 nt, Homo sapiens
ugacaagcaagggcugug

SEQ ID NO: 1128826 - RNA, 21 nt, Homo sapiens
ugacaagcaagggcugugcug

SEQ ID NO: 1128827 - RNA, 23 nt, Homo sapiens
ugacaagcaagggcugugcugag

SEQ ID NO: 1128828 - RNA, 19 nt, Homo sapiens
ugacagagguuuugaaaug

SEQ ID NO: 1128829 - RNA, 14 nt, Homo sapiens
ugacauagccuuug

SEQ ID NO: 1128830 - RNA, 20 nt, Homo sapiens
ugaccaagauacuuaagugc

SEQ ID NO: 1128831 - RNA, 13 nt, Homo sapiens
ugacuaccagcua

SEQ ID NO: 1128832 - RNA, 16 nt, Homo sapiens
ugacuaccagcuaacu

SEQ ID NO: 1128833 - RNA, 18 nt, Homo sapiens
ugacucuuagccccagac

SEQ ID NO: 1128834 - RNA, 19 nt, Homo sapiens
ugacuguguguugugaaau

SEQ ID NO: 1128835 - RNA, 13 nt, Homo sapiens
ugacuucuagaaa

SEQ ID NO: 1128836 - RNA, 18 nt, Homo sapiens
ugagaaauuuaaacuaua

SEQ ID NO: 1128837 - RNA, 22 nt, Homo sapiens
ugagagcauugggauaucuccu

SEQ ID NO: 1128838 - RNA, 18 nt, Homo sapiens
ugagccaaacacacugua

SEQ ID NO: 1128839 - RNA, 16 nt, Homo sapiens
ugagccauugauucuu

SEQ ID NO: 1128840 - RNA, 13 nt, Homo sapiens
ugagcgcuguguu

SEQ ID NO: 1128841 - RNA, 16 nt, Homo sapiens
ugagggaucugucuca

SEQ ID NO: 1128842 - RNA, 19 nt, Homo sapiens
ugagugcccaacccuaucc

SEQ ID NO: 1128843 - RNA, 16 nt, Homo sapiens
ugagugcuccugugug

SEQ ID NO: 1128844 - RNA, 17 nt, Homo sapiens
ugaugcgaaaacuugaa

SEQ ID NO: 1128845 - RNA, 18 nt, Homo sapiens
ugauuaaucugauuauac

SEQ ID NO: 1128846 - RNA, 15 nt, Homo sapiens
ugcaagucacauaaa

SEQ ID NO: 1128847 - RNA, 23 nt, Homo sapiens
ugcaauuuccccucuguguccuc

SEQ ID NO: 1128848 - RNA, 22 nt, Homo sapiens
ugcaauuucucccgaauccuga

SEQ ID NO: 1128849 - RNA, 19 nt, Homo sapiens
ugcacuccagccuaggcaa

SEQ ID NO: 1128850 - RNA, 19 nt, Homo sapiens
ugcagaaauuugaaugaca

SEQ ID NO: 1128851 - RNA, 17 nt, Homo sapiens
ugcagacacaucagcug

SEQ ID NO: 1128852 - RNA, 23 nt, Homo sapiens
ugcaggaaagaauagaagugauu

SEQ ID NO: 1128853 - RNA, 16 nt, Homo sapiens
ugcagucuuggcucac

SEQ ID NO: 1128854 - RNA, 14 nt, Homo sapiens
ugcauguaucuucu

SEQ ID NO: 1128855 - RNA, 14 nt, Homo sapiens
ugccaaccagacac

SEQ ID NO: 1128856 - RNA, 13 nt, Homo sapiens
ugccacaaugccu

SEQ ID NO: 1128857 - RNA, 14 nt, Homo sapiens
ugccaguccugcaa

SEQ ID NO: 1128858 - RNA, 18 nt, Homo sapiens
ugcccaacccuaucccag

SEQ ID NO: 1128859 - RNA, 18 nt, Homo sapiens
ugcccugugagggcucac

SEQ ID NO: 1128860 - RNA, 15 nt, Homo sapiens
ugccuucucuucuau

SEQ ID NO: 1128861 - RNA, 21 nt, Homo sapiens
ugccuucucuucuauccugca

SEQ ID NO: 1128862 - RNA, 12 nt, Homo sapiens
ugcuacccagua

SEQ ID NO: 1128863 - RNA, 23 nt, Homo sapiens
ugcuaugguuuucuccaagagcu

SEQ ID NO: 1128864 - RNA, 12 nt, Homo sapiens
ugcucacauucc

SEQ ID NO: 1128865 - RNA, 22 nt, Homo sapiens
ugcuccuaccccuguccugggg

SEQ ID NO: 1128866 - RNA, 22 nt, Homo sapiens
ugcuggcaccucagacaaucca

SEQ ID NO: 1128867 - RNA, 20 nt, Homo sapiens
ugcugggcccuggccuggau

SEQ ID NO: 1128868 - RNA, 19 nt, Homo sapiens
uggaaguaguaauugcaag

SEQ ID NO: 1128869 - RNA, 22 nt, Homo sapiens
uggacacuuauggggacagcau

SEQ ID NO: 1128870 - RNA, 14 nt, Homo sapiens
uggacccccuggaa

SEQ ID NO: 1128871 - RNA, 18 nt, Homo sapiens
uggagaguggcaucuucu

SEQ ID NO: 1128872 - RNA, 14 nt, Homo sapiens
uggaugugcucacu

SEQ ID NO: 1128873 - RNA, 22 nt, Homo sapiens
uggcacagaugcccacguaugu

SEQ ID NO: 1128874 - RNA, 19 nt, Homo sapiens
uggcaccucagacaaucca

SEQ ID NO: 1128875 - RNA, 15 nt, Homo sapiens
uggccauuguguugg

SEQ ID NO: 1128876 - RNA, 24 nt, Homo sapiens
uggcccccucccuggaugacauua

SEQ ID NO: 1128877 - RNA, 18 nt, Homo sapiens
uggccucccaaucuugcc

SEQ ID NO: 1128878 - RNA, 17 nt, Homo sapiens
uggcucacuacagccuc

SEQ ID NO: 1128879 - RNA, 11 nt, Homo sapiens
uggcuguaaac

SEQ ID NO: 1128880 - RNA, 17 nt, Homo sapiens
uggcuuuaagccauuau

SEQ ID NO: 1128881 - RNA, 11 nt, Homo sapiens
uggcuuucaua

SEQ ID NO: 1128882 - RNA, 14 nt, Homo sapiens
ugggaccugugauc

SEQ ID NO: 1128883 - RNA, 15 nt, Homo sapiens
gagcugaagcuggga

SEQ ID NO: 1128884 - RNA, 17 nt, Homo sapiens
gaggaagaugaagacca

SEQ ID NO: 1128885 - RNA, 12 nt, Homo sapiens
gaggacacagau

SEQ ID NO: 1128886 - RNA, 17 nt, Homo sapiens
gaggacugagacuggca

SEQ ID NO: 1128887 - RNA, 23 nt, Homo sapiens
gaggcacugggaagccuagagaa

SEQ ID NO: 1128888 - RNA, 20 nt, Homo sapiens
gagggaauuugaagaaagga

SEQ ID NO: 1128889 - RNA, 20 nt, Homo sapiens
gagguggagguugcagugag

SEQ ID NO: 1128890 - RNA, 17 nt, Homo sapiens
gaguaacaugccagcuu

SEQ ID NO: 1128891 - RNA, 17 nt, Homo sapiens
gagucaugcacucaggc

SEQ ID NO: 1128892 - RNA, 13 nt, Homo sapiens
gaguggaaacaaa

SEQ ID NO: 1128893 - RNA, 21 nt, Homo sapiens
gaguggcaucuucuuugcauc

SEQ ID NO: 1128894 - RNA, 18 nt, Homo sapiens
gaguguuuaaaguucaac

SEQ ID NO: 1128895 - RNA, 19 nt, Homo sapiens
gauaaaccaaugucauaac

SEQ ID NO: 1128896 - RNA, 20 nt, Homo sapiens
gauacagccuuacaauacaa

SEQ ID NO: 1128897 - RNA, 14 nt, Homo sapiens
gaucuccacuguug

SEQ ID NO: 1128898 - RNA, 22 nt, Homo sapiens
gaugaaagaggggugggaucca

SEQ ID NO: 1128899 - RNA, 21 nt, Homo sapiens
gaugacauuaaagaaggguug

SEQ ID NO: 1128900 - RNA, 14 nt, Homo sapiens
gaugagaagccaaa

SEQ ID NO: 1128901 - RNA, 17 nt, Homo sapiens
gauggcaugcugccuua

SEQ ID NO: 1128902 - RNA, 17 nt, Homo sapiens
gauuuucugaacaagcu

SEQ ID NO: 1128903 - RNA, 13 nt, Homo sapiens
gcaaaucaucuaa

SEQ ID NO: 1128904 - RNA, 14 nt, Homo sapiens
gcaacagccuguuu

SEQ ID NO: 1128905 - RNA, 16 nt, Homo sapiens
gcaacccucacugugu

SEQ ID NO: 1128906 - RNA, 16 nt, Homo sapiens
gcaagggcugugcuga

SEQ ID NO: 1128907 - RNA, 21 nt, Homo sapiens
gcacaacgcaccagacacuca

SEQ ID NO: 1128908 - RNA, 18 nt, Homo sapiens
gcacaccucaugcugagc

SEQ ID NO: 1128909 - RNA, 17 nt, Homo sapiens
gcacagaugcccacgua

SEQ ID NO: 1128910 - RNA, 22 nt, Homo sapiens
gcacuccagccuaggcaacaag

SEQ ID NO: 1128911 - RNA, 18 nt, Homo sapiens
gcacucuucccaccucag

SEQ ID NO: 1128912 - RNA, 15 nt, Homo sapiens
gcacuuagcccaaga

SEQ ID NO: 1128913 - RNA, 14 nt, Homo sapiens
gcagccuucugaca

SEQ ID NO: 1128914 - RNA, 20 nt, Homo sapiens
gcagccuucugacaagcaag

SEQ ID NO: 1128915 - RNA, 23 nt, Homo sapiens
gcagcugucauggaaaagcccag

SEQ ID NO: 1128916 - RNA, 20 nt, Homo sapiens
gcagucuuggcucacuacag

SEQ ID NO: 1128917 - RNA, 13 nt, Homo sapiens
gcauaaagcaauu

SEQ ID NO: 1128918 - RNA, 15 nt, Homo sapiens
gcauccuaaggacga

SEQ ID NO: 1128919 - RNA, 19 nt, Homo sapiens
gcauccuuuucaaaaccua

SEQ ID NO: 1128920 - RNA, 15 nt, Homo sapiens
acuaaagugucuauu

SEQ ID NO: 1128921 - RNA, 17 nt, Homo sapiens
acuauaaacuacuguaa

SEQ ID NO: 1128922 - RNA, 13 nt, Homo sapiens
acuaucaguuccc

SEQ ID NO: 1128923 - RNA, 13 nt, Homo sapiens
acuaugagccuau

SEQ ID NO: 1128924 - RNA, 15 nt, Homo sapiens
acucaagucuggauc

SEQ ID NO: 1128925 - RNA, 20 nt, Homo sapiens
acuccuauaaggagaguuca

SEQ ID NO: 1128926 - RNA, 22 nt, Homo sapiens
acucucuauaaguguucagugu

SEQ ID NO: 1128927 - RNA, 18 nt, Homo sapiens
acucucuuucuuccacua

SEQ ID NO: 1128928 - RNA, 22 nt, Homo sapiens
acugaaccuuguugaugccagc

SEQ ID NO: 1128929 - RNA, 15 nt, Homo sapiens
acugacuaccagcua

SEQ ID NO: 1128930 - RNA, 19 nt, Homo sapiens
acugaugcgaaaacuugaa

SEQ ID NO: 1128931 - RNA, 17 nt, Homo sapiens
acugcaagucacauaaa

SEQ ID NO: 1128932 - RNA, 16 nt, Homo sapiens
acuggcaggcagcaga

SEQ ID NO: 1128933 - RNA, 20 nt, Homo sapiens
acuggccugauugcagagua

SEQ ID NO: 1128934 - RNA, 22 nt, Homo sapiens
acuggcuucucuuucucugagu

SEQ ID NO: 1128935 - RNA, 20 nt, Homo sapiens
acuggggucuguguggugcc

SEQ ID NO: 1128936 - RNA, 17 nt, Homo sapiens
acuguaaauauccacag

SEQ ID NO: 1128937 - RNA, 14 nt, Homo sapiens
acuguauuuuccaa

SEQ ID NO: 1128938 - RNA, 23 nt, Homo sapiens
acuucucauuuuuuaaaaaagcu

SEQ ID NO: 1128939 - RNA, 18 nt, Homo sapiens
acuucuucugguccuuca

SEQ ID NO: 1128940 - RNA, 12 nt, Homo sapiens
acuugagacaaa

SEQ ID NO: 1128941 - RNA, 23 nt, Homo sapiens
acuuggaaccuuggaaaugacca

SEQ ID NO: 1128942 - RNA, 22 nt, Homo sapiens
acuuguguccccaccucaggcu

SEQ ID NO: 1128943 - RNA, 19 nt, Homo sapiens
acuuuaaagcguuugcaca

SEQ ID NO: 1128944 - RNA, 17 nt, Homo sapiens
acuuuaauuuccuugac

SEQ ID NO: 1128945 - RNA, 14 nt, Homo sapiens
acuuuccaaaaccu

SEQ ID NO: 1128946 - RNA, 22 nt, Homo sapiens
acuuugugaucucauggcuuug

SEQ ID NO: 1128947 - RNA, 13 nt, Homo sapiens
agaaacaacagaa

SEQ ID NO: 1128948 - RNA, 16 nt, Homo sapiens
agaaacguaacugugu

SEQ ID NO: 1128949 - RNA, 15 nt, Homo sapiens
agaaagaaugcaaga

SEQ ID NO: 1128950 - RNA, 14 nt, Homo sapiens
agaaagaggcagug

SEQ ID NO: 1128951 - RNA, 13 nt, Homo sapiens
agaaagugaaaaa

SEQ ID NO: 1128952 - RNA, 22 nt, Homo sapiens
agaagaaaaaguugcagucuca

SEQ ID NO: 1128953 - RNA, 20 nt, Homo sapiens
agaaggcugugagccaagga

SEQ ID NO: 1128954 - RNA, 21 nt, Homo sapiens
agaaugccucugcugugggcu

SEQ ID NO: 1128955 - RNA, 16 nt, Homo sapiens
cucgcuccucaacccc

SEQ ID NO: 1128956 - RNA, 23 nt, Homo sapiens
cucuaauucuagagucucuguua

SEQ ID NO: 1128957 - RNA, 15 nt, Homo sapiens
cucuauaaguguuca

SEQ ID NO: 1128958 - RNA, 15 nt, Homo sapiens
cucuauuacacugga

SEQ ID NO: 1128959 - RNA, 16 nt, Homo sapiens
cucucaagcuagccag

SEQ ID NO: 1128960 - RNA, 15 nt, Homo sapiens
cucucucucaccuac

SEQ ID NO: 1128961 - RNA, 21 nt, Homo sapiens
cucucuuucuuccacuacccu

SEQ ID NO: 1128962 - RNA, 19 nt, Homo sapiens
cucugggagccugacagug

SEQ ID NO: 1128963 - RNA, 17 nt, Homo sapiens
cucugucgccaggcuag

SEQ ID NO: 1128964 - RNA, 12 nt, Homo sapiens
cucuuccagcaa

SEQ ID NO: 1128965 - RNA, 22 nt, Homo sapiens
cucuucuuccccagguccuucc

SEQ ID NO: 1128966 - RNA, 14 nt, Homo sapiens
cugacagugcccag

SEQ ID NO: 1128967 - RNA, 17 nt, Homo sapiens
cugaccaagauacuuaa

SEQ ID NO: 1128968 - RNA, 15 nt, Homo sapiens
cugaccgaguaccug

SEQ ID NO: 1128969 - RNA, 18 nt, Homo sapiens
cugagaacuccucauucc

SEQ ID NO: 1128970 - RNA, 15 nt, Homo sapiens
cugagccaaacacac

SEQ ID NO: 1128971 - RNA, 19 nt, Homo sapiens
cugagccauugauucuuca

SEQ ID NO: 1128972 - RNA, 17 nt, Homo sapiens
cugaggcaaauggcaca

SEQ ID NO: 1128973 - RNA, 22 nt, Homo sapiens
cugaggcccgaucuccacuguu

SEQ ID NO: 1128974 - RNA, 14 nt, Homo sapiens
cugaguucaaguca

SEQ ID NO: 1128975 - RNA, 19 nt, Homo sapiens
cugaguuccggggugcaau

SEQ ID NO: 1128976 - RNA, 16 nt, Homo sapiens
cugaugaacuguggug

SEQ ID NO: 1128977 - RNA, 15 nt, Homo sapiens
cugcccagcucugag

SEQ ID NO: 1128978 - RNA, 15 nt, Homo sapiens
cuggaagccaaacaa

SEQ ID NO: 1128979 - RNA, 14 nt, Homo sapiens
cuggacacugucca

SEQ ID NO: 1128980 - RNA, 16 nt, Homo sapiens
cuggacacuguccaug

SEQ ID NO: 1128981 - RNA, 20 nt, Homo sapiens
cuggacacuuauggggacag

SEQ ID NO: 1128982 - RNA, 15 nt, Homo sapiens
cuggaugacauuaaa

SEQ ID NO: 1128983 - RNA, 21 nt, Homo sapiens
cuggauuggggauggggacaa

SEQ ID NO: 1128984 - RNA, 19 nt, Homo sapiens
acaccaucacccucugggc

SEQ ID NO: 1128985 - RNA, 16 nt, Homo sapiens
acaccuccuucuuccu

SEQ ID NO: 1128986 - RNA, 22 nt, Homo sapiens
acacuaucuguacuaaaaacac

SEQ ID NO: 1128987 - RNA, 19 nt, Homo sapiens
acacugaaccuuguugaug

SEQ ID NO: 1128988 - RNA, 19 nt, Homo sapiens
acacugaggaggcugccuu

SEQ ID NO: 1128989 - RNA, 23 nt, Homo sapiens
acacuggauuuguuucugugauc

SEQ ID NO: 1128990 - RNA, 16 nt, Homo sapiens
acacuguccaugaagc

SEQ ID NO: 1128991 - RNA, 22 nt, Homo sapiens
acagaggagagaggcucagcca

SEQ ID NO: 1128992 - RNA, 17 nt, Homo sapiens
acagcaaggauggagcu

SEQ ID NO: 1128993 - RNA, 14 nt, Homo sapiens
acaggggacacuga

SEQ ID NO: 1128994 - RNA, 21 nt, Homo sapiens
acagggucuaccucugucacc

SEQ ID NO: 1128995 - RNA, 20 nt, Homo sapiens
acagguguagaccagagugu

SEQ ID NO: 1128996 - RNA, 20 nt, Homo sapiens
acaguugugagauugugccc

SEQ ID NO: 1128997 - RNA, 15 nt, Homo sapiens
acaugccagcuuccu

SEQ ID NO: 1128998 - RNA, 22 nt, Homo sapiens
acauggcuggcacugagcagua

SEQ ID NO: 1128999 - RNA, 18 nt, Homo sapiens
acaugugcuggacacugu

SEQ ID NO: 1129000 - RNA, 18 nt, Homo sapiens
acauuucuauagccaaaa

SEQ ID NO: 1129001 - RNA, 14 nt, Homo sapiens
acauuucucugagc

SEQ ID NO: 1129002 - RNA, 14 nt, Homo sapiens
acauuugugcagaa

SEQ ID NO: 1129003 - RNA, 19 nt, Homo sapiens
accaaagccaccaagacag

SEQ ID NO: 1129004 - RNA, 23 nt, Homo sapiens
accaaaucuugguugaugccaaa

SEQ ID NO: 1129005 - RNA, 21 nt, Homo sapiens
accaaugcaacauuugugcag

SEQ ID NO: 1129006 - RNA, 15 nt, Homo sapiens
accaaugucauaaca

SEQ ID NO: 1129007 - RNA, 16 nt, Homo sapiens
accaggccaagacuca

SEQ ID NO: 1129008 - RNA, 17 nt, Homo sapiens
accauagcacaggcuaa

SEQ ID NO: 1129009 - RNA, 15 nt, Homo sapiens
accaugccaggcuaa

SEQ ID NO: 1129010 - RNA, 23 nt, Homo sapiens
accccaggacgccacucauuuca

SEQ ID NO: 1129011 - RNA, 20 nt, Homo sapiens
acccgagcuagagugcagug

SEQ ID NO: 1129012 - RNA, 22 nt, Homo sapiens
accuaaaaacauuuacugacca

SEQ ID NO: 1129013 - RNA, 20 nt, Homo sapiens
accuccaaggaccucucuca

SEQ ID NO: 1129014 - RNA, 22 nt, Homo sapiens
accuugaugcuuggccucccaa

SEQ ID NO: 1129015 - RNA, 21 nt, Homo sapiens
accuuggaaaugaccaggcca

SEQ ID NO: 1129016 - RNA, 13 nt, Homo sapiens
acgcaccagacac

SEQ ID NO: 1129017 - RNA, 19 nt, Homo sapiens
acgcaccagacacucacag

SEQ ID NO: 1129018 - RNA, 20 nt, Homo sapiens
acgccacucauuucaucuca

SEQ ID NO: 1129019 - RNA, 21 nt, Homo sapiens
acgccacucauuucaucucau

SEQ ID NO: 1129020 - RNA, 14 nt, Homo sapiens
acuagaaacagagg

SEQ ID NO: 1129021 - RNA, 15 nt, Homo sapiens
acuagagcucaggcc

SEQ ID NO: 1129022 - RNA, 14 nt, Homo sapiens
acuauaaacuacug

SEQ ID NO: 1129023 - RNA, 22 nt, Homo sapiens
acucagagcugcugaggacaau

SEQ ID NO: 1129024 - RNA, 17 nt, Homo sapiens
acucagcggucauucua

SEQ ID NO: 1129025 - RNA, 19 nt, Homo sapiens
acuccggccaccuccucca

SEQ ID NO: 1129026 - RNA, 18 nt, Homo sapiens
acucucuauaaguguuca

SEQ ID NO: 1129027 - RNA, 23 nt, Homo sapiens
acucucuauaaguguucaguguu

SEQ ID NO: 1129028 - RNA, 13 nt, Homo sapiens
acucuguccugga

SEQ ID NO: 1129029 - RNA, 13 nt, Homo sapiens
acucuucauucag

SEQ ID NO: 1129030 - RNA, 14 nt, Homo sapiens
acucuucauucagu

SEQ ID NO: 1129031 - RNA, 22 nt, Homo sapiens
acugaauauuaucaguggcugc

SEQ ID NO: 1129032 - RNA, 21 nt, Homo sapiens
acugagccaaacacacuguaa

SEQ ID NO: 1129033 - RNA, 17 nt, Homo sapiens
acugccagcucucugau

SEQ ID NO: 1129034 - RNA, 22 nt, Homo sapiens
acuggagaguggagucgacuca

SEQ ID NO: 1129035 - RNA, 13 nt, Homo sapiens
acuggccaugccu

SEQ ID NO: 1129036 - RNA, 12 nt, Homo sapiens
acugucgagucc

SEQ ID NO: 1129037 - RNA, 13 nt, Homo sapiens
acuuaagaggcag

SEQ ID NO: 1129038 - RNA, 12 nt, Homo sapiens
acuucucugagu

SEQ ID NO: 1129039 - RNA, 19 nt, Homo sapiens
acuugccaggcucccuuuc

SEQ ID NO: 1129040 - RNA, 17 nt, Homo sapiens
acuuucccacagcacua

SEQ ID NO: 1129041 - RNA, 22 nt, Homo sapiens
acuuugguggccacauaagcca

SEQ ID NO: 1129042 - RNA, 15 nt, Homo sapiens
acuuuucccauucag

SEQ ID NO: 1129043 - RNA, 16 nt, Homo sapiens
acuuuucccauucagc

SEQ ID NO: 1129044 - RNA, 12 nt, Homo sapiens
agaaaacacagc

SEQ ID NO: 1129045 - RNA, 22 nt, Homo sapiens
agaaacagagguggcugcugug

SEQ ID NO: 1129046 - RNA, 17 nt, Homo sapiens
agaaagaggcagugauu

SEQ ID NO: 1129047 - RNA, 22 nt, Homo sapiens
agaaauaggaccuuccacacag

SEQ ID NO: 1129048 - RNA, 21 nt, Homo sapiens
agaagaaaaaguugcagucuc

SEQ ID NO: 1129049 - RNA, 17 nt, Homo sapiens
agaagccccuaggcaaa

SEQ ID NO: 1129050 - RNA, 20 nt, Homo sapiens
agaaugcaagaguggacuga

SEQ ID NO: 1129051 - RNA, 16 nt, Homo sapiens
agaauggaugugcuca

SEQ ID NO: 1129052 - RNA, 11 nt, Homo sapiens
agagacagggu

SEQ ID NO: 1129053 - RNA, 15 nt, Homo sapiens
agagaugaaagaggg

SEQ ID NO: 1129054 - RNA, 18 nt, Homo sapiens
agagcaaugguagcaaaa

SEQ ID NO: 1129055 - RNA, 15 nt, Homo sapiens
agagccgcauggcac

SEQ ID NO: 1129056 - RNA, 13 nt, Homo sapiens
agagcuagggcug

SEQ ID NO: 1129057 - RNA, 17 nt, Homo sapiens
agaggagagaggcucag

SEQ ID NO: 1129058 - RNA, 16 nt, Homo sapiens
agaguggagucugagu

SEQ ID NO: 1129059 - RNA, 21 nt, Homo sapiens
agaucauauuguauauaguua

SEQ ID NO: 1129060 - RNA, 19 nt, Homo sapiens
agaucgugccauugcacuc

SEQ ID NO: 1129061 - RNA, 16 nt, Homo sapiens
agaugagaagccaaag

SEQ ID NO: 1129062 - RNA, 17 nt, Homo sapiens
agauuuugucaaaaacu

SEQ ID NO: 1129063 - RNA, 19 nt, Homo sapiens
agcaagauuuugucaaaaa

SEQ ID NO: 1129064 - RNA, 19 nt, Homo sapiens
agcaggguucugaggcaaa

SEQ ID NO: 1129065 - RNA, 17 nt, Homo sapiens
agcaguaccagugugcu

SEQ ID NO: 1129066 - RNA, 12 nt, Homo sapiens
agcagucagggu

SEQ ID NO: 1129067 - RNA, 18 nt, Homo sapiens
agcauaccuuggacugac

SEQ ID NO: 1129068 - RNA, 14 nt, Homo sapiens
agcaucauugaucu

SEQ ID NO: 1129069 - RNA, 12 nt, Homo sapiens
agcaucuaagaa

SEQ ID NO: 1129070 - RNA, 15 nt, Homo sapiens
agcaucucacugcaa

SEQ ID NO: 1129071 - RNA, 14 nt, Homo sapiens
agccaaacacuguu

SEQ ID NO: 1129072 - RNA, 20 nt, Homo sapiens
agccagaaacguaacugugu

SEQ ID NO: 1129073 - RNA, 19 nt, Homo sapiens
agccauuucggaagacacc

SEQ ID NO: 1129074 - RNA, 13 nt, Homo sapiens
agccccgacucca

SEQ ID NO: 1129075 - RNA, 21 nt, Homo sapiens
agccuggcccuggaacuagaa

SEQ ID NO: 1129076 - RNA, 13 nt, Homo sapiens
caaagaaauagca

SEQ ID NO: 1129077 - RNA, 21 nt, Homo sapiens
caaagaugagaagccaaagcc

SEQ ID NO: 1129078 - RNA, 15 nt, Homo sapiens
caaaugggucccuca

SEQ ID NO: 1129079 - RNA, 13 nt, Homo sapiens
caacaacaaggac

SEQ ID NO: 1129080 - RNA, 14 nt, Homo sapiens
caaccuuucccuca

SEQ ID NO: 1129081 - RNA, 20 nt, Homo sapiens
caacgcaccagacacucaca

SEQ ID NO: 1129082 - RNA, 18 nt, Homo sapiens
caagagugaaacuccauc

SEQ ID NO: 1129083 - RNA, 15 nt, Homo sapiens
caagaguggacugaa

SEQ ID NO: 1129084 - RNA, 20 nt, Homo sapiens
caagaucgugccauugcacu

SEQ ID NO: 1129085 - RNA, 15 nt, Homo sapiens
caagcauuuguucca

SEQ ID NO: 1129086 - RNA, 18 nt, Homo sapiens
caagccacagaaaugugu

SEQ ID NO: 1129087 - RNA, 15 nt, Homo sapiens
caaggaccucucuca

SEQ ID NO: 1129088 - RNA, 15 nt, Homo sapiens
caaggauggagcuga

SEQ ID NO: 1129089 - RNA, 15 nt, Homo sapiens
caauccccagacuca

SEQ ID NO: 1129090 - RNA, 20 nt, Homo sapiens
caaugcaccuaaagaaaaac

SEQ ID NO: 1129091 - RNA, 23 nt, Homo sapiens
caaugcgaggucgcaacugagau

SEQ ID NO: 1129092 - RNA, 21 nt, Homo sapiens
caaugcuucuaucaaauacua

SEQ ID NO: 1129093 - RNA, 22 nt, Homo sapiens
caaugggacucugagaacuccu

SEQ ID NO: 1129094 - RNA, 16 nt, Homo sapiens
caaugguagcaaaaca

SEQ ID NO: 1129095 - RNA, 17 nt, Homo sapiens
cacaacgcaccagacac

SEQ ID NO: 1129096 - RNA, 13 nt, Homo sapiens
cacaccuacugua

SEQ ID NO: 1129097 - RNA, 14 nt, Homo sapiens
cacagagcaauggu

SEQ ID NO: 1129098 - RNA, 23 nt, Homo sapiens
cacaggcugggauggagcacuuc

SEQ ID NO: 1129099 - RNA, 21 nt, Homo sapiens
cacauaggaaacuuuugauaa

SEQ ID NO: 1129100 - RNA, 14 nt, Homo sapiens
cacauggacaugug

SEQ ID NO: 1129101 - RNA, 16 nt, Homo sapiens
ccucccauagcacugc

SEQ ID NO: 1129102 - RNA, 16 nt, Homo sapiens
ccucccuggaugacau

SEQ ID NO: 1129103 - RNA, 22 nt, Homo sapiens
ccuccugucuuagccucccaaa

SEQ ID NO: 1129104 - RNA, 13 nt, Homo sapiens
ccucuccccucau

SEQ ID NO: 1129105 - RNA, 20 nt, Homo sapiens
ccucucgcuccucaaccccu

SEQ ID NO: 1129106 - RNA, 14 nt, Homo sapiens
ccugacagugccca

SEQ ID NO: 1129107 - RNA, 18 nt, Homo sapiens
ccugccucaugcucucua

SEQ ID NO: 1129108 - RNA, 19 nt, Homo sapiens
ccugcuccaucaugcuuga

SEQ ID NO: 1129109 - RNA, 21 nt, Homo sapiens
ccuggagacauaucacucaau

SEQ ID NO: 1129110 - RNA, 16 nt, Homo sapiens
ccuggaugacauuaaa

SEQ ID NO: 1129111 - RNA, 16 nt, Homo sapiens
ccugggauggggcaug

SEQ ID NO: 1129112 - RNA, 21 nt, Homo sapiens
ccuggggcuggguguguuuca

SEQ ID NO: 1129113 - RNA, 14 nt, Homo sapiens
ccugguguguuucc

SEQ ID NO: 1129114 - RNA, 20 nt, Homo sapiens
ccuguaaucccaacacuuug

SEQ ID NO: 1129115 - RNA, 16 nt, Homo sapiens
ccuguauauaauacua

SEQ ID NO: 1129116 - RNA, 21 nt, Homo sapiens
ccugugaucuccacaccaaag

SEQ ID NO: 1129117 - RNA, 15 nt, Homo sapiens
ccuuaggaaaaacau

SEQ ID NO: 1129118 - RNA, 21 nt, Homo sapiens
ccuuccucucaagcuagccag

SEQ ID NO: 1129119 - RNA, 18 nt, Homo sapiens
ccuuggaccguaucacug

SEQ ID NO: 1129120 - RNA, 16 nt, Homo sapiens
ccuuucuucaccaaau

SEQ ID NO: 1129121 - RNA, 14 nt, Homo sapiens
ccuuuucaaaaccu

SEQ ID NO: 1129122 - RNA, 22 nt, Homo sapiens
cgaaagcaaugcuucuaucaaa

SEQ ID NO: 1129123 - RNA, 12 nt, Homo sapiens
cgaagcccaguu

SEQ ID NO: 1129124 - RNA, 17 nt, Homo sapiens
cgaagggggucaaagga

SEQ ID NO: 1129125 - RNA, 16 nt, Homo sapiens
cgagucaugcacucag

SEQ ID NO: 1129126 - RNA, 15 nt, Homo sapiens
cggcugccucaggag

SEQ ID NO: 1129127 - RNA, 14 nt, Homo sapiens
cgggggaaagcaca

SEQ ID NO: 1129128 - RNA, 22 nt, Homo sapiens
cgggggaaagcacaccucaugc

SEQ ID NO: 1129129 - RNA, 16 nt, Homo sapiens
cguaugugaaacacac

SEQ ID NO: 1129130 - RNA, 17 nt, Homo sapiens
cuaaacccuuaaccuaa

SEQ ID NO: 1129131 - RNA, 23 nt, Homo sapiens
cuaaggacgaaaaacacagugca

SEQ ID NO: 1129132 - RNA, 22 nt, Homo sapiens
cuaaguguugugaaacuguaaa

SEQ ID NO: 1129133 - RNA, 17 nt, Homo sapiens
cuaauuuuuuguuguuu

SEQ ID NO: 1129134 - RNA, 23 nt, Homo sapiens
cuagaaagggcuaauuaggucuc

SEQ ID NO: 1129135 - RNA, 21 nt, Homo sapiens
cuagggcuggagggacaggga

SEQ ID NO: 1129136 - RNA, 15 nt, Homo sapiens
cuauaaacuacugua

SEQ ID NO: 1129137 - RNA, 13 nt, Homo sapiens
cuauaaguguuca

SEQ ID NO: 1129138 - RNA, 16 nt, Homo sapiens
cuauaaguguucagug

SEQ ID NO: 1129139 - RNA, 17 nt, Homo sapiens
cuauaauuucuguaaca

SEQ ID NO: 1129140 - RNA, 12 nt, Homo sapiens
cuauccuuccag

SEQ ID NO: 1129141 - RNA, 19 nt, Homo sapiens
cuauucaaaauaaacaaua

SEQ ID NO: 1129142 - RNA, 14 nt, Homo sapiens
cuauugaacugagc

SEQ ID NO: 1129143 - RNA, 19 nt, Homo sapiens
cuauuguaguaaacuugga

SEQ ID NO: 1129144 - RNA, 14 nt, Homo sapiens
cucaaaaccuccaa

SEQ ID NO: 1129145 - RNA, 20 nt, Homo sapiens
cucaaccccuccccuccauc

SEQ ID NO: 1129146 - RNA, 15 nt, Homo sapiens
cucaauccuaucaca

SEQ ID NO: 1129147 - RNA, 20 nt, Homo sapiens
cucacucggcuuccagggag

SEQ ID NO: 1129148 - RNA, 18 nt, Homo sapiens
cucacuggggucugugug

SEQ ID NO: 1129149 - RNA, 14 nt, Homo sapiens
cucagaauccacaa

SEQ ID NO: 1129150 - RNA, 19 nt, Homo sapiens
cucagccgugcacucccua

SEQ ID NO: 1129151 - RNA, 17 nt, Homo sapiens
cucaugcugagcgcugu

SEQ ID NO: 1129152 - RNA, 21 nt, Homo sapiens
cucauucuaugaacagugaca

SEQ ID NO: 1129153 - RNA, 14 nt, Homo sapiens
cucauuucaucuca

SEQ ID NO: 1129154 - RNA, 14 nt, Homo sapiens
cuccagcccuaugg

SEQ ID NO: 1129155 - RNA, 21 nt, Homo sapiens
cuccauacuuucccacagcac

SEQ ID NO: 1129156 - RNA, 17 nt, Homo sapiens
cucccuggaugacauua

SEQ ID NO: 1129157 - RNA, 22 nt, Homo sapiens
cuccuaccccuguccuggggcu

SEQ ID NO: 1129158 - RNA, 13 nt, Homo sapiens
cuccuacccugau

SEQ ID NO: 1129159 - RNA, 23 nt, Homo sapiens
cuccugacauuaagacacaccuc

SEQ ID NO: 1129160 - RNA, 13 nt, Homo sapiens
cuccugugugcug

SEQ ID NO: 1129161 - RNA, 17 nt, Homo sapiens
cuccuucuuccuagcca

SEQ ID NO: 1129162 - RNA, 19 nt, Homo sapiens
cucgucuuccucucucuca

SEQ ID NO: 1129163 - RNA, 22 nt, Homo sapiens
cucuccauaucuccuuccccua

SEQ ID NO: 1129164 - RNA, 21 nt, Homo sapiens
cucucuauaaguguucagugu

SEQ ID NO: 1129165 - RNA, 23 nt, Homo sapiens
cucucuugcaggaaggacuauga

SEQ ID NO: 1129166 - RNA, 14 nt, Homo sapiens
cucugacuggaguc

SEQ ID NO: 1129167 - RNA, 20 nt, Homo sapiens
cucugacuggagucuaggaa

SEQ ID NO: 1129168 - RNA, 23 nt, Homo sapiens
cucuguccuggaggcacugggaa

SEQ ID NO: 1129169 - RNA, 20 nt, Homo sapiens
cucuuaaaccacagcacuau

SEQ ID NO: 1129170 - RNA, 18 nt, Homo sapiens
cucuuagccccagacucu

SEQ ID NO: 1129171 - RNA, 21 nt, Homo sapiens
cucuucccaccucagugccca

SEQ ID NO: 1129172 - RNA, 22 nt, Homo sapiens
cugacauuaagacacaccucug

SEQ ID NO: 1129173 - RNA, 16 nt, Homo sapiens
cugaccuuuguccuua

SEQ ID NO: 1129174 - RNA, 21 nt, Homo sapiens
cugacuuuucccauucagcug

SEQ ID NO: 1129175 - RNA, 20 nt, Homo sapiens
cugagccaaacacacuguaa

SEQ ID NO: 1129176 - RNA, 21 nt, Homo sapiens
cugagcccugguguguuucca

SEQ ID NO: 1129177 - RNA, 18 nt, Homo sapiens
cugaugagaaaggccuga

SEQ ID NO: 1129178 - RNA, 16 nt, Homo sapiens
cugcaagucacauaaa

SEQ ID NO: 1129179 - RNA, 16 nt, Homo sapiens
cugccagcucucugau

SEQ ID NO: 1129180 - RNA, 16 nt, Homo sapiens
cugccugcuccaagaa

SEQ ID NO: 1129181 - RNA, 21 nt, Homo sapiens
cugcugugcccucccauagca

SEQ ID NO: 1129182 - RNA, 19 nt, Homo sapiens
cugcugugcuagugccuga

SEQ ID NO: 1129183 - RNA, 15 nt, Homo sapiens
cugcuucugugcauu

SEQ ID NO: 1129184 - RNA, 16 nt, Homo sapiens
cugcuucugugcauuu

SEQ ID NO: 1129185 - RNA, 13 nt, Homo sapiens
cugcuuguuggcu

SEQ ID NO: 1129186 - RNA, 17 nt, Homo sapiens
cuggaggugggagacaa

SEQ ID NO: 1129187 - RNA, 12 nt, Homo sapiens
cuggaugacauu

SEQ ID NO: 1129188 - RNA, 22 nt, Homo sapiens
cuggaugacauuaaagaagggu

SEQ ID NO: 1129189 - RNA, 21 nt, Homo sapiens
cuggcuucucuuucucugagu

SEQ ID NO: 1129190 - RNA, 23 nt, Homo sapiens
cugguaggaaggauaucggguca

SEQ ID NO: 1129191 - RNA, 23 nt, Homo sapiens
cugguuaaaucaauucugauaca

SEQ ID NO: 1129192 - RNA, 19 nt, Homo sapiens
cuguaauauggcuguauca

SEQ ID NO: 1129193 - RNA, 20 nt, Homo sapiens
cuguagagccgcauggcacu

SEQ ID NO: 1129194 - RNA, 14 nt, Homo sapiens
cuguccaugaagca

SEQ ID NO: 1129195 - RNA, 18 nt, Homo sapiens
cuguccuggaggcacugg

SEQ ID NO: 1129196 - RNA, 21 nt, Homo sapiens
cugucuguagagccgcauggc

SEQ ID NO: 1129197 - RNA, 22 nt, Homo sapiens
cugugcccucccauagcacugc

SEQ ID NO: 1129198 - RNA, 16 nt, Homo sapiens
agccuucugacaagca

SEQ ID NO: 1129199 - RNA, 17 nt, Homo sapiens
agccuucugacaagcaa

SEQ ID NO: 1129200 - RNA, 17 nt, Homo sapiens
agcuaacuccagucucc

SEQ ID NO: 1129201 - RNA, 19 nt, Homo sapiens
agcuagagugcaguggugc

SEQ ID NO: 1129202 - RNA, 12 nt, Homo sapiens
agcuagccagag

SEQ ID NO: 1129203 - RNA, 17 nt, Homo sapiens
agcucagccgugcacuc

SEQ ID NO: 1129204 - RNA, 14 nt, Homo sapiens
agcugaaaacauaa

SEQ ID NO: 1129205 - RNA, 20 nt, Homo sapiens
agcugaugaacuguggugcc

SEQ ID NO: 1129206 - RNA, 13 nt, Homo sapiens
agcuggguggugu

SEQ ID NO: 1129207 - RNA, 20 nt, Homo sapiens
aggaaaaacaugagcauccc

SEQ ID NO: 1129208 - RNA, 16 nt, Homo sapiens
aggaaagccaaacacu

SEQ ID NO: 1129209 - RNA, 21 nt, Homo sapiens
aggaaagccaaacacuguuuc

SEQ ID NO: 1129210 - RNA, 17 nt, Homo sapiens
aggaagcaagaaagccg

SEQ ID NO: 1129211 - RNA, 18 nt, Homo sapiens
aggaagcauaaagcaauu

SEQ ID NO: 1129212 - RNA, 22 nt, Homo sapiens
aggaagggcgugucccauggga

SEQ ID NO: 1129213 - RNA, 12 nt, Homo sapiens
aggaugcuucug

SEQ ID NO: 1129214 - RNA, 16 nt, Homo sapiens
aggaugcuucugcuca

SEQ ID NO: 1129215 - RNA, 18 nt, Homo sapiens
aggauggcgugugugccg

SEQ ID NO: 1129216 - RNA, 20 nt, Homo sapiens
aggauggggugucuguguua

SEQ ID NO: 1129217 - RNA, 19 nt, Homo sapiens
aggcaaaaauguccagcca

SEQ ID NO: 1129218 - RNA, 14 nt, Homo sapiens
aggcauccaugaaa

SEQ ID NO: 1129219 - RNA, 16 nt, Homo sapiens
aggcauccugugugcu

SEQ ID NO: 1129220 - RNA, 18 nt, Homo sapiens
aggcauccugugugcuga

SEQ ID NO: 1129221 - RNA, 19 nt, Homo sapiens
aggcauccugugugcugac

SEQ ID NO: 1129222 - RNA, 18 nt, Homo sapiens
aggcaugcgaaugagcug

SEQ ID NO: 1129223 - RNA, 14 nt, Homo sapiens
aggccagggacuca

SEQ ID NO: 1129224 - RNA, 15 nt, Homo sapiens
aggcccagcagccuu

SEQ ID NO: 1129225 - RNA, 22 nt, Homo sapiens
gcccuucugaugagaaaggccu

SEQ ID NO: 1129226 - RNA, 22 nt, Homo sapiens
gccguauacaaggaauaugaca

SEQ ID NO: 1129227 - RNA, 14 nt, Homo sapiens
gccucaaagcaagc

SEQ ID NO: 1129228 - RNA, 12 nt, Homo sapiens
gccugcugugcc

SEQ ID NO: 1129229 - RNA, 20 nt, Homo sapiens
gccuggaagccaaacaaagg

SEQ ID NO: 1129230 - RNA, 16 nt, Homo sapiens
gccuggagacauauca

SEQ ID NO: 1129231 - RNA, 14 nt, Homo sapiens
gccuguuugggagg

SEQ ID NO: 1129232 - RNA, 21 nt, Homo sapiens
gcgcaacaacaaggacccugu

SEQ ID NO: 1129233 - RNA, 23 nt, Homo sapiens
gcguggcaacccucacuguguug

SEQ ID NO: 1129234 - RNA, 19 nt, Homo sapiens
gcuaaacaagggcagugag

SEQ ID NO: 1129235 - RNA, 15 nt, Homo sapiens
gcuagagugcagugg

SEQ ID NO: 1129236 - RNA, 17 nt, Homo sapiens
gcuaggaaaagaaauca

SEQ ID NO: 1129237 - RNA, 16 nt, Homo sapiens
gcucacucggcuucca

SEQ ID NO: 1129238 - RNA, 13 nt, Homo sapiens
gcucuaguuuuca

SEQ ID NO: 1129239 - RNA, 13 nt, Homo sapiens
gcugaaaacauaa

SEQ ID NO: 1129240 - RNA, 23 nt, Homo sapiens
gcugaggacaaugucuggcugaa

SEQ ID NO: 1129241 - RNA, 18 nt, Homo sapiens
gcugcugaggacaauguc

SEQ ID NO: 1129242 - RNA, 20 nt, Homo sapiens
gcuggcaccucagacaaucc

SEQ ID NO: 1129243 - RNA, 15 nt, Homo sapiens
acaaagggugggcau

SEQ ID NO: 1129244 - RNA, 15 nt, Homo sapiens
acaaauaguucugaa

SEQ ID NO: 1129245 - RNA, 17 nt, Homo sapiens
acaacugccagcucucu

SEQ ID NO: 1129246 - RNA, 14 nt, Homo sapiens
acaaggaaccaccg

SEQ ID NO: 1129247 - RNA, 13 nt, Homo sapiens
acaauccacucuc

SEQ ID NO: 1129248 - RNA, 16 nt, Homo sapiens
acacaggggacacuga

SEQ ID NO: 1129249 - RNA, 21 nt, Homo sapiens
acaccucccuccccacaccuc

SEQ ID NO: 1129250 - RNA, 17 nt, Homo sapiens
acacuaucuguacuaaa

SEQ ID NO: 1129251 - RNA, 23 nt, Homo sapiens
acacucacagcaaggauggagcu

SEQ ID NO: 1129252 - RNA, 15 nt, Homo sapiens
acacugagagagugg

SEQ ID NO: 1129253 - RNA, 20 nt, Homo sapiens
acagagguggcugcugugcu

SEQ ID NO: 1129254 - RNA, 15 nt, Homo sapiens
acagcagaugccaaa

SEQ ID NO: 1129255 - RNA, 14 nt, Homo sapiens
acagcagcagcuca

SEQ ID NO: 1129256 - RNA, 21 nt, Homo sapiens
acagccuauaaccagacacau

SEQ ID NO: 1129257 - RNA, 10 nt, Homo sapiens
acagcuacuu

SEQ ID NO: 1129258 - RNA, 13 nt, Homo sapiens
acagcugaugaac

SEQ ID NO: 1129259 - RNA, 21 nt, Homo sapiens
acagcugcuucugugcauuug

SEQ ID NO: 1129260 - RNA, 16 nt, Homo sapiens
acaggagacccagaga

SEQ ID NO: 1129261 - RNA, 13 nt, Homo sapiens
acaggcacuauaa

SEQ ID NO: 1129262 - RNA, 15 nt, Homo sapiens
acaggggacacugaa

SEQ ID NO: 1129263 - RNA, 20 nt, Homo sapiens
acagggucuaccucugucac

SEQ ID NO: 1129264 - RNA, 16 nt, Homo sapiens
acagugcccagcauga

SEQ ID NO: 1129265 - RNA, 18 nt, Homo sapiens
acaguuaugggacacuga

SEQ ID NO: 1129266 - RNA, 17 nt, Homo sapiens
acauaacccacucuguc

SEQ ID NO: 1129267 - RNA, 17 nt, Homo sapiens
acaugaauccugugaua

SEQ ID NO: 1129268 - RNA, 16 nt, Homo sapiens
acauggcuggcacuga

SEQ ID NO: 1129269 - RNA, 19 nt, Homo sapiens
acaugugucccagccacag

SEQ ID NO: 1129270 - RNA, 20 nt, Homo sapiens
acauuaaagaaggguugagc

SEQ ID NO: 1129271 - RNA, 16 nt, Homo sapiens
acauuaagacacaccu

SEQ ID NO: 1129272 - RNA, 20 nt, Homo sapiens
acauuuuuguggcuuaugac

SEQ ID NO: 1129273 - RNA, 14 nt, Homo sapiens
accaaguccuggga

SEQ ID NO: 1129274 - RNA, 22 nt, Homo sapiens
accacaaaggacccaaucccca

SEQ ID NO: 1129275 - RNA, 15 nt, Homo sapiens
accacaccaaugcaa

SEQ ID NO: 1129276 - RNA, 21 nt, Homo sapiens
accagacacucacagcaagga

SEQ ID NO: 1129277 - RNA, 18 nt, Homo sapiens
accaggacuacagcuuuc

SEQ ID NO: 1129278 - RNA, 23 nt, Homo sapiens
accagugugcuugcccaccacag

SEQ ID NO: 1129279 - RNA, 14 nt, Homo sapiens
accaucguccuucc

SEQ ID NO: 1129280 - RNA, 16 nt, Homo sapiens
accgcuuauccccuca

SEQ ID NO: 1129281 - RNA, 14 nt, Homo sapiens
accuaaaaacaaaa

SEQ ID NO: 1129282 - RNA, 17 nt, Homo sapiens
accucagacaauccacu

SEQ ID NO: 1129283 - RNA, 21 nt, Homo sapiens
accucaugcugagcgcugugu

SEQ ID NO: 1129284 - RNA, 18 nt, Homo sapiens
accuccugagccccucaa

SEQ ID NO: 1129285 - RNA, 14 nt, Homo sapiens
accuuccucuucca

SEQ ID NO: 1129286 - RNA, 18 nt, Homo sapiens
accuuggacugacuacca

SEQ ID NO: 1129287 - RNA, 13 nt, Homo sapiens
accuuucccucac

SEQ ID NO: 1129288 - RNA, 15 nt, Homo sapiens
acgccacucauuuca

SEQ ID NO: 1129289 - RNA, 19 nt, Homo sapiens
acgccacucauuucaucuc

SEQ ID NO: 1129290 - RNA, 22 nt, Homo sapiens
acgcuguaauauggcuguauca

SEQ ID NO: 1129291 - RNA, 13 nt, Homo sapiens
acguuuaagccaa

SEQ ID NO: 1129292 - RNA, 16 nt, Homo sapiens
acuaguuuuacuuuga

SEQ ID NO: 1129293 - RNA, 18 nt, Homo sapiens
acuauaaacuacuguaau

SEQ ID NO: 1129294 - RNA, 20 nt, Homo sapiens
acuauugagugaaacauuga

SEQ ID NO: 1129295 - RNA, 16 nt, Homo sapiens
acucacagcaaggaug

SEQ ID NO: 1129296 - RNA, 17 nt, Homo sapiens
acucacucauuccuuca

SEQ ID NO: 1129297 - RNA, 15 nt, Homo sapiens
acucauuucaucuca

SEQ ID NO: 1129298 - RNA, 16 nt, Homo sapiens
acucauuucaucucau

SEQ ID NO: 1129299 - RNA, 15 nt, Homo sapiens
acucugagaacuccu

SEQ ID NO: 1129300 - RNA, 19 nt, Homo sapiens
acucuuagccccagacucu

SEQ ID NO: 1129301 - RNA, 16 nt, Homo sapiens
acucuucccaccucag

SEQ ID NO: 1129302 - RNA, 18 nt, Homo sapiens
acugaagaugcagcaaaa

SEQ ID NO: 1129303 - RNA, 14 nt, Homo sapiens
acugaccuuugucc

SEQ ID NO: 1129304 - RNA, 20 nt, Homo sapiens
acugagcaguaccagugugc

SEQ ID NO: 1129305 - RNA, 20 nt, Homo sapiens
acugaugcgaaaacuugaau

SEQ ID NO: 1129306 - RNA, 14 nt, Homo sapiens
acugauguucaaua

SEQ ID NO: 1129307 - RNA, 19 nt, Homo sapiens
acuggggucuguguggugc

SEQ ID NO: 1129308 - RNA, 20 nt, Homo sapiens
acugguuaaaucaauucuga

SEQ ID NO: 1129309 - RNA, 15 nt, Homo sapiens
acuguccaugaagca

SEQ ID NO: 1129310 - RNA, 19 nt, Homo sapiens
acuguccaugaagcacuga

SEQ ID NO: 1129311 - RNA, 14 nt, Homo sapiens
acuuuacaacuuag

SEQ ID NO: 1129312 - RNA, 16 nt, Homo sapiens
acuuuugauaaguauc

SEQ ID NO: 1129313 - RNA, 19 nt, Homo sapiens
agaaaaaguugcagucuca

SEQ ID NO: 1129314 - RNA, 12 nt, Homo sapiens
agaaaacauuuu

SEQ ID NO: 1129315 - RNA, 17 nt, Homo sapiens
agaaacguaacugugug

SEQ ID NO: 1129316 - RNA, 14 nt, Homo sapiens
agaaacuauaugca

SEQ ID NO: 1129317 - RNA, 23 nt, Homo sapiens
agaagaauuguuugaaccuggga

SEQ ID NO: 1129318 - RNA, 21 nt, Homo sapiens
agaagauggcagauacaggag

SEQ ID NO: 1129319 - RNA, 16 nt, Homo sapiens
agaaggacaugugcua

SEQ ID NO: 1129320 - RNA, 12 nt, Homo sapiens
agacaacaaaug

SEQ ID NO: 1129321 - RNA, 21 nt, Homo sapiens
agacaacaaaugggucccuca

SEQ ID NO: 1129322 - RNA, 21 nt, Homo sapiens
agacaaccuugucccaaggaa

SEQ ID NO: 1129323 - RNA, 16 nt, Homo sapiens
agacaauccacucuca

SEQ ID NO: 1129324 - RNA, 12 nt, Homo sapiens
agacaauggcca

SEQ ID NO: 1129325 - RNA, 18 nt, Homo sapiens
agacuuaggaaccuacca

SEQ ID NO: 1129326 - RNA, 21 nt, Homo sapiens
agacuuguguccccaccucag

SEQ ID NO: 1129327 - RNA, 19 nt, Homo sapiens
agagaaggacaugugcuau

SEQ ID NO: 1129328 - RNA, 16 nt, Homo sapiens
agagaaggcugugagc

SEQ ID NO: 1129329 - RNA, 12 nt, Homo sapiens
agagaucuguca

SEQ ID NO: 1129330 - RNA, 21 nt, Homo sapiens
agagcugcugaggacaauguc

SEQ ID NO: 1129331 - RNA, 13 nt, Homo sapiens
agaggacugagac

SEQ ID NO: 1129332 - RNA, 16 nt, Homo sapiens
agaggagagaggcuca

SEQ ID NO: 1129333 - RNA, 13 nt, Homo sapiens
agagguggcugcu

SEQ ID NO: 1129334 - RNA, 20 nt, Homo sapiens
agagguggcugcugugcuag

SEQ ID NO: 1129335 - RNA, 16 nt, Homo sapiens
agagugcaguggugca

SEQ ID NO: 1129336 - RNA, 18 nt, Homo sapiens
agaugguucccuuuguug

SEQ ID NO: 1129337 - RNA, 13 nt, Homo sapiens
agauugugcccag

SEQ ID NO: 1129338 - RNA, 17 nt, Homo sapiens
agauugugcccagcccu

SEQ ID NO: 1129339 - RNA, 22 nt, Homo sapiens
agcaauugugaaauacaguaua

SEQ ID NO: 1129340 - RNA, 16 nt, Homo sapiens
agcaccgcuuaucccc

SEQ ID NO: 1129341 - RNA, 19 nt, Homo sapiens
agcagaagcuggaggcaca

SEQ ID NO: 1129342 - RNA, 13 nt, Homo sapiens
agcaggccaggga

SEQ ID NO: 1129343 - RNA, 15 nt, Homo sapiens
agcaucauugaucuu

SEQ ID NO: 1129344 - RNA, 15 nt, Homo sapiens
agcauccccagccac

SEQ ID NO: 1129345 - RNA, 23 nt, Homo sapiens
agcauccccagccacaacugcca

SEQ ID NO: 1129346 - RNA, 17 nt, Homo sapiens
agcauggagaguggcau

SEQ ID NO: 1129347 - RNA, 19 nt, Homo sapiens
agccaagaucgugccauug

SEQ ID NO: 1129348 - RNA, 16 nt, Homo sapiens
agccacacaggaagaa

SEQ ID NO: 1129349 - RNA, 16 nt, Homo sapiens
agccacccagccagga

SEQ ID NO: 1129350 - RNA, 17 nt, Homo sapiens
agccauugauucuucag

SEQ ID NO: 1129351 - RNA, 17 nt, Homo sapiens
agccccagacucuucau

SEQ ID NO: 1129352 - RNA, 13 nt, Homo sapiens
agccgugcacucc

SEQ ID NO: 1129353 - RNA, 20 nt, Homo sapiens
agccuccugacccugugaug

SEQ ID NO: 1129354 - RNA, 23 nt, Homo sapiens
agccugggggguccucaucugca

SEQ ID NO: 1129355 - RNA, 12 nt, Homo sapiens
agcgcuguguua

SEQ ID NO: 1129356 - RNA, 16 nt, Homo sapiens
agcucagacuugccag

SEQ ID NO: 1129357 - RNA, 18 nt, Homo sapiens
agcucucugauuccccaa

SEQ ID NO: 1129358 - RNA, 18 nt, Homo sapiens
agcugccauaauaaugcc

SEQ ID NO: 1129359 - RNA, 15 nt, Homo sapiens
agcugcuucugugca

SEQ ID NO: 1129360 - RNA, 15 nt, Homo sapiens
aggaaagccaaacac

SEQ ID NO: 1129361 - RNA, 14 nt, Homo sapiens
aggaagacuugaag

SEQ ID NO: 1129362 - RNA, 16 nt, Homo sapiens
aggacagcugcuucug

SEQ ID NO: 1129363 - RNA, 19 nt, Homo sapiens
aggaccucucucaaugcca

SEQ ID NO: 1129364 - RNA, 19 nt, Homo sapiens
cuugaaucuguuacugaaa

SEQ ID NO: 1129365 - RNA, 14 nt, Homo sapiens
cuuggaaaugacca

SEQ ID NO: 1129366 - RNA, 16 nt, Homo sapiens
cuugggcuccauuccc

SEQ ID NO: 1129367 - RNA, 20 nt, Homo sapiens
cuuguguccccaccucaggc

SEQ ID NO: 1129368 - RNA, 17 nt, Homo sapiens
cuuguugcaucucagau

SEQ ID NO: 1129369 - RNA, 20 nt, Homo sapiens
cuuuaaagcguuugcacaga

SEQ ID NO: 1129370 - RNA, 20 nt, Homo sapiens
cuuuagaaaugucaguugcu

SEQ ID NO: 1129371 - RNA, 14 nt, Homo sapiens
cuuucgaaagcaau

SEQ ID NO: 1129372 - RNA, 23 nt, Homo sapiens
cuuucuguuacugauguucaaua

SEQ ID NO: 1129373 - RNA, 22 nt, Homo sapiens
cuuuguaaaggucagagucaaa

SEQ ID NO: 1129374 - RNA, 21 nt, Homo sapiens
cuuuguggggcucaaaaccuc

SEQ ID NO: 1129375 - RNA, 17 nt, Homo sapiens
cuuuucuuucuacagac

SEQ ID NO: 1129376 - RNA, 13 nt, Homo sapiens
cuuuuugaucuca

SEQ ID NO: 1129377 - RNA, 13 nt, Homo sapiens
cuuuuugaucugu

SEQ ID NO: 1129378 - RNA, 15 nt, Homo sapiens
gaaaaacaaauaaaa

SEQ ID NO: 1129379 - RNA, 11 nt, Homo sapiens
gaaaacauuuu

SEQ ID NO: 1129380 - RNA, 19 nt, Homo sapiens
gaaacacacauggacaugu

SEQ ID NO: 1129381 - RNA, 20 nt, Homo sapiens
gaaacauugaacucauaucu

SEQ ID NO: 1129382 - RNA, 14 nt, Homo sapiens
gaaagaaugcaaga

SEQ ID NO: 1129383 - RNA, 14 nt, Homo sapiens
gaaagaggcaguga

SEQ ID NO: 1129384 - RNA, 18 nt, Homo sapiens
gaaagccguacugucuau

SEQ ID NO: 1129385 - RNA, 16 nt, Homo sapiens
gaaaggaaagccaaac

SEQ ID NO: 1129386 - RNA, 24 nt, Homo sapiens
gaaaugaccaggccaagacucaag

SEQ ID NO: 1129387 - RNA, 21 nt, Homo sapiens
gaacuguggugccacaugacc

SEQ ID NO: 1129388 - RNA, 15 nt, Homo sapiens
gaagcauaaagcaau

SEQ ID NO: 1129389 - RNA, 16 nt, Homo sapiens
gaaggacaugugcuau

SEQ ID NO: 1129390 - RNA, 21 nt, Homo sapiens
gaaggacuaugaaaagcuaga

SEQ ID NO: 1129391 - RNA, 16 nt, Homo sapiens
gaaguccuccagacaa

SEQ ID NO: 1129392 - RNA, 18 nt, Homo sapiens
gaauacuguuauaucuaa

SEQ ID NO: 1129393 - RNA, 14 nt, Homo sapiens
gaauccuacagccu

SEQ ID NO: 1129394 - RNA, 17 nt, Homo sapiens
gacacaggggacacuga

SEQ ID NO: 1129395 - RNA, 13 nt, Homo sapiens
gacaccuccuucu

SEQ ID NO: 1129396 - RNA, 19 nt, Homo sapiens
gacagcaucuaagaaguuu

SEQ ID NO: 1129397 - RNA, 18 nt, Homo sapiens
gacaggagacccagagag

SEQ ID NO: 1129398 - RNA, 13 nt, Homo sapiens
gacauagccuuug

SEQ ID NO: 1129399 - RNA, 23 nt, Homo sapiens
gacccaaguguugaggggaccaa

SEQ ID NO: 1129400 - RNA, 11 nt, Homo sapiens
gacccaauccc

SEQ ID NO: 1129401 - RNA, 19 nt, Homo sapiens
gacccaauccccagacuca

SEQ ID NO: 1129402 - RNA, 17 nt, Homo sapiens
gaccuuccacacagggu

SEQ ID NO: 1129403 - RNA, 22 nt, Homo sapiens
gacgccacucauuucaucucau

SEQ ID NO: 1129404 - RNA, 20 nt, Homo sapiens
gacuaucuuacuauuucaca

SEQ ID NO: 1129405 - RNA, 19 nt, Homo sapiens
gacucugagaacuccucau

SEQ ID NO: 1129406 - RNA, 20 nt, Homo sapiens
gacucuuagccccagacucu

SEQ ID NO: 1129407 - RNA, 19 nt, Homo sapiens
gacuggccucaaagcaagc

SEQ ID NO: 1129408 - RNA, 21 nt, Homo sapiens
gagaaauuuaaacuauaagca

SEQ ID NO: 1129409 - RNA, 22 nt, Homo sapiens
gagaagcaacacuuugugaucu

SEQ ID NO: 1129410 - RNA, 19 nt, Homo sapiens
gagacccagagagcuaggg

SEQ ID NO: 1129411 - RNA, 18 nt, Homo sapiens
gagaugagaaacaacaga

SEQ ID NO: 1129412 - RNA, 19 nt, Homo sapiens
gagcagaagcuggaggcac

SEQ ID NO: 1129413 - RNA, 16 nt, Homo sapiens
gagccaaacacacugu

SEQ ID NO: 1129414 - RNA, 18 nt, Homo sapiens
gagccuccugacccugug

SEQ ID NO: 1129415 - RNA, 20 nt, Homo sapiens
gagcugacccagaguggagu

SEQ ID NO: 1129416 - RNA, 20 nt, Homo sapiens
gaggcucagccacacaggaa

SEQ ID NO: 1129417 - RNA, 20 nt, Homo sapiens
gagggcucacucggcuucca

SEQ ID NO: 1129418 - RNA, 19 nt, Homo sapiens
gagggcugggggcugaccc

SEQ ID NO: 1129419 - RNA, 21 nt, Homo sapiens
gagguggguggaucaccugag

SEQ ID NO: 1129420 - RNA, 20 nt, Homo sapiens
gaguaacaugccagcuuccu

SEQ ID NO: 1129421 - RNA, 13 nt, Homo sapiens
gagucaugcacuc

SEQ ID NO: 1129422 - RNA, 17 nt, Homo sapiens
gagugaaacauugaacu

SEQ ID NO: 1129423 - RNA, 18 nt, Homo sapiens
gagugaaacauugaacuc

SEQ ID NO: 1129424 - RNA, 21 nt, Homo sapiens
gauaacccauacuacccucau

SEQ ID NO: 1129425 - RNA, 20 nt, Homo sapiens
gaucgugccauugcacucca

SEQ ID NO: 1129426 - RNA, 18 nt, Homo sapiens
gaucucacacaccagggc

SEQ ID NO: 1129427 - RNA, 17 nt, Homo sapiens
gaugaacuguggugcca

SEQ ID NO: 1129428 - RNA, 21 nt, Homo sapiens
gaugaagaccaggacuacagc

SEQ ID NO: 1129429 - RNA, 16 nt, Homo sapiens
gaugagaaaggccuga

SEQ ID NO: 1129430 - RNA, 13 nt, Homo sapiens
gaugccugacaca

SEQ ID NO: 1129431 - RNA, 16 nt, Homo sapiens
gauguacgagcugcgc

SEQ ID NO: 1129432 - RNA, 14 nt, Homo sapiens
gauuagaaugccuc

SEQ ID NO: 1129433 - RNA, 15 nt, Homo sapiens
gauuauaagaguaau

SEQ ID NO: 1129434 - RNA, 17 nt, Homo sapiens
gauugugcccagcccuu

SEQ ID NO: 1129435 - RNA, 17 nt, Homo sapiens
gcaacauuaugauuaau

SEQ ID NO: 1129436 - RNA, 22 nt, Homo sapiens
gcaagaaagccguacugucuau

SEQ ID NO: 1129437 - RNA, 16 nt, Homo sapiens
gcaagaguggacugaa

SEQ ID NO: 1129438 - RNA, 14 nt, Homo sapiens
gcaagccacagaaa

SEQ ID NO: 1129439 - RNA, 19 nt, Homo sapiens
gcaaggggcauuacuggga

SEQ ID NO: 1129440 - RNA, 19 nt, Homo sapiens
gcaaugguagcaaaacaag

SEQ ID NO: 1129441 - RNA, 15 nt, Homo sapiens
gcacaggcugggaug

SEQ ID NO: 1129442 - RNA, 18 nt, Homo sapiens
gcacauggcuggcacuga

SEQ ID NO: 1129443 - RNA, 14 nt, Homo sapiens
gcaccagacacuca

SEQ ID NO: 1129444 - RNA, 17 nt, Homo sapiens
gcaccucagacaaucca

SEQ ID NO: 1129445 - RNA, 14 nt, Homo sapiens
gcacugagcagaag

SEQ ID NO: 1129446 - RNA, 14 nt, Homo sapiens
gcagaaaacacagc

SEQ ID NO: 1129447 - RNA, 17 nt, Homo sapiens
gcagaagcuggaggcac

SEQ ID NO: 1129448 - RNA, 12 nt, Homo sapiens
gcagacagcagg

SEQ ID NO: 1129449 - RNA, 23 nt, Homo sapiens
gcagcccgaagcccaguuucccu

SEQ ID NO: 1129450 - RNA, 22 nt, Homo sapiens
gcagcugucauggaaaagccca

SEQ ID NO: 1129451 - RNA, 17 nt, Homo sapiens
gcagucucagaaagccu

SEQ ID NO: 1129452 - RNA, 16 nt, Homo sapiens
gcaucaaagaugagaa

SEQ ID NO: 1129453 - RNA, 17 nt, Homo sapiens
gcauccugugugcugac

SEQ ID NO: 1129454 - RNA, 18 nt, Homo sapiens
gcauccuuuucaaaaccu

SEQ ID NO: 1129455 - RNA, 13 nt, Homo sapiens
gcauuacugggaa

SEQ ID NO: 1129456 - RNA, 14 nt, Homo sapiens
gccaaaaauagcua

SEQ ID NO: 1129457 - RNA, 15 nt, Homo sapiens
gccaaccagacaccu

SEQ ID NO: 1129458 - RNA, 20 nt, Homo sapiens
gccaauaaagugaucugugu

SEQ ID NO: 1129459 - RNA, 22 nt, Homo sapiens
gccagaaacguaacugugugca

SEQ ID NO: 1129460 - RNA, 22 nt, Homo sapiens
gccaggagccuccugacccugu

SEQ ID NO: 1129461 - RNA, 18 nt, Homo sapiens
gccaugccuggagacaua

SEQ ID NO: 1129462 - RNA, 17 nt, Homo sapiens
gcccaacccuaucccag

SEQ ID NO: 1129463 - RNA, 18 nt, Homo sapiens
gcccaagaggacugagac

SEQ ID NO: 1129464 - RNA, 15 nt, Homo sapiens
gcccaagaggucuga

SEQ ID NO: 1129465 - RNA, 12 nt, Homo sapiens
gcccacagccaa

SEQ ID NO: 1129466 - RNA, 21 nt, Homo sapiens
gcccccucccuggaugacauu

SEQ ID NO: 1129467 - RNA, 17 nt, Homo sapiens
gcccugguguguuucca

SEQ ID NO: 1129468 - RNA, 15 nt, Homo sapiens
gcccuucugaugaga

SEQ ID NO: 1129469 - RNA, 15 nt, Homo sapiens
gccguacugucuaug

SEQ ID NO: 1129470 - RNA, 22 nt, Homo sapiens
gccuccucgggggaaagcacac

SEQ ID NO: 1129471 - RNA, 20 nt, Homo sapiens
gccugccucaugcucucuau

SEQ ID NO: 1129472 - RNA, 15 nt, Homo sapiens
gccuggaagccaaac

SEQ ID NO: 1129473 - RNA, 15 nt, Homo sapiens
gccuggcccuggaac

SEQ ID NO: 1129474 - RNA, 23 nt, Homo sapiens
gccuuuggggacggccacucugu

SEQ ID NO: 1129475 - RNA, 23 nt, Homo sapiens
gcgcacuucccauuuguguuuca

SEQ ID NO: 1129476 - RNA, 12 nt, Homo sapiens
gcuagugccuga

SEQ ID NO: 1129477 - RNA, 20 nt, Homo sapiens
gcuagugccugagaugcacg

SEQ ID NO: 1129478 - RNA, 11 nt, Homo sapiens
gcuauucccug

SEQ ID NO: 1129479 - RNA, 21 nt, Homo sapiens
gcucaaaaccuccaaggaccu

SEQ ID NO: 1129480 - RNA, 14 nt, Homo sapiens
gcucaguagccuuu

SEQ ID NO: 1129481 - RNA, 21 nt, Homo sapiens
gcucuguauucugcaacagcc

SEQ ID NO: 1129482 - RNA, 18 nt, Homo sapiens
gcugaguuccggggugca

SEQ ID NO: 1129483 - RNA, 19 nt, Homo sapiens
gcugaugaacuguggugcc

SEQ ID NO: 1129484 - RNA, 17 nt, Homo sapiens
ugaauguauaaagacac

SEQ ID NO: 1129485 - RNA, 18 nt, Homo sapiens
ugaauguauaaagacacc

SEQ ID NO: 1129486 - RNA, 18 nt, Homo sapiens
ugacacaggggacacuga

SEQ ID NO: 1129487 - RNA, 19 nt, Homo sapiens
ugacacaggggacacugaa

SEQ ID NO: 1129488 - RNA, 15 nt, Homo sapiens
ugacauagccuuugu

SEQ ID NO: 1129489 - RNA, 22 nt, Homo sapiens
ugacuuuuuggcuuuaagccau

SEQ ID NO: 1129490 - RNA, 15 nt, Homo sapiens
ugagauugugcccag

SEQ ID NO: 1129491 - RNA, 16 nt, Homo sapiens
ugagcagaagcuggag

SEQ ID NO: 1129492 - RNA, 17 nt, Homo sapiens
ugagccaaacacacugu

SEQ ID NO: 1129493 - RNA, 13 nt, Homo sapiens
ugaggcccagaaa

SEQ ID NO: 1129494 - RNA, 18 nt, Homo sapiens
ugaggggaccaaagccac

SEQ ID NO: 1129495 - RNA, 22 nt, Homo sapiens
ugagguccaggguugcuaggaa

SEQ ID NO: 1129496 - RNA, 14 nt, Homo sapiens
ugagguccugucua

SEQ ID NO: 1129497 - RNA, 18 nt, Homo sapiens
ugaguauuccaccacagg

SEQ ID NO: 1129498 - RNA, 19 nt, Homo sapiens
ugaguucucauccacagag

SEQ ID NO: 1129499 - RNA, 19 nt, Homo sapiens
ugaguugggaaaaacugac

SEQ ID NO: 1129500 - RNA, 18 nt, Homo sapiens
ugaucucauggcuuugau

SEQ ID NO: 1129501 - RNA, 20 nt, Homo sapiens
ugauggaaccaaaaaucacu

SEQ ID NO: 1129502 - RNA, 18 nt, Homo sapiens
ugauggcguggcaacccu

SEQ ID NO: 1129503 - RNA, 17 nt, Homo sapiens
ugauuaaaaaacugaca

SEQ ID NO: 1129504 - RNA, 20 nt, Homo sapiens
ugauuaccuagaagugcaag

SEQ ID NO: 1129505 - RNA, 16 nt, Homo sapiens
ugcacuaugagccuau

SEQ ID NO: 1129506 - RNA, 15 nt, Homo sapiens
ugcacuccagccuag

SEQ ID NO: 1129507 - RNA, 20 nt, Homo sapiens
ugcacuccagccuaggcaac

SEQ ID NO: 1129508 - RNA, 16 nt, Homo sapiens
ugcagaaauuugaaug

SEQ ID NO: 1129509 - RNA, 17 nt, Homo sapiens
ugccaaccucacugaca

SEQ ID NO: 1129510 - RNA, 12 nt, Homo sapiens
ugccacaaugcc

SEQ ID NO: 1129511 - RNA, 14 nt, Homo sapiens
ugccacaaugccuc

SEQ ID NO: 1129512 - RNA, 17 nt, Homo sapiens
ugcccaacccuauccca

SEQ ID NO: 1129513 - RNA, 15 nt, Homo sapiens
ugcccaccacagcga

SEQ ID NO: 1129514 - RNA, 19 nt, Homo sapiens
ugcccuaggauacccagau

SEQ ID NO: 1129515 - RNA, 20 nt, Homo sapiens
ugcccuguauauaauacuaa

SEQ ID NO: 1129516 - RNA, 20 nt, Homo sapiens
ugcccugugagggcucacuc

SEQ ID NO: 1129517 - RNA, 19 nt, Homo sapiens
ugccgggacccugcucaca

SEQ ID NO: 1129518 - RNA, 13 nt, Homo sapiens
ugccuggagacau

SEQ ID NO: 1129519 - RNA, 20 nt, Homo sapiens
ugcggaaaaacaaacaugaa

SEQ ID NO: 1129520 - RNA, 15 nt, Homo sapiens
ugcggauacuuugcu

SEQ ID NO: 1129521 - RNA, 24 nt, Homo sapiens
ugcugaggacaaugucuggcugaa

SEQ ID NO: 1129522 - RNA, 22 nt, Homo sapiens
ugcugaguuccggggugcaaug

SEQ ID NO: 1129523 - RNA, 18 nt, Homo sapiens
ugcuggggguuucuguag

SEQ ID NO: 1129524 - RNA, 19 nt, Homo sapiens
ugcuuauguaugccuauuc

SEQ ID NO: 1129525 - RNA, 18 nt, Homo sapiens
ugcuugauugagugcucc

SEQ ID NO: 1129526 - RNA, 18 nt, Homo sapiens
ugcuugggcuauaccugg

SEQ ID NO: 1129527 - RNA, 14 nt, Homo sapiens
uggaaguaguaauu

SEQ ID NO: 1129528 - RNA, 17 nt, Homo sapiens
uggacuuaacucuaauu

SEQ ID NO: 1129529 - RNA, 23 nt, Homo sapiens
uggaggcacaacgcaccagacac

SEQ ID NO: 1129530 - RNA, 14 nt, Homo sapiens
uggauaacgaugaa

SEQ ID NO: 1129531 - RNA, 21 nt, Homo sapiens
uggaugggguugugaccaaga

SEQ ID NO: 1129532 - RNA, 15 nt, Homo sapiens
uggauucacucacuc

SEQ ID NO: 1129533 - RNA, 18 nt, Homo sapiens
uggauuuucugaacaagc

SEQ ID NO: 1129534 - RNA, 18 nt, Homo sapiens
uggcauguguacaaugaa

SEQ ID NO: 1129535 - RNA, 14 nt, Homo sapiens
uggccaaucccugu

SEQ ID NO: 1129536 - RNA, 22 nt, Homo sapiens
uggccauuuuguaccagggcuc

SEQ ID NO: 1129537 - RNA, 14 nt, Homo sapiens
uggcuggcacugag

SEQ ID NO: 1129538 - RNA, 16 nt, Homo sapiens
uggcuguaaacuauaa

SEQ ID NO: 1129539 - RNA, 22 nt, Homo sapiens
uggcuguaaacuauaaacuacu

SEQ ID NO: 1129540 - RNA, 16 nt, Homo sapiens
ugggauccacacugag

SEQ ID NO: 1129541 - RNA, 21 nt, Homo sapiens
ugggauggggcauguggccaa

SEQ ID NO: 1129542 - RNA, 18 nt, Homo sapiens
ugggauguccaccacagu

SEQ ID NO: 1129543 - RNA, 23 nt, Homo sapiens
uggucaucgugacagcagcagcu

SEQ ID NO: 1129544 - RNA, 20 nt, Homo sapiens
uggucucaagcaguccuccu

SEQ ID NO: 1129545 - RNA, 18 nt, Homo sapiens
ugguguaauuuuguccuc

SEQ ID NO: 1129546 - RNA, 13 nt, Homo sapiens
uguacuccucuga

SEQ ID NO: 1129547 - RNA, 21 nt, Homo sapiens
uguauaauuuucuacaaccua

SEQ ID NO: 1129548 - RNA, 16 nt, Homo sapiens
uguauucugcaacagc

SEQ ID NO: 1129549 - RNA, 20 nt, Homo sapiens
uguauugaaguccuccagac

SEQ ID NO: 1129550 - RNA, 15 nt, Homo sapiens
uguccuggaauuauu

SEQ ID NO: 1129551 - RNA, 18 nt, Homo sapiens
uguccuggaggcacuggg

SEQ ID NO: 1129552 - RNA, 20 nt, Homo sapiens
ugucuauguugugauccuuc

SEQ ID NO: 1129553 - RNA, 17 nt, Homo sapiens
ugugauccuucaucgaa

SEQ ID NO: 1129554 - RNA, 20 nt, Homo sapiens
ugugaugccugacacagggg

SEQ ID NO: 1129555 - RNA, 12 nt, Homo sapiens
ugugcuauugaa

SEQ ID NO: 1129556 - RNA, 19 nt, Homo sapiens
uguggucacagccaugaag

SEQ ID NO: 1129557 - RNA, 16 nt, Homo sapiens
uguggugcccaugagg

SEQ ID NO: 1129558 - RNA, 18 nt, Homo sapiens
ugugugccgugacagggc

SEQ ID NO: 1129559 - RNA, 12 nt, Homo sapiens
uguguggcugcu

SEQ ID NO: 1129560 - RNA, 19 nt, Homo sapiens
uguguugggaccugugauc

SEQ ID NO: 1129561 - RNA, 22 nt, Homo sapiens
uguucaguguugacauagccuu

SEQ ID NO: 1129562 - RNA, 15 nt, Homo sapiens
uguuccaugccugcu

SEQ ID NO: 1129563 - RNA, 13 nt, Homo sapiens
uguugacauagcc

SEQ ID NO: 1129564 - RNA, 17 nt, Homo sapiens
uguugacauagccuuug

SEQ ID NO: 1129565 - RNA, 19 nt, Homo sapiens
uguuuauuugcacuaugag

SEQ ID NO: 1129566 - RNA, 17 nt, Homo sapiens
uuaaagaaggguugagc

SEQ ID NO: 1129567 - RNA, 18 nt, Homo sapiens
uuaacuuauugcauaaca

SEQ ID NO: 1129568 - RNA, 20 nt, Homo sapiens
uuagaaaugucaguugcugc

SEQ ID NO: 1129569 - RNA, 16 nt, Homo sapiens
uuagcuguacuguaau

SEQ ID NO: 1129570 - RNA, 16 nt, Homo sapiens
uuaggugugaggucca

SEQ ID NO: 1129571 - RNA, 16 nt, Homo sapiens
uuauauuacacuacac

SEQ ID NO: 1129572 - RNA, 14 nt, Homo sapiens
uuaugaaaaagaag

SEQ ID NO: 1129573 - RNA, 19 nt, Homo sapiens
uucacauaacuucucugag

SEQ ID NO: 1129574 - RNA, 16 nt, Homo sapiens
uucagaauaaaugggu

SEQ ID NO: 1129575 - RNA, 19 nt, Homo sapiens
uucagccauugcccuguga

SEQ ID NO: 1129576 - RNA, 17 nt, Homo sapiens
uucaguaauguugacug

SEQ ID NO: 1129577 - RNA, 23 nt, Homo sapiens
uucauacugaagaugcagcaaaa

SEQ ID NO: 1129578 - RNA, 18 nt, Homo sapiens
uucccccaucuagccauu

SEQ ID NO: 1129579 - RNA, 14 nt, Homo sapiens
uuccuucacucauc

SEQ ID NO: 1129580 - RNA, 18 nt, Homo sapiens
uuccuuugaagaggaaaa

SEQ ID NO: 1129581 - RNA, 20 nt, Homo sapiens
uucuguggaaguagcuuuga

SEQ ID NO: 1129582 - RNA, 12 nt, Homo sapiens
uucuuccuuauu

SEQ ID NO: 1129583 - RNA, 18 nt, Homo sapiens
uucuuuagcuguacugua

SEQ ID NO: 1129584 - RNA, 14 nt, Homo sapiens
uugacauagccuuu

SEQ ID NO: 1129585 - RNA, 22 nt, Homo sapiens
uugacuucauagauuaugcuuu

SEQ ID NO: 1129586 - RNA, 16 nt, Homo sapiens
uugagcaccuacugug

SEQ ID NO: 1129587 - RNA, 13 nt, Homo sapiens
uugauugauuugg

SEQ ID NO: 1129588 - RNA, 15 nt, Homo sapiens
uugucagcaguuccc

SEQ ID NO: 1129589 - RNA, 16 nt, Homo sapiens
uuuaaaaaagcuuaaa

SEQ ID NO: 1129590 - RNA, 14 nt, Homo sapiens
uuuaauagcaaaga

SEQ ID NO: 1129591 - RNA, 12 nt, Homo sapiens
uuuacuuugaac

SEQ ID NO: 1129592 - RNA, 19 nt, Homo sapiens
uuuauuuuacauagaucau

SEQ ID NO: 1129593 - RNA, 15 nt, Homo sapiens
uuucuauagccaaaa

SEQ ID NO: 1129594 - RNA, 16 nt, Homo sapiens
uuugaaaaagcgaaaa

SEQ ID NO: 1129595 - RNA, 21 nt, Homo sapiens
uuugaucucacacaccagggc

SEQ ID NO: 1129596 - RNA, 21 nt, Homo sapiens
uuugccaaagugacacagagc

SEQ ID NO: 1129597 - RNA, 18 nt, Homo sapiens
uuugguguuacacagccc

SEQ ID NO: 1129598 - RNA, 18 nt, Homo sapiens
uuuugaaaaagcgaaaaa

SEQ ID NO: 1129599 - RNA, 16 nt, Homo sapiens
uuuugagagacagggu

SEQ ID NO: 1129600 - RNA, 21 nt, Homo sapiens
uuuuuuaggaagcaagcuuaa

SEQ ID NO: 1129601 - RNA, 19 nt, Homo sapiens
uauaacuguggcuaauuca

SEQ ID NO: 1129602 - RNA, 16 nt, Homo sapiens
uauaauacuaaagugu

SEQ ID NO: 1129603 - RNA, 19 nt, Homo sapiens
uauaauacuaaagugucua

SEQ ID NO: 1129604 - RNA, 20 nt, Homo sapiens
uaucacucaauuucucugag

SEQ ID NO: 1129605 - RNA, 21 nt, Homo sapiens
uaucacugguccaccuccuga

SEQ ID NO: 1129606 - RNA, 11 nt, Homo sapiens
uaucaguuccc

SEQ ID NO: 1129607 - RNA, 13 nt, Homo sapiens
uaugaguguuaau

SEQ ID NO: 1129608 - RNA, 19 nt, Homo sapiens
uaugcaguauugccacaau

SEQ ID NO: 1129609 - RNA, 12 nt, Homo sapiens
uaugcuagugau

SEQ ID NO: 1129610 - RNA, 14 nt, Homo sapiens
uaugggacacugaa

SEQ ID NO: 1129611 - RNA, 21 nt, Homo sapiens
uauguaucuggguucuaacca

SEQ ID NO: 1129612 - RNA, 14 nt, Homo sapiens
uauuaugugcaaca

SEQ ID NO: 1129613 - RNA, 15 nt, Homo sapiens
uauugcauaacagca

SEQ ID NO: 1129614 - RNA, 14 nt, Homo sapiens
uauuuaaacaacag

SEQ ID NO: 1129615 - RNA, 17 nt, Homo sapiens
uauuuaaacaacagcuc

SEQ ID NO: 1129616 - RNA, 20 nt, Homo sapiens
uauuugcacuaugagccuau

SEQ ID NO: 1129617 - RNA, 14 nt, Homo sapiens
uauuugugggguac

SEQ ID NO: 1129618 - RNA, 14 nt, Homo sapiens
uauuuuauaugauu

SEQ ID NO: 1129619 - RNA, 14 nt, Homo sapiens
uauuuuauguauau

SEQ ID NO: 1129620 - RNA, 15 nt, Homo sapiens
ucaaaggaagacuug

SEQ ID NO: 1129621 - RNA, 18 nt, Homo sapiens
ucaaauuauuaccaguga

SEQ ID NO: 1129622 - RNA, 20 nt, Homo sapiens
ucaaccccuccccuccaucc

SEQ ID NO: 1129623 - RNA, 21 nt, Homo sapiens
ucaacuuaccaggcaccaaaa

SEQ ID NO: 1129624 - RNA, 15 nt, Homo sapiens
ucaagcuagccagag

SEQ ID NO: 1129625 - RNA, 22 nt, Homo sapiens
ucaagcuuuggauaacgaugaa

SEQ ID NO: 1129626 - RNA, 21 nt, Homo sapiens
ucaaggacuccugucuguccu

SEQ ID NO: 1129627 - RNA, 13 nt, Homo sapiens
ucaauccuaucac

SEQ ID NO: 1129628 - RNA, 17 nt, Homo sapiens
ucaauuucucugaggac

SEQ ID NO: 1129629 - RNA, 21 nt, Homo sapiens
ucaauuuucacaucaaagaca

SEQ ID NO: 1129630 - RNA, 22 nt, Homo sapiens
ucacagcaaggauggagcugaa

SEQ ID NO: 1129631 - RNA, 19 nt, Homo sapiens
ucacauaacuucucugagu

SEQ ID NO: 1129632 - RNA, 20 nt, Homo sapiens
ucacauaacuucucugaguc

SEQ ID NO: 1129633 - RNA, 14 nt, Homo sapiens
ucaccacuacauca

SEQ ID NO: 1129634 - RNA, 16 nt, Homo sapiens
ucacuacagccucgaa

SEQ ID NO: 1129635 - RNA, 15 nt, Homo sapiens
ucacucaauuucucu

SEQ ID NO: 1129636 - RNA, 20 nt, Homo sapiens
ucacucauuccuucacucau

SEQ ID NO: 1129637 - RNA, 17 nt, Homo sapiens
ucacugguccaccuccu

SEQ ID NO: 1129638 - RNA, 18 nt, Homo sapiens
ucagacaauccacucuca

SEQ ID NO: 1129639 - RNA, 21 nt, Homo sapiens
ucagcggucauucuacacuga

SEQ ID NO: 1129640 - RNA, 22 nt, Homo sapiens
ucagcggucauucuacacugag

SEQ ID NO: 1129641 - RNA, 22 nt, Homo sapiens
ucaguguagaaccuaauucaau

SEQ ID NO: 1129642 - RNA, 21 nt, Homo sapiens
ucaguguugacauagccuuug

SEQ ID NO: 1129643 - RNA, 19 nt, Homo sapiens
ucauaguguauaauaauau

SEQ ID NO: 1129644 - RNA, 15 nt, Homo sapiens
ucauuccuucacuca

SEQ ID NO: 1129645 - RNA, 14 nt, Homo sapiens
uccaaaaccuuccu

SEQ ID NO: 1129646 - RNA, 19 nt, Homo sapiens
uccacaccaaagucaggga

SEQ ID NO: 1129647 - RNA, 13 nt, Homo sapiens
uccacacugagag

SEQ ID NO: 1129648 - RNA, 15 nt, Homo sapiens
uccacagacucccuc

SEQ ID NO: 1129649 - RNA, 23 nt, Homo sapiens
uccaggcuugggcuccauuccca

SEQ ID NO: 1129650 - RNA, 16 nt, Homo sapiens
uccaggguaccuuuga

SEQ ID NO: 1129651 - RNA, 14 nt, Homo sapiens
ucccaaagcucaga

SEQ ID NO: 1129652 - RNA, 15 nt, Homo sapiens
ucccagcuacuuggg

SEQ ID NO: 1129653 - RNA, 12 nt, Homo sapiens
uccccaccucag

SEQ ID NO: 1129654 - RNA, 17 nt, Homo sapiens
ucccgagucaugcacuc

SEQ ID NO: 1129655 - RNA, 21 nt, Homo sapiens
ucccuaccccauuugugguca

SEQ ID NO: 1129656 - RNA, 15 nt, Homo sapiens
ucccucaugucuuua

SEQ ID NO: 1129657 - RNA, 16 nt, Homo sapiens
ucccugcuuaccugac

SEQ ID NO: 1129658 - RNA, 15 nt, Homo sapiens
ucccuggaugacauu

SEQ ID NO: 1129659 - RNA, 13 nt, Homo sapiens
ucccuuuguugcu

SEQ ID NO: 1129660 - RNA, 12 nt, Homo sapiens
uccuccagacaa

SEQ ID NO: 1129661 - RNA, 17 nt, Homo sapiens
uccucgggggaaagcac

SEQ ID NO: 1129662 - RNA, 22 nt, Homo sapiens
uccucucccgcgggccuggaca

SEQ ID NO: 1129663 - RNA, 22 nt, Homo sapiens
uccucugacuggagucuaggaa

SEQ ID NO: 1129664 - RNA, 14 nt, Homo sapiens
uccugacccuguga

SEQ ID NO: 1129665 - RNA, 15 nt, Homo sapiens
uccugcuacccagua

SEQ ID NO: 1129666 - RNA, 15 nt, Homo sapiens
uccuggaggcacugg

SEQ ID NO: 1129667 - RNA, 17 nt, Homo sapiens
uccugggaauaugcuag

SEQ ID NO: 1129668 - RNA, 22 nt, Homo sapiens
uccuggggcuggguguguuuca

SEQ ID NO: 1129669 - RNA, 13 nt, Homo sapiens
uccugugugcuga

SEQ ID NO: 1129670 - RNA, 22 nt, Homo sapiens
uccuuaggaaaaacaugagcau

SEQ ID NO: 1129671 - RNA, 17 nt, Homo sapiens
uccuuaggugugagguc

SEQ ID NO: 1129672 - RNA, 16 nt, Homo sapiens
uccuuauuucacugaa

SEQ ID NO: 1129673 - RNA, 23 nt, Homo sapiens
uccuuuaggucugguuguugcac

SEQ ID NO: 1129674 - RNA, 17 nt, Homo sapiens
ucgcaacugagaucucc

SEQ ID NO: 1129675 - RNA, 20 nt, Homo sapiens
ucuaaaagggggcuauuccc

SEQ ID NO: 1129676 - RNA, 19 nt, Homo sapiens
ucuaagaaguuuuguucug

SEQ ID NO: 1129677 - RNA, 23 nt, Homo sapiens
ucuaaguguugugaaacuguaaa

SEQ ID NO: 1129678 - RNA, 13 nt, Homo sapiens
ucuacacugagga

SEQ ID NO: 1129679 - RNA, 20 nt, Homo sapiens
ucuaccucugucacccgagc

SEQ ID NO: 1129680 - RNA, 19 nt, Homo sapiens
ucuacugaccuuuguccuu

SEQ ID NO: 1129681 - RNA, 17 nt, Homo sapiens
ucuauaaguguucagug

SEQ ID NO: 1129682 - RNA, 12 nt, Homo sapiens
uuagcccaagag

SEQ ID NO: 1129683 - RNA, 20 nt, Homo sapiens
uuauggggacagcauaccuu

SEQ ID NO: 1129684 - RNA, 13 nt, Homo sapiens
uuauugcauaaca

SEQ ID NO: 1129685 - RNA, 21 nt, Homo sapiens
uucaggaagcauaaagcaauu

SEQ ID NO: 1129686 - RNA, 23 nt, Homo sapiens
uucaggccuuguugcaucucaga

SEQ ID NO: 1129687 - RNA, 13 nt, Homo sapiens
uucaguguugaca

SEQ ID NO: 1129688 - RNA, 14 nt, Homo sapiens
uucaguguugacau

SEQ ID NO: 1129689 - RNA, 12 nt, Homo sapiens
uucccaccucag

SEQ ID NO: 1129690 - RNA, 22 nt, Homo sapiens
uuccuagcaccgcuuauccccu

SEQ ID NO: 1129691 - RNA, 20 nt, Homo sapiens
uuccuaguagaacucacaga

SEQ ID NO: 1129692 - RNA, 13 nt, Homo sapiens
uuccucucucuca

SEQ ID NO: 1129693 - RNA, 13 nt, Homo sapiens
uucugaggcaaau

SEQ ID NO: 1129694 - RNA, 19 nt, Homo sapiens
uucugaugagaaaggccug

SEQ ID NO: 1129695 - RNA, 22 nt, Homo sapiens
uucuuaaaacaaagccaugcca

SEQ ID NO: 1129696 - RNA, 21 nt, Homo sapiens
uucuucucccuguguggcugc

SEQ ID NO: 1129697 - RNA, 13 nt, Homo sapiens
uugaaaacauaca

SEQ ID NO: 1129698 - RNA, 20 nt, Homo sapiens
uugaagaaaggaacugaggc

SEQ ID NO: 1129699 - RNA, 21 nt, Homo sapiens
uugaauuuugaaccaugugac

SEQ ID NO: 1129700 - RNA, 11 nt, Homo sapiens
uugacauagcc

SEQ ID NO: 1129701 - RNA, 12 nt, Homo sapiens
uugauagcagaa

SEQ ID NO: 1129702 - RNA, 14 nt, Homo sapiens
uugaugauuuccua

SEQ ID NO: 1129703 - RNA, 15 nt, Homo sapiens
uugcggauacuuugc

SEQ ID NO: 1129704 - RNA, 15 nt, Homo sapiens
uuggaaugaaugaca

SEQ ID NO: 1129705 - RNA, 20 nt, Homo sapiens
uugggaggcuggaguggaaa

SEQ ID NO: 1129706 - RNA, 17 nt, Homo sapiens
uuguaaguugaagcaaa

SEQ ID NO: 1129707 - RNA, 18 nt, Homo sapiens
uuguaccagggcucugua

SEQ ID NO: 1129708 - RNA, 20 nt, Homo sapiens
uugugaaauaaaauggugaa

SEQ ID NO: 1129709 - RNA, 17 nt, Homo sapiens
uuguguccccaccucag

SEQ ID NO: 1129710 - RNA, 15 nt, Homo sapiens
uuuaaaaaacuaaaa

SEQ ID NO: 1129711 - RNA, 17 nt, Homo sapiens
uuuaaaaauaauuuugu

SEQ ID NO: 1129712 - RNA, 18 nt, Homo sapiens
uuuaaacuauaagcaaga

SEQ ID NO: 1129713 - RNA, 12 nt, Homo sapiens
uuuaauagcaaa

SEQ ID NO: 1129714 - RNA, 19 nt, Homo sapiens
uuuaggaagcaagcuuaau

SEQ ID NO: 1129715 - RNA, 21 nt, Homo sapiens
uuucagcacgccguaaccagg

SEQ ID NO: 1129716 - RNA, 12 nt, Homo sapiens
uuuccacaccau

SEQ ID NO: 1129717 - RNA, 17 nt, Homo sapiens
uuucuuucucacuaaau

SEQ ID NO: 1129718 - RNA, 13 nt, Homo sapiens
uuugccaaaguga

SEQ ID NO: 1129719 - RNA, 17 nt, Homo sapiens
uuuguaaaggucagagu

SEQ ID NO: 1129720 - RNA, 16 nt, Homo sapiens
uuuguggucacagcca

SEQ ID NO: 1129721 - RNA, 13 nt, Homo sapiens
uuuucacucuggg

SEQ ID NO: 1129722 - RNA, 22 nt, Homo sapiens
gugaaaaaaacaaccuacagaa

SEQ ID NO: 1129723 - RNA, 22 nt, Homo sapiens
gugaaaaaggcaagccacagaa

SEQ ID NO: 1129724 - RNA, 17 nt, Homo sapiens
gugcccucccauagcac

SEQ ID NO: 1129725 - RNA, 15 nt, Homo sapiens
gugccgugacagggc

SEQ ID NO: 1129726 - RNA, 15 nt, Homo sapiens
gugcugggauuacag

SEQ ID NO: 1129727 - RNA, 19 nt, Homo sapiens
guggugcccaugaggacaa

SEQ ID NO: 1129728 - RNA, 15 nt, Homo sapiens
guguccccaccucag

SEQ ID NO: 1129729 - RNA, 22 nt, Homo sapiens
guguccuggggaauacuggcca

SEQ ID NO: 1129730 - RNA, 11 nt, Homo sapiens
guguucagugu

SEQ ID NO: 1129731 - RNA, 21 nt, Homo sapiens
guguucaguguugacauagcc

SEQ ID NO: 1129732 - RNA, 21 nt, Homo sapiens
guguugaggggaccaaagcca

SEQ ID NO: 1129733 - RNA, 22 nt, Homo sapiens
guuaggcacaggcugggaugga

SEQ ID NO: 1129734 - RNA, 14 nt, Homo sapiens
guucaaaagcaauc

SEQ ID NO: 1129735 - RNA, 19 nt, Homo sapiens
guuccuuucgaaagcaaug

SEQ ID NO: 1129736 - RNA, 16 nt, Homo sapiens
guugacauagccuuug

SEQ ID NO: 1129737 - RNA, 21 nt, Homo sapiens
guuggugggggucagucacuu

SEQ ID NO: 1129738 - RNA, 16 nt, Homo sapiens
guugugaaacuguaaa

SEQ ID NO: 1129739 - RNA, 21 nt, Homo sapiens
guugugaaauaaaauggugaa

SEQ ID NO: 1129740 - RNA, 21 nt, Homo sapiens
guuuuauucugacuuccucug

SEQ ID NO: 1129741 - RNA, 13 nt, Homo sapiens
uaaaacacagaaa

SEQ ID NO: 1129742 - RNA, 17 nt, Homo sapiens
uaaaaccugagccauug

SEQ ID NO: 1129743 - RNA, 21 nt, Homo sapiens
uaaaagcaagauuuugucaaa

SEQ ID NO: 1129744 - RNA, 23 nt, Homo sapiens
uaaaccaaugucauaacaggcau

SEQ ID NO: 1129745 - RNA, 21 nt, Homo sapiens
uaaacuguuuauuugcacuau

SEQ ID NO: 1129746 - RNA, 20 nt, Homo sapiens
uaaacuuggaaccuuggaaa

SEQ ID NO: 1129747 - RNA, 20 nt, Homo sapiens
uaaagaaguaaauuugucca

SEQ ID NO: 1129748 - RNA, 14 nt, Homo sapiens
uaaagagcuguuau

SEQ ID NO: 1129749 - RNA, 12 nt, Homo sapiens
uaaaucaauucu

SEQ ID NO: 1129750 - RNA, 23 nt, Homo sapiens
uaacacuggauuuguuucuguga

SEQ ID NO: 1129751 - RNA, 16 nt, Homo sapiens
uaacagcagaugccaa

SEQ ID NO: 1129752 - RNA, 19 nt, Homo sapiens
uaaccagacacauacucau

SEQ ID NO: 1129753 - RNA, 16 nt, Homo sapiens
uaacuuauugcauaac

SEQ ID NO: 1129754 - RNA, 13 nt, Homo sapiens
uaacuucucugag

SEQ ID NO: 1129755 - RNA, 16 nt, Homo sapiens
uaagaggcagugagau

SEQ ID NO: 1129756 - RNA, 21 nt, Homo sapiens
uaaggacgaaaaacacagugc

SEQ ID NO: 1129757 - RNA, 21 nt, Homo sapiens
uaauauccuaaacaucauuca

SEQ ID NO: 1129758 - RNA, 20 nt, Homo sapiens
uaaucccagcuacuugggag

SEQ ID NO: 1129759 - RNA, 14 nt, Homo sapiens
uaaugaaacaaaga

SEQ ID NO: 1129760 - RNA, 13 nt, Homo sapiens
uaaugacauacuu

SEQ ID NO: 1129761 - RNA, 14 nt, Homo sapiens
uaauucugucacuc

SEQ ID NO: 1129762 - RNA, 15 nt, Homo sapiens
uaauuuaguuucaua

SEQ ID NO: 1129763 - RNA, 16 nt, Homo sapiens
uacaaggaauaugaca

SEQ ID NO: 1129764 - RNA, 13 nt, Homo sapiens
uacauuuacuuua

SEQ ID NO: 1129765 - RNA, 22 nt, Homo sapiens
uaccagggcucuguauucugca

SEQ ID NO: 1129766 - RNA, 18 nt, Homo sapiens
uacuauauaauauaucau

SEQ ID NO: 1129767 - RNA, 22 nt, Homo sapiens
uacuucuguggaaguagcuuug

SEQ ID NO: 1129768 - RNA, 22 nt, Homo sapiens
uacuuucuauucuuuagcugua

SEQ ID NO: 1129769 - RNA, 12 nt, Homo sapiens
uagacuaguuuc

SEQ ID NO: 1129770 - RNA, 20 nt, Homo sapiens
uagagaaggcugugagccaa

SEQ ID NO: 1129771 - RNA, 23 nt, Homo sapiens
uagcugguucacacugaccaaga

SEQ ID NO: 1129772 - RNA, 15 nt, Homo sapiens
uaggaguugcuccua

SEQ ID NO: 1129773 - RNA, 12 nt, Homo sapiens
uaggcaaagacu

SEQ ID NO: 1129774 - RNA, 22 nt, Homo sapiens
uaggcaauuuuuacaaccugag

SEQ ID NO: 1129775 - RNA, 17 nt, Homo sapiens
uagggaaauucaaagca

SEQ ID NO: 1129776 - RNA, 15 nt, Homo sapiens
uaguagaacucacag

SEQ ID NO: 1129777 - RNA, 14 nt, Homo sapiens
uagugccugagaug

SEQ ID NO: 1129778 - RNA, 12 nt, Homo sapiens
uauaaacacaua

SEQ ID NO: 1129779 - RNA, 21 nt, Homo sapiens
uauaagcaagaaggcaaaaau

SEQ ID NO: 1129780 - RNA, 17 nt, Homo sapiens
uauaauaauauacugua

SEQ ID NO: 1129781 - RNA, 17 nt, Homo sapiens
uauaccugggcauacua

SEQ ID NO: 1129782 - RNA, 12 nt, Homo sapiens
uauauaauacua

SEQ ID NO: 1129783 - RNA, 14 nt, Homo sapiens
uauaugcaaagaaa

SEQ ID NO: 1129784 - RNA, 15 nt, Homo sapiens
uauaugcagaauuac

SEQ ID NO: 1129785 - RNA, 17 nt, Homo sapiens
uaucaaauacuaguauu

SEQ ID NO: 1129786 - RNA, 22 nt, Homo sapiens
uaucacucaauuucucugagga

SEQ ID NO: 1129787 - RNA, 21 nt, Homo sapiens
uaugaaaaagaagaaucucau

SEQ ID NO: 1129788 - RNA, 12 nt, Homo sapiens
uaugccacucag

SEQ ID NO: 1129789 - RNA, 16 nt, Homo sapiens
uauguaugccuauuca

SEQ ID NO: 1129790 - RNA, 16 nt, Homo sapiens
uauuaucaguggcugc

SEQ ID NO: 1129791 - RNA, 15 nt, Homo sapiens
uauucugcaacagcc

SEQ ID NO: 1129792 - RNA, 13 nt, Homo sapiens
uauuugcacuaug

SEQ ID NO: 1129793 - RNA, 14 nt, Homo sapiens
ucaaaauguuuauu

SEQ ID NO: 1129794 - RNA, 19 nt, Homo sapiens
ucaaagcccacauacugga

SEQ ID NO: 1129795 - RNA, 16 nt, Homo sapiens
ucaaaggaagacuuga

SEQ ID NO: 1129796 - RNA, 21 nt, Homo sapiens
ucaaccccuccccuccauccc

SEQ ID NO: 1129797 - RNA, 17 nt, Homo sapiens
ucaauccuaucacaguc

SEQ ID NO: 1129798 - RNA, 16 nt, Homo sapiens
ucacauaaaaaugcaa

SEQ ID NO: 1129799 - RNA, 11 nt, Homo sapiens
ucacauucccu

SEQ ID NO: 1129800 - RNA, 17 nt, Homo sapiens
ucacauucccucucauc

SEQ ID NO: 1129801 - RNA, 22 nt, Homo sapiens
ucacauucccucucauccaggu

SEQ ID NO: 1129802 - RNA, 19 nt, Homo sapiens
ucacccgagcuagagugca

SEQ ID NO: 1129803 - RNA, 23 nt, Homo sapiens
ucagaauaaauggguaacacuga

SEQ ID NO: 1129804 - RNA, 19 nt, Homo sapiens
ucagccauugcccugugag

SEQ ID NO: 1129805 - RNA, 20 nt, Homo sapiens
ucaggaagcauaaagcaauu

SEQ ID NO: 1129806 - RNA, 13 nt, Homo sapiens
ucaguguugacau

SEQ ID NO: 1129807 - RNA, 15 nt, Homo sapiens
ucaguguugacauag

SEQ ID NO: 1129808 - RNA, 17 nt, Homo sapiens
ucauggaaaagcccagu

SEQ ID NO: 1129809 - RNA, 18 nt, Homo sapiens
ucauggagaaacauccua

SEQ ID NO: 1129810 - RNA, 16 nt, Homo sapiens
ucauuaugacucuuaa

SEQ ID NO: 1129811 - RNA, 16 nt, Homo sapiens
ucauuauuagucuuca

SEQ ID NO: 1129812 - RNA, 14 nt, Homo sapiens
ucauuuaagggaaa

SEQ ID NO: 1129813 - RNA, 16 nt, Homo sapiens
uccaacuccugguuca

SEQ ID NO: 1129814 - RNA, 20 nt, Homo sapiens
uccaaggacucuaaaagggg

SEQ ID NO: 1129815 - RNA, 16 nt, Homo sapiens
uccaauggcuguaaac

SEQ ID NO: 1129816 - RNA, 20 nt, Homo sapiens
uccacaccaaagucagggag

SEQ ID NO: 1129817 - RNA, 13 nt, Homo sapiens
uccacuauuucca

SEQ ID NO: 1129818 - RNA, 22 nt, Homo sapiens
ugugcuggacacuguccaugaa

SEQ ID NO: 1129819 - RNA, 16 nt, Homo sapiens
uguguacugcaguugg

SEQ ID NO: 1129820 - RNA, 23 nt, Homo sapiens
uguucaguguugacauagccuuu

SEQ ID NO: 1129821 - RNA, 19 nt, Homo sapiens
uguugguggccucugcuug

SEQ ID NO: 1129822 - RNA, 15 nt, Homo sapiens
uguuuuguacuuuag

SEQ ID NO: 1129823 - RNA, 19 nt, Homo sapiens
uuaaaauagcaaaagaaga

SEQ ID NO: 1129824 - RNA, 15 nt, Homo sapiens
uuaaagaaggguuga

SEQ ID NO: 1129825 - RNA, 23 nt, Homo sapiens
uuaacuuguaaaugaaaaaauuc

SEQ ID NO: 1129826 - RNA, 19 nt, Homo sapiens
uuaauuuuugauacuaagc

SEQ ID NO: 1129827 - RNA, 15 nt, Homo sapiens
uuaccaaguccuggg

SEQ ID NO: 1129828 - RNA, 21 nt, Homo sapiens
uuaccaggcaccaaaagaagu

SEQ ID NO: 1129829 - RNA, 18 nt, Homo sapiens
uuacuauuucacaacagc

SEQ ID NO: 1129830 - RNA, 15 nt, Homo sapiens
uuaugaaaaagaaga

SEQ ID NO: 1129831 - RNA, 21 nt, Homo sapiens
uuauuugcacuaugagccuau

SEQ ID NO: 1129832 - RNA, 18 nt, Homo sapiens
uucaaaauaaacaauaaa

SEQ ID NO: 1129833 - RNA, 23 nt, Homo sapiens
uucaaaauaaacaauaaaugggc

SEQ ID NO: 1129834 - RNA, 15 nt, Homo sapiens
uucaaagcaggguuc

SEQ ID NO: 1129835 - RNA, 23 nt, Homo sapiens
uucaauaaaagaauaguugccaa

SEQ ID NO: 1129836 - RNA, 16 nt, Homo sapiens
uucacacugaccaaga

SEQ ID NO: 1129837 - RNA, 22 nt, Homo sapiens
uucaccaaaucuugguugaugc

SEQ ID NO: 1129838 - RNA, 18 nt, Homo sapiens
uucagaagaaaaagaagc

SEQ ID NO: 1129839 - RNA, 23 nt, Homo sapiens
uuccucucugaguggacuggccu

SEQ ID NO: 1129840 - RNA, 13 nt, Homo sapiens
uucgaaagcaaug

SEQ ID NO: 1129841 - RNA, 12 nt, Homo sapiens
uucucccugugu

SEQ ID NO: 1129842 - RNA, 17 nt, Homo sapiens
uucucugaggacacaga

SEQ ID NO: 1129843 - RNA, 17 nt, Homo sapiens
uucucuuugguguuaca

SEQ ID NO: 1129844 - RNA, 12 nt, Homo sapiens
uucugucuguag

SEQ ID NO: 1129845 - RNA, 14 nt, Homo sapiens
uugaaaacauacac

SEQ ID NO: 1129846 - RNA, 18 nt, Homo sapiens
uugaauuuugaaccaugu

SEQ ID NO: 1129847 - RNA, 14 nt, Homo sapiens
uugagagacagggu

SEQ ID NO: 1129848 - RNA, 17 nt, Homo sapiens
uugaucuuuggaugugg

SEQ ID NO: 1129849 - RNA, 17 nt, Homo sapiens
uugaugccagcuguacu

SEQ ID NO: 1129850 - RNA, 12 nt, Homo sapiens
uugccaaaguga

SEQ ID NO: 1129851 - RNA, 11 nt, Homo sapiens
uugcccuguga

SEQ ID NO: 1129852 - RNA, 20 nt, Homo sapiens
uuguugcuacauuuacuuua

SEQ ID NO: 1129853 - RNA, 14 nt, Homo sapiens
uuuaaaauagcaaa

SEQ ID NO: 1129854 - RNA, 15 nt, Homo sapiens
uuuaaaccgcuaaaa

SEQ ID NO: 1129855 - RNA, 21 nt, Homo sapiens
uuucaugauaaugaacagaac

SEQ ID NO: 1129856 - RNA, 16 nt, Homo sapiens
uuuccccucugugucc

SEQ ID NO: 1129857 - RNA, 17 nt, Homo sapiens
uuucuaacucaggggug

SEQ ID NO: 1129858 - RNA, 18 nt, Homo sapiens
uuugaaugacaagauuag

SEQ ID NO: 1129859 - RNA, 18 nt, Homo sapiens
uuugauacuaagcauuga

SEQ ID NO: 1129860 - RNA, 21 nt, Homo sapiens
uuuuacauagaucauauugua

SEQ ID NO: 1129861 - RNA, 15 nt, Homo sapiens
uuuucuacaaccuaa

SEQ ID NO: 1129862 - RNA, 21 nt, Homo sapiens
uuuucucaaccugggacuucc

SEQ ID NO: 1129863 - RNA, 15 nt, Homo sapiens
uuuugguaauauuca

SEQ ID NO: 1129864 - RNA, 18 nt, Homo sapiens
auggcgugugugccguga

SEQ ID NO: 1129865 - RNA, 18 nt, Homo sapiens
auggguaacacugauuac

SEQ ID NO: 1129866 - RNA, 16 nt, Homo sapiens
augugcuauugaacug

SEQ ID NO: 1129867 - RNA, 22 nt, Homo sapiens
auguuaaaaaaauaagaagaau

SEQ ID NO: 1129868 - RNA, 21 nt, Homo sapiens
auguuagaauuuggagggaau

SEQ ID NO: 1129869 - RNA, 17 nt, Homo sapiens
auguuuuugcugcuacu

SEQ ID NO: 1129870 - RNA, 12 nt, Homo sapiens
auuaagugcaau

SEQ ID NO: 1129871 - RNA, 13 nt, Homo sapiens
auuaagugcaauu

SEQ ID NO: 1129872 - RNA, 14 nt, Homo sapiens
auuaucaauguucu

SEQ ID NO: 1129873 - RNA, 18 nt, Homo sapiens
auuccuucacucauccag

SEQ ID NO: 1129874 - RNA, 14 nt, Homo sapiens
auucuacacugagg

SEQ ID NO: 1129875 - RNA, 16 nt, Homo sapiens
auugagugaaacauug

SEQ ID NO: 1129876 - RNA, 21 nt, Homo sapiens
auugcauaacagcagaugcca

SEQ ID NO: 1129877 - RNA, 13 nt, Homo sapiens
auugcccugugag

SEQ ID NO: 1129878 - RNA, 23 nt, Homo sapiens
auugggaguaggaguugcuccua

SEQ ID NO: 1129879 - RNA, 17 nt, Homo sapiens
auuguaucaggcaagau

SEQ ID NO: 1129880 - RNA, 16 nt, Homo sapiens
auugugcccagcccuu

SEQ ID NO: 1129881 - RNA, 20 nt, Homo sapiens
auuguguugggaccugugau

SEQ ID NO: 1129882 - RNA, 18 nt, Homo sapiens
auuuccuaguagaacuca

SEQ ID NO: 1129883 - RNA, 16 nt, Homo sapiens
auuucuauagccaaaa

SEQ ID NO: 1129884 - RNA, 16 nt, Homo sapiens
auuuugaaccauguga

SEQ ID NO: 1129885 - RNA, 20 nt, Homo sapiens
auuuuguccagaagaauuca

SEQ ID NO: 1129886 - RNA, 16 nt, Homo sapiens
caaaaacagcuacuua

SEQ ID NO: 1129887 - RNA, 19 nt, Homo sapiens
caaaaccuuccucuuccag

SEQ ID NO: 1129888 - RNA, 20 nt, Homo sapiens
caaacaugaauccugugaua

SEQ ID NO: 1129889 - RNA, 15 nt, Homo sapiens
caaagcaagcauuca

SEQ ID NO: 1129890 - RNA, 21 nt, Homo sapiens
caaagcaggguucugaggcaa

SEQ ID NO: 1129891 - RNA, 14 nt, Homo sapiens
caaagccaugccaa

SEQ ID NO: 1129892 - RNA, 15 nt, Homo sapiens
caaaggacccaaucc

SEQ ID NO: 1129893 - RNA, 18 nt, Homo sapiens
caaaggacccaaucccca

SEQ ID NO: 1129894 - RNA, 22 nt, Homo sapiens
caaagugacacagagcaauggu

SEQ ID NO: 1129895 - RNA, 23 nt, Homo sapiens
caaauaaaacaaaaccaacucag

SEQ ID NO: 1129896 - RNA, 23 nt, Homo sapiens
caaaugcuuuuugaucuguugau

SEQ ID NO: 1129897 - RNA, 22 nt, Homo sapiens
caacaaaugggucccucagucu

SEQ ID NO: 1129898 - RNA, 19 nt, Homo sapiens
caacaugguccuuguccca

SEQ ID NO: 1129899 - RNA, 15 nt, Homo sapiens
caacauguuauuugu

SEQ ID NO: 1129900 - RNA, 20 nt, Homo sapiens
caaccccuccccuccauccc

SEQ ID NO: 1129901 - RNA, 17 nt, Homo sapiens
caacccucacuguguug

SEQ ID NO: 1129902 - RNA, 13 nt, Homo sapiens
caaccugaguuca

SEQ ID NO: 1129903 - RNA, 18 nt, Homo sapiens
caaccugggacuuccuaa

SEQ ID NO: 1129904 - RNA, 19 nt, Homo sapiens
caaccugggacuuccuaaa

SEQ ID NO: 1129905 - RNA, 18 nt, Homo sapiens
caagcaagggcugugcug

SEQ ID NO: 1129906 - RNA, 19 nt, Homo sapiens
caagcaagggcugugcuga

SEQ ID NO: 1129907 - RNA, 21 nt, Homo sapiens
caagcauucagaagaaaaaga

SEQ ID NO: 1129908 - RNA, 12 nt, Homo sapiens
caagccacagaa

SEQ ID NO: 1129909 - RNA, 17 nt, Homo sapiens
caaggacuagagcucag

SEQ ID NO: 1129910 - RNA, 13 nt, Homo sapiens
caagggcagugag

SEQ ID NO: 1129911 - RNA, 15 nt, Homo sapiens
caagggcuccagggc

SEQ ID NO: 1129912 - RNA, 21 nt, Homo sapiens
caagugauuugggggugcaau

SEQ ID NO: 1129913 - RNA, 18 nt, Homo sapiens
caaguguugaggggacca

SEQ ID NO: 1129914 - RNA, 21 nt, Homo sapiens
caauaaaagaauaguugccaa

SEQ ID NO: 1129915 - RNA, 16 nt, Homo sapiens
caauaaagugaucugu

SEQ ID NO: 1129916 - RNA, 17 nt, Homo sapiens
caauacaauaguaugca

SEQ ID NO: 1129917 - RNA, 13 nt, Homo sapiens
caauccuaucaca

SEQ ID NO: 1129918 - RNA, 13 nt, Homo sapiens
caaucuugcccua

SEQ ID NO: 1129919 - RNA, 22 nt, Homo sapiens
cacaacuuguaccaaguuuccc

SEQ ID NO: 1129920 - RNA, 10 nt, Homo sapiens
cacacugaga

SEQ ID NO: 1129921 - RNA, 11 nt, Homo sapiens
cacacuguaaa

SEQ ID NO: 1129922 - RNA, 22 nt, Homo sapiens
cacacuguaaauauccacagac

SEQ ID NO: 1129923 - RNA, 15 nt, Homo sapiens
cacagaaacuauaug

SEQ ID NO: 1129924 - RNA, 13 nt, Homo sapiens
cacagacucccuc

SEQ ID NO: 1129925 - RNA, 14 nt, Homo sapiens
cacagcccaagagg

SEQ ID NO: 1129926 - RNA, 22 nt, Homo sapiens
caccaaaugcuuuuugaucugu

SEQ ID NO: 1129927 - RNA, 16 nt, Homo sapiens
caccucuggaucccug

SEQ ID NO: 1129928 - RNA, 19 nt, Homo sapiens
cacgucaagcuuuggauaa

SEQ ID NO: 1129929 - RNA, 23 nt, Homo sapiens
cacucaauuucucugaggacaca

SEQ ID NO: 1129930 - RNA, 17 nt, Homo sapiens
cacucauuccuucacuc

SEQ ID NO: 1129931 - RNA, 14 nt, Homo sapiens
cacugauuacuuuu

SEQ ID NO: 1129932 - RNA, 14 nt, Homo sapiens
cacugccucuucca

SEQ ID NO: 1129933 - RNA, 21 nt, Homo sapiens
cacuucccauuuguguuucag

SEQ ID NO: 1129934 - RNA, 15 nt, Homo sapiens
cacuuugugaucuca

SEQ ID NO: 1129935 - RNA, 20 nt, Homo sapiens
cagaaaacacagccugugua

SEQ ID NO: 1129936 - RNA, 19 nt, Homo sapiens
cagaaauaaagagcuguua

SEQ ID NO: 1129937 - RNA, 14 nt, Homo sapiens
cagaauccacaacu

SEQ ID NO: 1129938 - RNA, 14 nt, Homo sapiens
cagaauuacauaaa

SEQ ID NO: 1129939 - RNA, 16 nt, Homo sapiens
cagacacagguguaga

SEQ ID NO: 1129940 - RNA, 18 nt, Homo sapiens
cagacagcaggcuggagc

SEQ ID NO: 1129941 - RNA, 15 nt, Homo sapiens
cagacucuucauuca

SEQ ID NO: 1129942 - RNA, 15 nt, Homo sapiens
cagagguggcugcug

SEQ ID NO: 1129943 - RNA, 21 nt, Homo sapiens
cagaugcccacguaugugaaa

SEQ ID NO: 1129944 - RNA, 23 nt, Homo sapiens
cagaugcccacguaugugaaaca

SEQ ID NO: 1129945 - RNA, 14 nt, Homo sapiens
cagcaaaaugugaa

SEQ ID NO: 1129946 - RNA, 11 nt, Homo sapiens
cagcauaccuu

SEQ ID NO: 1129947 - RNA, 14 nt, Homo sapiens
cagccaugaaguca

SEQ ID NO: 1129948 - RNA, 19 nt, Homo sapiens
cagcccuauggaagucuca

SEQ ID NO: 1129949 - RNA, 17 nt, Homo sapiens
cagccuucugacaagca

SEQ ID NO: 1129950 - RNA, 22 nt, Homo sapiens
cagccuucugacaagcaagggc

SEQ ID NO: 1129951 - RNA, 20 nt, Homo sapiens
cagcggucauucuacacuga

SEQ ID NO: 1129952 - RNA, 21 nt, Homo sapiens
uaucaauguucuaguucugug

SEQ ID NO: 1129953 - RNA, 21 nt, Homo sapiens
uauccuaaacccuuaaccuaa

SEQ ID NO: 1129954 - RNA, 16 nt, Homo sapiens
uaucuggccugagaca

SEQ ID NO: 1129955 - RNA, 17 nt, Homo sapiens
uaucugguuaaugacau

SEQ ID NO: 1129956 - RNA, 13 nt, Homo sapiens
uauuaccuauuca

SEQ ID NO: 1129957 - RNA, 22 nt, Homo sapiens
uauuaugugcaacauuaugauu

SEQ ID NO: 1129958 - RNA, 13 nt, Homo sapiens
uauugcauaacag

SEQ ID NO: 1129959 - RNA, 15 nt, Homo sapiens
uauuuaaacaacagc

SEQ ID NO: 1129960 - RNA, 12 nt, Homo sapiens
ucaaaagcaauc

SEQ ID NO: 1129961 - RNA, 20 nt, Homo sapiens
ucaaccugggacuuccuaaa

SEQ ID NO: 1129962 - RNA, 21 nt, Homo sapiens
ucaagccuccccaguucuacu

SEQ ID NO: 1129963 - RNA, 13 nt, Homo sapiens
ucaagucuggauc

SEQ ID NO: 1129964 - RNA, 19 nt, Homo sapiens
ucaauuucucugaggacac

SEQ ID NO: 1129965 - RNA, 16 nt, Homo sapiens
ucaccaaaugcuuuuu

SEQ ID NO: 1129966 - RNA, 18 nt, Homo sapiens
ucacuaaccaagccagaa

SEQ ID NO: 1129967 - RNA, 15 nt, Homo sapiens
ucacucacucauucc

SEQ ID NO: 1129968 - RNA, 23 nt, Homo sapiens
ucagagcugcugaggacaauguc

SEQ ID NO: 1129969 - RNA, 17 nt, Homo sapiens
ucagaguggccaauccc

SEQ ID NO: 1129970 - RNA, 18 nt, Homo sapiens
ucagccauugcccuguga

SEQ ID NO: 1129971 - RNA, 20 nt, Homo sapiens
ucagggagccuggaagccaa

SEQ ID NO: 1129972 - RNA, 21 nt, Homo sapiens
ucagugaagaauacuucucau

SEQ ID NO: 1129973 - RNA, 20 nt, Homo sapiens
ucaguguugacauagccuuu

SEQ ID NO: 1129974 - RNA, 14 nt, Homo sapiens
ucaugcucucuaua

SEQ ID NO: 1129975 - RNA, 13 nt, Homo sapiens
ucauuucaucuca

SEQ ID NO: 1129976 - RNA, 15 nt, Homo sapiens
uccaagaccccaaau

SEQ ID NO: 1129977 - RNA, 14 nt, Homo sapiens
uccaaucacauuca

SEQ ID NO: 1129978 - RNA, 12 nt, Homo sapiens
uccacacugaga

SEQ ID NO: 1129979 - RNA, 14 nt, Homo sapiens
uccacuauuuccau

SEQ ID NO: 1129980 - RNA, 14 nt, Homo sapiens
uccagcaacugaac

SEQ ID NO: 1129981 - RNA, 12 nt, Homo sapiens
uccaucucuggc

SEQ ID NO: 1129982 - RNA, 18 nt, Homo sapiens
ucccacaugaucuugaga

SEQ ID NO: 1129983 - RNA, 18 nt, Homo sapiens
ucccaguaaagauaccau

SEQ ID NO: 1129984 - RNA, 19 nt, Homo sapiens
uccccaguucuacugaccu

SEQ ID NO: 1129985 - RNA, 14 nt, Homo sapiens
ucccuggaugacau

SEQ ID NO: 1129986 - RNA, 18 nt, Homo sapiens
ucccuugugucuguugcu

SEQ ID NO: 1129987 - RNA, 11 nt, Homo sapiens
uccuacugugu

SEQ ID NO: 1129988 - RNA, 19 nt, Homo sapiens
uccugagccccucaauccu

SEQ ID NO: 1129989 - RNA, 19 nt, Homo sapiens
uccugaggggauaucccua

SEQ ID NO: 1129990 - RNA, 11 nt, Homo sapiens
uccugcaaguc

SEQ ID NO: 1129991 - RNA, 17 nt, Homo sapiens
uccugcaaguccauagc

SEQ ID NO: 1129992 - RNA, 15 nt, Homo sapiens
uccugcccucuggga

SEQ ID NO: 1129993 - RNA, 21 nt, Homo sapiens
uccugccuucucuucuauccu

SEQ ID NO: 1129994 - RNA, 15 nt, Homo sapiens
uccuggauucacuca

SEQ ID NO: 1129995 - RNA, 18 nt, Homo sapiens
uccuugauaaaguauuau

SEQ ID NO: 1129996 - RNA, 17 nt, Homo sapiens
uccuuucgaaagcaaug

SEQ ID NO: 1129997 - RNA, 19 nt, Homo sapiens
ucgauccuggauucacuca

SEQ ID NO: 1129998 - RNA, 17 nt, Homo sapiens
ucgcggagguccugcua

SEQ ID NO: 1129999 - RNA, 19 nt, Homo sapiens
ucggcucuggagauuaucc

SEQ ID NO: 1130000 - RNA, 18 nt, Homo sapiens
ucuacugacuuuucccau

SEQ ID NO: 1130001 - RNA, 14 nt, Homo sapiens
ucuauuacacugga

SEQ ID NO: 1130002 - RNA, 16 nt, Homo sapiens
ucucaagcuagccaga

SEQ ID NO: 1130003 - RNA, 14 nt, Homo sapiens
ucucauggcuuuga

SEQ ID NO: 1130004 - RNA, 23 nt, Homo sapiens
ucuccagcccuauggaagucuca

SEQ ID NO: 1130005 - RNA, 18 nt, Homo sapiens
ucucgcuccucaaccccu

SEQ ID NO: 1130006 - RNA, 12 nt, Homo sapiens
ucucucucaccu

SEQ ID NO: 1130007 - RNA, 13 nt, Homo sapiens
ucucuucuauccu

SEQ ID NO: 1130008 - RNA, 21 nt, Homo sapiens
ucugcauccuuuucaaaaccu

SEQ ID NO: 1130009 - RNA, 14 nt, Homo sapiens
ucugcccuguauau

SEQ ID NO: 1130010 - RNA, 22 nt, Homo sapiens
ucugcggaaaaacaaacaugaa

SEQ ID NO: 1130011 - RNA, 19 nt, Homo sapiens
ucuggcaaugggacucuga

SEQ ID NO: 1130012 - RNA, 20 nt, Homo sapiens
ucuguccuggaggcacuggg

SEQ ID NO: 1130013 - RNA, 18 nt, Homo sapiens
ucuguugcuuauugggag

SEQ ID NO: 1130014 - RNA, 13 nt, Homo sapiens
ucuucauucagug

SEQ ID NO: 1130015 - RNA, 19 nt, Homo sapiens
ucuuccagggccucuggga

SEQ ID NO: 1130016 - RNA, 20 nt, Homo sapiens
ucuuccagggccucugggag

SEQ ID NO: 1130017 - RNA, 20 nt, Homo sapiens
ucuugcccuaggauacccag

SEQ ID NO: 1130018 - RNA, 16 nt, Homo sapiens
ugaaaaaaacaaccua

SEQ ID NO: 1130019 - RNA, 21 nt, Homo sapiens
ugaaaagcuagaauugagugu

SEQ ID NO: 1130020 - RNA, 17 nt, Homo sapiens
ugaaacacacauggaca

SEQ ID NO: 1130021 - RNA, 20 nt, Homo sapiens
ugaaagaggggugggaucca

SEQ ID NO: 1130022 - RNA, 20 nt, Homo sapiens
ugaaaucuuugcagcaauga

SEQ ID NO: 1130023 - RNA, 14 nt, Homo sapiens
ugaacuaguuuuac

SEQ ID NO: 1130024 - RNA, 20 nt, Homo sapiens
ugaacugagccaaacacacu

SEQ ID NO: 1130025 - RNA, 17 nt, Homo sapiens
ugaacuguggugccaca

SEQ ID NO: 1130026 - RNA, 19 nt, Homo sapiens
ugaagcacugagcagaagc

SEQ ID NO: 1130027 - RNA, 20 nt, Homo sapiens
ugaagccccuuguccucucc

SEQ ID NO: 1130028 - RNA, 16 nt, Homo sapiens
ugaaguccuccagaca

SEQ ID NO: 1130029 - RNA, 17 nt, Homo sapiens
ugaaguccuccagacaa

SEQ ID NO: 1130030 - RNA, 15 nt, Homo sapiens
ugaaugacaugaccu

SEQ ID NO: 1130031 - RNA, 15 nt, Homo sapiens
ugaaugcaaaccaua

SEQ ID NO: 1130032 - RNA, 22 nt, Homo sapiens
ugaauguagugugucagaguaa

SEQ ID NO: 1130033 - RNA, 19 nt, Homo sapiens
ugaaugugccuaauggaga

SEQ ID NO: 1130034 - RNA, 16 nt, Homo sapiens
ugaauuuugaaccaug

SEQ ID NO: 1130035 - RNA, 15 nt, Homo sapiens
ugacacaggggacac

SEQ ID NO: 1130036 - RNA, 18 nt, Homo sapiens
ugacagugcccagcauga

SEQ ID NO: 1130037 - RNA, 21 nt, Homo sapiens
ugacaugugcuggacacuguc

SEQ ID NO: 1130038 - RNA, 18 nt, Homo sapiens
ugacauuaagacacaccu

SEQ ID NO: 1130039 - RNA, 16 nt, Homo sapiens
ugaccgaguaccugcu

SEQ ID NO: 1130040 - RNA, 16 nt, Homo sapiens
ugacggacguccugcu

SEQ ID NO: 1130041 - RNA, 12 nt, Homo sapiens
ugacuaccagcu

SEQ ID NO: 1130042 - RNA, 20 nt, Homo sapiens
ugacuucauagauuaugcuu

SEQ ID NO: 1130043 - RNA, 18 nt, Homo sapiens
ugagaacuccucauuccc

SEQ ID NO: 1130044 - RNA, 19 nt, Homo sapiens
ugaggagagaaggacaugu

SEQ ID NO: 1130045 - RNA, 22 nt, Homo sapiens
ugaggcaaauggcacauggcug

SEQ ID NO: 1130046 - RNA, 22 nt, Homo sapiens
ugagggaucugucucacuggca

SEQ ID NO: 1130047 - RNA, 20 nt, Homo sapiens
ugaguauuccaccacaggaa

SEQ ID NO: 1130048 - RNA, 20 nt, Homo sapiens
ugagucugaguccugucucu

SEQ ID NO: 1130049 - RNA, 14 nt, Homo sapiens
ugauaaaguauuau

SEQ ID NO: 1130050 - RNA, 21 nt, Homo sapiens
ugauauugggcucuucaggaa

SEQ ID NO: 1130051 - RNA, 20 nt, Homo sapiens
ugaugaacuguggugccaca

SEQ ID NO: 1130052 - RNA, 17 nt, Homo sapiens
ugcaagaguggacugaa

SEQ ID NO: 1130053 - RNA, 18 nt, Homo sapiens
ugcaagaguggacugaau

SEQ ID NO: 1130054 - RNA, 16 nt, Homo sapiens
ugcaagucacauaaaa

SEQ ID NO: 1130055 - RNA, 21 nt, Homo sapiens
ugcagacacaucagcuguuaa

SEQ ID NO: 1130056 - RNA, 20 nt, Homo sapiens
ugcauccuuuucaaaaccua

SEQ ID NO: 1130057 - RNA, 21 nt, Homo sapiens
ugccccucgcucgguccggcu

SEQ ID NO: 1130058 - RNA, 22 nt, Homo sapiens
ugcccguaaaaccugagccauu

SEQ ID NO: 1130059 - RNA, 14 nt, Homo sapiens
ugccgugacagggc

SEQ ID NO: 1130060 - RNA, 21 nt, Homo sapiens
ugccugcccuuucucccaaaa

SEQ ID NO: 1130061 - RNA, 13 nt, Homo sapiens
ugcgcguccugcc

SEQ ID NO: 1130062 - RNA, 15 nt, Homo sapiens
ugcuauugaacugag

SEQ ID NO: 1130063 - RNA, 23 nt, Homo sapiens
ugcugugcccucccauagcacug

SEQ ID NO: 1130064 - RNA, 16 nt, Homo sapiens
ugcuuauguaugccua

SEQ ID NO: 1130065 - RNA, 17 nt, Homo sapiens
ugcuucugcucacauuc

SEQ ID NO: 1130066 - RNA, 17 nt, Homo sapiens
uggaauccuacagccuc

SEQ ID NO: 1130067 - RNA, 14 nt, Homo sapiens
uggaaugaaugaca

SEQ ID NO: 1130068 - RNA, 21 nt, Homo sapiens
uggacaugugucccagccaca

SEQ ID NO: 1130069 - RNA, 21 nt, Homo sapiens
uggagcccagcauucaggggu

SEQ ID NO: 1130070 - RNA, 12 nt, Homo sapiens
cugugugcugac

SEQ ID NO: 1130071 - RNA, 18 nt, Homo sapiens
cuguuacugauguucaau

SEQ ID NO: 1130072 - RNA, 17 nt, Homo sapiens
cuguuuauuugcacuau

SEQ ID NO: 1130073 - RNA, 17 nt, Homo sapiens
cuguuucuaacucaggg

SEQ ID NO: 1130074 - RNA, 16 nt, Homo sapiens
cuuaaaccacagcacu

SEQ ID NO: 1130075 - RNA, 16 nt, Homo sapiens
cuuagccccagacucu

SEQ ID NO: 1130076 - RNA, 17 nt, Homo sapiens
cuuaggugugaggucca

SEQ ID NO: 1130077 - RNA, 18 nt, Homo sapiens
cuuauguaugccuauuca

SEQ ID NO: 1130078 - RNA, 17 nt, Homo sapiens
cuuauuaugugcaacau

SEQ ID NO: 1130079 - RNA, 20 nt, Homo sapiens
cuucauagauuaugcuuuaa

SEQ ID NO: 1130080 - RNA, 16 nt, Homo sapiens
cuucccaccucagugc

SEQ ID NO: 1130081 - RNA, 21 nt, Homo sapiens
cuuccccagguccuuccuuua

SEQ ID NO: 1130082 - RNA, 19 nt, Homo sapiens
cuucugcucacauucccuc

SEQ ID NO: 1130083 - RNA, 23 nt, Homo sapiens
cuugacuguaaagagaaguaauu

SEQ ID NO: 1130084 - RNA, 20 nt, Homo sapiens
cuugagacaaaucuaugcca

SEQ ID NO: 1130085 - RNA, 23 nt, Homo sapiens
cuugcugauuuucagacagggaa

SEQ ID NO: 1130086 - RNA, 15 nt, Homo sapiens
cuuggaccguaucac

SEQ ID NO: 1130087 - RNA, 20 nt, Homo sapiens
cuugguuacuuaagaggcag

SEQ ID NO: 1130088 - RNA, 18 nt, Homo sapiens
cuuguguccccaccucag

SEQ ID NO: 1130089 - RNA, 21 nt, Homo sapiens
cuuuccuggacuuaacucuaa

SEQ ID NO: 1130090 - RNA, 14 nt, Homo sapiens
gcuggcacugagca

SEQ ID NO: 1130091 - RNA, 20 nt, Homo sapiens
gcuggguguguuucaggaca

SEQ ID NO: 1130092 - RNA, 11 nt, Homo sapiens
gcugugcugag

SEQ ID NO: 1130093 - RNA, 17 nt, Homo sapiens
gcuguuugauagcagaa

SEQ ID NO: 1130094 - RNA, 15 nt, Homo sapiens
gcuuaccaaguccug

SEQ ID NO: 1130095 - RNA, 21 nt, Homo sapiens
gcuuaugacagagguuuugaa

SEQ ID NO: 1130096 - RNA, 18 nt, Homo sapiens
gcuugggcuccauuccca

SEQ ID NO: 1130097 - RNA, 21 nt, Homo sapiens
gcuuugucacuuuuccuuuuc

SEQ ID NO: 1130098 - RNA, 15 nt, Homo sapiens
gcuuuugguaauauu

SEQ ID NO: 1130099 - RNA, 14 nt, Homo sapiens
ggaaacacagcuga

SEQ ID NO: 1130100 - RNA, 16 nt, Homo sapiens
ggaaagcacaccucau

SEQ ID NO: 1130101 - RNA, 20 nt, Homo sapiens
ggaagggucuuaacacuuac

SEQ ID NO: 1130102 - RNA, 21 nt, Homo sapiens
ggacaaaguguagcagccucc

SEQ ID NO: 1130103 - RNA, 19 nt, Homo sapiens
ggacacuguccaugaagca

SEQ ID NO: 1130104 - RNA, 17 nt, Homo sapiens
ggacugaaugugccuaa

SEQ ID NO: 1130105 - RNA, 23 nt, Homo sapiens
ggacuggcuucucuuucucugag

SEQ ID NO: 1130106 - RNA, 13 nt, Homo sapiens
ggagacauaucac

SEQ ID NO: 1130107 - RNA, 20 nt, Homo sapiens
ggagagaggcucagccacac

SEQ ID NO: 1130108 - RNA, 18 nt, Homo sapiens
ggagccuccugacccugu

SEQ ID NO: 1130109 - RNA, 16 nt, Homo sapiens
ggaggauggcacuccg

SEQ ID NO: 1130110 - RNA, 18 nt, Homo sapiens
ggagguccugcuacccag

SEQ ID NO: 1130111 - RNA, 19 nt, Homo sapiens
ggagguggagguugcagug

SEQ ID NO: 1130112 - RNA, 20 nt, Homo sapiens
ggagguggagguugcaguga

SEQ ID NO: 1130113 - RNA, 13 nt, Homo sapiens
ggauggagcacuu

SEQ ID NO: 1130114 - RNA, 21 nt, Homo sapiens
ggauggagcugaaaacauaac

SEQ ID NO: 1130115 - RNA, 20 nt, Homo sapiens
ggauuguuguuuaacuugua

SEQ ID NO: 1130116 - RNA, 16 nt, Homo sapiens
ggcaacccucacugug

SEQ ID NO: 1130117 - RNA, 19 nt, Homo sapiens
ggcaacccucacuguguug

SEQ ID NO: 1130118 - RNA, 18 nt, Homo sapiens
ggcagaaaacacagccug

SEQ ID NO: 1130119 - RNA, 22 nt, Homo sapiens
ggcagaaaacacagccugugua

SEQ ID NO: 1130120 - RNA, 20 nt, Homo sapiens
ggccacucuguugguggccu

SEQ ID NO: 1130121 - RNA, 23 nt, Homo sapiens
ggccaugccuggagacauaucac

SEQ ID NO: 1130122 - RNA, 21 nt, Homo sapiens
ggcuauaccugggcauacuaa

SEQ ID NO: 1130123 - RNA, 21 nt, Homo sapiens
ggcuccauucccaucacugcu

SEQ ID NO: 1130124 - RNA, 13 nt, Homo sapiens
ggcugcugacuca

SEQ ID NO: 1130125 - RNA, 14 nt, Homo sapiens
ggcuucucuuucuc

SEQ ID NO: 1130126 - RNA, 20 nt, Homo sapiens
gggagccuaaggaagcgugg

SEQ ID NO: 1130127 - RNA, 20 nt, Homo sapiens
gggagguggagguugcagug

SEQ ID NO: 1130128 - RNA, 13 nt, Homo sapiens
gggccagugcugg

SEQ ID NO: 1130129 - RNA, 17 nt, Homo sapiens
ggggucuguguggugcc

SEQ ID NO: 1130130 - RNA, 19 nt, Homo sapiens
gggugggauccacacugag

SEQ ID NO: 1130131 - RNA, 18 nt, Homo sapiens
ggucacuaaccaagccag

SEQ ID NO: 1130132 - RNA, 23 nt, Homo sapiens
ggucaucgugacagcagcagcuc

SEQ ID NO: 1130133 - RNA, 16 nt, Homo sapiens
gguccagacccacucc

SEQ ID NO: 1130134 - RNA, 14 nt, Homo sapiens
gguccuucauucuu

SEQ ID NO: 1130135 - RNA, 18 nt, Homo sapiens
gguguaauuuuguccucu

SEQ ID NO: 1130136 - RNA, 18 nt, Homo sapiens
gguguauugaaguccucc

SEQ ID NO: 1130137 - RNA, 13 nt, Homo sapiens
guaaaaauccacu

SEQ ID NO: 1130138 - RNA, 17 nt, Homo sapiens
guaaaaauccacuauuu

SEQ ID NO: 1130139 - RNA, 14 nt, Homo sapiens
guaaaagcaaaaaa

SEQ ID NO: 1130140 - RNA, 17 nt, Homo sapiens
guaacaugccagcuucc

SEQ ID NO: 1130141 - RNA, 12 nt, Homo sapiens
guacaagcauuu

SEQ ID NO: 1130142 - RNA, 19 nt, Homo sapiens
guagaacucacagaaauaa

SEQ ID NO: 1130143 - RNA, 14 nt, Homo sapiens
guauauaauacuaa

SEQ ID NO: 1130144 - RNA, 23 nt, Homo sapiens
guauauaauacuaaagugucuau

SEQ ID NO: 1130145 - RNA, 22 nt, Homo sapiens
guaugugaaacacacauggaca

SEQ ID NO: 1130146 - RNA, 21 nt, Homo sapiens
guauuuauuuuuucaaaaaca

SEQ ID NO: 1130147 - RNA, 22 nt, Homo sapiens
guauuuuccaacuuguucaaau

SEQ ID NO: 1130148 - RNA, 14 nt, Homo sapiens
gucacagccaugaa

SEQ ID NO: 1130149 - RNA, 22 nt, Homo sapiens
gucacccgagcuagagugcagu

SEQ ID NO: 1130150 - RNA, 22 nt, Homo sapiens
gucacucaccacuacaucacuu

SEQ ID NO: 1130151 - RNA, 23 nt, Homo sapiens
gucagggagccuggaagccaaac

SEQ ID NO: 1130152 - RNA, 16 nt, Homo sapiens
gucccaagcccaggga

SEQ ID NO: 1130153 - RNA, 19 nt, Homo sapiens
gucccacucccacagagga

SEQ ID NO: 1130154 - RNA, 13 nt, Homo sapiens
guccccaccucag

SEQ ID NO: 1130155 - RNA, 15 nt, Homo sapiens
guccucucugugucc

SEQ ID NO: 1130156 - RNA, 14 nt, Homo sapiens
guccugcuacccag

SEQ ID NO: 1130157 - RNA, 16 nt, Homo sapiens
guccugcuacccagua

SEQ ID NO: 1130158 - RNA, 15 nt, Homo sapiens
guccugcuggcaccu

SEQ ID NO: 1130159 - RNA, 23 nt, Homo sapiens
guccuuuccuucucgucuuccuc

SEQ ID NO: 1130160 - RNA, 19 nt, Homo sapiens
gucguucccuugugucugu

SEQ ID NO: 1130161 - RNA, 17 nt, Homo sapiens
gugacaugugcuggaca

SEQ ID NO: 1130162 - RNA, 23 nt, Homo sapiens
gugauccuucaucgaacaaacug

SEQ ID NO: 1130163 - RNA, 15 nt, Homo sapiens
gugaugccugacaca

SEQ ID NO: 1130164 - RNA, 19 nt, Homo sapiens
gugauuugggggugcaaug

SEQ ID NO: 1130165 - RNA, 17 nt, Homo sapiens
gugcagucuuggcucac

SEQ ID NO: 1130166 - RNA, 20 nt, Homo sapiens
gugcugggauuacaggugua

SEQ ID NO: 1130167 - RNA, 17 nt, Homo sapiens
guggggcucaaaaccuc

SEQ ID NO: 1130168 - RNA, 20 nt, Homo sapiens
guggugcccaugaggacaaa

SEQ ID NO: 1130169 - RNA, 17 nt, Homo sapiens
guguauugaaguccucc

SEQ ID NO: 1130170 - RNA, 11 nt, Homo sapiens
guguggcugcu

SEQ ID NO: 1130171 - RNA, 18 nt, Homo sapiens
guguguuuggaagacuau

SEQ ID NO: 1130172 - RNA, 13 nt, Homo sapiens
guguuaggcacag

SEQ ID NO: 1130173 - RNA, 14 nt, Homo sapiens
guguucaguguuga

SEQ ID NO: 1130174 - RNA, 16 nt, Homo sapiens
guuacacagcccaaga

SEQ ID NO: 1130175 - RNA, 18 nt, Homo sapiens
guucucuuugguguuaca

SEQ ID NO: 1130176 - RNA, 23 nt, Homo sapiens
guugcagucucagaaagccuucc

SEQ ID NO: 1130177 - RNA, 13 nt, Homo sapiens
guuguuguuguug

SEQ ID NO: 1130178 - RNA, 16 nt, Homo sapiens
guuucuaacucagggg

SEQ ID NO: 1130179 - RNA, 16 nt, Homo sapiens
uaaaaauccacuauuu

SEQ ID NO: 1130180 - RNA, 18 nt, Homo sapiens
uaaaacaaagccaugcca

SEQ ID NO: 1130181 - RNA, 15 nt, Homo sapiens
uaaaaccugagccau

SEQ ID NO: 1130182 - RNA, 23 nt, Homo sapiens
uaaaaugaccaguaauugugaaa

SEQ ID NO: 1130183 - RNA, 16 nt, Homo sapiens
uaaaaugauggaacca

SEQ ID NO: 1130184 - RNA, 17 nt, Homo sapiens
uaaacaauaaaugggcc

SEQ ID NO: 1130185 - RNA, 15 nt, Homo sapiens
uaaaccacagcacua

SEQ ID NO: 1130186 - RNA, 19 nt, Homo sapiens
uaaacuauaaacuacugua

SEQ ID NO: 1130187 - RNA, 18 nt, Homo sapiens
uaaaguaugguauugaaa

SEQ ID NO: 1130188 - RNA, 15 nt, Homo sapiens
uaagacacaccucug

SEQ ID NO: 1130189 - RNA, 14 nt, Homo sapiens
uaagaggcagugag

SEQ ID NO: 1130190 - RNA, 17 nt, Homo sapiens
uaaguguucaguguuga

SEQ ID NO: 1130191 - RNA, 20 nt, Homo sapiens
uaauccucacaccuacugua

SEQ ID NO: 1130192 - RNA, 23 nt, Homo sapiens
aggacgccacucauuucaucuca

SEQ ID NO: 1130193 - RNA, 21 nt, Homo sapiens
aggagacuuaggaaccuacca

SEQ ID NO: 1130194 - RNA, 23 nt, Homo sapiens
aggagagaggcucagccacacag

SEQ ID NO: 1130195 - RNA, 14 nt, Homo sapiens
aggauggagcugaa

SEQ ID NO: 1130196 - RNA, 14 nt, Homo sapiens
aggcaaauggcaca

SEQ ID NO: 1130197 - RNA, 18 nt, Homo sapiens
aggcaagauaaaccaaug

SEQ ID NO: 1130198 - RNA, 14 nt, Homo sapiens
aggcaagccacaga

SEQ ID NO: 1130199 - RNA, 22 nt, Homo sapiens
aggcacaacgcaccagacacuc

SEQ ID NO: 1130200 - RNA, 20 nt, Homo sapiens
aggcagcagaaaucauuuuc

SEQ ID NO: 1130201 - RNA, 14 nt, Homo sapiens
aggcagugagaugu

SEQ ID NO: 1130202 - RNA, 21 nt, Homo sapiens
aggcagugauuugccaaagug

SEQ ID NO: 1130203 - RNA, 19 nt, Homo sapiens
aggcuaucuggccugagac

SEQ ID NO: 1130204 - RNA, 18 nt, Homo sapiens
aggcuggagcccagcauu

SEQ ID NO: 1130205 - RNA, 14 nt, Homo sapiens
aggcugugagccaa

SEQ ID NO: 1130206 - RNA, 21 nt, Homo sapiens
aggcugugagccaaggaggga

SEQ ID NO: 1130207 - RNA, 13 nt, Homo sapiens
agggagccuggaa

SEQ ID NO: 1130208 - RNA, 18 nt, Homo sapiens
agggauggggagcagcug

SEQ ID NO: 1130209 - RNA, 22 nt, Homo sapiens
agggucacuaaccaagccagaa

SEQ ID NO: 1130210 - RNA, 19 nt, Homo sapiens
aggguugccaguccugcaa

SEQ ID NO: 1130211 - RNA, 19 nt, Homo sapiens
agguagcaucauugaucuu

SEQ ID NO: 1130212 - RNA, 12 nt, Homo sapiens
agguccugcuac

SEQ ID NO: 1130213 - RNA, 13 nt, Homo sapiens
agguguagaccag

SEQ ID NO: 1130214 - RNA, 16 nt, Homo sapiens
agguguauugaagucc

SEQ ID NO: 1130215 - RNA, 15 nt, Homo sapiens
agguucaaaagcaau

SEQ ID NO: 1130216 - RNA, 23 nt, Homo sapiens
aguaauguugacuguauuuucca

SEQ ID NO: 1130217 - RNA, 22 nt, Homo sapiens
agugacaugugcuggacacugu

SEQ ID NO: 1130218 - RNA, 14 nt, Homo sapiens
agugcaguggugca

SEQ ID NO: 1130219 - RNA, 16 nt, Homo sapiens
agugcugaacuggcug

SEQ ID NO: 1130220 - RNA, 15 nt, Homo sapiens
aguggagucgacuca

SEQ ID NO: 1130221 - RNA, 18 nt, Homo sapiens
aguggcaucuucuuugca

SEQ ID NO: 1130222 - RNA, 20 nt, Homo sapiens
aguggugcagucuuggcuca

SEQ ID NO: 1130223 - RNA, 15 nt, Homo sapiens
aguguugacauagcc

SEQ ID NO: 1130224 - RNA, 14 nt, Homo sapiens
aguucuacugaccu

SEQ ID NO: 1130225 - RNA, 13 nt, Homo sapiens
aguugcagucuca

SEQ ID NO: 1130226 - RNA, 12 nt, Homo sapiens
aguugcuccuac

SEQ ID NO: 1130227 - RNA, 14 nt, Homo sapiens
auaaaauaugagga

SEQ ID NO: 1130228 - RNA, 21 nt, Homo sapiens
auaaaggucuaguauccaaaa

SEQ ID NO: 1130229 - RNA, 21 nt, Homo sapiens
auaaaguaugguauugaaacu

SEQ ID NO: 1130230 - RNA, 21 nt, Homo sapiens
auaauaaaucugccugcaacu

SEQ ID NO: 1130231 - RNA, 21 nt, Homo sapiens
auaaucacucauucuaugaac

SEQ ID NO: 1130232 - RNA, 14 nt, Homo sapiens
auaccauguauaau

SEQ ID NO: 1130233 - RNA, 20 nt, Homo sapiens
auacuggccaugccuggaga

SEQ ID NO: 1130234 - RNA, 16 nt, Homo sapiens
auagaagugauugaau

SEQ ID NO: 1130235 - RNA, 20 nt, Homo sapiens
auagauccuauuacuguuuc

SEQ ID NO: 1130236 - RNA, 17 nt, Homo sapiens
auauacuaauauguaau

SEQ ID NO: 1130237 - RNA, 15 nt, Homo sapiens
aucaaagacagcauc

SEQ ID NO: 1130238 - RNA, 22 nt, Homo sapiens
aucaccaaaugcuuuuugaucu

SEQ ID NO: 1130239 - RNA, 17 nt, Homo sapiens
aucacucauucuaugaa

SEQ ID NO: 1130240 - RNA, 15 nt, Homo sapiens
aucaguggcugccuu

SEQ ID NO: 1130241 - RNA, 14 nt, Homo sapiens
auccacacugagag

SEQ ID NO: 1130242 - RNA, 15 nt, Homo sapiens
auccacuauuuccau

SEQ ID NO: 1130243 - RNA, 17 nt, Homo sapiens
auccaugaaacauuaca

SEQ ID NO: 1130244 - RNA, 15 nt, Homo sapiens
auccucacaccuacu

SEQ ID NO: 1130245 - RNA, 13 nt, Homo sapiens
auccugugugcug

SEQ ID NO: 1130246 - RNA, 20 nt, Homo sapiens
aucgauccuggauucacuca

SEQ ID NO: 1130247 - RNA, 15 nt, Homo sapiens
aucgaugacgggcug

SEQ ID NO: 1130248 - RNA, 19 nt, Homo sapiens
aucucacacaccagggcau

SEQ ID NO: 1130249 - RNA, 14 nt, Homo sapiens
aucucauggcuuug

SEQ ID NO: 1130250 - RNA, 13 nt, Homo sapiens
aucuccacuguug

SEQ ID NO: 1130251 - RNA, 19 nt, Homo sapiens
aucuuuggauguggcuuuu

SEQ ID NO: 1130252 - RNA, 19 nt, Homo sapiens
augaaacuuuccuuuguca

SEQ ID NO: 1130253 - RNA, 15 nt, Homo sapiens
augaagcacugagca

SEQ ID NO: 1130254 - RNA, 19 nt, Homo sapiens
augaccaggccaagacuca

SEQ ID NO: 1130255 - RNA, 18 nt, Homo sapiens
augaccaguaauugugaa

SEQ ID NO: 1130256 - RNA, 12 nt, Homo sapiens
augcaacauuug

SEQ ID NO: 1130257 - RNA, 15 nt, Homo sapiens
augcuuuuugaucug

SEQ ID NO: 1130258 - RNA, 16 nt, Homo sapiens
augggacucugagaac

SEQ ID NO: 1130259 - RNA, 17 nt, Homo sapiens
auggucaucgugacagc

SEQ ID NO: 1130260 - RNA, 21 nt, Homo sapiens
augguuuucuccaagagcuac

SEQ ID NO: 1130261 - RNA, 20 nt, Homo sapiens
augucauuuugguacuuugg

SEQ ID NO: 1130262 - RNA, 19 nt, Homo sapiens
augucccagccccugguac

SEQ ID NO: 1130263 - RNA, 13 nt, Homo sapiens
augugaaacacac

SEQ ID NO: 1130264 - RNA, 20 nt, Homo sapiens
augugucccagccacagugu

SEQ ID NO: 1130265 - RNA, 20 nt, Homo sapiens
auguuccuuucgaaagcaau

SEQ ID NO: 1130266 - RNA, 20 nt, Homo sapiens
auuaccuagaagugcaagaa

SEQ ID NO: 1130267 - RNA, 21 nt, Homo sapiens
auuagagagggcuaaacaagg

SEQ ID NO: 1130268 - RNA, 14 nt, Homo sapiens
auucaaagcagggu

SEQ ID NO: 1130269 - RNA, 17 nt, Homo sapiens
auucagaauaaaugggu

SEQ ID NO: 1130270 - RNA, 21 nt, Homo sapiens
auucaggcaugcgaaugagcu

SEQ ID NO: 1130271 - RNA, 15 nt, Homo sapiens
auucccucucaucca

SEQ ID NO: 1130272 - RNA, 13 nt, Homo sapiens
auucuagagucuc

SEQ ID NO: 1130273 - RNA, 15 nt, Homo sapiens
auucugucacucacc

SEQ ID NO: 1130274 - RNA, 22 nt, Homo sapiens
auucugucacucaccacuacau

SEQ ID NO: 1130275 - RNA, 16 nt, Homo sapiens
auucuuuagcuguacu

SEQ ID NO: 1130276 - RNA, 19 nt, Homo sapiens
auugaaguccuccagacaa

SEQ ID NO: 1130277 - RNA, 23 nt, Homo sapiens
auugaucuuuggauguggcuuuu

SEQ ID NO: 1130278 - RNA, 20 nt, Homo sapiens
auugcacuccagccuaggca

SEQ ID NO: 1130279 - RNA, 14 nt, Homo sapiens
auuuaaacaacagc

SEQ ID NO: 1130280 - RNA, 15 nt, Homo sapiens
auuuaaacaacagcu

SEQ ID NO: 1130281 - RNA, 14 nt, Homo sapiens
auuucacugaagau

SEQ ID NO: 1130282 - RNA, 20 nt, Homo sapiens
auuuccuaguagaacucaca

SEQ ID NO: 1130283 - RNA, 21 nt, Homo sapiens
auuuguggucacagccaugaa

SEQ ID NO: 1130284 - RNA, 16 nt, Homo sapiens
auuuucacucugggcu

SEQ ID NO: 1130285 - RNA, 20 nt, Homo sapiens
auuuuccuuaggaaaaacau

SEQ ID NO: 1130286 - RNA, 11 nt, Homo sapiens
caaaaccucca

SEQ ID NO: 1130287 - RNA, 13 nt, Homo sapiens
caaaagcaugaaa

SEQ ID NO: 1130288 - RNA, 16 nt, Homo sapiens
caaacacacuguaaau

SEQ ID NO: 1130289 - RNA, 13 nt, Homo sapiens
caaagacagcauc

SEQ ID NO: 1130290 - RNA, 18 nt, Homo sapiens
caaauaaaacaaaaccaa

SEQ ID NO: 1130291 - RNA, 19 nt, Homo sapiens
caaaucaauaaauucccaa

SEQ ID NO: 1130292 - RNA, 19 nt, Homo sapiens
caaaugcuuuuugaucugu

SEQ ID NO: 1130293 - RNA, 15 nt, Homo sapiens
caaccuacuuucaua

SEQ ID NO: 1130294 - RNA, 20 nt, Homo sapiens
caacuccugguucagccauu

SEQ ID NO: 1130295 - RNA, 14 nt, Homo sapiens
caacucugcuccca

SEQ ID NO: 1130296 - RNA, 22 nt, Homo sapiens
caagaggacugagacuggcacu

SEQ ID NO: 1130297 - RNA, 21 nt, Homo sapiens
caagaucgugccauugcacuc

SEQ ID NO: 1130298 - RNA, 20 nt, Homo sapiens
cacaacgcaccagacacuca

SEQ ID NO: 1130299 - RNA, 20 nt, Homo sapiens
cacacagggugcaugugagg

SEQ ID NO: 1130300 - RNA, 18 nt, Homo sapiens
cacagaaacuauaugcaa

SEQ ID NO: 1130301 - RNA, 13 nt, Homo sapiens
cacagcccaagag

SEQ ID NO: 1130302 - RNA, 23 nt, Homo sapiens
cacauaaaaaugcaacgcuguaa

SEQ ID NO: 1130303 - RNA, 15 nt, Homo sapiens
caccucagugcccac

SEQ ID NO: 1130304 - RNA, 13 nt, Homo sapiens
caccucuggaucc

SEQ ID NO: 1130305 - RNA, 22 nt, Homo sapiens
cacggagcugaagcugggagcu

SEQ ID NO: 1130306 - RNA, 19 nt, Homo sapiens
cacuauggggggaggugua

SEQ ID NO: 1130307 - RNA, 12 nt, Homo sapiens
cacucauuccuu

SEQ ID NO: 1130308 - RNA, 16 nt, Homo sapiens
cacucauuucaucuca

SEQ ID NO: 1130309 - RNA, 18 nt, Homo sapiens
cacugcaagucacauaaa

SEQ ID NO: 1130310 - RNA, 18 nt, Homo sapiens
cacuguaaauauccacag

SEQ ID NO: 1130311 - RNA, 22 nt, Homo sapiens
cacuguccaugaagcacugagc

SEQ ID NO: 1130312 - RNA, 20 nt, Homo sapiens
cagaagaaaaaguugcaguc

SEQ ID NO: 1130313 - RNA, 18 nt, Homo sapiens
cagaauaaauggguaaca

SEQ ID NO: 1130314 - RNA, 14 nt, Homo sapiens
cagacaauccacuc

SEQ ID NO: 1130315 - RNA, 21 nt, Homo sapiens
cagacaccuccuucuuccuag

SEQ ID NO: 1130316 - RNA, 12 nt, Homo sapiens
cagagcaauggu

SEQ ID NO: 1130317 - RNA, 20 nt, Homo sapiens
cagagguggcugcugugcua

SEQ ID NO: 1130318 - RNA, 13 nt, Homo sapiens
cagaguggagucu

SEQ ID NO: 1130319 - RNA, 17 nt, Homo sapiens
cagauaaaccugugacu

SEQ ID NO: 1130320 - RNA, 21 nt, Homo sapiens
cagaucgcuuuacuccaggaa

SEQ ID NO: 1130321 - RNA, 12 nt, Homo sapiens
cagcagacacag

SEQ ID NO: 1130322 - RNA, 19 nt, Homo sapiens
cagcaucuaagaaguuuug

SEQ ID NO: 1130323 - RNA, 19 nt, Homo sapiens
cagcuaacuccagucuccu

SEQ ID NO: 1130324 - RNA, 17 nt, Homo sapiens
cagcugcuucugugcau

SEQ ID NO: 1130325 - RNA, 22 nt, Homo sapiens
caggaaggggaaacacagcuga

SEQ ID NO: 1130326 - RNA, 22 nt, Homo sapiens
caggauggaauccuacagccuc

SEQ ID NO: 1130327 - RNA, 17 nt, Homo sapiens
caggcacuauaauuucu

SEQ ID NO: 1130328 - RNA, 14 nt, Homo sapiens
caggcucggagcca

SEQ ID NO: 1130329 - RNA, 16 nt, Homo sapiens
cagggcagaaaacaca

SEQ ID NO: 1130330 - RNA, 13 nt, Homo sapiens
cagggcagggaaa

SEQ ID NO: 1130331 - RNA, 18 nt, Homo sapiens
cagggccucugggagccu

SEQ ID NO: 1130332 - RNA, 21 nt, Homo sapiens
cagggccuggccugguccagg

SEQ ID NO: 1130333 - RNA, 19 nt, Homo sapiens
cagggucuaccucugucac

SEQ ID NO: 1130334 - RNA, 16 nt, Homo sapiens
caguaaaaauccacua

SEQ ID NO: 1130335 - RNA, 14 nt, Homo sapiens
cagucaauuuucac

SEQ ID NO: 1130336 - RNA, 19 nt, Homo sapiens
cagucuacugacuuuuccc

SEQ ID NO: 1130337 - RNA, 20 nt, Homo sapiens
cagugagccaagaucgugcc

SEQ ID NO: 1130338 - RNA, 18 nt, Homo sapiens
cagugauuugccaaagug

SEQ ID NO: 1130339 - RNA, 19 nt, Homo sapiens
cagugauuugccaaaguga

SEQ ID NO: 1130340 - RNA, 17 nt, Homo sapiens
caguguugacauagccu

SEQ ID NO: 1130341 - RNA, 18 nt, Homo sapiens
caguguugacauagccuu

SEQ ID NO: 1130342 - RNA, 15 nt, Homo sapiens
cauacuuucccacag

SEQ ID NO: 1130343 - RNA, 19 nt, Homo sapiens
caucagcuguuaaccauuu

SEQ ID NO: 1130344 - RNA, 21 nt, Homo sapiens
caucauucauuuuuguuguug

SEQ ID NO: 1130345 - RNA, 18 nt, Homo sapiens
caucauugaucuuuggau

SEQ ID NO: 1130346 - RNA, 21 nt, Homo sapiens
cauccuaagugggaagugaag

SEQ ID NO: 1130347 - RNA, 14 nt, Homo sapiens
cauccugugugcug

SEQ ID NO: 1130348 - RNA, 18 nt, Homo sapiens
cauccuuuucaaaaccua

SEQ ID NO: 1130349 - RNA, 20 nt, Homo sapiens
cauccuuuucaaaaccuaaa

SEQ ID NO: 1130350 - RNA, 23 nt, Homo sapiens
caucuaagaaguuuuguucuguc

SEQ ID NO: 1130351 - RNA, 14 nt, Homo sapiens
caugagcaucccca

SEQ ID NO: 1130352 - RNA, 22 nt, Homo sapiens
cauggcacucuucccaccucag

SEQ ID NO: 1130353 - RNA, 20 nt, Homo sapiens
caugggauggggaugaagua

SEQ ID NO: 1130354 - RNA, 23 nt, Homo sapiens
cauguauaauuuucuacaaccua

SEQ ID NO: 1130355 - RNA, 14 nt, Homo sapiens
caugugacuguauu

SEQ ID NO: 1130356 - RNA, 13 nt, Homo sapiens
cauucuacacuga

SEQ ID NO: 1130357 - RNA, 20 nt, Homo sapiens
cauugauucuucagaacuuu

SEQ ID NO: 1130358 - RNA, 17 nt, Homo sapiens
cauuucaagugauuugg

SEQ ID NO: 1130359 - RNA, 16 nt, Homo sapiens
cauuucuauagccaaa

SEQ ID NO: 1130360 - RNA, 20 nt, Homo sapiens
cauuuuccuuaggaaaaaca

SEQ ID NO: 1130361 - RNA, 21 nt, Homo sapiens
cauuuuccuuaggaaaaacau

SEQ ID NO: 1130362 - RNA, 21 nt, Homo sapiens
cauuuuguaaguugaagcaaa

SEQ ID NO: 1130363 - RNA, 23 nt, Homo sapiens
cauuuuguaccagggcucuguau

SEQ ID NO: 1130364 - RNA, 23 nt, Homo sapiens
ccaaaaaaaaauacaugcuaaga

SEQ ID NO: 1130365 - RNA, 14 nt, Homo sapiens
ccaaacacacugua

SEQ ID NO: 1130366 - RNA, 14 nt, Homo sapiens
ccaaaccgcaggca

SEQ ID NO: 1130367 - RNA, 21 nt, Homo sapiens
ccaaagugacacagagcaaug

SEQ ID NO: 1130368 - RNA, 15 nt, Homo sapiens
ccaaccucacugaca

SEQ ID NO: 1130369 - RNA, 19 nt, Homo sapiens
ccaacuugguuuugcuaca

SEQ ID NO: 1130370 - RNA, 10 nt, Homo sapiens
ccaagagcua

SEQ ID NO: 1130371 - RNA, 22 nt, Homo sapiens
ccaaggaccucucucaaugcca

SEQ ID NO: 1130372 - RNA, 15 nt, Homo sapiens
ccaauggcuguaaac

SEQ ID NO: 1130373 - RNA, 14 nt, Homo sapiens
ccacacagggugca

SEQ ID NO: 1130374 - RNA, 11 nt, Homo sapiens
ccacacugaga

SEQ ID NO: 1130375 - RNA, 14 nt, Homo sapiens
ccacagaggccagg

SEQ ID NO: 1130376 - RNA, 22 nt, Homo sapiens
ccacagcacuacgauguguuga

SEQ ID NO: 1130377 - RNA, 22 nt, Homo sapiens
ccacagcgauccacggagcuga

SEQ ID NO: 1130378 - RNA, 12 nt, Homo sapiens
ccaccucaggcu

SEQ ID NO: 1130379 - RNA, 13 nt, Homo sapiens
ccacuauuuccau

SEQ ID NO: 1130380 - RNA, 18 nt, Homo sapiens
ccagaaagaggcagugau

SEQ ID NO: 1130381 - RNA, 16 nt, Homo sapiens
ccagaguggagucuga

SEQ ID NO: 1130382 - RNA, 17 nt, Homo sapiens
ccagaugccaaccagac

SEQ ID NO: 1130383 - RNA, 20 nt, Homo sapiens
ccagcccuauggaagucuca

SEQ ID NO: 1130384 - RNA, 22 nt, Homo sapiens
ccaggauggcgugugugccgug

SEQ ID NO: 1130385 - RNA, 16 nt, Homo sapiens
ccaggccaagacucaa

SEQ ID NO: 1130386 - RNA, 13 nt, Homo sapiens
ccaguaaaaaucc

SEQ ID NO: 1130387 - RNA, 14 nt, Homo sapiens
ccaguucuacugac

SEQ ID NO: 1130388 - RNA, 21 nt, Homo sapiens
ccauacuuucccacagcacua

SEQ ID NO: 1130389 - RNA, 20 nt, Homo sapiens
ccaugaaacauuacaggaaa

SEQ ID NO: 1130390 - RNA, 12 nt, Homo sapiens
ccaugacugugu

SEQ ID NO: 1130391 - RNA, 12 nt, Homo sapiens
cccacagcacua

SEQ ID NO: 1130392 - RNA, 14 nt, Homo sapiens
cccaccucaggcug

SEQ ID NO: 1130393 - RNA, 17 nt, Homo sapiens
cccagaaagaggcagug

SEQ ID NO: 1130394 - RNA, 17 nt, Homo sapiens
cccagccacaacugcca

SEQ ID NO: 1130395 - RNA, 17 nt, Homo sapiens
cccagcccucaguuuuc

SEQ ID NO: 1130396 - RNA, 14 nt, Homo sapiens
cccagugaccugac

SEQ ID NO: 1130397 - RNA, 18 nt, Homo sapiens
cccaguuaauccucacac

SEQ ID NO: 1130398 - RNA, 22 nt, Homo sapiens
ccccucaauccuaucacagucu

SEQ ID NO: 1130399 - RNA, 18 nt, Homo sapiens
cccgagcuagagugcagu

SEQ ID NO: 1130400 - RNA, 15 nt, Homo sapiens
cccuaucccagagac

SEQ ID NO: 1130401 - RNA, 16 nt, Homo sapiens
cccucagauuugauga

SEQ ID NO: 1130402 - RNA, 22 nt, Homo sapiens
cccucagauuugaugauuuccu

SEQ ID NO: 1130403 - RNA, 18 nt, Homo sapiens
cccucccuggaugacauu

SEQ ID NO: 1130404 - RNA, 23 nt, Homo sapiens
cccucccuggaugacauuaaaga

SEQ ID NO: 1130405 - RNA, 18 nt, Homo sapiens
cccucuccccucauggag

SEQ ID NO: 1130406 - RNA, 21 nt, Homo sapiens
cccugccgggacccugcucac

SEQ ID NO: 1130407 - RNA, 14 nt, Homo sapiens
cccugcuuaccuga

SEQ ID NO: 1130408 - RNA, 15 nt, Homo sapiens
cccugguguguuucc

SEQ ID NO: 1130409 - RNA, 14 nt, Homo sapiens
cccuugugucuguu

SEQ ID NO: 1130410 - RNA, 15 nt, Homo sapiens
cccuuuuguacauuu

SEQ ID NO: 1130411 - RNA, 13 nt, Homo sapiens
ccgaagcccaguu

SEQ ID NO: 1130412 - RNA, 16 nt, Homo sapiens
ccgagcuagagugcag

SEQ ID NO: 1130413 - RNA, 12 nt, Homo sapiens
ccgugacagggc

SEQ ID NO: 1130414 - RNA, 14 nt, Homo sapiens
ccgugcacucccua

SEQ ID NO: 1130415 - RNA, 14 nt, Homo sapiens
ccuaagaggcagug

SEQ ID NO: 1130416 - RNA, 16 nt, Homo sapiens
ccuaagaggcagugag

SEQ ID NO: 1130417 - RNA, 23 nt, Homo sapiens
ccuaccaguuggccaugaugucu

SEQ ID NO: 1130418 - RNA, 18 nt, Homo sapiens
ccuagagaaggcugugag

SEQ ID NO: 1130419 - RNA, 11 nt, Homo sapiens
ccuaggcaaag

SEQ ID NO: 1130420 - RNA, 19 nt, Homo sapiens
ccuaguggggaggggccug

SEQ ID NO: 1130421 - RNA, 19 nt, Homo sapiens
ccuauuacuguuucuggag

SEQ ID NO: 1130422 - RNA, 16 nt, Homo sapiens
ccucaacaugguccuu

SEQ ID NO: 1130423 - RNA, 20 nt, Homo sapiens
ccucaaccccuccccuccau

SEQ ID NO: 1130424 - RNA, 14 nt, Homo sapiens
ccucacuguguugg

SEQ ID NO: 1130425 - RNA, 15 nt, Homo sapiens
ccucagaauccacaa

SEQ ID NO: 1130426 - RNA, 19 nt, Homo sapiens
ccucaggcugccaggaugg

SEQ ID NO: 1130427 - RNA, 22 nt, Homo sapiens
ccucagucuggcaaugggacuc

SEQ ID NO: 1130428 - RNA, 20 nt, Homo sapiens
ccucaguuuucagucaaguu

SEQ ID NO: 1130429 - RNA, 19 nt, Homo sapiens
ccucccuggaugacauuaa

SEQ ID NO: 1130430 - RNA, 20 nt, Homo sapiens
ccucccuggaugacauuaaa

SEQ ID NO: 1130431 - RNA, 23 nt, Homo sapiens
ccucgaacuccuggucucaagca

SEQ ID NO: 1130432 - RNA, 16 nt, Homo sapiens
gcuggagcccagcauu

SEQ ID NO: 1130433 - RNA, 13 nt, Homo sapiens
gcuggcacugagc

SEQ ID NO: 1130434 - RNA, 22 nt, Homo sapiens
gcugugcccucccauagcacug

SEQ ID NO: 1130435 - RNA, 19 nt, Homo sapiens
gcuuuaauuuucacucugg

SEQ ID NO: 1130436 - RNA, 17 nt, Homo sapiens
ggaaaaacaaacaugaa

SEQ ID NO: 1130437 - RNA, 14 nt, Homo sapiens
ggaaaagcccagug

SEQ ID NO: 1130438 - RNA, 12 nt, Homo sapiens
ggaaagccaaac

SEQ ID NO: 1130439 - RNA, 14 nt, Homo sapiens
ggaaccaaaaauca

SEQ ID NO: 1130440 - RNA, 17 nt, Homo sapiens
ggaagaaagaaugcaag

SEQ ID NO: 1130441 - RNA, 18 nt, Homo sapiens
ggaagacuugaagcacag

SEQ ID NO: 1130442 - RNA, 19 nt, Homo sapiens
ggaauacuggccaugccug

SEQ ID NO: 1130443 - RNA, 17 nt, Homo sapiens
ggacacugaaccuuguu

SEQ ID NO: 1130444 - RNA, 21 nt, Homo sapiens
ggacagcugcuucugugcauu

SEQ ID NO: 1130445 - RNA, 18 nt, Homo sapiens
ggaccuuccacacagggu

SEQ ID NO: 1130446 - RNA, 22 nt, Homo sapiens
ggacgaaaaacacagugcacuc

SEQ ID NO: 1130447 - RNA, 22 nt, Homo sapiens
ggacguccugcuggcaccucag

SEQ ID NO: 1130448 - RNA, 14 nt, Homo sapiens
ggacuacagcuuuc

SEQ ID NO: 1130449 - RNA, 16 nt, Homo sapiens
ggaguggaaacaaagg

SEQ ID NO: 1130450 - RNA, 11 nt, Homo sapiens
ggaugacauua

SEQ ID NO: 1130451 - RNA, 11 nt, Homo sapiens
ggauggcacuc

SEQ ID NO: 1130452 - RNA, 15 nt, Homo sapiens
ggauggggacaaaga

SEQ ID NO: 1130453 - RNA, 21 nt, Homo sapiens
ggcaacaagagugaaacucca

SEQ ID NO: 1130454 - RNA, 16 nt, Homo sapiens
ggcacugggaagccua

SEQ ID NO: 1130455 - RNA, 21 nt, Homo sapiens
ggcagagaagccccuaggcaa

SEQ ID NO: 1130456 - RNA, 16 nt, Homo sapiens
ggccacucuguuggug

SEQ ID NO: 1130457 - RNA, 12 nt, Homo sapiens
ggcugacaaugc

SEQ ID NO: 1130458 - RNA, 14 nt, Homo sapiens
gggaagccuagaga

SEQ ID NO: 1130459 - RNA, 15 nt, Homo sapiens
gggacccugcucaca

SEQ ID NO: 1130460 - RNA, 19 nt, Homo sapiens
gggagagcgaaggggguca

SEQ ID NO: 1130461 - RNA, 14 nt, Homo sapiens
gggagcuacagggg

SEQ ID NO: 1130462 - RNA, 15 nt, Homo sapiens
gggaggugggguaca

SEQ ID NO: 1130463 - RNA, 17 nt, Homo sapiens
gggcuggguguguuuca

SEQ ID NO: 1130464 - RNA, 16 nt, Homo sapiens
gguaauauucauuuua

SEQ ID NO: 1130465 - RNA, 14 nt, Homo sapiens
ggucagucacuuga

SEQ ID NO: 1130466 - RNA, 15 nt, Homo sapiens
ggucagucacuugaa

SEQ ID NO: 1130467 - RNA, 15 nt, Homo sapiens
ggucauaguguauaa

SEQ ID NO: 1130468 - RNA, 14 nt, Homo sapiens
gguccaccuccuga

SEQ ID NO: 1130469 - RNA, 17 nt, Homo sapiens
ggucgcggagguccugc

SEQ ID NO: 1130470 - RNA, 22 nt, Homo sapiens
ggucuuccuuuggcaugggaug

SEQ ID NO: 1130471 - RNA, 20 nt, Homo sapiens
ggugcagucuuggcucacua

SEQ ID NO: 1130472 - RNA, 15 nt, Homo sapiens
gguguauugaagucc

SEQ ID NO: 1130473 - RNA, 20 nt, Homo sapiens
guaaucccagcuacuuggga

SEQ ID NO: 1130474 - RNA, 14 nt, Homo sapiens
guaaugaaacaaag

SEQ ID NO: 1130475 - RNA, 22 nt, Homo sapiens
guaaugaaacaaagaguucaag

SEQ ID NO: 1130476 - RNA, 11 nt, Homo sapiens
guacagagaug

SEQ ID NO: 1130477 - RNA, 20 nt, Homo sapiens
guacauaauauccaauggaa

SEQ ID NO: 1130478 - RNA, 18 nt, Homo sapiens
guagcaucauugaucuuu

SEQ ID NO: 1130479 - RNA, 16 nt, Homo sapiens
guaguaaacuuggaac

SEQ ID NO: 1130480 - RNA, 21 nt, Homo sapiens
guauauaauacuaaagugucu

SEQ ID NO: 1130481 - RNA, 14 nt, Homo sapiens
guauuaccuauuca

SEQ ID NO: 1130482 - RNA, 17 nt, Homo sapiens
guauuccaccacaggaa

SEQ ID NO: 1130483 - RNA, 18 nt, Homo sapiens
guauuccaccacaggaau

SEQ ID NO: 1130484 - RNA, 21 nt, Homo sapiens
guauucccccaucuagccauu

SEQ ID NO: 1130485 - RNA, 19 nt, Homo sapiens
guauucugcaacagccugu

SEQ ID NO: 1130486 - RNA, 13 nt, Homo sapiens
guauugccacaau

SEQ ID NO: 1130487 - RNA, 15 nt, Homo sapiens
gucaaggacuccugu

SEQ ID NO: 1130488 - RNA, 19 nt, Homo sapiens
gucacuaaccaagccagaa

SEQ ID NO: 1130489 - RNA, 22 nt, Homo sapiens
guccaauggcuguaaacuauaa

SEQ ID NO: 1130490 - RNA, 15 nt, Homo sapiens
guccaugaagcacug

SEQ ID NO: 1130491 - RNA, 19 nt, Homo sapiens
guccaugaagcacugagca

SEQ ID NO: 1130492 - RNA, 16 nt, Homo sapiens
gucccagccacagugu

SEQ ID NO: 1130493 - RNA, 12 nt, Homo sapiens
guccuccagaca

SEQ ID NO: 1130494 - RNA, 14 nt, Homo sapiens
guccuccagacaac

SEQ ID NO: 1130495 - RNA, 17 nt, Homo sapiens
guccugcccucugggag

SEQ ID NO: 1130496 - RNA, 19 nt, Homo sapiens
guccugcuacccaguaaaa

SEQ ID NO: 1130497 - RNA, 18 nt, Homo sapiens
guccuggaggcacuggga

SEQ ID NO: 1130498 - RNA, 13 nt, Homo sapiens
guccuucauucuu

SEQ ID NO: 1130499 - RNA, 22 nt, Homo sapiens
gucuggcaaugggacucugaga

SEQ ID NO: 1130500 - RNA, 22 nt, Homo sapiens
gucuguagagccgcauggcacu

SEQ ID NO: 1130501 - RNA, 14 nt, Homo sapiens
gucuguguggugcc

SEQ ID NO: 1130502 - RNA, 16 nt, Homo sapiens
gugaaauacaguauac

SEQ ID NO: 1130503 - RNA, 21 nt, Homo sapiens
gugagaagacuggcaggcagc

SEQ ID NO: 1130504 - RNA, 19 nt, Homo sapiens
gugaucuccacaccaaagu

SEQ ID NO: 1130505 - RNA, 11 nt, Homo sapiens
gugaugccuga

SEQ ID NO: 1130506 - RNA, 19 nt, Homo sapiens
gugcagaaauuugaaugac

SEQ ID NO: 1130507 - RNA, 16 nt, Homo sapiens
gugcauuugugucugc

SEQ ID NO: 1130508 - RNA, 14 nt, Homo sapiens
guggcaacccucac

SEQ ID NO: 1130509 - RNA, 17 nt, Homo sapiens
guggcaacccucacugu

SEQ ID NO: 1130510 - RNA, 20 nt, Homo sapiens
guggcaacccucacuguguu

SEQ ID NO: 1130511 - RNA, 14 nt, Homo sapiens
guggcuucugucug

SEQ ID NO: 1130512 - RNA, 12 nt, Homo sapiens
guggugccacau

SEQ ID NO: 1130513 - RNA, 16 nt, Homo sapiens
gugucgagaagcaaca

SEQ ID NO: 1130514 - RNA, 19 nt, Homo sapiens
gugugcgugugcgugcgug

SEQ ID NO: 1130515 - RNA, 17 nt, Homo sapiens
guguucaguguugacau

SEQ ID NO: 1130516 - RNA, 15 nt, Homo sapiens
guguugacauagccu

SEQ ID NO: 1130517 - RNA, 15 nt, Homo sapiens
guuacugauguucaa

SEQ ID NO: 1130518 - RNA, 21 nt, Homo sapiens
guuacuuaagaggcagagaag

SEQ ID NO: 1130519 - RNA, 15 nt, Homo sapiens
guugacauagccuuu

SEQ ID NO: 1130520 - RNA, 12 nt, Homo sapiens
guugcagucuca

SEQ ID NO: 1130521 - RNA, 18 nt, Homo sapiens
guuuaggcauccugugug

SEQ ID NO: 1130522 - RNA, 14 nt, Homo sapiens
guuuauuugcacua

SEQ ID NO: 1130523 - RNA, 15 nt, Homo sapiens
guuuauuugcacuau

SEQ ID NO: 1130524 - RNA, 18 nt, Homo sapiens
guuucacagccuauaacc

SEQ ID NO: 1130525 - RNA, 15 nt, Homo sapiens
uaaaacaaaaccaac

SEQ ID NO: 1130526 - RNA, 23 nt, Homo sapiens
uaaacaguagcagccugcguuaa

SEQ ID NO: 1130527 - RNA, 16 nt, Homo sapiens
uaaacccuuaaccuaa

SEQ ID NO: 1130528 - RNA, 14 nt, Homo sapiens
uaaacuacuguaau

SEQ ID NO: 1130529 - RNA, 19 nt, Homo sapiens
uaaacuuuccaaaaccuuc

SEQ ID NO: 1130530 - RNA, 21 nt, Homo sapiens
uaacucaggggugauucugaa

SEQ ID NO: 1130531 - RNA, 14 nt, Homo sapiens
uaacuccagucucc

SEQ ID NO: 1130532 - RNA, 22 nt, Homo sapiens
uaacuggguaaugaaacaaaga

SEQ ID NO: 1130533 - RNA, 21 nt, Homo sapiens
uaacuguggcuaauucacaua

SEQ ID NO: 1130534 - RNA, 20 nt, Homo sapiens
uaacuuauugcauaacagca

SEQ ID NO: 1130535 - RNA, 22 nt, Homo sapiens
uaacuuauugcauaacagcaga

SEQ ID NO: 1130536 - RNA, 19 nt, Homo sapiens
uaacuucucugagucugaa

SEQ ID NO: 1130537 - RNA, 20 nt, Homo sapiens
uaagaagaaugcuuaaucag

SEQ ID NO: 1130538 - RNA, 17 nt, Homo sapiens
uaauaaucuucagguga

SEQ ID NO: 1130539 - RNA, 19 nt, Homo sapiens
uaauaguuguugaguauuc

SEQ ID NO: 1130540 - RNA, 14 nt, Homo sapiens
uaauauggcuguau

SEQ ID NO: 1130541 - RNA, 19 nt, Homo sapiens
uaaucugauuauacaccau

SEQ ID NO: 1130542 - RNA, 18 nt, Homo sapiens
uaaugaacagaacauaga

SEQ ID NO: 1130543 - RNA, 15 nt, Homo sapiens
uaauuuucacucugg

SEQ ID NO: 1130544 - RNA, 23 nt, Homo sapiens
uacaagcauuuguuccaugccug

SEQ ID NO: 1130545 - RNA, 16 nt, Homo sapiens
uaccaaguccugggaa

SEQ ID NO: 1130546 - RNA, 15 nt, Homo sapiens
uaccagcuaacucca

SEQ ID NO: 1130547 - RNA, 20 nt, Homo sapiens
uacccaguaaaaauccacua

SEQ ID NO: 1130548 - RNA, 16 nt, Homo sapiens
uaccugggcauacuaa

SEQ ID NO: 1130549 - RNA, 22 nt, Homo sapiens
uaccuuugacuuuuuggcuuua

SEQ ID NO: 1130550 - RNA, 17 nt, Homo sapiens
uacuccucugacuggag

SEQ ID NO: 1130551 - RNA, 17 nt, Homo sapiens
uacugaguucucaucca

SEQ ID NO: 1130552 - RNA, 14 nt, Homo sapiens
uacugggaagacaa

SEQ ID NO: 1130553 - RNA, 17 nt, Homo sapiens
acggucaguuugguguc

SEQ ID NO: 1130554 - RNA, 19 nt, Homo sapiens
acggugcagucugggugcu

SEQ ID NO: 1130555 - RNA, 20 nt, Homo sapiens
acgguggcucacgccuguaa

SEQ ID NO: 1130556 - RNA, 15 nt, Homo sapiens
acgguguuuugccau

SEQ ID NO: 1130557 - RNA, 18 nt, Homo sapiens
acguaaugaaacuuggau

SEQ ID NO: 1130558 - RNA, 15 nt, Homo sapiens
acgucauuacaagcu

SEQ ID NO: 1130559 - RNA, 20 nt, Homo sapiens
acgucucuucucuguggaac

SEQ ID NO: 1130560 - RNA, 22 nt, Homo sapiens
acgucugcagaaacagugcaag

SEQ ID NO: 1130561 - RNA, 22 nt, Homo sapiens
acgucugggagaaauugacaga

SEQ ID NO: 1130562 - RNA, 16 nt, Homo sapiens
acgucuguaaucccag

SEQ ID NO: 1130563 - RNA, 17 nt, Homo sapiens
acgucuuuauuuaggag

SEQ ID NO: 1130564 - RNA, 20 nt, Homo sapiens
acgugaaauacuucgaugau

SEQ ID NO: 1130565 - RNA, 18 nt, Homo sapiens
acgugcaggacagcucuu

SEQ ID NO: 1130566 - RNA, 16 nt, Homo sapiens
acguggcucagccagc

SEQ ID NO: 1130567 - RNA, 18 nt, Homo sapiens
acgugucccgagcuuaga

SEQ ID NO: 1130568 - RNA, 21 nt, Homo sapiens
acgugugaaaucugucuuugc

SEQ ID NO: 1130569 - RNA, 14 nt, Homo sapiens
acgugugguucauc

SEQ ID NO: 1130570 - RNA, 14 nt, Homo sapiens
acguuaacagcgug

SEQ ID NO: 1130571 - RNA, 14 nt, Homo sapiens
acguuauacugaaa

SEQ ID NO: 1130572 - RNA, 18 nt, Homo sapiens
acguugccucuacuuuau

SEQ ID NO: 1130573 - RNA, 16 nt, Homo sapiens
acuaaaaauacaaaaa

SEQ ID NO: 1130574 - RNA, 17 nt, Homo sapiens
acuaaaaauaccaaaaa

SEQ ID NO: 1130575 - RNA, 14 nt, Homo sapiens
acuaaaaaucauga

SEQ ID NO: 1130576 - RNA, 14 nt, Homo sapiens
acuaaaaaugcauc

SEQ ID NO: 1130577 - RNA, 15 nt, Homo sapiens
acuaaaauucaaaaa

SEQ ID NO: 1130578 - RNA, 15 nt, Homo sapiens
acuaaacuacauuau

SEQ ID NO: 1130579 - RNA, 21 nt, Homo sapiens
acuaaagguggccacaaauuc

SEQ ID NO: 1130580 - RNA, 19 nt, Homo sapiens
acuaaauaucauaaucuga

SEQ ID NO: 1130581 - RNA, 19 nt, Homo sapiens
acuaacuaugcauggugcc

SEQ ID NO: 1130582 - RNA, 17 nt, Homo sapiens
acuaagaagugguguuc

SEQ ID NO: 1130583 - RNA, 23 nt, Homo sapiens
acuaagaagugguguuccaugac

SEQ ID NO: 1130584 - RNA, 15 nt, Homo sapiens
acuaagaguaugugc

SEQ ID NO: 1130585 - RNA, 15 nt, Homo sapiens
acuaaggagcaugau

SEQ ID NO: 1130586 - RNA, 21 nt, Homo sapiens
acuaaggaguaaucuguguac

SEQ ID NO: 1130587 - RNA, 22 nt, Homo sapiens
acuaagugauuuguaugucuau

SEQ ID NO: 1130588 - RNA, 20 nt, Homo sapiens
acuaauagcuugaacccuuu

SEQ ID NO: 1130589 - RNA, 22 nt, Homo sapiens
acuaaucugauguuaaccaaug

SEQ ID NO: 1130590 - RNA, 18 nt, Homo sapiens
acuaaugcaaacugggau

SEQ ID NO: 1130591 - RNA, 18 nt, Homo sapiens
acuaaugcuuucugugga

SEQ ID NO: 1130592 - RNA, 22 nt, Homo sapiens
acuaauggcaugagaaauacaa

SEQ ID NO: 1130593 - RNA, 19 nt, Homo sapiens
acuaauuauacuacuuugu

SEQ ID NO: 1130594 - RNA, 20 nt, Homo sapiens
acuaauuauacuacuuuguu

SEQ ID NO: 1130595 - RNA, 20 nt, Homo sapiens
acuaauucugcaucugggca

SEQ ID NO: 1130596 - RNA, 18 nt, Homo sapiens
acuacaaacaaaagcagc

SEQ ID NO: 1130597 - RNA, 19 nt, Homo sapiens
acuacaagugauccucagg

SEQ ID NO: 1130598 - RNA, 21 nt, Homo sapiens
acuacaauugaggagugucau

SEQ ID NO: 1130599 - RNA, 21 nt, Homo sapiens
acuacaccacacacaacagcc

SEQ ID NO: 1130600 - RNA, 22 nt, Homo sapiens
acuacaccacacacaacagcca

SEQ ID NO: 1130601 - RNA, 15 nt, Homo sapiens
acuacaccacgagaa

SEQ ID NO: 1130602 - RNA, 18 nt, Homo sapiens
acuacagcuaugaagaaa

SEQ ID NO: 1130603 - RNA, 22 nt, Homo sapiens
acuacauuuuauuuuuguaucu

SEQ ID NO: 1130604 - RNA, 13 nt, Homo sapiens
acuacuacaggaa

SEQ ID NO: 1130605 - RNA, 16 nt, Homo sapiens
acuacugugucacugu

SEQ ID NO: 1130606 - RNA, 21 nt, Homo sapiens
acuagacaccuucugugcuca

SEQ ID NO: 1130607 - RNA, 16 nt, Homo sapiens
acuagaugaccucauu

SEQ ID NO: 1130608 - RNA, 18 nt, Homo sapiens
acuagcaccugccaggga

SEQ ID NO: 1130609 - RNA, 19 nt, Homo sapiens
acuagcaccugccagggag

SEQ ID NO: 1130610 - RNA, 12 nt, Homo sapiens
acuagcugagca

SEQ ID NO: 1130611 - RNA, 15 nt, Homo sapiens
acuagggaagcucag

SEQ ID NO: 1130612 - RNA, 21 nt, Homo sapiens
acuaguauggccagcagacag

SEQ ID NO: 1130613 - RNA, 21 nt, Homo sapiens
acuaguauuucauguugcaca

SEQ ID NO: 1130614 - RNA, 22 nt, Homo sapiens
acuauaaauacaaaucuguaua

SEQ ID NO: 1130615 - RNA, 12 nt, Homo sapiens
acuauaccucug

SEQ ID NO: 1130616 - RNA, 15 nt, Homo sapiens
acuauauaugacugg

SEQ ID NO: 1130617 - RNA, 18 nt, Homo sapiens
acuaucaaaauugccuuu

SEQ ID NO: 1130618 - RNA, 13 nt, Homo sapiens
acuaucaguuccc

SEQ ID NO: 1130619 - RNA, 20 nt, Homo sapiens
acuaucuuucagcuccaguu

SEQ ID NO: 1130620 - RNA, 11 nt, Homo sapiens
acuaugaccuu

SEQ ID NO: 1130621 - RNA, 14 nt, Homo sapiens
acuaugauggacca

SEQ ID NO: 1130622 - RNA, 20 nt, Homo sapiens
acuauucccacuuucauuca

SEQ ID NO: 1130623 - RNA, 16 nt, Homo sapiens
acuauugagugaaaca

SEQ ID NO: 1130624 - RNA, 21 nt, Homo sapiens
acucaaauggggccagaucca

SEQ ID NO: 1130625 - RNA, 12 nt, Homo sapiens
acucaacaauaa

SEQ ID NO: 1130626 - RNA, 14 nt, Homo sapiens
acucaaucauuucu

SEQ ID NO: 1130627 - RNA, 19 nt, Homo sapiens
acucacauccauucuuccc

SEQ ID NO: 1130628 - RNA, 22 nt, Homo sapiens
acucacccuccacaaagcaaag

SEQ ID NO: 1130629 - RNA, 17 nt, Homo sapiens
acucaccucugccucaa

SEQ ID NO: 1130630 - RNA, 21 nt, Homo sapiens
acucagaagaaagcucagagu

SEQ ID NO: 1130631 - RNA, 23 nt, Homo sapiens
acucagaagggagcuagccagag

SEQ ID NO: 1130632 - RNA, 14 nt, Homo sapiens
acucagagacuuca

SEQ ID NO: 1130633 - RNA, 14 nt, Homo sapiens
acucagagugcaag

SEQ ID NO: 1130634 - RNA, 14 nt, Homo sapiens
acucagcagcagag

SEQ ID NO: 1130635 - RNA, 16 nt, Homo sapiens
acucagcagcagagag

SEQ ID NO: 1130636 - RNA, 15 nt, Homo sapiens
acucagccaagcaca

SEQ ID NO: 1130637 - RNA, 16 nt, Homo sapiens
acucagccugcaguua

SEQ ID NO: 1130638 - RNA, 20 nt, Homo sapiens
acucagcucugucugcucaa

SEQ ID NO: 1130639 - RNA, 15 nt, Homo sapiens
acucagcucuuggcu

SEQ ID NO: 1130640 - RNA, 18 nt, Homo sapiens
acucagggcagcugccug

SEQ ID NO: 1130641 - RNA, 16 nt, Homo sapiens
acucaggggucacuga

SEQ ID NO: 1130642 - RNA, 16 nt, Homo sapiens
acucaguugcaacuug

SEQ ID NO: 1130643 - RNA, 15 nt, Homo sapiens
acucauaaucuauaa

SEQ ID NO: 1130644 - RNA, 12 nt, Homo sapiens
acucauaauucu

SEQ ID NO: 1130645 - RNA, 21 nt, Homo sapiens
acucauagauguuaugcaaaa

SEQ ID NO: 1130646 - RNA, 22 nt, Homo sapiens
acucauaggggaguaggggugg

SEQ ID NO: 1130647 - RNA, 18 nt, Homo sapiens
acucaucuaaaaauggau

SEQ ID NO: 1130648 - RNA, 17 nt, Homo sapiens
acucaucugacucauuc

SEQ ID NO: 1130649 - RNA, 21 nt, Homo sapiens
acucauggccuugucuaacuu

SEQ ID NO: 1130650 - RNA, 12 nt, Homo sapiens
acuccagcauca

SEQ ID NO: 1130651 - RNA, 15 nt, Homo sapiens
acuccagccugggca

SEQ ID NO: 1130652 - RNA, 18 nt, Homo sapiens
acuccaggcccaaggcuc

SEQ ID NO: 1130653 - RNA, 22 nt, Homo sapiens
acuccaucugacaaauucaaaa

SEQ ID NO: 1130654 - RNA, 16 nt, Homo sapiens
acuccaugguucucaa

SEQ ID NO: 1130655 - RNA, 13 nt, Homo sapiens
acucccauaccuu

SEQ ID NO: 1130656 - RNA, 22 nt, Homo sapiens
acucccauuuuggugugcaucu

SEQ ID NO: 1130657 - RNA, 20 nt, Homo sapiens
acucccccaggauugugcaa

SEQ ID NO: 1130658 - RNA, 23 nt, Homo sapiens
acuccccuguuucaaucacuguc

SEQ ID NO: 1130659 - RNA, 19 nt, Homo sapiens
acucccggccugucauuca

SEQ ID NO: 1130660 - RNA, 16 nt, Homo sapiens
acucccuaggcccaag

SEQ ID NO: 1130661 - RNA, 23 nt, Homo sapiens
acucccugaucccagaccugucg

SEQ ID NO: 1130662 - RNA, 20 nt, Homo sapiens
acucccuguuuuaauucaac

SEQ ID NO: 1130663 - RNA, 20 nt, Homo sapiens
acuccggccugggugacaga

SEQ ID NO: 1130664 - RNA, 14 nt, Homo sapiens
acuccgugaggcug

SEQ ID NO: 1130665 - RNA, 18 nt, Homo sapiens
acuccuaaccucaaguga

SEQ ID NO: 1130666 - RNA, 14 nt, Homo sapiens
acuccuccuagcca

SEQ ID NO: 1130667 - RNA, 21 nt, Homo sapiens
acuccugaccccagauucaac

SEQ ID NO: 1130668 - RNA, 19 nt, Homo sapiens
acuccugguucagugccac

SEQ ID NO: 1130669 - RNA, 20 nt, Homo sapiens
acuccugguucagugccacg

SEQ ID NO: 1130670 - RNA, 11 nt, Homo sapiens
acuccuuccau

SEQ ID NO: 1130671 - RNA, 20 nt, Homo sapiens
acucgagaagauucaaucac

SEQ ID NO: 1130672 - RNA, 16 nt, Homo sapiens
acucgcaccugugcug

SEQ ID NO: 1130673 - RNA, 13 nt, Homo sapiens
acucuagauucca

SEQ ID NO: 1130674 - RNA, 15 nt, Homo sapiens
acucucaccuuccaa

SEQ ID NO: 1130675 - RNA, 23 nt, Homo sapiens
acucucauuccccagguggcuga

SEQ ID NO: 1130676 - RNA, 20 nt, Homo sapiens
acucuccaauguucuauuaa

SEQ ID NO: 1130677 - RNA, 18 nt, Homo sapiens
acucuccucgcugacccu

SEQ ID NO: 1130678 - RNA, 14 nt, Homo sapiens
acucuccuugcagu

SEQ ID NO: 1130679 - RNA, 21 nt, Homo sapiens
acucuccuugcaguucuugag

SEQ ID NO: 1130680 - RNA, 14 nt, Homo sapiens
acucucuaccagau

SEQ ID NO: 1130681 - RNA, 23 nt, Homo sapiens
acucucuaccagauaacugagga

SEQ ID NO: 1130682 - RNA, 20 nt, Homo sapiens
acucucugaguacauugugc

SEQ ID NO: 1130683 - RNA, 20 nt, Homo sapiens
acucucugucuucucuccac

SEQ ID NO: 1130684 - RNA, 21 nt, Homo sapiens
agaaccaugcaggaaggaaaa

SEQ ID NO: 1130685 - RNA, 15 nt, Homo sapiens
agaacccuugcacua

SEQ ID NO: 1130686 - RNA, 18 nt, Homo sapiens
agaaccggccuggagcuc

SEQ ID NO: 1130687 - RNA, 16 nt, Homo sapiens
agaacguggcucugcu

SEQ ID NO: 1130688 - RNA, 19 nt, Homo sapiens
agaacguuuuuuccucagu

SEQ ID NO: 1130689 - RNA, 12 nt, Homo sapiens
agaacucaaggc

SEQ ID NO: 1130690 - RNA, 15 nt, Homo sapiens
agaacucacuggggc

SEQ ID NO: 1130691 - RNA, 20 nt, Homo sapiens
agaacugauuuuacaaauua

SEQ ID NO: 1130692 - RNA, 19 nt, Homo sapiens
agaacuucagcauuguaau

SEQ ID NO: 1130693 - RNA, 12 nt, Homo sapiens
agaacuuugcau

SEQ ID NO: 1130694 - RNA, 23 nt, Homo sapiens
agaacuuugcauagcagcugcua

SEQ ID NO: 1130695 - RNA, 16 nt, Homo sapiens
agaagaaaauuugcca

SEQ ID NO: 1130696 - RNA, 22 nt, Homo sapiens
agaagaacagcuguuccugugu

SEQ ID NO: 1130697 - RNA, 11 nt, Homo sapiens
agaagaauuaa

SEQ ID NO: 1130698 - RNA, 15 nt, Homo sapiens
agaagacuauuuacc

SEQ ID NO: 1130699 - RNA, 22 nt, Homo sapiens
agaagagccccuccuuccuuca

SEQ ID NO: 1130700 - RNA, 23 nt, Homo sapiens
agaagagccggagccuccagcug

SEQ ID NO: 1130701 - RNA, 15 nt, Homo sapiens
agaagauaaugacuu

SEQ ID NO: 1130702 - RNA, 13 nt, Homo sapiens
agaagaucuguaa

SEQ ID NO: 1130703 - RNA, 20 nt, Homo sapiens
agaagcacuuugauugaagu

SEQ ID NO: 1130704 - RNA, 13 nt, Homo sapiens
agaagcagcucuu

SEQ ID NO: 1130705 - RNA, 14 nt, Homo sapiens
agaagcaguuggug

SEQ ID NO: 1130706 - RNA, 22 nt, Homo sapiens
agaagccuaauugucacaucaa

SEQ ID NO: 1130707 - RNA, 20 nt, Homo sapiens
agaagcugagcaccagggga

SEQ ID NO: 1130708 - RNA, 16 nt, Homo sapiens
agaagcugcccucagc

SEQ ID NO: 1130709 - RNA, 20 nt, Homo sapiens
agaagcugcccucagccaga

SEQ ID NO: 1130710 - RNA, 21 nt, Homo sapiens
agaagcugucagggacccagg

SEQ ID NO: 1130711 - RNA, 12 nt, Homo sapiens
agaaggaaagca

SEQ ID NO: 1130712 - RNA, 21 nt, Homo sapiens
agaaggaguuucacuacaauc

SEQ ID NO: 1130713 - RNA, 21 nt, Homo sapiens
agaaggccacuguuugucuca

SEQ ID NO: 1130714 - RNA, 23 nt, Homo sapiens
agaaggccacuguuugucucacc

SEQ ID NO: 1130715 - RNA, 18 nt, Homo sapiens
agaagggaauccuccucc

SEQ ID NO: 1130716 - RNA, 21 nt, Homo sapiens
agaagggcagcuccacagggc

SEQ ID NO: 1130717 - RNA, 22 nt, Homo sapiens
agaagggcagcuccacagggca

SEQ ID NO: 1130718 - RNA, 18 nt, Homo sapiens
agaagggccuggaugcaa

SEQ ID NO: 1130719 - RNA, 16 nt, Homo sapiens
agaagguuacuaccua

SEQ ID NO: 1130720 - RNA, 24 nt, Homo sapiens
agaaguaagcagaguucuuugcaa

SEQ ID NO: 1130721 - RNA, 16 nt, Homo sapiens
agaaguaggcucugau

SEQ ID NO: 1130722 - RNA, 20 nt, Homo sapiens
agaagucagagaaaacacuu

SEQ ID NO: 1130723 - RNA, 14 nt, Homo sapiens
agaagugaacacuu

SEQ ID NO: 1130724 - RNA, 18 nt, Homo sapiens
agaagugcgaguccauug

SEQ ID NO: 1130725 - RNA, 13 nt, Homo sapiens
agaagugugauug

SEQ ID NO: 1130726 - RNA, 13 nt, Homo sapiens
agaaguuccucaa

SEQ ID NO: 1130727 - RNA, 11 nt, Homo sapiens
agaaguucugg

SEQ ID NO: 1130728 - RNA, 18 nt, Homo sapiens
agaaguuugggcuaacau

SEQ ID NO: 1130729 - RNA, 18 nt, Homo sapiens
agaauaaggaacaacguu

SEQ ID NO: 1130730 - RNA, 18 nt, Homo sapiens
agaauauaaagccucaaa

SEQ ID NO: 1130731 - RNA, 13 nt, Homo sapiens
agaauaugacuuu

SEQ ID NO: 1130732 - RNA, 15 nt, Homo sapiens
agaaucuaaagccag

SEQ ID NO: 1130733 - RNA, 17 nt, Homo sapiens
agaaugaaacaauccaa

SEQ ID NO: 1130734 - RNA, 22 nt, Homo sapiens
agaaugaaagacugaaucuucc

SEQ ID NO: 1130735 - RNA, 23 nt, Homo sapiens
agaauggcgccaccagcucugcc

SEQ ID NO: 1130736 - RNA, 21 nt, Homo sapiens
agaaugguaaaauaccaacuc

SEQ ID NO: 1130737 - RNA, 22 nt, Homo sapiens
agaaugguugaguuacauuaaa

SEQ ID NO: 1130738 - RNA, 23 nt, Homo sapiens
agaauguauuguaccuuuuaaca

SEQ ID NO: 1130739 - RNA, 20 nt, Homo sapiens
agaaugucucggucacauca

SEQ ID NO: 1130740 - RNA, 23 nt, Homo sapiens
agaauuacuuguguuacuugcca

SEQ ID NO: 1130741 - RNA, 16 nt, Homo sapiens
agaauuagaaacaaca

SEQ ID NO: 1130742 - RNA, 17 nt, Homo sapiens
agaauucccugaucuaa

SEQ ID NO: 1130743 - RNA, 16 nt, Homo sapiens
agaauucuuacauguu

SEQ ID NO: 1130744 - RNA, 23 nt, Homo sapiens
agaauuugccuucucccugggaa

SEQ ID NO: 1130745 - RNA, 13 nt, Homo sapiens
agaauuuggcucu

SEQ ID NO: 1130746 - RNA, 20 nt, Homo sapiens
agacaaacuccugaaaugcc

SEQ ID NO: 1130747 - RNA, 18 nt, Homo sapiens
agacaaauacucaugugu

SEQ ID NO: 1130748 - RNA, 22 nt, Homo sapiens
agacaaauacuuagacaguaug

SEQ ID NO: 1130749 - RNA, 14 nt, Homo sapiens
agacaagauggcua

SEQ ID NO: 1130750 - RNA, 14 nt, Homo sapiens
agacacagcccuga

SEQ ID NO: 1130751 - RNA, 14 nt, Homo sapiens
agacacauucacac

SEQ ID NO: 1130752 - RNA, 12 nt, Homo sapiens
agacaccugguu

SEQ ID NO: 1130753 - RNA, 17 nt, Homo sapiens
agacaccuucugugcuc

SEQ ID NO: 1130754 - RNA, 21 nt, Homo sapiens
agacaccuucugugcucaugu

SEQ ID NO: 1130755 - RNA, 15 nt, Homo sapiens
agacacgcucuucua

SEQ ID NO: 1130756 - RNA, 18 nt, Homo sapiens
agacacucccaccagcac

SEQ ID NO: 1130757 - RNA, 20 nt, Homo sapiens
agacacuggcguuacugcuu

SEQ ID NO: 1130758 - RNA, 15 nt, Homo sapiens
agacagagggucaca

SEQ ID NO: 1130759 - RNA, 21 nt, Homo sapiens
agacagauuuucggaacacau

SEQ ID NO: 1130760 - RNA, 15 nt, Homo sapiens
agacagcuacacaga

SEQ ID NO: 1130761 - RNA, 14 nt, Homo sapiens
agacagcugcucag

SEQ ID NO: 1130762 - RNA, 20 nt, Homo sapiens
agacaggagaaacacuugaa

SEQ ID NO: 1130763 - RNA, 23 nt, Homo sapiens
agacaggcaaauaaaagugaccu

SEQ ID NO: 1130764 - RNA, 10 nt, Homo sapiens
agacagugaa

SEQ ID NO: 1130765 - RNA, 14 nt, Homo sapiens
agacaguguaugua

SEQ ID NO: 1130766 - RNA, 11 nt, Homo sapiens
agacauacucc

SEQ ID NO: 1130767 - RNA, 13 nt, Homo sapiens
agacaugguggca

SEQ ID NO: 1130768 - RNA, 18 nt, Homo sapiens
agacaugguggcaugcac

SEQ ID NO: 1130769 - RNA, 23 nt, Homo sapiens
agaccaacagaacuucacaguga

SEQ ID NO: 1130770 - RNA, 13 nt, Homo sapiens
agaccagccagug

SEQ ID NO: 1130771 - RNA, 17 nt, Homo sapiens
agaccaggcccuggcua

SEQ ID NO: 1130772 - RNA, 13 nt, Homo sapiens
agaccauugcaau

SEQ ID NO: 1130773 - RNA, 18 nt, Homo sapiens
agaccauuuguauuacca

SEQ ID NO: 1130774 - RNA, 13 nt, Homo sapiens
agacccaacaaug

SEQ ID NO: 1130775 - RNA, 15 nt, Homo sapiens
agacccccagcacuu

SEQ ID NO: 1130776 - RNA, 20 nt, Homo sapiens
agaccccucucccagcuauu

SEQ ID NO: 1130777 - RNA, 14 nt, Homo sapiens
agacccuuucccca

SEQ ID NO: 1130778 - RNA, 22 nt, Homo sapiens
agaccguugguuccaucacugc

SEQ ID NO: 1130779 - RNA, 12 nt, Homo sapiens
agaccuagagau

SEQ ID NO: 1130780 - RNA, 17 nt, Homo sapiens
agaccugaagugugcac

SEQ ID NO: 1130781 - RNA, 23 nt, Homo sapiens
agaccugacccauccaguucucu

SEQ ID NO: 1130782 - RNA, 20 nt, Homo sapiens
agaccuggugcucuaaugcc

SEQ ID NO: 1130783 - RNA, 23 nt, Homo sapiens
agaccuuugauuuuugcccagaa

SEQ ID NO: 1130784 - RNA, 13 nt, Homo sapiens
agacggggugaag

SEQ ID NO: 1130785 - RNA, 17 nt, Homo sapiens
agacgguguuuugccau

SEQ ID NO: 1130786 - RNA, 21 nt, Homo sapiens
agacuaaugcuuucuguggac

SEQ ID NO: 1130787 - RNA, 18 nt, Homo sapiens
agacuagaauucugggaa

SEQ ID NO: 1130788 - RNA, 17 nt, Homo sapiens
agacuaggauaaugucc

SEQ ID NO: 1130789 - RNA, 15 nt, Homo sapiens
agacuaucaguuccc

SEQ ID NO: 1130790 - RNA, 17 nt, Homo sapiens
agacuauugugccuuag

SEQ ID NO: 1130791 - RNA, 15 nt, Homo sapiens
agacucauucuucac

SEQ ID NO: 1130792 - RNA, 16 nt, Homo sapiens
agacuccaagccaaga

SEQ ID NO: 1130793 - RNA, 13 nt, Homo sapiens
agacuccaucuca

SEQ ID NO: 1130794 - RNA, 14 nt, Homo sapiens
agacuccaucucaa

SEQ ID NO: 1130795 - RNA, 12 nt, Homo sapiens
agacucccugau

SEQ ID NO: 1130796 - RNA, 16 nt, Homo sapiens
agacucuuaccuacaa

SEQ ID NO: 1130797 - RNA, 19 nt, Homo sapiens
agacugaacuuacacugua

SEQ ID NO: 1130798 - RNA, 15 nt, Homo sapiens
agacugaagauuuau

SEQ ID NO: 1130799 - RNA, 17 nt, Homo sapiens
agacugaaucuaccugc

SEQ ID NO: 1130800 - RNA, 21 nt, Homo sapiens
agacugguaggaggaggcaug

SEQ ID NO: 1130801 - RNA, 21 nt, Homo sapiens
agacugguugaguucagguag

SEQ ID NO: 1130802 - RNA, 14 nt, Homo sapiens
agacuguggagcuc

SEQ ID NO: 1130803 - RNA, 16 nt, Homo sapiens
agacuucaccuaacua

SEQ ID NO: 1130804 - RNA, 20 nt, Homo sapiens
agacuucucccgugagccag

SEQ ID NO: 1130805 - RNA, 15 nt, Homo sapiens
agacuugauacugca

SEQ ID NO: 1130806 - RNA, 12 nt, Homo sapiens
agacuugcacug

SEQ ID NO: 1130807 - RNA, 22 nt, Homo sapiens
agacuuguuucuccaugggcuc

SEQ ID NO: 1130808 - RNA, 13 nt, Homo sapiens
agacuuucuguua

SEQ ID NO: 1130809 - RNA, 21 nt, Homo sapiens
agacuuuuguuaugaggagcu

SEQ ID NO: 1130810 - RNA, 14 nt, Homo sapiens
agagaaaaauggac

SEQ ID NO: 1130811 - RNA, 17 nt, Homo sapiens
agagaaagaguuugaaa

SEQ ID NO: 1130812 - RNA, 17 nt, Homo sapiens
agagaaagcacaauuua

SEQ ID NO: 1130813 - RNA, 16 nt, Homo sapiens
agagaaauaguuucac

SEQ ID NO: 1130814 - RNA, 13 nt, Homo sapiens
agagaaauguguc

SEQ ID NO: 1130815 - RNA, 16 nt, Homo sapiens
agagaaaugugucauc

SEQ ID NO: 1130816 - RNA, 20 nt, Homo sapiens
agagaaccuaacuguaucuu

SEQ ID NO: 1130817 - RNA, 16 nt, Homo sapiens
agagaauaaguggcuu

SEQ ID NO: 1130818 - RNA, 17 nt, Homo sapiens
agagaauucuguucuaa

SEQ ID NO: 1130819 - RNA, 21 nt, Homo sapiens
agagaccuucaaaugcgaaca

SEQ ID NO: 1130820 - RNA, 13 nt, Homo sapiens
agagaccuuugcc

SEQ ID NO: 1130821 - RNA, 17 nt, Homo sapiens
agagacgcaccuugcug

SEQ ID NO: 1130822 - RNA, 23 nt, Homo sapiens
agagacgggcccuggugguggcu

SEQ ID NO: 1130823 - RNA, 21 nt, Homo sapiens
agagacgggguuucuccaugu

SEQ ID NO: 1130824 - RNA, 18 nt, Homo sapiens
agagacgguguuuugcca

SEQ ID NO: 1130825 - RNA, 17 nt, Homo sapiens
agagacuccugaagguc

SEQ ID NO: 1130826 - RNA, 13 nt, Homo sapiens
agagacugaguca

SEQ ID NO: 1130827 - RNA, 11 nt, Homo sapiens
agagacuucac

SEQ ID NO: 1130828 - RNA, 17 nt, Homo sapiens
agagagaauuugcuuua

SEQ ID NO: 1130829 - RNA, 21 nt, Homo sapiens
agagagauuguguucuuccuc

SEQ ID NO: 1130830 - RNA, 23 nt, Homo sapiens
agagagauuuuucauuuuuccau

SEQ ID NO: 1130831 - RNA, 20 nt, Homo sapiens
agagauagauauuguccuaa

SEQ ID NO: 1130832 - RNA, 16 nt, Homo sapiens
agagauggucaauuaa

SEQ ID NO: 1130833 - RNA, 20 nt, Homo sapiens
agagcaaaacucugucucaa

SEQ ID NO: 1130834 - RNA, 13 nt, Homo sapiens
agagcaaagugac

SEQ ID NO: 1130835 - RNA, 14 nt, Homo sapiens
agagcaacaguaau

SEQ ID NO: 1130836 - RNA, 17 nt, Homo sapiens
agagcaagacccaucuc

SEQ ID NO: 1130837 - RNA, 18 nt, Homo sapiens
agagcaagacccaucuca

SEQ ID NO: 1130838 - RNA, 19 nt, Homo sapiens
agagcaagacuccaucuca

SEQ ID NO: 1130839 - RNA, 20 nt, Homo sapiens
agagcaagacuccaucucaa

SEQ ID NO: 1130840 - RNA, 12 nt, Homo sapiens
agagcaauguuu

SEQ ID NO: 1130841 - RNA, 14 nt, Homo sapiens
agagccacaggugc

SEQ ID NO: 1130842 - RNA, 20 nt, Homo sapiens
agagccagccggcuaugaaa

SEQ ID NO: 1130843 - RNA, 22 nt, Homo sapiens
agagccuguccccgccuucccu

SEQ ID NO: 1130844 - RNA, 15 nt, Homo sapiens
agagccuuugaucuu

SEQ ID NO: 1130845 - RNA, 20 nt, Homo sapiens
agagcgagacuccaucucaa

SEQ ID NO: 1130846 - RNA, 19 nt, Homo sapiens
agagcgagacuccaucucu

SEQ ID NO: 1130847 - RNA, 19 nt, Homo sapiens
agagcgagauuccgucuca

SEQ ID NO: 1130848 - RNA, 14 nt, Homo sapiens
agagcucaagggac

SEQ ID NO: 1130849 - RNA, 17 nt, Homo sapiens
agagcucugacccacag

SEQ ID NO: 1130850 - RNA, 21 nt, Homo sapiens
agagcuguucaacaucacuga

SEQ ID NO: 1130851 - RNA, 16 nt, Homo sapiens
agagcuugcagugaag

SEQ ID NO: 1130852 - RNA, 20 nt, Homo sapiens
agagcuuuuaaaaauguccu

SEQ ID NO: 1130853 - RNA, 13 nt, Homo sapiens
agaggaaaacccu

SEQ ID NO: 1130854 - RNA, 15 nt, Homo sapiens
agaggaccagugagu

SEQ ID NO: 1130855 - RNA, 22 nt, Homo sapiens
agaggacguguuacccacugcc

SEQ ID NO: 1130856 - RNA, 19 nt, Homo sapiens
agaggagggaggaggaaua

SEQ ID NO: 1130857 - RNA, 13 nt, Homo sapiens
agaggaugagcuc

SEQ ID NO: 1130858 - RNA, 14 nt, Homo sapiens
agaggcagugacag

SEQ ID NO: 1130859 - RNA, 15 nt, Homo sapiens
agaggcaguggccac

SEQ ID NO: 1130860 - RNA, 20 nt, Homo sapiens
agaggccccaggucaccucg

SEQ ID NO: 1130861 - RNA, 14 nt, Homo sapiens
agaggccuuggcca

SEQ ID NO: 1130862 - RNA, 19 nt, Homo sapiens
agaggcguugcuuucacuc

SEQ ID NO: 1130863 - RNA, 19 nt, Homo sapiens
agaggcuaauucaguguca

SEQ ID NO: 1130864 - RNA, 21 nt, Homo sapiens
agaggcuaauucagugucaca

SEQ ID NO: 1130865 - RNA, 15 nt, Homo sapiens
agaggcucugagaaa

SEQ ID NO: 1130866 - RNA, 16 nt, Homo sapiens
agaggcugcacuugug

SEQ ID NO: 1130867 - RNA, 16 nt, Homo sapiens
agagggcugcugacca

SEQ ID NO: 1130868 - RNA, 13 nt, Homo sapiens
agaggggaaaaug

SEQ ID NO: 1130869 - RNA, 12 nt, Homo sapiens
agaggggacgca

SEQ ID NO: 1130870 - RNA, 14 nt, Homo sapiens
agaggguggcugga

SEQ ID NO: 1130871 - RNA, 17 nt, Homo sapiens
agaggguggguguucau

SEQ ID NO: 1130872 - RNA, 22 nt, Homo sapiens
agaggguguugaguucacugug

SEQ ID NO: 1130873 - RNA, 20 nt, Homo sapiens
agaggguuuuucucacugug

SEQ ID NO: 1130874 - RNA, 21 nt, Homo sapiens
agaguacaccccaacagcacc

SEQ ID NO: 1130875 - RNA, 23 nt, Homo sapiens
agaguauagcucuguaguggaau

SEQ ID NO: 1130876 - RNA, 19 nt, Homo sapiens
agaguaucagaucuaucuu

SEQ ID NO: 1130877 - RNA, 20 nt, Homo sapiens
agaguauuaaugaaaagcac

SEQ ID NO: 1130878 - RNA, 16 nt, Homo sapiens
agagucaggaucucac

SEQ ID NO: 1130879 - RNA, 19 nt, Homo sapiens
agagucuccaguuacugaa

SEQ ID NO: 1130880 - RNA, 12 nt, Homo sapiens
agagugccacau

SEQ ID NO: 1130881 - RNA, 16 nt, Homo sapiens
agagugcuaugaagac

SEQ ID NO: 1130882 - RNA, 19 nt, Homo sapiens
agagugcuuggcugcugua

SEQ ID NO: 1130883 - RNA, 13 nt, Homo sapiens
agagugggaccaa

SEQ ID NO: 1130884 - RNA, 19 nt, Homo sapiens
agaguggggaugacaugca

SEQ ID NO: 1130885 - RNA, 18 nt, Homo sapiens
agaguucgugaagaggga

SEQ ID NO: 1130886 - RNA, 19 nt, Homo sapiens
agaguucuucauuccuugc

SEQ ID NO: 1130887 - RNA, 18 nt, Homo sapiens
agaguugccccgucucug

SEQ ID NO: 1130888 - RNA, 13 nt, Homo sapiens
agaguuggaguga

SEQ ID NO: 1130889 - RNA, 15 nt, Homo sapiens
agaguuggagugaga

SEQ ID NO: 1130890 - RNA, 13 nt, Homo sapiens
agaguuuccugaa

SEQ ID NO: 1130891 - RNA, 18 nt, Homo sapiens
agaguuuguguguugucu

SEQ ID NO: 1130892 - RNA, 16 nt, Homo sapiens
agaguuuucuguugca

SEQ ID NO: 1130893 - RNA, 20 nt, Homo sapiens
agauaaaaugauguuauaca

SEQ ID NO: 1130894 - RNA, 20 nt, Homo sapiens
agauaaaccaauaaauccac

SEQ ID NO: 1130895 - RNA, 13 nt, Homo sapiens
agauaaagaccuu

SEQ ID NO: 1130896 - RNA, 13 nt, Homo sapiens
agauaacuaggaa

SEQ ID NO: 1130897 - RNA, 14 nt, Homo sapiens
agauaauaugagaa

SEQ ID NO: 1130898 - RNA, 15 nt, Homo sapiens
agauacaaacauguu

SEQ ID NO: 1130899 - RNA, 17 nt, Homo sapiens
agauacauacagaauua

SEQ ID NO: 1130900 - RNA, 18 nt, Homo sapiens
agauacugucucuuucau

SEQ ID NO: 1130901 - RNA, 19 nt, Homo sapiens
agauacugugagcuuacau

SEQ ID NO: 1130902 - RNA, 17 nt, Homo sapiens
agauagcucaauacucu

SEQ ID NO: 1130903 - RNA, 22 nt, Homo sapiens
agauagcuucaccccaauccca

SEQ ID NO: 1130904 - RNA, 18 nt, Homo sapiens
agauauggacacacggga

SEQ ID NO: 1130905 - RNA, 20 nt, Homo sapiens
agauauucacuaaggacuua

SEQ ID NO: 1130906 - RNA, 12 nt, Homo sapiens
agaucacagugu

SEQ ID NO: 1130907 - RNA, 17 nt, Homo sapiens
agaucacgucacugcac

SEQ ID NO: 1130908 - RNA, 22 nt, Homo sapiens
agaucacuucaggucaggaguu

SEQ ID NO: 1130909 - RNA, 19 nt, Homo sapiens
agaucagaugcuccaagau

SEQ ID NO: 1130910 - RNA, 18 nt, Homo sapiens
agaucauauacgugaaaa

SEQ ID NO: 1130911 - RNA, 14 nt, Homo sapiens
agaucaucagucac

SEQ ID NO: 1130912 - RNA, 15 nt, Homo sapiens
agaucaucagucacc

SEQ ID NO: 1130913 - RNA, 19 nt, Homo sapiens
agaucauuuggagcucuug

SEQ ID NO: 1130914 - RNA, 12 nt, Homo sapiens
agauccaaagac

SEQ ID NO: 1130915 - RNA, 13 nt, Homo sapiens
agauccuccauuu

SEQ ID NO: 1130916 - RNA, 14 nt, Homo sapiens
agauccucuucuca

SEQ ID NO: 1130917 - RNA, 19 nt, Homo sapiens
agaucgccuggcucaguca

SEQ ID NO: 1130918 - RNA, 18 nt, Homo sapiens
agaucgugccacugcacu

SEQ ID NO: 1130919 - RNA, 20 nt, Homo sapiens
agaucgugccacugcacucc

SEQ ID NO: 1130920 - RNA, 17 nt, Homo sapiens
agaucuaucuugucaau

SEQ ID NO: 1130921 - RNA, 19 nt, Homo sapiens
agaucuccaacagccagug

SEQ ID NO: 1130922 - RNA, 17 nt, Homo sapiens
agaucucgguuugccaa

SEQ ID NO: 1130923 - RNA, 23 nt, Homo sapiens
agaucugcuuucuguucaucucu

SEQ ID NO: 1130924 - RNA, 19 nt, Homo sapiens
agaucuggaaccucagccu

SEQ ID NO: 1130925 - RNA, 20 nt, Homo sapiens
agaugaacaugguguucaac

SEQ ID NO: 1130926 - RNA, 21 nt, Homo sapiens
agaugaaggaaggacuaugac

SEQ ID NO: 1130927 - RNA, 20 nt, Homo sapiens
agaugaaggagaggcaacau

SEQ ID NO: 1130928 - RNA, 15 nt, Homo sapiens
agaugacagggaaaa

SEQ ID NO: 1130929 - RNA, 18 nt, Homo sapiens
agaugacggaugccuaga

SEQ ID NO: 1130930 - RNA, 15 nt, Homo sapiens
agaugagaguacacc

SEQ ID NO: 1130931 - RNA, 16 nt, Homo sapiens
agaugagaguacaccc

SEQ ID NO: 1130932 - RNA, 14 nt, Homo sapiens
agaugagggggcca

SEQ ID NO: 1130933 - RNA, 22 nt, Homo sapiens
agaugauaaaaggaaucuggca

SEQ ID NO: 1130934 - RNA, 18 nt, Homo sapiens
agaugaucagggauccaa

SEQ ID NO: 1130935 - RNA, 16 nt, Homo sapiens
agaugcaaugugcuac

SEQ ID NO: 1130936 - RNA, 20 nt, Homo sapiens
agaugccacccaguugugac

SEQ ID NO: 1130937 - RNA, 19 nt, Homo sapiens
agaugcccaggauuugacu

SEQ ID NO: 1130938 - RNA, 23 nt, Homo sapiens
agaugccgcggaaggucccucag

SEQ ID NO: 1130939 - RNA, 21 nt, Homo sapiens
agaugcuacuucccacuguau

SEQ ID NO: 1130940 - RNA, 21 nt, Homo sapiens
agaugcucuaucuugcucugu

SEQ ID NO: 1130941 - RNA, 13 nt, Homo sapiens
agaugcugauguu

SEQ ID NO: 1130942 - RNA, 17 nt, Homo sapiens
agaugcugauguucagu

SEQ ID NO: 1130943 - RNA, 21 nt, Homo sapiens
agauggaaaaacuugugcuau

SEQ ID NO: 1130944 - RNA, 17 nt, Homo sapiens
agauggacaacucaaug

SEQ ID NO: 1130945 - RNA, 12 nt, Homo sapiens
agauggaguucu

SEQ ID NO: 1130946 - RNA, 14 nt, Homo sapiens
agauggaugcaugu

SEQ ID NO: 1130947 - RNA, 15 nt, Homo sapiens
agauggauugauaau

SEQ ID NO: 1130948 - RNA, 21 nt, Homo sapiens
agauggcagauucccacugcc

SEQ ID NO: 1130949 - RNA, 17 nt, Homo sapiens
agcuacuuuugccaaau

SEQ ID NO: 1130950 - RNA, 19 nt, Homo sapiens
agcuagaggaaccaacccc

SEQ ID NO: 1130951 - RNA, 23 nt, Homo sapiens
agcuagcaaauaguaaucuguaa

SEQ ID NO: 1130952 - RNA, 19 nt, Homo sapiens
agcuauaacuuacuucugu

SEQ ID NO: 1130953 - RNA, 20 nt, Homo sapiens
agcuauuuaucuguaguaaa

SEQ ID NO: 1130954 - RNA, 13 nt, Homo sapiens
agcucacguguau

SEQ ID NO: 1130955 - RNA, 20 nt, Homo sapiens
agcucagaguugagaccuuu

SEQ ID NO: 1130956 - RNA, 18 nt, Homo sapiens
agcucagcauuuccacac

SEQ ID NO: 1130957 - RNA, 23 nt, Homo sapiens
agcucaggaaggggugugcugag

SEQ ID NO: 1130958 - RNA, 11 nt, Homo sapiens
agcucagggac

SEQ ID NO: 1130959 - RNA, 22 nt, Homo sapiens
agcucauagugaacacagcaga

SEQ ID NO: 1130960 - RNA, 13 nt, Homo sapiens
agcuccagcuuua

SEQ ID NO: 1130961 - RNA, 18 nt, Homo sapiens
agcucccaggccaacagu

SEQ ID NO: 1130962 - RNA, 10 nt, Homo sapiens
agcuccucac

SEQ ID NO: 1130963 - RNA, 13 nt, Homo sapiens
agcuccucacuca

SEQ ID NO: 1130964 - RNA, 23 nt, Homo sapiens
agcuccucagcggcuccagcuca

SEQ ID NO: 1130965 - RNA, 18 nt, Homo sapiens
agcuccuccccacuagca

SEQ ID NO: 1130966 - RNA, 21 nt, Homo sapiens
agcuccuccccacuagcauuu

SEQ ID NO: 1130967 - RNA, 23 nt, Homo sapiens
agcucguaauuuuuuaacuguaa

SEQ ID NO: 1130968 - RNA, 15 nt, Homo sapiens
agcucguuacuucag

SEQ ID NO: 1130969 - RNA, 15 nt, Homo sapiens
agcucuaaagaccau

SEQ ID NO: 1130970 - RNA, 21 nt, Homo sapiens
agcucuauguuuacaaaugga

SEQ ID NO: 1130971 - RNA, 19 nt, Homo sapiens
agcucucuucaaugacaua

SEQ ID NO: 1130972 - RNA, 16 nt, Homo sapiens
agcucugacauucuga

SEQ ID NO: 1130973 - RNA, 23 nt, Homo sapiens
agcucuggacagccccacccugg

SEQ ID NO: 1130974 - RNA, 20 nt, Homo sapiens
agcucuggugauaaggacau

SEQ ID NO: 1130975 - RNA, 16 nt, Homo sapiens
agcucuguccuguuag

SEQ ID NO: 1130976 - RNA, 23 nt, Homo sapiens
agcucugucugcucaaugccauu

SEQ ID NO: 1130977 - RNA, 11 nt, Homo sapiens
agcucuuccau

SEQ ID NO: 1130978 - RNA, 17 nt, Homo sapiens
agcucuuccgaaaacca

SEQ ID NO: 1130979 - RNA, 16 nt, Homo sapiens
agcucuugugucauug

SEQ ID NO: 1130980 - RNA, 16 nt, Homo sapiens
agcugaccagccguga

SEQ ID NO: 1130981 - RNA, 18 nt, Homo sapiens
agcugagcugugacauug

SEQ ID NO: 1130982 - RNA, 22 nt, Homo sapiens
agcugagggcccuguggagucc

SEQ ID NO: 1130983 - RNA, 13 nt, Homo sapiens
agcugcaaagugu

SEQ ID NO: 1130984 - RNA, 12 nt, Homo sapiens
agcugcauuaaa

SEQ ID NO: 1130985 - RNA, 21 nt, Homo sapiens
agcugcauuucacaugccuug

SEQ ID NO: 1130986 - RNA, 22 nt, Homo sapiens
agcugccccuccuggagcagaa

SEQ ID NO: 1130987 - RNA, 20 nt, Homo sapiens
agcugccucuucucuugaca

SEQ ID NO: 1130988 - RNA, 22 nt, Homo sapiens
agcugccuuggcucagacaugu

SEQ ID NO: 1130989 - RNA, 17 nt, Homo sapiens
agcugcuacuagcucuu

SEQ ID NO: 1130990 - RNA, 14 nt, Homo sapiens
agcugcuccgugcu

SEQ ID NO: 1130991 - RNA, 19 nt, Homo sapiens
agcugcugcagcccugcca

SEQ ID NO: 1130992 - RNA, 17 nt, Homo sapiens
agcugcuguugaacuuu

SEQ ID NO: 1130993 - RNA, 15 nt, Homo sapiens
agcuggaaaaccucc

SEQ ID NO: 1130994 - RNA, 13 nt, Homo sapiens
agcuggagccugg

SEQ ID NO: 1130995 - RNA, 13 nt, Homo sapiens
agcuggagggacc

SEQ ID NO: 1130996 - RNA, 19 nt, Homo sapiens
agcuggagggaccuugucu

SEQ ID NO: 1130997 - RNA, 20 nt, Homo sapiens
agcuggagggaccuugucuc

SEQ ID NO: 1130998 - RNA, 17 nt, Homo sapiens
agcuggauuacaggcau

SEQ ID NO: 1130999 - RNA, 13 nt, Homo sapiens
agcuggcuuucau

SEQ ID NO: 1131000 - RNA, 20 nt, Homo sapiens
agcugggcccgacauggcuc

SEQ ID NO: 1131001 - RNA, 23 nt, Homo sapiens
agcuggggaggugagagugcaga

SEQ ID NO: 1131002 - RNA, 13 nt, Homo sapiens
agcugggggucaa

SEQ ID NO: 1131003 - RNA, 18 nt, Homo sapiens
agcugguaaucuugcucu

SEQ ID NO: 1131004 - RNA, 15 nt, Homo sapiens
agcuguacugaggau

SEQ ID NO: 1131005 - RNA, 16 nt, Homo sapiens
agcugugcccugacca

SEQ ID NO: 1131006 - RNA, 23 nt, Homo sapiens
agcugugcugggugagcucuucc

SEQ ID NO: 1131007 - RNA, 17 nt, Homo sapiens
agcuguggugucagaaa

SEQ ID NO: 1131008 - RNA, 11 nt, Homo sapiens
agcuguugcua

SEQ ID NO: 1131009 - RNA, 13 nt, Homo sapiens
agcuguugcuauu

SEQ ID NO: 1131010 - RNA, 14 nt, Homo sapiens
agcuguugggaaca

SEQ ID NO: 1131011 - RNA, 19 nt, Homo sapiens
agcuuaagggaauaugcau

SEQ ID NO: 1131012 - RNA, 20 nt, Homo sapiens
agcuuacaagccagcuggag

SEQ ID NO: 1131013 - RNA, 14 nt, Homo sapiens
agcuuagaaugcau

SEQ ID NO: 1131014 - RNA, 17 nt, Homo sapiens
agcuuaggaaagaacau

SEQ ID NO: 1131015 - RNA, 14 nt, Homo sapiens
agcuuagugaaaag

SEQ ID NO: 1131016 - RNA, 20 nt, Homo sapiens
agcuuauggcaucucauuga

SEQ ID NO: 1131017 - RNA, 20 nt, Homo sapiens
agcuuccagagcucugaccc

SEQ ID NO: 1131018 - RNA, 17 nt, Homo sapiens
agcuucccacaccugcc

SEQ ID NO: 1131019 - RNA, 18 nt, Homo sapiens
agcuucccacaccugccu

SEQ ID NO: 1131020 - RNA, 20 nt, Homo sapiens
agcuuccuguccucccagcu

SEQ ID NO: 1131021 - RNA, 21 nt, Homo sapiens
agcuucuucaucuucaccaga

SEQ ID NO: 1131022 - RNA, 23 nt, Homo sapiens
agcuucuuccaggugcccagcua

SEQ ID NO: 1131023 - RNA, 16 nt, Homo sapiens
agcuugaucaaaggca

SEQ ID NO: 1131024 - RNA, 23 nt, Homo sapiens
agcuugcucuucagugggagaaa

SEQ ID NO: 1131025 - RNA, 17 nt, Homo sapiens
agcuuuacgcucaucac

SEQ ID NO: 1131026 - RNA, 15 nt, Homo sapiens
agcuuuccucaaaaa

SEQ ID NO: 1131027 - RNA, 18 nt, Homo sapiens
agcuuuuaaaaauguccu

SEQ ID NO: 1131028 - RNA, 18 nt, Homo sapiens
agcuuuuggagggugaua

SEQ ID NO: 1131029 - RNA, 13 nt, Homo sapiens
aggaaaacaauaa

SEQ ID NO: 1131030 - RNA, 15 nt, Homo sapiens
aggaaaagauuccug

SEQ ID NO: 1131031 - RNA, 17 nt, Homo sapiens
aggaaaagauuccuguc

SEQ ID NO: 1131032 - RNA, 20 nt, Homo sapiens
aggaaaagcggacaucagcu

SEQ ID NO: 1131033 - RNA, 15 nt, Homo sapiens
aggaaaauaaugaca

SEQ ID NO: 1131034 - RNA, 23 nt, Homo sapiens
aggaaaauguauccagaggaauu

SEQ ID NO: 1131035 - RNA, 15 nt, Homo sapiens
aggaaaauuugacau

SEQ ID NO: 1131036 - RNA, 14 nt, Homo sapiens
aggaaacaauauaa

SEQ ID NO: 1131037 - RNA, 18 nt, Homo sapiens
aggaaacaauucuuucaa

SEQ ID NO: 1131038 - RNA, 19 nt, Homo sapiens
aggaaacagcaaacagugg

SEQ ID NO: 1131039 - RNA, 16 nt, Homo sapiens
aggaaaccacaaccuu

SEQ ID NO: 1131040 - RNA, 16 nt, Homo sapiens
aggaaacccccagugu

SEQ ID NO: 1131041 - RNA, 21 nt, Homo sapiens
aggaaagaaguucacaucaga

SEQ ID NO: 1131042 - RNA, 20 nt, Homo sapiens
aggaaagaauuugccuucuc

SEQ ID NO: 1131043 - RNA, 13 nt, Homo sapiens
aggaaagcaauaa

SEQ ID NO: 1131044 - RNA, 15 nt, Homo sapiens
aggaaaggcacauua

SEQ ID NO: 1131045 - RNA, 15 nt, Homo sapiens
aggaaauaaaguaua

SEQ ID NO: 1131046 - RNA, 22 nt, Homo sapiens
aggaacagugugguuugggaaa

SEQ ID NO: 1131047 - RNA, 19 nt, Homo sapiens
aggaaccucgaguacugug

SEQ ID NO: 1131048 - RNA, 14 nt, Homo sapiens
aggaacuuugucac

SEQ ID NO: 1131049 - RNA, 18 nt, Homo sapiens
aggaagaagauagaucca

SEQ ID NO: 1131050 - RNA, 13 nt, Homo sapiens
aggaagagggauc

SEQ ID NO: 1131051 - RNA, 14 nt, Homo sapiens
aggaagaugcucau

SEQ ID NO: 1131052 - RNA, 14 nt, Homo sapiens
aggaagcuuaggga

SEQ ID NO: 1131053 - RNA, 22 nt, Homo sapiens
aggaaggcucucggguggggga

SEQ ID NO: 1131054 - RNA, 17 nt, Homo sapiens
aggaaguagaccucuuu

SEQ ID NO: 1131055 - RNA, 19 nt, Homo sapiens
aggaagucacagauucuuu

SEQ ID NO: 1131056 - RNA, 19 nt, Homo sapiens
aggaauccucugugucuuc

SEQ ID NO: 1131057 - RNA, 21 nt, Homo sapiens
aggaauccucugugucuucaa

SEQ ID NO: 1131058 - RNA, 16 nt, Homo sapiens
aggaaugcugggcugu

SEQ ID NO: 1131059 - RNA, 23 nt, Homo sapiens
aggaauuuuuuuaacuuaaggga

SEQ ID NO: 1131060 - RNA, 19 nt, Homo sapiens
aggacaaagugccaaagaa

SEQ ID NO: 1131061 - RNA, 13 nt, Homo sapiens
aggacaaauugag

SEQ ID NO: 1131062 - RNA, 18 nt, Homo sapiens
aggacaagaggagcauga

SEQ ID NO: 1131063 - RNA, 13 nt, Homo sapiens
aggacaagggaau

SEQ ID NO: 1131064 - RNA, 23 nt, Homo sapiens
aggacacuacccugagaucugca

SEQ ID NO: 1131065 - RNA, 15 nt, Homo sapiens
aggacagacagcagg

SEQ ID NO: 1131066 - RNA, 15 nt, Homo sapiens
aggacagugacccca

SEQ ID NO: 1131067 - RNA, 20 nt, Homo sapiens
aggacauccccccgccaaaa

SEQ ID NO: 1131068 - RNA, 20 nt, Homo sapiens
aggacaugcaugacacuucc

SEQ ID NO: 1131069 - RNA, 23 nt, Homo sapiens
aggacaugcgguagccagcacac

SEQ ID NO: 1131070 - RNA, 16 nt, Homo sapiens
aggaccaacauccagu

SEQ ID NO: 1131071 - RNA, 19 nt, Homo sapiens
aggaccagaagcauuucac

SEQ ID NO: 1131072 - RNA, 11 nt, Homo sapiens
aggacccaagc

SEQ ID NO: 1131073 - RNA, 15 nt, Homo sapiens
aggacccacacugcu

SEQ ID NO: 1131074 - RNA, 16 nt, Homo sapiens
aggaccuggcugccau

SEQ ID NO: 1131075 - RNA, 20 nt, Homo sapiens
aggaccuuaaaugcuacuga

SEQ ID NO: 1131076 - RNA, 21 nt, Homo sapiens
aggaccuuaaaugcuacugaa

SEQ ID NO: 1131077 - RNA, 15 nt, Homo sapiens
aggacuaaguucuca

SEQ ID NO: 1131078 - RNA, 22 nt, Homo sapiens
aggacuaaguucucauuguuca

SEQ ID NO: 1131079 - RNA, 17 nt, Homo sapiens
aggacuaauccaauacc

SEQ ID NO: 1131080 - RNA, 13 nt, Homo sapiens
aggacuaugacaa

SEQ ID NO: 1131081 - RNA, 15 nt, Homo sapiens
cagaaaguccagcua

SEQ ID NO: 1131082 - RNA, 20 nt, Homo sapiens
cagaaagugccuuuaucuca

SEQ ID NO: 1131083 - RNA, 22 nt, Homo sapiens
cagaaaugaggaggaugcuaaa

SEQ ID NO: 1131084 - RNA, 18 nt, Homo sapiens
cagaaauuuaauucaugu

SEQ ID NO: 1131085 - RNA, 21 nt, Homo sapiens
cagaacacagcaauuccucag

SEQ ID NO: 1131086 - RNA, 16 nt, Homo sapiens
cagaaccaccccggcc

SEQ ID NO: 1131087 - RNA, 22 nt, Homo sapiens
cagaaccagcagaacagccauu

SEQ ID NO: 1131088 - RNA, 15 nt, Homo sapiens
cagaaccagugacaa

SEQ ID NO: 1131089 - RNA, 19 nt, Homo sapiens
cagaaccggccuggagcuc

SEQ ID NO: 1131090 - RNA, 23 nt, Homo sapiens
cagaacuucacagugacacugga

SEQ ID NO: 1131091 - RNA, 15 nt, Homo sapiens
cagaagaaaagcaaa

SEQ ID NO: 1131092 - RNA, 20 nt, Homo sapiens
cagaagaaaauuugccaauc

SEQ ID NO: 1131093 - RNA, 16 nt, Homo sapiens
cagaagagaauuagaa

SEQ ID NO: 1131094 - RNA, 14 nt, Homo sapiens
cagaagccugaugc

SEQ ID NO: 1131095 - RNA, 18 nt, Homo sapiens
cagaagccugaugcugac

SEQ ID NO: 1131096 - RNA, 12 nt, Homo sapiens
cagaagcugccc

SEQ ID NO: 1131097 - RNA, 15 nt, Homo sapiens
cagaaggagagugag

SEQ ID NO: 1131098 - RNA, 22 nt, Homo sapiens
cagaaguguaguaugcuguaug

SEQ ID NO: 1131099 - RNA, 14 nt, Homo sapiens
cagaaguucugggu

SEQ ID NO: 1131100 - RNA, 20 nt, Homo sapiens
cagaaguuguggauuucagu

SEQ ID NO: 1131101 - RNA, 22 nt, Homo sapiens
cagaauacgggucccucuaacc

SEQ ID NO: 1131102 - RNA, 17 nt, Homo sapiens
cagaauauaauucccaa

SEQ ID NO: 1131103 - RNA, 20 nt, Homo sapiens
cagaaucccccaaagaacca

SEQ ID NO: 1131104 - RNA, 18 nt, Homo sapiens
cagaaucccguaacaccu

SEQ ID NO: 1131105 - RNA, 22 nt, Homo sapiens
cagaaugaacccauagggagcu

SEQ ID NO: 1131106 - RNA, 11 nt, Homo sapiens
cagaauggagg

SEQ ID NO: 1131107 - RNA, 15 nt, Homo sapiens
cagaauguacuugau

SEQ ID NO: 1131108 - RNA, 21 nt, Homo sapiens
cagaauguauauuaaggugug

SEQ ID NO: 1131109 - RNA, 13 nt, Homo sapiens
cagaauucuucag

SEQ ID NO: 1131110 - RNA, 20 nt, Homo sapiens
cagaauuuuaugcggcauuu

SEQ ID NO: 1131111 - RNA, 16 nt, Homo sapiens
cagaauuuuuaacugu

SEQ ID NO: 1131112 - RNA, 20 nt, Homo sapiens
cagacaaauacuuagacagu

SEQ ID NO: 1131113 - RNA, 16 nt, Homo sapiens
cagacaacacugggaa

SEQ ID NO: 1131114 - RNA, 14 nt, Homo sapiens
cagacaagcuugaa

SEQ ID NO: 1131115 - RNA, 17 nt, Homo sapiens
cagacaaguaaucacua

SEQ ID NO: 1131116 - RNA, 16 nt, Homo sapiens
cagacagacaacacug

SEQ ID NO: 1131117 - RNA, 20 nt, Homo sapiens
cagacagacaacacugggaa

SEQ ID NO: 1131118 - RNA, 17 nt, Homo sapiens
cagacaggacaggugug

SEQ ID NO: 1131119 - RNA, 21 nt, Homo sapiens
cagacaggcggggcccagcgc

SEQ ID NO: 1131120 - RNA, 22 nt, Homo sapiens
cagacagguguauggagucacc

SEQ ID NO: 1131121 - RNA, 18 nt, Homo sapiens
cagacauacaaacauaag

SEQ ID NO: 1131122 - RNA, 20 nt, Homo sapiens
cagacauacauuucucauac

SEQ ID NO: 1131123 - RNA, 22 nt, Homo sapiens
cagaccacuauucuuaacuauu

SEQ ID NO: 1131124 - RNA, 20 nt, Homo sapiens
cagaccacugauaaaaccau

SEQ ID NO: 1131125 - RNA, 23 nt, Homo sapiens
cagacccacagaagguguucaaa

SEQ ID NO: 1131126 - RNA, 17 nt, Homo sapiens
cagacccccuccacggu

SEQ ID NO: 1131127 - RNA, 14 nt, Homo sapiens
cagaccucuggauu

SEQ ID NO: 1131128 - RNA, 16 nt, Homo sapiens
cagaccugucgucucu

SEQ ID NO: 1131129 - RNA, 14 nt, Homo sapiens
cagaccuuuggacu

SEQ ID NO: 1131130 - RNA, 18 nt, Homo sapiens
cagaccuuuuauccacuu

SEQ ID NO: 1131131 - RNA, 13 nt, Homo sapiens
cagacgaaggcaa

SEQ ID NO: 1131132 - RNA, 15 nt, Homo sapiens
cagacgucucaagac

SEQ ID NO: 1131133 - RNA, 17 nt, Homo sapiens
cagacgucucaagacug

SEQ ID NO: 1131134 - RNA, 13 nt, Homo sapiens
cagacgugugacc

SEQ ID NO: 1131135 - RNA, 22 nt, Homo sapiens
cagacuagacaccuucugugcu

SEQ ID NO: 1131136 - RNA, 23 nt, Homo sapiens
cagacuagacaccuucugugcuc

SEQ ID NO: 1131137 - RNA, 16 nt, Homo sapiens
cagacucaaaugcuca

SEQ ID NO: 1131138 - RNA, 22 nt, Homo sapiens
cagacucauccugaacagcaug

SEQ ID NO: 1131139 - RNA, 14 nt, Homo sapiens
cagacucccauucc

SEQ ID NO: 1131140 - RNA, 18 nt, Homo sapiens
cagacucuuccaccagag

SEQ ID NO: 1131141 - RNA, 15 nt, Homo sapiens
cagacuuccuugaga

SEQ ID NO: 1131142 - RNA, 18 nt, Homo sapiens
cagacuuuggaaaaugca

SEQ ID NO: 1131143 - RNA, 14 nt, Homo sapiens
cagagaaaagagau

SEQ ID NO: 1131144 - RNA, 19 nt, Homo sapiens
cagagaaaagcuguuugca

SEQ ID NO: 1131145 - RNA, 18 nt, Homo sapiens
cagagaaaggcaagggag

SEQ ID NO: 1131146 - RNA, 23 nt, Homo sapiens
cagagaagcucucgggcuaggaa

SEQ ID NO: 1131147 - RNA, 16 nt, Homo sapiens
cagagacaggaaaauc

SEQ ID NO: 1131148 - RNA, 15 nt, Homo sapiens
cagagaccauugcaa

SEQ ID NO: 1131149 - RNA, 14 nt, Homo sapiens
cagagaccuaugua

SEQ ID NO: 1131150 - RNA, 20 nt, Homo sapiens
cagagaccugaagugugcac

SEQ ID NO: 1131151 - RNA, 20 nt, Homo sapiens
cagagagacaacagauuuac

SEQ ID NO: 1131152 - RNA, 18 nt, Homo sapiens
cagagagacuguuaucag

SEQ ID NO: 1131153 - RNA, 22 nt, Homo sapiens
cagagagaggggagaagccugg

SEQ ID NO: 1131154 - RNA, 15 nt, Homo sapiens
cagagaguccagcua

SEQ ID NO: 1131155 - RNA, 16 nt, Homo sapiens
cagagauaaaccaaua

SEQ ID NO: 1131156 - RNA, 18 nt, Homo sapiens
cagagauauuucuucagg

SEQ ID NO: 1131157 - RNA, 22 nt, Homo sapiens
cagagauggaugcauguucuga

SEQ ID NO: 1131158 - RNA, 21 nt, Homo sapiens
cagagccaccugacucuugca

SEQ ID NO: 1131159 - RNA, 21 nt, Homo sapiens
cagagccagccggcuaugaaa

SEQ ID NO: 1131160 - RNA, 12 nt, Homo sapiens
cagagcccggug

SEQ ID NO: 1131161 - RNA, 12 nt, Homo sapiens
cagagcucccuc

SEQ ID NO: 1131162 - RNA, 18 nt, Homo sapiens
cagagcugcacaggguuu

SEQ ID NO: 1131163 - RNA, 13 nt, Homo sapiens
cagagcuuuucag

SEQ ID NO: 1131164 - RNA, 17 nt, Homo sapiens
cagaggaagagacauga

SEQ ID NO: 1131165 - RNA, 14 nt, Homo sapiens
cagaggacugugau

SEQ ID NO: 1131166 - RNA, 22 nt, Homo sapiens
cagaggcagcccgcacaccugc

SEQ ID NO: 1131167 - RNA, 20 nt, Homo sapiens
cagagggaugggagagucaa

SEQ ID NO: 1131168 - RNA, 19 nt, Homo sapiens
cagaggguggcuggaguga

SEQ ID NO: 1131169 - RNA, 21 nt, Homo sapiens
cagagggugggaggggccaug

SEQ ID NO: 1131170 - RNA, 12 nt, Homo sapiens
cagagguaaaaa

SEQ ID NO: 1131171 - RNA, 18 nt, Homo sapiens
cagagguuguagugagcc

SEQ ID NO: 1131172 - RNA, 15 nt, Homo sapiens
cagaguccuuuccaa

SEQ ID NO: 1131173 - RNA, 22 nt, Homo sapiens
cagagucugccccacauguggc

SEQ ID NO: 1131174 - RNA, 16 nt, Homo sapiens
cagaguggacuguucc

SEQ ID NO: 1131175 - RNA, 18 nt, Homo sapiens
cagaguggggaugacaug

SEQ ID NO: 1131176 - RNA, 21 nt, Homo sapiens
cagaguguguuuuugcacugu

SEQ ID NO: 1131177 - RNA, 23 nt, Homo sapiens
cagaguuggacuucuagacucac

SEQ ID NO: 1131178 - RNA, 20 nt, Homo sapiens
cagaguuucucucuguugcc

SEQ ID NO: 1131179 - RNA, 13 nt, Homo sapiens
cagauaaaugaca

SEQ ID NO: 1131180 - RNA, 19 nt, Homo sapiens
cagauaaaugacaagcaaa

SEQ ID NO: 1131181 - RNA, 17 nt, Homo sapiens
cagauacugcuguguaa

SEQ ID NO: 1131182 - RNA, 12 nt, Homo sapiens
cagauagcaucu

SEQ ID NO: 1131183 - RNA, 12 nt, Homo sapiens
cagauaugugcc

SEQ ID NO: 1131184 - RNA, 14 nt, Homo sapiens
cagaucaaauuuca

SEQ ID NO: 1131185 - RNA, 16 nt, Homo sapiens
cagaucaagcugugag

SEQ ID NO: 1131186 - RNA, 17 nt, Homo sapiens
cagaucaagcugugaga

SEQ ID NO: 1131187 - RNA, 18 nt, Homo sapiens
cagaucaagcugugagac

SEQ ID NO: 1131188 - RNA, 12 nt, Homo sapiens
cagauccaggga

SEQ ID NO: 1131189 - RNA, 17 nt, Homo sapiens
cagauccucuucucaaa

SEQ ID NO: 1131190 - RNA, 23 nt, Homo sapiens
cagaucuaucuugucaaucccaa

SEQ ID NO: 1131191 - RNA, 16 nt, Homo sapiens
cagaucucauguccuc

SEQ ID NO: 1131192 - RNA, 19 nt, Homo sapiens
cagaucugcaccaccaugc

SEQ ID NO: 1131193 - RNA, 18 nt, Homo sapiens
cagaucuuggacucauga

SEQ ID NO: 1131194 - RNA, 15 nt, Homo sapiens
cagaugaacuaucca

SEQ ID NO: 1131195 - RNA, 14 nt, Homo sapiens
cagaugagaguaca

SEQ ID NO: 1131196 - RNA, 17 nt, Homo sapiens
cagaugaugcuuuggaa

SEQ ID NO: 1131197 - RNA, 16 nt, Homo sapiens
cagaugcuaaaagcua

SEQ ID NO: 1131198 - RNA, 15 nt, Homo sapiens
cagaugcuccaagau

SEQ ID NO: 1131199 - RNA, 19 nt, Homo sapiens
cagaugcuuuccugcacau

SEQ ID NO: 1131200 - RNA, 22 nt, Homo sapiens
cagaugcuuuccugcacauuaa

SEQ ID NO: 1131201 - RNA, 21 nt, Homo sapiens
cagauggacuccagccugccu

SEQ ID NO: 1131202 - RNA, 20 nt, Homo sapiens
cagauggcagguuugcaauc

SEQ ID NO: 1131203 - RNA, 18 nt, Homo sapiens
cagauggccacugcucuu

SEQ ID NO: 1131204 - RNA, 20 nt, Homo sapiens
cagaugggcauaugugucag

SEQ ID NO: 1131205 - RNA, 22 nt, Homo sapiens
cagaugggcauaugugucagug

SEQ ID NO: 1131206 - RNA, 13 nt, Homo sapiens
cagauguguuugc

SEQ ID NO: 1131207 - RNA, 18 nt, Homo sapiens
cagauuagcuaggggaca

SEQ ID NO: 1131208 - RNA, 21 nt, Homo sapiens
cagauucuccucuaauucugu

SEQ ID NO: 1131209 - RNA, 22 nt, Homo sapiens
cagauucuccucuaauucugua

SEQ ID NO: 1131210 - RNA, 12 nt, Homo sapiens
cagauucuucag

SEQ ID NO: 1131211 - RNA, 13 nt, Homo sapiens
cagauugugauaa

SEQ ID NO: 1131212 - RNA, 22 nt, Homo sapiens
cagauugugauaagaaaagcca

SEQ ID NO: 1131213 - RNA, 16 nt, Homo sapiens
caggcagagggccuuu

SEQ ID NO: 1131214 - RNA, 15 nt, Homo sapiens
caggcagauccagga

SEQ ID NO: 1131215 - RNA, 14 nt, Homo sapiens
caggcagcugccug

SEQ ID NO: 1131216 - RNA, 15 nt, Homo sapiens
caggcagugugaguu

SEQ ID NO: 1131217 - RNA, 20 nt, Homo sapiens
caggcauggcuggugccuga

SEQ ID NO: 1131218 - RNA, 20 nt, Homo sapiens
caggcaugugucccuuccaa

SEQ ID NO: 1131219 - RNA, 13 nt, Homo sapiens
caggcauugccaa

SEQ ID NO: 1131220 - RNA, 14 nt, Homo sapiens
caggcauuuuuaca

SEQ ID NO: 1131221 - RNA, 20 nt, Homo sapiens
caggcauuuuuacagcacac

SEQ ID NO: 1131222 - RNA, 16 nt, Homo sapiens
caggccagcgcugcaa

SEQ ID NO: 1131223 - RNA, 14 nt, Homo sapiens
caggccagcuccuu

SEQ ID NO: 1131224 - RNA, 15 nt, Homo sapiens
caggccaggccagcu

SEQ ID NO: 1131225 - RNA, 14 nt, Homo sapiens
caggcccaaagccu

SEQ ID NO: 1131226 - RNA, 17 nt, Homo sapiens
caggccccgugaggcaa

SEQ ID NO: 1131227 - RNA, 17 nt, Homo sapiens
caggcccgcuaggucca

SEQ ID NO: 1131228 - RNA, 19 nt, Homo sapiens
caggccuaggagacuagga

SEQ ID NO: 1131229 - RNA, 17 nt, Homo sapiens
caggccucacuggcuca

SEQ ID NO: 1131230 - RNA, 14 nt, Homo sapiens
caggccucccucaa

SEQ ID NO: 1131231 - RNA, 20 nt, Homo sapiens
caggccucucggugcuccau

SEQ ID NO: 1131232 - RNA, 23 nt, Homo sapiens
caggccucugguguuugcaaagg

SEQ ID NO: 1131233 - RNA, 19 nt, Homo sapiens
caggccugccuucucaggg

SEQ ID NO: 1131234 - RNA, 17 nt, Homo sapiens
caggccuggagcguuug

SEQ ID NO: 1131235 - RNA, 13 nt, Homo sapiens
caggccuguguga

SEQ ID NO: 1131236 - RNA, 16 nt, Homo sapiens
caggccuugcugacuc

SEQ ID NO: 1131237 - RNA, 16 nt, Homo sapiens
caggcgugacucagca

SEQ ID NO: 1131238 - RNA, 17 nt, Homo sapiens
caggcuagagugcaaug

SEQ ID NO: 1131239 - RNA, 22 nt, Homo sapiens
caggcuagagugcaauggugca

SEQ ID NO: 1131240 - RNA, 13 nt, Homo sapiens
caggcucugacca

SEQ ID NO: 1131241 - RNA, 18 nt, Homo sapiens
caggcuggaccagacccc

SEQ ID NO: 1131242 - RNA, 17 nt, Homo sapiens
caggcuggagugcagug

SEQ ID NO: 1131243 - RNA, 19 nt, Homo sapiens
caggcugggcaucauagca

SEQ ID NO: 1131244 - RNA, 13 nt, Homo sapiens
caggcuggucuca

SEQ ID NO: 1131245 - RNA, 15 nt, Homo sapiens
caggcuggucucaaa

SEQ ID NO: 1131246 - RNA, 16 nt, Homo sapiens
caggcugucucauuua

SEQ ID NO: 1131247 - RNA, 21 nt, Homo sapiens
caggcuguuuauauguucaca

SEQ ID NO: 1131248 - RNA, 15 nt, Homo sapiens
caggcuucugagcac

SEQ ID NO: 1131249 - RNA, 21 nt, Homo sapiens
caggcuuggauggaacaugcc

SEQ ID NO: 1131250 - RNA, 23 nt, Homo sapiens
cagggaauccugaccugagccag

SEQ ID NO: 1131251 - RNA, 17 nt, Homo sapiens
cagggaccccugcccuu

SEQ ID NO: 1131252 - RNA, 15 nt, Homo sapiens
cagggacugugaaca

SEQ ID NO: 1131253 - RNA, 18 nt, Homo sapiens
cagggagaggcugugucc

SEQ ID NO: 1131254 - RNA, 16 nt, Homo sapiens
cagggauccaauauga

SEQ ID NO: 1131255 - RNA, 20 nt, Homo sapiens
cagggcagaggagagcagcu

SEQ ID NO: 1131256 - RNA, 18 nt, Homo sapiens
cagggcagcgccaggcug

SEQ ID NO: 1131257 - RNA, 22 nt, Homo sapiens
cagggcagucauuggcugucuc

SEQ ID NO: 1131258 - RNA, 19 nt, Homo sapiens
cagggccacagagcuacau

SEQ ID NO: 1131259 - RNA, 19 nt, Homo sapiens
cagggccauggcucagggu

SEQ ID NO: 1131260 - RNA, 14 nt, Homo sapiens
cagggccauuucag

SEQ ID NO: 1131261 - RNA, 19 nt, Homo sapiens
cagggcccagagcccagcu

SEQ ID NO: 1131262 - RNA, 17 nt, Homo sapiens
cagggcccccaucucau

SEQ ID NO: 1131263 - RNA, 16 nt, Homo sapiens
cagggccccccaacug

SEQ ID NO: 1131264 - RNA, 20 nt, Homo sapiens
cagggcggucuucugcucca

SEQ ID NO: 1131265 - RNA, 22 nt, Homo sapiens
cagggcucagcuagacauugca

SEQ ID NO: 1131266 - RNA, 19 nt, Homo sapiens
cagggcucccugcccugac

SEQ ID NO: 1131267 - RNA, 13 nt, Homo sapiens
cagggcugauaag

SEQ ID NO: 1131268 - RNA, 13 nt, Homo sapiens
cagggcugggccu

SEQ ID NO: 1131269 - RNA, 18 nt, Homo sapiens
cagggcuuccucuuccgg

SEQ ID NO: 1131270 - RNA, 13 nt, Homo sapiens
caggggacacugg

SEQ ID NO: 1131271 - RNA, 17 nt, Homo sapiens
caggggaccagagggau

SEQ ID NO: 1131272 - RNA, 15 nt, Homo sapiens
caggggcagccacac

SEQ ID NO: 1131273 - RNA, 23 nt, Homo sapiens
caggggcugcaguagccauguua

SEQ ID NO: 1131274 - RNA, 17 nt, Homo sapiens
caggguaaaaggugcag

SEQ ID NO: 1131275 - RNA, 20 nt, Homo sapiens
caggguagguuugugucuua

SEQ ID NO: 1131276 - RNA, 17 nt, Homo sapiens
cagggugaggugcuuga

SEQ ID NO: 1131277 - RNA, 15 nt, Homo sapiens
cagggugcaguauca

SEQ ID NO: 1131278 - RNA, 16 nt, Homo sapiens
cagggugcuaguggug

SEQ ID NO: 1131279 - RNA, 16 nt, Homo sapiens
caggguggagugcagu

SEQ ID NO: 1131280 - RNA, 15 nt, Homo sapiens
cagggugguggcaca

SEQ ID NO: 1131281 - RNA, 17 nt, Homo sapiens
cagggugguguaccugc

SEQ ID NO: 1131282 - RNA, 13 nt, Homo sapiens
cagguacuaugca

SEQ ID NO: 1131283 - RNA, 23 nt, Homo sapiens
cagguaggaaacaauucuuucaa

SEQ ID NO: 1131284 - RNA, 17 nt, Homo sapiens
caggucaguuuaugaaa

SEQ ID NO: 1131285 - RNA, 20 nt, Homo sapiens
cagguccagcuuuacugugg

SEQ ID NO: 1131286 - RNA, 13 nt, Homo sapiens
caggucccacugc

SEQ ID NO: 1131287 - RNA, 15 nt, Homo sapiens
caggucccuauagca

SEQ ID NO: 1131288 - RNA, 22 nt, Homo sapiens
cagguccugcuccgcugccugg

SEQ ID NO: 1131289 - RNA, 12 nt, Homo sapiens
caggucuuucaa

SEQ ID NO: 1131290 - RNA, 15 nt, Homo sapiens
caggugcagccagag

SEQ ID NO: 1131291 - RNA, 14 nt, Homo sapiens
caggugccuuucaa

SEQ ID NO: 1131292 - RNA, 11 nt, Homo sapiens
cagguggaccc

SEQ ID NO: 1131293 - RNA, 18 nt, Homo sapiens
caggugugacucuagcaa

SEQ ID NO: 1131294 - RNA, 19 nt, Homo sapiens
caggugugagccaccacac

SEQ ID NO: 1131295 - RNA, 16 nt, Homo sapiens
cagguuaaugcugaaa

SEQ ID NO: 1131296 - RNA, 17 nt, Homo sapiens
cagguucuauuuggaau

SEQ ID NO: 1131297 - RNA, 12 nt, Homo sapiens
cagguucuuagg

SEQ ID NO: 1131298 - RNA, 21 nt, Homo sapiens
cagguuugguuuuuuuguaca

SEQ ID NO: 1131299 - RNA, 14 nt, Homo sapiens
cagguuuuugccca

SEQ ID NO: 1131300 - RNA, 15 nt, Homo sapiens
caguaaccaugcccg

SEQ ID NO: 1131301 - RNA, 19 nt, Homo sapiens
caguaacccccacuggacu

SEQ ID NO: 1131302 - RNA, 19 nt, Homo sapiens
caguaaucccagcuacuca

SEQ ID NO: 1131303 - RNA, 20 nt, Homo sapiens
caguaauuauuauuuaacuc

SEQ ID NO: 1131304 - RNA, 17 nt, Homo sapiens
caguacauaauacacuu

SEQ ID NO: 1131305 - RNA, 14 nt, Homo sapiens
caguaccaguguaa

SEQ ID NO: 1131306 - RNA, 14 nt, Homo sapiens
caguacucuaguca

SEQ ID NO: 1131307 - RNA, 22 nt, Homo sapiens
caguagacaucguuuuaugaaa

SEQ ID NO: 1131308 - RNA, 18 nt, Homo sapiens
caguagcaaacuuuucac

SEQ ID NO: 1131309 - RNA, 23 nt, Homo sapiens
caguauacucagcuaacaaaccu

SEQ ID NO: 1131310 - RNA, 17 nt, Homo sapiens
caguauagguguuugcu

SEQ ID NO: 1131311 - RNA, 23 nt, Homo sapiens
caguaucccaacugcagguccag

SEQ ID NO: 1131312 - RNA, 14 nt, Homo sapiens
caguaugacauuuc

SEQ ID NO: 1131313 - RNA, 21 nt, Homo sapiens
cagucaaaacccaccaaaacc

SEQ ID NO: 1131314 - RNA, 23 nt, Homo sapiens
cagucaauauguuggaggcaugc

SEQ ID NO: 1131315 - RNA, 12 nt, Homo sapiens
cagucacagcca

SEQ ID NO: 1131316 - RNA, 15 nt, Homo sapiens
cagucacugugagcu

SEQ ID NO: 1131317 - RNA, 17 nt, Homo sapiens
cagucagacauggccaa

SEQ ID NO: 1131318 - RNA, 16 nt, Homo sapiens
cagucaucaacaauga

SEQ ID NO: 1131319 - RNA, 15 nt, Homo sapiens
caguccaugcuccag

SEQ ID NO: 1131320 - RNA, 13 nt, Homo sapiens
caguccauuuccu

SEQ ID NO: 1131321 - RNA, 21 nt, Homo sapiens
caguccccaaccugcacucua

SEQ ID NO: 1131322 - RNA, 13 nt, Homo sapiens
caguccccaguga

SEQ ID NO: 1131323 - RNA, 18 nt, Homo sapiens
cagucccuaaaaacacag

SEQ ID NO: 1131324 - RNA, 20 nt, Homo sapiens
caguccucccagacuaccug

SEQ ID NO: 1131325 - RNA, 14 nt, Homo sapiens
caguccucuuucaa

SEQ ID NO: 1131326 - RNA, 12 nt, Homo sapiens
caguccuuccac

SEQ ID NO: 1131327 - RNA, 17 nt, Homo sapiens
cagucgcauagacuuau

SEQ ID NO: 1131328 - RNA, 23 nt, Homo sapiens
cagucuaaaaaaggaauccucug

SEQ ID NO: 1131329 - RNA, 18 nt, Homo sapiens
cagucuaguguaauggau

SEQ ID NO: 1131330 - RNA, 17 nt, Homo sapiens
cagucucuccagcauca

SEQ ID NO: 1131331 - RNA, 23 nt, Homo sapiens
cagucucuccagcaucaauucca

SEQ ID NO: 1131332 - RNA, 18 nt, Homo sapiens
cagucucuucuaagcaaa

SEQ ID NO: 1131333 - RNA, 15 nt, Homo sapiens
cagucuggcaugcag

SEQ ID NO: 1131334 - RNA, 22 nt, Homo sapiens
cagucuggugaacuucaaaagc

SEQ ID NO: 1131335 - RNA, 22 nt, Homo sapiens
cagucuuccauuugcaagggaa

SEQ ID NO: 1131336 - RNA, 18 nt, Homo sapiens
cagugaaagucaauucag

SEQ ID NO: 1131337 - RNA, 14 nt, Homo sapiens
cagugaacaguuug

SEQ ID NO: 1131338 - RNA, 13 nt, Homo sapiens
cagugaagacaga

SEQ ID NO: 1131339 - RNA, 20 nt, Homo sapiens
cagugaaggcuguccuuacc

SEQ ID NO: 1131340 - RNA, 14 nt, Homo sapiens
cagugaaguguucu

SEQ ID NO: 1131341 - RNA, 15 nt, Homo sapiens
cagugacaaccaaaa

SEQ ID NO: 1131342 - RNA, 16 nt, Homo sapiens
cagugacgugacucag

SEQ ID NO: 1131343 - RNA, 21 nt, Homo sapiens
cagugagaguacucacuuuuc

SEQ ID NO: 1131344 - RNA, 20 nt, Homo sapiens
cagugagcugagaucaugcc

SEQ ID NO: 1131345 - RNA, 21 nt, Homo sapiens
cagugagcugagaucaugcca

SEQ ID NO: 1131346 - RNA, 18 nt, Homo sapiens
caugugacuaaaaaugca

SEQ ID NO: 1131347 - RNA, 22 nt, Homo sapiens
caugugcguggaaguguuccug

SEQ ID NO: 1131348 - RNA, 17 nt, Homo sapiens
caugugcuagucacugg

SEQ ID NO: 1131349 - RNA, 22 nt, Homo sapiens
cauguggaagaaaacaagacau

SEQ ID NO: 1131350 - RNA, 21 nt, Homo sapiens
cauguguguguacaacacugg

SEQ ID NO: 1131351 - RNA, 19 nt, Homo sapiens
cauguuacuaagcaggcca

SEQ ID NO: 1131352 - RNA, 23 nt, Homo sapiens
cauguucaucaauaccugcugag

SEQ ID NO: 1131353 - RNA, 17 nt, Homo sapiens
cauguucccaaaacaau

SEQ ID NO: 1131354 - RNA, 13 nt, Homo sapiens
cauguugauuaaa

SEQ ID NO: 1131355 - RNA, 22 nt, Homo sapiens
cauguuggccaggcuggucuca

SEQ ID NO: 1131356 - RNA, 24 nt, Homo sapiens
cauguuggccaggcuggucucaaa

SEQ ID NO: 1131357 - RNA, 17 nt, Homo sapiens
cauguuuaaaccugaca

SEQ ID NO: 1131358 - RNA, 14 nt, Homo sapiens
cauguuuaauguga

SEQ ID NO: 1131359 - RNA, 16 nt, Homo sapiens
cauguuuaauugugau

SEQ ID NO: 1131360 - RNA, 23 nt, Homo sapiens
cauguuuauaaaucuuaugcucu

SEQ ID NO: 1131361 - RNA, 17 nt, Homo sapiens
cauguuuuuucugcaau

SEQ ID NO: 1131362 - RNA, 18 nt, Homo sapiens
cauguuuuuucugcaaug

SEQ ID NO: 1131363 - RNA, 23 nt, Homo sapiens
cauguuuuuucugcaaugacugu

SEQ ID NO: 1131364 - RNA, 15 nt, Homo sapiens
cauuaagguagaacu

SEQ ID NO: 1131365 - RNA, 18 nt, Homo sapiens
cauuaauuuucaacucaa

SEQ ID NO: 1131366 - RNA, 16 nt, Homo sapiens
cauuacccagcuaaau

SEQ ID NO: 1131367 - RNA, 18 nt, Homo sapiens
cauuacccagcuaaauaa

SEQ ID NO: 1131368 - RNA, 16 nt, Homo sapiens
cauuacuuguauaaau

SEQ ID NO: 1131369 - RNA, 18 nt, Homo sapiens
cauuaggcuuacguacua

SEQ ID NO: 1131370 - RNA, 23 nt, Homo sapiens
cauuaguuguuagugauggagcu

SEQ ID NO: 1131371 - RNA, 14 nt, Homo sapiens
cauuauagccucag

SEQ ID NO: 1131372 - RNA, 15 nt, Homo sapiens
cauuaucauguguaa

SEQ ID NO: 1131373 - RNA, 21 nt, Homo sapiens
cauuauguaaaauguuuuagc

SEQ ID NO: 1131374 - RNA, 16 nt, Homo sapiens
cauuauuauuacuuuu

SEQ ID NO: 1131375 - RNA, 16 nt, Homo sapiens
cauuauugacgaacug

SEQ ID NO: 1131376 - RNA, 17 nt, Homo sapiens
cauucaacucuccaaug

SEQ ID NO: 1131377 - RNA, 23 nt, Homo sapiens
cauucaaucaaccugcacuucau

SEQ ID NO: 1131378 - RNA, 13 nt, Homo sapiens
cauucacaguucu

SEQ ID NO: 1131379 - RNA, 18 nt, Homo sapiens
cauucaccuuagugcaac

SEQ ID NO: 1131380 - RNA, 14 nt, Homo sapiens
cauucagauuuacc

SEQ ID NO: 1131381 - RNA, 20 nt, Homo sapiens
cauucaggagcuuccugucc

SEQ ID NO: 1131382 - RNA, 21 nt, Homo sapiens
cauucagggcuauuuuuuccc

SEQ ID NO: 1131383 - RNA, 22 nt, Homo sapiens
cauucauaaaaguuugcaugug

SEQ ID NO: 1131384 - RNA, 11 nt, Homo sapiens
cauucauaucc

SEQ ID NO: 1131385 - RNA, 22 nt, Homo sapiens
cauuccaggaccagaagcauuu

SEQ ID NO: 1131386 - RNA, 17 nt, Homo sapiens
cauucccucucaucuca

SEQ ID NO: 1131387 - RNA, 13 nt, Homo sapiens
cauuccugaagaa

SEQ ID NO: 1131388 - RNA, 20 nt, Homo sapiens
cauuccuuuuucuucacuua

SEQ ID NO: 1131389 - RNA, 17 nt, Homo sapiens
cauucgcgcucugcuca

SEQ ID NO: 1131390 - RNA, 16 nt, Homo sapiens
cauucucaggcaccag

SEQ ID NO: 1131391 - RNA, 22 nt, Homo sapiens
cauucucuaauaagaaaaccac

SEQ ID NO: 1131392 - RNA, 20 nt, Homo sapiens
cauucugauucgaaugacac

SEQ ID NO: 1131393 - RNA, 16 nt, Homo sapiens
cauucugcaaguauac

SEQ ID NO: 1131394 - RNA, 16 nt, Homo sapiens
cauucugcucuuugau

SEQ ID NO: 1131395 - RNA, 23 nt, Homo sapiens
cauucuuuucacuuccucuccac

SEQ ID NO: 1131396 - RNA, 15 nt, Homo sapiens
cauugaaagugcuuc

SEQ ID NO: 1131397 - RNA, 16 nt, Homo sapiens
cauugaacacaaacug

SEQ ID NO: 1131398 - RNA, 23 nt, Homo sapiens
cauugagaacugcauauguuucg

SEQ ID NO: 1131399 - RNA, 16 nt, Homo sapiens
cauugagcugagaucg

SEQ ID NO: 1131400 - RNA, 20 nt, Homo sapiens
cauugagcugagaucgugcc

SEQ ID NO: 1131401 - RNA, 15 nt, Homo sapiens
cauugagcugugcaa

SEQ ID NO: 1131402 - RNA, 14 nt, Homo sapiens
cauugaucugggau

SEQ ID NO: 1131403 - RNA, 16 nt, Homo sapiens
cauugccuuugaaugu

SEQ ID NO: 1131404 - RNA, 15 nt, Homo sapiens
cauugcugucugcag

SEQ ID NO: 1131405 - RNA, 17 nt, Homo sapiens
cauugcuguucuacuuu

SEQ ID NO: 1131406 - RNA, 16 nt, Homo sapiens
cauuggaaacacugcc

SEQ ID NO: 1131407 - RNA, 15 nt, Homo sapiens
cauuggaaagcacac

SEQ ID NO: 1131408 - RNA, 16 nt, Homo sapiens
cauuggcaaguguaaa

SEQ ID NO: 1131409 - RNA, 21 nt, Homo sapiens
cauuggcccauagguacauug

SEQ ID NO: 1131410 - RNA, 23 nt, Homo sapiens
cauuggcuauuuaaaacuuguaa

SEQ ID NO: 1131411 - RNA, 14 nt, Homo sapiens
cauugggauauucu

SEQ ID NO: 1131412 - RNA, 16 nt, Homo sapiens
cauugggcuacuguag

SEQ ID NO: 1131413 - RNA, 14 nt, Homo sapiens
cauugguccaagau

SEQ ID NO: 1131414 - RNA, 22 nt, Homo sapiens
cauugucguauaggcauguaaa

SEQ ID NO: 1131415 - RNA, 14 nt, Homo sapiens
cauugugauguaua

SEQ ID NO: 1131416 - RNA, 16 nt, Homo sapiens
cauugugcagagaagc

SEQ ID NO: 1131417 - RNA, 22 nt, Homo sapiens
cauuguuuagaaagaauauuca

SEQ ID NO: 1131418 - RNA, 19 nt, Homo sapiens
cauuuaaaacauugcaaau

SEQ ID NO: 1131419 - RNA, 17 nt, Homo sapiens
cauuuaauaacuuugcu

SEQ ID NO: 1131420 - RNA, 20 nt, Homo sapiens
cauuuagacuuauguggaac

SEQ ID NO: 1131421 - RNA, 13 nt, Homo sapiens
cauuuagucuucc

SEQ ID NO: 1131422 - RNA, 23 nt, Homo sapiens
cauuuauaaaaggagcaaucaua

SEQ ID NO: 1131423 - RNA, 13 nt, Homo sapiens
cauuuauagcaua

SEQ ID NO: 1131424 - RNA, 14 nt, Homo sapiens
cauuuauuuuauga

SEQ ID NO: 1131425 - RNA, 18 nt, Homo sapiens
cauuuauuuuuagccauu

SEQ ID NO: 1131426 - RNA, 22 nt, Homo sapiens
cauuucaaaauuaauagcuuuu

SEQ ID NO: 1131427 - RNA, 18 nt, Homo sapiens
cauuucaaaucuguagca

SEQ ID NO: 1131428 - RNA, 21 nt, Homo sapiens
cauuucaucguggcuguuucu

SEQ ID NO: 1131429 - RNA, 12 nt, Homo sapiens
cauuuccaaaag

SEQ ID NO: 1131430 - RNA, 17 nt, Homo sapiens
cauuuccaugcauaaau

SEQ ID NO: 1131431 - RNA, 14 nt, Homo sapiens
cauuucccacaucu

SEQ ID NO: 1131432 - RNA, 24 nt, Homo sapiens
cauuucccuacccuaaagcgacau

SEQ ID NO: 1131433 - RNA, 13 nt, Homo sapiens
cauuucuuugugc

SEQ ID NO: 1131434 - RNA, 15 nt, Homo sapiens
cauuugaacuauauu

SEQ ID NO: 1131435 - RNA, 18 nt, Homo sapiens
cauuuggacuugcugaau

SEQ ID NO: 1131436 - RNA, 15 nt, Homo sapiens
cauuuuaaaaaccag

SEQ ID NO: 1131437 - RNA, 17 nt, Homo sapiens
cauuuuaacaagaagau

SEQ ID NO: 1131438 - RNA, 13 nt, Homo sapiens
cauuuuacaagca

SEQ ID NO: 1131439 - RNA, 22 nt, Homo sapiens
cauuuuauuuuuucuugcaaau

SEQ ID NO: 1131440 - RNA, 19 nt, Homo sapiens
cauuuucagcaucaaacau

SEQ ID NO: 1131441 - RNA, 18 nt, Homo sapiens
cauuuucuugucaaugga

SEQ ID NO: 1131442 - RNA, 20 nt, Homo sapiens
cauuuugacacaauguugca

SEQ ID NO: 1131443 - RNA, 19 nt, Homo sapiens
cauuuuggcaucugcaaag

SEQ ID NO: 1131444 - RNA, 18 nt, Homo sapiens
cauuuugugaagcccugu

SEQ ID NO: 1131445 - RNA, 22 nt, Homo sapiens
cauuuuuagaaaucacaacaaa

SEQ ID NO: 1131446 - RNA, 21 nt, Homo sapiens
cauuuuuagauugguucuguu

SEQ ID NO: 1131447 - RNA, 21 nt, Homo sapiens
cauuuuuaucccuuccugucu

SEQ ID NO: 1131448 - RNA, 19 nt, Homo sapiens
cauuuuucaacuuugaaua

SEQ ID NO: 1131449 - RNA, 16 nt, Homo sapiens
cauuuuuccaugacau

SEQ ID NO: 1131450 - RNA, 17 nt, Homo sapiens
ccaaaaauaugguugau

SEQ ID NO: 1131451 - RNA, 13 nt, Homo sapiens
ccaaaagaagccc

SEQ ID NO: 1131452 - RNA, 19 nt, Homo sapiens
ccaaaauaguuaagacaug

SEQ ID NO: 1131453 - RNA, 17 nt, Homo sapiens
ccaaaccuccacugcug

SEQ ID NO: 1131454 - RNA, 16 nt, Homo sapiens
ccaaacuacgaccuca

SEQ ID NO: 1131455 - RNA, 19 nt, Homo sapiens
ccaaagacggcuccauuaa

SEQ ID NO: 1131456 - RNA, 20 nt, Homo sapiens
ccaaagagucucuggcucag

SEQ ID NO: 1131457 - RNA, 19 nt, Homo sapiens
ccaaaggucaagaacacag

SEQ ID NO: 1131458 - RNA, 21 nt, Homo sapiens
ccaaagguuggcagugauccu

SEQ ID NO: 1131459 - RNA, 20 nt, Homo sapiens
ccaaaguccuuuuuuuccau

SEQ ID NO: 1131460 - RNA, 18 nt, Homo sapiens
ccaaagugucuuuugaca

SEQ ID NO: 1131461 - RNA, 12 nt, Homo sapiens
ccaaaguucuaa

SEQ ID NO: 1131462 - RNA, 14 nt, Homo sapiens
ccaaaugaagggac

SEQ ID NO: 1131463 - RNA, 22 nt, Homo sapiens
ccaaaugcugugcaaacagugu

SEQ ID NO: 1131464 - RNA, 15 nt, Homo sapiens
ccaaauugcuucuag

SEQ ID NO: 1131465 - RNA, 13 nt, Homo sapiens
ccaacaagaaugc

SEQ ID NO: 1131466 - RNA, 18 nt, Homo sapiens
ccaacagaccuggugcuc

SEQ ID NO: 1131467 - RNA, 10 nt, Homo sapiens
ccaacagcac

SEQ ID NO: 1131468 - RNA, 21 nt, Homo sapiens
ccaacagcacccucuccagau

SEQ ID NO: 1131469 - RNA, 17 nt, Homo sapiens
ccaacagcuacaacagc

SEQ ID NO: 1131470 - RNA, 11 nt, Homo sapiens
ccaacauccag

SEQ ID NO: 1131471 - RNA, 14 nt, Homo sapiens
ccaacauguaucug

SEQ ID NO: 1131472 - RNA, 16 nt, Homo sapiens
ccaacccacugcccau

SEQ ID NO: 1131473 - RNA, 16 nt, Homo sapiens
ccaaccccucagauuu

SEQ ID NO: 1131474 - RNA, 15 nt, Homo sapiens
ccaacgaagugccag

SEQ ID NO: 1131475 - RNA, 22 nt, Homo sapiens
ccaacgcgaaaccaauuccuca

SEQ ID NO: 1131476 - RNA, 21 nt, Homo sapiens
ccaacuaaaaacaaacccuuu

SEQ ID NO: 1131477 - RNA, 22 nt, Homo sapiens
ccaacuagcucuauguuuacaa

SEQ ID NO: 1131478 - RNA, 13 nt, Homo sapiens
uuuuuaucuccaa

SEQ ID NO: 1131479 - RNA, 15 nt, Homo sapiens
uuuuucaacuuggaa

SEQ ID NO: 1131480 - RNA, 19 nt, Homo sapiens
uuuuucaagaaaacuggaa

SEQ ID NO: 1131481 - RNA, 12 nt, Homo sapiens
uuuuucauggaa

SEQ ID NO: 1131482 - RNA, 17 nt, Homo sapiens
uuuuuccaugacauuuu

SEQ ID NO: 1131483 - RNA, 16 nt, Homo sapiens
uuuuuccucucugcaa

SEQ ID NO: 1131484 - RNA, 16 nt, Homo sapiens
uuuuuccuuccugaga

SEQ ID NO: 1131485 - RNA, 23 nt, Homo sapiens
uuuuuccuuccuuaucacugaca

SEQ ID NO: 1131486 - RNA, 21 nt, Homo sapiens
uuuuucucacugaaaagugag

SEQ ID NO: 1131487 - RNA, 22 nt, Homo sapiens
uuuuucuccagaagauggugcu

SEQ ID NO: 1131488 - RNA, 12 nt, Homo sapiens
uuuuucugcaau

SEQ ID NO: 1131489 - RNA, 15 nt, Homo sapiens
uuuuucuguggucuu

SEQ ID NO: 1131490 - RNA, 16 nt, Homo sapiens
uuuuugaacauggaaa

SEQ ID NO: 1131491 - RNA, 15 nt, Homo sapiens
uuuuugaaucuauga

SEQ ID NO: 1131492 - RNA, 15 nt, Homo sapiens
uuuuugagaaacagc

SEQ ID NO: 1131493 - RNA, 11 nt, Homo sapiens
uuuuugcaaua

SEQ ID NO: 1131494 - RNA, 14 nt, Homo sapiens
uuuuugcacuauug

SEQ ID NO: 1131495 - RNA, 20 nt, Homo sapiens
uuuuugccuucauuaccuuu

SEQ ID NO: 1131496 - RNA, 14 nt, Homo sapiens
uuuuuguaacugga

SEQ ID NO: 1131497 - RNA, 18 nt, Homo sapiens
uuuuuguucaaagccagc

SEQ ID NO: 1131498 - RNA, 23 nt, Homo sapiens
uuuuuguuuuuaaauaaagcauc

SEQ ID NO: 1131499 - RNA, 19 nt, Homo sapiens
uuuuuuaaggugaguucuc

SEQ ID NO: 1131500 - RNA, 20 nt, Homo sapiens
uuuuuucaaaauccaaaaag

SEQ ID NO: 1131501 - RNA, 21 nt, Homo sapiens
uuucuuaaguauaaaccuuau

SEQ ID NO: 1131502 - RNA, 22 nt, Homo sapiens
uuucuuauagucaauguuucuu

SEQ ID NO: 1131503 - RNA, 23 nt, Homo sapiens
uuucuucccgaaccccaaggagg

SEQ ID NO: 1131504 - RNA, 18 nt, Homo sapiens
uuucuucuuuguggucuu

SEQ ID NO: 1131505 - RNA, 17 nt, Homo sapiens
uuucuugcagaucaaau

SEQ ID NO: 1131506 - RNA, 14 nt, Homo sapiens
uuucuuuaucauug

SEQ ID NO: 1131507 - RNA, 18 nt, Homo sapiens
uuucuuuuaaaauuuuga

SEQ ID NO: 1131508 - RNA, 16 nt, Homo sapiens
uuucuuuuaucacgau

SEQ ID NO: 1131509 - RNA, 13 nt, Homo sapiens
uuucuuuuugcca

SEQ ID NO: 1131510 - RNA, 12 nt, Homo sapiens
uuugaaaacacu

SEQ ID NO: 1131511 - RNA, 22 nt, Homo sapiens
uuugaaagagaaauauaauucc

SEQ ID NO: 1131512 - RNA, 19 nt, Homo sapiens
uuugaaagcuuauuugaua

SEQ ID NO: 1131513 - RNA, 13 nt, Homo sapiens
uuugaaauaccuu

SEQ ID NO: 1131514 - RNA, 12 nt, Homo sapiens
uuugaaccauaa

SEQ ID NO: 1131515 - RNA, 20 nt, Homo sapiens
uuugaagcagucuugcucug

SEQ ID NO: 1131516 - RNA, 22 nt, Homo sapiens
uuugaaguagacucauucuuca

SEQ ID NO: 1131517 - RNA, 16 nt, Homo sapiens
uuugaccagugcaguu

SEQ ID NO: 1131518 - RNA, 17 nt, Homo sapiens
uuugaccuucagagcca

SEQ ID NO: 1131519 - RNA, 20 nt, Homo sapiens
uuugagauuaagaaugccag

SEQ ID NO: 1131520 - RNA, 21 nt, Homo sapiens
uuugagcuccaucaaggguau

SEQ ID NO: 1131521 - RNA, 21 nt, Homo sapiens
uuugaugagauauuaaauucu

SEQ ID NO: 1131522 - RNA, 14 nt, Homo sapiens
uuugcaaaagugua

SEQ ID NO: 1131523 - RNA, 20 nt, Homo sapiens
uuugcaaauaacugaucuca

SEQ ID NO: 1131524 - RNA, 18 nt, Homo sapiens
uuugcaauaaaaaugaua

SEQ ID NO: 1131525 - RNA, 17 nt, Homo sapiens
uuugcaauaaugcagua

SEQ ID NO: 1131526 - RNA, 22 nt, Homo sapiens
uuugcaauuggaauaaucacuu

SEQ ID NO: 1131527 - RNA, 15 nt, Homo sapiens
uuugcagugauuuga

SEQ ID NO: 1131528 - RNA, 17 nt, Homo sapiens
uuugccaaaauucauuu

SEQ ID NO: 1131529 - RNA, 21 nt, Homo sapiens
uuugccaucggaacugccuua

SEQ ID NO: 1131530 - RNA, 18 nt, Homo sapiens
uuugccauucucuggguu

SEQ ID NO: 1131531 - RNA, 23 nt, Homo sapiens
uuugcccauccucccaaucucaa

SEQ ID NO: 1131532 - RNA, 14 nt, Homo sapiens
uuugcccauucucu

SEQ ID NO: 1131533 - RNA, 22 nt, Homo sapiens
uuugccugauccuccaacagcu

SEQ ID NO: 1131534 - RNA, 14 nt, Homo sapiens
uuugccuucuccac

SEQ ID NO: 1131535 - RNA, 22 nt, Homo sapiens
uuugccuuuccauaaucacuca

SEQ ID NO: 1131536 - RNA, 15 nt, Homo sapiens
uuugcucugucuccu

SEQ ID NO: 1131537 - RNA, 23 nt, Homo sapiens
uuugcuguuaaaauaagaacaaa

SEQ ID NO: 1131538 - RNA, 16 nt, Homo sapiens
uuugcuugcaauguag

SEQ ID NO: 1131539 - RNA, 14 nt, Homo sapiens
uuugcuuugcucuc

SEQ ID NO: 1131540 - RNA, 15 nt, Homo sapiens
uuugcuuuucacugg

SEQ ID NO: 1131541 - RNA, 20 nt, Homo sapiens
uuuggaagggaaacuuucaa

SEQ ID NO: 1131542 - RNA, 17 nt, Homo sapiens
uuuggaauauuguccau

SEQ ID NO: 1131543 - RNA, 13 nt, Homo sapiens
uuuggcaacagaa

SEQ ID NO: 1131544 - RNA, 22 nt, Homo sapiens
uuugggagcccaugggggagcu

SEQ ID NO: 1131545 - RNA, 16 nt, Homo sapiens
uuugggauaacuucaa

SEQ ID NO: 1131546 - RNA, 18 nt, Homo sapiens
uuuggggcaagucaugua

SEQ ID NO: 1131547 - RNA, 15 nt, Homo sapiens
uuugggggcacuuag

SEQ ID NO: 1131548 - RNA, 23 nt, Homo sapiens
uuugguagagauggagucuugcu

SEQ ID NO: 1131549 - RNA, 14 nt, Homo sapiens
uuuggucacacucu

SEQ ID NO: 1131550 - RNA, 15 nt, Homo sapiens
uuuggugcuuuccag

SEQ ID NO: 1131551 - RNA, 22 nt, Homo sapiens
uuugguuaagaauaaauuaaaa

SEQ ID NO: 1131552 - RNA, 19 nt, Homo sapiens
uuugguuuugacagguuuu

SEQ ID NO: 1131553 - RNA, 17 nt, Homo sapiens
uuuguaaaauguucucu

SEQ ID NO: 1131554 - RNA, 22 nt, Homo sapiens
uuuguaaagcauccucuaccuc

SEQ ID NO: 1131555 - RNA, 14 nt, Homo sapiens
uuuguagucuuguc

SEQ ID NO: 1131556 - RNA, 17 nt, Homo sapiens
uuuguauccuugaugaa

SEQ ID NO: 1131557 - RNA, 23 nt, Homo sapiens
uuuguauucauguucaugugauu

SEQ ID NO: 1131558 - RNA, 17 nt, Homo sapiens
uuugucaacauugugau

SEQ ID NO: 1131559 - RNA, 22 nt, Homo sapiens
uuugugcagagauaaagaccuu

SEQ ID NO: 1131560 - RNA, 19 nt, Homo sapiens
uuugugcaucuuaaaguag

SEQ ID NO: 1131561 - RNA, 14 nt, Homo sapiens
uuugugcggcagau

SEQ ID NO: 1131562 - RNA, 11 nt, Homo sapiens
uuuguggcauc

SEQ ID NO: 1131563 - RNA, 11 nt, Homo sapiens
uuugugugauc

SEQ ID NO: 1131564 - RNA, 22 nt, Homo sapiens
uuugugugaucauacaguuaug

SEQ ID NO: 1131565 - RNA, 15 nt, Homo sapiens
uuuguuaacuguacu

SEQ ID NO: 1131566 - RNA, 13 nt, Homo sapiens
uuuguuacuuuga

SEQ ID NO: 1131567 - RNA, 14 nt, Homo sapiens
uuuguuacuuugaa

SEQ ID NO: 1131568 - RNA, 12 nt, Homo sapiens
uuuguuguaaaa

SEQ ID NO: 1131569 - RNA, 22 nt, Homo sapiens
uuuuaaaaaaaacaauuccaca

SEQ ID NO: 1131570 - RNA, 19 nt, Homo sapiens
uuuuaaaaaaauuccaagu

SEQ ID NO: 1131571 - RNA, 19 nt, Homo sapiens
uuuuaaaaaggaacugcag

SEQ ID NO: 1131572 - RNA, 14 nt, Homo sapiens
uuuuaaacauucuu

SEQ ID NO: 1131573 - RNA, 16 nt, Homo sapiens
uuuuaaauuagaucau

SEQ ID NO: 1131574 - RNA, 16 nt, Homo sapiens
uuuuaaauuuugacaa

SEQ ID NO: 1131575 - RNA, 13 nt, Homo sapiens
uuuuaacgggaaa

SEQ ID NO: 1131576 - RNA, 14 nt, Homo sapiens
uuuuaauagaguau

SEQ ID NO: 1131577 - RNA, 11 nt, Homo sapiens
uuuuaaucucc

SEQ ID NO: 1131578 - RNA, 17 nt, Homo sapiens
uuuuacccacacacaga

SEQ ID NO: 1131579 - RNA, 22 nt, Homo sapiens
uuuuaccuggauauaaauuaau

SEQ ID NO: 1131580 - RNA, 22 nt, Homo sapiens
uuuuacuaaaauggcagcuuaa

SEQ ID NO: 1131581 - RNA, 15 nt, Homo sapiens
uuuuacucaaccaaa

SEQ ID NO: 1131582 - RNA, 15 nt, Homo sapiens
uuuuacugugauuca

SEQ ID NO: 1131583 - RNA, 19 nt, Homo sapiens
uuuuagaaaucacaacaaa

SEQ ID NO: 1131584 - RNA, 13 nt, Homo sapiens
uuuuagaaaucag

SEQ ID NO: 1131585 - RNA, 14 nt, Homo sapiens
uuuuagaaaucagc

SEQ ID NO: 1131586 - RNA, 17 nt, Homo sapiens
uuuuagaaucucuuucg

SEQ ID NO: 1131587 - RNA, 22 nt, Homo sapiens
uuuuagaauuaaaaaagcauac

SEQ ID NO: 1131588 - RNA, 18 nt, Homo sapiens
uuuuagcgugcucacuga

SEQ ID NO: 1131589 - RNA, 19 nt, Homo sapiens
uuuuaguugcucaaagagc

SEQ ID NO: 1131590 - RNA, 19 nt, Homo sapiens
uuuuaguuuaaaaucuugc

SEQ ID NO: 1131591 - RNA, 15 nt, Homo sapiens
uuuuauacuguacuu

SEQ ID NO: 1131592 - RNA, 15 nt, Homo sapiens
uuuuaugaucaaggu

SEQ ID NO: 1131593 - RNA, 22 nt, Homo sapiens
uuuuauggcucacacagcuuaa

SEQ ID NO: 1131594 - RNA, 16 nt, Homo sapiens
uuuuauuuugucucug

SEQ ID NO: 1131595 - RNA, 18 nt, Homo sapiens
uuuuauuuuugcaaaaua

SEQ ID NO: 1131596 - RNA, 20 nt, Homo sapiens
uuuucaagcuauaaugcuau

SEQ ID NO: 1131597 - RNA, 23 nt, Homo sapiens
uuuucaauguuagccacagugua

SEQ ID NO: 1131598 - RNA, 21 nt, Homo sapiens
uuuucacucccauaccuuuaa

SEQ ID NO: 1131599 - RNA, 11 nt, Homo sapiens
uuuucaucuaa

SEQ ID NO: 1131600 - RNA, 11 nt, Homo sapiens
uuuuccaaaug

SEQ ID NO: 1131601 - RNA, 22 nt, Homo sapiens
uuuuccaauuuuagaaaaucaa

SEQ ID NO: 1131602 - RNA, 13 nt, Homo sapiens
uuuuccauguguu

SEQ ID NO: 1131603 - RNA, 23 nt, Homo sapiens
uuuuccauuuuuauuucaaaaua

SEQ ID NO: 1131604 - RNA, 19 nt, Homo sapiens
uuuucccuccauaaguuua

SEQ ID NO: 1131605 - RNA, 16 nt, Homo sapiens
uuuuccucuucuagau

SEQ ID NO: 1131606 - RNA, 21 nt, Homo sapiens
uuuuccuggauuauaaggaaa

SEQ ID NO: 1131607 - RNA, 18 nt, Homo sapiens
uuuuccuggcucaucucu

SEQ ID NO: 1131608 - RNA, 13 nt, Homo sapiens
uuuuccuucucau

SEQ ID NO: 1131609 - RNA, 19 nt, Homo sapiens
uuuucuaaaccuucaucau

SEQ ID NO: 1131610 - RNA, 22 nt, Homo sapiens
uuuucuaaacguaagcacuguu

SEQ ID NO: 1131611 - RNA, 13 nt, Homo sapiens
uuuucuccagggu

SEQ ID NO: 1131612 - RNA, 15 nt, Homo sapiens
uguacuaaaaauaca

SEQ ID NO: 1131613 - RNA, 14 nt, Homo sapiens
uguacuaaagccaa

SEQ ID NO: 1131614 - RNA, 20 nt, Homo sapiens
uguacuccagccugggcaac

SEQ ID NO: 1131615 - RNA, 19 nt, Homo sapiens
uaacauguauucuguucuu

SEQ ID NO: 1131616 - RNA, 12 nt, Homo sapiens
uaacauucccac

SEQ ID NO: 1131617 - RNA, 17 nt, Homo sapiens
uaaccagcucaguguuu

SEQ ID NO: 1131618 - RNA, 18 nt, Homo sapiens
uaaccaggcugggcucag

SEQ ID NO: 1131619 - RNA, 20 nt, Homo sapiens
uaaccaucacugguugcacu

SEQ ID NO: 1131620 - RNA, 22 nt, Homo sapiens
uaaccaucacugguugcacuua

SEQ ID NO: 1131621 - RNA, 22 nt, Homo sapiens
uaaccaucuuuaaucaauguga

SEQ ID NO: 1131622 - RNA, 18 nt, Homo sapiens
uaaccaugaaaauagcca

SEQ ID NO: 1131623 - RNA, 16 nt, Homo sapiens
uaaccuuugcuaugua

SEQ ID NO: 1131624 - RNA, 20 nt, Homo sapiens
uaacgauaaaagacagugaa

SEQ ID NO: 1131625 - RNA, 18 nt, Homo sapiens
uaacuaugaccaugcuga

SEQ ID NO: 1131626 - RNA, 13 nt, Homo sapiens
uaacuauucauaa

SEQ ID NO: 1131627 - RNA, 20 nt, Homo sapiens
uaacucccuccucacacucc

SEQ ID NO: 1131628 - RNA, 22 nt, Homo sapiens
uaacucuuacagcuuugccuug

SEQ ID NO: 1131629 - RNA, 21 nt, Homo sapiens
uaacugaaggagaaggugccc

SEQ ID NO: 1131630 - RNA, 16 nt, Homo sapiens
uaacugccaauccuua

SEQ ID NO: 1131631 - RNA, 15 nt, Homo sapiens
uaacuguacugaaua

SEQ ID NO: 1131632 - RNA, 18 nt, Homo sapiens
uaacugugccaguucuuu

SEQ ID NO: 1131633 - RNA, 12 nt, Homo sapiens
uaacuguucaaa

SEQ ID NO: 1131634 - RNA, 14 nt, Homo sapiens
uaacuguugucaua

SEQ ID NO: 1131635 - RNA, 19 nt, Homo sapiens
uaacuuaagauuugcucau

SEQ ID NO: 1131636 - RNA, 13 nt, Homo sapiens
uaacuuauugccu

SEQ ID NO: 1131637 - RNA, 21 nt, Homo sapiens
uaacuuuaaaacuguauuuaa

SEQ ID NO: 1131638 - RNA, 15 nt, Homo sapiens
uaacuuuauguguaa

SEQ ID NO: 1131639 - RNA, 16 nt, Homo sapiens
uaacuuugacuuucuu

SEQ ID NO: 1131640 - RNA, 14 nt, Homo sapiens
uaacuuugcccuuc

SEQ ID NO: 1131641 - RNA, 15 nt, Homo sapiens
uaacuuugcuugcag

SEQ ID NO: 1131642 - RNA, 20 nt, Homo sapiens
uaacuuuggaaacaugggaa

SEQ ID NO: 1131643 - RNA, 20 nt, Homo sapiens
uaacuuuucaaugacauuuu

SEQ ID NO: 1131644 - RNA, 18 nt, Homo sapiens
uaagaaaagcccugagau

SEQ ID NO: 1131645 - RNA, 22 nt, Homo sapiens
uaagaacaauagguaaagcuau

SEQ ID NO: 1131646 - RNA, 13 nt, Homo sapiens
uaagaacugugca

SEQ ID NO: 1131647 - RNA, 13 nt, Homo sapiens
uaagaagucugau

SEQ ID NO: 1131648 - RNA, 19 nt, Homo sapiens
uaagaauucaaacuggggc

SEQ ID NO: 1131649 - RNA, 17 nt, Homo sapiens
uaagaauuucacaagcu

SEQ ID NO: 1131650 - RNA, 20 nt, Homo sapiens
uaagaauuucacaagcuauu

SEQ ID NO: 1131651 - RNA, 21 nt, Homo sapiens
uaagacauacuccuuccauca

SEQ ID NO: 1131652 - RNA, 21 nt, Homo sapiens
uaagacauuaguaacauaaua

SEQ ID NO: 1131653 - RNA, 19 nt, Homo sapiens
uaagacucucgcaucuucc

SEQ ID NO: 1131654 - RNA, 21 nt, Homo sapiens
uaagacucuuaccuacaaaau

SEQ ID NO: 1131655 - RNA, 20 nt, Homo sapiens
uaagagaaucaacauuucuc

SEQ ID NO: 1131656 - RNA, 15 nt, Homo sapiens
uaagagaucccuucc

SEQ ID NO: 1131657 - RNA, 17 nt, Homo sapiens
uaagagcagaacagauc

SEQ ID NO: 1131658 - RNA, 21 nt, Homo sapiens
uaagagccauauaaguuugaa

SEQ ID NO: 1131659 - RNA, 15 nt, Homo sapiens
uaagaggccugugau

SEQ ID NO: 1131660 - RNA, 20 nt, Homo sapiens
uaagaggcugacagcuucua

SEQ ID NO: 1131661 - RNA, 21 nt, Homo sapiens
uaagagggcauauacagugaa

SEQ ID NO: 1131662 - RNA, 20 nt, Homo sapiens
uaagagguugcuaaugccuu

SEQ ID NO: 1131663 - RNA, 13 nt, Homo sapiens
uaagauucuagau

SEQ ID NO: 1131664 - RNA, 14 nt, Homo sapiens
uaagauuugcucau

SEQ ID NO: 1131665 - RNA, 13 nt, Homo sapiens
uaagcaacaucua

SEQ ID NO: 1131666 - RNA, 16 nt, Homo sapiens
uaagcagaccacugau

SEQ ID NO: 1131667 - RNA, 21 nt, Homo sapiens
uaagccaauccucacucccca

SEQ ID NO: 1131668 - RNA, 21 nt, Homo sapiens
uaagcccaauaucagcucuuu

SEQ ID NO: 1131669 - RNA, 18 nt, Homo sapiens
uaagccccaagcgaauuu

SEQ ID NO: 1131670 - RNA, 21 nt, Homo sapiens
uaagcccccacuacaagugau

SEQ ID NO: 1131671 - RNA, 20 nt, Homo sapiens
uaagccugcauucuuaacaa

SEQ ID NO: 1131672 - RNA, 18 nt, Homo sapiens
uaagcucuaucugcaaug

SEQ ID NO: 1131673 - RNA, 18 nt, Homo sapiens
uaagcuguaaauuacaua

SEQ ID NO: 1131674 - RNA, 17 nt, Homo sapiens
uaagcuguaacuuguca

SEQ ID NO: 1131675 - RNA, 19 nt, Homo sapiens
uaagcugugguguguuccc

SEQ ID NO: 1131676 - RNA, 20 nt, Homo sapiens
uaagcugugguguguucccc

SEQ ID NO: 1131677 - RNA, 13 nt, Homo sapiens
uaagcuuuccauu

SEQ ID NO: 1131678 - RNA, 18 nt, Homo sapiens
uaagcuuuccauuuucua

SEQ ID NO: 1131679 - RNA, 14 nt, Homo sapiens
uaaggaaagcaaua

SEQ ID NO: 1131680 - RNA, 14 nt, Homo sapiens
uaaggacauuuccc

SEQ ID NO: 1131681 - RNA, 15 nt, Homo sapiens
uaaggacauuuccca

SEQ ID NO: 1131682 - RNA, 14 nt, Homo sapiens
uaaggauguugcca

SEQ ID NO: 1131683 - RNA, 18 nt, Homo sapiens
uaaggcucugugccuugg

SEQ ID NO: 1131684 - RNA, 17 nt, Homo sapiens
uaagguagaacuugaga

SEQ ID NO: 1131685 - RNA, 13 nt, Homo sapiens
uaaggucauagau

SEQ ID NO: 1131686 - RNA, 18 nt, Homo sapiens
uaagguccgguguucuaa

SEQ ID NO: 1131687 - RNA, 12 nt, Homo sapiens
uaaggucuuugu

SEQ ID NO: 1131688 - RNA, 22 nt, Homo sapiens
uaaguagcuggguuuacaggca

SEQ ID NO: 1131689 - RNA, 15 nt, Homo sapiens
uaaguauuuugauca

SEQ ID NO: 1131690 - RNA, 17 nt, Homo sapiens
uaagucaaccugccuga

SEQ ID NO: 1131691 - RNA, 22 nt, Homo sapiens
uaagucaaccugccugacauuu

SEQ ID NO: 1131692 - RNA, 22 nt, Homo sapiens
uaagucccuuuuaguuugauca

SEQ ID NO: 1131693 - RNA, 15 nt, Homo sapiens
uaagucucaacugcu

SEQ ID NO: 1131694 - RNA, 21 nt, Homo sapiens
uaaguggcuugucugcaguca

SEQ ID NO: 1131695 - RNA, 18 nt, Homo sapiens
uaaguggggaaaauccua

SEQ ID NO: 1131696 - RNA, 23 nt, Homo sapiens
uaaguggggugggaaggggagca

SEQ ID NO: 1131697 - RNA, 19 nt, Homo sapiens
uaaguguauuuuaaaugug

SEQ ID NO: 1131698 - RNA, 16 nt, Homo sapiens
uaagugucugugaugc

SEQ ID NO: 1131699 - RNA, 23 nt, Homo sapiens
uaaguguucucggggaugcauag

SEQ ID NO: 1131700 - RNA, 13 nt, Homo sapiens
uaaguuauugcca

SEQ ID NO: 1131701 - RNA, 18 nt, Homo sapiens
uaaguucauucaugccaa

SEQ ID NO: 1131702 - RNA, 22 nt, Homo sapiens
uaaguugucuaaacaaugcuga

SEQ ID NO: 1131703 - RNA, 15 nt, Homo sapiens
uaaguuuccuuccag

SEQ ID NO: 1131704 - RNA, 23 nt, Homo sapiens
uaaguuuuguuuguucacacucc

SEQ ID NO: 1131705 - RNA, 20 nt, Homo sapiens
uaauaaaaauuguagcuuuu

SEQ ID NO: 1131706 - RNA, 15 nt, Homo sapiens
uaauaaaauaauugu

SEQ ID NO: 1131707 - RNA, 20 nt, Homo sapiens
uaauaaacugcaaaugugca

SEQ ID NO: 1131708 - RNA, 15 nt, Homo sapiens
uaauaaagacagggu

SEQ ID NO: 1131709 - RNA, 14 nt, Homo sapiens
uaauaauaauaaua

SEQ ID NO: 1131710 - RNA, 17 nt, Homo sapiens
uaauaauaguaauuccu

SEQ ID NO: 1131711 - RNA, 19 nt, Homo sapiens
uaauaauguguacauuagu

SEQ ID NO: 1131712 - RNA, 18 nt, Homo sapiens
uaauagaaauaaauuccu

SEQ ID NO: 1131713 - RNA, 17 nt, Homo sapiens
uaauagaguaugugaaa

SEQ ID NO: 1131714 - RNA, 14 nt, Homo sapiens
uaauagcacugcca

SEQ ID NO: 1131715 - RNA, 17 nt, Homo sapiens
uaauaguacauaaucuu

SEQ ID NO: 1131716 - RNA, 17 nt, Homo sapiens
uaauauaaaguguaaua

SEQ ID NO: 1131717 - RNA, 18 nt, Homo sapiens
uaauauacugagcugcua

SEQ ID NO: 1131718 - RNA, 13 nt, Homo sapiens
uaauauaguccaa

SEQ ID NO: 1131719 - RNA, 20 nt, Homo sapiens
uaauaugaguaauacaucaa

SEQ ID NO: 1131720 - RNA, 15 nt, Homo sapiens
uaauaugguguacau

SEQ ID NO: 1131721 - RNA, 20 nt, Homo sapiens
uaauaugguguacauucuuc

SEQ ID NO: 1131722 - RNA, 18 nt, Homo sapiens
uaauauuguauugcugcu

SEQ ID NO: 1131723 - RNA, 18 nt, Homo sapiens
uaauauuuuaaauugcuu

SEQ ID NO: 1131724 - RNA, 17 nt, Homo sapiens
uaauauuuucuguguaa

SEQ ID NO: 1131725 - RNA, 15 nt, Homo sapiens
uaauauuuugcacag

SEQ ID NO: 1131726 - RNA, 19 nt, Homo sapiens
uaaucaagaaauaaccaug

SEQ ID NO: 1131727 - RNA, 17 nt, Homo sapiens
uaaucacucagugauug

SEQ ID NO: 1131728 - RNA, 19 nt, Homo sapiens
ugcuggaaccugcaaaaaa

SEQ ID NO: 1131729 - RNA, 16 nt, Homo sapiens
ugcuggaauuccuaac

SEQ ID NO: 1131730 - RNA, 17 nt, Homo sapiens
ugcuggagucaugugcc

SEQ ID NO: 1131731 - RNA, 13 nt, Homo sapiens
ugcuggggaacaa

SEQ ID NO: 1131732 - RNA, 23 nt, Homo sapiens
ugcuggggagccaaaggcaucca

SEQ ID NO: 1131733 - RNA, 20 nt, Homo sapiens
ugcugggguacacagugaga

SEQ ID NO: 1131734 - RNA, 19 nt, Homo sapiens
ugcugucucuuaaaucucu

SEQ ID NO: 1131735 - RNA, 22 nt, Homo sapiens
ugcugugaagggagaaagggag

SEQ ID NO: 1131736 - RNA, 10 nt, Homo sapiens
ugcugugcaa

SEQ ID NO: 1131737 - RNA, 19 nt, Homo sapiens
ugcugugugagaccagggg

SEQ ID NO: 1131738 - RNA, 14 nt, Homo sapiens
ugcuguguguccca

SEQ ID NO: 1131739 - RNA, 20 nt, Homo sapiens
ugcuguuaaaauaagaacaa

SEQ ID NO: 1131740 - RNA, 22 nt, Homo sapiens
ugcuuaagguaugguacaagca

SEQ ID NO: 1131741 - RNA, 13 nt, Homo sapiens
ugcuuaaucugag

SEQ ID NO: 1131742 - RNA, 15 nt, Homo sapiens
ugcuuaaucugagga

SEQ ID NO: 1131743 - RNA, 21 nt, Homo sapiens
ugcuuaccuuguuuugccagu

SEQ ID NO: 1131744 - RNA, 18 nt, Homo sapiens
ugcuuacuaugaccuucc

SEQ ID NO: 1131745 - RNA, 19 nt, Homo sapiens
ugcuuacuaugaccuucca

SEQ ID NO: 1131746 - RNA, 16 nt, Homo sapiens
ugcuuaguaaugcuac

SEQ ID NO: 1131747 - RNA, 18 nt, Homo sapiens
ugcuucaccagacuuuuc

SEQ ID NO: 1131748 - RNA, 14 nt, Homo sapiens
ugcuucacuuuccu

SEQ ID NO: 1131749 - RNA, 20 nt, Homo sapiens
ugcuucagauguggagccag

SEQ ID NO: 1131750 - RNA, 15 nt, Homo sapiens
ugcuucagugcugcu

SEQ ID NO: 1131751 - RNA, 22 nt, Homo sapiens
ugcuuccucccaacaagcagcu

SEQ ID NO: 1131752 - RNA, 13 nt, Homo sapiens
ugcuucucggggu

SEQ ID NO: 1131753 - RNA, 14 nt, Homo sapiens
ugcuugaccaaaga

SEQ ID NO: 1131754 - RNA, 18 nt, Homo sapiens
ugcuuggagcugagcaaa

SEQ ID NO: 1131755 - RNA, 21 nt, Homo sapiens
ugcuuggguggagaagccauu

SEQ ID NO: 1131756 - RNA, 18 nt, Homo sapiens
ugcuugguuaaaauggcu

SEQ ID NO: 1131757 - RNA, 18 nt, Homo sapiens
ugcuuguaguuauaguga

SEQ ID NO: 1131758 - RNA, 15 nt, Homo sapiens
ugcuugucaucugca

SEQ ID NO: 1131759 - RNA, 13 nt, Homo sapiens
ugcuuuaaccuca

SEQ ID NO: 1131760 - RNA, 17 nt, Homo sapiens
ugcuuuccaaagccaau

SEQ ID NO: 1131761 - RNA, 16 nt, Homo sapiens
ugcuuucugaaauuca

SEQ ID NO: 1131762 - RNA, 13 nt, Homo sapiens
ugcuuugacgggc

SEQ ID NO: 1131763 - RNA, 18 nt, Homo sapiens
ugcuuugaggcaguucca

SEQ ID NO: 1131764 - RNA, 12 nt, Homo sapiens
ugcuuugcugac

SEQ ID NO: 1131765 - RNA, 23 nt, Homo sapiens
ugcuuugugccaucacugagcau

SEQ ID NO: 1131766 - RNA, 22 nt, Homo sapiens
ugcuuuugguggcuaccaugca

SEQ ID NO: 1131767 - RNA, 22 nt, Homo sapiens
uggaaaaagccaaggugucauu

SEQ ID NO: 1131768 - RNA, 13 nt, Homo sapiens
uggaaaaagccug

SEQ ID NO: 1131769 - RNA, 19 nt, Homo sapiens
uggaaaaccuccuuuacca

SEQ ID NO: 1131770 - RNA, 12 nt, Homo sapiens
uggaaaagccaa

SEQ ID NO: 1131771 - RNA, 13 nt, Homo sapiens
uggaaaagccaag

SEQ ID NO: 1131772 - RNA, 12 nt, Homo sapiens
uggaaaaugcau

SEQ ID NO: 1131773 - RNA, 15 nt, Homo sapiens
uggaaacacugccuu

SEQ ID NO: 1131774 - RNA, 22 nt, Homo sapiens
uggaaacauucaggagcuuccu

SEQ ID NO: 1131775 - RNA, 12 nt, Homo sapiens
uggaaacugccc

SEQ ID NO: 1131776 - RNA, 13 nt, Homo sapiens
uggaaacuucugu

SEQ ID NO: 1131777 - RNA, 17 nt, Homo sapiens
uggaaagacaagcucaa

SEQ ID NO: 1131778 - RNA, 15 nt, Homo sapiens
uggaaagacuugaau

SEQ ID NO: 1131779 - RNA, 20 nt, Homo sapiens
uggaaaguccuccuauucca

SEQ ID NO: 1131780 - RNA, 18 nt, Homo sapiens
uggaaauaaaccauugga

SEQ ID NO: 1131781 - RNA, 20 nt, Homo sapiens
uggaaaugguuucacuugcu

SEQ ID NO: 1131782 - RNA, 20 nt, Homo sapiens
uggaacaagacagccuucac

SEQ ID NO: 1131783 - RNA, 13 nt, Homo sapiens
uggaacaauguuu

SEQ ID NO: 1131784 - RNA, 22 nt, Homo sapiens
uggaacaccagcagcacuggaa

SEQ ID NO: 1131785 - RNA, 15 nt, Homo sapiens
uggaacacggccaca

SEQ ID NO: 1131786 - RNA, 21 nt, Homo sapiens
uggaacacuagacaagccaga

SEQ ID NO: 1131787 - RNA, 13 nt, Homo sapiens
uggaacagcccau

SEQ ID NO: 1131788 - RNA, 20 nt, Homo sapiens
uggaaccucagccuggccag

SEQ ID NO: 1131789 - RNA, 16 nt, Homo sapiens
uggaaccugcaaaaaa

SEQ ID NO: 1131790 - RNA, 21 nt, Homo sapiens
uggaacuuuuauuacuggggu

SEQ ID NO: 1131791 - RNA, 14 nt, Homo sapiens
uggaagaaagcuaa

SEQ ID NO: 1131792 - RNA, 16 nt, Homo sapiens
uggaagauccugugag

SEQ ID NO: 1131793 - RNA, 21 nt, Homo sapiens
uggaagcacuuuuucugcaua

SEQ ID NO: 1131794 - RNA, 18 nt, Homo sapiens
uggaagcaggacagacac

SEQ ID NO: 1131795 - RNA, 19 nt, Homo sapiens
uggaagcauuuguuucuac

SEQ ID NO: 1131796 - RNA, 18 nt, Homo sapiens
uggaagcuaauuugcauu

SEQ ID NO: 1131797 - RNA, 18 nt, Homo sapiens
uggaagcuguguccuugc

SEQ ID NO: 1131798 - RNA, 23 nt, Homo sapiens
uggaagggccaaggucugagcac

SEQ ID NO: 1131799 - RNA, 22 nt, Homo sapiens
uggaaguaaccauuugcacugg

SEQ ID NO: 1131800 - RNA, 21 nt, Homo sapiens
uggaaguauuuuccuccaaag

SEQ ID NO: 1131801 - RNA, 14 nt, Homo sapiens
uggaagucaucuca

SEQ ID NO: 1131802 - RNA, 22 nt, Homo sapiens
uggaagugcaucuacuugccag

SEQ ID NO: 1131803 - RNA, 18 nt, Homo sapiens
uggaaguguuccugucuc

SEQ ID NO: 1131804 - RNA, 22 nt, Homo sapiens
uggaauauaaggaaagcaauaa

SEQ ID NO: 1131805 - RNA, 16 nt, Homo sapiens
uggaaucagauuuuaa

SEQ ID NO: 1131806 - RNA, 20 nt, Homo sapiens
uggaaugccaaugucagcau

SEQ ID NO: 1131807 - RNA, 17 nt, Homo sapiens
uggaaugucaguguuca

SEQ ID NO: 1131808 - RNA, 22 nt, Homo sapiens
uggaauuacaaaacucagagaa

SEQ ID NO: 1131809 - RNA, 16 nt, Homo sapiens
uggaauucaaagcucu

SEQ ID NO: 1131810 - RNA, 17 nt, Homo sapiens
uggaauucaaagcucua

SEQ ID NO: 1131811 - RNA, 12 nt, Homo sapiens
uggacaaaggug

SEQ ID NO: 1131812 - RNA, 12 nt, Homo sapiens
uggacaaccaga

SEQ ID NO: 1131813 - RNA, 12 nt, Homo sapiens
uggacacccuca

SEQ ID NO: 1131814 - RNA, 16 nt, Homo sapiens
uggacacugugcuacu

SEQ ID NO: 1131815 - RNA, 17 nt, Homo sapiens
uggacagaagcagcucu

SEQ ID NO: 1131816 - RNA, 18 nt, Homo sapiens
uggaccacuccugaauga

SEQ ID NO: 1131817 - RNA, 13 nt, Homo sapiens
uggaccagacaau

SEQ ID NO: 1131818 - RNA, 19 nt, Homo sapiens
uggaccuaggguggccuga

SEQ ID NO: 1131819 - RNA, 18 nt, Homo sapiens
uggacguggguugcacug

SEQ ID NO: 1131820 - RNA, 19 nt, Homo sapiens
uggacguggguugcacugg

SEQ ID NO: 1131821 - RNA, 17 nt, Homo sapiens
uggacuauuuucuuuca

SEQ ID NO: 1131822 - RNA, 11 nt, Homo sapiens
uggacucagag

SEQ ID NO: 1131823 - RNA, 19 nt, Homo sapiens
uggacucaguuuucuugca

SEQ ID NO: 1131824 - RNA, 20 nt, Homo sapiens
uggacucgccuguaaucuca

SEQ ID NO: 1131825 - RNA, 14 nt, Homo sapiens
uggacucugcacau

SEQ ID NO: 1131826 - RNA, 22 nt, Homo sapiens
uggacugguuuucacauuagaa

SEQ ID NO: 1131827 - RNA, 18 nt, Homo sapiens
uggacuugcugaauucuc

SEQ ID NO: 1131828 - RNA, 16 nt, Homo sapiens
uggagaacuaaaggug

SEQ ID NO: 1131829 - RNA, 13 nt, Homo sapiens
uggagaagccauu

SEQ ID NO: 1131830 - RNA, 16 nt, Homo sapiens
uggagaaggaguuuca

SEQ ID NO: 1131831 - RNA, 22 nt, Homo sapiens
uggagaauuuuuggauggugau

SEQ ID NO: 1131832 - RNA, 12 nt, Homo sapiens
uggagacaaugu

SEQ ID NO: 1131833 - RNA, 12 nt, Homo sapiens
uggagagccacc

SEQ ID NO: 1131834 - RNA, 13 nt, Homo sapiens
uggagaugcaaau

SEQ ID NO: 1131835 - RNA, 21 nt, Homo sapiens
uggagauucaguuuucauuug

SEQ ID NO: 1131836 - RNA, 17 nt, Homo sapiens
uggagccccacugcccu

SEQ ID NO: 1131837 - RNA, 20 nt, Homo sapiens
uggagccgagcggggagcca

SEQ ID NO: 1131838 - RNA, 22 nt, Homo sapiens
uggagccugggauuucuaugca

SEQ ID NO: 1131839 - RNA, 17 nt, Homo sapiens
uggaggaaaaaaagcau

SEQ ID NO: 1131840 - RNA, 15 nt, Homo sapiens
uggaggccagugaaa

SEQ ID NO: 1131841 - RNA, 23 nt, Homo sapiens
uggaggcggaauugcucucccag

SEQ ID NO: 1131842 - RNA, 20 nt, Homo sapiens
uggaggcucucuugugcauu

SEQ ID NO: 1131843 - RNA, 23 nt, Homo sapiens
uggagggcgccaucuauggugug

SEQ ID NO: 1131844 - RNA, 13 nt, Homo sapiens
uggaggguccauu

SEQ ID NO: 1131845 - RNA, 18 nt, Homo sapiens
uggagguucuaaggccua

SEQ ID NO: 1131846 - RNA, 18 nt, Homo sapiens
uggaguacaguggugcca

SEQ ID NO: 1131847 - RNA, 19 nt, Homo sapiens
uggagugcaguggugcgau

SEQ ID NO: 1131848 - RNA, 15 nt, Homo sapiens
uggaguggcucgcca

SEQ ID NO: 1131849 - RNA, 16 nt, Homo sapiens
uggaguggggaagugu

SEQ ID NO: 1131850 - RNA, 14 nt, Homo sapiens
uggaguuccugcuc

SEQ ID NO: 1131851 - RNA, 13 nt, Homo sapiens
uggaguugcugaa

SEQ ID NO: 1131852 - RNA, 23 nt, Homo sapiens
uggaguuucucucuuguugucca

SEQ ID NO: 1131853 - RNA, 17 nt, Homo sapiens
uggauaaaauaaaugca

SEQ ID NO: 1131854 - RNA, 17 nt, Homo sapiens
uggauaagggaauaaua

SEQ ID NO: 1131855 - RNA, 18 nt, Homo sapiens
uggauaccagcucagggg

SEQ ID NO: 1131856 - RNA, 18 nt, Homo sapiens
uggauaucaaaagcaaau

SEQ ID NO: 1131857 - RNA, 12 nt, Homo sapiens
uggaucagaaua

SEQ ID NO: 1131858 - RNA, 18 nt, Homo sapiens
uggauccuggauugagac

SEQ ID NO: 1131859 - RNA, 15 nt, Homo sapiens
aagaaagaucaaaga

SEQ ID NO: 1131860 - RNA, 16 nt, Homo sapiens
aagaaaucaaaaucca

SEQ ID NO: 1131861 - RNA, 13 nt, Homo sapiens
aagaacagcucau

SEQ ID NO: 1131862 - RNA, 17 nt, Homo sapiens
aagaacaugcaguuuga

SEQ ID NO: 1131863 - RNA, 22 nt, Homo sapiens
aagaaccagagaggcucugaga

SEQ ID NO: 1131864 - RNA, 12 nt, Homo sapiens
aagaacuuaccc

SEQ ID NO: 1131865 - RNA, 21 nt, Homo sapiens
aagaacuucuccuacuguagc

SEQ ID NO: 1131866 - RNA, 23 nt, Homo sapiens
aagaacuuuuucuuuucccucaa

SEQ ID NO: 1131867 - RNA, 21 nt, Homo sapiens
aagaagauaggcucucaguaa

SEQ ID NO: 1131868 - RNA, 12 nt, Homo sapiens
aguccuaaaaag

SEQ ID NO: 1131869 - RNA, 17 nt, Homo sapiens
aguccuaaaaguucuca

SEQ ID NO: 1131870 - RNA, 17 nt, Homo sapiens
aguccuaucugcgagaa

SEQ ID NO: 1131871 - RNA, 20 nt, Homo sapiens
aguccucccagacuaccugc

SEQ ID NO: 1131872 - RNA, 22 nt, Homo sapiens
aguccuccuauuccagugucca

SEQ ID NO: 1131873 - RNA, 19 nt, Homo sapiens
aguccucgcggcucuccag

SEQ ID NO: 1131874 - RNA, 12 nt, Homo sapiens
aguccucugaau

SEQ ID NO: 1131875 - RNA, 16 nt, Homo sapiens
aguccucugccuccau

SEQ ID NO: 1131876 - RNA, 18 nt, Homo sapiens
aguccuggagcaaucaca

SEQ ID NO: 1131877 - RNA, 22 nt, Homo sapiens
aguccugguccuggcugcacuc

SEQ ID NO: 1131878 - RNA, 21 nt, Homo sapiens
aguccuuaaaaaucacacugu

SEQ ID NO: 1131879 - RNA, 15 nt, Homo sapiens
agucgcuugccaaag

SEQ ID NO: 1131880 - RNA, 14 nt, Homo sapiens
agucgggacuugaa

SEQ ID NO: 1131881 - RNA, 22 nt, Homo sapiens
agucuaaaaaaggaauccucug

SEQ ID NO: 1131882 - RNA, 17 nt, Homo sapiens
agucuaaauuuucagag

SEQ ID NO: 1131883 - RNA, 20 nt, Homo sapiens
agucuaagauguguuccuug

SEQ ID NO: 1131884 - RNA, 19 nt, Homo sapiens
agucuacucuuaagccauc

SEQ ID NO: 1131885 - RNA, 17 nt, Homo sapiens
agucuaggagcugggag

SEQ ID NO: 1131886 - RNA, 20 nt, Homo sapiens
agucuauaccauagcaaugu

SEQ ID NO: 1131887 - RNA, 22 nt, Homo sapiens
agucuaucaaccccagacacug

SEQ ID NO: 1131888 - RNA, 23 nt, Homo sapiens
agucucaccuccugccauagggu

SEQ ID NO: 1131889 - RNA, 22 nt, Homo sapiens
agucucuaucauuaaaguucua

SEQ ID NO: 1131890 - RNA, 15 nt, Homo sapiens
agucucucauucuag

SEQ ID NO: 1131891 - RNA, 17 nt, Homo sapiens
agucucuucuaagcaaa

SEQ ID NO: 1131892 - RNA, 19 nt, Homo sapiens
agucucuuguacagcguuu

SEQ ID NO: 1131893 - RNA, 17 nt, Homo sapiens
agucugcagauagaaag

SEQ ID NO: 1131894 - RNA, 22 nt, Homo sapiens
agucugcagauagaaagcauua

SEQ ID NO: 1131895 - RNA, 21 nt, Homo sapiens
agucugcuacccucauuucuc

SEQ ID NO: 1131896 - RNA, 17 nt, Homo sapiens
agucuggcaaacaugug

SEQ ID NO: 1131897 - RNA, 16 nt, Homo sapiens
agucuguauuuuccac

SEQ ID NO: 1131898 - RNA, 15 nt, Homo sapiens
agucuguguucaaaa

SEQ ID NO: 1131899 - RNA, 14 nt, Homo sapiens
agucuguucucaca

SEQ ID NO: 1131900 - RNA, 15 nt, Homo sapiens
agucuguugcugcuc

SEQ ID NO: 1131901 - RNA, 13 nt, Homo sapiens
agucuucuguaua

SEQ ID NO: 1131902 - RNA, 16 nt, Homo sapiens
agucuugccuugcuga

SEQ ID NO: 1131903 - RNA, 20 nt, Homo sapiens
agucuugggucuaugccuug

SEQ ID NO: 1131904 - RNA, 17 nt, Homo sapiens
agucuuuagggguuggg

SEQ ID NO: 1131905 - RNA, 17 nt, Homo sapiens
agucuuucuaucaaaua

SEQ ID NO: 1131906 - RNA, 13 nt, Homo sapiens
agucuuugccagu

SEQ ID NO: 1131907 - RNA, 19 nt, Homo sapiens
agugaaacauugaacucau

SEQ ID NO: 1131908 - RNA, 14 nt, Homo sapiens
agugaacauucuga

SEQ ID NO: 1131909 - RNA, 15 nt, Homo sapiens
agugaagcauggcau

SEQ ID NO: 1131910 - RNA, 14 nt, Homo sapiens
agugaaggauuuau

SEQ ID NO: 1131911 - RNA, 17 nt, Homo sapiens
agugaaggcuguccuua

SEQ ID NO: 1131912 - RNA, 14 nt, Homo sapiens
agugaaggugcugg

SEQ ID NO: 1131913 - RNA, 18 nt, Homo sapiens
agugacaagugaccccca

SEQ ID NO: 1131914 - RNA, 20 nt, Homo sapiens
agugacaguugcagcccuug

SEQ ID NO: 1131915 - RNA, 20 nt, Homo sapiens
agugacaucucuuugauguc

SEQ ID NO: 1131916 - RNA, 23 nt, Homo sapiens
agugacgggugcccguaauccca

SEQ ID NO: 1131917 - RNA, 15 nt, Homo sapiens
agugagacaggugau

SEQ ID NO: 1131918 - RNA, 17 nt, Homo sapiens
agugagacuccaucuca

SEQ ID NO: 1131919 - RNA, 22 nt, Homo sapiens
agugagcacucacgcccuaagc

SEQ ID NO: 1131920 - RNA, 19 nt, Homo sapiens
agugagcccagauugugcc

SEQ ID NO: 1131921 - RNA, 20 nt, Homo sapiens
agugaggacaaaaucacauu

SEQ ID NO: 1131922 - RNA, 19 nt, Homo sapiens
agugaguucccuuagugaa

SEQ ID NO: 1131923 - RNA, 18 nt, Homo sapiens
agugauguuggcuagccc

SEQ ID NO: 1131924 - RNA, 19 nt, Homo sapiens
agugauguuggcuagccca

SEQ ID NO: 1131925 - RNA, 22 nt, Homo sapiens
agugauuaacuuaagauuugcu

SEQ ID NO: 1131926 - RNA, 21 nt, Homo sapiens
agugauucaucuucacagcac

SEQ ID NO: 1131927 - RNA, 17 nt, Homo sapiens
agugauucccaacuccu

SEQ ID NO: 1131928 - RNA, 16 nt, Homo sapiens
agugauucuccugccu

SEQ ID NO: 1131929 - RNA, 19 nt, Homo sapiens
agugauucuccugccucag

SEQ ID NO: 1131930 - RNA, 19 nt, Homo sapiens
agugcaagccccugcucca

SEQ ID NO: 1131931 - RNA, 21 nt, Homo sapiens
agugcaauggcaggaucucag

SEQ ID NO: 1131932 - RNA, 21 nt, Homo sapiens
agugcaggcuggccagccgcu

SEQ ID NO: 1131933 - RNA, 19 nt, Homo sapiens
agugcaucuaaucacuuag

SEQ ID NO: 1131934 - RNA, 14 nt, Homo sapiens
agugcaugguggcc

SEQ ID NO: 1131935 - RNA, 16 nt, Homo sapiens
agugccaugggggcaa

SEQ ID NO: 1131936 - RNA, 17 nt, Homo sapiens
agugcccaacuguuaua

SEQ ID NO: 1131937 - RNA, 22 nt, Homo sapiens
agugccccagacugagcucucc

SEQ ID NO: 1131938 - RNA, 22 nt, Homo sapiens
agugccgaaaacuucacugugc

SEQ ID NO: 1131939 - RNA, 14 nt, Homo sapiens
agugccuucucuca

SEQ ID NO: 1131940 - RNA, 15 nt, Homo sapiens
agugccuuuaucuca

SEQ ID NO: 1131941 - RNA, 23 nt, Homo sapiens
agugcuauuucagcaacaaccau

SEQ ID NO: 1131942 - RNA, 18 nt, Homo sapiens
agugcucaagcagcaaaa

SEQ ID NO: 1131943 - RNA, 20 nt, Homo sapiens
agugcuggggaacaaccaga

SEQ ID NO: 1131944 - RNA, 18 nt, Homo sapiens
agugcuucuuguaauauu

SEQ ID NO: 1131945 - RNA, 18 nt, Homo sapiens
aguggauugugagaaauu

SEQ ID NO: 1131946 - RNA, 14 nt, Homo sapiens
aguggcaacguagu

SEQ ID NO: 1131947 - RNA, 22 nt, Homo sapiens
aguggcauguggguugugauau

SEQ ID NO: 1131948 - RNA, 14 nt, Homo sapiens
aguggccuuugcaa

SEQ ID NO: 1131949 - RNA, 23 nt, Homo sapiens
aguggcgcaugccuguaauccca

SEQ ID NO: 1131950 - RNA, 17 nt, Homo sapiens
aguggcucacaccugua

SEQ ID NO: 1131951 - RNA, 18 nt, Homo sapiens
aguggcucgaccucgcug

SEQ ID NO: 1131952 - RNA, 15 nt, Homo sapiens
aguggcuuagcugcc

SEQ ID NO: 1131953 - RNA, 19 nt, Homo sapiens
agugggaaauauuuagcaa

SEQ ID NO: 1131954 - RNA, 18 nt, Homo sapiens
aguggugacaaaucaaga

SEQ ID NO: 1131955 - RNA, 15 nt, Homo sapiens
aguguaaacaccaua

SEQ ID NO: 1131956 - RNA, 20 nt, Homo sapiens
aguguaaauucagucuuuuc

SEQ ID NO: 1131957 - RNA, 18 nt, Homo sapiens
aguguaauugagaaggaa

SEQ ID NO: 1131958 - RNA, 19 nt, Homo sapiens
aguguacauguacauagua

SEQ ID NO: 1131959 - RNA, 19 nt, Homo sapiens
aguguauagaaaaaccaaa

SEQ ID NO: 1131960 - RNA, 15 nt, Homo sapiens
agugucaaccagaca

SEQ ID NO: 1131961 - RNA, 19 nt, Homo sapiens
agugucaccuuuucuugcc

SEQ ID NO: 1131962 - RNA, 20 nt, Homo sapiens
agugucuggguuuggcccaa

SEQ ID NO: 1131963 - RNA, 14 nt, Homo sapiens
agugucuuuugaca

SEQ ID NO: 1131964 - RNA, 13 nt, Homo sapiens
agugugaguguga

SEQ ID NO: 1131965 - RNA, 17 nt, Homo sapiens
aguguggccaggcugcc

SEQ ID NO: 1131966 - RNA, 20 nt, Homo sapiens
agugugggaggcuccuguua

SEQ ID NO: 1131967 - RNA, 23 nt, Homo sapiens
agugugggcgcucucccuaccuu

SEQ ID NO: 1131968 - RNA, 16 nt, Homo sapiens
aguguguaugccaaga

SEQ ID NO: 1131969 - RNA, 14 nt, Homo sapiens
agugugugugcaug

SEQ ID NO: 1131970 - RNA, 14 nt, Homo sapiens
aguguguuugcuaa

SEQ ID NO: 1131971 - RNA, 17 nt, Homo sapiens
aguguucacaaccugga

SEQ ID NO: 1131972 - RNA, 17 nt, Homo sapiens
aguguucuccacuaaua

SEQ ID NO: 1131973 - RNA, 22 nt, Homo sapiens
aguguucugcugagacugagca

SEQ ID NO: 1131974 - RNA, 17 nt, Homo sapiens
aguguuugaaagcuuua

SEQ ID NO: 1131975 - RNA, 14 nt, Homo sapiens
aguguuuguauacc

SEQ ID NO: 1131976 - RNA, 20 nt, Homo sapiens
aguuaaaauguuuacuguaa

SEQ ID NO: 1131977 - RNA, 12 nt, Homo sapiens
aguuaaagcuac

SEQ ID NO: 1131978 - RNA, 17 nt, Homo sapiens
aguuaaagcuacagguc

SEQ ID NO: 1131979 - RNA, 12 nt, Homo sapiens
aguuaaccaauc

SEQ ID NO: 1131980 - RNA, 22 nt, Homo sapiens
acaaaucaagaauaaacacugg

SEQ ID NO: 1131981 - RNA, 22 nt, Homo sapiens
acaaauccaaugaaaugaguuu

SEQ ID NO: 1131982 - RNA, 19 nt, Homo sapiens
acaaaucccucauccugac

SEQ ID NO: 1131983 - RNA, 15 nt, Homo sapiens
acaaaugacauggac

SEQ ID NO: 1131984 - RNA, 17 nt, Homo sapiens
acaaaugguuaccuugu

SEQ ID NO: 1131985 - RNA, 20 nt, Homo sapiens
acaaauguauuaaugcuaua

SEQ ID NO: 1131986 - RNA, 15 nt, Homo sapiens
acaacaaacacugug

SEQ ID NO: 1131987 - RNA, 16 nt, Homo sapiens
acaacaaacacuguga

SEQ ID NO: 1131988 - RNA, 15 nt, Homo sapiens
acaacaagaugaaau

SEQ ID NO: 1131989 - RNA, 16 nt, Homo sapiens
acaacaauaauaaaga

SEQ ID NO: 1131990 - RNA, 14 nt, Homo sapiens
acaacacaguucuc

SEQ ID NO: 1131991 - RNA, 11 nt, Homo sapiens
acaacacuggu

SEQ ID NO: 1131992 - RNA, 21 nt, Homo sapiens
acaacagauuugugaacucag

SEQ ID NO: 1131993 - RNA, 20 nt, Homo sapiens
acaacauguauguggauaca

SEQ ID NO: 1131994 - RNA, 14 nt, Homo sapiens
acaaccaagcagaa

SEQ ID NO: 1131995 - RNA, 11 nt, Homo sapiens
acaaccugcug

SEQ ID NO: 1131996 - RNA, 19 nt, Homo sapiens
acaaccuuuccagcuacuu

SEQ ID NO: 1131997 - RNA, 14 nt, Homo sapiens
acaacuaaauaacu

SEQ ID NO: 1131998 - RNA, 18 nt, Homo sapiens
acaacuaagugauuugua

SEQ ID NO: 1131999 - RNA, 20 nt, Homo sapiens
acaacuauuuucagauguga

SEQ ID NO: 1132000 - RNA, 12 nt, Homo sapiens
acaacucagucc

SEQ ID NO: 1132001 - RNA, 17 nt, Homo sapiens
acaacucagucccuaaa

SEQ ID NO: 1132002 - RNA, 18 nt, Homo sapiens
acaacuugaauaauacac

SEQ ID NO: 1132003 - RNA, 22 nt, Homo sapiens
acaacuugucacccaaagccug

SEQ ID NO: 1132004 - RNA, 22 nt, Homo sapiens
acaagaaacuuuggaagcacuu

SEQ ID NO: 1132005 - RNA, 14 nt, Homo sapiens
acaagaaucacuug

SEQ ID NO: 1132006 - RNA, 15 nt, Homo sapiens
acaagaccaccacuu

SEQ ID NO: 1132007 - RNA, 18 nt, Homo sapiens
acaagaguuucaaaacau

SEQ ID NO: 1132008 - RNA, 17 nt, Homo sapiens
acaagauacacgucaca

SEQ ID NO: 1132009 - RNA, 18 nt, Homo sapiens
acaagaucuguaauguua

SEQ ID NO: 1132010 - RNA, 23 nt, Homo sapiens
acaagauggcuaggccaucacca

SEQ ID NO: 1132011 - RNA, 18 nt, Homo sapiens
acaagcacuaaacaaaga

SEQ ID NO: 1132012 - RNA, 17 nt, Homo sapiens
acaagccagaacuugac

SEQ ID NO: 1132013 - RNA, 15 nt, Homo sapiens
acaagcugcauuuca

SEQ ID NO: 1132014 - RNA, 19 nt, Homo sapiens
acaagcuguaucacugccu

SEQ ID NO: 1132015 - RNA, 13 nt, Homo sapiens
acaagcuuuccaa

SEQ ID NO: 1132016 - RNA, 15 nt, Homo sapiens
acaaggacaacuuua

SEQ ID NO: 1132017 - RNA, 17 nt, Homo sapiens
acaaggcuccacaagcg

SEQ ID NO: 1132018 - RNA, 20 nt, Homo sapiens
acaagguccucugucaguca

SEQ ID NO: 1132019 - RNA, 15 nt, Homo sapiens
acaaguaaucacuaa

SEQ ID NO: 1132020 - RNA, 12 nt, Homo sapiens
acaagugguggu

SEQ ID NO: 1132021 - RNA, 15 nt, Homo sapiens
acaauaaaacauuaa

SEQ ID NO: 1132022 - RNA, 16 nt, Homo sapiens
acaauaaaacauuaau

SEQ ID NO: 1132023 - RNA, 13 nt, Homo sapiens
acaauaaaagaca

SEQ ID NO: 1132024 - RNA, 18 nt, Homo sapiens
acaauaacgauaaaagac

SEQ ID NO: 1132025 - RNA, 19 nt, Homo sapiens
acaauaacgauaaaagaca

SEQ ID NO: 1132026 - RNA, 17 nt, Homo sapiens
acaauaccuacaauaaa

SEQ ID NO: 1132027 - RNA, 17 nt, Homo sapiens
acaauagcccaaagcca

SEQ ID NO: 1132028 - RNA, 23 nt, Homo sapiens
acaauccaaaaauguuuuucaaa

SEQ ID NO: 1132029 - RNA, 15 nt, Homo sapiens
acaaugaaaugcucu

SEQ ID NO: 1132030 - RNA, 19 nt, Homo sapiens
acaaugaacccccaugaug

SEQ ID NO: 1132031 - RNA, 20 nt, Homo sapiens
acaaugaacccccaugaugu

SEQ ID NO: 1132032 - RNA, 19 nt, Homo sapiens
acaaugaguggacaaguca

SEQ ID NO: 1132033 - RNA, 17 nt, Homo sapiens
acaaugauuaaucagcu

SEQ ID NO: 1132034 - RNA, 15 nt, Homo sapiens
acaauguaagagccu

SEQ ID NO: 1132035 - RNA, 18 nt, Homo sapiens
acaauguacaagguaugu

SEQ ID NO: 1132036 - RNA, 17 nt, Homo sapiens
acaauguugcacugaaa

SEQ ID NO: 1132037 - RNA, 17 nt, Homo sapiens
acaauguuugauacucu

SEQ ID NO: 1132038 - RNA, 18 nt, Homo sapiens
acaauuaugaacauccaa

SEQ ID NO: 1132039 - RNA, 12 nt, Homo sapiens
acaauuccacac

SEQ ID NO: 1132040 - RNA, 17 nt, Homo sapiens
acaauuggcacuaaaga

SEQ ID NO: 1132041 - RNA, 22 nt, Homo sapiens
acacaaaugguaaacuccucca

SEQ ID NO: 1132042 - RNA, 17 nt, Homo sapiens
acacaaauuaaggggaa

SEQ ID NO: 1132043 - RNA, 16 nt, Homo sapiens
acacaagagcuggagc

SEQ ID NO: 1132044 - RNA, 20 nt, Homo sapiens
acacaaggauagaugcuggc

SEQ ID NO: 1132045 - RNA, 12 nt, Homo sapiens
acacaauaccua

SEQ ID NO: 1132046 - RNA, 19 nt, Homo sapiens
acacaaugauuuuguacau

SEQ ID NO: 1132047 - RNA, 17 nt, Homo sapiens
acacaauuaaaugacuu

SEQ ID NO: 1132048 - RNA, 12 nt, Homo sapiens
acacacacaagu

SEQ ID NO: 1132049 - RNA, 11 nt, Homo sapiens
acacacacaga

SEQ ID NO: 1132050 - RNA, 15 nt, Homo sapiens
acacacagagcucac

SEQ ID NO: 1132051 - RNA, 23 nt, Homo sapiens
acacacaucuaucuauacauaau

SEQ ID NO: 1132052 - RNA, 13 nt, Homo sapiens
acacaccucuuga

SEQ ID NO: 1132053 - RNA, 22 nt, Homo sapiens
acacacuuucucuucaaugaaa

SEQ ID NO: 1132054 - RNA, 19 nt, Homo sapiens
acacagagcaggacugcac

SEQ ID NO: 1132055 - RNA, 22 nt, Homo sapiens
acacagagcaggacugcacagc

SEQ ID NO: 1132056 - RNA, 17 nt, Homo sapiens
acacagaggggagucac

SEQ ID NO: 1132057 - RNA, 21 nt, Homo sapiens
acacagaggggagucaccagc

SEQ ID NO: 1132058 - RNA, 11 nt, Homo sapiens
acacagccaca

SEQ ID NO: 1132059 - RNA, 16 nt, Homo sapiens
acacagcccugaauca

SEQ ID NO: 1132060 - RNA, 23 nt, Homo sapiens
acacagcccugcuucugacauaa

SEQ ID NO: 1132061 - RNA, 19 nt, Homo sapiens
acacagccguguguucaaa

SEQ ID NO: 1132062 - RNA, 16 nt, Homo sapiens
acacagggugguggca

SEQ ID NO: 1132063 - RNA, 19 nt, Homo sapiens
acacagucuuggcucacug

SEQ ID NO: 1132064 - RNA, 20 nt, Homo sapiens
acacagugagaguacucacu

SEQ ID NO: 1132065 - RNA, 15 nt, Homo sapiens
acacauacauaggau

SEQ ID NO: 1132066 - RNA, 17 nt, Homo sapiens
acacaugacacucuucu

SEQ ID NO: 1132067 - RNA, 17 nt, Homo sapiens
acacauucuuaacacau

SEQ ID NO: 1132068 - RNA, 21 nt, Homo sapiens
acacauuuagaugcacuacca

SEQ ID NO: 1132069 - RNA, 11 nt, Homo sapiens
acaccaaaaau

SEQ ID NO: 1132070 - RNA, 21 nt, Homo sapiens
acaccaaacgagguuccuggu

SEQ ID NO: 1132071 - RNA, 16 nt, Homo sapiens
acaccacacacaacag

SEQ ID NO: 1132072 - RNA, 23 nt, Homo sapiens
acaccacaucuaagccugaaggg

SEQ ID NO: 1132073 - RNA, 15 nt, Homo sapiens
acaccaguaauccca

SEQ ID NO: 1132074 - RNA, 15 nt, Homo sapiens
acaccccaacacuuc

SEQ ID NO: 1132075 - RNA, 23 nt, Homo sapiens
acacccccucuucugagcacaga

SEQ ID NO: 1132076 - RNA, 12 nt, Homo sapiens
acacccuaccuu

SEQ ID NO: 1132077 - RNA, 19 nt, Homo sapiens
acaccguacaucugcaaua

SEQ ID NO: 1132078 - RNA, 14 nt, Homo sapiens
acaccguucauuca

SEQ ID NO: 1132079 - RNA, 12 nt, Homo sapiens
acaccugagaaa

SEQ ID NO: 1132080 - RNA, 20 nt, Homo sapiens
acaccuguaaucccagcaca

SEQ ID NO: 1132081 - RNA, 21 nt, Homo sapiens
acaccuuugaauuacagcagu

SEQ ID NO: 1132082 - RNA, 18 nt, Homo sapiens
acaccuuuuauugacaca

SEQ ID NO: 1132083 - RNA, 21 nt, Homo sapiens
acacgcaggccucccugccuc

SEQ ID NO: 1132084 - RNA, 22 nt, Homo sapiens
acacgccugcaaacgcugccug

SEQ ID NO: 1132085 - RNA, 19 nt, Homo sapiens
acacguaaugaaacuugga

SEQ ID NO: 1132086 - RNA, 14 nt, Homo sapiens
acacgugaugugau

SEQ ID NO: 1132087 - RNA, 13 nt, Homo sapiens
acacuaaaacuuu

SEQ ID NO: 1132088 - RNA, 17 nt, Homo sapiens
acacuaagaaugaggaa

SEQ ID NO: 1132089 - RNA, 14 nt, Homo sapiens
acacucaacaauaa

SEQ ID NO: 1132090 - RNA, 15 nt, Homo sapiens
acacucccaccagca

SEQ ID NO: 1132091 - RNA, 19 nt, Homo sapiens
acacucuucuaugacccag

SEQ ID NO: 1132092 - RNA, 22 nt, Homo sapiens
acacucuucugaauugacugua

SEQ ID NO: 1132093 - RNA, 22 nt, Homo sapiens
acacugaaaaaauacuaccuau

SEQ ID NO: 1132094 - RNA, 17 nt, Homo sapiens
acacugaaggaacaguu

SEQ ID NO: 1132095 - RNA, 17 nt, Homo sapiens
acacugaagguugacac

SEQ ID NO: 1132096 - RNA, 13 nt, Homo sapiens
acacugauccagc

SEQ ID NO: 1132097 - RNA, 21 nt, Homo sapiens
acacugauccagcccugaguu

SEQ ID NO: 1132098 - RNA, 22 nt, Homo sapiens
acacugaucugaacaucuggcc

SEQ ID NO: 1132099 - RNA, 16 nt, Homo sapiens
acacugaugcuuagau

SEQ ID NO: 1132100 - RNA, 18 nt, Homo sapiens
acacuggcagacaucuag

SEQ ID NO: 1132101 - RNA, 15 nt, Homo sapiens
acacuggcagacugu

SEQ ID NO: 1132102 - RNA, 18 nt, Homo sapiens
acacuggcguuacugcuu

SEQ ID NO: 1132103 - RNA, 21 nt, Homo sapiens
acacuggcguuacugcuugac

SEQ ID NO: 1132104 - RNA, 13 nt, Homo sapiens
acacugugcuacu

SEQ ID NO: 1132105 - RNA, 17 nt, Homo sapiens
acacugugcuacugaaa

SEQ ID NO: 1132106 - RNA, 14 nt, Homo sapiens
acacuuacccaagg

SEQ ID NO: 1132107 - RNA, 21 nt, Homo sapiens
acacuuacuguaagacauuag

SEQ ID NO: 1132108 - RNA, 18 nt, Homo sapiens
acauauucuuuaaauuuc

SEQ ID NO: 1132109 - RNA, 22 nt, Homo sapiens
acaucaaagacagcaucuaaga

SEQ ID NO: 1132110 - RNA, 16 nt, Homo sapiens
acaucagaacagacaa

SEQ ID NO: 1132111 - RNA, 12 nt, Homo sapiens
acaucaggaaau

SEQ ID NO: 1132112 - RNA, 15 nt, Homo sapiens
acaucauaacccaug

SEQ ID NO: 1132113 - RNA, 23 nt, Homo sapiens
acaucaugcuggaaccugcaaaa

SEQ ID NO: 1132114 - RNA, 15 nt, Homo sapiens
acaucauuacuauaa

SEQ ID NO: 1132115 - RNA, 20 nt, Homo sapiens
acccaagugccaagacacag

SEQ ID NO: 1132116 - RNA, 14 nt, Homo sapiens
acccaaugauucag

SEQ ID NO: 1132117 - RNA, 15 nt, Homo sapiens
acccaaugauucagc

SEQ ID NO: 1132118 - RNA, 15 nt, Homo sapiens
acccaccaccaugcc

SEQ ID NO: 1132119 - RNA, 19 nt, Homo sapiens
acccaccccacaauuccuc

SEQ ID NO: 1132120 - RNA, 15 nt, Homo sapiens
acccacuggcacauu

SEQ ID NO: 1132121 - RNA, 15 nt, Homo sapiens
acccagaacaugaag

SEQ ID NO: 1132122 - RNA, 18 nt, Homo sapiens
acccagcagccaacuggc

SEQ ID NO: 1132123 - RNA, 15 nt, Homo sapiens
acccagccaugcaau

SEQ ID NO: 1132124 - RNA, 22 nt, Homo sapiens
acccaggaggggaacacugccc

SEQ ID NO: 1132125 - RNA, 24 nt, Homo sapiens
acccagggggcugaaacuugaacu

SEQ ID NO: 1132126 - RNA, 19 nt, Homo sapiens
acccaguagaugccacuag

SEQ ID NO: 1132127 - RNA, 19 nt, Homo sapiens
acccagucagacaaauuca

SEQ ID NO: 1132128 - RNA, 17 nt, Homo sapiens
acccagugacugacauu

SEQ ID NO: 1132129 - RNA, 18 nt, Homo sapiens
acccaguugugacaauua

SEQ ID NO: 1132130 - RNA, 22 nt, Homo sapiens
acccaucacgugugauugacau

SEQ ID NO: 1132131 - RNA, 21 nt, Homo sapiens
acccauugugauuguggaaga

SEQ ID NO: 1132132 - RNA, 18 nt, Homo sapiens
accccaaggagggagaug

SEQ ID NO: 1132133 - RNA, 22 nt, Homo sapiens
accccagauucaugcacuguag

SEQ ID NO: 1132134 - RNA, 18 nt, Homo sapiens
accccaggaaaagcacaa

SEQ ID NO: 1132135 - RNA, 23 nt, Homo sapiens
accccaggcccacucagggguca

SEQ ID NO: 1132136 - RNA, 19 nt, Homo sapiens
accccagucccagcuaacu

SEQ ID NO: 1132137 - RNA, 15 nt, Homo sapiens
accccaucucuacua

SEQ ID NO: 1132138 - RNA, 12 nt, Homo sapiens
accccauuugau

SEQ ID NO: 1132139 - RNA, 23 nt, Homo sapiens
acccccagaccauacugacucaa

SEQ ID NO: 1132140 - RNA, 14 nt, Homo sapiens
acccccagcacuug

SEQ ID NO: 1132141 - RNA, 15 nt, Homo sapiens
acccccaguguaaua

SEQ ID NO: 1132142 - RNA, 16 nt, Homo sapiens
acccccaucucuacua

SEQ ID NO: 1132143 - RNA, 21 nt, Homo sapiens
acccccaucucuacuaaaaau

SEQ ID NO: 1132144 - RNA, 17 nt, Homo sapiens
acccccgcuuugguucu

SEQ ID NO: 1132145 - RNA, 21 nt, Homo sapiens
acccccucccugcccccagac

SEQ ID NO: 1132146 - RNA, 20 nt, Homo sapiens
accccguuuuccagcaugug

SEQ ID NO: 1132147 - RNA, 21 nt, Homo sapiens
accccuagagacagugaugcc

SEQ ID NO: 1132148 - RNA, 23 nt, Homo sapiens
accccuagagacagugaugccug

SEQ ID NO: 1132149 - RNA, 14 nt, Homo sapiens
accccuccaggaau

SEQ ID NO: 1132150 - RNA, 18 nt, Homo sapiens
accccucccccacgucuc

SEQ ID NO: 1132151 - RNA, 19 nt, Homo sapiens
accccugccuuugggagca

SEQ ID NO: 1132152 - RNA, 19 nt, Homo sapiens
accccuuguuuagcauaua

SEQ ID NO: 1132153 - RNA, 19 nt, Homo sapiens
acccguuuuauucuauucc

SEQ ID NO: 1132154 - RNA, 13 nt, Homo sapiens
acccuaaugcaua

SEQ ID NO: 1132155 - RNA, 20 nt, Homo sapiens
acccuaaugcauaagcuuuu

SEQ ID NO: 1132156 - RNA, 19 nt, Homo sapiens
acccuagccuccaccaucc

SEQ ID NO: 1132157 - RNA, 16 nt, Homo sapiens
acccucaccacccaac

SEQ ID NO: 1132158 - RNA, 17 nt, Homo sapiens
acccucagcgagucccu

SEQ ID NO: 1132159 - RNA, 14 nt, Homo sapiens
acccucauacacag

SEQ ID NO: 1132160 - RNA, 19 nt, Homo sapiens
acccucauucuacugaaaa

SEQ ID NO: 1132161 - RNA, 19 nt, Homo sapiens
acccuccuggccucagacu

SEQ ID NO: 1132162 - RNA, 15 nt, Homo sapiens
acccucucacuuugg

SEQ ID NO: 1132163 - RNA, 13 nt, Homo sapiens
acccucuccagca

SEQ ID NO: 1132164 - RNA, 20 nt, Homo sapiens
acccucuuucuuguuuguca

SEQ ID NO: 1132165 - RNA, 23 nt, Homo sapiens
acccugacuccucuuugugcaga

SEQ ID NO: 1132166 - RNA, 23 nt, Homo sapiens
acccugccucgcccccacuuuuc

SEQ ID NO: 1132167 - RNA, 20 nt, Homo sapiens
acccugcugcuggugcacag

SEQ ID NO: 1132168 - RNA, 14 nt, Homo sapiens
acccuggggccaga

SEQ ID NO: 1132169 - RNA, 21 nt, Homo sapiens
acccuggugggccaacaaaga

SEQ ID NO: 1132170 - RNA, 16 nt, Homo sapiens
acccugugcaauucag

SEQ ID NO: 1132171 - RNA, 12 nt, Homo sapiens
acccuguuacaa

SEQ ID NO: 1132172 - RNA, 22 nt, Homo sapiens
acccuucauuuaacaaguaaga

SEQ ID NO: 1132173 - RNA, 18 nt, Homo sapiens
acccuuccacguguaugc

SEQ ID NO: 1132174 - RNA, 13 nt, Homo sapiens
acccuucccucac

SEQ ID NO: 1132175 - RNA, 14 nt, Homo sapiens
acccuuucauaaag

SEQ ID NO: 1132176 - RNA, 19 nt, Homo sapiens
acccuuucauuagaacuuc

SEQ ID NO: 1132177 - RNA, 22 nt, Homo sapiens
accgaaucucuuuucucuguaa

SEQ ID NO: 1132178 - RNA, 13 nt, Homo sapiens
accgauggccaug

SEQ ID NO: 1132179 - RNA, 11 nt, Homo sapiens
accgcacucca

SEQ ID NO: 1132180 - RNA, 21 nt, Homo sapiens
accgcauccucagcuucuucc

SEQ ID NO: 1132181 - RNA, 21 nt, Homo sapiens
accgguggggcugguucugua

SEQ ID NO: 1132182 - RNA, 21 nt, Homo sapiens
accgguucccacaagccugcc

SEQ ID NO: 1132183 - RNA, 18 nt, Homo sapiens
accguguaccucaguucc

SEQ ID NO: 1132184 - RNA, 21 nt, Homo sapiens
accguuauaaagugugccaca

SEQ ID NO: 1132185 - RNA, 22 nt, Homo sapiens
accuaagagggcaggagggaaa

SEQ ID NO: 1132186 - RNA, 15 nt, Homo sapiens
accuacacacuguca

SEQ ID NO: 1132187 - RNA, 14 nt, Homo sapiens
accuacccaugacc

SEQ ID NO: 1132188 - RNA, 21 nt, Homo sapiens
accuacccuccacaggcacag

SEQ ID NO: 1132189 - RNA, 12 nt, Homo sapiens
accuacugcuga

SEQ ID NO: 1132190 - RNA, 19 nt, Homo sapiens
accuacuuuucuuuccuca

SEQ ID NO: 1132191 - RNA, 15 nt, Homo sapiens
accuauuugacuuac

SEQ ID NO: 1132192 - RNA, 21 nt, Homo sapiens
accuauuuuugaaggcauaaa

SEQ ID NO: 1132193 - RNA, 14 nt, Homo sapiens
accucacauacccu

SEQ ID NO: 1132194 - RNA, 16 nt, Homo sapiens
accucagccuggccag

SEQ ID NO: 1132195 - RNA, 23 nt, Homo sapiens
accucaggguauugcuugccacu

SEQ ID NO: 1132196 - RNA, 19 nt, Homo sapiens
accucaugagucuaccuga

SEQ ID NO: 1132197 - RNA, 13 nt, Homo sapiens
accucauucugaa

SEQ ID NO: 1132198 - RNA, 16 nt, Homo sapiens
accuccaagccacuga

SEQ ID NO: 1132199 - RNA, 19 nt, Homo sapiens
accuccaagccacugagca

SEQ ID NO: 1132200 - RNA, 14 nt, Homo sapiens
accuccacgggcuc

SEQ ID NO: 1132201 - RNA, 16 nt, Homo sapiens
accuccauaugcugua

SEQ ID NO: 1132202 - RNA, 12 nt, Homo sapiens
accucccacugc

SEQ ID NO: 1132203 - RNA, 21 nt, Homo sapiens
accuccuacgucaaacaugaa

SEQ ID NO: 1132204 - RNA, 20 nt, Homo sapiens
accuccucccuaaugcucac

SEQ ID NO: 1132205 - RNA, 22 nt, Homo sapiens
accuccuuucaucacacugggu

SEQ ID NO: 1132206 - RNA, 20 nt, Homo sapiens
accuccuuuuuugaggucag

SEQ ID NO: 1132207 - RNA, 17 nt, Homo sapiens
accucgaggucugcaca

SEQ ID NO: 1132208 - RNA, 21 nt, Homo sapiens
accucgaguacugugggcaau

SEQ ID NO: 1132209 - RNA, 16 nt, Homo sapiens
accucucagcugcuga

SEQ ID NO: 1132210 - RNA, 17 nt, Homo sapiens
accucucagcugcugaa

SEQ ID NO: 1132211 - RNA, 19 nt, Homo sapiens
accugaaaacacugugcac

SEQ ID NO: 1132212 - RNA, 14 nt, Homo sapiens
accugaagugugca

SEQ ID NO: 1132213 - RNA, 15 nt, Homo sapiens
accugauauauucca

SEQ ID NO: 1132214 - RNA, 12 nt, Homo sapiens
accugauggaga

SEQ ID NO: 1132215 - RNA, 14 nt, Homo sapiens
accugcaacacaac

SEQ ID NO: 1132216 - RNA, 17 nt, Homo sapiens
accugcacuuacaggcc

SEQ ID NO: 1132217 - RNA, 13 nt, Homo sapiens
accugcacuucau

SEQ ID NO: 1132218 - RNA, 18 nt, Homo sapiens
accugcacuucauaucua

SEQ ID NO: 1132219 - RNA, 17 nt, Homo sapiens
accugccagaggaugcu

SEQ ID NO: 1132220 - RNA, 16 nt, Homo sapiens
accugccgagagucca

SEQ ID NO: 1132221 - RNA, 17 nt, Homo sapiens
accugcgcacagguggg

SEQ ID NO: 1132222 - RNA, 15 nt, Homo sapiens
accugcggguccuca

SEQ ID NO: 1132223 - RNA, 12 nt, Homo sapiens
accugcucuccg

SEQ ID NO: 1132224 - RNA, 14 nt, Homo sapiens
accuggacggugcg

SEQ ID NO: 1132225 - RNA, 16 nt, Homo sapiens
accuggcaacccagga

SEQ ID NO: 1132226 - RNA, 15 nt, Homo sapiens
accuggcaagucaca

SEQ ID NO: 1132227 - RNA, 18 nt, Homo sapiens
accuggcagcaaacugcu

SEQ ID NO: 1132228 - RNA, 19 nt, Homo sapiens
accuggcagccacaacugc

SEQ ID NO: 1132229 - RNA, 19 nt, Homo sapiens
accuggcccuugcaaucuu

SEQ ID NO: 1132230 - RNA, 23 nt, Homo sapiens
accugguacaaaugcacgucaca

SEQ ID NO: 1132231 - RNA, 17 nt, Homo sapiens
accugguaugugccagg

SEQ ID NO: 1132232 - RNA, 19 nt, Homo sapiens
accuguuagcagacaggcc

SEQ ID NO: 1132233 - RNA, 17 nt, Homo sapiens
accuguuccugacuuaa

SEQ ID NO: 1132234 - RNA, 16 nt, Homo sapiens
accuguucuguagcuu

SEQ ID NO: 1132235 - RNA, 21 nt, Homo sapiens
accuguugauagcaagugaau

SEQ ID NO: 1132236 - RNA, 18 nt, Homo sapiens
accuguuuccuacagaca

SEQ ID NO: 1132237 - RNA, 20 nt, Homo sapiens
accuuaugagaaacugcaug

SEQ ID NO: 1132238 - RNA, 14 nt, Homo sapiens
accuuauugaucuu

SEQ ID NO: 1132239 - RNA, 13 nt, Homo sapiens
accuucaauacuu

SEQ ID NO: 1132240 - RNA, 15 nt, Homo sapiens
accuucaauacuuaa

SEQ ID NO: 1132241 - RNA, 14 nt, Homo sapiens
accuucagagccag

SEQ ID NO: 1132242 - RNA, 18 nt, Homo sapiens
caggagaaucacuugaac

SEQ ID NO: 1132243 - RNA, 18 nt, Homo sapiens
caggagacccaacaauga

SEQ ID NO: 1132244 - RNA, 14 nt, Homo sapiens
caggagaccugcuc

SEQ ID NO: 1132245 - RNA, 13 nt, Homo sapiens
caggagacugggc

SEQ ID NO: 1132246 - RNA, 19 nt, Homo sapiens
caggagaugggugcaacuc

SEQ ID NO: 1132247 - RNA, 23 nt, Homo sapiens
caggagauguaggaggggaacua

SEQ ID NO: 1132248 - RNA, 21 nt, Homo sapiens
caggagauuccagucuacuug

SEQ ID NO: 1132249 - RNA, 20 nt, Homo sapiens
caggagccggacacuucuca

SEQ ID NO: 1132250 - RNA, 22 nt, Homo sapiens
caggagcgugaaggacuuagcc

SEQ ID NO: 1132251 - RNA, 14 nt, Homo sapiens
caggagcucuccac

SEQ ID NO: 1132252 - RNA, 21 nt, Homo sapiens
caggaggcccugguccuggcc

SEQ ID NO: 1132253 - RNA, 18 nt, Homo sapiens
caggagggcacuggagcu

SEQ ID NO: 1132254 - RNA, 18 nt, Homo sapiens
caggaguuugugugucuu

SEQ ID NO: 1132255 - RNA, 24 nt, Homo sapiens
caggauagagacuggaacacuaga

SEQ ID NO: 1132256 - RNA, 17 nt, Homo sapiens
caggaucaagcaugaaa

SEQ ID NO: 1132257 - RNA, 22 nt, Homo sapiens
caggaucguugucccuacagga

SEQ ID NO: 1132258 - RNA, 22 nt, Homo sapiens
caggaucucagaucacugcaac

SEQ ID NO: 1132259 - RNA, 18 nt, Homo sapiens
caggaugauggcacugag

SEQ ID NO: 1132260 - RNA, 22 nt, Homo sapiens
caggaugcuggcugguggaaca

SEQ ID NO: 1132261 - RNA, 16 nt, Homo sapiens
caggauuggggaccug

SEQ ID NO: 1132262 - RNA, 18 nt, Homo sapiens
caggauuuuguauugcca

SEQ ID NO: 1132263 - RNA, 21 nt, Homo sapiens
caggcaagcuuauucuuuccu

SEQ ID NO: 1132264 - RNA, 18 nt, Homo sapiens
caggcacacagcuacucu

SEQ ID NO: 1132265 - RNA, 12 nt, Homo sapiens
caggcaccugcc

SEQ ID NO: 1132266 - RNA, 23 nt, Homo sapiens
caggcacgaacccaccugcugag

SEQ ID NO: 1132267 - RNA, 12 nt, Homo sapiens
caggcacucucc

SEQ ID NO: 1132268 - RNA, 12 nt, Homo sapiens
caggcacugaga

SEQ ID NO: 1132269 - RNA, 21 nt, Homo sapiens
caggcacugggcaagugaaga

SEQ ID NO: 1132270 - RNA, 17 nt, Homo sapiens
caggcagauaacugcug

SEQ ID NO: 1132271 - RNA, 19 nt, Homo sapiens
caggcagauaacugcugua

SEQ ID NO: 1132272 - RNA, 13 nt, Homo sapiens
caggcagugugag

SEQ ID NO: 1132273 - RNA, 19 nt, Homo sapiens
caggcauuuuuacagcaca

SEQ ID NO: 1132274 - RNA, 16 nt, Homo sapiens
caggccagggcugggu

SEQ ID NO: 1132275 - RNA, 13 nt, Homo sapiens
caggcccaaagcc

SEQ ID NO: 1132276 - RNA, 17 nt, Homo sapiens
caggcccacucaggggu

SEQ ID NO: 1132277 - RNA, 13 nt, Homo sapiens
caggcccacuguc

SEQ ID NO: 1132278 - RNA, 15 nt, Homo sapiens
caggcccgcgggcac

SEQ ID NO: 1132279 - RNA, 12 nt, Homo sapiens
caggcccugugg

SEQ ID NO: 1132280 - RNA, 22 nt, Homo sapiens
caggccucuuggcagucacauc

SEQ ID NO: 1132281 - RNA, 16 nt, Homo sapiens
caggccugccuucuca

SEQ ID NO: 1132282 - RNA, 16 nt, Homo sapiens
caggccuuucgauccc

SEQ ID NO: 1132283 - RNA, 20 nt, Homo sapiens
caggcgccuauaaucccagc

SEQ ID NO: 1132284 - RNA, 17 nt, Homo sapiens
caggcggcccucagugc

SEQ ID NO: 1132285 - RNA, 15 nt, Homo sapiens
caggcggguccgggu

SEQ ID NO: 1132286 - RNA, 15 nt, Homo sapiens
caggcuagagugcaa

SEQ ID NO: 1132287 - RNA, 16 nt, Homo sapiens
caggcuagagugcaau

SEQ ID NO: 1132288 - RNA, 19 nt, Homo sapiens
caggcuagagugcaauggu

SEQ ID NO: 1132289 - RNA, 16 nt, Homo sapiens
caggcucaacugagga

SEQ ID NO: 1132290 - RNA, 16 nt, Homo sapiens
caggcuccaggccuca

SEQ ID NO: 1132291 - RNA, 14 nt, Homo sapiens
caggcucugaccag

SEQ ID NO: 1132292 - RNA, 22 nt, Homo sapiens
caggcugcagaugaucagggau

SEQ ID NO: 1132293 - RNA, 20 nt, Homo sapiens
caggcuggagggcaguggca

SEQ ID NO: 1132294 - RNA, 17 nt, Homo sapiens
caggcuggcuugaguga

SEQ ID NO: 1132295 - RNA, 19 nt, Homo sapiens
caggcuggucucaaacucc

SEQ ID NO: 1132296 - RNA, 20 nt, Homo sapiens
caggcuguuuauauguucac

SEQ ID NO: 1132297 - RNA, 14 nt, Homo sapiens
caggcuuaugaaua

SEQ ID NO: 1132298 - RNA, 22 nt, Homo sapiens
caggcuucugagcacagcugca

SEQ ID NO: 1132299 - RNA, 16 nt, Homo sapiens
cagggaaaacugcaaa

SEQ ID NO: 1132300 - RNA, 14 nt, Homo sapiens
cagggaacccacag

SEQ ID NO: 1132301 - RNA, 12 nt, Homo sapiens
cagggaagggag

SEQ ID NO: 1132302 - RNA, 23 nt, Homo sapiens
cagggaccaggccagcgcugcaa

SEQ ID NO: 1132303 - RNA, 17 nt, Homo sapiens
cagggacugugaacauu

SEQ ID NO: 1132304 - RNA, 22 nt, Homo sapiens
cagggagaggcugugucccugc

SEQ ID NO: 1132305 - RNA, 23 nt, Homo sapiens
cagggagauguuggacugugccu

SEQ ID NO: 1132306 - RNA, 16 nt, Homo sapiens
cagggagggccaggga

SEQ ID NO: 1132307 - RNA, 20 nt, Homo sapiens
cagggcagccucccccggcu

SEQ ID NO: 1132308 - RNA, 21 nt, Homo sapiens
cagggccccccaacuguggua

SEQ ID NO: 1132309 - RNA, 17 nt, Homo sapiens
cagggccucaguuucau

SEQ ID NO: 1132310 - RNA, 21 nt, Homo sapiens
cagggcucccugccauuuuag

SEQ ID NO: 1132311 - RNA, 20 nt, Homo sapiens
cagggcucuaaugugucucu

SEQ ID NO: 1132312 - RNA, 20 nt, Homo sapiens
cagggggcccagggugccug

SEQ ID NO: 1132313 - RNA, 20 nt, Homo sapiens
cagggggcugaaacuugaac

SEQ ID NO: 1132314 - RNA, 13 nt, Homo sapiens
caggggucacuga

SEQ ID NO: 1132315 - RNA, 14 nt, Homo sapiens
caggggugacacag

SEQ ID NO: 1132316 - RNA, 22 nt, Homo sapiens
cagggguggcugccucauuuag

SEQ ID NO: 1132317 - RNA, 19 nt, Homo sapiens
caggguagguuugugucuu

SEQ ID NO: 1132318 - RNA, 21 nt, Homo sapiens
caggguagguuugugucuuaa

SEQ ID NO: 1132319 - RNA, 21 nt, Homo sapiens
cagggucucacucuguugccc

SEQ ID NO: 1132320 - RNA, 22 nt, Homo sapiens
cagggugagguucagccuguga

SEQ ID NO: 1132321 - RNA, 15 nt, Homo sapiens
cagggugcaguguga

SEQ ID NO: 1132322 - RNA, 18 nt, Homo sapiens
caggguggagugcagugg

SEQ ID NO: 1132323 - RNA, 17 nt, Homo sapiens
cagggugguggcacauu

SEQ ID NO: 1132324 - RNA, 13 nt, Homo sapiens
cagguacuuguaa

SEQ ID NO: 1132325 - RNA, 19 nt, Homo sapiens
cagguagcugggauuacag

SEQ ID NO: 1132326 - RNA, 23 nt, Homo sapiens
cagguagcugggauuacaggcau

SEQ ID NO: 1132327 - RNA, 16 nt, Homo sapiens
cagguccaauuuguaa

SEQ ID NO: 1132328 - RNA, 18 nt, Homo sapiens
cagguccugagagcugcu

SEQ ID NO: 1132329 - RNA, 18 nt, Homo sapiens
caggucuuucaaaaagca

SEQ ID NO: 1132330 - RNA, 13 nt, Homo sapiens
caggugaguguga

SEQ ID NO: 1132331 - RNA, 18 nt, Homo sapiens
caggugauccgccuaccu

SEQ ID NO: 1132332 - RNA, 13 nt, Homo sapiens
caggugcacacau

SEQ ID NO: 1132333 - RNA, 16 nt, Homo sapiens
caggugccuucccaga

SEQ ID NO: 1132334 - RNA, 12 nt, Homo sapiens
cagguguggaac

SEQ ID NO: 1132335 - RNA, 21 nt, Homo sapiens
cagguguuaacauuccaagac

SEQ ID NO: 1132336 - RNA, 20 nt, Homo sapiens
cagguguuacuguaauuccu

SEQ ID NO: 1132337 - RNA, 15 nt, Homo sapiens
cagguguuggugaca

SEQ ID NO: 1132338 - RNA, 13 nt, Homo sapiens
ccaccaggauauc

SEQ ID NO: 1132339 - RNA, 12 nt, Homo sapiens
ccacccaaacag

SEQ ID NO: 1132340 - RNA, 15 nt, Homo sapiens
ccacccacuaauacu

SEQ ID NO: 1132341 - RNA, 14 nt, Homo sapiens
ccacccgaagccaa

SEQ ID NO: 1132342 - RNA, 19 nt, Homo sapiens
ccacccucccagcucugag

SEQ ID NO: 1132343 - RNA, 21 nt, Homo sapiens
ccacccuggugggccaacaaa

SEQ ID NO: 1132344 - RNA, 17 nt, Homo sapiens
ccaccguucagucauuu

SEQ ID NO: 1132345 - RNA, 23 nt, Homo sapiens
ccaccucagagcuguucaggaag

SEQ ID NO: 1132346 - RNA, 12 nt, Homo sapiens
ccaccuucuuca

SEQ ID NO: 1132347 - RNA, 15 nt, Homo sapiens
ccacgaggugcaaca

SEQ ID NO: 1132348 - RNA, 17 nt, Homo sapiens
ccacgcggccaccucac

SEQ ID NO: 1132349 - RNA, 14 nt, Homo sapiens
ccacggugccucca

SEQ ID NO: 1132350 - RNA, 17 nt, Homo sapiens
ccacggugccuccagau

SEQ ID NO: 1132351 - RNA, 13 nt, Homo sapiens
ccacguucaggga

SEQ ID NO: 1132352 - RNA, 16 nt, Homo sapiens
ccacuagcauuuucuc

SEQ ID NO: 1132353 - RNA, 13 nt, Homo sapiens
ccacucacauucc

SEQ ID NO: 1132354 - RNA, 23 nt, Homo sapiens
ccacucaccuuucuccacugggu

SEQ ID NO: 1132355 - RNA, 14 nt, Homo sapiens
ccacucagggguca

SEQ ID NO: 1132356 - RNA, 12 nt, Homo sapiens
ccacuccagaga

SEQ ID NO: 1132357 - RNA, 15 nt, Homo sapiens
ccacuccagcuccuu

SEQ ID NO: 1132358 - RNA, 22 nt, Homo sapiens
ccacuccuaaucaagagucucu

SEQ ID NO: 1132359 - RNA, 16 nt, Homo sapiens
ccacuccucugacuca

SEQ ID NO: 1132360 - RNA, 14 nt, Homo sapiens
ccacuccugccagc

SEQ ID NO: 1132361 - RNA, 18 nt, Homo sapiens
ccacucucuaccagauaa

SEQ ID NO: 1132362 - RNA, 16 nt, Homo sapiens
ccacugacccaaauga

SEQ ID NO: 1132363 - RNA, 19 nt, Homo sapiens
ccacugcacuccagccuag

SEQ ID NO: 1132364 - RNA, 20 nt, Homo sapiens
ccacugcccugggcagccau

SEQ ID NO: 1132365 - RNA, 19 nt, Homo sapiens
ccacugccuguaacagcca

SEQ ID NO: 1132366 - RNA, 20 nt, Homo sapiens
ccacuggcaaauguaacugu

SEQ ID NO: 1132367 - RNA, 18 nt, Homo sapiens
ccacuggcuucacauucu

SEQ ID NO: 1132368 - RNA, 20 nt, Homo sapiens
ccacuguggaagucccucag

SEQ ID NO: 1132369 - RNA, 23 nt, Homo sapiens
ccacuguugguauuauauaauuc

SEQ ID NO: 1132370 - RNA, 16 nt, Homo sapiens
ccacuuuauugcaaug

SEQ ID NO: 1132371 - RNA, 13 nt, Homo sapiens
ccacuuucauuca

SEQ ID NO: 1132372 - RNA, 19 nt, Homo sapiens
ccacuuucuucuaccagac

SEQ ID NO: 1132373 - RNA, 17 nt, Homo sapiens
ccacuuuucauugcaaa

SEQ ID NO: 1132374 - RNA, 13 nt, Homo sapiens
ccagaaacuguuc

SEQ ID NO: 1132375 - RNA, 19 nt, Homo sapiens
ccagaaagcuaggucgugg

SEQ ID NO: 1132376 - RNA, 16 nt, Homo sapiens
ccagaacccaaaucca

SEQ ID NO: 1132377 - RNA, 19 nt, Homo sapiens
ccagaagcagcauccucca

SEQ ID NO: 1132378 - RNA, 16 nt, Homo sapiens
ccagaagcuguacuuu

SEQ ID NO: 1132379 - RNA, 12 nt, Homo sapiens
ccagaaugcugc

SEQ ID NO: 1132380 - RNA, 13 nt, Homo sapiens
ccagacacauuca

SEQ ID NO: 1132381 - RNA, 14 nt, Homo sapiens
ccagacacauucac

SEQ ID NO: 1132382 - RNA, 15 nt, Homo sapiens
aguuccaagagucua

SEQ ID NO: 1132383 - RNA, 20 nt, Homo sapiens
aguuccaagagucuaaagau

SEQ ID NO: 1132384 - RNA, 17 nt, Homo sapiens
aguucccuuagugaauu

SEQ ID NO: 1132385 - RNA, 13 nt, Homo sapiens
aguuccuagccac

SEQ ID NO: 1132386 - RNA, 18 nt, Homo sapiens
aguuccugcugccugggu

SEQ ID NO: 1132387 - RNA, 16 nt, Homo sapiens
aguucuaagauucuaa

SEQ ID NO: 1132388 - RNA, 23 nt, Homo sapiens
aguucuagcucuauuuacuucua

SEQ ID NO: 1132389 - RNA, 22 nt, Homo sapiens
aguucuccacuagcuauggugu

SEQ ID NO: 1132390 - RNA, 17 nt, Homo sapiens
aguucuuggucccucca

SEQ ID NO: 1132391 - RNA, 15 nt, Homo sapiens
aguucuugugccaua

SEQ ID NO: 1132392 - RNA, 16 nt, Homo sapiens
aguucuuugggccaga

SEQ ID NO: 1132393 - RNA, 15 nt, Homo sapiens
aguucuuuguuccug

SEQ ID NO: 1132394 - RNA, 16 nt, Homo sapiens
aguucuuuuaagccca

SEQ ID NO: 1132395 - RNA, 16 nt, Homo sapiens
aguucuuuugucuuag

SEQ ID NO: 1132396 - RNA, 13 nt, Homo sapiens
aguugcaguauug

SEQ ID NO: 1132397 - RNA, 21 nt, Homo sapiens
aguugcguggacucugcacau

SEQ ID NO: 1132398 - RNA, 15 nt, Homo sapiens
aguugcuuccagucc

SEQ ID NO: 1132399 - RNA, 15 nt, Homo sapiens
aguugcuuuguuaca

SEQ ID NO: 1132400 - RNA, 21 nt, Homo sapiens
aguuggagugagaugaaggaa

SEQ ID NO: 1132401 - RNA, 22 nt, Homo sapiens
aguuggggaauaaauggauaug

SEQ ID NO: 1132402 - RNA, 21 nt, Homo sapiens
aguuguccuauggacaacuua

SEQ ID NO: 1132403 - RNA, 20 nt, Homo sapiens
aguuguuccuuaagucagaa

SEQ ID NO: 1132404 - RNA, 19 nt, Homo sapiens
aguuguuuuauauguugcu

SEQ ID NO: 1132405 - RNA, 21 nt, Homo sapiens
aguuuaaaucaagauuaugau

SEQ ID NO: 1132406 - RNA, 18 nt, Homo sapiens
aguuuaagacaccaaaua

SEQ ID NO: 1132407 - RNA, 23 nt, Homo sapiens
aguuuaauuuuugaaaacuggcu

SEQ ID NO: 1132408 - RNA, 23 nt, Homo sapiens
aguuuacaugggccucugaugga

SEQ ID NO: 1132409 - RNA, 13 nt, Homo sapiens
aguuuaccauccu

SEQ ID NO: 1132410 - RNA, 14 nt, Homo sapiens
aguuuaccuaugua

SEQ ID NO: 1132411 - RNA, 12 nt, Homo sapiens
aguuuaccucuu

SEQ ID NO: 1132412 - RNA, 21 nt, Homo sapiens
aguuuauacaguguacaugua

SEQ ID NO: 1132413 - RNA, 22 nt, Homo sapiens
aguuuauaggagaacguaucaa

SEQ ID NO: 1132414 - RNA, 15 nt, Homo sapiens
aguuuaugcuaccua

SEQ ID NO: 1132415 - RNA, 23 nt, Homo sapiens
aguuuauuuguugagagugugac

SEQ ID NO: 1132416 - RNA, 20 nt, Homo sapiens
aguuucauuaacuggugaau

SEQ ID NO: 1132417 - RNA, 17 nt, Homo sapiens
aguuucuaagauucuaa

SEQ ID NO: 1132418 - RNA, 14 nt, Homo sapiens
aguuucuaagcaug

SEQ ID NO: 1132419 - RNA, 21 nt, Homo sapiens
aguuucuaucccuuaccugcu

SEQ ID NO: 1132420 - RNA, 18 nt, Homo sapiens
aguuucuuccauucccau

SEQ ID NO: 1132421 - RNA, 14 nt, Homo sapiens
aguuucuuuaccua

SEQ ID NO: 1132422 - RNA, 15 nt, Homo sapiens
aguuugagacuccaa

SEQ ID NO: 1132423 - RNA, 19 nt, Homo sapiens
aguuugccguuuguccuua

SEQ ID NO: 1132424 - RNA, 18 nt, Homo sapiens
aguuugcuucuacaugau

SEQ ID NO: 1132425 - RNA, 15 nt, Homo sapiens
aguuugggaggcuga

SEQ ID NO: 1132426 - RNA, 21 nt, Homo sapiens
aguuugugaaugugacuacuu

SEQ ID NO: 1132427 - RNA, 14 nt, Homo sapiens
aguuuuaaacuggu

SEQ ID NO: 1132428 - RNA, 14 nt, Homo sapiens
aguuuuaacuguaa

SEQ ID NO: 1132429 - RNA, 16 nt, Homo sapiens
aguuuucggaaacacu

SEQ ID NO: 1132430 - RNA, 19 nt, Homo sapiens
aguuuucuagaugacauaa

SEQ ID NO: 1132431 - RNA, 20 nt, Homo sapiens
aguuuucuggagugagcacu

SEQ ID NO: 1132432 - RNA, 13 nt, Homo sapiens
aguuuugccaagg

SEQ ID NO: 1132433 - RNA, 18 nt, Homo sapiens
aguuuuguaaagggcaag

SEQ ID NO: 1132434 - RNA, 22 nt, Homo sapiens
aguuuuguuuguucacacuccu

SEQ ID NO: 1132435 - RNA, 19 nt, Homo sapiens
aguuuuuacaaaauacuau

SEQ ID NO: 1132436 - RNA, 14 nt, Homo sapiens
aguuuuuugaacau

SEQ ID NO: 1132437 - RNA, 16 nt, Homo sapiens
auaaaaacccaauuca

SEQ ID NO: 1132438 - RNA, 14 nt, Homo sapiens
auaaaaagcagaau

SEQ ID NO: 1132439 - RNA, 15 nt, Homo sapiens
auaaaaauaaaucag

SEQ ID NO: 1132440 - RNA, 16 nt, Homo sapiens
auaaaacacugcccuc

SEQ ID NO: 1132441 - RNA, 16 nt, Homo sapiens
auaaaacaggucaaua

SEQ ID NO: 1132442 - RNA, 17 nt, Homo sapiens
auaaaaccagagaagau

SEQ ID NO: 1132443 - RNA, 15 nt, Homo sapiens
auaaaaggaagccaa

SEQ ID NO: 1132444 - RNA, 14 nt, Homo sapiens
auaaaaguuccuag

SEQ ID NO: 1132445 - RNA, 17 nt, Homo sapiens
auaaaaugauccugcca

SEQ ID NO: 1132446 - RNA, 16 nt, Homo sapiens
auaaaauucauuaguu

SEQ ID NO: 1132447 - RNA, 14 nt, Homo sapiens
auaaacagacuguu

SEQ ID NO: 1132448 - RNA, 11 nt, Homo sapiens
auaaaccaaga

SEQ ID NO: 1132449 - RNA, 20 nt, Homo sapiens
auaaaccaagacaagaccuc

SEQ ID NO: 1132450 - RNA, 17 nt, Homo sapiens
auaaaccugcaggguca

SEQ ID NO: 1132451 - RNA, 16 nt, Homo sapiens
auaaacugauuuaucu

SEQ ID NO: 1132452 - RNA, 15 nt, Homo sapiens
auaaacuugcuuuca

SEQ ID NO: 1132453 - RNA, 18 nt, Homo sapiens
auaaacuugcuuucacuu

SEQ ID NO: 1132454 - RNA, 12 nt, Homo sapiens
auaaacuuugaa

SEQ ID NO: 1132455 - RNA, 18 nt, Homo sapiens
auaaacuuugcuguguac

SEQ ID NO: 1132456 - RNA, 19 nt, Homo sapiens
auaaagaaaaaugcaccua

SEQ ID NO: 1132457 - RNA, 19 nt, Homo sapiens
auaaagacaccugguugcu

SEQ ID NO: 1132458 - RNA, 15 nt, Homo sapiens
auaaagacaggguuu

SEQ ID NO: 1132459 - RNA, 13 nt, Homo sapiens
auaaagacugaga

SEQ ID NO: 1132460 - RNA, 14 nt, Homo sapiens
auaaagacugagac

SEQ ID NO: 1132461 - RNA, 17 nt, Homo sapiens
auaaagagccauaguuu

SEQ ID NO: 1132462 - RNA, 15 nt, Homo sapiens
auaaagagugcuaca

SEQ ID NO: 1132463 - RNA, 19 nt, Homo sapiens
auaaagcaaaaguagccau

SEQ ID NO: 1132464 - RNA, 19 nt, Homo sapiens
auaaaguugcacugugacu

SEQ ID NO: 1132465 - RNA, 23 nt, Homo sapiens
auaaaucguccucccaggccagg

SEQ ID NO: 1132466 - RNA, 20 nt, Homo sapiens
auaaauuagaaucuccacua

SEQ ID NO: 1132467 - RNA, 17 nt, Homo sapiens
auaaauuauacacuaug

SEQ ID NO: 1132468 - RNA, 19 nt, Homo sapiens
auaaauuaugaauauuaaa

SEQ ID NO: 1132469 - RNA, 21 nt, Homo sapiens
auaaauuauuaguuuacauca

SEQ ID NO: 1132470 - RNA, 22 nt, Homo sapiens
auaaauucuauaggaacauaug

SEQ ID NO: 1132471 - RNA, 24 nt, Homo sapiens
auaaauucucuccuaaugaugacu

SEQ ID NO: 1132472 - RNA, 16 nt, Homo sapiens
auaaauuggagaugca

SEQ ID NO: 1132473 - RNA, 21 nt, Homo sapiens
auaaauuuacucuguugaaua

SEQ ID NO: 1132474 - RNA, 15 nt, Homo sapiens
auaaauuuugugcaa

SEQ ID NO: 1132475 - RNA, 20 nt, Homo sapiens
auaaauuuuuugaaacacaa

SEQ ID NO: 1132476 - RNA, 14 nt, Homo sapiens
auaacaaagcccuu

SEQ ID NO: 1132477 - RNA, 14 nt, Homo sapiens
auaacaagggugua

SEQ ID NO: 1132478 - RNA, 19 nt, Homo sapiens
auaacaccugccaccacua

SEQ ID NO: 1132479 - RNA, 20 nt, Homo sapiens
auaacagcaggguaccugaa

SEQ ID NO: 1132480 - RNA, 14 nt, Homo sapiens
auaacaucacuguc

SEQ ID NO: 1132481 - RNA, 11 nt, Homo sapiens
auaaccacugc

SEQ ID NO: 1132482 - RNA, 19 nt, Homo sapiens
auaaccagccauuggcuau

SEQ ID NO: 1132483 - RNA, 15 nt, Homo sapiens
auaacccuguuacaa

SEQ ID NO: 1132484 - RNA, 19 nt, Homo sapiens
auaaccuuuuuguauauca

SEQ ID NO: 1132485 - RNA, 22 nt, Homo sapiens
auaacgauaaaagacagugaaa

SEQ ID NO: 1132486 - RNA, 22 nt, Homo sapiens
auaacuaggaaauccauucaca

SEQ ID NO: 1132487 - RNA, 19 nt, Homo sapiens
auaacuauauaagacauua

SEQ ID NO: 1132488 - RNA, 11 nt, Homo sapiens
auaacuccuaa

SEQ ID NO: 1132489 - RNA, 14 nt, Homo sapiens
auaacucuccagua

SEQ ID NO: 1132490 - RNA, 14 nt, Homo sapiens
auaacugaaccaaa

SEQ ID NO: 1132491 - RNA, 15 nt, Homo sapiens
auaacugaaccaaau

SEQ ID NO: 1132492 - RNA, 16 nt, Homo sapiens
auaacugaaccaaauu

SEQ ID NO: 1132493 - RNA, 15 nt, Homo sapiens
auaacugacaaacca

SEQ ID NO: 1132494 - RNA, 12 nt, Homo sapiens
agguccuagucg

SEQ ID NO: 1132495 - RNA, 18 nt, Homo sapiens
agguccugagagcugcuu

SEQ ID NO: 1132496 - RNA, 19 nt, Homo sapiens
agguccugagagcugcuuu

SEQ ID NO: 1132497 - RNA, 19 nt, Homo sapiens
agguccugcuccgcugccu

SEQ ID NO: 1132498 - RNA, 22 nt, Homo sapiens
agguccugcuccgcugccugga

SEQ ID NO: 1132499 - RNA, 17 nt, Homo sapiens
aggucuaggugcuuuaa

SEQ ID NO: 1132500 - RNA, 14 nt, Homo sapiens
aggucucacacucc

SEQ ID NO: 1132501 - RNA, 22 nt, Homo sapiens
aggucugagcacuggaguggcu

SEQ ID NO: 1132502 - RNA, 14 nt, Homo sapiens
aggugaaacccagu

SEQ ID NO: 1132503 - RNA, 20 nt, Homo sapiens
aggugaaacccagucacugu

SEQ ID NO: 1132504 - RNA, 15 nt, Homo sapiens
aggugaccaguggga

SEQ ID NO: 1132505 - RNA, 21 nt, Homo sapiens
aggugaggcguucuccugcuu

SEQ ID NO: 1132506 - RNA, 17 nt, Homo sapiens
aggugauccaccugccu

SEQ ID NO: 1132507 - RNA, 19 nt, Homo sapiens
aggugauccgccuaccuca

SEQ ID NO: 1132508 - RNA, 13 nt, Homo sapiens
aggugcagccaga

SEQ ID NO: 1132509 - RNA, 13 nt, Homo sapiens
aggugccacuggu

SEQ ID NO: 1132510 - RNA, 15 nt, Homo sapiens
aggugccagaaggaa

SEQ ID NO: 1132511 - RNA, 20 nt, Homo sapiens
aggugcguaguccaacucuu

SEQ ID NO: 1132512 - RNA, 14 nt, Homo sapiens
aggugcugacaaua

SEQ ID NO: 1132513 - RNA, 14 nt, Homo sapiens
aggccuccagcuca

SEQ ID NO: 1132514 - RNA, 13 nt, Homo sapiens
aggccucccucaa

SEQ ID NO: 1132515 - RNA, 19 nt, Homo sapiens
aggccucuuuuccugaaga

SEQ ID NO: 1132516 - RNA, 13 nt, Homo sapiens
aggccugagacac

SEQ ID NO: 1132517 - RNA, 17 nt, Homo sapiens
aggccugagacccagga

SEQ ID NO: 1132518 - RNA, 22 nt, Homo sapiens
aggccugccuucucagggacuu

SEQ ID NO: 1132519 - RNA, 22 nt, Homo sapiens
aggccugggaccucccacugcc

SEQ ID NO: 1132520 - RNA, 16 nt, Homo sapiens
aggccugugauuauuc

SEQ ID NO: 1132521 - RNA, 16 nt, Homo sapiens
aggccuguggggagcc

SEQ ID NO: 1132522 - RNA, 17 nt, Homo sapiens
aggccuugcucacagcu

SEQ ID NO: 1132523 - RNA, 17 nt, Homo sapiens
aggcgaaauccugucug

SEQ ID NO: 1132524 - RNA, 20 nt, Homo sapiens
aggcgccugccaucaugccu

SEQ ID NO: 1132525 - RNA, 17 nt, Homo sapiens
aggcgcggggucucagg

SEQ ID NO: 1132526 - RNA, 17 nt, Homo sapiens
aggcgggaggcuucucu

SEQ ID NO: 1132527 - RNA, 18 nt, Homo sapiens
aggcgggcggaucacuua

SEQ ID NO: 1132528 - RNA, 20 nt, Homo sapiens
aggcgggguuucaccaugcu

SEQ ID NO: 1132529 - RNA, 23 nt, Homo sapiens
aggcgguggacuugaacuuuccu

SEQ ID NO: 1132530 - RNA, 17 nt, Homo sapiens
aggcgugggaucagauu

SEQ ID NO: 1132531 - RNA, 17 nt, Homo sapiens
accuuggcaccagacac

SEQ ID NO: 1132532 - RNA, 23 nt, Homo sapiens
accuuggcaccagacacccagga

SEQ ID NO: 1132533 - RNA, 14 nt, Homo sapiens
accuugugccuugg

SEQ ID NO: 1132534 - RNA, 16 nt, Homo sapiens
accuuguuauuucuca

SEQ ID NO: 1132535 - RNA, 18 nt, Homo sapiens
accuuguuuugccaguga

SEQ ID NO: 1132536 - RNA, 18 nt, Homo sapiens
accuuuaaaaauguauaa

SEQ ID NO: 1132537 - RNA, 13 nt, Homo sapiens
accuuuaccccau

SEQ ID NO: 1132538 - RNA, 14 nt, Homo sapiens
accuuuacuuuaga

SEQ ID NO: 1132539 - RNA, 14 nt, Homo sapiens
accuuuccauuuau

SEQ ID NO: 1132540 - RNA, 19 nt, Homo sapiens
accuuuccucaaauguuga

SEQ ID NO: 1132541 - RNA, 19 nt, Homo sapiens
accuuugauuuuugcccag

SEQ ID NO: 1132542 - RNA, 22 nt, Homo sapiens
accuuugcuacuacuaugugca

SEQ ID NO: 1132543 - RNA, 18 nt, Homo sapiens
accuuuggugcuuuccag

SEQ ID NO: 1132544 - RNA, 20 nt, Homo sapiens
accuuuuaacaccugaugug

SEQ ID NO: 1132545 - RNA, 21 nt, Homo sapiens
accuuuuguuaccacagaguu

SEQ ID NO: 1132546 - RNA, 19 nt, Homo sapiens
acgaccccugccucgaggg

SEQ ID NO: 1132547 - RNA, 16 nt, Homo sapiens
acgacucuaaacacac

SEQ ID NO: 1132548 - RNA, 17 nt, Homo sapiens
acgagaagguacugaaa

SEQ ID NO: 1132549 - RNA, 17 nt, Homo sapiens
acgagcguucaaacugc

SEQ ID NO: 1132550 - RNA, 15 nt, Homo sapiens
acgaggcucaaaaac

SEQ ID NO: 1132551 - RNA, 14 nt, Homo sapiens
acgauggaauguaa

SEQ ID NO: 1132552 - RNA, 19 nt, Homo sapiens
acgcaacaagaaacucaau

SEQ ID NO: 1132553 - RNA, 14 nt, Homo sapiens
acgcaccugccuca

SEQ ID NO: 1132554 - RNA, 15 nt, Homo sapiens
acgcagaccaacaga

SEQ ID NO: 1132555 - RNA, 20 nt, Homo sapiens
acgccccgaaccucaccuga

SEQ ID NO: 1132556 - RNA, 18 nt, Homo sapiens
acgcgcguacagaucucu

SEQ ID NO: 1132557 - RNA, 21 nt, Homo sapiens
acgcguauuuacagccagugg

SEQ ID NO: 1132558 - RNA, 16 nt, Homo sapiens
acgcuggcaacacaga

SEQ ID NO: 1132559 - RNA, 21 nt, Homo sapiens
acggagacuuucaaacauaua

SEQ ID NO: 1132560 - RNA, 20 nt, Homo sapiens
acggagccacuccucugacu

SEQ ID NO: 1132561 - RNA, 18 nt, Homo sapiens
acggaggcauccuacccu

SEQ ID NO: 1132562 - RNA, 14 nt, Homo sapiens
acggaggccugcga

SEQ ID NO: 1132563 - RNA, 19 nt, Homo sapiens
acggaguacagacgucuca

SEQ ID NO: 1132564 - RNA, 14 nt, Homo sapiens
acggccacaucaaa

SEQ ID NO: 1132565 - RNA, 19 nt, Homo sapiens
acggcguuucaccauguug

SEQ ID NO: 1132566 - RNA, 16 nt, Homo sapiens
acggcugugggaccag

SEQ ID NO: 1132567 - RNA, 18 nt, Homo sapiens
acggcuuguaaaugugac

SEQ ID NO: 1132568 - RNA, 16 nt, Homo sapiens
acgggugaugugauuc

SEQ ID NO: 1132569 - RNA, 17 nt, Homo sapiens
acgguccgcggccugca

SEQ ID NO: 1132570 - RNA, 15 nt, Homo sapiens
acggugacucugucc

SEQ ID NO: 1132571 - RNA, 11 nt, Homo sapiens
acggugcaguc

SEQ ID NO: 1132572 - RNA, 21 nt, Homo sapiens
acggugcagucugggugcucg

SEQ ID NO: 1132573 - RNA, 17 nt, Homo sapiens
acggugucucgcugcau

SEQ ID NO: 1132574 - RNA, 18 nt, Homo sapiens
acguaaaauuuacaguca

SEQ ID NO: 1132575 - RNA, 23 nt, Homo sapiens
acguaacccauuaaaaugaauuu

SEQ ID NO: 1132576 - RNA, 13 nt, Homo sapiens
acguaagcacugu

SEQ ID NO: 1132577 - RNA, 15 nt, Homo sapiens
acguaucugcuacuu

SEQ ID NO: 1132578 - RNA, 17 nt, Homo sapiens
acguaugcaugugaaga

SEQ ID NO: 1132579 - RNA, 19 nt, Homo sapiens
acgucacaaagaccuugcu

SEQ ID NO: 1132580 - RNA, 14 nt, Homo sapiens
acguccauguucua

SEQ ID NO: 1132581 - RNA, 21 nt, Homo sapiens
acgucccagcggccucagggu

SEQ ID NO: 1132582 - RNA, 14 nt, Homo sapiens
acguccugucuguu

SEQ ID NO: 1132583 - RNA, 13 nt, Homo sapiens
acguccuuuggac

SEQ ID NO: 1132584 - RNA, 16 nt, Homo sapiens
acgucucaagacugaa

SEQ ID NO: 1132585 - RNA, 21 nt, Homo sapiens
acgugacacaaacacacacaa

SEQ ID NO: 1132586 - RNA, 20 nt, Homo sapiens
acgugauccucucaccucag

SEQ ID NO: 1132587 - RNA, 14 nt, Homo sapiens
acgugcaacugaca

SEQ ID NO: 1132588 - RNA, 22 nt, Homo sapiens
acgugcaggacagcucuugauu

SEQ ID NO: 1132589 - RNA, 14 nt, Homo sapiens
acguggaugaagca

SEQ ID NO: 1132590 - RNA, 19 nt, Homo sapiens
acguggaugaagcagagag

SEQ ID NO: 1132591 - RNA, 14 nt, Homo sapiens
acguggcucagcca

SEQ ID NO: 1132592 - RNA, 17 nt, Homo sapiens
acguggcucagccagca

SEQ ID NO: 1132593 - RNA, 18 nt, Homo sapiens
acguguagccaaccugcu

SEQ ID NO: 1132594 - RNA, 21 nt, Homo sapiens
acguuauaguccaugguccau

SEQ ID NO: 1132595 - RNA, 19 nt, Homo sapiens
acguugaaacaagugcaag

SEQ ID NO: 1132596 - RNA, 13 nt, Homo sapiens
acguuucuucccc

SEQ ID NO: 1132597 - RNA, 17 nt, Homo sapiens
acuaaagaagaucugua

SEQ ID NO: 1132598 - RNA, 11 nt, Homo sapiens
acuaaagccaa

SEQ ID NO: 1132599 - RNA, 14 nt, Homo sapiens
acuaaaguuuuaca

SEQ ID NO: 1132600 - RNA, 18 nt, Homo sapiens
acuaaaugcacauuuuau

SEQ ID NO: 1132601 - RNA, 16 nt, Homo sapiens
acuaaccacauuuuag

SEQ ID NO: 1132602 - RNA, 14 nt, Homo sapiens
acuaacuaaccaca

SEQ ID NO: 1132603 - RNA, 15 nt, Homo sapiens
acuaauuuuacaugu

SEQ ID NO: 1132604 - RNA, 21 nt, Homo sapiens
acuacaaccaauggaauguga

SEQ ID NO: 1132605 - RNA, 18 nt, Homo sapiens
acuacaaggaaaacaaug

SEQ ID NO: 1132606 - RNA, 12 nt, Homo sapiens
acuacaccacac

SEQ ID NO: 1132607 - RNA, 19 nt, Homo sapiens
acuacauuugugaacaaaa

SEQ ID NO: 1132608 - RNA, 13 nt, Homo sapiens
acuacauuuugcu

SEQ ID NO: 1132609 - RNA, 20 nt, Homo sapiens
acuaccagugggcauguauu

SEQ ID NO: 1132610 - RNA, 19 nt, Homo sapiens
acuaccauugcuguucuac

SEQ ID NO: 1132611 - RNA, 19 nt, Homo sapiens
acuaccuacugguguaauc

SEQ ID NO: 1132612 - RNA, 20 nt, Homo sapiens
acuaccugaugugcaguuua

SEQ ID NO: 1132613 - RNA, 22 nt, Homo sapiens
acuaccuguauuuaaaaauaga

SEQ ID NO: 1132614 - RNA, 22 nt, Homo sapiens
acuacuguagaagaagugaaca

SEQ ID NO: 1132615 - RNA, 18 nt, Homo sapiens
acuacuuagcacugcccu

SEQ ID NO: 1132616 - RNA, 16 nt, Homo sapiens
acuagaauucugggaa

SEQ ID NO: 1132617 - RNA, 20 nt, Homo sapiens
acuagacaccuucugugcuc

SEQ ID NO: 1132618 - RNA, 18 nt, Homo sapiens
acuagaccuguaacuuuu

SEQ ID NO: 1132619 - RNA, 23 nt, Homo sapiens
acuagagacgcaccuugcugcag

SEQ ID NO: 1132620 - RNA, 15 nt, Homo sapiens
acuagagaugugcaa

SEQ ID NO: 1132621 - RNA, 17 nt, Homo sapiens
acuagagcuugcaguga

SEQ ID NO: 1132622 - RNA, 19 nt, Homo sapiens
acuagagcuugcagugaag

SEQ ID NO: 1132623 - RNA, 15 nt, Homo sapiens
acuagccaguauggc

SEQ ID NO: 1132624 - RNA, 15 nt, Homo sapiens
acuaggaaauuccaa

SEQ ID NO: 1132625 - RNA, 13 nt, Homo sapiens
acuaggacuccuu

SEQ ID NO: 1132626 - RNA, 18 nt, Homo sapiens
acuagggagccauuugag

SEQ ID NO: 1132627 - RNA, 13 nt, Homo sapiens
acuaggugccuuu

SEQ ID NO: 1132628 - RNA, 23 nt, Homo sapiens
acuaguugauaacuuuggaguua

SEQ ID NO: 1132629 - RNA, 16 nt, Homo sapiens
acuaguuuaagcaaau

SEQ ID NO: 1132630 - RNA, 12 nt, Homo sapiens
acuaguuuauuu

SEQ ID NO: 1132631 - RNA, 17 nt, Homo sapiens
acuauaaagcuguuauu

SEQ ID NO: 1132632 - RNA, 18 nt, Homo sapiens
acuauauaagacauuaag

SEQ ID NO: 1132633 - RNA, 14 nt, Homo sapiens
acuauauaagccag

SEQ ID NO: 1132634 - RNA, 11 nt, Homo sapiens
acuaugacaaa

SEQ ID NO: 1132635 - RNA, 13 nt, Homo sapiens
acuaugagccuau

SEQ ID NO: 1132636 - RNA, 16 nt, Homo sapiens
acuauggaaaagggau

SEQ ID NO: 1132637 - RNA, 15 nt, Homo sapiens
acuauggacuuaccc

SEQ ID NO: 1132638 - RNA, 22 nt, Homo sapiens
acuauuaaaaagguuuacagaa

SEQ ID NO: 1132639 - RNA, 17 nt, Homo sapiens
acuauuaaacagucugu

SEQ ID NO: 1132640 - RNA, 20 nt, Homo sapiens
acuauuaauagaacacagag

SEQ ID NO: 1132641 - RNA, 20 nt, Homo sapiens
acuauuuacaagacugcuga

SEQ ID NO: 1132642 - RNA, 17 nt, Homo sapiens
acuauuuuugcacauug

SEQ ID NO: 1132643 - RNA, 18 nt, Homo sapiens
acucaaaaugaugcaacc

SEQ ID NO: 1132644 - RNA, 19 nt, Homo sapiens
acucaaaucgaauagggaa

SEQ ID NO: 1132645 - RNA, 15 nt, Homo sapiens
acucaaaugcucaga

SEQ ID NO: 1132646 - RNA, 13 nt, Homo sapiens
acucaacaauaaa

SEQ ID NO: 1132647 - RNA, 13 nt, Homo sapiens
acucaaugcacaa

SEQ ID NO: 1132648 - RNA, 15 nt, Homo sapiens
acucacaacacuuaa

SEQ ID NO: 1132649 - RNA, 20 nt, Homo sapiens
acucacauagguagguaucu

SEQ ID NO: 1132650 - RNA, 20 nt, Homo sapiens
acucacauuggcaaguguaa

SEQ ID NO: 1132651 - RNA, 17 nt, Homo sapiens
acucaccuguucucacu

SEQ ID NO: 1132652 - RNA, 17 nt, Homo sapiens
acucacuuagcaugaau

SEQ ID NO: 1132653 - RNA, 19 nt, Homo sapiens
acucagaagaaagcucaga

SEQ ID NO: 1132654 - RNA, 20 nt, Homo sapiens
acucagaauccacagugucc

SEQ ID NO: 1132655 - RNA, 16 nt, Homo sapiens
acucagacacaaauaa

SEQ ID NO: 1132656 - RNA, 22 nt, Homo sapiens
acucagauggaaccgcaggaag

SEQ ID NO: 1132657 - RNA, 12 nt, Homo sapiens
acucagcauuug

SEQ ID NO: 1132658 - RNA, 16 nt, Homo sapiens
acucagccccuacccc

SEQ ID NO: 1132659 - RNA, 22 nt, Homo sapiens
agcuuuagugaauuaaauuuag

SEQ ID NO: 1132660 - RNA, 21 nt, Homo sapiens
agcuuuucccaggagaccauu

SEQ ID NO: 1132661 - RNA, 17 nt, Homo sapiens
agcuuuuugauguauaa

SEQ ID NO: 1132662 - RNA, 16 nt, Homo sapiens
agcuuuuuguccugua

SEQ ID NO: 1132663 - RNA, 20 nt, Homo sapiens
agcuuuuuguccuguaccca

SEQ ID NO: 1132664 - RNA, 17 nt, Homo sapiens
aggaaaaggcugguaca

SEQ ID NO: 1132665 - RNA, 19 nt, Homo sapiens
aggaaaauguauccagagg

SEQ ID NO: 1132666 - RNA, 14 nt, Homo sapiens
aggaaacaacagcu

SEQ ID NO: 1132667 - RNA, 12 nt, Homo sapiens
aggaaacauauu

SEQ ID NO: 1132668 - RNA, 19 nt, Homo sapiens
aggaaacccccaguguaau

SEQ ID NO: 1132669 - RNA, 15 nt, Homo sapiens
aggaaagaugcauuu

SEQ ID NO: 1132670 - RNA, 17 nt, Homo sapiens
aggaaaggcacauuaca

SEQ ID NO: 1132671 - RNA, 13 nt, Homo sapiens
aggaaccaaagcg

SEQ ID NO: 1132672 - RNA, 17 nt, Homo sapiens
aggaaccaggaggacaa

SEQ ID NO: 1132673 - RNA, 17 nt, Homo sapiens
aggaaccugagcaggac

SEQ ID NO: 1132674 - RNA, 23 nt, Homo sapiens
aggaacucuggccacccaaacag

SEQ ID NO: 1132675 - RNA, 13 nt, Homo sapiens
ccagacauggugg

SEQ ID NO: 1132676 - RNA, 13 nt, Homo sapiens
ccagacauggugu

SEQ ID NO: 1132677 - RNA, 11 nt, Homo sapiens
ccagaccccau

SEQ ID NO: 1132678 - RNA, 14 nt, Homo sapiens
ccagaccucaggga

SEQ ID NO: 1132679 - RNA, 13 nt, Homo sapiens
ccagaccuuuuau

SEQ ID NO: 1132680 - RNA, 20 nt, Homo sapiens
ccagacuucucccgugagcc

SEQ ID NO: 1132681 - RNA, 23 nt, Homo sapiens
ccagagacaaucuagcacuuuaa

SEQ ID NO: 1132682 - RNA, 22 nt, Homo sapiens
ccagagccaggggggugaggag

SEQ ID NO: 1132683 - RNA, 17 nt, Homo sapiens
ccagagcccagcuccaa

SEQ ID NO: 1132684 - RNA, 15 nt, Homo sapiens
ccagagcuguggugu

SEQ ID NO: 1132685 - RNA, 20 nt, Homo sapiens
ccagaggauugcugccccau

SEQ ID NO: 1132686 - RNA, 15 nt, Homo sapiens
ccagaggcaccucaa

SEQ ID NO: 1132687 - RNA, 19 nt, Homo sapiens
ccagaggccccaggucacc

SEQ ID NO: 1132688 - RNA, 19 nt, Homo sapiens
ccagaggccuuggccaagc

SEQ ID NO: 1132689 - RNA, 24 nt, Homo sapiens
ccagagggaccggaguuaugacaa

SEQ ID NO: 1132690 - RNA, 15 nt, Homo sapiens
ccagauaugugccaa

SEQ ID NO: 1132691 - RNA, 18 nt, Homo sapiens
ccagaugagaagucugcu

SEQ ID NO: 1132692 - RNA, 17 nt, Homo sapiens
ccagauuacacuccagc

SEQ ID NO: 1132693 - RNA, 14 nt, Homo sapiens
ccagauucaugcac

SEQ ID NO: 1132694 - RNA, 12 nt, Homo sapiens
ccagcaaaaucc

SEQ ID NO: 1132695 - RNA, 14 nt, Homo sapiens
ccagcacaaacaca

SEQ ID NO: 1132696 - RNA, 11 nt, Homo sapiens
ccagcacauuc

SEQ ID NO: 1132697 - RNA, 16 nt, Homo sapiens
ccagcaccaccagguc

SEQ ID NO: 1132698 - RNA, 23 nt, Homo sapiens
ccagcaccggccccauuuaccca

SEQ ID NO: 1132699 - RNA, 21 nt, Homo sapiens
ccagcaccugguugaugugua

SEQ ID NO: 1132700 - RNA, 12 nt, Homo sapiens
ccagcacuucca

SEQ ID NO: 1132701 - RNA, 14 nt, Homo sapiens
ccagcaguacucag

SEQ ID NO: 1132702 - RNA, 14 nt, Homo sapiens
ccagcagugccuug

SEQ ID NO: 1132703 - RNA, 17 nt, Homo sapiens
ccagcaguuacugugaa

SEQ ID NO: 1132704 - RNA, 12 nt, Homo sapiens
ccagcauucuca

SEQ ID NO: 1132705 - RNA, 22 nt, Homo sapiens
ccagcauuuaagugaccuucug

SEQ ID NO: 1132706 - RNA, 15 nt, Homo sapiens
ccagccacagcauuu

SEQ ID NO: 1132707 - RNA, 14 nt, Homo sapiens
ccagccacauuuca

SEQ ID NO: 1132708 - RNA, 19 nt, Homo sapiens
ccagccagauggacuccag

SEQ ID NO: 1132709 - RNA, 15 nt, Homo sapiens
ccagccagccacucu

SEQ ID NO: 1132710 - RNA, 15 nt, Homo sapiens
ccagccauucuuucc

SEQ ID NO: 1132711 - RNA, 20 nt, Homo sapiens
ccagcccagacccccagugu

SEQ ID NO: 1132712 - RNA, 13 nt, Homo sapiens
ccagcccagagac

SEQ ID NO: 1132713 - RNA, 14 nt, Homo sapiens
ccagccucaucucu

SEQ ID NO: 1132714 - RNA, 15 nt, Homo sapiens
ccagccugagcaaca

SEQ ID NO: 1132715 - RNA, 12 nt, Homo sapiens
ccagccugauuu

SEQ ID NO: 1132716 - RNA, 15 nt, Homo sapiens
ccagccugauuuaua

SEQ ID NO: 1132717 - RNA, 16 nt, Homo sapiens
ccagccugccuggcag

SEQ ID NO: 1132718 - RNA, 20 nt, Homo sapiens
ccagccuggccaacauggca

SEQ ID NO: 1132719 - RNA, 19 nt, Homo sapiens
ccagccuugagaugcuuca

SEQ ID NO: 1132720 - RNA, 14 nt, Homo sapiens
ccagcgagccacag

SEQ ID NO: 1132721 - RNA, 13 nt, Homo sapiens
ccagcggcccaag

SEQ ID NO: 1132722 - RNA, 15 nt, Homo sapiens
ccagcuacucaggag

SEQ ID NO: 1132723 - RNA, 17 nt, Homo sapiens
ccagcuacuuuugccaa

SEQ ID NO: 1132724 - RNA, 13 nt, Homo sapiens
ccagcucacagga

SEQ ID NO: 1132725 - RNA, 17 nt, Homo sapiens
ccagcucagggcucuuu

SEQ ID NO: 1132726 - RNA, 15 nt, Homo sapiens
ccagcuccucacuca

SEQ ID NO: 1132727 - RNA, 17 nt, Homo sapiens
ccagcucuaagucucaa

SEQ ID NO: 1132728 - RNA, 18 nt, Homo sapiens
ccagcugcacugaugcug

SEQ ID NO: 1132729 - RNA, 23 nt, Homo sapiens
ccagcugcgccugcgcugcagga

SEQ ID NO: 1132730 - RNA, 17 nt, Homo sapiens
ccagcuugggccugucu

SEQ ID NO: 1132731 - RNA, 11 nt, Homo sapiens
ccagcuuuaag

SEQ ID NO: 1132732 - RNA, 19 nt, Homo sapiens
ccagcuuucuauuuucuaa

SEQ ID NO: 1132733 - RNA, 20 nt, Homo sapiens
ccaggaaacucuugcuauug

SEQ ID NO: 1132734 - RNA, 22 nt, Homo sapiens
ccaggaacucgcaccugugcug

SEQ ID NO: 1132735 - RNA, 17 nt, Homo sapiens
ccaggaagccgugcccu

SEQ ID NO: 1132736 - RNA, 12 nt, Homo sapiens
ccaggaccaguc

SEQ ID NO: 1132737 - RNA, 13 nt, Homo sapiens
ccaggacccugaa

SEQ ID NO: 1132738 - RNA, 22 nt, Homo sapiens
ccaggacccugaaggggccaug

SEQ ID NO: 1132739 - RNA, 20 nt, Homo sapiens
ccaggacggaugggcccuau

SEQ ID NO: 1132740 - RNA, 23 nt, Homo sapiens
ccaggacucugaccccagcauuc

SEQ ID NO: 1132741 - RNA, 22 nt, Homo sapiens
ccaggagccggacacuucucag

SEQ ID NO: 1132742 - RNA, 15 nt, Homo sapiens
ccaggauagugggca

SEQ ID NO: 1132743 - RNA, 13 nt, Homo sapiens
ccaggauuugcac

SEQ ID NO: 1132744 - RNA, 16 nt, Homo sapiens
ccaggcaugguggcuc

SEQ ID NO: 1132745 - RNA, 17 nt, Homo sapiens
ccaggcaugguggcuca

SEQ ID NO: 1132746 - RNA, 19 nt, Homo sapiens
ccaggccagcgcugcaacc

SEQ ID NO: 1132747 - RNA, 18 nt, Homo sapiens
ccaggcccccaccacaca

SEQ ID NO: 1132748 - RNA, 18 nt, Homo sapiens
ccaggccucacuggcuca

SEQ ID NO: 1132749 - RNA, 19 nt, Homo sapiens
ccaggccucgccugcccuc

SEQ ID NO: 1132750 - RNA, 21 nt, Homo sapiens
ccaggccucgccugcccuccu

SEQ ID NO: 1132751 - RNA, 19 nt, Homo sapiens
ccaggcgagccugacucug

SEQ ID NO: 1132752 - RNA, 18 nt, Homo sapiens
ccaggcugaccacagcac

SEQ ID NO: 1132753 - RNA, 19 nt, Homo sapiens
ccaggcugcagaugaucag

SEQ ID NO: 1132754 - RNA, 18 nt, Homo sapiens
ccaggcuggagggcagug

SEQ ID NO: 1132755 - RNA, 16 nt, Homo sapiens
ccaggcuggagugcaa

SEQ ID NO: 1132756 - RNA, 18 nt, Homo sapiens
ccaggcuggagugcaaug

SEQ ID NO: 1132757 - RNA, 19 nt, Homo sapiens
ccaggcuggagugcaaugg

SEQ ID NO: 1132758 - RNA, 14 nt, Homo sapiens
ccagggacaagcag

SEQ ID NO: 1132759 - RNA, 17 nt, Homo sapiens
ccagggagaagcuccuc

SEQ ID NO: 1132760 - RNA, 13 nt, Homo sapiens
ccagggccucagu

SEQ ID NO: 1132761 - RNA, 16 nt, Homo sapiens
ccaggggaauguauuu

SEQ ID NO: 1132762 - RNA, 12 nt, Homo sapiens
ccaggggaccag

SEQ ID NO: 1132763 - RNA, 16 nt, Homo sapiens
ccaggguggacucugu

SEQ ID NO: 1132764 - RNA, 18 nt, Homo sapiens
ccagguacgcacagacag

SEQ ID NO: 1132765 - RNA, 17 nt, Homo sapiens
ccagguccauuuugccu

SEQ ID NO: 1132766 - RNA, 17 nt, Homo sapiens
cugggcugaccccggug

SEQ ID NO: 1132767 - RNA, 20 nt, Homo sapiens
cuggggagagucacccugag

SEQ ID NO: 1132768 - RNA, 15 nt, Homo sapiens
cuggggagcucagga

SEQ ID NO: 1132769 - RNA, 18 nt, Homo sapiens
cuggggaugguaggauug

SEQ ID NO: 1132770 - RNA, 15 nt, Homo sapiens
cuggggccuccagaa

SEQ ID NO: 1132771 - RNA, 20 nt, Homo sapiens
cuggggggacccagugcaga

SEQ ID NO: 1132772 - RNA, 19 nt, Homo sapiens
cugggguuggaagugcaga

SEQ ID NO: 1132773 - RNA, 13 nt, Homo sapiens
cugggucaaucca

SEQ ID NO: 1132774 - RNA, 22 nt, Homo sapiens
cugggucacaggaaggaaacaa

SEQ ID NO: 1132775 - RNA, 20 nt, Homo sapiens
cuggguccaccccaugucac

SEQ ID NO: 1132776 - RNA, 21 nt, Homo sapiens
cugggucugcuggcuucuaca

SEQ ID NO: 1132777 - RNA, 19 nt, Homo sapiens
cugggugagcucuuccagg

SEQ ID NO: 1132778 - RNA, 22 nt, Homo sapiens
cuggguuuuguauucucugagc

SEQ ID NO: 1132779 - RNA, 15 nt, Homo sapiens
cugguaaucuugcuc

SEQ ID NO: 1132780 - RNA, 15 nt, Homo sapiens
cugguauguguggau

SEQ ID NO: 1132781 - RNA, 17 nt, Homo sapiens
cuggucacacacaggug

SEQ ID NO: 1132782 - RNA, 21 nt, Homo sapiens
cuggucauccuuggugcucuu

SEQ ID NO: 1132783 - RNA, 22 nt, Homo sapiens
cugguccacagggcaccugcca

SEQ ID NO: 1132784 - RNA, 18 nt, Homo sapiens
cuggucccggucaccgcg

SEQ ID NO: 1132785 - RNA, 11 nt, Homo sapiens
cugguccuguu

SEQ ID NO: 1132786 - RNA, 14 nt, Homo sapiens
cuggugcacagggc

SEQ ID NO: 1132787 - RNA, 15 nt, Homo sapiens
cugguggaagucuga

SEQ ID NO: 1132788 - RNA, 22 nt, Homo sapiens
cugguggcacaggaguguccuc

SEQ ID NO: 1132789 - RNA, 19 nt, Homo sapiens
cuggugggaaaaugcacac

SEQ ID NO: 1132790 - RNA, 18 nt, Homo sapiens
cuggugggugguguccug

SEQ ID NO: 1132791 - RNA, 23 nt, Homo sapiens
cuggugugugccucauugcuugg

SEQ ID NO: 1132792 - RNA, 20 nt, Homo sapiens
cugguguuagggcuaucuca

SEQ ID NO: 1132793 - RNA, 14 nt, Homo sapiens
cugguguucuugcu

SEQ ID NO: 1132794 - RNA, 18 nt, Homo sapiens
cugguguuugcaaaggau

SEQ ID NO: 1132795 - RNA, 19 nt, Homo sapiens
cugguuaccaccagccuuu

SEQ ID NO: 1132796 - RNA, 18 nt, Homo sapiens
cugguuauggaaggugac

SEQ ID NO: 1132797 - RNA, 21 nt, Homo sapiens
cugguuccgccaggcgcugca

SEQ ID NO: 1132798 - RNA, 23 nt, Homo sapiens
cugguugaacucugguggcacag

SEQ ID NO: 1132799 - RNA, 16 nt, Homo sapiens
cuguaaaacuaagaaa

SEQ ID NO: 1132800 - RNA, 13 nt, Homo sapiens
cuguaaaccccaa

SEQ ID NO: 1132801 - RNA, 22 nt, Homo sapiens
cuguaaauaugaaucugcucac

SEQ ID NO: 1132802 - RNA, 13 nt, Homo sapiens
cuguaaccuaccu

SEQ ID NO: 1132803 - RNA, 17 nt, Homo sapiens
cuguaacugguaguguu

SEQ ID NO: 1132804 - RNA, 16 nt, Homo sapiens
cuguaaggaacuggaa

SEQ ID NO: 1132805 - RNA, 21 nt, Homo sapiens
cuguaaucccagcacuuuggg

SEQ ID NO: 1132806 - RNA, 20 nt, Homo sapiens
cuguacaaaauaacucucca

SEQ ID NO: 1132807 - RNA, 15 nt, Homo sapiens
cuguacagucugucu

SEQ ID NO: 1132808 - RNA, 13 nt, Homo sapiens
cuguacaguuuug

SEQ ID NO: 1132809 - RNA, 13 nt, Homo sapiens
cuguacaugacau

SEQ ID NO: 1132810 - RNA, 13 nt, Homo sapiens
cuguacccagugu

SEQ ID NO: 1132811 - RNA, 20 nt, Homo sapiens
cuguacuaaaaauacaaaaa

SEQ ID NO: 1132812 - RNA, 19 nt, Homo sapiens
cuguacuaaggagcaugau

SEQ ID NO: 1132813 - RNA, 12 nt, Homo sapiens
cuguacuguuac

SEQ ID NO: 1132814 - RNA, 22 nt, Homo sapiens
cuguacuguuacugggcccuga

SEQ ID NO: 1132815 - RNA, 18 nt, Homo sapiens
cuguagccccagugacag

SEQ ID NO: 1132816 - RNA, 18 nt, Homo sapiens
cuguauaacccuguuaca

SEQ ID NO: 1132817 - RNA, 20 nt, Homo sapiens
cuguauaacuaggcuguuaa

SEQ ID NO: 1132818 - RNA, 14 nt, Homo sapiens
cuguauacauuaca

SEQ ID NO: 1132819 - RNA, 13 nt, Homo sapiens
cuagaugaccuca

SEQ ID NO: 1132820 - RNA, 14 nt, Homo sapiens
cuagauggacccca

SEQ ID NO: 1132821 - RNA, 15 nt, Homo sapiens
cuagauggcuccucu

SEQ ID NO: 1132822 - RNA, 15 nt, Homo sapiens
cuagauucaaagguu

SEQ ID NO: 1132823 - RNA, 20 nt, Homo sapiens
cuagcaaauguuaugcauaa

SEQ ID NO: 1132824 - RNA, 22 nt, Homo sapiens
cuagcacggccaccucucaggg

SEQ ID NO: 1132825 - RNA, 21 nt, Homo sapiens
cuagcaucucaugagugccaa

SEQ ID NO: 1132826 - RNA, 13 nt, Homo sapiens
cuagccaaucaga

SEQ ID NO: 1132827 - RNA, 13 nt, Homo sapiens
cuagccaauucac

SEQ ID NO: 1132828 - RNA, 22 nt, Homo sapiens
cuagccaccgccuccuacagcc

SEQ ID NO: 1132829 - RNA, 16 nt, Homo sapiens
cuagcccucauuuuaa

SEQ ID NO: 1132830 - RNA, 17 nt, Homo sapiens
cuagcuucagaaaugca

SEQ ID NO: 1132831 - RNA, 18 nt, Homo sapiens
cuaggaagacauuuuucc

SEQ ID NO: 1132832 - RNA, 20 nt, Homo sapiens
cuaggaagagucuacccgac

SEQ ID NO: 1132833 - RNA, 16 nt, Homo sapiens
cuaggagacaucuucc

SEQ ID NO: 1132834 - RNA, 19 nt, Homo sapiens
cuaggagcugggaggaaaa

SEQ ID NO: 1132835 - RNA, 14 nt, Homo sapiens
cuaggauaaugucc

SEQ ID NO: 1132836 - RNA, 17 nt, Homo sapiens
cuaggauccccccaugc

SEQ ID NO: 1132837 - RNA, 23 nt, Homo sapiens
cuaggcagaucacguugcaaugg

SEQ ID NO: 1132838 - RNA, 20 nt, Homo sapiens
cuaggcuguuaaccuaugau

SEQ ID NO: 1132839 - RNA, 21 nt, Homo sapiens
cuaggcuguuaaccuaugauu

SEQ ID NO: 1132840 - RNA, 14 nt, Homo sapiens
cuagggagccauuu

SEQ ID NO: 1132841 - RNA, 16 nt, Homo sapiens
cuagggagccauuuga

SEQ ID NO: 1132842 - RNA, 23 nt, Homo sapiens
cuagguacgaagagggguggugg

SEQ ID NO: 1132843 - RNA, 18 nt, Homo sapiens
cuaggucuuuaauccacu

SEQ ID NO: 1132844 - RNA, 22 nt, Homo sapiens
cuaggugagaacccuugcacua

SEQ ID NO: 1132845 - RNA, 13 nt, Homo sapiens
cuaggugcccuug

SEQ ID NO: 1132846 - RNA, 16 nt, Homo sapiens
cuaguagcggaucuca

SEQ ID NO: 1132847 - RNA, 17 nt, Homo sapiens
cuaguagcggaucucac

SEQ ID NO: 1132848 - RNA, 21 nt, Homo sapiens
cuaguaguucucuugguguua

SEQ ID NO: 1132849 - RNA, 17 nt, Homo sapiens
cuagucgacacuaagaa

SEQ ID NO: 1132850 - RNA, 16 nt, Homo sapiens
cuagucucccucacag

SEQ ID NO: 1132851 - RNA, 14 nt, Homo sapiens
cuagucucuaucau

SEQ ID NO: 1132852 - RNA, 17 nt, Homo sapiens
cuagucugguggauaaa

SEQ ID NO: 1132853 - RNA, 19 nt, Homo sapiens
cuagugaccuuaaacugaa

SEQ ID NO: 1132854 - RNA, 19 nt, Homo sapiens
cuaguuaaccaaucgcaaa

SEQ ID NO: 1132855 - RNA, 12 nt, Homo sapiens
cuaguuacacau

SEQ ID NO: 1132856 - RNA, 11 nt, Homo sapiens
cuaguuugcaa

SEQ ID NO: 1132857 - RNA, 16 nt, Homo sapiens
cuaguuuuauacaaag

SEQ ID NO: 1132858 - RNA, 22 nt, Homo sapiens
cuaguuuuguuuauaaauugga

SEQ ID NO: 1132859 - RNA, 12 nt, Homo sapiens
cuauaaugugcc

SEQ ID NO: 1132860 - RNA, 21 nt, Homo sapiens
cuauaauucuauacuguugau

SEQ ID NO: 1132861 - RNA, 22 nt, Homo sapiens
cuauacaaauauaaaucuuaaa

SEQ ID NO: 1132862 - RNA, 16 nt, Homo sapiens
cuauagaaacaccagu

SEQ ID NO: 1132863 - RNA, 18 nt, Homo sapiens
cuauagcugcuauagcaa

SEQ ID NO: 1132864 - RNA, 21 nt, Homo sapiens
cuauagugaacucccaucuau

SEQ ID NO: 1132865 - RNA, 23 nt, Homo sapiens
cuauaguuauuaaguucuuuaaa

SEQ ID NO: 1132866 - RNA, 17 nt, Homo sapiens
cuauauaagccagugag

SEQ ID NO: 1132867 - RNA, 22 nt, Homo sapiens
cuauauauccaagaagcaugca

SEQ ID NO: 1132868 - RNA, 20 nt, Homo sapiens
cuaaaaacacagacauucug

SEQ ID NO: 1132869 - RNA, 23 nt, Homo sapiens
cuaaaaauauuaaagccucaugu

SEQ ID NO: 1132870 - RNA, 15 nt, Homo sapiens
cuaaaaaucugagaa

SEQ ID NO: 1132871 - RNA, 17 nt, Homo sapiens
cuaaaacuuaacauuca

SEQ ID NO: 1132872 - RNA, 17 nt, Homo sapiens
cuaaaagaaaaucuauu

SEQ ID NO: 1132873 - RNA, 19 nt, Homo sapiens
cuaaaagaaaaucuauuau

SEQ ID NO: 1132874 - RNA, 18 nt, Homo sapiens
cuaaaagacaauuuuccu

SEQ ID NO: 1132875 - RNA, 14 nt, Homo sapiens
cuaaaagcuuuaaa

SEQ ID NO: 1132876 - RNA, 18 nt, Homo sapiens
cuaaaagugggcuugauu

SEQ ID NO: 1132877 - RNA, 19 nt, Homo sapiens
cuaaaaguucucaauguag

SEQ ID NO: 1132878 - RNA, 20 nt, Homo sapiens
cuaaaaucuuauaguucuag

SEQ ID NO: 1132879 - RNA, 20 nt, Homo sapiens
cuaaaauucagguauuacug

SEQ ID NO: 1132880 - RNA, 16 nt, Homo sapiens
cuaaacccaauccaaa

SEQ ID NO: 1132881 - RNA, 16 nt, Homo sapiens
cuaaacggauuccaaa

SEQ ID NO: 1132882 - RNA, 21 nt, Homo sapiens
cuaaacucauuuauaaagcua

SEQ ID NO: 1132883 - RNA, 21 nt, Homo sapiens
cuaaagaaaaauaucuuggcc

SEQ ID NO: 1132884 - RNA, 17 nt, Homo sapiens
cuaaagaagaucuguaa

SEQ ID NO: 1132885 - RNA, 13 nt, Homo sapiens
cuaaagaauauaa

SEQ ID NO: 1132886 - RNA, 14 nt, Homo sapiens
cuaaagaguuuauu

SEQ ID NO: 1132887 - RNA, 14 nt, Homo sapiens
cuaaagccauugua

SEQ ID NO: 1132888 - RNA, 13 nt, Homo sapiens
cuaaagguggcca

SEQ ID NO: 1132889 - RNA, 22 nt, Homo sapiens
cuaaagucaucaugaacuggcu

SEQ ID NO: 1132890 - RNA, 12 nt, Homo sapiens
cuaaagugcaag

SEQ ID NO: 1132891 - RNA, 23 nt, Homo sapiens
cuaaauaaagagaacuccagugu

SEQ ID NO: 1132892 - RNA, 17 nt, Homo sapiens
cuaaauaagaaaauaac

SEQ ID NO: 1132893 - RNA, 21 nt, Homo sapiens
cuaaauaaucuuacucuagau

SEQ ID NO: 1132894 - RNA, 12 nt, Homo sapiens
cuaaaugagcua

SEQ ID NO: 1132895 - RNA, 12 nt, Homo sapiens
cuaaaugcacug

SEQ ID NO: 1132896 - RNA, 20 nt, Homo sapiens
cuaaauguguaauaauguaa

SEQ ID NO: 1132897 - RNA, 22 nt, Homo sapiens
cuaacaaugacauuuauaucac

SEQ ID NO: 1132898 - RNA, 14 nt, Homo sapiens
cuaacacggugcuc

SEQ ID NO: 1132899 - RNA, 14 nt, Homo sapiens
cuaacauacuauau

SEQ ID NO: 1132900 - RNA, 21 nt, Homo sapiens
cuaacauacuauauaagccag

SEQ ID NO: 1132901 - RNA, 20 nt, Homo sapiens
cuaacauauugccaugugug

SEQ ID NO: 1132902 - RNA, 17 nt, Homo sapiens
cuaacauguaauugcag

SEQ ID NO: 1132903 - RNA, 18 nt, Homo sapiens
cuaaccaaggcuguguuu

SEQ ID NO: 1132904 - RNA, 23 nt, Homo sapiens
cuaaccauaguuauuuacuugaa

SEQ ID NO: 1132905 - RNA, 15 nt, Homo sapiens
cuaacuacuguagaa

SEQ ID NO: 1132906 - RNA, 21 nt, Homo sapiens
cuaacuaugcauggugcccca

SEQ ID NO: 1132907 - RNA, 13 nt, Homo sapiens
cuaacuccaguga

SEQ ID NO: 1132908 - RNA, 21 nt, Homo sapiens
cuaagaauaaacuccauuuaa

SEQ ID NO: 1132909 - RNA, 12 nt, Homo sapiens
cuaagacuacua

SEQ ID NO: 1132910 - RNA, 12 nt, Homo sapiens
cuaagaugacau

SEQ ID NO: 1132911 - RNA, 18 nt, Homo sapiens
cuaagccgaaguuuugua

SEQ ID NO: 1132912 - RNA, 15 nt, Homo sapiens
cuaagcgcacauuca

SEQ ID NO: 1132913 - RNA, 20 nt, Homo sapiens
cuaagcugccgguucuuaaa

SEQ ID NO: 1132914 - RNA, 16 nt, Homo sapiens
cuaagcuucacuguaa

SEQ ID NO: 1132915 - RNA, 17 nt, Homo sapiens
cuaaggaagcuaaaagc

SEQ ID NO: 1132916 - RNA, 21 nt, Homo sapiens
cuaaggagaagcuaauaugau

SEQ ID NO: 1132917 - RNA, 21 nt, Homo sapiens
cgaaugcggugcaaaauuucc

SEQ ID NO: 1132918 - RNA, 18 nt, Homo sapiens
cgaauugacaacccaaac

SEQ ID NO: 1132919 - RNA, 20 nt, Homo sapiens
cgacaagaccaccaacgugu

SEQ ID NO: 1132920 - RNA, 18 nt, Homo sapiens
cgaccagaggagccuuuu

SEQ ID NO: 1132921 - RNA, 13 nt, Homo sapiens
cgacugggcucaa

SEQ ID NO: 1132922 - RNA, 20 nt, Homo sapiens
cgacuucaugacaagcauuu

SEQ ID NO: 1132923 - RNA, 17 nt, Homo sapiens
cgagaagguacugaaau

SEQ ID NO: 1132924 - RNA, 18 nt, Homo sapiens
cgagaagguacugaaaua

SEQ ID NO: 1132925 - RNA, 19 nt, Homo sapiens
cgagaauguauggauuuac

SEQ ID NO: 1132926 - RNA, 17 nt, Homo sapiens
cgagaccaaccuagcca

SEQ ID NO: 1132927 - RNA, 15 nt, Homo sapiens
cgagacuccaucuca

SEQ ID NO: 1132928 - RNA, 17 nt, Homo sapiens
cgagacuccaucucaaa

SEQ ID NO: 1132929 - RNA, 19 nt, Homo sapiens
cgagauaggguggcacauc

SEQ ID NO: 1132930 - RNA, 21 nt, Homo sapiens
cgagaucacgucacugcacuc

SEQ ID NO: 1132931 - RNA, 21 nt, Homo sapiens
cgagaucgugccauugcacuc

SEQ ID NO: 1132932 - RNA, 14 nt, Homo sapiens
cgagcaggguguuu

SEQ ID NO: 1132933 - RNA, 19 nt, Homo sapiens
cgagcauaguccaaaaagc

SEQ ID NO: 1132934 - RNA, 23 nt, Homo sapiens
cgagccccucggcucuggaggca

SEQ ID NO: 1132935 - RNA, 21 nt, Homo sapiens
cgagcccuuagccuugcugua

SEQ ID NO: 1132936 - RNA, 15 nt, Homo sapiens
cgagccuggcuccaa

SEQ ID NO: 1132937 - RNA, 13 nt, Homo sapiens
cgagcggggagcc

SEQ ID NO: 1132938 - RNA, 20 nt, Homo sapiens
cgagcggggagccaggaaag

SEQ ID NO: 1132939 - RNA, 20 nt, Homo sapiens
cgaggacuguauuugugacu

SEQ ID NO: 1132940 - RNA, 17 nt, Homo sapiens
cgaggggcucaguucug

SEQ ID NO: 1132941 - RNA, 13 nt, Homo sapiens
cgaguauguguuu

SEQ ID NO: 1132942 - RNA, 23 nt, Homo sapiens
cgagucuugcucuucaaugcuac

SEQ ID NO: 1132943 - RNA, 17 nt, Homo sapiens
cgauaaaagacagugaa

SEQ ID NO: 1132944 - RNA, 22 nt, Homo sapiens
cgaugccgugugucucgucucc

SEQ ID NO: 1132945 - RNA, 11 nt, Homo sapiens
cgaugcugcug

SEQ ID NO: 1132946 - RNA, 19 nt, Homo sapiens
cgauugaaagaaccagaga

SEQ ID NO: 1132947 - RNA, 16 nt, Homo sapiens
cgcaaaccacacugga

SEQ ID NO: 1132948 - RNA, 14 nt, Homo sapiens
cgcacaaauuccac

SEQ ID NO: 1132949 - RNA, 16 nt, Homo sapiens
cgcacaaauuccacau

SEQ ID NO: 1132950 - RNA, 13 nt, Homo sapiens
cgcaccagguguc

SEQ ID NO: 1132951 - RNA, 20 nt, Homo sapiens
cgcagcccuggcagggggca

SEQ ID NO: 1132952 - RNA, 14 nt, Homo sapiens
cgcagccuccaguu

SEQ ID NO: 1132953 - RNA, 19 nt, Homo sapiens
cgcaggccucagcaucucc

SEQ ID NO: 1132954 - RNA, 19 nt, Homo sapiens
cgcaucaaaagacaauucu

SEQ ID NO: 1132955 - RNA, 22 nt, Homo sapiens
cgccaacugcugaucaaugaaa

SEQ ID NO: 1132956 - RNA, 21 nt, Homo sapiens
cgcccacuugucccacuaucu

SEQ ID NO: 1132957 - RNA, 12 nt, Homo sapiens
cgcccucaggcu

SEQ ID NO: 1132958 - RNA, 18 nt, Homo sapiens
cgcccuggacuugguaca

SEQ ID NO: 1132959 - RNA, 22 nt, Homo sapiens
cgccuccccccacccgaagcca

SEQ ID NO: 1132960 - RNA, 17 nt, Homo sapiens
cgccuccugaguucaag

SEQ ID NO: 1132961 - RNA, 16 nt, Homo sapiens
cgccucuccccggggc

SEQ ID NO: 1132962 - RNA, 15 nt, Homo sapiens
cgccuggcucaguca

SEQ ID NO: 1132963 - RNA, 16 nt, Homo sapiens
cgccuggcugcugcuu

SEQ ID NO: 1132964 - RNA, 19 nt, Homo sapiens
cgcugaaauuaaaugccac

SEQ ID NO: 1132965 - RNA, 22 nt, Homo sapiens
cgcugagcgaggagaugcuccu

SEQ ID NO: 1132966 - RNA, 19 nt, Homo sapiens
cuuuggcuggaauuacaaa

SEQ ID NO: 1132967 - RNA, 17 nt, Homo sapiens
cuuuggcuuugcaaaau

SEQ ID NO: 1132968 - RNA, 14 nt, Homo sapiens
cuuugggacugugu

SEQ ID NO: 1132969 - RNA, 17 nt, Homo sapiens
cuuugguauuucacuga

SEQ ID NO: 1132970 - RNA, 16 nt, Homo sapiens
cuuugguggcauggaa

SEQ ID NO: 1132971 - RNA, 13 nt, Homo sapiens
cuuuguagcgucu

SEQ ID NO: 1132972 - RNA, 14 nt, Homo sapiens
cuuuguauauuaca

SEQ ID NO: 1132973 - RNA, 20 nt, Homo sapiens
cuuuguauccucugaccuac

SEQ ID NO: 1132974 - RNA, 14 nt, Homo sapiens
cuuuguucuuguca

SEQ ID NO: 1132975 - RNA, 15 nt, Homo sapiens
cuuuuaaaacuucua

SEQ ID NO: 1132976 - RNA, 20 nt, Homo sapiens
cuuuuaaaacuuugccauuu

SEQ ID NO: 1132977 - RNA, 22 nt, Homo sapiens
cuuuuaaagaaauaaccacugc

SEQ ID NO: 1132978 - RNA, 13 nt, Homo sapiens
cuuuuaagacaaa

SEQ ID NO: 1132979 - RNA, 15 nt, Homo sapiens
cuuuuaaggcuaaaa

SEQ ID NO: 1132980 - RNA, 17 nt, Homo sapiens
cuuuuaaugaacaaaug

SEQ ID NO: 1132981 - RNA, 18 nt, Homo sapiens
cuuuuaauuagugaaaau

SEQ ID NO: 1132982 - RNA, 16 nt, Homo sapiens
cuuuuacauacugcug

SEQ ID NO: 1132983 - RNA, 21 nt, Homo sapiens
cuuuuacccggcacauucccc

SEQ ID NO: 1132984 - RNA, 17 nt, Homo sapiens
cuuuuacugaagccuuu

SEQ ID NO: 1132985 - RNA, 16 nt, Homo sapiens
cuuuuaggccaaggaa

SEQ ID NO: 1132986 - RNA, 22 nt, Homo sapiens
cuuuuaucaauaaagcacuauu

SEQ ID NO: 1132987 - RNA, 18 nt, Homo sapiens
cuuuuaugcaaccauaag

SEQ ID NO: 1132988 - RNA, 21 nt, Homo sapiens
cuuuuauguaguaauugacau

SEQ ID NO: 1132989 - RNA, 15 nt, Homo sapiens
cuuuuaugugucuca

SEQ ID NO: 1132990 - RNA, 19 nt, Homo sapiens
cuuuuauuaaugcacuuuc

SEQ ID NO: 1132991 - RNA, 18 nt, Homo sapiens
cuuuuauugacacagaaa

SEQ ID NO: 1132992 - RNA, 19 nt, Homo sapiens
cuuuuauuuuacacagaaa

SEQ ID NO: 1132993 - RNA, 23 nt, Homo sapiens
cuuuucaagcuauaaugcuauuu

SEQ ID NO: 1132994 - RNA, 23 nt, Homo sapiens
cuuuucagcgauguaugcagcua

SEQ ID NO: 1132995 - RNA, 21 nt, Homo sapiens
cuuuuccccggucccuugaga

SEQ ID NO: 1132996 - RNA, 13 nt, Homo sapiens
cuuuuccccucau

SEQ ID NO: 1132997 - RNA, 21 nt, Homo sapiens
cuuuuccgcacuaccugaaca

SEQ ID NO: 1132998 - RNA, 16 nt, Homo sapiens
cuuuuccuuaccuuua

SEQ ID NO: 1132999 - RNA, 19 nt, Homo sapiens
cuuuucucagcuggaugau

SEQ ID NO: 1133000 - RNA, 15 nt, Homo sapiens
cuuuucucaguuugg

SEQ ID NO: 1133001 - RNA, 15 nt, Homo sapiens
cuuuucuuuccucag

SEQ ID NO: 1133002 - RNA, 20 nt, Homo sapiens
cuuuugaaaagaggugugca

SEQ ID NO: 1133003 - RNA, 13 nt, Homo sapiens
cuuuugaauucag

SEQ ID NO: 1133004 - RNA, 14 nt, Homo sapiens
cuuuugacauuuua

SEQ ID NO: 1133005 - RNA, 21 nt, Homo sapiens
cuuuugauccugggggaccaa

SEQ ID NO: 1133006 - RNA, 19 nt, Homo sapiens
cuuuugguuacagcacaaa

SEQ ID NO: 1133007 - RNA, 22 nt, Homo sapiens
cuuuuguagaaugaaccacugc

SEQ ID NO: 1133008 - RNA, 18 nt, Homo sapiens
cuuuuuaaacaguguuua

SEQ ID NO: 1133009 - RNA, 21 nt, Homo sapiens
cuuuuuaaauauuucuacuaa

SEQ ID NO: 1133010 - RNA, 17 nt, Homo sapiens
cuuuuuaauaaagugga

SEQ ID NO: 1133011 - RNA, 16 nt, Homo sapiens
cuuuuuauugccuucu

SEQ ID NO: 1133012 - RNA, 21 nt, Homo sapiens
cuuuuuauuucucugugggcu

SEQ ID NO: 1133013 - RNA, 19 nt, Homo sapiens
cuuuuuccaguccccagaa

SEQ ID NO: 1133014 - RNA, 17 nt, Homo sapiens
gaaaaaaaaagaauuac

SEQ ID NO: 1133015 - RNA, 15 nt, Homo sapiens
gaaaaaaaaauggaa

SEQ ID NO: 1133016 - RNA, 16 nt, Homo sapiens
gaaaaaaaaugaccuc

SEQ ID NO: 1133017 - RNA, 13 nt, Homo sapiens
gaaaaaaaccaaa

SEQ ID NO: 1133018 - RNA, 14 nt, Homo sapiens
gaaaaaaaccaaag

SEQ ID NO: 1133019 - RNA, 20 nt, Homo sapiens
gaaaaaaaccaaaguacuuu

SEQ ID NO: 1133020 - RNA, 14 nt, Homo sapiens
gaaaaacaacccag

SEQ ID NO: 1133021 - RNA, 19 nt, Homo sapiens
gaaaaacaccgcuucugcc

SEQ ID NO: 1133022 - RNA, 17 nt, Homo sapiens
gaaaaagaaagaacugu

SEQ ID NO: 1133023 - RNA, 16 nt, Homo sapiens
gaaaaagccugugaaa

SEQ ID NO: 1133024 - RNA, 18 nt, Homo sapiens
gaaaaaucauccaagaca

SEQ ID NO: 1133025 - RNA, 13 nt, Homo sapiens
gaaaaauuauagu

SEQ ID NO: 1133026 - RNA, 14 nt, Homo sapiens
gaaaacaaacaaau

SEQ ID NO: 1133027 - RNA, 15 nt, Homo sapiens
gaaaacacugugcac

SEQ ID NO: 1133028 - RNA, 14 nt, Homo sapiens
gaaaacaucuggaa

SEQ ID NO: 1133029 - RNA, 21 nt, Homo sapiens
gaaaacauuccagaugcauga

SEQ ID NO: 1133030 - RNA, 12 nt, Homo sapiens
gaaaaccaucac

SEQ ID NO: 1133031 - RNA, 13 nt, Homo sapiens
gaaaaccaucaca

SEQ ID NO: 1133032 - RNA, 22 nt, Homo sapiens
gaaaacuagauugcuaguuuau

SEQ ID NO: 1133033 - RNA, 23 nt, Homo sapiens
gaaaacucagaagaaagcucaga

SEQ ID NO: 1133034 - RNA, 17 nt, Homo sapiens
gaaaacugccauaacau

SEQ ID NO: 1133035 - RNA, 18 nt, Homo sapiens
gaaaacugccauaacaua

SEQ ID NO: 1133036 - RNA, 14 nt, Homo sapiens
gaaaacuucacugu

SEQ ID NO: 1133037 - RNA, 21 nt, Homo sapiens
gaaaagaaaucuaugauucca

SEQ ID NO: 1133038 - RNA, 19 nt, Homo sapiens
gaaaagagagcagagaaua

SEQ ID NO: 1133039 - RNA, 23 nt, Homo sapiens
gaaaagagauaugggaacacugg

SEQ ID NO: 1133040 - RNA, 22 nt, Homo sapiens
gaaaagauacccaaaggucaag

SEQ ID NO: 1133041 - RNA, 22 nt, Homo sapiens
cuucguuuacuaugccuguguc

SEQ ID NO: 1133042 - RNA, 19 nt, Homo sapiens
cuucucaaagcugggauua

SEQ ID NO: 1133043 - RNA, 12 nt, Homo sapiens
cuucucagucuu

SEQ ID NO: 1133044 - RNA, 12 nt, Homo sapiens
cuucucauuucu

SEQ ID NO: 1133045 - RNA, 14 nt, Homo sapiens
cuucucucagcucc

SEQ ID NO: 1133046 - RNA, 18 nt, Homo sapiens
cuucucuggauaagugac

SEQ ID NO: 1133047 - RNA, 15 nt, Homo sapiens
cuucugacauuuauc

SEQ ID NO: 1133048 - RNA, 20 nt, Homo sapiens
cuucugacccagggcugaga

SEQ ID NO: 1133049 - RNA, 21 nt, Homo sapiens
cuucugacccagggcugagac

SEQ ID NO: 1133050 - RNA, 17 nt, Homo sapiens
cuucugagcagaaaugg

SEQ ID NO: 1133051 - RNA, 18 nt, Homo sapiens
cuucugaggacauuccaa

SEQ ID NO: 1133052 - RNA, 14 nt, Homo sapiens
cuucugcaaaaaac

SEQ ID NO: 1133053 - RNA, 16 nt, Homo sapiens
cuucugcaacugaaau

SEQ ID NO: 1133054 - RNA, 13 nt, Homo sapiens
cuucugcuucuca

SEQ ID NO: 1133055 - RNA, 18 nt, Homo sapiens
cuucuggaacccagaaga

SEQ ID NO: 1133056 - RNA, 22 nt, Homo sapiens
cuucuggccucccacagacuca

SEQ ID NO: 1133057 - RNA, 22 nt, Homo sapiens
cuucugucccucacagcacuag

SEQ ID NO: 1133058 - RNA, 22 nt, Homo sapiens
cuucuguggaccacugcaugag

SEQ ID NO: 1133059 - RNA, 15 nt, Homo sapiens
cuucuuacuggugcu

SEQ ID NO: 1133060 - RNA, 14 nt, Homo sapiens
cuucuuaugguggu

SEQ ID NO: 1133061 - RNA, 16 nt, Homo sapiens
cuucuucaccauuugg

SEQ ID NO: 1133062 - RNA, 22 nt, Homo sapiens
cuucuuccucaagucuugacaa

SEQ ID NO: 1133063 - RNA, 18 nt, Homo sapiens
cuucuucuuagcaccaca

SEQ ID NO: 1133064 - RNA, 22 nt, Homo sapiens
cuucuuggacuucuugaaauca

SEQ ID NO: 1133065 - RNA, 18 nt, Homo sapiens
cuucuuuagaacagggaa

SEQ ID NO: 1133066 - RNA, 13 nt, Homo sapiens
cuucuuuauacuc

SEQ ID NO: 1133067 - RNA, 13 nt, Homo sapiens
cuucuuuccaugg

SEQ ID NO: 1133068 - RNA, 23 nt, Homo sapiens
cuugaaaagcuaguguaccuccu

SEQ ID NO: 1133069 - RNA, 13 nt, Homo sapiens
cuugaacugagac

SEQ ID NO: 1133070 - RNA, 15 nt, Homo sapiens
cuugaagacagagca

SEQ ID NO: 1133071 - RNA, 13 nt, Homo sapiens
cuugaagacuccc

SEQ ID NO: 1133072 - RNA, 21 nt, Homo sapiens
cuugaagcauuucaaagcccu

SEQ ID NO: 1133073 - RNA, 16 nt, Homo sapiens
cuugaaggugcugacg

SEQ ID NO: 1133074 - RNA, 17 nt, Homo sapiens
cuugaaguuacacauaa

SEQ ID NO: 1133075 - RNA, 22 nt, Homo sapiens
cuugaaucaagucagcaacaga

SEQ ID NO: 1133076 - RNA, 18 nt, Homo sapiens
cuugaauggagcugguga

SEQ ID NO: 1133077 - RNA, 17 nt, Homo sapiens
cuugaauguaguauuca

SEQ ID NO: 1133078 - RNA, 23 nt, Homo sapiens
cuugaauguuuguauacauguua

SEQ ID NO: 1133079 - RNA, 18 nt, Homo sapiens
cuugacuaccuacuggug

SEQ ID NO: 1133080 - RNA, 20 nt, Homo sapiens
cuugagccuuugacugauaa

SEQ ID NO: 1133081 - RNA, 22 nt, Homo sapiens
cuugagcucugcucucagcaga

SEQ ID NO: 1133082 - RNA, 18 nt, Homo sapiens
cuugaggaaaacaagcau

SEQ ID NO: 1133083 - RNA, 12 nt, Homo sapiens
cuugaggucucu

SEQ ID NO: 1133084 - RNA, 16 nt, Homo sapiens
cuugauagaaaugcca

SEQ ID NO: 1133085 - RNA, 16 nt, Homo sapiens
cuugauauuuucuaua

SEQ ID NO: 1133086 - RNA, 15 nt, Homo sapiens
cuugauucacaauga

SEQ ID NO: 1133087 - RNA, 19 nt, Homo sapiens
cuugcaaccuaccuguuga

SEQ ID NO: 1133088 - RNA, 18 nt, Homo sapiens
cuugcaauguagucaaua

SEQ ID NO: 1133089 - RNA, 21 nt, Homo sapiens
cuugcaauuguuaaucaaaga

SEQ ID NO: 1133090 - RNA, 12 nt, Homo sapiens
cuugcagacucg

SEQ ID NO: 1133091 - RNA, 18 nt, Homo sapiens
cuugcagugaaguguucu

SEQ ID NO: 1133092 - RNA, 22 nt, Homo sapiens
cuugcauccaugcccagccaau

SEQ ID NO: 1133093 - RNA, 21 nt, Homo sapiens
cuugcauugaauuuagucauu

SEQ ID NO: 1133094 - RNA, 11 nt, Homo sapiens
cuugcauuuau

SEQ ID NO: 1133095 - RNA, 14 nt, Homo sapiens
cuugccaaagcaga

SEQ ID NO: 1133096 - RNA, 20 nt, Homo sapiens
cuugccaagcagugcacauu

SEQ ID NO: 1133097 - RNA, 12 nt, Homo sapiens
cuugccagagau

SEQ ID NO: 1133098 - RNA, 20 nt, Homo sapiens
cuguguuuuauugugguaau

SEQ ID NO: 1133099 - RNA, 18 nt, Homo sapiens
cuguuaaaucaguucugu

SEQ ID NO: 1133100 - RNA, 18 nt, Homo sapiens
cuguuaccaauauaguuu

SEQ ID NO: 1133101 - RNA, 18 nt, Homo sapiens
cuguuacuaaauccuuuu

SEQ ID NO: 1133102 - RNA, 18 nt, Homo sapiens
cuguuaucgaacacauuc

SEQ ID NO: 1133103 - RNA, 14 nt, Homo sapiens
cuguucauugccuc

SEQ ID NO: 1133104 - RNA, 17 nt, Homo sapiens
cuguuccccugcucugu

SEQ ID NO: 1133105 - RNA, 15 nt, Homo sapiens
cuguucccuugccau

SEQ ID NO: 1133106 - RNA, 16 nt, Homo sapiens
cuguucucacauaaca

SEQ ID NO: 1133107 - RNA, 14 nt, Homo sapiens
cuguucuccagugu

SEQ ID NO: 1133108 - RNA, 18 nt, Homo sapiens
cuguucuuuaagacuuuu

SEQ ID NO: 1133109 - RNA, 15 nt, Homo sapiens
cuguugcauauacca

SEQ ID NO: 1133110 - RNA, 13 nt, Homo sapiens
cuguugcuuacaa

SEQ ID NO: 1133111 - RNA, 16 nt, Homo sapiens
cuguuggcaagccaca

SEQ ID NO: 1133112 - RNA, 18 nt, Homo sapiens
cuguugugcuccauagag

SEQ ID NO: 1133113 - RNA, 19 nt, Homo sapiens
cuguuuaauguucugugau

SEQ ID NO: 1133114 - RNA, 17 nt, Homo sapiens
cuguuuauauguucaca

SEQ ID NO: 1133115 - RNA, 14 nt, Homo sapiens
cuguuuauugccau

SEQ ID NO: 1133116 - RNA, 17 nt, Homo sapiens
cuguuucaaucacuguc

SEQ ID NO: 1133117 - RNA, 18 nt, Homo sapiens
cuguuucucucacugggc

SEQ ID NO: 1133118 - RNA, 17 nt, Homo sapiens
cuguuuucuccuaggcc

SEQ ID NO: 1133119 - RNA, 18 nt, Homo sapiens
cuuaaaaaaauaugccuu

SEQ ID NO: 1133120 - RNA, 21 nt, Homo sapiens
cuuaaaaaguggcguuguuca

SEQ ID NO: 1133121 - RNA, 22 nt, Homo sapiens
cuuaaaagaaacuauaaaguuu

SEQ ID NO: 1133122 - RNA, 17 nt, Homo sapiens
cuuaaaagguacuggua

SEQ ID NO: 1133123 - RNA, 12 nt, Homo sapiens
cuuaaacaucau

SEQ ID NO: 1133124 - RNA, 18 nt, Homo sapiens
cuuaaaguuguguaucug

SEQ ID NO: 1133125 - RNA, 15 nt, Homo sapiens
cuuaaaucuuuucaa

SEQ ID NO: 1133126 - RNA, 15 nt, Homo sapiens
cuuaacaaaccaaca

SEQ ID NO: 1133127 - RNA, 22 nt, Homo sapiens
cuuaacaacugacuaaccauug

SEQ ID NO: 1133128 - RNA, 15 nt, Homo sapiens
cuuaacaagacuuuu

SEQ ID NO: 1133129 - RNA, 14 nt, Homo sapiens
cuuaacacuugacc

SEQ ID NO: 1133130 - RNA, 19 nt, Homo sapiens
cuuaaccuuugcuauguaa

SEQ ID NO: 1133131 - RNA, 18 nt, Homo sapiens
cuuaaccuuuuaauacug

SEQ ID NO: 1133132 - RNA, 16 nt, Homo sapiens
cuuaacuaagacuccc

SEQ ID NO: 1133133 - RNA, 14 nt, Homo sapiens
cuuaacuauucaau

SEQ ID NO: 1133134 - RNA, 18 nt, Homo sapiens
cuuaacuuugaaccauaa

SEQ ID NO: 1133135 - RNA, 22 nt, Homo sapiens
cuuaagcagcaacagccuacaa

SEQ ID NO: 1133136 - RNA, 13 nt, Homo sapiens
cuuaauacugucc

SEQ ID NO: 1133137 - RNA, 17 nt, Homo sapiens
cuuaauacuuuaugaug

SEQ ID NO: 1133138 - RNA, 14 nt, Homo sapiens
cuuaaugcucugau

SEQ ID NO: 1133139 - RNA, 21 nt, Homo sapiens
cuuaaugugaccuagcaauag

SEQ ID NO: 1133140 - RNA, 13 nt, Homo sapiens
cuuaauguuucca

SEQ ID NO: 1133141 - RNA, 17 nt, Homo sapiens
cuuaauuaggaugcaug

SEQ ID NO: 1133142 - RNA, 22 nt, Homo sapiens
cuuaauuuaacuuuccagucuu

SEQ ID NO: 1133143 - RNA, 19 nt, Homo sapiens
cuuaauuuaccuguuguug

SEQ ID NO: 1133144 - RNA, 18 nt, Homo sapiens
cuuaauuuauuucuuaac

SEQ ID NO: 1133145 - RNA, 15 nt, Homo sapiens
cuuacaaccuuguca

SEQ ID NO: 1133146 - RNA, 20 nt, Homo sapiens
cuuacaauuggcacuaaaga

SEQ ID NO: 1133147 - RNA, 21 nt, Homo sapiens
cuuacaggcauggacaugcag

SEQ ID NO: 1133148 - RNA, 15 nt, Homo sapiens
cuuacaucaggaaau

SEQ ID NO: 1133149 - RNA, 13 nt, Homo sapiens
cuuacccuaaaga

SEQ ID NO: 1133150 - RNA, 19 nt, Homo sapiens
cuuaccuagauucuacaua

SEQ ID NO: 1133151 - RNA, 20 nt, Homo sapiens
cuuaccuggcagcaaacugc

SEQ ID NO: 1133152 - RNA, 21 nt, Homo sapiens
cuuaccuuguuuugccaguga

SEQ ID NO: 1133153 - RNA, 15 nt, Homo sapiens
gcuguuccacaaagc

SEQ ID NO: 1133154 - RNA, 15 nt, Homo sapiens
gcuguuccuguucag

SEQ ID NO: 1133155 - RNA, 15 nt, Homo sapiens
gcuguugacauauuu

SEQ ID NO: 1133156 - RNA, 13 nt, Homo sapiens
gcuguugcauggg

SEQ ID NO: 1133157 - RNA, 20 nt, Homo sapiens
gcuguugcaugggcuaauga

SEQ ID NO: 1133158 - RNA, 15 nt, Homo sapiens
gcuguuuacagacaa

SEQ ID NO: 1133159 - RNA, 19 nt, Homo sapiens
gcuguuuauuaaugcugaa

SEQ ID NO: 1133160 - RNA, 15 nt, Homo sapiens
gcuguuucagcuuua

SEQ ID NO: 1133161 - RNA, 17 nt, Homo sapiens
gcuguuugcaauccaaa

SEQ ID NO: 1133162 - RNA, 21 nt, Homo sapiens
gcuguuuggauuauuccucua

SEQ ID NO: 1133163 - RNA, 18 nt, Homo sapiens
gcuguuuucaacauugua

SEQ ID NO: 1133164 - RNA, 15 nt, Homo sapiens
gcuuaacuugaaaaa

SEQ ID NO: 1133165 - RNA, 17 nt, Homo sapiens
gcuuaagccaucuuugu

SEQ ID NO: 1133166 - RNA, 12 nt, Homo sapiens
gcuuaaucugag

SEQ ID NO: 1133167 - RNA, 15 nt, Homo sapiens
gcuuacuaugaccuu

SEQ ID NO: 1133168 - RNA, 17 nt, Homo sapiens
gcuuaggagacagauca

SEQ ID NO: 1133169 - RNA, 23 nt, Homo sapiens
gcuuaguagagcuuuuugcaugu

SEQ ID NO: 1133170 - RNA, 22 nt, Homo sapiens
gcuuaguccaauuccuugcaca

SEQ ID NO: 1133171 - RNA, 23 nt, Homo sapiens
gcuuauaaauggcaccacaucuu

SEQ ID NO: 1133172 - RNA, 14 nt, Homo sapiens
gcuuauauuuagaa

SEQ ID NO: 1133173 - RNA, 20 nt, Homo sapiens
gcuuaucucccugcuucaua

SEQ ID NO: 1133174 - RNA, 13 nt, Homo sapiens
gcuuaugaauaua

SEQ ID NO: 1133175 - RNA, 18 nt, Homo sapiens
gcuuauuuuuuucuacau

SEQ ID NO: 1133176 - RNA, 20 nt, Homo sapiens
gcuuauuuuuuucuacauaa

SEQ ID NO: 1133177 - RNA, 17 nt, Homo sapiens
gcuucaaggacauuggu

SEQ ID NO: 1133178 - RNA, 16 nt, Homo sapiens
gcuucaccccaauccc

SEQ ID NO: 1133179 - RNA, 12 nt, Homo sapiens
gcuucacucucc

SEQ ID NO: 1133180 - RNA, 15 nt, Homo sapiens
gcuucagauguggag

SEQ ID NO: 1133181 - RNA, 17 nt, Homo sapiens
gcuucagcgaaagggac

SEQ ID NO: 1133182 - RNA, 23 nt, Homo sapiens
gcuucaggaaccucgaguacugu

SEQ ID NO: 1133183 - RNA, 15 nt, Homo sapiens
gcuucauacacauga

SEQ ID NO: 1133184 - RNA, 14 nt, Homo sapiens
gcuucauacaggga

SEQ ID NO: 1133185 - RNA, 16 nt, Homo sapiens
gcuucaugccagguua

SEQ ID NO: 1133186 - RNA, 17 nt, Homo sapiens
gcuucuagaguuuuaua

SEQ ID NO: 1133187 - RNA, 19 nt, Homo sapiens
gcuucuaguuugcaacuuc

SEQ ID NO: 1133188 - RNA, 14 nt, Homo sapiens
gcuucuccuuuuaa

SEQ ID NO: 1133189 - RNA, 19 nt, Homo sapiens
gcuucucuugagucacacu

SEQ ID NO: 1133190 - RNA, 19 nt, Homo sapiens
gcuucuggaacccagaaga

SEQ ID NO: 1133191 - RNA, 18 nt, Homo sapiens
gcuucuugugaaggccau

SEQ ID NO: 1133192 - RNA, 14 nt, Homo sapiens
gcuugacaacaucu

SEQ ID NO: 1133193 - RNA, 22 nt, Homo sapiens
gcuugagucucaaggguggcag

SEQ ID NO: 1133194 - RNA, 13 nt, Homo sapiens
gcuugaguuauau

SEQ ID NO: 1133195 - RNA, 23 nt, Homo sapiens
gcuugcaaaaacuacaaccaaug

SEQ ID NO: 1133196 - RNA, 16 nt, Homo sapiens
gcuugcagccaggaga

SEQ ID NO: 1133197 - RNA, 11 nt, Homo sapiens
gcuugccaaag

SEQ ID NO: 1133198 - RNA, 12 nt, Homo sapiens
gcuugccacuaa

SEQ ID NO: 1133199 - RNA, 15 nt, Homo sapiens
gcuuggcaucugugu

SEQ ID NO: 1133200 - RNA, 19 nt, Homo sapiens
gcuuggguggagaagccau

SEQ ID NO: 1133201 - RNA, 14 nt, Homo sapiens
gcuuguacuaagcc

SEQ ID NO: 1133202 - RNA, 17 nt, Homo sapiens
gcuugugauaugcacgu

SEQ ID NO: 1133203 - RNA, 18 nt, Homo sapiens
gcuuguuauugccucuac

SEQ ID NO: 1133204 - RNA, 15 nt, Homo sapiens
uggugauuucuugcu

SEQ ID NO: 1133205 - RNA, 17 nt, Homo sapiens
uggugauuucuugcuaa

SEQ ID NO: 1133206 - RNA, 19 nt, Homo sapiens
uggugccccaggaccagcu

SEQ ID NO: 1133207 - RNA, 23 nt, Homo sapiens
uggugcuaaaugcuacauacucc

SEQ ID NO: 1133208 - RNA, 11 nt, Homo sapiens
ugguggcaugg

SEQ ID NO: 1133209 - RNA, 14 nt, Homo sapiens
ugguggcuacccaa

SEQ ID NO: 1133210 - RNA, 13 nt, Homo sapiens
ugguggcucuuca

SEQ ID NO: 1133211 - RNA, 16 nt, Homo sapiens
uggugguucauuccac

SEQ ID NO: 1133212 - RNA, 14 nt, Homo sapiens
ugguguaccugcug

SEQ ID NO: 1133213 - RNA, 20 nt, Homo sapiens
ugguguggagggcgccaucu

SEQ ID NO: 1133214 - RNA, 22 nt, Homo sapiens
ugguguucucuggcucuugucc

SEQ ID NO: 1133215 - RNA, 21 nt, Homo sapiens
ugguguucuugcuaacuuugc

SEQ ID NO: 1133216 - RNA, 15 nt, Homo sapiens
ugguuauaauguguu

SEQ ID NO: 1133217 - RNA, 15 nt, Homo sapiens
ugguuccaucacugc

SEQ ID NO: 1133218 - RNA, 21 nt, Homo sapiens
ugguuccaucuaguaccagag

SEQ ID NO: 1133219 - RNA, 21 nt, Homo sapiens
ugguuucucggugacuuggag

SEQ ID NO: 1133220 - RNA, 17 nt, Homo sapiens
ugguuugaacacaauuc

SEQ ID NO: 1133221 - RNA, 12 nt, Homo sapiens
ugguuuuacuac

SEQ ID NO: 1133222 - RNA, 16 nt, Homo sapiens
ugguuuuguacuggau

SEQ ID NO: 1133223 - RNA, 14 nt, Homo sapiens
ugguuuuuugccag

SEQ ID NO: 1133224 - RNA, 19 nt, Homo sapiens
uguaaaaacuuucacugaa

SEQ ID NO: 1133225 - RNA, 19 nt, Homo sapiens
uguaaaccccaagaugaca

SEQ ID NO: 1133226 - RNA, 14 nt, Homo sapiens
uguaaagaugucag

SEQ ID NO: 1133227 - RNA, 17 nt, Homo sapiens
uguaaagcauccucuac

SEQ ID NO: 1133228 - RNA, 13 nt, Homo sapiens
uguaaagcuuuaa

SEQ ID NO: 1133229 - RNA, 13 nt, Homo sapiens
uguaaaguagcug

SEQ ID NO: 1133230 - RNA, 18 nt, Homo sapiens
uguaaauacacauagcau

SEQ ID NO: 1133231 - RNA, 17 nt, Homo sapiens
uguaaaucacauccuua

SEQ ID NO: 1133232 - RNA, 14 nt, Homo sapiens
uguaaaugcucaaa

SEQ ID NO: 1133233 - RNA, 16 nt, Homo sapiens
uguaaaugcucaaaga

SEQ ID NO: 1133234 - RNA, 13 nt, Homo sapiens
uguaaauguacug

SEQ ID NO: 1133235 - RNA, 16 nt, Homo sapiens
uguaaauucagucuuu

SEQ ID NO: 1133236 - RNA, 22 nt, Homo sapiens
uguaaauucuagcuuagucuac

SEQ ID NO: 1133237 - RNA, 19 nt, Homo sapiens
uguaaauuuaucaaugaug

SEQ ID NO: 1133238 - RNA, 17 nt, Homo sapiens
uguaacgaaacacuuca

SEQ ID NO: 1133239 - RNA, 14 nt, Homo sapiens
uguaacuauaccuc

SEQ ID NO: 1133240 - RNA, 19 nt, Homo sapiens
uguaacuugaaccuaugaa

SEQ ID NO: 1133241 - RNA, 14 nt, Homo sapiens
uguaagaaacacac

SEQ ID NO: 1133242 - RNA, 16 nt, Homo sapiens
uguaagaaagcauaga

SEQ ID NO: 1133243 - RNA, 17 nt, Homo sapiens
uguaagaaguuucuuaa

SEQ ID NO: 1133244 - RNA, 23 nt, Homo sapiens
uguaagaucguucucugccucac

SEQ ID NO: 1133245 - RNA, 16 nt, Homo sapiens
uguaaggaacuggaac

SEQ ID NO: 1133246 - RNA, 15 nt, Homo sapiens
uguaaggccuuucaa

SEQ ID NO: 1133247 - RNA, 14 nt, Homo sapiens
uguaaggugcuaca

SEQ ID NO: 1133248 - RNA, 15 nt, Homo sapiens
uguaagugggcccac

SEQ ID NO: 1133249 - RNA, 17 nt, Homo sapiens
uguaauaaaacauguuc

SEQ ID NO: 1133250 - RNA, 18 nt, Homo sapiens
uguaauaauaaaucgucc

SEQ ID NO: 1133251 - RNA, 16 nt, Homo sapiens
uguaauacuucaccuc

SEQ ID NO: 1133252 - RNA, 18 nt, Homo sapiens
uguaaucccagcacuuug

SEQ ID NO: 1133253 - RNA, 21 nt, Homo sapiens
uguaaucgcccuacuauucag

SEQ ID NO: 1133254 - RNA, 22 nt, Homo sapiens
uguaaugguaucuuaaagugug

SEQ ID NO: 1133255 - RNA, 22 nt, Homo sapiens
uguaauuucuuugccuguucag

SEQ ID NO: 1133256 - RNA, 18 nt, Homo sapiens
uguacaaaauaacucucc

SEQ ID NO: 1133257 - RNA, 12 nt, Homo sapiens
uguacaaagccc

SEQ ID NO: 1133258 - RNA, 20 nt, Homo sapiens
uguacaaggggccauuuggc

SEQ ID NO: 1133259 - RNA, 23 nt, Homo sapiens
uguacaagguauguacaguucau

SEQ ID NO: 1133260 - RNA, 14 nt, Homo sapiens
uguacaaguugaaa

SEQ ID NO: 1133261 - RNA, 21 nt, Homo sapiens
uguacaauaaaaacauugccu

SEQ ID NO: 1133262 - RNA, 20 nt, Homo sapiens
uguacaaugaacccccauga

SEQ ID NO: 1133263 - RNA, 22 nt, Homo sapiens
uguacacaacaccuaaaaccag

SEQ ID NO: 1133264 - RNA, 17 nt, Homo sapiens
uguacagacuucuuggu

SEQ ID NO: 1133265 - RNA, 15 nt, Homo sapiens
uguacagguguauau

SEQ ID NO: 1133266 - RNA, 13 nt, Homo sapiens
uguacaugguauu

SEQ ID NO: 1133267 - RNA, 20 nt, Homo sapiens
uguacauguguagccugugc

SEQ ID NO: 1133268 - RNA, 17 nt, Homo sapiens
uguacauuagucauuca

SEQ ID NO: 1133269 - RNA, 15 nt, Homo sapiens
uguaccagugaauuu

SEQ ID NO: 1133270 - RNA, 18 nt, Homo sapiens
uguacucaauggauuuga

SEQ ID NO: 1133271 - RNA, 18 nt, Homo sapiens
uguacuguuacuguguca

SEQ ID NO: 1133272 - RNA, 19 nt, Homo sapiens
uguacuguuacugugucag

SEQ ID NO: 1133273 - RNA, 10 nt, Homo sapiens
uguacuugau

SEQ ID NO: 1133274 - RNA, 18 nt, Homo sapiens
uguacuugccuuauuaga

SEQ ID NO: 1133275 - RNA, 21 nt, Homo sapiens
uguagaaagauacacugacuu

SEQ ID NO: 1133276 - RNA, 21 nt, Homo sapiens
uguagaagaagugaacacuua

SEQ ID NO: 1133277 - RNA, 17 nt, Homo sapiens
uguagacuuaacacuuc

SEQ ID NO: 1133278 - RNA, 22 nt, Homo sapiens
uguagagacgguguuuugccau

SEQ ID NO: 1133279 - RNA, 17 nt, Homo sapiens
uguagauaaacucagaa

SEQ ID NO: 1133280 - RNA, 19 nt, Homo sapiens
uguagauaaacucagaaau

SEQ ID NO: 1133281 - RNA, 17 nt, Homo sapiens
uguagauucacauacag

SEQ ID NO: 1133282 - RNA, 12 nt, Homo sapiens
uguagcaaagau

SEQ ID NO: 1133283 - RNA, 14 nt, Homo sapiens
uguaggcauuuuaa

SEQ ID NO: 1133284 - RNA, 22 nt, Homo sapiens
uguaguccagucucuccagcau

SEQ ID NO: 1133285 - RNA, 14 nt, Homo sapiens
uguaguuuguauua

SEQ ID NO: 1133286 - RNA, 18 nt, Homo sapiens
uguauaacuaggcuguua

SEQ ID NO: 1133287 - RNA, 15 nt, Homo sapiens
uguauaagcuacuca

SEQ ID NO: 1133288 - RNA, 16 nt, Homo sapiens
uguauaccaaggcaaa

SEQ ID NO: 1133289 - RNA, 15 nt, Homo sapiens
uguauaccagccuac

SEQ ID NO: 1133290 - RNA, 16 nt, Homo sapiens
uguauaccaugaugca

SEQ ID NO: 1133291 - RNA, 18 nt, Homo sapiens
uguauacugugugcuaaa

SEQ ID NO: 1133292 - RNA, 15 nt, Homo sapiens
uguauagaccuaaaa

SEQ ID NO: 1133293 - RNA, 19 nt, Homo sapiens
uguauauuuugaugagcuu

SEQ ID NO: 1133294 - RNA, 15 nt, Homo sapiens
uguaucaaaugugac

SEQ ID NO: 1133295 - RNA, 16 nt, Homo sapiens
uguaucaaaugugaca

SEQ ID NO: 1133296 - RNA, 18 nt, Homo sapiens
uguaucaaaugugacauu

SEQ ID NO: 1133297 - RNA, 16 nt, Homo sapiens
uguaucaugugcuaga

SEQ ID NO: 1133298 - RNA, 14 nt, Homo sapiens
uguauccagaggaa

SEQ ID NO: 1133299 - RNA, 20 nt, Homo sapiens
uguaucugaagaccuaccag

SEQ ID NO: 1133300 - RNA, 20 nt, Homo sapiens
uguaugcuggugaacaguca

SEQ ID NO: 1133301 - RNA, 21 nt, Homo sapiens
uguauggguuaaaucaaagau

SEQ ID NO: 1133302 - RNA, 14 nt, Homo sapiens
uguauuaaugcuau

SEQ ID NO: 1133303 - RNA, 15 nt, Homo sapiens
uguauucgugcauuu

SEQ ID NO: 1133304 - RNA, 13 nt, Homo sapiens
uguauugagcaag

SEQ ID NO: 1133305 - RNA, 20 nt, Homo sapiens
uguauuuggacuaugcaugu

SEQ ID NO: 1133306 - RNA, 17 nt, Homo sapiens
uguauuuuauuacaucu

SEQ ID NO: 1133307 - RNA, 21 nt, Homo sapiens
uguauuuuguguuccuaucaa

SEQ ID NO: 1133308 - RNA, 17 nt, Homo sapiens
ugucaaguauaaaguca

SEQ ID NO: 1133309 - RNA, 20 nt, Homo sapiens
ugucaaugugaacguccaca

SEQ ID NO: 1133310 - RNA, 13 nt, Homo sapiens
ugucacacucugu

SEQ ID NO: 1133311 - RNA, 12 nt, Homo sapiens
ugucacagggac

SEQ ID NO: 1133312 - RNA, 15 nt, Homo sapiens
ugucacccaaagccu

SEQ ID NO: 1133313 - RNA, 16 nt, Homo sapiens
ugucacuuugcuacag

SEQ ID NO: 1133314 - RNA, 13 nt, Homo sapiens
ugucagagcccag

SEQ ID NO: 1133315 - RNA, 20 nt, Homo sapiens
ugucagcaucugaccaucug

SEQ ID NO: 1133316 - RNA, 23 nt, Homo sapiens
ugucagcaugacaaaagugacag

SEQ ID NO: 1133317 - RNA, 12 nt, Homo sapiens
ugucagccugac

SEQ ID NO: 1133318 - RNA, 13 nt, Homo sapiens
ugucauaguucug

SEQ ID NO: 1133319 - RNA, 20 nt, Homo sapiens
ugucauuguuagaaaucccu

SEQ ID NO: 1133320 - RNA, 22 nt, Homo sapiens
ugucauuuuacaagcauuagau

SEQ ID NO: 1133321 - RNA, 20 nt, Homo sapiens
ugucauuuuggcaucugcaa

SEQ ID NO: 1133322 - RNA, 18 nt, Homo sapiens
uguccaaaacugccucag

SEQ ID NO: 1133323 - RNA, 18 nt, Homo sapiens
uguccaaacaggugcugg

SEQ ID NO: 1133324 - RNA, 14 nt, Homo sapiens
uguccacacauaca

SEQ ID NO: 1133325 - RNA, 14 nt, Homo sapiens
uguccagcaccuug

SEQ ID NO: 1133326 - RNA, 15 nt, Homo sapiens
uguccagcauggaug

SEQ ID NO: 1133327 - RNA, 17 nt, Homo sapiens
uguccaggcacugagau

SEQ ID NO: 1133328 - RNA, 19 nt, Homo sapiens
uguccaggcuggagugcaa

SEQ ID NO: 1133329 - RNA, 19 nt, Homo sapiens
uguccaucuuugugguuua

SEQ ID NO: 1133330 - RNA, 18 nt, Homo sapiens
uguccauguuggccucca

SEQ ID NO: 1133331 - RNA, 22 nt, Homo sapiens
uguccauuuacagcccucagca

SEQ ID NO: 1133332 - RNA, 18 nt, Homo sapiens
ugucccaaacaugcacuu

SEQ ID NO: 1133333 - RNA, 21 nt, Homo sapiens
ugucccacuaucugggugcau

SEQ ID NO: 1133334 - RNA, 19 nt, Homo sapiens
uguccccgccuucccucac

SEQ ID NO: 1133335 - RNA, 21 nt, Homo sapiens
uguccccuuuuauugcugcuu

SEQ ID NO: 1133336 - RNA, 18 nt, Homo sapiens
ugucccucacagcacuag

SEQ ID NO: 1133337 - RNA, 18 nt, Homo sapiens
ugucccuccuggugucac

SEQ ID NO: 1133338 - RNA, 17 nt, Homo sapiens
ugucccucuuccauccc

SEQ ID NO: 1133339 - RNA, 19 nt, Homo sapiens
ugcaaauccuaugugauuu

SEQ ID NO: 1133340 - RNA, 23 nt, Homo sapiens
ugcaaauuggcuaaagugcauuu

SEQ ID NO: 1133341 - RNA, 20 nt, Homo sapiens
ugcaacagccacuacauuac

SEQ ID NO: 1133342 - RNA, 13 nt, Homo sapiens
ugcaacagcuuuc

SEQ ID NO: 1133343 - RNA, 22 nt, Homo sapiens
ugcaaccuaccuguugagcauc

SEQ ID NO: 1133344 - RNA, 18 nt, Homo sapiens
ugcaaccucugcuuccca

SEQ ID NO: 1133345 - RNA, 12 nt, Homo sapiens
ugcaacuaggaa

SEQ ID NO: 1133346 - RNA, 19 nt, Homo sapiens
ugcaagaacucaucacugu

SEQ ID NO: 1133347 - RNA, 22 nt, Homo sapiens
ugcaagccuucuaaaugaguca

SEQ ID NO: 1133348 - RNA, 19 nt, Homo sapiens
ugcaagcgucugugcauuu

SEQ ID NO: 1133349 - RNA, 23 nt, Homo sapiens
ugcaagcuaaagccccucuauac

SEQ ID NO: 1133350 - RNA, 14 nt, Homo sapiens
ugcaaggggcucaa

SEQ ID NO: 1133351 - RNA, 20 nt, Homo sapiens
ugcaagguucaacuuauuaa

SEQ ID NO: 1133352 - RNA, 18 nt, Homo sapiens
ugcaauaaauuauggcuc

SEQ ID NO: 1133353 - RNA, 23 nt, Homo sapiens
ugcaauaccaaguauagccuaug

SEQ ID NO: 1133354 - RNA, 23 nt, Homo sapiens
ugcaauauguuuaucaacucaag

SEQ ID NO: 1133355 - RNA, 20 nt, Homo sapiens
ugcaauccagccugggcaac

SEQ ID NO: 1133356 - RNA, 21 nt, Homo sapiens
ugcaauccucccuaccguccu

SEQ ID NO: 1133357 - RNA, 12 nt, Homo sapiens
ugcaaucuucua

SEQ ID NO: 1133358 - RNA, 15 nt, Homo sapiens
ugcaaucuuugccaa

SEQ ID NO: 1133359 - RNA, 20 nt, Homo sapiens
ugcaaugacucaggacaucc

SEQ ID NO: 1133360 - RNA, 22 nt, Homo sapiens
ugagauauaucuuuauacuuaa

SEQ ID NO: 1133361 - RNA, 13 nt, Homo sapiens
ugagaucaugcca

SEQ ID NO: 1133362 - RNA, 19 nt, Homo sapiens
ugagauccggcaacaucaa

SEQ ID NO: 1133363 - RNA, 15 nt, Homo sapiens
ugagauccuuuaaau

SEQ ID NO: 1133364 - RNA, 23 nt, Homo sapiens
ugagauccuuuaaauccuuccau

SEQ ID NO: 1133365 - RNA, 13 nt, Homo sapiens
ugagaugaaggaa

SEQ ID NO: 1133366 - RNA, 23 nt, Homo sapiens
ugagaugaaggaaggacuaugac

SEQ ID NO: 1133367 - RNA, 16 nt, Homo sapiens
ugagauguaagucuca

SEQ ID NO: 1133368 - RNA, 12 nt, Homo sapiens
ugagcaacucuu

SEQ ID NO: 1133369 - RNA, 19 nt, Homo sapiens
ugagcaacucuugauuauc

SEQ ID NO: 1133370 - RNA, 22 nt, Homo sapiens
ugagcaauguauaaccccaaag

SEQ ID NO: 1133371 - RNA, 18 nt, Homo sapiens
ugagcacagcugcauuaa

SEQ ID NO: 1133372 - RNA, 15 nt, Homo sapiens
ugagcaccaggggau

SEQ ID NO: 1133373 - RNA, 17 nt, Homo sapiens
ugagcagaaugccuuau

SEQ ID NO: 1133374 - RNA, 15 nt, Homo sapiens
ugagcagacaggaca

SEQ ID NO: 1133375 - RNA, 19 nt, Homo sapiens
ugagcagacugcaaaucug

SEQ ID NO: 1133376 - RNA, 22 nt, Homo sapiens
ugagcauagagaacaaaguaaa

SEQ ID NO: 1133377 - RNA, 15 nt, Homo sapiens
ugagcaucuccagca

SEQ ID NO: 1133378 - RNA, 13 nt, Homo sapiens
ugagcaugugaug

SEQ ID NO: 1133379 - RNA, 16 nt, Homo sapiens
ugagccaguggugcua

SEQ ID NO: 1133380 - RNA, 22 nt, Homo sapiens
ugagcccagcugggucaggcag

SEQ ID NO: 1133381 - RNA, 13 nt, Homo sapiens
ugagcccucccca

SEQ ID NO: 1133382 - RNA, 21 nt, Homo sapiens
ugagccuguuuauugccauua

SEQ ID NO: 1133383 - RNA, 15 nt, Homo sapiens
ugagcgcaagccaca

SEQ ID NO: 1133384 - RNA, 23 nt, Homo sapiens
ugagcgcaagccacagccugucu

SEQ ID NO: 1133385 - RNA, 18 nt, Homo sapiens
ugagcuauugcuguucuc

SEQ ID NO: 1133386 - RNA, 23 nt, Homo sapiens
ugagcucugcucucagcagauuu

SEQ ID NO: 1133387 - RNA, 12 nt, Homo sapiens
ugagcuggugcc

SEQ ID NO: 1133388 - RNA, 16 nt, Homo sapiens
ugagcugucaucaaca

SEQ ID NO: 1133389 - RNA, 21 nt, Homo sapiens
ugaggaaaagcggacaucagc

SEQ ID NO: 1133390 - RNA, 15 nt, Homo sapiens
ugaggaaacaacagc

SEQ ID NO: 1133391 - RNA, 20 nt, Homo sapiens
ugaggaaauucggagcuaua

SEQ ID NO: 1133392 - RNA, 15 nt, Homo sapiens
ugaggaggaugcuaa

SEQ ID NO: 1133393 - RNA, 20 nt, Homo sapiens
ugaggaugauguuauucaca

SEQ ID NO: 1133394 - RNA, 20 nt, Homo sapiens
ugaggcacaagaaucacuug

SEQ ID NO: 1133395 - RNA, 22 nt, Homo sapiens
ugaggcacaagaaucacuugaa

SEQ ID NO: 1133396 - RNA, 23 nt, Homo sapiens
ugaggcacaagaaucacuugaac

SEQ ID NO: 1133397 - RNA, 13 nt, Homo sapiens
ugaggcaguucca

SEQ ID NO: 1133398 - RNA, 19 nt, Homo sapiens
ugaggcaguuccaggagua

SEQ ID NO: 1133399 - RNA, 23 nt, Homo sapiens
ugaggccacugcugcuucuccau

SEQ ID NO: 1133400 - RNA, 17 nt, Homo sapiens
ugaggccuuguguguca

SEQ ID NO: 1133401 - RNA, 22 nt, Homo sapiens
ugaggcuacagggaguguagua

SEQ ID NO: 1133402 - RNA, 22 nt, Homo sapiens
ugaggcugcuuuccaaagccaa

SEQ ID NO: 1133403 - RNA, 19 nt, Homo sapiens
ugagggagccuggccccau

SEQ ID NO: 1133404 - RNA, 17 nt, Homo sapiens
ugagggcaccaccaaga

SEQ ID NO: 1133405 - RNA, 15 nt, Homo sapiens
ugagggcagcacugg

SEQ ID NO: 1133406 - RNA, 17 nt, Homo sapiens
ugagggcagcacuggga

SEQ ID NO: 1133407 - RNA, 21 nt, Homo sapiens
ugaggguguuucuuccugcac

SEQ ID NO: 1133408 - RNA, 19 nt, Homo sapiens
ugaggucuuuuacauacag

SEQ ID NO: 1133409 - RNA, 19 nt, Homo sapiens
ugaggugcugaucuguggu

SEQ ID NO: 1133410 - RNA, 16 nt, Homo sapiens
ugagguggacucucac

SEQ ID NO: 1133411 - RNA, 23 nt, Homo sapiens
ugaggugggaaaaucacuugaac

SEQ ID NO: 1133412 - RNA, 17 nt, Homo sapiens
ugaggugggagaugugg

SEQ ID NO: 1133413 - RNA, 20 nt, Homo sapiens
ugagguuuccgggggaugaa

SEQ ID NO: 1133414 - RNA, 23 nt, Homo sapiens
ugagguuuccgggggaugaauga

SEQ ID NO: 1133415 - RNA, 17 nt, Homo sapiens
ugaguaauacaucaaag

SEQ ID NO: 1133416 - RNA, 12 nt, Homo sapiens
ugaguacuguua

SEQ ID NO: 1133417 - RNA, 14 nt, Homo sapiens
ugaguagacauugu

SEQ ID NO: 1133418 - RNA, 19 nt, Homo sapiens
ugaguuaugaguuauucau

SEQ ID NO: 1133419 - RNA, 15 nt, Homo sapiens
ugaguuccuagccac

SEQ ID NO: 1133420 - RNA, 18 nt, Homo sapiens
ugaguuucuuaacccuuu

SEQ ID NO: 1133421 - RNA, 15 nt, Homo sapiens
ugauaaaacacugcc

SEQ ID NO: 1133422 - RNA, 15 nt, Homo sapiens
ugauaaaauacuaaa

SEQ ID NO: 1133423 - RNA, 14 nt, Homo sapiens
ugauaaagccuaaa

SEQ ID NO: 1133424 - RNA, 19 nt, Homo sapiens
ugauaaguacuacauaccu

SEQ ID NO: 1133425 - RNA, 23 nt, Homo sapiens
ugauaaguucuuaugccauguua

SEQ ID NO: 1133426 - RNA, 20 nt, Homo sapiens
ugauaauagcacuaaugcuu

SEQ ID NO: 1133427 - RNA, 20 nt, Homo sapiens
ugauacaaacacuacagaca

SEQ ID NO: 1133428 - RNA, 14 nt, Homo sapiens
ugauacauauguga

SEQ ID NO: 1133429 - RNA, 14 nt, Homo sapiens
ugauaccauuuccu

SEQ ID NO: 1133430 - RNA, 21 nt, Homo sapiens
ugauacuuacugaacugugug

SEQ ID NO: 1133431 - RNA, 22 nt, Homo sapiens
ugauaguauuuucuacuagcca

SEQ ID NO: 1133432 - RNA, 12 nt, Homo sapiens
ugauagugcaag

SEQ ID NO: 1133433 - RNA, 12 nt, Homo sapiens
ugauagugcuuc

SEQ ID NO: 1133434 - RNA, 12 nt, Homo sapiens
ugauaugcauuu

SEQ ID NO: 1133435 - RNA, 12 nt, Homo sapiens
ugauauugcagc

SEQ ID NO: 1133436 - RNA, 22 nt, Homo sapiens
ugauauuuaacuuuuugccaaa

SEQ ID NO: 1133437 - RNA, 15 nt, Homo sapiens
ugauauuucuugcuu

SEQ ID NO: 1133438 - RNA, 18 nt, Homo sapiens
ugaucaaagccacacucu

SEQ ID NO: 1133439 - RNA, 17 nt, Homo sapiens
ugaucaguggacagucu

SEQ ID NO: 1133440 - RNA, 17 nt, Homo sapiens
ugauccuccaacagcug

SEQ ID NO: 1133441 - RNA, 22 nt, Homo sapiens
ugauccugacacauucugagua

SEQ ID NO: 1133442 - RNA, 20 nt, Homo sapiens
ugauccuggaggcccaguuc

SEQ ID NO: 1133443 - RNA, 15 nt, Homo sapiens
ugauccugggggacc

SEQ ID NO: 1133444 - RNA, 13 nt, Homo sapiens
ugaucgacguggu

SEQ ID NO: 1133445 - RNA, 15 nt, Homo sapiens
ugaucuacccgugcc

SEQ ID NO: 1133446 - RNA, 15 nt, Homo sapiens
ugaucuauacaaauu

SEQ ID NO: 1133447 - RNA, 14 nt, Homo sapiens
ugaucugagcaaaa

SEQ ID NO: 1133448 - RNA, 13 nt, Homo sapiens
ugaucugcacauu

SEQ ID NO: 1133449 - RNA, 17 nt, Homo sapiens
ugaucugccugccuugg

SEQ ID NO: 1133450 - RNA, 13 nt, Homo sapiens
ugaucuucagggc

SEQ ID NO: 1133451 - RNA, 12 nt, Homo sapiens
ugaucuugagca

SEQ ID NO: 1133452 - RNA, 14 nt, Homo sapiens
ugaucuuugcaaag

SEQ ID NO: 1133453 - RNA, 13 nt, Homo sapiens
ugaugaaggugaa

SEQ ID NO: 1133454 - RNA, 18 nt, Homo sapiens
ugaugaaugaggaacaau

SEQ ID NO: 1133455 - RNA, 14 nt, Homo sapiens
ugaugacuuacuau

SEQ ID NO: 1133456 - RNA, 14 nt, Homo sapiens
ugaugaugaugaua

SEQ ID NO: 1133457 - RNA, 12 nt, Homo sapiens
ugaugcuagcca

SEQ ID NO: 1133458 - RNA, 18 nt, Homo sapiens
ugauggaccagcccugag

SEQ ID NO: 1133459 - RNA, 19 nt, Homo sapiens
ugauggaccagcccugaga

SEQ ID NO: 1133460 - RNA, 17 nt, Homo sapiens
ugauggaugaugaaccu

SEQ ID NO: 1133461 - RNA, 13 nt, Homo sapiens
ugauggcacugag

SEQ ID NO: 1133462 - RNA, 15 nt, Homo sapiens
ugaugggaucuguaa

SEQ ID NO: 1133463 - RNA, 15 nt, Homo sapiens
ugauguaacauugua

SEQ ID NO: 1133464 - RNA, 21 nt, Homo sapiens
ugauguauaaaacuugauaaa

SEQ ID NO: 1133465 - RNA, 15 nt, Homo sapiens
ugauguauuuagcuu

SEQ ID NO: 1133466 - RNA, 23 nt, Homo sapiens
ugaugucauaagcgaucacuucc

SEQ ID NO: 1133467 - RNA, 14 nt, Homo sapiens
ugaugucuaugaua

SEQ ID NO: 1133468 - RNA, 15 nt, Homo sapiens
ugaugugcacugcau

SEQ ID NO: 1133469 - RNA, 17 nt, Homo sapiens
ugauguuaaccaaugua

SEQ ID NO: 1133470 - RNA, 12 nt, Homo sapiens
ugauguugucac

SEQ ID NO: 1133471 - RNA, 19 nt, Homo sapiens
ugauuacuaucauggcaua

SEQ ID NO: 1133472 - RNA, 20 nt, Homo sapiens
ugauuauagcaaugugauuu

SEQ ID NO: 1133473 - RNA, 20 nt, Homo sapiens
ugauucaggcuuauaacaaa

SEQ ID NO: 1133474 - RNA, 14 nt, Homo sapiens
ugauucaugucuca

SEQ ID NO: 1133475 - RNA, 15 nt, Homo sapiens
ugauucugcagguaa

SEQ ID NO: 1133476 - RNA, 23 nt, Homo sapiens
ugauucugcagguaaaagaccau

SEQ ID NO: 1133477 - RNA, 16 nt, Homo sapiens
ugauugggauuuccau

SEQ ID NO: 1133478 - RNA, 16 nt, Homo sapiens
ugauugugccuacgaa

SEQ ID NO: 1133479 - RNA, 19 nt, Homo sapiens
ugauuuaccucuuaccugu

SEQ ID NO: 1133480 - RNA, 20 nt, Homo sapiens
ugauuuauuaaauaaucucu

SEQ ID NO: 1133481 - RNA, 17 nt, Homo sapiens
ugauuugugcugagauc

SEQ ID NO: 1133482 - RNA, 16 nt, Homo sapiens
ugauuuuaacucuguc

SEQ ID NO: 1133483 - RNA, 22 nt, Homo sapiens
ugauuuuauuguacaaguugaa

SEQ ID NO: 1133484 - RNA, 22 nt, Homo sapiens
ugauuuuuaucuagaacauuca

SEQ ID NO: 1133485 - RNA, 15 nt, Homo sapiens
ugauuuuuuuccaca

SEQ ID NO: 1133486 - RNA, 16 nt, Homo sapiens
ugcaaaaaacucagag

SEQ ID NO: 1133487 - RNA, 14 nt, Homo sapiens
ugcaaaacauuuca

SEQ ID NO: 1133488 - RNA, 22 nt, Homo sapiens
ugcaaaaggacucucaggacca

SEQ ID NO: 1133489 - RNA, 20 nt, Homo sapiens
ugcaaaaguaaauguugaca

SEQ ID NO: 1133490 - RNA, 22 nt, Homo sapiens
ugcaaaauaaguuuuucuuuaa

SEQ ID NO: 1133491 - RNA, 13 nt, Homo sapiens
ugcaaacgcugcc

SEQ ID NO: 1133492 - RNA, 23 nt, Homo sapiens
ugcaaagucaaaacuauagccau

SEQ ID NO: 1133493 - RNA, 17 nt, Homo sapiens
ugcaaaucacucugcaa

SEQ ID NO: 1133494 - RNA, 23 nt, Homo sapiens
ugcaaaucagagcauacaaaaua

SEQ ID NO: 1133495 - RNA, 18 nt, Homo sapiens
ugaaggaaggacuaugac

SEQ ID NO: 1133496 - RNA, 15 nt, Homo sapiens
ugaaggcccaugaag

SEQ ID NO: 1133497 - RNA, 14 nt, Homo sapiens
ugaaggcuguccuu

SEQ ID NO: 1133498 - RNA, 13 nt, Homo sapiens
ugaaggggccaug

SEQ ID NO: 1133499 - RNA, 15 nt, Homo sapiens
ugaagguaacuauua

SEQ ID NO: 1133500 - RNA, 23 nt, Homo sapiens
ugaagguaacuauuagaauauaa

SEQ ID NO: 1133501 - RNA, 19 nt, Homo sapiens
ugaagguggaacaagcaca

SEQ ID NO: 1133502 - RNA, 23 nt, Homo sapiens
ugaaguaaugaauuuuuaugaua

SEQ ID NO: 1133503 - RNA, 14 nt, Homo sapiens
ugaaguacuuuuaa

SEQ ID NO: 1133504 - RNA, 20 nt, Homo sapiens
ugaagucaugaccuccaggg

SEQ ID NO: 1133505 - RNA, 18 nt, Homo sapiens
ugaaguccaggacugggu

SEQ ID NO: 1133506 - RNA, 19 nt, Homo sapiens
ugaaguccuggcuucaggc

SEQ ID NO: 1133507 - RNA, 11 nt, Homo sapiens
ugaagugaauu

SEQ ID NO: 1133508 - RNA, 15 nt, Homo sapiens
ugaagugaggacaaa

SEQ ID NO: 1133509 - RNA, 13 nt, Homo sapiens
ugaagugcugcuc

SEQ ID NO: 1133510 - RNA, 23 nt, Homo sapiens
ugaagugguuggcaacaggccaa

SEQ ID NO: 1133511 - RNA, 15 nt, Homo sapiens
ugaaguuuacaauca

SEQ ID NO: 1133512 - RNA, 16 nt, Homo sapiens
ugaauaaaccaagaca

SEQ ID NO: 1133513 - RNA, 19 nt, Homo sapiens
ugaauaaagggaacaugca

SEQ ID NO: 1133514 - RNA, 17 nt, Homo sapiens
ugaauacucuucccaca

SEQ ID NO: 1133515 - RNA, 20 nt, Homo sapiens
ugaauacuuacauucucuaa

SEQ ID NO: 1133516 - RNA, 16 nt, Homo sapiens
ugaaucaaaagugccu

SEQ ID NO: 1133517 - RNA, 13 nt, Homo sapiens
ugaaucagaguga

SEQ ID NO: 1133518 - RNA, 20 nt, Homo sapiens
ugaaucagagugcacaagca

SEQ ID NO: 1133519 - RNA, 14 nt, Homo sapiens
ugaaucaggggcaa

SEQ ID NO: 1133520 - RNA, 20 nt, Homo sapiens
ugaaucaggggcaaacggag

SEQ ID NO: 1133521 - RNA, 21 nt, Homo sapiens
ugaaucaucauaucuacuaua

SEQ ID NO: 1133522 - RNA, 13 nt, Homo sapiens
ugaauccuacaua

SEQ ID NO: 1133523 - RNA, 14 nt, Homo sapiens
ugaauccuacauac

SEQ ID NO: 1133524 - RNA, 14 nt, Homo sapiens
ugaaucuacauuug

SEQ ID NO: 1133525 - RNA, 16 nt, Homo sapiens
ugaauucuaaaccaau

SEQ ID NO: 1133526 - RNA, 19 nt, Homo sapiens
ugaauucucugcucaguga

SEQ ID NO: 1133527 - RNA, 19 nt, Homo sapiens
ugaauuguuacaucaugcu

SEQ ID NO: 1133528 - RNA, 22 nt, Homo sapiens
ugaauuuaaaaauaaauaccaa

SEQ ID NO: 1133529 - RNA, 20 nt, Homo sapiens
ugaauuucaaacauuuguca

SEQ ID NO: 1133530 - RNA, 23 nt, Homo sapiens
ugaauuugagauacaaacauguu

SEQ ID NO: 1133531 - RNA, 19 nt, Homo sapiens
ugaauuugcaaaguacugu

SEQ ID NO: 1133532 - RNA, 13 nt, Homo sapiens
ugaauuugcaugu

SEQ ID NO: 1133533 - RNA, 21 nt, Homo sapiens
ugaauuuucaaguaauuguga

SEQ ID NO: 1133534 - RNA, 15 nt, Homo sapiens
ugaauuuuugcacau

SEQ ID NO: 1133535 - RNA, 13 nt, Homo sapiens
ugacaaccaaaag

SEQ ID NO: 1133536 - RNA, 21 nt, Homo sapiens
ugacaaccgagaagguuuauc

SEQ ID NO: 1133537 - RNA, 19 nt, Homo sapiens
ugacaacgccaacugccca

SEQ ID NO: 1133538 - RNA, 18 nt, Homo sapiens
ugacaauacugcugccuu

SEQ ID NO: 1133539 - RNA, 16 nt, Homo sapiens
ugacaauagagggcca

SEQ ID NO: 1133540 - RNA, 20 nt, Homo sapiens
ugacaaugguguuauuugaa

SEQ ID NO: 1133541 - RNA, 13 nt, Homo sapiens
ugacacagucuug

SEQ ID NO: 1133542 - RNA, 14 nt, Homo sapiens
ugacacauaugcac

SEQ ID NO: 1133543 - RNA, 14 nt, Homo sapiens
ugacaccuuucaua

SEQ ID NO: 1133544 - RNA, 18 nt, Homo sapiens
ugacagaagcuucugccc

SEQ ID NO: 1133545 - RNA, 19 nt, Homo sapiens
ugacagaucaagcugugag

SEQ ID NO: 1133546 - RNA, 20 nt, Homo sapiens
ugacagcaggagcagugaua

SEQ ID NO: 1133547 - RNA, 21 nt, Homo sapiens
ugacagcaggagcagugauag

SEQ ID NO: 1133548 - RNA, 15 nt, Homo sapiens
ugacagcuucuacuu

SEQ ID NO: 1133549 - RNA, 18 nt, Homo sapiens
ugacaggcagccuggaca

SEQ ID NO: 1133550 - RNA, 12 nt, Homo sapiens
ugacaguagcau

SEQ ID NO: 1133551 - RNA, 20 nt, Homo sapiens
ugacaguggaacuacauuag

SEQ ID NO: 1133552 - RNA, 17 nt, Homo sapiens
ugacaguugcagcccuu

SEQ ID NO: 1133553 - RNA, 15 nt, Homo sapiens
ugacauaauuuacau

SEQ ID NO: 1133554 - RNA, 19 nt, Homo sapiens
ugacauaauuuacaugcaa

SEQ ID NO: 1133555 - RNA, 14 nt, Homo sapiens
ugacauagccucau

SEQ ID NO: 1133556 - RNA, 13 nt, Homo sapiens
ugacauauuuaau

SEQ ID NO: 1133557 - RNA, 22 nt, Homo sapiens
ugacaucaugaggccggaugaa

SEQ ID NO: 1133558 - RNA, 19 nt, Homo sapiens
ugacaucucuuugauguca

SEQ ID NO: 1133559 - RNA, 19 nt, Homo sapiens
ugacauggacacaucagga

SEQ ID NO: 1133560 - RNA, 15 nt, Homo sapiens
ugacaugucucacag

SEQ ID NO: 1133561 - RNA, 22 nt, Homo sapiens
ugacauucugauucgaaugaca

SEQ ID NO: 1133562 - RNA, 23 nt, Homo sapiens
ugacauugcguuugaccuuuuau

SEQ ID NO: 1133563 - RNA, 14 nt, Homo sapiens
ugacauugugucag

SEQ ID NO: 1133564 - RNA, 23 nt, Homo sapiens
ugacauuuaccagcaacuugaac

SEQ ID NO: 1133565 - RNA, 16 nt, Homo sapiens
ugacauuuuuccucuc

SEQ ID NO: 1133566 - RNA, 17 nt, Homo sapiens
ugaccaaagagcccuca

SEQ ID NO: 1133567 - RNA, 14 nt, Homo sapiens
ugaccaacaguucc

SEQ ID NO: 1133568 - RNA, 13 nt, Homo sapiens
ugaccagugcagu

SEQ ID NO: 1133569 - RNA, 14 nt, Homo sapiens
ugaccagugcaguu

SEQ ID NO: 1133570 - RNA, 14 nt, Homo sapiens
ugaccagugcugcu

SEQ ID NO: 1133571 - RNA, 14 nt, Homo sapiens
ugaccaucugugac

SEQ ID NO: 1133572 - RNA, 15 nt, Homo sapiens
ugaccaucugugacu

SEQ ID NO: 1133573 - RNA, 14 nt, Homo sapiens
ugacccaaugauuc

SEQ ID NO: 1133574 - RNA, 16 nt, Homo sapiens
ugacccucucacuuug

SEQ ID NO: 1133575 - RNA, 18 nt, Homo sapiens
ugacccuguaaaauggag

SEQ ID NO: 1133576 - RNA, 18 nt, Homo sapiens
ugacccuucuccaaaggc

SEQ ID NO: 1133577 - RNA, 22 nt, Homo sapiens
ugaccgggcucacuugcucaaa

SEQ ID NO: 1133578 - RNA, 20 nt, Homo sapiens
ugaccucaagugaucugccc

SEQ ID NO: 1133579 - RNA, 20 nt, Homo sapiens
ugaccucagcgguugccagg

SEQ ID NO: 1133580 - RNA, 21 nt, Homo sapiens
ugaccucagggcuauguggau

SEQ ID NO: 1133581 - RNA, 13 nt, Homo sapiens
ugaccuccacagc

SEQ ID NO: 1133582 - RNA, 14 nt, Homo sapiens
ugaccugagccaga

SEQ ID NO: 1133583 - RNA, 19 nt, Homo sapiens
ugaccugaggaagcgugaa

SEQ ID NO: 1133584 - RNA, 19 nt, Homo sapiens
ugaccugguccacagggca

SEQ ID NO: 1133585 - RNA, 17 nt, Homo sapiens
ugaccuuccaagagccu

SEQ ID NO: 1133586 - RNA, 21 nt, Homo sapiens
ugaccuuguaaaagacagugu

SEQ ID NO: 1133587 - RNA, 16 nt, Homo sapiens
ugacggguugugagac

SEQ ID NO: 1133588 - RNA, 12 nt, Homo sapiens
ugacuaaccauu

SEQ ID NO: 1133589 - RNA, 18 nt, Homo sapiens
ugacuaaucuuugcugaa

SEQ ID NO: 1133590 - RNA, 19 nt, Homo sapiens
ugacucaaaaaugagguac

SEQ ID NO: 1133591 - RNA, 21 nt, Homo sapiens
ugacuccaggaaccauuuuca

SEQ ID NO: 1133592 - RNA, 16 nt, Homo sapiens
ugacucgggccuuaga

SEQ ID NO: 1133593 - RNA, 12 nt, Homo sapiens
ugacucuagcaa

SEQ ID NO: 1133594 - RNA, 22 nt, Homo sapiens
ugacucuuccauucaguuuuau

SEQ ID NO: 1133595 - RNA, 15 nt, Homo sapiens
ugacugcguaggcaa

SEQ ID NO: 1133596 - RNA, 11 nt, Homo sapiens
ugacuggugcu

SEQ ID NO: 1133597 - RNA, 22 nt, Homo sapiens
ugacuguggccaugguccccaa

SEQ ID NO: 1133598 - RNA, 15 nt, Homo sapiens
ugacuuaaggugaag

SEQ ID NO: 1133599 - RNA, 15 nt, Homo sapiens
ugacuuaaucucauu

SEQ ID NO: 1133600 - RNA, 15 nt, Homo sapiens
ugacuuccacaccua

SEQ ID NO: 1133601 - RNA, 12 nt, Homo sapiens
ugacuuguucau

SEQ ID NO: 1133602 - RNA, 17 nt, Homo sapiens
ugacuuuagaaagcuga

SEQ ID NO: 1133603 - RNA, 15 nt, Homo sapiens
ugacuuuuaauguca

SEQ ID NO: 1133604 - RNA, 21 nt, Homo sapiens
ugagaaaaggcuuucuuuauc

SEQ ID NO: 1133605 - RNA, 18 nt, Homo sapiens
ugagaaaccuguaucuuu

SEQ ID NO: 1133606 - RNA, 17 nt, Homo sapiens
ugagaaagaaacuaaua

SEQ ID NO: 1133607 - RNA, 12 nt, Homo sapiens
ugagaaagccaa

SEQ ID NO: 1133608 - RNA, 12 nt, Homo sapiens
ugagaaagccuu

SEQ ID NO: 1133609 - RNA, 20 nt, Homo sapiens
ugagaaauauggacacuuaa

SEQ ID NO: 1133610 - RNA, 24 nt, Homo sapiens
ugagaaauuccacccacguggaga

SEQ ID NO: 1133611 - RNA, 14 nt, Homo sapiens
ugagaaauuuacua

SEQ ID NO: 1133612 - RNA, 18 nt, Homo sapiens
ugagaacugguucuugcc

SEQ ID NO: 1133613 - RNA, 23 nt, Homo sapiens
ugagacaggagaaacacuugaac

SEQ ID NO: 1133614 - RNA, 21 nt, Homo sapiens
ugagacaggaggauugccuga

SEQ ID NO: 1133615 - RNA, 22 nt, Homo sapiens
ugagacaguuuacuuugccaac

SEQ ID NO: 1133616 - RNA, 16 nt, Homo sapiens
ugagaccaggggacca

SEQ ID NO: 1133617 - RNA, 19 nt, Homo sapiens
ugagaccaggggaccagag

SEQ ID NO: 1133618 - RNA, 19 nt, Homo sapiens
ugagaccuuggcgcuacaa

SEQ ID NO: 1133619 - RNA, 22 nt, Homo sapiens
ugagacuacaagugugugccac

SEQ ID NO: 1133620 - RNA, 13 nt, Homo sapiens
ugagacuacaggu

SEQ ID NO: 1133621 - RNA, 14 nt, Homo sapiens
ugagacuugccuuc

SEQ ID NO: 1133622 - RNA, 21 nt, Homo sapiens
ugagagaaaauacuauuucaa

SEQ ID NO: 1133623 - RNA, 13 nt, Homo sapiens
ugagagaaccuca

SEQ ID NO: 1133624 - RNA, 21 nt, Homo sapiens
ugagagagagaaccuuuccac

SEQ ID NO: 1133625 - RNA, 19 nt, Homo sapiens
ugagagcugcuuugaggca

SEQ ID NO: 1133626 - RNA, 14 nt, Homo sapiens
ugagaggcaaugau

SEQ ID NO: 1133627 - RNA, 19 nt, Homo sapiens
ugagagggcugcugaccau

SEQ ID NO: 1133628 - RNA, 18 nt, Homo sapiens
ugagagugagguggaauu

SEQ ID NO: 1133629 - RNA, 18 nt, Homo sapiens
ugagaguugcuuccaguc

SEQ ID NO: 1133630 - RNA, 14 nt, Homo sapiens
ucuuggcucugaga

SEQ ID NO: 1133631 - RNA, 17 nt, Homo sapiens
ucuuggcuuaaucauuu

SEQ ID NO: 1133632 - RNA, 18 nt, Homo sapiens
ucuuggggcccagugcau

SEQ ID NO: 1133633 - RNA, 18 nt, Homo sapiens
ucuuggguucaagugauu

SEQ ID NO: 1133634 - RNA, 15 nt, Homo sapiens
ucuuggucacauaca

SEQ ID NO: 1133635 - RNA, 14 nt, Homo sapiens
ucuugguuccagcc

SEQ ID NO: 1133636 - RNA, 14 nt, Homo sapiens
ucuugguugccagu

SEQ ID NO: 1133637 - RNA, 14 nt, Homo sapiens
ucuugguuuccaaa

SEQ ID NO: 1133638 - RNA, 24 nt, Homo sapiens
ucuuguagguuccaucaaugguga

SEQ ID NO: 1133639 - RNA, 20 nt, Homo sapiens
ucuuguauaagauccuagau

SEQ ID NO: 1133640 - RNA, 13 nt, Homo sapiens
ucuugucucuggu

SEQ ID NO: 1133641 - RNA, 17 nt, Homo sapiens
ucuuguuuaaaaaaaga

SEQ ID NO: 1133642 - RNA, 18 nt, Homo sapiens
ucuuguuucuaacaagga

SEQ ID NO: 1133643 - RNA, 18 nt, Homo sapiens
ucuuguuugucagcaucu

SEQ ID NO: 1133644 - RNA, 23 nt, Homo sapiens
ucuuguuuucaaagggacuuuug

SEQ ID NO: 1133645 - RNA, 16 nt, Homo sapiens
ucuuguuuucagaaaa

SEQ ID NO: 1133646 - RNA, 21 nt, Homo sapiens
ucuuuaaagcaggauuucuca

SEQ ID NO: 1133647 - RNA, 18 nt, Homo sapiens
ucuuuaaaggcaucuaca

SEQ ID NO: 1133648 - RNA, 18 nt, Homo sapiens
ucuuuaaauuucaucuca

SEQ ID NO: 1133649 - RNA, 13 nt, Homo sapiens
ucuuuaacacagc

SEQ ID NO: 1133650 - RNA, 14 nt, Homo sapiens
ucuuuaagaugugu

SEQ ID NO: 1133651 - RNA, 12 nt, Homo sapiens
ucuuuacuccuc

SEQ ID NO: 1133652 - RNA, 14 nt, Homo sapiens
ucuuuauacuuaaa

SEQ ID NO: 1133653 - RNA, 21 nt, Homo sapiens
ucuuuauacuuaaacagcuuu

SEQ ID NO: 1133654 - RNA, 20 nt, Homo sapiens
ucuuuauauggccucaagau

SEQ ID NO: 1133655 - RNA, 16 nt, Homo sapiens
ucuuuaucauugcuaa

SEQ ID NO: 1133656 - RNA, 22 nt, Homo sapiens
ucuuucauucucucuuccugca

SEQ ID NO: 1133657 - RNA, 21 nt, Homo sapiens
ucuuuccacuccuccuagcca

SEQ ID NO: 1133658 - RNA, 13 nt, Homo sapiens
ucuuucccaacac

SEQ ID NO: 1133659 - RNA, 18 nt, Homo sapiens
ucuuucuaacuccaguga

SEQ ID NO: 1133660 - RNA, 13 nt, Homo sapiens
ucuuucuguaaac

SEQ ID NO: 1133661 - RNA, 16 nt, Homo sapiens
ucuuucuucuauguga

SEQ ID NO: 1133662 - RNA, 19 nt, Homo sapiens
ucuuugauuuaacugacuu

SEQ ID NO: 1133663 - RNA, 15 nt, Homo sapiens
ucuuuggcgaccucc

SEQ ID NO: 1133664 - RNA, 19 nt, Homo sapiens
ucuuugucagcaguucccu

SEQ ID NO: 1133665 - RNA, 20 nt, Homo sapiens
ucuuugucccaccaacuuaa

SEQ ID NO: 1133666 - RNA, 22 nt, Homo sapiens
ucuuuuacccggcacauucccc

SEQ ID NO: 1133667 - RNA, 19 nt, Homo sapiens
ucuuuucauaucucuugcc

SEQ ID NO: 1133668 - RNA, 14 nt, Homo sapiens
ucuuuuccccucau

SEQ ID NO: 1133669 - RNA, 22 nt, Homo sapiens
ucuuuuccccucauugcauuua

SEQ ID NO: 1133670 - RNA, 15 nt, Homo sapiens
ucuuuuccugucccu

SEQ ID NO: 1133671 - RNA, 15 nt, Homo sapiens
gccucgcucuugucu

SEQ ID NO: 1133672 - RNA, 20 nt, Homo sapiens
gccucgggacaucaaaaaca

SEQ ID NO: 1133673 - RNA, 13 nt, Homo sapiens
gccucgugccagc

SEQ ID NO: 1133674 - RNA, 14 nt, Homo sapiens
gccucuaacucccu

SEQ ID NO: 1133675 - RNA, 13 nt, Homo sapiens
gccucuacuuuau

SEQ ID NO: 1133676 - RNA, 14 nt, Homo sapiens
gccucuacuuugau

SEQ ID NO: 1133677 - RNA, 22 nt, Homo sapiens
gccucugcagucgcuugccaaa

SEQ ID NO: 1133678 - RNA, 13 nt, Homo sapiens
gccucuugcaaug

SEQ ID NO: 1133679 - RNA, 13 nt, Homo sapiens
gccucuuggcagu

SEQ ID NO: 1133680 - RNA, 14 nt, Homo sapiens
gccucuuuguucca

SEQ ID NO: 1133681 - RNA, 17 nt, Homo sapiens
gccugaagccaggccau

SEQ ID NO: 1133682 - RNA, 19 nt, Homo sapiens
gccugaauaaaccaagaca

SEQ ID NO: 1133683 - RNA, 12 nt, Homo sapiens
gccugaccucca

SEQ ID NO: 1133684 - RNA, 19 nt, Homo sapiens
gccugagacacagcccuga

SEQ ID NO: 1133685 - RNA, 19 nt, Homo sapiens
gccugaggucaauggugca

SEQ ID NO: 1133686 - RNA, 23 nt, Homo sapiens
gccugaggugugugccacucaga

SEQ ID NO: 1133687 - RNA, 21 nt, Homo sapiens
gccugagguuugccagcauuu

SEQ ID NO: 1133688 - RNA, 13 nt, Homo sapiens
gccugagucaccu

SEQ ID NO: 1133689 - RNA, 15 nt, Homo sapiens
gccugagucagcacc

SEQ ID NO: 1133690 - RNA, 22 nt, Homo sapiens
gccugaguuggcguugugggca

SEQ ID NO: 1133691 - RNA, 14 nt, Homo sapiens
gccugaugcugaca

SEQ ID NO: 1133692 - RNA, 18 nt, Homo sapiens
gccugcaucaccaccuca

SEQ ID NO: 1133693 - RNA, 18 nt, Homo sapiens
gccugccgguaaacacgc

SEQ ID NO: 1133694 - RNA, 14 nt, Homo sapiens
gccugccuucucag

SEQ ID NO: 1133695 - RNA, 16 nt, Homo sapiens
gccugccuucucaggg

SEQ ID NO: 1133696 - RNA, 22 nt, Homo sapiens
gccugccuucucagggacuucu

SEQ ID NO: 1133697 - RNA, 15 nt, Homo sapiens
gccugccuuuucuag

SEQ ID NO: 1133698 - RNA, 15 nt, Homo sapiens
gccuggaacaccagc

SEQ ID NO: 1133699 - RNA, 14 nt, Homo sapiens
gccuggacacagag

SEQ ID NO: 1133700 - RNA, 23 nt, Homo sapiens
gccuggacuagagggaccucucc

SEQ ID NO: 1133701 - RNA, 17 nt, Homo sapiens
gccuggagccccacugc

SEQ ID NO: 1133702 - RNA, 20 nt, Homo sapiens
gccuggauuuaucauugggu

SEQ ID NO: 1133703 - RNA, 15 nt, Homo sapiens
gccuggcaucugugc

SEQ ID NO: 1133704 - RNA, 15 nt, Homo sapiens
gccuggcaucugugu

SEQ ID NO: 1133705 - RNA, 21 nt, Homo sapiens
gccuggcaucugugugcgugg

SEQ ID NO: 1133706 - RNA, 21 nt, Homo sapiens
gccugggaccucccacugccc

SEQ ID NO: 1133707 - RNA, 18 nt, Homo sapiens
gccugggaguguguggug

SEQ ID NO: 1133708 - RNA, 17 nt, Homo sapiens
gccugguacucaagccc

SEQ ID NO: 1133709 - RNA, 17 nt, Homo sapiens
gccuggucccugguccu

SEQ ID NO: 1133710 - RNA, 20 nt, Homo sapiens
gccuguaaucccagaacuuu

SEQ ID NO: 1133711 - RNA, 22 nt, Homo sapiens
gccuguaaucccagcacuuugg

SEQ ID NO: 1133712 - RNA, 19 nt, Homo sapiens
gccuguacagucugucuuc

SEQ ID NO: 1133713 - RNA, 19 nt, Homo sapiens
gccuguccaacauggugaa

SEQ ID NO: 1133714 - RNA, 21 nt, Homo sapiens
gccugucccaggacucacccu

SEQ ID NO: 1133715 - RNA, 21 nt, Homo sapiens
gccugucucuuuccacuuugu

SEQ ID NO: 1133716 - RNA, 18 nt, Homo sapiens
gccugucuguuacacugg

SEQ ID NO: 1133717 - RNA, 22 nt, Homo sapiens
gccuguguggaggccucaggga

SEQ ID NO: 1133718 - RNA, 20 nt, Homo sapiens
gccuguugaagaugcuugua

SEQ ID NO: 1133719 - RNA, 21 nt, Homo sapiens
gccuuaaguggcagaauauaa

SEQ ID NO: 1133720 - RNA, 22 nt, Homo sapiens
gccuuaccuccugcccaggaga

SEQ ID NO: 1133721 - RNA, 12 nt, Homo sapiens
gccuuacuguug

SEQ ID NO: 1133722 - RNA, 21 nt, Homo sapiens
gccuuagccgcccaugcacug

SEQ ID NO: 1133723 - RNA, 21 nt, Homo sapiens
gccuuaggaaaagcauuugcu

SEQ ID NO: 1133724 - RNA, 14 nt, Homo sapiens
gccuucauucugca

SEQ ID NO: 1133725 - RNA, 18 nt, Homo sapiens
gccuucccaggaguacac

SEQ ID NO: 1133726 - RNA, 12 nt, Homo sapiens
gccuuccugacc

SEQ ID NO: 1133727 - RNA, 18 nt, Homo sapiens
gccuuccugccaggagcu

SEQ ID NO: 1133728 - RNA, 15 nt, Homo sapiens
gccuucucaccagcu

SEQ ID NO: 1133729 - RNA, 12 nt, Homo sapiens
gccuucucaggg

SEQ ID NO: 1133730 - RNA, 13 nt, Homo sapiens
gccuucucaggga

SEQ ID NO: 1133731 - RNA, 21 nt, Homo sapiens
gcucgacugcucaaccucacc

SEQ ID NO: 1133732 - RNA, 14 nt, Homo sapiens
gcucgcccaggaag

SEQ ID NO: 1133733 - RNA, 21 nt, Homo sapiens
gcucuauauaugaagugaaaa

SEQ ID NO: 1133734 - RNA, 15 nt, Homo sapiens
gcucuauguuuacaa

SEQ ID NO: 1133735 - RNA, 15 nt, Homo sapiens
gcucuccauucaauu

SEQ ID NO: 1133736 - RNA, 14 nt, Homo sapiens
gcucucgacaguau

SEQ ID NO: 1133737 - RNA, 21 nt, Homo sapiens
gcucucugugucugagagcaa

SEQ ID NO: 1133738 - RNA, 18 nt, Homo sapiens
gcucucuugugacgugca

SEQ ID NO: 1133739 - RNA, 19 nt, Homo sapiens
gcucugagaaaccucggga

SEQ ID NO: 1133740 - RNA, 22 nt, Homo sapiens
gcucugauugcuuuauccaaaa

SEQ ID NO: 1133741 - RNA, 21 nt, Homo sapiens
gcucugcgccgagccucagaa

SEQ ID NO: 1133742 - RNA, 14 nt, Homo sapiens
gcucugugccuugg

SEQ ID NO: 1133743 - RNA, 14 nt, Homo sapiens
gcucuuacucccuc

SEQ ID NO: 1133744 - RNA, 13 nt, Homo sapiens
gcucuuauuauau

SEQ ID NO: 1133745 - RNA, 16 nt, Homo sapiens
gcucuuccaggagcca

SEQ ID NO: 1133746 - RNA, 13 nt, Homo sapiens
gcucuugcucaag

SEQ ID NO: 1133747 - RNA, 10 nt, Homo sapiens
gcucuugucc

SEQ ID NO: 1133748 - RNA, 17 nt, Homo sapiens
gcucuuuuauacuguac

SEQ ID NO: 1133749 - RNA, 20 nt, Homo sapiens
gcugaaauacugucuaucuc

SEQ ID NO: 1133750 - RNA, 14 nt, Homo sapiens
gcugaagcagguuc

SEQ ID NO: 1133751 - RNA, 13 nt, Homo sapiens
gcugaagccaaac

SEQ ID NO: 1133752 - RNA, 13 nt, Homo sapiens
gcugaauucucug

SEQ ID NO: 1133753 - RNA, 15 nt, Homo sapiens
gcugacaucuguaaa

SEQ ID NO: 1133754 - RNA, 20 nt, Homo sapiens
gcugaccacagcacagccaa

SEQ ID NO: 1133755 - RNA, 17 nt, Homo sapiens
gcugagaucgugccacu

SEQ ID NO: 1133756 - RNA, 20 nt, Homo sapiens
gcugagaucgugccacugca

SEQ ID NO: 1133757 - RNA, 16 nt, Homo sapiens
gcugagcaccagggga

SEQ ID NO: 1133758 - RNA, 16 nt, Homo sapiens
gcugaggacacucagu

SEQ ID NO: 1133759 - RNA, 16 nt, Homo sapiens
gcugaggcaagagaau

SEQ ID NO: 1133760 - RNA, 15 nt, Homo sapiens
gcugagggucuggga

SEQ ID NO: 1133761 - RNA, 15 nt, Homo sapiens
gcugauuauucacua

SEQ ID NO: 1133762 - RNA, 12 nt, Homo sapiens
gcugcaaccucc

SEQ ID NO: 1133763 - RNA, 18 nt, Homo sapiens
gcugcagcgcuuguuaau

SEQ ID NO: 1133764 - RNA, 20 nt, Homo sapiens
gcugcauccaggacugugcc

SEQ ID NO: 1133765 - RNA, 14 nt, Homo sapiens
gcugccacugggca

SEQ ID NO: 1133766 - RNA, 16 nt, Homo sapiens
gcugccagggcuuccu

SEQ ID NO: 1133767 - RNA, 15 nt, Homo sapiens
gcugccauccaugug

SEQ ID NO: 1133768 - RNA, 18 nt, Homo sapiens
gcugccauccaugugcua

SEQ ID NO: 1133769 - RNA, 19 nt, Homo sapiens
gcugccccuggcaccugug

SEQ ID NO: 1133770 - RNA, 21 nt, Homo sapiens
gcugccugccgguaaacacgc

SEQ ID NO: 1133771 - RNA, 15 nt, Homo sapiens
gcugcucagagccaa

SEQ ID NO: 1133772 - RNA, 16 nt, Homo sapiens
gcugcucagagccaag

SEQ ID NO: 1133773 - RNA, 13 nt, Homo sapiens
gcugcucuuccca

SEQ ID NO: 1133774 - RNA, 15 nt, Homo sapiens
gcugcuggugcacag

SEQ ID NO: 1133775 - RNA, 19 nt, Homo sapiens
gcugcuuuccaaagccaau

SEQ ID NO: 1133776 - RNA, 23 nt, Homo sapiens
gcuggaaaaccuccuuuaccaga

SEQ ID NO: 1133777 - RNA, 20 nt, Homo sapiens
gcuggaaaagggucuuggga

SEQ ID NO: 1133778 - RNA, 18 nt, Homo sapiens
gcuggaaccugcaaaaaa

SEQ ID NO: 1133779 - RNA, 19 nt, Homo sapiens
gcuggaauuacaaaacuca

SEQ ID NO: 1133780 - RNA, 23 nt, Homo sapiens
gcuggaauuacaaaacucagaga

SEQ ID NO: 1133781 - RNA, 15 nt, Homo sapiens
gcuggacgugcgcga

SEQ ID NO: 1133782 - RNA, 20 nt, Homo sapiens
gcuggagggcaguggcacga

SEQ ID NO: 1133783 - RNA, 18 nt, Homo sapiens
gcuggaguacaguggugu

SEQ ID NO: 1133784 - RNA, 17 nt, Homo sapiens
gcuggagucaugugccu

SEQ ID NO: 1133785 - RNA, 20 nt, Homo sapiens
gcuggagugcagugguguga

SEQ ID NO: 1133786 - RNA, 15 nt, Homo sapiens
gcuggaugauggucu

SEQ ID NO: 1133787 - RNA, 18 nt, Homo sapiens
gcuggcaagauaaacacu

SEQ ID NO: 1133788 - RNA, 14 nt, Homo sapiens
gcuggcugcagcgg

SEQ ID NO: 1133789 - RNA, 23 nt, Homo sapiens
gcugggauuacaggcaugugcca

SEQ ID NO: 1133790 - RNA, 19 nt, Homo sapiens
gcugggauuacagguguga

SEQ ID NO: 1133791 - RNA, 23 nt, Homo sapiens
gcugggcaugguggcucaugccu

SEQ ID NO: 1133792 - RNA, 21 nt, Homo sapiens
gcugggccaccagccacuuua

SEQ ID NO: 1133793 - RNA, 20 nt, Homo sapiens
gcugggggagggacugcuga

SEQ ID NO: 1133794 - RNA, 22 nt, Homo sapiens
gcugguauucucucuaugcaaa

SEQ ID NO: 1133795 - RNA, 19 nt, Homo sapiens
gcuggucacucugcccucu

SEQ ID NO: 1133796 - RNA, 22 nt, Homo sapiens
gcuggucccggggccagcacuu

SEQ ID NO: 1133797 - RNA, 20 nt, Homo sapiens
gcuguauuccuuuauacaaa

SEQ ID NO: 1133798 - RNA, 20 nt, Homo sapiens
gcugucaguaugacauuuca

SEQ ID NO: 1133799 - RNA, 21 nt, Homo sapiens
gcugucaucugugcacugccc

SEQ ID NO: 1133800 - RNA, 18 nt, Homo sapiens
gcugucaugagugaugcc

SEQ ID NO: 1133801 - RNA, 15 nt, Homo sapiens
gcugucccugcacug

SEQ ID NO: 1133802 - RNA, 19 nt, Homo sapiens
gcugucccuugcuugccug

SEQ ID NO: 1133803 - RNA, 23 nt, Homo sapiens
gcugugccuggccuccgaugccu

SEQ ID NO: 1133804 - RNA, 14 nt, Homo sapiens
gcuguggacuauua

SEQ ID NO: 1133805 - RNA, 22 nt, Homo sapiens
gcugugggaccaggucugugga

SEQ ID NO: 1133806 - RNA, 16 nt, Homo sapiens
gcugugguguguuccc

SEQ ID NO: 1133807 - RNA, 23 nt, Homo sapiens
gcugugugagaccaggggaccag

SEQ ID NO: 1133808 - RNA, 16 nt, Homo sapiens
gcugugugcucuccaa

SEQ ID NO: 1133809 - RNA, 21 nt, Homo sapiens
gcuguguuaccucaauuucag

SEQ ID NO: 1133810 - RNA, 18 nt, Homo sapiens
gccauacuguaugcagua

SEQ ID NO: 1133811 - RNA, 12 nt, Homo sapiens
gccauacuucug

SEQ ID NO: 1133812 - RNA, 22 nt, Homo sapiens
gccauaugaaugucaguaguuu

SEQ ID NO: 1133813 - RNA, 16 nt, Homo sapiens
gccaucaaacuguaaa

SEQ ID NO: 1133814 - RNA, 14 nt, Homo sapiens
gccaucaagcacuu

SEQ ID NO: 1133815 - RNA, 15 nt, Homo sapiens
gccaucgccaaguaa

SEQ ID NO: 1133816 - RNA, 14 nt, Homo sapiens
gccauggcuuucau

SEQ ID NO: 1133817 - RNA, 20 nt, Homo sapiens
gccauucuuuuuuucuuggc

SEQ ID NO: 1133818 - RNA, 14 nt, Homo sapiens
gccauugcacucca

SEQ ID NO: 1133819 - RNA, 15 nt, Homo sapiens
gccauuggcuacuga

SEQ ID NO: 1133820 - RNA, 17 nt, Homo sapiens
gccauuggcuacugacu

SEQ ID NO: 1133821 - RNA, 20 nt, Homo sapiens
gccauuguugagaauuagau

SEQ ID NO: 1133822 - RNA, 21 nt, Homo sapiens
gcccaaauggcucugugaaau

SEQ ID NO: 1133823 - RNA, 21 nt, Homo sapiens
gcccaacuacuaucucagaga

SEQ ID NO: 1133824 - RNA, 18 nt, Homo sapiens
gcccaauaucagcucuuu

SEQ ID NO: 1133825 - RNA, 11 nt, Homo sapiens
gcccaauccau

SEQ ID NO: 1133826 - RNA, 22 nt, Homo sapiens
gcccaaucucugccauaucagu

SEQ ID NO: 1133827 - RNA, 19 nt, Homo sapiens
gcccacaacuugucaccca

SEQ ID NO: 1133828 - RNA, 20 nt, Homo sapiens
gcccacacccgacaccagcc

SEQ ID NO: 1133829 - RNA, 14 nt, Homo sapiens
gcccacauauuuca

SEQ ID NO: 1133830 - RNA, 13 nt, Homo sapiens
gcccacaucccac

SEQ ID NO: 1133831 - RNA, 20 nt, Homo sapiens
gcccaccuccuccaccacag

SEQ ID NO: 1133832 - RNA, 16 nt, Homo sapiens
gcccacgucacgugua

SEQ ID NO: 1133833 - RNA, 14 nt, Homo sapiens
gcccacucaggggu

SEQ ID NO: 1133834 - RNA, 19 nt, Homo sapiens
gcccacuguccugggccug

SEQ ID NO: 1133835 - RNA, 18 nt, Homo sapiens
gcccacuuccucccggcc

SEQ ID NO: 1133836 - RNA, 17 nt, Homo sapiens
gcccagaaaguccagcu

SEQ ID NO: 1133837 - RNA, 17 nt, Homo sapiens
gcccagaaagucucuca

SEQ ID NO: 1133838 - RNA, 14 nt, Homo sapiens
gcccagagcccagc

SEQ ID NO: 1133839 - RNA, 14 nt, Homo sapiens
gcccagagcccggu

SEQ ID NO: 1133840 - RNA, 17 nt, Homo sapiens
gcccagaucucugcauc

SEQ ID NO: 1133841 - RNA, 20 nt, Homo sapiens
gcccagaucucugcaucucu

SEQ ID NO: 1133842 - RNA, 13 nt, Homo sapiens
gcccagcccagcu

SEQ ID NO: 1133843 - RNA, 20 nt, Homo sapiens
gcccagcgcucuccuggacg

SEQ ID NO: 1133844 - RNA, 23 nt, Homo sapiens
gcccagcuccaaggggaaucaga

SEQ ID NO: 1133845 - RNA, 22 nt, Homo sapiens
gcccagcuuauugugugcgcug

SEQ ID NO: 1133846 - RNA, 17 nt, Homo sapiens
gcccaggcaggucugca

SEQ ID NO: 1133847 - RNA, 19 nt, Homo sapiens
gcccaggcuagagugcaau

SEQ ID NO: 1133848 - RNA, 19 nt, Homo sapiens
gcccaggcuggaguacagu

SEQ ID NO: 1133849 - RNA, 20 nt, Homo sapiens
gcccaggcuggaguacagug

SEQ ID NO: 1133850 - RNA, 19 nt, Homo sapiens
gcccaggcuggagugcagu

SEQ ID NO: 1133851 - RNA, 18 nt, Homo sapiens
gcccagggccgucaagga

SEQ ID NO: 1133852 - RNA, 20 nt, Homo sapiens
gcccagggugccugcacuuu

SEQ ID NO: 1133853 - RNA, 17 nt, Homo sapiens
gcccagucgacgucagc

SEQ ID NO: 1133854 - RNA, 20 nt, Homo sapiens
gcccagucuggcaugcagcu

SEQ ID NO: 1133855 - RNA, 16 nt, Homo sapiens
gcccaguguccccuuu

SEQ ID NO: 1133856 - RNA, 18 nt, Homo sapiens
gcccaguuucacugccau

SEQ ID NO: 1133857 - RNA, 22 nt, Homo sapiens
gcccaucaucucugccuuugag

SEQ ID NO: 1133858 - RNA, 18 nt, Homo sapiens
gcccauccccaggcaccu

SEQ ID NO: 1133859 - RNA, 21 nt, Homo sapiens
gcccauccccaggcaccucac

SEQ ID NO: 1133860 - RNA, 16 nt, Homo sapiens
gcccauuucuccauac

SEQ ID NO: 1133861 - RNA, 13 nt, Homo sapiens
gccccacaugucc

SEQ ID NO: 1133862 - RNA, 16 nt, Homo sapiens
gccccagacacagugc

SEQ ID NO: 1133863 - RNA, 15 nt, Homo sapiens
gccccagacugggcc

SEQ ID NO: 1133864 - RNA, 17 nt, Homo sapiens
gccccagcagugccuug

SEQ ID NO: 1133865 - RNA, 21 nt, Homo sapiens
gccccauccuccagcagggaa

SEQ ID NO: 1133866 - RNA, 15 nt, Homo sapiens
gccccaugaagccac

SEQ ID NO: 1133867 - RNA, 14 nt, Homo sapiens
gccccauuuaccca

SEQ ID NO: 1133868 - RNA, 15 nt, Homo sapiens
gccccauuuacccaa

SEQ ID NO: 1133869 - RNA, 13 nt, Homo sapiens
gcccccaacagca

SEQ ID NO: 1133870 - RNA, 15 nt, Homo sapiens
gcccccagcccagag

SEQ ID NO: 1133871 - RNA, 19 nt, Homo sapiens
gaaagcugacaucuguaaa

SEQ ID NO: 1133872 - RNA, 14 nt, Homo sapiens
gaaagcuuuggcag

SEQ ID NO: 1133873 - RNA, 19 nt, Homo sapiens
gaaaggcacauuacauuua

SEQ ID NO: 1133874 - RNA, 21 nt, Homo sapiens
gaaagguaauacagcuuguga

SEQ ID NO: 1133875 - RNA, 22 nt, Homo sapiens
gaaagugguucucaugaugcuu

SEQ ID NO: 1133876 - RNA, 16 nt, Homo sapiens
gaaaguguaaagcauu

SEQ ID NO: 1133877 - RNA, 22 nt, Homo sapiens
gaaauaaagcagggacugugaa

SEQ ID NO: 1133878 - RNA, 17 nt, Homo sapiens
gaaauaaauaacuuugg

SEQ ID NO: 1133879 - RNA, 13 nt, Homo sapiens
gaaauaaccacug

SEQ ID NO: 1133880 - RNA, 13 nt, Homo sapiens
gaaauaagccccc

SEQ ID NO: 1133881 - RNA, 14 nt, Homo sapiens
gaaauacaguauga

SEQ ID NO: 1133882 - RNA, 22 nt, Homo sapiens
gaaauaugcuuucaucuucugu

SEQ ID NO: 1133883 - RNA, 14 nt, Homo sapiens
gaaauauuauagag

SEQ ID NO: 1133884 - RNA, 15 nt, Homo sapiens
gaaaucaaaauccaa

SEQ ID NO: 1133885 - RNA, 20 nt, Homo sapiens
gaaaucaacuugcuuaucaa

SEQ ID NO: 1133886 - RNA, 18 nt, Homo sapiens
gaaaucagaagugcaaag

SEQ ID NO: 1133887 - RNA, 19 nt, Homo sapiens
gaaaucuggcuucuggcca

SEQ ID NO: 1133888 - RNA, 11 nt, Homo sapiens
gaaaugaacuu

SEQ ID NO: 1133889 - RNA, 20 nt, Homo sapiens
gaaaugcacauugauuugug

SEQ ID NO: 1133890 - RNA, 21 nt, Homo sapiens
gaaauggcaugcaaaagcaau

SEQ ID NO: 1133891 - RNA, 19 nt, Homo sapiens
gaaauguaaaauugaaaau

SEQ ID NO: 1133892 - RNA, 14 nt, Homo sapiens
gaaauguaugugcu

SEQ ID NO: 1133893 - RNA, 18 nt, Homo sapiens
gaaauguuugcugaguga

SEQ ID NO: 1133894 - RNA, 22 nt, Homo sapiens
gaaauuaaauguuuauaauuua

SEQ ID NO: 1133895 - RNA, 18 nt, Homo sapiens
gaaauuaacucagacaca

SEQ ID NO: 1133896 - RNA, 17 nt, Homo sapiens
gaaauuaagaaggcaaa

SEQ ID NO: 1133897 - RNA, 16 nt, Homo sapiens
gaaauuccaaagucuc

SEQ ID NO: 1133898 - RNA, 15 nt, Homo sapiens
gaaauucugcugaca

SEQ ID NO: 1133899 - RNA, 18 nt, Homo sapiens
gaaauugauuaaggcuuu

SEQ ID NO: 1133900 - RNA, 16 nt, Homo sapiens
gaaauuuaauguuucu

SEQ ID NO: 1133901 - RNA, 16 nt, Homo sapiens
gaaauuuacugugaga

SEQ ID NO: 1133902 - RNA, 16 nt, Homo sapiens
gaacaaaauaagcaac

SEQ ID NO: 1133903 - RNA, 16 nt, Homo sapiens
gaacaaagagugaaau

SEQ ID NO: 1133904 - RNA, 14 nt, Homo sapiens
gaacaacaaggaca

SEQ ID NO: 1133905 - RNA, 15 nt, Homo sapiens
gaacaacaugggagc

SEQ ID NO: 1133906 - RNA, 21 nt, Homo sapiens
gaacaaccuuuucucuggaca

SEQ ID NO: 1133907 - RNA, 13 nt, Homo sapiens
gaacaacuuggaa

SEQ ID NO: 1133908 - RNA, 17 nt, Homo sapiens
gaacaagucaaaauauu

SEQ ID NO: 1133909 - RNA, 16 nt, Homo sapiens
gaacaauuaugaacau

SEQ ID NO: 1133910 - RNA, 17 nt, Homo sapiens
gaacacaaacacauugu

SEQ ID NO: 1133911 - RNA, 17 nt, Homo sapiens
gaacacaaaugaaaaug

SEQ ID NO: 1133912 - RNA, 19 nt, Homo sapiens
gaacacacugagacuugaa

SEQ ID NO: 1133913 - RNA, 20 nt, Homo sapiens
gaacacauuucccuacccua

SEQ ID NO: 1133914 - RNA, 23 nt, Homo sapiens
gaacacuaacuaugcauggugcc

SEQ ID NO: 1133915 - RNA, 18 nt, Homo sapiens
gaacacucuuuugcuuua

SEQ ID NO: 1133916 - RNA, 20 nt, Homo sapiens
gaacacuggcagacugugua

SEQ ID NO: 1133917 - RNA, 19 nt, Homo sapiens
gaacagacaaucacagcaa

SEQ ID NO: 1133918 - RNA, 20 nt, Homo sapiens
gaacagguguuuuuccacaa

SEQ ID NO: 1133919 - RNA, 17 nt, Homo sapiens
gaacagugaaagucaau

SEQ ID NO: 1133920 - RNA, 17 nt, Homo sapiens
gaacaguuuuggcauaa

SEQ ID NO: 1133921 - RNA, 22 nt, Homo sapiens
gaacaugaagaagaccuuuaca

SEQ ID NO: 1133922 - RNA, 12 nt, Homo sapiens
gaacaugaauca

SEQ ID NO: 1133923 - RNA, 14 nt, Homo sapiens
gaacaugaaucaaa

SEQ ID NO: 1133924 - RNA, 15 nt, Homo sapiens
gaacaugcccacaac

SEQ ID NO: 1133925 - RNA, 21 nt, Homo sapiens
gaacaugcccacaacuuguca

SEQ ID NO: 1133926 - RNA, 19 nt, Homo sapiens
gaacaugcuuuuacuuuau

SEQ ID NO: 1133927 - RNA, 20 nt, Homo sapiens
gaacauggcggggcuuuccu

SEQ ID NO: 1133928 - RNA, 18 nt, Homo sapiens
gaacauucagauuuacca

SEQ ID NO: 1133929 - RNA, 21 nt, Homo sapiens
gaaccagagaggcucugagaa

SEQ ID NO: 1133930 - RNA, 19 nt, Homo sapiens
gaaccagcaagucccagac

SEQ ID NO: 1133931 - RNA, 18 nt, Homo sapiens
gaaccagcagaagccaga

SEQ ID NO: 1133932 - RNA, 20 nt, Homo sapiens
gaaccauaggacuguggcaa

SEQ ID NO: 1133933 - RNA, 18 nt, Homo sapiens
gaaccaugaaaaugggga

SEQ ID NO: 1133934 - RNA, 20 nt, Homo sapiens
gaaccuucauaugugcagua

SEQ ID NO: 1133935 - RNA, 21 nt, Homo sapiens
gaaccuucuggccucccacag

SEQ ID NO: 1133936 - RNA, 17 nt, Homo sapiens
gaaccuugagcaaauua

SEQ ID NO: 1133937 - RNA, 19 nt, Homo sapiens
gaacguaauaaaccagguu

SEQ ID NO: 1133938 - RNA, 16 nt, Homo sapiens
gaacgucuccuagcca

SEQ ID NO: 1133939 - RNA, 19 nt, Homo sapiens
gaacuaaauuuaagcuuaa

SEQ ID NO: 1133940 - RNA, 13 nt, Homo sapiens
gaacucacugcga

SEQ ID NO: 1133941 - RNA, 22 nt, Homo sapiens
gaacucacugcgauggggguca

SEQ ID NO: 1133942 - RNA, 16 nt, Homo sapiens
gaacucauaucuguaa

SEQ ID NO: 1133943 - RNA, 14 nt, Homo sapiens
gaacuccugacccc

SEQ ID NO: 1133944 - RNA, 18 nt, Homo sapiens
uugcccuguuuccugcug

SEQ ID NO: 1133945 - RNA, 19 nt, Homo sapiens
uugcccuuuggccagugac

SEQ ID NO: 1133946 - RNA, 21 nt, Homo sapiens
uugccgcacaugaaacauuau

SEQ ID NO: 1133947 - RNA, 17 nt, Homo sapiens
uugccgcgucgcccucc

SEQ ID NO: 1133948 - RNA, 18 nt, Homo sapiens
uugccuauggaguagcca

SEQ ID NO: 1133949 - RNA, 19 nt, Homo sapiens
uugccuauggaguagccau

SEQ ID NO: 1133950 - RNA, 21 nt, Homo sapiens
uugccucugaagccuauguau

SEQ ID NO: 1133951 - RNA, 13 nt, Homo sapiens
uugccugccugug

SEQ ID NO: 1133952 - RNA, 22 nt, Homo sapiens
uugccuucaucuucacugcaau

SEQ ID NO: 1133953 - RNA, 23 nt, Homo sapiens
uugccuuccuaaauuaugacugc

SEQ ID NO: 1133954 - RNA, 20 nt, Homo sapiens
uugcgagccucgcagccucc

SEQ ID NO: 1133955 - RNA, 23 nt, Homo sapiens
uugcguuucuuacugccuucuuu

SEQ ID NO: 1133956 - RNA, 18 nt, Homo sapiens
uugcuauaauaaagaagu

SEQ ID NO: 1133957 - RNA, 22 nt, Homo sapiens
uugcuccuggcuggggccuguu

SEQ ID NO: 1133958 - RNA, 17 nt, Homo sapiens
uugcugaagcugagcua

SEQ ID NO: 1133959 - RNA, 19 nt, Homo sapiens
uugcugaauucucugcuca

SEQ ID NO: 1133960 - RNA, 19 nt, Homo sapiens
uugcugcucacauucugag

SEQ ID NO: 1133961 - RNA, 12 nt, Homo sapiens
uugcuuaaacau

SEQ ID NO: 1133962 - RNA, 18 nt, Homo sapiens
uugcuuccaagaccauuu

SEQ ID NO: 1133963 - RNA, 20 nt, Homo sapiens
uugcuuccccuuuugccaau

SEQ ID NO: 1133964 - RNA, 13 nt, Homo sapiens
uugcuuguuacau

SEQ ID NO: 1133965 - RNA, 22 nt, Homo sapiens
uugcuuucgcuucuacagugca

SEQ ID NO: 1133966 - RNA, 20 nt, Homo sapiens
uugcuuugggggcuuuacaa

SEQ ID NO: 1133967 - RNA, 18 nt, Homo sapiens
uugcuuuguuucucugau

SEQ ID NO: 1133968 - RNA, 18 nt, Homo sapiens
uuggaaaaaauguuguaa

SEQ ID NO: 1133969 - RNA, 19 nt, Homo sapiens
uuggaaaaagccugugaaa

SEQ ID NO: 1133970 - RNA, 14 nt, Homo sapiens
uuggaaaugugaau

SEQ ID NO: 1133971 - RNA, 19 nt, Homo sapiens
uuggaacaggguuggcauu

SEQ ID NO: 1133972 - RNA, 15 nt, Homo sapiens
uuggaacucuugcua

SEQ ID NO: 1133973 - RNA, 22 nt, Homo sapiens
uuggaacuuuucuccugcaugu

SEQ ID NO: 1133974 - RNA, 22 nt, Homo sapiens
uuggaagcacuuuuucugcaua

SEQ ID NO: 1133975 - RNA, 16 nt, Homo sapiens
uuggaauaaucacuug

SEQ ID NO: 1133976 - RNA, 17 nt, Homo sapiens
uuggaauaaucacuugg

SEQ ID NO: 1133977 - RNA, 21 nt, Homo sapiens
uuggaaucccacuaaugcaaa

SEQ ID NO: 1133978 - RNA, 19 nt, Homo sapiens
uuggaauugacauucucua

SEQ ID NO: 1133979 - RNA, 19 nt, Homo sapiens
uuggacagaagcagcucuu

SEQ ID NO: 1133980 - RNA, 19 nt, Homo sapiens
uuggacuggauaagugcua

SEQ ID NO: 1133981 - RNA, 16 nt, Homo sapiens
uuggacuugcugaauu

SEQ ID NO: 1133982 - RNA, 15 nt, Homo sapiens
uuggagccugcagag

SEQ ID NO: 1133983 - RNA, 21 nt, Homo sapiens
uuggagggcacuuggccaguu

SEQ ID NO: 1133984 - RNA, 17 nt, Homo sapiens
uuggagguuaaggcaua

SEQ ID NO: 1133985 - RNA, 21 nt, Homo sapiens
uuggauaaaauaaaugcaauu

SEQ ID NO: 1133986 - RNA, 19 nt, Homo sapiens
uuggauacauacaccagca

SEQ ID NO: 1133987 - RNA, 20 nt, Homo sapiens
uuggauacauacaccagcau

SEQ ID NO: 1133988 - RNA, 18 nt, Homo sapiens
uuggauuauuccucuaca

SEQ ID NO: 1133989 - RNA, 15 nt, Homo sapiens
uuggauuggcacugu

SEQ ID NO: 1133990 - RNA, 12 nt, Homo sapiens
uuggauuugaca

SEQ ID NO: 1133991 - RNA, 19 nt, Homo sapiens
uuggauuugcucagugucu

SEQ ID NO: 1133992 - RNA, 12 nt, Homo sapiens
uuggcaagccac

SEQ ID NO: 1133993 - RNA, 14 nt, Homo sapiens
uuggcaaguguaaa

SEQ ID NO: 1133994 - RNA, 13 nt, Homo sapiens
uuggcaccagaca

SEQ ID NO: 1133995 - RNA, 20 nt, Homo sapiens
uuggcacuguuugccauucu

SEQ ID NO: 1133996 - RNA, 16 nt, Homo sapiens
uuggcagaacugcugg

SEQ ID NO: 1133997 - RNA, 14 nt, Homo sapiens
uuggcaucugcaaa

SEQ ID NO: 1133998 - RNA, 22 nt, Homo sapiens
uuggccaguagcuaaagugcaa

SEQ ID NO: 1133999 - RNA, 18 nt, Homo sapiens
uuggcugcaggaaucuuu

SEQ ID NO: 1134000 - RNA, 14 nt, Homo sapiens
uuggcuuuuacuga

SEQ ID NO: 1134001 - RNA, 19 nt, Homo sapiens
uuggcuuuuuuaggauucu

SEQ ID NO: 1134002 - RNA, 15 nt, Homo sapiens
uugggagcaggauuu

SEQ ID NO: 1134003 - RNA, 17 nt, Homo sapiens
uugggaugcucucuggu

SEQ ID NO: 1134004 - RNA, 14 nt, Homo sapiens
uugggcaacagagc

SEQ ID NO: 1134005 - RNA, 16 nt, Homo sapiens
uugggcaccugaccac

SEQ ID NO: 1134006 - RNA, 15 nt, Homo sapiens
uugggccauggcuuu

SEQ ID NO: 1134007 - RNA, 13 nt, Homo sapiens
uugggcuacugua

SEQ ID NO: 1134008 - RNA, 20 nt, Homo sapiens
uugggcuggaugccgaggua

SEQ ID NO: 1134009 - RNA, 17 nt, Homo sapiens
uuggggagauuugccac

SEQ ID NO: 1134010 - RNA, 16 nt, Homo sapiens
uuggggguuugagggu

SEQ ID NO: 1134011 - RNA, 17 nt, Homo sapiens
uuggguggagaagccau

SEQ ID NO: 1134012 - RNA, 21 nt, Homo sapiens
uugguccuaccuauuauccuu

SEQ ID NO: 1134013 - RNA, 22 nt, Homo sapiens
uuggugaauuucacaagcuauu

SEQ ID NO: 1134014 - RNA, 21 nt, Homo sapiens
uuggugacuucacagugaagu

SEQ ID NO: 1134015 - RNA, 18 nt, Homo sapiens
uuggugagaaaccuguau

SEQ ID NO: 1134016 - RNA, 23 nt, Homo sapiens
uuggugaggaaaagcggacauca

SEQ ID NO: 1134017 - RNA, 14 nt, Homo sapiens
uuggugauggaaaa

SEQ ID NO: 1134018 - RNA, 16 nt, Homo sapiens
uugguggcuaccaugc

SEQ ID NO: 1134019 - RNA, 19 nt, Homo sapiens
uuggugugugugacaauuc

SEQ ID NO: 1134020 - RNA, 13 nt, Homo sapiens
uugguuaaucagu

SEQ ID NO: 1134021 - RNA, 19 nt, Homo sapiens
uugguuaguuaacacugaa

SEQ ID NO: 1134022 - RNA, 13 nt, Homo sapiens
uugguugcuggaa

SEQ ID NO: 1134023 - RNA, 22 nt, Homo sapiens
uugguuuccaaaggcauuuuau

SEQ ID NO: 1134024 - RNA, 19 nt, Homo sapiens
uugguuugaguuucucuca

SEQ ID NO: 1134025 - RNA, 15 nt, Homo sapiens
uugguuuuuacucaa

SEQ ID NO: 1134026 - RNA, 21 nt, Homo sapiens
uuguaaaaacaaagugcuaaa

SEQ ID NO: 1134027 - RNA, 15 nt, Homo sapiens
uuguaaaggauauca

SEQ ID NO: 1134028 - RNA, 20 nt, Homo sapiens
uuguaaauaaagcccuggga

SEQ ID NO: 1134029 - RNA, 17 nt, Homo sapiens
uuguaaauacauguaca

SEQ ID NO: 1134030 - RNA, 22 nt, Homo sapiens
uucugugggagaauucuuacau

SEQ ID NO: 1134031 - RNA, 22 nt, Homo sapiens
uucuguguacugggugaugcac

SEQ ID NO: 1134032 - RNA, 16 nt, Homo sapiens
uucuguugaaguuuac

SEQ ID NO: 1134033 - RNA, 14 nt, Homo sapiens
uucuguugcucucu

SEQ ID NO: 1134034 - RNA, 22 nt, Homo sapiens
uucuguugcucucugugucuga

SEQ ID NO: 1134035 - RNA, 17 nt, Homo sapiens
uucuuaaaaaacauaua

SEQ ID NO: 1134036 - RNA, 18 nt, Homo sapiens
uucuuaaaaaacauauau

SEQ ID NO: 1134037 - RNA, 16 nt, Homo sapiens
uucuuaaccuuugcua

SEQ ID NO: 1134038 - RNA, 19 nt, Homo sapiens
uucuuaacuuugaaccaua

SEQ ID NO: 1134039 - RNA, 21 nt, Homo sapiens
uucuuaauaaacuugcuuuca

SEQ ID NO: 1134040 - RNA, 14 nt, Homo sapiens
uucuuacugcuuaa

SEQ ID NO: 1134041 - RNA, 14 nt, Homo sapiens
uucuuauucacuuu

SEQ ID NO: 1134042 - RNA, 16 nt, Homo sapiens
uucuucaagacucuga

SEQ ID NO: 1134043 - RNA, 11 nt, Homo sapiens
uucuucacuua

SEQ ID NO: 1134044 - RNA, 21 nt, Homo sapiens
uucuucauucuguaugugacu

SEQ ID NO: 1134045 - RNA, 15 nt, Homo sapiens
uucuucuguccugag

SEQ ID NO: 1134046 - RNA, 23 nt, Homo sapiens
uucuucuucaagacucugaacaa

SEQ ID NO: 1134047 - RNA, 16 nt, Homo sapiens
uucuugaguugcggca

SEQ ID NO: 1134048 - RNA, 13 nt, Homo sapiens
uucuugcagauca

SEQ ID NO: 1134049 - RNA, 18 nt, Homo sapiens
uucuugccuugaguucca

SEQ ID NO: 1134050 - RNA, 19 nt, Homo sapiens
uucuuggaguuacaacaga

SEQ ID NO: 1134051 - RNA, 22 nt, Homo sapiens
uucuuguguugugugaucuuga

SEQ ID NO: 1134052 - RNA, 16 nt, Homo sapiens
uucuuguuuucagaaa

SEQ ID NO: 1134053 - RNA, 14 nt, Homo sapiens
uucuuuaaaucagu

SEQ ID NO: 1134054 - RNA, 19 nt, Homo sapiens
uucuuuaaauuucaucuca

SEQ ID NO: 1134055 - RNA, 14 nt, Homo sapiens
uucuuuaagaaccu

SEQ ID NO: 1134056 - RNA, 17 nt, Homo sapiens
uucuuuaguacuuacau

SEQ ID NO: 1134057 - RNA, 17 nt, Homo sapiens
uucuuuccuucuuucau

SEQ ID NO: 1134058 - RNA, 12 nt, Homo sapiens
uucuuugcaaag

SEQ ID NO: 1134059 - RNA, 16 nt, Homo sapiens
uucuuugcugcaguca

SEQ ID NO: 1134060 - RNA, 17 nt, Homo sapiens
uucuuugggccagacau

SEQ ID NO: 1134061 - RNA, 13 nt, Homo sapiens
uucuuuugccaag

SEQ ID NO: 1134062 - RNA, 19 nt, Homo sapiens
uucuuuuggcuuccaugau

SEQ ID NO: 1134063 - RNA, 20 nt, Homo sapiens
uucuuuuuccacaaggaaua

SEQ ID NO: 1134064 - RNA, 14 nt, Homo sapiens
uucuuuuugcucua

SEQ ID NO: 1134065 - RNA, 19 nt, Homo sapiens
uugaaaacaaacaaaucaa

SEQ ID NO: 1134066 - RNA, 17 nt, Homo sapiens
uugaaaauaauuguucc

SEQ ID NO: 1134067 - RNA, 20 nt, Homo sapiens
uugaaaauggugggauucau

SEQ ID NO: 1134068 - RNA, 19 nt, Homo sapiens
uugaaaauguuuacaucau

SEQ ID NO: 1134069 - RNA, 11 nt, Homo sapiens
uugaaagaaga

SEQ ID NO: 1134070 - RNA, 22 nt, Homo sapiens
uugaaagcagaagaagacagac

SEQ ID NO: 1134071 - RNA, 21 nt, Homo sapiens
uugaaauguaggcaucaugca

SEQ ID NO: 1134072 - RNA, 17 nt, Homo sapiens
uugaacaaagacuacua

SEQ ID NO: 1134073 - RNA, 20 nt, Homo sapiens
uugaacaaaggaauuuucaa

SEQ ID NO: 1134074 - RNA, 12 nt, Homo sapiens
uugaacauggaa

SEQ ID NO: 1134075 - RNA, 20 nt, Homo sapiens
uugaacugauucacaucuca

SEQ ID NO: 1134076 - RNA, 15 nt, Homo sapiens
uugaacuucaccugc

SEQ ID NO: 1134077 - RNA, 12 nt, Homo sapiens
uugaacuuguca

SEQ ID NO: 1134078 - RNA, 15 nt, Homo sapiens
uugaagacucccuga

SEQ ID NO: 1134079 - RNA, 23 nt, Homo sapiens
uugaagagccugacaagugaagu

SEQ ID NO: 1134080 - RNA, 13 nt, Homo sapiens
uugaagggccaga

SEQ ID NO: 1134081 - RNA, 21 nt, Homo sapiens
uugaaguaacuauaacaaaaa

SEQ ID NO: 1134082 - RNA, 19 nt, Homo sapiens
uugaaguaggacuuuccua

SEQ ID NO: 1134083 - RNA, 13 nt, Homo sapiens
uugaagucuuuaa

SEQ ID NO: 1134084 - RNA, 18 nt, Homo sapiens
uugaauaaagccugcuuu

SEQ ID NO: 1134085 - RNA, 21 nt, Homo sapiens
uugaauaaagccugcuuuuua

SEQ ID NO: 1134086 - RNA, 21 nt, Homo sapiens
uugaauagaucuuuauaaccu

SEQ ID NO: 1134087 - RNA, 18 nt, Homo sapiens
uugaaugaacacuaugca

SEQ ID NO: 1134088 - RNA, 15 nt, Homo sapiens
uugaauucuuuugcc

SEQ ID NO: 1134089 - RNA, 15 nt, Homo sapiens
uugacaaaacccacu

SEQ ID NO: 1134090 - RNA, 13 nt, Homo sapiens
uugacaacauguu

SEQ ID NO: 1134091 - RNA, 13 nt, Homo sapiens
uugacaacccaaa

SEQ ID NO: 1134092 - RNA, 21 nt, Homo sapiens
uugacauguagguacccugcc

SEQ ID NO: 1134093 - RNA, 23 nt, Homo sapiens
uugaccacucuuccugaguucag

SEQ ID NO: 1134094 - RNA, 15 nt, Homo sapiens
uugaccagcucuggg

SEQ ID NO: 1134095 - RNA, 19 nt, Homo sapiens
uugaccaugucuaugauuc

SEQ ID NO: 1134096 - RNA, 15 nt, Homo sapiens
uugacuagugcaauu

SEQ ID NO: 1134097 - RNA, 13 nt, Homo sapiens
uugacugcugcuc

SEQ ID NO: 1134098 - RNA, 16 nt, Homo sapiens
uugacuuagauauuaa

SEQ ID NO: 1134099 - RNA, 20 nt, Homo sapiens
uugacuuuauuucugagcaa

SEQ ID NO: 1134100 - RNA, 11 nt, Homo sapiens
uugacuuuguc

SEQ ID NO: 1134101 - RNA, 21 nt, Homo sapiens
uugagaccuuugauuuuugcc

SEQ ID NO: 1134102 - RNA, 16 nt, Homo sapiens
uugagaggcugaggug

SEQ ID NO: 1134103 - RNA, 23 nt, Homo sapiens
uugagaguauauuauguauuuau

SEQ ID NO: 1134104 - RNA, 23 nt, Homo sapiens
uugagaguguuccugagacagaa

SEQ ID NO: 1134105 - RNA, 17 nt, Homo sapiens
uugagauuuagagcaau

SEQ ID NO: 1134106 - RNA, 18 nt, Homo sapiens
uugagauuuagagcaaug

SEQ ID NO: 1134107 - RNA, 22 nt, Homo sapiens
uugagcaacuaacuaaccacau

SEQ ID NO: 1134108 - RNA, 21 nt, Homo sapiens
uugagcagaauacaaugggaa

SEQ ID NO: 1134109 - RNA, 13 nt, Homo sapiens
uugagcaugugau

SEQ ID NO: 1134110 - RNA, 12 nt, Homo sapiens
uugagccaugag

SEQ ID NO: 1134111 - RNA, 18 nt, Homo sapiens
uugagcugcugacugcca

SEQ ID NO: 1134112 - RNA, 18 nt, Homo sapiens
uugaggaaacaacagcuu

SEQ ID NO: 1134113 - RNA, 22 nt, Homo sapiens
uugaggguccucaguccacugc

SEQ ID NO: 1134114 - RNA, 23 nt, Homo sapiens
uugaggugguaguaaaacacaga

SEQ ID NO: 1134115 - RNA, 14 nt, Homo sapiens
uugagucuguucuu

SEQ ID NO: 1134116 - RNA, 14 nt, Homo sapiens
uugaguuacagggg

SEQ ID NO: 1134117 - RNA, 15 nt, Homo sapiens
uugaguugugauuga

SEQ ID NO: 1134118 - RNA, 15 nt, Homo sapiens
uugauaagaugguuu

SEQ ID NO: 1134119 - RNA, 17 nt, Homo sapiens
uugauaauccaaagcga

SEQ ID NO: 1134120 - RNA, 19 nt, Homo sapiens
uugauauguuuuauuucau

SEQ ID NO: 1134121 - RNA, 23 nt, Homo sapiens
uugauauuucaauguuagccuca

SEQ ID NO: 1134122 - RNA, 16 nt, Homo sapiens
uugauauuuuaggaua

SEQ ID NO: 1134123 - RNA, 15 nt, Homo sapiens
uuccaugacaacaga

SEQ ID NO: 1134124 - RNA, 14 nt, Homo sapiens
uuccaugauucuau

SEQ ID NO: 1134125 - RNA, 16 nt, Homo sapiens
uuccaugggaccacaa

SEQ ID NO: 1134126 - RNA, 18 nt, Homo sapiens
uuccauuucgccccucau

SEQ ID NO: 1134127 - RNA, 14 nt, Homo sapiens
uucccaaaacugau

SEQ ID NO: 1134128 - RNA, 20 nt, Homo sapiens
uucccaacuucccuguucuu

SEQ ID NO: 1134129 - RNA, 16 nt, Homo sapiens
uucccaagcccaugag

SEQ ID NO: 1134130 - RNA, 21 nt, Homo sapiens
uucccaagguacagcuguaua

SEQ ID NO: 1134131 - RNA, 19 nt, Homo sapiens
uucccacagcacuaauuca

SEQ ID NO: 1134132 - RNA, 13 nt, Homo sapiens
uucccacgaggaa

SEQ ID NO: 1134133 - RNA, 17 nt, Homo sapiens
uucccacugcacuccag

SEQ ID NO: 1134134 - RNA, 15 nt, Homo sapiens
uucccacugccaggg

SEQ ID NO: 1134135 - RNA, 16 nt, Homo sapiens
uucccacuuucauuca

SEQ ID NO: 1134136 - RNA, 23 nt, Homo sapiens
uucccaucacuggagcaccaggc

SEQ ID NO: 1134137 - RNA, 14 nt, Homo sapiens
uucccaucuacuaa

SEQ ID NO: 1134138 - RNA, 17 nt, Homo sapiens
uucccauuggaugcauu

SEQ ID NO: 1134139 - RNA, 18 nt, Homo sapiens
uucccccacccagcuuuc

SEQ ID NO: 1134140 - RNA, 21 nt, Homo sapiens
uuccccgcccguuuuacaaag

SEQ ID NO: 1134141 - RNA, 21 nt, Homo sapiens
uuccccucacuguuugcagcu

SEQ ID NO: 1134142 - RNA, 17 nt, Homo sapiens
uuccccucauugcauuu

SEQ ID NO: 1134143 - RNA, 16 nt, Homo sapiens
uuccccuuccacugag

SEQ ID NO: 1134144 - RNA, 15 nt, Homo sapiens
uuccccuugccuaaa

SEQ ID NO: 1134145 - RNA, 20 nt, Homo sapiens
uucccgcacaaauuccacau

SEQ ID NO: 1134146 - RNA, 20 nt, Homo sapiens
uucccuaacacuuaccccau

SEQ ID NO: 1134147 - RNA, 14 nt, Homo sapiens
uucccucaccuguc

SEQ ID NO: 1134148 - RNA, 22 nt, Homo sapiens
uucccuccacaacucaguuuca

SEQ ID NO: 1134149 - RNA, 22 nt, Homo sapiens
uucccugaaggaaccaaagcga

SEQ ID NO: 1134150 - RNA, 19 nt, Homo sapiens
uucccugaccucccaacuc

SEQ ID NO: 1134151 - RNA, 18 nt, Homo sapiens
uucccuggacugccggaa

SEQ ID NO: 1134152 - RNA, 20 nt, Homo sapiens
uucccuggggaaaacuugca

SEQ ID NO: 1134153 - RNA, 20 nt, Homo sapiens
uucccuguacuuuucccauu

SEQ ID NO: 1134154 - RNA, 17 nt, Homo sapiens
uucccugugucugccaa

SEQ ID NO: 1134155 - RNA, 15 nt, Homo sapiens
uucccuuaguauuaa

SEQ ID NO: 1134156 - RNA, 19 nt, Homo sapiens
uucccuuugauacagucaa

SEQ ID NO: 1134157 - RNA, 15 nt, Homo sapiens
uucccuuuuaagcaa

SEQ ID NO: 1134158 - RNA, 23 nt, Homo sapiens
uuccgaggccccugucucagggu

SEQ ID NO: 1134159 - RNA, 13 nt, Homo sapiens
uuccgcagugugg

SEQ ID NO: 1134160 - RNA, 16 nt, Homo sapiens
uuccgcauccuagucu

SEQ ID NO: 1134161 - RNA, 14 nt, Homo sapiens
uuccggguucaagu

SEQ ID NO: 1134162 - RNA, 23 nt, Homo sapiens
uuccguccccgccgccucacugc

SEQ ID NO: 1134163 - RNA, 13 nt, Homo sapiens
uuccguuuugccu

SEQ ID NO: 1134164 - RNA, 23 nt, Homo sapiens
uuccuaacugucugacuuauaau

SEQ ID NO: 1134165 - RNA, 18 nt, Homo sapiens
uuccuacaaguuuaagua

SEQ ID NO: 1134166 - RNA, 17 nt, Homo sapiens
uuccuagaggagacagc

SEQ ID NO: 1134167 - RNA, 21 nt, Homo sapiens
uuccuaugcuuugaaacagaa

SEQ ID NO: 1134168 - RNA, 15 nt, Homo sapiens
uuccuauguaacugc

SEQ ID NO: 1134169 - RNA, 15 nt, Homo sapiens
uuccuauuucuggaa

SEQ ID NO: 1134170 - RNA, 16 nt, Homo sapiens
uuccucagaucaucca

SEQ ID NO: 1134171 - RNA, 17 nt, Homo sapiens
uuccucccuucugcuac

SEQ ID NO: 1134172 - RNA, 21 nt, Homo sapiens
uuccuccgaggccaguaccuu

SEQ ID NO: 1134173 - RNA, 20 nt, Homo sapiens
uuccuccucaggcacacagc

SEQ ID NO: 1134174 - RNA, 13 nt, Homo sapiens
uuccucuacuuaa

SEQ ID NO: 1134175 - RNA, 15 nt, Homo sapiens
uuccucucucagggg

SEQ ID NO: 1134176 - RNA, 15 nt, Homo sapiens
uuccucucugcaaau

SEQ ID NO: 1134177 - RNA, 14 nt, Homo sapiens
uuccucugauuuga

SEQ ID NO: 1134178 - RNA, 18 nt, Homo sapiens
uuccugagaggaagccug

SEQ ID NO: 1134179 - RNA, 20 nt, Homo sapiens
uuccugcaguguuuugcaua

SEQ ID NO: 1134180 - RNA, 12 nt, Homo sapiens
uuccugcuuauu

SEQ ID NO: 1134181 - RNA, 23 nt, Homo sapiens
uuccugggccuucucagcucucc

SEQ ID NO: 1134182 - RNA, 14 nt, Homo sapiens
uuccuguagccuuc

SEQ ID NO: 1134183 - RNA, 16 nt, Homo sapiens
uuccuucaagccaagu

SEQ ID NO: 1134184 - RNA, 21 nt, Homo sapiens
uuccuucaugaucaucacaau

SEQ ID NO: 1134185 - RNA, 12 nt, Homo sapiens
uuccuuccagcc

SEQ ID NO: 1134186 - RNA, 14 nt, Homo sapiens
uuccuucucuuuaa

SEQ ID NO: 1134187 - RNA, 14 nt, Homo sapiens
uuccuugggcuuua

SEQ ID NO: 1134188 - RNA, 20 nt, Homo sapiens
uuccuuggggcaggcaguga

SEQ ID NO: 1134189 - RNA, 22 nt, Homo sapiens
uuccuuguuccaauuugacaaa

SEQ ID NO: 1134190 - RNA, 23 nt, Homo sapiens
uuccuuuggugacuucacaguga

SEQ ID NO: 1134191 - RNA, 14 nt, Homo sapiens
uuccuuuuguaaaa

SEQ ID NO: 1134192 - RNA, 18 nt, Homo sapiens
uuccuuuuucuucacuua

SEQ ID NO: 1134193 - RNA, 16 nt, Homo sapiens
uucgaaacuccauuga

SEQ ID NO: 1134194 - RNA, 22 nt, Homo sapiens
uucgacuucuuuccaugggcgu

SEQ ID NO: 1134195 - RNA, 23 nt, Homo sapiens
uucgcgcgccuccgcuacuucca

SEQ ID NO: 1134196 - RNA, 16 nt, Homo sapiens
uucggacaacucaguc

SEQ ID NO: 1134197 - RNA, 15 nt, Homo sapiens
uucggagcuauacau

SEQ ID NO: 1134198 - RNA, 19 nt, Homo sapiens
uucgugaaguauacuguau

SEQ ID NO: 1134199 - RNA, 16 nt, Homo sapiens
uucuaaauaugaauga

SEQ ID NO: 1134200 - RNA, 13 nt, Homo sapiens
uucuacuagccau

SEQ ID NO: 1134201 - RNA, 18 nt, Homo sapiens
uucuacuuacuuuuccaa

SEQ ID NO: 1134202 - RNA, 20 nt, Homo sapiens
uucuagaugaucaacauaau

SEQ ID NO: 1134203 - RNA, 21 nt, Homo sapiens
uucuagcucuauuuacuucua

SEQ ID NO: 1134204 - RNA, 16 nt, Homo sapiens
uucuaggcucacugca

SEQ ID NO: 1134205 - RNA, 18 nt, Homo sapiens
uucuagguaauuugccac

SEQ ID NO: 1134206 - RNA, 18 nt, Homo sapiens
uucuaguauguacuuuga

SEQ ID NO: 1134207 - RNA, 19 nt, Homo sapiens
uucuaguauguacuuugaa

SEQ ID NO: 1134208 - RNA, 19 nt, Homo sapiens
uucuaguucugccaggaga

SEQ ID NO: 1134209 - RNA, 14 nt, Homo sapiens
uucuauacuguaaa

SEQ ID NO: 1134210 - RNA, 19 nt, Homo sapiens
uucuauuacuuauuguaug

SEQ ID NO: 1134211 - RNA, 13 nt, Homo sapiens
uucuauuagucac

SEQ ID NO: 1134212 - RNA, 15 nt, Homo sapiens
uucuauugacuucaa

SEQ ID NO: 1134213 - RNA, 15 nt, Homo sapiens
uucucaccacagagc

SEQ ID NO: 1134214 - RNA, 18 nt, Homo sapiens
uucucauaccuuccccac

SEQ ID NO: 1134215 - RNA, 22 nt, Homo sapiens
uucucaugcaugucuaaccuga

SEQ ID NO: 1134216 - RNA, 19 nt, Homo sapiens
uucuccccgccugcuccca

SEQ ID NO: 1134217 - RNA, 17 nt, Homo sapiens
uucucccgugagccagg

SEQ ID NO: 1134218 - RNA, 21 nt, Homo sapiens
uucucccgugagccaggcaaa

SEQ ID NO: 1134219 - RNA, 13 nt, Homo sapiens
uucuccuccaugg

SEQ ID NO: 1134220 - RNA, 18 nt, Homo sapiens
uucucgggguccagugca

SEQ ID NO: 1134221 - RNA, 22 nt, Homo sapiens
uucucuacugucuggauuaauu

SEQ ID NO: 1134222 - RNA, 12 nt, Homo sapiens
uucucuccggga

SEQ ID NO: 1134223 - RNA, 19 nt, Homo sapiens
uucucugccgcuaccuccc

SEQ ID NO: 1134224 - RNA, 12 nt, Homo sapiens
uucucugccuca

SEQ ID NO: 1134225 - RNA, 18 nt, Homo sapiens
uucucuggcucuugucca

SEQ ID NO: 1134226 - RNA, 22 nt, Homo sapiens
uucucugggccuucucaccaca

SEQ ID NO: 1134227 - RNA, 18 nt, Homo sapiens
uucucugucucuguggaa

SEQ ID NO: 1134228 - RNA, 15 nt, Homo sapiens
uucucuuucccuuca

SEQ ID NO: 1134229 - RNA, 20 nt, Homo sapiens
uucucuuuguauuucaucuc

SEQ ID NO: 1134230 - RNA, 20 nt, Homo sapiens
uucucuuuuccuuugguccu

SEQ ID NO: 1134231 - RNA, 15 nt, Homo sapiens
uucugaaaaaguauc

SEQ ID NO: 1134232 - RNA, 14 nt, Homo sapiens
uucugaacuuggaa

SEQ ID NO: 1134233 - RNA, 22 nt, Homo sapiens
uucugagaagaaacuuguccuu

SEQ ID NO: 1134234 - RNA, 14 nt, Homo sapiens
uucugagcaaagca

SEQ ID NO: 1134235 - RNA, 18 nt, Homo sapiens
uucugagccuucuacuua

SEQ ID NO: 1134236 - RNA, 19 nt, Homo sapiens
uucugagccuucuacuuau

SEQ ID NO: 1134237 - RNA, 17 nt, Homo sapiens
uucugaggacauuccaa

SEQ ID NO: 1134238 - RNA, 21 nt, Homo sapiens
uucugaggacauuccaagaca

SEQ ID NO: 1134239 - RNA, 14 nt, Homo sapiens
uucugauggauuca

SEQ ID NO: 1134240 - RNA, 18 nt, Homo sapiens
uucugcagacuggcaguc

SEQ ID NO: 1134241 - RNA, 17 nt, Homo sapiens
uucugcauacuaaccua

SEQ ID NO: 1134242 - RNA, 19 nt, Homo sapiens
uucugccuugaaauaccug

SEQ ID NO: 1134243 - RNA, 14 nt, Homo sapiens
uucuggagacagaa

SEQ ID NO: 1134244 - RNA, 17 nt, Homo sapiens
uucuggagugagcacuc

SEQ ID NO: 1134245 - RNA, 19 nt, Homo sapiens
uucuggauuccccaucuca

SEQ ID NO: 1134246 - RNA, 21 nt, Homo sapiens
uucuggcccaguuaauuugca

SEQ ID NO: 1134247 - RNA, 17 nt, Homo sapiens
uucuggccucccacaga

SEQ ID NO: 1134248 - RNA, 13 nt, Homo sapiens
uucuggcuguaga

SEQ ID NO: 1134249 - RNA, 20 nt, Homo sapiens
uucuggggaaagacacugcc

SEQ ID NO: 1134250 - RNA, 20 nt, Homo sapiens
uucugguauaaagcucucaa

SEQ ID NO: 1134251 - RNA, 23 nt, Homo sapiens
uucugguggagagaagugagaau

SEQ ID NO: 1134252 - RNA, 15 nt, Homo sapiens
uucuguacucaaaug

SEQ ID NO: 1134253 - RNA, 21 nt, Homo sapiens
uucugucccucacagcacuag

SEQ ID NO: 1134254 - RNA, 19 nt, Homo sapiens
uucugucuagacuggccua

SEQ ID NO: 1134255 - RNA, 13 nt, Homo sapiens
uucugucuuccua

SEQ ID NO: 1134256 - RNA, 22 nt, Homo sapiens
uucugugcagauaaacagaaau

SEQ ID NO: 1134257 - RNA, 18 nt, Homo sapiens
uuaucaaugaugagguaa

SEQ ID NO: 1134258 - RNA, 17 nt, Homo sapiens
uuaucaccaggauuuau

SEQ ID NO: 1134259 - RNA, 12 nt, Homo sapiens
uuaucagugcca

SEQ ID NO: 1134260 - RNA, 23 nt, Homo sapiens
uuaucauggagaacagcaugaca

SEQ ID NO: 1134261 - RNA, 17 nt, Homo sapiens
uuauccgcuguccagca

SEQ ID NO: 1134262 - RNA, 15 nt, Homo sapiens
uuauccugugcuaca

SEQ ID NO: 1134263 - RNA, 13 nt, Homo sapiens
uuauccuguucua

SEQ ID NO: 1134264 - RNA, 15 nt, Homo sapiens
uuaucuauauagucc

SEQ ID NO: 1134265 - RNA, 21 nt, Homo sapiens
uuaucucccugcuucauaucu

SEQ ID NO: 1134266 - RNA, 17 nt, Homo sapiens
uuaucugagcugagcca

SEQ ID NO: 1134267 - RNA, 23 nt, Homo sapiens
uuaucugagcugagccaggcuag

SEQ ID NO: 1134268 - RNA, 13 nt, Homo sapiens
uuaugaacaucca

SEQ ID NO: 1134269 - RNA, 23 nt, Homo sapiens
uuaugagaggcaaugauuguuaa

SEQ ID NO: 1134270 - RNA, 22 nt, Homo sapiens
uuaugauuacuaucauggcaua

SEQ ID NO: 1134271 - RNA, 19 nt, Homo sapiens
uuaugcacuuauaaggugu

SEQ ID NO: 1134272 - RNA, 16 nt, Homo sapiens
uuaugcauaaagucag

SEQ ID NO: 1134273 - RNA, 15 nt, Homo sapiens
uuaugcaucugcuac

SEQ ID NO: 1134274 - RNA, 22 nt, Homo sapiens
uuaugccaaauugauugucaua

SEQ ID NO: 1134275 - RNA, 23 nt, Homo sapiens
uuauggaguucuucuucuccuag

SEQ ID NO: 1134276 - RNA, 23 nt, Homo sapiens
uuauggcagaagggaauugcuca

SEQ ID NO: 1134277 - RNA, 20 nt, Homo sapiens
uuaugguaccagaugcagcu

SEQ ID NO: 1134278 - RNA, 14 nt, Homo sapiens
uuauggugcauuac

SEQ ID NO: 1134279 - RNA, 13 nt, Homo sapiens
uuauguaacuuga

SEQ ID NO: 1134280 - RNA, 19 nt, Homo sapiens
uuauguuuuuucugauucc

SEQ ID NO: 1134281 - RNA, 16 nt, Homo sapiens
uuauuaaacguaugca

SEQ ID NO: 1134282 - RNA, 15 nt, Homo sapiens
uuauuaaauaaucuc

SEQ ID NO: 1134283 - RNA, 16 nt, Homo sapiens
uuauuacaucuuucac

SEQ ID NO: 1134284 - RNA, 12 nt, Homo sapiens
uuauuacuguug

SEQ ID NO: 1134285 - RNA, 13 nt, Homo sapiens
uuauuacuguugg

SEQ ID NO: 1134286 - RNA, 19 nt, Homo sapiens
uuauuagagugucuuucca

SEQ ID NO: 1134287 - RNA, 14 nt, Homo sapiens
uuauuauaaauucu

SEQ ID NO: 1134288 - RNA, 18 nt, Homo sapiens
uuauuauaaauucuacua

SEQ ID NO: 1134289 - RNA, 22 nt, Homo sapiens
uuauuccggaaacuaguguaca

SEQ ID NO: 1134290 - RNA, 22 nt, Homo sapiens
uuauucucguuuuaaaacccau

SEQ ID NO: 1134291 - RNA, 15 nt, Homo sapiens
uuauugaaaugcaga

SEQ ID NO: 1134292 - RNA, 11 nt, Homo sapiens
uuauugaacau

SEQ ID NO: 1134293 - RNA, 13 nt, Homo sapiens
uuauugcaguuua

SEQ ID NO: 1134294 - RNA, 12 nt, Homo sapiens
uuauugccauua

SEQ ID NO: 1134295 - RNA, 19 nt, Homo sapiens
uuauuuagggaacugcuug

SEQ ID NO: 1134296 - RNA, 22 nt, Homo sapiens
uuauuuauaaugaagacaucua

SEQ ID NO: 1134297 - RNA, 14 nt, Homo sapiens
uuauuuauguaugu

SEQ ID NO: 1134298 - RNA, 19 nt, Homo sapiens
uuauuucaaccagcacauu

SEQ ID NO: 1134299 - RNA, 21 nt, Homo sapiens
uuauuucggagcgcaaugcca

SEQ ID NO: 1134300 - RNA, 17 nt, Homo sapiens
uuauuugaaaacauaua

SEQ ID NO: 1134301 - RNA, 14 nt, Homo sapiens
uuauuuuugcaaaa

SEQ ID NO: 1134302 - RNA, 14 nt, Homo sapiens
uucaaaacauacaa

SEQ ID NO: 1134303 - RNA, 22 nt, Homo sapiens
uucaaaacauucuccuuugcag

SEQ ID NO: 1134304 - RNA, 22 nt, Homo sapiens
uucaaaacauugugccauguca

SEQ ID NO: 1134305 - RNA, 18 nt, Homo sapiens
uucaaaauauacauucaa

SEQ ID NO: 1134306 - RNA, 15 nt, Homo sapiens
uucaaacacaaccua

SEQ ID NO: 1134307 - RNA, 19 nt, Homo sapiens
uucaaacuaccuauauucc

SEQ ID NO: 1134308 - RNA, 18 nt, Homo sapiens
uucaaagaguccuaagga

SEQ ID NO: 1134309 - RNA, 12 nt, Homo sapiens
uucaaaguuuag

SEQ ID NO: 1134310 - RNA, 14 nt, Homo sapiens
uucaacauauaccu

SEQ ID NO: 1134311 - RNA, 20 nt, Homo sapiens
uucaacaugucacacuggcu

SEQ ID NO: 1134312 - RNA, 12 nt, Homo sapiens
uucaagcuauaa

SEQ ID NO: 1134313 - RNA, 15 nt, Homo sapiens
uucaauaaauuguaa

SEQ ID NO: 1134314 - RNA, 14 nt, Homo sapiens
uucaaucacuguau

SEQ ID NO: 1134315 - RNA, 21 nt, Homo sapiens
uucaaucucguuuagugccaa

SEQ ID NO: 1134316 - RNA, 13 nt, Homo sapiens
uucaauguauuga

SEQ ID NO: 1134317 - RNA, 17 nt, Homo sapiens
uucaauugcaucuccca

SEQ ID NO: 1134318 - RNA, 14 nt, Homo sapiens
uucaauuugaacuc

SEQ ID NO: 1134319 - RNA, 11 nt, Homo sapiens
uucacacuccu

SEQ ID NO: 1134320 - RNA, 21 nt, Homo sapiens
uucacaguucuuugggccaga

SEQ ID NO: 1134321 - RNA, 19 nt, Homo sapiens
uucacaucagaacagacaa

SEQ ID NO: 1134322 - RNA, 18 nt, Homo sapiens
uucacaugccuugcaaug

SEQ ID NO: 1134323 - RNA, 22 nt, Homo sapiens
uucacauucugggcugacucau

SEQ ID NO: 1134324 - RNA, 12 nt, Homo sapiens
uucaccaugaug

SEQ ID NO: 1134325 - RNA, 20 nt, Homo sapiens
uucacccagagccagugugg

SEQ ID NO: 1134326 - RNA, 20 nt, Homo sapiens
uucaccccacacccaugugu

SEQ ID NO: 1134327 - RNA, 20 nt, Homo sapiens
uucaccguguuagccaggau

SEQ ID NO: 1134328 - RNA, 16 nt, Homo sapiens
uucaccuaacuagaga

SEQ ID NO: 1134329 - RNA, 14 nt, Homo sapiens
uucaccugaaucau

SEQ ID NO: 1134330 - RNA, 16 nt, Homo sapiens
uucaccuguguacuga

SEQ ID NO: 1134331 - RNA, 19 nt, Homo sapiens
uucaccuuuguagcacuca

SEQ ID NO: 1134332 - RNA, 14 nt, Homo sapiens
uucacuaaugacga

SEQ ID NO: 1134333 - RNA, 12 nt, Homo sapiens
uucacuggcaua

SEQ ID NO: 1134334 - RNA, 14 nt, Homo sapiens
uucacuguuucacu

SEQ ID NO: 1134335 - RNA, 19 nt, Homo sapiens
uucagaaaauucccaugag

SEQ ID NO: 1134336 - RNA, 19 nt, Homo sapiens
uucagaacagaggcauuua

SEQ ID NO: 1134337 - RNA, 15 nt, Homo sapiens
uucagacaagcugca

SEQ ID NO: 1134338 - RNA, 21 nt, Homo sapiens
uucagaggguaacuuaacaga

SEQ ID NO: 1134339 - RNA, 19 nt, Homo sapiens
uucagaugcuucugggaga

SEQ ID NO: 1134340 - RNA, 22 nt, Homo sapiens
uucagcaaaacugguugaacag

SEQ ID NO: 1134341 - RNA, 18 nt, Homo sapiens
uucagcaacaaccaucuc

SEQ ID NO: 1134342 - RNA, 22 nt, Homo sapiens
uucagcaagcuagaacuggaag

SEQ ID NO: 1134343 - RNA, 19 nt, Homo sapiens
uucagccaaacaguaugau

SEQ ID NO: 1134344 - RNA, 14 nt, Homo sapiens
uucagccccuccuc

SEQ ID NO: 1134345 - RNA, 18 nt, Homo sapiens
uucagcgaacaugccuga

SEQ ID NO: 1134346 - RNA, 12 nt, Homo sapiens
uucagguauuac

SEQ ID NO: 1134347 - RNA, 20 nt, Homo sapiens
uucagguuagugacauuuaa

SEQ ID NO: 1134348 - RNA, 15 nt, Homo sapiens
uucagucugugccua

SEQ ID NO: 1134349 - RNA, 21 nt, Homo sapiens
uucagugauaacuccuaagag

SEQ ID NO: 1134350 - RNA, 20 nt, Homo sapiens
uucaguucaagugcucuuca

SEQ ID NO: 1134351 - RNA, 21 nt, Homo sapiens
uucaguuccgucagaaagugu

SEQ ID NO: 1134352 - RNA, 21 nt, Homo sapiens
uucaguuggcugacuuccaca

SEQ ID NO: 1134353 - RNA, 17 nt, Homo sapiens
uucauauaccagcaaua

SEQ ID NO: 1134354 - RNA, 13 nt, Homo sapiens
uucauaucucucc

SEQ ID NO: 1134355 - RNA, 17 nt, Homo sapiens
uucauauuaugaugcca

SEQ ID NO: 1134356 - RNA, 13 nt, Homo sapiens
uucaucauuucag

SEQ ID NO: 1134357 - RNA, 22 nt, Homo sapiens
uucaucgacuuagccugaguca

SEQ ID NO: 1134358 - RNA, 17 nt, Homo sapiens
uucaucuaacgugcauu

SEQ ID NO: 1134359 - RNA, 17 nt, Homo sapiens
uucaucuggaaguauuu

SEQ ID NO: 1134360 - RNA, 21 nt, Homo sapiens
uucaugaguuuuucccagcua

SEQ ID NO: 1134361 - RNA, 21 nt, Homo sapiens
uucaugcacaguaaauucugc

SEQ ID NO: 1134362 - RNA, 16 nt, Homo sapiens
ccuguaccugugcacg

SEQ ID NO: 1134363 - RNA, 21 nt, Homo sapiens
ccuguacuuuucccauuugua

SEQ ID NO: 1134364 - RNA, 18 nt, Homo sapiens
ccuguagccccagugaca

SEQ ID NO: 1134365 - RNA, 22 nt, Homo sapiens
ccuguagccuucuguaggaauu

SEQ ID NO: 1134366 - RNA, 22 nt, Homo sapiens
ccuguccggaaugccacccaca

SEQ ID NO: 1134367 - RNA, 15 nt, Homo sapiens
ccuguccucuuugug

SEQ ID NO: 1134368 - RNA, 13 nt, Homo sapiens
ccugucucaguga

SEQ ID NO: 1134369 - RNA, 14 nt, Homo sapiens
ccugucucccccaa

SEQ ID NO: 1134370 - RNA, 16 nt, Homo sapiens
ccugucuguuuccucu

SEQ ID NO: 1134371 - RNA, 14 nt, Homo sapiens
ccugugaaauacca

SEQ ID NO: 1134372 - RNA, 21 nt, Homo sapiens
ccugugaaguccuucaccuca

SEQ ID NO: 1134373 - RNA, 21 nt, Homo sapiens
ccugugacccucucacuuugg

SEQ ID NO: 1134374 - RNA, 13 nt, Homo sapiens
ccugugacuggca

SEQ ID NO: 1134375 - RNA, 20 nt, Homo sapiens
ccugugagccccaggcacuu

SEQ ID NO: 1134376 - RNA, 13 nt, Homo sapiens
ccugugcaaaaaa

SEQ ID NO: 1134377 - RNA, 22 nt, Homo sapiens
ccugugcaauucagucugcucu

SEQ ID NO: 1134378 - RNA, 12 nt, Homo sapiens
ccugugcuacag

SEQ ID NO: 1134379 - RNA, 20 nt, Homo sapiens
ccuguggcugcgcuuccuau

SEQ ID NO: 1134380 - RNA, 16 nt, Homo sapiens
ccugugggaccccagg

SEQ ID NO: 1134381 - RNA, 18 nt, Homo sapiens
ccuguguccgaugcugga

SEQ ID NO: 1134382 - RNA, 21 nt, Homo sapiens
ccugugugauugacagcuuug

SEQ ID NO: 1134383 - RNA, 16 nt, Homo sapiens
ccugugugcgugcgca

SEQ ID NO: 1134384 - RNA, 21 nt, Homo sapiens
ccuguguguccaaaacugccu

SEQ ID NO: 1134385 - RNA, 15 nt, Homo sapiens
ccuguuaggccaacu

SEQ ID NO: 1134386 - RNA, 19 nt, Homo sapiens
ccuguuaggccaacugccu

SEQ ID NO: 1134387 - RNA, 16 nt, Homo sapiens
ccuguucagcuacucc

SEQ ID NO: 1134388 - RNA, 23 nt, Homo sapiens
ccuguucugguauacauuuacug

SEQ ID NO: 1134389 - RNA, 21 nt, Homo sapiens
ccuguucuuucuuacacaaga

SEQ ID NO: 1134390 - RNA, 22 nt, Homo sapiens
ccuguuuguggauguguguuug

SEQ ID NO: 1134391 - RNA, 21 nt, Homo sapiens
ccuuaaaaauuaaauucucuc

SEQ ID NO: 1134392 - RNA, 22 nt, Homo sapiens
ccuuaaaauguggucugccaau

SEQ ID NO: 1134393 - RNA, 14 nt, Homo sapiens
ccuuaaacuuucaa

SEQ ID NO: 1134394 - RNA, 12 nt, Homo sapiens
ccuuaaauaugu

SEQ ID NO: 1134395 - RNA, 13 nt, Homo sapiens
ccuuaaggcucuu

SEQ ID NO: 1134396 - RNA, 22 nt, Homo sapiens
ccuuaaugucaccaugcuugug

SEQ ID NO: 1134397 - RNA, 12 nt, Homo sapiens
ccuuagaguaug

SEQ ID NO: 1134398 - RNA, 23 nt, Homo sapiens
ccuuagcuauucccagggaaccc

SEQ ID NO: 1134399 - RNA, 13 nt, Homo sapiens
ccuuagugcuaua

SEQ ID NO: 1134400 - RNA, 18 nt, Homo sapiens
ccuuauacaucacuuccu

SEQ ID NO: 1134401 - RNA, 17 nt, Homo sapiens
ccuuaugguacacucca

SEQ ID NO: 1134402 - RNA, 17 nt, Homo sapiens
ccuucaacguuucuuca

SEQ ID NO: 1134403 - RNA, 22 nt, Homo sapiens
ccuucaaguugagaacugguca

SEQ ID NO: 1134404 - RNA, 15 nt, Homo sapiens
ccuucaauacuuaaa

SEQ ID NO: 1134405 - RNA, 17 nt, Homo sapiens
ccuucacggcacuggau

SEQ ID NO: 1134406 - RNA, 15 nt, Homo sapiens
ccuucacugugcucc

SEQ ID NO: 1134407 - RNA, 21 nt, Homo sapiens
ccuucacuuuucugaguucuu

SEQ ID NO: 1134408 - RNA, 22 nt, Homo sapiens
ccuucagaacagaggcauuuaa

SEQ ID NO: 1134409 - RNA, 15 nt, Homo sapiens
ccuucagcaccugac

SEQ ID NO: 1134410 - RNA, 20 nt, Homo sapiens
ccuucagcauugccuaggaa

SEQ ID NO: 1134411 - RNA, 19 nt, Homo sapiens
ccuucaggcagccagugug

SEQ ID NO: 1134412 - RNA, 16 nt, Homo sapiens
cacaaguggaccuuag

SEQ ID NO: 1134413 - RNA, 15 nt, Homo sapiens
cacaauauuaccuua

SEQ ID NO: 1134414 - RNA, 21 nt, Homo sapiens
cacaaucuugaacauuuuaca

SEQ ID NO: 1134415 - RNA, 22 nt, Homo sapiens
cacaaucuugaacauuuuacag

SEQ ID NO: 1134416 - RNA, 19 nt, Homo sapiens
cacaaugcaucauaaaaca

SEQ ID NO: 1134417 - RNA, 17 nt, Homo sapiens
cacaauucuguuuuagg

SEQ ID NO: 1134418 - RNA, 17 nt, Homo sapiens
cacacaaaagggaaccc

SEQ ID NO: 1134419 - RNA, 14 nt, Homo sapiens
cacacacacaagua

SEQ ID NO: 1134420 - RNA, 13 nt, Homo sapiens
cacacacaucuau

SEQ ID NO: 1134421 - RNA, 14 nt, Homo sapiens
cacacacauggaaa

SEQ ID NO: 1134422 - RNA, 19 nt, Homo sapiens
cacacagaaaauauacugu

SEQ ID NO: 1134423 - RNA, 11 nt, Homo sapiens
cacacaguguu

SEQ ID NO: 1134424 - RNA, 21 nt, Homo sapiens
caaauauggggaaaaaacugu

SEQ ID NO: 1134425 - RNA, 18 nt, Homo sapiens
caaauauuagcaaagaag

SEQ ID NO: 1134426 - RNA, 23 nt, Homo sapiens
caaauauuaucuuuguucuccua

SEQ ID NO: 1134427 - RNA, 19 nt, Homo sapiens
caaauauuugaucacuuaa

SEQ ID NO: 1134428 - RNA, 15 nt, Homo sapiens
caaaucaaagauuug

SEQ ID NO: 1134429 - RNA, 14 nt, Homo sapiens
caaaucaccacaaa

SEQ ID NO: 1134430 - RNA, 17 nt, Homo sapiens
caaaucacucugcaaug

SEQ ID NO: 1134431 - RNA, 20 nt, Homo sapiens
caaaucagaccuggcugcuu

SEQ ID NO: 1134432 - RNA, 17 nt, Homo sapiens
caaaucagucagugcaa

SEQ ID NO: 1134433 - RNA, 12 nt, Homo sapiens
caaaucaucucu

SEQ ID NO: 1134434 - RNA, 19 nt, Homo sapiens
caaaucccucauccugaca

SEQ ID NO: 1134435 - RNA, 16 nt, Homo sapiens
caaauccuaugugauu

SEQ ID NO: 1134436 - RNA, 23 nt, Homo sapiens
caaauccuuucugccccccaggg

SEQ ID NO: 1134437 - RNA, 21 nt, Homo sapiens
caaaucuggguaucuuuccag

SEQ ID NO: 1134438 - RNA, 12 nt, Homo sapiens
caaaucuuacca

SEQ ID NO: 1134439 - RNA, 21 nt, Homo sapiens
caaaugaauucuaaaccaauc

SEQ ID NO: 1134440 - RNA, 21 nt, Homo sapiens
caaaugacaguagcauugaag

SEQ ID NO: 1134441 - RNA, 16 nt, Homo sapiens
caaaugagccaugaga

SEQ ID NO: 1134442 - RNA, 20 nt, Homo sapiens
caaaugcccaaggaugccuu

SEQ ID NO: 1134443 - RNA, 14 nt, Homo sapiens
caaaugcugugcaa

SEQ ID NO: 1134444 - RNA, 13 nt, Homo sapiens
caaauggacauag

SEQ ID NO: 1134445 - RNA, 23 nt, Homo sapiens
caaauggcagaaccaaagcucaa

SEQ ID NO: 1134446 - RNA, 20 nt, Homo sapiens
caaauggggcaaacagucua

SEQ ID NO: 1134447 - RNA, 19 nt, Homo sapiens
caaauggggccagauccag

SEQ ID NO: 1134448 - RNA, 12 nt, Homo sapiens
caaaugguguga

SEQ ID NO: 1134449 - RNA, 13 nt, Homo sapiens
caaaugugcugcu

SEQ ID NO: 1134450 - RNA, 15 nt, Homo sapiens
caaauuaaaaaagcu

SEQ ID NO: 1134451 - RNA, 19 nt, Homo sapiens
caaauucuguuucuugaga

SEQ ID NO: 1134452 - RNA, 17 nt, Homo sapiens
caaauucuuuugaauug

SEQ ID NO: 1134453 - RNA, 13 nt, Homo sapiens
caaauugcacuga

SEQ ID NO: 1134454 - RNA, 14 nt, Homo sapiens
caaauugcacugaa

SEQ ID NO: 1134455 - RNA, 16 nt, Homo sapiens
caaauugcuucuagga

SEQ ID NO: 1134456 - RNA, 16 nt, Homo sapiens
caaauuggauacugcu

SEQ ID NO: 1134457 - RNA, 16 nt, Homo sapiens
caacaauaaagacuga

SEQ ID NO: 1134458 - RNA, 17 nt, Homo sapiens
caacaauaaagacugag

SEQ ID NO: 1134459 - RNA, 15 nt, Homo sapiens
caacacacugccuua

SEQ ID NO: 1134460 - RNA, 12 nt, Homo sapiens
caacaccaaaaa

SEQ ID NO: 1134461 - RNA, 18 nt, Homo sapiens
caacacccaaguugaaga

SEQ ID NO: 1134462 - RNA, 22 nt, Homo sapiens
caacaccuauauauccaagaag

SEQ ID NO: 1134463 - RNA, 20 nt, Homo sapiens
caacagaacuucacagugac

SEQ ID NO: 1134464 - RNA, 16 nt, Homo sapiens
caacagaccuggugcu

SEQ ID NO: 1134465 - RNA, 20 nt, Homo sapiens
caacagagcaagacccaucu

SEQ ID NO: 1134466 - RNA, 14 nt, Homo sapiens
caacagauaccucu

SEQ ID NO: 1134467 - RNA, 18 nt, Homo sapiens
caacagauaccucucagu

SEQ ID NO: 1134468 - RNA, 17 nt, Homo sapiens
caacagauuuacauccc

SEQ ID NO: 1134469 - RNA, 17 nt, Homo sapiens
caacagcaaaucacgac

SEQ ID NO: 1134470 - RNA, 20 nt, Homo sapiens
caacagccaacagcuacaac

SEQ ID NO: 1134471 - RNA, 20 nt, Homo sapiens
caacaggagcugggauccua

SEQ ID NO: 1134472 - RNA, 15 nt, Homo sapiens
caacaggaggacaau

SEQ ID NO: 1134473 - RNA, 12 nt, Homo sapiens
caacagugugaa

SEQ ID NO: 1134474 - RNA, 12 nt, Homo sapiens
caacaguuuucc

SEQ ID NO: 1134475 - RNA, 16 nt, Homo sapiens
caacauaguauucaug

SEQ ID NO: 1134476 - RNA, 17 nt, Homo sapiens
caacaucacacaguaua

SEQ ID NO: 1134477 - RNA, 14 nt, Homo sapiens
caacaucccauugc

SEQ ID NO: 1134478 - RNA, 22 nt, Homo sapiens
caacaucuuuuuaaccugcaaa

SEQ ID NO: 1134479 - RNA, 12 nt, Homo sapiens
caacaugacugu

SEQ ID NO: 1134480 - RNA, 18 nt, Homo sapiens
caacauggauguguugcc

SEQ ID NO: 1134481 - RNA, 17 nt, Homo sapiens
caacauggcagagcagu

SEQ ID NO: 1134482 - RNA, 20 nt, Homo sapiens
caacauggcgaaaccccucu

SEQ ID NO: 1134483 - RNA, 23 nt, Homo sapiens
caacauggugaaaccccgucucu

SEQ ID NO: 1134484 - RNA, 15 nt, Homo sapiens
caacauuuucuugaa

SEQ ID NO: 1134485 - RNA, 16 nt, Homo sapiens
caaccaaaagucuuca

SEQ ID NO: 1134486 - RNA, 18 nt, Homo sapiens
caaccaauggaaugugau

SEQ ID NO: 1134487 - RNA, 22 nt, Homo sapiens
caaccagaggaggaggaggaca

SEQ ID NO: 1134488 - RNA, 19 nt, Homo sapiens
caaccaggcuccugugaua

SEQ ID NO: 1134489 - RNA, 14 nt, Homo sapiens
caaccauaagacaa

SEQ ID NO: 1134490 - RNA, 18 nt, Homo sapiens
caacccugccccuuucug

SEQ ID NO: 1134491 - RNA, 13 nt, Homo sapiens
caacccuuucauu

SEQ ID NO: 1134492 - RNA, 20 nt, Homo sapiens
caacccuuucauuagaacuu

SEQ ID NO: 1134493 - RNA, 16 nt, Homo sapiens
caaccuaauuaccugu

SEQ ID NO: 1134494 - RNA, 19 nt, Homo sapiens
caaccuccgccuuccgggu

SEQ ID NO: 1134495 - RNA, 13 nt, Homo sapiens
caaccuccugggu

SEQ ID NO: 1134496 - RNA, 20 nt, Homo sapiens
caaccucgcuggacucucag

SEQ ID NO: 1134497 - RNA, 17 nt, Homo sapiens
caaccugaaauuaacuc

SEQ ID NO: 1134498 - RNA, 15 nt, Homo sapiens
caaccugcccagcug

SEQ ID NO: 1134499 - RNA, 14 nt, Homo sapiens
caaccuugcaguau

SEQ ID NO: 1134500 - RNA, 12 nt, Homo sapiens
caacgccagaau

SEQ ID NO: 1134501 - RNA, 22 nt, Homo sapiens
caacguagcuucuaccaugaac

SEQ ID NO: 1134502 - RNA, 16 nt, Homo sapiens
caacgucauuccuuca

SEQ ID NO: 1134503 - RNA, 16 nt, Homo sapiens
caacgugcaacugaca

SEQ ID NO: 1134504 - RNA, 20 nt, Homo sapiens
caacuauauuaucaugcaaa

SEQ ID NO: 1134505 - RNA, 20 nt, Homo sapiens
caacuaucaaaauugccuuu

SEQ ID NO: 1134506 - RNA, 15 nt, Homo sapiens
caacucauuuuuaca

SEQ ID NO: 1134507 - RNA, 12 nt, Homo sapiens
caacuccuggaa

SEQ ID NO: 1134508 - RNA, 16 nt, Homo sapiens
caacucuccaauguuc

SEQ ID NO: 1134509 - RNA, 18 nt, Homo sapiens
caacucuccaauguucua

SEQ ID NO: 1134510 - RNA, 22 nt, Homo sapiens
caacucuccccugaccugugag

SEQ ID NO: 1134511 - RNA, 15 nt, Homo sapiens
caacucuguacaaag

SEQ ID NO: 1134512 - RNA, 20 nt, Homo sapiens
caacugaggauguggcuuau

SEQ ID NO: 1134513 - RNA, 21 nt, Homo sapiens
caacugcccccgccacaaccc

SEQ ID NO: 1134514 - RNA, 16 nt, Homo sapiens
caacuguaaagcaaau

SEQ ID NO: 1134515 - RNA, 15 nt, Homo sapiens
caacuuaaugcucug

SEQ ID NO: 1134516 - RNA, 14 nt, Homo sapiens
caacuucaagggac

SEQ ID NO: 1134517 - RNA, 22 nt, Homo sapiens
caacuuccaaauuggauacugc

SEQ ID NO: 1134518 - RNA, 17 nt, Homo sapiens
caacuugucacccaaag

SEQ ID NO: 1134519 - RNA, 14 nt, Homo sapiens
caacuuugaauaaa

SEQ ID NO: 1134520 - RNA, 15 nt, Homo sapiens
caagaaaacuggaaa

SEQ ID NO: 1134521 - RNA, 22 nt, Homo sapiens
caagaaacaugaaaucugcuuc

SEQ ID NO: 1134522 - RNA, 16 nt, Homo sapiens
caagaaacgucuucua

SEQ ID NO: 1134523 - RNA, 18 nt, Homo sapiens
caagaaaucaaaauccaa

SEQ ID NO: 1134524 - RNA, 23 nt, Homo sapiens
caagaaaucugugccugagaaca

SEQ ID NO: 1134525 - RNA, 21 nt, Homo sapiens
caagaacaauaucgacuuccc

SEQ ID NO: 1134526 - RNA, 18 nt, Homo sapiens
caagaagauaggcucuca

SEQ ID NO: 1134527 - RNA, 14 nt, Homo sapiens
caagaagaugaaug

SEQ ID NO: 1134528 - RNA, 15 nt, Homo sapiens
caagaagccuuuccu

SEQ ID NO: 1134529 - RNA, 17 nt, Homo sapiens
caagaagucccaagacc

SEQ ID NO: 1134530 - RNA, 14 nt, Homo sapiens
caagaaguguaguu

SEQ ID NO: 1134531 - RNA, 18 nt, Homo sapiens
caagaauagcaucuguac

SEQ ID NO: 1134532 - RNA, 18 nt, Homo sapiens
caagaauguuucuuuaua

SEQ ID NO: 1134533 - RNA, 17 nt, Homo sapiens
caagacauagcauccaa

SEQ ID NO: 1134534 - RNA, 21 nt, Homo sapiens
caagacccaaguagcugcuac

SEQ ID NO: 1134535 - RNA, 14 nt, Homo sapiens
caagacccaucuca

SEQ ID NO: 1134536 - RNA, 15 nt, Homo sapiens
caagacccaucucaa

SEQ ID NO: 1134537 - RNA, 17 nt, Homo sapiens
caagaccccaccuccac

SEQ ID NO: 1134538 - RNA, 14 nt, Homo sapiens
caagagacacugcu

SEQ ID NO: 1134539 - RNA, 14 nt, Homo sapiens
caagagaggaagga

SEQ ID NO: 1134540 - RNA, 15 nt, Homo sapiens
caagagauugcuaau

SEQ ID NO: 1134541 - RNA, 21 nt, Homo sapiens
caagagcagcugccauugcag

SEQ ID NO: 1134542 - RNA, 16 nt, Homo sapiens
caagagcuuccagagc

SEQ ID NO: 1134543 - RNA, 17 nt, Homo sapiens
caagaguccuuacugaa

SEQ ID NO: 1134544 - RNA, 21 nt, Homo sapiens
caagauacacgucacaaagac

SEQ ID NO: 1134545 - RNA, 23 nt, Homo sapiens
caagauacuugaacacuguguuu

SEQ ID NO: 1134546 - RNA, 20 nt, Homo sapiens
caagaucgcaccacugcacu

SEQ ID NO: 1134547 - RNA, 19 nt, Homo sapiens
caagaugacaugguccaug

SEQ ID NO: 1134548 - RNA, 23 nt, Homo sapiens
caagaugagcaaugcuguuggaa

SEQ ID NO: 1134549 - RNA, 16 nt, Homo sapiens
caagauggagaugucu

SEQ ID NO: 1134550 - RNA, 21 nt, Homo sapiens
caagauugcgccguuguacuc

SEQ ID NO: 1134551 - RNA, 14 nt, Homo sapiens
caagcaagacugag

SEQ ID NO: 1134552 - RNA, 20 nt, Homo sapiens
caagcaagggucuccuucaa

SEQ ID NO: 1134553 - RNA, 19 nt, Homo sapiens
caagcaauccuccuaccuc

SEQ ID NO: 1134554 - RNA, 18 nt, Homo sapiens
caagcagccaagcuccuu

SEQ ID NO: 1134555 - RNA, 22 nt, Homo sapiens
gaaucagcaucucuucuucccu

SEQ ID NO: 1134556 - RNA, 17 nt, Homo sapiens
gaaucauguaguaucaa

SEQ ID NO: 1134557 - RNA, 19 nt, Homo sapiens
gaaucggcauguauacuua

SEQ ID NO: 1134558 - RNA, 18 nt, Homo sapiens
gaaucucgcaguguuucu

SEQ ID NO: 1134559 - RNA, 12 nt, Homo sapiens
gaaucugaugaa

SEQ ID NO: 1134560 - RNA, 14 nt, Homo sapiens
gaaucuggagacca

SEQ ID NO: 1134561 - RNA, 22 nt, Homo sapiens
gaaucuggcaggaaucuaucca

SEQ ID NO: 1134562 - RNA, 17 nt, Homo sapiens
gaaucugggguuuccau

SEQ ID NO: 1134563 - RNA, 19 nt, Homo sapiens
gaaucugugggucugggag

SEQ ID NO: 1134564 - RNA, 19 nt, Homo sapiens
gaaucuuaagguguagcca

SEQ ID NO: 1134565 - RNA, 19 nt, Homo sapiens
gaaucuuugucagcaguuc

SEQ ID NO: 1134566 - RNA, 15 nt, Homo sapiens
gaaugaaacaaucca

SEQ ID NO: 1134567 - RNA, 13 nt, Homo sapiens
gaaugacacuguu

SEQ ID NO: 1134568 - RNA, 19 nt, Homo sapiens
gaaugaggaacaaucacaa

SEQ ID NO: 1134569 - RNA, 14 nt, Homo sapiens
gaaugauucagugu

SEQ ID NO: 1134570 - RNA, 16 nt, Homo sapiens
gaaugcaaaacauuuc

SEQ ID NO: 1134571 - RNA, 19 nt, Homo sapiens
gaaugccagugugcugaug

SEQ ID NO: 1134572 - RNA, 15 nt, Homo sapiens
gaaugcccacugccu

SEQ ID NO: 1134573 - RNA, 14 nt, Homo sapiens
gaaugccugucacg

SEQ ID NO: 1134574 - RNA, 14 nt, Homo sapiens
gaauggcagcugcc

SEQ ID NO: 1134575 - RNA, 16 nt, Homo sapiens
gaauggucucugucaa

SEQ ID NO: 1134576 - RNA, 16 nt, Homo sapiens
gaauguaguauucaau

SEQ ID NO: 1134577 - RNA, 13 nt, Homo sapiens
gaauguaguauuu

SEQ ID NO: 1134578 - RNA, 18 nt, Homo sapiens
gaauguggagaacuaaag

SEQ ID NO: 1134579 - RNA, 19 nt, Homo sapiens
gaauguguucaccauccca

SEQ ID NO: 1134580 - RNA, 21 nt, Homo sapiens
gaauguguuucaaacuguaaa

SEQ ID NO: 1134581 - RNA, 22 nt, Homo sapiens
gaauguuaauuuuuugguacaa

SEQ ID NO: 1134582 - RNA, 19 nt, Homo sapiens
gaauguuugugucuguggu

SEQ ID NO: 1134583 - RNA, 17 nt, Homo sapiens
gaauuaaaaaagcauac

SEQ ID NO: 1134584 - RNA, 17 nt, Homo sapiens
gaauuaagcugugcaau

SEQ ID NO: 1134585 - RNA, 14 nt, Homo sapiens
gaauuaccaagaga

SEQ ID NO: 1134586 - RNA, 20 nt, Homo sapiens
gaauuacuccaaaaagacaa

SEQ ID NO: 1134587 - RNA, 17 nt, Homo sapiens
gaauuacuuguguuacu

SEQ ID NO: 1134588 - RNA, 18 nt, Homo sapiens
gaauuacuuguguuacuu

SEQ ID NO: 1134589 - RNA, 21 nt, Homo sapiens
gaauuagcuuggggccaggga

SEQ ID NO: 1134590 - RNA, 14 nt, Homo sapiens
gaauuaugcaucug

SEQ ID NO: 1134591 - RNA, 23 nt, Homo sapiens
gaauuaugcaucugcuacugugu

SEQ ID NO: 1134592 - RNA, 16 nt, Homo sapiens
gaauuauuauuuggcu

SEQ ID NO: 1134593 - RNA, 21 nt, Homo sapiens
gaauucagaccuggaauguaa

SEQ ID NO: 1134594 - RNA, 20 nt, Homo sapiens
gaauucauacucuguugccu

SEQ ID NO: 1134595 - RNA, 22 nt, Homo sapiens
gaauucauacucuguugccucc

SEQ ID NO: 1134596 - RNA, 21 nt, Homo sapiens
gaauucgaugcguauucugug

SEQ ID NO: 1134597 - RNA, 15 nt, Homo sapiens
gaauucuaaaccaau

SEQ ID NO: 1134598 - RNA, 17 nt, Homo sapiens
gaauucuuuacaauaaa

SEQ ID NO: 1134599 - RNA, 15 nt, Homo sapiens
gaauugaagauguaa

SEQ ID NO: 1134600 - RNA, 13 nt, Homo sapiens
gaauugagaugau

SEQ ID NO: 1134601 - RNA, 23 nt, Homo sapiens
gaauuggauacauacaccagcau

SEQ ID NO: 1134602 - RNA, 13 nt, Homo sapiens
gaauuggcauuuc

SEQ ID NO: 1134603 - RNA, 13 nt, Homo sapiens
gaauuggguuucu

SEQ ID NO: 1134604 - RNA, 10 nt, Homo sapiens
gaauuucaca

SEQ ID NO: 1134605 - RNA, 17 nt, Homo sapiens
gaauuucacaagcuauu

SEQ ID NO: 1134606 - RNA, 13 nt, Homo sapiens
gaauuugaggcag

SEQ ID NO: 1134607 - RNA, 16 nt, Homo sapiens
gaauuugccuguaaca

SEQ ID NO: 1134608 - RNA, 19 nt, Homo sapiens
gaauuuuugcaauaaugca

SEQ ID NO: 1134609 - RNA, 13 nt, Homo sapiens
gacaaaaggcaga

SEQ ID NO: 1134610 - RNA, 15 nt, Homo sapiens
gacaaaccagagaaa

SEQ ID NO: 1134611 - RNA, 13 nt, Homo sapiens
gacaaacuccuga

SEQ ID NO: 1134612 - RNA, 14 nt, Homo sapiens
gacaaacuccugaa

SEQ ID NO: 1134613 - RNA, 18 nt, Homo sapiens
gacaaagacaaauucugu

SEQ ID NO: 1134614 - RNA, 21 nt, Homo sapiens
gacaaagacauuauuucucau

SEQ ID NO: 1134615 - RNA, 16 nt, Homo sapiens
gacaaagaugauuuaa

SEQ ID NO: 1134616 - RNA, 21 nt, Homo sapiens
gacaaagucaagccacauggu

SEQ ID NO: 1134617 - RNA, 20 nt, Homo sapiens
gacaaauugagacagugcac

SEQ ID NO: 1134618 - RNA, 14 nt, Homo sapiens
gacaacgcugcuua

SEQ ID NO: 1134619 - RNA, 20 nt, Homo sapiens
gacaagacccccagcacuug

SEQ ID NO: 1134620 - RNA, 18 nt, Homo sapiens
gacaagacccucucaggc

SEQ ID NO: 1134621 - RNA, 15 nt, Homo sapiens
gacaagccagaacuu

SEQ ID NO: 1134622 - RNA, 17 nt, Homo sapiens
gacaagcugcauuucag

SEQ ID NO: 1134623 - RNA, 18 nt, Homo sapiens
gacaaucuagcacuuuaa

SEQ ID NO: 1134624 - RNA, 21 nt, Homo sapiens
gacaauucccgggcccuucag

SEQ ID NO: 1134625 - RNA, 17 nt, Homo sapiens
gaggccucucucaggag

SEQ ID NO: 1134626 - RNA, 23 nt, Homo sapiens
gaggccugugaagccaaacaaua

SEQ ID NO: 1134627 - RNA, 20 nt, Homo sapiens
gaggcggagguugcaaugag

SEQ ID NO: 1134628 - RNA, 16 nt, Homo sapiens
gaggcuccaggauuag

SEQ ID NO: 1134629 - RNA, 12 nt, Homo sapiens
gaggcugagaaa

SEQ ID NO: 1134630 - RNA, 15 nt, Homo sapiens
gaggcugcacuggag

SEQ ID NO: 1134631 - RNA, 18 nt, Homo sapiens
gaggcuuuaaaaagaaaa

SEQ ID NO: 1134632 - RNA, 20 nt, Homo sapiens
gagggagggcugacccagau

SEQ ID NO: 1134633 - RNA, 15 nt, Homo sapiens
gagggaguuacugaa

SEQ ID NO: 1134634 - RNA, 18 nt, Homo sapiens
gagggcauauacagugaa

SEQ ID NO: 1134635 - RNA, 22 nt, Homo sapiens
gagggcaucucugagugucucu

SEQ ID NO: 1134636 - RNA, 21 nt, Homo sapiens
gagggcucaccucuugccuuc

SEQ ID NO: 1134637 - RNA, 19 nt, Homo sapiens
gagggcugcugaccauuug

SEQ ID NO: 1134638 - RNA, 15 nt, Homo sapiens
gaggucucccaaacg

SEQ ID NO: 1134639 - RNA, 16 nt, Homo sapiens
gaggugaacaagcaaa

SEQ ID NO: 1134640 - RNA, 22 nt, Homo sapiens
gaggugagggggguucuccuuu

SEQ ID NO: 1134641 - RNA, 21 nt, Homo sapiens
gagguggcuaagggggaccau

SEQ ID NO: 1134642 - RNA, 21 nt, Homo sapiens
gaggugguaguaaaacacaga

SEQ ID NO: 1134643 - RNA, 22 nt, Homo sapiens
gaggugguaguaaaacacagag

SEQ ID NO: 1134644 - RNA, 13 nt, Homo sapiens
gagguuguaguga

SEQ ID NO: 1134645 - RNA, 13 nt, Homo sapiens
gagguugugcaug

SEQ ID NO: 1134646 - RNA, 20 nt, Homo sapiens
gagguuucccaaugguguuu

SEQ ID NO: 1134647 - RNA, 14 nt, Homo sapiens
gaguaaaauuccuu

SEQ ID NO: 1134648 - RNA, 17 nt, Homo sapiens
gaguaacaggugccuuc

SEQ ID NO: 1134649 - RNA, 18 nt, Homo sapiens
gaguaauacaucaaagag

SEQ ID NO: 1134650 - RNA, 16 nt, Homo sapiens
gaguaauaguaaacac

SEQ ID NO: 1134651 - RNA, 22 nt, Homo sapiens
gaguaauaguaaacacagggaa

SEQ ID NO: 1134652 - RNA, 17 nt, Homo sapiens
gaguaaucuguguacaa

SEQ ID NO: 1134653 - RNA, 17 nt, Homo sapiens
gaguaauuuucugaugg

SEQ ID NO: 1134654 - RNA, 19 nt, Homo sapiens
gaguacuuacuauugguca

SEQ ID NO: 1134655 - RNA, 12 nt, Homo sapiens
gaguagcuggau

SEQ ID NO: 1134656 - RNA, 12 nt, Homo sapiens
gaguauccucuu

SEQ ID NO: 1134657 - RNA, 16 nt, Homo sapiens
gaguauccucuugcca

SEQ ID NO: 1134658 - RNA, 22 nt, Homo sapiens
gaguauuaaugaaaagcacaaa

SEQ ID NO: 1134659 - RNA, 14 nt, Homo sapiens
gagucacacagugu

SEQ ID NO: 1134660 - RNA, 12 nt, Homo sapiens
gagucagcaccc

SEQ ID NO: 1134661 - RNA, 19 nt, Homo sapiens
gagucagcaccuuggccca

SEQ ID NO: 1134662 - RNA, 14 nt, Homo sapiens
gagucauugcugua

SEQ ID NO: 1134663 - RNA, 15 nt, Homo sapiens
gaguccaagaaucca

SEQ ID NO: 1134664 - RNA, 16 nt, Homo sapiens
gaguccuccuguccag

SEQ ID NO: 1134665 - RNA, 14 nt, Homo sapiens
gaguccuuacugaa

SEQ ID NO: 1134666 - RNA, 13 nt, Homo sapiens
gagucucaagggu

SEQ ID NO: 1134667 - RNA, 22 nt, Homo sapiens
gagucuccaacggcaagggaac

SEQ ID NO: 1134668 - RNA, 12 nt, Homo sapiens
gagucucugaac

SEQ ID NO: 1134669 - RNA, 18 nt, Homo sapiens
gagucugcaucauccucc

SEQ ID NO: 1134670 - RNA, 23 nt, Homo sapiens
gagucuugcaagacccagggaga

SEQ ID NO: 1134671 - RNA, 13 nt, Homo sapiens
gagucuugcuaua

SEQ ID NO: 1134672 - RNA, 19 nt, Homo sapiens
gagucuuugguucuaagga

SEQ ID NO: 1134673 - RNA, 12 nt, Homo sapiens
gagugacaccca

SEQ ID NO: 1134674 - RNA, 15 nt, Homo sapiens
gagugacacccaaga

SEQ ID NO: 1134675 - RNA, 21 nt, Homo sapiens
gagugacagagcgagacucca

SEQ ID NO: 1134676 - RNA, 19 nt, Homo sapiens
gagugagacccugucucaa

SEQ ID NO: 1134677 - RNA, 16 nt, Homo sapiens
gagugagucagugaug

SEQ ID NO: 1134678 - RNA, 22 nt, Homo sapiens
gagugaguucccuuagugaauu

SEQ ID NO: 1134679 - RNA, 19 nt, Homo sapiens
gagugcaauggugcaauca

SEQ ID NO: 1134680 - RNA, 23 nt, Homo sapiens
gagugccuuuucgagacuggcag

SEQ ID NO: 1134681 - RNA, 24 nt, Homo sapiens
gagugcuaugaagacaggaucuag

SEQ ID NO: 1134682 - RNA, 14 nt, Homo sapiens
gaguggggaugaca

SEQ ID NO: 1134683 - RNA, 16 nt, Homo sapiens
gaguggguuucacaag

SEQ ID NO: 1134684 - RNA, 16 nt, Homo sapiens
gaguguaguaaagccg

SEQ ID NO: 1134685 - RNA, 18 nt, Homo sapiens
gaguguccuggcugugaa

SEQ ID NO: 1134686 - RNA, 18 nt, Homo sapiens
gagugugguuaugaacuu

SEQ ID NO: 1134687 - RNA, 24 nt, Homo sapiens
gagugugugugaugggaucuguaa

SEQ ID NO: 1134688 - RNA, 20 nt, Homo sapiens
gaguuauucaaaugaaggug

SEQ ID NO: 1134689 - RNA, 18 nt, Homo sapiens
gaguucauccccugugaa

SEQ ID NO: 1134690 - RNA, 23 nt, Homo sapiens
gaguuccagcaaacaaaauggac

SEQ ID NO: 1134691 - RNA, 13 nt, Homo sapiens
gaguugaucugga

SEQ ID NO: 1134692 - RNA, 14 nt, Homo sapiens
gaguugcggcagaa

SEQ ID NO: 1134693 - RNA, 22 nt, Homo sapiens
gaguuuaauuuuugaaaacugg

SEQ ID NO: 1134694 - RNA, 16 nt, Homo sapiens
gaguuugccuguacuc

SEQ ID NO: 1134695 - RNA, 22 nt, Homo sapiens
gaguuuuauagccuggacugcu

SEQ ID NO: 1134696 - RNA, 12 nt, Homo sapiens
gauaaaagacag

SEQ ID NO: 1134697 - RNA, 13 nt, Homo sapiens
gauaaacucagaa

SEQ ID NO: 1134698 - RNA, 20 nt, Homo sapiens
gauaaacugcagagagacaa

SEQ ID NO: 1134699 - RNA, 20 nt, Homo sapiens
gauaacuuccuucacaucuc

SEQ ID NO: 1134700 - RNA, 21 nt, Homo sapiens
gauaagcacauuaaaguuaau

SEQ ID NO: 1134701 - RNA, 22 nt, Homo sapiens
gcuggacgugcgcgaugccugg

SEQ ID NO: 1134702 - RNA, 12 nt, Homo sapiens
gcuggagugcaa

SEQ ID NO: 1134703 - RNA, 13 nt, Homo sapiens
gcuggagugcaau

SEQ ID NO: 1134704 - RNA, 20 nt, Homo sapiens
gcuggagugcaauggcagga

SEQ ID NO: 1134705 - RNA, 19 nt, Homo sapiens
gcuggagugcaguggugca

SEQ ID NO: 1134706 - RNA, 22 nt, Homo sapiens
gcuggauuacaggcaugugcca

SEQ ID NO: 1134707 - RNA, 12 nt, Homo sapiens
gcuggauuugua

SEQ ID NO: 1134708 - RNA, 15 nt, Homo sapiens
gcuggcacuauccag

SEQ ID NO: 1134709 - RNA, 22 nt, Homo sapiens
gcuggccaaagagccuuuccaa

SEQ ID NO: 1134710 - RNA, 18 nt, Homo sapiens
gcuggccagauuuccuca

SEQ ID NO: 1134711 - RNA, 12 nt, Homo sapiens
gcuggcccugug

SEQ ID NO: 1134712 - RNA, 22 nt, Homo sapiens
gcuggccucacccaccccugca

SEQ ID NO: 1134713 - RNA, 20 nt, Homo sapiens
gcugggauuacaggugugca

SEQ ID NO: 1134714 - RNA, 13 nt, Homo sapiens
gcugggcacuucc

SEQ ID NO: 1134715 - RNA, 17 nt, Homo sapiens
gcugggcugagccaaag

SEQ ID NO: 1134716 - RNA, 19 nt, Homo sapiens
gcuggggaacaaccagagg

SEQ ID NO: 1134717 - RNA, 23 nt, Homo sapiens
gcugggucaggcagggugcagua

SEQ ID NO: 1134718 - RNA, 12 nt, Homo sapiens
gcugggugacag

SEQ ID NO: 1134719 - RNA, 19 nt, Homo sapiens
gcugggugagcucuuccag

SEQ ID NO: 1134720 - RNA, 18 nt, Homo sapiens
gcuggucucaaacuccug

SEQ ID NO: 1134721 - RNA, 17 nt, Homo sapiens
gcugucagaugucacau

SEQ ID NO: 1134722 - RNA, 17 nt, Homo sapiens
gcugucauccacuuuau

SEQ ID NO: 1134723 - RNA, 22 nt, Homo sapiens
gcugucuuugcagggcacagau

SEQ ID NO: 1134724 - RNA, 16 nt, Homo sapiens
gcugugccccuccccc

SEQ ID NO: 1134725 - RNA, 19 nt, Homo sapiens
gcuguggccuaaccugccg

SEQ ID NO: 1134726 - RNA, 15 nt, Homo sapiens
gcugugguguguucc

SEQ ID NO: 1134727 - RNA, 22 nt, Homo sapiens
gcugugucacacucuguguuuu

SEQ ID NO: 1134728 - RNA, 12 nt, Homo sapiens
gcuguguguucu

SEQ ID NO: 1134729 - RNA, 19 nt, Homo sapiens
gcuguuauucuuguuauac

SEQ ID NO: 1134730 - RNA, 21 nt, Homo sapiens
gcuuaaacaugccugguggaa

SEQ ID NO: 1134731 - RNA, 19 nt, Homo sapiens
gcuuaacacuugaccuaaa

SEQ ID NO: 1134732 - RNA, 21 nt, Homo sapiens
gcuuaagggaauaugcauugu

SEQ ID NO: 1134733 - RNA, 16 nt, Homo sapiens
gcuuaccaaaguauua

SEQ ID NO: 1134734 - RNA, 21 nt, Homo sapiens
gcuuaccuuguuuugccagug

SEQ ID NO: 1134735 - RNA, 23 nt, Homo sapiens
gcuuacuaugaccuuccaaguuu

SEQ ID NO: 1134736 - RNA, 20 nt, Homo sapiens
gcuuauaagagggcauauac

SEQ ID NO: 1134737 - RNA, 15 nt, Homo sapiens
gcuuauuacauuuaa

SEQ ID NO: 1134738 - RNA, 12 nt, Homo sapiens
gcuucaaaaacu

SEQ ID NO: 1134739 - RNA, 22 nt, Homo sapiens
gcuucagguuagugacauuuaa

SEQ ID NO: 1134740 - RNA, 16 nt, Homo sapiens
gcuucauauaccagca

SEQ ID NO: 1134741 - RNA, 22 nt, Homo sapiens
gcuuccaucaaaccuuugccaa

SEQ ID NO: 1134742 - RNA, 11 nt, Homo sapiens
gcuuccaugau

SEQ ID NO: 1134743 - RNA, 15 nt, Homo sapiens
gcuucccuacuccua

SEQ ID NO: 1134744 - RNA, 18 nt, Homo sapiens
gcuuccgcauccuagucu

SEQ ID NO: 1134745 - RNA, 19 nt, Homo sapiens
gcuuccuaaguagcugggu

SEQ ID NO: 1134746 - RNA, 20 nt, Homo sapiens
gcuuccuaaguagcuggguu

SEQ ID NO: 1134747 - RNA, 24 nt, Homo sapiens
gcuuccuaccacagauucuuuauu

SEQ ID NO: 1134748 - RNA, 20 nt, Homo sapiens
gcuuccugcguuccgugcaa

SEQ ID NO: 1134749 - RNA, 13 nt, Homo sapiens
gcuucuacacugg

SEQ ID NO: 1134750 - RNA, 14 nt, Homo sapiens
gcuucuccugguca

SEQ ID NO: 1134751 - RNA, 18 nt, Homo sapiens
gcuucuccuggucacugg

SEQ ID NO: 1134752 - RNA, 17 nt, Homo sapiens
gcuucucuucugaccca

SEQ ID NO: 1134753 - RNA, 21 nt, Homo sapiens
gcuucugguuaggugugucag

SEQ ID NO: 1134754 - RNA, 14 nt, Homo sapiens
gcuugaauguuugu

SEQ ID NO: 1134755 - RNA, 15 nt, Homo sapiens
gcuugacaacaucug

SEQ ID NO: 1134756 - RNA, 13 nt, Homo sapiens
gcuugaccaaaga

SEQ ID NO: 1134757 - RNA, 20 nt, Homo sapiens
gcuuggagcaaucagaacuu

SEQ ID NO: 1134758 - RNA, 21 nt, Homo sapiens
gcuuggcaucugugugcgugg

SEQ ID NO: 1134759 - RNA, 17 nt, Homo sapiens
gcuugggaaagguggug

SEQ ID NO: 1134760 - RNA, 20 nt, Homo sapiens
gcuuggguggagaagccauu

SEQ ID NO: 1134761 - RNA, 22 nt, Homo sapiens
gcuuguaacuccaccaacccau

SEQ ID NO: 1134762 - RNA, 22 nt, Homo sapiens
gcuuguccccuccucacucccu

SEQ ID NO: 1134763 - RNA, 17 nt, Homo sapiens
gcuuguggccaaugcau

SEQ ID NO: 1134764 - RNA, 22 nt, Homo sapiens
gcuuguuuuccagucucuugua

SEQ ID NO: 1134765 - RNA, 15 nt, Homo sapiens
gcuuuaggugguguu

SEQ ID NO: 1134766 - RNA, 20 nt, Homo sapiens
gcuuuauuccagaaugcugu

SEQ ID NO: 1134767 - RNA, 13 nt, Homo sapiens
gcuuuccaaaacc

SEQ ID NO: 1134768 - RNA, 18 nt, Homo sapiens
gcuuuccugcacauucuc

SEQ ID NO: 1134769 - RNA, 21 nt, Homo sapiens
gcuuucuccauuguaaaccac

SEQ ID NO: 1134770 - RNA, 11 nt, Homo sapiens
gcuuucuuaua

SEQ ID NO: 1134771 - RNA, 15 nt, Homo sapiens
gcuuugagcaacuaa

SEQ ID NO: 1134772 - RNA, 16 nt, Homo sapiens
gcuuugagcaacuaac

SEQ ID NO: 1134773 - RNA, 14 nt, Homo sapiens
gcuuugcugugaag

SEQ ID NO: 1134774 - RNA, 16 nt, Homo sapiens
gcuuugcuuucugcuc

SEQ ID NO: 1134775 - RNA, 17 nt, Homo sapiens
gcuuugugauagugaca

SEQ ID NO: 1134776 - RNA, 21 nt, Homo sapiens
gcuuugugccaucacugagca

SEQ ID NO: 1134777 - RNA, 12 nt, Homo sapiens
gcuuuguggcac

SEQ ID NO: 1134778 - RNA, 17 nt, Homo sapiens
gcuuuuaggaacuuuau

SEQ ID NO: 1134779 - RNA, 21 nt, Homo sapiens
gcuuuugguggcuaccaugca

SEQ ID NO: 1134780 - RNA, 19 nt, Homo sapiens
gcuuuugguuauaaugugu

SEQ ID NO: 1134781 - RNA, 13 nt, Homo sapiens
ggaaaacacugcc

SEQ ID NO: 1134782 - RNA, 12 nt, Homo sapiens
ggaaaaugcauu

SEQ ID NO: 1134783 - RNA, 20 nt, Homo sapiens
ggaaacauauuuaagaaaua

SEQ ID NO: 1134784 - RNA, 16 nt, Homo sapiens
ggaaacuugucacuug

SEQ ID NO: 1134785 - RNA, 15 nt, Homo sapiens
ggaaagaacugucau

SEQ ID NO: 1134786 - RNA, 21 nt, Homo sapiens
ggaaagacaugcagcuuucau

SEQ ID NO: 1134787 - RNA, 13 nt, Homo sapiens
ggaaagacuugaa

SEQ ID NO: 1134788 - RNA, 14 nt, Homo sapiens
ggaaaggauucaug

SEQ ID NO: 1134789 - RNA, 21 nt, Homo sapiens
ggaaagggagacgcccuuuca

SEQ ID NO: 1134790 - RNA, 13 nt, Homo sapiens
ggaaaguauuuau

SEQ ID NO: 1134791 - RNA, 20 nt, Homo sapiens
ggaaagugauuuuuuuccac

SEQ ID NO: 1134792 - RNA, 13 nt, Homo sapiens
ggaaaguguaaag

SEQ ID NO: 1134793 - RNA, 23 nt, Homo sapiens
ggaaauaguaccuucaauacuua

SEQ ID NO: 1134794 - RNA, 21 nt, Homo sapiens
ggaaauauuuugugauggugu

SEQ ID NO: 1134795 - RNA, 19 nt, Homo sapiens
ggaacaagacagccuucac

SEQ ID NO: 1134796 - RNA, 16 nt, Homo sapiens
ggaacaagccuaaaaa

SEQ ID NO: 1134797 - RNA, 14 nt, Homo sapiens
ggaaccgauggugg

SEQ ID NO: 1134798 - RNA, 22 nt, Homo sapiens
ggaaccguaggacccaagcaga

SEQ ID NO: 1134799 - RNA, 21 nt, Homo sapiens
ggaaccucagccuggccagac

SEQ ID NO: 1134800 - RNA, 16 nt, Homo sapiens
ggaagaaccacugucu

SEQ ID NO: 1134801 - RNA, 18 nt, Homo sapiens
ggaagaagauagauccaa

SEQ ID NO: 1134802 - RNA, 23 nt, Homo sapiens
ggaagacgcuuccuuccaggaca

SEQ ID NO: 1134803 - RNA, 14 nt, Homo sapiens
ggaagagauccaaa

SEQ ID NO: 1134804 - RNA, 12 nt, Homo sapiens
ggaagagcuaau

SEQ ID NO: 1134805 - RNA, 22 nt, Homo sapiens
ggaagaucuaccugcaacacaa

SEQ ID NO: 1134806 - RNA, 23 nt, Homo sapiens
ggaagcauuuguuucuacuuuga

SEQ ID NO: 1134807 - RNA, 15 nt, Homo sapiens
ggaagccuccugucu

SEQ ID NO: 1134808 - RNA, 15 nt, Homo sapiens
ggaagcuaauuugca

SEQ ID NO: 1134809 - RNA, 15 nt, Homo sapiens
ggaaggacuaugaca

SEQ ID NO: 1134810 - RNA, 23 nt, Homo sapiens
ggaaggcagcagagggucuccaa

SEQ ID NO: 1134811 - RNA, 13 nt, Homo sapiens
ggaaggcucucgg

SEQ ID NO: 1134812 - RNA, 14 nt, Homo sapiens
ggaagggacuggga

SEQ ID NO: 1134813 - RNA, 14 nt, Homo sapiens
ggaagggagguggc

SEQ ID NO: 1134814 - RNA, 15 nt, Homo sapiens
ggaaguagcugucag

SEQ ID NO: 1134815 - RNA, 13 nt, Homo sapiens
ggaagucaucuca

SEQ ID NO: 1134816 - RNA, 23 nt, Homo sapiens
ggaagucaucucauuccacuguu

SEQ ID NO: 1134817 - RNA, 14 nt, Homo sapiens
ggaagucucaaaga

SEQ ID NO: 1134818 - RNA, 13 nt, Homo sapiens
ggaagugacauug

SEQ ID NO: 1134819 - RNA, 11 nt, Homo sapiens
ggaagugcaga

SEQ ID NO: 1134820 - RNA, 11 nt, Homo sapiens
ggaagugcuuc

SEQ ID NO: 1134821 - RNA, 18 nt, Homo sapiens
ggaaguguuccugucuca

SEQ ID NO: 1134822 - RNA, 12 nt, Homo sapiens
ggaaguucuccu

SEQ ID NO: 1134823 - RNA, 23 nt, Homo sapiens
ggaauaugcauugucugcaaugg

SEQ ID NO: 1134824 - RNA, 23 nt, Homo sapiens
ggaaucagaacucaaauggggcc

SEQ ID NO: 1134825 - RNA, 23 nt, Homo sapiens
ggaauccgagauaggguggcaca

SEQ ID NO: 1134826 - RNA, 15 nt, Homo sapiens
ggaaucuugcuccaa

SEQ ID NO: 1134827 - RNA, 14 nt, Homo sapiens
ggaaugaacugucc

SEQ ID NO: 1134828 - RNA, 17 nt, Homo sapiens
ggaaugacucaugccuc

SEQ ID NO: 1134829 - RNA, 23 nt, Homo sapiens
ggaaugcacacagcggcugccuc

SEQ ID NO: 1134830 - RNA, 15 nt, Homo sapiens
ggaaugccaauguca

SEQ ID NO: 1134831 - RNA, 12 nt, Homo sapiens
ggaauguaggga

SEQ ID NO: 1134832 - RNA, 21 nt, Homo sapiens
ggaauuacaaaacucagagaa

SEQ ID NO: 1134833 - RNA, 21 nt, Homo sapiens
ggaauugcagcuguacugagg

SEQ ID NO: 1134834 - RNA, 13 nt, Homo sapiens
ggaauugcucaga

SEQ ID NO: 1134835 - RNA, 22 nt, Homo sapiens
ggacaaauugagacagugcaca

SEQ ID NO: 1134836 - RNA, 20 nt, Homo sapiens
ggaccagccucuccacucau

SEQ ID NO: 1134837 - RNA, 15 nt, Homo sapiens
ggaccagcucaggac

SEQ ID NO: 1134838 - RNA, 14 nt, Homo sapiens
ggaccagguauaga

SEQ ID NO: 1134839 - RNA, 22 nt, Homo sapiens
ggacccacacugcuacacuucu

SEQ ID NO: 1134840 - RNA, 13 nt, Homo sapiens
ggacccagugcag

SEQ ID NO: 1134841 - RNA, 16 nt, Homo sapiens
ggaccccaccccucau

SEQ ID NO: 1134842 - RNA, 22 nt, Homo sapiens
ggaccccgagccuggcuccaaa

SEQ ID NO: 1134843 - RNA, 21 nt, Homo sapiens
ggaccccugaguaaaaaagcu

SEQ ID NO: 1134844 - RNA, 20 nt, Homo sapiens
ggacccuguugaggguccuc

SEQ ID NO: 1134845 - RNA, 15 nt, Homo sapiens
ggaccgccauggugc

SEQ ID NO: 1134846 - RNA, 22 nt, Homo sapiens
ggaccuuuaaaaagcaggaaau

SEQ ID NO: 1134847 - RNA, 23 nt, Homo sapiens
ggacuaaguucucauuguucaaa

SEQ ID NO: 1134848 - RNA, 20 nt, Homo sapiens
ggacuaauccaauaccucuu

SEQ ID NO: 1134849 - RNA, 19 nt, Homo sapiens
ggacuauauuugggccugc

SEQ ID NO: 1134850 - RNA, 13 nt, Homo sapiens
ggacuaugacaaa

SEQ ID NO: 1134851 - RNA, 20 nt, Homo sapiens
ggacucaaaguuucagagac

SEQ ID NO: 1134852 - RNA, 21 nt, Homo sapiens
ggacuccagaaucuaaagcca

SEQ ID NO: 1134853 - RNA, 13 nt, Homo sapiens
ggacucugcacau

SEQ ID NO: 1134854 - RNA, 16 nt, Homo sapiens
ggacugagccagaccu

SEQ ID NO: 1134855 - RNA, 19 nt, Homo sapiens
ggacuuccacauuuuugca

SEQ ID NO: 1134856 - RNA, 18 nt, Homo sapiens
ggacuuccuguccagcuc

SEQ ID NO: 1134857 - RNA, 14 nt, Homo sapiens
ggacuucugcaucu

SEQ ID NO: 1134858 - RNA, 22 nt, Homo sapiens
ggacuucugcaucuuacaguca

SEQ ID NO: 1134859 - RNA, 18 nt, Homo sapiens
ggacuugcugaauucucu

SEQ ID NO: 1134860 - RNA, 16 nt, Homo sapiens
ggagaccugcucuccg

SEQ ID NO: 1134861 - RNA, 21 nt, Homo sapiens
ggagacucaccucugccucaa

SEQ ID NO: 1134862 - RNA, 23 nt, Homo sapiens
ggagagagauuguguucuuccuc

SEQ ID NO: 1134863 - RNA, 14 nt, Homo sapiens
ggagagcaaagguu

SEQ ID NO: 1134864 - RNA, 16 nt, Homo sapiens
ggagaggaacaagcuu

SEQ ID NO: 1134865 - RNA, 20 nt, Homo sapiens
ggagaggggaccaugcaaag

SEQ ID NO: 1134866 - RNA, 14 nt, Homo sapiens
ggagaggggacgca

SEQ ID NO: 1134867 - RNA, 18 nt, Homo sapiens
ggagaugaccugccuuau

SEQ ID NO: 1134868 - RNA, 16 nt, Homo sapiens
ggagauggacaacuca

SEQ ID NO: 1134869 - RNA, 16 nt, Homo sapiens
ggagaugggugcaacu

SEQ ID NO: 1134870 - RNA, 16 nt, Homo sapiens
ggagaugucucugcaa

SEQ ID NO: 1134871 - RNA, 21 nt, Homo sapiens
ggagauuucuuguugcucaaa

SEQ ID NO: 1134872 - RNA, 20 nt, Homo sapiens
ggagcacauacuaccuagaa

SEQ ID NO: 1134873 - RNA, 16 nt, Homo sapiens
ggagcagagagguggc

SEQ ID NO: 1134874 - RNA, 18 nt, Homo sapiens
ggagccaaaaucucaaga

SEQ ID NO: 1134875 - RNA, 11 nt, Homo sapiens
ggagccaaagc

SEQ ID NO: 1134876 - RNA, 17 nt, Homo sapiens
ggagccccacugcccuu

SEQ ID NO: 1134877 - RNA, 20 nt, Homo sapiens
ggagccgggacccucaggug

SEQ ID NO: 1134878 - RNA, 21 nt, Homo sapiens
ggagccuuuuuaaaacacaug

SEQ ID NO: 1134879 - RNA, 23 nt, Homo sapiens
ggagcggacucacuugauguuuc

SEQ ID NO: 1134880 - RNA, 14 nt, Homo sapiens
ggagcguguggcug

SEQ ID NO: 1134881 - RNA, 18 nt, Homo sapiens
ggagcguguggcugugcc

SEQ ID NO: 1134882 - RNA, 22 nt, Homo sapiens
ggagcguucuaaauaugaauga

SEQ ID NO: 1134883 - RNA, 14 nt, Homo sapiens
ggagcuagccagag

SEQ ID NO: 1134884 - RNA, 18 nt, Homo sapiens
ggagcucuucugugcccu

SEQ ID NO: 1134885 - RNA, 16 nt, Homo sapiens
ggagcugccccucucu

SEQ ID NO: 1134886 - RNA, 21 nt, Homo sapiens
ggagcugccuuggcucagaca

SEQ ID NO: 1134887 - RNA, 20 nt, Homo sapiens
ggagcuggcccagggggccu

SEQ ID NO: 1134888 - RNA, 12 nt, Homo sapiens
ggagcuggugac

SEQ ID NO: 1134889 - RNA, 23 nt, Homo sapiens
ggagcuuccuguccucccagcuc

SEQ ID NO: 1134890 - RNA, 22 nt, Homo sapiens
ggaggaaugugugccuuguuca

SEQ ID NO: 1134891 - RNA, 22 nt, Homo sapiens
ggaggauacugaggcacacaga

SEQ ID NO: 1134892 - RNA, 15 nt, Homo sapiens
ggaggcaacgccaga

SEQ ID NO: 1134893 - RNA, 18 nt, Homo sapiens
ggaggcaccaaacaccca

SEQ ID NO: 1134894 - RNA, 17 nt, Homo sapiens
ggaggcacccaugccau

SEQ ID NO: 1134895 - RNA, 20 nt, Homo sapiens
ggaggcagagcuugcaguga

SEQ ID NO: 1134896 - RNA, 19 nt, Homo sapiens
ggaggccagccagugaccu

SEQ ID NO: 1134897 - RNA, 14 nt, Homo sapiens
ggaggccagugagc

SEQ ID NO: 1134898 - RNA, 21 nt, Homo sapiens
ggaggccauucugagccacac

SEQ ID NO: 1134899 - RNA, 19 nt, Homo sapiens
ggaggcgcggccucccgag

SEQ ID NO: 1134900 - RNA, 20 nt, Homo sapiens
ggaggcggagguugcaauga

SEQ ID NO: 1134901 - RNA, 23 nt, Homo sapiens
ggaggcugaagcaggagauuugc

SEQ ID NO: 1134902 - RNA, 22 nt, Homo sapiens
ggagggcgugacucacccaagc

SEQ ID NO: 1134903 - RNA, 18 nt, Homo sapiens
ggagggggagagagcaag

SEQ ID NO: 1134904 - RNA, 11 nt, Homo sapiens
ggagggggccc

SEQ ID NO: 1134905 - RNA, 18 nt, Homo sapiens
ggagggguauuuuugccc

SEQ ID NO: 1134906 - RNA, 18 nt, Homo sapiens
ggaggucagcacaagaua

SEQ ID NO: 1134907 - RNA, 17 nt, Homo sapiens
ggaggugagagugcaga

SEQ ID NO: 1134908 - RNA, 23 nt, Homo sapiens
ggaguaauaguaaacacagggaa

SEQ ID NO: 1134909 - RNA, 22 nt, Homo sapiens
ggaguaaucuguguacaaagaa

SEQ ID NO: 1134910 - RNA, 18 nt, Homo sapiens
ggaguacaccccaacagc

SEQ ID NO: 1134911 - RNA, 22 nt, Homo sapiens
ggaguacaccccaacagcaccc

SEQ ID NO: 1134912 - RNA, 14 nt, Homo sapiens
ggagucacacagug

SEQ ID NO: 1134913 - RNA, 13 nt, Homo sapiens
ggaguccaagacc

SEQ ID NO: 1134914 - RNA, 15 nt, Homo sapiens
ggagucccagagcug

SEQ ID NO: 1134915 - RNA, 13 nt, Homo sapiens
ggagucucaggag

SEQ ID NO: 1134916 - RNA, 13 nt, Homo sapiens
ggagugcauuuag

SEQ ID NO: 1134917 - RNA, 17 nt, Homo sapiens
ggagugcccccaacagc

SEQ ID NO: 1134918 - RNA, 15 nt, Homo sapiens
ggaguggccacuaag

SEQ ID NO: 1134919 - RNA, 20 nt, Homo sapiens
ggaguguccucuucccucuc

SEQ ID NO: 1134920 - RNA, 21 nt, Homo sapiens
ggaguuaauuuuauugauaau

SEQ ID NO: 1134921 - RNA, 18 nt, Homo sapiens
ggaguuaggcuauucaca

SEQ ID NO: 1134922 - RNA, 14 nt, Homo sapiens
ggaguuaguggaua

SEQ ID NO: 1134923 - RNA, 12 nt, Homo sapiens
ggauacagucau

SEQ ID NO: 1134924 - RNA, 16 nt, Homo sapiens
ggauagagacuggaac

SEQ ID NO: 1134925 - RNA, 19 nt, Homo sapiens
ggauaguacuaagcauuuc

SEQ ID NO: 1134926 - RNA, 19 nt, Homo sapiens
ggauaucauacuuccaucu

SEQ ID NO: 1134927 - RNA, 16 nt, Homo sapiens
ggauauuaaauguugc

SEQ ID NO: 1134928 - RNA, 23 nt, Homo sapiens
ggaucaauuauggcaguaccuuu

SEQ ID NO: 1134929 - RNA, 22 nt, Homo sapiens
ggaucauguaaaugcucaaaga

SEQ ID NO: 1134930 - RNA, 21 nt, Homo sapiens
ggaucguugucccuacaggag

SEQ ID NO: 1134931 - RNA, 17 nt, Homo sapiens
ggaucuaccagcauaaa

SEQ ID NO: 1134932 - RNA, 14 nt, Homo sapiens
ggaucucacauuuc

SEQ ID NO: 1134933 - RNA, 20 nt, Homo sapiens
ggaucugcugcauccaggac

SEQ ID NO: 1134934 - RNA, 19 nt, Homo sapiens
ggaucugucauuaucaaaa

SEQ ID NO: 1134935 - RNA, 16 nt, Homo sapiens
ggaugaaacuaaagca

SEQ ID NO: 1134936 - RNA, 18 nt, Homo sapiens
ggaugaagcccagccaca

SEQ ID NO: 1134937 - RNA, 16 nt, Homo sapiens
ggaugagagggugcua

SEQ ID NO: 1134938 - RNA, 15 nt, Homo sapiens
ggaugaugcugucau

SEQ ID NO: 1134939 - RNA, 20 nt, Homo sapiens
ggaugauuauuuucuguucu

SEQ ID NO: 1134940 - RNA, 22 nt, Homo sapiens
ggaugcauagccuggacacaga

SEQ ID NO: 1134941 - RNA, 20 nt, Homo sapiens
ggauggggugggcuuagggg

SEQ ID NO: 1134942 - RNA, 17 nt, Homo sapiens
ggaugguggagggccac

SEQ ID NO: 1134943 - RNA, 16 nt, Homo sapiens
ggauggugggguacca

SEQ ID NO: 1134944 - RNA, 20 nt, Homo sapiens
ggaugguguuacugcaguug

SEQ ID NO: 1134945 - RNA, 13 nt, Homo sapiens
ggaugucugccac

SEQ ID NO: 1134946 - RNA, 23 nt, Homo sapiens
ggauguguccaguuugugcucua

SEQ ID NO: 1134947 - RNA, 10 nt, Homo sapiens
ggauguugcc

SEQ ID NO: 1134948 - RNA, 19 nt, Homo sapiens
ggauuccaaaccaggacac

SEQ ID NO: 1134949 - RNA, 12 nt, Homo sapiens
ggauucuauuua

SEQ ID NO: 1134950 - RNA, 11 nt, Homo sapiens
auaaacuguaa

SEQ ID NO: 1134951 - RNA, 11 nt, Homo sapiens
auaaagacagg

SEQ ID NO: 1134952 - RNA, 14 nt, Homo sapiens
auaaagcagcucag

SEQ ID NO: 1134953 - RNA, 22 nt, Homo sapiens
auaaagcaucauuaaugcacau

SEQ ID NO: 1134954 - RNA, 13 nt, Homo sapiens
auaaagcuaaaau

SEQ ID NO: 1134955 - RNA, 17 nt, Homo sapiens
auaaaggaaacauauaa

SEQ ID NO: 1134956 - RNA, 19 nt, Homo sapiens
auaaaggaaacccagcuca

SEQ ID NO: 1134957 - RNA, 14 nt, Homo sapiens
auaaaggaugugau

SEQ ID NO: 1134958 - RNA, 19 nt, Homo sapiens
auaaagguuagauaagucc

SEQ ID NO: 1134959 - RNA, 15 nt, Homo sapiens
auaaauaaaagaaca

SEQ ID NO: 1134960 - RNA, 18 nt, Homo sapiens
auaaauacaagaguuuca

SEQ ID NO: 1134961 - RNA, 20 nt, Homo sapiens
auaaauaccaauuauggaaa

SEQ ID NO: 1134962 - RNA, 21 nt, Homo sapiens
auaaaucguccucccaggcca

SEQ ID NO: 1134963 - RNA, 22 nt, Homo sapiens
auaaaucugaagugguucaguc

SEQ ID NO: 1134964 - RNA, 18 nt, Homo sapiens
auaaaucugacccagugc

SEQ ID NO: 1134965 - RNA, 14 nt, Homo sapiens
auaaaugaucuaga

SEQ ID NO: 1134966 - RNA, 12 nt, Homo sapiens
auaaauggauau

SEQ ID NO: 1134967 - RNA, 19 nt, Homo sapiens
auaaauucuacuaaguuau

SEQ ID NO: 1134968 - RNA, 15 nt, Homo sapiens
auaaauuuacugaaa

SEQ ID NO: 1134969 - RNA, 16 nt, Homo sapiens
auaacaaagauaucuu

SEQ ID NO: 1134970 - RNA, 22 nt, Homo sapiens
auaacaauaaaagacaaggaaa

SEQ ID NO: 1134971 - RNA, 12 nt, Homo sapiens
auaacaaugaaa

SEQ ID NO: 1134972 - RNA, 22 nt, Homo sapiens
auaacagcaggguaccugaaag

SEQ ID NO: 1134973 - RNA, 12 nt, Homo sapiens
auaacagguuau

SEQ ID NO: 1134974 - RNA, 20 nt, Homo sapiens
auaacaguaguccuuugaua

SEQ ID NO: 1134975 - RNA, 21 nt, Homo sapiens
auaacauuuucaauacugucc

SEQ ID NO: 1134976 - RNA, 19 nt, Homo sapiens
auaaccugaugccauaaau

SEQ ID NO: 1134977 - RNA, 16 nt, Homo sapiens
auaaccuugugccuug

SEQ ID NO: 1134978 - RNA, 17 nt, Homo sapiens
auaacgagguuccagua

SEQ ID NO: 1134979 - RNA, 18 nt, Homo sapiens
auaacucuccugcccaug

SEQ ID NO: 1134980 - RNA, 11 nt, Homo sapiens
auaacucugug

SEQ ID NO: 1134981 - RNA, 15 nt, Homo sapiens
auaacucugugaucu

SEQ ID NO: 1134982 - RNA, 23 nt, Homo sapiens
auaacugcuacuugcucugcucu

SEQ ID NO: 1134983 - RNA, 18 nt, Homo sapiens
auaacuuccauuuuauua

SEQ ID NO: 1134984 - RNA, 12 nt, Homo sapiens
auaagaaaaagg

SEQ ID NO: 1134985 - RNA, 16 nt, Homo sapiens
auaagcccaauaucag

SEQ ID NO: 1134986 - RNA, 18 nt, Homo sapiens
auaagccccaagcgaauu

SEQ ID NO: 1134987 - RNA, 14 nt, Homo sapiens
auaaggauucugaa

SEQ ID NO: 1134988 - RNA, 20 nt, Homo sapiens
auaaggggaagagucauuuu

SEQ ID NO: 1134989 - RNA, 20 nt, Homo sapiens
auaaguccuuguguagcaaa

SEQ ID NO: 1134990 - RNA, 19 nt, Homo sapiens
auaaguuauugcaguuuau

SEQ ID NO: 1134991 - RNA, 22 nt, Homo sapiens
auaauagcacuaaugcuuuaag

SEQ ID NO: 1134992 - RNA, 24 nt, Homo sapiens
auaauauccagccucccacaagaa

SEQ ID NO: 1134993 - RNA, 15 nt, Homo sapiens
auaauauccagguca

SEQ ID NO: 1134994 - RNA, 16 nt, Homo sapiens
auaauaugagaaucag

SEQ ID NO: 1134995 - RNA, 20 nt, Homo sapiens
auaauaugcacacagugcuu

SEQ ID NO: 1134996 - RNA, 22 nt, Homo sapiens
auaaucaaaacccaacaugacu

SEQ ID NO: 1134997 - RNA, 16 nt, Homo sapiens
auaaucuguacaauga

SEQ ID NO: 1134998 - RNA, 13 nt, Homo sapiens
auaaugaaugaga

SEQ ID NO: 1134999 - RNA, 19 nt, Homo sapiens
auaaugacucuuaggacau

SEQ ID NO: 1135000 - RNA, 14 nt, Homo sapiens
auaaugcaagcuua

SEQ ID NO: 1135001 - RNA, 21 nt, Homo sapiens
auaaugccauuuuaaggaaaa

SEQ ID NO: 1135002 - RNA, 15 nt, Homo sapiens
auaaugcuacugucu

SEQ ID NO: 1135003 - RNA, 23 nt, Homo sapiens
auaauggaaaaaaaaaaaagagg

SEQ ID NO: 1135004 - RNA, 20 nt, Homo sapiens
auaaugguuuuuaacaccuu

SEQ ID NO: 1135005 - RNA, 13 nt, Homo sapiens
auauccaagaagc

SEQ ID NO: 1135006 - RNA, 23 nt, Homo sapiens
auauccaagaagcaugcagagaa

SEQ ID NO: 1135007 - RNA, 14 nt, Homo sapiens
auauccucccucca

SEQ ID NO: 1135008 - RNA, 19 nt, Homo sapiens
auaucgcuggccagcauua

SEQ ID NO: 1135009 - RNA, 13 nt, Homo sapiens
auaucucuccagc

SEQ ID NO: 1135010 - RNA, 18 nt, Homo sapiens
auaucugggucaauccac

SEQ ID NO: 1135011 - RNA, 11 nt, Homo sapiens
auaucuuggcc

SEQ ID NO: 1135012 - RNA, 19 nt, Homo sapiens
auaucuuuuguaagacauu

SEQ ID NO: 1135013 - RNA, 19 nt, Homo sapiens
auaugaaucugcucacuuu

SEQ ID NO: 1135014 - RNA, 15 nt, Homo sapiens
auaugagacuuucaa

SEQ ID NO: 1135015 - RNA, 22 nt, Homo sapiens
auaugaggcuguugucuuuucc

SEQ ID NO: 1135016 - RNA, 18 nt, Homo sapiens
auaugaguaauacaucaa

SEQ ID NO: 1135017 - RNA, 14 nt, Homo sapiens
auaugauaaaacac

SEQ ID NO: 1135018 - RNA, 22 nt, Homo sapiens
auaugauuuuuagaaaucagcu

SEQ ID NO: 1135019 - RNA, 20 nt, Homo sapiens
auaugcaccaaaucaucucu

SEQ ID NO: 1135020 - RNA, 15 nt, Homo sapiens
auaugcagauuuugc

SEQ ID NO: 1135021 - RNA, 18 nt, Homo sapiens
auaugcauugucugcaau

SEQ ID NO: 1135022 - RNA, 17 nt, Homo sapiens
auaugcccacauuuagu

SEQ ID NO: 1135023 - RNA, 22 nt, Homo sapiens
auaugccuaaaugcacagucau

SEQ ID NO: 1135024 - RNA, 16 nt, Homo sapiens
auauggaaauucugcu

SEQ ID NO: 1135025 - RNA, 17 nt, Homo sapiens
auauggaauucaaagcu

SEQ ID NO: 1135026 - RNA, 16 nt, Homo sapiens
auauggacacugugac

SEQ ID NO: 1135027 - RNA, 21 nt, Homo sapiens
auauggacucugcacaugaau

SEQ ID NO: 1135028 - RNA, 20 nt, Homo sapiens
auauggggaaaaaacugugc

SEQ ID NO: 1135029 - RNA, 20 nt, Homo sapiens
auaugggguguuuguuccca

SEQ ID NO: 1135030 - RNA, 21 nt, Homo sapiens
auaugggguguuuguucccau

SEQ ID NO: 1135031 - RNA, 19 nt, Homo sapiens
auaugguguacauucuucc

SEQ ID NO: 1135032 - RNA, 17 nt, Homo sapiens
auauguauuucuauaua

SEQ ID NO: 1135033 - RNA, 16 nt, Homo sapiens
auauuacccuguaaua

SEQ ID NO: 1135034 - RNA, 12 nt, Homo sapiens
auauuagcuuua

SEQ ID NO: 1135035 - RNA, 18 nt, Homo sapiens
auauuaggagacacaggg

SEQ ID NO: 1135036 - RNA, 21 nt, Homo sapiens
auauuaguaaaagaugccaua

SEQ ID NO: 1135037 - RNA, 13 nt, Homo sapiens
auauuaugagaug

SEQ ID NO: 1135038 - RNA, 17 nt, Homo sapiens
auauuauuacuguugau

SEQ ID NO: 1135039 - RNA, 21 nt, Homo sapiens
auauuauuauuaauuuugcca

SEQ ID NO: 1135040 - RNA, 17 nt, Homo sapiens
auauuccaccaggauau

SEQ ID NO: 1135041 - RNA, 15 nt, Homo sapiens
auauucuggccagac

SEQ ID NO: 1135042 - RNA, 23 nt, Homo sapiens
auauugaacuuuuuuccacugaa

SEQ ID NO: 1135043 - RNA, 15 nt, Homo sapiens
auauugaccauguga

SEQ ID NO: 1135044 - RNA, 20 nt, Homo sapiens
auauugcaggagacauuuuc

SEQ ID NO: 1135045 - RNA, 20 nt, Homo sapiens
auauuggaaagugauuuuau

SEQ ID NO: 1135046 - RNA, 18 nt, Homo sapiens
auauuguaaaagggauuu

SEQ ID NO: 1135047 - RNA, 12 nt, Homo sapiens
auauugucauua

SEQ ID NO: 1135048 - RNA, 14 nt, Homo sapiens
auauuuaacaugua

SEQ ID NO: 1135049 - RNA, 22 nt, Homo sapiens
auauuuaacuuuuugccaaaua

SEQ ID NO: 1135050 - RNA, 12 nt, Homo sapiens
auauuuaucucu

SEQ ID NO: 1135051 - RNA, 19 nt, Homo sapiens
auauuuauggggggagaac

SEQ ID NO: 1135052 - RNA, 14 nt, Homo sapiens
auauuucaauguua

SEQ ID NO: 1135053 - RNA, 14 nt, Homo sapiens
auauuucaugugcu

SEQ ID NO: 1135054 - RNA, 17 nt, Homo sapiens
auauuuccugacuugag

SEQ ID NO: 1135055 - RNA, 19 nt, Homo sapiens
auauuugugugaggacuuc

SEQ ID NO: 1135056 - RNA, 15 nt, Homo sapiens
auauuuucaccauuu

SEQ ID NO: 1135057 - RNA, 20 nt, Homo sapiens
auauuuuuaaaaaucuaccu

SEQ ID NO: 1135058 - RNA, 17 nt, Homo sapiens
auauuuuugugcacauu

SEQ ID NO: 1135059 - RNA, 19 nt, Homo sapiens
auauuuuuuaaaaaacacu

SEQ ID NO: 1135060 - RNA, 16 nt, Homo sapiens
auauuuuuuuaacugu

SEQ ID NO: 1135061 - RNA, 15 nt, Homo sapiens
aucaaaagugaucag

SEQ ID NO: 1135062 - RNA, 15 nt, Homo sapiens
aucaaaauccaaaau

SEQ ID NO: 1135063 - RNA, 12 nt, Homo sapiens
aucaaacaugaa

SEQ ID NO: 1135064 - RNA, 16 nt, Homo sapiens
aucaaagcuucaaaaa

SEQ ID NO: 1135065 - RNA, 15 nt, Homo sapiens
aucaaaggcacacag

SEQ ID NO: 1135066 - RNA, 22 nt, Homo sapiens
aucaaaugugacauuauaugca

SEQ ID NO: 1135067 - RNA, 13 nt, Homo sapiens
aucaacagcauuu

SEQ ID NO: 1135068 - RNA, 16 nt, Homo sapiens
aucaacgaguacuuca

SEQ ID NO: 1135069 - RNA, 13 nt, Homo sapiens
aucaacucugucu

SEQ ID NO: 1135070 - RNA, 23 nt, Homo sapiens
aucaacuugcuuaucaacuuccu

SEQ ID NO: 1135071 - RNA, 18 nt, Homo sapiens
aucaagacugcaaacccu

SEQ ID NO: 1135072 - RNA, 23 nt, Homo sapiens
aucaagacugcaaacccuuucau

SEQ ID NO: 1135073 - RNA, 16 nt, Homo sapiens
aucaagaggcugagac

SEQ ID NO: 1135074 - RNA, 22 nt, Homo sapiens
aucaagcugugagacaguggga

SEQ ID NO: 1135075 - RNA, 22 nt, Homo sapiens
aucaagcuuuuaaaaacuagag

SEQ ID NO: 1135076 - RNA, 16 nt, Homo sapiens
aucaaggggucacuua

SEQ ID NO: 1135077 - RNA, 14 nt, Homo sapiens
aucaagucagcaac

SEQ ID NO: 1135078 - RNA, 13 nt, Homo sapiens
aucaauaaauucc

SEQ ID NO: 1135079 - RNA, 19 nt, Homo sapiens
aucaauauugggccuaaaa

SEQ ID NO: 1135080 - RNA, 18 nt, Homo sapiens
aucaaucaagacugcaaa

SEQ ID NO: 1135081 - RNA, 16 nt, Homo sapiens
aucaaugaaaugaugu

SEQ ID NO: 1135082 - RNA, 12 nt, Homo sapiens
aucaauuccauc

SEQ ID NO: 1135083 - RNA, 16 nt, Homo sapiens
aucaauuccaucagca

SEQ ID NO: 1135084 - RNA, 19 nt, Homo sapiens
aucaauuccaucagcacaa

SEQ ID NO: 1135085 - RNA, 22 nt, Homo sapiens
aucacacacauggaaacccaua

SEQ ID NO: 1135086 - RNA, 20 nt, Homo sapiens
aucacaggaaaauguaucca

SEQ ID NO: 1135087 - RNA, 13 nt, Homo sapiens
aucacaggcaucu

SEQ ID NO: 1135088 - RNA, 22 nt, Homo sapiens
aucauuaaggucauuacucuca

SEQ ID NO: 1135089 - RNA, 12 nt, Homo sapiens
aucauuagaaca

SEQ ID NO: 1135090 - RNA, 17 nt, Homo sapiens
aucauucaaguguaaaa

SEQ ID NO: 1135091 - RNA, 12 nt, Homo sapiens
aucauugguucg

SEQ ID NO: 1135092 - RNA, 16 nt, Homo sapiens
aucauuugaaagggcu

SEQ ID NO: 1135093 - RNA, 21 nt, Homo sapiens
aucauuuguuuacauuugaug

SEQ ID NO: 1135094 - RNA, 19 nt, Homo sapiens
aucauuuuuguaucuacau

SEQ ID NO: 1135095 - RNA, 23 nt, Homo sapiens
auccaaaaguggaagugacauug

SEQ ID NO: 1135096 - RNA, 13 nt, Homo sapiens
auccaaacaauuu

SEQ ID NO: 1135097 - RNA, 17 nt, Homo sapiens
auccaaagcugaauaca

SEQ ID NO: 1135098 - RNA, 17 nt, Homo sapiens
auccaaaugcugugcaa

SEQ ID NO: 1135099 - RNA, 19 nt, Homo sapiens
auccaaaugcugugcaaac

SEQ ID NO: 1135100 - RNA, 17 nt, Homo sapiens
auccaagaagcaugcag

SEQ ID NO: 1135101 - RNA, 14 nt, Homo sapiens
auccaauaccucuu

SEQ ID NO: 1135102 - RNA, 15 nt, Homo sapiens
auccaauaccucuug

SEQ ID NO: 1135103 - RNA, 17 nt, Homo sapiens
auccaauaugacucaga

SEQ ID NO: 1135104 - RNA, 18 nt, Homo sapiens
auccaauccuagcccuca

SEQ ID NO: 1135105 - RNA, 23 nt, Homo sapiens
auccaaucucaauaucuggguca

SEQ ID NO: 1135106 - RNA, 16 nt, Homo sapiens
auccacaauagcugac

SEQ ID NO: 1135107 - RNA, 18 nt, Homo sapiens
auccacaaucugacauuc

SEQ ID NO: 1135108 - RNA, 15 nt, Homo sapiens
auccaccacugcuua

SEQ ID NO: 1135109 - RNA, 12 nt, Homo sapiens
auccaccugccu

SEQ ID NO: 1135110 - RNA, 16 nt, Homo sapiens
auccagccucauaaag

SEQ ID NO: 1135111 - RNA, 18 nt, Homo sapiens
auccagcucuaagucuca

SEQ ID NO: 1135112 - RNA, 19 nt, Homo sapiens
auccagcucuaagucucaa

SEQ ID NO: 1135113 - RNA, 16 nt, Homo sapiens
auccagcuuccuucug

SEQ ID NO: 1135114 - RNA, 17 nt, Homo sapiens
auccaggagguucaaaa

SEQ ID NO: 1135115 - RNA, 23 nt, Homo sapiens
auccaggccagggcuccuguggc

SEQ ID NO: 1135116 - RNA, 14 nt, Homo sapiens
auccagggcugcca

SEQ ID NO: 1135117 - RNA, 16 nt, Homo sapiens
auccaguuucccaugc

SEQ ID NO: 1135118 - RNA, 17 nt, Homo sapiens
auccaguuucccaugca

SEQ ID NO: 1135119 - RNA, 19 nt, Homo sapiens
auccauauagaaaucuaga

SEQ ID NO: 1135120 - RNA, 13 nt, Homo sapiens
auccaucaucugc

SEQ ID NO: 1135121 - RNA, 19 nt, Homo sapiens
auccauucagcaucagaga

SEQ ID NO: 1135122 - RNA, 16 nt, Homo sapiens
auccauuguguucucu

SEQ ID NO: 1135123 - RNA, 20 nt, Homo sapiens
auccauuguguucucuuuaa

SEQ ID NO: 1135124 - RNA, 18 nt, Homo sapiens
aucccaaacugugaugaa

SEQ ID NO: 1135125 - RNA, 13 nt, Homo sapiens
aucccacuguaug

SEQ ID NO: 1135126 - RNA, 15 nt, Homo sapiens
aucccagcuacucag

SEQ ID NO: 1135127 - RNA, 21 nt, Homo sapiens
aucccagggcucccugccauu

SEQ ID NO: 1135128 - RNA, 11 nt, Homo sapiens
aucccaugagc

SEQ ID NO: 1135129 - RNA, 22 nt, Homo sapiens
auccccaggccuggcacgucaa

SEQ ID NO: 1135130 - RNA, 12 nt, Homo sapiens
auccccccaugc

SEQ ID NO: 1135131 - RNA, 21 nt, Homo sapiens
auccccuugucugaacuggag

SEQ ID NO: 1135132 - RNA, 18 nt, Homo sapiens
aucccucgggugugcuau

SEQ ID NO: 1135133 - RNA, 15 nt, Homo sapiens
aucccuuaccugcuu

SEQ ID NO: 1135134 - RNA, 20 nt, Homo sapiens
auccgaaccuccucugugaa

SEQ ID NO: 1135135 - RNA, 16 nt, Homo sapiens
auccgcgugugccugu

SEQ ID NO: 1135136 - RNA, 21 nt, Homo sapiens
auccggggaggaaacacuggc

SEQ ID NO: 1135137 - RNA, 22 nt, Homo sapiens
auccgucuaguuaacauuucaa

SEQ ID NO: 1135138 - RNA, 20 nt, Homo sapiens
auccuaaagaaggugauaaa

SEQ ID NO: 1135139 - RNA, 11 nt, Homo sapiens
auccuaaagau

SEQ ID NO: 1135140 - RNA, 20 nt, Homo sapiens
auccuaaagauuauuaccuu

SEQ ID NO: 1135141 - RNA, 13 nt, Homo sapiens
auccuagugcuuu

SEQ ID NO: 1135142 - RNA, 14 nt, Homo sapiens
auccuaugugauuu

SEQ ID NO: 1135143 - RNA, 13 nt, Homo sapiens
auccuccaacagc

SEQ ID NO: 1135144 - RNA, 15 nt, Homo sapiens
auccucccaaucuca

SEQ ID NO: 1135145 - RNA, 23 nt, Homo sapiens
auccuccccaccagagcugccuc

SEQ ID NO: 1135146 - RNA, 17 nt, Homo sapiens
auccuccuaccucagcc

SEQ ID NO: 1135147 - RNA, 15 nt, Homo sapiens
auccuccugauagaa

SEQ ID NO: 1135148 - RNA, 23 nt, Homo sapiens
auccugaguucauccccugugaa

SEQ ID NO: 1135149 - RNA, 20 nt, Homo sapiens
auccugggggaccaaugagg

SEQ ID NO: 1135150 - RNA, 11 nt, Homo sapiens
auccugugaag

SEQ ID NO: 1135151 - RNA, 16 nt, Homo sapiens
auccuuacuauccuau

SEQ ID NO: 1135152 - RNA, 20 nt, Homo sapiens
auccuuccuuuugagggagc

SEQ ID NO: 1135153 - RNA, 15 nt, Homo sapiens
auccuucuacuuguc

SEQ ID NO: 1135154 - RNA, 13 nt, Homo sapiens
auccuugaugaau

SEQ ID NO: 1135155 - RNA, 20 nt, Homo sapiens
auccuugaugaaucuggggu

SEQ ID NO: 1135156 - RNA, 20 nt, Homo sapiens
auccuugggagggugccauc

SEQ ID NO: 1135157 - RNA, 23 nt, Homo sapiens
auccuugucaaaaugagauucca

SEQ ID NO: 1135158 - RNA, 23 nt, Homo sapiens
auccuuuuuucucuucuguccau

SEQ ID NO: 1135159 - RNA, 14 nt, Homo sapiens
aucgaacacauuca

SEQ ID NO: 1135160 - RNA, 19 nt, Homo sapiens
aucgaaucuacuaauucca

SEQ ID NO: 1135161 - RNA, 17 nt, Homo sapiens
aucgcaguguucaaggc

SEQ ID NO: 1135162 - RNA, 17 nt, Homo sapiens
aucgccacaaacucuau

SEQ ID NO: 1135163 - RNA, 15 nt, Homo sapiens
aucgcuccucuccag

SEQ ID NO: 1135164 - RNA, 15 nt, Homo sapiens
aucgucuucuaagag

SEQ ID NO: 1135165 - RNA, 18 nt, Homo sapiens
aucgugccuugucauuuu

SEQ ID NO: 1135166 - RNA, 17 nt, Homo sapiens
aucguguccugaaaauc

SEQ ID NO: 1135167 - RNA, 20 nt, Homo sapiens
aucuaauccuuuaaugaucu

SEQ ID NO: 1135168 - RNA, 12 nt, Homo sapiens
aucuacauuugu

SEQ ID NO: 1135169 - RNA, 17 nt, Homo sapiens
aucuacccagucaugua

SEQ ID NO: 1135170 - RNA, 18 nt, Homo sapiens
aucuaccugcaacacaac

SEQ ID NO: 1135171 - RNA, 16 nt, Homo sapiens
aucuacucuggaccaa

SEQ ID NO: 1135172 - RNA, 13 nt, Homo sapiens
aucuagauggaua

SEQ ID NO: 1135173 - RNA, 13 nt, Homo sapiens
aucuagcauguaa

SEQ ID NO: 1135174 - RNA, 16 nt, Homo sapiens
aucuaguuaaccaauc

SEQ ID NO: 1135175 - RNA, 13 nt, Homo sapiens
aucugucuuguca

SEQ ID NO: 1135176 - RNA, 15 nt, Homo sapiens
aucugugcagggcug

SEQ ID NO: 1135177 - RNA, 20 nt, Homo sapiens
aucugugcucaggacucaga

SEQ ID NO: 1135178 - RNA, 18 nt, Homo sapiens
aucugugguuuuccucua

SEQ ID NO: 1135179 - RNA, 15 nt, Homo sapiens
aucuguguacaaaga

SEQ ID NO: 1135180 - RNA, 10 nt, Homo sapiens
aucuguguuc

SEQ ID NO: 1135181 - RNA, 19 nt, Homo sapiens
aucuguucuaacauguaau

SEQ ID NO: 1135182 - RNA, 13 nt, Homo sapiens
aucuuaacacuga

SEQ ID NO: 1135183 - RNA, 21 nt, Homo sapiens
aucuuaacacugaaauugccu

SEQ ID NO: 1135184 - RNA, 21 nt, Homo sapiens
aucuuaauuuugguuguauuc

SEQ ID NO: 1135185 - RNA, 19 nt, Homo sapiens
aucuuaccagguucacuua

SEQ ID NO: 1135186 - RNA, 14 nt, Homo sapiens
aucuuacugaaggu

SEQ ID NO: 1135187 - RNA, 19 nt, Homo sapiens
aucuuauacuguacaauaa

SEQ ID NO: 1135188 - RNA, 12 nt, Homo sapiens
aucuucaccaga

SEQ ID NO: 1135189 - RNA, 19 nt, Homo sapiens
aucuuccaaaccccacuuu

SEQ ID NO: 1135190 - RNA, 19 nt, Homo sapiens
aucuucccugccccugugc

SEQ ID NO: 1135191 - RNA, 22 nt, Homo sapiens
aucuucuaaacccaauccaaau

SEQ ID NO: 1135192 - RNA, 21 nt, Homo sapiens
aucuucuguugcucucugugu

SEQ ID NO: 1135193 - RNA, 16 nt, Homo sapiens
aucuucuuucaugaag

SEQ ID NO: 1135194 - RNA, 19 nt, Homo sapiens
aucuugaccaagcaggaag

SEQ ID NO: 1135195 - RNA, 18 nt, Homo sapiens
aucuugaugucuaugaua

SEQ ID NO: 1135196 - RNA, 14 nt, Homo sapiens
aucuugcaagaaua

SEQ ID NO: 1135197 - RNA, 18 nt, Homo sapiens
aucuugccuccaggugca

SEQ ID NO: 1135198 - RNA, 21 nt, Homo sapiens
aucuuggagacaggccaucca

SEQ ID NO: 1135199 - RNA, 14 nt, Homo sapiens
aucuuguaaaggau

SEQ ID NO: 1135200 - RNA, 19 nt, Homo sapiens
aucuuguaaaggauauuaa

SEQ ID NO: 1135201 - RNA, 18 nt, Homo sapiens
aucuuuauugcaugagaa

SEQ ID NO: 1135202 - RNA, 13 nt, Homo sapiens
aucuuucuuccaa

SEQ ID NO: 1135203 - RNA, 21 nt, Homo sapiens
aucuuucuuccaaacaggcuc

SEQ ID NO: 1135204 - RNA, 20 nt, Homo sapiens
aucuuuggacagaagcagcu

SEQ ID NO: 1135205 - RNA, 18 nt, Homo sapiens
aucuuuguauauuacaua

SEQ ID NO: 1135206 - RNA, 22 nt, Homo sapiens
aucuuuguguuuugaacaaagg

SEQ ID NO: 1135207 - RNA, 22 nt, Homo sapiens
aucuuuguugaaagcagaagaa

SEQ ID NO: 1135208 - RNA, 19 nt, Homo sapiens
aucuuuuauagacgcucuu

SEQ ID NO: 1135209 - RNA, 17 nt, Homo sapiens
aucuuuuauuucauuca

SEQ ID NO: 1135210 - RNA, 22 nt, Homo sapiens
aucuuuuauuucauucauaucc

SEQ ID NO: 1135211 - RNA, 23 nt, Homo sapiens
augaaaaggauauuaucuaccug

SEQ ID NO: 1135212 - RNA, 18 nt, Homo sapiens
augaaacaaacuacugug

SEQ ID NO: 1135213 - RNA, 20 nt, Homo sapiens
augaaacaaacuacuguguc

SEQ ID NO: 1135214 - RNA, 18 nt, Homo sapiens
augaaaccgccauugggc

SEQ ID NO: 1135215 - RNA, 22 nt, Homo sapiens
augaaaggacaguuaaguauuu

SEQ ID NO: 1135216 - RNA, 16 nt, Homo sapiens
augaaagggcaaagac

SEQ ID NO: 1135217 - RNA, 18 nt, Homo sapiens
augaaaguauuggcauuc

SEQ ID NO: 1135218 - RNA, 13 nt, Homo sapiens
augaaauaaucag

SEQ ID NO: 1135219 - RNA, 19 nt, Homo sapiens
augaaauaugugaagccca

SEQ ID NO: 1135220 - RNA, 16 nt, Homo sapiens
augaaaucucaggaau

SEQ ID NO: 1135221 - RNA, 21 nt, Homo sapiens
augaacaauuaugaacaucca

SEQ ID NO: 1135222 - RNA, 12 nt, Homo sapiens
augaacauccaa

SEQ ID NO: 1135223 - RNA, 13 nt, Homo sapiens
augaaccacauua

SEQ ID NO: 1135224 - RNA, 12 nt, Homo sapiens
augaaccacugc

SEQ ID NO: 1135225 - RNA, 19 nt, Homo sapiens
augaaccacugcacccacc

SEQ ID NO: 1135226 - RNA, 15 nt, Homo sapiens
augaacuauccacag

SEQ ID NO: 1135227 - RNA, 17 nt, Homo sapiens
augaacuuaaaaugaaa

SEQ ID NO: 1135228 - RNA, 22 nt, Homo sapiens
augaacuuguaaaggaauuuaa

SEQ ID NO: 1135229 - RNA, 18 nt, Homo sapiens
augaagaaauacugcacu

SEQ ID NO: 1135230 - RNA, 21 nt, Homo sapiens
augaagaauauaccauuucaa

SEQ ID NO: 1135231 - RNA, 23 nt, Homo sapiens
augaagcaagcuguguuacuuga

SEQ ID NO: 1135232 - RNA, 22 nt, Homo sapiens
augaagcagagaggcacgugcc

SEQ ID NO: 1135233 - RNA, 22 nt, Homo sapiens
augaaggaaggacuaugacaaa

SEQ ID NO: 1135234 - RNA, 21 nt, Homo sapiens
augaagguggaacaagcacag

SEQ ID NO: 1135235 - RNA, 16 nt, Homo sapiens
augaaggugugcuaca

SEQ ID NO: 1135236 - RNA, 13 nt, Homo sapiens
augaaucugcuca

SEQ ID NO: 1135237 - RNA, 12 nt, Homo sapiens
augaaucugggg

SEQ ID NO: 1135238 - RNA, 20 nt, Homo sapiens
augaauucuaaaccaaucaa

SEQ ID NO: 1135239 - RNA, 19 nt, Homo sapiens
augaauucugucauuucaa

SEQ ID NO: 1135240 - RNA, 21 nt, Homo sapiens
augaauucuuaagacuugcau

SEQ ID NO: 1135241 - RNA, 15 nt, Homo sapiens
augacaaacccagga

SEQ ID NO: 1135242 - RNA, 12 nt, Homo sapiens
augacacagucu

SEQ ID NO: 1135243 - RNA, 13 nt, Homo sapiens
augacaguagcau

SEQ ID NO: 1135244 - RNA, 17 nt, Homo sapiens
augacauggacacauca

SEQ ID NO: 1135245 - RNA, 18 nt, Homo sapiens
augacaugguccaugucu

SEQ ID NO: 1135246 - RNA, 14 nt, Homo sapiens
augacauugcauuu

SEQ ID NO: 1135247 - RNA, 23 nt, Homo sapiens
augacauuuuuccucucugcaaa

SEQ ID NO: 1135248 - RNA, 13 nt, Homo sapiens
augaccuggagca

SEQ ID NO: 1135249 - RNA, 21 nt, Homo sapiens
augacgucaucaucacauuca

SEQ ID NO: 1135250 - RNA, 17 nt, Homo sapiens
augacugagucuggcaa

SEQ ID NO: 1135251 - RNA, 19 nt, Homo sapiens
augacugcaccaacaucau

SEQ ID NO: 1135252 - RNA, 21 nt, Homo sapiens
augacugcaccaacaucauca

SEQ ID NO: 1135253 - RNA, 22 nt, Homo sapiens
augacuugguuuauggccuuaa

SEQ ID NO: 1135254 - RNA, 20 nt, Homo sapiens
augacuuuugguaaaggguu

SEQ ID NO: 1135255 - RNA, 18 nt, Homo sapiens
augagauagcugguguua

SEQ ID NO: 1135256 - RNA, 18 nt, Homo sapiens
augagauaggcacaugca

SEQ ID NO: 1135257 - RNA, 14 nt, Homo sapiens
augaggaucugaaa

SEQ ID NO: 1135258 - RNA, 14 nt, Homo sapiens
augaggcugcuuau

SEQ ID NO: 1135259 - RNA, 13 nt, Homo sapiens
augaggugggggu

SEQ ID NO: 1135260 - RNA, 17 nt, Homo sapiens
augaguaauacaucaaa

SEQ ID NO: 1135261 - RNA, 15 nt, Homo sapiens
augaguagacauugu

SEQ ID NO: 1135262 - RNA, 20 nt, Homo sapiens
augaguauaaugaacacuca

SEQ ID NO: 1135263 - RNA, 14 nt, Homo sapiens
augagugcuuaaac

SEQ ID NO: 1135264 - RNA, 16 nt, Homo sapiens
augaguuacugugcau

SEQ ID NO: 1135265 - RNA, 19 nt, Homo sapiens
augcagcacugcugccuca

SEQ ID NO: 1135266 - RNA, 19 nt, Homo sapiens
augcagcagggaugcccug

SEQ ID NO: 1135267 - RNA, 18 nt, Homo sapiens
augcagccccaucuccuc

SEQ ID NO: 1135268 - RNA, 13 nt, Homo sapiens
augcagcuaccca

SEQ ID NO: 1135269 - RNA, 14 nt, Homo sapiens
augcagcuacccag

SEQ ID NO: 1135270 - RNA, 22 nt, Homo sapiens
augcagcucaagagaucccaag

SEQ ID NO: 1135271 - RNA, 14 nt, Homo sapiens
augcauaagcuuuu

SEQ ID NO: 1135272 - RNA, 15 nt, Homo sapiens
augcauacacacaca

SEQ ID NO: 1135273 - RNA, 17 nt, Homo sapiens
augcauacguacauucc

SEQ ID NO: 1135274 - RNA, 20 nt, Homo sapiens
augcauagccuggacacaga

SEQ ID NO: 1135275 - RNA, 19 nt, Homo sapiens
augcaucauaaaacaaauc

SEQ ID NO: 1135276 - RNA, 20 nt, Homo sapiens
augcaucugcuacuguguca

SEQ ID NO: 1135277 - RNA, 14 nt, Homo sapiens
augcauggaaaaug

SEQ ID NO: 1135278 - RNA, 22 nt, Homo sapiens
augcauggugccccaggaccag

SEQ ID NO: 1135279 - RNA, 20 nt, Homo sapiens
augcaugucaaacaugagau

SEQ ID NO: 1135280 - RNA, 22 nt, Homo sapiens
augccaaccagcuucccuacuc

SEQ ID NO: 1135281 - RNA, 19 nt, Homo sapiens
augccaaguaucuuuccag

SEQ ID NO: 1135282 - RNA, 20 nt, Homo sapiens
augccacccacaucuuccau

SEQ ID NO: 1135283 - RNA, 12 nt, Homo sapiens
augccagugugc

SEQ ID NO: 1135284 - RNA, 21 nt, Homo sapiens
augcccacaacuugucaccca

SEQ ID NO: 1135285 - RNA, 19 nt, Homo sapiens
augcccugccgugguggca

SEQ ID NO: 1135286 - RNA, 19 nt, Homo sapiens
augcccuguaccugugcac

SEQ ID NO: 1135287 - RNA, 19 nt, Homo sapiens
augcccugugcaaccucuu

SEQ ID NO: 1135288 - RNA, 19 nt, Homo sapiens
augccgagguaaaaguucu

SEQ ID NO: 1135289 - RNA, 18 nt, Homo sapiens
augccuaaaaaguaucau

SEQ ID NO: 1135290 - RNA, 17 nt, Homo sapiens
augccuguaaucccaga

SEQ ID NO: 1135291 - RNA, 23 nt, Homo sapiens
augcgaacaaccuuuucucugga

SEQ ID NO: 1135292 - RNA, 14 nt, Homo sapiens
augcguauucugug

SEQ ID NO: 1135293 - RNA, 12 nt, Homo sapiens
augcgugcauug

SEQ ID NO: 1135294 - RNA, 23 nt, Homo sapiens
augcuaaaagcuauccaggauuu

SEQ ID NO: 1135295 - RNA, 14 nt, Homo sapiens
augcuacauggcuc

SEQ ID NO: 1135296 - RNA, 19 nt, Homo sapiens
augcuacugaaacuuaccu

SEQ ID NO: 1135297 - RNA, 14 nt, Homo sapiens
augcucagaccagc

SEQ ID NO: 1135298 - RNA, 14 nt, Homo sapiens
augcucaucugagc

SEQ ID NO: 1135299 - RNA, 21 nt, Homo sapiens
augcuccagcaacacagccug

SEQ ID NO: 1135300 - RNA, 17 nt, Homo sapiens
augcuccuuccaacagg

SEQ ID NO: 1135301 - RNA, 16 nt, Homo sapiens
augcucuuucccagga

SEQ ID NO: 1135302 - RNA, 22 nt, Homo sapiens
augcugaaaaaucauccaagac

SEQ ID NO: 1135303 - RNA, 20 nt, Homo sapiens
augcugacagcucuucacag

SEQ ID NO: 1135304 - RNA, 14 nt, Homo sapiens
augcugacauucac

SEQ ID NO: 1135305 - RNA, 23 nt, Homo sapiens
augcugagagagcuggaggcacc

SEQ ID NO: 1135306 - RNA, 19 nt, Homo sapiens
augcuggaaccugcaaaaa

SEQ ID NO: 1135307 - RNA, 12 nt, Homo sapiens
augcugguggcu

SEQ ID NO: 1135308 - RNA, 17 nt, Homo sapiens
augcugguuaaggugaa

SEQ ID NO: 1135309 - RNA, 15 nt, Homo sapiens
augcuguacaugaca

SEQ ID NO: 1135310 - RNA, 18 nt, Homo sapiens
augcugugcaaacagugu

SEQ ID NO: 1135311 - RNA, 23 nt, Homo sapiens
augcuguugauugcuaaauguaa

SEQ ID NO: 1135312 - RNA, 15 nt, Homo sapiens
augcuguugccucau

SEQ ID NO: 1135313 - RNA, 16 nt, Homo sapiens
augcuguuuaugacac

SEQ ID NO: 1135314 - RNA, 20 nt, Homo sapiens
augcuguuugacaaaguuac

SEQ ID NO: 1135315 - RNA, 18 nt, Homo sapiens
augcuuguauuuuacuuu

SEQ ID NO: 1135316 - RNA, 18 nt, Homo sapiens
augcuuuucauaggcuua

SEQ ID NO: 1135317 - RNA, 15 nt, Homo sapiens
auggaaauaguacua

SEQ ID NO: 1135318 - RNA, 21 nt, Homo sapiens
auggaaauucugcucagauag

SEQ ID NO: 1135319 - RNA, 20 nt, Homo sapiens
auggaagacaggaaaguuca

SEQ ID NO: 1135320 - RNA, 16 nt, Homo sapiens
auggaaucugaugaaa

SEQ ID NO: 1135321 - RNA, 16 nt, Homo sapiens
auggaauugauuugca

SEQ ID NO: 1135322 - RNA, 14 nt, Homo sapiens
auggacaacucaau

SEQ ID NO: 1135323 - RNA, 18 nt, Homo sapiens
auggacacaucaggaagu

SEQ ID NO: 1135324 - RNA, 23 nt, Homo sapiens
auggacagacagaggaugagcuc

SEQ ID NO: 1135325 - RNA, 17 nt, Homo sapiens
auggacauucaugcuca

SEQ ID NO: 1135326 - RNA, 16 nt, Homo sapiens
auggagaacaacccaa

SEQ ID NO: 1135327 - RNA, 16 nt, Homo sapiens
auggagauagccccac

SEQ ID NO: 1135328 - RNA, 20 nt, Homo sapiens
auggagauagugguccucau

SEQ ID NO: 1135329 - RNA, 22 nt, Homo sapiens
auggaguacacagcugagcaau

SEQ ID NO: 1135330 - RNA, 16 nt, Homo sapiens
auggaguguuugacga

SEQ ID NO: 1135331 - RNA, 17 nt, Homo sapiens
auggcaaaaguaggcau

SEQ ID NO: 1135332 - RNA, 14 nt, Homo sapiens
auggcagaagggaa

SEQ ID NO: 1135333 - RNA, 21 nt, Homo sapiens
auggcagaagggaauugcuca

SEQ ID NO: 1135334 - RNA, 13 nt, Homo sapiens
auggcagcugcca

SEQ ID NO: 1135335 - RNA, 19 nt, Homo sapiens
auggcaggauccaaggggc

SEQ ID NO: 1135336 - RNA, 15 nt, Homo sapiens
auggcagggugcuag

SEQ ID NO: 1135337 - RNA, 15 nt, Homo sapiens
auggcagugaugaau

SEQ ID NO: 1135338 - RNA, 22 nt, Homo sapiens
auggcaucucauugaggacaaa

SEQ ID NO: 1135339 - RNA, 16 nt, Homo sapiens
auggcaugagauagcu

SEQ ID NO: 1135340 - RNA, 14 nt, Homo sapiens
auggcauuagcuga

SEQ ID NO: 1135341 - RNA, 21 nt, Homo sapiens
auggcccucccagugccuccu

SEQ ID NO: 1135342 - RNA, 13 nt, Homo sapiens
auggccucaagau

SEQ ID NO: 1135343 - RNA, 13 nt, Homo sapiens
auggccuugucua

SEQ ID NO: 1135344 - RNA, 18 nt, Homo sapiens
auggcgaggccucucuca

SEQ ID NO: 1135345 - RNA, 20 nt, Homo sapiens
auggcucaacguuuuuggac

SEQ ID NO: 1135346 - RNA, 17 nt, Homo sapiens
auggcuccuccauaucu

SEQ ID NO: 1135347 - RNA, 15 nt, Homo sapiens
auggcuggggggcca

SEQ ID NO: 1135348 - RNA, 16 nt, Homo sapiens
auggcuggguccuugg

SEQ ID NO: 1135349 - RNA, 17 nt, Homo sapiens
auggcuguggagugugg

SEQ ID NO: 1135350 - RNA, 23 nt, Homo sapiens
auggcuuuggcuuugcaaaauaa

SEQ ID NO: 1135351 - RNA, 20 nt, Homo sapiens
augggaaaaacugcagucau

SEQ ID NO: 1135352 - RNA, 17 nt, Homo sapiens
augggaaaagagucucu

SEQ ID NO: 1135353 - RNA, 18 nt, Homo sapiens
augggaaggggaggaccc

SEQ ID NO: 1135354 - RNA, 20 nt, Homo sapiens
augggaauucuuuacaauaa

SEQ ID NO: 1135355 - RNA, 18 nt, Homo sapiens
augggagagucaagggaa

SEQ ID NO: 1135356 - RNA, 20 nt, Homo sapiens
augggaucuuucugacacac

SEQ ID NO: 1135357 - RNA, 21 nt, Homo sapiens
augggcagcccaacagcacuu

SEQ ID NO: 1135358 - RNA, 17 nt, Homo sapiens
augggcccacaggguac

SEQ ID NO: 1135359 - RNA, 19 nt, Homo sapiens
caggcuggagugcaauggu

SEQ ID NO: 1135360 - RNA, 17 nt, Homo sapiens
caggcugggcugagcca

SEQ ID NO: 1135361 - RNA, 23 nt, Homo sapiens
caggcugucccaagcucccaaga

SEQ ID NO: 1135362 - RNA, 13 nt, Homo sapiens
uagaacaaaaacu

SEQ ID NO: 1135363 - RNA, 22 nt, Homo sapiens
uagaacaaaggacagaguauga

SEQ ID NO: 1135364 - RNA, 14 nt, Homo sapiens
uagaacagcucaua

SEQ ID NO: 1135365 - RNA, 15 nt, Homo sapiens
uagaacagucauuaa

SEQ ID NO: 1135366 - RNA, 14 nt, Homo sapiens
uagaacagugccug

SEQ ID NO: 1135367 - RNA, 19 nt, Homo sapiens
uagaacagugccuggcaca

SEQ ID NO: 1135368 - RNA, 20 nt, Homo sapiens
uagaaccagcagaagccaga

SEQ ID NO: 1135369 - RNA, 21 nt, Homo sapiens
uagaacuggaagguacuuuaa

SEQ ID NO: 1135370 - RNA, 22 nt, Homo sapiens
uagaagccuaauugucacauca

SEQ ID NO: 1135371 - RNA, 15 nt, Homo sapiens
uagaauaaaugaaga

SEQ ID NO: 1135372 - RNA, 22 nt, Homo sapiens
uagaauagccuguggccuuugc

SEQ ID NO: 1135373 - RNA, 23 nt, Homo sapiens
uagaauaguaugaugcuuuacau

SEQ ID NO: 1135374 - RNA, 15 nt, Homo sapiens
uagaaugaaccacug

SEQ ID NO: 1135375 - RNA, 12 nt, Homo sapiens
uagaaugauaaa

SEQ ID NO: 1135376 - RNA, 15 nt, Homo sapiens
uagaaugggauguga

SEQ ID NO: 1135377 - RNA, 22 nt, Homo sapiens
uagaauuauuucacaaauaaua

SEQ ID NO: 1135378 - RNA, 12 nt, Homo sapiens
uagaauugcauu

SEQ ID NO: 1135379 - RNA, 14 nt, Homo sapiens
uagacaagccagaa

SEQ ID NO: 1135380 - RNA, 15 nt, Homo sapiens
uagacauugcaauuu

SEQ ID NO: 1135381 - RNA, 21 nt, Homo sapiens
uagacccugcauuuauagcau

SEQ ID NO: 1135382 - RNA, 23 nt, Homo sapiens
uagaccucauuaaauauuugaca

SEQ ID NO: 1135383 - RNA, 19 nt, Homo sapiens
uagacuauggaaugucagu

SEQ ID NO: 1135384 - RNA, 19 nt, Homo sapiens
uagacucuguaaccaccuc

SEQ ID NO: 1135385 - RNA, 17 nt, Homo sapiens
uagacugaaaagccaug

SEQ ID NO: 1135386 - RNA, 20 nt, Homo sapiens
uagacugaaaagccaugugu

SEQ ID NO: 1135387 - RNA, 16 nt, Homo sapiens
uagacugaagauuuau

SEQ ID NO: 1135388 - RNA, 18 nt, Homo sapiens
uagacugaggagcccucu

SEQ ID NO: 1135389 - RNA, 14 nt, Homo sapiens
uagagacaggguuu

SEQ ID NO: 1135390 - RNA, 19 nt, Homo sapiens
uagagacgggguuucucca

SEQ ID NO: 1135391 - RNA, 20 nt, Homo sapiens
uagagacgguguuuugccau

SEQ ID NO: 1135392 - RNA, 14 nt, Homo sapiens
uagagaugugcaau

SEQ ID NO: 1135393 - RNA, 15 nt, Homo sapiens
uagagauuuggugua

SEQ ID NO: 1135394 - RNA, 13 nt, Homo sapiens
uagagcacagccu

SEQ ID NO: 1135395 - RNA, 14 nt, Homo sapiens
uagagcacugccac

SEQ ID NO: 1135396 - RNA, 17 nt, Homo sapiens
uagagccuuugaucuuc

SEQ ID NO: 1135397 - RNA, 15 nt, Homo sapiens
uagaggaacuucuga

SEQ ID NO: 1135398 - RNA, 16 nt, Homo sapiens
uagaggaccagugagu

SEQ ID NO: 1135399 - RNA, 20 nt, Homo sapiens
uagaguauaccugugguuug

SEQ ID NO: 1135400 - RNA, 15 nt, Homo sapiens
uagaguauagcucug

SEQ ID NO: 1135401 - RNA, 15 nt, Homo sapiens
uagagucuagacaga

SEQ ID NO: 1135402 - RNA, 12 nt, Homo sapiens
uagagugcaaug

SEQ ID NO: 1135403 - RNA, 15 nt, Homo sapiens
uagagugcaguggca

SEQ ID NO: 1135404 - RNA, 15 nt, Homo sapiens
uagaguggcgauuga

SEQ ID NO: 1135405 - RNA, 13 nt, Homo sapiens
uagaguggugcug

SEQ ID NO: 1135406 - RNA, 22 nt, Homo sapiens
uagauaaaacacgccacagccu

SEQ ID NO: 1135407 - RNA, 23 nt, Homo sapiens
uagauauccaggcuuaccaaagu

SEQ ID NO: 1135408 - RNA, 16 nt, Homo sapiens
uagaucaucagucacc

SEQ ID NO: 1135409 - RNA, 11 nt, Homo sapiens
uagaucuggca

SEQ ID NO: 1135410 - RNA, 21 nt, Homo sapiens
uagaugcacuaccauugcugu

SEQ ID NO: 1135411 - RNA, 21 nt, Homo sapiens
uagaugccucgcucuuuucaa

SEQ ID NO: 1135412 - RNA, 17 nt, Homo sapiens
uagauggauaagggaau

SEQ ID NO: 1135413 - RNA, 16 nt, Homo sapiens
uagaugguuugagccu

SEQ ID NO: 1135414 - RNA, 21 nt, Homo sapiens
uagauucucugugucuaagau

SEQ ID NO: 1135415 - RNA, 19 nt, Homo sapiens
uagauuuacagaacaaagu

SEQ ID NO: 1135416 - RNA, 17 nt, Homo sapiens
uagauuugaaacauuua

SEQ ID NO: 1135417 - RNA, 19 nt, Homo sapiens
uagauuuguaguugcauau

SEQ ID NO: 1135418 - RNA, 23 nt, Homo sapiens
uagauuuguuuugagaguucuuc

SEQ ID NO: 1135419 - RNA, 22 nt, Homo sapiens
uagcaaaaacauguaugugcau

SEQ ID NO: 1135420 - RNA, 21 nt, Homo sapiens
uagcaaaacuaaauacuugcu

SEQ ID NO: 1135421 - RNA, 20 nt, Homo sapiens
uagcaaaauacaugacauuu

SEQ ID NO: 1135422 - RNA, 22 nt, Homo sapiens
uagcaaagccucgccuuccaug

SEQ ID NO: 1135423 - RNA, 19 nt, Homo sapiens
uagcaaauggcagaaccaa

SEQ ID NO: 1135424 - RNA, 17 nt, Homo sapiens
uagcaagugcuauuuca

SEQ ID NO: 1135425 - RNA, 18 nt, Homo sapiens
uagcaaugugauuuugua

SEQ ID NO: 1135426 - RNA, 11 nt, Homo sapiens
uagcaauguuu

SEQ ID NO: 1135427 - RNA, 20 nt, Homo sapiens
uagcaauuuaauauuuugca

SEQ ID NO: 1135428 - RNA, 18 nt, Homo sapiens
uagcaccuuaucuaugau

SEQ ID NO: 1135429 - RNA, 22 nt, Homo sapiens
uagcagaaaggaaaagauuccu

SEQ ID NO: 1135430 - RNA, 17 nt, Homo sapiens
uagcagcccagcauuuc

SEQ ID NO: 1135431 - RNA, 17 nt, Homo sapiens
uagcagggaguacccag

SEQ ID NO: 1135432 - RNA, 20 nt, Homo sapiens
uagcaggucccuauagcaua

SEQ ID NO: 1135433 - RNA, 13 nt, Homo sapiens
uagcaguggugag

SEQ ID NO: 1135434 - RNA, 15 nt, Homo sapiens
uagcauaaugaaaau

SEQ ID NO: 1135435 - RNA, 20 nt, Homo sapiens
uagcaugaauccuacauaca

SEQ ID NO: 1135436 - RNA, 22 nt, Homo sapiens
uagcaugauuuuucaaggauug

SEQ ID NO: 1135437 - RNA, 14 nt, Homo sapiens
uagcaugugacucc

SEQ ID NO: 1135438 - RNA, 22 nt, Homo sapiens
uagccacugcauaccaaccugg

SEQ ID NO: 1135439 - RNA, 21 nt, Homo sapiens
uagccagauuugucuuuuugu

SEQ ID NO: 1135440 - RNA, 18 nt, Homo sapiens
uagccagcacacagggca

SEQ ID NO: 1135441 - RNA, 17 nt, Homo sapiens
uagccagcacuuguaua

SEQ ID NO: 1135442 - RNA, 19 nt, Homo sapiens
uagccauguuaacaugaca

SEQ ID NO: 1135443 - RNA, 17 nt, Homo sapiens
uagccauuuuuuugcag

SEQ ID NO: 1135444 - RNA, 14 nt, Homo sapiens
uagcccagugcuuc

SEQ ID NO: 1135445 - RNA, 17 nt, Homo sapiens
uagccgcccaugcacug

SEQ ID NO: 1135446 - RNA, 22 nt, Homo sapiens
uagccgggauggucuugaucuc

SEQ ID NO: 1135447 - RNA, 21 nt, Homo sapiens
uagccugcagccucaucauuu

SEQ ID NO: 1135448 - RNA, 22 nt, Homo sapiens
uagccuggggcuugaauuugca

SEQ ID NO: 1135449 - RNA, 22 nt, Homo sapiens
uagccuguggccuuugcaauuu

SEQ ID NO: 1135450 - RNA, 14 nt, Homo sapiens
uagccuuacuguga

SEQ ID NO: 1135451 - RNA, 20 nt, Homo sapiens
uagcgcugccgcaccccaga

SEQ ID NO: 1135452 - RNA, 17 nt, Homo sapiens
uagcggaucucacucag

SEQ ID NO: 1135453 - RNA, 19 nt, Homo sapiens
uagcuaaacggauuccaaa

SEQ ID NO: 1135454 - RNA, 16 nt, Homo sapiens
uagcuagagcuuuucu

SEQ ID NO: 1135455 - RNA, 15 nt, Homo sapiens
uagcuagcuauuucu

SEQ ID NO: 1135456 - RNA, 12 nt, Homo sapiens
uagcucuauguu

SEQ ID NO: 1135457 - RNA, 16 nt, Homo sapiens
uagcucuguaguggaa

SEQ ID NO: 1135458 - RNA, 11 nt, Homo sapiens
uagcugcuacc

SEQ ID NO: 1135459 - RNA, 18 nt, Homo sapiens
ggcuccagaaauguuugc

SEQ ID NO: 1135460 - RNA, 21 nt, Homo sapiens
ggcucccagggacaccuggga

SEQ ID NO: 1135461 - RNA, 19 nt, Homo sapiens
ggcuccucugcuucucacg

SEQ ID NO: 1135462 - RNA, 19 nt, Homo sapiens
ggcuccuguuagcuccuca

SEQ ID NO: 1135463 - RNA, 16 nt, Homo sapiens
ggcucgaccucgcugc

SEQ ID NO: 1135464 - RNA, 14 nt, Homo sapiens
ggcucuaaaaccuu

SEQ ID NO: 1135465 - RNA, 12 nt, Homo sapiens
ggcucuccuagg

SEQ ID NO: 1135466 - RNA, 14 nt, Homo sapiens
ggcucucugugcaa

SEQ ID NO: 1135467 - RNA, 12 nt, Homo sapiens
ggcucugaccag

SEQ ID NO: 1135468 - RNA, 14 nt, Homo sapiens
ggcucugugccuug

SEQ ID NO: 1135469 - RNA, 15 nt, Homo sapiens
ggcucuucugugauu

SEQ ID NO: 1135470 - RNA, 14 nt, Homo sapiens
ggcucuugcucaag

SEQ ID NO: 1135471 - RNA, 16 nt, Homo sapiens
gguaacuagcugagca

SEQ ID NO: 1135472 - RNA, 20 nt, Homo sapiens
gguaagggauuucuuagggg

SEQ ID NO: 1135473 - RNA, 18 nt, Homo sapiens
gguaauauaaaguguaau

SEQ ID NO: 1135474 - RNA, 21 nt, Homo sapiens
gguaauuauguuuugugauuc

SEQ ID NO: 1135475 - RNA, 16 nt, Homo sapiens
gguacccagucaccuc

SEQ ID NO: 1135476 - RNA, 17 nt, Homo sapiens
gguaccugcaagcagaa

SEQ ID NO: 1135477 - RNA, 22 nt, Homo sapiens
gguagauuuccuccucccagug

SEQ ID NO: 1135478 - RNA, 16 nt, Homo sapiens
gguagcagcaaauagc

SEQ ID NO: 1135479 - RNA, 13 nt, Homo sapiens
gguagcugggauu

SEQ ID NO: 1135480 - RNA, 22 nt, Homo sapiens
gguaggggcuuaaaagaaacua

SEQ ID NO: 1135481 - RNA, 14 nt, Homo sapiens
gguaggugugacau

SEQ ID NO: 1135482 - RNA, 17 nt, Homo sapiens
gguauaaagcucucaaa

SEQ ID NO: 1135483 - RNA, 22 nt, Homo sapiens
gguauaguguguguugcaaauc

SEQ ID NO: 1135484 - RNA, 19 nt, Homo sapiens
gguauauacgugugguuca

SEQ ID NO: 1135485 - RNA, 16 nt, Homo sapiens
gguaugauaagcuuua

SEQ ID NO: 1135486 - RNA, 16 nt, Homo sapiens
gguauucugucauuua

SEQ ID NO: 1135487 - RNA, 17 nt, Homo sapiens
gguauugaucuguguua

SEQ ID NO: 1135488 - RNA, 21 nt, Homo sapiens
gguauuuguuuguagcuuucc

SEQ ID NO: 1135489 - RNA, 19 nt, Homo sapiens
gguauuuuccugugccuuu

SEQ ID NO: 1135490 - RNA, 15 nt, Homo sapiens
ggucaaaggcucaaa

SEQ ID NO: 1135491 - RNA, 17 nt, Homo sapiens
ggucaagaacacaguga

SEQ ID NO: 1135492 - RNA, 14 nt, Homo sapiens
ggucacccugugac

SEQ ID NO: 1135493 - RNA, 17 nt, Homo sapiens
ggucacuuaaaaugugc

SEQ ID NO: 1135494 - RNA, 18 nt, Homo sapiens
ggucagagaaaaugagaa

SEQ ID NO: 1135495 - RNA, 23 nt, Homo sapiens
ggucagcacaagauacacgucac

SEQ ID NO: 1135496 - RNA, 21 nt, Homo sapiens
ggucaucucucacacauucca

SEQ ID NO: 1135497 - RNA, 19 nt, Homo sapiens
ggucaugacaagaugggac

SEQ ID NO: 1135498 - RNA, 12 nt, Homo sapiens
ggucaugcccuc

SEQ ID NO: 1135499 - RNA, 16 nt, Homo sapiens
ggucauuguaaucacu

SEQ ID NO: 1135500 - RNA, 15 nt, Homo sapiens
gguccagaaggagac

SEQ ID NO: 1135501 - RNA, 13 nt, Homo sapiens
gguccagugcagg

SEQ ID NO: 1135502 - RNA, 21 nt, Homo sapiens
ggucccagcuacuugggaggc

SEQ ID NO: 1135503 - RNA, 16 nt, Homo sapiens
ggucccccgacugccu

SEQ ID NO: 1135504 - RNA, 17 nt, Homo sapiens
ggucccccgacugccug

SEQ ID NO: 1135505 - RNA, 13 nt, Homo sapiens
ggucccuauagca

SEQ ID NO: 1135506 - RNA, 22 nt, Homo sapiens
gguccgagcugaggacucugca

SEQ ID NO: 1135507 - RNA, 20 nt, Homo sapiens
gguccucaguccacugcuga

SEQ ID NO: 1135508 - RNA, 18 nt, Homo sapiens
gguccugaaaguaacuca

SEQ ID NO: 1135509 - RNA, 20 nt, Homo sapiens
gguccugaaaguaacucaua

SEQ ID NO: 1135510 - RNA, 17 nt, Homo sapiens
gguccugugaucuuauu

SEQ ID NO: 1135511 - RNA, 13 nt, Homo sapiens
ggucguucuuauc

SEQ ID NO: 1135512 - RNA, 12 nt, Homo sapiens
ggucuaugcaga

SEQ ID NO: 1135513 - RNA, 15 nt, Homo sapiens
ggucuauuccagcuc

SEQ ID NO: 1135514 - RNA, 20 nt, Homo sapiens
ggucucaaacuccugaccuc

SEQ ID NO: 1135515 - RNA, 16 nt, Homo sapiens
ggucuccucugcagcu

SEQ ID NO: 1135516 - RNA, 17 nt, Homo sapiens
ggucuccucugcagcuc

SEQ ID NO: 1135517 - RNA, 16 nt, Homo sapiens
ggucucgaugcugcug

SEQ ID NO: 1135518 - RNA, 14 nt, Homo sapiens
ggucucucgcugug

SEQ ID NO: 1135519 - RNA, 22 nt, Homo sapiens
ggucucugauagguagcauuuu

SEQ ID NO: 1135520 - RNA, 22 nt, Homo sapiens
ggucugcuggcuucuacacugg

SEQ ID NO: 1135521 - RNA, 21 nt, Homo sapiens
ggucugugugugugugugugc

SEQ ID NO: 1135522 - RNA, 21 nt, Homo sapiens
ggucuuuccuaaggcugcaag

SEQ ID NO: 1135523 - RNA, 16 nt, Homo sapiens
ggucuuuucaugugca

SEQ ID NO: 1135524 - RNA, 22 nt, Homo sapiens
ggugaaagccagagaaugacag

SEQ ID NO: 1135525 - RNA, 22 nt, Homo sapiens
ggugaagugaggacaaaaucac

SEQ ID NO: 1135526 - RNA, 19 nt, Homo sapiens
ggugaaguuaaaacaccuu

SEQ ID NO: 1135527 - RNA, 16 nt, Homo sapiens
ggugacaaaaggcaga

SEQ ID NO: 1135528 - RNA, 23 nt, Homo sapiens
ggugacagugacgugacucagag

SEQ ID NO: 1135529 - RNA, 16 nt, Homo sapiens
ggugacuucacaguga

SEQ ID NO: 1135530 - RNA, 12 nt, Homo sapiens
ggugagugcaag

SEQ ID NO: 1135531 - RNA, 17 nt, Homo sapiens
ggugauccgccuaccuc

SEQ ID NO: 1135532 - RNA, 11 nt, Homo sapiens
ggugauggugu

SEQ ID NO: 1135533 - RNA, 17 nt, Homo sapiens
ggugcacagccacuccc

SEQ ID NO: 1135534 - RNA, 19 nt, Homo sapiens
ggugcaguaucaugcccug

SEQ ID NO: 1135535 - RNA, 16 nt, Homo sapiens
gguggaccuggcagug

SEQ ID NO: 1135536 - RNA, 19 nt, Homo sapiens
gguggacuugaacuuuccu

SEQ ID NO: 1135537 - RNA, 17 nt, Homo sapiens
gguggagguugcaguga

SEQ ID NO: 1135538 - RNA, 22 nt, Homo sapiens
gguggcaucagugucuuuccac

SEQ ID NO: 1135539 - RNA, 22 nt, Homo sapiens
gguggcccugacugucagggag

SEQ ID NO: 1135540 - RNA, 23 nt, Homo sapiens
gguggcuaccaugcaggauuuga

SEQ ID NO: 1135541 - RNA, 16 nt, Homo sapiens
ggugggcggacaaaag

SEQ ID NO: 1135542 - RNA, 15 nt, Homo sapiens
ggugucucgcugcau

SEQ ID NO: 1135543 - RNA, 13 nt, Homo sapiens
ggugugcaagaga

SEQ ID NO: 1135544 - RNA, 19 nt, Homo sapiens
gguguggacugaaugggau

SEQ ID NO: 1135545 - RNA, 17 nt, Homo sapiens
gguguggcccguggccu

SEQ ID NO: 1135546 - RNA, 14 nt, Homo sapiens
gguguuaaaacacu

SEQ ID NO: 1135547 - RNA, 16 nt, Homo sapiens
gguuaaacaaaccaga

SEQ ID NO: 1135548 - RNA, 20 nt, Homo sapiens
gguuaaccagacccuuuccu

SEQ ID NO: 1135549 - RNA, 17 nt, Homo sapiens
gguuaagaaagcacuua

SEQ ID NO: 1135550 - RNA, 15 nt, Homo sapiens
gguuaauucauuugg

SEQ ID NO: 1135551 - RNA, 14 nt, Homo sapiens
gguuacaauuagaa

SEQ ID NO: 1135552 - RNA, 21 nt, Homo sapiens
gguuaguggucucuacugugg

SEQ ID NO: 1135553 - RNA, 13 nt, Homo sapiens
gguuauaaugugu

SEQ ID NO: 1135554 - RNA, 15 nt, Homo sapiens
gguucaagugacucu

SEQ ID NO: 1135555 - RNA, 13 nt, Homo sapiens
gguucaagugauu

SEQ ID NO: 1135556 - RNA, 17 nt, Homo sapiens
gguucaagugugcacug

SEQ ID NO: 1135557 - RNA, 21 nt, Homo sapiens
gguucauccaucaucugcugc

SEQ ID NO: 1135558 - RNA, 21 nt, Homo sapiens
gguuccaguaaucugagcagu

SEQ ID NO: 1135559 - RNA, 23 nt, Homo sapiens
gguucccaucauuuccuguguca

SEQ ID NO: 1135560 - RNA, 21 nt, Homo sapiens
gguuccucaggugaccaaaac

SEQ ID NO: 1135561 - RNA, 19 nt, Homo sapiens
gguucguucuguacuguua

SEQ ID NO: 1135562 - RNA, 15 nt, Homo sapiens
gguucuaauaggcca

SEQ ID NO: 1135563 - RNA, 17 nt, Homo sapiens
gguucucuccaccaggu

SEQ ID NO: 1135564 - RNA, 24 nt, Homo sapiens
gguucuguagagccaauuagacuu

SEQ ID NO: 1135565 - RNA, 16 nt, Homo sapiens
gguucuuacagcacau

SEQ ID NO: 1135566 - RNA, 20 nt, Homo sapiens
gguucuucuuccugaagcug

SEQ ID NO: 1135567 - RNA, 14 nt, Homo sapiens
gguucuugagccag

SEQ ID NO: 1135568 - RNA, 20 nt, Homo sapiens
gguugaacucugguggcaca

SEQ ID NO: 1135569 - RNA, 11 nt, Homo sapiens
gguugacacag

SEQ ID NO: 1135570 - RNA, 12 nt, Homo sapiens
gguugacauuuu

SEQ ID NO: 1135571 - RNA, 19 nt, Homo sapiens
gguugcagugagcugagau

SEQ ID NO: 1135572 - RNA, 19 nt, Homo sapiens
gguugcuuuuaagucuucc

SEQ ID NO: 1135573 - RNA, 13 nt, Homo sapiens
gguuggcaaaaua

SEQ ID NO: 1135574 - RNA, 13 nt, Homo sapiens
gguuggcauuugc

SEQ ID NO: 1135575 - RNA, 16 nt, Homo sapiens
gguuuacaacaaacac

SEQ ID NO: 1135576 - RNA, 18 nt, Homo sapiens
gguuuagaggaccaguga

SEQ ID NO: 1135577 - RNA, 20 nt, Homo sapiens
gguuuagaggaccagugagu

SEQ ID NO: 1135578 - RNA, 14 nt, Homo sapiens
gguuucacuauucc

SEQ ID NO: 1135579 - RNA, 19 nt, Homo sapiens
gguuuccaaaggcauuuua

SEQ ID NO: 1135580 - RNA, 16 nt, Homo sapiens
gguuucuuauucaaag

SEQ ID NO: 1135581 - RNA, 16 nt, Homo sapiens
gguuuuauccuuccuu

SEQ ID NO: 1135582 - RNA, 15 nt, Homo sapiens
gguuuuguacuggau

SEQ ID NO: 1135583 - RNA, 17 nt, Homo sapiens
gguuuuuuccuuucauu

SEQ ID NO: 1135584 - RNA, 12 nt, Homo sapiens
gguuuuuugcca

SEQ ID NO: 1135585 - RNA, 19 nt, Homo sapiens
guaaaagugaauuaucuuu

SEQ ID NO: 1135586 - RNA, 21 nt, Homo sapiens
guaaaaguucuuuuugcucua

SEQ ID NO: 1135587 - RNA, 23 nt, Homo sapiens
guaaaauugaaaggcauucucug

SEQ ID NO: 1135588 - RNA, 18 nt, Homo sapiens
guaaacacgccugcaaac

SEQ ID NO: 1135589 - RNA, 16 nt, Homo sapiens
guaaagaaaaaaacuu

SEQ ID NO: 1135590 - RNA, 21 nt, Homo sapiens
guaaagaaauauauaugauau

SEQ ID NO: 1135591 - RNA, 17 nt, Homo sapiens
guaaagaucuacaugaa

SEQ ID NO: 1135592 - RNA, 15 nt, Homo sapiens
guaaaggauauuaaa

SEQ ID NO: 1135593 - RNA, 18 nt, Homo sapiens
guaaagggcgcaaagggc

SEQ ID NO: 1135594 - RNA, 17 nt, Homo sapiens
guaaauaaagacauuca

SEQ ID NO: 1135595 - RNA, 21 nt, Homo sapiens
guaaauacacauagcauguaa

SEQ ID NO: 1135596 - RNA, 13 nt, Homo sapiens
guaaauacaugua

SEQ ID NO: 1135597 - RNA, 14 nt, Homo sapiens
guaaauaugaaucu

SEQ ID NO: 1135598 - RNA, 22 nt, Homo sapiens
guaaaucgggaaggaugggaaa

SEQ ID NO: 1135599 - RNA, 15 nt, Homo sapiens
uacugggugaugcac

SEQ ID NO: 1135600 - RNA, 14 nt, Homo sapiens
uacuguaugcagua

SEQ ID NO: 1135601 - RNA, 15 nt, Homo sapiens
uacugugcauuggga

SEQ ID NO: 1135602 - RNA, 15 nt, Homo sapiens
uacuguuauccauau

SEQ ID NO: 1135603 - RNA, 18 nt, Homo sapiens
uacuguucuaaagcucug

SEQ ID NO: 1135604 - RNA, 20 nt, Homo sapiens
uacuguuuucugggccagug

SEQ ID NO: 1135605 - RNA, 14 nt, Homo sapiens
uacuuaaacagcuu

SEQ ID NO: 1135606 - RNA, 13 nt, Homo sapiens
uacuuacaucagg

SEQ ID NO: 1135607 - RNA, 14 nt, Homo sapiens
uacuuagacaguau

SEQ ID NO: 1135608 - RNA, 17 nt, Homo sapiens
uacuuagacaguaugca

SEQ ID NO: 1135609 - RNA, 14 nt, Homo sapiens
uacuuagauacuaa

SEQ ID NO: 1135610 - RNA, 16 nt, Homo sapiens
uacuuagauacuaaua

SEQ ID NO: 1135611 - RNA, 20 nt, Homo sapiens
uacuuagauauuucaugugc

SEQ ID NO: 1135612 - RNA, 21 nt, Homo sapiens
uacuuaggacuacauuuugcu

SEQ ID NO: 1135613 - RNA, 20 nt, Homo sapiens
uacuucaaaaguauuuuccu

SEQ ID NO: 1135614 - RNA, 16 nt, Homo sapiens
uacuucaagaucugaa

SEQ ID NO: 1135615 - RNA, 15 nt, Homo sapiens
uacuucacuaaugac

SEQ ID NO: 1135616 - RNA, 13 nt, Homo sapiens
uacuucaguauua

SEQ ID NO: 1135617 - RNA, 20 nt, Homo sapiens
uacuucaguauuaaauuaga

SEQ ID NO: 1135618 - RNA, 16 nt, Homo sapiens
uacuucgaugaugaug

SEQ ID NO: 1135619 - RNA, 16 nt, Homo sapiens
uacuugaacacugugu

SEQ ID NO: 1135620 - RNA, 17 nt, Homo sapiens
uacuugaaguaacuaua

SEQ ID NO: 1135621 - RNA, 15 nt, Homo sapiens
uacuuguucauuugg

SEQ ID NO: 1135622 - RNA, 17 nt, Homo sapiens
uacuuuaugaugcuaug

SEQ ID NO: 1135623 - RNA, 20 nt, Homo sapiens
uacuuugugaauagaacucu

SEQ ID NO: 1135624 - RNA, 15 nt, Homo sapiens
uacuuugugcuugua

SEQ ID NO: 1135625 - RNA, 22 nt, Homo sapiens
uacuuuuuccuggcucaucucu

SEQ ID NO: 1135626 - RNA, 20 nt, Homo sapiens
uagaaaaagaacaugcaguu

SEQ ID NO: 1135627 - RNA, 20 nt, Homo sapiens
uagaaacaccaguaccugaa

SEQ ID NO: 1135628 - RNA, 18 nt, Homo sapiens
uagaaagaaacugcucua

SEQ ID NO: 1135629 - RNA, 19 nt, Homo sapiens
uagaaagcugacauugcca

SEQ ID NO: 1135630 - RNA, 16 nt, Homo sapiens
uagaaagcuugaaaag

SEQ ID NO: 1135631 - RNA, 22 nt, Homo sapiens
uagaaauuaacaaaugugcugc

SEQ ID NO: 1135632 - RNA, 14 nt, Homo sapiens
uaguaaacaugugg

SEQ ID NO: 1135633 - RNA, 13 nt, Homo sapiens
uaguaaacugugc

SEQ ID NO: 1135634 - RNA, 16 nt, Homo sapiens
uaguaacuguagaugg

SEQ ID NO: 1135635 - RNA, 21 nt, Homo sapiens
uaguaagaaaacaucacugaa

SEQ ID NO: 1135636 - RNA, 20 nt, Homo sapiens
uaguaauguaguauacacug

SEQ ID NO: 1135637 - RNA, 21 nt, Homo sapiens
uaguaauguuuuauacuguuu

SEQ ID NO: 1135638 - RNA, 21 nt, Homo sapiens
uaguaccuuguuuugccaugu

SEQ ID NO: 1135639 - RNA, 18 nt, Homo sapiens
uaguagccuuacugugaa

SEQ ID NO: 1135640 - RNA, 20 nt, Homo sapiens
uaguaugaugcuuuacauuu

SEQ ID NO: 1135641 - RNA, 12 nt, Homo sapiens
uaguauucauga

SEQ ID NO: 1135642 - RNA, 16 nt, Homo sapiens
uagucaaggugcucaa

SEQ ID NO: 1135643 - RNA, 19 nt, Homo sapiens
uagucacauggccuaugca

SEQ ID NO: 1135644 - RNA, 23 nt, Homo sapiens
uagucauacucccugguguagug

SEQ ID NO: 1135645 - RNA, 12 nt, Homo sapiens
uaguccaaaaag

SEQ ID NO: 1135646 - RNA, 13 nt, Homo sapiens
uaguccaaaaagc

SEQ ID NO: 1135647 - RNA, 21 nt, Homo sapiens
uagucccaccuuggagcauuu

SEQ ID NO: 1135648 - RNA, 23 nt, Homo sapiens
uagucccaccuuggagcauuuau

SEQ ID NO: 1135649 - RNA, 19 nt, Homo sapiens
uagucccagcuacuccgga

SEQ ID NO: 1135650 - RNA, 16 nt, Homo sapiens
uagucgaguuuucaau

SEQ ID NO: 1135651 - RNA, 20 nt, Homo sapiens
uagucucuacccaguagaug

SEQ ID NO: 1135652 - RNA, 13 nt, Homo sapiens
uagucucuaucau

SEQ ID NO: 1135653 - RNA, 18 nt, Homo sapiens
uagucucuaucauuaaag

SEQ ID NO: 1135654 - RNA, 21 nt, Homo sapiens
uagucuggacugcuuccccau

SEQ ID NO: 1135655 - RNA, 13 nt, Homo sapiens
uagucuuugccag

SEQ ID NO: 1135656 - RNA, 21 nt, Homo sapiens
uagugacauuuaaugccaucu

SEQ ID NO: 1135657 - RNA, 21 nt, Homo sapiens
uagugaccccugccuacuucc

SEQ ID NO: 1135658 - RNA, 17 nt, Homo sapiens
uagugagucagcaccuu

SEQ ID NO: 1135659 - RNA, 21 nt, Homo sapiens
uagugauguccuuaaaaugug

SEQ ID NO: 1135660 - RNA, 23 nt, Homo sapiens
uagugcuuuaagaaugaacacaa

SEQ ID NO: 1135661 - RNA, 16 nt, Homo sapiens
uaguggaccacuugga

SEQ ID NO: 1135662 - RNA, 20 nt, Homo sapiens
uaguggccugugcuuuucag

SEQ ID NO: 1135663 - RNA, 22 nt, Homo sapiens
uaguggucuaaucaacagauaa

SEQ ID NO: 1135664 - RNA, 17 nt, Homo sapiens
uaguggucucuacugug

SEQ ID NO: 1135665 - RNA, 18 nt, Homo sapiens
uaguggucucuacugugg

SEQ ID NO: 1135666 - RNA, 18 nt, Homo sapiens
uagugguugguggcaaca

SEQ ID NO: 1135667 - RNA, 16 nt, Homo sapiens
uaguguaaccauuuag

SEQ ID NO: 1135668 - RNA, 20 nt, Homo sapiens
uaguguaccuccucucagug

SEQ ID NO: 1135669 - RNA, 13 nt, Homo sapiens
uaguguauucucu

SEQ ID NO: 1135670 - RNA, 22 nt, Homo sapiens
uagugucuugguguaguguaac

SEQ ID NO: 1135671 - RNA, 23 nt, Homo sapiens
uaguuaaugaaggugugcuacag

SEQ ID NO: 1135672 - RNA, 15 nt, Homo sapiens
uaguuagccaucuaa

SEQ ID NO: 1135673 - RNA, 15 nt, Homo sapiens
uaguuaucaguauuu

SEQ ID NO: 1135674 - RNA, 16 nt, Homo sapiens
uaguucucuugguguu

SEQ ID NO: 1135675 - RNA, 19 nt, Homo sapiens
uaguucuuuguuccugcuu

SEQ ID NO: 1135676 - RNA, 17 nt, Homo sapiens
uaguugcugucauccac

SEQ ID NO: 1135677 - RNA, 20 nt, Homo sapiens
uaguuguauuuuguacauuu

SEQ ID NO: 1135678 - RNA, 18 nt, Homo sapiens
uaguuuauuuacucacuu

SEQ ID NO: 1135679 - RNA, 15 nt, Homo sapiens
uaguuuguuaugugu

SEQ ID NO: 1135680 - RNA, 19 nt, Homo sapiens
uaguuuuucuuacuugcau

SEQ ID NO: 1135681 - RNA, 19 nt, Homo sapiens
uauaaaaaugagugcuuaa

SEQ ID NO: 1135682 - RNA, 21 nt, Homo sapiens
uauaaaaugcugauauuuacu

SEQ ID NO: 1135683 - RNA, 18 nt, Homo sapiens
uauaaaauuaacaguauu

SEQ ID NO: 1135684 - RNA, 12 nt, Homo sapiens
uauaaacacaaa

SEQ ID NO: 1135685 - RNA, 16 nt, Homo sapiens
uauaaagucaggaccu

SEQ ID NO: 1135686 - RNA, 16 nt, Homo sapiens
uauaaauaaauaccaa

SEQ ID NO: 1135687 - RNA, 20 nt, Homo sapiens
uauaaauacaaaucuguaua

SEQ ID NO: 1135688 - RNA, 21 nt, Homo sapiens
uauaaauacacuuccugcuua

SEQ ID NO: 1135689 - RNA, 21 nt, Homo sapiens
uauaaaugcggauacagguua

SEQ ID NO: 1135690 - RNA, 21 nt, Homo sapiens
uauaaauuggagaugcaaaua

SEQ ID NO: 1135691 - RNA, 23 nt, Homo sapiens
uauaaauuuucccaaaacugaua

SEQ ID NO: 1135692 - RNA, 20 nt, Homo sapiens
uauaaauuuuuugaaacaca

SEQ ID NO: 1135693 - RNA, 12 nt, Homo sapiens
uauaacauauau

SEQ ID NO: 1135694 - RNA, 22 nt, Homo sapiens
uauaaccacaaagcacaguuug

SEQ ID NO: 1135695 - RNA, 18 nt, Homo sapiens
uauaacuaggcuguuaac

SEQ ID NO: 1135696 - RNA, 20 nt, Homo sapiens
uauaacuaguccuuuacuaa

SEQ ID NO: 1135697 - RNA, 17 nt, Homo sapiens
uauaacuuuggaggaaa

SEQ ID NO: 1135698 - RNA, 22 nt, Homo sapiens
uauaagcuauaucauaaauaca

SEQ ID NO: 1135699 - RNA, 15 nt, Homo sapiens
uauaagcugccauau

SEQ ID NO: 1135700 - RNA, 20 nt, Homo sapiens
uauaagguguuuucugugua

SEQ ID NO: 1135701 - RNA, 18 nt, Homo sapiens
uauaauauuguacaguua

SEQ ID NO: 1135702 - RNA, 16 nt, Homo sapiens
uauaauuagauuguga

SEQ ID NO: 1135703 - RNA, 16 nt, Homo sapiens
uauaauugaguuuuca

SEQ ID NO: 1135704 - RNA, 14 nt, Homo sapiens
uauaauuugcauac

SEQ ID NO: 1135705 - RNA, 11 nt, Homo sapiens
uauacagcuca

SEQ ID NO: 1135706 - RNA, 16 nt, Homo sapiens
uauacagugaagagua

SEQ ID NO: 1135707 - RNA, 13 nt, Homo sapiens
uauacagugauau

SEQ ID NO: 1135708 - RNA, 15 nt, Homo sapiens
uauacauuacaauca

SEQ ID NO: 1135709 - RNA, 15 nt, Homo sapiens
uauacgcaucuauaa

SEQ ID NO: 1135710 - RNA, 19 nt, Homo sapiens
uauacgcuggcaacacaga

SEQ ID NO: 1135711 - RNA, 16 nt, Homo sapiens
uauacucuucaaggac

SEQ ID NO: 1135712 - RNA, 15 nt, Homo sapiens
uauacugacaaacca

SEQ ID NO: 1135713 - RNA, 15 nt, Homo sapiens
uauacugagcugcua

SEQ ID NO: 1135714 - RNA, 16 nt, Homo sapiens
uauacugagcugcuaa

SEQ ID NO: 1135715 - RNA, 22 nt, Homo sapiens
uauacugcauuagcccaagaga

SEQ ID NO: 1135716 - RNA, 14 nt, Homo sapiens
uauacugccaaaga

SEQ ID NO: 1135717 - RNA, 10 nt, Homo sapiens
uauacuguaa

SEQ ID NO: 1135718 - RNA, 11 nt, Homo sapiens
uauacuguaaa

SEQ ID NO: 1135719 - RNA, 12 nt, Homo sapiens
uauacuguaaag

SEQ ID NO: 1135720 - RNA, 22 nt, Homo sapiens
uauacuuaauaaaacauuuuaa

SEQ ID NO: 1135721 - RNA, 21 nt, Homo sapiens
uauacuugggaauauaaagga

SEQ ID NO: 1135722 - RNA, 12 nt, Homo sapiens
uauagacagucc

SEQ ID NO: 1135723 - RNA, 17 nt, Homo sapiens
uauagccuauacugcau

SEQ ID NO: 1135724 - RNA, 17 nt, Homo sapiens
ucuggugccagauccuc

SEQ ID NO: 1135725 - RNA, 22 nt, Homo sapiens
ucuggugguguuaaucauuuca

SEQ ID NO: 1135726 - RNA, 22 nt, Homo sapiens
ucugguuaggugugucagguug

SEQ ID NO: 1135727 - RNA, 15 nt, Homo sapiens
ucuguaaaacuaaga

SEQ ID NO: 1135728 - RNA, 21 nt, Homo sapiens
ucuguaaaugaagggucauuu

SEQ ID NO: 1135729 - RNA, 22 nt, Homo sapiens
ucuguaagaaaccuacugccca

SEQ ID NO: 1135730 - RNA, 14 nt, Homo sapiens
ucuguaaggaacug

SEQ ID NO: 1135731 - RNA, 17 nt, Homo sapiens
ucuguaaggaacuggaa

SEQ ID NO: 1135732 - RNA, 17 nt, Homo sapiens
ucuguaauacauaucau

SEQ ID NO: 1135733 - RNA, 12 nt, Homo sapiens
ucuguaccuaaa

SEQ ID NO: 1135734 - RNA, 22 nt, Homo sapiens
ucuguacuugguccaacugcaa

SEQ ID NO: 1135735 - RNA, 21 nt, Homo sapiens
ucuguagagguuauuucugca

SEQ ID NO: 1135736 - RNA, 18 nt, Homo sapiens
ucuguagugagauagcau

SEQ ID NO: 1135737 - RNA, 15 nt, Homo sapiens
ucuguauugcuggca

SEQ ID NO: 1135738 - RNA, 14 nt, Homo sapiens
ucuguauuuuccac

SEQ ID NO: 1135739 - RNA, 17 nt, Homo sapiens
ucugucauccucaggaa

SEQ ID NO: 1135740 - RNA, 15 nt, Homo sapiens
ucugucauccugcua

SEQ ID NO: 1135741 - RNA, 15 nt, Homo sapiens
ucugucaucugcugc

SEQ ID NO: 1135742 - RNA, 12 nt, Homo sapiens
ucuguccacuug

SEQ ID NO: 1135743 - RNA, 17 nt, Homo sapiens
ucugucuagacuggccu

SEQ ID NO: 1135744 - RNA, 14 nt, Homo sapiens
ucugucugcucaau

SEQ ID NO: 1135745 - RNA, 18 nt, Homo sapiens
ucugugaagcccuuugcc

SEQ ID NO: 1135746 - RNA, 15 nt, Homo sapiens
ucugugcacugccca

SEQ ID NO: 1135747 - RNA, 22 nt, Homo sapiens
ucugugcaugguggcaccagcg

SEQ ID NO: 1135748 - RNA, 17 nt, Homo sapiens
ucugugcucauguuugg

SEQ ID NO: 1135749 - RNA, 18 nt, Homo sapiens
ucuguggacaccacugag

SEQ ID NO: 1135750 - RNA, 14 nt, Homo sapiens
ucuguggaugccag

SEQ ID NO: 1135751 - RNA, 19 nt, Homo sapiens
ucuguggauuggccuuuaa

SEQ ID NO: 1135752 - RNA, 19 nt, Homo sapiens
ucugugguugcagucuuuc

SEQ ID NO: 1135753 - RNA, 20 nt, Homo sapiens
ucugugucugucaccacauc

SEQ ID NO: 1135754 - RNA, 13 nt, Homo sapiens
ucuguguuuacag

SEQ ID NO: 1135755 - RNA, 20 nt, Homo sapiens
ucuguguuuuugaaauauua

SEQ ID NO: 1135756 - RNA, 22 nt, Homo sapiens
ucuguuaaccaaauaaaacaua

SEQ ID NO: 1135757 - RNA, 18 nt, Homo sapiens
ucuguuaucgaacacauu

SEQ ID NO: 1135758 - RNA, 16 nt, Homo sapiens
ucuguuuccucuguau

SEQ ID NO: 1135759 - RNA, 16 nt, Homo sapiens
ucuuaaaaaacauaua

SEQ ID NO: 1135760 - RNA, 21 nt, Homo sapiens
ucuuaaaaaucuaugccuaaa

SEQ ID NO: 1135761 - RNA, 14 nt, Homo sapiens
ucuuaacaaacucu

SEQ ID NO: 1135762 - RNA, 20 nt, Homo sapiens
ucuuaaccaguuucuauccc

SEQ ID NO: 1135763 - RNA, 15 nt, Homo sapiens
ucuuaacuuugaacc

SEQ ID NO: 1135764 - RNA, 20 nt, Homo sapiens
ucuuaagcagauagcacaua

SEQ ID NO: 1135765 - RNA, 12 nt, Homo sapiens
ucuuaagccauc

SEQ ID NO: 1135766 - RNA, 15 nt, Homo sapiens
ucuuaauguuuccaa

SEQ ID NO: 1135767 - RNA, 15 nt, Homo sapiens
ucuuaauucugaugc

SEQ ID NO: 1135768 - RNA, 23 nt, Homo sapiens
ucuuacaacaggcuuaugaauau

SEQ ID NO: 1135769 - RNA, 14 nt, Homo sapiens
ucuuacagcacauc

SEQ ID NO: 1135770 - RNA, 15 nt, Homo sapiens
ucuuaccagguucac

SEQ ID NO: 1135771 - RNA, 15 nt, Homo sapiens
ucuuacuggugcuau

SEQ ID NO: 1135772 - RNA, 23 nt, Homo sapiens
ucuuacuguaccuguuccuuaga

SEQ ID NO: 1135773 - RNA, 19 nt, Homo sapiens
ucuuacuuuguuuacuuau

SEQ ID NO: 1135774 - RNA, 16 nt, Homo sapiens
ucuuagaaguggacca

SEQ ID NO: 1135775 - RNA, 16 nt, Homo sapiens
ugaaaguuaauccacu

SEQ ID NO: 1135776 - RNA, 20 nt, Homo sapiens
ugaaaguuaauccacuguga

SEQ ID NO: 1135777 - RNA, 16 nt, Homo sapiens
ugaaauaaacagucua

SEQ ID NO: 1135778 - RNA, 19 nt, Homo sapiens
ugaaaugaagcaacagaga

SEQ ID NO: 1135779 - RNA, 18 nt, Homo sapiens
ugaaaugcagauugcuac

SEQ ID NO: 1135780 - RNA, 19 nt, Homo sapiens
ugaaaugcuuguugaauca

SEQ ID NO: 1135781 - RNA, 22 nt, Homo sapiens
ugaaauguaggcaucaugcaug

SEQ ID NO: 1135782 - RNA, 17 nt, Homo sapiens
ugaaaugugguuuuccu

SEQ ID NO: 1135783 - RNA, 13 nt, Homo sapiens
ugaaauuaacuca

SEQ ID NO: 1135784 - RNA, 19 nt, Homo sapiens
ugaaauuacggguaccuga

SEQ ID NO: 1135785 - RNA, 19 nt, Homo sapiens
ugaaauuauuugucauuca

SEQ ID NO: 1135786 - RNA, 18 nt, Homo sapiens
ugaaauucuucaacuugg

SEQ ID NO: 1135787 - RNA, 19 nt, Homo sapiens
ugaaauuugugauggaauc

SEQ ID NO: 1135788 - RNA, 20 nt, Homo sapiens
ugaacaaagacuacuaauga

SEQ ID NO: 1135789 - RNA, 21 nt, Homo sapiens
ugaacaaagugaggagaauga

SEQ ID NO: 1135790 - RNA, 21 nt, Homo sapiens
ugaacacucuuuugcuuuauu

SEQ ID NO: 1135791 - RNA, 14 nt, Homo sapiens
ugaacacuuaccug

SEQ ID NO: 1135792 - RNA, 23 nt, Homo sapiens
ugaacauuuuacaguagaacuca

SEQ ID NO: 1135793 - RNA, 16 nt, Homo sapiens
ugaaccauuaaccaga

SEQ ID NO: 1135794 - RNA, 23 nt, Homo sapiens
ugaaccuauuucuuaaacacuug

SEQ ID NO: 1135795 - RNA, 13 nt, Homo sapiens
ugaacucagggag

SEQ ID NO: 1135796 - RNA, 16 nt, Homo sapiens
ugaacuccuuccccac

SEQ ID NO: 1135797 - RNA, 23 nt, Homo sapiens
ugaacucugggcucaagcaaucc

SEQ ID NO: 1135798 - RNA, 19 nt, Homo sapiens
ugaacucuucacucuucaa

SEQ ID NO: 1135799 - RNA, 22 nt, Homo sapiens
ugaacugcagcgaguacuuccc

SEQ ID NO: 1135800 - RNA, 14 nt, Homo sapiens
ugaacuguauuuau

SEQ ID NO: 1135801 - RNA, 22 nt, Homo sapiens
ugaacugucuuuuaauguguaa

SEQ ID NO: 1135802 - RNA, 19 nt, Homo sapiens
ugaacuucagaagugccau

SEQ ID NO: 1135803 - RNA, 23 nt, Homo sapiens
ugaacuucgcaucaaaagacaau

SEQ ID NO: 1135804 - RNA, 17 nt, Homo sapiens
ugaagaagauaugugaa

SEQ ID NO: 1135805 - RNA, 21 nt, Homo sapiens
ugaagaauauaccauuucaaa

SEQ ID NO: 1135806 - RNA, 15 nt, Homo sapiens
ugaagacauguuuca

SEQ ID NO: 1135807 - RNA, 22 nt, Homo sapiens
ugaagaggccaaaggaaugucc

SEQ ID NO: 1135808 - RNA, 18 nt, Homo sapiens
ugaagaucucacucugcc

SEQ ID NO: 1135809 - RNA, 20 nt, Homo sapiens
ugaagauggcauccugugaa

SEQ ID NO: 1135810 - RNA, 19 nt, Homo sapiens
ugaagaugggcuucaucca

SEQ ID NO: 1135811 - RNA, 23 nt, Homo sapiens
ugaagcaagcuguguuacuugaa

SEQ ID NO: 1135812 - RNA, 16 nt, Homo sapiens
ugaagcagagaggcac

SEQ ID NO: 1135813 - RNA, 16 nt, Homo sapiens
ugaagcaggucuuuca

SEQ ID NO: 1135814 - RNA, 19 nt, Homo sapiens
ugaagcauaauuuguuuaa

SEQ ID NO: 1135815 - RNA, 19 nt, Homo sapiens
ugaagccaauucagacagg

SEQ ID NO: 1135816 - RNA, 18 nt, Homo sapiens
ugaagcccuuugccugua

SEQ ID NO: 1135817 - RNA, 15 nt, Homo sapiens
ugaagccucacuuau

SEQ ID NO: 1135818 - RNA, 14 nt, Homo sapiens
ugaagccuuugcca

SEQ ID NO: 1135819 - RNA, 17 nt, Homo sapiens
ugaagcucuaauuuaau

SEQ ID NO: 1135820 - RNA, 15 nt, Homo sapiens
ugaagcuuccuuggc

SEQ ID NO: 1135821 - RNA, 23 nt, Homo sapiens
ugaaggcaaaaaucuacaguguu

SEQ ID NO: 1135822 - RNA, 20 nt, Homo sapiens
ugaaggcauccccaggcccu

SEQ ID NO: 1135823 - RNA, 18 nt, Homo sapiens
ugaaggcuuugugauagu

SEQ ID NO: 1135824 - RNA, 20 nt, Homo sapiens
ugaagggccacugggacccu

SEQ ID NO: 1135825 - RNA, 14 nt, Homo sapiens
ugaaggggccauga

SEQ ID NO: 1135826 - RNA, 17 nt, Homo sapiens
ugaagguccccuggcag

SEQ ID NO: 1135827 - RNA, 14 nt, Homo sapiens
ugaagguguguccu

SEQ ID NO: 1135828 - RNA, 16 nt, Homo sapiens
ugaaguacuugccaga

SEQ ID NO: 1135829 - RNA, 23 nt, Homo sapiens
ugaagucaguuucuaucauucug

SEQ ID NO: 1135830 - RNA, 22 nt, Homo sapiens
ugaagugcaaauuugauacaua

SEQ ID NO: 1135831 - RNA, 19 nt, Homo sapiens
ugaaguggaaaaaggagag

SEQ ID NO: 1135832 - RNA, 16 nt, Homo sapiens
ugaaguguucugcuga

SEQ ID NO: 1135833 - RNA, 23 nt, Homo sapiens
ugaaguuacacauaacuucuuac

SEQ ID NO: 1135834 - RNA, 15 nt, Homo sapiens
ugaaguuacaugcau

SEQ ID NO: 1135835 - RNA, 22 nt, Homo sapiens
ugaaguucaccauuaaaaggga

SEQ ID NO: 1135836 - RNA, 20 nt, Homo sapiens
ugaaguuuagaccucauuaa

SEQ ID NO: 1135837 - RNA, 22 nt, Homo sapiens
ugaauaaaccaucaucuugcca

SEQ ID NO: 1135838 - RNA, 13 nt, Homo sapiens
ugaauacagcagc

SEQ ID NO: 1135839 - RNA, 15 nt, Homo sapiens
ugaauagaacucuga

SEQ ID NO: 1135840 - RNA, 20 nt, Homo sapiens
ugaauauuuuauaaauuaga

SEQ ID NO: 1135841 - RNA, 22 nt, Homo sapiens
ugaaucugggguuuccaucaga

SEQ ID NO: 1135842 - RNA, 17 nt, Homo sapiens
ugaauuaaugaugagga

SEQ ID NO: 1135843 - RNA, 13 nt, Homo sapiens
ugaauucaagaaa

SEQ ID NO: 1135844 - RNA, 14 nt, Homo sapiens
ugaauugugccuuu

SEQ ID NO: 1135845 - RNA, 15 nt, Homo sapiens
ugaauuuacauauag

SEQ ID NO: 1135846 - RNA, 16 nt, Homo sapiens
ugaauuuagucauuau

SEQ ID NO: 1135847 - RNA, 15 nt, Homo sapiens
ugaauuuauauagca

SEQ ID NO: 1135848 - RNA, 18 nt, Homo sapiens
ugaauuucacaagcuauu

SEQ ID NO: 1135849 - RNA, 18 nt, Homo sapiens
ugaauuucuuugauuuaa

SEQ ID NO: 1135850 - RNA, 21 nt, Homo sapiens
ugaauuucuuugauuuaacug

SEQ ID NO: 1135851 - RNA, 23 nt, Homo sapiens
ugaauuugcaaaguacuguaaga

SEQ ID NO: 1135852 - RNA, 17 nt, Homo sapiens
ugaauuuucaaguaauu

SEQ ID NO: 1135853 - RNA, 12 nt, Homo sapiens
ugacaacauguu

SEQ ID NO: 1135854 - RNA, 23 nt, Homo sapiens
ugacaacgucucuucaagcaucc

SEQ ID NO: 1135855 - RNA, 17 nt, Homo sapiens
ugacaaugacuaagcca

SEQ ID NO: 1135856 - RNA, 18 nt, Homo sapiens
ugacaaugcuuauggaaa

SEQ ID NO: 1135857 - RNA, 14 nt, Homo sapiens
ugacaauugcaaau

SEQ ID NO: 1135858 - RNA, 15 nt, Homo sapiens
ugacacauaugcacc

SEQ ID NO: 1135859 - RNA, 20 nt, Homo sapiens
ugacacucccuugggcuccc

SEQ ID NO: 1135860 - RNA, 16 nt, Homo sapiens
ugacacuucaagguga

SEQ ID NO: 1135861 - RNA, 22 nt, Homo sapiens
ugacagagugagacccugucuc

SEQ ID NO: 1135862 - RNA, 14 nt, Homo sapiens
ugacugucagggag

SEQ ID NO: 1135863 - RNA, 17 nt, Homo sapiens
ugacuguuuucuuuaug

SEQ ID NO: 1135864 - RNA, 15 nt, Homo sapiens
ugacuuaagcugccu

SEQ ID NO: 1135865 - RNA, 14 nt, Homo sapiens
ugacuucacaguga

SEQ ID NO: 1135866 - RNA, 19 nt, Homo sapiens
ugacuucagaguacaucca

SEQ ID NO: 1135867 - RNA, 20 nt, Homo sapiens
ugacuuuauuucugagcaaa

SEQ ID NO: 1135868 - RNA, 23 nt, Homo sapiens
ugagaaaagcuagguguuuaaua

SEQ ID NO: 1135869 - RNA, 21 nt, Homo sapiens
ugagaaaccuguaucuuucua

SEQ ID NO: 1135870 - RNA, 20 nt, Homo sapiens
ugagaaagccuucauaagcc

SEQ ID NO: 1135871 - RNA, 23 nt, Homo sapiens
ugagaacacagccgauucaccug

SEQ ID NO: 1135872 - RNA, 18 nt, Homo sapiens
ugagaaccauaggacugu

SEQ ID NO: 1135873 - RNA, 17 nt, Homo sapiens
ugagaacccuugcacua

SEQ ID NO: 1135874 - RNA, 21 nt, Homo sapiens
ugagaauggaaaccacaacuu

SEQ ID NO: 1135875 - RNA, 21 nt, Homo sapiens
ugagacaggagaaacacuuga

SEQ ID NO: 1135876 - RNA, 20 nt, Homo sapiens
ugagacaggaggauugccug

SEQ ID NO: 1135877 - RNA, 21 nt, Homo sapiens
ugagacaggaggucagcacaa

SEQ ID NO: 1135878 - RNA, 18 nt, Homo sapiens
ugagacagugcacaugaa

SEQ ID NO: 1135879 - RNA, 15 nt, Homo sapiens
ugagacccugucuca

SEQ ID NO: 1135880 - RNA, 21 nt, Homo sapiens
ugagaccuacugggcugcauu

SEQ ID NO: 1135881 - RNA, 13 nt, Homo sapiens
ugagaccuggcag

SEQ ID NO: 1135882 - RNA, 18 nt, Homo sapiens
ugagaccuggcagccaca

SEQ ID NO: 1135883 - RNA, 15 nt, Homo sapiens
ugagacggugucucg

SEQ ID NO: 1135884 - RNA, 14 nt, Homo sapiens
ugagacuccaucuc

SEQ ID NO: 1135885 - RNA, 16 nt, Homo sapiens
ugagacucugucucaa

SEQ ID NO: 1135886 - RNA, 23 nt, Homo sapiens
ugagacucugucuggauuugccu

SEQ ID NO: 1135887 - RNA, 22 nt, Homo sapiens
ugagagaaaauacuauuucaag

SEQ ID NO: 1135888 - RNA, 14 nt, Homo sapiens
ugagagacccaagg

SEQ ID NO: 1135889 - RNA, 17 nt, Homo sapiens
ugagagcacccacugaa

SEQ ID NO: 1135890 - RNA, 22 nt, Homo sapiens
ugagagcaggccauuggcuacu

SEQ ID NO: 1135891 - RNA, 13 nt, Homo sapiens
ugagagcauguga

SEQ ID NO: 1135892 - RNA, 13 nt, Homo sapiens
ugagagcugcuuu

SEQ ID NO: 1135893 - RNA, 19 nt, Homo sapiens
ugagagggaaucgacugua

SEQ ID NO: 1135894 - RNA, 16 nt, Homo sapiens
ugagaguacaccccaa

SEQ ID NO: 1135895 - RNA, 14 nt, Homo sapiens
ugagauacauacag

SEQ ID NO: 1135896 - RNA, 17 nt, Homo sapiens
ugagauagcauugugaa

SEQ ID NO: 1135897 - RNA, 19 nt, Homo sapiens
ugagauagcauugugaacu

SEQ ID NO: 1135898 - RNA, 22 nt, Homo sapiens
ugagauauuaaauucucaaagu

SEQ ID NO: 1135899 - RNA, 17 nt, Homo sapiens
ugagaucaacaacacua

SEQ ID NO: 1135900 - RNA, 15 nt, Homo sapiens
ugagaucaugccacu

SEQ ID NO: 1135901 - RNA, 16 nt, Homo sapiens
ugagaucguccacugu

SEQ ID NO: 1135902 - RNA, 19 nt, Homo sapiens
ugagaucguccacugucaa

SEQ ID NO: 1135903 - RNA, 22 nt, Homo sapiens
ugagaucucccgagaguuucca

SEQ ID NO: 1135904 - RNA, 16 nt, Homo sapiens
ugagaugcagcuggaa

SEQ ID NO: 1135905 - RNA, 17 nt, Homo sapiens
ugagaugcagcuggaaa

SEQ ID NO: 1135906 - RNA, 21 nt, Homo sapiens
ugagauucagaugucauuuag

SEQ ID NO: 1135907 - RNA, 15 nt, Homo sapiens
ugagcaacaugguga

SEQ ID NO: 1135908 - RNA, 14 nt, Homo sapiens
ugagcaaguuuaua

SEQ ID NO: 1135909 - RNA, 22 nt, Homo sapiens
ugagcaaugcuguuggaaaugu

SEQ ID NO: 1135910 - RNA, 17 nt, Homo sapiens
ugagcaaugugcacuuc

SEQ ID NO: 1135911 - RNA, 20 nt, Homo sapiens
ugagcacaaucuguucuacu

SEQ ID NO: 1135912 - RNA, 14 nt, Homo sapiens
ugagcacacuuuag

SEQ ID NO: 1135913 - RNA, 21 nt, Homo sapiens
ugagcacagauguucccccau

SEQ ID NO: 1135914 - RNA, 11 nt, Homo sapiens
ugagcaucuca

SEQ ID NO: 1135915 - RNA, 12 nt, Homo sapiens
ugagcaugugau

SEQ ID NO: 1135916 - RNA, 20 nt, Homo sapiens
ugagcauuggauacagcagu

SEQ ID NO: 1135917 - RNA, 15 nt, Homo sapiens
ugagccacucagagc

SEQ ID NO: 1135918 - RNA, 21 nt, Homo sapiens
ugagccacugcgcccgggcaa

SEQ ID NO: 1135919 - RNA, 14 nt, Homo sapiens
ugagccaugagaug

SEQ ID NO: 1135920 - RNA, 17 nt, Homo sapiens
ugagccccaggcacuuu

SEQ ID NO: 1135921 - RNA, 15 nt, Homo sapiens
ugagccggguggauc

SEQ ID NO: 1135922 - RNA, 13 nt, Homo sapiens
ugagcuaugauaa

SEQ ID NO: 1135923 - RNA, 14 nt, Homo sapiens
ugagcucaggaguu

SEQ ID NO: 1135924 - RNA, 15 nt, Homo sapiens
ugagcucccaggugc

SEQ ID NO: 1135925 - RNA, 16 nt, Homo sapiens
ugagcucccaggugca

SEQ ID NO: 1135926 - RNA, 12 nt, Homo sapiens
ugagcucucuca

SEQ ID NO: 1135927 - RNA, 15 nt, Homo sapiens
ugagcugugugccac

SEQ ID NO: 1135928 - RNA, 16 nt, Homo sapiens
ugagcuucuuuagcua

SEQ ID NO: 1135929 - RNA, 22 nt, Homo sapiens
ugaggaaauucggagcuauaca

SEQ ID NO: 1135930 - RNA, 13 nt, Homo sapiens
ugaggaauggagg

SEQ ID NO: 1135931 - RNA, 16 nt, Homo sapiens
ugaggacaaaaucaca

SEQ ID NO: 1135932 - RNA, 15 nt, Homo sapiens
ugaggacagcugucc

SEQ ID NO: 1135933 - RNA, 13 nt, Homo sapiens
ugaggaccucauc

SEQ ID NO: 1135934 - RNA, 17 nt, Homo sapiens
ugaggaccucauccaaa

SEQ ID NO: 1135935 - RNA, 20 nt, Homo sapiens
ugaggaccucauccaaacaa

SEQ ID NO: 1135936 - RNA, 15 nt, Homo sapiens
ugaggaugucacuca

SEQ ID NO: 1135937 - RNA, 14 nt, Homo sapiens
ugaggcaauaaaaa

SEQ ID NO: 1135938 - RNA, 18 nt, Homo sapiens
ugaggcaggagaaucacu

SEQ ID NO: 1135939 - RNA, 16 nt, Homo sapiens
ugaggccgaagcugcu

SEQ ID NO: 1135940 - RNA, 14 nt, Homo sapiens
ugaggccugagaca

SEQ ID NO: 1135941 - RNA, 19 nt, Homo sapiens
ugaggccugagacacagcc

SEQ ID NO: 1135942 - RNA, 17 nt, Homo sapiens
ugaggcuugacagaguc

SEQ ID NO: 1135943 - RNA, 19 nt, Homo sapiens
ugagggguggccaucuccu

SEQ ID NO: 1135944 - RNA, 19 nt, Homo sapiens
ugaggguaucugacaaugc

SEQ ID NO: 1135945 - RNA, 14 nt, Homo sapiens
ugagggugggguaa

SEQ ID NO: 1135946 - RNA, 16 nt, Homo sapiens
ugagguagcugacaca

SEQ ID NO: 1135947 - RNA, 22 nt, Homo sapiens
ugaguaacauuuauuuacauaa

SEQ ID NO: 1135948 - RNA, 19 nt, Homo sapiens
ugaguaaugguuacuaggc

SEQ ID NO: 1135949 - RNA, 17 nt, Homo sapiens
ugaguagcucuccugac

SEQ ID NO: 1135950 - RNA, 22 nt, Homo sapiens
ugaguagcuggauuacaggcau

SEQ ID NO: 1135951 - RNA, 18 nt, Homo sapiens
ugaguauaaugaacacuc

SEQ ID NO: 1135952 - RNA, 15 nt, Homo sapiens
ugaguaucagaauug

SEQ ID NO: 1135953 - RNA, 13 nt, Homo sapiens
ugaguaucuccuc

SEQ ID NO: 1135954 - RNA, 17 nt, Homo sapiens
ugcagugagcugagauc

SEQ ID NO: 1135955 - RNA, 16 nt, Homo sapiens
ugcaguggccccuuag

SEQ ID NO: 1135956 - RNA, 21 nt, Homo sapiens
ugcaguucaccugcacuuaag

SEQ ID NO: 1135957 - RNA, 14 nt, Homo sapiens
ugcaguuccaucag

SEQ ID NO: 1135958 - RNA, 21 nt, Homo sapiens
ugcaguuguaggcauguagcu

SEQ ID NO: 1135959 - RNA, 22 nt, Homo sapiens
ugcaguuugaaauucugaauuu

SEQ ID NO: 1135960 - RNA, 16 nt, Homo sapiens
ugcauacacacacaca

SEQ ID NO: 1135961 - RNA, 22 nt, Homo sapiens
ugcauacacacacacacacagc

SEQ ID NO: 1135962 - RNA, 20 nt, Homo sapiens
ugcauacagccuuugccauc

SEQ ID NO: 1135963 - RNA, 21 nt, Homo sapiens
ugcauagcagaugguuuccac

SEQ ID NO: 1135964 - RNA, 19 nt, Homo sapiens
ugcauauuuagcuuugcac

SEQ ID NO: 1135965 - RNA, 19 nt, Homo sapiens
ugcaucaguucacugcugc

SEQ ID NO: 1135966 - RNA, 19 nt, Homo sapiens
ugcaucguccccuccccca

SEQ ID NO: 1135967 - RNA, 16 nt, Homo sapiens
ugcaucugcuacugug

SEQ ID NO: 1135968 - RNA, 18 nt, Homo sapiens
ugcaucugcuacuguguc

SEQ ID NO: 1135969 - RNA, 23 nt, Homo sapiens
ugcaucuguuuauucuauaguua

SEQ ID NO: 1135970 - RNA, 17 nt, Homo sapiens
ugcaucuuauuucuguc

SEQ ID NO: 1135971 - RNA, 21 nt, Homo sapiens
ugcauggauguuuuagccauu

SEQ ID NO: 1135972 - RNA, 18 nt, Homo sapiens
ugcaugguggcaccagcg

SEQ ID NO: 1135973 - RNA, 17 nt, Homo sapiens
ugcauguaaacacgccu

SEQ ID NO: 1135974 - RNA, 14 nt, Homo sapiens
ugcauguaucuucu

SEQ ID NO: 1135975 - RNA, 23 nt, Homo sapiens
ugcauguggcuucucugucucug

SEQ ID NO: 1135976 - RNA, 19 nt, Homo sapiens
ugcauguguauauauguca

SEQ ID NO: 1135977 - RNA, 22 nt, Homo sapiens
ugcauuagaaagauuagugauu

SEQ ID NO: 1135978 - RNA, 22 nt, Homo sapiens
ugcauuccuuuuucuucacuua

SEQ ID NO: 1135979 - RNA, 23 nt, Homo sapiens
ugcauuguaggauguugagcagc

SEQ ID NO: 1135980 - RNA, 21 nt, Homo sapiens
ugcauuuauuuaagacacugu

SEQ ID NO: 1135981 - RNA, 16 nt, Homo sapiens
ugcauuuuuagaccau

SEQ ID NO: 1135982 - RNA, 13 nt, Homo sapiens
ugccaaacagccc

SEQ ID NO: 1135983 - RNA, 21 nt, Homo sapiens
ugccaaauaaaauauauugau

SEQ ID NO: 1135984 - RNA, 17 nt, Homo sapiens
ugccaaauaaaugcuca

SEQ ID NO: 1135985 - RNA, 19 nt, Homo sapiens
ugccaaauagccccagacu

SEQ ID NO: 1135986 - RNA, 21 nt, Homo sapiens
ugccaacaauccuagugcuuu

SEQ ID NO: 1135987 - RNA, 18 nt, Homo sapiens
ugccaacuguccuacuca

SEQ ID NO: 1135988 - RNA, 23 nt, Homo sapiens
ugccaagauacuugaacacugug

SEQ ID NO: 1135989 - RNA, 19 nt, Homo sapiens
ugccaaguaucuuuccagc

SEQ ID NO: 1135990 - RNA, 21 nt, Homo sapiens
ugccaauuacgguguacaguu

SEQ ID NO: 1135991 - RNA, 15 nt, Homo sapiens
ugccacacaccuuua

SEQ ID NO: 1135992 - RNA, 19 nt, Homo sapiens
ugccacaucugugucucug

SEQ ID NO: 1135993 - RNA, 17 nt, Homo sapiens
ugccacccacaucuucc

SEQ ID NO: 1135994 - RNA, 20 nt, Homo sapiens
ugccacccaguugugacaau

SEQ ID NO: 1135995 - RNA, 15 nt, Homo sapiens
ugccacucaauggga

SEQ ID NO: 1135996 - RNA, 18 nt, Homo sapiens
ugccacucagagacuuca

SEQ ID NO: 1135997 - RNA, 17 nt, Homo sapiens
ugccacugcucuccagc

SEQ ID NO: 1135998 - RNA, 14 nt, Homo sapiens
ugccagacaucacc

SEQ ID NO: 1135999 - RNA, 19 nt, Homo sapiens
ugccagagauaaacuaaug

SEQ ID NO: 1136000 - RNA, 17 nt, Homo sapiens
ugccagaggaugcucuu

SEQ ID NO: 1136001 - RNA, 19 nt, Homo sapiens
ugccagaggaugcucuuuc

SEQ ID NO: 1136002 - RNA, 21 nt, Homo sapiens
ugccagaggccccaggucacc

SEQ ID NO: 1136003 - RNA, 18 nt, Homo sapiens
ugccagcaguuacuguga

SEQ ID NO: 1136004 - RNA, 24 nt, Homo sapiens
ugccaggaauguuucagcugcagu

SEQ ID NO: 1136005 - RNA, 21 nt, Homo sapiens
ugccaggauuuuguauugcca

SEQ ID NO: 1136006 - RNA, 19 nt, Homo sapiens
ugccaggcccccaccacac

SEQ ID NO: 1136007 - RNA, 15 nt, Homo sapiens
ugccagggaggccau

SEQ ID NO: 1136008 - RNA, 14 nt, Homo sapiens
ugccagggccaguc

SEQ ID NO: 1136009 - RNA, 22 nt, Homo sapiens
ugccagugccuuaccuccugcc

SEQ ID NO: 1136010 - RNA, 17 nt, Homo sapiens
ugccaucaaacuguaaa

SEQ ID NO: 1136011 - RNA, 17 nt, Homo sapiens
ugccaucacugagcaua

SEQ ID NO: 1136012 - RNA, 22 nt, Homo sapiens
ugccauccacauuuuaacagua

SEQ ID NO: 1136013 - RNA, 14 nt, Homo sapiens
ugccauccaugugc

SEQ ID NO: 1136014 - RNA, 18 nt, Homo sapiens
ugccaucguuuccaugac

SEQ ID NO: 1136015 - RNA, 20 nt, Homo sapiens
ugccauggucaccaaacagg

SEQ ID NO: 1136016 - RNA, 12 nt, Homo sapiens
ugccauggugau

SEQ ID NO: 1136017 - RNA, 20 nt, Homo sapiens
ugccauguaaaggccuuuaa

SEQ ID NO: 1136018 - RNA, 21 nt, Homo sapiens
ugccauuugggcuuauuuaga

SEQ ID NO: 1136019 - RNA, 17 nt, Homo sapiens
ugcccacaacuugucac

SEQ ID NO: 1136020 - RNA, 17 nt, Homo sapiens
ugcccacacacacuccu

SEQ ID NO: 1136021 - RNA, 18 nt, Homo sapiens
ugcccaccugucaaacaa

SEQ ID NO: 1136022 - RNA, 23 nt, Homo sapiens
ugcccagaauaaguuauugcagu

SEQ ID NO: 1136023 - RNA, 22 nt, Homo sapiens
ugcccagcuucaauaauuacca

SEQ ID NO: 1136024 - RNA, 23 nt, Homo sapiens
ugcccaggagaaaagaagacauu

SEQ ID NO: 1136025 - RNA, 12 nt, Homo sapiens
ugcccaucaucu

SEQ ID NO: 1136026 - RNA, 18 nt, Homo sapiens
ugcccauggaagucucaa

SEQ ID NO: 1136027 - RNA, 21 nt, Homo sapiens
ugcccauggaagucucaaaga

SEQ ID NO: 1136028 - RNA, 14 nt, Homo sapiens
ugcccauggcaugu

SEQ ID NO: 1136029 - RNA, 19 nt, Homo sapiens
ugccccaggacugucauuu

SEQ ID NO: 1136030 - RNA, 13 nt, Homo sapiens
ugcccccaacagc

SEQ ID NO: 1136031 - RNA, 22 nt, Homo sapiens
ugcccccagacccaugugauuu

SEQ ID NO: 1136032 - RNA, 14 nt, Homo sapiens
ugcccccauuucac

SEQ ID NO: 1136033 - RNA, 14 nt, Homo sapiens
ugcccccuccacug

SEQ ID NO: 1136034 - RNA, 22 nt, Homo sapiens
ugccccuauacaaaacaccaga

SEQ ID NO: 1136035 - RNA, 23 nt, Homo sapiens
ugccccuauagaaacaccaguac

SEQ ID NO: 1136036 - RNA, 20 nt, Homo sapiens
ugccccucucugggccucag

SEQ ID NO: 1136037 - RNA, 21 nt, Homo sapiens
ugccccuucucuuuaaucuca

SEQ ID NO: 1136038 - RNA, 15 nt, Homo sapiens
ugcccgggagcucag

SEQ ID NO: 1136039 - RNA, 17 nt, Homo sapiens
ugcccucccgcaccuuc

SEQ ID NO: 1136040 - RNA, 15 nt, Homo sapiens
ugcccucccucagcc

SEQ ID NO: 1136041 - RNA, 21 nt, Homo sapiens
ugcccucugaaauaaugggau

SEQ ID NO: 1136042 - RNA, 20 nt, Homo sapiens
ugcccucuuguggugcauug

SEQ ID NO: 1136043 - RNA, 17 nt, Homo sapiens
ugcccugccgugguggc

SEQ ID NO: 1136044 - RNA, 14 nt, Homo sapiens
ugcccuguguggcu

SEQ ID NO: 1136045 - RNA, 18 nt, Homo sapiens
ugcccuuccgcagugugg

SEQ ID NO: 1136046 - RNA, 20 nt, Homo sapiens
ugccgaagaugagacugccc

SEQ ID NO: 1136047 - RNA, 22 nt, Homo sapiens
ugccgacucccccaaccaagga

SEQ ID NO: 1136048 - RNA, 23 nt, Homo sapiens
ugccggcucuggcucuccccaau

SEQ ID NO: 1136049 - RNA, 23 nt, Homo sapiens
ugccuauaaauuuacucuguuga

SEQ ID NO: 1136050 - RNA, 14 nt, Homo sapiens
ugccucacaucucc

SEQ ID NO: 1136051 - RNA, 14 nt, Homo sapiens
ugccucacuucuuc

SEQ ID NO: 1136052 - RNA, 20 nt, Homo sapiens
ugccuccaucagcuaaacac

SEQ ID NO: 1136053 - RNA, 22 nt, Homo sapiens
uguguacauuagucauucaaua

SEQ ID NO: 1136054 - RNA, 21 nt, Homo sapiens
uguguaccugaaguacaguau

SEQ ID NO: 1136055 - RNA, 15 nt, Homo sapiens
uguguagccugugca

SEQ ID NO: 1136056 - RNA, 15 nt, Homo sapiens
ugugucaggaaacau

SEQ ID NO: 1136057 - RNA, 18 nt, Homo sapiens
ugugucaggaaacauauu

SEQ ID NO: 1136058 - RNA, 17 nt, Homo sapiens
ugugucagggaacauau

SEQ ID NO: 1136059 - RNA, 19 nt, Homo sapiens
ugugucagggaacauauuu

SEQ ID NO: 1136060 - RNA, 15 nt, Homo sapiens
ugugucaugcaugaa

SEQ ID NO: 1136061 - RNA, 11 nt, Homo sapiens
uguguccaaaa

SEQ ID NO: 1136062 - RNA, 21 nt, Homo sapiens
uguguccccugaccuguccag

SEQ ID NO: 1136063 - RNA, 23 nt, Homo sapiens
ugugucccuggcgcugugcuagc

SEQ ID NO: 1136064 - RNA, 18 nt, Homo sapiens
ugugucugucaccacauc

SEQ ID NO: 1136065 - RNA, 13 nt, Homo sapiens
ugugugccacuca

SEQ ID NO: 1136066 - RNA, 16 nt, Homo sapiens
ugugugccuuguucaa

SEQ ID NO: 1136067 - RNA, 15 nt, Homo sapiens
ugugugcguguuugc

SEQ ID NO: 1136068 - RNA, 20 nt, Homo sapiens
uguguggaggccucagggag

SEQ ID NO: 1136069 - RNA, 17 nt, Homo sapiens
uguguggggugggcaca

SEQ ID NO: 1136070 - RNA, 20 nt, Homo sapiens
uguguguccacacauacaua

SEQ ID NO: 1136071 - RNA, 14 nt, Homo sapiens
ugugugugugcaca

SEQ ID NO: 1136072 - RNA, 16 nt, Homo sapiens
ugugugugugcacauc

SEQ ID NO: 1136073 - RNA, 13 nt, Homo sapiens
ugugugugugcgu

SEQ ID NO: 1136074 - RNA, 12 nt, Homo sapiens
uguguuacuuga

SEQ ID NO: 1136075 - RNA, 19 nt, Homo sapiens
uguguuaucagagugcauu

SEQ ID NO: 1136076 - RNA, 14 nt, Homo sapiens
uguguucuguagag

SEQ ID NO: 1136077 - RNA, 16 nt, Homo sapiens
uguguuucaaacugua

SEQ ID NO: 1136078 - RNA, 14 nt, Homo sapiens
uguguuuccuucag

SEQ ID NO: 1136079 - RNA, 16 nt, Homo sapiens
uguguuucuguucacc

SEQ ID NO: 1136080 - RNA, 15 nt, Homo sapiens
uguguuuucagcaaa

SEQ ID NO: 1136081 - RNA, 16 nt, Homo sapiens
uguguuuucagucuuu

SEQ ID NO: 1136082 - RNA, 21 nt, Homo sapiens
uguguuuuuaauaaagacagg

SEQ ID NO: 1136083 - RNA, 14 nt, Homo sapiens
uguguuuuuaauua

SEQ ID NO: 1136084 - RNA, 14 nt, Homo sapiens
uguguuuuucacau

SEQ ID NO: 1136085 - RNA, 15 nt, Homo sapiens
uguuaaaaccaaacu

SEQ ID NO: 1136086 - RNA, 19 nt, Homo sapiens
uguuaaaauugcucaugau

SEQ ID NO: 1136087 - RNA, 13 nt, Homo sapiens
uguuaaaucaaua

SEQ ID NO: 1136088 - RNA, 13 nt, Homo sapiens
uguuaacaugaca

SEQ ID NO: 1136089 - RNA, 18 nt, Homo sapiens
uguuaacaugacauuuac

SEQ ID NO: 1136090 - RNA, 19 nt, Homo sapiens
uguuaacauuccaagacuc

SEQ ID NO: 1136091 - RNA, 15 nt, Homo sapiens
uguuaacuguacuga

SEQ ID NO: 1136092 - RNA, 15 nt, Homo sapiens
uguuaauauggugua

SEQ ID NO: 1136093 - RNA, 21 nt, Homo sapiens
uguuaauaugguguacauucu

SEQ ID NO: 1136094 - RNA, 14 nt, Homo sapiens
uguuaaucauuuca

SEQ ID NO: 1136095 - RNA, 14 nt, Homo sapiens
uguuacacaugaca

SEQ ID NO: 1136096 - RNA, 16 nt, Homo sapiens
uguuaccacagaguuu

SEQ ID NO: 1136097 - RNA, 18 nt, Homo sapiens
uguuaccacugguaacau

SEQ ID NO: 1136098 - RNA, 20 nt, Homo sapiens
uguuaccugaaaacacugug

SEQ ID NO: 1136099 - RNA, 14 nt, Homo sapiens
uguuacuguaauuc

SEQ ID NO: 1136100 - RNA, 12 nt, Homo sapiens
uguuacuuugaa

SEQ ID NO: 1136101 - RNA, 21 nt, Homo sapiens
uguuaggaagguacugucaug

SEQ ID NO: 1136102 - RNA, 17 nt, Homo sapiens
uguuaggagaagcugca

SEQ ID NO: 1136103 - RNA, 20 nt, Homo sapiens
uguuaggcgggagcucuccu

SEQ ID NO: 1136104 - RNA, 23 nt, Homo sapiens
uguuagggcuaucucaggcaaua

SEQ ID NO: 1136105 - RNA, 22 nt, Homo sapiens
uguuaguuuuucuuacuugcau

SEQ ID NO: 1136106 - RNA, 14 nt, Homo sapiens
uguuaugcaaaaaa

SEQ ID NO: 1136107 - RNA, 18 nt, Homo sapiens
uguuauguaaaaggccaa

SEQ ID NO: 1136108 - RNA, 21 nt, Homo sapiens
uguuauugccucuacuuugau

SEQ ID NO: 1136109 - RNA, 22 nt, Homo sapiens
uguuauuuucuguugaaguuua

SEQ ID NO: 1136110 - RNA, 22 nt, Homo sapiens
uguucaaauagagcuguucaac

SEQ ID NO: 1136111 - RNA, 23 nt, Homo sapiens
uguucaaggccccugacagcugu

SEQ ID NO: 1136112 - RNA, 13 nt, Homo sapiens
uguucacacuccu

SEQ ID NO: 1136113 - RNA, 12 nt, Homo sapiens
uguucacaguua

SEQ ID NO: 1136114 - RNA, 20 nt, Homo sapiens
uguucagcuuuucagugaau

SEQ ID NO: 1136115 - RNA, 17 nt, Homo sapiens
uguuccaauuugacaaa

SEQ ID NO: 1136116 - RNA, 18 nt, Homo sapiens
uguuccacaaagcagugg

SEQ ID NO: 1136117 - RNA, 22 nt, Homo sapiens
uguuccaugaaggcagagccau

SEQ ID NO: 1136118 - RNA, 22 nt, Homo sapiens
uguuccccacuguaucuaggca

SEQ ID NO: 1136119 - RNA, 13 nt, Homo sapiens
uguuccccagaga

SEQ ID NO: 1136120 - RNA, 14 nt, Homo sapiens
uguuccccuaguuc

SEQ ID NO: 1136121 - RNA, 16 nt, Homo sapiens
uguuccccugcucugu

SEQ ID NO: 1136122 - RNA, 14 nt, Homo sapiens
uguucccugacucc

SEQ ID NO: 1136123 - RNA, 15 nt, Homo sapiens
uguuccuuuugacaa

SEQ ID NO: 1136124 - RNA, 18 nt, Homo sapiens
uguucgcaauuaugcuuu

SEQ ID NO: 1136125 - RNA, 22 nt, Homo sapiens
uguucuaagucuuuccauugga

SEQ ID NO: 1136126 - RNA, 21 nt, Homo sapiens
uguucuacaagguuguucaug

SEQ ID NO: 1136127 - RNA, 16 nt, Homo sapiens
uguucuauuugugcuu

SEQ ID NO: 1136128 - RNA, 17 nt, Homo sapiens
uguucucuuaugaucac

SEQ ID NO: 1136129 - RNA, 23 nt, Homo sapiens
uguucucuuaugaucaccaugua

SEQ ID NO: 1136130 - RNA, 15 nt, Homo sapiens
uguucuugaagcagu

SEQ ID NO: 1136131 - RNA, 16 nt, Homo sapiens
uguucuuggaccuuuu

SEQ ID NO: 1136132 - RNA, 19 nt, Homo sapiens
uguucuuucuuacacaaga

SEQ ID NO: 1136133 - RNA, 16 nt, Homo sapiens
uguugaagugagcuga

SEQ ID NO: 1136134 - RNA, 17 nt, Homo sapiens
uguugaaucaggggcaa

SEQ ID NO: 1136135 - RNA, 14 nt, Homo sapiens
uguugaaugcugcu

SEQ ID NO: 1136136 - RNA, 20 nt, Homo sapiens
uguugaauucuuuugccaag

SEQ ID NO: 1136137 - RNA, 13 nt, Homo sapiens
uguugacugcugc

SEQ ID NO: 1136138 - RNA, 18 nt, Homo sapiens
uguugauaauuucaggga

SEQ ID NO: 1136139 - RNA, 19 nt, Homo sapiens
uguugauaauuucagggaa

SEQ ID NO: 1136140 - RNA, 13 nt, Homo sapiens
uguugauagcaag

SEQ ID NO: 1136141 - RNA, 21 nt, Homo sapiens
uguugauccauccagcuugcc

SEQ ID NO: 1136142 - RNA, 20 nt, Homo sapiens
uguugcaugauaaacauuca

SEQ ID NO: 1136143 - RNA, 21 nt, Homo sapiens
uguugcaugggcuaaugaaga

SEQ ID NO: 1136144 - RNA, 24 nt, Homo sapiens
uguugccacuggcaaauguaacug

SEQ ID NO: 1136145 - RNA, 23 nt, Homo sapiens
uguugcccaacuacuaucucaga

SEQ ID NO: 1136146 - RNA, 13 nt, Homo sapiens
uguugcccccaaa

SEQ ID NO: 1136147 - RNA, 14 nt, Homo sapiens
uguugccuuuaugg

SEQ ID NO: 1136148 - RNA, 19 nt, Homo sapiens
uguugcuuaauugugaaca

SEQ ID NO: 1136149 - RNA, 20 nt, Homo sapiens
uguuggauaucauacuucca

SEQ ID NO: 1136150 - RNA, 15 nt, Homo sapiens
uguuggcaguguuug

SEQ ID NO: 1136151 - RNA, 15 nt, Homo sapiens
uguuggcccuuccag

SEQ ID NO: 1136152 - RNA, 24 nt, Homo sapiens
uguuggucacauggagcucuucca

SEQ ID NO: 1136153 - RNA, 22 nt, Homo sapiens
uguugucuacauuaaaucacuu

SEQ ID NO: 1136154 - RNA, 12 nt, Homo sapiens
uguuguguuucu

SEQ ID NO: 1136155 - RNA, 14 nt, Homo sapiens
uguuguuuaccuga

SEQ ID NO: 1136156 - RNA, 12 nt, Homo sapiens
uguuuacuguaa

SEQ ID NO: 1136157 - RNA, 23 nt, Homo sapiens
uguuucauaaugcagaaguauuc

SEQ ID NO: 1136158 - RNA, 12 nt, Homo sapiens
uguuucuuuagc

SEQ ID NO: 1136159 - RNA, 16 nt, Homo sapiens
uguuucuuuuugccag

SEQ ID NO: 1136160 - RNA, 13 nt, Homo sapiens
uguuugaauuauc

SEQ ID NO: 1136161 - RNA, 12 nt, Homo sapiens
uguuugaauuua

SEQ ID NO: 1136162 - RNA, 15 nt, Homo sapiens
uguuuggguggguua

SEQ ID NO: 1136163 - RNA, 15 nt, Homo sapiens
uguuugucagcaucu

SEQ ID NO: 1136164 - RNA, 22 nt, Homo sapiens
uguuugucucaccuacccauga

SEQ ID NO: 1136165 - RNA, 15 nt, Homo sapiens
uguuuuaacagaugc

SEQ ID NO: 1136166 - RNA, 13 nt, Homo sapiens
uguuuuacuaucu

SEQ ID NO: 1136167 - RNA, 16 nt, Homo sapiens
uguuuuauauguugcu

SEQ ID NO: 1136168 - RNA, 17 nt, Homo sapiens
uguuuucaacauuguau

SEQ ID NO: 1136169 - RNA, 22 nt, Homo sapiens
uguuuucuguguaaccauuuua

SEQ ID NO: 1136170 - RNA, 21 nt, Homo sapiens
uguuuucuguucccuugccau

SEQ ID NO: 1136171 - RNA, 21 nt, Homo sapiens
uguuuuguaggagacuugcca

SEQ ID NO: 1136172 - RNA, 14 nt, Homo sapiens
uguuuuuaaacuaa

SEQ ID NO: 1136173 - RNA, 20 nt, Homo sapiens
uguuuuuguucaaagccagc

SEQ ID NO: 1136174 - RNA, 19 nt, Homo sapiens
uguuuuuuuucagcacaug

SEQ ID NO: 1136175 - RNA, 22 nt, Homo sapiens
uuaaaaaaaaaaagaacacagg

SEQ ID NO: 1136176 - RNA, 22 nt, Homo sapiens
uuaaaaaaaauuaaaaccaauu

SEQ ID NO: 1136177 - RNA, 13 nt, Homo sapiens
uuaaaaacauaga

SEQ ID NO: 1136178 - RNA, 20 nt, Homo sapiens
uuaaaaagaagagacugcua

SEQ ID NO: 1136179 - RNA, 20 nt, Homo sapiens
uuaaaaagguuuacagaauu

SEQ ID NO: 1136180 - RNA, 16 nt, Homo sapiens
uuaaaaauagacacuc

SEQ ID NO: 1136181 - RNA, 13 nt, Homo sapiens
uucagaccuggaa

SEQ ID NO: 1136182 - RNA, 19 nt, Homo sapiens
uucagagaccauugcaaug

SEQ ID NO: 1136183 - RNA, 12 nt, Homo sapiens
uucagagaucau

SEQ ID NO: 1136184 - RNA, 12 nt, Homo sapiens
uucagaugugaa

SEQ ID NO: 1136185 - RNA, 15 nt, Homo sapiens
uucagauguggcaau

SEQ ID NO: 1136186 - RNA, 22 nt, Homo sapiens
uucagcagcagcucacacccua

SEQ ID NO: 1136187 - RNA, 13 nt, Homo sapiens
uucagccaccucu

SEQ ID NO: 1136188 - RNA, 16 nt, Homo sapiens
uucagccgagguccaa

SEQ ID NO: 1136189 - RNA, 14 nt, Homo sapiens
uucagcuauuuagu

SEQ ID NO: 1136190 - RNA, 20 nt, Homo sapiens
uucagcuauuuagugauaua

SEQ ID NO: 1136191 - RNA, 15 nt, Homo sapiens
uucagcugcaguuga

SEQ ID NO: 1136192 - RNA, 23 nt, Homo sapiens
uucaggaaccucgaguacugugg

SEQ ID NO: 1136193 - RNA, 18 nt, Homo sapiens
uucaggcaacgcacaaaa

SEQ ID NO: 1136194 - RNA, 18 nt, Homo sapiens
uucaggcagccaguguga

SEQ ID NO: 1136195 - RNA, 20 nt, Homo sapiens
uucaggccaucgacauguau

SEQ ID NO: 1136196 - RNA, 20 nt, Homo sapiens
uucaggggcgggugcauugu

SEQ ID NO: 1136197 - RNA, 13 nt, Homo sapiens
uucaggguuuuau

SEQ ID NO: 1136198 - RNA, 23 nt, Homo sapiens
uucagguauaaggcaggguggug

SEQ ID NO: 1136199 - RNA, 21 nt, Homo sapiens
uucaguaaaagcaaaaugaua

SEQ ID NO: 1136200 - RNA, 20 nt, Homo sapiens
uucaguauguuuuacacugu

SEQ ID NO: 1136201 - RNA, 15 nt, Homo sapiens
uucagugcugcugaa

SEQ ID NO: 1136202 - RNA, 13 nt, Homo sapiens
uucaguguucuga

SEQ ID NO: 1136203 - RNA, 16 nt, Homo sapiens
uucauaaguauuucaa

SEQ ID NO: 1136204 - RNA, 13 nt, Homo sapiens
uucauaugcagua

SEQ ID NO: 1136205 - RNA, 18 nt, Homo sapiens
uucaucccagaaacucca

SEQ ID NO: 1136206 - RNA, 17 nt, Homo sapiens
uucauccccuuacccuu

SEQ ID NO: 1136207 - RNA, 18 nt, Homo sapiens
uucauccggggaggaaac

SEQ ID NO: 1136208 - RNA, 18 nt, Homo sapiens
uucaucuucacugcaauu

SEQ ID NO: 1136209 - RNA, 16 nt, Homo sapiens
uucaucuuccccaagu

SEQ ID NO: 1136210 - RNA, 16 nt, Homo sapiens
uucaugacaagcauuu

SEQ ID NO: 1136211 - RNA, 22 nt, Homo sapiens
uucaugccaaguaucuuuccag

SEQ ID NO: 1136212 - RNA, 14 nt, Homo sapiens
uucaugccagguua

SEQ ID NO: 1136213 - RNA, 13 nt, Homo sapiens
uucauggaacuca

SEQ ID NO: 1136214 - RNA, 16 nt, Homo sapiens
uucauggucugcugag

SEQ ID NO: 1136215 - RNA, 22 nt, Homo sapiens
uucauguauguaugagacagaa

SEQ ID NO: 1136216 - RNA, 14 nt, Homo sapiens
uucaugucuuucca

SEQ ID NO: 1136217 - RNA, 17 nt, Homo sapiens
uucaugugcagauugca

SEQ ID NO: 1136218 - RNA, 20 nt, Homo sapiens
uucauguggagucauuauaa

SEQ ID NO: 1136219 - RNA, 16 nt, Homo sapiens
uucauugaaaucuuug

SEQ ID NO: 1136220 - RNA, 17 nt, Homo sapiens
uucauuucauguauagu

SEQ ID NO: 1136221 - RNA, 21 nt, Homo sapiens
uucauuuuuacccuuacuugg

SEQ ID NO: 1136222 - RNA, 17 nt, Homo sapiens
uuccaaagccaauguga

SEQ ID NO: 1136223 - RNA, 15 nt, Homo sapiens
uuccaaaugcccaag

SEQ ID NO: 1136224 - RNA, 19 nt, Homo sapiens
uuccaaauuggauacugcu

SEQ ID NO: 1136225 - RNA, 18 nt, Homo sapiens
uuccaagugcuacucuca

SEQ ID NO: 1136226 - RNA, 20 nt, Homo sapiens
uuccaauuugacaaaaccca

SEQ ID NO: 1136227 - RNA, 16 nt, Homo sapiens
uuccacaagacucaga

SEQ ID NO: 1136228 - RNA, 18 nt, Homo sapiens
uuccacccacguggagac

SEQ ID NO: 1136229 - RNA, 23 nt, Homo sapiens
uuccacguguuuuauuccuguau

SEQ ID NO: 1136230 - RNA, 14 nt, Homo sapiens
uuccacuacugcua

SEQ ID NO: 1136231 - RNA, 18 nt, Homo sapiens
uuccagagcucugaccca

SEQ ID NO: 1136232 - RNA, 19 nt, Homo sapiens
uuccagcuacuuuugccaa

SEQ ID NO: 1136233 - RNA, 22 nt, Homo sapiens
uuccagcuuagaaugcaucuca

SEQ ID NO: 1136234 - RNA, 23 nt, Homo sapiens
uuccaggacagggaagggagcag

SEQ ID NO: 1136235 - RNA, 21 nt, Homo sapiens
uuccagguggcaucagugucu

SEQ ID NO: 1136236 - RNA, 16 nt, Homo sapiens
uuccagucuacuugag

SEQ ID NO: 1136237 - RNA, 15 nt, Homo sapiens
uuccaguuaaccuau

SEQ ID NO: 1136238 - RNA, 16 nt, Homo sapiens
uuccaguuucuguaag

SEQ ID NO: 1136239 - RNA, 17 nt, Homo sapiens
uuccauaggacaaauga

SEQ ID NO: 1136240 - RNA, 18 nt, Homo sapiens
uuccaucagcacaaagac

SEQ ID NO: 1136241 - RNA, 19 nt, Homo sapiens
uuccaucccuagccauucu

SEQ ID NO: 1136242 - RNA, 19 nt, Homo sapiens
uuccaucuaguaccagagg

SEQ ID NO: 1136243 - RNA, 21 nt, Homo sapiens
uuccaucuccauccaagcaaa

SEQ ID NO: 1136244 - RNA, 17 nt, Homo sapiens
uuccaucugccugccaa

SEQ ID NO: 1136245 - RNA, 15 nt, Homo sapiens
uuccaugaugguuau

SEQ ID NO: 1136246 - RNA, 20 nt, Homo sapiens
uuccaugucuccuuuaagag

SEQ ID NO: 1136247 - RNA, 16 nt, Homo sapiens
uuccauugguccaaga

SEQ ID NO: 1136248 - RNA, 21 nt, Homo sapiens
uuccauuuauucuuugaucuu

SEQ ID NO: 1136249 - RNA, 17 nt, Homo sapiens
uuccauuuccauguccc

SEQ ID NO: 1136250 - RNA, 15 nt, Homo sapiens
uucccacauacauua

SEQ ID NO: 1136251 - RNA, 17 nt, Homo sapiens
uucccacccuccaucua

SEQ ID NO: 1136252 - RNA, 12 nt, Homo sapiens
uucccacugcca

SEQ ID NO: 1136253 - RNA, 14 nt, Homo sapiens
uucccagcuaggaa

SEQ ID NO: 1136254 - RNA, 16 nt, Homo sapiens
uucccaucauacccuu

SEQ ID NO: 1136255 - RNA, 14 nt, Homo sapiens
uucccauuggaugc

SEQ ID NO: 1136256 - RNA, 16 nt, Homo sapiens
uuccccaacaguguga

SEQ ID NO: 1136257 - RNA, 15 nt, Homo sapiens
uuccccaaccaaaga

SEQ ID NO: 1136258 - RNA, 12 nt, Homo sapiens
uuccccagagaa

SEQ ID NO: 1136259 - RNA, 15 nt, Homo sapiens
uuccccuugucccug

SEQ ID NO: 1136260 - RNA, 13 nt, Homo sapiens
uucccgacaccag

SEQ ID NO: 1136261 - RNA, 17 nt, Homo sapiens
uucccuagacucuguaa

SEQ ID NO: 1136262 - RNA, 19 nt, Homo sapiens
uucccucuugcucaguggg

SEQ ID NO: 1136263 - RNA, 20 nt, Homo sapiens
uucccugaaaacccagagag

SEQ ID NO: 1136264 - RNA, 20 nt, Homo sapiens
uucccugacugcagggguua

SEQ ID NO: 1136265 - RNA, 13 nt, Homo sapiens
uucccugagucac

SEQ ID NO: 1136266 - RNA, 19 nt, Homo sapiens
uucccuggguuuucugccc

SEQ ID NO: 1136267 - RNA, 19 nt, Homo sapiens
uucccuguacuuuucccau

SEQ ID NO: 1136268 - RNA, 18 nt, Homo sapiens
uucccuugccaucacacu

SEQ ID NO: 1136269 - RNA, 23 nt, Homo sapiens
uuccgcaguguggccaggcugcc

SEQ ID NO: 1136270 - RNA, 13 nt, Homo sapiens
uuccuaaguuuaa

SEQ ID NO: 1136271 - RNA, 23 nt, Homo sapiens
uuccuacgccuugucauuggaaa

SEQ ID NO: 1136272 - RNA, 21 nt, Homo sapiens
uuccuagggaugugugagaau

SEQ ID NO: 1136273 - RNA, 23 nt, Homo sapiens
uuccuaguagucagcuagaucau

SEQ ID NO: 1136274 - RNA, 18 nt, Homo sapiens
uuccuauuacuugcucca

SEQ ID NO: 1136275 - RNA, 15 nt, Homo sapiens
uuccucccaacaagc

SEQ ID NO: 1136276 - RNA, 16 nt, Homo sapiens
uuccucccuucugucc

SEQ ID NO: 1136277 - RNA, 18 nt, Homo sapiens
uuccuccuuucucuguau

SEQ ID NO: 1136278 - RNA, 13 nt, Homo sapiens
uuccucgccacgc

SEQ ID NO: 1136279 - RNA, 16 nt, Homo sapiens
uuccucucauuucccu

SEQ ID NO: 1136280 - RNA, 14 nt, Homo sapiens
uuccucucugcaaa

SEQ ID NO: 1136281 - RNA, 16 nt, Homo sapiens
uuccucuguaagauau

SEQ ID NO: 1136282 - RNA, 12 nt, Homo sapiens
uuccucuguaua

SEQ ID NO: 1136283 - RNA, 19 nt, Homo sapiens
uuccucuugggcuuuugaa

SEQ ID NO: 1136284 - RNA, 14 nt, Homo sapiens
uuccugagacagaa

SEQ ID NO: 1136285 - RNA, 16 nt, Homo sapiens
uuccugagaccacaga

SEQ ID NO: 1136286 - RNA, 22 nt, Homo sapiens
uuccugauagagguauggaaag

SEQ ID NO: 1136287 - RNA, 20 nt, Homo sapiens
uuccugugcccaucaucucu

SEQ ID NO: 1136288 - RNA, 15 nt, Homo sapiens
uuccuucaccaccuc

SEQ ID NO: 1136289 - RNA, 14 nt, Homo sapiens
uuccuucaggguga

SEQ ID NO: 1136290 - RNA, 20 nt, Homo sapiens
uuccuucagugcaucuggga

SEQ ID NO: 1136291 - RNA, 16 nt, Homo sapiens
uuccuugauucacaau

SEQ ID NO: 1136292 - RNA, 15 nt, Homo sapiens
uuccuugccagugag

SEQ ID NO: 1136293 - RNA, 16 nt, Homo sapiens
uuccuuggaacacaua

SEQ ID NO: 1136294 - RNA, 16 nt, Homo sapiens
uuccuuugaagauagu

SEQ ID NO: 1136295 - RNA, 22 nt, Homo sapiens
uucgaaacuccauugagucauu

SEQ ID NO: 1136296 - RNA, 20 nt, Homo sapiens
uucgagaccagccuggccaa

SEQ ID NO: 1136297 - RNA, 18 nt, Homo sapiens
uucgccauuuggccaggc

SEQ ID NO: 1136298 - RNA, 14 nt, Homo sapiens
uucggccucuccac

SEQ ID NO: 1136299 - RNA, 21 nt, Homo sapiens
uucgucggaggcaucauggaa

SEQ ID NO: 1136300 - RNA, 18 nt, Homo sapiens
uucguugaaacgauuuca

SEQ ID NO: 1136301 - RNA, 19 nt, Homo sapiens
uucuaaacugcaucuggau

SEQ ID NO: 1136302 - RNA, 22 nt, Homo sapiens
uucuaaagauucuauaguucua

SEQ ID NO: 1136303 - RNA, 14 nt, Homo sapiens
uucuaaaguucuaa

SEQ ID NO: 1136304 - RNA, 17 nt, Homo sapiens
uucuaaaugaagugcaa

SEQ ID NO: 1136305 - RNA, 15 nt, Homo sapiens
uucuaacaguaccag

SEQ ID NO: 1136306 - RNA, 12 nt, Homo sapiens
uucuaacauauu

SEQ ID NO: 1136307 - RNA, 21 nt, Homo sapiens
uucuaagaugugauauucuaa

SEQ ID NO: 1136308 - RNA, 14 nt, Homo sapiens
uucuaagauucuaa

SEQ ID NO: 1136309 - RNA, 16 nt, Homo sapiens
ugcgcucggcaggaag

SEQ ID NO: 1136310 - RNA, 20 nt, Homo sapiens
ugcgcucggccugcucgccc

SEQ ID NO: 1136311 - RNA, 16 nt, Homo sapiens
ugcgcuguaguaggca

SEQ ID NO: 1136312 - RNA, 15 nt, Homo sapiens
ugcggcaguugccgc

SEQ ID NO: 1136313 - RNA, 14 nt, Homo sapiens
ugcgggcaccugua

SEQ ID NO: 1136314 - RNA, 18 nt, Homo sapiens
ugcgggugaacaaagcag

SEQ ID NO: 1136315 - RNA, 19 nt, Homo sapiens
ugcguccaccaggccucac

SEQ ID NO: 1136316 - RNA, 13 nt, Homo sapiens
ugcgugaagacca

SEQ ID NO: 1136317 - RNA, 12 nt, Homo sapiens
ugcgugaguaug

SEQ ID NO: 1136318 - RNA, 14 nt, Homo sapiens
ugcguggacucugc

SEQ ID NO: 1136319 - RNA, 17 nt, Homo sapiens
ugcuaaaugcacugacc

SEQ ID NO: 1136320 - RNA, 22 nt, Homo sapiens
ugcuaaaugcuacauacuccaa

SEQ ID NO: 1136321 - RNA, 13 nt, Homo sapiens
ugcuaacuuugcc

SEQ ID NO: 1136322 - RNA, 21 nt, Homo sapiens
ugcuacagaaaauaaucuggu

SEQ ID NO: 1136323 - RNA, 15 nt, Homo sapiens
ugcuacagaaagcac

SEQ ID NO: 1136324 - RNA, 21 nt, Homo sapiens
ugcuacagggcucacagaauu

SEQ ID NO: 1136325 - RNA, 14 nt, Homo sapiens
ugcuauaauucuua

SEQ ID NO: 1136326 - RNA, 18 nt, Homo sapiens
ugcuauagucaauuuagu

SEQ ID NO: 1136327 - RNA, 18 nt, Homo sapiens
ugcuaucuuuuuuagugu

SEQ ID NO: 1136328 - RNA, 22 nt, Homo sapiens
ugcuauucccuggggcugcugu

SEQ ID NO: 1136329 - RNA, 20 nt, Homo sapiens
ugcucaagcagcaaaauccu

SEQ ID NO: 1136330 - RNA, 20 nt, Homo sapiens
ugcucaccuuuaucaccuca

SEQ ID NO: 1136331 - RNA, 16 nt, Homo sapiens
ugcucaggaaaccaca

SEQ ID NO: 1136332 - RNA, 16 nt, Homo sapiens
ugcucagggaaaagca

SEQ ID NO: 1136333 - RNA, 17 nt, Homo sapiens
ugcucagguacuuguaa

SEQ ID NO: 1136334 - RNA, 21 nt, Homo sapiens
ugcucauuuuuucuucuccua

SEQ ID NO: 1136335 - RNA, 15 nt, Homo sapiens
ugcuccaagauucua

SEQ ID NO: 1136336 - RNA, 20 nt, Homo sapiens
ugcuccauaguuuggcauuu

SEQ ID NO: 1136337 - RNA, 14 nt, Homo sapiens
ugcuccauuuacaa

SEQ ID NO: 1136338 - RNA, 20 nt, Homo sapiens
ugcucccacacuugugccag

SEQ ID NO: 1136339 - RNA, 15 nt, Homo sapiens
ugcuccuacuuucag

SEQ ID NO: 1136340 - RNA, 17 nt, Homo sapiens
ugcuccuuagcugccaa

SEQ ID NO: 1136341 - RNA, 22 nt, Homo sapiens
ugcucuacgggugaugugauuc

SEQ ID NO: 1136342 - RNA, 22 nt, Homo sapiens
ugcucucgcaccuuuccaaagu

SEQ ID NO: 1136343 - RNA, 18 nt, Homo sapiens
ugcucucggugcuuccaa

SEQ ID NO: 1136344 - RNA, 19 nt, Homo sapiens
ugcucuggggcacuguuga

SEQ ID NO: 1136345 - RNA, 12 nt, Homo sapiens
ugcucugugaac

SEQ ID NO: 1136346 - RNA, 14 nt, Homo sapiens
ugcucuguuaccca

SEQ ID NO: 1136347 - RNA, 18 nt, Homo sapiens
ugcucuuucaaugcagca

SEQ ID NO: 1136348 - RNA, 15 nt, Homo sapiens
ugcucuuucuugacu

SEQ ID NO: 1136349 - RNA, 21 nt, Homo sapiens
ugcucuuugauucaaagcacu

SEQ ID NO: 1136350 - RNA, 23 nt, Homo sapiens
ugcucuuugauucaaagcacugu

SEQ ID NO: 1136351 - RNA, 17 nt, Homo sapiens
ugcucuuuuauacugua

SEQ ID NO: 1136352 - RNA, 17 nt, Homo sapiens
ugcugaaaaaucaucca

SEQ ID NO: 1136353 - RNA, 18 nt, Homo sapiens
ugcugaccagacagccuc

SEQ ID NO: 1136354 - RNA, 16 nt, Homo sapiens
ugcugaccucaccugg

SEQ ID NO: 1136355 - RNA, 18 nt, Homo sapiens
ugcugaccuccacagcuu

SEQ ID NO: 1136356 - RNA, 21 nt, Homo sapiens
ugcugagauacauacagaauu

SEQ ID NO: 1136357 - RNA, 14 nt, Homo sapiens
ugcugaggccucuc

SEQ ID NO: 1136358 - RNA, 17 nt, Homo sapiens
ugcugauaccauaugaa

SEQ ID NO: 1136359 - RNA, 17 nt, Homo sapiens
ugcugauguagugacca

SEQ ID NO: 1136360 - RNA, 16 nt, Homo sapiens
ugcugcagcgcuuguu

SEQ ID NO: 1136361 - RNA, 18 nt, Homo sapiens
ugcugccaccaaaucugu

SEQ ID NO: 1136362 - RNA, 13 nt, Homo sapiens
ugcugccugggua

SEQ ID NO: 1136363 - RNA, 23 nt, Homo sapiens
ugcugcucauuccacacuguuga

SEQ ID NO: 1136364 - RNA, 15 nt, Homo sapiens
ugcugcuggugcaca

SEQ ID NO: 1136365 - RNA, 13 nt, Homo sapiens
ugcugcuguggaa

SEQ ID NO: 1136366 - RNA, 22 nt, Homo sapiens
ugcugcuugugccucccuuccc

SEQ ID NO: 1136367 - RNA, 15 nt, Homo sapiens
ugcuggaaagggagg

SEQ ID NO: 1136368 - RNA, 22 nt, Homo sapiens
ugcuggaaaucucaaaacugua

SEQ ID NO: 1136369 - RNA, 17 nt, Homo sapiens
ugcuggaaccugcaaaa

SEQ ID NO: 1136370 - RNA, 20 nt, Homo sapiens
ugcuggagggaagaucuuga

SEQ ID NO: 1136371 - RNA, 23 nt, Homo sapiens
ugcuggagggaagaucuugaugg

SEQ ID NO: 1136372 - RNA, 19 nt, Homo sapiens
ugcuggagucaugugccuc

SEQ ID NO: 1136373 - RNA, 21 nt, Homo sapiens
ugcuggagucaugugccucug

SEQ ID NO: 1136374 - RNA, 17 nt, Homo sapiens
ugcuggccggagcaaac

SEQ ID NO: 1136375 - RNA, 18 nt, Homo sapiens
ugcugggcucuccaccuc

SEQ ID NO: 1136376 - RNA, 21 nt, Homo sapiens
ugcuggggucucagguccagc

SEQ ID NO: 1136377 - RNA, 23 nt, Homo sapiens
ugcuggucccggggccagcacuu

SEQ ID NO: 1136378 - RNA, 12 nt, Homo sapiens
ugcuggugcaca

SEQ ID NO: 1136379 - RNA, 13 nt, Homo sapiens
ugcuggugcacag

SEQ ID NO: 1136380 - RNA, 17 nt, Homo sapiens
ugcugguggcucuucag

SEQ ID NO: 1136381 - RNA, 15 nt, Homo sapiens
ugcugguuaagguga

SEQ ID NO: 1136382 - RNA, 13 nt, Homo sapiens
ugcuguacaugac

SEQ ID NO: 1136383 - RNA, 11 nt, Homo sapiens
ugcuguaugaa

SEQ ID NO: 1136384 - RNA, 21 nt, Homo sapiens
ugcuguaugcugaucaucgcc

SEQ ID NO: 1136385 - RNA, 18 nt, Homo sapiens
ugcugucccaaacaugca

SEQ ID NO: 1136386 - RNA, 17 nt, Homo sapiens
ugcugucugcagccuug

SEQ ID NO: 1136387 - RNA, 13 nt, Homo sapiens
ugcugugcuaugg

SEQ ID NO: 1136388 - RNA, 12 nt, Homo sapiens
ugcuguggguuc

SEQ ID NO: 1136389 - RNA, 12 nt, Homo sapiens
ugcugugucaca

SEQ ID NO: 1136390 - RNA, 19 nt, Homo sapiens
ugcugugucuuuagaacag

SEQ ID NO: 1136391 - RNA, 19 nt, Homo sapiens
ugcuguuaaaucaguucug

SEQ ID NO: 1136392 - RNA, 16 nt, Homo sapiens
ugcuguucagccuuug

SEQ ID NO: 1136393 - RNA, 20 nt, Homo sapiens
ugcuguuccacaaagcagug

SEQ ID NO: 1136394 - RNA, 18 nt, Homo sapiens
ugcuguucguucaaaagu

SEQ ID NO: 1136395 - RNA, 23 nt, Homo sapiens
ugcuguucuagcacuucaucugg

SEQ ID NO: 1136396 - RNA, 22 nt, Homo sapiens
ugcuguuuuuguucuacucuag

SEQ ID NO: 1136397 - RNA, 18 nt, Homo sapiens
ugcuuaaacuugacccag

SEQ ID NO: 1136398 - RNA, 13 nt, Homo sapiens
ugcuuaaggcaua

SEQ ID NO: 1136399 - RNA, 15 nt, Homo sapiens
ugcuuaagugccuau

SEQ ID NO: 1136400 - RNA, 12 nt, Homo sapiens
ugcuuaauucaa

SEQ ID NO: 1136401 - RNA, 20 nt, Homo sapiens
ugcuuaauugugaacagcca

SEQ ID NO: 1136402 - RNA, 22 nt, Homo sapiens
ugcuuacuaugaccuuccaagu

SEQ ID NO: 1136403 - RNA, 22 nt, Homo sapiens
ugcuuaguaaugcuacguguga

SEQ ID NO: 1136404 - RNA, 23 nt, Homo sapiens
ugcuuaguagagcuuuuugcaug

SEQ ID NO: 1136405 - RNA, 15 nt, Homo sapiens
ugcuuauaacaagca

SEQ ID NO: 1136406 - RNA, 19 nt, Homo sapiens
ugcuucaaaaacauucuua

SEQ ID NO: 1136407 - RNA, 20 nt, Homo sapiens
ugcuucagugccauugcagc

SEQ ID NO: 1136408 - RNA, 16 nt, Homo sapiens
ugcuucagugcugcuc

SEQ ID NO: 1136409 - RNA, 16 nt, Homo sapiens
ugcuuccaguccugag

SEQ ID NO: 1136410 - RNA, 18 nt, Homo sapiens
ugcuucccagguucaagc

SEQ ID NO: 1136411 - RNA, 18 nt, Homo sapiens
ugcuuccucccaacaagc

SEQ ID NO: 1136412 - RNA, 19 nt, Homo sapiens
ugcuuccucccaacaagca

SEQ ID NO: 1136413 - RNA, 21 nt, Homo sapiens
ugcuuccucccaacaagcagc

SEQ ID NO: 1136414 - RNA, 15 nt, Homo sapiens
uucuacaacaugaua

SEQ ID NO: 1136415 - RNA, 23 nt, Homo sapiens
uucuacacagagcaggacugcac

SEQ ID NO: 1136416 - RNA, 14 nt, Homo sapiens
uucuacuagccauu

SEQ ID NO: 1136417 - RNA, 14 nt, Homo sapiens
uucuagaucucagc

SEQ ID NO: 1136418 - RNA, 14 nt, Homo sapiens
uucuaggauagcua

SEQ ID NO: 1136419 - RNA, 14 nt, Homo sapiens
uucuaguuaccaca

SEQ ID NO: 1136420 - RNA, 15 nt, Homo sapiens
uucuauaaggccaua

SEQ ID NO: 1136421 - RNA, 13 nt, Homo sapiens
uucuauacaaaua

SEQ ID NO: 1136422 - RNA, 21 nt, Homo sapiens
uucuauaggcuuaugaucuga

SEQ ID NO: 1136423 - RNA, 22 nt, Homo sapiens
uucuaugacccagcauggguua

SEQ ID NO: 1136424 - RNA, 21 nt, Homo sapiens
uucuauuuauauguacaugag

SEQ ID NO: 1136425 - RNA, 21 nt, Homo sapiens
uucucaacuaccucgcaucau

SEQ ID NO: 1136426 - RNA, 21 nt, Homo sapiens
uucucaaguucuaagauucua

SEQ ID NO: 1136427 - RNA, 19 nt, Homo sapiens
uucucacaaugucccuuca

SEQ ID NO: 1136428 - RNA, 19 nt, Homo sapiens
uucucauauuagauuacua

SEQ ID NO: 1136429 - RNA, 14 nt, Homo sapiens
uucucaucacauca

SEQ ID NO: 1136430 - RNA, 20 nt, Homo sapiens
uucucauuucuguagccuga

SEQ ID NO: 1136431 - RNA, 18 nt, Homo sapiens
uucuccccugauuggaau

SEQ ID NO: 1136432 - RNA, 20 nt, Homo sapiens
uucucccuggggaugugcuu

SEQ ID NO: 1136433 - RNA, 18 nt, Homo sapiens
uucuccuaaugcucugaa

SEQ ID NO: 1136434 - RNA, 13 nt, Homo sapiens
uucuccugccuca

SEQ ID NO: 1136435 - RNA, 20 nt, Homo sapiens
uucuccugccuuugccucca

SEQ ID NO: 1136436 - RNA, 23 nt, Homo sapiens
uucuccuugauuuuaaaauuccu

SEQ ID NO: 1136437 - RNA, 23 nt, Homo sapiens
uucuccuuuuauucucuguauug

SEQ ID NO: 1136438 - RNA, 16 nt, Homo sapiens
uucucuaacucagaaa

SEQ ID NO: 1136439 - RNA, 22 nt, Homo sapiens
uucucucucauuuggacuugcu

SEQ ID NO: 1136440 - RNA, 17 nt, Homo sapiens
uucucucuuaguaacau

SEQ ID NO: 1136441 - RNA, 18 nt, Homo sapiens
uucucucuuguuguccag

SEQ ID NO: 1136442 - RNA, 19 nt, Homo sapiens
uucucuggcgacaguuuuc

SEQ ID NO: 1136443 - RNA, 19 nt, Homo sapiens
uucucuggcucuuguccau

SEQ ID NO: 1136444 - RNA, 18 nt, Homo sapiens
uucucugugcaguagcau

SEQ ID NO: 1136445 - RNA, 15 nt, Homo sapiens
uucucuuaagauuua

SEQ ID NO: 1136446 - RNA, 22 nt, Homo sapiens
uucucuuaugaucaccauguau

SEQ ID NO: 1136447 - RNA, 17 nt, Homo sapiens
uucucuugacagucuga

SEQ ID NO: 1136448 - RNA, 22 nt, Homo sapiens
uucugaaaccacaguuucauua

SEQ ID NO: 1136449 - RNA, 18 nt, Homo sapiens
uucugauuugccacugau

SEQ ID NO: 1136450 - RNA, 13 nt, Homo sapiens
uucugcaaaacau

SEQ ID NO: 1136451 - RNA, 16 nt, Homo sapiens
uucugccccugcugac

SEQ ID NO: 1136452 - RNA, 16 nt, Homo sapiens
uucugccuucuggaau

SEQ ID NO: 1136453 - RNA, 15 nt, Homo sapiens
uucugcuaaagaaga

SEQ ID NO: 1136454 - RNA, 18 nt, Homo sapiens
uucugcuagagcagacag

SEQ ID NO: 1136455 - RNA, 14 nt, Homo sapiens
uucuggaacagcuu

SEQ ID NO: 1136456 - RNA, 18 nt, Homo sapiens
uucuggacggaaccacgu

SEQ ID NO: 1136457 - RNA, 17 nt, Homo sapiens
uucuggugucugcucag

SEQ ID NO: 1136458 - RNA, 14 nt, Homo sapiens
uucuguacaugcau

SEQ ID NO: 1136459 - RNA, 17 nt, Homo sapiens
uucugucagaaucacau

SEQ ID NO: 1136460 - RNA, 16 nt, Homo sapiens
uucuguccgcucuuac

SEQ ID NO: 1136461 - RNA, 21 nt, Homo sapiens
uucugugaauuauugaauuua

SEQ ID NO: 1136462 - RNA, 18 nt, Homo sapiens
uucuguggaccacugcau

SEQ ID NO: 1136463 - RNA, 20 nt, Homo sapiens
uucuguucaacauguaccuc

SEQ ID NO: 1136464 - RNA, 20 nt, Homo sapiens
uucuuaagauagcccuaaau

SEQ ID NO: 1136465 - RNA, 13 nt, Homo sapiens
uucuuaauaaacu

SEQ ID NO: 1136466 - RNA, 13 nt, Homo sapiens
uucuuacuuuguu

SEQ ID NO: 1136467 - RNA, 15 nt, Homo sapiens
uucuuagacuuaucu

SEQ ID NO: 1136468 - RNA, 17 nt, Homo sapiens
uucuuauggcugcugaa

SEQ ID NO: 1136469 - RNA, 21 nt, Homo sapiens
uucuucagagaucauggaaca

SEQ ID NO: 1136470 - RNA, 17 nt, Homo sapiens
uucuucagcuugauccu

SEQ ID NO: 1136471 - RNA, 17 nt, Homo sapiens
uucuuccaaacaggcuc

SEQ ID NO: 1136472 - RNA, 17 nt, Homo sapiens
uucuuccagcagaacag

SEQ ID NO: 1136473 - RNA, 23 nt, Homo sapiens
uucuuccuccagucuguucucac

SEQ ID NO: 1136474 - RNA, 13 nt, Homo sapiens
uucuucuaccaga

SEQ ID NO: 1136475 - RNA, 15 nt, Homo sapiens
uucuucuacugcuau

SEQ ID NO: 1136476 - RNA, 14 nt, Homo sapiens
uucuucuucuccua

SEQ ID NO: 1136477 - RNA, 13 nt, Homo sapiens
uucuucuuuuugc

SEQ ID NO: 1136478 - RNA, 19 nt, Homo sapiens
uucuugcaagcaugcuugu

SEQ ID NO: 1136479 - RNA, 20 nt, Homo sapiens
uucuugcuuucaauuacaaa

SEQ ID NO: 1136480 - RNA, 13 nt, Homo sapiens
uucuuguauugua

SEQ ID NO: 1136481 - RNA, 19 nt, Homo sapiens
uucuugugaagaagccaac

SEQ ID NO: 1136482 - RNA, 19 nt, Homo sapiens
uucuuguggcaagagcagc

SEQ ID NO: 1136483 - RNA, 21 nt, Homo sapiens
uucuuguuugucagcaucuga

SEQ ID NO: 1136484 - RNA, 21 nt, Homo sapiens
uucuuuaaaauguaaagccau

SEQ ID NO: 1136485 - RNA, 22 nt, Homo sapiens
uucuuuaaaauguaaagccaug

SEQ ID NO: 1136486 - RNA, 13 nt, Homo sapiens
uucuuuaccucca

SEQ ID NO: 1136487 - RNA, 14 nt, Homo sapiens
uucuuuuaugauug

SEQ ID NO: 1136488 - RNA, 22 nt, Homo sapiens
uucuuuuccugucccucuucca

SEQ ID NO: 1136489 - RNA, 15 nt, Homo sapiens
uucuuuuugcucuaa

SEQ ID NO: 1136490 - RNA, 22 nt, Homo sapiens
uugaaaaacuaaaacagaaaaa

SEQ ID NO: 1136491 - RNA, 12 nt, Homo sapiens
uugaaaacacuu

SEQ ID NO: 1136492 - RNA, 15 nt, Homo sapiens
uugaaaacugugcaa

SEQ ID NO: 1136493 - RNA, 16 nt, Homo sapiens
uugaaaccccaucucu

SEQ ID NO: 1136494 - RNA, 14 nt, Homo sapiens
uugaaaccuuugac

SEQ ID NO: 1136495 - RNA, 20 nt, Homo sapiens
uugaaacugcuugagcauca

SEQ ID NO: 1136496 - RNA, 14 nt, Homo sapiens
uugaaagaaccaga

SEQ ID NO: 1136497 - RNA, 14 nt, Homo sapiens
uugaaagaagaaug

SEQ ID NO: 1136498 - RNA, 20 nt, Homo sapiens
uugaaagcagaagaagacag

SEQ ID NO: 1136499 - RNA, 21 nt, Homo sapiens
uugaaagugcuucaaggguaa

SEQ ID NO: 1136500 - RNA, 17 nt, Homo sapiens
uugaaaugaacuuuguc

SEQ ID NO: 1136501 - RNA, 13 nt, Homo sapiens
uugaaauguaauu

SEQ ID NO: 1136502 - RNA, 21 nt, Homo sapiens
uugaacugauaguuacuguug

SEQ ID NO: 1136503 - RNA, 16 nt, Homo sapiens
uugaacugauucacau

SEQ ID NO: 1136504 - RNA, 14 nt, Homo sapiens
uugaagaagauaug

SEQ ID NO: 1136505 - RNA, 17 nt, Homo sapiens
uugaagacauaucaugu

SEQ ID NO: 1136506 - RNA, 19 nt, Homo sapiens
uugaagauaguaacuguag

SEQ ID NO: 1136507 - RNA, 21 nt, Homo sapiens
uugaagauaguaacuguagau

SEQ ID NO: 1136508 - RNA, 16 nt, Homo sapiens
uugaagcuguugcuau

SEQ ID NO: 1136509 - RNA, 20 nt, Homo sapiens
uugaaggugcugacggccag

SEQ ID NO: 1136510 - RNA, 13 nt, Homo sapiens
uugaaguuuacaa

SEQ ID NO: 1136511 - RNA, 18 nt, Homo sapiens
uugaauaccagcuuucua

SEQ ID NO: 1136512 - RNA, 22 nt, Homo sapiens
uugaauggagcuggugagauca

SEQ ID NO: 1136513 - RNA, 14 nt, Homo sapiens
uugaauuugggaua

SEQ ID NO: 1136514 - RNA, 19 nt, Homo sapiens
uugacaaagucaagccaca

SEQ ID NO: 1136515 - RNA, 14 nt, Homo sapiens
uugacaacccaaac

SEQ ID NO: 1136516 - RNA, 13 nt, Homo sapiens
uugacaacuggca

SEQ ID NO: 1136517 - RNA, 19 nt, Homo sapiens
uugacagaucaagcuguga

SEQ ID NO: 1136518 - RNA, 21 nt, Homo sapiens
uugacaguuuuugacauuuau

SEQ ID NO: 1136519 - RNA, 20 nt, Homo sapiens
uugacgaacuggcuacagua

SEQ ID NO: 1136520 - RNA, 15 nt, Homo sapiens
uugacugaagacauu

SEQ ID NO: 1136521 - RNA, 11 nt, Homo sapiens
uugacugcugc

SEQ ID NO: 1136522 - RNA, 16 nt, Homo sapiens
uugacuggcuguguga

SEQ ID NO: 1136523 - RNA, 15 nt, Homo sapiens
uugacugucagcaag

SEQ ID NO: 1136524 - RNA, 22 nt, Homo sapiens
uugagauacuugaccuugcaug

SEQ ID NO: 1136525 - RNA, 20 nt, Homo sapiens
uugagauucugaaguaugaa

SEQ ID NO: 1136526 - RNA, 20 nt, Homo sapiens
uugagcaucacagaauguga

SEQ ID NO: 1136527 - RNA, 16 nt, Homo sapiens
uugagccaguggugcu

SEQ ID NO: 1136528 - RNA, 21 nt, Homo sapiens
uugagcccuccccaggaauuu

SEQ ID NO: 1136529 - RNA, 18 nt, Homo sapiens
uugaggaccucauccaaa

SEQ ID NO: 1136530 - RNA, 18 nt, Homo sapiens
uugagggacugagccaga

SEQ ID NO: 1136531 - RNA, 19 nt, Homo sapiens
uugagguggacucucacca

SEQ ID NO: 1136532 - RNA, 15 nt, Homo sapiens
uugauaaacuuugaa

SEQ ID NO: 1136533 - RNA, 15 nt, Homo sapiens
uugauaagcacauua

SEQ ID NO: 1136534 - RNA, 15 nt, Homo sapiens
uugauauugugaaca

SEQ ID NO: 1136535 - RNA, 22 nt, Homo sapiens
uugaucucugcuuaccguucaa

SEQ ID NO: 1136536 - RNA, 21 nt, Homo sapiens
uugaucuggaacccagacuca

SEQ ID NO: 1136537 - RNA, 21 nt, Homo sapiens
uuucauucaaucaaccugcac

SEQ ID NO: 1136538 - RNA, 17 nt, Homo sapiens
uuucauuccaaagggga

SEQ ID NO: 1136539 - RNA, 22 nt, Homo sapiens
uuucauugcugugucacacucu

SEQ ID NO: 1136540 - RNA, 21 nt, Homo sapiens
uuucauuugguucauuaauuc

SEQ ID NO: 1136541 - RNA, 21 nt, Homo sapiens
uuuccaagaaucggcauguau

SEQ ID NO: 1136542 - RNA, 21 nt, Homo sapiens
uuuccacucccacugccagga

SEQ ID NO: 1136543 - RNA, 16 nt, Homo sapiens
uuuccagcuacuuuug

SEQ ID NO: 1136544 - RNA, 13 nt, Homo sapiens
uuuccaguucccu

SEQ ID NO: 1136545 - RNA, 22 nt, Homo sapiens
uuuccauaguuuugaugacugg

SEQ ID NO: 1136546 - RNA, 15 nt, Homo sapiens
uuuccaucugcuggg

SEQ ID NO: 1136547 - RNA, 17 nt, Homo sapiens
uuuccaugcuauaauuc

SEQ ID NO: 1136548 - RNA, 15 nt, Homo sapiens
uuucccaacaccucu

SEQ ID NO: 1136549 - RNA, 22 nt, Homo sapiens
uuucccacgaggaaucuguggg

SEQ ID NO: 1136550 - RNA, 20 nt, Homo sapiens
uuuccccaauuaauugcuau

SEQ ID NO: 1136551 - RNA, 15 nt, Homo sapiens
uuuccccagugacac

SEQ ID NO: 1136552 - RNA, 19 nt, Homo sapiens
uuucccccugugaaagcaa

SEQ ID NO: 1136553 - RNA, 18 nt, Homo sapiens
uuucccucccacuauuaa

SEQ ID NO: 1136554 - RNA, 19 nt, Homo sapiens
uuucccuucaaaaugcuuu

SEQ ID NO: 1136555 - RNA, 22 nt, Homo sapiens
uuucccuuugccuucauucugc

SEQ ID NO: 1136556 - RNA, 13 nt, Homo sapiens
uuucccuuuggca

SEQ ID NO: 1136557 - RNA, 15 nt, Homo sapiens
uuuccgaaaucagaa

SEQ ID NO: 1136558 - RNA, 14 nt, Homo sapiens
uuuccgacuaggag

SEQ ID NO: 1136559 - RNA, 20 nt, Homo sapiens
uuuccgaggccccugucuca

SEQ ID NO: 1136560 - RNA, 18 nt, Homo sapiens
uuuccguaaaaaugauuu

SEQ ID NO: 1136561 - RNA, 13 nt, Homo sapiens
uuuccuacagaca

SEQ ID NO: 1136562 - RNA, 12 nt, Homo sapiens
uuuccucaaaaa

SEQ ID NO: 1136563 - RNA, 20 nt, Homo sapiens
uuuccucacuuuauggaaga

SEQ ID NO: 1136564 - RNA, 20 nt, Homo sapiens
uuuccucuaaaagccuugga

SEQ ID NO: 1136565 - RNA, 12 nt, Homo sapiens
uuuccugcacau

SEQ ID NO: 1136566 - RNA, 15 nt, Homo sapiens
uuuccugcggcauca

SEQ ID NO: 1136567 - RNA, 21 nt, Homo sapiens
uuuccuguguacacgugacag

SEQ ID NO: 1136568 - RNA, 18 nt, Homo sapiens
uuuccuuccuuccuucca

SEQ ID NO: 1136569 - RNA, 19 nt, Homo sapiens
uuuccuucuaacacuugua

SEQ ID NO: 1136570 - RNA, 23 nt, Homo sapiens
uuuccuugggcuuuagccuuaaa

SEQ ID NO: 1136571 - RNA, 16 nt, Homo sapiens
uuucguaccuucccac

SEQ ID NO: 1136572 - RNA, 15 nt, Homo sapiens
uuucuaaaccuucau

SEQ ID NO: 1136573 - RNA, 20 nt, Homo sapiens
uuucuaaacguaagcacugu

SEQ ID NO: 1136574 - RNA, 14 nt, Homo sapiens
uuucuacaaugcac

SEQ ID NO: 1136575 - RNA, 15 nt, Homo sapiens
uuucuacaaugcaca

SEQ ID NO: 1136576 - RNA, 17 nt, Homo sapiens
uuucuacagugaauuua

SEQ ID NO: 1136577 - RNA, 22 nt, Homo sapiens
uuucuagauaaggaagagucuc

SEQ ID NO: 1136578 - RNA, 18 nt, Homo sapiens
uuucuauuuuuaugauga

SEQ ID NO: 1136579 - RNA, 20 nt, Homo sapiens
uuucuauuuuuaugaugaca

SEQ ID NO: 1136580 - RNA, 12 nt, Homo sapiens
uuucucugugaa

SEQ ID NO: 1136581 - RNA, 17 nt, Homo sapiens
uuucugaaugucuguga

SEQ ID NO: 1136582 - RNA, 18 nt, Homo sapiens
uuucugcaucaguucacu

SEQ ID NO: 1136583 - RNA, 20 nt, Homo sapiens
uuucugcaucaguucacugc

SEQ ID NO: 1136584 - RNA, 19 nt, Homo sapiens
uuucuguguaagcuuuuaa

SEQ ID NO: 1136585 - RNA, 15 nt, Homo sapiens
uuucuguguacugua

SEQ ID NO: 1136586 - RNA, 22 nt, Homo sapiens
uuucuguucauagauauuggaa

SEQ ID NO: 1136587 - RNA, 18 nt, Homo sapiens
uuucuuaaugaaccuuag

SEQ ID NO: 1136588 - RNA, 16 nt, Homo sapiens
uuucuuacacaagagc

SEQ ID NO: 1136589 - RNA, 12 nt, Homo sapiens
uuucuuccugca

SEQ ID NO: 1136590 - RNA, 13 nt, Homo sapiens
uuucuugcuuuca

SEQ ID NO: 1136591 - RNA, 18 nt, Homo sapiens
uuucuuucuaacuccagu

SEQ ID NO: 1136592 - RNA, 12 nt, Homo sapiens
uuucuuugaacu

SEQ ID NO: 1136593 - RNA, 22 nt, Homo sapiens
uuugaaaacauauaaagcacua

SEQ ID NO: 1136594 - RNA, 12 nt, Homo sapiens
uuugaaagaaua

SEQ ID NO: 1136595 - RNA, 22 nt, Homo sapiens
uuugaaaugugguuuuccugaa

SEQ ID NO: 1136596 - RNA, 18 nt, Homo sapiens
uuugaaauuaaccucuca

SEQ ID NO: 1136597 - RNA, 12 nt, Homo sapiens
uuugaacaaagg

SEQ ID NO: 1136598 - RNA, 18 nt, Homo sapiens
uuugaagaacaugugaga

SEQ ID NO: 1136599 - RNA, 20 nt, Homo sapiens
uuugaaggcaaaauugcaaa

SEQ ID NO: 1136600 - RNA, 15 nt, Homo sapiens
uuugaauaaagaaua

SEQ ID NO: 1136601 - RNA, 13 nt, Homo sapiens
uuugaauacacau

SEQ ID NO: 1136602 - RNA, 22 nt, Homo sapiens
uuugaaucuuucguagccuaaa

SEQ ID NO: 1136603 - RNA, 18 nt, Homo sapiens
uuugaaucuuucuguguc

SEQ ID NO: 1136604 - RNA, 19 nt, Homo sapiens
uuugaaugaacacuaugca

SEQ ID NO: 1136605 - RNA, 19 nt, Homo sapiens
uuugaauuauccacaugaa

SEQ ID NO: 1136606 - RNA, 17 nt, Homo sapiens
uuugaauuggcauuucc

SEQ ID NO: 1136607 - RNA, 22 nt, Homo sapiens
uuugacagacauccuugcaguu

SEQ ID NO: 1136608 - RNA, 11 nt, Homo sapiens
uuugaccaguu

SEQ ID NO: 1136609 - RNA, 19 nt, Homo sapiens
uuugacuaugccgucuucu

SEQ ID NO: 1136610 - RNA, 18 nt, Homo sapiens
uuugacucuugcaaucca

SEQ ID NO: 1136611 - RNA, 19 nt, Homo sapiens
uuugagaacugccauucag

SEQ ID NO: 1136612 - RNA, 19 nt, Homo sapiens
uuugagaagaaaacaucua

SEQ ID NO: 1136613 - RNA, 15 nt, Homo sapiens
uuugagcacaacuuu

SEQ ID NO: 1136614 - RNA, 20 nt, Homo sapiens
uuugagugugggacuccagg

SEQ ID NO: 1136615 - RNA, 16 nt, Homo sapiens
uuugaguugugauuga

SEQ ID NO: 1136616 - RNA, 13 nt, Homo sapiens
uuugaucagacag

SEQ ID NO: 1136617 - RNA, 13 nt, Homo sapiens
uuugaucuucagg

SEQ ID NO: 1136618 - RNA, 17 nt, Homo sapiens
uuugauuaaagacucca

SEQ ID NO: 1136619 - RNA, 21 nt, Homo sapiens
uuugauuagaggaacuucuga

SEQ ID NO: 1136620 - RNA, 14 nt, Homo sapiens
uuugauugauuuga

SEQ ID NO: 1136621 - RNA, 18 nt, Homo sapiens
uuugauuucgccaaucau

SEQ ID NO: 1136622 - RNA, 20 nt, Homo sapiens
uuugauuuuuugcccagaga

SEQ ID NO: 1136623 - RNA, 23 nt, Homo sapiens
uuugcaaacacugugauuacucu

SEQ ID NO: 1136624 - RNA, 20 nt, Homo sapiens
uuugcaagggaaaagucucu

SEQ ID NO: 1136625 - RNA, 14 nt, Homo sapiens
uuugcaauuggaau

SEQ ID NO: 1136626 - RNA, 11 nt, Homo sapiens
uuugcacagaa

SEQ ID NO: 1136627 - RNA, 14 nt, Homo sapiens
uuugcagaaagcca

SEQ ID NO: 1136628 - RNA, 21 nt, Homo sapiens
uuugcaggguccucuucuggg

SEQ ID NO: 1136629 - RNA, 16 nt, Homo sapiens
uuugcauagcuuucca

SEQ ID NO: 1136630 - RNA, 21 nt, Homo sapiens
uuugcauuuugauauugcugu

SEQ ID NO: 1136631 - RNA, 23 nt, Homo sapiens
uuugccauauuuucaccauuuga

SEQ ID NO: 1136632 - RNA, 13 nt, Homo sapiens
uuugcccagaaag

SEQ ID NO: 1136633 - RNA, 20 nt, Homo sapiens
uuugcccccgacggcuguga

SEQ ID NO: 1136634 - RNA, 16 nt, Homo sapiens
uuugcccuucacuguu

SEQ ID NO: 1136635 - RNA, 16 nt, Homo sapiens
uuugcccuuuggccag

SEQ ID NO: 1136636 - RNA, 17 nt, Homo sapiens
uuugccugcagaguuug

SEQ ID NO: 1136637 - RNA, 19 nt, Homo sapiens
uuugcuauuagagcauuga

SEQ ID NO: 1136638 - RNA, 22 nt, Homo sapiens
uuugcucggauacuugccaaaa

SEQ ID NO: 1136639 - RNA, 17 nt, Homo sapiens
uuugcugcagucaucua

SEQ ID NO: 1136640 - RNA, 21 nt, Homo sapiens
uuugcuuccucccaacaagca

SEQ ID NO: 1136641 - RNA, 17 nt, Homo sapiens
uuugcuuuucacuggca

SEQ ID NO: 1136642 - RNA, 12 nt, Homo sapiens
uuuggaagcacu

SEQ ID NO: 1136643 - RNA, 21 nt, Homo sapiens
uuuggacuggcuucucccagg

SEQ ID NO: 1136644 - RNA, 16 nt, Homo sapiens
uuuggauugggguccc

SEQ ID NO: 1136645 - RNA, 19 nt, Homo sapiens
aacaccagcagcacuggaa

SEQ ID NO: 1136646 - RNA, 18 nt, Homo sapiens
aacacccuuccucugauc

SEQ ID NO: 1136647 - RNA, 12 nt, Homo sapiens
aacaccugaugu

SEQ ID NO: 1136648 - RNA, 15 nt, Homo sapiens
aacacgccugcaaac

SEQ ID NO: 1136649 - RNA, 23 nt, Homo sapiens
aacacgccugcaaacgcugccug

SEQ ID NO: 1136650 - RNA, 16 nt, Homo sapiens
aacacgcguauuuaca

SEQ ID NO: 1136651 - RNA, 14 nt, Homo sapiens
aacacggugcucau

SEQ ID NO: 1136652 - RNA, 15 nt, Homo sapiens
aacacgugaugugau

SEQ ID NO: 1136653 - RNA, 18 nt, Homo sapiens
aacacuacagacaauaaa

SEQ ID NO: 1136654 - RNA, 16 nt, Homo sapiens
aacacuuaacagggaa

SEQ ID NO: 1136655 - RNA, 22 nt, Homo sapiens
aacacuucaauaauuguccaug

SEQ ID NO: 1136656 - RNA, 17 nt, Homo sapiens
aacacuuccagcauuua

SEQ ID NO: 1136657 - RNA, 14 nt, Homo sapiens
aacagaaaacaauu

SEQ ID NO: 1136658 - RNA, 21 nt, Homo sapiens
aacagaaauguuucuguguca

SEQ ID NO: 1136659 - RNA, 18 nt, Homo sapiens
aacagacccacauuggaa

SEQ ID NO: 1136660 - RNA, 16 nt, Homo sapiens
aacagacucgauucau

SEQ ID NO: 1136661 - RNA, 14 nt, Homo sapiens
aacagagaagggaa

SEQ ID NO: 1136662 - RNA, 17 nt, Homo sapiens
aacagauuuacauccca

SEQ ID NO: 1136663 - RNA, 23 nt, Homo sapiens
aacagauuuacaucccagacaca

SEQ ID NO: 1136664 - RNA, 17 nt, Homo sapiens
aacagauuugugaacuc

SEQ ID NO: 1136665 - RNA, 13 nt, Homo sapiens
aacagcagaacuu

SEQ ID NO: 1136666 - RNA, 19 nt, Homo sapiens
aacagcaggguaccugaaa

SEQ ID NO: 1136667 - RNA, 16 nt, Homo sapiens
aacaggaggacaauuc

SEQ ID NO: 1136668 - RNA, 14 nt, Homo sapiens
aacaggcuugaauc

SEQ ID NO: 1136669 - RNA, 14 nt, Homo sapiens
aacagggacaaaga

SEQ ID NO: 1136670 - RNA, 12 nt, Homo sapiens
aacagguguguu

SEQ ID NO: 1136671 - RNA, 15 nt, Homo sapiens
aacaguaccagugua

SEQ ID NO: 1136672 - RNA, 17 nt, Homo sapiens
aacaguaccugugccug

SEQ ID NO: 1136673 - RNA, 22 nt, Homo sapiens
aacagucuaguguaauggauca

SEQ ID NO: 1136674 - RNA, 19 nt, Homo sapiens
aacagugguggcaacauuc

SEQ ID NO: 1136675 - RNA, 22 nt, Homo sapiens
aacauaaaaugaggcaguuaaa

SEQ ID NO: 1136676 - RNA, 21 nt, Homo sapiens
aacauacaagcaacagcaaaa

SEQ ID NO: 1136677 - RNA, 20 nt, Homo sapiens
aacauauaaagcacuauaca

SEQ ID NO: 1136678 - RNA, 12 nt, Homo sapiens
aacaucaaagau

SEQ ID NO: 1136679 - RNA, 21 nt, Homo sapiens
aacaucacugaaaugcuagcu

SEQ ID NO: 1136680 - RNA, 12 nt, Homo sapiens
aacaucacuugu

SEQ ID NO: 1136681 - RNA, 19 nt, Homo sapiens
aacaucaguuacucugaag

SEQ ID NO: 1136682 - RNA, 15 nt, Homo sapiens
aacaucauaacccau

SEQ ID NO: 1136683 - RNA, 21 nt, Homo sapiens
aacauccggcaaaacugaaaa

SEQ ID NO: 1136684 - RNA, 13 nt, Homo sapiens
aacaugacauuua

SEQ ID NO: 1136685 - RNA, 19 nt, Homo sapiens
aacaugacuauauauacau

SEQ ID NO: 1136686 - RNA, 15 nt, Homo sapiens
aacaugauaaaagac

SEQ ID NO: 1136687 - RNA, 22 nt, Homo sapiens
aacaugauguuuuaagcugcua

SEQ ID NO: 1136688 - RNA, 11 nt, Homo sapiens
aacaugcacaa

SEQ ID NO: 1136689 - RNA, 12 nt, Homo sapiens
aacaugccugau

SEQ ID NO: 1136690 - RNA, 16 nt, Homo sapiens
aacaugcucaguaccu

SEQ ID NO: 1136691 - RNA, 20 nt, Homo sapiens
aacaugcucaguaccugugu

SEQ ID NO: 1136692 - RNA, 22 nt, Homo sapiens
aacaugggaaggugccacuggu

SEQ ID NO: 1136693 - RNA, 17 nt, Homo sapiens
aacaugggagcguuccu

SEQ ID NO: 1136694 - RNA, 23 nt, Homo sapiens
aacauggugaaaaccccaucucu

SEQ ID NO: 1136695 - RNA, 23 nt, Homo sapiens
aacauggugaaacccccaucucu

SEQ ID NO: 1136696 - RNA, 11 nt, Homo sapiens
aacauguaauu

SEQ ID NO: 1136697 - RNA, 19 nt, Homo sapiens
aacauguaugugcauuuca

SEQ ID NO: 1136698 - RNA, 23 nt, Homo sapiens
aacauguauguggauacagucau

SEQ ID NO: 1136699 - RNA, 23 nt, Homo sapiens
aacaugugagagguuugacuaga

SEQ ID NO: 1136700 - RNA, 16 nt, Homo sapiens
aacauguugaagcucu

SEQ ID NO: 1136701 - RNA, 21 nt, Homo sapiens
aacauguuuaucguauuugau

SEQ ID NO: 1136702 - RNA, 15 nt, Homo sapiens
aacauguuucacuua

SEQ ID NO: 1136703 - RNA, 23 nt, Homo sapiens
aacauuuacauguauuauuucau

SEQ ID NO: 1136704 - RNA, 22 nt, Homo sapiens
aacauuugugauauauguauua

SEQ ID NO: 1136705 - RNA, 12 nt, Homo sapiens
aaccaagacaag

SEQ ID NO: 1136706 - RNA, 14 nt, Homo sapiens
aaccaagcuuucaa

SEQ ID NO: 1136707 - RNA, 20 nt, Homo sapiens
aaccaagucaggccaggugg

SEQ ID NO: 1136708 - RNA, 23 nt, Homo sapiens
aaccaagucuacuucacuaauga

SEQ ID NO: 1136709 - RNA, 22 nt, Homo sapiens
aaccacaaagcacaguuugaac

SEQ ID NO: 1136710 - RNA, 12 nt, Homo sapiens
aaccacacugga

SEQ ID NO: 1136711 - RNA, 18 nt, Homo sapiens
aaccacagucuauaccau

SEQ ID NO: 1136712 - RNA, 12 nt, Homo sapiens
aaccacauuaua

SEQ ID NO: 1136713 - RNA, 22 nt, Homo sapiens
aaccacuaagaauucaaacugg

SEQ ID NO: 1136714 - RNA, 22 nt, Homo sapiens
aaccacuaugaagcuaccucaa

SEQ ID NO: 1136715 - RNA, 16 nt, Homo sapiens
aaccacugcacccacc

SEQ ID NO: 1136716 - RNA, 20 nt, Homo sapiens
aaccagaucuagucaaucaa

SEQ ID NO: 1136717 - RNA, 21 nt, Homo sapiens
aaccaggcugggcucagcuca

SEQ ID NO: 1136718 - RNA, 19 nt, Homo sapiens
aaccaguugauuuaaauau

SEQ ID NO: 1136719 - RNA, 14 nt, Homo sapiens
aaccaguuuaucca

SEQ ID NO: 1136720 - RNA, 18 nt, Homo sapiens
aaccauaaagggugccag

SEQ ID NO: 1136721 - RNA, 12 nt, Homo sapiens
aaccauaguuau

SEQ ID NO: 1136722 - RNA, 12 nt, Homo sapiens
aaccauaugccc

SEQ ID NO: 1136723 - RNA, 13 nt, Homo sapiens
aaccaucacauga

SEQ ID NO: 1136724 - RNA, 20 nt, Homo sapiens
aaccauccauaguaguauga

SEQ ID NO: 1136725 - RNA, 14 nt, Homo sapiens
aacccaaauccaag

SEQ ID NO: 1136726 - RNA, 17 nt, Homo sapiens
aacccaacaugacuguu

SEQ ID NO: 1136727 - RNA, 14 nt, Homo sapiens
aacccacauauuaa

SEQ ID NO: 1136728 - RNA, 18 nt, Homo sapiens
aacccagcucacaggagc

SEQ ID NO: 1136729 - RNA, 17 nt, Homo sapiens
aacccagucacugugag

SEQ ID NO: 1136730 - RNA, 22 nt, Homo sapiens
aacccagucacugugagcuccc

SEQ ID NO: 1136731 - RNA, 16 nt, Homo sapiens
aacccauugucuuuac

SEQ ID NO: 1136732 - RNA, 23 nt, Homo sapiens
aacccccagaccauacugacuca

SEQ ID NO: 1136733 - RNA, 15 nt, Homo sapiens
aacccccaguguaau

SEQ ID NO: 1136734 - RNA, 13 nt, Homo sapiens
aacccccaucucc

SEQ ID NO: 1136735 - RNA, 17 nt, Homo sapiens
aacccccaucucuacua

SEQ ID NO: 1136736 - RNA, 18 nt, Homo sapiens
aaccccuucucugugacc

SEQ ID NO: 1136737 - RNA, 16 nt, Homo sapiens
aacccguuuuauucua

SEQ ID NO: 1136738 - RNA, 22 nt, Homo sapiens
aacccuggaucaguccuuugau

SEQ ID NO: 1136739 - RNA, 17 nt, Homo sapiens
aacccuuggucacaugu

SEQ ID NO: 1136740 - RNA, 23 nt, Homo sapiens
aacccuuucauaaagucuugccu

SEQ ID NO: 1136741 - RNA, 19 nt, Homo sapiens
aaccgcaggaagcugcucc

SEQ ID NO: 1136742 - RNA, 14 nt, Homo sapiens
aaccggcuuugugg

SEQ ID NO: 1136743 - RNA, 21 nt, Homo sapiens
aaccggcuuuguggcacuggg

SEQ ID NO: 1136744 - RNA, 16 nt, Homo sapiens
aaccguaucucuaaua

SEQ ID NO: 1136745 - RNA, 12 nt, Homo sapiens
aaccgucccuga

SEQ ID NO: 1136746 - RNA, 21 nt, Homo sapiens
aaccuacucacuuagcaugaa

SEQ ID NO: 1136747 - RNA, 12 nt, Homo sapiens
aaccuacugucu

SEQ ID NO: 1136748 - RNA, 20 nt, Homo sapiens
aaccuccgccuccuggguuc

SEQ ID NO: 1136749 - RNA, 20 nt, Homo sapiens
aaccuccgccuuccggguuc

SEQ ID NO: 1136750 - RNA, 20 nt, Homo sapiens
aaccugcaaagaucuguccu

SEQ ID NO: 1136751 - RNA, 13 nt, Homo sapiens
aaccugugauuca

SEQ ID NO: 1136752 - RNA, 13 nt, Homo sapiens
aaccugugcugaa

SEQ ID NO: 1136753 - RNA, 20 nt, Homo sapiens
aaccuucuggccucccacag

SEQ ID NO: 1136754 - RNA, 15 nt, Homo sapiens
aaccuugucaauaaa

SEQ ID NO: 1136755 - RNA, 21 nt, Homo sapiens
aacgagcauaguccaaaaagc

SEQ ID NO: 1136756 - RNA, 15 nt, Homo sapiens
aacgagccuggaagc

SEQ ID NO: 1136757 - RNA, 19 nt, Homo sapiens
aacgauaaaagacagugaa

SEQ ID NO: 1136758 - RNA, 13 nt, Homo sapiens
aacgcagccucca

SEQ ID NO: 1136759 - RNA, 12 nt, Homo sapiens
aacgcugccugc

SEQ ID NO: 1136760 - RNA, 21 nt, Homo sapiens
aacggaggacugaacugggga

SEQ ID NO: 1136761 - RNA, 18 nt, Homo sapiens
aacguaucaauacaguuu

SEQ ID NO: 1136762 - RNA, 14 nt, Homo sapiens
aacguaugcaugug

SEQ ID NO: 1136763 - RNA, 13 nt, Homo sapiens
aacguaugugcuc

SEQ ID NO: 1136764 - RNA, 13 nt, Homo sapiens
aacgucuccuagc

SEQ ID NO: 1136765 - RNA, 19 nt, Homo sapiens
aacguugauguaaugaaau

SEQ ID NO: 1136766 - RNA, 20 nt, Homo sapiens
aacguuuggaagauccugug

SEQ ID NO: 1136767 - RNA, 22 nt, Homo sapiens
aacuaaaaauauuaaagccuca

SEQ ID NO: 1136768 - RNA, 14 nt, Homo sapiens
aacuaaauacuugc

SEQ ID NO: 1136769 - RNA, 22 nt, Homo sapiens
aacuaaggugcuaaaucugcga

SEQ ID NO: 1136770 - RNA, 16 nt, Homo sapiens
aacuaccagugggcau

SEQ ID NO: 1136771 - RNA, 22 nt, Homo sapiens
aagagaagcccagcucugggaa

SEQ ID NO: 1136772 - RNA, 12 nt, Homo sapiens
aagagacucagc

SEQ ID NO: 1136773 - RNA, 19 nt, Homo sapiens
aagagaggggccaagugua

SEQ ID NO: 1136774 - RNA, 13 nt, Homo sapiens
aagagcaauguuu

SEQ ID NO: 1136775 - RNA, 22 nt, Homo sapiens
aagagcaggacuccaggcccaa

SEQ ID NO: 1136776 - RNA, 22 nt, Homo sapiens
aagagcccucaagcggcccuua

SEQ ID NO: 1136777 - RNA, 13 nt, Homo sapiens
aagaggagccaga

SEQ ID NO: 1136778 - RNA, 20 nt, Homo sapiens
aagaggaggcaaauggcacu

SEQ ID NO: 1136779 - RNA, 23 nt, Homo sapiens
aagaggcguugcuuucacucucc

SEQ ID NO: 1136780 - RNA, 20 nt, Homo sapiens
aagagggugauugcuggggc

SEQ ID NO: 1136781 - RNA, 19 nt, Homo sapiens
aagagguugcuaaugccuu

SEQ ID NO: 1136782 - RNA, 13 nt, Homo sapiens
aagaguaguuaua

SEQ ID NO: 1136783 - RNA, 13 nt, Homo sapiens
aagaguccaagaa

SEQ ID NO: 1136784 - RNA, 18 nt, Homo sapiens
aagaguccucugaaugaa

SEQ ID NO: 1136785 - RNA, 22 nt, Homo sapiens
aagaguccuuacugaagccagg

SEQ ID NO: 1136786 - RNA, 18 nt, Homo sapiens
aagauaaaaugauguuau

SEQ ID NO: 1136787 - RNA, 19 nt, Homo sapiens
aagauaccaaaaccacagu

SEQ ID NO: 1136788 - RNA, 23 nt, Homo sapiens
aagauaggacuaaaguugugcca

SEQ ID NO: 1136789 - RNA, 12 nt, Homo sapiens
aagauauggaau

SEQ ID NO: 1136790 - RNA, 12 nt, Homo sapiens
aagaucaaagac

SEQ ID NO: 1136791 - RNA, 18 nt, Homo sapiens
aagaucucgguuugccaa

SEQ ID NO: 1136792 - RNA, 13 nt, Homo sapiens
aagaucucugcag

SEQ ID NO: 1136793 - RNA, 18 nt, Homo sapiens
aagaucugaguugagacc

SEQ ID NO: 1136794 - RNA, 15 nt, Homo sapiens
aagaucuguuuugaa

SEQ ID NO: 1136795 - RNA, 12 nt, Homo sapiens
aagaugaugcuc

SEQ ID NO: 1136796 - RNA, 15 nt, Homo sapiens
aagaugcauuguagu

SEQ ID NO: 1136797 - RNA, 23 nt, Homo sapiens
aagauggagcucccccaucccac

SEQ ID NO: 1136798 - RNA, 22 nt, Homo sapiens
aagaugggacagcaacaaaauc

SEQ ID NO: 1136799 - RNA, 15 nt, Homo sapiens
aagaugggagccuuu

SEQ ID NO: 1136800 - RNA, 18 nt, Homo sapiens
aagaugguugccaagcaa

SEQ ID NO: 1136801 - RNA, 14 nt, Homo sapiens
aagauguaaggaau

SEQ ID NO: 1136802 - RNA, 16 nt, Homo sapiens
aagaugugcaacacaa

SEQ ID NO: 1136803 - RNA, 14 nt, Homo sapiens
aagauuaaugcuau

SEQ ID NO: 1136804 - RNA, 11 nt, Homo sapiens
aagauuacuuu

SEQ ID NO: 1136805 - RNA, 16 nt, Homo sapiens
aagauuagaagcugaa

SEQ ID NO: 1136806 - RNA, 19 nt, Homo sapiens
aagauucaaucacuguaua

SEQ ID NO: 1136807 - RNA, 16 nt, Homo sapiens
aagauucucugcccag

SEQ ID NO: 1136808 - RNA, 16 nt, Homo sapiens
aagauuuucaaacaaa

SEQ ID NO: 1136809 - RNA, 13 nt, Homo sapiens
aagcaacaucuag

SEQ ID NO: 1136810 - RNA, 13 nt, Homo sapiens
aagcaacccaguc

SEQ ID NO: 1136811 - RNA, 17 nt, Homo sapiens
aagcaacuuuacugaga

SEQ ID NO: 1136812 - RNA, 18 nt, Homo sapiens
aagcaagaagaaagccau

SEQ ID NO: 1136813 - RNA, 22 nt, Homo sapiens
aagcaagggcgccucaccugcu

SEQ ID NO: 1136814 - RNA, 13 nt, Homo sapiens
aagcacaguuuga

SEQ ID NO: 1136815 - RNA, 21 nt, Homo sapiens
aagcacauuuuaaaaaccaga

SEQ ID NO: 1136816 - RNA, 17 nt, Homo sapiens
aagcacuguuucucuca

SEQ ID NO: 1136817 - RNA, 19 nt, Homo sapiens
aagcagagcaaaaugcucu

SEQ ID NO: 1136818 - RNA, 15 nt, Homo sapiens
aagcagcucaaaggc

SEQ ID NO: 1136819 - RNA, 17 nt, Homo sapiens
aagcagugcacauuuca

SEQ ID NO: 1136820 - RNA, 22 nt, Homo sapiens
aagcaguuucuauuucuuuaaa

SEQ ID NO: 1136821 - RNA, 13 nt, Homo sapiens
aagcauacuucua

SEQ ID NO: 1136822 - RNA, 16 nt, Homo sapiens
aagcaugaagucuuaa

SEQ ID NO: 1136823 - RNA, 17 nt, Homo sapiens
aagcaugaagucuuaag

SEQ ID NO: 1136824 - RNA, 19 nt, Homo sapiens
aagcauucacaacuuguuu

SEQ ID NO: 1136825 - RNA, 20 nt, Homo sapiens
aagcauuuccagccuaucua

SEQ ID NO: 1136826 - RNA, 14 nt, Homo sapiens
aagccaagcacuuu

SEQ ID NO: 1136827 - RNA, 15 nt, Homo sapiens
aagccacacucuggg

SEQ ID NO: 1136828 - RNA, 16 nt, Homo sapiens
aagccacacucugggc

SEQ ID NO: 1136829 - RNA, 13 nt, Homo sapiens
aagccacugagca

SEQ ID NO: 1136830 - RNA, 15 nt, Homo sapiens
aagcccagugaauua

SEQ ID NO: 1136831 - RNA, 22 nt, Homo sapiens
aagcccaugggacaaauugcac

SEQ ID NO: 1136832 - RNA, 16 nt, Homo sapiens
aagcccccccuuccac

SEQ ID NO: 1136833 - RNA, 16 nt, Homo sapiens
aagccggcuuuccucu

SEQ ID NO: 1136834 - RNA, 15 nt, Homo sapiens
aagccuaccaaugua

SEQ ID NO: 1136835 - RNA, 20 nt, Homo sapiens
aagccugaugcugacauuca

SEQ ID NO: 1136836 - RNA, 14 nt, Homo sapiens
aagccuguccucac

SEQ ID NO: 1136837 - RNA, 21 nt, Homo sapiens
aagccuguccucaccgucucg

SEQ ID NO: 1136838 - RNA, 12 nt, Homo sapiens
aagcgauucucu

SEQ ID NO: 1136839 - RNA, 15 nt, Homo sapiens
aagcgggccgucucc

SEQ ID NO: 1136840 - RNA, 14 nt, Homo sapiens
aagcgucugugcau

SEQ ID NO: 1136841 - RNA, 18 nt, Homo sapiens
aagcuaacaccagacaga

SEQ ID NO: 1136842 - RNA, 22 nt, Homo sapiens
aagcuaaguauaguugauguaa

SEQ ID NO: 1136843 - RNA, 18 nt, Homo sapiens
aagcuagagagaaaaaga

SEQ ID NO: 1136844 - RNA, 14 nt, Homo sapiens
aagcuagguguuua

SEQ ID NO: 1136845 - RNA, 17 nt, Homo sapiens
aagcucaaguguucaca

SEQ ID NO: 1136846 - RNA, 17 nt, Homo sapiens
aagcugacauugccaaa

SEQ ID NO: 1136847 - RNA, 14 nt, Homo sapiens
aagcugccauauau

SEQ ID NO: 1136848 - RNA, 18 nt, Homo sapiens
aagcugccucaaggaauu

SEQ ID NO: 1136849 - RNA, 23 nt, Homo sapiens
aagcugcucagggaaaagcagcu

SEQ ID NO: 1136850 - RNA, 17 nt, Homo sapiens
aagcuggagugcugcuu

SEQ ID NO: 1136851 - RNA, 15 nt, Homo sapiens
aagcuggcuuucauc

SEQ ID NO: 1136852 - RNA, 19 nt, Homo sapiens
aagcugguccuguccagac

SEQ ID NO: 1136853 - RNA, 18 nt, Homo sapiens
aagcuguaucacugccuu

SEQ ID NO: 1136854 - RNA, 14 nt, Homo sapiens
aagcugucagggac

SEQ ID NO: 1136855 - RNA, 21 nt, Homo sapiens
aagcugugagacagugggaaa

SEQ ID NO: 1136856 - RNA, 11 nt, Homo sapiens
aagcuguuauu

SEQ ID NO: 1136857 - RNA, 15 nt, Homo sapiens
aagcuguugcuauuu

SEQ ID NO: 1136858 - RNA, 18 nt, Homo sapiens
aagcuuaacacuugaccu

SEQ ID NO: 1136859 - RNA, 19 nt, Homo sapiens
aagcuuaugcuuaaauuca

SEQ ID NO: 1136860 - RNA, 20 nt, Homo sapiens
aagcuuaugcuuaaauucaa

SEQ ID NO: 1136861 - RNA, 19 nt, Homo sapiens
aagcuuauuuagcacauuu

SEQ ID NO: 1136862 - RNA, 17 nt, Homo sapiens
aagcuuccuuggcuuuu

SEQ ID NO: 1136863 - RNA, 21 nt, Homo sapiens
aagcuuggcugucucaucccc

SEQ ID NO: 1136864 - RNA, 17 nt, Homo sapiens
aaggaaacccccagugu

SEQ ID NO: 1136865 - RNA, 19 nt, Homo sapiens
aaggaaagagaaaccugag

SEQ ID NO: 1136866 - RNA, 20 nt, Homo sapiens
aaggaaagaugaugcucagu

SEQ ID NO: 1136867 - RNA, 21 nt, Homo sapiens
aaggaacaaaaauuacaaaga

SEQ ID NO: 1136868 - RNA, 18 nt, Homo sapiens
aaggaacauguacuguua

SEQ ID NO: 1136869 - RNA, 12 nt, Homo sapiens
aaggaacuggaa

SEQ ID NO: 1136870 - RNA, 18 nt, Homo sapiens
aaggaagaagaguauuaa

SEQ ID NO: 1136871 - RNA, 17 nt, Homo sapiens
aaggaaggacuaugaca

SEQ ID NO: 1136872 - RNA, 16 nt, Homo sapiens
aaggacaaagugccaa

SEQ ID NO: 1136873 - RNA, 17 nt, Homo sapiens
aaggacaaagugccaaa

SEQ ID NO: 1136874 - RNA, 22 nt, Homo sapiens
aaggacagcugaaccccugggg

SEQ ID NO: 1136875 - RNA, 20 nt, Homo sapiens
aaggacaggucucugagaca

SEQ ID NO: 1136876 - RNA, 21 nt, Homo sapiens
aaggacguggaugaagcagag

SEQ ID NO: 1136877 - RNA, 13 nt, Homo sapiens
aaggacuaugaca

SEQ ID NO: 1136878 - RNA, 21 nt, Homo sapiens
aaggacuuucugaagccucac

SEQ ID NO: 1136879 - RNA, 12 nt, Homo sapiens
aaggagaagcua

SEQ ID NO: 1136880 - RNA, 16 nt, Homo sapiens
aaggagaagcuaauau

SEQ ID NO: 1136881 - RNA, 20 nt, Homo sapiens
aaggagcacauacuaccuag

SEQ ID NO: 1136882 - RNA, 21 nt, Homo sapiens
aaggagcagagagguggccac

SEQ ID NO: 1136883 - RNA, 18 nt, Homo sapiens
aaggagggugagugcaag

SEQ ID NO: 1136884 - RNA, 17 nt, Homo sapiens
aaggaguaaucugugua

SEQ ID NO: 1136885 - RNA, 18 nt, Homo sapiens
aaggaguaaucuguguac

SEQ ID NO: 1136886 - RNA, 17 nt, Homo sapiens
aaggauaaugaaauaau

SEQ ID NO: 1136887 - RNA, 19 nt, Homo sapiens
aaggaucccaugagcuccu

SEQ ID NO: 1136888 - RNA, 21 nt, Homo sapiens
aaggaugggaaaaacugcagu

SEQ ID NO: 1136889 - RNA, 20 nt, Homo sapiens
aaggauguguuuucagucuu

SEQ ID NO: 1136890 - RNA, 21 nt, Homo sapiens
aaggauguguuuucagucuuu

SEQ ID NO: 1136891 - RNA, 20 nt, Homo sapiens
aaggauuuuuaaaaugauuu

SEQ ID NO: 1136892 - RNA, 12 nt, Homo sapiens
aaggcaaaaauc

SEQ ID NO: 1136893 - RNA, 14 nt, Homo sapiens
aaggcacacuguua

SEQ ID NO: 1136894 - RNA, 13 nt, Homo sapiens
aaggcacagugaa

SEQ ID NO: 1136895 - RNA, 15 nt, Homo sapiens
aaggcaccuauaaaa

SEQ ID NO: 1136896 - RNA, 22 nt, Homo sapiens
aaggcagaggaauuuggcugcu

SEQ ID NO: 1136897 - RNA, 14 nt, Homo sapiens
aaggcauaaaugac

SEQ ID NO: 1136898 - RNA, 19 nt, Homo sapiens
aaggcaucuacacaauuua

SEQ ID NO: 1136899 - RNA, 20 nt, Homo sapiens
aaggcauuccacaggaucau

SEQ ID NO: 1136900 - RNA, 16 nt, Homo sapiens
aaggcauuuucaucuu

SEQ ID NO: 1136901 - RNA, 22 nt, Homo sapiens
aaggccagguguggugacucac

SEQ ID NO: 1136902 - RNA, 15 nt, Homo sapiens
aaggccccucugcaa

SEQ ID NO: 1136903 - RNA, 17 nt, Homo sapiens
aaggccgagaagcaaga

SEQ ID NO: 1136904 - RNA, 23 nt, Homo sapiens
aaggccuuuggaaagacuugaau

SEQ ID NO: 1136905 - RNA, 15 nt, Homo sapiens
aauaauuuucauuuc

SEQ ID NO: 1136906 - RNA, 18 nt, Homo sapiens
aauaauuuuuagaaucuc

SEQ ID NO: 1136907 - RNA, 12 nt, Homo sapiens
aauacaaaaauc

SEQ ID NO: 1136908 - RNA, 17 nt, Homo sapiens
aauacaauuaaagcaaa

SEQ ID NO: 1136909 - RNA, 23 nt, Homo sapiens
aauacacaucucugucaguguga

SEQ ID NO: 1136910 - RNA, 21 nt, Homo sapiens
aauacacuauuaucuucuuaa

SEQ ID NO: 1136911 - RNA, 22 nt, Homo sapiens
aauacagaaguccccucuacuu

SEQ ID NO: 1136912 - RNA, 23 nt, Homo sapiens
aauacaggagacccaacaaugag

SEQ ID NO: 1136913 - RNA, 15 nt, Homo sapiens
aauacaguaugaucu

SEQ ID NO: 1136914 - RNA, 17 nt, Homo sapiens
aauacaguaugaucuca

SEQ ID NO: 1136915 - RNA, 21 nt, Homo sapiens
aauacagucuuccauuugcaa

SEQ ID NO: 1136916 - RNA, 20 nt, Homo sapiens
aauacaguuuauaaagccaa

SEQ ID NO: 1136917 - RNA, 17 nt, Homo sapiens
aauacuacuacuguuau

SEQ ID NO: 1136918 - RNA, 23 nt, Homo sapiens
aauacuacugcacagagucagga

SEQ ID NO: 1136919 - RNA, 15 nt, Homo sapiens
aauacucauguguau

SEQ ID NO: 1136920 - RNA, 15 nt, Homo sapiens
aauacucucugagua

SEQ ID NO: 1136921 - RNA, 23 nt, Homo sapiens
aauacucucugaguacauugugc

SEQ ID NO: 1136922 - RNA, 21 nt, Homo sapiens
aauacuguaagucucaauuaa

SEQ ID NO: 1136923 - RNA, 17 nt, Homo sapiens
aauacuguuuuaucucc

SEQ ID NO: 1136924 - RNA, 18 nt, Homo sapiens
aauacuuuuuacaauuaa

SEQ ID NO: 1136925 - RNA, 13 nt, Homo sapiens
aauagaaacaaca

SEQ ID NO: 1136926 - RNA, 13 nt, Homo sapiens
aauagaaacauau

SEQ ID NO: 1136927 - RNA, 20 nt, Homo sapiens
aauagaaauaaauuccuaaa

SEQ ID NO: 1136928 - RNA, 22 nt, Homo sapiens
aauagaaggauguacauuucca

SEQ ID NO: 1136929 - RNA, 13 nt, Homo sapiens
aauagacugugaa

SEQ ID NO: 1136930 - RNA, 15 nt, Homo sapiens
aauagcaacuugugu

SEQ ID NO: 1136931 - RNA, 18 nt, Homo sapiens
aauagccugcgcuguuuu

SEQ ID NO: 1136932 - RNA, 22 nt, Homo sapiens
aauaggccaggggaguuuccaa

SEQ ID NO: 1136933 - RNA, 12 nt, Homo sapiens
aauaguaaucug

SEQ ID NO: 1136934 - RNA, 19 nt, Homo sapiens
aauaguauuacccauggga

SEQ ID NO: 1136935 - RNA, 13 nt, Homo sapiens
aauagucaauuuc

SEQ ID NO: 1136936 - RNA, 15 nt, Homo sapiens
aauagucuuugccag

SEQ ID NO: 1136937 - RNA, 22 nt, Homo sapiens
aauaguuuaacugaaaguuuaa

SEQ ID NO: 1136938 - RNA, 21 nt, Homo sapiens
aauauaauauuugaagcagcu

SEQ ID NO: 1136939 - RNA, 16 nt, Homo sapiens
aauauacaacuguaaa

SEQ ID NO: 1136940 - RNA, 14 nt, Homo sapiens
aauauacauucaaa

SEQ ID NO: 1136941 - RNA, 20 nt, Homo sapiens
aauauaccaacccacuggca

SEQ ID NO: 1136942 - RNA, 15 nt, Homo sapiens
aauauaccauuucaa

SEQ ID NO: 1136943 - RNA, 20 nt, Homo sapiens
aauauauauaaccuuguuau

SEQ ID NO: 1136944 - RNA, 12 nt, Homo sapiens
aauauauuugau

SEQ ID NO: 1136945 - RNA, 22 nt, Homo sapiens
aauauccagccucccacaagaa

SEQ ID NO: 1136946 - RNA, 12 nt, Homo sapiens
aauaucuagcau

SEQ ID NO: 1136947 - RNA, 11 nt, Homo sapiens
aauaugaauga

SEQ ID NO: 1136948 - RNA, 16 nt, Homo sapiens
aauaugaguaauacau

SEQ ID NO: 1136949 - RNA, 21 nt, Homo sapiens
aauaugcauugucugcaaugg

SEQ ID NO: 1136950 - RNA, 22 nt, Homo sapiens
aauaugccuagcacaaguacca

SEQ ID NO: 1136951 - RNA, 16 nt, Homo sapiens
aauaugcuuucaucuu

SEQ ID NO: 1136952 - RNA, 15 nt, Homo sapiens
aauauggacauauca

SEQ ID NO: 1136953 - RNA, 23 nt, Homo sapiens
aauaugguugauaguuuaccuga

SEQ ID NO: 1136954 - RNA, 21 nt, Homo sapiens
aauaugugaagcccagcaucu

SEQ ID NO: 1136955 - RNA, 19 nt, Homo sapiens
aauaugugaucagcuuuca

SEQ ID NO: 1136956 - RNA, 18 nt, Homo sapiens
aauauguuguuuaccuga

SEQ ID NO: 1136957 - RNA, 20 nt, Homo sapiens
aauauuaggagacacaggga

SEQ ID NO: 1136958 - RNA, 18 nt, Homo sapiens
aauauuauuacuguugau

SEQ ID NO: 1136959 - RNA, 14 nt, Homo sapiens
aauauucuguacau

SEQ ID NO: 1136960 - RNA, 22 nt, Homo sapiens
aauauuguuuuugcaccagacg

SEQ ID NO: 1136961 - RNA, 21 nt, Homo sapiens
aauauuuagaacgacauguua

SEQ ID NO: 1136962 - RNA, 15 nt, Homo sapiens
aauauuuaucugauu

SEQ ID NO: 1136963 - RNA, 16 nt, Homo sapiens
aauauuuccaauguga

SEQ ID NO: 1136964 - RNA, 20 nt, Homo sapiens
aauauuugcuaaacauuugc

SEQ ID NO: 1136965 - RNA, 15 nt, Homo sapiens
aauauuugcugugaa

SEQ ID NO: 1136966 - RNA, 18 nt, Homo sapiens
aauauuuuaagaauuuca

SEQ ID NO: 1136967 - RNA, 23 nt, Homo sapiens
aauauuuucaaagagacuaugau

SEQ ID NO: 1136968 - RNA, 18 nt, Homo sapiens
aauauuuucucuguacuu

SEQ ID NO: 1136969 - RNA, 17 nt, Homo sapiens
aauauuuugcacaguua

SEQ ID NO: 1136970 - RNA, 19 nt, Homo sapiens
aauauuuuguuuugugcag

SEQ ID NO: 1136971 - RNA, 20 nt, Homo sapiens
aaucaaaggcgcuuugaaac

SEQ ID NO: 1136972 - RNA, 12 nt, Homo sapiens
aaucaacauuuc

SEQ ID NO: 1136973 - RNA, 14 nt, Homo sapiens
aaucaaccuaucaa

SEQ ID NO: 1136974 - RNA, 18 nt, Homo sapiens
aaucaacuugcuuaucaa

SEQ ID NO: 1136975 - RNA, 16 nt, Homo sapiens
aaucaauaaagaccac

SEQ ID NO: 1136976 - RNA, 21 nt, Homo sapiens
aaucaauaaagaccacuuuac

SEQ ID NO: 1136977 - RNA, 14 nt, Homo sapiens
aaucaaucuguaaa

SEQ ID NO: 1136978 - RNA, 16 nt, Homo sapiens
aaucaaugugacaugu

SEQ ID NO: 1136979 - RNA, 23 nt, Homo sapiens
aaucaaugugacauguugcucuu

SEQ ID NO: 1136980 - RNA, 23 nt, Homo sapiens
aaucacacaugcuuuucuuccua

SEQ ID NO: 1136981 - RNA, 21 nt, Homo sapiens
aaucacagaugaguuaucuaa

SEQ ID NO: 1136982 - RNA, 10 nt, Homo sapiens
aaucacuguc

SEQ ID NO: 1136983 - RNA, 12 nt, Homo sapiens
aaucacuuugag

SEQ ID NO: 1136984 - RNA, 19 nt, Homo sapiens
aaucagcucguuacuucag

SEQ ID NO: 1136985 - RNA, 21 nt, Homo sapiens
aaucaggguggaauuggacuc

SEQ ID NO: 1136986 - RNA, 19 nt, Homo sapiens
aaucauaaauauaaucuaa

SEQ ID NO: 1136987 - RNA, 13 nt, Homo sapiens
aaucauacugucu

SEQ ID NO: 1136988 - RNA, 13 nt, Homo sapiens
aaucaucauaucu

SEQ ID NO: 1136989 - RNA, 15 nt, Homo sapiens
aaucaugcugagaga

SEQ ID NO: 1136990 - RNA, 20 nt, Homo sapiens
aaucauguuuuuucugcaau

SEQ ID NO: 1136991 - RNA, 22 nt, Homo sapiens
aaucauguuuuuucugcaauga

SEQ ID NO: 1136992 - RNA, 23 nt, Homo sapiens
aaucauuaaggucauuacucuca

SEQ ID NO: 1136993 - RNA, 17 nt, Homo sapiens
aaucauuuugugucuca

SEQ ID NO: 1136994 - RNA, 20 nt, Homo sapiens
aauccaacccaugaugagcu

SEQ ID NO: 1136995 - RNA, 13 nt, Homo sapiens
aauccauccugcu

SEQ ID NO: 1136996 - RNA, 12 nt, Homo sapiens
aauccaugaacc

SEQ ID NO: 1136997 - RNA, 12 nt, Homo sapiens
aaucccaaacaa

SEQ ID NO: 1136998 - RNA, 17 nt, Homo sapiens
aaucccacccacaugug

SEQ ID NO: 1136999 - RNA, 14 nt, Homo sapiens
aaucccagcacuuu

SEQ ID NO: 1137000 - RNA, 16 nt, Homo sapiens
aaucccagcuaccuca

SEQ ID NO: 1137001 - RNA, 19 nt, Homo sapiens
aauccccagauauuuaugu

SEQ ID NO: 1137002 - RNA, 22 nt, Homo sapiens
aaucccccauggaaacugcccu

SEQ ID NO: 1137003 - RNA, 15 nt, Homo sapiens
aauccuccuaccuca

SEQ ID NO: 1137004 - RNA, 14 nt, Homo sapiens
aauccugaccugag

SEQ ID NO: 1137005 - RNA, 21 nt, Homo sapiens
aauccugucgauuagacugga

SEQ ID NO: 1137006 - RNA, 15 nt, Homo sapiens
aauccuuccaugaaa

SEQ ID NO: 1137007 - RNA, 19 nt, Homo sapiens
aaucuaacagugacuucau

SEQ ID NO: 1137008 - RNA, 15 nt, Homo sapiens
aaucuaaguuuuaaa

SEQ ID NO: 1137009 - RNA, 15 nt, Homo sapiens
aaucuacuaauucca

SEQ ID NO: 1137010 - RNA, 21 nt, Homo sapiens
aaucuauccauugaacuaaaa

SEQ ID NO: 1137011 - RNA, 11 nt, Homo sapiens
aaucucagcac

SEQ ID NO: 1137012 - RNA, 20 nt, Homo sapiens
aaucucgucaggcugccaga

SEQ ID NO: 1137013 - RNA, 13 nt, Homo sapiens
aaucucguuucaa

SEQ ID NO: 1137014 - RNA, 16 nt, Homo sapiens
aaucucugaauuugag

SEQ ID NO: 1137015 - RNA, 17 nt, Homo sapiens
aaucucugaauuugaga

SEQ ID NO: 1137016 - RNA, 22 nt, Homo sapiens
aaucucuucuuugcugcaguca

SEQ ID NO: 1137017 - RNA, 22 nt, Homo sapiens
aaucugaggccuccucucucag

SEQ ID NO: 1137018 - RNA, 11 nt, Homo sapiens
aaucugaugaa

SEQ ID NO: 1137019 - RNA, 19 nt, Homo sapiens
aaucugauguuaaccaaug

SEQ ID NO: 1137020 - RNA, 13 nt, Homo sapiens
aaucugccuucca

SEQ ID NO: 1137021 - RNA, 21 nt, Homo sapiens
aaucuggcaggaaucuaucca

SEQ ID NO: 1137022 - RNA, 19 nt, Homo sapiens
aaucuguaaucagcaauaa

SEQ ID NO: 1137023 - RNA, 13 nt, Homo sapiens
aaucuguacaaug

SEQ ID NO: 1137024 - RNA, 15 nt, Homo sapiens
aaucuucuacuuuaa

SEQ ID NO: 1137025 - RNA, 14 nt, Homo sapiens
aaucuugagagugu

SEQ ID NO: 1137026 - RNA, 16 nt, Homo sapiens
aaucuugcucacagcu

SEQ ID NO: 1137027 - RNA, 17 nt, Homo sapiens
aaucuugcucugcuuga

SEQ ID NO: 1137028 - RNA, 17 nt, Homo sapiens
aaucuuuucauaauuaa

SEQ ID NO: 1137029 - RNA, 20 nt, Homo sapiens
aaucuuuuugauaagcacau

SEQ ID NO: 1137030 - RNA, 15 nt, Homo sapiens
aaugaaaggugacaa

SEQ ID NO: 1137031 - RNA, 19 nt, Homo sapiens
acauuugugccgacacugu

SEQ ID NO: 1137032 - RNA, 16 nt, Homo sapiens
acauuuuaaaaaccag

SEQ ID NO: 1137033 - RNA, 14 nt, Homo sapiens
acauuuuaaaugaa

SEQ ID NO: 1137034 - RNA, 19 nt, Homo sapiens
acauuuuacccacacacag

SEQ ID NO: 1137035 - RNA, 23 nt, Homo sapiens
acauuuuuauaaaaaugagugcu

SEQ ID NO: 1137036 - RNA, 19 nt, Homo sapiens
acauuuuuccucucugcaa

SEQ ID NO: 1137037 - RNA, 23 nt, Homo sapiens
acauuuuuuuuaacuacuauauu

SEQ ID NO: 1137038 - RNA, 14 nt, Homo sapiens
accaaaaacugaaa

SEQ ID NO: 1137039 - RNA, 17 nt, Homo sapiens
accaaaacugugcagag

SEQ ID NO: 1137040 - RNA, 17 nt, Homo sapiens
accaaaaggccgugugu

SEQ ID NO: 1137041 - RNA, 22 nt, Homo sapiens
accaaaaguuacauguuugcac

SEQ ID NO: 1137042 - RNA, 15 nt, Homo sapiens
accaaaauccgacug

SEQ ID NO: 1137043 - RNA, 12 nt, Homo sapiens
accaaagcuuua

SEQ ID NO: 1137044 - RNA, 15 nt, Homo sapiens
accaaauaggaucau

SEQ ID NO: 1137045 - RNA, 12 nt, Homo sapiens
accaaauugcuu

SEQ ID NO: 1137046 - RNA, 19 nt, Homo sapiens
accaacaguuccuucagcu

SEQ ID NO: 1137047 - RNA, 13 nt, Homo sapiens
accaacaugguga

SEQ ID NO: 1137048 - RNA, 15 nt, Homo sapiens
accaacuuuuuccaa

SEQ ID NO: 1137049 - RNA, 17 nt, Homo sapiens
accaagaacauaagaau

SEQ ID NO: 1137050 - RNA, 20 nt, Homo sapiens
accaagauauaccugauaua

SEQ ID NO: 1137051 - RNA, 14 nt, Homo sapiens
accaagcacagcag

SEQ ID NO: 1137052 - RNA, 16 nt, Homo sapiens
accaagcucuguccaa

SEQ ID NO: 1137053 - RNA, 20 nt, Homo sapiens
accaagcuuucaaacauguu

SEQ ID NO: 1137054 - RNA, 20 nt, Homo sapiens
accaaguccauuuugaauga

SEQ ID NO: 1137055 - RNA, 15 nt, Homo sapiens
accaagucuacuuca

SEQ ID NO: 1137056 - RNA, 17 nt, Homo sapiens
accaaguuggaauucca

SEQ ID NO: 1137057 - RNA, 14 nt, Homo sapiens
accaaucaaauguc

SEQ ID NO: 1137058 - RNA, 17 nt, Homo sapiens
accaauucaugaaguga

SEQ ID NO: 1137059 - RNA, 21 nt, Homo sapiens
accaauucaugaagugaauua

SEQ ID NO: 1137060 - RNA, 18 nt, Homo sapiens
accacaauaccacuauca

SEQ ID NO: 1137061 - RNA, 15 nt, Homo sapiens
accacacugauccag

SEQ ID NO: 1137062 - RNA, 14 nt, Homo sapiens
accacagcacuauu

SEQ ID NO: 1137063 - RNA, 13 nt, Homo sapiens
accacauggacag

SEQ ID NO: 1137064 - RNA, 20 nt, Homo sapiens
accaccuucccagcucuccc

SEQ ID NO: 1137065 - RNA, 20 nt, Homo sapiens
accacgggacaucacagggu

SEQ ID NO: 1137066 - RNA, 21 nt, Homo sapiens
accacuaagaauucaaacugg

SEQ ID NO: 1137067 - RNA, 23 nt, Homo sapiens
accacuccugaaugagacuuaau

SEQ ID NO: 1137068 - RNA, 13 nt, Homo sapiens
accacuccugcca

SEQ ID NO: 1137069 - RNA, 20 nt, Homo sapiens
accacucuuccugaguucag

SEQ ID NO: 1137070 - RNA, 11 nt, Homo sapiens
accacugaccc

SEQ ID NO: 1137071 - RNA, 19 nt, Homo sapiens
accacugcuuaagugccua

SEQ ID NO: 1137072 - RNA, 17 nt, Homo sapiens
accacuucgaaaccugg

SEQ ID NO: 1137073 - RNA, 15 nt, Homo sapiens
accagaagcauuuca

SEQ ID NO: 1137074 - RNA, 17 nt, Homo sapiens
accagaagcauuucacc

SEQ ID NO: 1137075 - RNA, 18 nt, Homo sapiens
accagacaagauggcuag

SEQ ID NO: 1137076 - RNA, 19 nt, Homo sapiens
accagacagacaacacugg

SEQ ID NO: 1137077 - RNA, 14 nt, Homo sapiens
accagacuuuucuc

SEQ ID NO: 1137078 - RNA, 21 nt, Homo sapiens
accagagaacaacaugggagc

SEQ ID NO: 1137079 - RNA, 20 nt, Homo sapiens
accagagaggcucugagaaa

SEQ ID NO: 1137080 - RNA, 19 nt, Homo sapiens
accagagauaauaugagaa

SEQ ID NO: 1137081 - RNA, 15 nt, Homo sapiens
accagcaagucccag

SEQ ID NO: 1137082 - RNA, 17 nt, Homo sapiens
accagcacggugacucu

SEQ ID NO: 1137083 - RNA, 17 nt, Homo sapiens
accagcaucaccugccu

SEQ ID NO: 1137084 - RNA, 17 nt, Homo sapiens
accagccucuccacuca

SEQ ID NO: 1137085 - RNA, 22 nt, Homo sapiens
accagccugagcaacaugguga

SEQ ID NO: 1137086 - RNA, 22 nt, Homo sapiens
accagccuguccaacaugguga

SEQ ID NO: 1137087 - RNA, 19 nt, Homo sapiens
accaggauagagacuggaa

SEQ ID NO: 1137088 - RNA, 20 nt, Homo sapiens
accaggauuuauacauacag

SEQ ID NO: 1137089 - RNA, 19 nt, Homo sapiens
accaggcugggcucagcuc

SEQ ID NO: 1137090 - RNA, 14 nt, Homo sapiens
accaggggaccaga

SEQ ID NO: 1137091 - RNA, 22 nt, Homo sapiens
accagugaauuuuugcaauaau

SEQ ID NO: 1137092 - RNA, 16 nt, Homo sapiens
accagugcagacucaa

SEQ ID NO: 1137093 - RNA, 19 nt, Homo sapiens
accaguuuaaauugguuca

SEQ ID NO: 1137094 - RNA, 22 nt, Homo sapiens
accaguuucuaucccuuaccug

SEQ ID NO: 1137095 - RNA, 13 nt, Homo sapiens
accauaaccacug

SEQ ID NO: 1137096 - RNA, 17 nt, Homo sapiens
accauauuuuauuguau

SEQ ID NO: 1137097 - RNA, 18 nt, Homo sapiens
accaucaguucuuuuguc

SEQ ID NO: 1137098 - RNA, 20 nt, Homo sapiens
accaucccaaagccaacgaa

SEQ ID NO: 1137099 - RNA, 16 nt, Homo sapiens
accaucuggaauucca

SEQ ID NO: 1137100 - RNA, 17 nt, Homo sapiens
accaugaaaauagccaa

SEQ ID NO: 1137101 - RNA, 16 nt, Homo sapiens
accaugcaaaggauaa

SEQ ID NO: 1137102 - RNA, 17 nt, Homo sapiens
accaugcgacacuggga

SEQ ID NO: 1137103 - RNA, 20 nt, Homo sapiens
accauguggauuuggucaca

SEQ ID NO: 1137104 - RNA, 20 nt, Homo sapiens
accauucaggucuuucuuuc

SEQ ID NO: 1137105 - RNA, 13 nt, Homo sapiens
accauuccucaag

SEQ ID NO: 1137106 - RNA, 16 nt, Homo sapiens
accauugucagcucaa

SEQ ID NO: 1137107 - RNA, 22 nt, Homo sapiens
accauuuguuaacuguacugaa

SEQ ID NO: 1137108 - RNA, 17 nt, Homo sapiens
accauuuuuagaaggaa

SEQ ID NO: 1137109 - RNA, 16 nt, Homo sapiens
accauuuuuuaaggaa

SEQ ID NO: 1137110 - RNA, 20 nt, Homo sapiens
acccaaaacugccgauuuca

SEQ ID NO: 1137111 - RNA, 21 nt, Homo sapiens
acccaaggaugucugccacac

SEQ ID NO: 1137112 - RNA, 16 nt, Homo sapiens
acccaagggcaggggc

SEQ ID NO: 1137113 - RNA, 15 nt, Homo sapiens
acccaauagcugccc

SEQ ID NO: 1137114 - RNA, 18 nt, Homo sapiens
acccaauuccacucugau

SEQ ID NO: 1137115 - RNA, 21 nt, Homo sapiens
acccacaguguuaccugacuu

SEQ ID NO: 1137116 - RNA, 21 nt, Homo sapiens
acccacaugugacacauaugc

SEQ ID NO: 1137117 - RNA, 22 nt, Homo sapiens
acccaccaaggucucacacucc

SEQ ID NO: 1137118 - RNA, 16 nt, Homo sapiens
acccaccccugcacag

SEQ ID NO: 1137119 - RNA, 14 nt, Homo sapiens
acccacccuguggc

SEQ ID NO: 1137120 - RNA, 22 nt, Homo sapiens
acccacccuguggcucacagug

SEQ ID NO: 1137121 - RNA, 22 nt, Homo sapiens
acccacuaauacuacugcacag

SEQ ID NO: 1137122 - RNA, 15 nt, Homo sapiens
acccacucacauucc

SEQ ID NO: 1137123 - RNA, 16 nt, Homo sapiens
acccacugcccauggc

SEQ ID NO: 1137124 - RNA, 17 nt, Homo sapiens
acccacuucucaucaca

SEQ ID NO: 1137125 - RNA, 15 nt, Homo sapiens
acccagagccagugu

SEQ ID NO: 1137126 - RNA, 20 nt, Homo sapiens
acccagaggguggguguuca

SEQ ID NO: 1137127 - RNA, 15 nt, Homo sapiens
acccagauuguauca

SEQ ID NO: 1137128 - RNA, 22 nt, Homo sapiens
acccaggaguauccucuugcca

SEQ ID NO: 1137129 - RNA, 12 nt, Homo sapiens
acccaggaguuu

SEQ ID NO: 1137130 - RNA, 16 nt, Homo sapiens
acccaggcacugggca

SEQ ID NO: 1137131 - RNA, 16 nt, Homo sapiens
acccaggcauagccug

SEQ ID NO: 1137132 - RNA, 18 nt, Homo sapiens
acccagggaacagccacu

SEQ ID NO: 1137133 - RNA, 19 nt, Homo sapiens
acccagggaacagccacuc

SEQ ID NO: 1137134 - RNA, 15 nt, Homo sapiens
acccaguccugcaca

SEQ ID NO: 1137135 - RNA, 18 nt, Homo sapiens
acccagucuguugcugcu

SEQ ID NO: 1137136 - RNA, 15 nt, Homo sapiens
agaaauaaaucagua

SEQ ID NO: 1137137 - RNA, 15 nt, Homo sapiens
agaaauaauaauauc

SEQ ID NO: 1137138 - RNA, 20 nt, Homo sapiens
agaaauacaguaugaucuca

SEQ ID NO: 1137139 - RNA, 14 nt, Homo sapiens
agaaauauggacac

SEQ ID NO: 1137140 - RNA, 18 nt, Homo sapiens
agaaauauggacacuuaa

SEQ ID NO: 1137141 - RNA, 19 nt, Homo sapiens
agaaauauuuucagcaaaa

SEQ ID NO: 1137142 - RNA, 23 nt, Homo sapiens
agaaauauuuucagcaaaacuuu

SEQ ID NO: 1137143 - RNA, 18 nt, Homo sapiens
agaaaugacugcauuuga

SEQ ID NO: 1137144 - RNA, 21 nt, Homo sapiens
agaaaugauguugucacuggu

SEQ ID NO: 1137145 - RNA, 13 nt, Homo sapiens
agaaaugucaugu

SEQ ID NO: 1137146 - RNA, 12 nt, Homo sapiens
agaaauguccuc

SEQ ID NO: 1137147 - RNA, 20 nt, Homo sapiens
agaaauuaacaaaugugcug

SEQ ID NO: 1137148 - RNA, 15 nt, Homo sapiens
agaaauuauaaacaa

SEQ ID NO: 1137149 - RNA, 12 nt, Homo sapiens
agaaauugauua

SEQ ID NO: 1137150 - RNA, 22 nt, Homo sapiens
agaaauuguugcuuuguuucuc

SEQ ID NO: 1137151 - RNA, 16 nt, Homo sapiens
agaacaaagagugaaa

SEQ ID NO: 1137152 - RNA, 16 nt, Homo sapiens
agaacaacaugggagc

SEQ ID NO: 1137153 - RNA, 11 nt, Homo sapiens
agaacagggaa

SEQ ID NO: 1137154 - RNA, 19 nt, Homo sapiens
agaacagguguuggugaca

SEQ ID NO: 1137155 - RNA, 21 nt, Homo sapiens
agaacagguguuggugacaau

SEQ ID NO: 1137156 - RNA, 23 nt, Homo sapiens
agaaccaggcagcccugccaugu

SEQ ID NO: 1137157 - RNA, 19 nt, Homo sapiens
agaaccagugacaaucuua

SEQ ID NO: 1137158 - RNA, 19 nt, Homo sapiens
agaaccauaggacuguggc

SEQ ID NO: 1137159 - RNA, 13 nt, Homo sapiens
agaaccauuacaa

SEQ ID NO: 1137160 - RNA, 20 nt, Homo sapiens
agaacccacugcuuuuccca

SEQ ID NO: 1137161 - RNA, 13 nt, Homo sapiens
agaacccugagac

SEQ ID NO: 1137162 - RNA, 23 nt, Homo sapiens
agaacguuuuuuccucagugcau

SEQ ID NO: 1137163 - RNA, 14 nt, Homo sapiens
agaacuaaaggugg

SEQ ID NO: 1137164 - RNA, 15 nt, Homo sapiens
agaacuaagcacuuu

SEQ ID NO: 1137165 - RNA, 21 nt, Homo sapiens
agaacucaaauggggccagau

SEQ ID NO: 1137166 - RNA, 23 nt, Homo sapiens
agaacucucugucuucucuccac

SEQ ID NO: 1137167 - RNA, 15 nt, Homo sapiens
agaacugaaaagaga

SEQ ID NO: 1137168 - RNA, 15 nt, Homo sapiens
agaacugaagcucuu

SEQ ID NO: 1137169 - RNA, 18 nt, Homo sapiens
agaacugacaugcagguc

SEQ ID NO: 1137170 - RNA, 21 nt, Homo sapiens
agaacugacaugcaggucaaa

SEQ ID NO: 1137171 - RNA, 16 nt, Homo sapiens
agaacugguucuugcc

SEQ ID NO: 1137172 - RNA, 17 nt, Homo sapiens
agaacugguucuugccu

SEQ ID NO: 1137173 - RNA, 17 nt, Homo sapiens
agaacuguugguuauuu

SEQ ID NO: 1137174 - RNA, 19 nt, Homo sapiens
agaacuuuucuuacuagcu

SEQ ID NO: 1137175 - RNA, 17 nt, Homo sapiens
agaagaaaauuugccaa

SEQ ID NO: 1137176 - RNA, 21 nt, Homo sapiens
agaagaccccugacucaucau

SEQ ID NO: 1137177 - RNA, 18 nt, Homo sapiens
agaagacugugcggcaca

SEQ ID NO: 1137178 - RNA, 14 nt, Homo sapiens
agaagagacugcua

SEQ ID NO: 1137179 - RNA, 18 nt, Homo sapiens
agaagagugccacauuua

SEQ ID NO: 1137180 - RNA, 16 nt, Homo sapiens
agaguggguuucacaa

SEQ ID NO: 1137181 - RNA, 11 nt, Homo sapiens
agaguggugcu

SEQ ID NO: 1137182 - RNA, 15 nt, Homo sapiens
agagugugguuauga

SEQ ID NO: 1137183 - RNA, 17 nt, Homo sapiens
agaguguuccugagaca

SEQ ID NO: 1137184 - RNA, 22 nt, Homo sapiens
agaguguuuggggguuccguga

SEQ ID NO: 1137185 - RNA, 16 nt, Homo sapiens
agaguuccaugaacac

SEQ ID NO: 1137186 - RNA, 17 nt, Homo sapiens
agaguugcuuccagucc

SEQ ID NO: 1137187 - RNA, 17 nt, Homo sapiens
agaguuggggaaggcaa

SEQ ID NO: 1137188 - RNA, 14 nt, Homo sapiens
agauaaaccaauaa

SEQ ID NO: 1137189 - RNA, 20 nt, Homo sapiens
agauaaagaauaauaauuaa

SEQ ID NO: 1137190 - RNA, 19 nt, Homo sapiens
agauaacugcuguauucau

SEQ ID NO: 1137191 - RNA, 12 nt, Homo sapiens
agauaacuuccu

SEQ ID NO: 1137192 - RNA, 13 nt, Homo sapiens
agauaaguguucu

SEQ ID NO: 1137193 - RNA, 14 nt, Homo sapiens
agauaauacauucc

SEQ ID NO: 1137194 - RNA, 13 nt, Homo sapiens
agauaauuggcaa

SEQ ID NO: 1137195 - RNA, 14 nt, Homo sapiens
agauaauuggcaac

SEQ ID NO: 1137196 - RNA, 22 nt, Homo sapiens
agauaauuggcaacugggugaa

SEQ ID NO: 1137197 - RNA, 18 nt, Homo sapiens
agauacacgucacaaaga

SEQ ID NO: 1137198 - RNA, 13 nt, Homo sapiens
agauacagcugcu

SEQ ID NO: 1137199 - RNA, 18 nt, Homo sapiens
agauacauaaaagugcuu

SEQ ID NO: 1137200 - RNA, 14 nt, Homo sapiens
agauacauacagaa

SEQ ID NO: 1137201 - RNA, 19 nt, Homo sapiens
agauacugucucuuucaug

SEQ ID NO: 1137202 - RNA, 14 nt, Homo sapiens
agauagaauucaau

SEQ ID NO: 1137203 - RNA, 15 nt, Homo sapiens
agauagccccacagg

SEQ ID NO: 1137204 - RNA, 16 nt, Homo sapiens
agauagcuugagcugg

SEQ ID NO: 1137205 - RNA, 21 nt, Homo sapiens
agauaggcacaugcaucuucu

SEQ ID NO: 1137206 - RNA, 20 nt, Homo sapiens
agauauacgcccucuuucau

SEQ ID NO: 1137207 - RNA, 17 nt, Homo sapiens
agauauaguaguaccuu

SEQ ID NO: 1137208 - RNA, 19 nt, Homo sapiens
agauauucacuaaggacuu

SEQ ID NO: 1137209 - RNA, 14 nt, Homo sapiens
agaucaacucuguc

SEQ ID NO: 1137210 - RNA, 19 nt, Homo sapiens
agaucaaugaaaugauguc

SEQ ID NO: 1137211 - RNA, 18 nt, Homo sapiens
agaucacgucacugcacu

SEQ ID NO: 1137212 - RNA, 19 nt, Homo sapiens
agaucacuuuuuaaacuca

SEQ ID NO: 1137213 - RNA, 20 nt, Homo sapiens
agaucauccagaaguuccuc

SEQ ID NO: 1137214 - RNA, 20 nt, Homo sapiens
agauccaaaugcugugcaaa

SEQ ID NO: 1137215 - RNA, 22 nt, Homo sapiens
agauccaguucuugaaaacacu

SEQ ID NO: 1137216 - RNA, 15 nt, Homo sapiens
agauccuuaaaaccu

SEQ ID NO: 1137217 - RNA, 15 nt, Homo sapiens
agaucgcaccacugc

SEQ ID NO: 1137218 - RNA, 17 nt, Homo sapiens
agaucgugccacugcac

SEQ ID NO: 1137219 - RNA, 19 nt, Homo sapiens
agaucguucucugccucac

SEQ ID NO: 1137220 - RNA, 20 nt, Homo sapiens
agaucuccaacagccagugu

SEQ ID NO: 1137221 - RNA, 22 nt, Homo sapiens
agaucugcaccaccaugcccag

SEQ ID NO: 1137222 - RNA, 14 nt, Homo sapiens
agaucuggcugugg

SEQ ID NO: 1137223 - RNA, 22 nt, Homo sapiens
agaucuucaaaaguaaugccuc

SEQ ID NO: 1137224 - RNA, 13 nt, Homo sapiens
agaugaaccacau

SEQ ID NO: 1137225 - RNA, 19 nt, Homo sapiens
agaugauacauccaaagca

SEQ ID NO: 1137226 - RNA, 19 nt, Homo sapiens
agaugauggaugccaauau

SEQ ID NO: 1137227 - RNA, 16 nt, Homo sapiens
agaugcagccccaucu

SEQ ID NO: 1137228 - RNA, 14 nt, Homo sapiens
agaugcagggcagu

SEQ ID NO: 1137229 - RNA, 20 nt, Homo sapiens
agaugccucgcucuuuucaa

SEQ ID NO: 1137230 - RNA, 21 nt, Homo sapiens
agaugcuagaaaaauguucuu

SEQ ID NO: 1137231 - RNA, 17 nt, Homo sapiens
agaugcucuaucuugcu

SEQ ID NO: 1137232 - RNA, 14 nt, Homo sapiens
agaugcugauguuc

SEQ ID NO: 1137233 - RNA, 17 nt, Homo sapiens
agaugcuuuccugcaca

SEQ ID NO: 1137234 - RNA, 16 nt, Homo sapiens
agauggcuggcuggug

SEQ ID NO: 1137235 - RNA, 20 nt, Homo sapiens
agauggcuggcuggugauag

SEQ ID NO: 1137236 - RNA, 20 nt, Homo sapiens
agaugggagcccaguuucac

SEQ ID NO: 1137237 - RNA, 14 nt, Homo sapiens
agaugggugcaacu

SEQ ID NO: 1137238 - RNA, 12 nt, Homo sapiens
agaugucaaaac

SEQ ID NO: 1137239 - RNA, 21 nt, Homo sapiens
agaugucccugaagucuugca

SEQ ID NO: 1137240 - RNA, 18 nt, Homo sapiens
agaugucuagguacuuca

SEQ ID NO: 1137241 - RNA, 19 nt, Homo sapiens
agauguguuaggaauguca

SEQ ID NO: 1137242 - RNA, 20 nt, Homo sapiens
agauguugaauucuuuugcc

SEQ ID NO: 1137243 - RNA, 22 nt, Homo sapiens
agauguuuuacgucugggagaa

SEQ ID NO: 1137244 - RNA, 18 nt, Homo sapiens
agauuagcuaggggacag

SEQ ID NO: 1137245 - RNA, 21 nt, Homo sapiens
agauucccacccaauucaaaa

SEQ ID NO: 1137246 - RNA, 12 nt, Homo sapiens
agauucccacug

SEQ ID NO: 1137247 - RNA, 21 nt, Homo sapiens
agauucccuuccggugcgugu

SEQ ID NO: 1137248 - RNA, 14 nt, Homo sapiens
agauuccuuuccug

SEQ ID NO: 1137249 - RNA, 13 nt, Homo sapiens
agauucuaaagau

SEQ ID NO: 1137250 - RNA, 21 nt, Homo sapiens
agauucuaacauauugccaug

SEQ ID NO: 1137251 - RNA, 16 nt, Homo sapiens
agauucuaaucccaac

SEQ ID NO: 1137252 - RNA, 13 nt, Homo sapiens
agauucuaaugau

SEQ ID NO: 1137253 - RNA, 21 nt, Homo sapiens
agauucucuuguauaagaucc

SEQ ID NO: 1137254 - RNA, 17 nt, Homo sapiens
agauucuucagcuugau

SEQ ID NO: 1137255 - RNA, 14 nt, Homo sapiens
agauucuucugugu

SEQ ID NO: 1137256 - RNA, 12 nt, Homo sapiens
agauugaacuuu

SEQ ID NO: 1137257 - RNA, 15 nt, Homo sapiens
agauugaacuuuccc

SEQ ID NO: 1137258 - RNA, 18 nt, Homo sapiens
agauugaagccuuugcca

SEQ ID NO: 1137259 - RNA, 21 nt, Homo sapiens
agauugaugugcacugcauua

SEQ ID NO: 1137260 - RNA, 17 nt, Homo sapiens
agauugcaccacugcac

SEQ ID NO: 1137261 - RNA, 24 nt, Homo sapiens
agauugcaccacugcacuccaguc

SEQ ID NO: 1137262 - RNA, 21 nt, Homo sapiens
agauugcagaaauacaguaug

SEQ ID NO: 1137263 - RNA, 16 nt, Homo sapiens
agauugcuacuagaaa

SEQ ID NO: 1137264 - RNA, 20 nt, Homo sapiens
agauuguaucaugugcuaga

SEQ ID NO: 1137265 - RNA, 13 nt, Homo sapiens
agauugugccacu

SEQ ID NO: 1137266 - RNA, 15 nt, Homo sapiens
agauuguguucuucc

SEQ ID NO: 1137267 - RNA, 19 nt, Homo sapiens
agauuugcuugaaccuggg

SEQ ID NO: 1137268 - RNA, 23 nt, Homo sapiens
agauuuugggagaguaaagcuaa

SEQ ID NO: 1137269 - RNA, 15 nt, Homo sapiens
agcaaaaaaauuauu

SEQ ID NO: 1137270 - RNA, 21 nt, Homo sapiens
agcaaaaacauguaugugcau

SEQ ID NO: 1137271 - RNA, 16 nt, Homo sapiens
agcaaaaagacuggau

SEQ ID NO: 1137272 - RNA, 15 nt, Homo sapiens
agcaaaaguagccau

SEQ ID NO: 1137273 - RNA, 20 nt, Homo sapiens
agcaaaauacaugacauuua

SEQ ID NO: 1137274 - RNA, 17 nt, Homo sapiens
agcaaacaaaauggacu

SEQ ID NO: 1137275 - RNA, 21 nt, Homo sapiens
agcaaauaaacuguaagucau

SEQ ID NO: 1137276 - RNA, 18 nt, Homo sapiens
agcaaauaguaaucugua

SEQ ID NO: 1137277 - RNA, 16 nt, Homo sapiens
agcaaaucgugccuug

SEQ ID NO: 1137278 - RNA, 18 nt, Homo sapiens
agcaaauguuaugcauaa

SEQ ID NO: 1137279 - RNA, 19 nt, Homo sapiens
agcaaauuagaaacaccau

SEQ ID NO: 1137280 - RNA, 14 nt, Homo sapiens
agcaacaccaaaaa

SEQ ID NO: 1137281 - RNA, 19 nt, Homo sapiens
agcaacauggcagagcagu

SEQ ID NO: 1137282 - RNA, 15 nt, Homo sapiens
agcaacccauuaauc

SEQ ID NO: 1137283 - RNA, 18 nt, Homo sapiens
agcaaccugccuugggac

SEQ ID NO: 1137284 - RNA, 13 nt, Homo sapiens
agcaacucuggcc

SEQ ID NO: 1137285 - RNA, 16 nt, Homo sapiens
agcaacuuguguuaca

SEQ ID NO: 1137286 - RNA, 23 nt, Homo sapiens
agcaagacugaagauggcuuuuc

SEQ ID NO: 1137287 - RNA, 18 nt, Homo sapiens
agcaagaucccaucucuu

SEQ ID NO: 1137288 - RNA, 11 nt, Homo sapiens
agcaagccaug

SEQ ID NO: 1137289 - RNA, 15 nt, Homo sapiens
agcaauaacauuccc

SEQ ID NO: 1137290 - RNA, 22 nt, Homo sapiens
agcaauauaucugaagagcuau

SEQ ID NO: 1137291 - RNA, 23 nt, Homo sapiens
agcaaucucuugcauuucuggac

SEQ ID NO: 1137292 - RNA, 19 nt, Homo sapiens
agcaaugcauucuggagac

SEQ ID NO: 1137293 - RNA, 20 nt, Homo sapiens
agcaaugcugaugaaucacu

SEQ ID NO: 1137294 - RNA, 13 nt, Homo sapiens
agcaauguauaac

SEQ ID NO: 1137295 - RNA, 17 nt, Homo sapiens
agcaauucuccugccuc

SEQ ID NO: 1137296 - RNA, 24 nt, Homo sapiens
agcaauuuaauauuuugcacaguu

SEQ ID NO: 1137297 - RNA, 18 nt, Homo sapiens
agcaauuucucuuuaaaa

SEQ ID NO: 1137298 - RNA, 18 nt, Homo sapiens
agcacaaaaccuguccua

SEQ ID NO: 1137299 - RNA, 15 nt, Homo sapiens
agcacaaacacaagg

SEQ ID NO: 1137300 - RNA, 14 nt, Homo sapiens
agcacaaagacaua

SEQ ID NO: 1137301 - RNA, 20 nt, Homo sapiens
agcacaagauacacgucaca

SEQ ID NO: 1137302 - RNA, 16 nt, Homo sapiens
agcacaaggccuugcc

SEQ ID NO: 1137303 - RNA, 15 nt, Homo sapiens
agcacacagggcagu

SEQ ID NO: 1137304 - RNA, 11 nt, Homo sapiens
agcacagccaa

SEQ ID NO: 1137305 - RNA, 12 nt, Homo sapiens
agcacagccuca

SEQ ID NO: 1137306 - RNA, 13 nt, Homo sapiens
agcacaguuugaa

SEQ ID NO: 1137307 - RNA, 14 nt, Homo sapiens
agcaccaggggaug

SEQ ID NO: 1137308 - RNA, 18 nt, Homo sapiens
agcaccguucugugcaca

SEQ ID NO: 1137309 - RNA, 21 nt, Homo sapiens
agcacuaauucaacauauacc

SEQ ID NO: 1137310 - RNA, 13 nt, Homo sapiens
agcacugacaaua

SEQ ID NO: 1137311 - RNA, 18 nt, Homo sapiens
agcacugccucccuuaau

SEQ ID NO: 1137312 - RNA, 22 nt, Homo sapiens
agggggcaucuuuaagcaaggu

SEQ ID NO: 1137313 - RNA, 15 nt, Homo sapiens
aggggguaaggcccc

SEQ ID NO: 1137314 - RNA, 21 nt, Homo sapiens
aggggucugaacgucuccuag

SEQ ID NO: 1137315 - RNA, 20 nt, Homo sapiens
agggguucuggaaacauuca

SEQ ID NO: 1137316 - RNA, 15 nt, Homo sapiens
agggguuucagaauu

SEQ ID NO: 1137317 - RNA, 15 nt, Homo sapiens
agggguuugccaaac

SEQ ID NO: 1137318 - RNA, 20 nt, Homo sapiens
aggguacuuuaagacauacu

SEQ ID NO: 1137319 - RNA, 13 nt, Homo sapiens
agggucauagcau

SEQ ID NO: 1137320 - RNA, 22 nt, Homo sapiens
agggucucacucuguugcccag

SEQ ID NO: 1137321 - RNA, 19 nt, Homo sapiens
agggucugagacucccuuu

SEQ ID NO: 1137322 - RNA, 22 nt, Homo sapiens
agggugaagcuauuuaucugua

SEQ ID NO: 1137323 - RNA, 14 nt, Homo sapiens
agggugagugcaag

SEQ ID NO: 1137324 - RNA, 19 nt, Homo sapiens
agggugcaguaucaugccc

SEQ ID NO: 1137325 - RNA, 16 nt, Homo sapiens
agggugcagugugagu

SEQ ID NO: 1137326 - RNA, 18 nt, Homo sapiens
aggguggggucuggucac

SEQ ID NO: 1137327 - RNA, 16 nt, Homo sapiens
agggugguggcacauu

SEQ ID NO: 1137328 - RNA, 16 nt, Homo sapiens
aggguuugcagaaagc

SEQ ID NO: 1137329 - RNA, 20 nt, Homo sapiens
agguaacuagcugagcacua

SEQ ID NO: 1137330 - RNA, 14 nt, Homo sapiens
agguacacauuuau

SEQ ID NO: 1137331 - RNA, 14 nt, Homo sapiens
agguacauccauga

SEQ ID NO: 1137332 - RNA, 22 nt, Homo sapiens
agguacugucaugggcuaggca

SEQ ID NO: 1137333 - RNA, 13 nt, Homo sapiens
agguauguugccu

SEQ ID NO: 1137334 - RNA, 17 nt, Homo sapiens
aggucaaaaaucugucc

SEQ ID NO: 1137335 - RNA, 14 nt, Homo sapiens
aggucaaaagucag

SEQ ID NO: 1137336 - RNA, 18 nt, Homo sapiens
aggucaagaacacaguga

SEQ ID NO: 1137337 - RNA, 13 nt, Homo sapiens
aggucagcacaag

SEQ ID NO: 1137338 - RNA, 14 nt, Homo sapiens
aggucagcacaaga

SEQ ID NO: 1137339 - RNA, 17 nt, Homo sapiens
aggucaggaguucaaga

SEQ ID NO: 1137340 - RNA, 15 nt, Homo sapiens
aggucucacacuccu

SEQ ID NO: 1137341 - RNA, 22 nt, Homo sapiens
aggucuuugccauaacuuuaug

SEQ ID NO: 1137342 - RNA, 18 nt, Homo sapiens
aggugacaaaaggcagaa

SEQ ID NO: 1137343 - RNA, 14 nt, Homo sapiens
aggugauaauggau

SEQ ID NO: 1137344 - RNA, 18 nt, Homo sapiens
agguggaacaagcacaga

SEQ ID NO: 1137345 - RNA, 21 nt, Homo sapiens
agguggccuccuugcuuguua

SEQ ID NO: 1137346 - RNA, 14 nt, Homo sapiens
agguggccucugcu

SEQ ID NO: 1137347 - RNA, 19 nt, Homo sapiens
agguggcuaagggggacca

SEQ ID NO: 1137348 - RNA, 18 nt, Homo sapiens
agguggguuaaacuguaa

SEQ ID NO: 1137349 - RNA, 17 nt, Homo sapiens
agguggugucacugucc

SEQ ID NO: 1137350 - RNA, 13 nt, Homo sapiens
aggugugacaugu

SEQ ID NO: 1137351 - RNA, 22 nt, Homo sapiens
aggugugcaaacuuguaucuga

SEQ ID NO: 1137352 - RNA, 18 nt, Homo sapiens
agguguucuaaucaaugu

SEQ ID NO: 1137353 - RNA, 15 nt, Homo sapiens
agguguuggugacaa

SEQ ID NO: 1137354 - RNA, 14 nt, Homo sapiens
agguuaagggguga

SEQ ID NO: 1137355 - RNA, 19 nt, Homo sapiens
agguucuaaaguucuaaga

SEQ ID NO: 1137356 - RNA, 15 nt, Homo sapiens
agguugacacaggaa

SEQ ID NO: 1137357 - RNA, 15 nt, Homo sapiens
agguugacagauacu

SEQ ID NO: 1137358 - RNA, 21 nt, Homo sapiens
agguugcagugagcugagauc

SEQ ID NO: 1137359 - RNA, 15 nt, Homo sapiens
agguuggacuggaaa

SEQ ID NO: 1137360 - RNA, 17 nt, Homo sapiens
agguuucaagacuugau

SEQ ID NO: 1137361 - RNA, 15 nt, Homo sapiens
agguuugccagcauu

SEQ ID NO: 1137362 - RNA, 15 nt, Homo sapiens
agguuuuaaagaccu

SEQ ID NO: 1137363 - RNA, 13 nt, Homo sapiens
aguaaaaauccaa

SEQ ID NO: 1137364 - RNA, 20 nt, Homo sapiens
aguaaaucuuuuacaacugc

SEQ ID NO: 1137365 - RNA, 14 nt, Homo sapiens
aguaacaucaaaga

SEQ ID NO: 1137366 - RNA, 16 nt, Homo sapiens
aguaaccauuugcacu

SEQ ID NO: 1137367 - RNA, 22 nt, Homo sapiens
aguaacccccacuggacugacc

SEQ ID NO: 1137368 - RNA, 20 nt, Homo sapiens
aguaagaaaacaucacugaa

SEQ ID NO: 1137369 - RNA, 14 nt, Homo sapiens
aguaagaagaggag

SEQ ID NO: 1137370 - RNA, 23 nt, Homo sapiens
aguaagaauguuaaaaagugaaa

SEQ ID NO: 1137371 - RNA, 24 nt, Homo sapiens
aguaagacauugggucuauuccag

SEQ ID NO: 1137372 - RNA, 13 nt, Homo sapiens
aguaagcaucuac

SEQ ID NO: 1137373 - RNA, 19 nt, Homo sapiens
aguaaucccagcuacucag

SEQ ID NO: 1137374 - RNA, 20 nt, Homo sapiens
aguaaugccucugucuagca

SEQ ID NO: 1137375 - RNA, 23 nt, Homo sapiens
aguacaccccaacagcacccucu

SEQ ID NO: 1137376 - RNA, 21 nt, Homo sapiens
aguacagacgucucaagacug

SEQ ID NO: 1137377 - RNA, 12 nt, Homo sapiens
aguacaguauau

SEQ ID NO: 1137378 - RNA, 21 nt, Homo sapiens
aguacaguauauucuuguaaa

SEQ ID NO: 1137379 - RNA, 12 nt, Homo sapiens
aguacaucucua

SEQ ID NO: 1137380 - RNA, 15 nt, Homo sapiens
aguacaucucuacua

SEQ ID NO: 1137381 - RNA, 18 nt, Homo sapiens
aguacaucucuacuaaaa

SEQ ID NO: 1137382 - RNA, 21 nt, Homo sapiens
aguaccaaagaaauuauaaac

SEQ ID NO: 1137383 - RNA, 18 nt, Homo sapiens
aguaccuauauugauuua

SEQ ID NO: 1137384 - RNA, 17 nt, Homo sapiens
aguaccuucaauacuua

SEQ ID NO: 1137385 - RNA, 14 nt, Homo sapiens
aguacuaagcauuu

SEQ ID NO: 1137386 - RNA, 16 nt, Homo sapiens
aguacuacauaccuca

SEQ ID NO: 1137387 - RNA, 18 nt, Homo sapiens
aguacuuuuggugucauu

SEQ ID NO: 1137388 - RNA, 14 nt, Homo sapiens
aguagaaucucagu

SEQ ID NO: 1137389 - RNA, 20 nt, Homo sapiens
aguagacauuuuaacaagaa

SEQ ID NO: 1137390 - RNA, 11 nt, Homo sapiens
aguagaugcca

SEQ ID NO: 1137391 - RNA, 16 nt, Homo sapiens
aguagccccuaaucac

SEQ ID NO: 1137392 - RNA, 19 nt, Homo sapiens
aguagcggaucucacucag

SEQ ID NO: 1137393 - RNA, 21 nt, Homo sapiens
aguagcuggauuacaggcaug

SEQ ID NO: 1137394 - RNA, 21 nt, Homo sapiens
aguagcugggauuacaggugu

SEQ ID NO: 1137395 - RNA, 13 nt, Homo sapiens
aguagggggagca

SEQ ID NO: 1137396 - RNA, 14 nt, Homo sapiens
aguagggggagcaa

SEQ ID NO: 1137397 - RNA, 19 nt, Homo sapiens
aguagucaaggugcucaau

SEQ ID NO: 1137398 - RNA, 19 nt, Homo sapiens
aguagugaguuaaagcuac

SEQ ID NO: 1137399 - RNA, 23 nt, Homo sapiens
aguauacaauaaagucuuaccuc

SEQ ID NO: 1137400 - RNA, 19 nt, Homo sapiens
aguauacuagggagccauu

SEQ ID NO: 1137401 - RNA, 19 nt, Homo sapiens
aguauaugucauuuacuca

SEQ ID NO: 1137402 - RNA, 13 nt, Homo sapiens
aguaucagcacua

SEQ ID NO: 1137403 - RNA, 12 nt, Homo sapiens
aguauccacaau

SEQ ID NO: 1137404 - RNA, 12 nt, Homo sapiens
aguauccaguca

SEQ ID NO: 1137405 - RNA, 16 nt, Homo sapiens
aguaucuuuccagcau

SEQ ID NO: 1137406 - RNA, 14 nt, Homo sapiens
aguaugaguaaugc

SEQ ID NO: 1137407 - RNA, 14 nt, Homo sapiens
aguaugaucucagu

SEQ ID NO: 1137408 - RNA, 17 nt, Homo sapiens
aguaugguggguugguu

SEQ ID NO: 1137409 - RNA, 14 nt, Homo sapiens
aguaugugccagga

SEQ ID NO: 1137410 - RNA, 18 nt, Homo sapiens
aguauguuuuacacugua

SEQ ID NO: 1137411 - RNA, 14 nt, Homo sapiens
aguauuaucagaug

SEQ ID NO: 1137412 - RNA, 19 nt, Homo sapiens
aguauucaggcacugagaa

SEQ ID NO: 1137413 - RNA, 16 nt, Homo sapiens
aguauucaugacuaug

SEQ ID NO: 1137414 - RNA, 16 nt, Homo sapiens
aguauuuuaagucuac

SEQ ID NO: 1137415 - RNA, 21 nt, Homo sapiens
agucaaauuuguaaaucuuau

SEQ ID NO: 1137416 - RNA, 19 nt, Homo sapiens
agucaacccucuuacaaga

SEQ ID NO: 1137417 - RNA, 21 nt, Homo sapiens
agucaaccugccugacauuug

SEQ ID NO: 1137418 - RNA, 15 nt, Homo sapiens
agucaauuucuacuu

SEQ ID NO: 1137419 - RNA, 13 nt, Homo sapiens
agucacacagugu

SEQ ID NO: 1137420 - RNA, 18 nt, Homo sapiens
agucacaccuuagugcua

SEQ ID NO: 1137421 - RNA, 21 nt, Homo sapiens
agucacauggccuaugcacau

SEQ ID NO: 1137422 - RNA, 23 nt, Homo sapiens
agucaccuguaaauugauucaag

SEQ ID NO: 1137423 - RNA, 16 nt, Homo sapiens
agucacucagccauuu

SEQ ID NO: 1137424 - RNA, 12 nt, Homo sapiens
agucacuggcag

SEQ ID NO: 1137425 - RNA, 22 nt, Homo sapiens
agucagaaguucuggguggugc

SEQ ID NO: 1137426 - RNA, 23 nt, Homo sapiens
agucaggggucaggugucaggcc

SEQ ID NO: 1137427 - RNA, 23 nt, Homo sapiens
agucaggugggguggagucccag

SEQ ID NO: 1137428 - RNA, 21 nt, Homo sapiens
agucauaugagaaggaacuuu

SEQ ID NO: 1137429 - RNA, 17 nt, Homo sapiens
agucaucaugaacuggc

SEQ ID NO: 1137430 - RNA, 22 nt, Homo sapiens
agucauccccuugggcucucac

SEQ ID NO: 1137431 - RNA, 14 nt, Homo sapiens
agucaucucaacca

SEQ ID NO: 1137432 - RNA, 18 nt, Homo sapiens
agucaucuugaccaagca

SEQ ID NO: 1137433 - RNA, 15 nt, Homo sapiens
agucaugggaacgca

SEQ ID NO: 1137434 - RNA, 13 nt, Homo sapiens
agucaugugccua

SEQ ID NO: 1137435 - RNA, 21 nt, Homo sapiens
aguccaagaggguccuuuagu

SEQ ID NO: 1137436 - RNA, 20 nt, Homo sapiens
aguccaauuccuugcacaua

SEQ ID NO: 1137437 - RNA, 18 nt, Homo sapiens
aguccacugcugaggaca

SEQ ID NO: 1137438 - RNA, 21 nt, Homo sapiens
aguccagagaacugacaugca

SEQ ID NO: 1137439 - RNA, 19 nt, Homo sapiens
aguccagccuagucuggac

SEQ ID NO: 1137440 - RNA, 17 nt, Homo sapiens
aguccaguaaagccuua

SEQ ID NO: 1137441 - RNA, 21 nt, Homo sapiens
aguccagucucuccagcauca

SEQ ID NO: 1137442 - RNA, 20 nt, Homo sapiens
agucccaggggcagccacac

SEQ ID NO: 1137443 - RNA, 20 nt, Homo sapiens
agucccccuucaaucucguu

SEQ ID NO: 1137444 - RNA, 17 nt, Homo sapiens
aguccccgggcaucuuu

SEQ ID NO: 1137445 - RNA, 22 nt, Homo sapiens
agucccucucacaggacaugcu

SEQ ID NO: 1137446 - RNA, 20 nt, Homo sapiens
agucccuguccggaaugcca

SEQ ID NO: 1137447 - RNA, 23 nt, Homo sapiens
aguccucagugaaaggauuccgc

SEQ ID NO: 1137448 - RNA, 22 nt, Homo sapiens
aguccucuggauugagauacuu

SEQ ID NO: 1137449 - RNA, 16 nt, Homo sapiens
aguccuggaaucacau

SEQ ID NO: 1137450 - RNA, 19 nt, Homo sapiens
aguccuguaugucugucau

SEQ ID NO: 1137451 - RNA, 13 nt, Homo sapiens
aguccuguucaga

SEQ ID NO: 1137452 - RNA, 14 nt, Homo sapiens
aguccuuacugaag

SEQ ID NO: 1137453 - RNA, 21 nt, Homo sapiens
aguccuucaccucacugaaaa

SEQ ID NO: 1137454 - RNA, 12 nt, Homo sapiens
aguccuuuccaa

SEQ ID NO: 1137455 - RNA, 14 nt, Homo sapiens
agucgcuugccaaa

SEQ ID NO: 1137456 - RNA, 16 nt, Homo sapiens
agucguacuguucaca

SEQ ID NO: 1137457 - RNA, 22 nt, Homo sapiens
agucgucuggcaucucccacac

SEQ ID NO: 1137458 - RNA, 18 nt, Homo sapiens
agucuacuucacuaauga

SEQ ID NO: 1137459 - RNA, 11 nt, Homo sapiens
agucuauggcc

SEQ ID NO: 1137460 - RNA, 20 nt, Homo sapiens
agucuccaugcaagauuucu

SEQ ID NO: 1137461 - RNA, 23 nt, Homo sapiens
agucuccccuugcagccugguca

SEQ ID NO: 1137462 - RNA, 22 nt, Homo sapiens
agucucuacccaguagaugcca

SEQ ID NO: 1137463 - RNA, 23 nt, Homo sapiens
agucugaagcucgcauccagaca

SEQ ID NO: 1137464 - RNA, 18 nt, Homo sapiens
agucuggcaaacaugugc

SEQ ID NO: 1137465 - RNA, 11 nt, Homo sapiens
agucuguucuc

SEQ ID NO: 1137466 - RNA, 22 nt, Homo sapiens
agucuuaaaaaaauaugccuuu

SEQ ID NO: 1137467 - RNA, 16 nt, Homo sapiens
agucuuagacaucaua

SEQ ID NO: 1137468 - RNA, 13 nt, Homo sapiens
agucuugccuugc

SEQ ID NO: 1137469 - RNA, 12 nt, Homo sapiens
agucuugcucug

SEQ ID NO: 1137470 - RNA, 22 nt, Homo sapiens
agucuuuuguucgcauggucac

SEQ ID NO: 1137471 - RNA, 15 nt, Homo sapiens
agugaaaaacaucca

SEQ ID NO: 1137472 - RNA, 18 nt, Homo sapiens
agugaacaagaaacauga

SEQ ID NO: 1137473 - RNA, 13 nt, Homo sapiens
agugaacuugaaa

SEQ ID NO: 1137474 - RNA, 21 nt, Homo sapiens
agugaacuugaaauauccugc

SEQ ID NO: 1137475 - RNA, 20 nt, Homo sapiens
agugaagggcaguacagugg

SEQ ID NO: 1137476 - RNA, 19 nt, Homo sapiens
agugaauaaaccaucaucu

SEQ ID NO: 1137477 - RNA, 13 nt, Homo sapiens
agugaauggucuc

SEQ ID NO: 1137478 - RNA, 15 nt, Homo sapiens
agugaauuguugaca

SEQ ID NO: 1137479 - RNA, 15 nt, Homo sapiens
agugacaaccaaaag

SEQ ID NO: 1137480 - RNA, 20 nt, Homo sapiens
agugacagagcgagacucca

SEQ ID NO: 1137481 - RNA, 18 nt, Homo sapiens
agugacagcagucaggga

SEQ ID NO: 1137482 - RNA, 15 nt, Homo sapiens
agugacauguuuaca

SEQ ID NO: 1137483 - RNA, 21 nt, Homo sapiens
agugaccccugccuacuuccu

SEQ ID NO: 1137484 - RNA, 16 nt, Homo sapiens
agugacgugguucauc

SEQ ID NO: 1137485 - RNA, 18 nt, Homo sapiens
agugagacccugucucaa

SEQ ID NO: 1137486 - RNA, 13 nt, Homo sapiens
agugagaugaagg

SEQ ID NO: 1137487 - RNA, 20 nt, Homo sapiens
agugagccaggaaagcagca

SEQ ID NO: 1137488 - RNA, 23 nt, Homo sapiens
agugagguucuuaaaguuugcag

SEQ ID NO: 1137489 - RNA, 16 nt, Homo sapiens
agugagugcugcucau

SEQ ID NO: 1137490 - RNA, 22 nt, Homo sapiens
agugaguggccccaccuguguc

SEQ ID NO: 1137491 - RNA, 12 nt, Homo sapiens
agugauccucag

SEQ ID NO: 1137492 - RNA, 14 nt, Homo sapiens
agugauccucccac

SEQ ID NO: 1137493 - RNA, 19 nt, Homo sapiens
agugaucugcccaccucag

SEQ ID NO: 1137494 - RNA, 19 nt, Homo sapiens
agugauuuagaacagucau

SEQ ID NO: 1137495 - RNA, 19 nt, Homo sapiens
agugcaaaagauuaagauu

SEQ ID NO: 1137496 - RNA, 18 nt, Homo sapiens
agugcacuaauucugcau

SEQ ID NO: 1137497 - RNA, 12 nt, Homo sapiens
agugcacuuaau

SEQ ID NO: 1137498 - RNA, 20 nt, Homo sapiens
agugcaguggugugaucuca

SEQ ID NO: 1137499 - RNA, 23 nt, Homo sapiens
agugcaucugggaagauuucuac

SEQ ID NO: 1137500 - RNA, 21 nt, Homo sapiens
agugcaugacguuuaaggcca

SEQ ID NO: 1137501 - RNA, 16 nt, Homo sapiens
agugcauuugugcuag

SEQ ID NO: 1137502 - RNA, 12 nt, Homo sapiens
agugccaaagaa

SEQ ID NO: 1137503 - RNA, 20 nt, Homo sapiens
agugccaacaauccuagugc

SEQ ID NO: 1137504 - RNA, 23 nt, Homo sapiens
agugccaacuguggcugguccuc

SEQ ID NO: 1137505 - RNA, 17 nt, Homo sapiens
agugccaugggggcaac

SEQ ID NO: 1137506 - RNA, 19 nt, Homo sapiens
agugccgacagcucuccaa

SEQ ID NO: 1137507 - RNA, 17 nt, Homo sapiens
agugccugccuaugaaa

SEQ ID NO: 1137508 - RNA, 18 nt, Homo sapiens
agugccuugcccacaggu

SEQ ID NO: 1137509 - RNA, 16 nt, Homo sapiens
agugccuuuuuccuua

SEQ ID NO: 1137510 - RNA, 18 nt, Homo sapiens
agugcugcccaugagcaa

SEQ ID NO: 1137511 - RNA, 21 nt, Homo sapiens
agugcugggauuauaggcaug

SEQ ID NO: 1137512 - RNA, 21 nt, Homo sapiens
agugcuggggaacaaccagag

SEQ ID NO: 1137513 - RNA, 12 nt, Homo sapiens
agugcugugcac

SEQ ID NO: 1137514 - RNA, 11 nt, Homo sapiens
agugcugugcu

SEQ ID NO: 1137515 - RNA, 13 nt, Homo sapiens
agugcugugcugu

SEQ ID NO: 1137516 - RNA, 18 nt, Homo sapiens
aguggaaaaaggagagca

SEQ ID NO: 1137517 - RNA, 16 nt, Homo sapiens
aguggaaccguugcca

SEQ ID NO: 1137518 - RNA, 22 nt, Homo sapiens
aguggaaccguugccaaccgag

SEQ ID NO: 1137519 - RNA, 21 nt, Homo sapiens
aguggaaggacacucuuggcu

SEQ ID NO: 1137520 - RNA, 14 nt, Homo sapiens
aguggaaggcauca

SEQ ID NO: 1137521 - RNA, 15 nt, Homo sapiens
aguggagaagcacac

SEQ ID NO: 1137522 - RNA, 14 nt, Homo sapiens
aguggcaaaacacu

SEQ ID NO: 1137523 - RNA, 22 nt, Homo sapiens
aguggccccaucauagccugca

SEQ ID NO: 1137524 - RNA, 15 nt, Homo sapiens
aguggccgaugauuu

SEQ ID NO: 1137525 - RNA, 19 nt, Homo sapiens
aguggccuagagcacucuc

SEQ ID NO: 1137526 - RNA, 15 nt, Homo sapiens
aguggcgcaugccug

SEQ ID NO: 1137527 - RNA, 23 nt, Homo sapiens
aguggcucacaccuguaauccca

SEQ ID NO: 1137528 - RNA, 18 nt, Homo sapiens
aguggcucgccaggccaa

SEQ ID NO: 1137529 - RNA, 15 nt, Homo sapiens
aguggcuucuuucca

SEQ ID NO: 1137530 - RNA, 20 nt, Homo sapiens
agugggaaggggugauggau

SEQ ID NO: 1137531 - RNA, 21 nt, Homo sapiens
agugggaggguaccagcagaa

SEQ ID NO: 1137532 - RNA, 14 nt, Homo sapiens
aguggugcugcuuu

SEQ ID NO: 1137533 - RNA, 13 nt, Homo sapiens
agugguucuucaa

SEQ ID NO: 1137534 - RNA, 19 nt, Homo sapiens
agugguugggcugugccug

SEQ ID NO: 1137535 - RNA, 18 nt, Homo sapiens
aguguaaauucagucuuu

SEQ ID NO: 1137536 - RNA, 17 nt, Homo sapiens
aguguaacaaccuaucu

SEQ ID NO: 1137537 - RNA, 15 nt, Homo sapiens
aguguaaugugacuu

SEQ ID NO: 1137538 - RNA, 17 nt, Homo sapiens
aguguaaugugacuuca

SEQ ID NO: 1137539 - RNA, 22 nt, Homo sapiens
aguguaaugugacuucaugcua

SEQ ID NO: 1137540 - RNA, 15 nt, Homo sapiens
aguguaccauuugcc

SEQ ID NO: 1137541 - RNA, 20 nt, Homo sapiens
agugucuggagcggcugcuc

SEQ ID NO: 1137542 - RNA, 15 nt, Homo sapiens
agugucuuuugacau

SEQ ID NO: 1137543 - RNA, 16 nt, Homo sapiens
agugugaacaaaagau

SEQ ID NO: 1137544 - RNA, 21 nt, Homo sapiens
agugugaacaaaagaugcucu

SEQ ID NO: 1137545 - RNA, 15 nt, Homo sapiens
agugugcugaacaca

SEQ ID NO: 1137546 - RNA, 14 nt, Homo sapiens
aguguggccugagu

SEQ ID NO: 1137547 - RNA, 17 nt, Homo sapiens
aguguguguggcagcag

SEQ ID NO: 1137548 - RNA, 22 nt, Homo sapiens
aguguucaguaaaagcaaaaug

SEQ ID NO: 1137549 - RNA, 13 nt, Homo sapiens
aguguucccugac

SEQ ID NO: 1137550 - RNA, 15 nt, Homo sapiens
aguguuccugagaca

SEQ ID NO: 1137551 - RNA, 15 nt, Homo sapiens
aguguucugcugaga

SEQ ID NO: 1137552 - RNA, 20 nt, Homo sapiens
aguuaaauguaucacauuga

SEQ ID NO: 1137553 - RNA, 17 nt, Homo sapiens
aguuaauaaguugaugu

SEQ ID NO: 1137554 - RNA, 15 nt, Homo sapiens
aguuaauauagucac

SEQ ID NO: 1137555 - RNA, 13 nt, Homo sapiens
aguuaauccacug

SEQ ID NO: 1137556 - RNA, 14 nt, Homo sapiens
aguuaaugaaggug

SEQ ID NO: 1137557 - RNA, 14 nt, Homo sapiens
aguuacaacagaag

SEQ ID NO: 1137558 - RNA, 19 nt, Homo sapiens
aguuaccacauuacucugc

SEQ ID NO: 1137559 - RNA, 20 nt, Homo sapiens
aguuagaauuauaucacuuc

SEQ ID NO: 1137560 - RNA, 22 nt, Homo sapiens
aguuaguggauaaccacagggc

SEQ ID NO: 1137561 - RNA, 12 nt, Homo sapiens
aguuauacacua

SEQ ID NO: 1137562 - RNA, 23 nt, Homo sapiens
aguuaucuguucuuuugacuuaa

SEQ ID NO: 1137563 - RNA, 20 nt, Homo sapiens
aguuauuucaaccagcacau

SEQ ID NO: 1137564 - RNA, 21 nt, Homo sapiens
aguuauuucaaccagcacauu

SEQ ID NO: 1137565 - RNA, 12 nt, Homo sapiens
aguucaagagaa

SEQ ID NO: 1137566 - RNA, 14 nt, Homo sapiens
aguucaagugcucu

SEQ ID NO: 1137567 - RNA, 18 nt, Homo sapiens
aguucaagugcucuucag

SEQ ID NO: 1137568 - RNA, 13 nt, Homo sapiens
aguucacaucaga

SEQ ID NO: 1137569 - RNA, 16 nt, Homo sapiens
aguucaccugcacuua

SEQ ID NO: 1137570 - RNA, 19 nt, Homo sapiens
aguuccaggagaauaaaag

SEQ ID NO: 1137571 - RNA, 15 nt, Homo sapiens
aguuccagugcugca

SEQ ID NO: 1137572 - RNA, 22 nt, Homo sapiens
aguuccgucagaaaguguaaau

SEQ ID NO: 1137573 - RNA, 21 nt, Homo sapiens
aguuccugcuccguggacugc

SEQ ID NO: 1137574 - RNA, 15 nt, Homo sapiens
aguuccuucagcuuc

SEQ ID NO: 1137575 - RNA, 22 nt, Homo sapiens
aguucuaggcacuguaguucua

SEQ ID NO: 1137576 - RNA, 17 nt, Homo sapiens
aguucucuugguguuaa

SEQ ID NO: 1137577 - RNA, 13 nt, Homo sapiens
aguucugauucau

SEQ ID NO: 1137578 - RNA, 17 nt, Homo sapiens
aguucuuugggccagac

SEQ ID NO: 1137579 - RNA, 23 nt, Homo sapiens
aguugaaagaguccuauuugcac

SEQ ID NO: 1137580 - RNA, 17 nt, Homo sapiens
aguugaaagggcaauau

SEQ ID NO: 1137581 - RNA, 17 nt, Homo sapiens
aguugaaauaugcucuu

SEQ ID NO: 1137582 - RNA, 20 nt, Homo sapiens
aguugacucagagugcaaga

SEQ ID NO: 1137583 - RNA, 19 nt, Homo sapiens
aguugaucuggaacccaga

SEQ ID NO: 1137584 - RNA, 21 nt, Homo sapiens
aguugaucuggaacccagacu

SEQ ID NO: 1137585 - RNA, 19 nt, Homo sapiens
aguugauguaacauuguag

SEQ ID NO: 1137586 - RNA, 22 nt, Homo sapiens
aguugccaucugcgugacaaua

SEQ ID NO: 1137587 - RNA, 19 nt, Homo sapiens
aguugcguggacucugcac

SEQ ID NO: 1137588 - RNA, 19 nt, Homo sapiens
aguugcugcauuccuaaac

SEQ ID NO: 1137589 - RNA, 14 nt, Homo sapiens
aguugcugucaucc

SEQ ID NO: 1137590 - RNA, 18 nt, Homo sapiens
aguugcugucauccacuu

SEQ ID NO: 1137591 - RNA, 18 nt, Homo sapiens
aguuggaauucaccaaga

SEQ ID NO: 1137592 - RNA, 16 nt, Homo sapiens
aguuggugcugcucau

SEQ ID NO: 1137593 - RNA, 20 nt, Homo sapiens
aguugguuuguaucuugccu

SEQ ID NO: 1137594 - RNA, 14 nt, Homo sapiens
aguuguccgugaua

SEQ ID NO: 1137595 - RNA, 16 nt, Homo sapiens
aguuguguuuguugcu

SEQ ID NO: 1137596 - RNA, 20 nt, Homo sapiens
aguuguuguaaaaauaaaag

SEQ ID NO: 1137597 - RNA, 14 nt, Homo sapiens
aguuguuugcuuau

SEQ ID NO: 1137598 - RNA, 20 nt, Homo sapiens
aguuuaaaacagaagccuga

SEQ ID NO: 1137599 - RNA, 15 nt, Homo sapiens
aguuuaacguauauu

SEQ ID NO: 1137600 - RNA, 21 nt, Homo sapiens
aguuuacaggaaagaugcauu

SEQ ID NO: 1137601 - RNA, 13 nt, Homo sapiens
aguuuacaggaua

SEQ ID NO: 1137602 - RNA, 16 nt, Homo sapiens
aguuuacuuugccaac

SEQ ID NO: 1137603 - RNA, 13 nt, Homo sapiens
aguuuagugcauc

SEQ ID NO: 1137604 - RNA, 17 nt, Homo sapiens
aguuuauauacaauuau

SEQ ID NO: 1137605 - RNA, 22 nt, Homo sapiens
aguuuaugaaacagaaaaguag

SEQ ID NO: 1137606 - RNA, 21 nt, Homo sapiens
aguuucagagaccauugcaau

SEQ ID NO: 1137607 - RNA, 21 nt, Homo sapiens
aguuucauguacaagaugaag

SEQ ID NO: 1137608 - RNA, 22 nt, Homo sapiens
aguuuccaauuauuugacuuua

SEQ ID NO: 1137609 - RNA, 23 nt, Homo sapiens
aguuucccuaacaaaaaagcuaa

SEQ ID NO: 1137610 - RNA, 18 nt, Homo sapiens
aguuucuaucauucugcu

SEQ ID NO: 1137611 - RNA, 22 nt, Homo sapiens
aguuucuaucccuuaccugcuu

SEQ ID NO: 1137612 - RNA, 21 nt, Homo sapiens
aguuucuuaacccuuuccaga

SEQ ID NO: 1137613 - RNA, 22 nt, Homo sapiens
aguuugaacaaaaucuccucuu

SEQ ID NO: 1137614 - RNA, 18 nt, Homo sapiens
aguuugauuauucagugu

SEQ ID NO: 1137615 - RNA, 16 nt, Homo sapiens
aguuugcccauucucu

SEQ ID NO: 1137616 - RNA, 13 nt, Homo sapiens
aguuugccuguac

SEQ ID NO: 1137617 - RNA, 21 nt, Homo sapiens
aguuuggauaaaaaauggcag

SEQ ID NO: 1137618 - RNA, 19 nt, Homo sapiens
aguuuggcaaacucuccac

SEQ ID NO: 1137619 - RNA, 21 nt, Homo sapiens
aguuuggucccuaaauuugca

SEQ ID NO: 1137620 - RNA, 12 nt, Homo sapiens
aguuuguauuaa

SEQ ID NO: 1137621 - RNA, 18 nt, Homo sapiens
aguuugugcucuacuguu

SEQ ID NO: 1137622 - RNA, 19 nt, Homo sapiens
aguuuguggcaucuugcca

SEQ ID NO: 1137623 - RNA, 23 nt, Homo sapiens
aguuuuaaaaaaaacaauuccac

SEQ ID NO: 1137624 - RNA, 14 nt, Homo sapiens
aguuuucuaacucc

SEQ ID NO: 1137625 - RNA, 15 nt, Homo sapiens
aguuuuggcauaaua

SEQ ID NO: 1137626 - RNA, 20 nt, Homo sapiens
aguuuuguuugcugcugugu

SEQ ID NO: 1137627 - RNA, 23 nt, Homo sapiens
aguuuuguuuguucacacuccua

SEQ ID NO: 1137628 - RNA, 21 nt, Homo sapiens
aguuuuuaauuuaucagagac

SEQ ID NO: 1137629 - RNA, 15 nt, Homo sapiens
aguuuuuauucugaa

SEQ ID NO: 1137630 - RNA, 22 nt, Homo sapiens
aguuuuucuuacuugcauuuau

SEQ ID NO: 1137631 - RNA, 21 nt, Homo sapiens
auaaaaauguuuugaggcuuu

SEQ ID NO: 1137632 - RNA, 21 nt, Homo sapiens
auaaaacaaaagcauuuugcu

SEQ ID NO: 1137633 - RNA, 15 nt, Homo sapiens
auaaaagacagugaa

SEQ ID NO: 1137634 - RNA, 17 nt, Homo sapiens
auaaaaggagacagaag

SEQ ID NO: 1137635 - RNA, 16 nt, Homo sapiens
auaaaagugcuuugca

SEQ ID NO: 1137636 - RNA, 21 nt, Homo sapiens
auaaaagugcuuugcauugaa

SEQ ID NO: 1137637 - RNA, 21 nt, Homo sapiens
auaaaauguuuaaucucugcu

SEQ ID NO: 1137638 - RNA, 17 nt, Homo sapiens
auaaaauuaacaugaua

SEQ ID NO: 1137639 - RNA, 16 nt, Homo sapiens
auaaacacaaaaacac

SEQ ID NO: 1137640 - RNA, 17 nt, Homo sapiens
auaaacacuuucuggaa

SEQ ID NO: 1137641 - RNA, 20 nt, Homo sapiens
auaaacaguuuuacuugugu

SEQ ID NO: 1137642 - RNA, 14 nt, Homo sapiens
auaaacccaguugc

SEQ ID NO: 1137643 - RNA, 17 nt, Homo sapiens
auaaacccaguugccau

SEQ ID NO: 1137644 - RNA, 21 nt, Homo sapiens
auaaacgcagaagagggggag

SEQ ID NO: 1137645 - RNA, 17 nt, Homo sapiens
auaaacguccuacugua

SEQ ID NO: 1137646 - RNA, 15 nt, Homo sapiens
auaaacuaacuacug

SEQ ID NO: 1137647 - RNA, 16 nt, Homo sapiens
auaaacucagaaauuu

SEQ ID NO: 1137648 - RNA, 16 nt, Homo sapiens
caccugaaagccuguc

SEQ ID NO: 1137649 - RNA, 13 nt, Homo sapiens
caccugagcagga

SEQ ID NO: 1137650 - RNA, 12 nt, Homo sapiens
caccugcagugc

SEQ ID NO: 1137651 - RNA, 14 nt, Homo sapiens
caccugguaugugc

SEQ ID NO: 1137652 - RNA, 14 nt, Homo sapiens
caccuguaauccca

SEQ ID NO: 1137653 - RNA, 15 nt, Homo sapiens
caccuguagucccag

SEQ ID NO: 1137654 - RNA, 17 nt, Homo sapiens
caccuuauacaucacuu

SEQ ID NO: 1137655 - RNA, 14 nt, Homo sapiens
caccuucguuuacu

SEQ ID NO: 1137656 - RNA, 22 nt, Homo sapiens
aauaaaauuuuuuuucauguuu

SEQ ID NO: 1137657 - RNA, 23 nt, Homo sapiens
aauaaacacugguuguagucagu

SEQ ID NO: 1137658 - RNA, 12 nt, Homo sapiens
aauaaaccaaau

SEQ ID NO: 1137659 - RNA, 23 nt, Homo sapiens
aauaaaccauuggacagauuuca

SEQ ID NO: 1137660 - RNA, 17 nt, Homo sapiens
aauaaacuagacucuga

SEQ ID NO: 1137661 - RNA, 17 nt, Homo sapiens
aauaaacugguaugaau

SEQ ID NO: 1137662 - RNA, 22 nt, Homo sapiens
aauaaagaccuauguacuuaau

SEQ ID NO: 1137663 - RNA, 20 nt, Homo sapiens
aauaaaggaugugauugugg

SEQ ID NO: 1137664 - RNA, 17 nt, Homo sapiens
aauaaaguauagguuua

SEQ ID NO: 1137665 - RNA, 19 nt, Homo sapiens
aauaaagugaggcaggaaa

SEQ ID NO: 1137666 - RNA, 18 nt, Homo sapiens
aauaaaguucuguacuca

SEQ ID NO: 1137667 - RNA, 14 nt, Homo sapiens
aauaaauacacaau

SEQ ID NO: 1137668 - RNA, 22 nt, Homo sapiens
aauaaaucacaggcaucuggaa

SEQ ID NO: 1137669 - RNA, 17 nt, Homo sapiens
aauaaaucguccuccca

SEQ ID NO: 1137670 - RNA, 20 nt, Homo sapiens
aauaaaucguccucccaggc

SEQ ID NO: 1137671 - RNA, 23 nt, Homo sapiens
aauaaaucguccucccaggccag

SEQ ID NO: 1137672 - RNA, 19 nt, Homo sapiens
aauaaaucugacccagugc

SEQ ID NO: 1137673 - RNA, 12 nt, Homo sapiens
aauaaaugccac

SEQ ID NO: 1137674 - RNA, 11 nt, Homo sapiens
aauaaauggaa

SEQ ID NO: 1137675 - RNA, 13 nt, Homo sapiens
aauaaauuccuaa

SEQ ID NO: 1137676 - RNA, 20 nt, Homo sapiens
aauaacauguuucucuauaa

SEQ ID NO: 1137677 - RNA, 13 nt, Homo sapiens
aauaaccaauccu

SEQ ID NO: 1137678 - RNA, 11 nt, Homo sapiens
aauaacuaaua

SEQ ID NO: 1137679 - RNA, 20 nt, Homo sapiens
aauaacuauauaagacauua

SEQ ID NO: 1137680 - RNA, 17 nt, Homo sapiens
aauaagagauccuuuag

SEQ ID NO: 1137681 - RNA, 13 nt, Homo sapiens
aauaauaaauuaa

SEQ ID NO: 1137682 - RNA, 12 nt, Homo sapiens
aauaauaauuag

SEQ ID NO: 1137683 - RNA, 15 nt, Homo sapiens
aauaauagcaauuca

SEQ ID NO: 1137684 - RNA, 20 nt, Homo sapiens
aauaaucaacugaauugcaa

SEQ ID NO: 1137685 - RNA, 21 nt, Homo sapiens
aauaaucaacugaauugcaaa

SEQ ID NO: 1137686 - RNA, 14 nt, Homo sapiens
aauaaugauaguua

SEQ ID NO: 1137687 - RNA, 15 nt, Homo sapiens
aauaauuaccaauau

SEQ ID NO: 1137688 - RNA, 16 nt, Homo sapiens
aauaauuuccuacaca

SEQ ID NO: 1137689 - RNA, 19 nt, Homo sapiens
aauacaaaaaucagccaga

SEQ ID NO: 1137690 - RNA, 12 nt, Homo sapiens
aauacaaaaauu

SEQ ID NO: 1137691 - RNA, 16 nt, Homo sapiens
aauacaaaaguggcuc

SEQ ID NO: 1137692 - RNA, 20 nt, Homo sapiens
aauacaaagcuguuuuauga

SEQ ID NO: 1137693 - RNA, 17 nt, Homo sapiens
aauacaaugauccugua

SEQ ID NO: 1137694 - RNA, 20 nt, Homo sapiens
aauacaauggguaucgcuga

SEQ ID NO: 1137695 - RNA, 14 nt, Homo sapiens
aauacacacaagua

SEQ ID NO: 1137696 - RNA, 21 nt, Homo sapiens
aauacauaccuacugacugau

SEQ ID NO: 1137697 - RNA, 13 nt, Homo sapiens
aauaccaaaaauu

SEQ ID NO: 1137698 - RNA, 21 nt, Homo sapiens
aauaccaacugaagucaauuu

SEQ ID NO: 1137699 - RNA, 15 nt, Homo sapiens
aauacuaaacuacau

SEQ ID NO: 1137700 - RNA, 23 nt, Homo sapiens
aauacuaacugcugauuuugaca

SEQ ID NO: 1137701 - RNA, 13 nt, Homo sapiens
aauacuacugcac

SEQ ID NO: 1137702 - RNA, 19 nt, Homo sapiens
aauacugaauuucuuugau

SEQ ID NO: 1137703 - RNA, 21 nt, Homo sapiens
aauacugcugagauacauaca

SEQ ID NO: 1137704 - RNA, 23 nt, Homo sapiens
aauacugguuauccugugcuaca

SEQ ID NO: 1137705 - RNA, 22 nt, Homo sapiens
aauacuuagacaguaugcauac

SEQ ID NO: 1137706 - RNA, 14 nt, Homo sapiens
aauagaaacauauc

SEQ ID NO: 1137707 - RNA, 16 nt, Homo sapiens
aauagaaccacuauga

SEQ ID NO: 1137708 - RNA, 16 nt, Homo sapiens
accagacagaggguca

SEQ ID NO: 1137709 - RNA, 18 nt, Homo sapiens
accagacagagggucaca

SEQ ID NO: 1137710 - RNA, 15 nt, Homo sapiens
accagacugcacagg

SEQ ID NO: 1137711 - RNA, 22 nt, Homo sapiens
accagaggccucuuuuccugaa

SEQ ID NO: 1137712 - RNA, 15 nt, Homo sapiens
accagauagcucaau

SEQ ID NO: 1137713 - RNA, 16 nt, Homo sapiens
accagauuugaggcug

SEQ ID NO: 1137714 - RNA, 15 nt, Homo sapiens
accagcaacuugaac

SEQ ID NO: 1137715 - RNA, 11 nt, Homo sapiens
accagcacauu

SEQ ID NO: 1137716 - RNA, 14 nt, Homo sapiens
accagccccucccc

SEQ ID NO: 1137717 - RNA, 19 nt, Homo sapiens
accagcccugagaaagaau

SEQ ID NO: 1137718 - RNA, 20 nt, Homo sapiens
accagcccugagaaagaaug

SEQ ID NO: 1137719 - RNA, 20 nt, Homo sapiens
accaggauagagacuggaac

SEQ ID NO: 1137720 - RNA, 14 nt, Homo sapiens
accaggcaguuuuu

SEQ ID NO: 1137721 - RNA, 20 nt, Homo sapiens
accaggcugggcucagcuca

SEQ ID NO: 1137722 - RNA, 18 nt, Homo sapiens
accaggggaccagaggga

SEQ ID NO: 1137723 - RNA, 19 nt, Homo sapiens
accaggggaccagagggau

SEQ ID NO: 1137724 - RNA, 13 nt, Homo sapiens
accaguaccugaa

SEQ ID NO: 1137725 - RNA, 20 nt, Homo sapiens
accagucuccuccccuacuc

SEQ ID NO: 1137726 - RNA, 18 nt, Homo sapiens
accaguguaaauucaguc

SEQ ID NO: 1137727 - RNA, 20 nt, Homo sapiens
accaguguaaauucagucuu

SEQ ID NO: 1137728 - RNA, 20 nt, Homo sapiens
accaguugugauacaauaaa

SEQ ID NO: 1137729 - RNA, 19 nt, Homo sapiens
accaguuugcccauucucu

SEQ ID NO: 1137730 - RNA, 14 nt, Homo sapiens
accauaaccacuga

SEQ ID NO: 1137731 - RNA, 18 nt, Homo sapiens
accauaggacuguggcaa

SEQ ID NO: 1137732 - RNA, 14 nt, Homo sapiens
accauauuugaauu

SEQ ID NO: 1137733 - RNA, 14 nt, Homo sapiens
accaucccaaagcc

SEQ ID NO: 1137734 - RNA, 17 nt, Homo sapiens
accaucgaucaugaugu

SEQ ID NO: 1137735 - RNA, 11 nt, Homo sapiens
accaucuccua

SEQ ID NO: 1137736 - RNA, 20 nt, Homo sapiens
accaucuggaauuccagucu

SEQ ID NO: 1137737 - RNA, 13 nt, Homo sapiens
accaucugugacu

SEQ ID NO: 1137738 - RNA, 14 nt, Homo sapiens
accaucugugacua

SEQ ID NO: 1137739 - RNA, 14 nt, Homo sapiens
accaugcccagcua

SEQ ID NO: 1137740 - RNA, 16 nt, Homo sapiens
accaugcuaauguuac

SEQ ID NO: 1137741 - RNA, 23 nt, Homo sapiens
accauggaguuaacaucaugaau

SEQ ID NO: 1137742 - RNA, 22 nt, Homo sapiens
accauggcaugguuauugauga

SEQ ID NO: 1137743 - RNA, 19 nt, Homo sapiens
accauggugagaaauugac

SEQ ID NO: 1137744 - RNA, 21 nt, Homo sapiens
accauuaacuccuccugagcu

SEQ ID NO: 1137745 - RNA, 15 nt, Homo sapiens
accauuccucaagau

SEQ ID NO: 1137746 - RNA, 21 nt, Homo sapiens
accauuuggucaggauuccug

SEQ ID NO: 1137747 - RNA, 13 nt, Homo sapiens
acccaaagccugu

SEQ ID NO: 1137748 - RNA, 20 nt, Homo sapiens
acccaaagccugucccagga

SEQ ID NO: 1137749 - RNA, 14 nt, Homo sapiens
acccaaaguaucag

SEQ ID NO: 1137750 - RNA, 13 nt, Homo sapiens
acccaaauccaag

SEQ ID NO: 1137751 - RNA, 17 nt, Homo sapiens
acccaagugccaagaca

SEQ ID NO: 1137752 - RNA, 19 nt, Homo sapiens
acccaaguugaagacuuug

SEQ ID NO: 1137753 - RNA, 21 nt, Homo sapiens
acccaauggaaaauauaauga

SEQ ID NO: 1137754 - RNA, 19 nt, Homo sapiens
acccaauuccacucugaua

SEQ ID NO: 1137755 - RNA, 23 nt, Homo sapiens
acccaauuccacucugauagaau

SEQ ID NO: 1137756 - RNA, 23 nt, Homo sapiens
acccacaugugacacauaugcac

SEQ ID NO: 1137757 - RNA, 16 nt, Homo sapiens
acccaccaaaaccaag

SEQ ID NO: 1137758 - RNA, 21 nt, Homo sapiens
acccaccuacuuagauauuuc

SEQ ID NO: 1137759 - RNA, 22 nt, Homo sapiens
acccagaggguggguguucaua

SEQ ID NO: 1137760 - RNA, 14 nt, Homo sapiens
acccagcucacagg

SEQ ID NO: 1137761 - RNA, 20 nt, Homo sapiens
acccaggaggggaacacugc

SEQ ID NO: 1137762 - RNA, 23 nt, Homo sapiens
acccaggcacugggcaagugaag

SEQ ID NO: 1137763 - RNA, 17 nt, Homo sapiens
acccagggccugcagga

SEQ ID NO: 1137764 - RNA, 23 nt, Homo sapiens
acccagggggcugaaacuugaac

SEQ ID NO: 1137765 - RNA, 19 nt, Homo sapiens
acccaggguggagugcagu

SEQ ID NO: 1137766 - RNA, 20 nt, Homo sapiens
acccaggguggagugcagug

SEQ ID NO: 1137767 - RNA, 17 nt, Homo sapiens
acccaguauuacugcug

SEQ ID NO: 1137768 - RNA, 18 nt, Homo sapiens
acccagucaccucugucu

SEQ ID NO: 1137769 - RNA, 20 nt, Homo sapiens
acccagugccuacagggcug

SEQ ID NO: 1137770 - RNA, 20 nt, Homo sapiens
acccagugcgugaagaccaa

SEQ ID NO: 1137771 - RNA, 19 nt, Homo sapiens
acccaguugugacaauuaa

SEQ ID NO: 1137772 - RNA, 21 nt, Homo sapiens
acccauaggcccacacacagg

SEQ ID NO: 1137773 - RNA, 19 nt, Homo sapiens
acccaugcaagcagaggac

SEQ ID NO: 1137774 - RNA, 17 nt, Homo sapiens
acccauucuacacagag

SEQ ID NO: 1137775 - RNA, 20 nt, Homo sapiens
acccauuugucucuacuuuu

SEQ ID NO: 1137776 - RNA, 15 nt, Homo sapiens
accccaacacuucca

SEQ ID NO: 1137777 - RNA, 12 nt, Homo sapiens
accccaacagca

SEQ ID NO: 1137778 - RNA, 21 nt, Homo sapiens
accccaagcggccuuuuccaa

SEQ ID NO: 1137779 - RNA, 19 nt, Homo sapiens
accccacaacgugcaacug

SEQ ID NO: 1137780 - RNA, 17 nt, Homo sapiens
accccacaccugcagug

SEQ ID NO: 1137781 - RNA, 20 nt, Homo sapiens
accccacaccugcagugcca

SEQ ID NO: 1137782 - RNA, 14 nt, Homo sapiens
accccaccgacuca

SEQ ID NO: 1137783 - RNA, 12 nt, Homo sapiens
accccacugcaa

SEQ ID NO: 1137784 - RNA, 19 nt, Homo sapiens
accccaggcccacucaggg

SEQ ID NO: 1137785 - RNA, 17 nt, Homo sapiens
accccaugcuguugauu

SEQ ID NO: 1137786 - RNA, 23 nt, Homo sapiens
accccaugcuguugauugcuaaa

SEQ ID NO: 1137787 - RNA, 23 nt, Homo sapiens
agaagacugugcggcacaggaaa

SEQ ID NO: 1137788 - RNA, 22 nt, Homo sapiens
agaagagacugcuacagugcau

SEQ ID NO: 1137789 - RNA, 13 nt, Homo sapiens
agaagagguguuu

SEQ ID NO: 1137790 - RNA, 15 nt, Homo sapiens
agaagauagauccaa

SEQ ID NO: 1137791 - RNA, 18 nt, Homo sapiens
agaagauucaaucacugu

SEQ ID NO: 1137792 - RNA, 11 nt, Homo sapiens
agaagcaaaau

SEQ ID NO: 1137793 - RNA, 12 nt, Homo sapiens
agaagcaauggg

SEQ ID NO: 1137794 - RNA, 14 nt, Homo sapiens
agaagccagagggu

SEQ ID NO: 1137795 - RNA, 24 nt, Homo sapiens
agaagccuaauugucacaucaagc

SEQ ID NO: 1137796 - RNA, 20 nt, Homo sapiens
agaagccugaugcugacauu

SEQ ID NO: 1137797 - RNA, 23 nt, Homo sapiens
agaagccugaugcugacauucac

SEQ ID NO: 1137798 - RNA, 12 nt, Homo sapiens
agaagcuuccau

SEQ ID NO: 1137799 - RNA, 16 nt, Homo sapiens
agaaggaggggagcag

SEQ ID NO: 1137800 - RNA, 23 nt, Homo sapiens
agaaggaguguaugagugugagu

SEQ ID NO: 1137801 - RNA, 20 nt, Homo sapiens
agaaggauguacauuuccaa

SEQ ID NO: 1137802 - RNA, 14 nt, Homo sapiens
agaaggcaaaaaug

SEQ ID NO: 1137803 - RNA, 17 nt, Homo sapiens
agaagggcuuacaggca

SEQ ID NO: 1137804 - RNA, 12 nt, Homo sapiens
agaaggggacaa

SEQ ID NO: 1137805 - RNA, 23 nt, Homo sapiens
agaaggggacaauggcagaacag

SEQ ID NO: 1137806 - RNA, 18 nt, Homo sapiens
agaaggugauaaauguca

SEQ ID NO: 1137807 - RNA, 13 nt, Homo sapiens
agaagguguucaa

SEQ ID NO: 1137808 - RNA, 22 nt, Homo sapiens
agaagguuggugaauuucacaa

SEQ ID NO: 1137809 - RNA, 19 nt, Homo sapiens
agaaguccccucuacuuua

SEQ ID NO: 1137810 - RNA, 23 nt, Homo sapiens
agaagucucuuaauucugaugcu

SEQ ID NO: 1137811 - RNA, 23 nt, Homo sapiens
agaaguggggaccccaccccuca

SEQ ID NO: 1137812 - RNA, 21 nt, Homo sapiens
agaaguuaaaccaugugacua

SEQ ID NO: 1137813 - RNA, 18 nt, Homo sapiens
agaaguugacaggcagug

SEQ ID NO: 1137814 - RNA, 22 nt, Homo sapiens
agaaguugacaggcagugccau

SEQ ID NO: 1137815 - RNA, 13 nt, Homo sapiens
agaaguugacaug

SEQ ID NO: 1137816 - RNA, 19 nt, Homo sapiens
agaauaaacacugguugua

SEQ ID NO: 1137817 - RNA, 19 nt, Homo sapiens
agaauacuuuuaauuucac

SEQ ID NO: 1137818 - RNA, 17 nt, Homo sapiens
agaauaucuagcaugua

SEQ ID NO: 1137819 - RNA, 21 nt, Homo sapiens
agaauauuuuaagaauuucac

SEQ ID NO: 1137820 - RNA, 14 nt, Homo sapiens
agaaucaaaaugca

SEQ ID NO: 1137821 - RNA, 14 nt, Homo sapiens
agaaucaacauuuc

SEQ ID NO: 1137822 - RNA, 12 nt, Homo sapiens
agaaucacuuga

SEQ ID NO: 1137823 - RNA, 16 nt, Homo sapiens
agaaucccccaaagaa

SEQ ID NO: 1137824 - RNA, 16 nt, Homo sapiens
agaauccccuccaucu

SEQ ID NO: 1137825 - RNA, 19 nt, Homo sapiens
agaauccccuucuccaaac

SEQ ID NO: 1137826 - RNA, 16 nt, Homo sapiens
agaaucuccacuacuu

SEQ ID NO: 1137827 - RNA, 21 nt, Homo sapiens
agaaucuccacuacuuaucca

SEQ ID NO: 1137828 - RNA, 18 nt, Homo sapiens
agaaucucuugaaccugg

SEQ ID NO: 1137829 - RNA, 16 nt, Homo sapiens
agaaugaaauguaugu

SEQ ID NO: 1137830 - RNA, 20 nt, Homo sapiens
agaaugaacacaaucacguu

SEQ ID NO: 1137831 - RNA, 15 nt, Homo sapiens
agaaugaaccacugc

SEQ ID NO: 1137832 - RNA, 16 nt, Homo sapiens
agaaugaacccauagg

SEQ ID NO: 1137833 - RNA, 14 nt, Homo sapiens
agaaugaggcugcu

SEQ ID NO: 1137834 - RNA, 14 nt, Homo sapiens
agaaugaguuauga

SEQ ID NO: 1137835 - RNA, 12 nt, Homo sapiens
agaaugcauuga

SEQ ID NO: 1137836 - RNA, 15 nt, Homo sapiens
agaaugccaggaaua

SEQ ID NO: 1137837 - RNA, 16 nt, Homo sapiens
agaaugguaaaauacc

SEQ ID NO: 1137838 - RNA, 20 nt, Homo sapiens
agaauguggagaacuaaagg

SEQ ID NO: 1137839 - RNA, 18 nt, Homo sapiens
agaaugugggauauuucc

SEQ ID NO: 1137840 - RNA, 18 nt, Homo sapiens
agaauuaaaaaagcauac

SEQ ID NO: 1137841 - RNA, 23 nt, Homo sapiens
agaauuaagcugugcaauuacug

SEQ ID NO: 1137842 - RNA, 13 nt, Homo sapiens
agaauuacuugug

SEQ ID NO: 1137843 - RNA, 19 nt, Homo sapiens
agaauuacuuguguuacuu

SEQ ID NO: 1137844 - RNA, 16 nt, Homo sapiens
agaggcccggugcagc

SEQ ID NO: 1137845 - RNA, 15 nt, Homo sapiens
agaggcuccagaaau

SEQ ID NO: 1137846 - RNA, 13 nt, Homo sapiens
agaggcucugaga

SEQ ID NO: 1137847 - RNA, 15 nt, Homo sapiens
agaggcugcacuugu

SEQ ID NO: 1137848 - RNA, 19 nt, Homo sapiens
agagggaagccaggauugg

SEQ ID NO: 1137849 - RNA, 19 nt, Homo sapiens
agagggagaagacugugcg

SEQ ID NO: 1137850 - RNA, 17 nt, Homo sapiens
agagggcugccuuugga

SEQ ID NO: 1137851 - RNA, 23 nt, Homo sapiens
agaggggccaaguguaggauugg

SEQ ID NO: 1137852 - RNA, 14 nt, Homo sapiens
agagggucacagug

SEQ ID NO: 1137853 - RNA, 20 nt, Homo sapiens
agaggugaauuaauggacag

SEQ ID NO: 1137854 - RNA, 23 nt, Homo sapiens
agaggugucacccaaaccggcag

SEQ ID NO: 1137855 - RNA, 21 nt, Homo sapiens
agaggugugugccuagugaug

SEQ ID NO: 1137856 - RNA, 22 nt, Homo sapiens
agaguacucacuuuucacuugu

SEQ ID NO: 1137857 - RNA, 23 nt, Homo sapiens
agaguauuaaugaaaagcacaaa

SEQ ID NO: 1137858 - RNA, 15 nt, Homo sapiens
agagucacaccuuag

SEQ ID NO: 1137859 - RNA, 16 nt, Homo sapiens
agagucccugccugga

SEQ ID NO: 1137860 - RNA, 13 nt, Homo sapiens
agagucuaaagau

SEQ ID NO: 1137861 - RNA, 16 nt, Homo sapiens
agagugaaggauuuau

SEQ ID NO: 1137862 - RNA, 16 nt, Homo sapiens
agagugacacccaaga

SEQ ID NO: 1137863 - RNA, 20 nt, Homo sapiens
agagugagacccugucucaa

SEQ ID NO: 1137864 - RNA, 19 nt, Homo sapiens
agagugagacuccaucuca

SEQ ID NO: 1137865 - RNA, 20 nt, Homo sapiens
agagugagagacauuaacuc

SEQ ID NO: 1137866 - RNA, 12 nt, Homo sapiens
agagugcaaugg

SEQ ID NO: 1137867 - RNA, 13 nt, Homo sapiens
agagugcaauggu

SEQ ID NO: 1137868 - RNA, 11 nt, Homo sapiens
agagugcagaa

SEQ ID NO: 1137869 - RNA, 14 nt, Homo sapiens
agagugcagaaagg

SEQ ID NO: 1137870 - RNA, 22 nt, Homo sapiens
agaguggccuagagcacucuca

SEQ ID NO: 1137871 - RNA, 15 nt, Homo sapiens
agaguguucccugac

SEQ ID NO: 1137872 - RNA, 21 nt, Homo sapiens
agaguuaaaauguuuacugua

SEQ ID NO: 1137873 - RNA, 14 nt, Homo sapiens
agaguuacacugga

SEQ ID NO: 1137874 - RNA, 12 nt, Homo sapiens
agaguugacaug

SEQ ID NO: 1137875 - RNA, 19 nt, Homo sapiens
agaguuggacuucuagacu

SEQ ID NO: 1137876 - RNA, 22 nt, Homo sapiens
agaguuggagugagaugaagga

SEQ ID NO: 1137877 - RNA, 18 nt, Homo sapiens
agaguuucaaaacauaca

SEQ ID NO: 1137878 - RNA, 24 nt, Homo sapiens
agaguuuccugaaacaacuuggaa

SEQ ID NO: 1137879 - RNA, 14 nt, Homo sapiens
agaguuuuaucaac

SEQ ID NO: 1137880 - RNA, 19 nt, Homo sapiens
agauaacuuccuucacauc

SEQ ID NO: 1137881 - RNA, 23 nt, Homo sapiens
agauaacuuccuucacaucuccc

SEQ ID NO: 1137882 - RNA, 15 nt, Homo sapiens
agauaauacauuccg

SEQ ID NO: 1137883 - RNA, 19 nt, Homo sapiens
agauaaucuuuuacauuga

SEQ ID NO: 1137884 - RNA, 20 nt, Homo sapiens
agauaauugaauaaguaccu

SEQ ID NO: 1137885 - RNA, 18 nt, Homo sapiens
agauacagggaugaggca

SEQ ID NO: 1137886 - RNA, 20 nt, Homo sapiens
agauacauuuuuagaaauca

SEQ ID NO: 1137887 - RNA, 18 nt, Homo sapiens
agauaccucucagugugu

SEQ ID NO: 1137888 - RNA, 15 nt, Homo sapiens
agauagaaagcauua

SEQ ID NO: 1137889 - RNA, 16 nt, Homo sapiens
agauagaaagcauuac

SEQ ID NO: 1137890 - RNA, 20 nt, Homo sapiens
agauagaauucaauuugaac

SEQ ID NO: 1137891 - RNA, 20 nt, Homo sapiens
agauagauaggucagugcaa

SEQ ID NO: 1137892 - RNA, 13 nt, Homo sapiens
agauagcccuaaa

SEQ ID NO: 1137893 - RNA, 14 nt, Homo sapiens
agauaggcucucag

SEQ ID NO: 1137894 - RNA, 23 nt, Homo sapiens
agauaguggggagacuucuuggc

SEQ ID NO: 1137895 - RNA, 14 nt, Homo sapiens
agauaguucauuca

SEQ ID NO: 1137896 - RNA, 21 nt, Homo sapiens
agauauacuugguucucucca

SEQ ID NO: 1137897 - RNA, 13 nt, Homo sapiens
agauaugugccaa

SEQ ID NO: 1137898 - RNA, 17 nt, Homo sapiens
agauauuaaauucucaa

SEQ ID NO: 1137899 - RNA, 17 nt, Homo sapiens
agauauuggacaaagaa

SEQ ID NO: 1137900 - RNA, 22 nt, Homo sapiens
agauauugugaggacaaauuga

SEQ ID NO: 1137901 - RNA, 16 nt, Homo sapiens
agauauuucaugugcu

SEQ ID NO: 1137902 - RNA, 17 nt, Homo sapiens
agauauuuuuagaauuu

SEQ ID NO: 1137903 - RNA, 22 nt, Homo sapiens
agaucaaugaaaugaugucaua

SEQ ID NO: 1137904 - RNA, 13 nt, Homo sapiens
agaucaguuauuc

SEQ ID NO: 1137905 - RNA, 16 nt, Homo sapiens
agaucauaaacuucag

SEQ ID NO: 1137906 - RNA, 11 nt, Homo sapiens
agaucaugcca

SEQ ID NO: 1137907 - RNA, 15 nt, Homo sapiens
agaucauucaguguu

SEQ ID NO: 1137908 - RNA, 13 nt, Homo sapiens
agauccagcuuuu

SEQ ID NO: 1137909 - RNA, 19 nt, Homo sapiens
agauccccccacaaagugg

SEQ ID NO: 1137910 - RNA, 16 nt, Homo sapiens
agauccccguguuacu

SEQ ID NO: 1137911 - RNA, 20 nt, Homo sapiens
agaucggauccaguuuccca

SEQ ID NO: 1137912 - RNA, 21 nt, Homo sapiens
agaucgugccauugcacucca

SEQ ID NO: 1137913 - RNA, 18 nt, Homo sapiens
agaucucuccugcaaaag

SEQ ID NO: 1137914 - RNA, 15 nt, Homo sapiens
agaucugaguugaga

SEQ ID NO: 1137915 - RNA, 16 nt, Homo sapiens
agaucuugaugguguu

SEQ ID NO: 1137916 - RNA, 21 nt, Homo sapiens
agaucuuuucuugaccuagua

SEQ ID NO: 1137917 - RNA, 22 nt, Homo sapiens
agaugaaggaaggacuaugaca

SEQ ID NO: 1137918 - RNA, 17 nt, Homo sapiens
agaugaccugccuuauc

SEQ ID NO: 1137919 - RNA, 18 nt, Homo sapiens
agaugaggcuuuccaugg

SEQ ID NO: 1137920 - RNA, 15 nt, Homo sapiens
agaugauacauccaa

SEQ ID NO: 1137921 - RNA, 13 nt, Homo sapiens
aagagcuaauaaa

SEQ ID NO: 1137922 - RNA, 17 nt, Homo sapiens
aagagcucaagggacaa

SEQ ID NO: 1137923 - RNA, 22 nt, Homo sapiens
aagagcugggaucccacagccc

SEQ ID NO: 1137924 - RNA, 16 nt, Homo sapiens
aagaggaaagaaugaa

SEQ ID NO: 1137925 - RNA, 12 nt, Homo sapiens
aagaggcuggau

SEQ ID NO: 1137926 - RNA, 20 nt, Homo sapiens
aagagggcauauacagugaa

SEQ ID NO: 1137927 - RNA, 19 nt, Homo sapiens
aagagucuacccgacauaa

SEQ ID NO: 1137928 - RNA, 16 nt, Homo sapiens
aagagucucuaaugag

SEQ ID NO: 1137929 - RNA, 21 nt, Homo sapiens
aagagucugugcugguugcca

SEQ ID NO: 1137930 - RNA, 22 nt, Homo sapiens
aagaguggguuucacaagugaa

SEQ ID NO: 1137931 - RNA, 18 nt, Homo sapiens
aagaguuggagugagaug

SEQ ID NO: 1137932 - RNA, 21 nt, Homo sapiens
aagaguuugccuguacucuua

SEQ ID NO: 1137933 - RNA, 17 nt, Homo sapiens
aagauacagaacucuuu

SEQ ID NO: 1137934 - RNA, 22 nt, Homo sapiens
aagaucuaccugcaacacaaca

SEQ ID NO: 1137935 - RNA, 14 nt, Homo sapiens
aagaucucaguggu

SEQ ID NO: 1137936 - RNA, 18 nt, Homo sapiens
aagaucuguccucagccu

SEQ ID NO: 1137937 - RNA, 20 nt, Homo sapiens
aagaucuguuuugaaggcaa

SEQ ID NO: 1137938 - RNA, 14 nt, Homo sapiens
aagaugaucagugg

SEQ ID NO: 1137939 - RNA, 18 nt, Homo sapiens
aagaugcaacuaggaaga

SEQ ID NO: 1137940 - RNA, 16 nt, Homo sapiens
aagauggaaagaacca

SEQ ID NO: 1137941 - RNA, 18 nt, Homo sapiens
aagauggcauccugugaa

SEQ ID NO: 1137942 - RNA, 19 nt, Homo sapiens
aagauggcauccugugaag

SEQ ID NO: 1137943 - RNA, 20 nt, Homo sapiens
aagauggcuaggccaucacc

SEQ ID NO: 1137944 - RNA, 22 nt, Homo sapiens
aagaugguauauuugguacugu

SEQ ID NO: 1137945 - RNA, 20 nt, Homo sapiens
aagaugugauauucuaagac

SEQ ID NO: 1137946 - RNA, 18 nt, Homo sapiens
aagauuaugaugaguaaa

SEQ ID NO: 1137947 - RNA, 23 nt, Homo sapiens
aagauucaguuuucccacuuuuu

SEQ ID NO: 1137948 - RNA, 20 nt, Homo sapiens
aagauucuauaguucuagac

SEQ ID NO: 1137949 - RNA, 15 nt, Homo sapiens
aagauugaaauucca

SEQ ID NO: 1137950 - RNA, 19 nt, Homo sapiens
aagauugaagccuuugcca

SEQ ID NO: 1137951 - RNA, 16 nt, Homo sapiens
aagauuuaagugcaua

SEQ ID NO: 1137952 - RNA, 14 nt, Homo sapiens
aagauuucucuuaa

SEQ ID NO: 1137953 - RNA, 19 nt, Homo sapiens
aagauuuugggagaguaaa

SEQ ID NO: 1137954 - RNA, 23 nt, Homo sapiens
aagcaaauagaucaugcauuuaa

SEQ ID NO: 1137955 - RNA, 15 nt, Homo sapiens
aagcaacguguuaau

SEQ ID NO: 1137956 - RNA, 15 nt, Homo sapiens
aagcaacuugcuucu

SEQ ID NO: 1137957 - RNA, 18 nt, Homo sapiens
aagcaacuugcuucuaaa

SEQ ID NO: 1137958 - RNA, 23 nt, Homo sapiens
aagcaaggcacaagucauaccua

SEQ ID NO: 1137959 - RNA, 17 nt, Homo sapiens
aagcaaguuuucuucca

SEQ ID NO: 1137960 - RNA, 18 nt, Homo sapiens
aagcaaguuuucuuccau

SEQ ID NO: 1137961 - RNA, 22 nt, Homo sapiens
aagcaaucagcaaacacaauaa

SEQ ID NO: 1137962 - RNA, 18 nt, Homo sapiens
aagcaccucuccugugag

SEQ ID NO: 1137963 - RNA, 12 nt, Homo sapiens
aagcacuugugg

SEQ ID NO: 1137964 - RNA, 20 nt, Homo sapiens
aagcacuuuauauuuuccuc

SEQ ID NO: 1137965 - RNA, 21 nt, Homo sapiens
aagcacuuuuucugcauacuu

SEQ ID NO: 1137966 - RNA, 18 nt, Homo sapiens
aagcagaacuuccaaaga

SEQ ID NO: 1137967 - RNA, 13 nt, Homo sapiens
aagcagaauuuaa

SEQ ID NO: 1137968 - RNA, 16 nt, Homo sapiens
aagcagagagcacagc

SEQ ID NO: 1137969 - RNA, 18 nt, Homo sapiens
aagcagaguucuuugcaa

SEQ ID NO: 1137970 - RNA, 18 nt, Homo sapiens
aagcagccaagcuccuug

SEQ ID NO: 1137971 - RNA, 21 nt, Homo sapiens
aagcagccacgaggugcaaca

SEQ ID NO: 1137972 - RNA, 19 nt, Homo sapiens
acuccucucgcauggugug

SEQ ID NO: 1137973 - RNA, 19 nt, Homo sapiens
acuccucuuaauguuucca

SEQ ID NO: 1137974 - RNA, 19 nt, Homo sapiens
acuccugaaggucuggguc

SEQ ID NO: 1137975 - RNA, 23 nt, Homo sapiens
acuccugaaggucugggucucag

SEQ ID NO: 1137976 - RNA, 14 nt, Homo sapiens
acuccugacuucag

SEQ ID NO: 1137977 - RNA, 13 nt, Homo sapiens
acuccuuccauca

SEQ ID NO: 1137978 - RNA, 11 nt, Homo sapiens
acuccuugcau

SEQ ID NO: 1137979 - RNA, 17 nt, Homo sapiens
acuccuuucagccacau

SEQ ID NO: 1137980 - RNA, 23 nt, Homo sapiens
acucggcccagggccgucaagga

SEQ ID NO: 1137981 - RNA, 20 nt, Homo sapiens
acucgggaggcugaggcaca

SEQ ID NO: 1137982 - RNA, 21 nt, Homo sapiens
acucgggaggcugaggcacaa

SEQ ID NO: 1137983 - RNA, 21 nt, Homo sapiens
acucgucuguucugaugccac

SEQ ID NO: 1137984 - RNA, 15 nt, Homo sapiens
acucgugucuggcac

SEQ ID NO: 1137985 - RNA, 21 nt, Homo sapiens
acucuagaugaaguuuuacau

SEQ ID NO: 1137986 - RNA, 18 nt, Homo sapiens
acucuaggcagugacagu

SEQ ID NO: 1137987 - RNA, 13 nt, Homo sapiens
acucuaucaaaug

SEQ ID NO: 1137988 - RNA, 19 nt, Homo sapiens
acucuaucggagaacauga

SEQ ID NO: 1137989 - RNA, 20 nt, Homo sapiens
acucucccuuguacagccuu

SEQ ID NO: 1137990 - RNA, 11 nt, Homo sapiens
acucugacccc

SEQ ID NO: 1137991 - RNA, 19 nt, Homo sapiens
acucugcggauagcauuug

SEQ ID NO: 1137992 - RNA, 17 nt, Homo sapiens
acucuggagcaaccuac

SEQ ID NO: 1137993 - RNA, 16 nt, Homo sapiens
acucuggccuccaaaa

SEQ ID NO: 1137994 - RNA, 14 nt, Homo sapiens
acucugggcuccag

SEQ ID NO: 1137995 - RNA, 14 nt, Homo sapiens
acucugguggcaca

SEQ ID NO: 1137996 - RNA, 21 nt, Homo sapiens
acucugucuuguucacugcag

SEQ ID NO: 1137997 - RNA, 14 nt, Homo sapiens
acucuguugaauau

SEQ ID NO: 1137998 - RNA, 22 nt, Homo sapiens
acucuguugaauauuuagcaua

SEQ ID NO: 1137999 - RNA, 13 nt, Homo sapiens
acucuuaagccau

SEQ ID NO: 1138000 - RNA, 14 nt, Homo sapiens
acucuuaagccauc

SEQ ID NO: 1138001 - RNA, 16 nt, Homo sapiens
acucuuaagccaucuu

SEQ ID NO: 1138002 - RNA, 13 nt, Homo sapiens
acucuucccacau

SEQ ID NO: 1138003 - RNA, 14 nt, Homo sapiens
acucuucuaaaaau

SEQ ID NO: 1138004 - RNA, 15 nt, Homo sapiens
acucuucugaauuga

SEQ ID NO: 1138005 - RNA, 16 nt, Homo sapiens
acucuugaacugggcg

SEQ ID NO: 1138006 - RNA, 15 nt, Homo sapiens
acucuugcaauccac

SEQ ID NO: 1138007 - RNA, 13 nt, Homo sapiens
acugaaaagccau

SEQ ID NO: 1138008 - RNA, 14 nt, Homo sapiens
acugaaaagccaug

SEQ ID NO: 1138009 - RNA, 15 nt, Homo sapiens
acugaaaagccaugu

SEQ ID NO: 1138010 - RNA, 12 nt, Homo sapiens
acugaaccaaau

SEQ ID NO: 1138011 - RNA, 17 nt, Homo sapiens
acugaacuuacacugua

SEQ ID NO: 1138012 - RNA, 19 nt, Homo sapiens
acugaacuuacacuguaua

SEQ ID NO: 1138013 - RNA, 19 nt, Homo sapiens
acugaagcgaacaucuuca

SEQ ID NO: 1138014 - RNA, 19 nt, Homo sapiens
acugaaugaaacccccaca

SEQ ID NO: 1138015 - RNA, 16 nt, Homo sapiens
acugaauugacaugac

SEQ ID NO: 1138016 - RNA, 12 nt, Homo sapiens
acugaccaaauu

SEQ ID NO: 1138017 - RNA, 13 nt, Homo sapiens
acugagacuugaa

SEQ ID NO: 1138018 - RNA, 23 nt, Homo sapiens
acugagcucugccucaacuccac

SEQ ID NO: 1138019 - RNA, 23 nt, Homo sapiens
acugaggccuugugugucaggcc

SEQ ID NO: 1138020 - RNA, 18 nt, Homo sapiens
acugagucuggcaaacau

SEQ ID NO: 1138021 - RNA, 15 nt, Homo sapiens
acugauagaugucua

SEQ ID NO: 1138022 - RNA, 15 nt, Homo sapiens
acugaucaucugcug

SEQ ID NO: 1138023 - RNA, 22 nt, Homo sapiens
acugauccagcccugaguuccu

SEQ ID NO: 1138024 - RNA, 22 nt, Homo sapiens
acugaucucaaguauaugucau

SEQ ID NO: 1138025 - RNA, 14 nt, Homo sapiens
acugauuuaucuau

SEQ ID NO: 1138026 - RNA, 16 nt, Homo sapiens
acugauuucaaaucau

SEQ ID NO: 1138027 - RNA, 18 nt, Homo sapiens
acugauuuuacaaauuaa

SEQ ID NO: 1138028 - RNA, 16 nt, Homo sapiens
acugcaaaccauggug

SEQ ID NO: 1138029 - RNA, 12 nt, Homo sapiens
acugcaaccucc

SEQ ID NO: 1138030 - RNA, 21 nt, Homo sapiens
agcagaguguucccugacucc

SEQ ID NO: 1138031 - RNA, 18 nt, Homo sapiens
agcagaucucauguccuc

SEQ ID NO: 1138032 - RNA, 21 nt, Homo sapiens
agcagcaccguucugugcaca

SEQ ID NO: 1138033 - RNA, 15 nt, Homo sapiens
agcagcccuggcucu

SEQ ID NO: 1138034 - RNA, 23 nt, Homo sapiens
agcagcccuucccccagugcccu

SEQ ID NO: 1138035 - RNA, 18 nt, Homo sapiens
agcagccuaacacggugc

SEQ ID NO: 1138036 - RNA, 22 nt, Homo sapiens
agcagcuaaaaccuacucacuu

SEQ ID NO: 1138037 - RNA, 15 nt, Homo sapiens
agcagcugcagcuca

SEQ ID NO: 1138038 - RNA, 13 nt, Homo sapiens
agcaggacuccag

SEQ ID NO: 1138039 - RNA, 17 nt, Homo sapiens
agcaggcuugugcuuua

SEQ ID NO: 1138040 - RNA, 16 nt, Homo sapiens
agcagggacugugaac

SEQ ID NO: 1138041 - RNA, 15 nt, Homo sapiens
agcagguaacuagcu

SEQ ID NO: 1138042 - RNA, 16 nt, Homo sapiens
agcaguagcaaacuuu

SEQ ID NO: 1138043 - RNA, 13 nt, Homo sapiens
agcaguagcauca

SEQ ID NO: 1138044 - RNA, 20 nt, Homo sapiens
agcagugaaugauucagugu

SEQ ID NO: 1138045 - RNA, 20 nt, Homo sapiens
agcagugcacaucugaccca

SEQ ID NO: 1138046 - RNA, 13 nt, Homo sapiens
agcagugccuugu

SEQ ID NO: 1138047 - RNA, 20 nt, Homo sapiens
agcaguggcuuagcugccau

SEQ ID NO: 1138048 - RNA, 14 nt, Homo sapiens
agcaguuacuguga

SEQ ID NO: 1138049 - RNA, 13 nt, Homo sapiens
agcaguugacuca

SEQ ID NO: 1138050 - RNA, 15 nt, Homo sapiens
agcaucaauuccauc

SEQ ID NO: 1138051 - RNA, 14 nt, Homo sapiens
agcauccucuuuaa

SEQ ID NO: 1138052 - RNA, 19 nt, Homo sapiens
agcaucuccagcauucuca

SEQ ID NO: 1138053 - RNA, 23 nt, Homo sapiens
agcaucuccagcauucucagcca

SEQ ID NO: 1138054 - RNA, 12 nt, Homo sapiens
agcaucugacca

SEQ ID NO: 1138055 - RNA, 13 nt, Homo sapiens
agcaucugaccau

SEQ ID NO: 1138056 - RNA, 15 nt, Homo sapiens
agcauggacagugug

SEQ ID NO: 1138057 - RNA, 14 nt, Homo sapiens
agcauggcacuccc

SEQ ID NO: 1138058 - RNA, 21 nt, Homo sapiens
agcaugugaugggcuguuuaa

SEQ ID NO: 1138059 - RNA, 23 nt, Homo sapiens
agcauuagauuccuuuccugugu

SEQ ID NO: 1138060 - RNA, 17 nt, Homo sapiens
agcauuuagacccugca

SEQ ID NO: 1138061 - RNA, 14 nt, Homo sapiens
agcauuuugcuaag

SEQ ID NO: 1138062 - RNA, 16 nt, Homo sapiens
agccaaagcagaauuu

SEQ ID NO: 1138063 - RNA, 16 nt, Homo sapiens
agccaagaaacacugc

SEQ ID NO: 1138064 - RNA, 13 nt, Homo sapiens
agccaagcacagu

SEQ ID NO: 1138065 - RNA, 13 nt, Homo sapiens
agccacaguaugg

SEQ ID NO: 1138066 - RNA, 24 nt, Homo sapiens
agccacaguuuccucaucugucca

SEQ ID NO: 1138067 - RNA, 12 nt, Homo sapiens
agccacaugccc

SEQ ID NO: 1138068 - RNA, 23 nt, Homo sapiens
agccaccgcgcccagccucaucu

SEQ ID NO: 1138069 - RNA, 14 nt, Homo sapiens
agccacuaagcaga

SEQ ID NO: 1138070 - RNA, 21 nt, Homo sapiens
agccacuacauuacuucaaac

SEQ ID NO: 1138071 - RNA, 11 nt, Homo sapiens
agccacuggaa

SEQ ID NO: 1138072 - RNA, 13 nt, Homo sapiens
agccacugugcuu

SEQ ID NO: 1138073 - RNA, 13 nt, Homo sapiens
agccagaacuuga

SEQ ID NO: 1138074 - RNA, 14 nt, Homo sapiens
agccagaacuugac

SEQ ID NO: 1138075 - RNA, 14 nt, Homo sapiens
agccagaagcugag

SEQ ID NO: 1138076 - RNA, 17 nt, Homo sapiens
agccagaggcaccucaa

SEQ ID NO: 1138077 - RNA, 22 nt, Homo sapiens
agccagaguuggauaagccaau

SEQ ID NO: 1138078 - RNA, 19 nt, Homo sapiens
agccagccaacccuuucau

SEQ ID NO: 1138079 - RNA, 21 nt, Homo sapiens
agccagccaucaaauagugaa

SEQ ID NO: 1138080 - RNA, 16 nt, Homo sapiens
agccagccuugcuccu

SEQ ID NO: 1138081 - RNA, 15 nt, Homo sapiens
agccaggaaagaaga

SEQ ID NO: 1138082 - RNA, 14 nt, Homo sapiens
agccaggaccugcc

SEQ ID NO: 1138083 - RNA, 15 nt, Homo sapiens
agccagguaauguga

SEQ ID NO: 1138084 - RNA, 15 nt, Homo sapiens
agccagucaucaucu

SEQ ID NO: 1138085 - RNA, 18 nt, Homo sapiens
agccagugagguucuuaa

SEQ ID NO: 1138086 - RNA, 16 nt, Homo sapiens
agccaguggugcuaaa

SEQ ID NO: 1138087 - RNA, 23 nt, Homo sapiens
agccaguguggucaguauuccaa

SEQ ID NO: 1138088 - RNA, 16 nt, Homo sapiens
agccauaggugcaguu

SEQ ID NO: 1138089 - RNA, 23 nt, Homo sapiens
agccauaggugcaguuugcuucu

SEQ ID NO: 1138090 - RNA, 16 nt, Homo sapiens
agccaucaagagacug

SEQ ID NO: 1138091 - RNA, 16 nt, Homo sapiens
agccaucaagcacuuc

SEQ ID NO: 1138092 - RNA, 15 nt, Homo sapiens
agccaucuugguaaa

SEQ ID NO: 1138093 - RNA, 15 nt, Homo sapiens
agccaugaagggaug

SEQ ID NO: 1138094 - RNA, 17 nt, Homo sapiens
agccaugcaaugccaaa

SEQ ID NO: 1138095 - RNA, 15 nt, Homo sapiens
agccauggcccuccc

SEQ ID NO: 1138096 - RNA, 14 nt, Homo sapiens
agccauggggagca

SEQ ID NO: 1138097 - RNA, 15 nt, Homo sapiens
agccauggggagcaa

SEQ ID NO: 1138098 - RNA, 21 nt, Homo sapiens
agccauguccugcugcuucug

SEQ ID NO: 1138099 - RNA, 16 nt, Homo sapiens
agccaugucugugcug

SEQ ID NO: 1138100 - RNA, 11 nt, Homo sapiens
agccauugcac

SEQ ID NO: 1138101 - RNA, 12 nt, Homo sapiens
agccauugcacc

SEQ ID NO: 1138102 - RNA, 15 nt, Homo sapiens
agcccaacagcacuu

SEQ ID NO: 1138103 - RNA, 16 nt, Homo sapiens
agcccaacagcacuuu

SEQ ID NO: 1138104 - RNA, 17 nt, Homo sapiens
agcccaacagcacuuuu

SEQ ID NO: 1138105 - RNA, 14 nt, Homo sapiens
agcccaauccaggu

SEQ ID NO: 1138106 - RNA, 13 nt, Homo sapiens
agcccacauccca

SEQ ID NO: 1138107 - RNA, 18 nt, Homo sapiens
agcccagaaagucucuca

SEQ ID NO: 1138108 - RNA, 20 nt, Homo sapiens
agcccagagacauacuugaa

SEQ ID NO: 1138109 - RNA, 16 nt, Homo sapiens
agcccagagaccuuca

SEQ ID NO: 1138110 - RNA, 17 nt, Homo sapiens
agcccagauugugccac

SEQ ID NO: 1138111 - RNA, 19 nt, Homo sapiens
agcccagauugugccacug

SEQ ID NO: 1138112 - RNA, 20 nt, Homo sapiens
agcccaggcuggagugcaau

SEQ ID NO: 1138113 - RNA, 22 nt, Homo sapiens
agcccaugggacaaauugcaca

SEQ ID NO: 1138114 - RNA, 16 nt, Homo sapiens
agccccacucacccac

SEQ ID NO: 1138115 - RNA, 15 nt, Homo sapiens
agccccucacacagc

SEQ ID NO: 1138116 - RNA, 17 nt, Homo sapiens
agccccugggguggcca

SEQ ID NO: 1138117 - RNA, 16 nt, Homo sapiens
agcccucccuaccuac

SEQ ID NO: 1138118 - RNA, 14 nt, Homo sapiens
agcccugacccugu

SEQ ID NO: 1138119 - RNA, 18 nt, Homo sapiens
agcccugaguuccuagcc

SEQ ID NO: 1138120 - RNA, 18 nt, Homo sapiens
agcccugcuaaauaauga

SEQ ID NO: 1138121 - RNA, 16 nt, Homo sapiens
agcccuggaccugccu

SEQ ID NO: 1138122 - RNA, 19 nt, Homo sapiens
agcccuggcccccugaguu

SEQ ID NO: 1138123 - RNA, 14 nt, Homo sapiens
agcccuggcucuca

SEQ ID NO: 1138124 - RNA, 16 nt, Homo sapiens
agcccuguugugccac

SEQ ID NO: 1138125 - RNA, 17 nt, Homo sapiens
agccgagcggggagcca

SEQ ID NO: 1138126 - RNA, 20 nt, Homo sapiens
agccgagcggggagccagga

SEQ ID NO: 1138127 - RNA, 21 nt, Homo sapiens
agccgagcggggagccaggaa

SEQ ID NO: 1138128 - RNA, 16 nt, Homo sapiens
agccggacacuucuca

SEQ ID NO: 1138129 - RNA, 20 nt, Homo sapiens
agccggagccuccagcugcc

SEQ ID NO: 1138130 - RNA, 20 nt, Homo sapiens
agccggcugcggcacugugc

SEQ ID NO: 1138131 - RNA, 21 nt, Homo sapiens
agccgggauggucuugaucuc

SEQ ID NO: 1138132 - RNA, 18 nt, Homo sapiens
agccgggcacaguggcgc

SEQ ID NO: 1138133 - RNA, 18 nt, Homo sapiens
agccgggcaugauggugc

SEQ ID NO: 1138134 - RNA, 17 nt, Homo sapiens
agccgggcaugguggca

SEQ ID NO: 1138135 - RNA, 23 nt, Homo sapiens
agccggggaagagauccaaagac

SEQ ID NO: 1138136 - RNA, 16 nt, Homo sapiens
agccuaacuccauccc

SEQ ID NO: 1138137 - RNA, 22 nt, Homo sapiens
agccuaugaggggguuuggcac

SEQ ID NO: 1138138 - RNA, 23 nt, Homo sapiens
agccuauguaugccauggaggca

SEQ ID NO: 1138139 - RNA, 20 nt, Homo sapiens
agccucagaagaaaacaaag

SEQ ID NO: 1138140 - RNA, 12 nt, Homo sapiens
agccucagcuca

SEQ ID NO: 1138141 - RNA, 21 nt, Homo sapiens
agccucugacuuaagcugccu

SEQ ID NO: 1138142 - RNA, 23 nt, Homo sapiens
agccucugaucuggcagacucau

SEQ ID NO: 1138143 - RNA, 23 nt, Homo sapiens
agccucugcagucgcuugccaaa

SEQ ID NO: 1138144 - RNA, 11 nt, Homo sapiens
agccucuuguu

SEQ ID NO: 1138145 - RNA, 21 nt, Homo sapiens
agccucuuuguuccagaagcu

SEQ ID NO: 1138146 - RNA, 20 nt, Homo sapiens
agccugaauaaaccaagaca

SEQ ID NO: 1138147 - RNA, 12 nt, Homo sapiens
agccugcacagu

SEQ ID NO: 1138148 - RNA, 16 nt, Homo sapiens
agccugcagucacugg

SEQ ID NO: 1138149 - RNA, 22 nt, Homo sapiens
agccugccuggcaggcugucug

SEQ ID NO: 1138150 - RNA, 12 nt, Homo sapiens
agccugccuuuc

SEQ ID NO: 1138151 - RNA, 14 nt, Homo sapiens
agccuggccagaca

SEQ ID NO: 1138152 - RNA, 20 nt, Homo sapiens
agccugggcaacaagagcaa

SEQ ID NO: 1138153 - RNA, 14 nt, Homo sapiens
agccugggugacaa

SEQ ID NO: 1138154 - RNA, 12 nt, Homo sapiens
agccugguggga

SEQ ID NO: 1138155 - RNA, 22 nt, Homo sapiens
agccugucagccaacauugccu

SEQ ID NO: 1138156 - RNA, 21 nt, Homo sapiens
agccugucucuccuuguugcc

SEQ ID NO: 1138157 - RNA, 22 nt, Homo sapiens
agccugucucuccuuguugccc

SEQ ID NO: 1138158 - RNA, 22 nt, Homo sapiens
agccugugcauguaugucuugg

SEQ ID NO: 1138159 - RNA, 19 nt, Homo sapiens
agccuuaaagauacuugaa

SEQ ID NO: 1138160 - RNA, 15 nt, Homo sapiens
agccuuauuucucau

SEQ ID NO: 1138161 - RNA, 16 nt, Homo sapiens
agccuugaaaacaaac

SEQ ID NO: 1138162 - RNA, 16 nt, Homo sapiens
agccuugcugccaagu

SEQ ID NO: 1138163 - RNA, 22 nt, Homo sapiens
agccuugggggggcugccuuug

SEQ ID NO: 1138164 - RNA, 23 nt, Homo sapiens
agccuugguuggaccuauugcca

SEQ ID NO: 1138165 - RNA, 12 nt, Homo sapiens
agccuuugcacu

SEQ ID NO: 1138166 - RNA, 12 nt, Homo sapiens
agccuuugccag

SEQ ID NO: 1138167 - RNA, 15 nt, Homo sapiens
agccuuuuaacugug

SEQ ID NO: 1138168 - RNA, 13 nt, Homo sapiens
agcgaccacugca

SEQ ID NO: 1138169 - RNA, 16 nt, Homo sapiens
agcgagacuccaucuc

SEQ ID NO: 1138170 - RNA, 16 nt, Homo sapiens
agcgagccacaggaac

SEQ ID NO: 1138171 - RNA, 15 nt, Homo sapiens
agcgagucccuuugc

SEQ ID NO: 1138172 - RNA, 18 nt, Homo sapiens
agcgccaggcugaccaca

SEQ ID NO: 1138173 - RNA, 23 nt, Homo sapiens
agcgcgcgcgcccucuggcugcu

SEQ ID NO: 1138174 - RNA, 15 nt, Homo sapiens
agcgcuagugccuug

SEQ ID NO: 1138175 - RNA, 17 nt, Homo sapiens
agcgggggccuugaaga

SEQ ID NO: 1138176 - RNA, 17 nt, Homo sapiens
aaaaaaaucaguguuua

SEQ ID NO: 1138177 - RNA, 13 nt, Homo sapiens
aaaaaacuauuaa

SEQ ID NO: 1138178 - RNA, 12 nt, Homo sapiens
aaaaaacuucca

SEQ ID NO: 1138179 - RNA, 13 nt, Homo sapiens
aaaaaagaacaca

SEQ ID NO: 1138180 - RNA, 14 nt, Homo sapiens
aaaaaagcaugcau

SEQ ID NO: 1138181 - RNA, 20 nt, Homo sapiens
aaaaaaguuuguuacuuuga

SEQ ID NO: 1138182 - RNA, 13 nt, Homo sapiens
aaaaacaauucca

SEQ ID NO: 1138183 - RNA, 15 nt, Homo sapiens
aaaaacaggucuuca

SEQ ID NO: 1138184 - RNA, 12 nt, Homo sapiens
aaaaaccaaagu

SEQ ID NO: 1138185 - RNA, 19 nt, Homo sapiens
aaaaaccaaaguacuuuug

SEQ ID NO: 1138186 - RNA, 18 nt, Homo sapiens
aaaaacuccccuuccuca

SEQ ID NO: 1138187 - RNA, 19 nt, Homo sapiens
aaaaacuggcaacauucca

SEQ ID NO: 1138188 - RNA, 17 nt, Homo sapiens
aaaaagaaauuaucuuu

SEQ ID NO: 1138189 - RNA, 14 nt, Homo sapiens
aaaaagacagggcu

SEQ ID NO: 1138190 - RNA, 19 nt, Homo sapiens
aaaaagaccuaugagcaca

SEQ ID NO: 1138191 - RNA, 17 nt, Homo sapiens
aaaaagagccuuacuuu

SEQ ID NO: 1138192 - RNA, 18 nt, Homo sapiens
aaaaagaguuacacugga

SEQ ID NO: 1138193 - RNA, 13 nt, Homo sapiens
aaaaagcauacuu

SEQ ID NO: 1138194 - RNA, 21 nt, Homo sapiens
aaaaagugaaaacaauguaag

SEQ ID NO: 1138195 - RNA, 15 nt, Homo sapiens
aaaaauagacacucc

SEQ ID NO: 1138196 - RNA, 15 nt, Homo sapiens
aaaaauaucuuugca

SEQ ID NO: 1138197 - RNA, 22 nt, Homo sapiens
aaaaauauguaccaagaaucuu

SEQ ID NO: 1138198 - RNA, 16 nt, Homo sapiens
aaaaaucaaguuuaau

SEQ ID NO: 1138199 - RNA, 16 nt, Homo sapiens
aaaaaucguccaggga

SEQ ID NO: 1138200 - RNA, 18 nt, Homo sapiens
aaaaaucugcaaaagauc

SEQ ID NO: 1138201 - RNA, 15 nt, Homo sapiens
aaaaaugaaguuuau

SEQ ID NO: 1138202 - RNA, 23 nt, Homo sapiens
aaaaaugcguaagaccaagcugu

SEQ ID NO: 1138203 - RNA, 15 nt, Homo sapiens
aaaaaugggaaaaau

SEQ ID NO: 1138204 - RNA, 20 nt, Homo sapiens
aaaaauguauuuuuccuaaa

SEQ ID NO: 1138205 - RNA, 15 nt, Homo sapiens
aaaaauguccugccu

SEQ ID NO: 1138206 - RNA, 17 nt, Homo sapiens
aaaaauuaaacuaaaga

SEQ ID NO: 1138207 - RNA, 21 nt, Homo sapiens
aaaaauugucuucauguacau

SEQ ID NO: 1138208 - RNA, 14 nt, Homo sapiens
aaaaauuuacuuga

SEQ ID NO: 1138209 - RNA, 18 nt, Homo sapiens
aaaacaaaaaaaacaaca

SEQ ID NO: 1138210 - RNA, 18 nt, Homo sapiens
aaaacaaaggagcauuaa

SEQ ID NO: 1138211 - RNA, 19 nt, Homo sapiens
aaaacaccuuguacuuuau

SEQ ID NO: 1138212 - RNA, 11 nt, Homo sapiens
aaaacacugug

SEQ ID NO: 1138213 - RNA, 14 nt, Homo sapiens
aaaacacugugcac

SEQ ID NO: 1138214 - RNA, 13 nt, Homo sapiens
aaaacacuucugu

SEQ ID NO: 1138215 - RNA, 18 nt, Homo sapiens
aaaacagauuguuugcaa

SEQ ID NO: 1138216 - RNA, 17 nt, Homo sapiens
aaaacaggagccuacca

SEQ ID NO: 1138217 - RNA, 13 nt, Homo sapiens
aaaacaucacuga

SEQ ID NO: 1138218 - RNA, 11 nt, Homo sapiens
aaaacauguaa

SEQ ID NO: 1138219 - RNA, 19 nt, Homo sapiens
aaaacauuuuauguauaga

SEQ ID NO: 1138220 - RNA, 20 nt, Homo sapiens
aaaaccacuggaaaguuuau

SEQ ID NO: 1138221 - RNA, 14 nt, Homo sapiens
aaaaccccaucucu

SEQ ID NO: 1138222 - RNA, 21 nt, Homo sapiens
aaaaccccaucuuuacuaaaa

SEQ ID NO: 1138223 - RNA, 13 nt, Homo sapiens
aaaacccuuucug

SEQ ID NO: 1138224 - RNA, 17 nt, Homo sapiens
aaaaccuguccuaugaa

SEQ ID NO: 1138225 - RNA, 13 nt, Homo sapiens
aaaacucauuucc

SEQ ID NO: 1138226 - RNA, 21 nt, Homo sapiens
aaaacucgaggacuguauuug

SEQ ID NO: 1138227 - RNA, 20 nt, Homo sapiens
aaaacuguuguagaaauucu

SEQ ID NO: 1138228 - RNA, 12 nt, Homo sapiens
aaaacuuccuag

SEQ ID NO: 1138229 - RNA, 23 nt, Homo sapiens
aaaagaaaaaaaccaaaguacuu

SEQ ID NO: 1138230 - RNA, 16 nt, Homo sapiens
aaaagaaaccacuucu

SEQ ID NO: 1138231 - RNA, 18 nt, Homo sapiens
aaaagaccaucuccugua

SEQ ID NO: 1138232 - RNA, 15 nt, Homo sapiens
aaaagacugaaucua

SEQ ID NO: 1138233 - RNA, 20 nt, Homo sapiens
aaaagacugaaucuaccugc

SEQ ID NO: 1138234 - RNA, 13 nt, Homo sapiens
aaaagacuuugau

SEQ ID NO: 1138235 - RNA, 21 nt, Homo sapiens
aaaagauacccaaaggucaag

SEQ ID NO: 1138236 - RNA, 14 nt, Homo sapiens
aaaagaugguugcc

SEQ ID NO: 1138237 - RNA, 15 nt, Homo sapiens
aauucccaagcuuuu

SEQ ID NO: 1138238 - RNA, 13 nt, Homo sapiens
aauuccuuugugu

SEQ ID NO: 1138239 - RNA, 15 nt, Homo sapiens
aauucuaaaccaauc

SEQ ID NO: 1138240 - RNA, 17 nt, Homo sapiens
aauucuaguguaaauca

SEQ ID NO: 1138241 - RNA, 17 nt, Homo sapiens
aauucugaauuugcaaa

SEQ ID NO: 1138242 - RNA, 19 nt, Homo sapiens
aauucugauggauucaauu

SEQ ID NO: 1138243 - RNA, 17 nt, Homo sapiens
aauucugccuuuauuga

SEQ ID NO: 1138244 - RNA, 15 nt, Homo sapiens
aauucugcucagaua

SEQ ID NO: 1138245 - RNA, 19 nt, Homo sapiens
aauucuguaggacuuugaa

SEQ ID NO: 1138246 - RNA, 16 nt, Homo sapiens
aauucuuaauuuggau

SEQ ID NO: 1138247 - RNA, 20 nt, Homo sapiens
aauucuuauugacucauaca

SEQ ID NO: 1138248 - RNA, 21 nt, Homo sapiens
aauucuuauugacucauacac

SEQ ID NO: 1138249 - RNA, 18 nt, Homo sapiens
aauucuucuguccugaga

SEQ ID NO: 1138250 - RNA, 16 nt, Homo sapiens
uccuucucauugcugc

SEQ ID NO: 1138251 - RNA, 18 nt, Homo sapiens
uccuucugagccugccuu

SEQ ID NO: 1138252 - RNA, 18 nt, Homo sapiens
uccuucuggcuguagaua

SEQ ID NO: 1138253 - RNA, 17 nt, Homo sapiens
uccuucuuggaguuaca

SEQ ID NO: 1138254 - RNA, 15 nt, Homo sapiens
uccuuggaaauugga

SEQ ID NO: 1138255 - RNA, 14 nt, Homo sapiens
uccuuggaacacau

SEQ ID NO: 1138256 - RNA, 16 nt, Homo sapiens
uccuuggcuuuuacug

SEQ ID NO: 1138257 - RNA, 18 nt, Homo sapiens
uccuugggcuuuagccuu

SEQ ID NO: 1138258 - RNA, 17 nt, Homo sapiens
uccuuugguccuucaaa

SEQ ID NO: 1138259 - RNA, 15 nt, Homo sapiens
uccuuuugguuuugg

SEQ ID NO: 1138260 - RNA, 23 nt, Homo sapiens
uccuuuuguagaaugaaccacug

SEQ ID NO: 1138261 - RNA, 15 nt, Homo sapiens
ucgaaagcucuagaa

SEQ ID NO: 1138262 - RNA, 14 nt, Homo sapiens
ucgaaagugaggag

SEQ ID NO: 1138263 - RNA, 12 nt, Homo sapiens
ucgaaaguguca

SEQ ID NO: 1138264 - RNA, 19 nt, Homo sapiens
ucgacuguauucgugcauu

SEQ ID NO: 1138265 - RNA, 18 nt, Homo sapiens
ucgagaauguauggauuu

SEQ ID NO: 1138266 - RNA, 16 nt, Homo sapiens
ucgagaccagccugac

SEQ ID NO: 1138267 - RNA, 22 nt, Homo sapiens
ucgagagcuggccaaagagccu

SEQ ID NO: 1138268 - RNA, 17 nt, Homo sapiens
ucgaggcucuugcucaa

SEQ ID NO: 1138269 - RNA, 16 nt, Homo sapiens
ucgagggacuuuaugu

SEQ ID NO: 1138270 - RNA, 17 nt, Homo sapiens
ucgagguagguggauca

SEQ ID NO: 1138271 - RNA, 17 nt, Homo sapiens
ucgauaaacuaacuacu

SEQ ID NO: 1138272 - RNA, 14 nt, Homo sapiens
ucgaucuuuuccua

SEQ ID NO: 1138273 - RNA, 15 nt, Homo sapiens
ucgcaccugugcugg

SEQ ID NO: 1138274 - RNA, 14 nt, Homo sapiens
ucgcaccuuuccaa

SEQ ID NO: 1138275 - RNA, 14 nt, Homo sapiens
ucgcauccagacag

SEQ ID NO: 1138276 - RNA, 15 nt, Homo sapiens
ucgcauccagacagu

SEQ ID NO: 1138277 - RNA, 21 nt, Homo sapiens
ucgcccaggcuggagggcagu

SEQ ID NO: 1138278 - RNA, 14 nt, Homo sapiens
ucgcccccacuuuu

SEQ ID NO: 1138279 - RNA, 16 nt, Homo sapiens
ucgccuccuacucuga

SEQ ID NO: 1138280 - RNA, 16 nt, Homo sapiens
ucgccugcccuccucu

SEQ ID NO: 1138281 - RNA, 15 nt, Homo sapiens
ucgccuuagcacuac

SEQ ID NO: 1138282 - RNA, 14 nt, Homo sapiens
ucgcuucagccaca

SEQ ID NO: 1138283 - RNA, 15 nt, Homo sapiens
ucgcuugaaccuggg

SEQ ID NO: 1138284 - RNA, 22 nt, Homo sapiens
ucggaaggacgcggaaccuggg

SEQ ID NO: 1138285 - RNA, 23 nt, Homo sapiens
ucggccaguuuucggaaacacug

SEQ ID NO: 1138286 - RNA, 13 nt, Homo sapiens
ucggccucuccac

SEQ ID NO: 1138287 - RNA, 19 nt, Homo sapiens
ucgggaagaaggggacaau

SEQ ID NO: 1138288 - RNA, 23 nt, Homo sapiens
ucgggcuaggaagaucucugcag

SEQ ID NO: 1138289 - RNA, 15 nt, Homo sapiens
ucggggaacuccugg

SEQ ID NO: 1138290 - RNA, 22 nt, Homo sapiens
ucggggaacuccuggaaauauc

SEQ ID NO: 1138291 - RNA, 20 nt, Homo sapiens
ucggugacugguuaucacac

SEQ ID NO: 1138292 - RNA, 12 nt, Homo sapiens
ucgguggcugcc

SEQ ID NO: 1138293 - RNA, 18 nt, Homo sapiens
ucgucaggcugccagaga

SEQ ID NO: 1138294 - RNA, 21 nt, Homo sapiens
ucgucuccugacaugucucac

SEQ ID NO: 1138295 - RNA, 16 nt, Homo sapiens
ucgucuucagcugcau

SEQ ID NO: 1138296 - RNA, 14 nt, Homo sapiens
ucgugccacugcac

SEQ ID NO: 1138297 - RNA, 22 nt, Homo sapiens
ucguucaacuccacucacugaa

SEQ ID NO: 1138298 - RNA, 14 nt, Homo sapiens
ucguuggacucauu

SEQ ID NO: 1138299 - RNA, 14 nt, Homo sapiens
ucuaaaauccugcu

SEQ ID NO: 1138300 - RNA, 14 nt, Homo sapiens
ucuaaacagacuca

SEQ ID NO: 1138301 - RNA, 18 nt, Homo sapiens
ucuaaaccagaggacaaa

SEQ ID NO: 1138302 - RNA, 23 nt, Homo sapiens
ucuaaagauggaguuucuaaggu

SEQ ID NO: 1138303 - RNA, 13 nt, Homo sapiens
ucuaaaguucuaa

SEQ ID NO: 1138304 - RNA, 19 nt, Homo sapiens
ucuaaaugaagugcaaauu

SEQ ID NO: 1138305 - RNA, 15 nt, Homo sapiens
ucuaacgugcauuau

SEQ ID NO: 1138306 - RNA, 20 nt, Homo sapiens
ucuaacucauauguucccaa

SEQ ID NO: 1138307 - RNA, 22 nt, Homo sapiens
ucuaacucccuccucacacucc

SEQ ID NO: 1138308 - RNA, 15 nt, Homo sapiens
ucuaagaaagaaauu

SEQ ID NO: 1138309 - RNA, 20 nt, Homo sapiens
ucuaagagaacaaugugcua

SEQ ID NO: 1138310 - RNA, 21 nt, Homo sapiens
uggccuuacuguugaacaaua

SEQ ID NO: 1138311 - RNA, 19 nt, Homo sapiens
uggccuuccacgucuuccu

SEQ ID NO: 1138312 - RNA, 13 nt, Homo sapiens
uggccuuccugcc

SEQ ID NO: 1138313 - RNA, 20 nt, Homo sapiens
uggccuuugcaauuguggau

SEQ ID NO: 1138314 - RNA, 13 nt, Homo sapiens
uggcgacaaaagu

SEQ ID NO: 1138315 - RNA, 21 nt, Homo sapiens
uggcggggcuuuccugcacau

SEQ ID NO: 1138316 - RNA, 15 nt, Homo sapiens
uggcguuacugcuug

SEQ ID NO: 1138317 - RNA, 22 nt, Homo sapiens
uggcuacacucaucugacucau

SEQ ID NO: 1138318 - RNA, 19 nt, Homo sapiens
uggcuacuaguuuaagcaa

SEQ ID NO: 1138319 - RNA, 23 nt, Homo sapiens
uggcuacuaguuuaagcaaauaa

SEQ ID NO: 1138320 - RNA, 18 nt, Homo sapiens
uggcucaaacaacauucc

SEQ ID NO: 1138321 - RNA, 20 nt, Homo sapiens
uggcucacgccuguaauccc

SEQ ID NO: 1138322 - RNA, 12 nt, Homo sapiens
uggcucaugccu

SEQ ID NO: 1138323 - RNA, 22 nt, Homo sapiens
uggcucaugccucuaaucucag

SEQ ID NO: 1138324 - RNA, 21 nt, Homo sapiens
uggcuccggccucugccuuug

SEQ ID NO: 1138325 - RNA, 12 nt, Homo sapiens
uggcucuucacc

SEQ ID NO: 1138326 - RNA, 15 nt, Homo sapiens
uggcucuucagagga

SEQ ID NO: 1138327 - RNA, 17 nt, Homo sapiens
uggcucuuguccaucug

SEQ ID NO: 1138328 - RNA, 23 nt, Homo sapiens
uggcugagauucccucaccuguc

SEQ ID NO: 1138329 - RNA, 22 nt, Homo sapiens
uggcugggggagggacugcuga

SEQ ID NO: 1138330 - RNA, 16 nt, Homo sapiens
uggcugggucuucaag

SEQ ID NO: 1138331 - RNA, 14 nt, Homo sapiens
uggcuggugccuga

SEQ ID NO: 1138332 - RNA, 22 nt, Homo sapiens
uggcugguggaacaaccugcug

SEQ ID NO: 1138333 - RNA, 18 nt, Homo sapiens
uggcuguggagacaaugu

SEQ ID NO: 1138334 - RNA, 12 nt, Homo sapiens
uggcuguggcau

SEQ ID NO: 1138335 - RNA, 11 nt, Homo sapiens
uggcuucuuac

SEQ ID NO: 1138336 - RNA, 22 nt, Homo sapiens
uggcuugacuguuuucuuuaug

SEQ ID NO: 1138337 - RNA, 13 nt, Homo sapiens
uggcuugaugucc

SEQ ID NO: 1138338 - RNA, 16 nt, Homo sapiens
ugggaaaacacugcca

SEQ ID NO: 1138339 - RNA, 14 nt, Homo sapiens
ugggaaaacccagg

SEQ ID NO: 1138340 - RNA, 19 nt, Homo sapiens
ugggaaaccaguucaugca

SEQ ID NO: 1138341 - RNA, 14 nt, Homo sapiens
ugggaaaugagcag

SEQ ID NO: 1138342 - RNA, 17 nt, Homo sapiens
ugggaacccugugcaau

SEQ ID NO: 1138343 - RNA, 17 nt, Homo sapiens
ugggaagcaggagccca

SEQ ID NO: 1138344 - RNA, 15 nt, Homo sapiens
ugggaagcuauuucc

SEQ ID NO: 1138345 - RNA, 21 nt, Homo sapiens
ugggaaggggagcacaauuuc

SEQ ID NO: 1138346 - RNA, 16 nt, Homo sapiens
ugggaaggggaggacc

SEQ ID NO: 1138347 - RNA, 17 nt, Homo sapiens
ugggaaggggaggaccc

SEQ ID NO: 1138348 - RNA, 23 nt, Homo sapiens
ugggaaugucucuuuggcgaccu

SEQ ID NO: 1138349 - RNA, 15 nt, Homo sapiens
ugggacguggcucag

SEQ ID NO: 1138350 - RNA, 21 nt, Homo sapiens
ugggacucauucacauuucaa

SEQ ID NO: 1138351 - RNA, 15 nt, Homo sapiens
ugggacucucuugau

SEQ ID NO: 1138352 - RNA, 18 nt, Homo sapiens
ugggacuuagaacaccgc

SEQ ID NO: 1138353 - RNA, 16 nt, Homo sapiens
ugggagaaaucuggcu

SEQ ID NO: 1138354 - RNA, 23 nt, Homo sapiens
ugggagagucaagggaaggacaa

SEQ ID NO: 1138355 - RNA, 15 nt, Homo sapiens
ugggagauguggaaa

SEQ ID NO: 1138356 - RNA, 19 nt, Homo sapiens
ugggagauguuagacucau

SEQ ID NO: 1138357 - RNA, 20 nt, Homo sapiens
ugggagauucaagggaccca

SEQ ID NO: 1138358 - RNA, 13 nt, Homo sapiens
ugggagcaaaaaa

SEQ ID NO: 1138359 - RNA, 15 nt, Homo sapiens
ugggagcaccgccug

SEQ ID NO: 1138360 - RNA, 19 nt, Homo sapiens
ugggagcccaguuucacug

SEQ ID NO: 1138361 - RNA, 15 nt, Homo sapiens
ugggagccuacccac

SEQ ID NO: 1138362 - RNA, 15 nt, Homo sapiens
ugggagccugaggca

SEQ ID NO: 1138363 - RNA, 18 nt, Homo sapiens
ugggagguugugggcauu

SEQ ID NO: 1138364 - RNA, 15 nt, Homo sapiens
ugggagucacacagu

SEQ ID NO: 1138365 - RNA, 17 nt, Homo sapiens
ugggagucacacagugu

SEQ ID NO: 1138366 - RNA, 20 nt, Homo sapiens
ugggauccuaagggcucacc

SEQ ID NO: 1138367 - RNA, 20 nt, Homo sapiens
ugggaugcgggcauuuugaa

SEQ ID NO: 1138368 - RNA, 20 nt, Homo sapiens
ugggauuacaggcaugugcc

SEQ ID NO: 1138369 - RNA, 15 nt, Homo sapiens
ugggcaacagagcaa

SEQ ID NO: 1138370 - RNA, 13 nt, Homo sapiens
ugggcagagccca

SEQ ID NO: 1138371 - RNA, 12 nt, Homo sapiens
ugggcagggucu

SEQ ID NO: 1138372 - RNA, 21 nt, Homo sapiens
ugggcaugguggcucaugccu

SEQ ID NO: 1138373 - RNA, 16 nt, Homo sapiens
ugggcauuuugacaac

SEQ ID NO: 1138374 - RNA, 16 nt, Homo sapiens
ugggccagacaugcca

SEQ ID NO: 1138375 - RNA, 13 nt, Homo sapiens
ugggcccacaaag

SEQ ID NO: 1138376 - RNA, 14 nt, Homo sapiens
ugggcccacaaagg

SEQ ID NO: 1138377 - RNA, 19 nt, Homo sapiens
ugggccccuggcacucuug

SEQ ID NO: 1138378 - RNA, 14 nt, Homo sapiens
ugggccugcuccag

SEQ ID NO: 1138379 - RNA, 19 nt, Homo sapiens
ugggccuggagggggagca

SEQ ID NO: 1138380 - RNA, 21 nt, Homo sapiens
ugggcgcucucccuaccuugc

SEQ ID NO: 1138381 - RNA, 17 nt, Homo sapiens
ugggcggaaguacuucc

SEQ ID NO: 1138382 - RNA, 21 nt, Homo sapiens
ugggcguuugaacucagggag

SEQ ID NO: 1138383 - RNA, 18 nt, Homo sapiens
ugggcuccuccagggugu

SEQ ID NO: 1138384 - RNA, 12 nt, Homo sapiens
ugggcuguuuag

SEQ ID NO: 1138385 - RNA, 17 nt, Homo sapiens
uggggaaaaaacugugc

SEQ ID NO: 1138386 - RNA, 14 nt, Homo sapiens
uggggacaccugcc

SEQ ID NO: 1138387 - RNA, 18 nt, Homo sapiens
uggggacauacacuugca

SEQ ID NO: 1138388 - RNA, 19 nt, Homo sapiens
uggggacaucucuuugaau

SEQ ID NO: 1138389 - RNA, 17 nt, Homo sapiens
uggggaccauggucugg

SEQ ID NO: 1138390 - RNA, 21 nt, Homo sapiens
uggggaccgguucccacaagc

SEQ ID NO: 1138391 - RNA, 16 nt, Homo sapiens
uggggacuccucuuaa

SEQ ID NO: 1138392 - RNA, 17 nt, Homo sapiens
uggggagacuucuuggc

SEQ ID NO: 1138393 - RNA, 23 nt, Homo sapiens
uggggagaggggagugcauuuag

SEQ ID NO: 1138394 - RNA, 15 nt, Homo sapiens
uggggagucagggac

SEQ ID NO: 1138395 - RNA, 20 nt, Homo sapiens
ugggggaccaaugaggugag

SEQ ID NO: 1138396 - RNA, 22 nt, Homo sapiens
ugggggagaaccacugacccaa

SEQ ID NO: 1138397 - RNA, 12 nt, Homo sapiens
uggggggaccca

SEQ ID NO: 1138398 - RNA, 22 nt, Homo sapiens
ugggguccccagggcugucauc

SEQ ID NO: 1138399 - RNA, 17 nt, Homo sapiens
ugggguggccaccagua

SEQ ID NO: 1138400 - RNA, 16 nt, Homo sapiens
uggggugggcacauug

SEQ ID NO: 1138401 - RNA, 14 nt, Homo sapiens
ugggguggggucau

SEQ ID NO: 1138402 - RNA, 22 nt, Homo sapiens
ugggguuuuggacacacgguca

SEQ ID NO: 1138403 - RNA, 13 nt, Homo sapiens
uggguaccuguau

SEQ ID NO: 1138404 - RNA, 21 nt, Homo sapiens
uggguaucgcugagacuaagu

SEQ ID NO: 1138405 - RNA, 21 nt, Homo sapiens
uggguauugugugagugcaug

SEQ ID NO: 1138406 - RNA, 22 nt, Homo sapiens
uggguauugugugagugcaugu

SEQ ID NO: 1138407 - RNA, 15 nt, Homo sapiens
ugggucaugacaaga

SEQ ID NO: 1138408 - RNA, 14 nt, Homo sapiens
uggguccaggggau

SEQ ID NO: 1138409 - RNA, 11 nt, Homo sapiens
ugggugacaaa

SEQ ID NO: 1138410 - RNA, 22 nt, Homo sapiens
ugggugagagugagacucaguc

SEQ ID NO: 1138411 - RNA, 17 nt, Homo sapiens
ugggugagcucuuccag

SEQ ID NO: 1138412 - RNA, 23 nt, Homo sapiens
ugggugagcucuuccaggagcca

SEQ ID NO: 1138413 - RNA, 15 nt, Homo sapiens
ugggugauuucuaga

SEQ ID NO: 1138414 - RNA, 12 nt, Homo sapiens
ugggugggauaa

SEQ ID NO: 1138415 - RNA, 20 nt, Homo sapiens
uggguggggcugcuccucca

SEQ ID NO: 1138416 - RNA, 11 nt, Homo sapiens
uggguucaagc

SEQ ID NO: 1138417 - RNA, 15 nt, Homo sapiens
uggguucaauuugcc

SEQ ID NO: 1138418 - RNA, 13 nt, Homo sapiens
uggguucugcuac

SEQ ID NO: 1138419 - RNA, 14 nt, Homo sapiens
ugguaaaugccaca

SEQ ID NO: 1138420 - RNA, 15 nt, Homo sapiens
ugguaaaugccacac

SEQ ID NO: 1138421 - RNA, 18 nt, Homo sapiens
ugguaauuuuugcuuuuu

SEQ ID NO: 1138422 - RNA, 18 nt, Homo sapiens
ugguaccuauuugacuua

SEQ ID NO: 1138423 - RNA, 19 nt, Homo sapiens
ugguaccuauuugacuuac

SEQ ID NO: 1138424 - RNA, 15 nt, Homo sapiens
ugguacucaagcccg

SEQ ID NO: 1138425 - RNA, 12 nt, Homo sapiens
gauaagguuaua

SEQ ID NO: 1138426 - RNA, 12 nt, Homo sapiens
gauaaguguucu

SEQ ID NO: 1138427 - RNA, 19 nt, Homo sapiens
gauaaguguucuucagugu

SEQ ID NO: 1138428 - RNA, 13 nt, Homo sapiens
gauaauaugagaa

SEQ ID NO: 1138429 - RNA, 24 nt, Homo sapiens
gauaauggauccuuaacagaugaa

SEQ ID NO: 1138430 - RNA, 17 nt, Homo sapiens
gauacauacaccagcau

SEQ ID NO: 1138431 - RNA, 17 nt, Homo sapiens
gauaccagauagcucaa

SEQ ID NO: 1138432 - RNA, 16 nt, Homo sapiens
gauaccagcucagggg

SEQ ID NO: 1138433 - RNA, 19 nt, Homo sapiens
gauacuugccaaaaugaga

SEQ ID NO: 1138434 - RNA, 17 nt, Homo sapiens
gauacuuuccugaaugu

SEQ ID NO: 1138435 - RNA, 18 nt, Homo sapiens
gauagaacuguacuguuu

SEQ ID NO: 1138436 - RNA, 23 nt, Homo sapiens
gauagagaguuguuguguacaga

SEQ ID NO: 1138437 - RNA, 13 nt, Homo sapiens
gauagaugucuau

SEQ ID NO: 1138438 - RNA, 16 nt, Homo sapiens
gauagauuugaccucc

SEQ ID NO: 1138439 - RNA, 14 nt, Homo sapiens
gauagcagauauca

SEQ ID NO: 1138440 - RNA, 18 nt, Homo sapiens
gauaggaauucacugaua

SEQ ID NO: 1138441 - RNA, 20 nt, Homo sapiens
gauaguacuaagcauuucag

SEQ ID NO: 1138442 - RNA, 22 nt, Homo sapiens
gauagugacaugauacaaacac

SEQ ID NO: 1138443 - RNA, 22 nt, Homo sapiens
gauagugggcaccccacugcaa

SEQ ID NO: 1138444 - RNA, 23 nt, Homo sapiens
gauaguggggagacuucuuggcu

SEQ ID NO: 1138445 - RNA, 12 nt, Homo sapiens
gauaguuuaccu

SEQ ID NO: 1138446 - RNA, 14 nt, Homo sapiens
gauauacuuacuca

SEQ ID NO: 1138447 - RNA, 18 nt, Homo sapiens
gauauaucuuuauacuua

SEQ ID NO: 1138448 - RNA, 17 nt, Homo sapiens
gauaucaaaagcaaaua

SEQ ID NO: 1138449 - RNA, 21 nt, Homo sapiens
gauauccaggcuuaccaaagu

SEQ ID NO: 1138450 - RNA, 22 nt, Homo sapiens
gauaugacaacucuuauuugaa

SEQ ID NO: 1138451 - RNA, 19 nt, Homo sapiens
gauaugcuuaguaaugcua

SEQ ID NO: 1138452 - RNA, 16 nt, Homo sapiens
gauauuaucuaccugu

SEQ ID NO: 1138453 - RNA, 22 nt, Homo sapiens
gauauuauuucagggucccauu

SEQ ID NO: 1138454 - RNA, 20 nt, Homo sapiens
gauauuuaaaagacaaacac

SEQ ID NO: 1138455 - RNA, 19 nt, Homo sapiens
gauauuuugggcauguggg

SEQ ID NO: 1138456 - RNA, 19 nt, Homo sapiens
gaucagacagcuugaauca

SEQ ID NO: 1138457 - RNA, 17 nt, Homo sapiens
gaucagauugcauguga

SEQ ID NO: 1138458 - RNA, 22 nt, Homo sapiens
gaucagcuuucaaagcauuuac

SEQ ID NO: 1138459 - RNA, 15 nt, Homo sapiens
gaucaggcacagugg

SEQ ID NO: 1138460 - RNA, 18 nt, Homo sapiens
gaucaucgccagaggugc

SEQ ID NO: 1138461 - RNA, 22 nt, Homo sapiens
gaucaucgccagaggugcuuca

SEQ ID NO: 1138462 - RNA, 19 nt, Homo sapiens
gaucauucuggagucacug

SEQ ID NO: 1138463 - RNA, 18 nt, Homo sapiens
gaucauuuggagcucuug

SEQ ID NO: 1138464 - RNA, 22 nt, Homo sapiens
gauccaaaagaagcccccagcu

SEQ ID NO: 1138465 - RNA, 22 nt, Homo sapiens
gauccaaggccgcggcccagac

SEQ ID NO: 1138466 - RNA, 18 nt, Homo sapiens
gauccauccagcuugcca

SEQ ID NO: 1138467 - RNA, 16 nt, Homo sapiens
gauccccaagugugaa

SEQ ID NO: 1138468 - RNA, 23 nt, Homo sapiens
gaucccgcguagugucaguacua

SEQ ID NO: 1138469 - RNA, 12 nt, Homo sapiens
gaucccugacau

SEQ ID NO: 1138470 - RNA, 19 nt, Homo sapiens
gauccuaagcaucuaaguu

SEQ ID NO: 1138471 - RNA, 15 nt, Homo sapiens
gaucgguaucuuugu

SEQ ID NO: 1138472 - RNA, 17 nt, Homo sapiens
gaucuacaugaaugcaa

SEQ ID NO: 1138473 - RNA, 21 nt, Homo sapiens
gaucuacaugaaugcaaaaca

SEQ ID NO: 1138474 - RNA, 14 nt, Homo sapiens
gaucuaccugcaac

SEQ ID NO: 1138475 - RNA, 15 nt, Homo sapiens
gaucucauguccucu

SEQ ID NO: 1138476 - RNA, 22 nt, Homo sapiens
gaucucggcucagugcaaccuc

SEQ ID NO: 1138477 - RNA, 15 nt, Homo sapiens
gaucugaacccagcu

SEQ ID NO: 1138478 - RNA, 18 nt, Homo sapiens
gucacuauggacuuaccc

SEQ ID NO: 1138479 - RNA, 17 nt, Homo sapiens
gucacuguacaguuuug

SEQ ID NO: 1138480 - RNA, 15 nt, Homo sapiens
gucacuucucacaau

SEQ ID NO: 1138481 - RNA, 13 nt, Homo sapiens
gucacuugcaauu

SEQ ID NO: 1138482 - RNA, 22 nt, Homo sapiens
gucagaaguucuggguggugcc

SEQ ID NO: 1138483 - RNA, 19 nt, Homo sapiens
gucagcaaaggguggguuu

SEQ ID NO: 1138484 - RNA, 16 nt, Homo sapiens
gucagcacagaacaca

SEQ ID NO: 1138485 - RNA, 19 nt, Homo sapiens
gucagccugacucuucccu

SEQ ID NO: 1138486 - RNA, 23 nt, Homo sapiens
gucaggcccucugccugcacucc

SEQ ID NO: 1138487 - RNA, 16 nt, Homo sapiens
gucagggaacauauuu

SEQ ID NO: 1138488 - RNA, 17 nt, Homo sapiens
gucagggggcacugucu

SEQ ID NO: 1138489 - RNA, 15 nt, Homo sapiens
gucaggggugacaca

SEQ ID NO: 1138490 - RNA, 13 nt, Homo sapiens
gucaguauuccaa

SEQ ID NO: 1138491 - RNA, 15 nt, Homo sapiens
gucagucacagccac

SEQ ID NO: 1138492 - RNA, 22 nt, Homo sapiens
gucaguguugccucuugcaaug

SEQ ID NO: 1138493 - RNA, 18 nt, Homo sapiens
gucauaagcauuacuuua

SEQ ID NO: 1138494 - RNA, 17 nt, Homo sapiens
gucauaccuacauucaa

SEQ ID NO: 1138495 - RNA, 13 nt, Homo sapiens
gucauagcauuca

SEQ ID NO: 1138496 - RNA, 14 nt, Homo sapiens
gucaucaucacauu

SEQ ID NO: 1138497 - RNA, 17 nt, Homo sapiens
gucaucaucacauucag

SEQ ID NO: 1138498 - RNA, 23 nt, Homo sapiens
gucauccccuugggcucucacca

SEQ ID NO: 1138499 - RNA, 20 nt, Homo sapiens
gucaucugcaugucuacuca

SEQ ID NO: 1138500 - RNA, 14 nt, Homo sapiens
gucaucugugcacu

SEQ ID NO: 1138501 - RNA, 12 nt, Homo sapiens
gucaucuucccu

SEQ ID NO: 1138502 - RNA, 12 nt, Homo sapiens
gucauuaucaaa

SEQ ID NO: 1138503 - RNA, 13 nt, Homo sapiens
gucauucauucaa

SEQ ID NO: 1138504 - RNA, 20 nt, Homo sapiens
gucauuggaaacacugccuu

SEQ ID NO: 1138505 - RNA, 14 nt, Homo sapiens
gucauuuauggguu

SEQ ID NO: 1138506 - RNA, 19 nt, Homo sapiens
gucauuucaaagacucuca

SEQ ID NO: 1138507 - RNA, 19 nt, Homo sapiens
gucauuugcugugaacuga

SEQ ID NO: 1138508 - RNA, 16 nt, Homo sapiens
gucauuuuacaagcau

SEQ ID NO: 1138509 - RNA, 15 nt, Homo sapiens
guccaacaguagcau

SEQ ID NO: 1138510 - RNA, 20 nt, Homo sapiens
guccaacuaaaaacaaaccc

SEQ ID NO: 1138511 - RNA, 18 nt, Homo sapiens
guccacacccaauuccac

SEQ ID NO: 1138512 - RNA, 13 nt, Homo sapiens
guccacacccagc

SEQ ID NO: 1138513 - RNA, 11 nt, Homo sapiens
guccacagggc

SEQ ID NO: 1138514 - RNA, 15 nt, Homo sapiens
guccaccaccaccug

SEQ ID NO: 1138515 - RNA, 11 nt, Homo sapiens
guccagcaccu

SEQ ID NO: 1138516 - RNA, 14 nt, Homo sapiens
guccagcagucacu

SEQ ID NO: 1138517 - RNA, 13 nt, Homo sapiens
guccaguuugugc

SEQ ID NO: 1138518 - RNA, 16 nt, Homo sapiens
guccaucacuauucaa

SEQ ID NO: 1138519 - RNA, 22 nt, Homo sapiens
guccauccuccucuccaugcaa

SEQ ID NO: 1138520 - RNA, 22 nt, Homo sapiens
guccauuaagcugagagugcua

SEQ ID NO: 1138521 - RNA, 13 nt, Homo sapiens
guccauuuugccu

SEQ ID NO: 1138522 - RNA, 19 nt, Homo sapiens
gucccagcggccucagggu

SEQ ID NO: 1138523 - RNA, 18 nt, Homo sapiens
gucccaguagccaaggcc

SEQ ID NO: 1138524 - RNA, 16 nt, Homo sapiens
gucccauaauugagaa

SEQ ID NO: 1138525 - RNA, 14 nt, Homo sapiens
guccccgaugcuga

SEQ ID NO: 1138526 - RNA, 16 nt, Homo sapiens
guccccgaugcugacc

SEQ ID NO: 1138527 - RNA, 19 nt, Homo sapiens
guccccgcccucucucaua

SEQ ID NO: 1138528 - RNA, 17 nt, Homo sapiens
guccccuaaaccaaaaa

SEQ ID NO: 1138529 - RNA, 23 nt, Homo sapiens
guccccucauucuacuaauguga

SEQ ID NO: 1138530 - RNA, 18 nt, Homo sapiens
gucccucacguuucuucc

SEQ ID NO: 1138531 - RNA, 17 nt, Homo sapiens
gucccucuaacaucucc

SEQ ID NO: 1138532 - RNA, 20 nt, Homo sapiens
gucccucuaacaucucccau

SEQ ID NO: 1138533 - RNA, 18 nt, Homo sapiens
gucccuggcgcugugcua

SEQ ID NO: 1138534 - RNA, 19 nt, Homo sapiens
gucccuugcuguaugcuga

SEQ ID NO: 1138535 - RNA, 22 nt, Homo sapiens
gucccuugcuugccugcagggc

SEQ ID NO: 1138536 - RNA, 17 nt, Homo sapiens
guccggaaugccaccca

SEQ ID NO: 1138537 - RNA, 21 nt, Homo sapiens
guccuaaaaguucucaaugua

SEQ ID NO: 1138538 - RNA, 18 nt, Homo sapiens
guccuacucauauuccuc

SEQ ID NO: 1138539 - RNA, 15 nt, Homo sapiens
guccuagcuuuauau

SEQ ID NO: 1138540 - RNA, 18 nt, Homo sapiens
guccuauccaaaggaauc

SEQ ID NO: 1138541 - RNA, 20 nt, Homo sapiens
guccucaccugguugaccca

SEQ ID NO: 1138542 - RNA, 16 nt, Homo sapiens
guccucacugcugauu

SEQ ID NO: 1138543 - RNA, 20 nt, Homo sapiens
guccucagcugcucccacac

SEQ ID NO: 1138544 - RNA, 12 nt, Homo sapiens
guccucauucuu

SEQ ID NO: 1138545 - RNA, 15 nt, Homo sapiens
guccucauucuugcc

SEQ ID NO: 1138546 - RNA, 15 nt, Homo sapiens
guccucccaggccag

SEQ ID NO: 1138547 - RNA, 18 nt, Homo sapiens
guccuccucuaccucucu

SEQ ID NO: 1138548 - RNA, 20 nt, Homo sapiens
guccugaaaguaacucauaa

SEQ ID NO: 1138549 - RNA, 16 nt, Homo sapiens
guccugacagcacucc

SEQ ID NO: 1138550 - RNA, 18 nt, Homo sapiens
guccugaugauuuuuauu

SEQ ID NO: 1138551 - RNA, 18 nt, Homo sapiens
guccugcuggccugcucu

SEQ ID NO: 1138552 - RNA, 18 nt, Homo sapiens
guccuggauucacuggcu

SEQ ID NO: 1138553 - RNA, 16 nt, Homo sapiens
guccuggcugcacucu

SEQ ID NO: 1138554 - RNA, 15 nt, Homo sapiens
guccuggcuucaggc

SEQ ID NO: 1138555 - RNA, 17 nt, Homo sapiens
guccugggaggcugcag

SEQ ID NO: 1138556 - RNA, 15 nt, Homo sapiens
guccuguacccagug

SEQ ID NO: 1138557 - RNA, 19 nt, Homo sapiens
guccuguccagacacgucc

SEQ ID NO: 1138558 - RNA, 19 nt, Homo sapiens
guccuguuuucuacagguu

SEQ ID NO: 1138559 - RNA, 15 nt, Homo sapiens
guccuuacucagagc

SEQ ID NO: 1138560 - RNA, 13 nt, Homo sapiens
gucgacuagggga

SEQ ID NO: 1138561 - RNA, 16 nt, Homo sapiens
gucgacuucaugacaa

SEQ ID NO: 1138562 - RNA, 15 nt, Homo sapiens
gucgggagagccagg

SEQ ID NO: 1138563 - RNA, 23 nt, Homo sapiens
gucgggauauuugggugcagagg

SEQ ID NO: 1138564 - RNA, 22 nt, Homo sapiens
gucuaagccggcuuuccucuau

SEQ ID NO: 1138565 - RNA, 19 nt, Homo sapiens
gucuaauagucuuugccag

SEQ ID NO: 1138566 - RNA, 13 nt, Homo sapiens
gucuagugucugg

SEQ ID NO: 1138567 - RNA, 13 nt, Homo sapiens
gucuauuguauau

SEQ ID NO: 1138568 - RNA, 17 nt, Homo sapiens
gucuauuuuuguacaaa

SEQ ID NO: 1138569 - RNA, 19 nt, Homo sapiens
gucucaaacuccugaccuc

SEQ ID NO: 1138570 - RNA, 15 nt, Homo sapiens
gucucaagacugaaa

SEQ ID NO: 1138571 - RNA, 13 nt, Homo sapiens
gucucacacuccu

SEQ ID NO: 1138572 - RNA, 17 nt, Homo sapiens
gucucagaccacuauuc

SEQ ID NO: 1138573 - RNA, 13 nt, Homo sapiens
gucucauguggaa

SEQ ID NO: 1138574 - RNA, 18 nt, Homo sapiens
gucuccaacggcaaggga

SEQ ID NO: 1138575 - RNA, 14 nt, Homo sapiens
gucuccagcaaacg

SEQ ID NO: 1138576 - RNA, 16 nt, Homo sapiens
gucuccgcacuuggaa

SEQ ID NO: 1138577 - RNA, 23 nt, Homo sapiens
gucuccuggaccuugacagagca

SEQ ID NO: 1138578 - RNA, 17 nt, Homo sapiens
gucucggggcuugcccc

SEQ ID NO: 1138579 - RNA, 18 nt, Homo sapiens
gucucuccagcaucaauu

SEQ ID NO: 1138580 - RNA, 18 nt, Homo sapiens
gucucuccuuguugcccc

SEQ ID NO: 1138581 - RNA, 17 nt, Homo sapiens
gucucuguuccaugucu

SEQ ID NO: 1138582 - RNA, 15 nt, Homo sapiens
gucucuuaaaucucu

SEQ ID NO: 1138583 - RNA, 22 nt, Homo sapiens
gucucuuguaauccgaaucucu

SEQ ID NO: 1138584 - RNA, 21 nt, Homo sapiens
gucucuugugacucagcagag

SEQ ID NO: 1138585 - RNA, 20 nt, Homo sapiens
gucugaaaagaggagccaga

SEQ ID NO: 1138586 - RNA, 21 nt, Homo sapiens
gucugaauacugcagcacucu

SEQ ID NO: 1138587 - RNA, 13 nt, Homo sapiens
gucugaccuggug

SEQ ID NO: 1138588 - RNA, 18 nt, Homo sapiens
gucugcaauggugacuga

SEQ ID NO: 1138589 - RNA, 19 nt, Homo sapiens
gucugccacaccucuccaa

SEQ ID NO: 1138590 - RNA, 22 nt, Homo sapiens
gucugccaggcccccaccacac

SEQ ID NO: 1138591 - RNA, 16 nt, Homo sapiens
gucugcucaaugccau

SEQ ID NO: 1138592 - RNA, 23 nt, Homo sapiens
gucugcuggcuucuacacugggu

SEQ ID NO: 1138593 - RNA, 22 nt, Homo sapiens
gucugggaagacuguugugcuc

SEQ ID NO: 1138594 - RNA, 20 nt, Homo sapiens
gucugggagaaauugacaga

SEQ ID NO: 1138595 - RNA, 23 nt, Homo sapiens
gucugggaguauacggaaacaaa

SEQ ID NO: 1138596 - RNA, 19 nt, Homo sapiens
gucugucucuuggcuauuu

SEQ ID NO: 1138597 - RNA, 11 nt, Homo sapiens
gucugucuucu

SEQ ID NO: 1138598 - RNA, 21 nt, Homo sapiens
gucuuaaaauggguauucaaa

SEQ ID NO: 1138599 - RNA, 15 nt, Homo sapiens
gucuuaaucauuugu

SEQ ID NO: 1138600 - RNA, 13 nt, Homo sapiens
gucuuagcucugg

SEQ ID NO: 1138601 - RNA, 19 nt, Homo sapiens
gucuuauugaaaugcagau

SEQ ID NO: 1138602 - RNA, 19 nt, Homo sapiens
gucuucaaggaucuccugu

SEQ ID NO: 1138603 - RNA, 13 nt, Homo sapiens
gucuucagcaccc

SEQ ID NO: 1138604 - RNA, 18 nt, Homo sapiens
gucuucuccuaauucugc

SEQ ID NO: 1138605 - RNA, 16 nt, Homo sapiens
gucuucuugacugucu

SEQ ID NO: 1138606 - RNA, 16 nt, Homo sapiens
gucuugccaugugcug

SEQ ID NO: 1138607 - RNA, 12 nt, Homo sapiens
gucuugcugaga

SEQ ID NO: 1138608 - RNA, 12 nt, Homo sapiens
gucuuuuacccg

SEQ ID NO: 1138609 - RNA, 17 nt, Homo sapiens
gucuuuucaucugggaa

SEQ ID NO: 1138610 - RNA, 14 nt, Homo sapiens
gugaaaaacuuaag

SEQ ID NO: 1138611 - RNA, 14 nt, Homo sapiens
gugaacaaagcagc

SEQ ID NO: 1138612 - RNA, 19 nt, Homo sapiens
gugaacaaagcagccacga

SEQ ID NO: 1138613 - RNA, 12 nt, Homo sapiens
gugaacacugga

SEQ ID NO: 1138614 - RNA, 13 nt, Homo sapiens
gugaacacuggag

SEQ ID NO: 1138615 - RNA, 20 nt, Homo sapiens
gugaaccaacccccaucucc

SEQ ID NO: 1138616 - RNA, 23 nt, Homo sapiens
gugaacugcagcgaguacuuccc

SEQ ID NO: 1138617 - RNA, 11 nt, Homo sapiens
gugaagaccaa

SEQ ID NO: 1138618 - RNA, 16 nt, Homo sapiens
gugaagacgucagggg

SEQ ID NO: 1138619 - RNA, 22 nt, Homo sapiens
gugaagcccuguugugccacag

SEQ ID NO: 1138620 - RNA, 16 nt, Homo sapiens
gugaaguauacuguau

SEQ ID NO: 1138621 - RNA, 15 nt, Homo sapiens
gugaauaaaccauca

SEQ ID NO: 1138622 - RNA, 16 nt, Homo sapiens
gugaauaaaccaucau

SEQ ID NO: 1138623 - RNA, 14 nt, Homo sapiens
gugaauagaacucu

SEQ ID NO: 1138624 - RNA, 22 nt, Homo sapiens
gugaauccaugggucuggcuag

SEQ ID NO: 1138625 - RNA, 19 nt, Homo sapiens
gugaaucugggugggauaa

SEQ ID NO: 1138626 - RNA, 23 nt, Homo sapiens
gugaaucuuugucagcaguuccc

SEQ ID NO: 1138627 - RNA, 16 nt, Homo sapiens
gugaauuucacaagcu

SEQ ID NO: 1138628 - RNA, 21 nt, Homo sapiens
gugacaauuaaaagugucuug

SEQ ID NO: 1138629 - RNA, 13 nt, Homo sapiens
gugacacauaugc

SEQ ID NO: 1138630 - RNA, 20 nt, Homo sapiens
gugacagacuccugaggaca

SEQ ID NO: 1138631 - RNA, 20 nt, Homo sapiens
gugacagagcgagacuccau

SEQ ID NO: 1138632 - RNA, 18 nt, Homo sapiens
gugacauugcuggucauc

SEQ ID NO: 1138633 - RNA, 21 nt, Homo sapiens
gugacauugugucaguuucag

SEQ ID NO: 1138634 - RNA, 22 nt, Homo sapiens
gugaccuuccaagagccugaga

SEQ ID NO: 1138635 - RNA, 19 nt, Homo sapiens
gugacuaauggcaugagaa

SEQ ID NO: 1138636 - RNA, 18 nt, Homo sapiens
gugacuauaaagcuguua

SEQ ID NO: 1138637 - RNA, 19 nt, Homo sapiens
gugacuauaaagcuguuau

SEQ ID NO: 1138638 - RNA, 14 nt, Homo sapiens
gugacucuuuccaa

SEQ ID NO: 1138639 - RNA, 18 nt, Homo sapiens
gugagaacccuugcacua

SEQ ID NO: 1138640 - RNA, 20 nt, Homo sapiens
gugagacccugucucaaaaa

SEQ ID NO: 1138641 - RNA, 21 nt, Homo sapiens
gugagacuucuguuugaucac

SEQ ID NO: 1138642 - RNA, 12 nt, Homo sapiens
gugagagugcag

SEQ ID NO: 1138643 - RNA, 20 nt, Homo sapiens
gugagaugaaggaaggacua

SEQ ID NO: 1138644 - RNA, 13 nt, Homo sapiens
gugagaugcagcu

SEQ ID NO: 1138645 - RNA, 16 nt, Homo sapiens
gugagcucuuccagga

SEQ ID NO: 1138646 - RNA, 23 nt, Homo sapiens
gugagcucuuccaggagccaccu

SEQ ID NO: 1138647 - RNA, 12 nt, Homo sapiens
gugagggguccc

SEQ ID NO: 1138648 - RNA, 14 nt, Homo sapiens
gugaggucuugcag

SEQ ID NO: 1138649 - RNA, 19 nt, Homo sapiens
gugaguguuucuaugagug

SEQ ID NO: 1138650 - RNA, 23 nt, Homo sapiens
gugauacaacuucaagugcaugc

SEQ ID NO: 1138651 - RNA, 22 nt, Homo sapiens
gugaucugccugccuuggucuc

SEQ ID NO: 1138652 - RNA, 18 nt, Homo sapiens
gugaugaaucuacauuug

SEQ ID NO: 1138653 - RNA, 11 nt, Homo sapiens
gugauguauau

SEQ ID NO: 1138654 - RNA, 17 nt, Homo sapiens
gugauucggccucucca

SEQ ID NO: 1138655 - RNA, 22 nt, Homo sapiens
gugauugacagcuuugcugcug

SEQ ID NO: 1138656 - RNA, 15 nt, Homo sapiens
gugauuuagguuugu

SEQ ID NO: 1138657 - RNA, 15 nt, Homo sapiens
gugauuuccacaggu

SEQ ID NO: 1138658 - RNA, 14 nt, Homo sapiens
gugcaacagacaaa

SEQ ID NO: 1138659 - RNA, 22 nt, Homo sapiens
gugcaaggccaucugcuuacca

SEQ ID NO: 1138660 - RNA, 21 nt, Homo sapiens
gugcagaccuuacucagggga

SEQ ID NO: 1138661 - RNA, 16 nt, Homo sapiens
gugcagccguuugaga

SEQ ID NO: 1138662 - RNA, 16 nt, Homo sapiens
gugcaggacagcucuu

SEQ ID NO: 1138663 - RNA, 19 nt, Homo sapiens
gugcaguucuaguuugcau

SEQ ID NO: 1138664 - RNA, 21 nt, Homo sapiens
gugcaguuucuaagcauguag

SEQ ID NO: 1138665 - RNA, 15 nt, Homo sapiens
gugcauccccacgac

SEQ ID NO: 1138666 - RNA, 14 nt, Homo sapiens
gugccacucagaga

SEQ ID NO: 1138667 - RNA, 22 nt, Homo sapiens
gugccacugcacuccaggcugg

SEQ ID NO: 1138668 - RNA, 15 nt, Homo sapiens
gugccagaacccaaa

SEQ ID NO: 1138669 - RNA, 19 nt, Homo sapiens
gugccagauccucuucuca

SEQ ID NO: 1138670 - RNA, 16 nt, Homo sapiens
gugccaguuugaaugc

SEQ ID NO: 1138671 - RNA, 16 nt, Homo sapiens
gugcccagucuggcau

SEQ ID NO: 1138672 - RNA, 17 nt, Homo sapiens
gugcccccugaaacagc

SEQ ID NO: 1138673 - RNA, 20 nt, Homo sapiens
gugcccuuggaggccagcca

SEQ ID NO: 1138674 - RNA, 14 nt, Homo sapiens
gugccgacacuguu

SEQ ID NO: 1138675 - RNA, 19 nt, Homo sapiens
gugccuacagggcugggcc

SEQ ID NO: 1138676 - RNA, 13 nt, Homo sapiens
gugccuacaggug

SEQ ID NO: 1138677 - RNA, 15 nt, Homo sapiens
gugccuaugggaaug

SEQ ID NO: 1138678 - RNA, 12 nt, Homo sapiens
gugccuccagau

SEQ ID NO: 1138679 - RNA, 18 nt, Homo sapiens
gugccuggcacacaguaa

SEQ ID NO: 1138680 - RNA, 17 nt, Homo sapiens
gugccugggccuagcac

SEQ ID NO: 1138681 - RNA, 14 nt, Homo sapiens
gugccuuuugcaga

SEQ ID NO: 1138682 - RNA, 21 nt, Homo sapiens
gugcgugaagaccaacaaagu

SEQ ID NO: 1138683 - RNA, 18 nt, Homo sapiens
gugcguggaaguguuccu

SEQ ID NO: 1138684 - RNA, 22 nt, Homo sapiens
gugcuaccuggccuuccugcca

SEQ ID NO: 1138685 - RNA, 21 nt, Homo sapiens
gugcuaugaauuuucaaguaa

SEQ ID NO: 1138686 - RNA, 13 nt, Homo sapiens
gugcucugacccu

SEQ ID NO: 1138687 - RNA, 19 nt, Homo sapiens
gugcugggugagcucuucc

SEQ ID NO: 1138688 - RNA, 16 nt, Homo sapiens
gugcugugcugugcua

SEQ ID NO: 1138689 - RNA, 20 nt, Homo sapiens
guggaaggcaucagucccua

SEQ ID NO: 1138690 - RNA, 22 nt, Homo sapiens
guggacaagucauggacauuca

SEQ ID NO: 1138691 - RNA, 11 nt, Homo sapiens
guggacaugcg

SEQ ID NO: 1138692 - RNA, 20 nt, Homo sapiens
guggagaaauuccuugauuc

SEQ ID NO: 1138693 - RNA, 20 nt, Homo sapiens
guggagacauauuucaguga

SEQ ID NO: 1138694 - RNA, 22 nt, Homo sapiens
guggagccuuuuaacugugcaa

SEQ ID NO: 1138695 - RNA, 18 nt, Homo sapiens
guggaggggcccuccgag

SEQ ID NO: 1138696 - RNA, 18 nt, Homo sapiens
guggagugcaguggugcg

SEQ ID NO: 1138697 - RNA, 14 nt, Homo sapiens
guggauaacaaaga

SEQ ID NO: 1138698 - RNA, 15 nt, Homo sapiens
guggaugaugcugcc

SEQ ID NO: 1138699 - RNA, 21 nt, Homo sapiens
guggauguauggggaaucuaa

SEQ ID NO: 1138700 - RNA, 21 nt, Homo sapiens
guggcaucagugucuuuccac

SEQ ID NO: 1138701 - RNA, 15 nt, Homo sapiens
guggcaugcaccugc

SEQ ID NO: 1138702 - RNA, 22 nt, Homo sapiens
guggccaccaguaugacaguau

SEQ ID NO: 1138703 - RNA, 18 nt, Homo sapiens
guggccacuucuguccau

SEQ ID NO: 1138704 - RNA, 16 nt, Homo sapiens
guggccaggcugccug

SEQ ID NO: 1138705 - RNA, 15 nt, Homo sapiens
guggcccguggccug

SEQ ID NO: 1138706 - RNA, 15 nt, Homo sapiens
guggcccguggcuug

SEQ ID NO: 1138707 - RNA, 20 nt, Homo sapiens
guggcccuaggacaggagga

SEQ ID NO: 1138708 - RNA, 13 nt, Homo sapiens
guggcccuguccu

SEQ ID NO: 1138709 - RNA, 16 nt, Homo sapiens
guggccuagcacuggu

SEQ ID NO: 1138710 - RNA, 14 nt, Homo sapiens
guggcucacagugg

SEQ ID NO: 1138711 - RNA, 22 nt, Homo sapiens
guggcuucacagacccacaaga

SEQ ID NO: 1138712 - RNA, 18 nt, Homo sapiens
guggcuucuaguuugcaa

SEQ ID NO: 1138713 - RNA, 20 nt, Homo sapiens
gugggaggguaccagcagaa

SEQ ID NO: 1138714 - RNA, 20 nt, Homo sapiens
gugggcucccugacugggag

SEQ ID NO: 1138715 - RNA, 18 nt, Homo sapiens
guggggaaggaggccaag

SEQ ID NO: 1138716 - RNA, 21 nt, Homo sapiens
guggguaaaauuagaugcaug

SEQ ID NO: 1138717 - RNA, 21 nt, Homo sapiens
guggguggcuucuaguuugca

SEQ ID NO: 1138718 - RNA, 23 nt, Homo sapiens
guggguugguuuugguguaacau

SEQ ID NO: 1138719 - RNA, 17 nt, Homo sapiens
gugguacccaggcuucc

SEQ ID NO: 1138720 - RNA, 16 nt, Homo sapiens
guggucugagcugucc

SEQ ID NO: 1138721 - RNA, 18 nt, Homo sapiens
gugguggcacacaccagu

SEQ ID NO: 1138722 - RNA, 18 nt, Homo sapiens
gugguguuagggugcagc

SEQ ID NO: 1138723 - RNA, 16 nt, Homo sapiens
gugguuuuuugccagg

SEQ ID NO: 1138724 - RNA, 15 nt, Homo sapiens
guguaccuccucuca

SEQ ID NO: 1138725 - RNA, 16 nt, Homo sapiens
guguaguagugcauag

SEQ ID NO: 1138726 - RNA, 23 nt, Homo sapiens
guguauauaugucaaauugucag

SEQ ID NO: 1138727 - RNA, 18 nt, Homo sapiens
guguauauuuaagguaua

SEQ ID NO: 1138728 - RNA, 16 nt, Homo sapiens
guguaucaugguguuc

SEQ ID NO: 1138729 - RNA, 17 nt, Homo sapiens
guguaucuuuaagaaaa

SEQ ID NO: 1138730 - RNA, 15 nt, Homo sapiens
gugucaccugugcuu

SEQ ID NO: 1138731 - RNA, 17 nt, Homo sapiens
gugucaggaaacauauu

SEQ ID NO: 1138732 - RNA, 23 nt, Homo sapiens
gugucauuuaugugucaguucau

SEQ ID NO: 1138733 - RNA, 19 nt, Homo sapiens
guuuauaucaaaugagcau

SEQ ID NO: 1138734 - RNA, 15 nt, Homo sapiens
guuuaucaacucaag

SEQ ID NO: 1138735 - RNA, 23 nt, Homo sapiens
guuuaucguauuugaugcuacag

SEQ ID NO: 1138736 - RNA, 23 nt, Homo sapiens
guuuaugagaacugguucuugcc

SEQ ID NO: 1138737 - RNA, 19 nt, Homo sapiens
guuuaugauauuucuugcu

SEQ ID NO: 1138738 - RNA, 15 nt, Homo sapiens
guuucaaauguguca

SEQ ID NO: 1138739 - RNA, 19 nt, Homo sapiens
guuucaccauguuggccag

SEQ ID NO: 1138740 - RNA, 23 nt, Homo sapiens
guuucacuacaaucgcuaccuga

SEQ ID NO: 1138741 - RNA, 15 nt, Homo sapiens
guuucaucccaugua

SEQ ID NO: 1138742 - RNA, 18 nt, Homo sapiens
guuuccaaagaugugggu

SEQ ID NO: 1138743 - RNA, 17 nt, Homo sapiens
guuuccaucagacugaa

SEQ ID NO: 1138744 - RNA, 14 nt, Homo sapiens
guuucccuuccuua

SEQ ID NO: 1138745 - RNA, 12 nt, Homo sapiens
guuuccugaaac

SEQ ID NO: 1138746 - RNA, 19 nt, Homo sapiens
guuuccugucugauagcac

SEQ ID NO: 1138747 - RNA, 18 nt, Homo sapiens
guuuccuuccagcccaga

SEQ ID NO: 1138748 - RNA, 21 nt, Homo sapiens
guuucgugaaguauacuguau

SEQ ID NO: 1138749 - RNA, 19 nt, Homo sapiens
guuucucccccugccaguc

SEQ ID NO: 1138750 - RNA, 23 nt, Homo sapiens
guuucugugcagauaaacagaaa

SEQ ID NO: 1138751 - RNA, 16 nt, Homo sapiens
guuucuguugcuguua

SEQ ID NO: 1138752 - RNA, 18 nt, Homo sapiens
guuucuuccccaaccccu

SEQ ID NO: 1138753 - RNA, 22 nt, Homo sapiens
guuucuuuccccaaaaauugac

SEQ ID NO: 1138754 - RNA, 13 nt, Homo sapiens
guuugacucagua

SEQ ID NO: 1138755 - RNA, 21 nt, Homo sapiens
guuugacuuauugcuguuuca

SEQ ID NO: 1138756 - RNA, 23 nt, Homo sapiens
guuugagaacugccauucaguag

SEQ ID NO: 1138757 - RNA, 15 nt, Homo sapiens
guuugagaccagccu

SEQ ID NO: 1138758 - RNA, 18 nt, Homo sapiens
guuugauuugcuuuugaa

SEQ ID NO: 1138759 - RNA, 18 nt, Homo sapiens
guuugcagaaaagcaccu

SEQ ID NO: 1138760 - RNA, 13 nt, Homo sapiens
guuuggcuuucag

SEQ ID NO: 1138761 - RNA, 18 nt, Homo sapiens
guuugucagcaucugacc

SEQ ID NO: 1138762 - RNA, 20 nt, Homo sapiens
guuugugcucuacuguuacu

SEQ ID NO: 1138763 - RNA, 22 nt, Homo sapiens
guuugugugaucauacaguuau

SEQ ID NO: 1138764 - RNA, 14 nt, Homo sapiens
guuuuacaaagggg

SEQ ID NO: 1138765 - RNA, 18 nt, Homo sapiens
guuuuacgucugggagaa

SEQ ID NO: 1138766 - RNA, 15 nt, Homo sapiens
guuuuacuaucucac

SEQ ID NO: 1138767 - RNA, 12 nt, Homo sapiens
guuuuauacaaa

SEQ ID NO: 1138768 - RNA, 13 nt, Homo sapiens
guuuucaacauug

SEQ ID NO: 1138769 - RNA, 20 nt, Homo sapiens
guuuucaucauuucagccaa

SEQ ID NO: 1138770 - RNA, 12 nt, Homo sapiens
guuuucauuugc

SEQ ID NO: 1138771 - RNA, 15 nt, Homo sapiens
guuuuccacugugcu

SEQ ID NO: 1138772 - RNA, 16 nt, Homo sapiens
guuuuccugaaaucaa

SEQ ID NO: 1138773 - RNA, 15 nt, Homo sapiens
guuuucuaauaucuu

SEQ ID NO: 1138774 - RNA, 14 nt, Homo sapiens
guuuucucucuccg

SEQ ID NO: 1138775 - RNA, 23 nt, Homo sapiens
guuuugaaggcaaaauugcaaau

SEQ ID NO: 1138776 - RNA, 20 nt, Homo sapiens
guuuugauaaaguaguaaaa

SEQ ID NO: 1138777 - RNA, 13 nt, Homo sapiens
guuuugccaugua

SEQ ID NO: 1138778 - RNA, 21 nt, Homo sapiens
guuuuguaaauguacugguaa

SEQ ID NO: 1138779 - RNA, 23 nt, Homo sapiens
guuuuguuugguaguuuugccaa

SEQ ID NO: 1138780 - RNA, 14 nt, Homo sapiens
guuuuuaaacuaau

SEQ ID NO: 1138781 - RNA, 12 nt, Homo sapiens
guuuuuaaucuc

SEQ ID NO: 1138782 - RNA, 18 nt, Homo sapiens
guuuuuacucaaccaaau

SEQ ID NO: 1138783 - RNA, 18 nt, Homo sapiens
guuuuuccacuacugcua

SEQ ID NO: 1138784 - RNA, 21 nt, Homo sapiens
guuuuucuuacuugcauuuau

SEQ ID NO: 1138785 - RNA, 11 nt, Homo sapiens
guuuuugccca

SEQ ID NO: 1138786 - RNA, 14 nt, Homo sapiens
guuuuugcuguuaa

SEQ ID NO: 1138787 - RNA, 22 nt, Homo sapiens
guuuuuuaaaaaaaaauugaac

SEQ ID NO: 1138788 - RNA, 15 nt, Homo sapiens
guuuuuucauuugaa

SEQ ID NO: 1138789 - RNA, 16 nt, Homo sapiens
guuuuuucugcaauga

SEQ ID NO: 1138790 - RNA, 12 nt, Homo sapiens
guuuuuugccag

SEQ ID NO: 1138791 - RNA, 13 nt, Homo sapiens
uaaaaaagcaaau

SEQ ID NO: 1138792 - RNA, 15 nt, Homo sapiens
uaaaaacaagaugga

SEQ ID NO: 1138793 - RNA, 19 nt, Homo sapiens
uaaaaaccccaaacuguug

SEQ ID NO: 1138794 - RNA, 18 nt, Homo sapiens
uaaaaauaaaaaacauau

SEQ ID NO: 1138795 - RNA, 19 nt, Homo sapiens
uaaaaauaaaaaacauaua

SEQ ID NO: 1138796 - RNA, 14 nt, Homo sapiens
uaaaaauagaaaca

SEQ ID NO: 1138797 - RNA, 13 nt, Homo sapiens
uaaaaauagacac

SEQ ID NO: 1138798 - RNA, 17 nt, Homo sapiens
uaaaaaucacacuguaa

SEQ ID NO: 1138799 - RNA, 14 nt, Homo sapiens
uaaaaaucccaaac

SEQ ID NO: 1138800 - RNA, 15 nt, Homo sapiens
uaaaaaucccaaaca

SEQ ID NO: 1138801 - RNA, 14 nt, Homo sapiens
uaaaaaucugagaa

SEQ ID NO: 1138802 - RNA, 15 nt, Homo sapiens
uaaaaaugagugcuu

SEQ ID NO: 1138803 - RNA, 16 nt, Homo sapiens
uaaaaaugagugcuua

SEQ ID NO: 1138804 - RNA, 17 nt, Homo sapiens
uaaaaaugauacugaug

SEQ ID NO: 1138805 - RNA, 13 nt, Homo sapiens
uaaaaaugcaaau

SEQ ID NO: 1138806 - RNA, 17 nt, Homo sapiens
uaaaacaaaauuugacu

SEQ ID NO: 1138807 - RNA, 20 nt, Homo sapiens
uaaaacaugcuggugaacca

SEQ ID NO: 1138808 - RNA, 21 nt, Homo sapiens
uaaaacauguaauauaaagau

SEQ ID NO: 1138809 - RNA, 11 nt, Homo sapiens
uaaaaccacua

SEQ ID NO: 1138810 - RNA, 22 nt, Homo sapiens
uaaaacggauaccaaguugauu

SEQ ID NO: 1138811 - RNA, 14 nt, Homo sapiens
uaaaacuggaccug

SEQ ID NO: 1138812 - RNA, 21 nt, Homo sapiens
uaaaacuucaucuuccccaag

SEQ ID NO: 1138813 - RNA, 14 nt, Homo sapiens
uaaaacuuugccau

SEQ ID NO: 1138814 - RNA, 12 nt, Homo sapiens
uaaaagacauua

SEQ ID NO: 1138815 - RNA, 16 nt, Homo sapiens
uaaaagagaauuuacu

SEQ ID NO: 1138816 - RNA, 16 nt, Homo sapiens
uaaaagcaucacauga

SEQ ID NO: 1138817 - RNA, 17 nt, Homo sapiens
uaaaagccaauuagcuc

SEQ ID NO: 1138818 - RNA, 23 nt, Homo sapiens
uaaaagggaagucuagaguuccu

SEQ ID NO: 1138819 - RNA, 19 nt, Homo sapiens
uaaaagugcuuugcauuga

SEQ ID NO: 1138820 - RNA, 16 nt, Homo sapiens
uaaaaguggauuuaga

SEQ ID NO: 1138821 - RNA, 12 nt, Homo sapiens
uaaaaguucuca

SEQ ID NO: 1138822 - RNA, 19 nt, Homo sapiens
uaaaaguuguuaccaaaua

SEQ ID NO: 1138823 - RNA, 12 nt, Homo sapiens
uaaaaguuugaa

SEQ ID NO: 1138824 - RNA, 17 nt, Homo sapiens
uaaaauaaaugcaauug

SEQ ID NO: 1138825 - RNA, 20 nt, Homo sapiens
uaaaauaaauucucuccuaa

SEQ ID NO: 1138826 - RNA, 14 nt, Homo sapiens
uaaaauaagagauc

SEQ ID NO: 1138827 - RNA, 15 nt, Homo sapiens
uaaaauacuuuuugu

SEQ ID NO: 1138828 - RNA, 16 nt, Homo sapiens
uaaaauagaaacuacc

SEQ ID NO: 1138829 - RNA, 20 nt, Homo sapiens
uaaaauauacccaucaguau

SEQ ID NO: 1138830 - RNA, 17 nt, Homo sapiens
uaaaaucaucacaauua

SEQ ID NO: 1138831 - RNA, 19 nt, Homo sapiens
uaaaaugccaugaugccuc

SEQ ID NO: 1138832 - RNA, 15 nt, Homo sapiens
uaaaauggaugccuu

SEQ ID NO: 1138833 - RNA, 22 nt, Homo sapiens
uaaaaugugauguucuaaggcu

SEQ ID NO: 1138834 - RNA, 13 nt, Homo sapiens
uaaaaugugcagu

SEQ ID NO: 1138835 - RNA, 19 nt, Homo sapiens
uaaaauguuccuuuugaca

SEQ ID NO: 1138836 - RNA, 13 nt, Homo sapiens
uaaaauguucucu

SEQ ID NO: 1138837 - RNA, 12 nt, Homo sapiens
uaaaauucaggu

SEQ ID NO: 1138838 - RNA, 16 nt, Homo sapiens
uaaaauuucuacuaca

SEQ ID NO: 1138839 - RNA, 12 nt, Homo sapiens
uaaacagaauaa

SEQ ID NO: 1138840 - RNA, 11 nt, Homo sapiens
uaaacaggguc

SEQ ID NO: 1138841 - RNA, 15 nt, Homo sapiens
uaaacauagcuugua

SEQ ID NO: 1138842 - RNA, 15 nt, Homo sapiens
uaaacauauuuccua

SEQ ID NO: 1138843 - RNA, 15 nt, Homo sapiens
uaaaccacagcacua

SEQ ID NO: 1138844 - RNA, 22 nt, Homo sapiens
uaaaccagguuugcaccuaagu

SEQ ID NO: 1138845 - RNA, 18 nt, Homo sapiens
uaaacccaguugccaucu

SEQ ID NO: 1138846 - RNA, 14 nt, Homo sapiens
uaaacccuuaccaa

SEQ ID NO: 1138847 - RNA, 15 nt, Homo sapiens
uaaaccugacaaugg

SEQ ID NO: 1138848 - RNA, 16 nt, Homo sapiens
uaaaccugcaggguca

SEQ ID NO: 1138849 - RNA, 14 nt, Homo sapiens
uaaacuaggaauuu

SEQ ID NO: 1138850 - RNA, 16 nt, Homo sapiens
uaaacuagguguucua

SEQ ID NO: 1138851 - RNA, 14 nt, Homo sapiens
uaaacuccauuuaa

SEQ ID NO: 1138852 - RNA, 16 nt, Homo sapiens
uaaacucuccuuugau

SEQ ID NO: 1138853 - RNA, 15 nt, Homo sapiens
uaaacucuguugcaa

SEQ ID NO: 1138854 - RNA, 21 nt, Homo sapiens
uaaacugaagcugcuguaacu

SEQ ID NO: 1138855 - RNA, 14 nt, Homo sapiens
uaaacugugugcaa

SEQ ID NO: 1138856 - RNA, 17 nt, Homo sapiens
uaaacuuguuuacaaag

SEQ ID NO: 1138857 - RNA, 23 nt, Homo sapiens
uaaacuuuccucuuccugccuag

SEQ ID NO: 1138858 - RNA, 12 nt, Homo sapiens
uaaacuuuuuga

SEQ ID NO: 1138859 - RNA, 20 nt, Homo sapiens
uaaagaaaaucucugugaaa

SEQ ID NO: 1138860 - RNA, 21 nt, Homo sapiens
uaaagaaagaaauauuaacua

SEQ ID NO: 1138861 - RNA, 17 nt, Homo sapiens
uaaagaagugcaugaaa

SEQ ID NO: 1138862 - RNA, 15 nt, Homo sapiens
uaaagaauacuugaa

SEQ ID NO: 1138863 - RNA, 18 nt, Homo sapiens
uaaagaauacuugaacuu

SEQ ID NO: 1138864 - RNA, 21 nt, Homo sapiens
uaaagaauacuugaacuuguc

SEQ ID NO: 1138865 - RNA, 16 nt, Homo sapiens
ucagacgugugaccuc

SEQ ID NO: 1138866 - RNA, 20 nt, Homo sapiens
ucagacugaacuuacacugu

SEQ ID NO: 1138867 - RNA, 13 nt, Homo sapiens
ucagacuugucaa

SEQ ID NO: 1138868 - RNA, 22 nt, Homo sapiens
ucagacuuuggaaaaugcauug

SEQ ID NO: 1138869 - RNA, 14 nt, Homo sapiens
ucagagaaaacacu

SEQ ID NO: 1138870 - RNA, 15 nt, Homo sapiens
ucagagaaaacacuu

SEQ ID NO: 1138871 - RNA, 21 nt, Homo sapiens
ucagagaaaagagauugagau

SEQ ID NO: 1138872 - RNA, 18 nt, Homo sapiens
ucagagaaccagugcaga

SEQ ID NO: 1138873 - RNA, 19 nt, Homo sapiens
ucagagaagaaaaacguga

SEQ ID NO: 1138874 - RNA, 15 nt, Homo sapiens
ucagagaccauugca

SEQ ID NO: 1138875 - RNA, 16 nt, Homo sapiens
ucagagaccugaagug

SEQ ID NO: 1138876 - RNA, 13 nt, Homo sapiens
ucagagagacugu

SEQ ID NO: 1138877 - RNA, 15 nt, Homo sapiens
ucagagaucauggaa

SEQ ID NO: 1138878 - RNA, 12 nt, Homo sapiens
ucagagugcaag

SEQ ID NO: 1138879 - RNA, 16 nt, Homo sapiens
ucagaguugagaccuu

SEQ ID NO: 1138880 - RNA, 18 nt, Homo sapiens
ucagauaccgacuggggc

SEQ ID NO: 1138881 - RNA, 16 nt, Homo sapiens
ucagauagaaugacag

SEQ ID NO: 1138882 - RNA, 15 nt, Homo sapiens
ucagauauucugcuc

SEQ ID NO: 1138883 - RNA, 12 nt, Homo sapiens
ucagaucacugc

SEQ ID NO: 1138884 - RNA, 15 nt, Homo sapiens
ucagauccagggaca

SEQ ID NO: 1138885 - RNA, 19 nt, Homo sapiens
ucagaugcaauugcuccca

SEQ ID NO: 1138886 - RNA, 19 nt, Homo sapiens
ucagauugaauguauuuaa

SEQ ID NO: 1138887 - RNA, 23 nt, Homo sapiens
ucagauuuuuuuuuccuguaaug

SEQ ID NO: 1138888 - RNA, 11 nt, Homo sapiens
ucagcaaaaaa

SEQ ID NO: 1138889 - RNA, 16 nt, Homo sapiens
ucagcaacaaccaucu

SEQ ID NO: 1138890 - RNA, 13 nt, Homo sapiens
ucagcaacagagc

SEQ ID NO: 1138891 - RNA, 17 nt, Homo sapiens
ucagcaccugacccugu

SEQ ID NO: 1138892 - RNA, 19 nt, Homo sapiens
ucagcaguaucaaggcuga

SEQ ID NO: 1138893 - RNA, 23 nt, Homo sapiens
ucagcauagugacuaaacuacau

SEQ ID NO: 1138894 - RNA, 15 nt, Homo sapiens
ucagcaucugaccau

SEQ ID NO: 1138895 - RNA, 23 nt, Homo sapiens
ucagcaucugaccaucugugacu

SEQ ID NO: 1138896 - RNA, 14 nt, Homo sapiens
ucagccaaacagua

SEQ ID NO: 1138897 - RNA, 13 nt, Homo sapiens
ucagccaaaggga

SEQ ID NO: 1138898 - RNA, 17 nt, Homo sapiens
ucagccaacauugccuu

SEQ ID NO: 1138899 - RNA, 18 nt, Homo sapiens
ucagccaacauugccuug

SEQ ID NO: 1138900 - RNA, 15 nt, Homo sapiens
ucagccaacugaaaa

SEQ ID NO: 1138901 - RNA, 16 nt, Homo sapiens
ucagccauaggugcag

SEQ ID NO: 1138902 - RNA, 12 nt, Homo sapiens
ucagccaugagg

SEQ ID NO: 1138903 - RNA, 16 nt, Homo sapiens
ucagccuggccagaca

SEQ ID NO: 1138904 - RNA, 21 nt, Homo sapiens
ucagccuugccagagauccaa

SEQ ID NO: 1138905 - RNA, 11 nt, Homo sapiens
ucagcuacaaa

SEQ ID NO: 1138906 - RNA, 20 nt, Homo sapiens
ucagcuagacauugcaauuu

SEQ ID NO: 1138907 - RNA, 14 nt, Homo sapiens
ucagcugcucccac

SEQ ID NO: 1138908 - RNA, 18 nt, Homo sapiens
ucagcuggucaaacaaac

SEQ ID NO: 1138909 - RNA, 18 nt, Homo sapiens
ucaggaaauauaucuuaa

SEQ ID NO: 1138910 - RNA, 23 nt, Homo sapiens
ucaggaagccauuuuuuauuuca

SEQ ID NO: 1138911 - RNA, 22 nt, Homo sapiens
ucaggaccuccaagccacugag

SEQ ID NO: 1138912 - RNA, 18 nt, Homo sapiens
ucaggaguucgagaccag

SEQ ID NO: 1138913 - RNA, 15 nt, Homo sapiens
ucaggcaacgcacaa

SEQ ID NO: 1138914 - RNA, 13 nt, Homo sapiens
ucaggcacacagc

SEQ ID NO: 1138915 - RNA, 17 nt, Homo sapiens
ucaggcacacagcuacu

SEQ ID NO: 1138916 - RNA, 12 nt, Homo sapiens
ucaggcaccugg

SEQ ID NO: 1138917 - RNA, 15 nt, Homo sapiens
ucaggcagugugagu

SEQ ID NO: 1138918 - RNA, 17 nt, Homo sapiens
ucagggauccaauauga

SEQ ID NO: 1138919 - RNA, 14 nt, Homo sapiens
ucagggccaggaag

SEQ ID NO: 1138920 - RNA, 20 nt, Homo sapiens
ucaggggcggggagggugac

SEQ ID NO: 1138921 - RNA, 18 nt, Homo sapiens
ucaggggcugacacuuca

SEQ ID NO: 1138922 - RNA, 20 nt, Homo sapiens
ucccgaggggaagcgauuac

SEQ ID NO: 1138923 - RNA, 20 nt, Homo sapiens
ucccgauaacuuugugaugu

SEQ ID NO: 1138924 - RNA, 21 nt, Homo sapiens
ucccgcaccugucugaacugu

SEQ ID NO: 1138925 - RNA, 16 nt, Homo sapiens
ucccggcccauguuga

SEQ ID NO: 1138926 - RNA, 21 nt, Homo sapiens
ucccggcgggugcucugaggc

SEQ ID NO: 1138927 - RNA, 14 nt, Homo sapiens
ucccgggacuaccu

SEQ ID NO: 1138928 - RNA, 13 nt, Homo sapiens
ucccgucucgccu

SEQ ID NO: 1138929 - RNA, 13 nt, Homo sapiens
ucccuaccuacca

SEQ ID NO: 1138930 - RNA, 17 nt, Homo sapiens
ucccuaguuagcaucca

SEQ ID NO: 1138931 - RNA, 13 nt, Homo sapiens
ucccuauuuuccu

SEQ ID NO: 1138932 - RNA, 16 nt, Homo sapiens
ucccucacagcacuag

SEQ ID NO: 1138933 - RNA, 16 nt, Homo sapiens
ucccucacccaggcac

SEQ ID NO: 1138934 - RNA, 21 nt, Homo sapiens
ucccucacccaggcacugggc

SEQ ID NO: 1138935 - RNA, 15 nt, Homo sapiens
ucccucaucuguccc

SEQ ID NO: 1138936 - RNA, 12 nt, Homo sapiens
ucccuccagcac

SEQ ID NO: 1138937 - RNA, 15 nt, Homo sapiens
ucccuccagcacaaa

SEQ ID NO: 1138938 - RNA, 21 nt, Homo sapiens
ucccucccaggacucugaccc

SEQ ID NO: 1138939 - RNA, 13 nt, Homo sapiens
ucccuccucacac

SEQ ID NO: 1138940 - RNA, 17 nt, Homo sapiens
ucccucgggugugcuau

SEQ ID NO: 1138941 - RNA, 11 nt, Homo sapiens
ucccucuacau

SEQ ID NO: 1138942 - RNA, 22 nt, Homo sapiens
ucccucuacauggacucagaga

SEQ ID NO: 1138943 - RNA, 14 nt, Homo sapiens
ucccucuacuggga

SEQ ID NO: 1138944 - RNA, 15 nt, Homo sapiens
ucccucuacugggag

SEQ ID NO: 1138945 - RNA, 15 nt, Homo sapiens
ucccucucagugccu

SEQ ID NO: 1138946 - RNA, 13 nt, Homo sapiens
ucccugacagagg

SEQ ID NO: 1138947 - RNA, 18 nt, Homo sapiens
ucccugacagagguacaa

SEQ ID NO: 1138948 - RNA, 15 nt, Homo sapiens
ucccuggccacugaa

SEQ ID NO: 1138949 - RNA, 21 nt, Homo sapiens
ucccuggggcugcugugcgcu

SEQ ID NO: 1138950 - RNA, 14 nt, Homo sapiens
ucccuguaaccucu

SEQ ID NO: 1138951 - RNA, 21 nt, Homo sapiens
ucccuguccuccucggaucac

SEQ ID NO: 1138952 - RNA, 19 nt, Homo sapiens
ucccuguggguggggagcu

SEQ ID NO: 1138953 - RNA, 23 nt, Homo sapiens
ucccuuacuauucccacuuucau

SEQ ID NO: 1138954 - RNA, 17 nt, Homo sapiens
ucccuuccaccucacaa

SEQ ID NO: 1138955 - RNA, 16 nt, Homo sapiens
ucccuucccauaagcu

SEQ ID NO: 1138956 - RNA, 20 nt, Homo sapiens
ucccuucgaaagccucucag

SEQ ID NO: 1138957 - RNA, 12 nt, Homo sapiens
ucccuugaccau

SEQ ID NO: 1138958 - RNA, 20 nt, Homo sapiens
ucccuugaggaaacaacagc

SEQ ID NO: 1138959 - RNA, 16 nt, Homo sapiens
ucccuugcuguaugcu

SEQ ID NO: 1138960 - RNA, 20 nt, Homo sapiens
ucccuugcuguaugcugauc

SEQ ID NO: 1138961 - RNA, 23 nt, Homo sapiens
ucccuugcuguaugcugaucauc

SEQ ID NO: 1138962 - RNA, 18 nt, Homo sapiens
ucccuuuggagaugcuga

SEQ ID NO: 1138963 - RNA, 20 nt, Homo sapiens
ucccuuuuacauacugcugu

SEQ ID NO: 1138964 - RNA, 23 nt, Homo sapiens
ucccuuuuaguuugaucagacag

SEQ ID NO: 1138965 - RNA, 14 nt, Homo sapiens
uccgagauagggug

SEQ ID NO: 1138966 - RNA, 13 nt, Homo sapiens
uccgaggccagua

SEQ ID NO: 1138967 - RNA, 22 nt, Homo sapiens
uccgaggccccugucucagggu

SEQ ID NO: 1138968 - RNA, 16 nt, Homo sapiens
uccgcagcuucagggg

SEQ ID NO: 1138969 - RNA, 14 nt, Homo sapiens
uccgcaugccaacg

SEQ ID NO: 1138970 - RNA, 17 nt, Homo sapiens
uccggaggcugaggcag

SEQ ID NO: 1138971 - RNA, 14 nt, Homo sapiens
uccggcggggaccc

SEQ ID NO: 1138972 - RNA, 13 nt, Homo sapiens
uccgugcuaugac

SEQ ID NO: 1138973 - RNA, 14 nt, Homo sapiens
uccgugcuaugaca

SEQ ID NO: 1138974 - RNA, 16 nt, Homo sapiens
uccguuccucauccac

SEQ ID NO: 1138975 - RNA, 19 nt, Homo sapiens
uccguugagcuugcuuuua

SEQ ID NO: 1138976 - RNA, 23 nt, Homo sapiens
uccuaaagaaaaauaucuuggcc

SEQ ID NO: 1138977 - RNA, 16 nt, Homo sapiens
uccuaaaguaacauca

SEQ ID NO: 1138978 - RNA, 17 nt, Homo sapiens
uccuaaggccacuguuu

SEQ ID NO: 1138979 - RNA, 20 nt, Homo sapiens
uccuaaggccacuguuuuaa

SEQ ID NO: 1138980 - RNA, 14 nt, Homo sapiens
uccuaagggcucac

SEQ ID NO: 1138981 - RNA, 21 nt, Homo sapiens
uccuaagggucgaaagcucua

SEQ ID NO: 1138982 - RNA, 20 nt, Homo sapiens
uccuaaucaagagucucucc

SEQ ID NO: 1138983 - RNA, 14 nt, Homo sapiens
uccuagccacccac

SEQ ID NO: 1138984 - RNA, 15 nt, Homo sapiens
uccuagugaaccuca

SEQ ID NO: 1138985 - RNA, 16 nt, Homo sapiens
uccuaucauucccuag

SEQ ID NO: 1138986 - RNA, 16 nt, Homo sapiens
uccuauuacuuuucau

SEQ ID NO: 1138987 - RNA, 20 nt, Homo sapiens
uccuauuucuuauagucaau

SEQ ID NO: 1138988 - RNA, 20 nt, Homo sapiens
uccucaacugggaaccuuca

SEQ ID NO: 1138989 - RNA, 15 nt, Homo sapiens
uccucaagaacacag

SEQ ID NO: 1138990 - RNA, 20 nt, Homo sapiens
uccucaccccagacuccuga

SEQ ID NO: 1138991 - RNA, 17 nt, Homo sapiens
uccucacuuuauggaag

SEQ ID NO: 1138992 - RNA, 19 nt, Homo sapiens
uccucagccuugccagaga

SEQ ID NO: 1138993 - RNA, 15 nt, Homo sapiens
uccucagcuuaucuc

SEQ ID NO: 1138994 - RNA, 23 nt, Homo sapiens
uccucagcuucuuccccgagaaa

SEQ ID NO: 1138995 - RNA, 15 nt, Homo sapiens
uccucaguccacugc

SEQ ID NO: 1138996 - RNA, 18 nt, Homo sapiens
uccucaguuaaguguuuc

SEQ ID NO: 1138997 - RNA, 20 nt, Homo sapiens
uccucaucgacacuuacucc

SEQ ID NO: 1138998 - RNA, 19 nt, Homo sapiens
uccucaucuuuaaaaugaa

SEQ ID NO: 1138999 - RNA, 15 nt, Homo sapiens
uccuccacaaauuau

SEQ ID NO: 1139000 - RNA, 14 nt, Homo sapiens
uccuccccaccaga

SEQ ID NO: 1139001 - RNA, 22 nt, Homo sapiens
uccuccccauguacccaaggaa

SEQ ID NO: 1139002 - RNA, 15 nt, Homo sapiens
uccucccuucugcua

SEQ ID NO: 1139003 - RNA, 23 nt, Homo sapiens
uccuccuauuccaguguccaugu

SEQ ID NO: 1139004 - RNA, 23 nt, Homo sapiens
uccuccuguucugaaaccuuagu

SEQ ID NO: 1139005 - RNA, 23 nt, Homo sapiens
uccucuaccucucagcugcugaa

SEQ ID NO: 1139006 - RNA, 13 nt, Homo sapiens
uccucugacucag

SEQ ID NO: 1139007 - RNA, 15 nt, Homo sapiens
uccucugccaccucc

SEQ ID NO: 1139008 - RNA, 21 nt, Homo sapiens
uccucugucagucacagccac

SEQ ID NO: 1139009 - RNA, 16 nt, Homo sapiens
uccucuucucaaagcu

SEQ ID NO: 1139010 - RNA, 17 nt, Homo sapiens
uccugaaagcauuauuu

SEQ ID NO: 1139011 - RNA, 13 nt, Homo sapiens
uccugaagcugcu

SEQ ID NO: 1139012 - RNA, 15 nt, Homo sapiens
uccugaauccagcau

SEQ ID NO: 1139013 - RNA, 18 nt, Homo sapiens
uccugaccucaaguaauc

SEQ ID NO: 1139014 - RNA, 23 nt, Homo sapiens
uccugaccucaaguaauccaccu

SEQ ID NO: 1139015 - RNA, 18 nt, Homo sapiens
uccugacucuucaggcca

SEQ ID NO: 1139016 - RNA, 19 nt, Homo sapiens
uccugacuuuuaaugucau

SEQ ID NO: 1139017 - RNA, 17 nt, Homo sapiens
uccugagaagcauguaa

SEQ ID NO: 1139018 - RNA, 18 nt, Homo sapiens
uccugagaggaagccuga

SEQ ID NO: 1139019 - RNA, 19 nt, Homo sapiens
uccugaguuggccaggcau

SEQ ID NO: 1139020 - RNA, 20 nt, Homo sapiens
uccugaucgccaaccuuucc

SEQ ID NO: 1139021 - RNA, 18 nt, Homo sapiens
uccugaugcuuuugucua

SEQ ID NO: 1139022 - RNA, 13 nt, Homo sapiens
uccugauguuugu

SEQ ID NO: 1139023 - RNA, 22 nt, Homo sapiens
uccugcaaagucuccagaagaa

SEQ ID NO: 1139024 - RNA, 23 nt, Homo sapiens
uccugcuacucuguuccuucaca

SEQ ID NO: 1139025 - RNA, 21 nt, Homo sapiens
uccugcuccguuccucaucca

SEQ ID NO: 1139026 - RNA, 17 nt, Homo sapiens
uccugcugcuucugcaa

SEQ ID NO: 1139027 - RNA, 15 nt, Homo sapiens
uccugcuucugauau

SEQ ID NO: 1139028 - RNA, 15 nt, Homo sapiens
uccugcuuuacagga

SEQ ID NO: 1139029 - RNA, 20 nt, Homo sapiens
uccuggaugucugaacuuug

SEQ ID NO: 1139030 - RNA, 19 nt, Homo sapiens
uccuggcugcacucuugaa

SEQ ID NO: 1139031 - RNA, 20 nt, Homo sapiens
uccugggccacguaucaaca

SEQ ID NO: 1139032 - RNA, 19 nt, Homo sapiens
uccuggugagaacugagga

SEQ ID NO: 1139033 - RNA, 15 nt, Homo sapiens
uccuguaacuuuuaa

SEQ ID NO: 1139034 - RNA, 22 nt, Homo sapiens
uccugucauuuuuuuucucuag

SEQ ID NO: 1139035 - RNA, 14 nt, Homo sapiens
uccuguccagacac

SEQ ID NO: 1139036 - RNA, 16 nt, Homo sapiens
uccugucccucuucca

SEQ ID NO: 1139037 - RNA, 14 nt, Homo sapiens
uccugucuccuuug

SEQ ID NO: 1139038 - RNA, 16 nt, Homo sapiens
uccugucugaacaaaa

SEQ ID NO: 1139039 - RNA, 22 nt, Homo sapiens
uccugucuguuuccucuguaua

SEQ ID NO: 1139040 - RNA, 17 nt, Homo sapiens
uccuguggcagcugccc

SEQ ID NO: 1139041 - RNA, 18 nt, Homo sapiens
uccuguggucucugacca

SEQ ID NO: 1139042 - RNA, 15 nt, Homo sapiens
uccugugucaaucca

SEQ ID NO: 1139043 - RNA, 24 nt, Homo sapiens
uccuguuagcuccucacuguggua

SEQ ID NO: 1139044 - RNA, 20 nt, Homo sapiens
uccuguucgguuccagacac

SEQ ID NO: 1139045 - RNA, 17 nt, Homo sapiens
uccuguucuuucuuaca

SEQ ID NO: 1139046 - RNA, 16 nt, Homo sapiens
uccuuaaaaaucacac

SEQ ID NO: 1139047 - RNA, 15 nt, Homo sapiens
uccuuaaaguuuucc

SEQ ID NO: 1139048 - RNA, 13 nt, Homo sapiens
uccuuacugucuc

SEQ ID NO: 1139049 - RNA, 12 nt, Homo sapiens
uccuuacuucca

SEQ ID NO: 1139050 - RNA, 15 nt, Homo sapiens
uccuuacuuuacugc

SEQ ID NO: 1139051 - RNA, 16 nt, Homo sapiens
uccuuaucagugccau

SEQ ID NO: 1139052 - RNA, 14 nt, Homo sapiens
uccuuaucugcuaa

SEQ ID NO: 1139053 - RNA, 17 nt, Homo sapiens
uccuuaugacuuuucau

SEQ ID NO: 1139054 - RNA, 14 nt, Homo sapiens
uccuuccuuaucac

SEQ ID NO: 1139055 - RNA, 18 nt, Homo sapiens
uccuuccuuuucuuugag

SEQ ID NO: 1139056 - RNA, 16 nt, Homo sapiens
uccuucucaucuguga

SEQ ID NO: 1139057 - RNA, 15 nt, Homo sapiens
gcacuuacaauccca

SEQ ID NO: 1139058 - RNA, 23 nt, Homo sapiens
gcacuuauaagaaagaucaaaga

SEQ ID NO: 1139059 - RNA, 11 nt, Homo sapiens
gcacuucauau

SEQ ID NO: 1139060 - RNA, 14 nt, Homo sapiens
gcacuuuaccagag

SEQ ID NO: 1139061 - RNA, 22 nt, Homo sapiens
gcacuuugcaucacagucacau

SEQ ID NO: 1139062 - RNA, 20 nt, Homo sapiens
gcacuuugggaggccaagga

SEQ ID NO: 1139063 - RNA, 17 nt, Homo sapiens
gcacuuuggggguuuga

SEQ ID NO: 1139064 - RNA, 19 nt, Homo sapiens
gcagaaagguuaguaucau

SEQ ID NO: 1139065 - RNA, 18 nt, Homo sapiens
gcagaagguuacuaccua

SEQ ID NO: 1139066 - RNA, 23 nt, Homo sapiens
gcagaaucccccaaagaaccagg

SEQ ID NO: 1139067 - RNA, 16 nt, Homo sapiens
gcagaaucucagagaa

SEQ ID NO: 1139068 - RNA, 15 nt, Homo sapiens
gcagaauguacuuga

SEQ ID NO: 1139069 - RNA, 18 nt, Homo sapiens
gcagaauugagagugauu

SEQ ID NO: 1139070 - RNA, 12 nt, Homo sapiens
gcagacaggcug

SEQ ID NO: 1139071 - RNA, 20 nt, Homo sapiens
gcagacauagaagagccaag

SEQ ID NO: 1139072 - RNA, 13 nt, Homo sapiens
gcagaccacugau

SEQ ID NO: 1139073 - RNA, 15 nt, Homo sapiens
gcagaccucuggauu

SEQ ID NO: 1139074 - RNA, 13 nt, Homo sapiens
gcagagcauuuaa

SEQ ID NO: 1139075 - RNA, 18 nt, Homo sapiens
gcagagggccuuugcuac

SEQ ID NO: 1139076 - RNA, 21 nt, Homo sapiens
gcagagggucuccaagggcau

SEQ ID NO: 1139077 - RNA, 14 nt, Homo sapiens
gcagaggucuccca

SEQ ID NO: 1139078 - RNA, 16 nt, Homo sapiens
gcagaguucuauaaug

SEQ ID NO: 1139079 - RNA, 19 nt, Homo sapiens
gcagaguugacaugagauu

SEQ ID NO: 1139080 - RNA, 21 nt, Homo sapiens
gcagauaacagaaaggcuuuu

SEQ ID NO: 1139081 - RNA, 20 nt, Homo sapiens
gcagauaacugcuguauuca

SEQ ID NO: 1139082 - RNA, 17 nt, Homo sapiens
gcagauagaaagcauua

SEQ ID NO: 1139083 - RNA, 19 nt, Homo sapiens
gcagaucacguugcaaugg

SEQ ID NO: 1139084 - RNA, 13 nt, Homo sapiens
gcagcaaacugcu

SEQ ID NO: 1139085 - RNA, 19 nt, Homo sapiens
gcagcaccguucugugcac

SEQ ID NO: 1139086 - RNA, 13 nt, Homo sapiens
gcagcagcucaca

SEQ ID NO: 1139087 - RNA, 13 nt, Homo sapiens
gcagcaggcaugg

SEQ ID NO: 1139088 - RNA, 16 nt, Homo sapiens
gcagcaucucuggccu

SEQ ID NO: 1139089 - RNA, 15 nt, Homo sapiens
gcagcauuccaugac

SEQ ID NO: 1139090 - RNA, 16 nt, Homo sapiens
gcagccagccaucaaa

SEQ ID NO: 1139091 - RNA, 18 nt, Homo sapiens
gcagcccaacagcacuuu

SEQ ID NO: 1139092 - RNA, 16 nt, Homo sapiens
gcagcccuuguuuaua

SEQ ID NO: 1139093 - RNA, 14 nt, Homo sapiens
gcagccucaucauu

SEQ ID NO: 1139094 - RNA, 14 nt, Homo sapiens
gcagcuaaaaccua

SEQ ID NO: 1139095 - RNA, 19 nt, Homo sapiens
gcagcucacacccuaccuu

SEQ ID NO: 1139096 - RNA, 20 nt, Homo sapiens
gcagcucauccaagcuugua

SEQ ID NO: 1139097 - RNA, 18 nt, Homo sapiens
gcagcugcuacuagcucu

SEQ ID NO: 1139098 - RNA, 17 nt, Homo sapiens
gcagcugguaaucuugc

SEQ ID NO: 1139099 - RNA, 18 nt, Homo sapiens
gcaggaaaugaaaauguc

SEQ ID NO: 1139100 - RNA, 19 nt, Homo sapiens
gcaggaagcucagacuggu

SEQ ID NO: 1139101 - RNA, 19 nt, Homo sapiens
gccaggaaagcagcaaagg

SEQ ID NO: 1139102 - RNA, 22 nt, Homo sapiens
gccaggaacuguguguguugca

SEQ ID NO: 1139103 - RNA, 18 nt, Homo sapiens
gccaggauggacuccauc

SEQ ID NO: 1139104 - RNA, 16 nt, Homo sapiens
gccaggcaaaggaaau

SEQ ID NO: 1139105 - RNA, 19 nt, Homo sapiens
gccaggccucgccugcccu

SEQ ID NO: 1139106 - RNA, 21 nt, Homo sapiens
gccaggccucuuggcagucac

SEQ ID NO: 1139107 - RNA, 15 nt, Homo sapiens
gccaggcugaucucg

SEQ ID NO: 1139108 - RNA, 19 nt, Homo sapiens
gccagggaauccugaccug

SEQ ID NO: 1139109 - RNA, 18 nt, Homo sapiens
gccagggcaaugaugaau

SEQ ID NO: 1139110 - RNA, 17 nt, Homo sapiens
gccaggggcgaggcccu

SEQ ID NO: 1139111 - RNA, 18 nt, Homo sapiens
gccaggugugguggcuca

SEQ ID NO: 1139112 - RNA, 18 nt, Homo sapiens
gccaggugugguggugca

SEQ ID NO: 1139113 - RNA, 22 nt, Homo sapiens
gccaguauaaagggacuugaag

SEQ ID NO: 1139114 - RNA, 14 nt, Homo sapiens
gccagugcacuccg

SEQ ID NO: 1139115 - RNA, 15 nt, Homo sapiens
gccagugucuguuca

SEQ ID NO: 1139116 - RNA, 19 nt, Homo sapiens
gccaguguggaagcugccu

SEQ ID NO: 1139117 - RNA, 10 nt, Homo sapiens
gccagugugu

SEQ ID NO: 1139118 - RNA, 14 nt, Homo sapiens
gccauaacuuuaug

SEQ ID NO: 1139119 - RNA, 22 nt, Homo sapiens
gccauaacuuuaugaagugcua

SEQ ID NO: 1139120 - RNA, 21 nt, Homo sapiens
gccauauaaguuugaaggaaa

SEQ ID NO: 1139121 - RNA, 20 nt, Homo sapiens
gccauauggacacugugaca

SEQ ID NO: 1139122 - RNA, 15 nt, Homo sapiens
gccaucaagcacuuc

SEQ ID NO: 1139123 - RNA, 15 nt, Homo sapiens
gccauccaugugcua

SEQ ID NO: 1139124 - RNA, 17 nt, Homo sapiens
gccaucuaauggcuuca

SEQ ID NO: 1139125 - RNA, 13 nt, Homo sapiens
gccaucucagguu

SEQ ID NO: 1139126 - RNA, 16 nt, Homo sapiens
gccaugagaugauaca

SEQ ID NO: 1139127 - RNA, 22 nt, Homo sapiens
gccaugagaugauacauccaaa

SEQ ID NO: 1139128 - RNA, 22 nt, Homo sapiens
gccauggcuuucauccuguguc

SEQ ID NO: 1139129 - RNA, 18 nt, Homo sapiens
gccaugggggcaacagcc

SEQ ID NO: 1139130 - RNA, 16 nt, Homo sapiens
gccauguuuuugccaa

SEQ ID NO: 1139131 - RNA, 17 nt, Homo sapiens
gccauguuuuugccaaa

SEQ ID NO: 1139132 - RNA, 13 nt, Homo sapiens
gccauucaugucc

SEQ ID NO: 1139133 - RNA, 22 nt, Homo sapiens
gccauuuuaaggaaaacuaccu

SEQ ID NO: 1139134 - RNA, 17 nt, Homo sapiens
gcccaaagaaagagcua

SEQ ID NO: 1139135 - RNA, 14 nt, Homo sapiens
gcccaacagcacuu

SEQ ID NO: 1139136 - RNA, 17 nt, Homo sapiens
gcccaacuacuaucuca

SEQ ID NO: 1139137 - RNA, 22 nt, Homo sapiens
gcccaacuacuaucucagagau

SEQ ID NO: 1139138 - RNA, 18 nt, Homo sapiens
gcccaauauaaaaggcaa

SEQ ID NO: 1139139 - RNA, 22 nt, Homo sapiens
gcccacccaucacgugugauug

SEQ ID NO: 1139140 - RNA, 21 nt, Homo sapiens
gcccacugcugcaguagggga

SEQ ID NO: 1139141 - RNA, 15 nt, Homo sapiens
gcccagagcccagcu

SEQ ID NO: 1139142 - RNA, 17 nt, Homo sapiens
gcccagagcccagcucc

SEQ ID NO: 1139143 - RNA, 17 nt, Homo sapiens
gcccagauugugccacu

SEQ ID NO: 1139144 - RNA, 19 nt, Homo sapiens
gcccagcaggggcccucac

SEQ ID NO: 1139145 - RNA, 14 nt, Homo sapiens
gcccagcauggaau

SEQ ID NO: 1139146 - RNA, 15 nt, Homo sapiens
gcccagccacauuuc

SEQ ID NO: 1139147 - RNA, 16 nt, Homo sapiens
gcccagcuaaagcaau

SEQ ID NO: 1139148 - RNA, 15 nt, Homo sapiens
gcccagcuauacugu

SEQ ID NO: 1139149 - RNA, 23 nt, Homo sapiens
gcccagcuuauugugugcgcugc

SEQ ID NO: 1139150 - RNA, 19 nt, Homo sapiens
gcccaggaccaucauccua

SEQ ID NO: 1139151 - RNA, 20 nt, Homo sapiens
gcccaggauggagugcaaug

SEQ ID NO: 1139152 - RNA, 20 nt, Homo sapiens
gcccaggccuugcugacucu

SEQ ID NO: 1139153 - RNA, 18 nt, Homo sapiens
gcccaggcuagagugcaa

SEQ ID NO: 1139154 - RNA, 12 nt, Homo sapiens
gcccagugcaug

SEQ ID NO: 1139155 - RNA, 19 nt, Homo sapiens
gcccauccgugcuaugaca

SEQ ID NO: 1139156 - RNA, 21 nt, Homo sapiens
gcccauggaagucucaaagau

SEQ ID NO: 1139157 - RNA, 21 nt, Homo sapiens
gcccauguugagccaugagug

SEQ ID NO: 1139158 - RNA, 14 nt, Homo sapiens
gcccauucuuuuca

SEQ ID NO: 1139159 - RNA, 20 nt, Homo sapiens
gcccauuucauauucuuuca

SEQ ID NO: 1139160 - RNA, 22 nt, Homo sapiens
gccccacauguccagcaccuug

SEQ ID NO: 1139161 - RNA, 23 nt, Homo sapiens
gccccacccuggaaugccaaugu

SEQ ID NO: 1139162 - RNA, 15 nt, Homo sapiens
gccccaggaagccgu

SEQ ID NO: 1139163 - RNA, 22 nt, Homo sapiens
gccccaggcacuuugcaucaca

SEQ ID NO: 1139164 - RNA, 16 nt, Homo sapiens
gccccaggcauugcca

SEQ ID NO: 1139165 - RNA, 14 nt, Homo sapiens
gccccaucugggga

SEQ ID NO: 1139166 - RNA, 22 nt, Homo sapiens
gcccccaccgggcugcaggugc

SEQ ID NO: 1139167 - RNA, 21 nt, Homo sapiens
gcccccaccgugggcagggag

SEQ ID NO: 1139168 - RNA, 13 nt, Homo sapiens
gcccccauuucac

SEQ ID NO: 1139169 - RNA, 13 nt, Homo sapiens
gcccccccuucca

SEQ ID NO: 1139170 - RNA, 16 nt, Homo sapiens
gcccccccuuccacuu

SEQ ID NO: 1139171 - RNA, 15 nt, Homo sapiens
gcccccucagggaug

SEQ ID NO: 1139172 - RNA, 13 nt, Homo sapiens
gccccgcggccca

SEQ ID NO: 1139173 - RNA, 20 nt, Homo sapiens
gccccuauagaaacaccagu

SEQ ID NO: 1139174 - RNA, 18 nt, Homo sapiens
gccccuggcucugaccga

SEQ ID NO: 1139175 - RNA, 22 nt, Homo sapiens
gccccugggguggccaccagua

SEQ ID NO: 1139176 - RNA, 20 nt, Homo sapiens
gccccugucgucaggaccuc

SEQ ID NO: 1139177 - RNA, 20 nt, Homo sapiens
gccccugugccucuguccua

SEQ ID NO: 1139178 - RNA, 14 nt, Homo sapiens
gcccgagccaggaa

SEQ ID NO: 1139179 - RNA, 21 nt, Homo sapiens
gcccgaguccccgggcaucuu

SEQ ID NO: 1139180 - RNA, 15 nt, Homo sapiens
gcccgcagcccagac

SEQ ID NO: 1139181 - RNA, 18 nt, Homo sapiens
gcccggggugguccaaug

SEQ ID NO: 1139182 - RNA, 16 nt, Homo sapiens
gcccguucuugaaaug

SEQ ID NO: 1139183 - RNA, 15 nt, Homo sapiens
gcccuaaaagcacac

SEQ ID NO: 1139184 - RNA, 15 nt, Homo sapiens
gcccuaauucaucuu

SEQ ID NO: 1139185 - RNA, 13 nt, Homo sapiens
gcccuaggugaga

SEQ ID NO: 1139186 - RNA, 17 nt, Homo sapiens
gcccucaaguaaaagaa

SEQ ID NO: 1139187 - RNA, 20 nt, Homo sapiens
gcccucagccccacuucuca

SEQ ID NO: 1139188 - RNA, 15 nt, Homo sapiens
gcccuccaugguccu

SEQ ID NO: 1139189 - RNA, 22 nt, Homo sapiens
gcccucccuaccuaccaagaua

SEQ ID NO: 1139190 - RNA, 18 nt, Homo sapiens
gcccugaaccucugaugc

SEQ ID NO: 1139191 - RNA, 17 nt, Homo sapiens
gcccugaauuucuucuu

SEQ ID NO: 1139192 - RNA, 14 nt, Homo sapiens
gcccugacccugug

SEQ ID NO: 1139193 - RNA, 17 nt, Homo sapiens
gcccugacccuguggaa

SEQ ID NO: 1139194 - RNA, 22 nt, Homo sapiens
gcccugcaggcuguuuauaugu

SEQ ID NO: 1139195 - RNA, 17 nt, Homo sapiens
gcccugcugaagcugcu

SEQ ID NO: 1139196 - RNA, 18 nt, Homo sapiens
gcccuggccucugcucaa

SEQ ID NO: 1139197 - RNA, 13 nt, Homo sapiens
cugggcucacuca

SEQ ID NO: 1139198 - RNA, 12 nt, Homo sapiens
cugggcucucca

SEQ ID NO: 1139199 - RNA, 22 nt, Homo sapiens
cugggcugagccaaagccagag

SEQ ID NO: 1139200 - RNA, 22 nt, Homo sapiens
cugggcuuacaggcaugagcca

SEQ ID NO: 1139201 - RNA, 20 nt, Homo sapiens
cuggggaaagacacugccug

SEQ ID NO: 1139202 - RNA, 20 nt, Homo sapiens
cuggggccuacagcuuugau

SEQ ID NO: 1139203 - RNA, 12 nt, Homo sapiens
cuggggcuccag

SEQ ID NO: 1139204 - RNA, 22 nt, Homo sapiens
cuggggcuccgaaauuccaagg

SEQ ID NO: 1139205 - RNA, 14 nt, Homo sapiens
cugggggaaaaagc

SEQ ID NO: 1139206 - RNA, 16 nt, Homo sapiens
cuggggggaccaaaua

SEQ ID NO: 1139207 - RNA, 18 nt, Homo sapiens
cuggggguggggcauggu

SEQ ID NO: 1139208 - RNA, 15 nt, Homo sapiens
cugggucagacccau

SEQ ID NO: 1139209 - RNA, 13 nt, Homo sapiens
cugggugagcucu

SEQ ID NO: 1139210 - RNA, 12 nt, Homo sapiens
cugggugcaaag

SEQ ID NO: 1139211 - RNA, 12 nt, Homo sapiens
cugggugcuccc

SEQ ID NO: 1139212 - RNA, 16 nt, Homo sapiens
cugggugggcaucuca

SEQ ID NO: 1139213 - RNA, 15 nt, Homo sapiens
cuggguguugaccac

SEQ ID NO: 1139214 - RNA, 15 nt, Homo sapiens
cuggguucugcuacu

SEQ ID NO: 1139215 - RNA, 22 nt, Homo sapiens
cugguacaucgaggcucuugcu

SEQ ID NO: 1139216 - RNA, 15 nt, Homo sapiens
cugguagcugagggg

SEQ ID NO: 1139217 - RNA, 17 nt, Homo sapiens
cugguauaaagcucuca

SEQ ID NO: 1139218 - RNA, 16 nt, Homo sapiens
cugguaucugcaugua

SEQ ID NO: 1139219 - RNA, 16 nt, Homo sapiens
cugguauguguggaug

SEQ ID NO: 1139220 - RNA, 16 nt, Homo sapiens
cuggucucgaacuccu

SEQ ID NO: 1139221 - RNA, 15 nt, Homo sapiens
cuggucuugaacucc

SEQ ID NO: 1139222 - RNA, 15 nt, Homo sapiens
cuggugacagccuug

SEQ ID NO: 1139223 - RNA, 19 nt, Homo sapiens
cuggugacucaugccuuuu

SEQ ID NO: 1139224 - RNA, 20 nt, Homo sapiens
cuggugagaucaacaacacu

SEQ ID NO: 1139225 - RNA, 20 nt, Homo sapiens
cuggugcagaugguugacau

SEQ ID NO: 1139226 - RNA, 17 nt, Homo sapiens
cuggugcucuaaugcca

SEQ ID NO: 1139227 - RNA, 19 nt, Homo sapiens
cugguggauaaagauggau

SEQ ID NO: 1139228 - RNA, 18 nt, Homo sapiens
cugguggucaugaauuca

SEQ ID NO: 1139229 - RNA, 15 nt, Homo sapiens
cuguaacaugcaauu

SEQ ID NO: 1139230 - RNA, 21 nt, Homo sapiens
cuguaagaaaccuacugccca

SEQ ID NO: 1139231 - RNA, 19 nt, Homo sapiens
cuguaaggaacuggaacac

SEQ ID NO: 1139232 - RNA, 17 nt, Homo sapiens
cuguaaucccagcacuu

SEQ ID NO: 1139233 - RNA, 20 nt, Homo sapiens
cuguaaucccagcacuuugg

SEQ ID NO: 1139234 - RNA, 16 nt, Homo sapiens
cuguaaucucacuaca

SEQ ID NO: 1139235 - RNA, 22 nt, Homo sapiens
cuguaauucaguguauuucagu

SEQ ID NO: 1139236 - RNA, 18 nt, Homo sapiens
cuguaccugugcacguug

SEQ ID NO: 1139237 - RNA, 16 nt, Homo sapiens
cuguaccuguuccuua

SEQ ID NO: 1139238 - RNA, 15 nt, Homo sapiens
cuguacuaaggagca

SEQ ID NO: 1139239 - RNA, 17 nt, Homo sapiens
cuguagaacugauuuua

SEQ ID NO: 1139240 - RNA, 11 nt, Homo sapiens
cuguagguuaa

SEQ ID NO: 1139241 - RNA, 23 nt, Homo sapiens
cuguaguagucaaggugcucaau

SEQ ID NO: 1139242 - RNA, 17 nt, Homo sapiens
cuguaguucuaagacuc

SEQ ID NO: 1139243 - RNA, 23 nt, Homo sapiens
cuguaguugcguggacucugcac

SEQ ID NO: 1139244 - RNA, 14 nt, Homo sapiens
cuguauaacccugu

SEQ ID NO: 1139245 - RNA, 21 nt, Homo sapiens
cuguauauaaacgugucccga

SEQ ID NO: 1139246 - RNA, 17 nt, Homo sapiens
cuguauauuuaugacca

SEQ ID NO: 1139247 - RNA, 15 nt, Homo sapiens
cuguaucacugccuu

SEQ ID NO: 1139248 - RNA, 19 nt, Homo sapiens
cuguaucuuguuuuuccac

SEQ ID NO: 1139249 - RNA, 16 nt, Homo sapiens
cuguauuaagccacuu

SEQ ID NO: 1139250 - RNA, 14 nt, Homo sapiens
cuguauuauugcaa

SEQ ID NO: 1139251 - RNA, 15 nt, Homo sapiens
cuguauuauugcaau

SEQ ID NO: 1139252 - RNA, 21 nt, Homo sapiens
cuguauucccaguuacuuggg

SEQ ID NO: 1139253 - RNA, 21 nt, Homo sapiens
cugucaaacaaagccagaagc

SEQ ID NO: 1139254 - RNA, 17 nt, Homo sapiens
cugucacuacaauuuaa

SEQ ID NO: 1139255 - RNA, 12 nt, Homo sapiens
cugucacuguag

SEQ ID NO: 1139256 - RNA, 14 nt, Homo sapiens
cugucauccacuuu

SEQ ID NO: 1139257 - RNA, 20 nt, Homo sapiens
cugucauccucaggaaccaa

SEQ ID NO: 1139258 - RNA, 22 nt, Homo sapiens
cugucauuuuggcaucugcaaa

SEQ ID NO: 1139259 - RNA, 14 nt, Homo sapiens
cugucccaagcucc

SEQ ID NO: 1139260 - RNA, 20 nt, Homo sapiens
cugucccuccuggugucacc

SEQ ID NO: 1139261 - RNA, 19 nt, Homo sapiens
cuguccuaacucuccucgc

SEQ ID NO: 1139262 - RNA, 19 nt, Homo sapiens
cuguccucagccuugccag

SEQ ID NO: 1139263 - RNA, 15 nt, Homo sapiens
cuguccucuuuguga

SEQ ID NO: 1139264 - RNA, 16 nt, Homo sapiens
cugucuacuugcucag

SEQ ID NO: 1139265 - RNA, 22 nt, Homo sapiens
cugucuccuuguugcccaacua

SEQ ID NO: 1139266 - RNA, 18 nt, Homo sapiens
cugucugcucaaugccau

SEQ ID NO: 1139267 - RNA, 17 nt, Homo sapiens
cugucugucuucuccua

SEQ ID NO: 1139268 - RNA, 18 nt, Homo sapiens
cugucuuugcagggcaca

SEQ ID NO: 1139269 - RNA, 17 nt, Homo sapiens
cugugaacuauccccug

SEQ ID NO: 1139270 - RNA, 13 nt, Homo sapiens
cugugacuuugcc

SEQ ID NO: 1139271 - RNA, 20 nt, Homo sapiens
cugugagcucccaggugcag

SEQ ID NO: 1139272 - RNA, 13 nt, Homo sapiens
cugugaucuugcu

SEQ ID NO: 1139273 - RNA, 18 nt, Homo sapiens
cugugcacugcccaugga

SEQ ID NO: 1139274 - RNA, 13 nt, Homo sapiens
cugugcacuguag

SEQ ID NO: 1139275 - RNA, 17 nt, Homo sapiens
cugugcagggcugguuu

SEQ ID NO: 1139276 - RNA, 17 nt, Homo sapiens
cugugccagcacaaagu

SEQ ID NO: 1139277 - RNA, 12 nt, Homo sapiens
cugugcccugac

SEQ ID NO: 1139278 - RNA, 16 nt, Homo sapiens
cugugccgccaccucu

SEQ ID NO: 1139279 - RNA, 15 nt, Homo sapiens
cugugcuaugaauuu

SEQ ID NO: 1139280 - RNA, 18 nt, Homo sapiens
cugugcucauguuuggaa

SEQ ID NO: 1139281 - RNA, 17 nt, Homo sapiens
cugugcuguguuuaauc

SEQ ID NO: 1139282 - RNA, 13 nt, Homo sapiens
cugugcuuuucag

SEQ ID NO: 1139283 - RNA, 23 nt, Homo sapiens
cuguggaaaagccaucucagguu

SEQ ID NO: 1139284 - RNA, 21 nt, Homo sapiens
cuguggagacaaugucugcag

SEQ ID NO: 1139285 - RNA, 11 nt, Homo sapiens
cuguggagcuc

SEQ ID NO: 1139286 - RNA, 17 nt, Homo sapiens
ccaacauggauguguug

SEQ ID NO: 1139287 - RNA, 12 nt, Homo sapiens
ccaacauguauc

SEQ ID NO: 1139288 - RNA, 19 nt, Homo sapiens
ccaacauugccuugcauuu

SEQ ID NO: 1139289 - RNA, 13 nt, Homo sapiens
ccaaccaaggaag

SEQ ID NO: 1139290 - RNA, 22 nt, Homo sapiens
ccaaccccucccccacgucucu

SEQ ID NO: 1139291 - RNA, 16 nt, Homo sapiens
ccaaccugaagacacc

SEQ ID NO: 1139292 - RNA, 21 nt, Homo sapiens
ccaacguguccuuguacccug

SEQ ID NO: 1139293 - RNA, 19 nt, Homo sapiens
ccaacuagcucuauguuua

SEQ ID NO: 1139294 - RNA, 16 nt, Homo sapiens
ccaacucagaagggag

SEQ ID NO: 1139295 - RNA, 15 nt, Homo sapiens
ccaacuccauucucu

SEQ ID NO: 1139296 - RNA, 18 nt, Homo sapiens
ccaacugauguccauuag

SEQ ID NO: 1139297 - RNA, 20 nt, Homo sapiens
ccaacugcugaucaaugaaa

SEQ ID NO: 1139298 - RNA, 17 nt, Homo sapiens
ccaacuggcuucaugcg

SEQ ID NO: 1139299 - RNA, 18 nt, Homo sapiens
ccaagaagucccaagacc

SEQ ID NO: 1139300 - RNA, 19 nt, Homo sapiens
ccaagaauccacauuucua

SEQ ID NO: 1139301 - RNA, 16 nt, Homo sapiens
ccaagagcagcugcca

SEQ ID NO: 1139302 - RNA, 16 nt, Homo sapiens
ccaagagucuaaagau

SEQ ID NO: 1139303 - RNA, 21 nt, Homo sapiens
ccaagauacuugaacacugug

SEQ ID NO: 1139304 - RNA, 17 nt, Homo sapiens
ccaagauuuuuuauuug

SEQ ID NO: 1139305 - RNA, 19 nt, Homo sapiens
ccaagcaggaagcucagac

SEQ ID NO: 1139306 - RNA, 18 nt, Homo sapiens
ccaagcauuuagugcaca

SEQ ID NO: 1139307 - RNA, 19 nt, Homo sapiens
ccaagcucuguccaaucag

SEQ ID NO: 1139308 - RNA, 14 nt, Homo sapiens
ccaagcugcugcuu

SEQ ID NO: 1139309 - RNA, 23 nt, Homo sapiens
ccaagcugugcccugaccacccu

SEQ ID NO: 1139310 - RNA, 21 nt, Homo sapiens
ccaaggaaacccccaguguaa

SEQ ID NO: 1139311 - RNA, 20 nt, Homo sapiens
ccaaggagggugagugcaag

SEQ ID NO: 1139312 - RNA, 21 nt, Homo sapiens
ccaaggagggugagugcaagg

SEQ ID NO: 1139313 - RNA, 22 nt, Homo sapiens
ccaaggcaaaaaaaucauauaa

SEQ ID NO: 1139314 - RNA, 17 nt, Homo sapiens
ccaaggccccgagcuca

SEQ ID NO: 1139315 - RNA, 20 nt, Homo sapiens
ccaaggggaaucagaacuca

SEQ ID NO: 1139316 - RNA, 21 nt, Homo sapiens
ccaaggugggcggaucacuug

SEQ ID NO: 1139317 - RNA, 22 nt, Homo sapiens
ccaaggugucauuuauguguca

SEQ ID NO: 1139318 - RNA, 17 nt, Homo sapiens
ccaagguuacucagcag

SEQ ID NO: 1139319 - RNA, 20 nt, Homo sapiens
ccaagguuuaaagagucuag

SEQ ID NO: 1139320 - RNA, 13 nt, Homo sapiens
ccaaguagcugcu

SEQ ID NO: 1139321 - RNA, 23 nt, Homo sapiens
ccaagucccucucacaggacaug

SEQ ID NO: 1139322 - RNA, 14 nt, Homo sapiens
ccaagucuacuuca

SEQ ID NO: 1139323 - RNA, 14 nt, Homo sapiens
ccaaguuuauauac

SEQ ID NO: 1139324 - RNA, 17 nt, Homo sapiens
ccaauacaggcaugaac

SEQ ID NO: 1139325 - RNA, 14 nt, Homo sapiens
ccaauaucagcucu

SEQ ID NO: 1139326 - RNA, 15 nt, Homo sapiens
ccaauaugacucaga

SEQ ID NO: 1139327 - RNA, 18 nt, Homo sapiens
ccaaucccagcuaccuca

SEQ ID NO: 1139328 - RNA, 15 nt, Homo sapiens
ccaauccucacuccc

SEQ ID NO: 1139329 - RNA, 21 nt, Homo sapiens
ccaauccuuaaauaugugaaa

SEQ ID NO: 1139330 - RNA, 23 nt, Homo sapiens
ccaaucucugccauaucagugaa

SEQ ID NO: 1139331 - RNA, 11 nt, Homo sapiens
ccaaugguguu

SEQ ID NO: 1139332 - RNA, 20 nt, Homo sapiens
ccaauuaaaaacgaaaaccu

SEQ ID NO: 1139333 - RNA, 17 nt, Homo sapiens
ccaauugccucuugcag

SEQ ID NO: 1139334 - RNA, 22 nt, Homo sapiens
ccacaaacuguaauacaaugau

SEQ ID NO: 1139335 - RNA, 21 nt, Homo sapiens
ccacaacuauauuaucaugca

SEQ ID NO: 1139336 - RNA, 14 nt, Homo sapiens
ccacaaguggcaga

SEQ ID NO: 1139337 - RNA, 15 nt, Homo sapiens
ccacacacaacagcc

SEQ ID NO: 1139338 - RNA, 23 nt, Homo sapiens
ccacacacagguggugucacugu

SEQ ID NO: 1139339 - RNA, 11 nt, Homo sapiens
ccacacuauuc

SEQ ID NO: 1139340 - RNA, 19 nt, Homo sapiens
ccacacucuccugugaaca

SEQ ID NO: 1139341 - RNA, 21 nt, Homo sapiens
ccacacugcuacacuucugau

SEQ ID NO: 1139342 - RNA, 21 nt, Homo sapiens
ccacagaaggugaacuuugug

SEQ ID NO: 1139343 - RNA, 22 nt, Homo sapiens
ccacagacagcuuagaagccau

SEQ ID NO: 1139344 - RNA, 13 nt, Homo sapiens
ccacagcacuaau

SEQ ID NO: 1139345 - RNA, 14 nt, Homo sapiens
ccacaggcacaggu

SEQ ID NO: 1139346 - RNA, 23 nt, Homo sapiens
ccacaggccgcccugcgggugaa

SEQ ID NO: 1139347 - RNA, 22 nt, Homo sapiens
ccacauaccuggcccaaccaga

SEQ ID NO: 1139348 - RNA, 23 nt, Homo sapiens
ccacauaccuggcccaaccagac

SEQ ID NO: 1139349 - RNA, 13 nt, Homo sapiens
ccacaucccacau

SEQ ID NO: 1139350 - RNA, 21 nt, Homo sapiens
ccacauccuccacguucugcu

SEQ ID NO: 1139351 - RNA, 13 nt, Homo sapiens
ccacauggugacu

SEQ ID NO: 1139352 - RNA, 22 nt, Homo sapiens
ccacauuagccuuugcacugua

SEQ ID NO: 1139353 - RNA, 21 nt, Homo sapiens
ccacauuugugccgacacugu

SEQ ID NO: 1139354 - RNA, 12 nt, Homo sapiens
ccaccacacauc

SEQ ID NO: 1139355 - RNA, 23 nt, Homo sapiens
ccaccacucccagccugauuuau

SEQ ID NO: 1139356 - RNA, 16 nt, Homo sapiens
ccaccauccuauugca

SEQ ID NO: 1139357 - RNA, 17 nt, Homo sapiens
ccaccauugucagcuca

SEQ ID NO: 1139358 - RNA, 10 nt, Homo sapiens
ccacccaaac

SEQ ID NO: 1139359 - RNA, 18 nt, Homo sapiens
ccacccaguccugcacac

SEQ ID NO: 1139360 - RNA, 15 nt, Homo sapiens
ccacccccugccaau

SEQ ID NO: 1139361 - RNA, 17 nt, Homo sapiens
ccacccccuucagugcc

SEQ ID NO: 1139362 - RNA, 22 nt, Homo sapiens
ccacccucauucuacugaaaag

SEQ ID NO: 1139363 - RNA, 13 nt, Homo sapiens
ccaccgcacucca

SEQ ID NO: 1139364 - RNA, 14 nt, Homo sapiens
ccaccgcccagaga

SEQ ID NO: 1139365 - RNA, 21 nt, Homo sapiens
ccaccuacuuuucuuuccuca

SEQ ID NO: 1139366 - RNA, 16 nt, Homo sapiens
ccaccugacucuugca

SEQ ID NO: 1139367 - RNA, 19 nt, Homo sapiens
ccaccugcuggagugaagg

SEQ ID NO: 1139368 - RNA, 16 nt, Homo sapiens
ccaccuuccuuaccuc

SEQ ID NO: 1139369 - RNA, 15 nt, Homo sapiens
ccacgcuuuuugacu

SEQ ID NO: 1139370 - RNA, 23 nt, Homo sapiens
ccacggggaggcccccccagaag

SEQ ID NO: 1139371 - RNA, 13 nt, Homo sapiens
ccacguaucuuuc

SEQ ID NO: 1139372 - RNA, 22 nt, Homo sapiens
ccacgucacguguaguguccau

SEQ ID NO: 1139373 - RNA, 17 nt, Homo sapiens
ccacgucacuucaugca

SEQ ID NO: 1139374 - RNA, 22 nt, Homo sapiens
ccacuaauuguguacauaugua

SEQ ID NO: 1139375 - RNA, 18 nt, Homo sapiens
ccacuaucugggugcaug

SEQ ID NO: 1139376 - RNA, 19 nt, Homo sapiens
ccacucaggcccaaagccu

SEQ ID NO: 1139377 - RNA, 15 nt, Homo sapiens
ccacucaggugcaca

SEQ ID NO: 1139378 - RNA, 18 nt, Homo sapiens
ccacuccuccuagccacc

SEQ ID NO: 1139379 - RNA, 12 nt, Homo sapiens
ccacugaccaga

SEQ ID NO: 1139380 - RNA, 14 nt, Homo sapiens
ccacugcacuccag

SEQ ID NO: 1139381 - RNA, 20 nt, Homo sapiens
ccacugucaaguguuuuacu

SEQ ID NO: 1139382 - RNA, 19 nt, Homo sapiens
ccacugucuagagcaacuu

SEQ ID NO: 1139383 - RNA, 14 nt, Homo sapiens
ccacuguguauaga

SEQ ID NO: 1139384 - RNA, 23 nt, Homo sapiens
ccacuuaccuagauucuacauau

SEQ ID NO: 1139385 - RNA, 17 nt, Homo sapiens
ccacuucacuccagcau

SEQ ID NO: 1139386 - RNA, 16 nt, Homo sapiens
ccacuuuccagggugg

SEQ ID NO: 1139387 - RNA, 13 nt, Homo sapiens
ccacuuuucauug

SEQ ID NO: 1139388 - RNA, 20 nt, Homo sapiens
ccacuuuucugcuguugccu

SEQ ID NO: 1139389 - RNA, 21 nt, Homo sapiens
ccagaaaacaaaacugcauuu

SEQ ID NO: 1139390 - RNA, 15 nt, Homo sapiens
ccagaaacagggaca

SEQ ID NO: 1139391 - RNA, 15 nt, Homo sapiens
ccagaagcugcccuc

SEQ ID NO: 1139392 - RNA, 18 nt, Homo sapiens
ccagaagcuguacuuuua

SEQ ID NO: 1139393 - RNA, 23 nt, Homo sapiens
ccagaagcuuccauaguggugca

SEQ ID NO: 1139394 - RNA, 19 nt, Homo sapiens
ccagaaugcugcaggacuu

SEQ ID NO: 1139395 - RNA, 16 nt, Homo sapiens
ccagaaugugcugccu

SEQ ID NO: 1139396 - RNA, 13 nt, Homo sapiens
ccagacacagugc

SEQ ID NO: 1139397 - RNA, 21 nt, Homo sapiens
ccagacagacaacacugggaa

SEQ ID NO: 1139398 - RNA, 15 nt, Homo sapiens
ccagacagcugcuca

SEQ ID NO: 1139399 - RNA, 19 nt, Homo sapiens
ccagacaucaccaacuguc

SEQ ID NO: 1139400 - RNA, 16 nt, Homo sapiens
ccagaccccauuccac

SEQ ID NO: 1139401 - RNA, 15 nt, Homo sapiens
ccagaccucagggac

SEQ ID NO: 1139402 - RNA, 17 nt, Homo sapiens
caaagccacuggaagga

SEQ ID NO: 1139403 - RNA, 16 nt, Homo sapiens
caaagcccacuuuguu

SEQ ID NO: 1139404 - RNA, 20 nt, Homo sapiens
caaagcccacuuuguucgca

SEQ ID NO: 1139405 - RNA, 20 nt, Homo sapiens
caaagcggcucuaaaccuca

SEQ ID NO: 1139406 - RNA, 23 nt, Homo sapiens
caaagcucuguggccacauuuuc

SEQ ID NO: 1139407 - RNA, 18 nt, Homo sapiens
caaaggacagaguaugaa

SEQ ID NO: 1139408 - RNA, 17 nt, Homo sapiens
caaaggauuugaugcuu

SEQ ID NO: 1139409 - RNA, 18 nt, Homo sapiens
caaaggcacagugaaggc

SEQ ID NO: 1139410 - RNA, 15 nt, Homo sapiens
caaaggcgcuuugaa

SEQ ID NO: 1139411 - RNA, 22 nt, Homo sapiens
caaaggcgcuuugaaacagggg

SEQ ID NO: 1139412 - RNA, 22 nt, Homo sapiens
caaagggggaggcuaaagccca

SEQ ID NO: 1139413 - RNA, 20 nt, Homo sapiens
caaaggucaagaacacagug

SEQ ID NO: 1139414 - RNA, 16 nt, Homo sapiens
caaagguuggcaguga

SEQ ID NO: 1139415 - RNA, 20 nt, Homo sapiens
caaaguccuuuuuuuccauc

SEQ ID NO: 1139416 - RNA, 17 nt, Homo sapiens
caaagucuaaacugagc

SEQ ID NO: 1139417 - RNA, 19 nt, Homo sapiens
caaagugaaagacauuuca

SEQ ID NO: 1139418 - RNA, 22 nt, Homo sapiens
caaaguuacugauucacugcau

SEQ ID NO: 1139419 - RNA, 15 nt, Homo sapiens
caaauaaacuguaag

SEQ ID NO: 1139420 - RNA, 16 nt, Homo sapiens
caaauaacugaucuca

SEQ ID NO: 1139421 - RNA, 18 nt, Homo sapiens
caaauagaauuugagcau

SEQ ID NO: 1139422 - RNA, 21 nt, Homo sapiens
agccuaacacacuccaagaua

SEQ ID NO: 1139423 - RNA, 16 nt, Homo sapiens
agccuaccaauguaga

SEQ ID NO: 1139424 - RNA, 16 nt, Homo sapiens
agccuacgcugaagau

SEQ ID NO: 1139425 - RNA, 13 nt, Homo sapiens
agccucacucagc

SEQ ID NO: 1139426 - RNA, 17 nt, Homo sapiens
agccucaucauuuccca

SEQ ID NO: 1139427 - RNA, 15 nt, Homo sapiens
agccucaugugugaa

SEQ ID NO: 1139428 - RNA, 15 nt, Homo sapiens
agccuccagcugccc

SEQ ID NO: 1139429 - RNA, 18 nt, Homo sapiens
agccuccauccuaccccc

SEQ ID NO: 1139430 - RNA, 23 nt, Homo sapiens
agccuccuauccaccacugcuua

SEQ ID NO: 1139431 - RNA, 18 nt, Homo sapiens
agccucgacacagagugg

SEQ ID NO: 1139432 - RNA, 15 nt, Homo sapiens
agccucgccuuccau

SEQ ID NO: 1139433 - RNA, 17 nt, Homo sapiens
agccucucaaguaauau

SEQ ID NO: 1139434 - RNA, 20 nt, Homo sapiens
agccucugggucaguggucc

SEQ ID NO: 1139435 - RNA, 22 nt, Homo sapiens
agccucuuuguuccagaagcug

SEQ ID NO: 1139436 - RNA, 17 nt, Homo sapiens
agccugagcagagacau

SEQ ID NO: 1139437 - RNA, 20 nt, Homo sapiens
agccugagguugaccagcuc

SEQ ID NO: 1139438 - RNA, 20 nt, Homo sapiens
agccugaugcugacauucac

SEQ ID NO: 1139439 - RNA, 15 nt, Homo sapiens
agccugcaccuggug

SEQ ID NO: 1139440 - RNA, 14 nt, Homo sapiens
agccugcagucauc

SEQ ID NO: 1139441 - RNA, 21 nt, Homo sapiens
agccugcucccccacccccuc

SEQ ID NO: 1139442 - RNA, 15 nt, Homo sapiens
agccuggacugcuac

SEQ ID NO: 1139443 - RNA, 21 nt, Homo sapiens
agccuggauccucaguucuca

SEQ ID NO: 1139444 - RNA, 16 nt, Homo sapiens
agccuggcaucugugc

SEQ ID NO: 1139445 - RNA, 13 nt, Homo sapiens
agccuggccagac

SEQ ID NO: 1139446 - RNA, 22 nt, Homo sapiens
agccuggccagccuacaauggg

SEQ ID NO: 1139447 - RNA, 18 nt, Homo sapiens
agccuggcuccaaacccu

SEQ ID NO: 1139448 - RNA, 20 nt, Homo sapiens
agccuggcuccaaacccucg

SEQ ID NO: 1139449 - RNA, 15 nt, Homo sapiens
agccugggaggcaca

SEQ ID NO: 1139450 - RNA, 18 nt, Homo sapiens
agccugggucacagagug

SEQ ID NO: 1139451 - RNA, 20 nt, Homo sapiens
agccuguccucaccgucucg

SEQ ID NO: 1139452 - RNA, 22 nt, Homo sapiens
agccugucucccccaacacccc

SEQ ID NO: 1139453 - RNA, 22 nt, Homo sapiens
agccugucucuuuccacuuugu

SEQ ID NO: 1139454 - RNA, 13 nt, Homo sapiens
agccugugcaaaa

SEQ ID NO: 1139455 - RNA, 16 nt, Homo sapiens
agccuguuuauugcca

SEQ ID NO: 1139456 - RNA, 17 nt, Homo sapiens
agccuuacccaguccua

SEQ ID NO: 1139457 - RNA, 19 nt, Homo sapiens
agccuucgggcgucugugu

SEQ ID NO: 1139458 - RNA, 17 nt, Homo sapiens
agccuugaacucugggc

SEQ ID NO: 1139459 - RNA, 15 nt, Homo sapiens
agccuuuucccuuag

SEQ ID NO: 1139460 - RNA, 21 nt, Homo sapiens
agccuuuuuaaaacacauguu

SEQ ID NO: 1139461 - RNA, 12 nt, Homo sapiens
agcgaacaucuu

SEQ ID NO: 1139462 - RNA, 17 nt, Homo sapiens
agcgacaucccaguagu

SEQ ID NO: 1139463 - RNA, 18 nt, Homo sapiens
agcgagaagaugcucugg

SEQ ID NO: 1139464 - RNA, 18 nt, Homo sapiens
agcgaggaggcuccagag

SEQ ID NO: 1139465 - RNA, 18 nt, Homo sapiens
agcgauucuccugccuca

SEQ ID NO: 1139466 - RNA, 20 nt, Homo sapiens
agcgcauugagccaguggug

SEQ ID NO: 1139467 - RNA, 13 nt, Homo sapiens
agcgcgucucagc

SEQ ID NO: 1139468 - RNA, 20 nt, Homo sapiens
agcgcuaguggaggguugga

SEQ ID NO: 1139469 - RNA, 17 nt, Homo sapiens
agcggaaagcagcucaa

SEQ ID NO: 1139470 - RNA, 11 nt, Homo sapiens
agcggggagcc

SEQ ID NO: 1139471 - RNA, 15 nt, Homo sapiens
agcggggagccagga

SEQ ID NO: 1139472 - RNA, 23 nt, Homo sapiens
agcgguccaacgccgccuuggcc

SEQ ID NO: 1139473 - RNA, 14 nt, Homo sapiens
agcgugcucacuga

SEQ ID NO: 1139474 - RNA, 16 nt, Homo sapiens
agcgugcucacugacc

SEQ ID NO: 1139475 - RNA, 22 nt, Homo sapiens
agcgugcuggcgacacucaggg

SEQ ID NO: 1139476 - RNA, 19 nt, Homo sapiens
agcguucaaacugcuggaa

SEQ ID NO: 1139477 - RNA, 18 nt, Homo sapiens
agcuaaacggauuccaaa

SEQ ID NO: 1139478 - RNA, 14 nt, Homo sapiens
agcuaaagccugaa

SEQ ID NO: 1139479 - RNA, 21 nt, Homo sapiens
ccagauggcagguuugcaauc

SEQ ID NO: 1139480 - RNA, 19 nt, Homo sapiens
ccagauugugccacugcuc

SEQ ID NO: 1139481 - RNA, 15 nt, Homo sapiens
ccagcaaaauccaaa

SEQ ID NO: 1139482 - RNA, 14 nt, Homo sapiens
ccagcacaaagugg

SEQ ID NO: 1139483 - RNA, 10 nt, Homo sapiens
ccagcacuuc

SEQ ID NO: 1139484 - RNA, 16 nt, Homo sapiens
ccagcacuuugggagg

SEQ ID NO: 1139485 - RNA, 20 nt, Homo sapiens
ccagcagccugccagcaguu

SEQ ID NO: 1139486 - RNA, 15 nt, Homo sapiens
ccagcagcgccuuuc

SEQ ID NO: 1139487 - RNA, 15 nt, Homo sapiens
ccagcaggacaguga

SEQ ID NO: 1139488 - RNA, 16 nt, Homo sapiens
ccagcaggacagugac

SEQ ID NO: 1139489 - RNA, 19 nt, Homo sapiens
ccagcagugccuugugcaa

SEQ ID NO: 1139490 - RNA, 14 nt, Homo sapiens
ccagcaucccgcgc

SEQ ID NO: 1139491 - RNA, 13 nt, Homo sapiens
ccagccaacgaga

SEQ ID NO: 1139492 - RNA, 19 nt, Homo sapiens
ccagccagaggaugcauag

SEQ ID NO: 1139493 - RNA, 20 nt, Homo sapiens
ccagccaucaaaaugcuuuu

SEQ ID NO: 1139494 - RNA, 14 nt, Homo sapiens
ccagccaugcaaug

SEQ ID NO: 1139495 - RNA, 15 nt, Homo sapiens
ccagcccguuaaaug

SEQ ID NO: 1139496 - RNA, 14 nt, Homo sapiens
ccagcccuccccau

SEQ ID NO: 1139497 - RNA, 14 nt, Homo sapiens
ccagccucacagau

SEQ ID NO: 1139498 - RNA, 16 nt, Homo sapiens
ccagccuccucuggau

SEQ ID NO: 1139499 - RNA, 14 nt, Homo sapiens
ccagcgcaccuguu

SEQ ID NO: 1139500 - RNA, 17 nt, Homo sapiens
ccagcuaacucugaccu

SEQ ID NO: 1139501 - RNA, 18 nt, Homo sapiens
ccagcuaagaaccuggaa

SEQ ID NO: 1139502 - RNA, 17 nt, Homo sapiens
ccagcuaaggacauuuc

SEQ ID NO: 1139503 - RNA, 14 nt, Homo sapiens
ccagcuacucagga

SEQ ID NO: 1139504 - RNA, 17 nt, Homo sapiens
ccagcuacucaggaggc

SEQ ID NO: 1139505 - RNA, 19 nt, Homo sapiens
ccagcucagggcucuuucc

SEQ ID NO: 1139506 - RNA, 15 nt, Homo sapiens
ccagcucauucauuu

SEQ ID NO: 1139507 - RNA, 19 nt, Homo sapiens
ccagcuccaaccugcaaag

SEQ ID NO: 1139508 - RNA, 16 nt, Homo sapiens
ccagcuccaaggggaa

SEQ ID NO: 1139509 - RNA, 19 nt, Homo sapiens
ccagcugccaaggaaaccc

SEQ ID NO: 1139510 - RNA, 17 nt, Homo sapiens
ccagcugggucaggcag

SEQ ID NO: 1139511 - RNA, 19 nt, Homo sapiens
ccaggaaagaagaguugga

SEQ ID NO: 1139512 - RNA, 19 nt, Homo sapiens
ccaggaaagcagcaaagga

SEQ ID NO: 1139513 - RNA, 14 nt, Homo sapiens
ccaggaaaggccca

SEQ ID NO: 1139514 - RNA, 17 nt, Homo sapiens
ccaggaauauccagugg

SEQ ID NO: 1139515 - RNA, 22 nt, Homo sapiens
ccaggaauguuucagcugcagu

SEQ ID NO: 1139516 - RNA, 21 nt, Homo sapiens
ccaggacuauauuugggccug

SEQ ID NO: 1139517 - RNA, 20 nt, Homo sapiens
ccaggacugggucugaccug

SEQ ID NO: 1139518 - RNA, 15 nt, Homo sapiens
ccaggacugucauuu

SEQ ID NO: 1139519 - RNA, 19 nt, Homo sapiens
ccaggaggggaacacugcc

SEQ ID NO: 1139520 - RNA, 23 nt, Homo sapiens
ccaggaugcuggcugguggaaca

SEQ ID NO: 1139521 - RNA, 17 nt, Homo sapiens
ccaggauggacuccauc

SEQ ID NO: 1139522 - RNA, 13 nt, Homo sapiens
ccaggcagaucca

SEQ ID NO: 1139523 - RNA, 14 nt, Homo sapiens
ccaggcaggcauuu

SEQ ID NO: 1139524 - RNA, 15 nt, Homo sapiens
ccaggccaacaguag

SEQ ID NO: 1139525 - RNA, 17 nt, Homo sapiens
ccaggccagcgcugcaa

SEQ ID NO: 1139526 - RNA, 22 nt, Homo sapiens
ccaggcccggggcuggcggcua

SEQ ID NO: 1139527 - RNA, 21 nt, Homo sapiens
ccaggcccugcucuuccucag

SEQ ID NO: 1139528 - RNA, 22 nt, Homo sapiens
ccaggcccugggucuugccaug

SEQ ID NO: 1139529 - RNA, 17 nt, Homo sapiens
ccaggcuagagugcaau

SEQ ID NO: 1139530 - RNA, 20 nt, Homo sapiens
ccaggcuagagugcaauggu

SEQ ID NO: 1139531 - RNA, 23 nt, Homo sapiens
ccaggcugaccacagcacagcca

SEQ ID NO: 1139532 - RNA, 17 nt, Homo sapiens
ccaggcuggagugcagu

SEQ ID NO: 1139533 - RNA, 20 nt, Homo sapiens
ccaggcuggagugcaguggu

SEQ ID NO: 1139534 - RNA, 20 nt, Homo sapiens
ccaggcuggucuugaacugg

SEQ ID NO: 1139535 - RNA, 20 nt, Homo sapiens
ccagggacccuggaguauuu

SEQ ID NO: 1139536 - RNA, 13 nt, Homo sapiens
ccagggaugggca

SEQ ID NO: 1139537 - RNA, 14 nt, Homo sapiens
ccagggcugucauc

SEQ ID NO: 1139538 - RNA, 16 nt, Homo sapiens
ccaggggcagccacac

SEQ ID NO: 1139539 - RNA, 15 nt, Homo sapiens
ccagguaagcccuuu

SEQ ID NO: 1139540 - RNA, 15 nt, Homo sapiens
ccagguacgcacaga

SEQ ID NO: 1139541 - RNA, 18 nt, Homo sapiens
ccagguagaaacuuuuau

SEQ ID NO: 1139542 - RNA, 18 nt, Homo sapiens
ccaggucugggugaaagg

SEQ ID NO: 1139543 - RNA, 14 nt, Homo sapiens
ccagguguggaaca

SEQ ID NO: 1139544 - RNA, 17 nt, Homo sapiens
ccaggugugguggugca

SEQ ID NO: 1139545 - RNA, 19 nt, Homo sapiens
ccaggugugguggugcaca

SEQ ID NO: 1139546 - RNA, 14 nt, Homo sapiens
ccaguaaagccuua

SEQ ID NO: 1139547 - RNA, 13 nt, Homo sapiens
ccaguaacugcug

SEQ ID NO: 1139548 - RNA, 16 nt, Homo sapiens
ccaguaacugcugucg

SEQ ID NO: 1139549 - RNA, 21 nt, Homo sapiens
ccaguauggcaaaaguaggca

SEQ ID NO: 1139550 - RNA, 14 nt, Homo sapiens
ccagucacugugag

SEQ ID NO: 1139551 - RNA, 17 nt, Homo sapiens
ccagucacugugagcuc

SEQ ID NO: 1139552 - RNA, 18 nt, Homo sapiens
ccagucagacaaauucac

SEQ ID NO: 1139553 - RNA, 17 nt, Homo sapiens
ccagugacaaccaaaag

SEQ ID NO: 1139554 - RNA, 18 nt, Homo sapiens
ccaguggauggauucauc

SEQ ID NO: 1139555 - RNA, 9 nt, Homo sapiens
ccagugggc

SEQ ID NO: 1139556 - RNA, 16 nt, Homo sapiens
ccagugggcuguguug

SEQ ID NO: 1139557 - RNA, 19 nt, Homo sapiens
ccagugugacacugcuuua

SEQ ID NO: 1139558 - RNA, 21 nt, Homo sapiens
ccaguuaguuagaauuggaaa

SEQ ID NO: 1139559 - RNA, 13 nt, Homo sapiens
ccaguucaugcag

SEQ ID NO: 1139560 - RNA, 16 nt, Homo sapiens
ccaguuuuuugaacau

SEQ ID NO: 1139561 - RNA, 18 nt, Homo sapiens
ccauaaauacaagauucu

SEQ ID NO: 1139562 - RNA, 12 nt, Homo sapiens
ccauaacuuuau

SEQ ID NO: 1139563 - RNA, 21 nt, Homo sapiens
ccauaauagacaccaaaacaa

SEQ ID NO: 1139564 - RNA, 16 nt, Homo sapiens
ccauaccuuugcuacu

SEQ ID NO: 1139565 - RNA, 13 nt, Homo sapiens
ccauacucaaaau

SEQ ID NO: 1139566 - RNA, 18 nt, Homo sapiens
ccauacuuugucugaaaa

SEQ ID NO: 1139567 - RNA, 18 nt, Homo sapiens
ccauagcucuucacuucc

SEQ ID NO: 1139568 - RNA, 19 nt, Homo sapiens
ccauagcucuucacuuccu

SEQ ID NO: 1139569 - RNA, 13 nt, Homo sapiens
ccauaggacugug

SEQ ID NO: 1139570 - RNA, 14 nt, Homo sapiens
ccauaggacugugg

SEQ ID NO: 1139571 - RNA, 19 nt, Homo sapiens
ccauagggacccauucuac

SEQ ID NO: 1139572 - RNA, 21 nt, Homo sapiens
ccauagggacccauucuacac

SEQ ID NO: 1139573 - RNA, 15 nt, Homo sapiens
ccauauagaaaucua

SEQ ID NO: 1139574 - RNA, 19 nt, Homo sapiens
ccauauuuaucccuggugc

SEQ ID NO: 1139575 - RNA, 18 nt, Homo sapiens
ccauauuuguguucaguu

SEQ ID NO: 1139576 - RNA, 22 nt, Homo sapiens
ccauauuuuauuguauuuugau

SEQ ID NO: 1139577 - RNA, 12 nt, Homo sapiens
ccauauuuucac

SEQ ID NO: 1139578 - RNA, 20 nt, Homo sapiens
ccaucaaagaaccuugaaga

SEQ ID NO: 1139579 - RNA, 12 nt, Homo sapiens
ccaucacacugu

SEQ ID NO: 1139580 - RNA, 18 nt, Homo sapiens
ccaucacgugugauugac

SEQ ID NO: 1139581 - RNA, 13 nt, Homo sapiens
ccaucacuauuca

SEQ ID NO: 1139582 - RNA, 17 nt, Homo sapiens
ccaucaucucugccuuu

SEQ ID NO: 1139583 - RNA, 13 nt, Homo sapiens
ccauccuauuuaa

SEQ ID NO: 1139584 - RNA, 19 nt, Homo sapiens
ccauccuguuuguaugaaa

SEQ ID NO: 1139585 - RNA, 21 nt, Homo sapiens
ccaucuaaugcuuguuuauga

SEQ ID NO: 1139586 - RNA, 10 nt, Homo sapiens
ccaucucagg

SEQ ID NO: 1139587 - RNA, 22 nt, Homo sapiens
ccaucucuacuaaaaauacaaa

SEQ ID NO: 1139588 - RNA, 15 nt, Homo sapiens
ccaucugccugccaa

SEQ ID NO: 1139589 - RNA, 23 nt, Homo sapiens
ccaucugggcuccuccagggugu

SEQ ID NO: 1139590 - RNA, 22 nt, Homo sapiens
ccaucuuuugugagauguaauu

SEQ ID NO: 1139591 - RNA, 13 nt, Homo sapiens
ccaugaagccaca

SEQ ID NO: 1139592 - RNA, 14 nt, Homo sapiens
ccaugacauugcau

SEQ ID NO: 1139593 - RNA, 22 nt, Homo sapiens
ccaugacuucagaguacaucca

SEQ ID NO: 1139594 - RNA, 14 nt, Homo sapiens
cuggagcuauucac

SEQ ID NO: 1139595 - RNA, 23 nt, Homo sapiens
cuggaggcccaguucacccugau

SEQ ID NO: 1139596 - RNA, 16 nt, Homo sapiens
cuggagggggagcacc

SEQ ID NO: 1139597 - RNA, 20 nt, Homo sapiens
cuggagggggagcaccagcg

SEQ ID NO: 1139598 - RNA, 15 nt, Homo sapiens
cuggagugcaauggu

SEQ ID NO: 1139599 - RNA, 21 nt, Homo sapiens
cuggagugcaguggugugauc

SEQ ID NO: 1139600 - RNA, 18 nt, Homo sapiens
cuggagugugucagagcc

SEQ ID NO: 1139601 - RNA, 17 nt, Homo sapiens
cuggaguuugagaccag

SEQ ID NO: 1139602 - RNA, 15 nt, Homo sapiens
cuggcaagaaagcuu

SEQ ID NO: 1139603 - RNA, 18 nt, Homo sapiens
cuggcaagacugucuuac

SEQ ID NO: 1139604 - RNA, 20 nt, Homo sapiens
cuggcacauuggaaagcaca

SEQ ID NO: 1139605 - RNA, 17 nt, Homo sapiens
cuggcaccgcaguuuug

SEQ ID NO: 1139606 - RNA, 19 nt, Homo sapiens
cuggcagggacgaggacaa

SEQ ID NO: 1139607 - RNA, 14 nt, Homo sapiens
cuggcaugauccaa

SEQ ID NO: 1139608 - RNA, 17 nt, Homo sapiens
cuggccacccaaacagg

SEQ ID NO: 1139609 - RNA, 19 nt, Homo sapiens
cuggccagccuacaauggg

SEQ ID NO: 1139610 - RNA, 22 nt, Homo sapiens
cuggcccaguuaauuugcacag

SEQ ID NO: 1139611 - RNA, 18 nt, Homo sapiens
cuggccggccagccagcc

SEQ ID NO: 1139612 - RNA, 13 nt, Homo sapiens
cuggccgggaccc

SEQ ID NO: 1139613 - RNA, 17 nt, Homo sapiens
cuggccuguacccagua

SEQ ID NO: 1139614 - RNA, 19 nt, Homo sapiens
cuggccuugguaugugcca

SEQ ID NO: 1139615 - RNA, 21 nt, Homo sapiens
cuggccuugguaugugccagg

SEQ ID NO: 1139616 - RNA, 13 nt, Homo sapiens
cuggcucaucucu

SEQ ID NO: 1139617 - RNA, 12 nt, Homo sapiens
cuggcuccaaac

SEQ ID NO: 1139618 - RNA, 15 nt, Homo sapiens
cuggcuggccagucu

SEQ ID NO: 1139619 - RNA, 23 nt, Homo sapiens
cuggcugguggagaacucaaggc

SEQ ID NO: 1139620 - RNA, 20 nt, Homo sapiens
cuggcuucucuugagucaca

SEQ ID NO: 1139621 - RNA, 14 nt, Homo sapiens
cuggcuucuggcca

SEQ ID NO: 1139622 - RNA, 18 nt, Homo sapiens
cugggaaaugagcaggga

SEQ ID NO: 1139623 - RNA, 20 nt, Homo sapiens
cugggaaaugagcagggaug

SEQ ID NO: 1139624 - RNA, 19 nt, Homo sapiens
cugggacugugcucagaga

SEQ ID NO: 1139625 - RNA, 21 nt, Homo sapiens
cugggauccuaagggcucacc

SEQ ID NO: 1139626 - RNA, 23 nt, Homo sapiens
cugggauuacaggcgugagccac

SEQ ID NO: 1139627 - RNA, 21 nt, Homo sapiens
cugggauuacaggcgugaucc

SEQ ID NO: 1139628 - RNA, 23 nt, Homo sapiens
cugggcacacgccucccacuggg

SEQ ID NO: 1139629 - RNA, 14 nt, Homo sapiens
cugggcacagucag

SEQ ID NO: 1139630 - RNA, 13 nt, Homo sapiens
cugggccaccagc

SEQ ID NO: 1139631 - RNA, 22 nt, Homo sapiens
cugggccauucuccacagcaac

SEQ ID NO: 1139632 - RNA, 22 nt, Homo sapiens
cugggccccuccccucagagcc

SEQ ID NO: 1139633 - RNA, 21 nt, Homo sapiens
cugggccguuacaucugugca

SEQ ID NO: 1139634 - RNA, 12 nt, Homo sapiens
cugggccuagca

SEQ ID NO: 1139635 - RNA, 15 nt, Homo sapiens
cugggccugaccaaa

SEQ ID NO: 1139636 - RNA, 16 nt, Homo sapiens
cugggcgccaacugcu

SEQ ID NO: 1139637 - RNA, 16 nt, Homo sapiens
aggaaguaugguuuua

SEQ ID NO: 1139638 - RNA, 17 nt, Homo sapiens
aggaaguggacauucua

SEQ ID NO: 1139639 - RNA, 18 nt, Homo sapiens
aggaauuucaagaagugu

SEQ ID NO: 1139640 - RNA, 13 nt, Homo sapiens
aggacaaagugcc

SEQ ID NO: 1139641 - RNA, 22 nt, Homo sapiens
aggacaaagugccaaagaaagu

SEQ ID NO: 1139642 - RNA, 19 nt, Homo sapiens
aggacagcugaaccccugg

SEQ ID NO: 1139643 - RNA, 17 nt, Homo sapiens
aggacaguugauuucca

SEQ ID NO: 1139644 - RNA, 12 nt, Homo sapiens
aggacauuccaa

SEQ ID NO: 1139645 - RNA, 14 nt, Homo sapiens
aggaccaacaucca

SEQ ID NO: 1139646 - RNA, 14 nt, Homo sapiens
aggaccccugagua

SEQ ID NO: 1139647 - RNA, 14 nt, Homo sapiens
aggaccugccugua

SEQ ID NO: 1139648 - RNA, 18 nt, Homo sapiens
aggacggacucacuucuc

SEQ ID NO: 1139649 - RNA, 19 nt, Homo sapiens
aggacguggaugaagcaga

SEQ ID NO: 1139650 - RNA, 20 nt, Homo sapiens
aggacguguuacccacugcc

SEQ ID NO: 1139651 - RNA, 16 nt, Homo sapiens
aggacucaaaguuuca

SEQ ID NO: 1139652 - RNA, 13 nt, Homo sapiens
aggacucacccuc

SEQ ID NO: 1139653 - RNA, 16 nt, Homo sapiens
aggacuccauuucuuu

SEQ ID NO: 1139654 - RNA, 20 nt, Homo sapiens
aggacucugcaagugucugg

SEQ ID NO: 1139655 - RNA, 19 nt, Homo sapiens
aggacugugccagcacaaa

SEQ ID NO: 1139656 - RNA, 17 nt, Homo sapiens
aggacuuguuuacaaag

SEQ ID NO: 1139657 - RNA, 22 nt, Homo sapiens
aggacuuuaucuaauaccucug

SEQ ID NO: 1139658 - RNA, 23 nt, Homo sapiens
aggagaaaaaaagcaugugucau

SEQ ID NO: 1139659 - RNA, 15 nt, Homo sapiens
aggagaaacacuuga

SEQ ID NO: 1139660 - RNA, 20 nt, Homo sapiens
aggagaaacucccauguaug

SEQ ID NO: 1139661 - RNA, 14 nt, Homo sapiens
aggagaagcugcau

SEQ ID NO: 1139662 - RNA, 15 nt, Homo sapiens
aggagaauaugauaa

SEQ ID NO: 1139663 - RNA, 18 nt, Homo sapiens
aggagaaucaaaaugcaa

SEQ ID NO: 1139664 - RNA, 22 nt, Homo sapiens
aggagaaugaaauguaugugcu

SEQ ID NO: 1139665 - RNA, 22 nt, Homo sapiens
aggagaauugaauucuggaaac

SEQ ID NO: 1139666 - RNA, 18 nt, Homo sapiens
aggagacaaagcaggagu

SEQ ID NO: 1139667 - RNA, 18 nt, Homo sapiens
aggagacccaacaaugag

SEQ ID NO: 1139668 - RNA, 22 nt, Homo sapiens
aggagacucaccucugccucaa

SEQ ID NO: 1139669 - RNA, 16 nt, Homo sapiens
aggagagcagcuguca

SEQ ID NO: 1139670 - RNA, 18 nt, Homo sapiens
aggagcagauuuuugcaa

SEQ ID NO: 1139671 - RNA, 19 nt, Homo sapiens
aggagccggacacuucuca

SEQ ID NO: 1139672 - RNA, 20 nt, Homo sapiens
aggaggcuuuaagcuccagc

SEQ ID NO: 1139673 - RNA, 16 nt, Homo sapiens
aggagggaaggauuua

SEQ ID NO: 1139674 - RNA, 17 nt, Homo sapiens
aggagggagaaaggaga

SEQ ID NO: 1139675 - RNA, 18 nt, Homo sapiens
aggagggaggugcuucua

SEQ ID NO: 1139676 - RNA, 15 nt, Homo sapiens
aggagggcaaaaauu

SEQ ID NO: 1139677 - RNA, 18 nt, Homo sapiens
aggagggcagaucacuuc

SEQ ID NO: 1139678 - RNA, 13 nt, Homo sapiens
aggaggggaacac

SEQ ID NO: 1139679 - RNA, 23 nt, Homo sapiens
aggaggggucuggguacuucuug

SEQ ID NO: 1139680 - RNA, 20 nt, Homo sapiens
aggaguacaccccaacagca

SEQ ID NO: 1139681 - RNA, 21 nt, Homo sapiens
aggaguacaccccaacagcac

SEQ ID NO: 1139682 - RNA, 15 nt, Homo sapiens
aggagucagccaugu

SEQ ID NO: 1139683 - RNA, 18 nt, Homo sapiens
aggagugugaccacugaa

SEQ ID NO: 1139684 - RNA, 18 nt, Homo sapiens
aggaguucgagaccagcc

SEQ ID NO: 1139685 - RNA, 15 nt, Homo sapiens
aggauaacuugcuuu

SEQ ID NO: 1139686 - RNA, 14 nt, Homo sapiens
aggauagaugcugg

SEQ ID NO: 1139687 - RNA, 21 nt, Homo sapiens
aggauauuaaauguugcuuua

SEQ ID NO: 1139688 - RNA, 17 nt, Homo sapiens
aggauccaagcuaagca

SEQ ID NO: 1139689 - RNA, 17 nt, Homo sapiens
aggauccccccaugccc

SEQ ID NO: 1139690 - RNA, 18 nt, Homo sapiens
aggaucucagaucacugc

SEQ ID NO: 1139691 - RNA, 18 nt, Homo sapiens
aggauguguuuucagucu

SEQ ID NO: 1139692 - RNA, 23 nt, Homo sapiens
aggauguugccacuggcaaaugu

SEQ ID NO: 1139693 - RNA, 23 nt, Homo sapiens
aggauuaauggauguaagguauu

SEQ ID NO: 1139694 - RNA, 14 nt, Homo sapiens
aggauugcuucaau

SEQ ID NO: 1139695 - RNA, 20 nt, Homo sapiens
aggauugugcugauguagug

SEQ ID NO: 1139696 - RNA, 14 nt, Homo sapiens
aggauuucagccau

SEQ ID NO: 1139697 - RNA, 16 nt, Homo sapiens
aggauuugaauuuguc

SEQ ID NO: 1139698 - RNA, 20 nt, Homo sapiens
aggauuuuagcuaggauuug

SEQ ID NO: 1139699 - RNA, 22 nt, Homo sapiens
aggcaaaaaaaucauauaagcu

SEQ ID NO: 1139700 - RNA, 19 nt, Homo sapiens
aggcaaacugcaaaccaug

SEQ ID NO: 1139701 - RNA, 14 nt, Homo sapiens
aggcaagccaugga

SEQ ID NO: 1139702 - RNA, 17 nt, Homo sapiens
aggcacaagaaucacuu

SEQ ID NO: 1139703 - RNA, 19 nt, Homo sapiens
aggcacacaccaccacgcc

SEQ ID NO: 1139704 - RNA, 22 nt, Homo sapiens
aggcacacagcaagucaggguu

SEQ ID NO: 1139705 - RNA, 18 nt, Homo sapiens
aggcacacagcuacucuc

SEQ ID NO: 1139706 - RNA, 17 nt, Homo sapiens
aggcacagcaaacuguc

SEQ ID NO: 1139707 - RNA, 19 nt, Homo sapiens
aggcacccaccaccaugcc

SEQ ID NO: 1139708 - RNA, 22 nt, Homo sapiens
aggcaccgcagccugucagcca

SEQ ID NO: 1139709 - RNA, 19 nt, Homo sapiens
aggcaccugccaccaugcc

SEQ ID NO: 1139710 - RNA, 16 nt, Homo sapiens
aggcacgucugcagaa

SEQ ID NO: 1139711 - RNA, 19 nt, Homo sapiens
aggcacuguaguucuaaga

SEQ ID NO: 1139712 - RNA, 19 nt, Homo sapiens
aggcagauaacugcuguau

SEQ ID NO: 1139713 - RNA, 14 nt, Homo sapiens
aggcagcauuccau

SEQ ID NO: 1139714 - RNA, 15 nt, Homo sapiens
aggcagccaguguga

SEQ ID NO: 1139715 - RNA, 17 nt, Homo sapiens
aggcaggagaaucucuu

SEQ ID NO: 1139716 - RNA, 23 nt, Homo sapiens
aggcaggaggccauuuacuugag

SEQ ID NO: 1139717 - RNA, 21 nt, Homo sapiens
aggcagggccuugcccagaga

SEQ ID NO: 1139718 - RNA, 17 nt, Homo sapiens
aggcaguuuagugcauc

SEQ ID NO: 1139719 - RNA, 18 nt, Homo sapiens
aggcaugaaccacugcac

SEQ ID NO: 1139720 - RNA, 19 nt, Homo sapiens
aggcauggcuggugccuga

SEQ ID NO: 1139721 - RNA, 16 nt, Homo sapiens
aggcaugguggcucau

SEQ ID NO: 1139722 - RNA, 19 nt, Homo sapiens
aggcaugugucccuuccaa

SEQ ID NO: 1139723 - RNA, 11 nt, Homo sapiens
aggcauucucu

SEQ ID NO: 1139724 - RNA, 16 nt, Homo sapiens
aggccaaaccucuguu

SEQ ID NO: 1139725 - RNA, 14 nt, Homo sapiens
aggccaacugccuc

SEQ ID NO: 1139726 - RNA, 19 nt, Homo sapiens
aggccacacucagcacaag

SEQ ID NO: 1139727 - RNA, 18 nt, Homo sapiens
aggccacuguuugucuca

SEQ ID NO: 1139728 - RNA, 21 nt, Homo sapiens
aggccaggcgagccugacucu

SEQ ID NO: 1139729 - RNA, 20 nt, Homo sapiens
aggccaugaaaaaaaugauc

SEQ ID NO: 1139730 - RNA, 9 nt, Homo sapiens
aggcccaag

SEQ ID NO: 1139731 - RNA, 16 nt, Homo sapiens
aggcccacacacaggu

SEQ ID NO: 1139732 - RNA, 13 nt, Homo sapiens
aggcccacugucc

SEQ ID NO: 1139733 - RNA, 20 nt, Homo sapiens
aggcccaguucacccugauu

SEQ ID NO: 1139734 - RNA, 22 nt, Homo sapiens
aggccccucuccuccguggcac

SEQ ID NO: 1139735 - RNA, 23 nt, Homo sapiens
aggccccucuccuccguggcaca

SEQ ID NO: 1139736 - RNA, 16 nt, Homo sapiens
aggcccuuuccacgaa

SEQ ID NO: 1139737 - RNA, 16 nt, Homo sapiens
aggccgagaagcaaga

SEQ ID NO: 1139738 - RNA, 18 nt, Homo sapiens
aggccuacugaccaaauu

SEQ ID NO: 1139739 - RNA, 22 nt, Homo sapiens
aggccucaaaugacaguagcau

SEQ ID NO: 1139740 - RNA, 14 nt, Homo sapiens
aggccucacuggcu

SEQ ID NO: 1139741 - RNA, 20 nt, Homo sapiens
aggccucacuggcucaugcc

SEQ ID NO: 1139742 - RNA, 13 nt, Homo sapiens
aggccucagggag

SEQ ID NO: 1139743 - RNA, 20 nt, Homo sapiens
aggccuccugugacuggcag

SEQ ID NO: 1139744 - RNA, 22 nt, Homo sapiens
aggccuccugugacuggcagca

SEQ ID NO: 1139745 - RNA, 23 nt, Homo sapiens
aggccucgaaaaccaucacauga

SEQ ID NO: 1139746 - RNA, 19 nt, Homo sapiens
aggccucucaccucugugc

SEQ ID NO: 1139747 - RNA, 19 nt, Homo sapiens
aggccucucggugcuccau

SEQ ID NO: 1139748 - RNA, 22 nt, Homo sapiens
aggccucucggugcuccaucuc

SEQ ID NO: 1139749 - RNA, 23 nt, Homo sapiens
aggccucucggugcuccaucucc

SEQ ID NO: 1139750 - RNA, 16 nt, Homo sapiens
aggccugcccugcuau

SEQ ID NO: 1139751 - RNA, 17 nt, Homo sapiens
aggccugcccugcuauu

SEQ ID NO: 1139752 - RNA, 17 nt, Homo sapiens
aggccugccgcuuugau

SEQ ID NO: 1139753 - RNA, 20 nt, Homo sapiens
aggccuggcacgucaaagag

SEQ ID NO: 1139754 - RNA, 16 nt, Homo sapiens
aggccugggaccuccc

SEQ ID NO: 1139755 - RNA, 21 nt, Homo sapiens
aggccugggaccucccacugc

SEQ ID NO: 1139756 - RNA, 13 nt, Homo sapiens
aggccugucugug

SEQ ID NO: 1139757 - RNA, 19 nt, Homo sapiens
aggccuugcucacagcuga

SEQ ID NO: 1139758 - RNA, 23 nt, Homo sapiens
aggccuuggccaagcugcugcuu

SEQ ID NO: 1139759 - RNA, 21 nt, Homo sapiens
aggccuuuggaaagacuugaa

SEQ ID NO: 1139760 - RNA, 16 nt, Homo sapiens
aggcgccugccaucau

SEQ ID NO: 1139761 - RNA, 15 nt, Homo sapiens
aggcggaucaucuaa

SEQ ID NO: 1139762 - RNA, 18 nt, Homo sapiens
aggcgugagccaccacgc

SEQ ID NO: 1139763 - RNA, 20 nt, Homo sapiens
aggcgugguggcgggugccu

SEQ ID NO: 1139764 - RNA, 14 nt, Homo sapiens
aggcguucuucgag

SEQ ID NO: 1139765 - RNA, 20 nt, Homo sapiens
aggcuaauuuuucaacuugg

SEQ ID NO: 1139766 - RNA, 21 nt, Homo sapiens
aggcuagaacagagaagcccu

SEQ ID NO: 1139767 - RNA, 15 nt, Homo sapiens
aggcuagagugcaau

SEQ ID NO: 1139768 - RNA, 20 nt, Homo sapiens
aggcuagcuggagccuggga

SEQ ID NO: 1139769 - RNA, 13 nt, Homo sapiens
aggcuccuguuag

SEQ ID NO: 1139770 - RNA, 16 nt, Homo sapiens
aggcucucuugugcau

SEQ ID NO: 1139771 - RNA, 15 nt, Homo sapiens
aggcucugugccuug

SEQ ID NO: 1139772 - RNA, 22 nt, Homo sapiens
aggcucugugccuuggucucuc

SEQ ID NO: 1139773 - RNA, 15 nt, Homo sapiens
aggcugaaagacagg

SEQ ID NO: 1139774 - RNA, 17 nt, Homo sapiens
aggcugaggcaggagaa

SEQ ID NO: 1139775 - RNA, 22 nt, Homo sapiens
aggcugaggugggaaaaucacu

SEQ ID NO: 1139776 - RNA, 15 nt, Homo sapiens
aggcugaucccugag

SEQ ID NO: 1139777 - RNA, 14 nt, Homo sapiens
aggcugcaaugagc

SEQ ID NO: 1139778 - RNA, 20 nt, Homo sapiens
aggcugcuuuccaaagccaa

SEQ ID NO: 1139779 - RNA, 21 nt, Homo sapiens
aggcugcuuuccaaagccaau

SEQ ID NO: 1139780 - RNA, 20 nt, Homo sapiens
aggcuggagugcaauggugu

SEQ ID NO: 1139781 - RNA, 20 nt, Homo sapiens
aggcuggagugcaguggugu

SEQ ID NO: 1139782 - RNA, 14 nt, Homo sapiens
aggcuggaguugcu

SEQ ID NO: 1139783 - RNA, 20 nt, Homo sapiens
aggcuggcuccagaugcagg

SEQ ID NO: 1139784 - RNA, 14 nt, Homo sapiens
aggcuggcucguag

SEQ ID NO: 1139785 - RNA, 14 nt, Homo sapiens
aggcugggccgcaa

SEQ ID NO: 1139786 - RNA, 17 nt, Homo sapiens
aggcugggcucagcuca

SEQ ID NO: 1139787 - RNA, 13 nt, Homo sapiens
aggcugugcugcc

SEQ ID NO: 1139788 - RNA, 20 nt, Homo sapiens
aggcuguuuauauguucaca

SEQ ID NO: 1139789 - RNA, 22 nt, Homo sapiens
aggcuucccugacuugcuuuag

SEQ ID NO: 1139790 - RNA, 12 nt, Homo sapiens
aggcuucuucag

SEQ ID NO: 1139791 - RNA, 23 nt, Homo sapiens
aggcuuggaaccguaggacccaa

SEQ ID NO: 1139792 - RNA, 13 nt, Homo sapiens
agggaaaagcagc

SEQ ID NO: 1139793 - RNA, 22 nt, Homo sapiens
agggaaaaggacuuguuuuccu

SEQ ID NO: 1139794 - RNA, 18 nt, Homo sapiens
agggaaaauuauuugcau

SEQ ID NO: 1139795 - RNA, 23 nt, Homo sapiens
agggaaagguaaauacaagugaa

SEQ ID NO: 1139796 - RNA, 18 nt, Homo sapiens
agggaacaaguacuucuu

SEQ ID NO: 1139797 - RNA, 16 nt, Homo sapiens
agggaaggaucccaug

SEQ ID NO: 1139798 - RNA, 13 nt, Homo sapiens
agggaagggagca

SEQ ID NO: 1139799 - RNA, 14 nt, Homo sapiens
agggaagggagcag

SEQ ID NO: 1139800 - RNA, 23 nt, Homo sapiens
agggaauaugcauugucugcaau

SEQ ID NO: 1139801 - RNA, 13 nt, Homo sapiens
agggaauccuccu

SEQ ID NO: 1139802 - RNA, 14 nt, Homo sapiens
agggacacuuaccc

SEQ ID NO: 1139803 - RNA, 14 nt, Homo sapiens
agggacccaugagu

SEQ ID NO: 1139804 - RNA, 17 nt, Homo sapiens
agggagaccccaaaaag

SEQ ID NO: 1139805 - RNA, 9 nt, Homo sapiens
agggagcag

SEQ ID NO: 1139806 - RNA, 16 nt, Homo sapiens
agggagcagaugcaau

SEQ ID NO: 1139807 - RNA, 13 nt, Homo sapiens
agggaggaccaaa

SEQ ID NO: 1139808 - RNA, 20 nt, Homo sapiens
agggaggcaagcccuguuga

SEQ ID NO: 1139809 - RNA, 22 nt, Homo sapiens
agggagggacacuuacccaagg

SEQ ID NO: 1139810 - RNA, 15 nt, Homo sapiens
agggaguuccaguca

SEQ ID NO: 1139811 - RNA, 23 nt, Homo sapiens
agggauggcgaggccucucucag

SEQ ID NO: 1139812 - RNA, 13 nt, Homo sapiens
agggauuacuuau

SEQ ID NO: 1139813 - RNA, 23 nt, Homo sapiens
agggcaaaaucgccauaggccaa

SEQ ID NO: 1139814 - RNA, 11 nt, Homo sapiens
agggcacaaag

SEQ ID NO: 1139815 - RNA, 13 nt, Homo sapiens
agggcagcugccu

SEQ ID NO: 1139816 - RNA, 17 nt, Homo sapiens
agggcauauacagugaa

SEQ ID NO: 1139817 - RNA, 18 nt, Homo sapiens
agggccaagaagucccaa

SEQ ID NO: 1139818 - RNA, 22 nt, Homo sapiens
agggccacagagcuacauggug

SEQ ID NO: 1139819 - RNA, 16 nt, Homo sapiens
agggccacaugggagg

SEQ ID NO: 1139820 - RNA, 16 nt, Homo sapiens
agggcccccaucucau

SEQ ID NO: 1139821 - RNA, 21 nt, Homo sapiens
agggcggccagggacccaaag

SEQ ID NO: 1139822 - RNA, 20 nt, Homo sapiens
agggcuacaaaggaggacaa

SEQ ID NO: 1139823 - RNA, 13 nt, Homo sapiens
agggcuaucucag

SEQ ID NO: 1139824 - RNA, 11 nt, Homo sapiens
agggcugccag

SEQ ID NO: 1139825 - RNA, 18 nt, Homo sapiens
agggcugguucagggcug

SEQ ID NO: 1139826 - RNA, 21 nt, Homo sapiens
aggggaaaagagaugaugaaa

SEQ ID NO: 1139827 - RNA, 20 nt, Homo sapiens
aggggaacagaagaaaauaa

SEQ ID NO: 1139828 - RNA, 14 nt, Homo sapiens
aggggacacuggcc

SEQ ID NO: 1139829 - RNA, 12 nt, Homo sapiens
aggggaccaugc

SEQ ID NO: 1139830 - RNA, 19 nt, Homo sapiens
aggggacucaggggcuugg

SEQ ID NO: 1139831 - RNA, 14 nt, Homo sapiens
aggggagccagggu

SEQ ID NO: 1139832 - RNA, 16 nt, Homo sapiens
aggggaggaacaggga

SEQ ID NO: 1139833 - RNA, 12 nt, Homo sapiens
aggggauguuua

SEQ ID NO: 1139834 - RNA, 13 nt, Homo sapiens
aggggcagccaca

SEQ ID NO: 1139835 - RNA, 23 nt, Homo sapiens
aggggcuagggaggaccaaaggg

SEQ ID NO: 1139836 - RNA, 20 nt, Homo sapiens
aggggcuguguuuccaucuc

SEQ ID NO: 1139837 - RNA, 21 nt, Homo sapiens
auuagcuuggggccagggaag

SEQ ID NO: 1139838 - RNA, 21 nt, Homo sapiens
auuaggauggugaaccagcag

SEQ ID NO: 1139839 - RNA, 19 nt, Homo sapiens
auuaggcaaaaauaauuua

SEQ ID NO: 1139840 - RNA, 23 nt, Homo sapiens
auuagucaccuaacccucuguca

SEQ ID NO: 1139841 - RNA, 13 nt, Homo sapiens
auuaguuaaucuc

SEQ ID NO: 1139842 - RNA, 17 nt, Homo sapiens
auuauaaacagcagggu

SEQ ID NO: 1139843 - RNA, 21 nt, Homo sapiens
auuauaaauaaauaccaaaaa

SEQ ID NO: 1139844 - RNA, 18 nt, Homo sapiens
auuauacacuaugaaacc

SEQ ID NO: 1139845 - RNA, 13 nt, Homo sapiens
auuauagcacaaa

SEQ ID NO: 1139846 - RNA, 20 nt, Homo sapiens
auuauauaaggacagaccaa

SEQ ID NO: 1139847 - RNA, 16 nt, Homo sapiens
auuauaugcacuagca

SEQ ID NO: 1139848 - RNA, 17 nt, Homo sapiens
auuauaugcacuagcaa

SEQ ID NO: 1139849 - RNA, 20 nt, Homo sapiens
auuauauuuacaaaugggaa

SEQ ID NO: 1139850 - RNA, 13 nt, Homo sapiens
auuauauuugaca

SEQ ID NO: 1139851 - RNA, 14 nt, Homo sapiens
auuaucaauguucu

SEQ ID NO: 1139852 - RNA, 22 nt, Homo sapiens
auuauccuagauuauaucaaag

SEQ ID NO: 1139853 - RNA, 19 nt, Homo sapiens
auuaucuaaaaucugcuag

SEQ ID NO: 1139854 - RNA, 17 nt, Homo sapiens
auuaucuauacauaaaa

SEQ ID NO: 1139855 - RNA, 16 nt, Homo sapiens
auuaugcaucugcuac

SEQ ID NO: 1139856 - RNA, 19 nt, Homo sapiens
auuauguuuugugauucaa

SEQ ID NO: 1139857 - RNA, 22 nt, Homo sapiens
auuauucuuguaguuuaccucu

SEQ ID NO: 1139858 - RNA, 16 nt, Homo sapiens
auuauuggacagucuc

SEQ ID NO: 1139859 - RNA, 17 nt, Homo sapiens
auuauuggacagucuca

SEQ ID NO: 1139860 - RNA, 20 nt, Homo sapiens
auuauuugucauucauucaa

SEQ ID NO: 1139861 - RNA, 16 nt, Homo sapiens
auuauuuuccuuccau

SEQ ID NO: 1139862 - RNA, 22 nt, Homo sapiens
auuauuuuccuuccaugcuccc

SEQ ID NO: 1139863 - RNA, 20 nt, Homo sapiens
auuauuuucucuuaacaaga

SEQ ID NO: 1139864 - RNA, 22 nt, Homo sapiens
auucaaacuucuguguacuggg

SEQ ID NO: 1139865 - RNA, 21 nt, Homo sapiens
auucaacucuccaauguucua

SEQ ID NO: 1139866 - RNA, 14 nt, Homo sapiens
auucaagaaugcca

SEQ ID NO: 1139867 - RNA, 17 nt, Homo sapiens
auucaaucaaccugcac

SEQ ID NO: 1139868 - RNA, 23 nt, Homo sapiens
auucaaucaaccugcacuucaua

SEQ ID NO: 1139869 - RNA, 12 nt, Homo sapiens
auucacaaugaa

SEQ ID NO: 1139870 - RNA, 14 nt, Homo sapiens
auucaccaauauca

SEQ ID NO: 1139871 - RNA, 15 nt, Homo sapiens
auucacuaaggacuu

SEQ ID NO: 1139872 - RNA, 13 nt, Homo sapiens
auucagagcucaa

SEQ ID NO: 1139873 - RNA, 18 nt, Homo sapiens
auucagaguagaaccacu

SEQ ID NO: 1139874 - RNA, 18 nt, Homo sapiens
auucaggcagcacugaca

SEQ ID NO: 1139875 - RNA, 21 nt, Homo sapiens
auucaggcagcacugacaaua

SEQ ID NO: 1139876 - RNA, 16 nt, Homo sapiens
auucagguauaaggca

SEQ ID NO: 1139877 - RNA, 21 nt, Homo sapiens
auucagucucuucuaagcaaa

SEQ ID NO: 1139878 - RNA, 20 nt, Homo sapiens
auucagucuuuucucugaaa

SEQ ID NO: 1139879 - RNA, 16 nt, Homo sapiens
auucauaaaucacaaa

SEQ ID NO: 1139880 - RNA, 12 nt, Homo sapiens
auucauguacau

SEQ ID NO: 1139881 - RNA, 14 nt, Homo sapiens
auucauguggaaua

SEQ ID NO: 1139882 - RNA, 22 nt, Homo sapiens
auucaugugggcauuucuugcg

SEQ ID NO: 1139883 - RNA, 22 nt, Homo sapiens
auucauguucaucaauaccugc

SEQ ID NO: 1139884 - RNA, 21 nt, Homo sapiens
auucauuugaauaaaaaggaa

SEQ ID NO: 1139885 - RNA, 15 nt, Homo sapiens
auuccaaacucucca

SEQ ID NO: 1139886 - RNA, 13 nt, Homo sapiens
auuccaggcuccu

SEQ ID NO: 1139887 - RNA, 14 nt, Homo sapiens
auuccagucuacuu

SEQ ID NO: 1139888 - RNA, 23 nt, Homo sapiens
auuccaguugcaauucauaacua

SEQ ID NO: 1139889 - RNA, 15 nt, Homo sapiens
auuccaucagcacaa

SEQ ID NO: 1139890 - RNA, 21 nt, Homo sapiens
auucccacagcacuaauucaa

SEQ ID NO: 1139891 - RNA, 11 nt, Homo sapiens
auucccacugc

SEQ ID NO: 1139892 - RNA, 14 nt, Homo sapiens
auucccacugccag

SEQ ID NO: 1139893 - RNA, 18 nt, Homo sapiens
auucccauuuccugucau

SEQ ID NO: 1139894 - RNA, 17 nt, Homo sapiens
auuccccacacucuccu

SEQ ID NO: 1139895 - RNA, 22 nt, Homo sapiens
auucccucaccugucgcuuccu

SEQ ID NO: 1139896 - RNA, 22 nt, Homo sapiens
auucccuuccucugauuugaag

SEQ ID NO: 1139897 - RNA, 18 nt, Homo sapiens
auucccuuugcauguuaa

SEQ ID NO: 1139898 - RNA, 21 nt, Homo sapiens
auuccggaaacuaguguacau

SEQ ID NO: 1139899 - RNA, 19 nt, Homo sapiens
auuccguugucuguggaug

SEQ ID NO: 1139900 - RNA, 15 nt, Homo sapiens
auuccuaaugcauua

SEQ ID NO: 1139901 - RNA, 17 nt, Homo sapiens
auuccucagaaaccaaa

SEQ ID NO: 1139902 - RNA, 14 nt, Homo sapiens
auuccucauuugga

SEQ ID NO: 1139903 - RNA, 16 nt, Homo sapiens
auuccucucaguccuu

SEQ ID NO: 1139904 - RNA, 21 nt, Homo sapiens
auuccuguacaauuucauccc

SEQ ID NO: 1139905 - RNA, 14 nt, Homo sapiens
auuccuguccuuca

SEQ ID NO: 1139906 - RNA, 16 nt, Homo sapiens
auucgaaugacacugu

SEQ ID NO: 1139907 - RNA, 13 nt, Homo sapiens
auucgccucugga

SEQ ID NO: 1139908 - RNA, 21 nt, Homo sapiens
auucgcugcaaccuguugaua

SEQ ID NO: 1139909 - RNA, 15 nt, Homo sapiens
auucgguaauaucau

SEQ ID NO: 1139910 - RNA, 13 nt, Homo sapiens
auucuaaacagau

SEQ ID NO: 1139911 - RNA, 14 nt, Homo sapiens
auucuaaaccaauc

SEQ ID NO: 1139912 - RNA, 16 nt, Homo sapiens
auucuacacagagcag

SEQ ID NO: 1139913 - RNA, 16 nt, Homo sapiens
auucuacucaaaguca

SEQ ID NO: 1139914 - RNA, 23 nt, Homo sapiens
auucucaagccagagacaaucua

SEQ ID NO: 1139915 - RNA, 16 nt, Homo sapiens
auucucagugccaacu

SEQ ID NO: 1139916 - RNA, 13 nt, Homo sapiens
auucucauucuca

SEQ ID NO: 1139917 - RNA, 21 nt, Homo sapiens
auucuccauguacuggcaaga

SEQ ID NO: 1139918 - RNA, 16 nt, Homo sapiens
auucucucuccuguac

SEQ ID NO: 1139919 - RNA, 18 nt, Homo sapiens
auucucugagcugugcag

SEQ ID NO: 1139920 - RNA, 20 nt, Homo sapiens
auucucuuuuuuucuugucc

SEQ ID NO: 1139921 - RNA, 17 nt, Homo sapiens
auucugauaaugcucac

SEQ ID NO: 1139922 - RNA, 19 nt, Homo sapiens
auucugauuuuacauguaa

SEQ ID NO: 1139923 - RNA, 22 nt, Homo sapiens
auucugggaacccugugcaauu

SEQ ID NO: 1139924 - RNA, 14 nt, Homo sapiens
auucuguggaacaa

SEQ ID NO: 1139925 - RNA, 20 nt, Homo sapiens
auucuguucuaaaacuccaa

SEQ ID NO: 1139926 - RNA, 22 nt, Homo sapiens
auucuucccuuuuaaacacauu

SEQ ID NO: 1139927 - RNA, 14 nt, Homo sapiens
auucuuguuauacc

SEQ ID NO: 1139928 - RNA, 23 nt, Homo sapiens
auucuuuaaaauuacaacuaagu

SEQ ID NO: 1139929 - RNA, 18 nt, Homo sapiens
auucuuuauacauucuag

SEQ ID NO: 1139930 - RNA, 20 nt, Homo sapiens
auucuuuugaauuguuacau

SEQ ID NO: 1139931 - RNA, 15 nt, Homo sapiens
auucuuuugccaagg

SEQ ID NO: 1139932 - RNA, 20 nt, Homo sapiens
auucuuuuuccaucccuagc

SEQ ID NO: 1139933 - RNA, 17 nt, Homo sapiens
auugaaaggcauucucu

SEQ ID NO: 1139934 - RNA, 13 nt, Homo sapiens
auugaacacugcg

SEQ ID NO: 1139935 - RNA, 20 nt, Homo sapiens
auugaagaccagcuuucuca

SEQ ID NO: 1139936 - RNA, 18 nt, Homo sapiens
auugaagccuuugccagc

SEQ ID NO: 1139937 - RNA, 19 nt, Homo sapiens
auugaauuuacauauagcu

SEQ ID NO: 1139938 - RNA, 14 nt, Homo sapiens
cuauauaugacugg

SEQ ID NO: 1139939 - RNA, 23 nt, Homo sapiens
cuauauguuauggcuuauugugu

SEQ ID NO: 1139940 - RNA, 20 nt, Homo sapiens
cuauauuugagcacuggucu

SEQ ID NO: 1139941 - RNA, 24 nt, Homo sapiens
cuaucaaaacucuaucaaauguga

SEQ ID NO: 1139942 - RNA, 15 nt, Homo sapiens
cuaucaaaauugccu

SEQ ID NO: 1139943 - RNA, 20 nt, Homo sapiens
cuaucggggucacuugcaau

SEQ ID NO: 1139944 - RNA, 21 nt, Homo sapiens
cuaucuacuacaaacuucaaa

SEQ ID NO: 1139945 - RNA, 23 nt, Homo sapiens
cuaucuacuacaaacuucaaaga

SEQ ID NO: 1139946 - RNA, 21 nt, Homo sapiens
cuaugaaauuucaacuuuucc

SEQ ID NO: 1139947 - RNA, 15 nt, Homo sapiens
cuaugaaccugaaaa

SEQ ID NO: 1139948 - RNA, 21 nt, Homo sapiens
cuaugaaguaaagaacugcac

SEQ ID NO: 1139949 - RNA, 12 nt, Homo sapiens
cuaugagucuag

SEQ ID NO: 1139950 - RNA, 16 nt, Homo sapiens
cuaugauggguggugu

SEQ ID NO: 1139951 - RNA, 22 nt, Homo sapiens
cuaugauguuucuuuugcaauu

SEQ ID NO: 1139952 - RNA, 13 nt, Homo sapiens
cuaugccuugaaa

SEQ ID NO: 1139953 - RNA, 20 nt, Homo sapiens
cuaugcugggguacacagug

SEQ ID NO: 1139954 - RNA, 14 nt, Homo sapiens
cuauggaaguauua

SEQ ID NO: 1139955 - RNA, 14 nt, Homo sapiens
cuauggugcucugu

SEQ ID NO: 1139956 - RNA, 15 nt, Homo sapiens
cuaugguuugccauu

SEQ ID NO: 1139957 - RNA, 15 nt, Homo sapiens
cuaugugaaacuuga

SEQ ID NO: 1139958 - RNA, 15 nt, Homo sapiens
cuauguggcuguauc

SEQ ID NO: 1139959 - RNA, 19 nt, Homo sapiens
cuauguguguuguuuccau

SEQ ID NO: 1139960 - RNA, 11 nt, Homo sapiens
cuauguuguuu

SEQ ID NO: 1139961 - RNA, 21 nt, Homo sapiens
cuauguuuccccccuuuucag

SEQ ID NO: 1139962 - RNA, 20 nt, Homo sapiens
cuauuaaucaccucucugua

SEQ ID NO: 1139963 - RNA, 18 nt, Homo sapiens
cuauuacuuuucaucuaa

SEQ ID NO: 1139964 - RNA, 16 nt, Homo sapiens
cuauuagagcauugaa

SEQ ID NO: 1139965 - RNA, 21 nt, Homo sapiens
cuauuauacuuuaucaaagau

SEQ ID NO: 1139966 - RNA, 16 nt, Homo sapiens
cuauuaucaacugcug

SEQ ID NO: 1139967 - RNA, 13 nt, Homo sapiens
cuauuauccuucu

SEQ ID NO: 1139968 - RNA, 12 nt, Homo sapiens
cuauuaucucaa

SEQ ID NO: 1139969 - RNA, 18 nt, Homo sapiens
cuauuccugaacuauaac

SEQ ID NO: 1139970 - RNA, 19 nt, Homo sapiens
cuauuguauauauaaucua

SEQ ID NO: 1139971 - RNA, 12 nt, Homo sapiens
cuauuguguuau

SEQ ID NO: 1139972 - RNA, 22 nt, Homo sapiens
cuauuuaagugaaaaaagcaaa

SEQ ID NO: 1139973 - RNA, 11 nt, Homo sapiens
cuauuuccauu

SEQ ID NO: 1139974 - RNA, 15 nt, Homo sapiens
cuauuugaacaagug

SEQ ID NO: 1139975 - RNA, 13 nt, Homo sapiens
cuauuugaagugu

SEQ ID NO: 1139976 - RNA, 19 nt, Homo sapiens
cuauuugcacuguagccuc

SEQ ID NO: 1139977 - RNA, 13 nt, Homo sapiens
cuauuuuccucuu

SEQ ID NO: 1139978 - RNA, 18 nt, Homo sapiens
cuauuuuuagcaauguuu

SEQ ID NO: 1139979 - RNA, 15 nt, Homo sapiens
cuauuuuuguacaaa

SEQ ID NO: 1139980 - RNA, 16 nt, Homo sapiens
cuauuuuuguacaaaa

SEQ ID NO: 1139981 - RNA, 16 nt, Homo sapiens
cucaaaacuguacugu

SEQ ID NO: 1139982 - RNA, 13 nt, Homo sapiens
cucaaaagaacuu

SEQ ID NO: 1139983 - RNA, 17 nt, Homo sapiens
cucaaacggcaacauuc

SEQ ID NO: 1139984 - RNA, 21 nt, Homo sapiens
cucaaacggcaacauuccuca

SEQ ID NO: 1139985 - RNA, 18 nt, Homo sapiens
cucaaacuccugagcuca

SEQ ID NO: 1139986 - RNA, 20 nt, Homo sapiens
cucaaaugugaccaugugaa

SEQ ID NO: 1139987 - RNA, 21 nt, Homo sapiens
cucaaauguucuaaguuucua

SEQ ID NO: 1139988 - RNA, 17 nt, Homo sapiens
cucaacacccaacuguc

SEQ ID NO: 1139989 - RNA, 11 nt, Homo sapiens
cucaaccaaau

SEQ ID NO: 1139990 - RNA, 18 nt, Homo sapiens
cucaaccaaugccaaaaa

SEQ ID NO: 1139991 - RNA, 16 nt, Homo sapiens
cucaagacugaaacgg

SEQ ID NO: 1139992 - RNA, 17 nt, Homo sapiens
cucaagccaagcagcca

SEQ ID NO: 1139993 - RNA, 14 nt, Homo sapiens
cucaagucuugaca

SEQ ID NO: 1139994 - RNA, 18 nt, Homo sapiens
cucaagugagccaagaaa

SEQ ID NO: 1139995 - RNA, 12 nt, Homo sapiens
cucaaguucuaa

SEQ ID NO: 1139996 - RNA, 20 nt, Homo sapiens
cucaauagcuccaagcuguu

SEQ ID NO: 1139997 - RNA, 20 nt, Homo sapiens
cucaauccauccauguacuu

SEQ ID NO: 1139998 - RNA, 19 nt, Homo sapiens
cucaaugcacaacaaagga

SEQ ID NO: 1139999 - RNA, 13 nt, Homo sapiens
cucaauugggaaa

SEQ ID NO: 1140000 - RNA, 13 nt, Homo sapiens
cucacaaccugaa

SEQ ID NO: 1140001 - RNA, 13 nt, Homo sapiens
cucacaccacuaa

SEQ ID NO: 1140002 - RNA, 16 nt, Homo sapiens
cucacacuuacuguaa

SEQ ID NO: 1140003 - RNA, 18 nt, Homo sapiens
cucacagaagaauaugac

SEQ ID NO: 1140004 - RNA, 18 nt, Homo sapiens
cucacaggccccaggaaa

SEQ ID NO: 1140005 - RNA, 17 nt, Homo sapiens
cucacaucucccuucca

SEQ ID NO: 1140006 - RNA, 13 nt, Homo sapiens
cucaccacuucag

SEQ ID NO: 1140007 - RNA, 20 nt, Homo sapiens
cucacccaggucuccagcaa

SEQ ID NO: 1140008 - RNA, 19 nt, Homo sapiens
cucaccuagccugaugaga

SEQ ID NO: 1140009 - RNA, 15 nt, Homo sapiens
cucaccucuugccuu

SEQ ID NO: 1140010 - RNA, 19 nt, Homo sapiens
cucaccuguuugaaaccaa

SEQ ID NO: 1140011 - RNA, 20 nt, Homo sapiens
cucaccuugcagaaccagug

SEQ ID NO: 1140012 - RNA, 16 nt, Homo sapiens
cucacgcaccucccau

SEQ ID NO: 1140013 - RNA, 20 nt, Homo sapiens
cucacugaaaacaucuggaa

SEQ ID NO: 1140014 - RNA, 18 nt, Homo sapiens
cucacugaggguaucuga

SEQ ID NO: 1140015 - RNA, 21 nt, Homo sapiens
cucacugaggguaucugacaa

SEQ ID NO: 1140016 - RNA, 16 nt, Homo sapiens
cucacugcuguuuuua

SEQ ID NO: 1140017 - RNA, 19 nt, Homo sapiens
cucacugugguaaaugcca

SEQ ID NO: 1140018 - RNA, 14 nt, Homo sapiens
cucacuucuuccau

SEQ ID NO: 1140019 - RNA, 11 nt, Homo sapiens
cucacuuuaaa

SEQ ID NO: 1140020 - RNA, 23 nt, Homo sapiens
cucagaaaugucauguggcuacc

SEQ ID NO: 1140021 - RNA, 18 nt, Homo sapiens
cucagaaggaauggugcg

SEQ ID NO: 1140022 - RNA, 15 nt, Homo sapiens
cucagaaggcuucau

SEQ ID NO: 1140023 - RNA, 17 nt, Homo sapiens
cucagaauccacagugu

SEQ ID NO: 1140024 - RNA, 20 nt, Homo sapiens
cuccugauccugacacauuc

SEQ ID NO: 1140025 - RNA, 17 nt, Homo sapiens
cuccugauuugagauuc

SEQ ID NO: 1140026 - RNA, 17 nt, Homo sapiens
cuccugccaccagcauc

SEQ ID NO: 1140027 - RNA, 15 nt, Homo sapiens
cuccugcccaggaga

SEQ ID NO: 1140028 - RNA, 16 nt, Homo sapiens
cuccugccucagccuu

SEQ ID NO: 1140029 - RNA, 21 nt, Homo sapiens
cuccuggaccuugacagagca

SEQ ID NO: 1140030 - RNA, 17 nt, Homo sapiens
cuccugggcuauauucc

SEQ ID NO: 1140031 - RNA, 17 nt, Homo sapiens
cuccuggguucaagcaa

SEQ ID NO: 1140032 - RNA, 16 nt, Homo sapiens
cuccugugaacacugg

SEQ ID NO: 1140033 - RNA, 21 nt, Homo sapiens
cuccuuccccuugucccuggg

SEQ ID NO: 1140034 - RNA, 16 nt, Homo sapiens
cuccuuccuucaagcc

SEQ ID NO: 1140035 - RNA, 13 nt, Homo sapiens
cuccuucgcuuaa

SEQ ID NO: 1140036 - RNA, 12 nt, Homo sapiens
cuccuugcaguu

SEQ ID NO: 1140037 - RNA, 19 nt, Homo sapiens
cuccuugggaggccccacu

SEQ ID NO: 1140038 - RNA, 22 nt, Homo sapiens
cuccuugggaggccccacuggg

SEQ ID NO: 1140039 - RNA, 15 nt, Homo sapiens
cuccuugggcagggu

SEQ ID NO: 1140040 - RNA, 13 nt, Homo sapiens
cuccuuuacuaaa

SEQ ID NO: 1140041 - RNA, 19 nt, Homo sapiens
cuccuuucuuucuaacucc

SEQ ID NO: 1140042 - RNA, 15 nt, Homo sapiens
cucgaaacacagaaa

SEQ ID NO: 1140043 - RNA, 21 nt, Homo sapiens
cucgagaauguauggauuuac

SEQ ID NO: 1140044 - RNA, 23 nt, Homo sapiens
cucgaggagguaaugaauuaaag

SEQ ID NO: 1140045 - RNA, 18 nt, Homo sapiens
cucgccuccuacucugag

SEQ ID NO: 1140046 - RNA, 19 nt, Homo sapiens
cucgggaggcugaggcaca

SEQ ID NO: 1140047 - RNA, 17 nt, Homo sapiens
cucggggaugcauagau

SEQ ID NO: 1140048 - RNA, 17 nt, Homo sapiens
cucgggggccuguggug

SEQ ID NO: 1140049 - RNA, 16 nt, Homo sapiens
cucggucacaucaggc

SEQ ID NO: 1140050 - RNA, 22 nt, Homo sapiens
cucgguucaaaaccuugcacag

SEQ ID NO: 1140051 - RNA, 21 nt, Homo sapiens
cucguaauuuuuuaacuguaa

SEQ ID NO: 1140052 - RNA, 16 nt, Homo sapiens
cucguuccggucccca

SEQ ID NO: 1140053 - RNA, 18 nt, Homo sapiens
cucguuucaaaaacacag

SEQ ID NO: 1140054 - RNA, 18 nt, Homo sapiens
cucguuugugauucuucc

SEQ ID NO: 1140055 - RNA, 12 nt, Homo sapiens
cucuaaacacac

SEQ ID NO: 1140056 - RNA, 13 nt, Homo sapiens
cucuaaagaccau

SEQ ID NO: 1140057 - RNA, 17 nt, Homo sapiens
cucuaaccaaggcugug

SEQ ID NO: 1140058 - RNA, 13 nt, Homo sapiens
cucuaacccagug

SEQ ID NO: 1140059 - RNA, 18 nt, Homo sapiens
cucuaacuuaagaaauaa

SEQ ID NO: 1140060 - RNA, 15 nt, Homo sapiens
cucuaauacauucca

SEQ ID NO: 1140061 - RNA, 15 nt, Homo sapiens
cucuaaugccaaguu

SEQ ID NO: 1140062 - RNA, 19 nt, Homo sapiens
cucuacaaaaaaaauauaa

SEQ ID NO: 1140063 - RNA, 20 nt, Homo sapiens
cucuacuaaaaauacaaaaa

SEQ ID NO: 1140064 - RNA, 21 nt, Homo sapiens
cucuacuaaaaauacaaaaau

SEQ ID NO: 1140065 - RNA, 22 nt, Homo sapiens
cucuacuugcaagccucaaaga

SEQ ID NO: 1140066 - RNA, 20 nt, Homo sapiens
cucuaucggagaacaugaau

SEQ ID NO: 1140067 - RNA, 23 nt, Homo sapiens
cucuaucggggucacuugcaauu

SEQ ID NO: 1140068 - RNA, 23 nt, Homo sapiens
cucuauguuuacaaauggacaua

SEQ ID NO: 1140069 - RNA, 21 nt, Homo sapiens
cucucaccccaagcggccuuu

SEQ ID NO: 1140070 - RNA, 23 nt, Homo sapiens
cucucaccucugugccucugucu

SEQ ID NO: 1140071 - RNA, 14 nt, Homo sapiens
cucucagcuucuaa

SEQ ID NO: 1140072 - RNA, 12 nt, Homo sapiens
cucucagggcca

SEQ ID NO: 1140073 - RNA, 17 nt, Homo sapiens
cauccaggccagggcuc

SEQ ID NO: 1140074 - RNA, 21 nt, Homo sapiens
cauccauccuggagccucaug

SEQ ID NO: 1140075 - RNA, 12 nt, Homo sapiens
cauccauucuuc

SEQ ID NO: 1140076 - RNA, 19 nt, Homo sapiens
caucccagacacauucaca

SEQ ID NO: 1140077 - RNA, 20 nt, Homo sapiens
caucccgcgcgcccuuccuu

SEQ ID NO: 1140078 - RNA, 15 nt, Homo sapiens
caucccuauccugug

SEQ ID NO: 1140079 - RNA, 19 nt, Homo sapiens
caucccucgggugugcuau

SEQ ID NO: 1140080 - RNA, 15 nt, Homo sapiens
caucccucuguucac

SEQ ID NO: 1140081 - RNA, 16 nt, Homo sapiens
cauccgcgugugccug

SEQ ID NO: 1140082 - RNA, 14 nt, Homo sapiens
cauccguaucuuuu

SEQ ID NO: 1140083 - RNA, 19 nt, Homo sapiens
cauccuaugcaauauaucu

SEQ ID NO: 1140084 - RNA, 16 nt, Homo sapiens
cauccucccaaucuca

SEQ ID NO: 1140085 - RNA, 17 nt, Homo sapiens
cauccuccucuccaugc

SEQ ID NO: 1140086 - RNA, 20 nt, Homo sapiens
cauccuucuuucuaguucag

SEQ ID NO: 1140087 - RNA, 19 nt, Homo sapiens
caucgacauguauuguuaa

SEQ ID NO: 1140088 - RNA, 15 nt, Homo sapiens
caucgcgaugucgca

SEQ ID NO: 1140089 - RNA, 13 nt, Homo sapiens
caucggucaugug

SEQ ID NO: 1140090 - RNA, 15 nt, Homo sapiens
caucuaacgugcauu

SEQ ID NO: 1140091 - RNA, 11 nt, Homo sapiens
caucuaagcau

SEQ ID NO: 1140092 - RNA, 13 nt, Homo sapiens
caucuaagcccau

SEQ ID NO: 1140093 - RNA, 23 nt, Homo sapiens
caucuaagcugugguguguuccc

SEQ ID NO: 1140094 - RNA, 19 nt, Homo sapiens
caucuaccggcguccugcc

SEQ ID NO: 1140095 - RNA, 14 nt, Homo sapiens
caucuagcaauuuc

SEQ ID NO: 1140096 - RNA, 19 nt, Homo sapiens
caucucaggccucccucaa

SEQ ID NO: 1140097 - RNA, 15 nt, Homo sapiens
caucucaucaacuua

SEQ ID NO: 1140098 - RNA, 11 nt, Homo sapiens
caucucuacua

SEQ ID NO: 1140099 - RNA, 21 nt, Homo sapiens
caucucuucaugaauugugag

SEQ ID NO: 1140100 - RNA, 22 nt, Homo sapiens
caucugaauuugcccugggaaa

SEQ ID NO: 1140101 - RNA, 16 nt, Homo sapiens
caucugacuugaacuc

SEQ ID NO: 1140102 - RNA, 20 nt, Homo sapiens
caucugcgaacccaagcaau

SEQ ID NO: 1140103 - RNA, 23 nt, Homo sapiens
caucugcuauuaaccuugccuua

SEQ ID NO: 1140104 - RNA, 17 nt, Homo sapiens
caucuggaccugguaca

SEQ ID NO: 1140105 - RNA, 13 nt, Homo sapiens
caucugggaaaga

SEQ ID NO: 1140106 - RNA, 22 nt, Homo sapiens
caucugugcacugcccauggac

SEQ ID NO: 1140107 - RNA, 22 nt, Homo sapiens
caucuguuuuauuuuuguaaaa

SEQ ID NO: 1140108 - RNA, 14 nt, Homo sapiens
caucuucacagcac

SEQ ID NO: 1140109 - RNA, 18 nt, Homo sapiens
caucuucacagcacauuu

SEQ ID NO: 1140110 - RNA, 19 nt, Homo sapiens
caucuuccaccucaccucu

SEQ ID NO: 1140111 - RNA, 18 nt, Homo sapiens
caucuuccagaaguguga

SEQ ID NO: 1140112 - RNA, 15 nt, Homo sapiens
caucuuccauuucca

SEQ ID NO: 1140113 - RNA, 18 nt, Homo sapiens
caucuucccacaguggcu

SEQ ID NO: 1140114 - RNA, 23 nt, Homo sapiens
caucuucgucuucacucuuaggc

SEQ ID NO: 1140115 - RNA, 15 nt, Homo sapiens
caucuucuccaucug

SEQ ID NO: 1140116 - RNA, 17 nt, Homo sapiens
caucuugaaguuacaca

SEQ ID NO: 1140117 - RNA, 14 nt, Homo sapiens
caucuuggucacau

SEQ ID NO: 1140118 - RNA, 14 nt, Homo sapiens
caucuuuaacacag

SEQ ID NO: 1140119 - RNA, 12 nt, Homo sapiens
caucuuucacau

SEQ ID NO: 1140120 - RNA, 21 nt, Homo sapiens
caucuuugcugaaugucauua

SEQ ID NO: 1140121 - RNA, 22 nt, Homo sapiens
caucuuuggggagguguucacu

SEQ ID NO: 1140122 - RNA, 20 nt, Homo sapiens
caucuuuuauagacgcucuu

SEQ ID NO: 1140123 - RNA, 23 nt, Homo sapiens
caugaaaaguuauuuaugcuaua

SEQ ID NO: 1140124 - RNA, 18 nt, Homo sapiens
caugaaaguggacaagga

SEQ ID NO: 1140125 - RNA, 19 nt, Homo sapiens
caugaaaguggacaaggag

SEQ ID NO: 1140126 - RNA, 21 nt, Homo sapiens
caugaacuuguaaaggaauuu

SEQ ID NO: 1140127 - RNA, 17 nt, Homo sapiens
caugaaggcagagccau

SEQ ID NO: 1140128 - RNA, 21 nt, Homo sapiens
caugaaguggaaaaaggagag

SEQ ID NO: 1140129 - RNA, 13 nt, Homo sapiens
caugaauaaucca

SEQ ID NO: 1140130 - RNA, 19 nt, Homo sapiens
caugaauaauccaccccuu

SEQ ID NO: 1140131 - RNA, 18 nt, Homo sapiens
caugaaucaaaagugccu

SEQ ID NO: 1140132 - RNA, 22 nt, Homo sapiens
caugaaucccacccacauguga

SEQ ID NO: 1140133 - RNA, 19 nt, Homo sapiens
caugaaugcaaaacauuuc

SEQ ID NO: 1140134 - RNA, 11 nt, Homo sapiens
caugaauucau

SEQ ID NO: 1140135 - RNA, 14 nt, Homo sapiens
caugaauucuguca

SEQ ID NO: 1140136 - RNA, 16 nt, Homo sapiens
caugacauugcauuug

SEQ ID NO: 1140137 - RNA, 23 nt, Homo sapiens
caugacauuuuuccucucugcaa

SEQ ID NO: 1140138 - RNA, 12 nt, Homo sapiens
caugaccagaaa

SEQ ID NO: 1140139 - RNA, 14 nt, Homo sapiens
caugacccagugaa

SEQ ID NO: 1140140 - RNA, 23 nt, Homo sapiens
caugaccugaagccccucccuga

SEQ ID NO: 1140141 - RNA, 14 nt, Homo sapiens
caugagaaagggag

SEQ ID NO: 1140142 - RNA, 17 nt, Homo sapiens
caugagacucagugcag

SEQ ID NO: 1140143 - RNA, 19 nt, Homo sapiens
caugagacucagugcagau

SEQ ID NO: 1140144 - RNA, 20 nt, Homo sapiens
caugagacucagugcagaug

SEQ ID NO: 1140145 - RNA, 13 nt, Homo sapiens
caugagauuuaua

SEQ ID NO: 1140146 - RNA, 21 nt, Homo sapiens
caugagccuguuuauugccau

SEQ ID NO: 1140147 - RNA, 18 nt, Homo sapiens
caugaggccaccaguaaa

SEQ ID NO: 1140148 - RNA, 19 nt, Homo sapiens
caugauaguguauucuguu

SEQ ID NO: 1140149 - RNA, 18 nt, Homo sapiens
caugaucaucacaaucau

SEQ ID NO: 1140150 - RNA, 13 nt, Homo sapiens
caugauccaagca

SEQ ID NO: 1140151 - RNA, 16 nt, Homo sapiens
caugauuuccuugaau

SEQ ID NO: 1140152 - RNA, 21 nt, Homo sapiens
caugcaagaacucaucacugu

SEQ ID NO: 1140153 - RNA, 14 nt, Homo sapiens
caugcacacggcug

SEQ ID NO: 1140154 - RNA, 16 nt, Homo sapiens
caugcagcaggugcaa

SEQ ID NO: 1140155 - RNA, 18 nt, Homo sapiens
caugcagccagccaucaa

SEQ ID NO: 1140156 - RNA, 18 nt, Homo sapiens
caugcaugacacuuccaa

SEQ ID NO: 1140157 - RNA, 22 nt, Homo sapiens
caugccaacaagaaugcauuga

SEQ ID NO: 1140158 - RNA, 19 nt, Homo sapiens
caugccaaguaucuuucca

SEQ ID NO: 1140159 - RNA, 16 nt, Homo sapiens
caugcccugugcaacc

SEQ ID NO: 1140160 - RNA, 12 nt, Homo sapiens
caugcccugugu

SEQ ID NO: 1140161 - RNA, 17 nt, Homo sapiens
caugccucuaaucucag

SEQ ID NO: 1140162 - RNA, 18 nt, Homo sapiens
caugcgguagccagcaca

SEQ ID NO: 1140163 - RNA, 17 nt, Homo sapiens
caugcguaagacguucu

SEQ ID NO: 1140164 - RNA, 15 nt, Homo sapiens
caugcuaauguuacu

SEQ ID NO: 1140165 - RNA, 20 nt, Homo sapiens
caugcuggaaccugcaaaaa

SEQ ID NO: 1140166 - RNA, 15 nt, Homo sapiens
cauuucuaagcagau

SEQ ID NO: 1140167 - RNA, 22 nt, Homo sapiens
cauuucuauuucuccuccaugg

SEQ ID NO: 1140168 - RNA, 19 nt, Homo sapiens
cauuucucauaccuucccc

SEQ ID NO: 1140169 - RNA, 19 nt, Homo sapiens
cauuucuccagaacccauu

SEQ ID NO: 1140170 - RNA, 19 nt, Homo sapiens
cauuugcgaaugguuccau

SEQ ID NO: 1140171 - RNA, 21 nt, Homo sapiens
cauuugcuucaggaguuucau

SEQ ID NO: 1140172 - RNA, 17 nt, Homo sapiens
cauuugcuuccucccaa

SEQ ID NO: 1140173 - RNA, 18 nt, Homo sapiens
cauuuggcagagcuucuu

SEQ ID NO: 1140174 - RNA, 20 nt, Homo sapiens
cauuuggggcuagacaguuc

SEQ ID NO: 1140175 - RNA, 15 nt, Homo sapiens
cauuugucucuacuu

SEQ ID NO: 1140176 - RNA, 12 nt, Homo sapiens
cauuugugauau

SEQ ID NO: 1140177 - RNA, 15 nt, Homo sapiens
cauuuguugcugcug

SEQ ID NO: 1140178 - RNA, 13 nt, Homo sapiens
cauuuuaacaaga

SEQ ID NO: 1140179 - RNA, 20 nt, Homo sapiens
cauuuuagucaugcaaagau

SEQ ID NO: 1140180 - RNA, 22 nt, Homo sapiens
cauuuuaucccauggaaccacu

SEQ ID NO: 1140181 - RNA, 14 nt, Homo sapiens
cauuuucagccaaa

SEQ ID NO: 1140182 - RNA, 22 nt, Homo sapiens
cauuuucuauaagaaaaaggaa

SEQ ID NO: 1140183 - RNA, 16 nt, Homo sapiens
cauuuucucuaccuuc

SEQ ID NO: 1140184 - RNA, 18 nt, Homo sapiens
cauuuugcccuuccauag

SEQ ID NO: 1140185 - RNA, 16 nt, Homo sapiens
cauuuugcucugugaa

SEQ ID NO: 1140186 - RNA, 12 nt, Homo sapiens
cauuuuguauaa

SEQ ID NO: 1140187 - RNA, 14 nt, Homo sapiens
cauuuuuagcuccu

SEQ ID NO: 1140188 - RNA, 18 nt, Homo sapiens
cauuuuuaucccauugag

SEQ ID NO: 1140189 - RNA, 18 nt, Homo sapiens
cauuuuuccucucugcaa

SEQ ID NO: 1140190 - RNA, 23 nt, Homo sapiens
cauuuuuucuuuaucaaggagau

SEQ ID NO: 1140191 - RNA, 16 nt, Homo sapiens
cauuuuuuugcaguga

SEQ ID NO: 1140192 - RNA, 19 nt, Homo sapiens
ccaaaaaaauacugccaga
